United States Patent 11,421,016 (CANCER NEOEPITOPES) - sequence listing, part 13

SEQ ID NO: 555388 - protein, 9 aa, Homo Sapiens
YFIKGKRTG

SEQ ID NO: 555389 - protein, 9 aa, Homo Sapiens
PDPAWASRR

SEQ ID NO: 555390 - protein, 9 aa, Homo Sapiens
TLTDVALAC

SEQ ID NO: 555391 - protein, 9 aa, Homo Sapiens
VSYFIKGKR

SEQ ID NO: 555392 - protein, 9 aa, Homo Sapiens
TYLRDFMYV

SEQ ID NO: 555393 - protein, 9 aa, Homo Sapiens
NTFGPRMHT

SEQ ID NO: 555394 - protein, 9 aa, Homo Sapiens
AVPVDFFPH

SEQ ID NO: 555395 - protein, 9 aa, Homo Sapiens
YKPKTYLRD

SEQ ID NO: 555396 - protein, 9 aa, Homo Sapiens
IVMQTGNSH

SEQ ID NO: 555397 - protein, 9 aa, Homo Sapiens
LILSVTPSF

SEQ ID NO: 555398 - protein, 9 aa, Homo Sapiens
DRDNKGSST

SEQ ID NO: 555399 - protein, 9 aa, Homo Sapiens
PLILSVTPS

SEQ ID NO: 555400 - protein, 9 aa, Homo Sapiens
CLHVLGPNR

SEQ ID NO: 555401 - protein, 9 aa, Homo Sapiens
ITLPVYTRK

SEQ ID NO: 555402 - protein, 9 aa, Homo Sapiens
SMQGSAGAR

SEQ ID NO: 555403 - protein, 9 aa, Homo Sapiens
TSSTDGTMT

SEQ ID NO: 555404 - protein, 9 aa, Homo Sapiens
FTVSYFIKG

SEQ ID NO: 555405 - protein, 9 aa, Homo Sapiens
ALAASSAVR

SEQ ID NO: 555406 - protein, 9 aa, Homo Sapiens
VHHPVFSDP

SEQ ID NO: 555407 - protein, 9 aa, Homo Sapiens
QKPLDSNDD

SEQ ID NO: 555408 - protein, 9 aa, Homo Sapiens
SFEDAHWRE

SEQ ID NO: 555409 - protein, 9 aa, Homo Sapiens
FPDLVWTLT

SEQ ID NO: 555410 - protein, 9 aa, Homo Sapiens
EDDFDANDE

SEQ ID NO: 555411 - protein, 9 aa, Homo Sapiens
HLDSMLLRG

SEQ ID NO: 555412 - protein, 9 aa, Homo Sapiens
MQNLNDCLA

SEQ ID NO: 555413 - protein, 9 aa, Homo Sapiens
PTLSESDPV

SEQ ID NO: 555414 - protein, 9 aa, Homo Sapiens
TVSYFIKGK

SEQ ID NO: 555415 - protein, 9 aa, Homo Sapiens
YKCEHFYLF

SEQ ID NO: 555416 - protein, 9 aa, Homo Sapiens
GYCTVRKKY

SEQ ID NO: 555417 - protein, 9 aa, Homo Sapiens
LEWNKDLLP

SEQ ID NO: 555418 - protein, 9 aa, Homo Sapiens
KFPTSLGPE

SEQ ID NO: 555419 - protein, 9 aa, Homo Sapiens
LESELENKE

SEQ ID NO: 555420 - protein, 9 aa, Homo Sapiens
SESDPVPLA

SEQ ID NO: 555421 - protein, 9 aa, Homo Sapiens
NLNDCLASY

SEQ ID NO: 555422 - protein, 9 aa, Homo Sapiens
EQADGPKGT

SEQ ID NO: 555423 - protein, 9 aa, Homo Sapiens
FSNELHLRL

SEQ ID NO: 555424 - protein, 9 aa, Homo Sapiens
LAERYDPDR

SEQ ID NO: 555425 - protein, 9 aa, Homo Sapiens
GDFPDGSLE

SEQ ID NO: 555426 - protein, 9 aa, Homo Sapiens
SVQVISLEP

SEQ ID NO: 555427 - protein, 9 aa, Homo Sapiens
IPSAEEELS

SEQ ID NO: 555428 - protein, 9 aa, Homo Sapiens
RGSWRALRL

SEQ ID NO: 555429 - protein, 9 aa, Homo Sapiens
KGEVGAPSM

SEQ ID NO: 555430 - protein, 9 aa, Homo Sapiens
MIENATDIW

SEQ ID NO: 555431 - protein, 9 aa, Homo Sapiens
PKGTLRGDS

SEQ ID NO: 555432 - protein, 9 aa, Homo Sapiens
AECTKNITA

SEQ ID NO: 555433 - protein, 9 aa, Homo Sapiens
YLAAPRGVC

SEQ ID NO: 555434 - protein, 9 aa, Homo Sapiens
SLQSCPWPR

SEQ ID NO: 555435 - protein, 9 aa, Homo Sapiens
SGLGKTTDI

SEQ ID NO: 555436 - protein, 9 aa, Homo Sapiens
ESELENKER

SEQ ID NO: 555437 - protein, 9 aa, Homo Sapiens
LLAERYDPD

SEQ ID NO: 555438 - protein, 9 aa, Homo Sapiens
PPNLEIDPN

SEQ ID NO: 555439 - protein, 9 aa, Homo Sapiens
LACRWQRTA

SEQ ID NO: 555440 - protein, 9 aa, Homo Sapiens
IWGYCTVRK

SEQ ID NO: 555441 - protein, 9 aa, Homo Sapiens
HSDERPTRS

SEQ ID NO: 555442 - protein, 9 aa, Homo Sapiens
HTSSTDGTM

SEQ ID NO: 555443 - protein, 9 aa, Homo Sapiens
KGTLRGDSF

SEQ ID NO: 555444 - protein, 9 aa, Homo Sapiens
SDPAPAADP

SEQ ID NO: 555445 - protein, 9 aa, Homo Sapiens
KYQNVNHNL

SEQ ID NO: 555446 - protein, 9 aa, Homo Sapiens
MHTNDGRVV

SEQ ID NO: 555447 - protein, 9 aa, Homo Sapiens
LSVTPSFLV

SEQ ID NO: 555448 - protein, 9 aa, Homo Sapiens
PFSLCLFLL

SEQ ID NO: 555449 - protein, 9 aa, Homo Sapiens
AECAIAVFA

SEQ ID NO: 555450 - protein, 9 aa, Homo Sapiens
VYLLALLFI

SEQ ID NO: 555451 - protein, 9 aa, Homo Sapiens
LVLHCLLIL

SEQ ID NO: 555452 - protein, 9 aa, Homo Sapiens
VSSFSFCGL

SEQ ID NO: 555453 - protein, 9 aa, Homo Sapiens
TNRSIQSLL

SEQ ID NO: 555454 - protein, 9 aa, Homo Sapiens
RAHEKEVSV

SEQ ID NO: 555455 - protein, 9 aa, Homo Sapiens
IVSSLLDLR

SEQ ID NO: 555456 - protein, 9 aa, Homo Sapiens
AQVKRSDPR

SEQ ID NO: 555457 - protein, 9 aa, Homo Sapiens
READEFTRK

SEQ ID NO: 555458 - protein, 9 aa, Homo Sapiens
KCACASRVA

SEQ ID NO: 555459 - protein, 9 aa, Homo Sapiens
RFIPQVLVI

SEQ ID NO: 555460 - protein, 9 aa, Homo Sapiens
NIPNGTFSH

SEQ ID NO: 555461 - protein, 9 aa, Homo Sapiens
QLLHHPTES

SEQ ID NO: 555462 - protein, 9 aa, Homo Sapiens
SFSFCGLNE

SEQ ID NO: 555463 - protein, 9 aa, Homo Sapiens
LDLRFSIPF

SEQ ID NO: 555464 - protein, 9 aa, Homo Sapiens
PRPIPLSSV

SEQ ID NO: 555465 - protein, 9 aa, Homo Sapiens
AASVLVKDG

SEQ ID NO: 555466 - protein, 9 aa, Homo Sapiens
MTQAEKGGT

SEQ ID NO: 555467 - protein, 9 aa, Homo Sapiens
FSSAVGLGT

SEQ ID NO: 555468 - protein, 9 aa, Homo Sapiens
HAGGGGGGS

SEQ ID NO: 555469 - protein, 9 aa, Homo Sapiens
LLDVVANPL

SEQ ID NO: 555470 - protein, 9 aa, Homo Sapiens
PCFRPVFTE

SEQ ID NO: 555471 - protein, 9 aa, Homo Sapiens
KAPVPCFRP

SEQ ID NO: 555472 - protein, 9 aa, Homo Sapiens
NSDEYKQED

SEQ ID NO: 555473 - protein, 9 aa, Homo Sapiens
TRKGQNFTL

SEQ ID NO: 555474 - protein, 9 aa, Homo Sapiens
IGMEDSPDS

SEQ ID NO: 555475 - protein, 9 aa, Homo Sapiens
SWVSSFSFC

SEQ ID NO: 555476 - protein, 9 aa, Homo Sapiens
KELLDVVAN

SEQ ID NO: 555477 - protein, 9 aa, Homo Sapiens
VMVWGTPFC

SEQ ID NO: 555478 - protein, 9 aa, Homo Sapiens
LLHILQALH

SEQ ID NO: 555479 - protein, 9 aa, Homo Sapiens
HCLLILPIS

SEQ ID NO: 555480 - protein, 9 aa, Homo Sapiens
FRPVFTEVE

SEQ ID NO: 555481 - protein, 9 aa, Homo Sapiens
GLGTIVECG

SEQ ID NO: 555482 - protein, 9 aa, Homo Sapiens
TCGPPPPID

SEQ ID NO: 555483 - protein, 9 aa, Homo Sapiens
QSLLLHGSP

SEQ ID NO: 555484 - protein, 9 aa, Homo Sapiens
LLRYLVLHC

SEQ ID NO: 555485 - protein, 9 aa, Homo Sapiens
KDVGYLEFL

SEQ ID NO: 555486 - protein, 9 aa, Homo Sapiens
SAETCGPPP

SEQ ID NO: 555487 - protein, 9 aa, Homo Sapiens
LLILPISIL

SEQ ID NO: 555488 - protein, 9 aa, Homo Sapiens
EACRAHEKE

SEQ ID NO: 555489 - protein, 9 aa, Homo Sapiens
MIDNIPNGT

SEQ ID NO: 555490 - protein, 9 aa, Homo Sapiens
ADTRAIRAE

SEQ ID NO: 555491 - protein, 9 aa, Homo Sapiens
TVFARVTIP

SEQ ID NO: 555492 - protein, 9 aa, Homo Sapiens
STISAETCG

SEQ ID NO: 555493 - protein, 9 aa, Homo Sapiens
LHILQALHP

SEQ ID NO: 555494 - protein, 9 aa, Homo Sapiens
PVIAGVIRA

SEQ ID NO: 555495 - protein, 9 aa, Homo Sapiens
NMIDNIPNG

SEQ ID NO: 555496 - protein, 9 aa, Homo Sapiens
DVGYLEFLN

SEQ ID NO: 555497 - protein, 9 aa, Homo Sapiens
TPHPLAGPP

SEQ ID NO: 555498 - protein, 9 aa, Homo Sapiens
QWCAPCKIL

SEQ ID NO: 555499 - protein, 9 aa, Homo Sapiens
TTQKELLDV

SEQ ID NO: 555500 - protein, 9 aa, Homo Sapiens
SNSDEYKQE

SEQ ID NO: 555501 - protein, 9 aa, Homo Sapiens
KGGTENGKE

SEQ ID NO: 555502 - protein, 9 aa, Homo Sapiens
LFLLLLLRY

SEQ ID NO: 555503 - protein, 9 aa, Homo Sapiens
SVLVKDGKF

SEQ ID NO: 555504 - protein, 9 aa, Homo Sapiens
VAEKYLAYH

SEQ ID NO: 555505 - protein, 9 aa, Homo Sapiens
ISILGECQL

SEQ ID NO: 555506 - protein, 9 aa, Homo Sapiens
VSSLLDLRF

SEQ ID NO: 555507 - protein, 9 aa, Homo Sapiens
KKVADERFI

SEQ ID NO: 555508 - protein, 9 aa, Homo Sapiens
VARGPDAYQ

SEQ ID NO: 555509 - protein, 9 aa, Homo Sapiens
EKGGTENGK

SEQ ID NO: 555510 - protein, 9 aa, Homo Sapiens
CAIAVFASF

SEQ ID NO: 555511 - protein, 9 aa, Homo Sapiens
TGHATSLHV

SEQ ID NO: 555512 - protein, 9 aa, Homo Sapiens
ALSQTGFSY

SEQ ID NO: 555513 - protein, 9 aa, Homo Sapiens
SAVGLGTIV

SEQ ID NO: 555514 - protein, 9 aa, Homo Sapiens
EIVAQVKRS

SEQ ID NO: 555515 - protein, 9 aa, Homo Sapiens
LLFIVSSLL

SEQ ID NO: 555516 - protein, 9 aa, Homo Sapiens
VTIPTITLL

SEQ ID NO: 555517 - protein, 9 aa, Homo Sapiens
QKELLDVVA

SEQ ID NO: 555518 - protein, 9 aa, Homo Sapiens
AAAEAALSQ

SEQ ID NO: 555519 - protein, 9 aa, Homo Sapiens
CFRPVFTEV

SEQ ID NO: 555520 - protein, 9 aa, Homo Sapiens
RNIYLQYNQ

SEQ ID NO: 555521 - protein, 9 aa, Homo Sapiens
GTAWLEWWH

SEQ ID NO: 555522 - protein, 9 aa, Homo Sapiens
LAYHMEKYG

SEQ ID NO: 555523 - protein, 9 aa, Homo Sapiens
FARVTIPTI

SEQ ID NO: 555524 - protein, 9 aa, Homo Sapiens
FSIPFSLCL

SEQ ID NO: 555525 - protein, 9 aa, Homo Sapiens
EAIVNFVNK

SEQ ID NO: 555526 - protein, 9 aa, Homo Sapiens
VADERFIPQ

SEQ ID NO: 555527 - protein, 9 aa, Homo Sapiens
SPDSLAARK

SEQ ID NO: 555528 - protein, 9 aa, Homo Sapiens
RNIPQVSMV

SEQ ID NO: 555529 - protein, 9 aa, Homo Sapiens
FSFCGLNEI

SEQ ID NO: 555530 - protein, 9 aa, Homo Sapiens
KLPHGFPDS

SEQ ID NO: 555531 - protein, 9 aa, Homo Sapiens
VEAAQLLHI

SEQ ID NO: 555532 - protein, 9 aa, Homo Sapiens
QTSWVSSFS

SEQ ID NO: 555533 - protein, 9 aa, Homo Sapiens
LCLFLLLLL

SEQ ID NO: 555534 - protein, 9 aa, Homo Sapiens
RSTISAETC

SEQ ID NO: 555535 - protein, 9 aa, Homo Sapiens
CLLILPISI

SEQ ID NO: 555536 - protein, 9 aa, Homo Sapiens
IPLSSVLQV

SEQ ID NO: 555537 - protein, 9 aa, Homo Sapiens
IPNGTFSHL

SEQ ID NO: 555538 - protein, 9 aa, Homo Sapiens
RYLVLHCLL

SEQ ID NO: 555539 - protein, 9 aa, Homo Sapiens
RFSIPFSLC

SEQ ID NO: 555540 - protein, 9 aa, Homo Sapiens
RKGQNFTLR

SEQ ID NO: 555541 - protein, 9 aa, Homo Sapiens
VPCFRPVFT

SEQ ID NO: 555542 - protein, 9 aa, Homo Sapiens
AIKKVADER

SEQ ID NO: 555543 - protein, 9 aa, Homo Sapiens
VGLGTIVEC

SEQ ID NO: 555544 - protein, 9 aa, Homo Sapiens
YLAYHMEKY

SEQ ID NO: 555545 - protein, 9 aa, Homo Sapiens
TSWVSSFSF

SEQ ID NO: 555546 - protein, 9 aa, Homo Sapiens
ECQLLHHPT

SEQ ID NO: 555547 - protein, 9 aa, Homo Sapiens
RAIRAEECR

SEQ ID NO: 555548 - protein, 9 aa, Homo Sapiens
FHAQWCAPC

SEQ ID NO: 555549 - protein, 9 aa, Homo Sapiens
RTVFARVTI

SEQ ID NO: 555550 - protein, 9 aa, Homo Sapiens
PHGFPDSKD

SEQ ID NO: 555551 - protein, 9 aa, Homo Sapiens
MQEVMVWGT

SEQ ID NO: 555552 - protein, 9 aa, Homo Sapiens
AGVIRARKP

SEQ ID NO: 555553 - protein, 9 aa, Homo Sapiens
CLFLLLLLR

SEQ ID NO: 555554 - protein, 9 aa, Homo Sapiens
RTPHPLAGP

SEQ ID NO: 555555 - protein, 9 aa, Homo Sapiens
LFIVSSLLD

SEQ ID NO: 555556 - protein, 9 aa, Homo Sapiens
DERFIPQVL

SEQ ID NO: 555557 - protein, 9 aa, Homo Sapiens
GTIVECGPV

SEQ ID NO: 555558 - protein, 9 aa, Homo Sapiens
LQVYLLALL

SEQ ID NO: 555559 - protein, 9 aa, Homo Sapiens
NIYLQYNQV

SEQ ID NO: 555560 - protein, 9 aa, Homo Sapiens
SVGSSNSDE

SEQ ID NO: 555561 - protein, 9 aa, Homo Sapiens
GLLNLRNIY

SEQ ID NO: 555562 - protein, 9 aa, Homo Sapiens
IVEAAQLLH

SEQ ID NO: 555563 - protein, 9 aa, Homo Sapiens
ARVTIPTIT

SEQ ID NO: 555564 - protein, 9 aa, Homo Sapiens
LRTPHPLAG

SEQ ID NO: 555565 - protein, 9 aa, Homo Sapiens
VDFHAQWCA

SEQ ID NO: 555566 - protein, 9 aa, Homo Sapiens
KGLLNLRNI

SEQ ID NO: 555567 - protein, 9 aa, Homo Sapiens
TVARGPDAY

SEQ ID NO: 555568 - protein, 9 aa, Homo Sapiens
QVYLLALLF

SEQ ID NO: 555569 - protein, 9 aa, Homo Sapiens
AETCGPPPP

SEQ ID NO: 555570 - protein, 9 aa, Homo Sapiens
YLLKLPHGF

SEQ ID NO: 555571 - protein, 9 aa, Homo Sapiens
GHATSLHVT

SEQ ID NO: 555572 - protein, 9 aa, Homo Sapiens
ELLDVVANP

SEQ ID NO: 555573 - protein, 9 aa, Homo Sapiens
AQWCAPCKI

SEQ ID NO: 555574 - protein, 9 aa, Homo Sapiens
IKKVADERF

SEQ ID NO: 555575 - protein, 9 aa, Homo Sapiens
RPVFTEVEK

SEQ ID NO: 555576 - protein, 9 aa, Homo Sapiens
AWLEWWHVQ

SEQ ID NO: 555577 - protein, 9 aa, Homo Sapiens
RFSSAVGLG

SEQ ID NO: 555578 - protein, 9 aa, Homo Sapiens
SKAPVPCFR

SEQ ID NO: 555579 - protein, 9 aa, Homo Sapiens
SVAECAIAV

SEQ ID NO: 555580 - protein, 9 aa, Homo Sapiens
ELTMWFFIS

SEQ ID NO: 555581 - protein, 9 aa, Homo Sapiens
FIPQVLVIS

SEQ ID NO: 555582 - protein, 9 aa, Homo Sapiens
GGGGHAGGG

SEQ ID NO: 555583 - protein, 9 aa, Homo Sapiens
ITKDVGYLE

SEQ ID NO: 555584 - protein, 9 aa, Homo Sapiens
KKLDRLGLS

SEQ ID NO: 555585 - protein, 9 aa, Homo Sapiens
PELTMWFFI

SEQ ID NO: 555586 - protein, 9 aa, Homo Sapiens
EDSPDSLAA

SEQ ID NO: 555587 - protein, 9 aa, Homo Sapiens
YLEFLNIRP

SEQ ID NO: 555588 - protein, 9 aa, Homo Sapiens
AIVNFVNKK

SEQ ID NO: 555589 - protein, 9 aa, Homo Sapiens
LEACRAHEK

SEQ ID NO: 555590 - protein, 9 aa, Homo Sapiens
GGTENGKEK

SEQ ID NO: 555591 - protein, 9 aa, Homo Sapiens
DAYQILTRA

SEQ ID NO: 555592 - protein, 9 aa, Homo Sapiens
WGTPFCMMD

SEQ ID NO: 555593 - protein, 9 aa, Homo Sapiens
LTPLRTPHP

SEQ ID NO: 555594 - protein, 9 aa, Homo Sapiens
LPHGFPDSK

SEQ ID NO: 555595 - protein, 9 aa, Homo Sapiens
LPISILGEC

SEQ ID NO: 555596 - protein, 9 aa, Homo Sapiens
CQLLHHPTE

SEQ ID NO: 555597 - protein, 9 aa, Homo Sapiens
SGGGGHAGG

SEQ ID NO: 555598 - protein, 9 aa, Homo Sapiens
RSIQSLLLH

SEQ ID NO: 555599 - protein, 9 aa, Homo Sapiens
FPDSKDAQK

SEQ ID NO: 555600 - protein, 9 aa, Homo Sapiens
SVLEACRAH

SEQ ID NO: 555601 - protein, 9 aa, Homo Sapiens
LTMWFFISL

SEQ ID NO: 555602 - protein, 9 aa, Homo Sapiens
AYQILTRAP

SEQ ID NO: 555603 - protein, 9 aa, Homo Sapiens
SLSTGHATS

SEQ ID NO: 555604 - protein, 9 aa, Homo Sapiens
EADEFTRKG

SEQ ID NO: 555605 - protein, 9 aa, Homo Sapiens
AHEKEVSVY

SEQ ID NO: 555606 - protein, 9 aa, Homo Sapiens
FIVSSLLDL

SEQ ID NO: 555607 - protein, 9 aa, Homo Sapiens
GSSNSDEYK

SEQ ID NO: 555608 - protein, 9 aa, Homo Sapiens
YQILTRAPL

SEQ ID NO: 555609 - protein, 9 aa, Homo Sapiens
ARKCACASR

SEQ ID NO: 555610 - protein, 9 aa, Homo Sapiens
GMEDSPDSL

SEQ ID NO: 555611 - protein, 9 aa, Homo Sapiens
PSVAECAIA

SEQ ID NO: 555612 - protein, 9 aa, Homo Sapiens
SSAVGLGTI

SEQ ID NO: 555613 - protein, 9 aa, Homo Sapiens
LILPISILG

SEQ ID NO: 555614 - protein, 9 aa, Homo Sapiens
WHVQPTLDL

SEQ ID NO: 555615 - protein, 9 aa, Homo Sapiens
RRTSVGSSN

SEQ ID NO: 555616 - protein, 9 aa, Homo Sapiens
CACASRVAK

SEQ ID NO: 555617 - protein, 9 aa, Homo Sapiens
PDAYQILTR

SEQ ID NO: 555618 - protein, 9 aa, Homo Sapiens
GPDAYQILT

SEQ ID NO: 555619 - protein, 9 aa, Homo Sapiens
ACASRVAKV

SEQ ID NO: 555620 - protein, 9 aa, Homo Sapiens
HPLAGPPRR

SEQ ID NO: 555621 - protein, 9 aa, Homo Sapiens
LHHPTESTA

SEQ ID NO: 555622 - protein, 9 aa, Homo Sapiens
CRAHEKEVS

SEQ ID NO: 555623 - protein, 9 aa, Homo Sapiens
AEKGGTENG

SEQ ID NO: 555624 - protein, 9 aa, Homo Sapiens
VAECAIAVF

SEQ ID NO: 555625 - protein, 9 aa, Homo Sapiens
RARKPQYDI

SEQ ID NO: 555626 - protein, 9 aa, Homo Sapiens
WFFISLIPE

SEQ ID NO: 555627 - protein, 9 aa, Homo Sapiens
VGSSNSDEY

SEQ ID NO: 555628 - protein, 9 aa, Homo Sapiens
SLLDLRFSI

SEQ ID NO: 555629 - protein, 9 aa, Homo Sapiens
ADEFTRKGQ

SEQ ID NO: 555630 - protein, 9 aa, Homo Sapiens
KYLAYHMEK

SEQ ID NO: 555631 - protein, 9 aa, Homo Sapiens
FSYQKRKES

SEQ ID NO: 555632 - protein, 9 aa, Homo Sapiens
TPLRTPHPL

SEQ ID NO: 555633 - protein, 9 aa, Homo Sapiens
QAIKKVADE

SEQ ID NO: 555634 - protein, 9 aa, Homo Sapiens
VLQVYLLAL

SEQ ID NO: 555635 - protein, 9 aa, Homo Sapiens
SSVLQVYLL

SEQ ID NO: 555636 - protein, 9 aa, Homo Sapiens
DLRFSIPFS

SEQ ID NO: 555637 - protein, 9 aa, Homo Sapiens
GKFIMTVEQ

SEQ ID NO: 555638 - protein, 9 aa, Homo Sapiens
ETCGPPPPI

SEQ ID NO: 555639 - protein, 9 aa, Homo Sapiens
NKKLDRLGL

SEQ ID NO: 555640 - protein, 9 aa, Homo Sapiens
VLVISLNLS

SEQ ID NO: 555641 - protein, 9 aa, Homo Sapiens
WCAPCKILG

SEQ ID NO: 555642 - protein, 9 aa, Homo Sapiens
AAEAALSQT

SEQ ID NO: 555643 - protein, 9 aa, Homo Sapiens
LSSVLQVYL

SEQ ID NO: 555644 - protein, 9 aa, Homo Sapiens
VKRSDPRSL

SEQ ID NO: 555645 - protein, 9 aa, Homo Sapiens
HGFPDSKDA

SEQ ID NO: 555646 - protein, 9 aa, Homo Sapiens
GEEIVAQVK

SEQ ID NO: 555647 - protein, 9 aa, Homo Sapiens
AEAALSQTG

SEQ ID NO: 555648 - protein, 9 aa, Homo Sapiens
VLVKDGKFI

SEQ ID NO: 555649 - protein, 9 aa, Homo Sapiens
QLLHILQAL

SEQ ID NO: 555650 - protein, 9 aa, Homo Sapiens
LHCLLILPI

SEQ ID NO: 555651 - protein, 9 aa, Homo Sapiens
GYLEFLNIR

SEQ ID NO: 555652 - protein, 9 aa, Homo Sapiens
YQKRKESNR

SEQ ID NO: 555653 - protein, 9 aa, Homo Sapiens
LVKDGKFIM

SEQ ID NO: 555654 - protein, 9 aa, Homo Sapiens
AYHMEKYGF

SEQ ID NO: 555655 - protein, 9 aa, Homo Sapiens
ADERFIPQV

SEQ ID NO: 555656 - protein, 9 aa, Homo Sapiens
RVAKVAEFF

SEQ ID NO: 555657 - protein, 9 aa, Homo Sapiens
DNIPNGTFS

SEQ ID NO: 555658 - protein, 9 aa, Homo Sapiens
NAPELTMWF

SEQ ID NO: 555659 - protein, 9 aa, Homo Sapiens
PHPLAGPPR

SEQ ID NO: 555660 - protein, 9 aa, Homo Sapiens
NLRNIYLQY

SEQ ID NO: 555661 - protein, 9 aa, Homo Sapiens
QVLVISLNL

SEQ ID NO: 555662 - protein, 9 aa, Homo Sapiens
LGTIVECGP

SEQ ID NO: 555663 - protein, 9 aa, Homo Sapiens
PLRTPHPLA

SEQ ID NO: 555664 - protein, 9 aa, Homo Sapiens
MEDSPDSLA

SEQ ID NO: 555665 - protein, 9 aa, Homo Sapiens
DEFTRKGQN

SEQ ID NO: 555666 - protein, 9 aa, Homo Sapiens
MWFFISLIP

SEQ ID NO: 555667 - protein, 9 aa, Homo Sapiens
VIAGVIRAR

SEQ ID NO: 555668 - protein, 9 aa, Homo Sapiens
VKDGKFIMT

SEQ ID NO: 555669 - protein, 9 aa, Homo Sapiens
SMVKSVRLD

SEQ ID NO: 555670 - protein, 9 aa, Homo Sapiens
RGPDAYQIL

SEQ ID NO: 555671 - protein, 9 aa, Homo Sapiens
APVPCFRPV

SEQ ID NO: 555672 - protein, 9 aa, Homo Sapiens
LEFLNIRPY

SEQ ID NO: 555673 - protein, 9 aa, Homo Sapiens
LLDLRFSIP

SEQ ID NO: 555674 - protein, 9 aa, Homo Sapiens
GSGGGGHAG

SEQ ID NO: 555675 - protein, 9 aa, Homo Sapiens
KDGKFIMTV

SEQ ID NO: 555676 - protein, 9 aa, Homo Sapiens
ALLFIVSSL

SEQ ID NO: 555677 - protein, 9 aa, Homo Sapiens
DTRAIRAEE

SEQ ID NO: 555678 - protein, 9 aa, Homo Sapiens
GTENGKEKG

SEQ ID NO: 555679 - protein, 9 aa, Homo Sapiens
IAGVIRARK

SEQ ID NO: 555680 - protein, 9 aa, Homo Sapiens
HTTQKELLD

SEQ ID NO: 555681 - protein, 9 aa, Homo Sapiens
QSVLEACRA

SEQ ID NO: 555682 - protein, 9 aa, Homo Sapiens
VNFVNKKLD

SEQ ID NO: 555683 - protein, 9 aa, Homo Sapiens
SFCGLNEIN

SEQ ID NO: 555684 - protein, 9 aa, Homo Sapiens
VAQVKRSDP

SEQ ID NO: 555685 - protein, 9 aa, Homo Sapiens
RKESNRKSL

SEQ ID NO: 555686 - protein, 9 aa, Homo Sapiens
EVMVWGTPF

SEQ ID NO: 555687 - protein, 9 aa, Homo Sapiens
IDNIPNGTF

SEQ ID NO: 555688 - protein, 9 aa, Homo Sapiens
GGSGGGGHA

SEQ ID NO: 555689 - protein, 9 aa, Homo Sapiens
HRNIPQVSM

SEQ ID NO: 555690 - protein, 9 aa, Homo Sapiens
RKCACASRV

SEQ ID NO: 555691 - protein, 9 aa, Homo Sapiens
SIQSLLLHG

SEQ ID NO: 555692 - protein, 9 aa, Homo Sapiens
PDSLAARKV

SEQ ID NO: 555693 - protein, 9 aa, Homo Sapiens
VFARVTIPT

SEQ ID NO: 555694 - protein, 9 aa, Homo Sapiens
APCKILGPR

SEQ ID NO: 555695 - protein, 9 aa, Homo Sapiens
ASRVAKVAE

SEQ ID NO: 555696 - protein, 9 aa, Homo Sapiens
TQAEKGGTE

SEQ ID NO: 555697 - protein, 9 aa, Homo Sapiens
PQVLVISLN

SEQ ID NO: 555698 - protein, 9 aa, Homo Sapiens
IRARKPQYD

SEQ ID NO: 555699 - protein, 9 aa, Homo Sapiens
ARGPDAYQI

SEQ ID NO: 555700 - protein, 9 aa, Homo Sapiens
TIPTITLLL

SEQ ID NO: 555701 - protein, 9 aa, Homo Sapiens
TAWLEWWHV

SEQ ID NO: 555702 - protein, 9 aa, Homo Sapiens
AAQLLHILQ

SEQ ID NO: 555703 - protein, 9 aa, Homo Sapiens
QEVMVWGTP

SEQ ID NO: 555704 - protein, 9 aa, Homo Sapiens
TQKELLDVV

SEQ ID NO: 555705 - protein, 9 aa, Homo Sapiens
APELTMWFF

SEQ ID NO: 555706 - protein, 9 aa, Homo Sapiens
ECAIAVFAS

SEQ ID NO: 555707 - protein, 9 aa, Homo Sapiens
SPSVAECAI

SEQ ID NO: 555708 - protein, 9 aa, Homo Sapiens
NIMKKLAAD

SEQ ID NO: 555709 - protein, 9 aa, Homo Sapiens
IMQEVMVWG

SEQ ID NO: 555710 - protein, 9 aa, Homo Sapiens
DNAPELTMW

SEQ ID NO: 555711 - protein, 9 aa, Homo Sapiens
CAPCKILGP

SEQ ID NO: 555712 - protein, 9 aa, Homo Sapiens
EAAQLLHIL

SEQ ID NO: 555713 - protein, 9 aa, Homo Sapiens
TTSFSYQKR

SEQ ID NO: 555714 - protein, 9 aa, Homo Sapiens
ALTPLRTPH

SEQ ID NO: 555715 - protein, 9 aa, Homo Sapiens
EFTRKGQNF

SEQ ID NO: 555716 - protein, 9 aa, Homo Sapiens
AEKYLAYHM

SEQ ID NO: 555717 - protein, 9 aa, Homo Sapiens
IPQVSMVKS

SEQ ID NO: 555718 - protein, 9 aa, Homo Sapiens
SILGECQLL

SEQ ID NO: 555719 - protein, 9 aa, Homo Sapiens
IPQVLVISL

SEQ ID NO: 555720 - protein, 9 aa, Homo Sapiens
IVNFVNKKL

SEQ ID NO: 555721 - protein, 9 aa, Homo Sapiens
LLLLRYLVL

SEQ ID NO: 555722 - protein, 9 aa, Homo Sapiens
KVADERFIP

SEQ ID NO: 555723 - protein, 9 aa, Homo Sapiens
GHAGGGGGG

SEQ ID NO: 555724 - protein, 9 aa, Homo Sapiens
GVIRARKPQ

SEQ ID NO: 555725 - protein, 9 aa, Homo Sapiens
QKRKESNRK

SEQ ID NO: 555726 - protein, 9 aa, Homo Sapiens
PLSSVLQVY

SEQ ID NO: 555727 - protein, 9 aa, Homo Sapiens
VWGTPFCMM

SEQ ID NO: 555728 - protein, 9 aa, Homo Sapiens
QVSMVKSVR

SEQ ID NO: 555729 - protein, 9 aa, Homo Sapiens
ACRAHEKEV

SEQ ID NO: 555730 - protein, 9 aa, Homo Sapiens
MVWGTPFCM

SEQ ID NO: 555731 - protein, 9 aa, Homo Sapiens
AIAVFASFL

SEQ ID NO: 555732 - protein, 9 aa, Homo Sapiens
VSMVKSVRL

SEQ ID NO: 555733 - protein, 9 aa, Homo Sapiens
RAAAEAALS

SEQ ID NO: 555734 - protein, 9 aa, Homo Sapiens
RTSVGSSNS

SEQ ID NO: 555735 - protein, 9 aa, Homo Sapiens
SRVAKVAEF

SEQ ID NO: 555736 - protein, 9 aa, Homo Sapiens
LRFSIPFSL

SEQ ID NO: 555737 - protein, 9 aa, Homo Sapiens
KGQNFTLRQ

SEQ ID NO: 555738 - protein, 9 aa, Homo Sapiens
LLLRYLVLH

SEQ ID NO: 555739 - protein, 9 aa, Homo Sapiens
MVKSVRLDA

SEQ ID NO: 555740 - protein, 9 aa, Homo Sapiens
LNLRNIYLQ

SEQ ID NO: 555741 - protein, 9 aa, Homo Sapiens
MKKLAADAG

SEQ ID NO: 555742 - protein, 9 aa, Homo Sapiens
PVPCFRPVF

SEQ ID NO: 555743 - protein, 9 aa, Homo Sapiens
YLLALLFIV

SEQ ID NO: 555744 - protein, 9 aa, Homo Sapiens
TRAIRAEEC

SEQ ID NO: 555745 - protein, 9 aa, Homo Sapiens
GECQLLHHP

SEQ ID NO: 555746 - protein, 9 aa, Homo Sapiens
KRKESNRKS

SEQ ID NO: 555747 - protein, 9 aa, Homo Sapiens
SYQKRKESN

SEQ ID NO: 555748 - protein, 9 aa, Homo Sapiens
LALLFIVSS

SEQ ID NO: 555749 - protein, 9 aa, Homo Sapiens
NIPQVSMVK

SEQ ID NO: 555750 - protein, 9 aa, Homo Sapiens
QVKRSDPRS

SEQ ID NO: 555751 - protein, 9 aa, Homo Sapiens
LEWWHVQPT

SEQ ID NO: 555752 - protein, 9 aa, Homo Sapiens
DSLAARKVA

SEQ ID NO: 555753 - protein, 9 aa, Homo Sapiens
LLKLPHGFP

SEQ ID NO: 555754 - protein, 9 aa, Homo Sapiens
ERFIPQVLV

SEQ ID NO: 555755 - protein, 9 aa, Homo Sapiens
TSVGSSNSD

SEQ ID NO: 555756 - protein, 9 aa, Homo Sapiens
TISAETCGP

SEQ ID NO: 555757 - protein, 9 aa, Homo Sapiens
LRYLVLHCL

SEQ ID NO: 555758 - protein, 9 aa, Homo Sapiens
SVLQVYLLA

SEQ ID NO: 555759 - protein, 9 aa, Homo Sapiens
LRAAAEAAL

SEQ ID NO: 555760 - protein, 9 aa, Homo Sapiens
PISILGECQ

SEQ ID NO: 555761 - protein, 9 aa, Homo Sapiens
VNKKLDRLG

SEQ ID NO: 555762 - protein, 9 aa, Homo Sapiens
GGHAGGGGG

SEQ ID NO: 555763 - protein, 9 aa, Homo Sapiens
VIRARKPQY

SEQ ID NO: 555764 - protein, 9 aa, Homo Sapiens
IPTITLLLE

SEQ ID NO: 555765 - protein, 9 aa, Homo Sapiens
LKLPHGFPD

SEQ ID NO: 555766 - protein, 9 aa, Homo Sapiens
FTRKGQNFT

SEQ ID NO: 555767 - protein, 9 aa, Homo Sapiens
IAVFASFLW

SEQ ID NO: 555768 - protein, 9 aa, Homo Sapiens
IQSLLLHGS

SEQ ID NO: 555769 - protein, 9 aa, Homo Sapiens
TSFSYQKRK

SEQ ID NO: 555770 - protein, 9 aa, Homo Sapiens
AVGLGTIVE

SEQ ID NO: 555771 - protein, 9 aa, Homo Sapiens
FSLCLFLLL

SEQ ID NO: 555772 - protein, 9 aa, Homo Sapiens
AQLLHILQA

SEQ ID NO: 555773 - protein, 9 aa, Homo Sapiens
LLLHGSPLT

SEQ ID NO: 555774 - protein, 9 aa, Homo Sapiens
SLAARKVAD

SEQ ID NO: 555775 - protein, 9 aa, Homo Sapiens
VLEACRAHE

SEQ ID NO: 555776 - protein, 9 aa, Homo Sapiens
GFPDSKDAQ

SEQ ID NO: 555777 - protein, 9 aa, Homo Sapiens
TKDVGYLEF

SEQ ID NO: 555778 - protein, 9 aa, Homo Sapiens
IIMQEVMVW

SEQ ID NO: 555779 - protein, 9 aa, Homo Sapiens
HAQWCAPCK

SEQ ID NO: 555780 - protein, 9 aa, Homo Sapiens
ASVLVKDGK

SEQ ID NO: 555781 - protein, 9 aa, Homo Sapiens
AGEEIVAQV

SEQ ID NO: 555782 - protein, 9 aa, Homo Sapiens
VEVAEKYLA

SEQ ID NO: 555783 - protein, 9 aa, Homo Sapiens
LSTGHATSL

SEQ ID NO: 555784 - protein, 9 aa, Homo Sapiens
EAALSQTGF

SEQ ID NO: 555785 - protein, 9 aa, Homo Sapiens
GPVIAGVIR

SEQ ID NO: 555786 - protein, 9 aa, Homo Sapiens
GWADTRAIR

SEQ ID NO: 555787 - protein, 9 aa, Homo Sapiens
LLALLFIVS

SEQ ID NO: 555788 - protein, 9 aa, Homo Sapiens
LLHHPTEST

SEQ ID NO: 555789 - protein, 9 aa, Homo Sapiens
IYLQYNQVS

SEQ ID NO: 555790 - protein, 9 aa, Homo Sapiens
IVAQVKRSD

SEQ ID NO: 555791 - protein, 9 aa, Homo Sapiens
LDVVANPLV

SEQ ID NO: 555792 - protein, 9 aa, Homo Sapiens
ILPISILGE

SEQ ID NO: 555793 - protein, 9 aa, Homo Sapiens
LSQTGFSYD

SEQ ID NO: 555794 - protein, 9 aa, Homo Sapiens
WWHVQPTLD

SEQ ID NO: 555795 - protein, 9 aa, Homo Sapiens
VGYLEFLNI

SEQ ID NO: 555796 - protein, 9 aa, Homo Sapiens
IPFSLCLFL

SEQ ID NO: 555797 - protein, 9 aa, Homo Sapiens
EWWHVQPTL

SEQ ID NO: 555798 - protein, 9 aa, Homo Sapiens
IRAEECRPN

SEQ ID NO: 555799 - protein, 9 aa, Homo Sapiens
DGKFIMTVE

SEQ ID NO: 555800 - protein, 9 aa, Homo Sapiens
PNGTFSHLH

SEQ ID NO: 555801 - protein, 9 aa, Homo Sapiens
SFSYQKRKE

SEQ ID NO: 555802 - protein, 9 aa, Homo Sapiens
RVTIPTITL

SEQ ID NO: 555803 - protein, 9 aa, Homo Sapiens
TMWFFISLI

SEQ ID NO: 555804 - protein, 9 aa, Homo Sapiens
SSFSFCGLN

SEQ ID NO: 555805 - protein, 9 aa, Homo Sapiens
NGTFSHLHK

SEQ ID NO: 555806 - protein, 9 aa, Homo Sapiens
LRNIYLQYN

SEQ ID NO: 555807 - protein, 9 aa, Homo Sapiens
DFHAQWCAP

SEQ ID NO: 555808 - protein, 9 aa, Homo Sapiens
ILGECQLLH

SEQ ID NO: 555809 - protein, 9 aa, Homo Sapiens
MNIMKKLAA

SEQ ID NO: 555810 - protein, 9 aa, Homo Sapiens
LLNLRNIYL

SEQ ID NO: 555811 - protein, 9 aa, Homo Sapiens
HILQALHPP

SEQ ID NO: 555812 - protein, 9 aa, Homo Sapiens
AALSQTGFS

SEQ ID NO: 555813 - protein, 9 aa, Homo Sapiens
LLHGSPLTD

SEQ ID NO: 555814 - protein, 9 aa, Homo Sapiens
ISAETCGPP

SEQ ID NO: 555815 - protein, 9 aa, Homo Sapiens
FLLLLLRYL

SEQ ID NO: 555816 - protein, 9 aa, Homo Sapiens
GGTAWLEWW

SEQ ID NO: 555817 - protein, 9 aa, Homo Sapiens
GGGHAGGGG

SEQ ID NO: 555818 - protein, 9 aa, Homo Sapiens
THTTQKELL

SEQ ID NO: 555819 - protein, 9 aa, Homo Sapiens
WLEWWHVQP

SEQ ID NO: 555820 - protein, 9 aa, Homo Sapiens
LGECQLLHH

SEQ ID NO: 555821 - protein, 9 aa, Homo Sapiens
QAEKGGTEN

SEQ ID NO: 555822 - protein, 9 aa, Homo Sapiens
AIRAEECRP

SEQ ID NO: 555823 - protein, 9 aa, Homo Sapiens
SIPFSLCLF

SEQ ID NO: 555824 - protein, 9 aa, Homo Sapiens
VLHCLLILP

SEQ ID NO: 555825 - protein, 9 aa, Homo Sapiens
SSLLDLRFS

SEQ ID NO: 555826 - protein, 9 aa, Homo Sapiens
RAEECRPNS

SEQ ID NO: 555827 - protein, 9 aa, Homo Sapiens
STGHATSLH

SEQ ID NO: 555828 - protein, 9 aa, Homo Sapiens
WADTRAIRA

SEQ ID NO: 555829 - protein, 9 aa, Homo Sapiens
PQVSMVKSV

SEQ ID NO: 555830 - protein, 9 aa, Homo Sapiens
PIPLSSVLQ

SEQ ID NO: 555831 - protein, 9 aa, Homo Sapiens
DSPDSLAAR

SEQ ID NO: 555832 - protein, 9 aa, Homo Sapiens
SLLLHGSPL

SEQ ID NO: 555833 - protein, 9 aa, Homo Sapiens
KITKDVGYL

SEQ ID NO: 555834 - protein, 9 aa, Homo Sapiens
IMKKLAADA

SEQ ID NO: 555835 - protein, 9 aa, Homo Sapiens
FVNKKLDRL

SEQ ID NO: 555836 - protein, 9 aa, Homo Sapiens
EVAEKYLAY

SEQ ID NO: 555837 - protein, 9 aa, Homo Sapiens
RPIPLSSVL

SEQ ID NO: 555838 - protein, 9 aa, Homo Sapiens
NRSIQSLLL

SEQ ID NO: 555839 - protein, 9 aa, Homo Sapiens
SLCLFLLLL

SEQ ID NO: 555840 - protein, 9 aa, Homo Sapiens
WVSSFSFCG

SEQ ID NO: 555841 - protein, 9 aa, Homo Sapiens
EEIVAQVKR

SEQ ID NO: 555842 - protein, 9 aa, Homo Sapiens
CRSTISAET

SEQ ID NO: 555843 - protein, 9 aa, Homo Sapiens
YLVLHCLLI

SEQ ID NO: 555844 - protein, 9 aa, Homo Sapiens
HNMIDNIPN

SEQ ID NO: 555845 - protein, 9 aa, Homo Sapiens
NFVNKKLDR

SEQ ID NO: 555846 - protein, 9 aa, Homo Sapiens
EKYLAYHME

SEQ ID NO: 555847 - protein, 9 aa, Homo Sapiens
CASRVAKVA

SEQ ID NO: 555848 - protein, 9 aa, Homo Sapiens
SSNSDEYKQ

SEQ ID NO: 555849 - protein, 9 aa, Homo Sapiens
EPGSPKAKG

SEQ ID NO: 555850 - protein, 9 aa, Homo Sapiens
GPRPTGKSY

SEQ ID NO: 555851 - protein, 9 aa, Homo Sapiens
QILLSLPEH

SEQ ID NO: 555852 - protein, 9 aa, Homo Sapiens
DSPSYSNGV

SEQ ID NO: 555853 - protein, 9 aa, Homo Sapiens
IDETCDIEN

SEQ ID NO: 555854 - protein, 9 aa, Homo Sapiens
QNLSQNSCP

SEQ ID NO: 555855 - protein, 9 aa, Homo Sapiens
CRNPKCPSV

SEQ ID NO: 555856 - protein, 9 aa, Homo Sapiens
LPSGRLASM

SEQ ID NO: 555857 - protein, 9 aa, Homo Sapiens
HSAPGPVIQ

SEQ ID NO: 555858 - protein, 9 aa, Homo Sapiens
TKLLLMRLL

SEQ ID NO: 555859 - protein, 9 aa, Homo Sapiens
FACSQDVKT

SEQ ID NO: 555860 - protein, 9 aa, Homo Sapiens
IDVLQMKEE

SEQ ID NO: 555861 - protein, 9 aa, Homo Sapiens
QWKARMEFV

SEQ ID NO: 555862 - protein, 9 aa, Homo Sapiens
NFDLPFKKG

SEQ ID NO: 555863 - protein, 9 aa, Homo Sapiens
AGSPMQRHS

SEQ ID NO: 555864 - protein, 9 aa, Homo Sapiens
CNATDFISK

SEQ ID NO: 555865 - protein, 9 aa, Homo Sapiens
QFAGLEHLR

SEQ ID NO: 555866 - protein, 9 aa, Homo Sapiens
QDVKTCNEV

SEQ ID NO: 555867 - protein, 9 aa, Homo Sapiens
AMGINQRTV

SEQ ID NO: 555868 - protein, 9 aa, Homo Sapiens
CKVRFVALI

SEQ ID NO: 555869 - protein, 9 aa, Homo Sapiens
IQMKDRTVC

SEQ ID NO: 555870 - protein, 9 aa, Homo Sapiens
AQLVAGDDG

SEQ ID NO: 555871 - protein, 9 aa, Homo Sapiens
QSICHRWGL

SEQ ID NO: 555872 - protein, 9 aa, Homo Sapiens
IFAGETVLN

SEQ ID NO: 555873 - protein, 9 aa, Homo Sapiens
ITPGLYAMI

SEQ ID NO: 555874 - protein, 9 aa, Homo Sapiens
ECQNLSQNS

SEQ ID NO: 555875 - protein, 9 aa, Homo Sapiens
SVAGIVCRV

SEQ ID NO: 555876 - protein, 9 aa, Homo Sapiens
DSAIQKQLV

SEQ ID NO: 555877 - protein, 9 aa, Homo Sapiens
AGDDGRLVG

SEQ ID NO: 555878 - protein, 9 aa, Homo Sapiens
YAVAIPLAV

SEQ ID NO: 555879 - protein, 9 aa, Homo Sapiens
FCNATDFIS

SEQ ID NO: 555880 - protein, 9 aa, Homo Sapiens
LRGRSATGR

SEQ ID NO: 555881 - protein, 9 aa, Homo Sapiens
IFFLFACSQ

SEQ ID NO: 555882 - protein, 9 aa, Homo Sapiens
NYAMGINQR

SEQ ID NO: 555883 - protein, 9 aa, Homo Sapiens
RAMNFDLPF

SEQ ID NO: 555884 - protein, 9 aa, Homo Sapiens
SLTSSWDYR

SEQ ID NO: 555885 - protein, 9 aa, Homo Sapiens
CFLLNSVFP

SEQ ID NO: 555886 - protein, 9 aa, Homo Sapiens
YLKANCKVR

SEQ ID NO: 555887 - protein, 9 aa, Homo Sapiens
QEEREQQLR

SEQ ID NO: 555888 - protein, 9 aa, Homo Sapiens
AYAKLMLLT

SEQ ID NO: 555889 - protein, 9 aa, Homo Sapiens
MEFVLRHLP

SEQ ID NO: 555890 - protein, 9 aa, Homo Sapiens
QAHITRAPH

SEQ ID NO: 555891 - protein, 9 aa, Homo Sapiens
FSCLSLTSS

SEQ ID NO: 555892 - protein, 9 aa, Homo Sapiens
PFPGGVGPM

SEQ ID NO: 555893 - protein, 9 aa, Homo Sapiens
GCRNPKCPS

SEQ ID NO: 555894 - protein, 9 aa, Homo Sapiens
VAGIVCRVG

SEQ ID NO: 555895 - protein, 9 aa, Homo Sapiens
MKDRTVCKE

SEQ ID NO: 555896 - protein, 9 aa, Homo Sapiens
FAGETVLNY

SEQ ID NO: 555897 - protein, 9 aa, Homo Sapiens
PECQNLSQN

SEQ ID NO: 555898 - protein, 9 aa, Homo Sapiens
RQILLSLPE

SEQ ID NO: 555899 - protein, 9 aa, Homo Sapiens
QNFIDETCD

SEQ ID NO: 555900 - protein, 9 aa, Homo Sapiens
VCRVGKAED

SEQ ID NO: 555901 - protein, 9 aa, Homo Sapiens
IDGSNFSRH

SEQ ID NO: 555902 - protein, 9 aa, Homo Sapiens
KHEVEKKEL

SEQ ID NO: 555903 - protein, 9 aa, Homo Sapiens
PSSVLPPSF

SEQ ID NO: 555904 - protein, 9 aa, Homo Sapiens
YAMIGAAAC

SEQ ID NO: 555905 - protein, 9 aa, Homo Sapiens
RRELIFAGE

SEQ ID NO: 555906 - protein, 9 aa, Homo Sapiens
AWEKGEPEL

SEQ ID NO: 555907 - protein, 9 aa, Homo Sapiens
ILQLVMSAL

SEQ ID NO: 555908 - protein, 9 aa, Homo Sapiens
ISSPCPTVQ

SEQ ID NO: 555909 - protein, 9 aa, Homo Sapiens
WRSRKWHAC

SEQ ID NO: 555910 - protein, 9 aa, Homo Sapiens
SALCFVFFL

SEQ ID NO: 555911 - protein, 9 aa, Homo Sapiens
IQKQSICHR

SEQ ID NO: 555912 - protein, 9 aa, Homo Sapiens
ESPSSGPDG

SEQ ID NO: 555913 - protein, 9 aa, Homo Sapiens
DYGPAASAQ

SEQ ID NO: 555914 - protein, 9 aa, Homo Sapiens
GPDGAESPS

SEQ ID NO: 555915 - protein, 9 aa, Homo Sapiens
VAVRSKVSD

SEQ ID NO: 555916 - protein, 9 aa, Homo Sapiens
DETCDIENL

SEQ ID NO: 555917 - protein, 9 aa, Homo Sapiens
FAGLEHLRE

SEQ ID NO: 555918 - protein, 9 aa, Homo Sapiens
PVAVRSKVS

SEQ ID NO: 555919 - protein, 9 aa, Homo Sapiens
NATDFISKI

SEQ ID NO: 555920 - protein, 9 aa, Homo Sapiens
LASMAPGAP

SEQ ID NO: 555921 - protein, 9 aa, Homo Sapiens
PGCSLRTIS

SEQ ID NO: 555922 - protein, 9 aa, Homo Sapiens
CPRGVPACS

SEQ ID NO: 555923 - protein, 9 aa, Homo Sapiens
EKIMKLSLP

SEQ ID NO: 555924 - protein, 9 aa, Homo Sapiens
RTLGCRNPK

SEQ ID NO: 555925 - protein, 9 aa, Homo Sapiens
YSNGVASTK

SEQ ID NO: 555926 - protein, 9 aa, Homo Sapiens
LMRLLPSGR

SEQ ID NO: 555927 - protein, 9 aa, Homo Sapiens
VGSKVGDRT

SEQ ID NO: 555928 - protein, 9 aa, Homo Sapiens
NTGADSPSY

SEQ ID NO: 555929 - protein, 9 aa, Homo Sapiens
ASMAPGAPT

SEQ ID NO: 555930 - protein, 9 aa, Homo Sapiens
AIPLAVGLL

SEQ ID NO: 555931 - protein, 9 aa, Homo Sapiens
DGDAPLQSR

SEQ ID NO: 555932 - protein, 9 aa, Homo Sapiens
YLRRELIFA

SEQ ID NO: 555933 - protein, 9 aa, Homo Sapiens
KSFIDGSNF

SEQ ID NO: 555934 - protein, 9 aa, Homo Sapiens
HEVEKKELE

SEQ ID NO: 555935 - protein, 9 aa, Homo Sapiens
SGGRTLADY

SEQ ID NO: 555936 - protein, 9 aa, Homo Sapiens
LSWRSRKWH

SEQ ID NO: 555937 - protein, 9 aa, Homo Sapiens
RFVALIQSF

SEQ ID NO: 555938 - protein, 9 aa, Homo Sapiens
EVKDIIPIQ

SEQ ID NO: 555939 - protein, 9 aa, Homo Sapiens
KARMEFVLR

SEQ ID NO: 555940 - protein, 9 aa, Homo Sapiens
PSGRLASMA

SEQ ID NO: 555941 - protein, 9 aa, Homo Sapiens
MNFDLPFKK

SEQ ID NO: 555942 - protein, 9 aa, Homo Sapiens
ICFDGDAPL

SEQ ID NO: 555943 - protein, 9 aa, Homo Sapiens
SSGPDGAES

SEQ ID NO: 555944 - protein, 9 aa, Homo Sapiens
LVLRRQANI

SEQ ID NO: 555945 - protein, 9 aa, Homo Sapiens
TDANQPDPD

SEQ ID NO: 555946 - protein, 9 aa, Homo Sapiens
CRVGKAEDR

SEQ ID NO: 555947 - protein, 9 aa, Homo Sapiens
LPENFLANF

SEQ ID NO: 555948 - protein, 9 aa, Homo Sapiens
SPSSGPDGA

SEQ ID NO: 555949 - protein, 9 aa, Homo Sapiens
TAPAAAGSP

SEQ ID NO: 555950 - protein, 9 aa, Homo Sapiens
AHITRAPHN

SEQ ID NO: 555951 - protein, 9 aa, Homo Sapiens
PRPQDHDTD

SEQ ID NO: 555952 - protein, 9 aa, Homo Sapiens
LLFSKESPV

SEQ ID NO: 555953 - protein, 9 aa, Homo Sapiens
HTCPRGVPA

SEQ ID NO: 555954 - protein, 9 aa, Homo Sapiens
WKARMEFVL

SEQ ID NO: 555955 - protein, 9 aa, Homo Sapiens
AAAGSPMQR

SEQ ID NO: 555956 - protein, 9 aa, Homo Sapiens
LLSLPEHNY

SEQ ID NO: 555957 - protein, 9 aa, Homo Sapiens
AHTCPRGVP

SEQ ID NO: 555958 - protein, 9 aa, Homo Sapiens
CFFCPKEGC

SEQ ID NO: 555959 - protein, 9 aa, Homo Sapiens
DPDAATPDY

SEQ ID NO: 555960 - protein, 9 aa, Homo Sapiens
IPLAVGLLL

SEQ ID NO: 555961 - protein, 9 aa, Homo Sapiens
TLAPGCSLR

SEQ ID NO: 555962 - protein, 9 aa, Homo Sapiens
MRLLPSGRL

SEQ ID NO: 555963 - protein, 9 aa, Homo Sapiens
RPTGKSYCI

SEQ ID NO: 555964 - protein, 9 aa, Homo Sapiens
SLVLRRQAN

SEQ ID NO: 555965 - protein, 9 aa, Homo Sapiens
AAETADQGP

SEQ ID NO: 555966 - protein, 9 aa, Homo Sapiens
PVAAETADQ

SEQ ID NO: 555967 - protein, 9 aa, Homo Sapiens
TIPPEKPTI

SEQ ID NO: 555968 - protein, 9 aa, Homo Sapiens
VAGDDGRLV

SEQ ID NO: 555969 - protein, 9 aa, Homo Sapiens
GAIDVLQMK

SEQ ID NO: 555970 - protein, 9 aa, Homo Sapiens
LPGGPGISS

SEQ ID NO: 555971 - protein, 9 aa, Homo Sapiens
LQFAGLEHL

SEQ ID NO: 555972 - protein, 9 aa, Homo Sapiens
KRFSCLSLT

SEQ ID NO: 555973 - protein, 9 aa, Homo Sapiens
GIVCRVGKA

SEQ ID NO: 555974 - protein, 9 aa, Homo Sapiens
CFRRDSAIQ

SEQ ID NO: 555975 - protein, 9 aa, Homo Sapiens
AETADQGPT

SEQ ID NO: 555976 - protein, 9 aa, Homo Sapiens
SKRLIRTIA

SEQ ID NO: 555977 - protein, 9 aa, Homo Sapiens
TGADSPSYS

SEQ ID NO: 555978 - protein, 9 aa, Homo Sapiens
VKDIIPIQL

SEQ ID NO: 555979 - protein, 9 aa, Homo Sapiens
PRGVPACSH

SEQ ID NO: 555980 - protein, 9 aa, Homo Sapiens
YGPAASAQA

SEQ ID NO: 555981 - protein, 9 aa, Homo Sapiens
QKQLVKNEK

SEQ ID NO: 555982 - protein, 9 aa, Homo Sapiens
KGPKEGLPI

SEQ ID NO: 555983 - protein, 9 aa, Homo Sapiens
GAPTLAPGC

SEQ ID NO: 555984 - protein, 9 aa, Homo Sapiens
LCFVFFLFS

SEQ ID NO: 555985 - protein, 9 aa, Homo Sapiens
FITPFPGGV

SEQ ID NO: 555986 - protein, 9 aa, Homo Sapiens
PIGPQPPPE

SEQ ID NO: 555987 - protein, 9 aa, Homo Sapiens
ALCFVFFLF

SEQ ID NO: 555988 - protein, 9 aa, Homo Sapiens
PSSGPDGAE

SEQ ID NO: 555989 - protein, 9 aa, Homo Sapiens
TAVSPPPPP

SEQ ID NO: 555990 - protein, 9 aa, Homo Sapiens
EEREQQLRR

SEQ ID NO: 555991 - protein, 9 aa, Homo Sapiens
KGPQKSQKT

SEQ ID NO: 555992 - protein, 9 aa, Homo Sapiens
LKANCKVRF

SEQ ID NO: 555993 - protein, 9 aa, Homo Sapiens
AVRSKVSDS

SEQ ID NO: 555994 - protein, 9 aa, Homo Sapiens
YKVGNYETN

SEQ ID NO: 555995 - protein, 9 aa, Homo Sapiens
AFLCEVKDI

SEQ ID NO: 555996 - protein, 9 aa, Homo Sapiens
SKVGDRTLP

SEQ ID NO: 555997 - protein, 9 aa, Homo Sapiens
EQEVLPENF

SEQ ID NO: 555998 - protein, 9 aa, Homo Sapiens
ILLSLPEHN

SEQ ID NO: 555999 - protein, 9 aa, Homo Sapiens
APAAAGSPM

SEQ ID NO: 556000 - protein, 9 aa, Homo Sapiens
VTGCRQILL

SEQ ID NO: 556001 - protein, 9 aa, Homo Sapiens
TCDIENLLK

SEQ ID NO: 556002 - protein, 9 aa, Homo Sapiens
KVRFVALIQ

SEQ ID NO: 556003 - protein, 9 aa, Homo Sapiens
DQGPTPRYF

SEQ ID NO: 556004 - protein, 9 aa, Homo Sapiens
AVAIPLAVG

SEQ ID NO: 556005 - protein, 9 aa, Homo Sapiens
VAAETADQG

SEQ ID NO: 556006 - protein, 9 aa, Homo Sapiens
ADYGPAASA

SEQ ID NO: 556007 - protein, 9 aa, Homo Sapiens
TKTEEEDDG

SEQ ID NO: 556008 - protein, 9 aa, Homo Sapiens
PSPSLPSSV

SEQ ID NO: 556009 - protein, 9 aa, Homo Sapiens
SPSLPSSVL

SEQ ID NO: 556010 - protein, 9 aa, Homo Sapiens
WEKGEPELR

SEQ ID NO: 556011 - protein, 9 aa, Homo Sapiens
CHRWGLPQK

SEQ ID NO: 556012 - protein, 9 aa, Homo Sapiens
SSDVPSGTK

SEQ ID NO: 556013 - protein, 9 aa, Homo Sapiens
GLRIFCNAT

SEQ ID NO: 556014 - protein, 9 aa, Homo Sapiens
VLNYAMGIN

SEQ ID NO: 556015 - protein, 9 aa, Homo Sapiens
GSKESSSVP

SEQ ID NO: 556016 - protein, 9 aa, Homo Sapiens
SKVSDSEFP

SEQ ID NO: 556017 - protein, 9 aa, Homo Sapiens
CFDGDAPLQ

SEQ ID NO: 556018 - protein, 9 aa, Homo Sapiens
SGAIDVLQM

SEQ ID NO: 556019 - protein, 9 aa, Homo Sapiens
HEALLQTAV

SEQ ID NO: 556020 - protein, 9 aa, Homo Sapiens
YETNTNSSV

SEQ ID NO: 556021 - protein, 9 aa, Homo Sapiens
NCFFCPKEG

SEQ ID NO: 556022 - protein, 9 aa, Homo Sapiens
ELRGRSATG

SEQ ID NO: 556023 - protein, 9 aa, Homo Sapiens
TCPRGVPAC

SEQ ID NO: 556024 - protein, 9 aa, Homo Sapiens
DLIPPAESA

SEQ ID NO: 556025 - protein, 9 aa, Homo Sapiens
DNVCISFVD

SEQ ID NO: 556026 - protein, 9 aa, Homo Sapiens
ASFITPFPG

SEQ ID NO: 556027 - protein, 9 aa, Homo Sapiens
AAGSKESSS

SEQ ID NO: 556028 - protein, 9 aa, Homo Sapiens
AKKHEVEKK

SEQ ID NO: 556029 - protein, 9 aa, Homo Sapiens
PRPTGKSYC

SEQ ID NO: 556030 - protein, 9 aa, Homo Sapiens
FLLNSVFPR

SEQ ID NO: 556031 - protein, 9 aa, Homo Sapiens
ARMEFVLRH

SEQ ID NO: 556032 - protein, 9 aa, Homo Sapiens
AGSKESSSV

SEQ ID NO: 556033 - protein, 9 aa, Homo Sapiens
SSPSPSLPS

SEQ ID NO: 556034 - protein, 9 aa, Homo Sapiens
PPAHTCPRG

SEQ ID NO: 556035 - protein, 9 aa, Homo Sapiens
RLVGSKVGD

SEQ ID NO: 556036 - protein, 9 aa, Homo Sapiens
LGCRNPKCP

SEQ ID NO: 556037 - protein, 9 aa, Homo Sapiens
SLRTISPAL

SEQ ID NO: 556038 - protein, 9 aa, Homo Sapiens
VSPPPPPTR

SEQ ID NO: 556039 - protein, 9 aa, Homo Sapiens
GRTLADYGP

SEQ ID NO: 556040 - protein, 9 aa, Homo Sapiens
GLPIGPQPP

SEQ ID NO: 556041 - protein, 9 aa, Homo Sapiens
PTLAPGCSL

SEQ ID NO: 556042 - protein, 9 aa, Homo Sapiens
QSKYSLSKR

SEQ ID NO: 556043 - protein, 9 aa, Homo Sapiens
KIMKLSLPE

SEQ ID NO: 556044 - protein, 9 aa, Homo Sapiens
LHEHAPYRG

SEQ ID NO: 556045 - protein, 9 aa, Homo Sapiens
IQKQLVKNE

SEQ ID NO: 556046 - protein, 9 aa, Homo Sapiens
NCKVRFVAL

SEQ ID NO: 556047 - protein, 9 aa, Homo Sapiens
RFYYYDYLD

SEQ ID NO: 556048 - protein, 9 aa, Homo Sapiens
PGLYAMIGA

SEQ ID NO: 556049 - protein, 9 aa, Homo Sapiens
FLFACSQDV

SEQ ID NO: 556050 - protein, 9 aa, Homo Sapiens
ADQGPTPRY

SEQ ID NO: 556051 - protein, 9 aa, Homo Sapiens
KAKGPQKSQ

SEQ ID NO: 556052 - protein, 9 aa, Homo Sapiens
RIFCNATDF

SEQ ID NO: 556053 - protein, 9 aa, Homo Sapiens
DANQPDPDA

SEQ ID NO: 556054 - protein, 9 aa, Homo Sapiens
VIQPAPCPG

SEQ ID NO: 556055 - protein, 9 aa, Homo Sapiens
DECGKSFID

SEQ ID NO: 556056 - protein, 9 aa, Homo Sapiens
SKESPVLPA

SEQ ID NO: 556057 - protein, 9 aa, Homo Sapiens
LSLPEHNYV

SEQ ID NO: 556058 - protein, 9 aa, Homo Sapiens
APHNPGHVI

SEQ ID NO: 556059 - protein, 9 aa, Homo Sapiens
RTLADYGPA

SEQ ID NO: 556060 - protein, 9 aa, Homo Sapiens
VGLSWRSRK

SEQ ID NO: 556061 - protein, 9 aa, Homo Sapiens
FPGGVGPMT

SEQ ID NO: 556062 - protein, 9 aa, Homo Sapiens
DDNVCISFV

SEQ ID NO: 556063 - protein, 9 aa, Homo Sapiens
INQRTVLIS

SEQ ID NO: 556064 - protein, 9 aa, Homo Sapiens
ENSRFYYYD

SEQ ID NO: 556065 - protein, 9 aa, Homo Sapiens
PYRGHRFIT

SEQ ID NO: 556066 - protein, 9 aa, Homo Sapiens
MGINQRTVL

SEQ ID NO: 556067 - protein, 9 aa, Homo Sapiens
PPGFLQESW

SEQ ID NO: 556068 - protein, 9 aa, Homo Sapiens
FTPRPQDHD

SEQ ID NO: 556069 - protein, 9 aa, Homo Sapiens
RMEFVLRHL

SEQ ID NO: 556070 - protein, 9 aa, Homo Sapiens
RRDSAIQKQ

SEQ ID NO: 556071 - protein, 9 aa, Homo Sapiens
SENSRFYYY

SEQ ID NO: 556072 - protein, 9 aa, Homo Sapiens
VGLLLLLFV

SEQ ID NO: 556073 - protein, 9 aa, Homo Sapiens
LLNSVFPRC

SEQ ID NO: 556074 - protein, 9 aa, Homo Sapiens
FFCPKEGCP

SEQ ID NO: 556075 - protein, 9 aa, Homo Sapiens
LAYAKLMLL

SEQ ID NO: 556076 - protein, 9 aa, Homo Sapiens
QPAPCPGQA

SEQ ID NO: 556077 - protein, 9 aa, Homo Sapiens
SIQMKDRTV

SEQ ID NO: 556078 - protein, 9 aa, Homo Sapiens
FRRDSAIQK

SEQ ID NO: 556079 - protein, 9 aa, Homo Sapiens
TPGLYAMIG

SEQ ID NO: 556080 - protein, 9 aa, Homo Sapiens
STEKPTIPP

SEQ ID NO: 556081 - protein, 9 aa, Homo Sapiens
CDIENLLKE

SEQ ID NO: 556082 - protein, 9 aa, Homo Sapiens
SGTKTEEED

SEQ ID NO: 556083 - protein, 9 aa, Homo Sapiens
SFIDGSNFS

SEQ ID NO: 556084 - protein, 9 aa, Homo Sapiens
RGLDDRPVQ

SEQ ID NO: 556085 - protein, 9 aa, Homo Sapiens
FESPSSGPD

SEQ ID NO: 556086 - protein, 9 aa, Homo Sapiens
KDRTVCKER

SEQ ID NO: 556087 - protein, 9 aa, Homo Sapiens
SGPDGAESP

SEQ ID NO: 556088 - protein, 9 aa, Homo Sapiens
TPFPGGVGP

SEQ ID NO: 556089 - protein, 9 aa, Homo Sapiens
QKQSICHRW

SEQ ID NO: 556090 - protein, 9 aa, Homo Sapiens
ANQPDPDAA

SEQ ID NO: 556091 - protein, 9 aa, Homo Sapiens
LQLVMSALC

SEQ ID NO: 556092 - protein, 9 aa, Homo Sapiens
KDIIPIQLV

SEQ ID NO: 556093 - protein, 9 aa, Homo Sapiens
RDSAIQKQL

SEQ ID NO: 556094 - protein, 9 aa, Homo Sapiens
PKCPSVCHR

SEQ ID NO: 556095 - protein, 9 aa, Homo Sapiens
AAGSPMQRH

SEQ ID NO: 556096 - protein, 9 aa, Homo Sapiens
PSYSNGVAS

SEQ ID NO: 556097 - protein, 9 aa, Homo Sapiens
LPIGPQPPP

SEQ ID NO: 556098 - protein, 9 aa, Homo Sapiens
ITPFPGGVG

SEQ ID NO: 556099 - protein, 9 aa, Homo Sapiens
RGVPACSHV

SEQ ID NO: 556100 - protein, 9 aa, Homo Sapiens
TVLNYAMGI

SEQ ID NO: 556101 - protein, 9 aa, Homo Sapiens
LSKRLIRTI

SEQ ID NO: 556102 - protein, 9 aa, Homo Sapiens
PGSPKAKGP

SEQ ID NO: 556103 - protein, 9 aa, Homo Sapiens
AKGPQKSQK

SEQ ID NO: 556104 - protein, 9 aa, Homo Sapiens
GNCFFCPKE

SEQ ID NO: 556105 - protein, 9 aa, Homo Sapiens
QLVMSALCF

SEQ ID NO: 556106 - protein, 9 aa, Homo Sapiens
LVAGDDGRL

SEQ ID NO: 556107 - protein, 9 aa, Homo Sapiens
LPSSVLPPS

SEQ ID NO: 556108 - protein, 9 aa, Homo Sapiens
ESPVLPAAT

SEQ ID NO: 556109 - protein, 9 aa, Homo Sapiens
HITRAPHNP

SEQ ID NO: 556110 - protein, 9 aa, Homo Sapiens
SKYSLSKRL

SEQ ID NO: 556111 - protein, 9 aa, Homo Sapiens
NSRFYYYDY

SEQ ID NO: 556112 - protein, 9 aa, Homo Sapiens
GPKEGLPIG

SEQ ID NO: 556113 - protein, 9 aa, Homo Sapiens
NFLANFPSL

SEQ ID NO: 556114 - protein, 9 aa, Homo Sapiens
LRLVGSKVG

SEQ ID NO: 556115 - protein, 9 aa, Homo Sapiens
ALLQTAVSP

SEQ ID NO: 556116 - protein, 9 aa, Homo Sapiens
LSQNSCPPS

SEQ ID NO: 556117 - protein, 9 aa, Homo Sapiens
GLDDRPVQT

SEQ ID NO: 556118 - protein, 9 aa, Homo Sapiens
GETVLNYAM

SEQ ID NO: 556119 - protein, 9 aa, Homo Sapiens
RPVQTEKER

SEQ ID NO: 556120 - protein, 9 aa, Homo Sapiens
LRRQANILR

SEQ ID NO: 556121 - protein, 9 aa, Homo Sapiens
RTAPAAAGS

SEQ ID NO: 556122 - protein, 9 aa, Homo Sapiens
FHIQKQSIC

SEQ ID NO: 556123 - protein, 9 aa, Homo Sapiens
PTIPPEKPT

SEQ ID NO: 556124 - protein, 9 aa, Homo Sapiens
LESSQLQFA

SEQ ID NO: 556125 - protein, 9 aa, Homo Sapiens
VRTAPAAAG

SEQ ID NO: 556126 - protein, 9 aa, Homo Sapiens
QRTVLISGH

SEQ ID NO: 556127 - protein, 9 aa, Homo Sapiens
EKPTIPPEK

SEQ ID NO: 556128 - protein, 9 aa, Homo Sapiens
KLMLLTLST

SEQ ID NO: 556129 - protein, 9 aa, Homo Sapiens
RTVCKERIR

SEQ ID NO: 556130 - protein, 9 aa, Homo Sapiens
FIDGSNFSR

SEQ ID NO: 556131 - protein, 9 aa, Homo Sapiens
SLPSSVLPP

SEQ ID NO: 556132 - protein, 9 aa, Homo Sapiens
ILDEDDNVC

SEQ ID NO: 556133 - protein, 9 aa, Homo Sapiens
VLPAATELA

SEQ ID NO: 556134 - protein, 9 aa, Homo Sapiens
ESSQLQFAG

SEQ ID NO: 556135 - protein, 9 aa, Homo Sapiens
SACFLLNSV

SEQ ID NO: 556136 - protein, 9 aa, Homo Sapiens
IPPEKPTIP

SEQ ID NO: 556137 - protein, 9 aa, Homo Sapiens
SPVLPAATE

SEQ ID NO: 556138 - protein, 9 aa, Homo Sapiens
ELIFAGETV

SEQ ID NO: 556139 - protein, 9 aa, Homo Sapiens
TSSWDYRSS

SEQ ID NO: 556140 - protein, 9 aa, Homo Sapiens
KGEPELRGR

SEQ ID NO: 556141 - protein, 9 aa, Homo Sapiens
ITRAPHNPG

SEQ ID NO: 556142 - protein, 9 aa, Homo Sapiens
TYPPGFLQE

SEQ ID NO: 556143 - protein, 9 aa, Homo Sapiens
QTEKERKSV

SEQ ID NO: 556144 - protein, 9 aa, Homo Sapiens
VLRRQANIL

SEQ ID NO: 556145 - protein, 9 aa, Homo Sapiens
ACSQDVKTC

SEQ ID NO: 556146 - protein, 9 aa, Homo Sapiens
DEDDNVCIS

SEQ ID NO: 556147 - protein, 9 aa, Homo Sapiens
VYLRRELIF

SEQ ID NO: 556148 - protein, 9 aa, Homo Sapiens
NTNSSVDQE

SEQ ID NO: 556149 - protein, 9 aa, Homo Sapiens
LSSPSPSLP

SEQ ID NO: 556150 - protein, 9 aa, Homo Sapiens
CPKEGCPTM

SEQ ID NO: 556151 - protein, 9 aa, Homo Sapiens
KLSLPESLK

SEQ ID NO: 556152 - protein, 9 aa, Homo Sapiens
VAIPLAVGL

SEQ ID NO: 556153 - protein, 9 aa, Homo Sapiens
ATTYPPGFL

SEQ ID NO: 556154 - protein, 9 aa, Homo Sapiens
TNTNSSVDQ

SEQ ID NO: 556155 - protein, 9 aa, Homo Sapiens
DDGRLVGLS

SEQ ID NO: 556156 - protein, 9 aa, Homo Sapiens
LSACFLLNS

SEQ ID NO: 556157 - protein, 9 aa, Homo Sapiens
KESPVLPAA

SEQ ID NO: 556158 - protein, 9 aa, Homo Sapiens
HAPYRGHRF

SEQ ID NO: 556159 - protein, 9 aa, Homo Sapiens
SGRLASMAP

SEQ ID NO: 556160 - protein, 9 aa, Homo Sapiens
SMAPGAPTL

SEQ ID NO: 556161 - protein, 9 aa, Homo Sapiens
LTSSWDYRS

SEQ ID NO: 556162 - protein, 9 aa, Homo Sapiens
LDEDDNVCI

SEQ ID NO: 556163 - protein, 9 aa, Homo Sapiens
RRQANILRE

SEQ ID NO: 556164 - protein, 9 aa, Homo Sapiens
GRLVGLSWR

SEQ ID NO: 556165 - protein, 9 aa, Homo Sapiens
LFSKESPVL

SEQ ID NO: 556166 - protein, 9 aa, Homo Sapiens
EDDNVCISF

SEQ ID NO: 556167 - protein, 9 aa, Homo Sapiens
ICHRWGLPQ

SEQ ID NO: 556168 - protein, 9 aa, Homo Sapiens
KVGDRTLPG

SEQ ID NO: 556169 - protein, 9 aa, Homo Sapiens
LNYAMGINQ

SEQ ID NO: 556170 - protein, 9 aa, Homo Sapiens
AAKKHEVEK

SEQ ID NO: 556171 - protein, 9 aa, Homo Sapiens
EEQEVLPEN

SEQ ID NO: 556172 - protein, 9 aa, Homo Sapiens
GPQKSQKTL

SEQ ID NO: 556173 - protein, 9 aa, Homo Sapiens
GGPGISSPC

SEQ ID NO: 556174 - protein, 9 aa, Homo Sapiens
PKAKGPQKS

SEQ ID NO: 556175 - protein, 9 aa, Homo Sapiens
TRAPHNPGH

SEQ ID NO: 556176 - protein, 9 aa, Homo Sapiens
LRRELIFAG

SEQ ID NO: 556177 - protein, 9 aa, Homo Sapiens
KVGNYETNT

SEQ ID NO: 556178 - protein, 9 aa, Homo Sapiens
LLMRLLPSG

SEQ ID NO: 556179 - protein, 9 aa, Homo Sapiens
PAESALQSL

SEQ ID NO: 556180 - protein, 9 aa, Homo Sapiens
LCEVKDIIP

SEQ ID NO: 556181 - protein, 9 aa, Homo Sapiens
PAAAGSPMQ

SEQ ID NO: 556182 - protein, 9 aa, Homo Sapiens
KKHEVEKKE

SEQ ID NO: 556183 - protein, 9 aa, Homo Sapiens
TADQGPTPR

SEQ ID NO: 556184 - protein, 9 aa, Homo Sapiens
EVLPENFLA

SEQ ID NO: 556185 - protein, 9 aa, Homo Sapiens
GISSPCPTV

SEQ ID NO: 556186 - protein, 9 aa, Homo Sapiens
YAKLMLLTL

SEQ ID NO: 556187 - protein, 9 aa, Homo Sapiens
QMKDRTVCK

SEQ ID NO: 556188 - protein, 9 aa, Homo Sapiens
MIGAAACLG

SEQ ID NO: 556189 - protein, 9 aa, Homo Sapiens
DLPFKKGSG

SEQ ID NO: 556190 - protein, 9 aa, Homo Sapiens
KESSSVPMP

SEQ ID NO: 556191 - protein, 9 aa, Homo Sapiens
PAHTCPRGV

SEQ ID NO: 556192 - protein, 9 aa, Homo Sapiens
QNSCPPSEV

SEQ ID NO: 556193 - protein, 9 aa, Homo Sapiens
EPELRGRSA

SEQ ID NO: 556194 - protein, 9 aa, Homo Sapiens
DDRPVQTEK

SEQ ID NO: 556195 - protein, 9 aa, Homo Sapiens
PTGKSYCIN

SEQ ID NO: 556196 - protein, 9 aa, Homo Sapiens
RTVLISGHT

SEQ ID NO: 556197 - protein, 9 aa, Homo Sapiens
LLEICFDGD

SEQ ID NO: 556198 - protein, 9 aa, Homo Sapiens
PVQTEKERK

SEQ ID NO: 556199 - protein, 9 aa, Homo Sapiens
TGCRQILLS

SEQ ID NO: 556200 - protein, 9 aa, Homo Sapiens
SDSEFPVMQ

SEQ ID NO: 556201 - protein, 9 aa, Homo Sapiens
NYETNTNSS

SEQ ID NO: 556202 - protein, 9 aa, Homo Sapiens
GLSACFLLN

SEQ ID NO: 556203 - protein, 9 aa, Homo Sapiens
FDLPFKKGS

SEQ ID NO: 556204 - protein, 9 aa, Homo Sapiens
LVGLSWRSR

SEQ ID NO: 556205 - protein, 9 aa, Homo Sapiens
CISFVDSVA

SEQ ID NO: 556206 - protein, 9 aa, Homo Sapiens
MQAHITRAP

SEQ ID NO: 556207 - protein, 9 aa, Homo Sapiens
PGFLQESWG

SEQ ID NO: 556208 - protein, 9 aa, Homo Sapiens
EGLPIGPQP

SEQ ID NO: 556209 - protein, 9 aa, Homo Sapiens
LSVAGIVCR

SEQ ID NO: 556210 - protein, 9 aa, Homo Sapiens
AGETVLNYA

SEQ ID NO: 556211 - protein, 9 aa, Homo Sapiens
PDPDAATPD

SEQ ID NO: 556212 - protein, 9 aa, Homo Sapiens
PPAESALQS

SEQ ID NO: 556213 - protein, 9 aa, Homo Sapiens
RLASMAPGA

SEQ ID NO: 556214 - protein, 9 aa, Homo Sapiens
AVGLLLLLF

SEQ ID NO: 556215 - protein, 9 aa, Homo Sapiens
PELRGRSAT

SEQ ID NO: 556216 - protein, 9 aa, Homo Sapiens
LLAYAKLML

SEQ ID NO: 556217 - protein, 9 aa, Homo Sapiens
FLHEHAPYR

SEQ ID NO: 556218 - protein, 9 aa, Homo Sapiens
LRIFCNATD

SEQ ID NO: 556219 - protein, 9 aa, Homo Sapiens
IGAAACLGG

SEQ ID NO: 556220 - protein, 9 aa, Homo Sapiens
SQLQFAGLE

SEQ ID NO: 556221 - protein, 9 aa, Homo Sapiens
LLQTAVSPP

SEQ ID NO: 556222 - protein, 9 aa, Homo Sapiens
CLSLTSSWD

SEQ ID NO: 556223 - protein, 9 aa, Homo Sapiens
ADSENSRFY

SEQ ID NO: 556224 - protein, 9 aa, Homo Sapiens
TDFISKIKS

SEQ ID NO: 556225 - protein, 9 aa, Homo Sapiens
RELIFAGET

SEQ ID NO: 556226 - protein, 9 aa, Homo Sapiens
PGPVIQPAP

SEQ ID NO: 556227 - protein, 9 aa, Homo Sapiens
DPECQNLSQ

SEQ ID NO: 556228 - protein, 9 aa, Homo Sapiens
QPDPDAATP

SEQ ID NO: 556229 - protein, 9 aa, Homo Sapiens
DAPLQSRSP

SEQ ID NO: 556230 - protein, 9 aa, Homo Sapiens
SLPESLKAY

SEQ ID NO: 556231 - protein, 9 aa, Homo Sapiens
EICFDGDAP

SEQ ID NO: 556232 - protein, 9 aa, Homo Sapiens
TGKSYCINS

SEQ ID NO: 556233 - protein, 9 aa, Homo Sapiens
GSPMQRHST

SEQ ID NO: 556234 - protein, 9 aa, Homo Sapiens
RTISPALWR

SEQ ID NO: 556235 - protein, 9 aa, Homo Sapiens
SWRSRKWHA

SEQ ID NO: 556236 - protein, 9 aa, Homo Sapiens
KAGNCFFCP

SEQ ID NO: 556237 - protein, 9 aa, Homo Sapiens
QLVAGDDGR

SEQ ID NO: 556238 - protein, 9 aa, Homo Sapiens
ANCKVRFVA

SEQ ID NO: 556239 - protein, 9 aa, Homo Sapiens
AGIVCRVGK

SEQ ID NO: 556240 - protein, 9 aa, Homo Sapiens
PKEGLPIGP

SEQ ID NO: 556241 - protein, 9 aa, Homo Sapiens
QEAAKKHEV

SEQ ID NO: 556242 - protein, 9 aa, Homo Sapiens
TLGCRNPKC

SEQ ID NO: 556243 - protein, 9 aa, Homo Sapiens
RFSCLSLTS

SEQ ID NO: 556244 - protein, 9 aa, Homo Sapiens
GGRTLADYG

SEQ ID NO: 556245 - protein, 9 aa, Homo Sapiens
TTYPPGFLQ

SEQ ID NO: 556246 - protein, 9 aa, Homo Sapiens
EDADSENSR

SEQ ID NO: 556247 - protein, 9 aa, Homo Sapiens
ERASFITPF

SEQ ID NO: 556248 - protein, 9 aa, Homo Sapiens
REKIMKLSL

SEQ ID NO: 556249 - protein, 9 aa, Homo Sapiens
IGPQPPPEA

SEQ ID NO: 556250 - protein, 9 aa, Homo Sapiens
SFITPFPGG

SEQ ID NO: 556251 - protein, 9 aa, Homo Sapiens
AGNCFFCPK

SEQ ID NO: 556252 - protein, 9 aa, Homo Sapiens
VLRHLPDYR

SEQ ID NO: 556253 - protein, 9 aa, Homo Sapiens
LIFAGETVL

SEQ ID NO: 556254 - protein, 9 aa, Homo Sapiens
YPPGFLQES

SEQ ID NO: 556255 - protein, 9 aa, Homo Sapiens
GKSFIDGSN

SEQ ID NO: 556256 - protein, 9 aa, Homo Sapiens
LEICFDGDA

SEQ ID NO: 556257 - protein, 9 aa, Homo Sapiens
SYCINSAAL

SEQ ID NO: 556258 - protein, 9 aa, Homo Sapiens
IVCRVGKAE

SEQ ID NO: 556259 - protein, 9 aa, Homo Sapiens
SRFYYYDYL

SEQ ID NO: 556260 - protein, 9 aa, Homo Sapiens
KTEEEDDGM

SEQ ID NO: 556261 - protein, 9 aa, Homo Sapiens
RPQDHDTDL

SEQ ID NO: 556262 - protein, 9 aa, Homo Sapiens
TPRPQDHDT

SEQ ID NO: 556263 - protein, 9 aa, Homo Sapiens
LLLMRLLPS

SEQ ID NO: 556264 - protein, 9 aa, Homo Sapiens
EQEEREQQL

SEQ ID NO: 556265 - protein, 9 aa, Homo Sapiens
KYSLSKRLI

SEQ ID NO: 556266 - protein, 9 aa, Homo Sapiens
PDAATPDYV

SEQ ID NO: 556267 - protein, 9 aa, Homo Sapiens
PSGTKTEEE

SEQ ID NO: 556268 - protein, 9 aa, Homo Sapiens
QTAVSPPPP

SEQ ID NO: 556269 - protein, 9 aa, Homo Sapiens
RSKVSDSEF

SEQ ID NO: 556270 - protein, 9 aa, Homo Sapiens
GFLQESWGQ

SEQ ID NO: 556271 - protein, 9 aa, Homo Sapiens
ELTKLLLMR

SEQ ID NO: 556272 - protein, 9 aa, Homo Sapiens
FSKESPVLP

SEQ ID NO: 556273 - protein, 9 aa, Homo Sapiens
APYRGHRFI

SEQ ID NO: 556274 - protein, 9 aa, Homo Sapiens
VRSKVSDSE

SEQ ID NO: 556275 - protein, 9 aa, Homo Sapiens
LAVGLLLLL

SEQ ID NO: 556276 - protein, 9 aa, Homo Sapiens
DVPSGTKTE

SEQ ID NO: 556277 - protein, 9 aa, Homo Sapiens
RREQEEREQ

SEQ ID NO: 556278 - protein, 9 aa, Homo Sapiens
GDAPLQSRS

SEQ ID NO: 556279 - protein, 9 aa, Homo Sapiens
GDDGRLVGL

SEQ ID NO: 556280 - protein, 9 aa, Homo Sapiens
LAPGCSLRT

SEQ ID NO: 556281 - protein, 9 aa, Homo Sapiens
PPEKPTIPT

SEQ ID NO: 556282 - protein, 9 aa, Homo Sapiens
AVSPPPPPT

SEQ ID NO: 556283 - protein, 9 aa, Homo Sapiens
MKLSLPESL

SEQ ID NO: 556284 - protein, 9 aa, Homo Sapiens
SICHRWGLP

SEQ ID NO: 556285 - protein, 9 aa, Homo Sapiens
PGISSPCPT

SEQ ID NO: 556286 - protein, 9 aa, Homo Sapiens
VRFVALIQS

SEQ ID NO: 556287 - protein, 9 aa, Homo Sapiens
LADYGPAAS

SEQ ID NO: 556288 - protein, 9 aa, Homo Sapiens
VLPENFLAN

SEQ ID NO: 556289 - protein, 9 aa, Homo Sapiens
LDDRPVQTE

SEQ ID NO: 556290 - protein, 9 aa, Homo Sapiens
EHAPYRGHR

SEQ ID NO: 556291 - protein, 9 aa, Homo Sapiens
PENFLANFP

SEQ ID NO: 556292 - protein, 9 aa, Homo Sapiens
GLSWRSRKW

SEQ ID NO: 556293 - protein, 9 aa, Homo Sapiens
LRAFLCEVK

SEQ ID NO: 556294 - protein, 9 aa, Homo Sapiens
TDLLLAYAK

SEQ ID NO: 556295 - protein, 9 aa, Homo Sapiens
FIDETCDIE

SEQ ID NO: 556296 - protein, 9 aa, Homo Sapiens
SPKAKGPQK

SEQ ID NO: 556297 - protein, 9 aa, Homo Sapiens
NQRTVLISG

SEQ ID NO: 556298 - protein, 9 aa, Homo Sapiens
ACFLLNSVF

SEQ ID NO: 556299 - protein, 9 aa, Homo Sapiens
IMKLSLPES

SEQ ID NO: 556300 - protein, 9 aa, Homo Sapiens
NQPDPDAAT

SEQ ID NO: 556301 - protein, 9 aa, Homo Sapiens
GADSPSYSN

SEQ ID NO: 556302 - protein, 9 aa, Homo Sapiens
REQEEREQQ

SEQ ID NO: 556303 - protein, 9 aa, Homo Sapiens
AIQKQLVKN

SEQ ID NO: 556304 - protein, 9 aa, Homo Sapiens
YSLSKRLIR

SEQ ID NO: 556305 - protein, 9 aa, Homo Sapiens
VGNYETNTN

SEQ ID NO: 556306 - protein, 9 aa, Homo Sapiens
SYSNGVAST

SEQ ID NO: 556307 - protein, 9 aa, Homo Sapiens
LSLTSSWDY

SEQ ID NO: 556308 - protein, 9 aa, Homo Sapiens
APTLAPGCS

SEQ ID NO: 556309 - protein, 9 aa, Homo Sapiens
MSALCFVFF

SEQ ID NO: 556310 - protein, 9 aa, Homo Sapiens
NPKCPSVCH

SEQ ID NO: 556311 - protein, 9 aa, Homo Sapiens
YRGHRFITE

SEQ ID NO: 556312 - protein, 9 aa, Homo Sapiens
GLYAMIGAA

SEQ ID NO: 556313 - protein, 9 aa, Homo Sapiens
VPSGTKTEE

SEQ ID NO: 556314 - protein, 9 aa, Homo Sapiens
EVEKKELER

SEQ ID NO: 556315 - protein, 9 aa, Homo Sapiens
KLLLMRLLP

SEQ ID NO: 556316 - protein, 9 aa, Homo Sapiens
CGKSFIDGS

SEQ ID NO: 556317 - protein, 9 aa, Homo Sapiens
ENFLANFPS

SEQ ID NO: 556318 - protein, 9 aa, Homo Sapiens
PGAPTLAPG

SEQ ID NO: 556319 - protein, 9 aa, Homo Sapiens
EGLRLVGSK

SEQ ID NO: 556320 - protein, 9 aa, Homo Sapiens
AMIGAAACL

SEQ ID NO: 556321 - protein, 9 aa, Homo Sapiens
LREKIMKLS

SEQ ID NO: 556322 - protein, 9 aa, Homo Sapiens
KQSICHRWG

SEQ ID NO: 556323 - protein, 9 aa, Homo Sapiens
VSDSEFPVM

SEQ ID NO: 556324 - protein, 9 aa, Homo Sapiens
GCSLRTISP

SEQ ID NO: 556325 - protein, 9 aa, Homo Sapiens
QEVLPENFL

SEQ ID NO: 556326 - protein, 9 aa, Homo Sapiens
FLQESWGQL

SEQ ID NO: 556327 - protein, 9 aa, Homo Sapiens
DGRLVGLSW

SEQ ID NO: 556328 - protein, 9 aa, Homo Sapiens
KPTIPPEKP

SEQ ID NO: 556329 - protein, 9 aa, Homo Sapiens
SPSPSLPSS

SEQ ID NO: 556330 - protein, 9 aa, Homo Sapiens
DPVAAETAD

SEQ ID NO: 556331 - protein, 9 aa, Homo Sapiens
KVSDSEFPV

SEQ ID NO: 556332 - protein, 9 aa, Homo Sapiens
ETADQGPTP

SEQ ID NO: 556333 - protein, 9 aa, Homo Sapiens
HEHAPYRGH

SEQ ID NO: 556334 - protein, 9 aa, Homo Sapiens
ETVLNYAMG

SEQ ID NO: 556335 - protein, 9 aa, Homo Sapiens
AIDVLQMKE

SEQ ID NO: 556336 - protein, 9 aa, Homo Sapiens
CPPAHTCPR

SEQ ID NO: 556337 - protein, 9 aa, Homo Sapiens
SQNSCPPSE

SEQ ID NO: 556338 - protein, 9 aa, Homo Sapiens
TLADYGPAA

SEQ ID NO: 556339 - protein, 9 aa, Homo Sapiens
ECGKSFIDG

SEQ ID NO: 556340 - protein, 9 aa, Homo Sapiens
ADSPSYSNG

SEQ ID NO: 556341 - protein, 9 aa, Homo Sapiens
GEPELRGRS

SEQ ID NO: 556342 - protein, 9 aa, Homo Sapiens
RVGKAEDRE

SEQ ID NO: 556343 - protein, 9 aa, Homo Sapiens
GPGISSPCP

SEQ ID NO: 556344 - protein, 9 aa, Homo Sapiens
LQTAVSPPP

SEQ ID NO: 556345 - protein, 9 aa, Homo Sapiens
DRPVQTEKE

SEQ ID NO: 556346 - protein, 9 aa, Homo Sapiens
SSQLQFAGL

SEQ ID NO: 556347 - protein, 9 aa, Homo Sapiens
QSRAMNFDL

SEQ ID NO: 556348 - protein, 9 aa, Homo Sapiens
ETCDIENLL

SEQ ID NO: 556349 - protein, 9 aa, Homo Sapiens
LSLPESLKA

SEQ ID NO: 556350 - protein, 9 aa, Homo Sapiens
EKGEPELRG

SEQ ID NO: 556351 - protein, 9 aa, Homo Sapiens
LFESPSSGP

SEQ ID NO: 556352 - protein, 9 aa, Homo Sapiens
CRQILLSLP

SEQ ID NO: 556353 - protein, 9 aa, Homo Sapiens
IPPAESALQ

SEQ ID NO: 556354 - protein, 9 aa, Homo Sapiens
LVGSKVGDR

SEQ ID NO: 556355 - protein, 9 aa, Homo Sapiens
KSYCINSAA

SEQ ID NO: 556356 - protein, 9 aa, Homo Sapiens
RASFITPFP

SEQ ID NO: 556357 - protein, 9 aa, Homo Sapiens
VQTEKERKS

SEQ ID NO: 556358 - protein, 9 aa, Homo Sapiens
PHNPGHVIQ

SEQ ID NO: 556359 - protein, 9 aa, Homo Sapiens
GSKVGDRTL

SEQ ID NO: 556360 - protein, 9 aa, Homo Sapiens
MAPGAPTLA

SEQ ID NO: 556361 - protein, 9 aa, Homo Sapiens
RAPHNPGHV

SEQ ID NO: 556362 - protein, 9 aa, Homo Sapiens
HIQKQSICH

SEQ ID NO: 556363 - protein, 9 aa, Homo Sapiens
APGPVIQPA

SEQ ID NO: 556364 - protein, 9 aa, Homo Sapiens
SPSYSNGVA

SEQ ID NO: 556365 - protein, 9 aa, Homo Sapiens
IQPAPCPGQ

SEQ ID NO: 556366 - protein, 9 aa, Homo Sapiens
SCLSLTSSW

SEQ ID NO: 556367 - protein, 9 aa, Homo Sapiens
FDGDAPLQS

SEQ ID NO: 556368 - protein, 9 aa, Homo Sapiens
VCISFVDSV

SEQ ID NO: 556369 - protein, 9 aa, Homo Sapiens
CQNLSQNSC

SEQ ID NO: 556370 - protein, 9 aa, Homo Sapiens
FDLIPPAES

SEQ ID NO: 556371 - protein, 9 aa, Homo Sapiens
FVLRHLPDY

SEQ ID NO: 556372 - protein, 9 aa, Homo Sapiens
CEVKDIIPI

SEQ ID NO: 556373 - protein, 9 aa, Homo Sapiens
LGLSACFLL

SEQ ID NO: 556374 - protein, 9 aa, Homo Sapiens
GTKTEEEDD

SEQ ID NO: 556375 - protein, 9 aa, Homo Sapiens
DLLLAYAKL

SEQ ID NO: 556376 - protein, 9 aa, Homo Sapiens
TELTKLLLM

SEQ ID NO: 556377 - protein, 9 aa, Homo Sapiens
AKLMLLTLS

SEQ ID NO: 556378 - protein, 9 aa, Homo Sapiens
LFACSQDVK

SEQ ID NO: 556379 - protein, 9 aa, Homo Sapiens
SAPGPVIQP

SEQ ID NO: 556380 - protein, 9 aa, Homo Sapiens
FCPKEGCPT

SEQ ID NO: 556381 - protein, 9 aa, Homo Sapiens
TVCKERIRP

SEQ ID NO: 556382 - protein, 9 aa, Homo Sapiens
EREQQLRRE

SEQ ID NO: 556383 - protein, 9 aa, Homo Sapiens
RGHRFITEK

SEQ ID NO: 556384 - protein, 9 aa, Homo Sapiens
PGGPGISSP

SEQ ID NO: 556385 - protein, 9 aa, Homo Sapiens
YAMGINQRT

SEQ ID NO: 556386 - protein, 9 aa, Homo Sapiens
SKESSSVPM

SEQ ID NO: 556387 - protein, 9 aa, Homo Sapiens
RNPKCPSVC

SEQ ID NO: 556388 - protein, 9 aa, Homo Sapiens
PSLPSSVLP

SEQ ID NO: 556389 - protein, 9 aa, Homo Sapiens
ATDFISKIK

SEQ ID NO: 556390 - protein, 9 aa, Homo Sapiens
EFVLRHLPD

SEQ ID NO: 556391 - protein, 9 aa, Homo Sapiens
NLSQNSCPP

SEQ ID NO: 556392 - protein, 9 aa, Homo Sapiens
AMNFDLPFK

SEQ ID NO: 556393 - protein, 9 aa, Homo Sapiens
FFLFACSQD

SEQ ID NO: 556394 - protein, 9 aa, Homo Sapiens
VCKERIRPL

SEQ ID NO: 556395 - protein, 9 aa, Homo Sapiens
GLRLVGSKV

SEQ ID NO: 556396 - protein, 9 aa, Homo Sapiens
PLAVGLLLL

SEQ ID NO: 556397 - protein, 9 aa, Homo Sapiens
GRLASMAPG

SEQ ID NO: 556398 - protein, 9 aa, Homo Sapiens
APGCSLRTI

SEQ ID NO: 556399 - protein, 9 aa, Homo Sapiens
CSQDVKTCN

SEQ ID NO: 556400 - protein, 9 aa, Homo Sapiens
PQNFIDETC

SEQ ID NO: 556401 - protein, 9 aa, Homo Sapiens
NVCISFVDS

SEQ ID NO: 556402 - protein, 9 aa, Homo Sapiens
EALLQTAVS

SEQ ID NO: 556403 - protein, 9 aa, Homo Sapiens
LRTISPALW

SEQ ID NO: 556404 - protein, 9 aa, Homo Sapiens
KRLIRTIAA

SEQ ID NO: 556405 - protein, 9 aa, Homo Sapiens
IQSKYSLSK

SEQ ID NO: 556406 - protein, 9 aa, Homo Sapiens
LIPPAESAL

SEQ ID NO: 556407 - protein, 9 aa, Homo Sapiens
FLCEVKDII

SEQ ID NO: 556408 - protein, 9 aa, Homo Sapiens
SAIQKQLVK

SEQ ID NO: 556409 - protein, 9 aa, Homo Sapiens
RAFLCEVKD

SEQ ID NO: 556410 - protein, 9 aa, Homo Sapiens
SLSKRLIRT

SEQ ID NO: 556411 - protein, 9 aa, Homo Sapiens
PVLPAATEL

SEQ ID NO: 556412 - protein, 9 aa, Homo Sapiens
TEKPTIPPE

SEQ ID NO: 556413 - protein, 9 aa, Homo Sapiens
LLLAYAKLM

SEQ ID NO: 556414 - protein, 9 aa, Homo Sapiens
PKEGCPTMG

SEQ ID NO: 556415 - protein, 9 aa, Homo Sapiens
APGAPTLAP

SEQ ID NO: 556416 - protein, 9 aa, Homo Sapiens
DGPRPTGKS

SEQ ID NO: 556417 - protein, 9 aa, Homo Sapiens
DRTVCKERI

SEQ ID NO: 556418 - protein, 9 aa, Homo Sapiens
PLPGGPGIS

SEQ ID NO: 556419 - protein, 9 aa, Homo Sapiens
KLESSQLQF

SEQ ID NO: 556420 - protein, 9 aa, Homo Sapiens
MSGAIDVLQ

SEQ ID NO: 556421 - protein, 9 aa, Homo Sapiens
IFCNATDFI

SEQ ID NO: 556422 - protein, 9 aa, Homo Sapiens
RLVGLSWRS

SEQ ID NO: 556423 - protein, 9 aa, Homo Sapiens
PVIQPAPCP

SEQ ID NO: 556424 - protein, 9 aa, Homo Sapiens
DATTYPPGF

SEQ ID NO: 556425 - protein, 9 aa, Homo Sapiens
VMSALCFVF

SEQ ID NO: 556426 - protein, 9 aa, Homo Sapiens
EAAKKHEVE

SEQ ID NO: 556427 - protein, 9 aa, Homo Sapiens
GINQRTVLI

SEQ ID NO: 556428 - protein, 9 aa, Homo Sapiens
KEGLPIGPQ

SEQ ID NO: 556429 - protein, 9 aa, Homo Sapiens
LLPSGRLAS

SEQ ID NO: 556430 - protein, 9 aa, Homo Sapiens
GPVIQPAPC

SEQ ID NO: 556431 - protein, 9 aa, Homo Sapiens
GNYETNTNS

SEQ ID NO: 556432 - protein, 9 aa, Homo Sapiens
QLQFAGLEH

SEQ ID NO: 556433 - protein, 9 aa, Homo Sapiens
DSENSRFYY

SEQ ID NO: 556434 - protein, 9 aa, Homo Sapiens
LVMSALCFV

SEQ ID NO: 556435 - protein, 9 aa, Homo Sapiens
LYAMIGAAA

SEQ ID NO: 556436 - protein, 9 aa, Homo Sapiens
DADSENSRF

SEQ ID NO: 556437 - protein, 9 aa, Homo Sapiens
LTKLLLMRL

SEQ ID NO: 556438 - protein, 9 aa, Homo Sapiens
GCRQILLSL

SEQ ID NO: 556439 - protein, 9 aa, Homo Sapiens
NFIDETCDI

SEQ ID NO: 556440 - protein, 9 aa, Homo Sapiens
RLLPSGRLA

SEQ ID NO: 556441 - protein, 9 aa, Homo Sapiens
SSPCPTVQL

SEQ ID NO: 556442 - protein, 9 aa, Homo Sapiens
GKSYCINSA

SEQ ID NO: 556443 - protein, 9 aa, Homo Sapiens
LNSVFPRCS

SEQ ID NO: 556444 - protein, 9 aa, Homo Sapiens
GSPKAKGPQ

SEQ ID NO: 556445 - protein, 9 aa, Homo Sapiens
PDGAESPSA

SEQ ID NO: 556446 - protein, 9 aa, Homo Sapiens
SRAMNFDLP

SEQ ID NO: 556447 - protein, 9 aa, Homo Sapiens
SQDVKTCNE

SEQ ID NO: 556448 - protein, 9 aa, Homo Sapiens
KANCKVRFV

SEQ ID NO: 556449 - protein, 9 aa, Homo Sapiens
LRREQEERE

SEQ ID NO: 556450 - protein, 9 aa, Homo Sapiens
LPFKKGSGI

SEQ ID NO: 556451 - protein, 9 aa, Homo Sapiens
ETNTNSSVD

SEQ ID NO: 556452 - protein, 9 aa, Homo Sapiens
GRTLGCRNP

SEQ ID NO: 556453 - protein, 9 aa, Homo Sapiens
CSLRTISPA

SEQ ID NO: 556454 - protein, 9 aa, Homo Sapiens
SDVPSGTKT

SEQ ID NO: 556455 - protein, 9 aa, Homo Sapiens
VEKKELERK

SEQ ID NO: 556456 - protein, 9 aa, Homo Sapiens
KVYVKLLNP

SEQ ID NO: 556457 - protein, 9 aa, Homo Sapiens
EASCLQLAL

SEQ ID NO: 556458 - protein, 9 aa, Homo Sapiens
AATQDFAVD

SEQ ID NO: 556459 - protein, 9 aa, Homo Sapiens
SYATHGTSN

SEQ ID NO: 556460 - protein, 9 aa, Homo Sapiens
SWCRSTAAA

SEQ ID NO: 556461 - protein, 9 aa, Homo Sapiens
TVLSNEIAT

SEQ ID NO: 556462 - protein, 9 aa, Homo Sapiens
VVVFTHGYY

SEQ ID NO: 556463 - protein, 9 aa, Homo Sapiens
PARYSWTIN

SEQ ID NO: 556464 - protein, 9 aa, Homo Sapiens
DKLQEHLPE

SEQ ID NO: 556465 - protein, 9 aa, Homo Sapiens
HFSELPQFD

SEQ ID NO: 556466 - protein, 9 aa, Homo Sapiens
MSTTCPGSP

SEQ ID NO: 556467 - protein, 9 aa, Homo Sapiens
CLEHLEMGF

SEQ ID NO: 556468 - protein, 9 aa, Homo Sapiens
APSLGMSPS

SEQ ID NO: 556469 - protein, 9 aa, Homo Sapiens
ELPQFDTIL

SEQ ID NO: 556470 - protein, 9 aa, Homo Sapiens
YVVQGPEMT

SEQ ID NO: 556471 - protein, 9 aa, Homo Sapiens
LFLYCVPSK

SEQ ID NO: 556472 - protein, 9 aa, Homo Sapiens
LCGPSSSQL

SEQ ID NO: 556473 - protein, 9 aa, Homo Sapiens
ATPLPVTYT

SEQ ID NO: 556474 - protein, 9 aa, Homo Sapiens
MEASCLQLA

SEQ ID NO: 556475 - protein, 9 aa, Homo Sapiens
TAAASISPS

SEQ ID NO: 556476 - protein, 9 aa, Homo Sapiens
PLQKVLLNS

SEQ ID NO: 556477 - protein, 9 aa, Homo Sapiens
FQQSCNLPC

SEQ ID NO: 556478 - protein, 9 aa, Homo Sapiens
TCYPPTSCW

SEQ ID NO: 556479 - protein, 9 aa, Homo Sapiens
KKQAALDEE

SEQ ID NO: 556480 - protein, 9 aa, Homo Sapiens
CREMIPALR

SEQ ID NO: 556481 - protein, 9 aa, Homo Sapiens
PGKAASLTE

SEQ ID NO: 556482 - protein, 9 aa, Homo Sapiens
VPSKNSRHT

SEQ ID NO: 556483 - protein, 9 aa, Homo Sapiens
RSQENQSPK

SEQ ID NO: 556484 - protein, 9 aa, Homo Sapiens
SKSSALANH

SEQ ID NO: 556485 - protein, 9 aa, Homo Sapiens
VLLNSDEDG

SEQ ID NO: 556486 - protein, 9 aa, Homo Sapiens
RGREDCKGA

SEQ ID NO: 556487 - protein, 9 aa, Homo Sapiens
FVKTLAGKT

SEQ ID NO: 556488 - protein, 9 aa, Homo Sapiens
YRRPHSITS

SEQ ID NO: 556489 - protein, 9 aa, Homo Sapiens
ALLVVMSIL

SEQ ID NO: 556490 - protein, 9 aa, Homo Sapiens
SPSSSSLTS

SEQ ID NO: 556491 - protein, 9 aa, Homo Sapiens
ASFLSDYNM

SEQ ID NO: 556492 - protein, 9 aa, Homo Sapiens
ASCLQLALE

SEQ ID NO: 556493 - protein, 9 aa, Homo Sapiens
WMSTTCPGS

SEQ ID NO: 556494 - protein, 9 aa, Homo Sapiens
KKAAGAGKD

SEQ ID NO: 556495 - protein, 9 aa, Homo Sapiens
FNPYYVLFE

SEQ ID NO: 556496 - protein, 9 aa, Homo Sapiens
RRPHSITSQ

SEQ ID NO: 556497 - protein, 9 aa, Homo Sapiens
SNCPGAAAV

SEQ ID NO: 556498 - protein, 9 aa, Homo Sapiens
SPSHCVWSW

SEQ ID NO: 556499 - protein, 9 aa, Homo Sapiens
HNLMIFQMK

SEQ ID NO: 556500 - protein, 9 aa, Homo Sapiens
CVPSKNSRH

SEQ ID NO: 556501 - protein, 9 aa, Homo Sapiens
ATGINLENI

SEQ ID NO: 556502 - protein, 9 aa, Homo Sapiens
TRSGSSRGT

SEQ ID NO: 556503 - protein, 9 aa, Homo Sapiens
KMLCGPSSS

SEQ ID NO: 556504 - protein, 9 aa, Homo Sapiens
PVVPKVEKE

SEQ ID NO: 556505 - protein, 9 aa, Homo Sapiens
QPLWVHRLR

SEQ ID NO: 556506 - protein, 9 aa, Homo Sapiens
AAGAGKDTK

SEQ ID NO: 556507 - protein, 9 aa, Homo Sapiens
AAICYFFAF

SEQ ID NO: 556508 - protein, 9 aa, Homo Sapiens
ENCLEHLEM

SEQ ID NO: 556509 - protein, 9 aa, Homo Sapiens
MKLMNLDVE

SEQ ID NO: 556510 - protein, 9 aa, Homo Sapiens
LTVHQRIRT

SEQ ID NO: 556511 - protein, 9 aa, Homo Sapiens
SPSPWCAST

SEQ ID NO: 556512 - protein, 9 aa, Homo Sapiens
PSLVAEDTD

SEQ ID NO: 556513 - protein, 9 aa, Homo Sapiens
ATQDFAVDG

SEQ ID NO: 556514 - protein, 9 aa, Homo Sapiens
PPGNCSARV

SEQ ID NO: 556515 - protein, 9 aa, Homo Sapiens
PWYESSPKP

SEQ ID NO: 556516 - protein, 9 aa, Homo Sapiens
LSENTQQAA

SEQ ID NO: 556517 - protein, 9 aa, Homo Sapiens
SYNRYHNNC

SEQ ID NO: 556518 - protein, 9 aa, Homo Sapiens
YATHGTSNW

SEQ ID NO: 556519 - protein, 9 aa, Homo Sapiens
PSKNSRHTV

SEQ ID NO: 556520 - protein, 9 aa, Homo Sapiens
VPKVEKELV

SEQ ID NO: 556521 - protein, 9 aa, Homo Sapiens
ALPEVDVSP

SEQ ID NO: 556522 - protein, 9 aa, Homo Sapiens
QTSNCPGAA

SEQ ID NO: 556523 - protein, 9 aa, Homo Sapiens
SFSKSSALA

SEQ ID NO: 556524 - protein, 9 aa, Homo Sapiens
PCSARCPVT

SEQ ID NO: 556525 - protein, 9 aa, Homo Sapiens
IRTGERPYE

SEQ ID NO: 556526 - protein, 9 aa, Homo Sapiens
ERTPTHRGW

SEQ ID NO: 556527 - protein, 9 aa, Homo Sapiens
LLPPGNCSA

SEQ ID NO: 556528 - protein, 9 aa, Homo Sapiens
LEHLEMGFP

SEQ ID NO: 556529 - protein, 9 aa, Homo Sapiens
PQFDTILFK

SEQ ID NO: 556530 - protein, 9 aa, Homo Sapiens
GSSRGTSWC

SEQ ID NO: 556531 - protein, 9 aa, Homo Sapiens
SQLSTPAAT

SEQ ID NO: 556532 - protein, 9 aa, Homo Sapiens
TVHQRIRTG

SEQ ID NO: 556533 - protein, 9 aa, Homo Sapiens
PSPWCASTC

SEQ ID NO: 556534 - protein, 9 aa, Homo Sapiens
PVSCEEIDY

SEQ ID NO: 556535 - protein, 9 aa, Homo Sapiens
ELDQVTYSL

SEQ ID NO: 556536 - protein, 9 aa, Homo Sapiens
REGLSNKVY

SEQ ID NO: 556537 - protein, 9 aa, Homo Sapiens
QDFAVDGWA

SEQ ID NO: 556538 - protein, 9 aa, Homo Sapiens
GRESYATHG

SEQ ID NO: 556539 - protein, 9 aa, Homo Sapiens
LQAQQYMQK

SEQ ID NO: 556540 - protein, 9 aa, Homo Sapiens
ARSQENQSP

SEQ ID NO: 556541 - protein, 9 aa, Homo Sapiens
NTQQAANVL

SEQ ID NO: 556542 - protein, 9 aa, Homo Sapiens
GSYNRYHNN

SEQ ID NO: 556543 - protein, 9 aa, Homo Sapiens
VKTLAGKTI

SEQ ID NO: 556544 - protein, 9 aa, Homo Sapiens
CNSPSLGAP

SEQ ID NO: 556545 - protein, 9 aa, Homo Sapiens
LFALLVVMS

SEQ ID NO: 556546 - protein, 9 aa, Homo Sapiens
SPSGSPSPW

SEQ ID NO: 556547 - protein, 9 aa, Homo Sapiens
SYNFTSSIP

SEQ ID NO: 556548 - protein, 9 aa, Homo Sapiens
CLLAAICYF

SEQ ID NO: 556549 - protein, 9 aa, Homo Sapiens
LYCVPSKNS

SEQ ID NO: 556550 - protein, 9 aa, Homo Sapiens
TWMVPRMTL

SEQ ID NO: 556551 - protein, 9 aa, Homo Sapiens
NQSPKDLFV

SEQ ID NO: 556552 - protein, 9 aa, Homo Sapiens
PVTYTSSVS

SEQ ID NO: 556553 - protein, 9 aa, Homo Sapiens
CRITSNFVT

SEQ ID NO: 556554 - protein, 9 aa, Homo Sapiens
YVLFEYSAN

SEQ ID NO: 556555 - protein, 9 aa, Homo Sapiens
YFSCGRESY

SEQ ID NO: 556556 - protein, 9 aa, Homo Sapiens
SPWCASTCY

SEQ ID NO: 556557 - protein, 9 aa, Homo Sapiens
KAAGAGKDT

SEQ ID NO: 556558 - protein, 9 aa, Homo Sapiens
EDGHCTGSA

SEQ ID NO: 556559 - protein, 9 aa, Homo Sapiens
YVKLLNPNY

SEQ ID NO: 556560 - protein, 9 aa, Homo Sapiens
VPRMTLPTA

SEQ ID NO: 556561 - protein, 9 aa, Homo Sapiens
YTSSVSTAH

SEQ ID NO: 556562 - protein, 9 aa, Homo Sapiens
DLDKLQEHL

SEQ ID NO: 556563 - protein, 9 aa, Homo Sapiens
RTPTHRGWS

SEQ ID NO: 556564 - protein, 9 aa, Homo Sapiens
HRGWSRRLF

SEQ ID NO: 556565 - protein, 9 aa, Homo Sapiens
SWNVVISDS

SEQ ID NO: 556566 - protein, 9 aa, Homo Sapiens
VSCEEIDYP

SEQ ID NO: 556567 - protein, 9 aa, Homo Sapiens
DEDGHCTGS

SEQ ID NO: 556568 - protein, 9 aa, Homo Sapiens
LATRWAPSR

SEQ ID NO: 556569 - protein, 9 aa, Homo Sapiens
DGHCTGSAY

SEQ ID NO: 556570 - protein, 9 aa, Homo Sapiens
RMEASCLQL

SEQ ID NO: 556571 - protein, 9 aa, Homo Sapiens
PHPVVPKVE

SEQ ID NO: 556572 - protein, 9 aa, Homo Sapiens
TERLAADTV

SEQ ID NO: 556573 - protein, 9 aa, Homo Sapiens
AIAVLLFAL

SEQ ID NO: 556574 - protein, 9 aa, Homo Sapiens
PRMTLPTAP

SEQ ID NO: 556575 - protein, 9 aa, Homo Sapiens
SPSPSSSSL

SEQ ID NO: 556576 - protein, 9 aa, Homo Sapiens
LPCSARCPV

SEQ ID NO: 556577 - protein, 9 aa, Homo Sapiens
NFRELSENT

SEQ ID NO: 556578 - protein, 9 aa, Homo Sapiens
PNDNEFGKY

SEQ ID NO: 556579 - protein, 9 aa, Homo Sapiens
LSTPAATVA

SEQ ID NO: 556580 - protein, 9 aa, Homo Sapiens
TAPSLGMSP

SEQ ID NO: 556581 - protein, 9 aa, Homo Sapiens
VLFLLGTIF

SEQ ID NO: 556582 - protein, 9 aa, Homo Sapiens
RMTLPTAPS

SEQ ID NO: 556583 - protein, 9 aa, Homo Sapiens
CPVSCEEID

SEQ ID NO: 556584 - protein, 9 aa, Homo Sapiens
VHQRIRTGE

SEQ ID NO: 556585 - protein, 9 aa, Homo Sapiens
WSWMSTTCP

SEQ ID NO: 556586 - protein, 9 aa, Homo Sapiens
NLMIFQMKF

SEQ ID NO: 556587 - protein, 9 aa, Homo Sapiens
YNMFINLPR

SEQ ID NO: 556588 - protein, 9 aa, Homo Sapiens
RSTAAASIS

SEQ ID NO: 556589 - protein, 9 aa, Homo Sapiens
ASISPSPSS

SEQ ID NO: 556590 - protein, 9 aa, Homo Sapiens
PPARYSWTI

SEQ ID NO: 556591 - protein, 9 aa, Homo Sapiens
AVLLFALLV

SEQ ID NO: 556592 - protein, 9 aa, Homo Sapiens
NSNPPARYS

SEQ ID NO: 556593 - protein, 9 aa, Homo Sapiens
SGSSRGTSW

SEQ ID NO: 556594 - protein, 9 aa, Homo Sapiens
SNPPARYSW

SEQ ID NO: 556595 - protein, 9 aa, Homo Sapiens
PSHCVWSWM

SEQ ID NO: 556596 - protein, 9 aa, Homo Sapiens
SALANHQRT

SEQ ID NO: 556597 - protein, 9 aa, Homo Sapiens
STAAASISP

SEQ ID NO: 556598 - protein, 9 aa, Homo Sapiens
IYEPYLPCS

SEQ ID NO: 556599 - protein, 9 aa, Homo Sapiens
PVTWMVPRM

SEQ ID NO: 556600 - protein, 9 aa, Homo Sapiens
ALRTFLKRH

SEQ ID NO: 556601 - protein, 9 aa, Homo Sapiens
DQASFLSDY

SEQ ID NO: 556602 - protein, 9 aa, Homo Sapiens
DCKGAAEAA

SEQ ID NO: 556603 - protein, 9 aa, Homo Sapiens
RESYATHGT

SEQ ID NO: 556604 - protein, 9 aa, Homo Sapiens
PWCASTCYP

SEQ ID NO: 556605 - protein, 9 aa, Homo Sapiens
PTAPSLGMS

SEQ ID NO: 556606 - protein, 9 aa, Homo Sapiens
SELPQFDTI

SEQ ID NO: 556607 - protein, 9 aa, Homo Sapiens
GTIFLLCPY

SEQ ID NO: 556608 - protein, 9 aa, Homo Sapiens
QLSTPAATV

SEQ ID NO: 556609 - protein, 9 aa, Homo Sapiens
LFNPYYVLF

SEQ ID NO: 556610 - protein, 9 aa, Homo Sapiens
SCLQLALEG

SEQ ID NO: 556611 - protein, 9 aa, Homo Sapiens
SDEDGHCTG

SEQ ID NO: 556612 - protein, 9 aa, Homo Sapiens
VWSWMSTTC

SEQ ID NO: 556613 - protein, 9 aa, Homo Sapiens
VDVSPPAPG

SEQ ID NO: 556614 - protein, 9 aa, Homo Sapiens
RTMTRSGSS

SEQ ID NO: 556615 - protein, 9 aa, Homo Sapiens
AYPRQGERT

SEQ ID NO: 556616 - protein, 9 aa, Homo Sapiens
FGQGFHCNS

SEQ ID NO: 556617 - protein, 9 aa, Homo Sapiens
KCREMIPAL

SEQ ID NO: 556618 - protein, 9 aa, Homo Sapiens
CEEIDYPAT

SEQ ID NO: 556619 - protein, 9 aa, Homo Sapiens
GSPSGSPSP

SEQ ID NO: 556620 - protein, 9 aa, Homo Sapiens
QFDTILFKD

SEQ ID NO: 556621 - protein, 9 aa, Homo Sapiens
SDYNMFINL

SEQ ID NO: 556622 - protein, 9 aa, Homo Sapiens
RPHSITSQT

SEQ ID NO: 556623 - protein, 9 aa, Homo Sapiens
LGTIFLLCP

SEQ ID NO: 556624 - protein, 9 aa, Homo Sapiens
CVWSWMSTT

SEQ ID NO: 556625 - protein, 9 aa, Homo Sapiens
EATGINLEN

SEQ ID NO: 556626 - protein, 9 aa, Homo Sapiens
EMIPALRTF

SEQ ID NO: 556627 - protein, 9 aa, Homo Sapiens
LRTFLKRHD

SEQ ID NO: 556628 - protein, 9 aa, Homo Sapiens
CWSPCLATR

SEQ ID NO: 556629 - protein, 9 aa, Homo Sapiens
AYPHNLMIF

SEQ ID NO: 556630 - protein, 9 aa, Homo Sapiens
CIHAALIFV

SEQ ID NO: 556631 - protein, 9 aa, Homo Sapiens
YMQKQLLSK

SEQ ID NO: 556632 - protein, 9 aa, Homo Sapiens
VYVKLLNPN

SEQ ID NO: 556633 - protein, 9 aa, Homo Sapiens
SLTERLAAD

SEQ ID NO: 556634 - protein, 9 aa, Homo Sapiens
CYFFAFKSR

SEQ ID NO: 556635 - protein, 9 aa, Homo Sapiens
MVPRMTLPT

SEQ ID NO: 556636 - protein, 9 aa, Homo Sapiens
YNFTSSIPW

SEQ ID NO: 556637 - protein, 9 aa, Homo Sapiens
LWVHRLRAF

SEQ ID NO: 556638 - protein, 9 aa, Homo Sapiens
TKRSLLHKK

SEQ ID NO: 556639 - protein, 9 aa, Homo Sapiens
SRMEASCLQ

SEQ ID NO: 556640 - protein, 9 aa, Homo Sapiens
FDTILFKDN

SEQ ID NO: 556641 - protein, 9 aa, Homo Sapiens
QSCNLPCRQ

SEQ ID NO: 556642 - protein, 9 aa, Homo Sapiens
LLNELDQVT

SEQ ID NO: 556643 - protein, 9 aa, Homo Sapiens
EVDVSPPAP

SEQ ID NO: 556644 - protein, 9 aa, Homo Sapiens
CPVTWMVPR

SEQ ID NO: 556645 - protein, 9 aa, Homo Sapiens
QGERTPTHR

SEQ ID NO: 556646 - protein, 9 aa, Homo Sapiens
VLFEYSAND

SEQ ID NO: 556647 - protein, 9 aa, Homo Sapiens
LLLAVVVFT

SEQ ID NO: 556648 - protein, 9 aa, Homo Sapiens
SAYPRQGER

SEQ ID NO: 556649 - protein, 9 aa, Homo Sapiens
ILQLQAQQY

SEQ ID NO: 556650 - protein, 9 aa, Homo Sapiens
ELFNPYYVL

SEQ ID NO: 556651 - protein, 9 aa, Homo Sapiens
NFTSSIPWY

SEQ ID NO: 556652 - protein, 9 aa, Homo Sapiens
LGSYNRYHN

SEQ ID NO: 556653 - protein, 9 aa, Homo Sapiens
EDTDTVPAE

SEQ ID NO: 556654 - protein, 9 aa, Homo Sapiens
SIPWYESSP

SEQ ID NO: 556655 - protein, 9 aa, Homo Sapiens
IPALRTFLK

SEQ ID NO: 556656 - protein, 9 aa, Homo Sapiens
DSQLSTPAA

SEQ ID NO: 556657 - protein, 9 aa, Homo Sapiens
PEVDVSPPA

SEQ ID NO: 556658 - protein, 9 aa, Homo Sapiens
NFVTPSEYW

SEQ ID NO: 556659 - protein, 9 aa, Homo Sapiens
LQEHLPELL

SEQ ID NO: 556660 - protein, 9 aa, Homo Sapiens
HKKKKEARR

SEQ ID NO: 556661 - protein, 9 aa, Homo Sapiens
LLAAICYFF

SEQ ID NO: 556662 - protein, 9 aa, Homo Sapiens
EPYLPCSAR

SEQ ID NO: 556663 - protein, 9 aa, Homo Sapiens
GLSNKVYVK

SEQ ID NO: 556664 - protein, 9 aa, Homo Sapiens
QENQSPKDL

SEQ ID NO: 556665 - protein, 9 aa, Homo Sapiens
LAATQDFAV

SEQ ID NO: 556666 - protein, 9 aa, Homo Sapiens
LPPGNCSAR

SEQ ID NO: 556667 - protein, 9 aa, Homo Sapiens
MTLPTAPSL

SEQ ID NO: 556668 - protein, 9 aa, Homo Sapiens
HRLRAFLPL

SEQ ID NO: 556669 - protein, 9 aa, Homo Sapiens
TCLLAAICY

SEQ ID NO: 556670 - protein, 9 aa, Homo Sapiens
IHAALIFVM

SEQ ID NO: 556671 - protein, 9 aa, Homo Sapiens
FLSDYNMFI

SEQ ID NO: 556672 - protein, 9 aa, Homo Sapiens
AICYFFAFK

SEQ ID NO: 556673 - protein, 9 aa, Homo Sapiens
IGPNDNEFG

SEQ ID NO: 556674 - protein, 9 aa, Homo Sapiens
SLGMSPSHC

SEQ ID NO: 556675 - protein, 9 aa, Homo Sapiens
PHNLMIFQM

SEQ ID NO: 556676 - protein, 9 aa, Homo Sapiens
NLENIVYYK

SEQ ID NO: 556677 - protein, 9 aa, Homo Sapiens
TIENMKAKI

SEQ ID NO: 556678 - protein, 9 aa, Homo Sapiens
AFLPLQKVL

SEQ ID NO: 556679 - protein, 9 aa, Homo Sapiens
GPSSSQLVL

SEQ ID NO: 556680 - protein, 9 aa, Homo Sapiens
QLALEGERL

SEQ ID NO: 556681 - protein, 9 aa, Homo Sapiens
ELSENTQQA

SEQ ID NO: 556682 - protein, 9 aa, Homo Sapiens
CSARCPVTW

SEQ ID NO: 556683 - protein, 9 aa, Homo Sapiens
VTPSEYWVE

SEQ ID NO: 556684 - protein, 9 aa, Homo Sapiens
STCWSPCLA

SEQ ID NO: 556685 - protein, 9 aa, Homo Sapiens
LALLPPGNC

SEQ ID NO: 556686 - protein, 9 aa, Homo Sapiens
LNELDQVTY

SEQ ID NO: 556687 - protein, 9 aa, Homo Sapiens
FQPLWVHRL

SEQ ID NO: 556688 - protein, 9 aa, Homo Sapiens
TQDFAVDGW

SEQ ID NO: 556689 - protein, 9 aa, Homo Sapiens
PSSSSLTST

SEQ ID NO: 556690 - protein, 9 aa, Homo Sapiens
LPVTYTSSV

SEQ ID NO: 556691 - protein, 9 aa, Homo Sapiens
VSPPAPGAG

SEQ ID NO: 556692 - protein, 9 aa, Homo Sapiens
KDTKSAQKA

SEQ ID NO: 556693 - protein, 9 aa, Homo Sapiens
VVQGPEMTP

SEQ ID NO: 556694 - protein, 9 aa, Homo Sapiens
QAQQYMQKQ

SEQ ID NO: 556695 - protein, 9 aa, Homo Sapiens
LPYRRPHSI

SEQ ID NO: 556696 - protein, 9 aa, Homo Sapiens
QEHLPELLE

SEQ ID NO: 556697 - protein, 9 aa, Homo Sapiens
DNEFGKYSF

SEQ ID NO: 556698 - protein, 9 aa, Homo Sapiens
SSRGTSWCR

SEQ ID NO: 556699 - protein, 9 aa, Homo Sapiens
PQTSNCPGA

SEQ ID NO: 556700 - protein, 9 aa, Homo Sapiens
NLDVEQLGI

SEQ ID NO: 556701 - protein, 9 aa, Homo Sapiens
SRGTSWCRS

SEQ ID NO: 556702 - protein, 9 aa, Homo Sapiens
HYVVQGPEM

SEQ ID NO: 556703 - protein, 9 aa, Homo Sapiens
LIGPNDNEF

SEQ ID NO: 556704 - protein, 9 aa, Homo Sapiens
DHFSELPQF

SEQ ID NO: 556705 - protein, 9 aa, Homo Sapiens
VAEDTDTVP

SEQ ID NO: 556706 - protein, 9 aa, Homo Sapiens
DFAVDGWAL

SEQ ID NO: 556707 - protein, 9 aa, Homo Sapiens
LLVVMSILA

SEQ ID NO: 556708 - protein, 9 aa, Homo Sapiens
QYMQKQLLS

SEQ ID NO: 556709 - protein, 9 aa, Homo Sapiens
QKVLLNSDE

SEQ ID NO: 556710 - protein, 9 aa, Homo Sapiens
QGFHCNSPS

SEQ ID NO: 556711 - protein, 9 aa, Homo Sapiens
MTRSGSSRG

SEQ ID NO: 556712 - protein, 9 aa, Homo Sapiens
KQAALDEEE

SEQ ID NO: 556713 - protein, 9 aa, Homo Sapiens
EIATLSTSC

SEQ ID NO: 556714 - protein, 9 aa, Homo Sapiens
ARVLERPLP

SEQ ID NO: 556715 - protein, 9 aa, Homo Sapiens
LSNEIATLS

SEQ ID NO: 556716 - protein, 9 aa, Homo Sapiens
ATRWAPSRR

SEQ ID NO: 556717 - protein, 9 aa, Homo Sapiens
RGWSRRLFL

SEQ ID NO: 556718 - protein, 9 aa, Homo Sapiens
CLATRWAPS

SEQ ID NO: 556719 - protein, 9 aa, Homo Sapiens
LQLALEGER

SEQ ID NO: 556720 - protein, 9 aa, Homo Sapiens
TCWSPCLAT

SEQ ID NO: 556721 - protein, 9 aa, Homo Sapiens
PCLATRWAP

SEQ ID NO: 556722 - protein, 9 aa, Homo Sapiens
ELREATGIN

SEQ ID NO: 556723 - protein, 9 aa, Homo Sapiens
ICYFFAFKS

SEQ ID NO: 556724 - protein, 9 aa, Homo Sapiens
NCSARVRAT

SEQ ID NO: 556725 - protein, 9 aa, Homo Sapiens
PSSSQLVLL

SEQ ID NO: 556726 - protein, 9 aa, Homo Sapiens
LAVVVFTHG

SEQ ID NO: 556727 - protein, 9 aa, Homo Sapiens
VVISDSQLS

SEQ ID NO: 556728 - protein, 9 aa, Homo Sapiens
EIDYPATIS

SEQ ID NO: 556729 - protein, 9 aa, Homo Sapiens
HLPELLEII

SEQ ID NO: 556730 - protein, 9 aa, Homo Sapiens
RAFLPLQKV

SEQ ID NO: 556731 - protein, 9 aa, Homo Sapiens
SLPYRRPHS

SEQ ID NO: 556732 - protein, 9 aa, Homo Sapiens
NPPARYSWT

SEQ ID NO: 556733 - protein, 9 aa, Homo Sapiens
LDQVTYSLG

SEQ ID NO: 556734 - protein, 9 aa, Homo Sapiens
ADLDKLQEH

SEQ ID NO: 556735 - protein, 9 aa, Homo Sapiens
LVAEDTDTV

SEQ ID NO: 556736 - protein, 9 aa, Homo Sapiens
IFQMKFFYI

SEQ ID NO: 556737 - protein, 9 aa, Homo Sapiens
QQSCNLPCR

SEQ ID NO: 556738 - protein, 9 aa, Homo Sapiens
PLPVTYTSS

SEQ ID NO: 556739 - protein, 9 aa, Homo Sapiens
EFLAATQDF

SEQ ID NO: 556740 - protein, 9 aa, Homo Sapiens
VTWMVPRMT

SEQ ID NO: 556741 - protein, 9 aa, Homo Sapiens
AKLRKKQAA

SEQ ID NO: 556742 - protein, 9 aa, Homo Sapiens
SWMSTTCPG

SEQ ID NO: 556743 - protein, 9 aa, Homo Sapiens
AALIFVMTM

SEQ ID NO: 556744 - protein, 9 aa, Homo Sapiens
DTKSAQKAQ

SEQ ID NO: 556745 - protein, 9 aa, Homo Sapiens
YLTVHQRIR

SEQ ID NO: 556746 - protein, 9 aa, Homo Sapiens
YFFAFKSRK

SEQ ID NO: 556747 - protein, 9 aa, Homo Sapiens
SSALANHQR

SEQ ID NO: 556748 - protein, 9 aa, Homo Sapiens
RYSWTINGK

SEQ ID NO: 556749 - protein, 9 aa, Homo Sapiens
CPGSPSGSP

SEQ ID NO: 556750 - protein, 9 aa, Homo Sapiens
QSPKDLFVP

SEQ ID NO: 556751 - protein, 9 aa, Homo Sapiens
TSWCRSTAA

SEQ ID NO: 556752 - protein, 9 aa, Homo Sapiens
NRYHNNCYR

SEQ ID NO: 556753 - protein, 9 aa, Homo Sapiens
AASISPSPS

SEQ ID NO: 556754 - protein, 9 aa, Homo Sapiens
IATLSTSCS

SEQ ID NO: 556755 - protein, 9 aa, Homo Sapiens
AKMLCGPSS

SEQ ID NO: 556756 - protein, 9 aa, Homo Sapiens
PGNCSARVR

SEQ ID NO: 556757 - protein, 9 aa, Homo Sapiens
ESYATHGTS

SEQ ID NO: 556758 - protein, 9 aa, Homo Sapiens
EGLSNKVYV

SEQ ID NO: 556759 - protein, 9 aa, Homo Sapiens
GMSPSHCVW

SEQ ID NO: 556760 - protein, 9 aa, Homo Sapiens
SCEEIDYPA

SEQ ID NO: 556761 - protein, 9 aa, Homo Sapiens
RRTMTRSGS

SEQ ID NO: 556762 - protein, 9 aa, Homo Sapiens
QATPLPVTY

SEQ ID NO: 556763 - protein, 9 aa, Homo Sapiens
SCGRESYAT

SEQ ID NO: 556764 - protein, 9 aa, Homo Sapiens
CRSTAAASI

SEQ ID NO: 556765 - protein, 9 aa, Homo Sapiens
TCPGSPSGS

SEQ ID NO: 556766 - protein, 9 aa, Homo Sapiens
TRWAPSRRT

SEQ ID NO: 556767 - protein, 9 aa, Homo Sapiens
HCVWSWMST

SEQ ID NO: 556768 - protein, 9 aa, Homo Sapiens
PTHRGWSRR

SEQ ID NO: 556769 - protein, 9 aa, Homo Sapiens
QELFNPYYV

SEQ ID NO: 556770 - protein, 9 aa, Homo Sapiens
QIFVKTLAG

SEQ ID NO: 556771 - protein, 9 aa, Homo Sapiens
CASTCYPPT

SEQ ID NO: 556772 - protein, 9 aa, Homo Sapiens
ARCPVTWMV

SEQ ID NO: 556773 - protein, 9 aa, Homo Sapiens
PPTSCWSTC

SEQ ID NO: 556774 - protein, 9 aa, Homo Sapiens
EEIDYPATI

SEQ ID NO: 556775 - protein, 9 aa, Homo Sapiens
GCIHAALIF

SEQ ID NO: 556776 - protein, 9 aa, Homo Sapiens
NVVISDSQL

SEQ ID NO: 556777 - protein, 9 aa, Homo Sapiens
NCLEHLEMG

SEQ ID NO: 556778 - protein, 9 aa, Homo Sapiens
ISDSQLSTP

SEQ ID NO: 556779 - protein, 9 aa, Homo Sapiens
NCPGAAAVQ

SEQ ID NO: 556780 - protein, 9 aa, Homo Sapiens
KRSLLHKKK

SEQ ID NO: 556781 - protein, 9 aa, Homo Sapiens
KSFSKSSAL

SEQ ID NO: 556782 - protein, 9 aa, Homo Sapiens
SRRTMTRSG

SEQ ID NO: 556783 - protein, 9 aa, Homo Sapiens
NSDEDGHCT

SEQ ID NO: 556784 - protein, 9 aa, Homo Sapiens
STTCPGSPS

SEQ ID NO: 556785 - protein, 9 aa, Homo Sapiens
KLMNLDVEQ

SEQ ID NO: 556786 - protein, 9 aa, Homo Sapiens
IDYPATISY

SEQ ID NO: 556787 - protein, 9 aa, Homo Sapiens
TTCPGSPSG

SEQ ID NO: 556788 - protein, 9 aa, Homo Sapiens
DVSPPAPGA

SEQ ID NO: 556789 - protein, 9 aa, Homo Sapiens
SVIYEPYLP

SEQ ID NO: 556790 - protein, 9 aa, Homo Sapiens
YEPYLPCSA

SEQ ID NO: 556791 - protein, 9 aa, Homo Sapiens
AASLTERLA

SEQ ID NO: 556792 - protein, 9 aa, Homo Sapiens
WPFQQSCNL

SEQ ID NO: 556793 - protein, 9 aa, Homo Sapiens
KVEKELVPD

SEQ ID NO: 556794 - protein, 9 aa, Homo Sapiens
DTIENMKAK

SEQ ID NO: 556795 - protein, 9 aa, Homo Sapiens
IFVKTLAGK

SEQ ID NO: 556796 - protein, 9 aa, Homo Sapiens
CRQSWNVVI

SEQ ID NO: 556797 - protein, 9 aa, Homo Sapiens
PGSPSGSPS

SEQ ID NO: 556798 - protein, 9 aa, Homo Sapiens
WAPSRRTMT

SEQ ID NO: 556799 - protein, 9 aa, Homo Sapiens
KQARSQENQ

SEQ ID NO: 556800 - protein, 9 aa, Homo Sapiens
LRKKQAALD

SEQ ID NO: 556801 - protein, 9 aa, Homo Sapiens
LLHKKKKEA

SEQ ID NO: 556802 - protein, 9 aa, Homo Sapiens
GINLENIVY

SEQ ID NO: 556803 - protein, 9 aa, Homo Sapiens
NLPCRQSWN

SEQ ID NO: 556804 - protein, 9 aa, Homo Sapiens
AEDTDTVPA

SEQ ID NO: 556805 - protein, 9 aa, Homo Sapiens
LLGTIFLLC

SEQ ID NO: 556806 - protein, 9 aa, Homo Sapiens
MLCGPSSSQ

SEQ ID NO: 556807 - protein, 9 aa, Homo Sapiens
NEIATLSTS

SEQ ID NO: 556808 - protein, 9 aa, Homo Sapiens
LMNLDVEQL

SEQ ID NO: 556809 - protein, 9 aa, Homo Sapiens
ALLPPGNCS

SEQ ID NO: 556810 - protein, 9 aa, Homo Sapiens
AVVVFTHGY

SEQ ID NO: 556811 - protein, 9 aa, Homo Sapiens
TSNCPGAAA

SEQ ID NO: 556812 - protein, 9 aa, Homo Sapiens
EHLPELLEI

SEQ ID NO: 556813 - protein, 9 aa, Homo Sapiens
TALGSYNRY

SEQ ID NO: 556814 - protein, 9 aa, Homo Sapiens
FVTPSEYWV

SEQ ID NO: 556815 - protein, 9 aa, Homo Sapiens
LGMSPSHCV

SEQ ID NO: 556816 - protein, 9 aa, Homo Sapiens
SPPAPGAGL

SEQ ID NO: 556817 - protein, 9 aa, Homo Sapiens
HPVVPKVEK

SEQ ID NO: 556818 - protein, 9 aa, Homo Sapiens
LPEVDVSPP

SEQ ID NO: 556819 - protein, 9 aa, Homo Sapiens
EIPENCLEH

SEQ ID NO: 556820 - protein, 9 aa, Homo Sapiens
TPSEYWVEE

SEQ ID NO: 556821 - protein, 9 aa, Homo Sapiens
FRELSENTQ

SEQ ID NO: 556822 - protein, 9 aa, Homo Sapiens
ALIFVMTMY

SEQ ID NO: 556823 - protein, 9 aa, Homo Sapiens
WCASTCYPP

SEQ ID NO: 556824 - protein, 9 aa, Homo Sapiens
PSDTIENMK

SEQ ID NO: 556825 - protein, 9 aa, Homo Sapiens
SSQLVLLKL

SEQ ID NO: 556826 - protein, 9 aa, Homo Sapiens
FLPLQKVLL

SEQ ID NO: 556827 - protein, 9 aa, Homo Sapiens
PCRQSWNVV

SEQ ID NO: 556828 - protein, 9 aa, Homo Sapiens
CGRESYATH

SEQ ID NO: 556829 - protein, 9 aa, Homo Sapiens
PSPSSSSLT

SEQ ID NO: 556830 - protein, 9 aa, Homo Sapiens
NSPSLGAPE

SEQ ID NO: 556831 - protein, 9 aa, Homo Sapiens
RWAPSRRTM

SEQ ID NO: 556832 - protein, 9 aa, Homo Sapiens
LDKLQEHLP

SEQ ID NO: 556833 - protein, 9 aa, Homo Sapiens
ATKRSLLHK

SEQ ID NO: 556834 - protein, 9 aa, Homo Sapiens
TSSIPWYES

SEQ ID NO: 556835 - protein, 9 aa, Homo Sapiens
PTSCWSTCW

SEQ ID NO: 556836 - protein, 9 aa, Homo Sapiens
YNRYHNNCY

SEQ ID NO: 556837 - protein, 9 aa, Homo Sapiens
TQQAANVLS

SEQ ID NO: 556838 - protein, 9 aa, Homo Sapiens
PSGSPSPWC

SEQ ID NO: 556839 - protein, 9 aa, Homo Sapiens
EDCKGAAEA

SEQ ID NO: 556840 - protein, 9 aa, Homo Sapiens
VIYEPYLPC

SEQ ID NO: 556841 - protein, 9 aa, Homo Sapiens
AGKTITLEV

SEQ ID NO: 556842 - protein, 9 aa, Homo Sapiens
HLEMGFPRG

SEQ ID NO: 556843 - protein, 9 aa, Homo Sapiens
SDTIENMKA

SEQ ID NO: 556844 - protein, 9 aa, Homo Sapiens
LPTAPSLGM

SEQ ID NO: 556845 - protein, 9 aa, Homo Sapiens
LREATGINL

SEQ ID NO: 556846 - protein, 9 aa, Homo Sapiens
RAYPHNLMI

SEQ ID NO: 556847 - protein, 9 aa, Homo Sapiens
AALDEEEKE

SEQ ID NO: 556848 - protein, 9 aa, Homo Sapiens
LPLQKVLLN

SEQ ID NO: 556849 - protein, 9 aa, Homo Sapiens
TGSAYPRQG

SEQ ID NO: 556850 - protein, 9 aa, Homo Sapiens
WNVVISDSQ

SEQ ID NO: 556851 - protein, 9 aa, Homo Sapiens
MQIFVKTLA

SEQ ID NO: 556852 - protein, 9 aa, Homo Sapiens
GSPSPWCAS

SEQ ID NO: 556853 - protein, 9 aa, Homo Sapiens
VVFTHGYYA

SEQ ID NO: 556854 - protein, 9 aa, Homo Sapiens
HCNSPSLGA

SEQ ID NO: 556855 - protein, 9 aa, Homo Sapiens
YCVPSKNSR

SEQ ID NO: 556856 - protein, 9 aa, Homo Sapiens
RCPVTWMVP

SEQ ID NO: 556857 - protein, 9 aa, Homo Sapiens
HAALIFVMT

SEQ ID NO: 556858 - protein, 9 aa, Homo Sapiens
ALGSYNRYH

SEQ ID NO: 556859 - protein, 9 aa, Homo Sapiens
ALANHQRTH

SEQ ID NO: 556860 - protein, 9 aa, Homo Sapiens
MKAKIQDKE

SEQ ID NO: 556861 - protein, 9 aa, Homo Sapiens
SLVAEDTDT

SEQ ID NO: 556862 - protein, 9 aa, Homo Sapiens
REMIPALRT

SEQ ID NO: 556863 - protein, 9 aa, Homo Sapiens
GSAYPRQGE

SEQ ID NO: 556864 - protein, 9 aa, Homo Sapiens
GKSFSKSSA

SEQ ID NO: 556865 - protein, 9 aa, Homo Sapiens
VISDSQLST

SEQ ID NO: 556866 - protein, 9 aa, Homo Sapiens
NKVYVKLLN

SEQ ID NO: 556867 - protein, 9 aa, Homo Sapiens
VTYTSSVST

SEQ ID NO: 556868 - protein, 9 aa, Homo Sapiens
PYRRPHSIT

SEQ ID NO: 556869 - protein, 9 aa, Homo Sapiens
ITSNFVTPS

SEQ ID NO: 556870 - protein, 9 aa, Homo Sapiens
WDYRHYVVQ

SEQ ID NO: 556871 - protein, 9 aa, Homo Sapiens
ALARVLERP

SEQ ID NO: 556872 - protein, 9 aa, Homo Sapiens
GTSWCRSTA

SEQ ID NO: 556873 - protein, 9 aa, Homo Sapiens
RRLLNELDQ

SEQ ID NO: 556874 - protein, 9 aa, Homo Sapiens
RIRTGERPY

SEQ ID NO: 556875 - protein, 9 aa, Homo Sapiens
GKDTKSAQK

SEQ ID NO: 556876 - protein, 9 aa, Homo Sapiens
SENTQQAAN

SEQ ID NO: 556877 - protein, 9 aa, Homo Sapiens
CNLPCRQSW

SEQ ID NO: 556878 - protein, 9 aa, Homo Sapiens
ENMKAKIQD

SEQ ID NO: 556879 - protein, 9 aa, Homo Sapiens
KSSALANHQ

SEQ ID NO: 556880 - protein, 9 aa, Homo Sapiens
HQRIRTGER

SEQ ID NO: 556881 - protein, 9 aa, Homo Sapiens
AGKDTKSAQ

SEQ ID NO: 556882 - protein, 9 aa, Homo Sapiens
SNKVYVKLL

SEQ ID NO: 556883 - protein, 9 aa, Homo Sapiens
SPCLATRWA

SEQ ID NO: 556884 - protein, 9 aa, Homo Sapiens
RHYVVQGPE

SEQ ID NO: 556885 - protein, 9 aa, Homo Sapiens
LAGKTITLE

SEQ ID NO: 556886 - protein, 9 aa, Homo Sapiens
NPYYVLFEY

SEQ ID NO: 556887 - protein, 9 aa, Homo Sapiens
GERTPTHRG

SEQ ID NO: 556888 - protein, 9 aa, Homo Sapiens
SISPSPSSS

SEQ ID NO: 556889 - protein, 9 aa, Homo Sapiens
ENTQQAANV

SEQ ID NO: 556890 - protein, 9 aa, Homo Sapiens
TPTHRGWSR

SEQ ID NO: 556891 - protein, 9 aa, Homo Sapiens
ASTCYPPTS

SEQ ID NO: 556892 - protein, 9 aa, Homo Sapiens
LQLQAQQYM

SEQ ID NO: 556893 - protein, 9 aa, Homo Sapiens
FHCNSPSLG

SEQ ID NO: 556894 - protein, 9 aa, Homo Sapiens
VEKELVPDQ

SEQ ID NO: 556895 - protein, 9 aa, Homo Sapiens
LQKVLLNSD

SEQ ID NO: 556896 - protein, 9 aa, Homo Sapiens
ENQSPKDLF

SEQ ID NO: 556897 - protein, 9 aa, Homo Sapiens
WSTCWSPCL

SEQ ID NO: 556898 - protein, 9 aa, Homo Sapiens
QQYMQKQLL

SEQ ID NO: 556899 - protein, 9 aa, Homo Sapiens
YEMKLMNLD

SEQ ID NO: 556900 - protein, 9 aa, Homo Sapiens
TSNFVTPSE

SEQ ID NO: 556901 - protein, 9 aa, Homo Sapiens
STPAATVAE

SEQ ID NO: 556902 - protein, 9 aa, Homo Sapiens
SCNLPCRQS

SEQ ID NO: 556903 - protein, 9 aa, Homo Sapiens
REDCKGAAE

SEQ ID NO: 556904 - protein, 9 aa, Homo Sapiens
QARSQENQS

SEQ ID NO: 556905 - protein, 9 aa, Homo Sapiens
KLQEHLPEL

SEQ ID NO: 556906 - protein, 9 aa, Homo Sapiens
FSCGRESYA

SEQ ID NO: 556907 - protein, 9 aa, Homo Sapiens
QGPEMTPYE

SEQ ID NO: 556908 - protein, 9 aa, Homo Sapiens
PYYVLFEYS

SEQ ID NO: 556909 - protein, 9 aa, Homo Sapiens
VLLFALLVV

SEQ ID NO: 556910 - protein, 9 aa, Homo Sapiens
LPCRQSWNV

SEQ ID NO: 556911 - protein, 9 aa, Homo Sapiens
RQSWNVVIS

SEQ ID NO: 556912 - protein, 9 aa, Homo Sapiens
CKGAAEAAL

SEQ ID NO: 556913 - protein, 9 aa, Homo Sapiens
RITSNFVTP

SEQ ID NO: 556914 - protein, 9 aa, Homo Sapiens
PGAAAVQEE

SEQ ID NO: 556915 - protein, 9 aa, Homo Sapiens
IPWYESSPK

SEQ ID NO: 556916 - protein, 9 aa, Homo Sapiens
QSWNVVISD

SEQ ID NO: 556917 - protein, 9 aa, Homo Sapiens
SSSSLTSTW

SEQ ID NO: 556918 - protein, 9 aa, Homo Sapiens
CGPSSSQLV

SEQ ID NO: 556919 - protein, 9 aa, Homo Sapiens
RQGERTPTH

SEQ ID NO: 556920 - protein, 9 aa, Homo Sapiens
KTLAGKTIT

SEQ ID NO: 556921 - protein, 9 aa, Homo Sapiens
SDYEMKLMN

SEQ ID NO: 556922 - protein, 9 aa, Homo Sapiens
RGTSWCRST

SEQ ID NO: 556923 - protein, 9 aa, Homo Sapiens
FLAATQDFA

SEQ ID NO: 556924 - protein, 9 aa, Homo Sapiens
SCWSTCWSP

SEQ ID NO: 556925 - protein, 9 aa, Homo Sapiens
TPAATVAEN

SEQ ID NO: 556926 - protein, 9 aa, Homo Sapiens
QPQTSNCPG

SEQ ID NO: 556927 - protein, 9 aa, Homo Sapiens
NEFGKYSFL

SEQ ID NO: 556928 - protein, 9 aa, Homo Sapiens
YYVLFEYSA

SEQ ID NO: 556929 - protein, 9 aa, Homo Sapiens
RVLERPLPV

SEQ ID NO: 556930 - protein, 9 aa, Homo Sapiens
ANSNPPARY

SEQ ID NO: 556931 - protein, 9 aa, Homo Sapiens
KLRKKQAAL

SEQ ID NO: 556932 - protein, 9 aa, Homo Sapiens
LRAFLPLQK

SEQ ID NO: 556933 - protein, 9 aa, Homo Sapiens
VHRLRAFLP

SEQ ID NO: 556934 - protein, 9 aa, Homo Sapiens
GHCTGSAYP

SEQ ID NO: 556935 - protein, 9 aa, Homo Sapiens
PHSITSQTS

SEQ ID NO: 556936 - protein, 9 aa, Homo Sapiens
LVLFLLGTI

SEQ ID NO: 556937 - protein, 9 aa, Homo Sapiens
LAAICYFFA

SEQ ID NO: 556938 - protein, 9 aa, Homo Sapiens
SALPEVDVS

SEQ ID NO: 556939 - protein, 9 aa, Homo Sapiens
FALLVVMSI

SEQ ID NO: 556940 - protein, 9 aa, Homo Sapiens
SNFVTPSEY

SEQ ID NO: 556941 - protein, 9 aa, Homo Sapiens
WMVPRMTLP

SEQ ID NO: 556942 - protein, 9 aa, Homo Sapiens
SGSPSPWCA

SEQ ID NO: 556943 - protein, 9 aa, Homo Sapiens
FTSSIPWYE

SEQ ID NO: 556944 - protein, 9 aa, Homo Sapiens
GNCSARVRA

SEQ ID NO: 556945 - protein, 9 aa, Homo Sapiens
VPSLVAEDT

SEQ ID NO: 556946 - protein, 9 aa, Homo Sapiens
ALDEEEKEI

SEQ ID NO: 556947 - protein, 9 aa, Homo Sapiens
NELDQVTYS

SEQ ID NO: 556948 - protein, 9 aa, Homo Sapiens
QAALDEEEK

SEQ ID NO: 556949 - protein, 9 aa, Homo Sapiens
QASFLSDYN

SEQ ID NO: 556950 - protein, 9 aa, Homo Sapiens
EATKRSLLH

SEQ ID NO: 556951 - protein, 9 aa, Homo Sapiens
SLLHKKKKE

SEQ ID NO: 556952 - protein, 9 aa, Homo Sapiens
VLSNEIATL

SEQ ID NO: 556953 - protein, 9 aa, Homo Sapiens
SSSQLVLLK

SEQ ID NO: 556954 - protein, 9 aa, Homo Sapiens
GQGFHCNSP

SEQ ID NO: 556955 - protein, 9 aa, Homo Sapiens
HQPQTSNCP

SEQ ID NO: 556956 - protein, 9 aa, Homo Sapiens
GPGKAASLT

SEQ ID NO: 556957 - protein, 9 aa, Homo Sapiens
REATGINLE

SEQ ID NO: 556958 - protein, 9 aa, Homo Sapiens
LSDYNMFIN

SEQ ID NO: 556959 - protein, 9 aa, Homo Sapiens
RLRAFLPLQ

SEQ ID NO: 556960 - protein, 9 aa, Homo Sapiens
EPSDTIENM

SEQ ID NO: 556961 - protein, 9 aa, Homo Sapiens
DYRHYVVQG

SEQ ID NO: 556962 - protein, 9 aa, Homo Sapiens
LSNKVYVKL

SEQ ID NO: 556963 - protein, 9 aa, Homo Sapiens
DYPATISYS

SEQ ID NO: 556964 - protein, 9 aa, Homo Sapiens
WSPCLATRW

SEQ ID NO: 556965 - protein, 9 aa, Homo Sapiens
TGINLENIV

SEQ ID NO: 556966 - protein, 9 aa, Homo Sapiens
LTERLAADT

SEQ ID NO: 556967 - protein, 9 aa, Homo Sapiens
SARCPVTWM

SEQ ID NO: 556968 - protein, 9 aa, Homo Sapiens
EMKLMNLDV

SEQ ID NO: 556969 - protein, 9 aa, Homo Sapiens
GPNDNEFGK

SEQ ID NO: 556970 - protein, 9 aa, Homo Sapiens
CYPPTSCWS

SEQ ID NO: 556971 - protein, 9 aa, Homo Sapiens
ILFLYCVPS

SEQ ID NO: 556972 - protein, 9 aa, Homo Sapiens
AQQYMQKQL

SEQ ID NO: 556973 - protein, 9 aa, Homo Sapiens
WVHRLRAFL

SEQ ID NO: 556974 - protein, 9 aa, Homo Sapiens
TIFLLCPYW

SEQ ID NO: 556975 - protein, 9 aa, Homo Sapiens
PFQQSCNLP

SEQ ID NO: 556976 - protein, 9 aa, Homo Sapiens
INLENIVYY

SEQ ID NO: 556977 - protein, 9 aa, Homo Sapiens
FAVDGWALT

SEQ ID NO: 556978 - protein, 9 aa, Homo Sapiens
RSGSSRGTS

SEQ ID NO: 556979 - protein, 9 aa, Homo Sapiens
RYHNNCYRD

SEQ ID NO: 556980 - protein, 9 aa, Homo Sapiens
ETVLSNEIA

SEQ ID NO: 556981 - protein, 9 aa, Homo Sapiens
ARYSWTING

SEQ ID NO: 556982 - protein, 9 aa, Homo Sapiens
MIFQMKFFY

SEQ ID NO: 556983 - protein, 9 aa, Homo Sapiens
PLWVHRLRA

SEQ ID NO: 556984 - protein, 9 aa, Homo Sapiens
FSKSSALAN

SEQ ID NO: 556985 - protein, 9 aa, Homo Sapiens
TLPTAPSLG

SEQ ID NO: 556986 - protein, 9 aa, Homo Sapiens
EHLEMGFPR

SEQ ID NO: 556987 - protein, 9 aa, Homo Sapiens
PYLPCSARC

SEQ ID NO: 556988 - protein, 9 aa, Homo Sapiens
EFGKYSFLF

SEQ ID NO: 556989 - protein, 9 aa, Homo Sapiens
STCYPPTSC

SEQ ID NO: 556990 - protein, 9 aa, Homo Sapiens
RKKQAALDE

SEQ ID NO: 556991 - protein, 9 aa, Homo Sapiens
YRHYVVQGP

SEQ ID NO: 556992 - protein, 9 aa, Homo Sapiens
RSLLHKKKK

SEQ ID NO: 556993 - protein, 9 aa, Homo Sapiens
SSSLTSTWW

SEQ ID NO: 556994 - protein, 9 aa, Homo Sapiens
TFGQGFHCN

SEQ ID NO: 556995 - protein, 9 aa, Homo Sapiens
GSLPYRRPH

SEQ ID NO: 556996 - protein, 9 aa, Homo Sapiens
MSPSHCVWS

SEQ ID NO: 556997 - protein, 9 aa, Homo Sapiens
KAASLTERL

SEQ ID NO: 556998 - protein, 9 aa, Homo Sapiens
FLYCVPSKN

SEQ ID NO: 556999 - protein, 9 aa, Homo Sapiens
LPQFDTILF

SEQ ID NO: 557000 - protein, 9 aa, Homo Sapiens
LLAVVVFTH

SEQ ID NO: 557001 - protein, 9 aa, Homo Sapiens
ATLSTSCSH

SEQ ID NO: 557002 - protein, 9 aa, Homo Sapiens
LHKKKKEAR

SEQ ID NO: 557003 - protein, 9 aa, Homo Sapiens
TLAGKTITL

SEQ ID NO: 557004 - protein, 9 aa, Homo Sapiens
TYTSSVSTA

SEQ ID NO: 557005 - protein, 9 aa, Homo Sapiens
LLFALLVVM

SEQ ID NO: 557006 - protein, 9 aa, Homo Sapiens
CTGSAYPRQ

SEQ ID NO: 557007 - protein, 9 aa, Homo Sapiens
RELSENTQQ

SEQ ID NO: 557008 - protein, 9 aa, Homo Sapiens
VQGPEMTPY

SEQ ID NO: 557009 - protein, 9 aa, Homo Sapiens
GKAASLTER

SEQ ID NO: 557010 - protein, 9 aa, Homo Sapiens
PLGCIHAAL

SEQ ID NO: 557011 - protein, 9 aa, Homo Sapiens
LFLLGTIFL

SEQ ID NO: 557012 - protein, 9 aa, Homo Sapiens
TSCWSTCWS

SEQ ID NO: 557013 - protein, 9 aa, Homo Sapiens
NMKAKIQDK

SEQ ID NO: 557014 - protein, 9 aa, Homo Sapiens
FLLGTIFLL

SEQ ID NO: 557015 - protein, 9 aa, Homo Sapiens
STRGREDCK

SEQ ID NO: 557016 - protein, 9 aa, Homo Sapiens
HCTGSAYPR

SEQ ID NO: 557017 - protein, 9 aa, Homo Sapiens
SWPFQQSCN

SEQ ID NO: 557018 - protein, 9 aa, Homo Sapiens
WCRSTAAAS

SEQ ID NO: 557019 - protein, 9 aa, Homo Sapiens
YLPCSARCP

SEQ ID NO: 557020 - protein, 9 aa, Homo Sapiens
QLQAQQYMQ

SEQ ID NO: 557021 - protein, 9 aa, Homo Sapiens
DQVTYSLGT

SEQ ID NO: 557022 - protein, 9 aa, Homo Sapiens
LNSDEDGHC

SEQ ID NO: 557023 - protein, 9 aa, Homo Sapiens
DYEMKLMNL

SEQ ID NO: 557024 - protein, 9 aa, Homo Sapiens
HSITSQTSL

SEQ ID NO: 557025 - protein, 9 aa, Homo Sapiens
CLQLALEGE

SEQ ID NO: 557026 - protein, 9 aa, Homo Sapiens
YSTRGREDC

SEQ ID NO: 557027 - protein, 9 aa, Homo Sapiens
QRIRTGERP

SEQ ID NO: 557028 - protein, 9 aa, Homo Sapiens
HPHPVVPKV

SEQ ID NO: 557029 - protein, 9 aa, Homo Sapiens
SFLSDYNMF

SEQ ID NO: 557030 - protein, 9 aa, Homo Sapiens
SSIPWYESS

SEQ ID NO: 557031 - protein, 9 aa, Homo Sapiens
TRGREDCKG

SEQ ID NO: 557032 - protein, 9 aa, Homo Sapiens
GAGKDTKSA

SEQ ID NO: 557033 - protein, 9 aa, Homo Sapiens
AAASISPSP

SEQ ID NO: 557034 - protein, 9 aa, Homo Sapiens
THRGWSRRL

SEQ ID NO: 557035 - protein, 9 aa, Homo Sapiens
FSELPQFDT

SEQ ID NO: 557036 - protein, 9 aa, Homo Sapiens
CSARVRATS

SEQ ID NO: 557037 - protein, 9 aa, Homo Sapiens
LARVLERPL

SEQ ID NO: 557038 - protein, 9 aa, Homo Sapiens
GFHCNSPSL

SEQ ID NO: 557039 - protein, 9 aa, Homo Sapiens
LIFVMTMYT

SEQ ID NO: 557040 - protein, 9 aa, Homo Sapiens
SHCVWSWMS

SEQ ID NO: 557041 - protein, 9 aa, Homo Sapiens
PENCLEHLE

SEQ ID NO: 557042 - protein, 9 aa, Homo Sapiens
MIPALRTFL

SEQ ID NO: 557043 - protein, 9 aa, Homo Sapiens
VVPKVEKEL

SEQ ID NO: 557044 - protein, 9 aa, Homo Sapiens
PKVEKELVP

SEQ ID NO: 557045 - protein, 9 aa, Homo Sapiens
IFLLCPYWG

SEQ ID NO: 557046 - protein, 9 aa, Homo Sapiens
CPGAAAVQE

SEQ ID NO: 557047 - protein, 9 aa, Homo Sapiens
YPHNLMIFQ

SEQ ID NO: 557048 - protein, 9 aa, Homo Sapiens
FANSNPPAR

SEQ ID NO: 557049 - protein, 9 aa, Homo Sapiens
PSRRTMTRS

SEQ ID NO: 557050 - protein, 9 aa, Homo Sapiens
IAVLLFALL

SEQ ID NO: 557051 - protein, 9 aa, Homo Sapiens
WIVPSLVAE

SEQ ID NO: 557052 - protein, 9 aa, Homo Sapiens
CWSTCWSPC

SEQ ID NO: 557053 - protein, 9 aa, Homo Sapiens
LGCIHAALI

SEQ ID NO: 557054 - protein, 9 aa, Homo Sapiens
PRQGERTPT

SEQ ID NO: 557055 - protein, 9 aa, Homo Sapiens
NDNEFGKYS

SEQ ID NO: 557056 - protein, 9 aa, Homo Sapiens
IVPSLVAED

SEQ ID NO: 557057 - protein, 9 aa, Homo Sapiens
ISPSPSSSS

SEQ ID NO: 557058 - protein, 9 aa, Homo Sapiens
QVTYSLGTR

SEQ ID NO: 557059 - protein, 9 aa, Homo Sapiens
PSLGMSPSH

SEQ ID NO: 557060 - protein, 9 aa, Homo Sapiens
TPLPVTYTS

SEQ ID NO: 557061 - protein, 9 aa, Homo Sapiens
APSRRTMTR

SEQ ID NO: 557062 - protein, 9 aa, Homo Sapiens
KVLLNSDED

SEQ ID NO: 557063 - protein, 9 aa, Homo Sapiens
RLLNELDQV

SEQ ID NO: 557064 - protein, 9 aa, Homo Sapiens
SQENQSPKD

SEQ ID NO: 557065 - protein, 9 aa, Homo Sapiens
MNLDVEQLG

SEQ ID NO: 557066 - protein, 9 aa, Homo Sapiens
LMIFQMKFF

SEQ ID NO: 557067 - protein, 9 aa, Homo Sapiens
LLNSDEDGH

SEQ ID NO: 557068 - protein, 9 aa, Homo Sapiens
YPPTSCWST

SEQ ID NO: 557069 - protein, 9 aa, Homo Sapiens
AGAGKDTKS

SEQ ID NO: 557070 - protein, 9 aa, Homo Sapiens
ASLTERLAA

SEQ ID NO: 557071 - protein, 9 aa, Homo Sapiens
MALARVLER

SEQ ID NO: 557072 - protein, 9 aa, Homo Sapiens
SDSQLSTPA

SEQ ID NO: 557073 - protein, 9 aa, Homo Sapiens
TMTRSGSSR

SEQ ID NO: 557074 - protein, 9 aa, Homo Sapiens
IPENCLEHL

SEQ ID NO: 557075 - protein, 9 aa, Homo Sapiens
PALRTFLKR

SEQ ID NO: 557076 - protein, 9 aa, Homo Sapiens
YPRQGERTP

SEQ ID NO: 557077 - protein, 9 aa, Homo Sapiens
HLIGPNDNE

SEQ ID NO: 557078 - protein, 9 aa, Homo Sapiens
GREDCKGAA

SEQ ID NO: 557079 - protein, 9 aa, Homo Sapiens
SNEIATLST

SEQ ID NO: 557080 - protein, 9 aa, Homo Sapiens
IENMKAKIQ

SEQ ID NO: 557081 - protein, 9 aa, Homo Sapiens
DYNMFINLP

SEQ ID NO: 557082 - protein, 9 aa, Homo Sapiens
RSTTRQGVR

SEQ ID NO: 557083 - protein, 9 aa, Homo Sapiens
SKSLLVLLC

SEQ ID NO: 557084 - protein, 9 aa, Homo Sapiens
LPKSHTVPT

SEQ ID NO: 557085 - protein, 9 aa, Homo Sapiens
PKSHTVPTW

SEQ ID NO: 557086 - protein, 9 aa, Homo Sapiens
GARGSSGSG

SEQ ID NO: 557087 - protein, 9 aa, Homo Sapiens
ARFTRGARK

SEQ ID NO: 557088 - protein, 9 aa, Homo Sapiens
SLASGTSRA

SEQ ID NO: 557089 - protein, 9 aa, Homo Sapiens
LKEELPGPS

SEQ ID NO: 557090 - protein, 9 aa, Homo Sapiens
PHFRLPKER

SEQ ID NO: 557091 - protein, 9 aa, Homo Sapiens
NTSLSSLAG

SEQ ID NO: 557092 - protein, 9 aa, Homo Sapiens
GPPPLHYLL

SEQ ID NO: 557093 - protein, 9 aa, Homo Sapiens
TKFSTFNDY

SEQ ID NO: 557094 - protein, 9 aa, Homo Sapiens
TRETLESGG

SEQ ID NO: 557095 - protein, 9 aa, Homo Sapiens
TDALWNKVT

SEQ ID NO: 557096 - protein, 9 aa, Homo Sapiens
SRTRRARGS

SEQ ID NO: 557097 - protein, 9 aa, Homo Sapiens
IRTRAARAS

SEQ ID NO: 557098 - protein, 9 aa, Homo Sapiens
VVIKEWGTG

SEQ ID NO: 557099 - protein, 9 aa, Homo Sapiens
RFTRGARKT

SEQ ID NO: 557100 - protein, 9 aa, Homo Sapiens
RRARGSSIS

SEQ ID NO: 557101 - protein, 9 aa, Homo Sapiens
LRPWKTSCT

SEQ ID NO: 557102 - protein, 9 aa, Homo Sapiens
SGNTSLSSL

SEQ ID NO: 557103 - protein, 9 aa, Homo Sapiens
GTRLTTVSG

SEQ ID NO: 557104 - protein, 9 aa, Homo Sapiens
RSMEKSQRS

SEQ ID NO: 557105 - protein, 9 aa, Homo Sapiens
PSGTSRTRG

SEQ ID NO: 557106 - protein, 9 aa, Homo Sapiens
SGTLGTSNT

SEQ ID NO: 557107 - protein, 9 aa, Homo Sapiens
WRTSRTRET

SEQ ID NO: 557108 - protein, 9 aa, Homo Sapiens
RDEDDEACG

SEQ ID NO: 557109 - protein, 9 aa, Homo Sapiens
TGTFAAFFA

SEQ ID NO: 557110 - protein, 9 aa, Homo Sapiens
GPGRSLKSP

SEQ ID NO: 557111 - protein, 9 aa, Homo Sapiens
GSGNTSLSS

SEQ ID NO: 557112 - protein, 9 aa, Homo Sapiens
TFAAFFASR

SEQ ID NO: 557113 - protein, 9 aa, Homo Sapiens
PSKSLLVLL

SEQ ID NO: 557114 - protein, 9 aa, Homo Sapiens
ASRTRRARG

SEQ ID NO: 557115 - protein, 9 aa, Homo Sapiens
TGLEGESDE

SEQ ID NO: 557116 - protein, 9 aa, Homo Sapiens
DAIFARRAI

SEQ ID NO: 557117 - protein, 9 aa, Homo Sapiens
DRFVAICCP

SEQ ID NO: 557118 - protein, 9 aa, Homo Sapiens
PSNCLCIRG

SEQ ID NO: 557119 - protein, 9 aa, Homo Sapiens
DGSTGPTGF

SEQ ID NO: 557120 - protein, 9 aa, Homo Sapiens
DENDNASEI

SEQ ID NO: 557121 - protein, 9 aa, Homo Sapiens
LTTGTFAAF

SEQ ID NO: 557122 - protein, 9 aa, Homo Sapiens
SNTLRPGST

SEQ ID NO: 557123 - protein, 9 aa, Homo Sapiens
FITDAVLSL

SEQ ID NO: 557124 - protein, 9 aa, Homo Sapiens
KNNFEFCET

SEQ ID NO: 557125 - protein, 9 aa, Homo Sapiens
GAKYQGSIH

SEQ ID NO: 557126 - protein, 9 aa, Homo Sapiens
FTLVTRGTS

SEQ ID NO: 557127 - protein, 9 aa, Homo Sapiens
STSITRFAF

SEQ ID NO: 557128 - protein, 9 aa, Homo Sapiens
AAGTTFTLV

SEQ ID NO: 557129 - protein, 9 aa, Homo Sapiens
STSRTISTR

SEQ ID NO: 557130 - protein, 9 aa, Homo Sapiens
VLEHQQGQA

SEQ ID NO: 557131 - protein, 9 aa, Homo Sapiens
HFRLPKERS

SEQ ID NO: 557132 - protein, 9 aa, Homo Sapiens
KARGALATG

SEQ ID NO: 557133 - protein, 9 aa, Homo Sapiens
TISTRGSFL

SEQ ID NO: 557134 - protein, 9 aa, Homo Sapiens
ESHHTSLTT

SEQ ID NO: 557135 - protein, 9 aa, Homo Sapiens
LLVLLCGRA

SEQ ID NO: 557136 - protein, 9 aa, Homo Sapiens
SKASRAGGT

SEQ ID NO: 557137 - protein, 9 aa, Homo Sapiens
PTPTTSSGP

SEQ ID NO: 557138 - protein, 9 aa, Homo Sapiens
RHQTFPSFF

SEQ ID NO: 557139 - protein, 9 aa, Homo Sapiens
SHTVPTWPK

SEQ ID NO: 557140 - protein, 9 aa, Homo Sapiens
SLVMGLQGV

SEQ ID NO: 557141 - protein, 9 aa, Homo Sapiens
GGTRGASFA

SEQ ID NO: 557142 - protein, 9 aa, Homo Sapiens
FHWLSLGEA

SEQ ID NO: 557143 - protein, 9 aa, Homo Sapiens
EVCNIVGQT

SEQ ID NO: 557144 - protein, 9 aa, Homo Sapiens
PGRSLKSPS

SEQ ID NO: 557145 - protein, 9 aa, Homo Sapiens
RGALATGSS

SEQ ID NO: 557146 - protein, 9 aa, Homo Sapiens
STGPTGFFL

SEQ ID NO: 557147 - protein, 9 aa, Homo Sapiens
CPLLYSTKM

SEQ ID NO: 557148 - protein, 9 aa, Homo Sapiens
RGTNFTRTS

SEQ ID NO: 557149 - protein, 9 aa, Homo Sapiens
QWVRVHLEL

SEQ ID NO: 557150 - protein, 9 aa, Homo Sapiens
PTTSSGPPS

SEQ ID NO: 557151 - protein, 9 aa, Homo Sapiens
FARRAISTF

SEQ ID NO: 557152 - protein, 9 aa, Homo Sapiens
SSLAGLSSS

SEQ ID NO: 557153 - protein, 9 aa, Homo Sapiens
SLSSLTRQA

SEQ ID NO: 557154 - protein, 9 aa, Homo Sapiens
HHAACLLGK

SEQ ID NO: 557155 - protein, 9 aa, Homo Sapiens
TGTRWAWGS

SEQ ID NO: 557156 - protein, 9 aa, Homo Sapiens
STVGPSGTS

SEQ ID NO: 557157 - protein, 9 aa, Homo Sapiens
LFARFTRGA

SEQ ID NO: 557158 - protein, 9 aa, Homo Sapiens
RVHLELLAF

SEQ ID NO: 557159 - protein, 9 aa, Homo Sapiens
TDSASSTRE

SEQ ID NO: 557160 - protein, 9 aa, Homo Sapiens
TASAATSDA

SEQ ID NO: 557161 - protein, 9 aa, Homo Sapiens
ATILTGGTR

SEQ ID NO: 557162 - protein, 9 aa, Homo Sapiens
GSSRGTSIT

SEQ ID NO: 557163 - protein, 9 aa, Homo Sapiens
GSCEDPGAI

SEQ ID NO: 557164 - protein, 9 aa, Homo Sapiens
ASTFGSRST

SEQ ID NO: 557165 - protein, 9 aa, Homo Sapiens
CTTFTRHSL

SEQ ID NO: 557166 - protein, 9 aa, Homo Sapiens
SLTTGTFAA

SEQ ID NO: 557167 - protein, 9 aa, Homo Sapiens
REASLSSLT

SEQ ID NO: 557168 - protein, 9 aa, Homo Sapiens
RALFTSLAS

SEQ ID NO: 557169 - protein, 9 aa, Homo Sapiens
SFAIRTRAA

SEQ ID NO: 557170 - protein, 9 aa, Homo Sapiens
TGFFLFGIL

SEQ ID NO: 557171 - protein, 9 aa, Homo Sapiens
STRGSFLAS

SEQ ID NO: 557172 - protein, 9 aa, Homo Sapiens
KLLCLQLSL

SEQ ID NO: 557173 - protein, 9 aa, Homo Sapiens
SARTGLEGE

SEQ ID NO: 557174 - protein, 9 aa, Homo Sapiens
GASQTTDAI

SEQ ID NO: 557175 - protein, 9 aa, Homo Sapiens
RRSFGASRA

SEQ ID NO: 557176 - protein, 9 aa, Homo Sapiens
TSRTRETLE

SEQ ID NO: 557177 - protein, 9 aa, Homo Sapiens
ITNGARGSS

SEQ ID NO: 557178 - protein, 9 aa, Homo Sapiens
SSLTRQADH

SEQ ID NO: 557179 - protein, 9 aa, Homo Sapiens
LYLLPKSHT

SEQ ID NO: 557180 - protein, 9 aa, Homo Sapiens
DLEENSGIG

SEQ ID NO: 557181 - protein, 9 aa, Homo Sapiens
GSTVGPSGT

SEQ ID NO: 557182 - protein, 9 aa, Homo Sapiens
GTSRARGSL

SEQ ID NO: 557183 - protein, 9 aa, Homo Sapiens
SVPMPTPTT

SEQ ID NO: 557184 - protein, 9 aa, Homo Sapiens
GQGVLEHQQ

SEQ ID NO: 557185 - protein, 9 aa, Homo Sapiens
GALATGSSR

SEQ ID NO: 557186 - protein, 9 aa, Homo Sapiens
AFFASRTRR

SEQ ID NO: 557187 - protein, 9 aa, Homo Sapiens
LSLASKTSC

SEQ ID NO: 557188 - protein, 9 aa, Homo Sapiens
TWRTSRTRE

SEQ ID NO: 557189 - protein, 9 aa, Homo Sapiens
LHHAACLLG

SEQ ID NO: 557190 - protein, 9 aa, Homo Sapiens
RFAFSTRLA

SEQ ID NO: 557191 - protein, 9 aa, Homo Sapiens
TATRSTTRQ

SEQ ID NO: 557192 - protein, 9 aa, Homo Sapiens
LHTTLARET

SEQ ID NO: 557193 - protein, 9 aa, Homo Sapiens
MLSLLSDLE

SEQ ID NO: 557194 - protein, 9 aa, Homo Sapiens
SRSTNITNG

SEQ ID NO: 557195 - protein, 9 aa, Homo Sapiens
GASRALFTS

SEQ ID NO: 557196 - protein, 9 aa, Homo Sapiens
SFGASRARR

SEQ ID NO: 557197 - protein, 9 aa, Homo Sapiens
IAFSTSITR

SEQ ID NO: 557198 - protein, 9 aa, Homo Sapiens
GATILTGGT

SEQ ID NO: 557199 - protein, 9 aa, Homo Sapiens
FNTDLEENS

SEQ ID NO: 557200 - protein, 9 aa, Homo Sapiens
GTLGTSNTI

SEQ ID NO: 557201 - protein, 9 aa, Homo Sapiens
GSLLGKLLC

SEQ ID NO: 557202 - protein, 9 aa, Homo Sapiens
ASCSRGARG

SEQ ID NO: 557203 - protein, 9 aa, Homo Sapiens
KVSRNTLFT

SEQ ID NO: 557204 - protein, 9 aa, Homo Sapiens
SLNDTYRSR

SEQ ID NO: 557205 - protein, 9 aa, Homo Sapiens
STRLAVSTR

SEQ ID NO: 557206 - protein, 9 aa, Homo Sapiens
HLGPPPLHY

SEQ ID NO: 557207 - protein, 9 aa, Homo Sapiens
ARRTTFTSG

SEQ ID NO: 557208 - protein, 9 aa, Homo Sapiens
NASEITLAS

SEQ ID NO: 557209 - protein, 9 aa, Homo Sapiens
LVTRGTSRA

SEQ ID NO: 557210 - protein, 9 aa, Homo Sapiens
GSSLNDTYR

SEQ ID NO: 557211 - protein, 9 aa, Homo Sapiens
LPLQQGQGV

SEQ ID NO: 557212 - protein, 9 aa, Homo Sapiens
RGTSRARRT

SEQ ID NO: 557213 - protein, 9 aa, Homo Sapiens
ARTGLEGES

SEQ ID NO: 557214 - protein, 9 aa, Homo Sapiens
PAKCKVYDS

SEQ ID NO: 557215 - protein, 9 aa, Homo Sapiens
DLLPVRRQQ

SEQ ID NO: 557216 - protein, 9 aa, Homo Sapiens
YPPSTKFST

SEQ ID NO: 557217 - protein, 9 aa, Homo Sapiens
VSRNTLFTR

SEQ ID NO: 557218 - protein, 9 aa, Homo Sapiens
CKVYDSQGL

SEQ ID NO: 557219 - protein, 9 aa, Homo Sapiens
KMREQEKMR

SEQ ID NO: 557220 - protein, 9 aa, Homo Sapiens
PPSTKFSTF

SEQ ID NO: 557221 - protein, 9 aa, Homo Sapiens
NKYLLKYLK

SEQ ID NO: 557222 - protein, 9 aa, Homo Sapiens
AIAFHWLSL

SEQ ID NO: 557223 - protein, 9 aa, Homo Sapiens
RFACFTWRT

SEQ ID NO: 557224 - protein, 9 aa, Homo Sapiens
LFTSLASGT

SEQ ID NO: 557225 - protein, 9 aa, Homo Sapiens
VAGSTVGPS

SEQ ID NO: 557226 - protein, 9 aa, Homo Sapiens
RKTREASLS

SEQ ID NO: 557227 - protein, 9 aa, Homo Sapiens
VMGLQGVLS

SEQ ID NO: 557228 - protein, 9 aa, Homo Sapiens
IMVVIKEWG

SEQ ID NO: 557229 - protein, 9 aa, Homo Sapiens
GASRARRTT

SEQ ID NO: 557230 - protein, 9 aa, Homo Sapiens
SRSMEKSQR

SEQ ID NO: 557231 - protein, 9 aa, Homo Sapiens
PTGFFLFGI

SEQ ID NO: 557232 - protein, 9 aa, Homo Sapiens
RARGSSISR

SEQ ID NO: 557233 - protein, 9 aa, Homo Sapiens
LASRARGTR

SEQ ID NO: 557234 - protein, 9 aa, Homo Sapiens
GARGAKVSR

SEQ ID NO: 557235 - protein, 9 aa, Homo Sapiens
SRGTSITLS

SEQ ID NO: 557236 - protein, 9 aa, Homo Sapiens
EDDEACGKP

SEQ ID NO: 557237 - protein, 9 aa, Homo Sapiens
ETLESGGAS

SEQ ID NO: 557238 - protein, 9 aa, Homo Sapiens
KTLSYYQAC

SEQ ID NO: 557239 - protein, 9 aa, Homo Sapiens
RFLPYDNFI

SEQ ID NO: 557240 - protein, 9 aa, Homo Sapiens
LCGRAMFQP

SEQ ID NO: 557241 - protein, 9 aa, Homo Sapiens
GTSIAFSTS

SEQ ID NO: 557242 - protein, 9 aa, Homo Sapiens
ARRTDSASS

SEQ ID NO: 557243 - protein, 9 aa, Homo Sapiens
GSLSSSLSI

SEQ ID NO: 557244 - protein, 9 aa, Homo Sapiens
NQHAIDEEG

SEQ ID NO: 557245 - protein, 9 aa, Homo Sapiens
TFTSGTLGT

SEQ ID NO: 557246 - protein, 9 aa, Homo Sapiens
RGARKTREA

SEQ ID NO: 557247 - protein, 9 aa, Homo Sapiens
FEFCETHIP

SEQ ID NO: 557248 - protein, 9 aa, Homo Sapiens
GRSLKSPSP

SEQ ID NO: 557249 - protein, 9 aa, Homo Sapiens
RETSLASCS

SEQ ID NO: 557250 - protein, 9 aa, Homo Sapiens
NTDLEENSG

SEQ ID NO: 557251 - protein, 9 aa, Homo Sapiens
AQGAKYQGS

SEQ ID NO: 557252 - protein, 9 aa, Homo Sapiens
LVMGLQGVL

SEQ ID NO: 557253 - protein, 9 aa, Homo Sapiens
AGATVDTDI

SEQ ID NO: 557254 - protein, 9 aa, Homo Sapiens
HQTFPSFFK

SEQ ID NO: 557255 - protein, 9 aa, Homo Sapiens
GARRTDSAS

SEQ ID NO: 557256 - protein, 9 aa, Homo Sapiens
TFGTSITSV

SEQ ID NO: 557257 - protein, 9 aa, Homo Sapiens
VSYLNASSL

SEQ ID NO: 557258 - protein, 9 aa, Homo Sapiens
QADHTTLSS

SEQ ID NO: 557259 - protein, 9 aa, Homo Sapiens
CCPLLYSTK

SEQ ID NO: 557260 - protein, 9 aa, Homo Sapiens
RTSRTRETL

SEQ ID NO: 557261 - protein, 9 aa, Homo Sapiens
FGASRARRT

SEQ ID NO: 557262 - protein, 9 aa, Homo Sapiens
FTRHSLKAR

SEQ ID NO: 557263 - protein, 9 aa, Homo Sapiens
HRQPHFRLP

SEQ ID NO: 557264 - protein, 9 aa, Homo Sapiens
SSSTFRSRE

SEQ ID NO: 557265 - protein, 9 aa, Homo Sapiens
RGARGAKVS

SEQ ID NO: 557266 - protein, 9 aa, Homo Sapiens
PPPLHYLLP

SEQ ID NO: 557267 - protein, 9 aa, Homo Sapiens
CKLHHAACL

SEQ ID NO: 557268 - protein, 9 aa, Homo Sapiens
KPFKYPPST

SEQ ID NO: 557269 - protein, 9 aa, Homo Sapiens
TRGSFLASR

SEQ ID NO: 557270 - protein, 9 aa, Homo Sapiens
ARETTATRS

SEQ ID NO: 557271 - protein, 9 aa, Homo Sapiens
SRSRSMEKS

SEQ ID NO: 557272 - protein, 9 aa, Homo Sapiens
TSCTTFTRH

SEQ ID NO: 557273 - protein, 9 aa, Homo Sapiens
SMEKSQRSG

SEQ ID NO: 557274 - protein, 9 aa, Homo Sapiens
SMAISCCQS

SEQ ID NO: 557275 - protein, 9 aa, Homo Sapiens
SCSRGARGA

SEQ ID NO: 557276 - protein, 9 aa, Homo Sapiens
KAPQKVNAA

SEQ ID NO: 557277 - protein, 9 aa, Homo Sapiens
ESLKSVKRK

SEQ ID NO: 557278 - protein, 9 aa, Homo Sapiens
GASFAIRTR

SEQ ID NO: 557279 - protein, 9 aa, Homo Sapiens
AISTFGTSI

SEQ ID NO: 557280 - protein, 9 aa, Homo Sapiens
GTTFTLVTR

SEQ ID NO: 557281 - protein, 9 aa, Homo Sapiens
TSRTISTRG

SEQ ID NO: 557282 - protein, 9 aa, Homo Sapiens
KAQEVCNIV

SEQ ID NO: 557283 - protein, 9 aa, Homo Sapiens
CFSVPVSYL

SEQ ID NO: 557284 - protein, 9 aa, Homo Sapiens
RTRRARGSS

SEQ ID NO: 557285 - protein, 9 aa, Homo Sapiens
CEDPGAIAF

SEQ ID NO: 557286 - protein, 9 aa, Homo Sapiens
VPVSYLNAS

SEQ ID NO: 557287 - protein, 9 aa, Homo Sapiens
CHRQPHFRL

SEQ ID NO: 557288 - protein, 9 aa, Homo Sapiens
SPSKSLLVL

SEQ ID NO: 557289 - protein, 9 aa, Homo Sapiens
YDNFITDAV

SEQ ID NO: 557290 - protein, 9 aa, Homo Sapiens
SGTSRARGS

SEQ ID NO: 557291 - protein, 9 aa, Homo Sapiens
ACLLSLRMK

SEQ ID NO: 557292 - protein, 9 aa, Homo Sapiens
TGPTGFFLF

SEQ ID NO: 557293 - protein, 9 aa, Homo Sapiens
LFFDDSSNV

SEQ ID NO: 557294 - protein, 9 aa, Homo Sapiens
GAKVSRNTL

SEQ ID NO: 557295 - protein, 9 aa, Homo Sapiens
NGASQTTDA

SEQ ID NO: 557296 - protein, 9 aa, Homo Sapiens
QVIPAKCKV

SEQ ID NO: 557297 - protein, 9 aa, Homo Sapiens
ASQTTDAIF

SEQ ID NO: 557298 - protein, 9 aa, Homo Sapiens
SSISRGARR

SEQ ID NO: 557299 - protein, 9 aa, Homo Sapiens
HTSLTTGTR

SEQ ID NO: 557300 - protein, 9 aa, Homo Sapiens
SPSPSKSLL

SEQ ID NO: 557301 - protein, 9 aa, Homo Sapiens
PAPVLSLLT

SEQ ID NO: 557302 - protein, 9 aa, Homo Sapiens
MKFKRRHQT

SEQ ID NO: 557303 - protein, 9 aa, Homo Sapiens
MFQPATCPW

SEQ ID NO: 557304 - protein, 9 aa, Homo Sapiens
SVLFFDDSS

SEQ ID NO: 557305 - protein, 9 aa, Homo Sapiens
MVVIKEWGT

SEQ ID NO: 557306 - protein, 9 aa, Homo Sapiens
AISVLFFDD

SEQ ID NO: 557307 - protein, 9 aa, Homo Sapiens
GRARGTSIA

SEQ ID NO: 557308 - protein, 9 aa, Homo Sapiens
LGTSNTICA

SEQ ID NO: 557309 - protein, 9 aa, Homo Sapiens
GTLHTTLAR

SEQ ID NO: 557310 - protein, 9 aa, Homo Sapiens
KRGANQHAI

SEQ ID NO: 557311 - protein, 9 aa, Homo Sapiens
TSIAFSTSI

SEQ ID NO: 557312 - protein, 9 aa, Homo Sapiens
PLQQGQGVL

SEQ ID NO: 557313 - protein, 9 aa, Homo Sapiens
GVLEHQQGQ

SEQ ID NO: 557314 - protein, 9 aa, Homo Sapiens
GQWVRVHLE

SEQ ID NO: 557315 - protein, 9 aa, Homo Sapiens
AGTTFTLVT

SEQ ID NO: 557316 - protein, 9 aa, Homo Sapiens
SESLKSVKR

SEQ ID NO: 557317 - protein, 9 aa, Homo Sapiens
SRTISTRGS

SEQ ID NO: 557318 - protein, 9 aa, Homo Sapiens
SSTRETSST

SEQ ID NO: 557319 - protein, 9 aa, Homo Sapiens
FGSRSTNIT

SEQ ID NO: 557320 - protein, 9 aa, Homo Sapiens
RSRSMEKSQ

SEQ ID NO: 557321 - protein, 9 aa, Homo Sapiens
PVSYLNASS

SEQ ID NO: 557322 - protein, 9 aa, Homo Sapiens
RASLTTGTF

SEQ ID NO: 557323 - protein, 9 aa, Homo Sapiens
PEHSAPITV

SEQ ID NO: 557324 - protein, 9 aa, Homo Sapiens
TPTTSSGPP

SEQ ID NO: 557325 - protein, 9 aa, Homo Sapiens
SLSSLAGLS

SEQ ID NO: 557326 - protein, 9 aa, Homo Sapiens
TNGARGSSG

SEQ ID NO: 557327 - protein, 9 aa, Homo Sapiens
RGASKASRA

SEQ ID NO: 557328 - protein, 9 aa, Homo Sapiens
QGVLEHQQG

SEQ ID NO: 557329 - protein, 9 aa, Homo Sapiens
SGGTTSSSG

SEQ ID NO: 557330 - protein, 9 aa, Homo Sapiens
TRQADHTTL

SEQ ID NO: 557331 - protein, 9 aa, Homo Sapiens
SRGARGAKV

SEQ ID NO: 557332 - protein, 9 aa, Homo Sapiens
NFITDAVLS

SEQ ID NO: 557333 - protein, 9 aa, Homo Sapiens
RGTSITLST

SEQ ID NO: 557334 - protein, 9 aa, Homo Sapiens
ASLSSLTRQ

SEQ ID NO: 557335 - protein, 9 aa, Homo Sapiens
HHTSLTTGT

SEQ ID NO: 557336 - protein, 9 aa, Homo Sapiens
TTRQGVRAG

SEQ ID NO: 557337 - protein, 9 aa, Homo Sapiens
FFDDSSNVI

SEQ ID NO: 557338 - protein, 9 aa, Homo Sapiens
GSGRARGTS

SEQ ID NO: 557339 - protein, 9 aa, Homo Sapiens
TSESLKSVK

SEQ ID NO: 557340 - protein, 9 aa, Homo Sapiens
QSLRLSLAS

SEQ ID NO: 557341 - protein, 9 aa, Homo Sapiens
ASSTRETSS

SEQ ID NO: 557342 - protein, 9 aa, Homo Sapiens
GCWPGAKDE

SEQ ID NO: 557343 - protein, 9 aa, Homo Sapiens
TSAAASTFG

SEQ ID NO: 557344 - protein, 9 aa, Homo Sapiens
TDSARGSGN

SEQ ID NO: 557345 - protein, 9 aa, Homo Sapiens
FACFTWRTS

SEQ ID NO: 557346 - protein, 9 aa, Homo Sapiens
TRLAVSTRG

SEQ ID NO: 557347 - protein, 9 aa, Homo Sapiens
ALWNKVTEL

SEQ ID NO: 557348 - protein, 9 aa, Homo Sapiens
TLRPWKTSC

SEQ ID NO: 557349 - protein, 9 aa, Homo Sapiens
AASTFGSRS

SEQ ID NO: 557350 - protein, 9 aa, Homo Sapiens
VHLELLAFL

SEQ ID NO: 557351 - protein, 9 aa, Homo Sapiens
CSRNKYLLK

SEQ ID NO: 557352 - protein, 9 aa, Homo Sapiens
RRTDSASST

SEQ ID NO: 557353 - protein, 9 aa, Homo Sapiens
LPVRRQQTQ

SEQ ID NO: 557354 - protein, 9 aa, Homo Sapiens
SARGSGNTS

SEQ ID NO: 557355 - protein, 9 aa, Homo Sapiens
RNKYLLKYL

SEQ ID NO: 557356 - protein, 9 aa, Homo Sapiens
YLLKYLKDR

SEQ ID NO: 557357 - protein, 9 aa, Homo Sapiens
LSARTGLEG

SEQ ID NO: 557358 - protein, 9 aa, Homo Sapiens
SQTLGTRQT

SEQ ID NO: 557359 - protein, 9 aa, Homo Sapiens
WVRVHLELL

SEQ ID NO: 557360 - protein, 9 aa, Homo Sapiens
VNAAIASIP

SEQ ID NO: 557361 - protein, 9 aa, Homo Sapiens
TRRSFGASR

SEQ ID NO: 557362 - protein, 9 aa, Homo Sapiens
TTDALWNKV

SEQ ID NO: 557363 - protein, 9 aa, Homo Sapiens
SSLSIFASR

SEQ ID NO: 557364 - protein, 9 aa, Homo Sapiens
RAMFQPATC

SEQ ID NO: 557365 - protein, 9 aa, Homo Sapiens
SHHTSLTTG

SEQ ID NO: 557366 - protein, 9 aa, Homo Sapiens
RAARASSQT

SEQ ID NO: 557367 - protein, 9 aa, Homo Sapiens
DLEELSART

SEQ ID NO: 557368 - protein, 9 aa, Homo Sapiens
RSRDSSFRL

SEQ ID NO: 557369 - protein, 9 aa, Homo Sapiens
PGSTRSTSR

SEQ ID NO: 557370 - protein, 9 aa, Homo Sapiens
TSRARRTNG

SEQ ID NO: 557371 - protein, 9 aa, Homo Sapiens
LELLAFLPL

SEQ ID NO: 557372 - protein, 9 aa, Homo Sapiens
LTGGTRGAS

SEQ ID NO: 557373 - protein, 9 aa, Homo Sapiens
STFDIYEFH

SEQ ID NO: 557374 - protein, 9 aa, Homo Sapiens
LGKLLCLQL

SEQ ID NO: 557375 - protein, 9 aa, Homo Sapiens
KSHTVPTWP

SEQ ID NO: 557376 - protein, 9 aa, Homo Sapiens
RTSSRASLT

SEQ ID NO: 557377 - protein, 9 aa, Homo Sapiens
AGLSSSTFR

SEQ ID NO: 557378 - protein, 9 aa, Homo Sapiens
TRHSLKARG

SEQ ID NO: 557379 - protein, 9 aa, Homo Sapiens
LTTGTRWAW

SEQ ID NO: 557380 - protein, 9 aa, Homo Sapiens
TSFTGTTSF

SEQ ID NO: 557381 - protein, 9 aa, Homo Sapiens
ITSVTLRPW

SEQ ID NO: 557382 - protein, 9 aa, Homo Sapiens
AAASTFGSR

SEQ ID NO: 557383 - protein, 9 aa, Homo Sapiens
AFSTSITRF

SEQ ID NO: 557384 - protein, 9 aa, Homo Sapiens
SAAASTFGS

SEQ ID NO: 557385 - protein, 9 aa, Homo Sapiens
FTRRSFGAS

SEQ ID NO: 557386 - protein, 9 aa, Homo Sapiens
VGVASMAIS

SEQ ID NO: 557387 - protein, 9 aa, Homo Sapiens
RGTLHTTLA

SEQ ID NO: 557388 - protein, 9 aa, Homo Sapiens
GTRWAWGSG

SEQ ID NO: 557389 - protein, 9 aa, Homo Sapiens
FARFTRGAR

SEQ ID NO: 557390 - protein, 9 aa, Homo Sapiens
SSVGCWPGA

SEQ ID NO: 557391 - protein, 9 aa, Homo Sapiens
LWPHLGPPP

SEQ ID NO: 557392 - protein, 9 aa, Homo Sapiens
YQGSIHDFP

SEQ ID NO: 557393 - protein, 9 aa, Homo Sapiens
PVYTEVKRV

SEQ ID NO: 557394 - protein, 9 aa, Homo Sapiens
TSSGPPSTP

SEQ ID NO: 557395 - protein, 9 aa, Homo Sapiens
SRTRETLES

SEQ ID NO: 557396 - protein, 9 aa, Homo Sapiens
SIFASRTDS

SEQ ID NO: 557397 - protein, 9 aa, Homo Sapiens
LNDTYRSRD

SEQ ID NO: 557398 - protein, 9 aa, Homo Sapiens
GNIPAGATV

SEQ ID NO: 557399 - protein, 9 aa, Homo Sapiens
RGYSGPGRS

SEQ ID NO: 557400 - protein, 9 aa, Homo Sapiens
FASRTDSAR

SEQ ID NO: 557401 - protein, 9 aa, Homo Sapiens
VRVHLELLA

SEQ ID NO: 557402 - protein, 9 aa, Homo Sapiens
SSSGTSRAA

SEQ ID NO: 557403 - protein, 9 aa, Homo Sapiens
AAFFASRTR

SEQ ID NO: 557404 - protein, 9 aa, Homo Sapiens
TLFARFTRG

SEQ ID NO: 557405 - protein, 9 aa, Homo Sapiens
RTRETLESG

SEQ ID NO: 557406 - protein, 9 aa, Homo Sapiens
DPSNCLCIR

SEQ ID NO: 557407 - protein, 9 aa, Homo Sapiens
RLTTVSGGT

SEQ ID NO: 557408 - protein, 9 aa, Homo Sapiens
NDNASEITL

SEQ ID NO: 557409 - protein, 9 aa, Homo Sapiens
AGGTRLTTV

SEQ ID NO: 557410 - protein, 9 aa, Homo Sapiens
SLKSVKRKK

SEQ ID NO: 557411 - protein, 9 aa, Homo Sapiens
KEKIMVVIK

SEQ ID NO: 557412 - protein, 9 aa, Homo Sapiens
GVRAGQWVR

SEQ ID NO: 557413 - protein, 9 aa, Homo Sapiens
VKEKIMVVI

SEQ ID NO: 557414 - protein, 9 aa, Homo Sapiens
RRHQTFPSF

SEQ ID NO: 557415 - protein, 9 aa, Homo Sapiens
ARASSQTLG

SEQ ID NO: 557416 - protein, 9 aa, Homo Sapiens
NTLFTRFAC

SEQ ID NO: 557417 - protein, 9 aa, Homo Sapiens
SLLTASAAT

SEQ ID NO: 557418 - protein, 9 aa, Homo Sapiens
KEELPGPST

SEQ ID NO: 557419 - protein, 9 aa, Homo Sapiens
TLSTIVAGS

SEQ ID NO: 557420 - protein, 9 aa, Homo Sapiens
PGAKDEEVP

SEQ ID NO: 557421 - protein, 9 aa, Homo Sapiens
ASLTTGTFA

SEQ ID NO: 557422 - protein, 9 aa, Homo Sapiens
CGKPVKYDP

SEQ ID NO: 557423 - protein, 9 aa, Homo Sapiens
QRDEDDEAC

SEQ ID NO: 557424 - protein, 9 aa, Homo Sapiens
GSSGSGRAR

SEQ ID NO: 557425 - protein, 9 aa, Homo Sapiens
VNVGVASMA

SEQ ID NO: 557426 - protein, 9 aa, Homo Sapiens
RPGSTRSTS

SEQ ID NO: 557427 - protein, 9 aa, Homo Sapiens
RESHHTSLT

SEQ ID NO: 557428 - protein, 9 aa, Homo Sapiens
SFLASRARG

SEQ ID NO: 557429 - protein, 9 aa, Homo Sapiens
ETSSTRGTS

SEQ ID NO: 557430 - protein, 9 aa, Homo Sapiens
VASMAISCC

SEQ ID NO: 557431 - protein, 9 aa, Homo Sapiens
RGTSAAAST

SEQ ID NO: 557432 - protein, 9 aa, Homo Sapiens
CETHIPFYN

SEQ ID NO: 557433 - protein, 9 aa, Homo Sapiens
STNITNGAR

SEQ ID NO: 557434 - protein, 9 aa, Homo Sapiens
QGSIHDFPG

SEQ ID NO: 557435 - protein, 9 aa, Homo Sapiens
FNGMLSLLS

SEQ ID NO: 557436 - protein, 9 aa, Homo Sapiens
TRFACFTWR

SEQ ID NO: 557437 - protein, 9 aa, Homo Sapiens
TRETSSTRG

SEQ ID NO: 557438 - protein, 9 aa, Homo Sapiens
EELSARTGL

SEQ ID NO: 557439 - protein, 9 aa, Homo Sapiens
SLASKTSCN

SEQ ID NO: 557440 - protein, 9 aa, Homo Sapiens
RFVAICCPL

SEQ ID NO: 557441 - protein, 9 aa, Homo Sapiens
TRLTTVSGG

SEQ ID NO: 557442 - protein, 9 aa, Homo Sapiens
SRALFTSLA

SEQ ID NO: 557443 - protein, 9 aa, Homo Sapiens
TLSSNTLRP

SEQ ID NO: 557444 - protein, 9 aa, Homo Sapiens
RQVIPAKCK

SEQ ID NO: 557445 - protein, 9 aa, Homo Sapiens
TTDAIFARR

SEQ ID NO: 557446 - protein, 9 aa, Homo Sapiens
DHTTLSSNT

SEQ ID NO: 557447 - protein, 9 aa, Homo Sapiens
LPYDNFITD

SEQ ID NO: 557448 - protein, 9 aa, Homo Sapiens
FGTSITSVT

SEQ ID NO: 557449 - protein, 9 aa, Homo Sapiens
IGDLAPARG

SEQ ID NO: 557450 - protein, 9 aa, Homo Sapiens
TSRARGSLS

SEQ ID NO: 557451 - protein, 9 aa, Homo Sapiens
QPATCPWQL

SEQ ID NO: 557452 - protein, 9 aa, Homo Sapiens
SSGFNGMLS

SEQ ID NO: 557453 - protein, 9 aa, Homo Sapiens
TRRARGSSI

SEQ ID NO: 557454 - protein, 9 aa, Homo Sapiens
RTISTRGSF

SEQ ID NO: 557455 - protein, 9 aa, Homo Sapiens
SITSVTLRP

SEQ ID NO: 557456 - protein, 9 aa, Homo Sapiens
LQQGQGVLE

SEQ ID NO: 557457 - protein, 9 aa, Homo Sapiens
YSGPGRSLK

SEQ ID NO: 557458 - protein, 9 aa, Homo Sapiens
HWTQDLLPV

SEQ ID NO: 557459 - protein, 9 aa, Homo Sapiens
FQPATCPWQ

SEQ ID NO: 557460 - protein, 9 aa, Homo Sapiens
LSSLAGLSS

SEQ ID NO: 557461 - protein, 9 aa, Homo Sapiens
ETTATRSTT

SEQ ID NO: 557462 - protein, 9 aa, Homo Sapiens
ARGALATGS

SEQ ID NO: 557463 - protein, 9 aa, Homo Sapiens
GPSTFDIYE

SEQ ID NO: 557464 - protein, 9 aa, Homo Sapiens
TFGSRSTNI

SEQ ID NO: 557465 - protein, 9 aa, Homo Sapiens
RGTRGTNFT

SEQ ID NO: 557466 - protein, 9 aa, Homo Sapiens
TSNTICARE

SEQ ID NO: 557467 - protein, 9 aa, Homo Sapiens
SSTSSPSTS

SEQ ID NO: 557468 - protein, 9 aa, Homo Sapiens
ASRARRTTF

SEQ ID NO: 557469 - protein, 9 aa, Homo Sapiens
HAACLLGKR

SEQ ID NO: 557470 - protein, 9 aa, Homo Sapiens
GGASRALFT

SEQ ID NO: 557471 - protein, 9 aa, Homo Sapiens
GAIAFHWLS

SEQ ID NO: 557472 - protein, 9 aa, Homo Sapiens
RVSSGFNGM

SEQ ID NO: 557473 - protein, 9 aa, Homo Sapiens
KRRHQTFPS

SEQ ID NO: 557474 - protein, 9 aa, Homo Sapiens
SITRFAFST

SEQ ID NO: 557475 - protein, 9 aa, Homo Sapiens
CARETTATR

SEQ ID NO: 557476 - protein, 9 aa, Homo Sapiens
HSAPITVHH

SEQ ID NO: 557477 - protein, 9 aa, Homo Sapiens
RQGVRAGQW

SEQ ID NO: 557478 - protein, 9 aa, Homo Sapiens
SLLVLLCGR

SEQ ID NO: 557479 - protein, 9 aa, Homo Sapiens
TRQTSFTGT

SEQ ID NO: 557480 - protein, 9 aa, Homo Sapiens
RRAISTFGT

SEQ ID NO: 557481 - protein, 9 aa, Homo Sapiens
GSSISRGAR

SEQ ID NO: 557482 - protein, 9 aa, Homo Sapiens
VLFFDDSSN

SEQ ID NO: 557483 - protein, 9 aa, Homo Sapiens
PARGYSGPG

SEQ ID NO: 557484 - protein, 9 aa, Homo Sapiens
RQADHTTLS

SEQ ID NO: 557485 - protein, 9 aa, Homo Sapiens
RASSQTLGT

SEQ ID NO: 557486 - protein, 9 aa, Homo Sapiens
GPSGTSRTR

SEQ ID NO: 557487 - protein, 9 aa, Homo Sapiens
RHSLKARGA

SEQ ID NO: 557488 - protein, 9 aa, Homo Sapiens
TNFTRTSSR

SEQ ID NO: 557489 - protein, 9 aa, Homo Sapiens
PATCPWQLP

SEQ ID NO: 557490 - protein, 9 aa, Homo Sapiens
CPEHSAPIT

SEQ ID NO: 557491 - protein, 9 aa, Homo Sapiens
FTRFACFTW

SEQ ID NO: 557492 - protein, 9 aa, Homo Sapiens
SQTTDAIFA

SEQ ID NO: 557493 - protein, 9 aa, Homo Sapiens
SIAFSTSIT

SEQ ID NO: 557494 - protein, 9 aa, Homo Sapiens
FTRGARKTR

SEQ ID NO: 557495 - protein, 9 aa, Homo Sapiens
LLGKLLCLQ

SEQ ID NO: 557496 - protein, 9 aa, Homo Sapiens
MSPEGPPSR

SEQ ID NO: 557497 - protein, 9 aa, Homo Sapiens
GTSITLSTI

SEQ ID NO: 557498 - protein, 9 aa, Homo Sapiens
TRAARASSQ

SEQ ID NO: 557499 - protein, 9 aa, Homo Sapiens
ICARETTAT

SEQ ID NO: 557500 - protein, 9 aa, Homo Sapiens
SRAGGTRLT

SEQ ID NO: 557501 - protein, 9 aa, Homo Sapiens
RRTTFTSGT

SEQ ID NO: 557502 - protein, 9 aa, Homo Sapiens
CNIVGQTLG

SEQ ID NO: 557503 - protein, 9 aa, Homo Sapiens
ASRARGTRG

SEQ ID NO: 557504 - protein, 9 aa, Homo Sapiens
VTRGTSRAR

SEQ ID NO: 557505 - protein, 9 aa, Homo Sapiens
HLELLAFLP

SEQ ID NO: 557506 - protein, 9 aa, Homo Sapiens
ADHTTLSSN

SEQ ID NO: 557507 - protein, 9 aa, Homo Sapiens
LGTRQTSFT

SEQ ID NO: 557508 - protein, 9 aa, Homo Sapiens
TSITRFAFS

SEQ ID NO: 557509 - protein, 9 aa, Homo Sapiens
SRASLTTGT

SEQ ID NO: 557510 - protein, 9 aa, Homo Sapiens
YLLPKSHTV

SEQ ID NO: 557511 - protein, 9 aa, Homo Sapiens
GTSITSVTL

SEQ ID NO: 557512 - protein, 9 aa, Homo Sapiens
ASRTDSARG

SEQ ID NO: 557513 - protein, 9 aa, Homo Sapiens
RQPHFRLPK

SEQ ID NO: 557514 - protein, 9 aa, Homo Sapiens
HIKKSKALS

SEQ ID NO: 557515 - protein, 9 aa, Homo Sapiens
PPLHYLLPP

SEQ ID NO: 557516 - protein, 9 aa, Homo Sapiens
ELPGPSTFD

SEQ ID NO: 557517 - protein, 9 aa, Homo Sapiens
ARGSLSSSL

SEQ ID NO: 557518 - protein, 9 aa, Homo Sapiens
LTTVSGGTT

SEQ ID NO: 557519 - protein, 9 aa, Homo Sapiens
RGSGNTSLS

SEQ ID NO: 557520 - protein, 9 aa, Homo Sapiens
GSTRSTSRT

SEQ ID NO: 557521 - protein, 9 aa, Homo Sapiens
NFTRTSSRA

SEQ ID NO: 557522 - protein, 9 aa, Homo Sapiens
KPAQGAKYQ

SEQ ID NO: 557523 - protein, 9 aa, Homo Sapiens
LASGTSRAR

SEQ ID NO: 557524 - protein, 9 aa, Homo Sapiens
GSFLASRAR

SEQ ID NO: 557525 - protein, 9 aa, Homo Sapiens
RGAKVSRNT

SEQ ID NO: 557526 - protein, 9 aa, Homo Sapiens
ICCPLLYST

SEQ ID NO: 557527 - protein, 9 aa, Homo Sapiens
ELLAFLPLQ

SEQ ID NO: 557528 - protein, 9 aa, Homo Sapiens
KFKRRHQTF

SEQ ID NO: 557529 - protein, 9 aa, Homo Sapiens
VIPAKCKVY

SEQ ID NO: 557530 - protein, 9 aa, Homo Sapiens
SRAAGTTFT

SEQ ID NO: 557531 - protein, 9 aa, Homo Sapiens
PGPSTFDIY

SEQ ID NO: 557532 - protein, 9 aa, Homo Sapiens
SLTRQADHT

SEQ ID NO: 557533 - protein, 9 aa, Homo Sapiens
AICCPLLYS

SEQ ID NO: 557534 - protein, 9 aa, Homo Sapiens
SASSTRETS

SEQ ID NO: 557535 - protein, 9 aa, Homo Sapiens
DALWNKVTE

SEQ ID NO: 557536 - protein, 9 aa, Homo Sapiens
ASFAIRTRA

SEQ ID NO: 557537 - protein, 9 aa, Homo Sapiens
RGSSGSGRA

SEQ ID NO: 557538 - protein, 9 aa, Homo Sapiens
FLPLQQGQG

SEQ ID NO: 557539 - protein, 9 aa, Homo Sapiens
FLWPHLGPP

SEQ ID NO: 557540 - protein, 9 aa, Homo Sapiens
PSTKFSTFN

SEQ ID NO: 557541 - protein, 9 aa, Homo Sapiens
NVGVASMAI

SEQ ID NO: 557542 - protein, 9 aa, Homo Sapiens
TLARETSLA

SEQ ID NO: 557543 - protein, 9 aa, Homo Sapiens
FFASRTRRA

SEQ ID NO: 557544 - protein, 9 aa, Homo Sapiens
TTATRSTTR

SEQ ID NO: 557545 - protein, 9 aa, Homo Sapiens
FVAICCPLL

SEQ ID NO: 557546 - protein, 9 aa, Homo Sapiens
YYQACLLSL

SEQ ID NO: 557547 - protein, 9 aa, Homo Sapiens
VGCWPGAKD

SEQ ID NO: 557548 - protein, 9 aa, Homo Sapiens
YRSRDSSFR

SEQ ID NO: 557549 - protein, 9 aa, Homo Sapiens
SLAGLSSST

SEQ ID NO: 557550 - protein, 9 aa, Homo Sapiens
GTNFTRTSS

SEQ ID NO: 557551 - protein, 9 aa, Homo Sapiens
LRLSLASKT

SEQ ID NO: 557552 - protein, 9 aa, Homo Sapiens
QTFPSFFKM

SEQ ID NO: 557553 - protein, 9 aa, Homo Sapiens
RARGTSIAF

SEQ ID NO: 557554 - protein, 9 aa, Homo Sapiens
SLASCSRGA

SEQ ID NO: 557555 - protein, 9 aa, Homo Sapiens
SCEDPGAIA

SEQ ID NO: 557556 - protein, 9 aa, Homo Sapiens
QTTDAIFAR

SEQ ID NO: 557557 - protein, 9 aa, Homo Sapiens
AFLPLQQGQ

SEQ ID NO: 557558 - protein, 9 aa, Homo Sapiens
STKFSTFND

SEQ ID NO: 557559 - protein, 9 aa, Homo Sapiens
LPGKTPVYT

SEQ ID NO: 557560 - protein, 9 aa, Homo Sapiens
QGQGVLEHQ

SEQ ID NO: 557561 - protein, 9 aa, Homo Sapiens
RARRTNGAS

SEQ ID NO: 557562 - protein, 9 aa, Homo Sapiens
ATRSTTRQG

SEQ ID NO: 557563 - protein, 9 aa, Homo Sapiens
LVLLCGRAM

SEQ ID NO: 557564 - protein, 9 aa, Homo Sapiens
WKTSCTTFT

SEQ ID NO: 557565 - protein, 9 aa, Homo Sapiens
GTFAAFFAS

SEQ ID NO: 557566 - protein, 9 aa, Homo Sapiens
RSRESHHTS

SEQ ID NO: 557567 - protein, 9 aa, Homo Sapiens
TILTGGTRG

SEQ ID NO: 557568 - protein, 9 aa, Homo Sapiens
LLPVRRQQT

SEQ ID NO: 557569 - protein, 9 aa, Homo Sapiens
RCHRQPHFR

SEQ ID NO: 557570 - protein, 9 aa, Homo Sapiens
ILTGGTRGA

SEQ ID NO: 557571 - protein, 9 aa, Homo Sapiens
SSGTSRAAG

SEQ ID NO: 557572 - protein, 9 aa, Homo Sapiens
SRARGTRGT

SEQ ID NO: 557573 - protein, 9 aa, Homo Sapiens
GATVDTDIT

SEQ ID NO: 557574 - protein, 9 aa, Homo Sapiens
QQGQGVLEH

SEQ ID NO: 557575 - protein, 9 aa, Homo Sapiens
KGTSESLKS

SEQ ID NO: 557576 - protein, 9 aa, Homo Sapiens
SVPVSYLNA

SEQ ID NO: 557577 - protein, 9 aa, Homo Sapiens
SRARRTTFT

SEQ ID NO: 557578 - protein, 9 aa, Homo Sapiens
ALATGSSRG

SEQ ID NO: 557579 - protein, 9 aa, Homo Sapiens
SRNKYLLKY

SEQ ID NO: 557580 - protein, 9 aa, Homo Sapiens
IFASRTDSA

SEQ ID NO: 557581 - protein, 9 aa, Homo Sapiens
SCTTFTRHS

SEQ ID NO: 557582 - protein, 9 aa, Homo Sapiens
SRARRTNGA

SEQ ID NO: 557583 - protein, 9 aa, Homo Sapiens
RARGTRGTN

SEQ ID NO: 557584 - protein, 9 aa, Homo Sapiens
LKSVKRKKI

SEQ ID NO: 557585 - protein, 9 aa, Homo Sapiens
SSGSGRARG

SEQ ID NO: 557586 - protein, 9 aa, Homo Sapiens
SNCLCIRGF

SEQ ID NO: 557587 - protein, 9 aa, Homo Sapiens
LLKYLKDRM

SEQ ID NO: 557588 - protein, 9 aa, Homo Sapiens
LESLVMGLQ

SEQ ID NO: 557589 - protein, 9 aa, Homo Sapiens
ALFTSLASG

SEQ ID NO: 557590 - protein, 9 aa, Homo Sapiens
LNAISVLFF

SEQ ID NO: 557591 - protein, 9 aa, Homo Sapiens
NCLCIRGFA

SEQ ID NO: 557592 - protein, 9 aa, Homo Sapiens
QGAKYQGSI

SEQ ID NO: 557593 - protein, 9 aa, Homo Sapiens
GVASMAISC

SEQ ID NO: 557594 - protein, 9 aa, Homo Sapiens
PWKTSCTTF

SEQ ID NO: 557595 - protein, 9 aa, Homo Sapiens
STFRSRESH

SEQ ID NO: 557596 - protein, 9 aa, Homo Sapiens
EELPGPSTF

SEQ ID NO: 557597 - protein, 9 aa, Homo Sapiens
LLSSVGCWP

SEQ ID NO: 557598 - protein, 9 aa, Homo Sapiens
NFEFCETHI

SEQ ID NO: 557599 - protein, 9 aa, Homo Sapiens
GLSSSTFRS

SEQ ID NO: 557600 - protein, 9 aa, Homo Sapiens
VLLCGRAMF

SEQ ID NO: 557601 - protein, 8 aa, Homo Sapiens
EAGQRDYD

SEQ ID NO: 557602 - protein, 9 aa, Homo Sapiens
STFGTSITS

SEQ ID NO: 557603 - protein, 9 aa, Homo Sapiens
KTPFNTDLE

SEQ ID NO: 557604 - protein, 9 aa, Homo Sapiens
STRGASKAS

SEQ ID NO: 557605 - protein, 9 aa, Homo Sapiens
FLPYDNFIT

SEQ ID NO: 557606 - protein, 9 aa, Homo Sapiens
PKAPQKVNA

SEQ ID NO: 557607 - protein, 9 aa, Homo Sapiens
TSSRASLTT

SEQ ID NO: 557608 - protein, 9 aa, Homo Sapiens
LSSVGCWPG

SEQ ID NO: 557609 - protein, 9 aa, Homo Sapiens
STHIKKSKA

SEQ ID NO: 557610 - protein, 9 aa, Homo Sapiens
FCETHIPFY

SEQ ID NO: 557611 - protein, 9 aa, Homo Sapiens
ARGTSIAFS

SEQ ID NO: 557612 - protein, 9 aa, Homo Sapiens
HWLSLGEAI

SEQ ID NO: 557613 - protein, 9 aa, Homo Sapiens
ETSLASCSR

SEQ ID NO: 557614 - protein, 9 aa, Homo Sapiens
RSLKSPSPS

SEQ ID NO: 557615 - protein, 9 aa, Homo Sapiens
LDGSTGPTG

SEQ ID NO: 557616 - protein, 9 aa, Homo Sapiens
EENSGIGKL

SEQ ID NO: 557617 - protein, 9 aa, Homo Sapiens
APARGYSGP

SEQ ID NO: 557618 - protein, 9 aa, Homo Sapiens
SGATILTGG

SEQ ID NO: 557619 - protein, 9 aa, Homo Sapiens
VAICCPLLY

SEQ ID NO: 557620 - protein, 9 aa, Homo Sapiens
HAIDEEGKD

SEQ ID NO: 557621 - protein, 9 aa, Homo Sapiens
CSRGARGAK

SEQ ID NO: 557622 - protein, 9 aa, Homo Sapiens
GFNGMLSLL

SEQ ID NO: 557623 - protein, 9 aa, Homo Sapiens
EGPPSRWAR

SEQ ID NO: 557624 - protein, 9 aa, Homo Sapiens
SRGARRTDS

SEQ ID NO: 557625 - protein, 9 aa, Homo Sapiens
SSSTSSPST

SEQ ID NO: 557626 - protein, 9 aa, Homo Sapiens
KVNAAIASI

SEQ ID NO: 557627 - protein, 9 aa, Homo Sapiens
QTSFTGTTS

SEQ ID NO: 557628 - protein, 9 aa, Homo Sapiens
GDLAPARGY

SEQ ID NO: 557629 - protein, 9 aa, Homo Sapiens
PQKVNAAIA

SEQ ID NO: 557630 - protein, 9 aa, Homo Sapiens
QKVNAAIAS

SEQ ID NO: 557631 - protein, 9 aa, Homo Sapiens
RSGNIPAGA

SEQ ID NO: 557632 - protein, 9 aa, Homo Sapiens
QLDPSNCLC

SEQ ID NO: 557633 - protein, 9 aa, Homo Sapiens
WPGAKDEEV

SEQ ID NO: 557634 - protein, 9 aa, Homo Sapiens
SRARGSLSS

SEQ ID NO: 557635 - protein, 9 aa, Homo Sapiens
ARGAKVSRN

SEQ ID NO: 557636 - protein, 9 aa, Homo Sapiens
SRFLPYDNF

SEQ ID NO: 557637 - protein, 9 aa, Homo Sapiens
LAGLSSSTF

SEQ ID NO: 557638 - protein, 9 aa, Homo Sapiens
TVHHNQTGK

SEQ ID NO: 557639 - protein, 9 aa, Homo Sapiens
YTEVKRVGD

SEQ ID NO: 557640 - protein, 9 aa, Homo Sapiens
LCIRGFADA

SEQ ID NO: 557641 - protein, 9 aa, Homo Sapiens
FTGTTSFTR

SEQ ID NO: 557642 - protein, 9 aa, Homo Sapiens
SSRGTSITL

SEQ ID NO: 557643 - protein, 9 aa, Homo Sapiens
QTLGTRQTS

SEQ ID NO: 557644 - protein, 9 aa, Homo Sapiens
GTSAAASTF

SEQ ID NO: 557645 - protein, 9 aa, Homo Sapiens
ITLSTIVAG

SEQ ID NO: 557646 - protein, 9 aa, Homo Sapiens
ESGGASRAL

SEQ ID NO: 557647 - protein, 9 aa, Homo Sapiens
TLESGGASR

SEQ ID NO: 557648 - protein, 9 aa, Homo Sapiens
SLKSPSPSK

SEQ ID NO: 557649 - protein, 9 aa, Homo Sapiens
SGLPSTHIK

SEQ ID NO: 557650 - protein, 9 aa, Homo Sapiens
RTRAARASS

SEQ ID NO: 557651 - protein, 9 aa, Homo Sapiens
SSLNDTYRS

SEQ ID NO: 557652 - protein, 9 aa, Homo Sapiens
RARGSLSSS

SEQ ID NO: 557653 - protein, 9 aa, Homo Sapiens
NAISVLFFD

SEQ ID NO: 557654 - protein, 9 aa, Homo Sapiens
ARETSLASC

SEQ ID NO: 557655 - protein, 9 aa, Homo Sapiens
PSPSKSLLV

SEQ ID NO: 557656 - protein, 9 aa, Homo Sapiens
TTLARETSL

SEQ ID NO: 557657 - protein, 9 aa, Homo Sapiens
NYQSLRLSL

SEQ ID NO: 557658 - protein, 9 aa, Homo Sapiens
GTSRARRTN

SEQ ID NO: 557659 - protein, 9 aa, Homo Sapiens
FSVPVSYLN

SEQ ID NO: 557660 - protein, 9 aa, Homo Sapiens
APQKVNAAI

SEQ ID NO: 557661 - protein, 9 aa, Homo Sapiens
CLCIRGFAD

SEQ ID NO: 557662 - protein, 9 aa, Homo Sapiens
LPGPSTFDI

SEQ ID NO: 557663 - protein, 9 aa, Homo Sapiens
RARRTTFTS

SEQ ID NO: 557664 - protein, 9 aa, Homo Sapiens
TTFTSGTLG

SEQ ID NO: 557665 - protein, 9 aa, Homo Sapiens
AIGDLAPAR

SEQ ID NO: 557666 - protein, 9 aa, Homo Sapiens
ELSARTGLE

SEQ ID NO: 557667 - protein, 9 aa, Homo Sapiens
DEDDEACGK

SEQ ID NO: 557668 - protein, 9 aa, Homo Sapiens
RTNGASQTT

SEQ ID NO: 557669 - protein, 9 aa, Homo Sapiens
NAAIASIPV

SEQ ID NO: 557670 - protein, 9 aa, Homo Sapiens
SSNTLRPGS

SEQ ID NO: 557671 - protein, 9 aa, Homo Sapiens
TTGTRWAWG

SEQ ID NO: 557672 - protein, 9 aa, Homo Sapiens
ETHIPFYNR

SEQ ID NO: 557673 - protein, 9 aa, Homo Sapiens
TSSSGTSRA

SEQ ID NO: 557674 - protein, 9 aa, Homo Sapiens
KIMVVIKEW

SEQ ID NO: 557675 - protein, 9 aa, Homo Sapiens
LAPARGYSG

SEQ ID NO: 557676 - protein, 9 aa, Homo Sapiens
TRGTLHTTL

SEQ ID NO: 557677 - protein, 9 aa, Homo Sapiens
FTRTSSRAS

SEQ ID NO: 557678 - protein, 9 aa, Homo Sapiens
AIDEEGKDP

SEQ ID NO: 557679 - protein, 9 aa, Homo Sapiens
SLSIFASRT

SEQ ID NO: 557680 - protein, 9 aa, Homo Sapiens
WGSGATILT

SEQ ID NO: 557681 - protein, 9 aa, Homo Sapiens
FLASRARGT

SEQ ID NO: 557682 - protein, 9 aa, Homo Sapiens
DDEACGKPV

SEQ ID NO: 557683 - protein, 9 aa, Homo Sapiens
SGNIPAGAT

SEQ ID NO: 557684 - protein, 9 aa, Homo Sapiens
GKLLCLQLS

SEQ ID NO: 557685 - protein, 9 aa, Homo Sapiens
KTSCTTFTR

SEQ ID NO: 557686 - protein, 9 aa, Homo Sapiens
ITRFAFSTR

SEQ ID NO: 557687 - protein, 9 aa, Homo Sapiens
PFKYPPSTK

SEQ ID NO: 557688 - protein, 9 aa, Homo Sapiens
GLPSTHIKK

SEQ ID NO: 557689 - protein, 9 aa, Homo Sapiens
RTRGTLHTT

SEQ ID NO: 557690 - protein, 9 aa, Homo Sapiens
SPEGPPSRW

SEQ ID NO: 557691 - protein, 9 aa, Homo Sapiens
KLHHAACLL

SEQ ID NO: 557692 - protein, 9 aa, Homo Sapiens
RWAWGSGAT

SEQ ID NO: 557693 - protein, 9 aa, Homo Sapiens
RRTNGASQT

SEQ ID NO: 557694 - protein, 9 aa, Homo Sapiens
HTTLSSNTL

SEQ ID NO: 557695 - protein, 9 aa, Homo Sapiens
LSTIVAGST

SEQ ID NO: 557696 - protein, 9 aa, Homo Sapiens
FAIRTRAAR

SEQ ID NO: 557697 - protein, 9 aa, Homo Sapiens
FASRTRRAR

SEQ ID NO: 557698 - protein, 9 aa, Homo Sapiens
TRFAFSTRL

SEQ ID NO: 557699 - protein, 9 aa, Homo Sapiens
KLNAISVLF

SEQ ID NO: 557700 - protein, 9 aa, Homo Sapiens
STIVAGSTV

SEQ ID NO: 557701 - protein, 9 aa, Homo Sapiens
DSASSTRET

SEQ ID NO: 557702 - protein, 9 aa, Homo Sapiens
GTRGTNFTR

SEQ ID NO: 557703 - protein, 9 aa, Homo Sapiens
TVSGGTTSS

SEQ ID NO: 557704 - protein, 9 aa, Homo Sapiens
PSTFDIYEF

SEQ ID NO: 557705 - protein, 9 aa, Homo Sapiens
LEHQQGQAL

SEQ ID NO: 557706 - protein, 9 aa, Homo Sapiens
RTGLEGESD

SEQ ID NO: 557707 - protein, 9 aa, Homo Sapiens
TTSSSGTSR

SEQ ID NO: 557708 - protein, 9 aa, Homo Sapiens
SRESHHTSL

SEQ ID NO: 557709 - protein, 9 aa, Homo Sapiens
KTREASLSS

SEQ ID NO: 557710 - protein, 9 aa, Homo Sapiens
VMGSLLGKL

SEQ ID NO: 557711 - protein, 9 aa, Homo Sapiens
VLYLLPKSH

SEQ ID NO: 557712 - protein, 9 aa, Homo Sapiens
TSITLSTIV

SEQ ID NO: 557713 - protein, 9 aa, Homo Sapiens
NITNGARGS

SEQ ID NO: 557714 - protein, 9 aa, Homo Sapiens
AGSTVGPSG

SEQ ID NO: 557715 - protein, 9 aa, Homo Sapiens
SESGLPSTH

SEQ ID NO: 557716 - protein, 9 aa, Homo Sapiens
TSLASGTSR

SEQ ID NO: 557717 - protein, 9 aa, Homo Sapiens
PKHSRSRSM

SEQ ID NO: 557718 - protein, 9 aa, Homo Sapiens
LTRQADHTT

SEQ ID NO: 557719 - protein, 9 aa, Homo Sapiens
AKYQGSIHD

SEQ ID NO: 557720 - protein, 9 aa, Homo Sapiens
ARGTRGTNF

SEQ ID NO: 557721 - protein, 9 aa, Homo Sapiens
SLGEAIGDL

SEQ ID NO: 557722 - protein, 9 aa, Homo Sapiens
VTLRPWKTS

SEQ ID NO: 557723 - protein, 9 aa, Homo Sapiens
TVGPSGTSR

SEQ ID NO: 557724 - protein, 9 aa, Homo Sapiens
TDAIFARRA

SEQ ID NO: 557725 - protein, 9 aa, Homo Sapiens
KTPVYTEVK

SEQ ID NO: 557726 - protein, 9 aa, Homo Sapiens
TDLEENSGI

SEQ ID NO: 557727 - protein, 9 aa, Homo Sapiens
PITVHHNQT

SEQ ID NO: 557728 - protein, 9 aa, Homo Sapiens
TTGTFAAFF

SEQ ID NO: 557729 - protein, 9 aa, Homo Sapiens
AQEVCNIVG

SEQ ID NO: 557730 - protein, 9 aa, Homo Sapiens
QDLLPVRRQ

SEQ ID NO: 557731 - protein, 9 aa, Homo Sapiens
STSSPSTSS

SEQ ID NO: 557732 - protein, 9 aa, Homo Sapiens
RETLESGGA

SEQ ID NO: 557733 - protein, 9 aa, Homo Sapiens
SGGASRALF

SEQ ID NO: 557734 - protein, 9 aa, Homo Sapiens
ATGSSRGTS

SEQ ID NO: 557735 - protein, 9 aa, Homo Sapiens
IPAKCKVYD

SEQ ID NO: 557736 - protein, 9 aa, Homo Sapiens
SRTRGTLHT

SEQ ID NO: 557737 - protein, 9 aa, Homo Sapiens
AGQWVRVHL

SEQ ID NO: 557738 - protein, 9 aa, Homo Sapiens
EDPGAIAFH

SEQ ID NO: 557739 - protein, 9 aa, Homo Sapiens
IVGQTLGKP

SEQ ID NO: 557740 - protein, 9 aa, Homo Sapiens
SPKAPQKVN

SEQ ID NO: 557741 - protein, 9 aa, Homo Sapiens
YQACLLSLR

SEQ ID NO: 557742 - protein, 9 aa, Homo Sapiens
GSGATILTG

SEQ ID NO: 557743 - protein, 9 aa, Homo Sapiens
LKARGALAT

SEQ ID NO: 557744 - protein, 9 aa, Homo Sapiens
TLSYYQACL

SEQ ID NO: 557745 - protein, 9 aa, Homo Sapiens
ARRTNGASQ

SEQ ID NO: 557746 - protein, 9 aa, Homo Sapiens
FAFSTRLAV

SEQ ID NO: 557747 - protein, 9 aa, Homo Sapiens
WPHLGPPPL

SEQ ID NO: 557748 - protein, 9 aa, Homo Sapiens
ARGSSISRG

SEQ ID NO: 557749 - protein, 9 aa, Homo Sapiens
ANQHAIDEE

SEQ ID NO: 557750 - protein, 9 aa, Homo Sapiens
TRGASFAIR

SEQ ID NO: 557751 - protein, 9 aa, Homo Sapiens
TSRAAGTTF

SEQ ID NO: 557752 - protein, 9 aa, Homo Sapiens
TLGTRQTSF

SEQ ID NO: 557753 - protein, 9 aa, Homo Sapiens
PLRCLQICV

SEQ ID NO: 557754 - protein, 9 aa, Homo Sapiens
EFCETHIPF

SEQ ID NO: 557755 - protein, 9 aa, Homo Sapiens
SGSGRARGT

SEQ ID NO: 557756 - protein, 9 aa, Homo Sapiens
EACGKPVKY

SEQ ID NO: 557757 - protein, 9 aa, Homo Sapiens
SFTRRSFGA

SEQ ID NO: 557758 - protein, 9 aa, Homo Sapiens
RVLYLLPKS

SEQ ID NO: 557759 - protein, 9 aa, Homo Sapiens
LSLLTASAA

SEQ ID NO: 557760 - protein, 9 aa, Homo Sapiens
RKAQEVCNI

SEQ ID NO: 557761 - protein, 9 aa, Homo Sapiens
LSSSLSIFA

SEQ ID NO: 557762 - protein, 9 aa, Homo Sapiens
LESGGASRA

SEQ ID NO: 557763 - protein, 9 aa, Homo Sapiens
SRTDSARGS

SEQ ID NO: 557764 - protein, 9 aa, Homo Sapiens
AIRTRAARA

SEQ ID NO: 557765 - protein, 9 aa, Homo Sapiens
LATGSSRGT

SEQ ID NO: 557766 - protein, 9 aa, Homo Sapiens
KSLLVLLCG

SEQ ID NO: 557767 - protein, 9 aa, Homo Sapiens
GLQGVLSES

SEQ ID NO: 557768 - protein, 9 aa, Homo Sapiens
WLSLGEAIG

SEQ ID NO: 557769 - protein, 9 aa, Homo Sapiens
GARKTREAS

SEQ ID NO: 557770 - protein, 9 aa, Homo Sapiens
SYYQACLLS

SEQ ID NO: 557771 - protein, 9 aa, Homo Sapiens
GSRSTNITN

SEQ ID NO: 557772 - protein, 9 aa, Homo Sapiens
ESLVMGLQG

SEQ ID NO: 557773 - protein, 9 aa, Homo Sapiens
LNASSLDSL

SEQ ID NO: 557774 - protein, 9 aa, Homo Sapiens
PSTHIKKSK

SEQ ID NO: 557775 - protein, 9 aa, Homo Sapiens
FSTSITRFA

SEQ ID NO: 557776 - protein, 9 aa, Homo Sapiens
HTTLARETS

SEQ ID NO: 557777 - protein, 9 aa, Homo Sapiens
FKRRHQTFP

SEQ ID NO: 557778 - protein, 9 aa, Homo Sapiens
PAGATVDTD

SEQ ID NO: 557779 - protein, 9 aa, Homo Sapiens
TLFTRFACF

SEQ ID NO: 557780 - protein, 9 aa, Homo Sapiens
SNTICARET

SEQ ID NO: 557781 - protein, 9 aa, Homo Sapiens
STRETSSTR

SEQ ID NO: 557782 - protein, 9 aa, Homo Sapiens
TTSSGPPST

SEQ ID NO: 557783 - protein, 9 aa, Homo Sapiens
HSRSRSMEK

SEQ ID NO: 557784 - protein, 9 aa, Homo Sapiens
TNGASQTTD

SEQ ID NO: 557785 - protein, 9 aa, Homo Sapiens
TTSFTRRSF

SEQ ID NO: 557786 - protein, 9 aa, Homo Sapiens
TSSPSTSSP

SEQ ID NO: 557787 - protein, 9 aa, Homo Sapiens
GFFLFGILF

SEQ ID NO: 557788 - protein, 9 aa, Homo Sapiens
MEKSQRSGK

SEQ ID NO: 557789 - protein, 9 aa, Homo Sapiens
LEENSGIGK

SEQ ID NO: 557790 - protein, 9 aa, Homo Sapiens
SSRASLTTG

SEQ ID NO: 557791 - protein, 9 aa, Homo Sapiens
KYQGSIHDF

SEQ ID NO: 557792 - protein, 9 aa, Homo Sapiens
CWPGAKDEE

SEQ ID NO: 557793 - protein, 9 aa, Homo Sapiens
LQGVLSESK

SEQ ID NO: 557794 - protein, 9 aa, Homo Sapiens
LARETSLAS

SEQ ID NO: 557795 - protein, 9 aa, Homo Sapiens
KHSRSRSME

SEQ ID NO: 557796 - protein, 9 aa, Homo Sapiens
VSSGFNGML

SEQ ID NO: 557797 - protein, 9 aa, Homo Sapiens
FTWRTSRTR

SEQ ID NO: 557798 - protein, 9 aa, Homo Sapiens
EKMREQEKM

SEQ ID NO: 557799 - protein, 9 aa, Homo Sapiens
RAGQWVRVH

SEQ ID NO: 557800 - protein, 9 aa, Homo Sapiens
GANQHAIDE

SEQ ID NO: 557801 - protein, 9 aa, Homo Sapiens
VSGGTTSSS

SEQ ID NO: 557802 - protein, 9 aa, Homo Sapiens
REQEKMRGQ

SEQ ID NO: 557803 - protein, 9 aa, Homo Sapiens
TLVTRGTSR

SEQ ID NO: 557804 - protein, 9 aa, Homo Sapiens
KRCHRQPHF

SEQ ID NO: 557805 - protein, 9 aa, Homo Sapiens
DEACGKPVK

SEQ ID NO: 557806 - protein, 9 aa, Homo Sapiens
GKTPVYTEV

SEQ ID NO: 557807 - protein, 9 aa, Homo Sapiens
GRAMFQPAT

SEQ ID NO: 557808 - protein, 9 aa, Homo Sapiens
LSSNTLRPG

SEQ ID NO: 557809 - protein, 9 aa, Homo Sapiens
TTVSGGTTS

SEQ ID NO: 557810 - protein, 9 aa, Homo Sapiens
QPHFRLPKE

SEQ ID NO: 557811 - protein, 9 aa, Homo Sapiens
NIPAGATVD

SEQ ID NO: 557812 - protein, 9 aa, Homo Sapiens
HSLKARGAL

SEQ ID NO: 557813 - protein, 9 aa, Homo Sapiens
ENDNASEIT

SEQ ID NO: 557814 - protein, 9 aa, Homo Sapiens
ASRALFTSL

SEQ ID NO: 557815 - protein, 9 aa, Homo Sapiens
VLSLLTASA

SEQ ID NO: 557816 - protein, 9 aa, Homo Sapiens
GASKASRAG

SEQ ID NO: 557817 - protein, 9 aa, Homo Sapiens
TPFNTDLEE

SEQ ID NO: 557818 - protein, 9 aa, Homo Sapiens
RTTFTSGTL

SEQ ID NO: 557819 - protein, 9 aa, Homo Sapiens
SSQTLGTRQ

SEQ ID NO: 557820 - protein, 9 aa, Homo Sapiens
SDENDNASE

SEQ ID NO: 557821 - protein, 9 aa, Homo Sapiens
RLAVSTRGA

SEQ ID NO: 557822 - protein, 9 aa, Homo Sapiens
ASMAISCCQ

SEQ ID NO: 557823 - protein, 9 aa, Homo Sapiens
APITVHHNQ

SEQ ID NO: 557824 - protein, 9 aa, Homo Sapiens
PVKEKIMVV

SEQ ID NO: 557825 - protein, 9 aa, Homo Sapiens
EEKMREQEK

SEQ ID NO: 557826 - protein, 9 aa, Homo Sapiens
SLLGKLLCL

SEQ ID NO: 557827 - protein, 9 aa, Homo Sapiens
NGARGSSGS

SEQ ID NO: 557828 - protein, 9 aa, Homo Sapiens
MPTPTTSSG

SEQ ID NO: 557829 - protein, 9 aa, Homo Sapiens
LTTDALWNK

SEQ ID NO: 557830 - protein, 9 aa, Homo Sapiens
ARGYSGPGR

SEQ ID NO: 557831 - protein, 9 aa, Homo Sapiens
GTRGASFAI

SEQ ID NO: 557832 - protein, 9 aa, Homo Sapiens
STRGTSAAA

SEQ ID NO: 557833 - protein, 9 aa, Homo Sapiens
KLHWTQDLL

SEQ ID NO: 557834 - protein, 9 aa, Homo Sapiens
RGARRTDSA

SEQ ID NO: 557835 - protein, 9 aa, Homo Sapiens
SSTFRSRES

SEQ ID NO: 557836 - protein, 9 aa, Homo Sapiens
ITVHHNQTG

SEQ ID NO: 557837 - protein, 9 aa, Homo Sapiens
TRWAWGSGA

SEQ ID NO: 557838 - protein, 9 aa, Homo Sapiens
GGTTSSSGT

SEQ ID NO: 557839 - protein, 9 aa, Homo Sapiens
TRGTSRARR

SEQ ID NO: 557840 - protein, 9 aa, Homo Sapiens
LSSSTFRSR

SEQ ID NO: 557841 - protein, 9 aa, Homo Sapiens
SGPGRSLKS

SEQ ID NO: 557842 - protein, 9 aa, Homo Sapiens
VSTRGASKA

SEQ ID NO: 557843 - protein, 9 aa, Homo Sapiens
SPSTSSPSS

SEQ ID NO: 557844 - protein, 9 aa, Homo Sapiens
TSITSVTLR

SEQ ID NO: 557845 - protein, 9 aa, Homo Sapiens
LFTRFACFT

SEQ ID NO: 557846 - protein, 9 aa, Homo Sapiens
AKVSRNTLF

SEQ ID NO: 557847 - protein, 9 aa, Homo Sapiens
ASEITLASE

SEQ ID NO: 557848 - protein, 9 aa, Homo Sapiens
TLHTTLARE

SEQ ID NO: 557849 - protein, 9 aa, Homo Sapiens
YLNASSLDS

SEQ ID NO: 557850 - protein, 9 aa, Homo Sapiens
VRAGQWVRV

SEQ ID NO: 557851 - protein, 9 aa, Homo Sapiens
TSSTRGTSA

SEQ ID NO: 557852 - protein, 9 aa, Homo Sapiens
RGTSIAFST

SEQ ID NO: 557853 - protein, 9 aa, Homo Sapiens
LSSLTRQAD

SEQ ID NO: 557854 - protein, 9 aa, Homo Sapiens
RSTNITNGA

SEQ ID NO: 557855 - protein, 9 aa, Homo Sapiens
DSARGSGNT

SEQ ID NO: 557856 - protein, 9 aa, Homo Sapiens
KASRAGGTR

SEQ ID NO: 557857 - protein, 9 aa, Homo Sapiens
STFGSRSTN

SEQ ID NO: 557858 - protein, 9 aa, Homo Sapiens
EASLSSLTR

SEQ ID NO: 557859 - protein, 9 aa, Homo Sapiens
GTSRAAGTT

SEQ ID NO: 557860 - protein, 9 aa, Homo Sapiens
WNKVTELER

SEQ ID NO: 557861 - protein, 9 aa, Homo Sapiens
WAWGSGATI

SEQ ID NO: 557862 - protein, 9 aa, Homo Sapiens
ACFTWRTSR

SEQ ID NO: 557863 - protein, 9 aa, Homo Sapiens
GNTSLSSLA

SEQ ID NO: 557864 - protein, 9 aa, Homo Sapiens
CKRCHRQPH

SEQ ID NO: 557865 - protein, 9 aa, Homo Sapiens
IDEEGKDPL

SEQ ID NO: 557866 - protein, 9 aa, Homo Sapiens
GPVKEKIMV

SEQ ID NO: 557867 - protein, 9 aa, Homo Sapiens
TTFTRHSLK

SEQ ID NO: 557868 - protein, 9 aa, Homo Sapiens
RGANQHAID

SEQ ID NO: 557869 - protein, 9 aa, Homo Sapiens
LWNKVTELE

SEQ ID NO: 557870 - protein, 9 aa, Homo Sapiens
SRNTLFTRF

SEQ ID NO: 557871 - protein, 9 aa, Homo Sapiens
TSLASCSRG

SEQ ID NO: 557872 - protein, 9 aa, Homo Sapiens
TPVYTEVKR

SEQ ID NO: 557873 - protein, 9 aa, Homo Sapiens
EHQQGQALP

SEQ ID NO: 557874 - protein, 9 aa, Homo Sapiens
SSPSTSSPS

SEQ ID NO: 557875 - protein, 9 aa, Homo Sapiens
TRTSSRASL

SEQ ID NO: 557876 - protein, 9 aa, Homo Sapiens
KCKVYDSQG

SEQ ID NO: 557877 - protein, 9 aa, Homo Sapiens
EHSAPITVH

SEQ ID NO: 557878 - protein, 9 aa, Homo Sapiens
NDTYRSRDS

SEQ ID NO: 557879 - protein, 9 aa, Homo Sapiens
LSYYQACLL

SEQ ID NO: 557880 - protein, 9 aa, Homo Sapiens
RGSFLASRA

SEQ ID NO: 557881 - protein, 9 aa, Homo Sapiens
AARASSQTL

SEQ ID NO: 557882 - protein, 9 aa, Homo Sapiens
YENHCKLHH

SEQ ID NO: 557883 - protein, 9 aa, Homo Sapiens
PPSRWARPR

SEQ ID NO: 557884 - protein, 9 aa, Homo Sapiens
LASKTSCNQ

SEQ ID NO: 557885 - protein, 9 aa, Homo Sapiens
YQSLRLSLA

SEQ ID NO: 557886 - protein, 9 aa, Homo Sapiens
TGSSRGTSI

SEQ ID NO: 557887 - protein, 9 aa, Homo Sapiens
GTSNTICAR

SEQ ID NO: 557888 - protein, 9 aa, Homo Sapiens
SLTTGTRWA

SEQ ID NO: 557889 - protein, 9 aa, Homo Sapiens
PGKTPVYTE

SEQ ID NO: 557890 - protein, 9 aa, Homo Sapiens
AFSTRLAVS

SEQ ID NO: 557891 - protein, 9 aa, Homo Sapiens
SGFNGMLSL

SEQ ID NO: 557892 - protein, 9 aa, Homo Sapiens
AIFARRAIS

SEQ ID NO: 557893 - protein, 9 aa, Homo Sapiens
NNFEFCETH

SEQ ID NO: 557894 - protein, 9 aa, Homo Sapiens
SISRGARRT

SEQ ID NO: 557895 - protein, 9 aa, Homo Sapiens
VGPSGTSRT

SEQ ID NO: 557896 - protein, 9 aa, Homo Sapiens
ISTRGSFLA

SEQ ID NO: 557897 - protein, 9 aa, Homo Sapiens
GTSRTRGTL

SEQ ID NO: 557898 - protein, 9 aa, Homo Sapiens
LHWTQDLLP

SEQ ID NO: 557899 - protein, 9 aa, Homo Sapiens
GPTGFFLFG

SEQ ID NO: 557900 - protein, 9 aa, Homo Sapiens
GGTRLTTVS

SEQ ID NO: 557901 - protein, 9 aa, Homo Sapiens
RCLQICVLR

SEQ ID NO: 557902 - protein, 9 aa, Homo Sapiens
GTRQTSFTG

SEQ ID NO: 557903 - protein, 9 aa, Homo Sapiens
LLPKSHTVP

SEQ ID NO: 557904 - protein, 9 aa, Homo Sapiens
IVAGSTVGP

SEQ ID NO: 557905 - protein, 9 aa, Homo Sapiens
LLCLQLSLD

SEQ ID NO: 557906 - protein, 9 aa, Homo Sapiens
TYRSRDSSF

SEQ ID NO: 557907 - protein, 9 aa, Homo Sapiens
ASGTSRARG

SEQ ID NO: 557908 - protein, 9 aa, Homo Sapiens
RLSLASKTS

SEQ ID NO: 557909 - protein, 9 aa, Homo Sapiens
ACGKPVKYD

SEQ ID NO: 557910 - protein, 9 aa, Homo Sapiens
TICARETTA

SEQ ID NO: 557911 - protein, 9 aa, Homo Sapiens
FRSRESHHT

SEQ ID NO: 557912 - protein, 9 aa, Homo Sapiens
RSFGASRAR

SEQ ID NO: 557913 - protein, 9 aa, Homo Sapiens
TRGASKASR

SEQ ID NO: 557914 - protein, 9 aa, Homo Sapiens
SAPITVHHN

SEQ ID NO: 557915 - protein, 9 aa, Homo Sapiens
SYLNASSLD

SEQ ID NO: 557916 - protein, 9 aa, Homo Sapiens
PHLGPPPLH

SEQ ID NO: 557917 - protein, 9 aa, Homo Sapiens
DLAPARGYS

SEQ ID NO: 557918 - protein, 9 aa, Homo Sapiens
TNITNGARG

SEQ ID NO: 557919 - protein, 9 aa, Homo Sapiens
LAVSTRGAS

SEQ ID NO: 557920 - protein, 9 aa, Homo Sapiens
ATCPWQLPA

SEQ ID NO: 557921 - protein, 9 aa, Homo Sapiens
TRGARKTRE

SEQ ID NO: 557922 - protein, 9 aa, Homo Sapiens
KSPSPSKSL

SEQ ID NO: 557923 - protein, 9 aa, Homo Sapiens
PFNTDLEEN

SEQ ID NO: 557924 - protein, 9 aa, Homo Sapiens
VYTEVKRVG

SEQ ID NO: 557925 - protein, 9 aa, Homo Sapiens
GTTSFTRRS

SEQ ID NO: 557926 - protein, 9 aa, Homo Sapiens
PAQGAKYQG

SEQ ID NO: 557927 - protein, 9 aa, Homo Sapiens
LLTASAATS

SEQ ID NO: 557928 - protein, 9 aa, Homo Sapiens
RNTLFTRFA

SEQ ID NO: 557929 - protein, 9 aa, Homo Sapiens
SGTSRAAGT

SEQ ID NO: 557930 - protein, 9 aa, Homo Sapiens
CLLSLRMKT

SEQ ID NO: 557931 - protein, 9 aa, Homo Sapiens
GTLFARFTR

SEQ ID NO: 557932 - protein, 9 aa, Homo Sapiens
TEVKRVGDT

SEQ ID NO: 557933 - protein, 9 aa, Homo Sapiens
QACLLSLRM

SEQ ID NO: 557934 - protein, 9 aa, Homo Sapiens
ISTFGTSIT

SEQ ID NO: 557935 - protein, 9 aa, Homo Sapiens
AMFQPATCP

SEQ ID NO: 557936 - protein, 9 aa, Homo Sapiens
LKSPSPSKS

SEQ ID NO: 557937 - protein, 9 aa, Homo Sapiens
LDPSNCLCI

SEQ ID NO: 557938 - protein, 9 aa, Homo Sapiens
KYPPSTKFS

SEQ ID NO: 557939 - protein, 9 aa, Homo Sapiens
TSFTRRSFG

SEQ ID NO: 557940 - protein, 9 aa, Homo Sapiens
SSSLSIFAS

SEQ ID NO: 557941 - protein, 9 aa, Homo Sapiens
QEVCNIVGQ

SEQ ID NO: 557942 - protein, 9 aa, Homo Sapiens
DNFITDAVL

SEQ ID NO: 557943 - protein, 9 aa, Homo Sapiens
GMLSLLSDL

SEQ ID NO: 557944 - protein, 9 aa, Homo Sapiens
LSIFASRTD

SEQ ID NO: 557945 - protein, 9 aa, Homo Sapiens
LAFLPLQQG

SEQ ID NO: 557946 - protein, 9 aa, Homo Sapiens
STTRQGVRA

SEQ ID NO: 557947 - protein, 9 aa, Homo Sapiens
NCSRNKYLL

SEQ ID NO: 557948 - protein, 9 aa, Homo Sapiens
NTLRPGSTR

SEQ ID NO: 557949 - protein, 9 aa, Homo Sapiens
TSVTLRPWK

SEQ ID NO: 557950 - protein, 9 aa, Homo Sapiens
LLESLVMGL

SEQ ID NO: 557951 - protein, 9 aa, Homo Sapiens
GTSESLKSV

SEQ ID NO: 557952 - protein, 9 aa, Homo Sapiens
RGSLSSSLS

SEQ ID NO: 557953 - protein, 9 aa, Homo Sapiens
SLSSSLSIF

SEQ ID NO: 557954 - protein, 9 aa, Homo Sapiens
ARRAISTFG

SEQ ID NO: 557955 - protein, 9 aa, Homo Sapiens
MAISCCQSF

SEQ ID NO: 557956 - protein, 9 aa, Homo Sapiens
RQTSFTGTT

SEQ ID NO: 557957 - protein, 9 aa, Homo Sapiens
GEAIGDLAP

SEQ ID NO: 557958 - protein, 9 aa, Homo Sapiens
RAGGTRLTT

SEQ ID NO: 557959 - protein, 9 aa, Homo Sapiens
ARGSGNTSL

SEQ ID NO: 557960 - protein, 9 aa, Homo Sapiens
QHAIDEEGK

SEQ ID NO: 557961 - protein, 9 aa, Homo Sapiens
PYDNFITDA

SEQ ID NO: 557962 - protein, 9 aa, Homo Sapiens
LLCGRAMFQ

SEQ ID NO: 557963 - protein, 9 aa, Homo Sapiens
ISDENDNAS

SEQ ID NO: 557964 - protein, 9 aa, Homo Sapiens
RETSSTRGT

SEQ ID NO: 557965 - protein, 9 aa, Homo Sapiens
VDEQEAAVS

SEQ ID NO: 557966 - protein, 9 aa, Homo Sapiens
SFTGTTSFT

SEQ ID NO: 557967 - protein, 9 aa, Homo Sapiens
AVSTRGASK

SEQ ID NO: 557968 - protein, 9 aa, Homo Sapiens
RAAGTTFTL

SEQ ID NO: 557969 - protein, 9 aa, Homo Sapiens
RNCSRNKYL

SEQ ID NO: 557970 - protein, 9 aa, Homo Sapiens
TFTRHSLKA

SEQ ID NO: 557971 - protein, 9 aa, Homo Sapiens
TSLSSLAGL

SEQ ID NO: 557972 - protein, 9 aa, Homo Sapiens
TREASLSSL

SEQ ID NO: 557973 - protein, 9 aa, Homo Sapiens
DPGAIAFHW

SEQ ID NO: 557974 - protein, 9 aa, Homo Sapiens
FKYPPSTKF

SEQ ID NO: 557975 - protein, 9 aa, Homo Sapiens
IFARRAIST

SEQ ID NO: 557976 - protein, 9 aa, Homo Sapiens
TRQGVRAGQ

SEQ ID NO: 557977 - protein, 9 aa, Homo Sapiens
SLKARGALA

SEQ ID NO: 557978 - protein, 9 aa, Homo Sapiens
THIPFYNRG

SEQ ID NO: 557979 - protein, 9 aa, Homo Sapiens
ISRGARRTD

SEQ ID NO: 557980 - protein, 9 aa, Homo Sapiens
MGSLLGKLL

SEQ ID NO: 557981 - protein, 9 aa, Homo Sapiens
LRPGSTRST

SEQ ID NO: 557982 - protein, 9 aa, Homo Sapiens
GTTSSSGTS

SEQ ID NO: 557983 - protein, 9 aa, Homo Sapiens
LRCLQICVL

SEQ ID NO: 557984 - protein, 9 aa, Homo Sapiens
LLAFLPLQQ

SEQ ID NO: 557985 - protein, 9 aa, Homo Sapiens
FPLRCLQIC

SEQ ID NO: 557986 - protein, 9 aa, Homo Sapiens
VCNIVGQTL

SEQ ID NO: 557987 - protein, 9 aa, Homo Sapiens
LPSTHIKKS

SEQ ID NO: 557988 - protein, 9 aa, Homo Sapiens
FTSGTLGTS

SEQ ID NO: 557989 - protein, 9 aa, Homo Sapiens
TCPWQLPAL

SEQ ID NO: 557990 - protein, 9 aa, Homo Sapiens
TIVAGSTVG

SEQ ID NO: 557991 - protein, 9 aa, Homo Sapiens
RGSSISRGA

SEQ ID NO: 557992 - protein, 9 aa, Homo Sapiens
THIKKSKAL

SEQ ID NO: 557993 - protein, 9 aa, Homo Sapiens
FSTRLAVST

SEQ ID NO: 557994 - protein, 9 aa, Homo Sapiens
EKIMVVIKE

SEQ ID NO: 557995 - protein, 9 aa, Homo Sapiens
CFTWRTSRT

SEQ ID NO: 557996 - protein, 9 aa, Homo Sapiens
DEQEAAVSR

SEQ ID NO: 557997 - protein, 9 aa, Homo Sapiens
ASSQTLGTR

SEQ ID NO: 557998 - protein, 9 aa, Homo Sapiens
SVKRKKIVA

SEQ ID NO: 557999 - protein, 9 aa, Homo Sapiens
PEGPPSRWA

SEQ ID NO: 558000 - protein, 9 aa, Homo Sapiens
EAIGDLAPA

SEQ ID NO: 558001 - protein, 9 aa, Homo Sapiens
MREQEKMRG

SEQ ID NO: 558002 - protein, 9 aa, Homo Sapiens
HCKLHHAAC

SEQ ID NO: 558003 - protein, 9 aa, Homo Sapiens
AWGSGATIL

SEQ ID NO: 558004 - protein, 9 aa, Homo Sapiens
NIVGQTLGK

SEQ ID NO: 558005 - protein, 9 aa, Homo Sapiens
LASCSRGAR

SEQ ID NO: 558006 - protein, 9 aa, Homo Sapiens
AKCKVYDSQ

SEQ ID NO: 558007 - protein, 9 aa, Homo Sapiens
MGLQGVLSE

SEQ ID NO: 558008 - protein, 9 aa, Homo Sapiens
IAFHWLSLG

SEQ ID NO: 558009 - protein, 9 aa, Homo Sapiens
NHCKLHHAA

SEQ ID NO: 558010 - protein, 9 aa, Homo Sapiens
RTDSARGSG

SEQ ID NO: 558011 - protein, 9 aa, Homo Sapiens
TSRTRGTLH

SEQ ID NO: 558012 - protein, 9 aa, Homo Sapiens
TTLSSNTLR

SEQ ID NO: 558013 - protein, 9 aa, Homo Sapiens
GSTGPTGFF

SEQ ID NO: 558014 - protein, 9 aa, Homo Sapiens
GPPSRWARP

SEQ ID NO: 558015 - protein, 9 aa, Homo Sapiens
SVGCWPGAK

SEQ ID NO: 558016 - protein, 9 aa, Homo Sapiens
EQEKMRGQE

SEQ ID NO: 558017 - protein, 9 aa, Homo Sapiens
CIRGFADAH

SEQ ID NO: 558018 - protein, 9 aa, Homo Sapiens
TGTTSFTRR

SEQ ID NO: 558019 - protein, 9 aa, Homo Sapiens
PVLSLLTAS

SEQ ID NO: 558020 - protein, 9 aa, Homo Sapiens
SGRARGTSI

SEQ ID NO: 558021 - protein, 9 aa, Homo Sapiens
SVTLRPWKT

SEQ ID NO: 558022 - protein, 9 aa, Homo Sapiens
RSTSRTIST

SEQ ID NO: 558023 - protein, 9 aa, Homo Sapiens
TGGTRGASF

SEQ ID NO: 558024 - protein, 9 aa, Homo Sapiens
TTFTLVTRG

SEQ ID NO: 558025 - protein, 9 aa, Homo Sapiens
ASKASRAGG

SEQ ID NO: 558026 - protein, 9 aa, Homo Sapiens
ESGLPSTHI

SEQ ID NO: 558027 - protein, 9 aa, Homo Sapiens
LGPPPLHYL

SEQ ID NO: 558028 - protein, 9 aa, Homo Sapiens
PSTSSPSSS

SEQ ID NO: 558029 - protein, 9 aa, Homo Sapiens
TFRSRESHH

SEQ ID NO: 558030 - protein, 9 aa, Homo Sapiens
RAISTFGTS

SEQ ID NO: 558031 - protein, 9 aa, Homo Sapiens
ENHCKLHHA

SEQ ID NO: 558032 - protein, 9 aa, Homo Sapiens
TLRPGSTRS

SEQ ID NO: 558033 - protein, 9 aa, Homo Sapiens
TQDLLPVRR

SEQ ID NO: 558034 - protein, 9 aa, Homo Sapiens
TSGTLGTSN

SEQ ID NO: 558035 - protein, 9 aa, Homo Sapiens
IPAGATVDT

SEQ ID NO: 558036 - protein, 9 aa, Homo Sapiens
STRSTSRTI

SEQ ID NO: 558037 - protein, 9 aa, Homo Sapiens
NLTTDALWN

SEQ ID NO: 558038 - protein, 9 aa, Homo Sapiens
CLQICVLRQ

SEQ ID NO: 558039 - protein, 9 aa, Homo Sapiens
SGTSRTRGT

SEQ ID NO: 558040 - protein, 9 aa, Homo Sapiens
PGAIAFHWL

SEQ ID NO: 558041 - protein, 9 aa, Homo Sapiens
RGASFAIRT

SEQ ID NO: 558042 - protein, 9 aa, Homo Sapiens
GYSGPGRSL

SEQ ID NO: 558043 - protein, 9 aa, Homo Sapiens
TRSTSRTIS

SEQ ID NO: 558044 - protein, 9 aa, Homo Sapiens
SSTRGTSAA

SEQ ID NO: 558045 - protein, 9 aa, Homo Sapiens
ASRAGGTRL

SEQ ID NO: 558046 - protein, 9 aa, Homo Sapiens
AFHWLSLGE

SEQ ID NO: 558047 - protein, 9 aa, Homo Sapiens
NGMLSLLSD

SEQ ID NO: 558048 - protein, 9 aa, Homo Sapiens
TSLTTGTRW

SEQ ID NO: 558049 - protein, 9 aa, Homo Sapiens
TRGTSAAAS

SEQ ID NO: 558050 - protein, 9 aa, Homo Sapiens
AISCCQSFL

SEQ ID NO: 558051 - protein, 9 aa, Homo Sapiens
CGRAMFQPA

SEQ ID NO: 558052 - protein, 9 aa, Homo Sapiens
RTDSASSTR

SEQ ID NO: 558053 - protein, 9 aa, Homo Sapiens
LTASAATSD

SEQ ID NO: 558054 - protein, 9 aa, Homo Sapiens
PMPTPTTSS

SEQ ID NO: 558055 - protein, 9 aa, Homo Sapiens
VPMPTPTTS

SEQ ID NO: 558056 - protein, 9 aa, Homo Sapiens
SITLSTIVA

SEQ ID NO: 558057 - protein, 9 aa, Homo Sapiens
PWQLPALSK

SEQ ID NO: 558058 - protein, 9 aa, Homo Sapiens
TFTLVTRGT

SEQ ID NO: 558059 - protein, 9 aa, Homo Sapiens
TFPSFFKMK

SEQ ID NO: 558060 - protein, 9 aa, Homo Sapiens
SLRLSLASK

SEQ ID NO: 558061 - protein, 9 aa, Homo Sapiens
LSLGEAIGD

SEQ ID NO: 558062 - protein, 9 aa, Homo Sapiens
ISVLFFDDS

SEQ ID NO: 558063 - protein, 9 aa, Homo Sapiens
RPWKTSCTT

SEQ ID NO: 558064 - protein, 9 aa, Homo Sapiens
WTQDLLPVR

SEQ ID NO: 558065 - protein, 9 aa, Homo Sapiens
KYLLKYLKD

SEQ ID NO: 558066 - protein, 9 aa, Homo Sapiens
ARGSSGSGR

SEQ ID NO: 558067 - protein, 9 aa, Homo Sapiens
QGVRAGQWV

SEQ ID NO: 558068 - protein, 9 aa, Homo Sapiens
DNASEITLA

SEQ ID NO: 558069 - protein, 9 aa, Homo Sapiens
RETTATRST

SEQ ID NO: 558070 - protein, 9 aa, Homo Sapiens
DTYRSRDSS

SEQ ID NO: 558071 - protein, 9 aa, Homo Sapiens
SEITLASES

SEQ ID NO: 558072 - protein, 9 aa, Homo Sapiens
HGSCEDPGA

SEQ ID NO: 558073 - protein, 9 aa, Homo Sapiens
QEKMRGQEE

SEQ ID NO: 558074 - protein, 9 aa, Homo Sapiens
NTICARETT

SEQ ID NO: 558075 - protein, 9 aa, Homo Sapiens
FTSLASGTS

SEQ ID NO: 558076 - protein, 9 aa, Homo Sapiens
TRGTNFTRT

SEQ ID NO: 558077 - protein, 9 aa, Homo Sapiens
LEELSARTG

SEQ ID NO: 558078 - protein, 9 aa, Homo Sapiens
FAAFFASRT

SEQ ID NO: 558079 - protein, 9 aa, Homo Sapiens
KSVKRKKIV

SEQ ID NO: 558080 - protein, 9 aa, Homo Sapiens
GNLTTDALW

SEQ ID NO: 558081 - protein, 9 aa, Homo Sapiens
TLGTSNTIC

SEQ ID NO: 558082 - protein, 9 aa, Homo Sapiens
YDRFVAICC

SEQ ID NO: 558083 - protein, 9 aa, Homo Sapiens
ARKTREASL

SEQ ID NO: 558084 - protein, 9 aa, Homo Sapiens
TRSTTRQGV

SEQ ID NO: 558085 - protein, 9 aa, Homo Sapiens
ATVDTDITH

SEQ ID NO: 558086 - protein, 9 aa, Homo Sapiens
APVLSLLTA

SEQ ID NO: 558087 - protein, 9 aa, Homo Sapiens
CPWQLPALS

SEQ ID NO: 558088 - protein, 9 aa, Homo Sapiens
DRQVIPAKC

SEQ ID NO: 558089 - protein, 9 aa, Homo Sapiens
LGEAIGDLA

SEQ ID NO: 558090 - protein, 9 aa, Homo Sapiens
GDGDRWRSA

SEQ ID NO: 558091 - protein, 9 aa, Homo Sapiens
TKDCCPFQI

SEQ ID NO: 558092 - protein, 9 aa, Homo Sapiens
KRRKQQYKN

SEQ ID NO: 558093 - protein, 9 aa, Homo Sapiens
DGTFDCISM

SEQ ID NO: 558094 - protein, 9 aa, Homo Sapiens
VNFYGPRSD

SEQ ID NO: 558095 - protein, 9 aa, Homo Sapiens
DVVLETAGR

SEQ ID NO: 558096 - protein, 9 aa, Homo Sapiens
IRTWTQTYK

SEQ ID NO: 558097 - protein, 9 aa, Homo Sapiens
FPQSTYHFK

SEQ ID NO: 558098 - protein, 9 aa, Homo Sapiens
KGSAPWSLW

SEQ ID NO: 558099 - protein, 9 aa, Homo Sapiens
FYGPRSDFV

SEQ ID NO: 558100 - protein, 9 aa, Homo Sapiens
PQSTYHFKT

SEQ ID NO: 558101 - protein, 9 aa, Homo Sapiens
NCFLLTAVG

SEQ ID NO: 558102 - protein, 9 aa, Homo Sapiens
RALPPAQSS

SEQ ID NO: 558103 - protein, 9 aa, Homo Sapiens
RGVCEERKD

SEQ ID NO: 558104 - protein, 9 aa, Homo Sapiens
KTQKFFRKV

SEQ ID NO: 558105 - protein, 9 aa, Homo Sapiens
VMQAQFAPD

SEQ ID NO: 558106 - protein, 9 aa, Homo Sapiens
TRARPSCVD

SEQ ID NO: 558107 - protein, 9 aa, Homo Sapiens
RSFYEQGVA

SEQ ID NO: 558108 - protein, 9 aa, Homo Sapiens
ENPLRSCCL

SEQ ID NO: 558109 - protein, 9 aa, Homo Sapiens
DKIFRGVIL

SEQ ID NO: 558110 - protein, 9 aa, Homo Sapiens
LTAVGYDRY

SEQ ID NO: 558111 - protein, 9 aa, Homo Sapiens
DEVEAASQQ

SEQ ID NO: 558112 - protein, 9 aa, Homo Sapiens
TAVGYDRYV

SEQ ID NO: 558113 - protein, 9 aa, Homo Sapiens
AFQGIKKLS

SEQ ID NO: 558114 - protein, 9 aa, Homo Sapiens
CEEPDVPAY

SEQ ID NO: 558115 - protein, 9 aa, Homo Sapiens
EEDEDEVEA

SEQ ID NO: 558116 - protein, 9 aa, Homo Sapiens
MQAQFAPDN

SEQ ID NO: 558117 - protein, 9 aa, Homo Sapiens
GPRSDFVVS

SEQ ID NO: 558118 - protein, 9 aa, Homo Sapiens
ISGLTHEIE

SEQ ID NO: 558119 - protein, 9 aa, Homo Sapiens
GGRTRDRLD

SEQ ID NO: 558120 - protein, 9 aa, Homo Sapiens
ISDVATKQE

SEQ ID NO: 558121 - protein, 9 aa, Homo Sapiens
EMGGRTRDR

SEQ ID NO: 558122 - protein, 9 aa, Homo Sapiens
IAMARTGGI

SEQ ID NO: 558123 - protein, 9 aa, Homo Sapiens
ISTPAPFAG

SEQ ID NO: 558124 - protein, 9 aa, Homo Sapiens
SLPGHATKT

SEQ ID NO: 558125 - protein, 9 aa, Homo Sapiens
EQVVYKTQK

SEQ ID NO: 558126 - protein, 9 aa, Homo Sapiens
PDPGTPSLA

SEQ ID NO: 558127 - protein, 9 aa, Homo Sapiens
NFYGPRSDF

SEQ ID NO: 558128 - protein, 9 aa, Homo Sapiens
GLTHEIEPI

SEQ ID NO: 558129 - protein, 9 aa, Homo Sapiens
ASSLPGHAT

SEQ ID NO: 558130 - protein, 9 aa, Homo Sapiens
WFRIVDVCK

SEQ ID NO: 558131 - protein, 9 aa, Homo Sapiens
PFQIPVSVR

SEQ ID NO: 558132 - protein, 9 aa, Homo Sapiens
FSTTKDCCP

SEQ ID NO: 558133 - protein, 9 aa, Homo Sapiens
NTIGNFKCR

SEQ ID NO: 558134 - protein, 9 aa, Homo Sapiens
TNCFLLTAV

SEQ ID NO: 558135 - protein, 9 aa, Homo Sapiens
QVMQAQFAP

SEQ ID NO: 558136 - protein, 9 aa, Homo Sapiens
CRNTIGNFK

SEQ ID NO: 558137 - protein, 9 aa, Homo Sapiens
VDVCKEVLE

SEQ ID NO: 558138 - protein, 9 aa, Homo Sapiens
ARTGGIGFI

SEQ ID NO: 558139 - protein, 9 aa, Homo Sapiens
SQKGSAPWS

SEQ ID NO: 558140 - protein, 9 aa, Homo Sapiens
QMLKTHRSD

SEQ ID NO: 558141 - protein, 9 aa, Homo Sapiens
LAEDMTLCV

SEQ ID NO: 558142 - protein, 9 aa, Homo Sapiens
ICGPQSQPP

SEQ ID NO: 558143 - protein, 9 aa, Homo Sapiens
PLENPLRSC

SEQ ID NO: 558144 - protein, 9 aa, Homo Sapiens
GLFRPSQKG

SEQ ID NO: 558145 - protein, 9 aa, Homo Sapiens
DVLQMLKTH

SEQ ID NO: 558146 - protein, 9 aa, Homo Sapiens
LKTHRSDPQ

SEQ ID NO: 558147 - protein, 9 aa, Homo Sapiens
GRELSSEGI

SEQ ID NO: 558148 - protein, 9 aa, Homo Sapiens
LCVADFGLS

SEQ ID NO: 558149 - protein, 9 aa, Homo Sapiens
CKEVLEEIS

SEQ ID NO: 558150 - protein, 9 aa, Homo Sapiens
DKFIKDFTG

SEQ ID NO: 558151 - protein, 9 aa, Homo Sapiens
MLKTHRSDP

SEQ ID NO: 558152 - protein, 9 aa, Homo Sapiens
DVPAYSIRK

SEQ ID NO: 558153 - protein, 9 aa, Homo Sapiens
ILANMHSQL

SEQ ID NO: 558154 - protein, 9 aa, Homo Sapiens
FQGIKKLSY

SEQ ID NO: 558155 - protein, 9 aa, Homo Sapiens
SSIAGPLLS

SEQ ID NO: 558156 - protein, 9 aa, Homo Sapiens
VCRETLQVL

SEQ ID NO: 558157 - protein, 9 aa, Homo Sapiens
AEDMTLCVA

SEQ ID NO: 558158 - protein, 9 aa, Homo Sapiens
MHSQLKELQ

SEQ ID NO: 558159 - protein, 9 aa, Homo Sapiens
EVARELQES

SEQ ID NO: 558160 - protein, 9 aa, Homo Sapiens
WLTPFLRVT

SEQ ID NO: 558161 - protein, 9 aa, Homo Sapiens
RPRSKQEAW

SEQ ID NO: 558162 - protein, 9 aa, Homo Sapiens
IPAKGYAEI

SEQ ID NO: 558163 - protein, 9 aa, Homo Sapiens
RSKQEAWST

SEQ ID NO: 558164 - protein, 9 aa, Homo Sapiens
RMEEMGGRT

SEQ ID NO: 558165 - protein, 9 aa, Homo Sapiens
SASGESLRE

SEQ ID NO: 558166 - protein, 9 aa, Homo Sapiens
DNVLMLLSV

SEQ ID NO: 558167 - protein, 9 aa, Homo Sapiens
FLTTGDPKA

SEQ ID NO: 558168 - protein, 9 aa, Homo Sapiens
IFCIRSPRV

SEQ ID NO: 558169 - protein, 9 aa, Homo Sapiens
SLWSSQEYL

SEQ ID NO: 558170 - protein, 9 aa, Homo Sapiens
EVKRIVGGI

SEQ ID NO: 558171 - protein, 9 aa, Homo Sapiens
PAPFAGLGP

SEQ ID NO: 558172 - protein, 9 aa, Homo Sapiens
ARELQESKY

SEQ ID NO: 558173 - protein, 9 aa, Homo Sapiens
CFLLTAVGY

SEQ ID NO: 558174 - protein, 9 aa, Homo Sapiens
THRSDPQLI

SEQ ID NO: 558175 - protein, 9 aa, Homo Sapiens
ASPLENPLR

SEQ ID NO: 558176 - protein, 9 aa, Homo Sapiens
SDWASPLEN

SEQ ID NO: 558177 - protein, 9 aa, Homo Sapiens
IFRGVILTS

SEQ ID NO: 558178 - protein, 9 aa, Homo Sapiens
TPSLAVAPE

SEQ ID NO: 558179 - protein, 9 aa, Homo Sapiens
KKSLEKILP

SEQ ID NO: 558180 - protein, 9 aa, Homo Sapiens
APFAGLGPR

SEQ ID NO: 558181 - protein, 9 aa, Homo Sapiens
KLENDKIFR

SEQ ID NO: 558182 - protein, 9 aa, Homo Sapiens
IENGAFQGI

SEQ ID NO: 558183 - protein, 9 aa, Homo Sapiens
IPVLVGLFR

SEQ ID NO: 558184 - protein, 9 aa, Homo Sapiens
DLEPCEEPD

SEQ ID NO: 558185 - protein, 9 aa, Homo Sapiens
PDNNPDAQT

SEQ ID NO: 558186 - protein, 9 aa, Homo Sapiens
PPAQSSIAG

SEQ ID NO: 558187 - protein, 9 aa, Homo Sapiens
VEAASQQFL

SEQ ID NO: 558188 - protein, 9 aa, Homo Sapiens
RPSQKGSAP

SEQ ID NO: 558189 - protein, 9 aa, Homo Sapiens
MEEMGGRTR

SEQ ID NO: 558190 - protein, 9 aa, Homo Sapiens
CPFQIPVSV

SEQ ID NO: 558191 - protein, 9 aa, Homo Sapiens
ITECDNVLM

SEQ ID NO: 558192 - protein, 9 aa, Homo Sapiens
MTLCVADFG

SEQ ID NO: 558193 - protein, 9 aa, Homo Sapiens
GIPVLVGLF

SEQ ID NO: 558194 - protein, 9 aa, Homo Sapiens
EQGVAVLCT

SEQ ID NO: 558195 - protein, 9 aa, Homo Sapiens
SCVDARIIK

SEQ ID NO: 558196 - protein, 9 aa, Homo Sapiens
MARTGGIGF

SEQ ID NO: 558197 - protein, 9 aa, Homo Sapiens
ENDKIFRGV

SEQ ID NO: 558198 - protein, 9 aa, Homo Sapiens
YPEEADGTF

SEQ ID NO: 558199 - protein, 9 aa, Homo Sapiens
WASPLENPL

SEQ ID NO: 558200 - protein, 9 aa, Homo Sapiens
LWTLRNISD

SEQ ID NO: 558201 - protein, 9 aa, Homo Sapiens
LRNISDVAT

SEQ ID NO: 558202 - protein, 9 aa, Homo Sapiens
GTFDCISMA

SEQ ID NO: 558203 - protein, 9 aa, Homo Sapiens
VIFCIRSPR

SEQ ID NO: 558204 - protein, 9 aa, Homo Sapiens
GGIIHHTQA

SEQ ID NO: 558205 - protein, 9 aa, Homo Sapiens
RIVGGIIHH

SEQ ID NO: 558206 - protein, 9 aa, Homo Sapiens
RFPQSTYHF

SEQ ID NO: 558207 - protein, 9 aa, Homo Sapiens
SSQEYLFWT

SEQ ID NO: 558208 - protein, 9 aa, Homo Sapiens
KIFRGVILT

SEQ ID NO: 558209 - protein, 9 aa, Homo Sapiens
RGDGDRWRS

SEQ ID NO: 558210 - protein, 9 aa, Homo Sapiens
KISGLTHEI

SEQ ID NO: 558211 - protein, 9 aa, Homo Sapiens
IQQFLTTGD

SEQ ID NO: 558212 - protein, 9 aa, Homo Sapiens
YVCRETLQV

SEQ ID NO: 558213 - protein, 9 aa, Homo Sapiens
TTGDPKAAY

SEQ ID NO: 558214 - protein, 9 aa, Homo Sapiens
RVTTRRFDT

SEQ ID NO: 558215 - protein, 9 aa, Homo Sapiens
THEIEPIRH

SEQ ID NO: 558216 - protein, 9 aa, Homo Sapiens
VARELQESK

SEQ ID NO: 558217 - protein, 9 aa, Homo Sapiens
TKTLPGGAG

SEQ ID NO: 558218 - protein, 9 aa, Homo Sapiens
ESLRELLLV

SEQ ID NO: 558219 - protein, 9 aa, Homo Sapiens
SKQEAWSTH

SEQ ID NO: 558220 - protein, 9 aa, Homo Sapiens
KDCCPFQIP

SEQ ID NO: 558221 - protein, 9 aa, Homo Sapiens
QEAWSTHNT

SEQ ID NO: 558222 - protein, 9 aa, Homo Sapiens
VTTRRFDTA

SEQ ID NO: 558223 - protein, 9 aa, Homo Sapiens
LTTGDPKAA

SEQ ID NO: 558224 - protein, 9 aa, Homo Sapiens
AGTTRARPS

SEQ ID NO: 558225 - protein, 9 aa, Homo Sapiens
RKQQYKNSL

SEQ ID NO: 558226 - protein, 9 aa, Homo Sapiens
YGPRSDFVV

SEQ ID NO: 558227 - protein, 9 aa, Homo Sapiens
KTHRSDPQL

SEQ ID NO: 558228 - protein, 9 aa, Homo Sapiens
LSSEGITCC

SEQ ID NO: 558229 - protein, 9 aa, Homo Sapiens
GESLRELLL

SEQ ID NO: 558230 - protein, 9 aa, Homo Sapiens
PAQSSIAGP

SEQ ID NO: 558231 - protein, 9 aa, Homo Sapiens
AIAMARTGG

SEQ ID NO: 558232 - protein, 9 aa, Homo Sapiens
SQVIFCIRS

SEQ ID NO: 558233 - protein, 9 aa, Homo Sapiens
MGITECDNV

SEQ ID NO: 558234 - protein, 9 aa, Homo Sapiens
GRPRSKQEA

SEQ ID NO: 558235 - protein, 9 aa, Homo Sapiens
LEQVVYKTQ

SEQ ID NO: 558236 - protein, 9 aa, Homo Sapiens
RNTIGNFKC

SEQ ID NO: 558237 - protein, 9 aa, Homo Sapiens
NPLRSCCLV

SEQ ID NO: 558238 - protein, 9 aa, Homo Sapiens
LENPLRSCC

SEQ ID NO: 558239 - protein, 9 aa, Homo Sapiens
YKNSLKKRP

SEQ ID NO: 558240 - protein, 9 aa, Homo Sapiens
PRFPQSTYH

SEQ ID NO: 558241 - protein, 9 aa, Homo Sapiens
VTKKSLEKI

SEQ ID NO: 558242 - protein, 9 aa, Homo Sapiens
NLRVRRAGY

SEQ ID NO: 558243 - protein, 9 aa, Homo Sapiens
SSLPGHATK

SEQ ID NO: 558244 - protein, 9 aa, Homo Sapiens
LQVLAYLHT

SEQ ID NO: 558245 - protein, 9 aa, Homo Sapiens
YHFKTPESS

SEQ ID NO: 558246 - protein, 9 aa, Homo Sapiens
AQSSIAGPL

SEQ ID NO: 558247 - protein, 9 aa, Homo Sapiens
LLTAVGYDR

SEQ ID NO: 558248 - protein, 9 aa, Homo Sapiens
ELSSEGITC

SEQ ID NO: 558249 - protein, 9 aa, Homo Sapiens
TQKFFRKVE

SEQ ID NO: 558250 - protein, 9 aa, Homo Sapiens
HRWRGVCEE

SEQ ID NO: 558251 - protein, 9 aa, Homo Sapiens
ELEQVVYKT

SEQ ID NO: 558252 - protein, 9 aa, Homo Sapiens
KQEAWSTHN

SEQ ID NO: 558253 - protein, 9 aa, Homo Sapiens
LPPAQSSIA

SEQ ID NO: 558254 - protein, 9 aa, Homo Sapiens
QSSIAGPLL

SEQ ID NO: 558255 - protein, 9 aa, Homo Sapiens
SGLTHEIEP

SEQ ID NO: 558256 - protein, 9 aa, Homo Sapiens
LQILANMHS

SEQ ID NO: 558257 - protein, 9 aa, Homo Sapiens
WTLRNISDV

SEQ ID NO: 558258 - protein, 9 aa, Homo Sapiens
ARPSCVDAR

SEQ ID NO: 558259 - protein, 9 aa, Homo Sapiens
GGRELSSEG

SEQ ID NO: 558260 - protein, 9 aa, Homo Sapiens
TKKSLEKIL

SEQ ID NO: 558261 - protein, 9 aa, Homo Sapiens
PDVPAYSIR

SEQ ID NO: 558262 - protein, 9 aa, Homo Sapiens
KSLEKILPQ

SEQ ID NO: 558263 - protein, 9 aa, Homo Sapiens
SELPIRTWT

SEQ ID NO: 558264 - protein, 9 aa, Homo Sapiens
VCEERKDVC

SEQ ID NO: 558265 - protein, 9 aa, Homo Sapiens
LTPFLRVTT

SEQ ID NO: 558266 - protein, 9 aa, Homo Sapiens
EDEVEAASQ

SEQ ID NO: 558267 - protein, 9 aa, Homo Sapiens
GTPSLAVAP

SEQ ID NO: 558268 - protein, 9 aa, Homo Sapiens
QESKYQYSE

SEQ ID NO: 558269 - protein, 9 aa, Homo Sapiens
VVYKTQKFF

SEQ ID NO: 558270 - protein, 9 aa, Homo Sapiens
SGESLRELL

SEQ ID NO: 558271 - protein, 9 aa, Homo Sapiens
VGGRELSSE

SEQ ID NO: 558272 - protein, 9 aa, Homo Sapiens
GGRICGPQS

SEQ ID NO: 558273 - protein, 9 aa, Homo Sapiens
CRETLQVLA

SEQ ID NO: 558274 - protein, 9 aa, Homo Sapiens
CDNVLMLLS

SEQ ID NO: 558275 - protein, 9 aa, Homo Sapiens
KNSLKKRPA

SEQ ID NO: 558276 - protein, 9 aa, Homo Sapiens
LVGLFRPSQ

SEQ ID NO: 558277 - protein, 9 aa, Homo Sapiens
PSQKGSAPW

SEQ ID NO: 558278 - protein, 9 aa, Homo Sapiens
VSSGISTAT

SEQ ID NO: 558279 - protein, 9 aa, Homo Sapiens
TLQVLAYLH

SEQ ID NO: 558280 - protein, 9 aa, Homo Sapiens
AGMAIAMAR

SEQ ID NO: 558281 - protein, 9 aa, Homo Sapiens
PRSFYEQGV

SEQ ID NO: 558282 - protein, 9 aa, Homo Sapiens
NMHSQLKEL

SEQ ID NO: 558283 - protein, 9 aa, Homo Sapiens
QKGSAPWSL

SEQ ID NO: 558284 - protein, 9 aa, Homo Sapiens
RARMEEMGG

SEQ ID NO: 558285 - protein, 9 aa, Homo Sapiens
GNFKCRCDS

SEQ ID NO: 558286 - protein, 9 aa, Homo Sapiens
PCEEPDVPA

SEQ ID NO: 558287 - protein, 9 aa, Homo Sapiens
DEDEVEAAS

SEQ ID NO: 558288 - protein, 9 aa, Homo Sapiens
TLRNISDVA

SEQ ID NO: 558289 - protein, 9 aa, Homo Sapiens
QYKNSLKKR

SEQ ID NO: 558290 - protein, 9 aa, Homo Sapiens
PGHATKTLP

SEQ ID NO: 558291 - protein, 9 aa, Homo Sapiens
QLQILANMH

SEQ ID NO: 558292 - protein, 9 aa, Homo Sapiens
GYAEIKEEK

SEQ ID NO: 558293 - protein, 9 aa, Homo Sapiens
VCGGGGRIC

SEQ ID NO: 558294 - protein, 9 aa, Homo Sapiens
VYKTQKFFR

SEQ ID NO: 558295 - protein, 9 aa, Homo Sapiens
DFVVSGSDC

SEQ ID NO: 558296 - protein, 9 aa, Homo Sapiens
GVCEERKDV

SEQ ID NO: 558297 - protein, 9 aa, Homo Sapiens
ELPIRTWTQ

SEQ ID NO: 558298 - protein, 9 aa, Homo Sapiens
GPRGDGDRW

SEQ ID NO: 558299 - protein, 9 aa, Homo Sapiens
LAPLPDPGT

SEQ ID NO: 558300 - protein, 9 aa, Homo Sapiens
EEMGGRTRD

SEQ ID NO: 558301 - protein, 9 aa, Homo Sapiens
NLKDKFIKD

SEQ ID NO: 558302 - protein, 9 aa, Homo Sapiens
EVEAASQQF

SEQ ID NO: 558303 - protein, 9 aa, Homo Sapiens
EKLENDKIF

SEQ ID NO: 558304 - protein, 9 aa, Homo Sapiens
VCKEVLEEI

SEQ ID NO: 558305 - protein, 9 aa, Homo Sapiens
RNISDVATK

SEQ ID NO: 558306 - protein, 9 aa, Homo Sapiens
NISDVATKQ

SEQ ID NO: 558307 - protein, 9 aa, Homo Sapiens
LEKLENDKI

SEQ ID NO: 558308 - protein, 9 aa, Homo Sapiens
MGGRTRDRL

SEQ ID NO: 558309 - protein, 9 aa, Homo Sapiens
EDMTLCVAD

SEQ ID NO: 558310 - protein, 9 aa, Homo Sapiens
CLWTLRNIS

SEQ ID NO: 558311 - protein, 9 aa, Homo Sapiens
GISTPAPFA

SEQ ID NO: 558312 - protein, 9 aa, Homo Sapiens
EDEDEVEAA

SEQ ID NO: 558313 - protein, 9 aa, Homo Sapiens
VVLETAGRH

SEQ ID NO: 558314 - protein, 9 aa, Homo Sapiens
GAFQGIKKL

SEQ ID NO: 558315 - protein, 9 aa, Homo Sapiens
EADGTFDCI

SEQ ID NO: 558316 - protein, 9 aa, Homo Sapiens
TTKDCCPFQ

SEQ ID NO: 558317 - protein, 9 aa, Homo Sapiens
IGNFKCRCD

SEQ ID NO: 558318 - protein, 9 aa, Homo Sapiens
CMLAEDMTL

SEQ ID NO: 558319 - protein, 9 aa, Homo Sapiens
DIQQFLTTG

SEQ ID NO: 558320 - protein, 9 aa, Homo Sapiens
LENDKIFRG

SEQ ID NO: 558321 - protein, 9 aa, Homo Sapiens
RRKQQYKNS

SEQ ID NO: 558322 - protein, 9 aa, Homo Sapiens
ASGESLREL

SEQ ID NO: 558323 - protein, 9 aa, Homo Sapiens
RELQESKYQ

SEQ ID NO: 558324 - protein, 9 aa, Homo Sapiens
AVGYDRYVA

SEQ ID NO: 558325 - protein, 9 aa, Homo Sapiens
PWSLWSSQE

SEQ ID NO: 558326 - protein, 9 aa, Homo Sapiens
CCPFQIPVS

SEQ ID NO: 558327 - protein, 9 aa, Homo Sapiens
VKRIVGGII

SEQ ID NO: 558328 - protein, 9 aa, Homo Sapiens
ELQESKYQY

SEQ ID NO: 558329 - protein, 9 aa, Homo Sapiens
VPASASGES

SEQ ID NO: 558330 - protein, 9 aa, Homo Sapiens
RWRGVCEER

SEQ ID NO: 558331 - protein, 9 aa, Homo Sapiens
GRICGPQSQ

SEQ ID NO: 558332 - protein, 9 aa, Homo Sapiens
PGRPRSKQE

SEQ ID NO: 558333 - protein, 9 aa, Homo Sapiens
HATKTLPGG

SEQ ID NO: 558334 - protein, 9 aa, Homo Sapiens
EGDIQQFLT

SEQ ID NO: 558335 - protein, 9 aa, Homo Sapiens
APLPDPGTP

SEQ ID NO: 558336 - protein, 9 aa, Homo Sapiens
SLRELLLVQ

SEQ ID NO: 558337 - protein, 9 aa, Homo Sapiens
ELEHRWRGV

SEQ ID NO: 558338 - protein, 9 aa, Homo Sapiens
MAIAMARTG

SEQ ID NO: 558339 - protein, 9 aa, Homo Sapiens
PFLRVTTRR

SEQ ID NO: 558340 - protein, 9 aa, Homo Sapiens
ARMEEMGGR

SEQ ID NO: 558341 - protein, 9 aa, Homo Sapiens
QILANMHSQ

SEQ ID NO: 558342 - protein, 9 aa, Homo Sapiens
NGAFQGIKK

SEQ ID NO: 558343 - protein, 9 aa, Homo Sapiens
FRIVDVCKE

SEQ ID NO: 558344 - protein, 9 aa, Homo Sapiens
FAPDNNPDA

SEQ ID NO: 558345 - protein, 9 aa, Homo Sapiens
GSAPWSLWS

SEQ ID NO: 558346 - protein, 9 aa, Homo Sapiens
PGTPSLAVA

SEQ ID NO: 558347 - protein, 9 aa, Homo Sapiens
IVGGIIHHT

SEQ ID NO: 558348 - protein, 9 aa, Homo Sapiens
KIPAKGYAE

SEQ ID NO: 558349 - protein, 9 aa, Homo Sapiens
LPGHATKTL

SEQ ID NO: 558350 - protein, 9 aa, Homo Sapiens
VGGIIHHTQ

SEQ ID NO: 558351 - protein, 9 aa, Homo Sapiens
RETLQVLAY

SEQ ID NO: 558352 - protein, 9 aa, Homo Sapiens
RELSSEGIT

SEQ ID NO: 558353 - protein, 9 aa, Homo Sapiens
PSCVDARII

SEQ ID NO: 558354 - protein, 9 aa, Homo Sapiens
ISELPIRTW

SEQ ID NO: 558355 - protein, 9 aa, Homo Sapiens
CIRSPRVVL

SEQ ID NO: 558356 - protein, 9 aa, Homo Sapiens
DVCKEVLEE

SEQ ID NO: 558357 - protein, 9 aa, Homo Sapiens
LFRPSQKGS

SEQ ID NO: 558358 - protein, 9 aa, Homo Sapiens
IKKLSYIRI

SEQ ID NO: 558359 - protein, 9 aa, Homo Sapiens
EPDVPAYSI

SEQ ID NO: 558360 - protein, 9 aa, Homo Sapiens
TPAPFAGLG

SEQ ID NO: 558361 - protein, 9 aa, Homo Sapiens
PDVVLETAG

SEQ ID NO: 558362 - protein, 9 aa, Homo Sapiens
STTKDCCPF

SEQ ID NO: 558363 - protein, 9 aa, Homo Sapiens
FLLTAVGYD

SEQ ID NO: 558364 - protein, 9 aa, Homo Sapiens
LANMHSQLK

SEQ ID NO: 558365 - protein, 9 aa, Homo Sapiens
QAQFAPDNN

SEQ ID NO: 558366 - protein, 9 aa, Homo Sapiens
WRLGAGPRG

SEQ ID NO: 558367 - protein, 9 aa, Homo Sapiens
PSQVIFCIR

SEQ ID NO: 558368 - protein, 9 aa, Homo Sapiens
KFIKDFTGP

SEQ ID NO: 558369 - protein, 9 aa, Homo Sapiens
APDNNPDAQ

SEQ ID NO: 558370 - protein, 9 aa, Homo Sapiens
GKCRNTIGN

SEQ ID NO: 558371 - protein, 9 aa, Homo Sapiens
PEEADGTFD

SEQ ID NO: 558372 - protein, 9 aa, Homo Sapiens
RRALPPAQS

SEQ ID NO: 558373 - protein, 9 aa, Homo Sapiens
GHATKTLPG

SEQ ID NO: 558374 - protein, 9 aa, Homo Sapiens
PRSKQEAWS

SEQ ID NO: 558375 - protein, 9 aa, Homo Sapiens
KRIVGGIIH

SEQ ID NO: 558376 - protein, 9 aa, Homo Sapiens
HFKTPESSP

SEQ ID NO: 558377 - protein, 9 aa, Homo Sapiens
RIVDVCKEV

SEQ ID NO: 558378 - protein, 9 aa, Homo Sapiens
TYHFKTPES

SEQ ID NO: 558379 - protein, 9 aa, Homo Sapiens
GGGRICGPQ

SEQ ID NO: 558380 - protein, 9 aa, Homo Sapiens
FCIRSPRVV

SEQ ID NO: 558381 - protein, 9 aa, Homo Sapiens
FLRVTTRRF

SEQ ID NO: 558382 - protein, 9 aa, Homo Sapiens
PVLVGLFRP

SEQ ID NO: 558383 - protein, 9 aa, Homo Sapiens
GDIQQFLTT

SEQ ID NO: 558384 - protein, 9 aa, Homo Sapiens
EIKEEKIKL

SEQ ID NO: 558385 - protein, 9 aa, Homo Sapiens
VLKISGLTH

SEQ ID NO: 558386 - protein, 9 aa, Homo Sapiens
WSLWSSQEY

SEQ ID NO: 558387 - protein, 9 aa, Homo Sapiens
YKTQKFFRK

SEQ ID NO: 558388 - protein, 9 aa, Homo Sapiens
HEIEPIRHS

SEQ ID NO: 558389 - protein, 9 aa, Homo Sapiens
SSEGITCCC

SEQ ID NO: 558390 - protein, 9 aa, Homo Sapiens
QSTYHFKTP

SEQ ID NO: 558391 - protein, 9 aa, Homo Sapiens
STPAPFAGL

SEQ ID NO: 558392 - protein, 9 aa, Homo Sapiens
AGPRGDGDR

SEQ ID NO: 558393 - protein, 9 aa, Homo Sapiens
GRTRDRLDE

SEQ ID NO: 558394 - protein, 9 aa, Homo Sapiens
ANMHSQLKE

SEQ ID NO: 558395 - protein, 9 aa, Homo Sapiens
ASASGESLR

SEQ ID NO: 558396 - protein, 9 aa, Homo Sapiens
KQQYKNSLK

SEQ ID NO: 558397 - protein, 9 aa, Homo Sapiens
NFKCRCDSG

SEQ ID NO: 558398 - protein, 9 aa, Homo Sapiens
LEHRWRGVC

SEQ ID NO: 558399 - protein, 9 aa, Homo Sapiens
GAGPRGDGD

SEQ ID NO: 558400 - protein, 9 aa, Homo Sapiens
FRPSQKGSA

SEQ ID NO: 558401 - protein, 9 aa, Homo Sapiens
SEVTKKSLE

SEQ ID NO: 558402 - protein, 9 aa, Homo Sapiens
EEVKRIVGG

SEQ ID NO: 558403 - protein, 9 aa, Homo Sapiens
ECDNVLMLL

SEQ ID NO: 558404 - protein, 9 aa, Homo Sapiens
QGIKKLSYI

SEQ ID NO: 558405 - protein, 9 aa, Homo Sapiens
LEPCEEPDV

SEQ ID NO: 558406 - protein, 9 aa, Homo Sapiens
EEADGTFDC

SEQ ID NO: 558407 - protein, 9 aa, Homo Sapiens
SEGITCCCS

SEQ ID NO: 558408 - protein, 9 aa, Homo Sapiens
VLQMLKTHR

SEQ ID NO: 558409 - protein, 9 aa, Homo Sapiens
NSLKKRPAS

SEQ ID NO: 558410 - protein, 9 aa, Homo Sapiens
SDFVVSGSD

SEQ ID NO: 558411 - protein, 9 aa, Homo Sapiens
KCRNTIGNF

SEQ ID NO: 558412 - protein, 9 aa, Homo Sapiens
RYLGLLENL

SEQ ID NO: 558413 - protein, 9 aa, Homo Sapiens
IRSPRVVLP

SEQ ID NO: 558414 - protein, 9 aa, Homo Sapiens
EDPRSFYEQ

SEQ ID NO: 558415 - protein, 9 aa, Homo Sapiens
QVVYKTQKF

SEQ ID NO: 558416 - protein, 9 aa, Homo Sapiens
CGGGGRICG

SEQ ID NO: 558417 - protein, 9 aa, Homo Sapiens
VLETAGRHN

SEQ ID NO: 558418 - protein, 9 aa, Homo Sapiens
GGGGRICGP

SEQ ID NO: 558419 - protein, 9 aa, Homo Sapiens
LETAGRHNI

SEQ ID NO: 558420 - protein, 9 aa, Homo Sapiens
EISELPIRT

SEQ ID NO: 558421 - protein, 9 aa, Homo Sapiens
PLPDPGTPS

SEQ ID NO: 558422 - protein, 9 aa, Homo Sapiens
DPGTPSLAV

SEQ ID NO: 558423 - protein, 9 aa, Homo Sapiens
EEPDVPAYS

SEQ ID NO: 558424 - protein, 9 aa, Homo Sapiens
VLMLLSVSQ

SEQ ID NO: 558425 - protein, 9 aa, Homo Sapiens
PRGDGDRWR

SEQ ID NO: 558426 - protein, 9 aa, Homo Sapiens
ETAGRHNIM

SEQ ID NO: 558427 - protein, 9 aa, Homo Sapiens
KDFTGPVTF

SEQ ID NO: 558428 - protein, 9 aa, Homo Sapiens
FYEQGVAVL

SEQ ID NO: 558429 - protein, 9 aa, Homo Sapiens
GRHNIMDFA

SEQ ID NO: 558430 - protein, 9 aa, Homo Sapiens
LKDKFIKDF

SEQ ID NO: 558431 - protein, 9 aa, Homo Sapiens
VGYDRYVAI

SEQ ID NO: 558432 - protein, 9 aa, Homo Sapiens
EPCEEPDVP

SEQ ID NO: 558433 - protein, 9 aa, Homo Sapiens
STYHFKTPE

SEQ ID NO: 558434 - protein, 9 aa, Homo Sapiens
IVDVCKEVL

SEQ ID NO: 558435 - protein, 9 aa, Homo Sapiens
RTGGIGFIH

SEQ ID NO: 558436 - protein, 9 aa, Homo Sapiens
KDKFIKDFT

SEQ ID NO: 558437 - protein, 9 aa, Homo Sapiens
AMARTGGIG

SEQ ID NO: 558438 - protein, 9 aa, Homo Sapiens
PIRTWTQTY

SEQ ID NO: 558439 - protein, 9 aa, Homo Sapiens
RSDFVVSGS

SEQ ID NO: 558440 - protein, 9 aa, Homo Sapiens
QFAPDNNPD

SEQ ID NO: 558441 - protein, 9 aa, Homo Sapiens
TVSSGISTA

SEQ ID NO: 558442 - protein, 9 aa, Homo Sapiens
ENGAFQGIK

SEQ ID NO: 558443 - protein, 9 aa, Homo Sapiens
GTTRARPSC

SEQ ID NO: 558444 - protein, 9 aa, Homo Sapiens
IKDFTGPVT

SEQ ID NO: 558445 - protein, 9 aa, Homo Sapiens
CGPQSQPPL

SEQ ID NO: 558446 - protein, 9 aa, Homo Sapiens
MLAEDMTLC

SEQ ID NO: 558447 - protein, 9 aa, Homo Sapiens
DPRSFYEQG

SEQ ID NO: 558448 - protein, 9 aa, Homo Sapiens
EAWSTHNTV

SEQ ID NO: 558449 - protein, 9 aa, Homo Sapiens
VLAYLHTKG

SEQ ID NO: 558450 - protein, 9 aa, Homo Sapiens
VKEVARELQ

SEQ ID NO: 558451 - protein, 9 aa, Homo Sapiens
TIEISELPI

SEQ ID NO: 558452 - protein, 9 aa, Homo Sapiens
TECDNVLML

SEQ ID NO: 558453 - protein, 9 aa, Homo Sapiens
NDKIFRGVI

SEQ ID NO: 558454 - protein, 9 aa, Homo Sapiens
TIGNFKCRC

SEQ ID NO: 558455 - protein, 9 aa, Homo Sapiens
DMTLCVADF

SEQ ID NO: 558456 - protein, 9 aa, Homo Sapiens
LPIRTWTQT

SEQ ID NO: 558457 - protein, 9 aa, Homo Sapiens
FAGLGPRAP

SEQ ID NO: 558458 - protein, 9 aa, Homo Sapiens
RARPSCVDA

SEQ ID NO: 558459 - protein, 9 aa, Homo Sapiens
WVGGRELSS

SEQ ID NO: 558460 - protein, 9 aa, Homo Sapiens
ADGTFDCIS

SEQ ID NO: 558461 - protein, 9 aa, Homo Sapiens
LWSSQEYLF

SEQ ID NO: 558462 - protein, 9 aa, Homo Sapiens
KEVARELQE

SEQ ID NO: 558463 - protein, 9 aa, Homo Sapiens
RICGPQSQP

SEQ ID NO: 558464 - protein, 9 aa, Homo Sapiens
LPDPGTPSL

SEQ ID NO: 558465 - protein, 9 aa, Homo Sapiens
FIKDFTGPV

SEQ ID NO: 558466 - protein, 9 aa, Homo Sapiens
AWLTPFLRV

SEQ ID NO: 558467 - protein, 9 aa, Homo Sapiens
TPFLRVTTR

SEQ ID NO: 558468 - protein, 9 aa, Homo Sapiens
QQYKNSLKK

SEQ ID NO: 558469 - protein, 9 aa, Homo Sapiens
QVLAYLHTK

SEQ ID NO: 558470 - protein, 9 aa, Homo Sapiens
AEIKEEKIK

SEQ ID NO: 558471 - protein, 9 aa, Homo Sapiens
RLGAGPRGD

SEQ ID NO: 558472 - protein, 9 aa, Homo Sapiens
QFLTTGDPK

SEQ ID NO: 558473 - protein, 9 aa, Homo Sapiens
PAKGYAEIK

SEQ ID NO: 558474 - protein, 9 aa, Homo Sapiens
VGLFRPSQK

SEQ ID NO: 558475 - protein, 9 aa, Homo Sapiens
LRVRRAGYA

SEQ ID NO: 558476 - protein, 9 aa, Homo Sapiens
GITECDNVL

SEQ ID NO: 558477 - protein, 9 aa, Homo Sapiens
PRSDFVVSG

SEQ ID NO: 558478 - protein, 9 aa, Homo Sapiens
MSEVTKKSL

SEQ ID NO: 558479 - protein, 9 aa, Homo Sapiens
TLCVADFGL

SEQ ID NO: 558480 - protein, 9 aa, Homo Sapiens
WRGVCEERK

SEQ ID NO: 558481 - protein, 9 aa, Homo Sapiens
AGISTPAPF

SEQ ID NO: 558482 - protein, 9 aa, Homo Sapiens
AQFAPDNNP

SEQ ID NO: 558483 - protein, 9 aa, Homo Sapiens
PDVLQMLKT

SEQ ID NO: 558484 - protein, 9 aa, Homo Sapiens
ALPPAQSSI

SEQ ID NO: 558485 - protein, 9 aa, Homo Sapiens
GMAIAMART

SEQ ID NO: 558486 - protein, 9 aa, Homo Sapiens
YAEIKEEKI

SEQ ID NO: 558487 - protein, 9 aa, Homo Sapiens
EPSQVIFCI

SEQ ID NO: 558488 - protein, 9 aa, Homo Sapiens
DWASPLENP

SEQ ID NO: 558489 - protein, 9 aa, Homo Sapiens
EEEVKRIVG

SEQ ID NO: 558490 - protein, 9 aa, Homo Sapiens
FDCISMALT

SEQ ID NO: 558491 - protein, 9 aa, Homo Sapiens
QVIFCIRSP

SEQ ID NO: 558492 - protein, 9 aa, Homo Sapiens
PFAGLGPRA

SEQ ID NO: 558493 - protein, 9 aa, Homo Sapiens
QQFLTTGDP

SEQ ID NO: 558494 - protein, 9 aa, Homo Sapiens
APWSLWSSQ

SEQ ID NO: 558495 - protein, 9 aa, Homo Sapiens
KGYAEIKEE

SEQ ID NO: 558496 - protein, 9 aa, Homo Sapiens
EVTKKSLEK

SEQ ID NO: 558497 - protein, 9 aa, Homo Sapiens
VLVGLFRPS

SEQ ID NO: 558498 - protein, 9 aa, Homo Sapiens
TFDCISMAL

SEQ ID NO: 558499 - protein, 9 aa, Homo Sapiens
DCCPFQIPV

SEQ ID NO: 558500 - protein, 9 aa, Homo Sapiens
EHRWRGVCE

SEQ ID NO: 558501 - protein, 9 aa, Homo Sapiens
LKISGLTHE

SEQ ID NO: 558502 - protein, 9 aa, Homo Sapiens
NCLWTLRNI

SEQ ID NO: 558503 - protein, 9 aa, Homo Sapiens
ETLQVLAYL

SEQ ID NO: 558504 - protein, 9 aa, Homo Sapiens
LQESKYQYS

SEQ ID NO: 558505 - protein, 9 aa, Homo Sapiens
LRVTTRRFD

SEQ ID NO: 558506 - protein, 9 aa, Homo Sapiens
DFTGPVTFS

SEQ ID NO: 558507 - protein, 9 aa, Homo Sapiens
PASASGESL

SEQ ID NO: 558508 - protein, 9 aa, Homo Sapiens
LQMLKTHRS

SEQ ID NO: 558509 - protein, 9 aa, Homo Sapiens
TAGRHNIMD

SEQ ID NO: 558510 - protein, 9 aa, Homo Sapiens
TTRARPSCV

SEQ ID NO: 558511 - protein, 9 aa, Homo Sapiens
NVLMLLSVS

SEQ ID NO: 558512 - protein, 9 aa, Homo Sapiens
QGVAVLCTE

SEQ ID NO: 558513 - protein, 9 aa, Homo Sapiens
HWFRIVDVC

SEQ ID NO: 558514 - protein, 9 aa, Homo Sapiens
GIKKLSYIR

SEQ ID NO: 558515 - protein, 9 aa, Homo Sapiens
RPSCVDARI

SEQ ID NO: 558516 - protein, 9 aa, Homo Sapiens
LGAGPRGDG

SEQ ID NO: 558517 - protein, 9 aa, Homo Sapiens
SAPWSLWSS

SEQ ID NO: 558518 - protein, 9 aa, Homo Sapiens
IEISELPIR

SEQ ID NO: 558519 - protein, 9 aa, Homo Sapiens
AKGYAEIKE

SEQ ID NO: 558520 - protein, 9 aa, Homo Sapiens
LTHEIEPIR

SEQ ID NO: 558521 - protein, 9 aa, Homo Sapiens
AGRHNIMDF

SEQ ID NO: 558522 - protein, 9 aa, Homo Sapiens
SPLENPLRS

SEQ ID NO: 558523 - protein, 9 aa, Homo Sapiens
WSSQEYLFW

SEQ ID NO: 558524 - protein, 9 aa, Homo Sapiens
YEQGVAVLC

SEQ ID NO: 558525 - protein, 9 aa, Homo Sapiens
HSQLKELQS

SEQ ID NO: 558526 - protein, 9 aa, Homo Sapiens
ISTATNSES

SEQ ID NO: 558527 - protein, 9 aa, Homo Sapiens
ATKTLPGGA

SEQ ID NO: 558528 - protein, 9 aa, Homo Sapiens
SFYEQGVAV

SEQ ID NO: 558529 - protein, 9 aa, Homo Sapiens
QTYHMWWVC

SEQ ID NO: 558530 - protein, 9 aa, Homo Sapiens
RSHLCPGLP

SEQ ID NO: 558531 - protein, 9 aa, Homo Sapiens
SNVLADFEQ

SEQ ID NO: 558532 - protein, 9 aa, Homo Sapiens
QFRPSGNLP

SEQ ID NO: 558533 - protein, 9 aa, Homo Sapiens
MYPPHLLTA

SEQ ID NO: 558534 - protein, 9 aa, Homo Sapiens
GRTVAGQAM

SEQ ID NO: 558535 - protein, 9 aa, Homo Sapiens
WDFLTGRQL

SEQ ID NO: 558536 - protein, 9 aa, Homo Sapiens
FITRVETYL

SEQ ID NO: 558537 - protein, 9 aa, Homo Sapiens
NHLLPLPLQ

SEQ ID NO: 558538 - protein, 9 aa, Homo Sapiens
KTQIQYDKS

SEQ ID NO: 558539 - protein, 9 aa, Homo Sapiens
KYLERRGPS

SEQ ID NO: 558540 - protein, 9 aa, Homo Sapiens
PAPPFWGLV

SEQ ID NO: 558541 - protein, 9 aa, Homo Sapiens
FRMYCMASR

SEQ ID NO: 558542 - protein, 9 aa, Homo Sapiens
DVFRKLSHL

SEQ ID NO: 558543 - protein, 9 aa, Homo Sapiens
QPAPVDVEP

SEQ ID NO: 558544 - protein, 9 aa, Homo Sapiens
PHWDFLTGR

SEQ ID NO: 558545 - protein, 9 aa, Homo Sapiens
MAELAAQHH

SEQ ID NO: 558546 - protein, 9 aa, Homo Sapiens
TDSSTDVFH

SEQ ID NO: 558547 - protein, 9 aa, Homo Sapiens
SEDRSPRVI

SEQ ID NO: 558548 - protein, 9 aa, Homo Sapiens
THKWAWFRM

SEQ ID NO: 558549 - protein, 9 aa, Homo Sapiens
LRFNETTMC

SEQ ID NO: 558550 - protein, 9 aa, Homo Sapiens
GAVFRKYAI

SEQ ID NO: 558551 - protein, 9 aa, Homo Sapiens
GPEGRTVAG

SEQ ID NO: 558552 - protein, 9 aa, Homo Sapiens
DSSTDVFHL

SEQ ID NO: 558553 - protein, 9 aa, Homo Sapiens
VQTYHMWWV

SEQ ID NO: 558554 - protein, 9 aa, Homo Sapiens
LEGFITRVE

SEQ ID NO: 558555 - protein, 9 aa, Homo Sapiens
PAPYSKALT

SEQ ID NO: 558556 - protein, 9 aa, Homo Sapiens
DSEIKQIKE

SEQ ID NO: 558557 - protein, 9 aa, Homo Sapiens
TSSKTTKNV

SEQ ID NO: 558558 - protein, 9 aa, Homo Sapiens
FGPELRDEF

SEQ ID NO: 558559 - protein, 9 aa, Homo Sapiens
TDVFHLEGM

SEQ ID NO: 558560 - protein, 9 aa, Homo Sapiens
TLSEDRSPR

SEQ ID NO: 558561 - protein, 9 aa, Homo Sapiens
GKSSFKPYS

SEQ ID NO: 558562 - protein, 9 aa, Homo Sapiens
EKYLERRGP

SEQ ID NO: 558563 - protein, 9 aa, Homo Sapiens
ADLAAAGVI

SEQ ID NO: 558564 - protein, 9 aa, Homo Sapiens
ALTQRMYSV

SEQ ID NO: 558565 - protein, 9 aa, Homo Sapiens
EEYRSRSLD

SEQ ID NO: 558566 - protein, 9 aa, Homo Sapiens
CELCQCFGH

SEQ ID NO: 558567 - protein, 9 aa, Homo Sapiens
EETSMRRMD

SEQ ID NO: 558568 - protein, 9 aa, Homo Sapiens
SASRCMSSK

SEQ ID NO: 558569 - protein, 9 aa, Homo Sapiens
NLVRLTKQQ

SEQ ID NO: 558570 - protein, 9 aa, Homo Sapiens
FNETTMCKP

SEQ ID NO: 558571 - protein, 9 aa, Homo Sapiens
IPQQAQELG

SEQ ID NO: 558572 - protein, 9 aa, Homo Sapiens
AFDIVQYSE

SEQ ID NO: 558573 - protein, 9 aa, Homo Sapiens
TLDKEVISQ

SEQ ID NO: 558574 - protein, 9 aa, Homo Sapiens
RTVAGQAML

SEQ ID NO: 558575 - protein, 9 aa, Homo Sapiens
GFITRVETY

SEQ ID NO: 558576 - protein, 9 aa, Homo Sapiens
RELAENLVR

SEQ ID NO: 558577 - protein, 9 aa, Homo Sapiens
ELAAQHHHS

SEQ ID NO: 558578 - protein, 9 aa, Homo Sapiens
WRELAENLV

SEQ ID NO: 558579 - protein, 9 aa, Homo Sapiens
IYGIHALLM

SEQ ID NO: 558580 - protein, 9 aa, Homo Sapiens
GIHALLMVG

SEQ ID NO: 558581 - protein, 9 aa, Homo Sapiens
YVGSLHVWK

SEQ ID NO: 558582 - protein, 9 aa, Homo Sapiens
RLDSASRCM

SEQ ID NO: 558583 - protein, 9 aa, Homo Sapiens
APYSKALTQ

SEQ ID NO: 558584 - protein, 9 aa, Homo Sapiens
ALGIPLIPQ

SEQ ID NO: 558585 - protein, 9 aa, Homo Sapiens
KYAIDLAGL

SEQ ID NO: 558586 - protein, 9 aa, Homo Sapiens
GNFGDGGGN

SEQ ID NO: 558587 - protein, 9 aa, Homo Sapiens
GFATVIAEA

SEQ ID NO: 558588 - protein, 9 aa, Homo Sapiens
KSNVLADFE

SEQ ID NO: 558589 - protein, 9 aa, Homo Sapiens
SMYPPHLLT

SEQ ID NO: 558590 - protein, 9 aa, Homo Sapiens
ATQMAELAA

SEQ ID NO: 558591 - protein, 9 aa, Homo Sapiens
MLSSTAWAA

SEQ ID NO: 558592 - protein, 9 aa, Homo Sapiens
VEGKSSFKP

SEQ ID NO: 558593 - protein, 9 aa, Homo Sapiens
ITLGTSLQF

SEQ ID NO: 558594 - protein, 9 aa, Homo Sapiens
LCQCFGHAE

SEQ ID NO: 558595 - protein, 9 aa, Homo Sapiens
LRALSKKLE

SEQ ID NO: 558596 - protein, 9 aa, Homo Sapiens
SSTDVFHLE

SEQ ID NO: 558597 - protein, 9 aa, Homo Sapiens
CSYVGSLHV

SEQ ID NO: 558598 - protein, 9 aa, Homo Sapiens
QYDKSNVLA

SEQ ID NO: 558599 - protein, 9 aa, Homo Sapiens
QEIKRLSTD

SEQ ID NO: 558600 - protein, 9 aa, Homo Sapiens
TPPPKTSSK

SEQ ID NO: 558601 - protein, 9 aa, Homo Sapiens
EAEATSGTE

SEQ ID NO: 558602 - protein, 9 aa, Homo Sapiens
MGHRGNFGD

SEQ ID NO: 558603 - protein, 9 aa, Homo Sapiens
QDVFRKLSH

SEQ ID NO: 558604 - protein, 9 aa, Homo Sapiens
SPSVGDTER

SEQ ID NO: 558605 - protein, 9 aa, Homo Sapiens
EELRALSKK

SEQ ID NO: 558606 - protein, 9 aa, Homo Sapiens
PVDVEPQAR

SEQ ID NO: 558607 - protein, 9 aa, Homo Sapiens
KLEGFITRV

SEQ ID NO: 558608 - protein, 9 aa, Homo Sapiens
LLMVGGFEA

SEQ ID NO: 558609 - protein, 9 aa, Homo Sapiens
FGDGGGNFG

SEQ ID NO: 558610 - protein, 9 aa, Homo Sapiens
SSTAWAAQA

SEQ ID NO: 558611 - protein, 9 aa, Homo Sapiens
PSVGDTERN

SEQ ID NO: 558612 - protein, 9 aa, Homo Sapiens
TAFDIVQYS

SEQ ID NO: 558613 - protein, 9 aa, Homo Sapiens
GDGGGNFGR

SEQ ID NO: 558614 - protein, 9 aa, Homo Sapiens
AKGFATVIA

SEQ ID NO: 558615 - protein, 9 aa, Homo Sapiens
LSKKLEQEL

SEQ ID NO: 558616 - protein, 9 aa, Homo Sapiens
ASRCMSSKG

SEQ ID NO: 558617 - protein, 9 aa, Homo Sapiens
PPHLLTAQY

SEQ ID NO: 558618 - protein, 9 aa, Homo Sapiens
PEKVTSANK

SEQ ID NO: 558619 - protein, 9 aa, Homo Sapiens
DKSNVLADF

SEQ ID NO: 558620 - protein, 9 aa, Homo Sapiens
QQHMRIGLL

SEQ ID NO: 558621 - protein, 9 aa, Homo Sapiens
EIKQIKEKQ

SEQ ID NO: 558622 - protein, 9 aa, Homo Sapiens
LDSASRCMS

SEQ ID NO: 558623 - protein, 9 aa, Homo Sapiens
PQPAPVDVE

SEQ ID NO: 558624 - protein, 9 aa, Homo Sapiens
LAAAGVILL

SEQ ID NO: 558625 - protein, 9 aa, Homo Sapiens
QMAELAAQH

SEQ ID NO: 558626 - protein, 9 aa, Homo Sapiens
NCMDIDECV

SEQ ID NO: 558627 - protein, 9 aa, Homo Sapiens
FRKLSHLPT

SEQ ID NO: 558628 - protein, 9 aa, Homo Sapiens
GPELRDEFS

SEQ ID NO: 558629 - protein, 9 aa, Homo Sapiens
MVGGFEAYE

SEQ ID NO: 558630 - protein, 9 aa, Homo Sapiens
ALLMVGGFE

SEQ ID NO: 558631 - protein, 9 aa, Homo Sapiens
SKKLEQELD

SEQ ID NO: 558632 - protein, 9 aa, Homo Sapiens
IKQIKEKQD

SEQ ID NO: 558633 - protein, 9 aa, Homo Sapiens
LKVPHWDFL

SEQ ID NO: 558634 - protein, 9 aa, Homo Sapiens
ETSMRRMDT

SEQ ID NO: 558635 - protein, 9 aa, Homo Sapiens
SLSKTLTLD

SEQ ID NO: 558636 - protein, 9 aa, Homo Sapiens
PTPPPKTSS

SEQ ID NO: 558637 - protein, 9 aa, Homo Sapiens
TQMAELAAQ

SEQ ID NO: 558638 - protein, 9 aa, Homo Sapiens
VLRFNETTM

SEQ ID NO: 558639 - protein, 9 aa, Homo Sapiens
PVRSHLCPG

SEQ ID NO: 558640 - protein, 9 aa, Homo Sapiens
ICELCQCFG

SEQ ID NO: 558641 - protein, 9 aa, Homo Sapiens
KSDSPSVGD

SEQ ID NO: 558642 - protein, 9 aa, Homo Sapiens
KMQQHMRIG

SEQ ID NO: 558643 - protein, 9 aa, Homo Sapiens
TDHSSVSEY

SEQ ID NO: 558644 - protein, 9 aa, Homo Sapiens
RMYCMASRV

SEQ ID NO: 558645 - protein, 9 aa, Homo Sapiens
MDIDECVRN

SEQ ID NO: 558646 - protein, 9 aa, Homo Sapiens
HCRMVQTYH

SEQ ID NO: 558647 - protein, 9 aa, Homo Sapiens
VPAPPFWGL

SEQ ID NO: 558648 - protein, 9 aa, Homo Sapiens
GIPLIPQQA

SEQ ID NO: 558649 - protein, 9 aa, Homo Sapiens
TAEELRALS

SEQ ID NO: 558650 - protein, 9 aa, Homo Sapiens
FVPAPPFWG

SEQ ID NO: 558651 - protein, 9 aa, Homo Sapiens
DSPSVGDTE

SEQ ID NO: 558652 - protein, 9 aa, Homo Sapiens
SANKTNKQT

SEQ ID NO: 558653 - protein, 9 aa, Homo Sapiens
TAWAAQAPT

SEQ ID NO: 558654 - protein, 9 aa, Homo Sapiens
QIQYDKSNV

SEQ ID NO: 558655 - protein, 9 aa, Homo Sapiens
YLERRGPSN

SEQ ID NO: 558656 - protein, 9 aa, Homo Sapiens
NERIKLEGF

SEQ ID NO: 558657 - protein, 9 aa, Homo Sapiens
RNKPEVDKA

SEQ ID NO: 558658 - protein, 9 aa, Homo Sapiens
TKDGELPFF

SEQ ID NO: 558659 - protein, 9 aa, Homo Sapiens
TTIDTKDGE

SEQ ID NO: 558660 - protein, 9 aa, Homo Sapiens
VFRKLSHLP

SEQ ID NO: 558661 - protein, 9 aa, Homo Sapiens
GVILLCHFF

SEQ ID NO: 558662 - protein, 9 aa, Homo Sapiens
DVEPQARFR

SEQ ID NO: 558663 - protein, 9 aa, Homo Sapiens
GGCYEEYRS

SEQ ID NO: 558664 - protein, 9 aa, Homo Sapiens
LPTPPPKTS

SEQ ID NO: 558665 - protein, 9 aa, Homo Sapiens
QHMRIGLLD

SEQ ID NO: 558666 - protein, 9 aa, Homo Sapiens
FRLEFFHRK

SEQ ID NO: 558667 - protein, 9 aa, Homo Sapiens
GLGGEAVGT

SEQ ID NO: 558668 - protein, 9 aa, Homo Sapiens
ESNCAGNDV

SEQ ID NO: 558669 - protein, 9 aa, Homo Sapiens
PPQPAPVDV

SEQ ID NO: 558670 - protein, 9 aa, Homo Sapiens
DEFSKLQNK

SEQ ID NO: 558671 - protein, 9 aa, Homo Sapiens
LCPGLPLWA

SEQ ID NO: 558672 - protein, 9 aa, Homo Sapiens
TQHPESNCA

SEQ ID NO: 558673 - protein, 9 aa, Homo Sapiens
ATILPNFGA

SEQ ID NO: 558674 - protein, 9 aa, Homo Sapiens
GWRELAENL

SEQ ID NO: 558675 - protein, 9 aa, Homo Sapiens
DIVQYSEPQ

SEQ ID NO: 558676 - protein, 9 aa, Homo Sapiens
SKTLTLDKE

SEQ ID NO: 558677 - protein, 9 aa, Homo Sapiens
GGEAVGTGE

SEQ ID NO: 558678 - protein, 9 aa, Homo Sapiens
QHPESNCAG

SEQ ID NO: 558679 - protein, 9 aa, Homo Sapiens
MVQTYHMWW

SEQ ID NO: 558680 - protein, 9 aa, Homo Sapiens
AKPPVRSHL

SEQ ID NO: 558681 - protein, 9 aa, Homo Sapiens
SNCAGNDVF

SEQ ID NO: 558682 - protein, 9 aa, Homo Sapiens
IDECVRNPL

SEQ ID NO: 558683 - protein, 9 aa, Homo Sapiens
NFGDGGGNF

SEQ ID NO: 558684 - protein, 9 aa, Homo Sapiens
GTEKKCGGD

SEQ ID NO: 558685 - protein, 9 aa, Homo Sapiens
AWAAQAPTP

SEQ ID NO: 558686 - protein, 9 aa, Homo Sapiens
SFRVKWLRR

SEQ ID NO: 558687 - protein, 9 aa, Homo Sapiens
LQGNFVPAP

SEQ ID NO: 558688 - protein, 9 aa, Homo Sapiens
PPVRSHLCP

SEQ ID NO: 558689 - protein, 9 aa, Homo Sapiens
RALSKKLEQ

SEQ ID NO: 558690 - protein, 9 aa, Homo Sapiens
SVGDTERNS

SEQ ID NO: 558691 - protein, 9 aa, Homo Sapiens
KTLTLDKEV

SEQ ID NO: 558692 - protein, 9 aa, Homo Sapiens
HPGLGGEAV

SEQ ID NO: 558693 - protein, 9 aa, Homo Sapiens
DECVRNPLL

SEQ ID NO: 558694 - protein, 9 aa, Homo Sapiens
LTQRMYSVL

SEQ ID NO: 558695 - protein, 9 aa, Homo Sapiens
FSSMYPPHL

SEQ ID NO: 558696 - protein, 9 aa, Homo Sapiens
KDGELPFFN

SEQ ID NO: 558697 - protein, 9 aa, Homo Sapiens
AIDLAGLLQ

SEQ ID NO: 558698 - protein, 9 aa, Homo Sapiens
TQRMYSVLT

SEQ ID NO: 558699 - protein, 9 aa, Homo Sapiens
STAWAAQAP

SEQ ID NO: 558700 - protein, 9 aa, Homo Sapiens
PSNFLAKLY

SEQ ID NO: 558701 - protein, 9 aa, Homo Sapiens
EISLSKTLT

SEQ ID NO: 558702 - protein, 9 aa, Homo Sapiens
VFRLEFFHR

SEQ ID NO: 558703 - protein, 9 aa, Homo Sapiens
VEPQARFRV

SEQ ID NO: 558704 - protein, 9 aa, Homo Sapiens
SMRRMDTIS

SEQ ID NO: 558705 - protein, 9 aa, Homo Sapiens
RLSTDHSSV

SEQ ID NO: 558706 - protein, 9 aa, Homo Sapiens
KVPHWDFLT

SEQ ID NO: 558707 - protein, 9 aa, Homo Sapiens
ANKTNKQTT

SEQ ID NO: 558708 - protein, 9 aa, Homo Sapiens
KPEVDKAAV

SEQ ID NO: 558709 - protein, 9 aa, Homo Sapiens
SDSPSVGDT

SEQ ID NO: 558710 - protein, 9 aa, Homo Sapiens
IFGGICELC

SEQ ID NO: 558711 - protein, 9 aa, Homo Sapiens
TIFGGICEL

SEQ ID NO: 558712 - protein, 9 aa, Homo Sapiens
YPPHLLTAQ

SEQ ID NO: 558713 - protein, 9 aa, Homo Sapiens
TEKKCGGDR

SEQ ID NO: 558714 - protein, 9 aa, Homo Sapiens
LSKTLTLDK

SEQ ID NO: 558715 - protein, 9 aa, Homo Sapiens
MDTISQHIA

SEQ ID NO: 558716 - protein, 9 aa, Homo Sapiens
ASKMQQHMR

SEQ ID NO: 558717 - protein, 9 aa, Homo Sapiens
VVGGTDSST

SEQ ID NO: 558718 - protein, 9 aa, Homo Sapiens
IHALLMVGG

SEQ ID NO: 558719 - protein, 9 aa, Homo Sapiens
EDCATILPN

SEQ ID NO: 558720 - protein, 9 aa, Homo Sapiens
AELAAQHHH

SEQ ID NO: 558721 - protein, 9 aa, Homo Sapiens
LSANHLLPL

SEQ ID NO: 558722 - protein, 9 aa, Homo Sapiens
GHRGNFGDG

SEQ ID NO: 558723 - protein, 9 aa, Homo Sapiens
KRLSTDHSS

SEQ ID NO: 558724 - protein, 9 aa, Homo Sapiens
TSMRRMDTI

SEQ ID NO: 558725 - protein, 9 aa, Homo Sapiens
ELPFFNVSL

SEQ ID NO: 558726 - protein, 9 aa, Homo Sapiens
WFRMYCMAS

SEQ ID NO: 558727 - protein, 9 aa, Homo Sapiens
DTERNSAEP

SEQ ID NO: 558728 - protein, 9 aa, Homo Sapiens
KIPASKMQQ

SEQ ID NO: 558729 - protein, 9 aa, Homo Sapiens
SGTEKKCGG

SEQ ID NO: 558730 - protein, 9 aa, Homo Sapiens
FHRKFEILD

SEQ ID NO: 558731 - protein, 9 aa, Homo Sapiens
EHPGLGGEA

SEQ ID NO: 558732 - protein, 9 aa, Homo Sapiens
EIKRLSTDH

SEQ ID NO: 558733 - protein, 9 aa, Homo Sapiens
HLGPEGRTV

SEQ ID NO: 558734 - protein, 9 aa, Homo Sapiens
MFHCRMVQT

SEQ ID NO: 558735 - protein, 9 aa, Homo Sapiens
VTSANKTNK

SEQ ID NO: 558736 - protein, 9 aa, Homo Sapiens
EVDKAAVDA

SEQ ID NO: 558737 - protein, 9 aa, Homo Sapiens
PELRDEFSK

SEQ ID NO: 558738 - protein, 9 aa, Homo Sapiens
LIPQQAQEL

SEQ ID NO: 558739 - protein, 9 aa, Homo Sapiens
DTKDGELPF

SEQ ID NO: 558740 - protein, 9 aa, Homo Sapiens
ANHLLPLPL

SEQ ID NO: 558741 - protein, 9 aa, Homo Sapiens
SKALTQRMY

SEQ ID NO: 558742 - protein, 9 aa, Homo Sapiens
FALSMLSAN

SEQ ID NO: 558743 - protein, 9 aa, Homo Sapiens
TILPNFGAD

SEQ ID NO: 558744 - protein, 9 aa, Homo Sapiens
ENLVRLTKQ

SEQ ID NO: 558745 - protein, 9 aa, Homo Sapiens
IDTKDGELP

SEQ ID NO: 558746 - protein, 9 aa, Homo Sapiens
RKLSHLPTF

SEQ ID NO: 558747 - protein, 9 aa, Homo Sapiens
VGDTERNSA

SEQ ID NO: 558748 - protein, 9 aa, Homo Sapiens
DLAAAGVIL

SEQ ID NO: 558749 - protein, 9 aa, Homo Sapiens
TAKGFATVI

SEQ ID NO: 558750 - protein, 9 aa, Homo Sapiens
RMVQTYHMW

SEQ ID NO: 558751 - protein, 9 aa, Homo Sapiens
TQIQYDKSN

SEQ ID NO: 558752 - protein, 9 aa, Homo Sapiens
LERRGPSNF

SEQ ID NO: 558753 - protein, 9 aa, Homo Sapiens
NFVPAPPFW

SEQ ID NO: 558754 - protein, 9 aa, Homo Sapiens
GDTERNSAE

SEQ ID NO: 558755 - protein, 9 aa, Homo Sapiens
KAAVDAILS

SEQ ID NO: 558756 - protein, 9 aa, Homo Sapiens
LRDEFSKLQ

SEQ ID NO: 558757 - protein, 9 aa, Homo Sapiens
FRPSGNLPL

SEQ ID NO: 558758 - protein, 9 aa, Homo Sapiens
KLSHLPTFS

SEQ ID NO: 558759 - protein, 9 aa, Homo Sapiens
KRLDSASRC

SEQ ID NO: 558760 - protein, 9 aa, Homo Sapiens
FAATQMAEL

SEQ ID NO: 558761 - protein, 9 aa, Homo Sapiens
IAEAVTSLD

SEQ ID NO: 558762 - protein, 9 aa, Homo Sapiens
DIGVEGKSS

SEQ ID NO: 558763 - protein, 9 aa, Homo Sapiens
SAMLSSTAW

SEQ ID NO: 558764 - protein, 9 aa, Homo Sapiens
RMDTISQHI

SEQ ID NO: 558765 - protein, 9 aa, Homo Sapiens
MRRMDTISQ

SEQ ID NO: 558766 - protein, 9 aa, Homo Sapiens
GELPFFNVS

SEQ ID NO: 558767 - protein, 9 aa, Homo Sapiens
RIKLEGFIT

SEQ ID NO: 558768 - protein, 9 aa, Homo Sapiens
RRMDTISQH

SEQ ID NO: 558769 - protein, 9 aa, Homo Sapiens
YEEYRSRSL

SEQ ID NO: 558770 - protein, 9 aa, Homo Sapiens
PYSKALTQR

SEQ ID NO: 558771 - protein, 9 aa, Homo Sapiens
SRCMSSKGP

SEQ ID NO: 558772 - protein, 9 aa, Homo Sapiens
RGPSNFLAK

SEQ ID NO: 558773 - protein, 9 aa, Homo Sapiens
FATVIAEAV

SEQ ID NO: 558774 - protein, 9 aa, Homo Sapiens
TMCKPLVPR

SEQ ID NO: 558775 - protein, 9 aa, Homo Sapiens
MYCMASRVA

SEQ ID NO: 558776 - protein, 9 aa, Homo Sapiens
APVDVEPQA

SEQ ID NO: 558777 - protein, 9 aa, Homo Sapiens
HRGNFGDGG

SEQ ID NO: 558778 - protein, 9 aa, Homo Sapiens
SKMQQHMRI

SEQ ID NO: 558779 - protein, 9 aa, Homo Sapiens
RDEFSKLQN

SEQ ID NO: 558780 - protein, 9 aa, Homo Sapiens
HQDVFRKLS

SEQ ID NO: 558781 - protein, 9 aa, Homo Sapiens
RFNETTMCK

SEQ ID NO: 558782 - protein, 9 aa, Homo Sapiens
CAGNDVFAK

SEQ ID NO: 558783 - protein, 9 aa, Homo Sapiens
DCATILPNF

SEQ ID NO: 558784 - protein, 9 aa, Homo Sapiens
SMLSANHLL

SEQ ID NO: 558785 - protein, 9 aa, Homo Sapiens
IPLIPQQAQ

SEQ ID NO: 558786 - protein, 9 aa, Homo Sapiens
AMLSSTAWA

SEQ ID NO: 558787 - protein, 9 aa, Homo Sapiens
GTSLQFRPS

SEQ ID NO: 558788 - protein, 9 aa, Homo Sapiens
TTMCKPLVP

SEQ ID NO: 558789 - protein, 9 aa, Homo Sapiens
EGFITRVET

SEQ ID NO: 558790 - protein, 9 aa, Homo Sapiens
AATQMAELA

SEQ ID NO: 558791 - protein, 9 aa, Homo Sapiens
LGPEGRTVA

SEQ ID NO: 558792 - protein, 9 aa, Homo Sapiens
RRGPSNFLA

SEQ ID NO: 558793 - protein, 9 aa, Homo Sapiens
NCAGNDVFA

SEQ ID NO: 558794 - protein, 9 aa, Homo Sapiens
MCKPLVPRE

SEQ ID NO: 558795 - protein, 9 aa, Homo Sapiens
LLPTPPPKT

SEQ ID NO: 558796 - protein, 9 aa, Homo Sapiens
YDKSNVLAD

SEQ ID NO: 558797 - protein, 9 aa, Homo Sapiens
RSRSLDANS

SEQ ID NO: 558798 - protein, 9 aa, Homo Sapiens
IQYDKSNVL

SEQ ID NO: 558799 - protein, 9 aa, Homo Sapiens
IGVEGKSSF

SEQ ID NO: 558800 - protein, 9 aa, Homo Sapiens
SANHLLPLP

SEQ ID NO: 558801 - protein, 9 aa, Homo Sapiens
NFAATQMAE

SEQ ID NO: 558802 - protein, 9 aa, Homo Sapiens
AVFRKYAID

SEQ ID NO: 558803 - protein, 9 aa, Homo Sapiens
VDVEPQARF

SEQ ID NO: 558804 - protein, 9 aa, Homo Sapiens
YLTLSEDRS

SEQ ID NO: 558805 - protein, 9 aa, Homo Sapiens
PGLGGEAVG

SEQ ID NO: 558806 - protein, 9 aa, Homo Sapiens
TSLQFRPSG

SEQ ID NO: 558807 - protein, 9 aa, Homo Sapiens
DGGGNFGRD

SEQ ID NO: 558808 - protein, 9 aa, Homo Sapiens
KPPVRSHLC

SEQ ID NO: 558809 - protein, 9 aa, Homo Sapiens
STDHSSVSE

SEQ ID NO: 558810 - protein, 9 aa, Homo Sapiens
TIDTKDGEL

SEQ ID NO: 558811 - protein, 9 aa, Homo Sapiens
FRKYAIDLA

SEQ ID NO: 558812 - protein, 9 aa, Homo Sapiens
LGIPLIPQQ

SEQ ID NO: 558813 - protein, 9 aa, Homo Sapiens
RLEFFHRKF

SEQ ID NO: 558814 - protein, 9 aa, Homo Sapiens
LGGEAVGTG

SEQ ID NO: 558815 - protein, 9 aa, Homo Sapiens
FLTGRQLRT

SEQ ID NO: 558816 - protein, 9 aa, Homo Sapiens
AWFRMYCMA

SEQ ID NO: 558817 - protein, 9 aa, Homo Sapiens
DSASRCMSS

SEQ ID NO: 558818 - protein, 9 aa, Homo Sapiens
ILPNFGADP

SEQ ID NO: 558819 - protein, 9 aa, Homo Sapiens
GCYEEYRSR

SEQ ID NO: 558820 - protein, 9 aa, Homo Sapiens
FGGICELCQ

SEQ ID NO: 558821 - protein, 9 aa, Homo Sapiens
HRKFEILDA

SEQ ID NO: 558822 - protein, 9 aa, Homo Sapiens
TSGTEKKCG

SEQ ID NO: 558823 - protein, 9 aa, Homo Sapiens
ELCQCFGHA

SEQ ID NO: 558824 - protein, 9 aa, Homo Sapiens
AEAEATSGT

SEQ ID NO: 558825 - protein, 9 aa, Homo Sapiens
PHLLTAQYG

SEQ ID NO: 558826 - protein, 9 aa, Homo Sapiens
LSDIGVEGK

SEQ ID NO: 558827 - protein, 9 aa, Homo Sapiens
LTLSEDRSP

SEQ ID NO: 558828 - protein, 9 aa, Homo Sapiens
ECVRNPLLC

SEQ ID NO: 558829 - protein, 9 aa, Homo Sapiens
VIAEAVTSL

SEQ ID NO: 558830 - protein, 9 aa, Homo Sapiens
CATILPNFG

SEQ ID NO: 558831 - protein, 9 aa, Homo Sapiens
YSKALTQRM

SEQ ID NO: 558832 - protein, 9 aa, Homo Sapiens
GICELCQCF

SEQ ID NO: 558833 - protein, 9 aa, Homo Sapiens
TPQEHPGLG

SEQ ID NO: 558834 - protein, 9 aa, Homo Sapiens
DFLTGRQLR

SEQ ID NO: 558835 - protein, 9 aa, Homo Sapiens
VGSLHVWKS

SEQ ID NO: 558836 - protein, 9 aa, Homo Sapiens
RKFEILDAV

SEQ ID NO: 558837 - protein, 9 aa, Homo Sapiens
YAIDLAGLL

SEQ ID NO: 558838 - protein, 9 aa, Homo Sapiens
EFFHRKFEI

SEQ ID NO: 558839 - protein, 9 aa, Homo Sapiens
LMVGGFEAY

SEQ ID NO: 558840 - protein, 9 aa, Homo Sapiens
GGTDSSTDV

SEQ ID NO: 558841 - protein, 9 aa, Homo Sapiens
EGRTVAGQA

SEQ ID NO: 558842 - protein, 9 aa, Homo Sapiens
LHVWKSELP

SEQ ID NO: 558843 - protein, 9 aa, Homo Sapiens
TYLTLSEDR

SEQ ID NO: 558844 - protein, 9 aa, Homo Sapiens
ERIKLEGFI

SEQ ID NO: 558845 - protein, 9 aa, Homo Sapiens
KWAWFRMYC

SEQ ID NO: 558846 - protein, 9 aa, Homo Sapiens
PEVDKAAVD

SEQ ID NO: 558847 - protein, 9 aa, Homo Sapiens
HKWAWFRMY

SEQ ID NO: 558848 - protein, 9 aa, Homo Sapiens
STDVFHLEG

SEQ ID NO: 558849 - protein, 9 aa, Homo Sapiens
SLQFRPSGN

SEQ ID NO: 558850 - protein, 9 aa, Homo Sapiens
PASKMQQHM

SEQ ID NO: 558851 - protein, 9 aa, Homo Sapiens
PNFGADPDL

SEQ ID NO: 558852 - protein, 9 aa, Homo Sapiens
DHSSVSEYH

SEQ ID NO: 558853 - protein, 9 aa, Homo Sapiens
TVAGQAMLL

SEQ ID NO: 558854 - protein, 9 aa, Homo Sapiens
LQFRPSGNL

SEQ ID NO: 558855 - protein, 9 aa, Homo Sapiens
CVRNPLLCR

SEQ ID NO: 558856 - protein, 9 aa, Homo Sapiens
SDIGVEGKS

SEQ ID NO: 558857 - protein, 9 aa, Homo Sapiens
PPKTSSKTT

SEQ ID NO: 558858 - protein, 9 aa, Homo Sapiens
LSTDHSSVS

SEQ ID NO: 558859 - protein, 9 aa, Homo Sapiens
LSSTAWAAQ

SEQ ID NO: 558860 - protein, 9 aa, Homo Sapiens
QEHPGLGGE

SEQ ID NO: 558861 - protein, 9 aa, Homo Sapiens
NEDCATILP

SEQ ID NO: 558862 - protein, 9 aa, Homo Sapiens
DKAAVDAIL

SEQ ID NO: 558863 - protein, 9 aa, Homo Sapiens
FHCRMVQTY

SEQ ID NO: 558864 - protein, 9 aa, Homo Sapiens
LSMLSANHL

SEQ ID NO: 558865 - protein, 9 aa, Homo Sapiens
CGAVFRKYA

SEQ ID NO: 558866 - protein, 9 aa, Homo Sapiens
QTDSEIKQI

SEQ ID NO: 558867 - protein, 9 aa, Homo Sapiens
QIKEKQDVL

SEQ ID NO: 558868 - protein, 9 aa, Homo Sapiens
VGGTDSSTD

SEQ ID NO: 558869 - protein, 9 aa, Homo Sapiens
LPNFGADPD

SEQ ID NO: 558870 - protein, 9 aa, Homo Sapiens
HVWKSELPR

SEQ ID NO: 558871 - protein, 9 aa, Homo Sapiens
EDRSPRVII

SEQ ID NO: 558872 - protein, 9 aa, Homo Sapiens
LSEDRSPRV

SEQ ID NO: 558873 - protein, 9 aa, Homo Sapiens
IKETAFDIV

SEQ ID NO: 558874 - protein, 9 aa, Homo Sapiens
FFHRKFEIL

SEQ ID NO: 558875 - protein, 9 aa, Homo Sapiens
FDIVQYSEP

SEQ ID NO: 558876 - protein, 9 aa, Homo Sapiens
GTDSSTDVF

SEQ ID NO: 558877 - protein, 9 aa, Homo Sapiens
VTHQDVFRK

SEQ ID NO: 558878 - protein, 9 aa, Homo Sapiens
LLTAQYGVK

SEQ ID NO: 558879 - protein, 9 aa, Homo Sapiens
KGFATVIAE

SEQ ID NO: 558880 - protein, 9 aa, Homo Sapiens
VRSHLCPGL

SEQ ID NO: 558881 - protein, 9 aa, Homo Sapiens
TDSEIKQIK

SEQ ID NO: 558882 - protein, 9 aa, Homo Sapiens
PEGRTVAGQ

SEQ ID NO: 558883 - protein, 9 aa, Homo Sapiens
VRNPLLCRG

SEQ ID NO: 558884 - protein, 9 aa, Homo Sapiens
ALSKKLEQE

SEQ ID NO: 558885 - protein, 9 aa, Homo Sapiens
QGNFVPAPP

SEQ ID NO: 558886 - protein, 9 aa, Homo Sapiens
CMDIDECVR

SEQ ID NO: 558887 - protein, 9 aa, Homo Sapiens
ACSYVGSLH

SEQ ID NO: 558888 - protein, 9 aa, Homo Sapiens
VPHWDFLTG

SEQ ID NO: 558889 - protein, 9 aa, Homo Sapiens
PQEHPGLGG

SEQ ID NO: 558890 - protein, 9 aa, Homo Sapiens
ISLSKTLTL

SEQ ID NO: 558891 - protein, 9 aa, Homo Sapiens
MQQHMRIGL

SEQ ID NO: 558892 - protein, 9 aa, Homo Sapiens
AEELRALSK

SEQ ID NO: 558893 - protein, 9 aa, Homo Sapiens
GHLGPEGRT

SEQ ID NO: 558894 - protein, 9 aa, Homo Sapiens
SEIKQIKEK

SEQ ID NO: 558895 - protein, 9 aa, Homo Sapiens
DIDECVRNP

SEQ ID NO: 558896 - protein, 9 aa, Homo Sapiens
LAENLVRLT

SEQ ID NO: 558897 - protein, 9 aa, Homo Sapiens
PKTSSKTTK

SEQ ID NO: 558898 - protein, 9 aa, Homo Sapiens
LGTSLQFRP

SEQ ID NO: 558899 - protein, 9 aa, Homo Sapiens
KAFGPELRD

SEQ ID NO: 558900 - protein, 9 aa, Homo Sapiens
TLTLDKEVI

SEQ ID NO: 558901 - protein, 9 aa, Homo Sapiens
APPFWGLVN

SEQ ID NO: 558902 - protein, 9 aa, Homo Sapiens
GNKRLDSAS

SEQ ID NO: 558903 - protein, 9 aa, Homo Sapiens
FSFRVKWLR

SEQ ID NO: 558904 - protein, 9 aa, Homo Sapiens
HLLTAQYGV

SEQ ID NO: 558905 - protein, 9 aa, Homo Sapiens
KGWRELAEN

SEQ ID NO: 558906 - protein, 9 aa, Homo Sapiens
NKRLDSASR

SEQ ID NO: 558907 - protein, 9 aa, Homo Sapiens
WAWFRMYCM

SEQ ID NO: 558908 - protein, 9 aa, Homo Sapiens
PPPKTSSKT

SEQ ID NO: 558909 - protein, 9 aa, Homo Sapiens
YGIHALLMV

SEQ ID NO: 558910 - protein, 9 aa, Homo Sapiens
NLQGNFVPA

SEQ ID NO: 558911 - protein, 9 aa, Homo Sapiens
KALTQRMYS

SEQ ID NO: 558912 - protein, 9 aa, Homo Sapiens
VQYSEPQSR

SEQ ID NO: 558913 - protein, 9 aa, Homo Sapiens
NKTNKQTTT

SEQ ID NO: 558914 - protein, 9 aa, Homo Sapiens
LEFFHRKFE

SEQ ID NO: 558915 - protein, 9 aa, Homo Sapiens
RSPRVIIHN

SEQ ID NO: 558916 - protein, 9 aa, Homo Sapiens
IKRLSTDHS

SEQ ID NO: 558917 - protein, 9 aa, Homo Sapiens
PAPVDVEPQ

SEQ ID NO: 558918 - protein, 9 aa, Homo Sapiens
GTQHPESNC

SEQ ID NO: 558919 - protein, 9 aa, Homo Sapiens
TVIAEAVTS

SEQ ID NO: 558920 - protein, 9 aa, Homo Sapiens
RKYAIDLAG

SEQ ID NO: 558921 - protein, 9 aa, Homo Sapiens
AENLVRLTK

SEQ ID NO: 558922 - protein, 9 aa, Homo Sapiens
HMFHCRMVQ

SEQ ID NO: 558923 - protein, 9 aa, Homo Sapiens
MLSANHLLP

SEQ ID NO: 558924 - protein, 9 aa, Homo Sapiens
VDKAAVDAI

SEQ ID NO: 558925 - protein, 9 aa, Homo Sapiens
GVEGKSSFK

SEQ ID NO: 558926 - protein, 9 aa, Homo Sapiens
ATVIAEAVT

SEQ ID NO: 558927 - protein, 9 aa, Homo Sapiens
HLCPGLPLW

SEQ ID NO: 558928 - protein, 9 aa, Homo Sapiens
AAGVILLCH

SEQ ID NO: 558929 - protein, 9 aa, Homo Sapiens
IKLEGFITR

SEQ ID NO: 558930 - protein, 9 aa, Homo Sapiens
VILLCHFFT

SEQ ID NO: 558931 - protein, 9 aa, Homo Sapiens
IKEKQDVLQ

SEQ ID NO: 558932 - protein, 9 aa, Homo Sapiens
EGKSSFKPY

SEQ ID NO: 558933 - protein, 9 aa, Homo Sapiens
TSANKTNKQ

SEQ ID NO: 558934 - protein, 9 aa, Homo Sapiens
EATSGTEKK

SEQ ID NO: 558935 - protein, 9 aa, Homo Sapiens
ETTMCKPLV

SEQ ID NO: 558936 - protein, 9 aa, Homo Sapiens
SSMYPPHLL

SEQ ID NO: 558937 - protein, 9 aa, Homo Sapiens
ERRGPSNFL

SEQ ID NO: 558938 - protein, 9 aa, Homo Sapiens
KETAFDIVQ

SEQ ID NO: 558939 - protein, 9 aa, Homo Sapiens
RGNFGDGGG

SEQ ID NO: 558940 - protein, 9 aa, Homo Sapiens
GNFVPAPPF

SEQ ID NO: 558941 - protein, 9 aa, Homo Sapiens
KVTSANKTN

SEQ ID NO: 558942 - protein, 9 aa, Homo Sapiens
SYVGSLHVW

SEQ ID NO: 558943 - protein, 9 aa, Homo Sapiens
ATSGTEKKC

SEQ ID NO: 558944 - protein, 9 aa, Homo Sapiens
SPEKVTSAN

SEQ ID NO: 558945 - protein, 9 aa, Homo Sapiens
IRNKPEVDK

SEQ ID NO: 558946 - protein, 9 aa, Homo Sapiens
ELAENLVRL

SEQ ID NO: 558947 - protein, 9 aa, Homo Sapiens
DGELPFFNV

SEQ ID NO: 558948 - protein, 9 aa, Homo Sapiens
EYRSRSLDA

SEQ ID NO: 558949 - protein, 9 aa, Homo Sapiens
FRVKWLRRS

SEQ ID NO: 558950 - protein, 9 aa, Homo Sapiens
LTLDKEVIS

SEQ ID NO: 558951 - protein, 9 aa, Homo Sapiens
EKVTSANKT

SEQ ID NO: 558952 - protein, 9 aa, Homo Sapiens
THQDVFRKL

SEQ ID NO: 558953 - protein, 9 aa, Homo Sapiens
KTSSKTTKN

SEQ ID NO: 558954 - protein, 9 aa, Homo Sapiens
CRMVQTYHM

SEQ ID NO: 558955 - protein, 9 aa, Homo Sapiens
AEATSGTEK

SEQ ID NO: 558956 - protein, 9 aa, Homo Sapiens
LTGRQLRTS

SEQ ID NO: 558957 - protein, 9 aa, Homo Sapiens
YRSRSLDAN

SEQ ID NO: 558958 - protein, 9 aa, Homo Sapiens
AAAGVILLC

SEQ ID NO: 558959 - protein, 9 aa, Homo Sapiens
ILLCHFFTD

SEQ ID NO: 558960 - protein, 9 aa, Homo Sapiens
RPPGLSKSR

SEQ ID NO: 558961 - protein, 9 aa, Homo Sapiens
ETAFDIVQY

SEQ ID NO: 558962 - protein, 9 aa, Homo Sapiens
DTISQHIAK

SEQ ID NO: 558963 - protein, 9 aa, Homo Sapiens
SHLCPGLPL

SEQ ID NO: 558964 - protein, 9 aa, Homo Sapiens
SRSLDANSG

SEQ ID NO: 558965 - protein, 9 aa, Homo Sapiens
AGVILLCHF

SEQ ID NO: 558966 - protein, 9 aa, Homo Sapiens
IPASKMQQH

SEQ ID NO: 558967 - protein, 9 aa, Homo Sapiens
ELRALSKKL

SEQ ID NO: 558968 - protein, 9 aa, Homo Sapiens
ELRDEFSKL

SEQ ID NO: 558969 - protein, 9 aa, Homo Sapiens
CYEEYRSRS

SEQ ID NO: 558970 - protein, 9 aa, Homo Sapiens
HWDFLTGRQ

SEQ ID NO: 558971 - protein, 9 aa, Homo Sapiens
ALSMLSANH

SEQ ID NO: 558972 - protein, 9 aa, Homo Sapiens
GPSNFLAKL

SEQ ID NO: 558973 - protein, 9 aa, Homo Sapiens
IVQYSEPQS

SEQ ID NO: 558974 - protein, 9 aa, Homo Sapiens
NETTMCKPL

SEQ ID NO: 558975 - protein, 9 aa, Homo Sapiens
HALLMVGGF

SEQ ID NO: 558976 - protein, 9 aa, Homo Sapiens
HPESNCAGN

SEQ ID NO: 558977 - protein, 9 aa, Homo Sapiens
WAAQAPTPG

SEQ ID NO: 558978 - protein, 9 aa, Homo Sapiens
VFRKYAIDL

SEQ ID NO: 558979 - protein, 9 aa, Homo Sapiens
KLSDIGVEG

SEQ ID NO: 558980 - protein, 9 aa, Homo Sapiens
PESNCAGND

SEQ ID NO: 558981 - protein, 9 aa, Homo Sapiens
PLIPQQAQE

SEQ ID NO: 558982 - protein, 9 aa, Homo Sapiens
KQIKEKQDV

SEQ ID NO: 558983 - protein, 9 aa, Homo Sapiens
GGICELCQC

SEQ ID NO: 558984 - protein, 9 aa, Homo Sapiens
AFGPELRDE

SEQ ID NO: 558985 - protein, 9 aa, Homo Sapiens
RVKWLRRSR

SEQ ID NO: 558986 - protein, 9 aa, Homo Sapiens
DRSPRVIIH

SEQ ID NO: 558987 - protein, 9 aa, Homo Sapiens
TLGTSLQFR

SEQ ID NO: 558988 - protein, 9 aa, Homo Sapiens
NKPEVDKAA

SEQ ID NO: 558989 - protein, 9 aa, Homo Sapiens
SRRRWCGRS

SEQ ID NO: 558990 - protein, 9 aa, Homo Sapiens
SASDILEES

SEQ ID NO: 558991 - protein, 9 aa, Homo Sapiens
LFRDAGHTM

SEQ ID NO: 558992 - protein, 9 aa, Homo Sapiens
RLRPFTYYK

SEQ ID NO: 558993 - protein, 9 aa, Homo Sapiens
GSLIMFSRA

SEQ ID NO: 558994 - protein, 9 aa, Homo Sapiens
KNNPFKARV

SEQ ID NO: 558995 - protein, 9 aa, Homo Sapiens
HSEIQCIIK

SEQ ID NO: 558996 - protein, 9 aa, Homo Sapiens
GSSILASLR

SEQ ID NO: 558997 - protein, 9 aa, Homo Sapiens
RLSFQGPLD

SEQ ID NO: 558998 - protein, 9 aa, Homo Sapiens
YFTRDKRIC

SEQ ID NO: 558999 - protein, 9 aa, Homo Sapiens
LEEEGSLIM

SEQ ID NO: 559000 - protein, 9 aa, Homo Sapiens
IHVKHPPAA

SEQ ID NO: 559001 - protein, 9 aa, Homo Sapiens
DPAPERSRA

SEQ ID NO: 559002 - protein, 9 aa, Homo Sapiens
SDILEESAI

SEQ ID NO: 559003 - protein, 9 aa, Homo Sapiens
MQYNTTRAG

SEQ ID NO: 559004 - protein, 9 aa, Homo Sapiens
PISHCQCIL

SEQ ID NO: 559005 - protein, 9 aa, Homo Sapiens
EYDAAGFTK

SEQ ID NO: 559006 - protein, 9 aa, Homo Sapiens
RKECGKAFR

SEQ ID NO: 559007 - protein, 9 aa, Homo Sapiens
KGVKEFQCE

SEQ ID NO: 559008 - protein, 9 aa, Homo Sapiens
SSSAMLILL

SEQ ID NO: 559009 - protein, 9 aa, Homo Sapiens
HNGLNALHL

SEQ ID NO: 559010 - protein, 9 aa, Homo Sapiens
LRSMNVGCY

SEQ ID NO: 559011 - protein, 9 aa, Homo Sapiens
CNHNGLNAL

SEQ ID NO: 559012 - protein, 9 aa, Homo Sapiens
VFTILPSHV

SEQ ID NO: 559013 - protein, 9 aa, Homo Sapiens
PERSRASSS

SEQ ID NO: 559014 - protein, 9 aa, Homo Sapiens
GGIPGGVYN

SEQ ID NO: 559015 - protein, 9 aa, Homo Sapiens
SMNVGCYPQ

SEQ ID NO: 559016 - protein, 9 aa, Homo Sapiens
EEEGSLIMF

SEQ ID NO: 559017 - protein, 9 aa, Homo Sapiens
TMGFWLTKL

SEQ ID NO: 559018 - protein, 9 aa, Homo Sapiens
DGLNCTEGP

SEQ ID NO: 559019 - protein, 9 aa, Homo Sapiens
AAHKPYICG

SEQ ID NO: 559020 - protein, 9 aa, Homo Sapiens
SQLTTDNIG

SEQ ID NO: 559021 - protein, 9 aa, Homo Sapiens
PVECQLGHP

SEQ ID NO: 559022 - protein, 9 aa, Homo Sapiens
LRPFTYYKL

SEQ ID NO: 559023 - protein, 9 aa, Homo Sapiens
SESPISDEV

SEQ ID NO: 559024 - protein, 9 aa, Homo Sapiens
ARPSPTSRR

SEQ ID NO: 559025 - protein, 9 aa, Homo Sapiens
TISFSCNTR

SEQ ID NO: 559026 - protein, 9 aa, Homo Sapiens
SEGQEDDEG

SEQ ID NO: 559027 - protein, 9 aa, Homo Sapiens
NLIPQGILK

SEQ ID NO: 559028 - protein, 9 aa, Homo Sapiens
GEHSEIQCI

SEQ ID NO: 559029 - protein, 9 aa, Homo Sapiens
PQRVQEGER

SEQ ID NO: 559030 - protein, 9 aa, Homo Sapiens
GQQETDRSE

SEQ ID NO: 559031 - protein, 9 aa, Homo Sapiens
QKLEEAIHK

SEQ ID NO: 559032 - protein, 9 aa, Homo Sapiens
VVSSQFCGA

SEQ ID NO: 559033 - protein, 9 aa, Homo Sapiens
SFVLRQHEI

SEQ ID NO: 559034 - protein, 9 aa, Homo Sapiens
EEAIHKYDS

SEQ ID NO: 559035 - protein, 9 aa, Homo Sapiens
LPLLSTEKI

SEQ ID NO: 559036 - protein, 9 aa, Homo Sapiens
DMTKNNPFK

SEQ ID NO: 559037 - protein, 9 aa, Homo Sapiens
WKPSSERMD

SEQ ID NO: 559038 - protein, 9 aa, Homo Sapiens
RAVVVADYR

SEQ ID NO: 559039 - protein, 9 aa, Homo Sapiens
EIEDFVLEL

SEQ ID NO: 559040 - protein, 9 aa, Homo Sapiens
RDKRICHLH

SEQ ID NO: 559041 - protein, 9 aa, Homo Sapiens
FSRALKELF

SEQ ID NO: 559042 - protein, 9 aa, Homo Sapiens
KKLVLGWDH

SEQ ID NO: 559043 - protein, 9 aa, Homo Sapiens
TYSACASQI

SEQ ID NO: 559044 - protein, 9 aa, Homo Sapiens
LVRRGHEII

SEQ ID NO: 559045 - protein, 9 aa, Homo Sapiens
LFSRGSRTR

SEQ ID NO: 559046 - protein, 9 aa, Homo Sapiens
KLMQNYRLR

SEQ ID NO: 559047 - protein, 9 aa, Homo Sapiens
LQKIIGMEF

SEQ ID NO: 559048 - protein, 9 aa, Homo Sapiens
LPISHCQCI

SEQ ID NO: 559049 - protein, 9 aa, Homo Sapiens
EGDAPTLFS

SEQ ID NO: 559050 - protein, 9 aa, Homo Sapiens
ASSSRYPDR

SEQ ID NO: 559051 - protein, 9 aa, Homo Sapiens
YFTTTNHSF

SEQ ID NO: 559052 - protein, 9 aa, Homo Sapiens
NIHVKHPPA

SEQ ID NO: 559053 - protein, 9 aa, Homo Sapiens
IGSSILASL

SEQ ID NO: 559054 - protein, 9 aa, Homo Sapiens
KNGFLPLLS

SEQ ID NO: 559055 - protein, 9 aa, Homo Sapiens
HACLQKLKG

SEQ ID NO: 559056 - protein, 9 aa, Homo Sapiens
IGDAAHKPY

SEQ ID NO: 559057 - protein, 9 aa, Homo Sapiens
VSVISGINE

SEQ ID NO: 559058 - protein, 9 aa, Homo Sapiens
IRRSVIEFS

SEQ ID NO: 559059 - protein, 9 aa, Homo Sapiens
EGGEPTPEL

SEQ ID NO: 559060 - protein, 9 aa, Homo Sapiens
LPSHVQPAY

SEQ ID NO: 559061 - protein, 9 aa, Homo Sapiens
QYNTTRAGG

SEQ ID NO: 559062 - protein, 9 aa, Homo Sapiens
RANPYFAYL

SEQ ID NO: 559063 - protein, 9 aa, Homo Sapiens
TQKLEEAIH

SEQ ID NO: 559064 - protein, 9 aa, Homo Sapiens
NVGCYPQDD

SEQ ID NO: 559065 - protein, 9 aa, Homo Sapiens
HTMGFWLTK

SEQ ID NO: 559066 - protein, 9 aa, Homo Sapiens
AVCLVRRGH

SEQ ID NO: 559067 - protein, 9 aa, Homo Sapiens
SCWGFLEDY

SEQ ID NO: 559068 - protein, 9 aa, Homo Sapiens
LAFQQHAPV

SEQ ID NO: 559069 - protein, 9 aa, Homo Sapiens
ENRHKGYER

SEQ ID NO: 559070 - protein, 9 aa, Homo Sapiens
RPSPTSRRR

SEQ ID NO: 559071 - protein, 9 aa, Homo Sapiens
PEALFYEFE

SEQ ID NO: 559072 - protein, 9 aa, Homo Sapiens
QEDDEGEEH

SEQ ID NO: 559073 - protein, 9 aa, Homo Sapiens
GYERNRHFG

SEQ ID NO: 559074 - protein, 9 aa, Homo Sapiens
MQNYRLREL

SEQ ID NO: 559075 - protein, 9 aa, Homo Sapiens
RWCGRSRAP

SEQ ID NO: 559076 - protein, 9 aa, Homo Sapiens
NSNVQWRAL

SEQ ID NO: 559077 - protein, 9 aa, Homo Sapiens
CHLSMLTDS

SEQ ID NO: 559078 - protein, 9 aa, Homo Sapiens
SPSWQEQHE

SEQ ID NO: 559079 - protein, 9 aa, Homo Sapiens
TVTTLSIKE

SEQ ID NO: 559080 - protein, 9 aa, Homo Sapiens
AFQQHAPVE

SEQ ID NO: 559081 - protein, 9 aa, Homo Sapiens
LTDSLFLPI

SEQ ID NO: 559082 - protein, 9 aa, Homo Sapiens
AFLDPLSTA

SEQ ID NO: 559083 - protein, 9 aa, Homo Sapiens
RMSRPRLSL

SEQ ID NO: 559084 - protein, 9 aa, Homo Sapiens
RSVIEFSRA

SEQ ID NO: 559085 - protein, 9 aa, Homo Sapiens
LAVGDVVNL

SEQ ID NO: 559086 - protein, 9 aa, Homo Sapiens
LSLCLPGPF

SEQ ID NO: 559087 - protein, 9 aa, Homo Sapiens
RGGTIIQDW

SEQ ID NO: 559088 - protein, 9 aa, Homo Sapiens
THKGVKEFQ

SEQ ID NO: 559089 - protein, 9 aa, Homo Sapiens
NICNHNGLN

SEQ ID NO: 559090 - protein, 9 aa, Homo Sapiens
RRGHEIILA

SEQ ID NO: 559091 - protein, 9 aa, Homo Sapiens
NYRLRELFK

SEQ ID NO: 559092 - protein, 9 aa, Homo Sapiens
CVRLSFQGP

SEQ ID NO: 559093 - protein, 9 aa, Homo Sapiens
SSAMLILLS

SEQ ID NO: 559094 - protein, 9 aa, Homo Sapiens
GPRDPAPER

SEQ ID NO: 559095 - protein, 9 aa, Homo Sapiens
EDFVLELTR

SEQ ID NO: 559096 - protein, 9 aa, Homo Sapiens
NNPFKARVS

SEQ ID NO: 559097 - protein, 9 aa, Homo Sapiens
HAPVECQLG

SEQ ID NO: 559098 - protein, 9 aa, Homo Sapiens
EVLLASSSR

SEQ ID NO: 559099 - protein, 9 aa, Homo Sapiens
LGHPAGGHR

SEQ ID NO: 559100 - protein, 9 aa, Homo Sapiens
ELVTSPHIY

SEQ ID NO: 559101 - protein, 9 aa, Homo Sapiens
HGCVRLSFQ

SEQ ID NO: 559102 - protein, 9 aa, Homo Sapiens
SRPRLSLCL

SEQ ID NO: 559103 - protein, 9 aa, Homo Sapiens
KQDGLNCTE

SEQ ID NO: 559104 - protein, 9 aa, Homo Sapiens
VYNQFIPLQ

SEQ ID NO: 559105 - protein, 9 aa, Homo Sapiens
CLHANQFTY

SEQ ID NO: 559106 - protein, 9 aa, Homo Sapiens
VLELTRMES

SEQ ID NO: 559107 - protein, 9 aa, Homo Sapiens
AVVVADYRR

SEQ ID NO: 559108 - protein, 9 aa, Homo Sapiens
IVIHNENTM

SEQ ID NO: 559109 - protein, 9 aa, Homo Sapiens
VMAHACLQK

SEQ ID NO: 559110 - protein, 9 aa, Homo Sapiens
CFRPFPEAL

SEQ ID NO: 559111 - protein, 9 aa, Homo Sapiens
SLIMFSRAS

SEQ ID NO: 559112 - protein, 9 aa, Homo Sapiens
DVVNLAFQQ

SEQ ID NO: 559113 - protein, 9 aa, Homo Sapiens
LILLSVVFV

SEQ ID NO: 559114 - protein, 9 aa, Homo Sapiens
YDAAGFTKL

SEQ ID NO: 559115 - protein, 9 aa, Homo Sapiens
RQHEIGEWE

SEQ ID NO: 559116 - protein, 9 aa, Homo Sapiens
LWLFRDAGH

SEQ ID NO: 559117 - protein, 9 aa, Homo Sapiens
NGFLPLLST

SEQ ID NO: 559118 - protein, 9 aa, Homo Sapiens
TTTNHSFIW

SEQ ID NO: 559119 - protein, 9 aa, Homo Sapiens
DLNNFTVEE

SEQ ID NO: 559120 - protein, 9 aa, Homo Sapiens
VRDINRTNV

SEQ ID NO: 559121 - protein, 9 aa, Homo Sapiens
DVPDLNNFT

SEQ ID NO: 559122 - protein, 9 aa, Homo Sapiens
VIEFSRALK

SEQ ID NO: 559123 - protein, 9 aa, Homo Sapiens
LKKLVLGWD

SEQ ID NO: 559124 - protein, 9 aa, Homo Sapiens
DNDLCVSES

SEQ ID NO: 559125 - protein, 9 aa, Homo Sapiens
PQEEDRFQE

SEQ ID NO: 559126 - protein, 9 aa, Homo Sapiens
MTKNNPFKA

SEQ ID NO: 559127 - protein, 9 aa, Homo Sapiens
SLCLPGPFP

SEQ ID NO: 559128 - protein, 9 aa, Homo Sapiens
EHGCVRLSF

SEQ ID NO: 559129 - protein, 9 aa, Homo Sapiens
AYLQIRKKI

SEQ ID NO: 559130 - protein, 9 aa, Homo Sapiens
HIYTDKELK

SEQ ID NO: 559131 - protein, 9 aa, Homo Sapiens
FLPISHCQC

SEQ ID NO: 559132 - protein, 9 aa, Homo Sapiens
TTRAGGVEV

SEQ ID NO: 559133 - protein, 9 aa, Homo Sapiens
YYKLRLKAT

SEQ ID NO: 559134 - protein, 9 aa, Homo Sapiens
FQCEVCGRE

SEQ ID NO: 559135 - protein, 9 aa, Homo Sapiens
VYESRRITD

SEQ ID NO: 559136 - protein, 9 aa, Homo Sapiens
MSEGDAPTL

SEQ ID NO: 559137 - protein, 9 aa, Homo Sapiens
RRSVIEFSR

SEQ ID NO: 559138 - protein, 9 aa, Homo Sapiens
NTRFYLNGA

SEQ ID NO: 559139 - protein, 9 aa, Homo Sapiens
MLILLSVVF

SEQ ID NO: 559140 - protein, 9 aa, Homo Sapiens
YESRRITDP

SEQ ID NO: 559141 - protein, 9 aa, Homo Sapiens
VDINICNHN

SEQ ID NO: 559142 - protein, 9 aa, Homo Sapiens
EDQDVPDLN

SEQ ID NO: 559143 - protein, 9 aa, Homo Sapiens
FTTTNHSFI

SEQ ID NO: 559144 - protein, 9 aa, Homo Sapiens
SQTVVVKQI

SEQ ID NO: 559145 - protein, 9 aa, Homo Sapiens
DVLRGGTII

SEQ ID NO: 559146 - protein, 9 aa, Homo Sapiens
GQHNSNVQW

SEQ ID NO: 559147 - protein, 9 aa, Homo Sapiens
SEIEDFVLE

SEQ ID NO: 559148 - protein, 9 aa, Homo Sapiens
RRWCGRSRA

SEQ ID NO: 559149 - protein, 9 aa, Homo Sapiens
LQYLHKAVM

SEQ ID NO: 559150 - protein, 9 aa, Homo Sapiens
GDNTITYSA

SEQ ID NO: 559151 - protein, 9 aa, Homo Sapiens
PTLFSRGSR

SEQ ID NO: 559152 - protein, 9 aa, Homo Sapiens
GEPTPELVE

SEQ ID NO: 559153 - protein, 9 aa, Homo Sapiens
IVPTLPEWE

SEQ ID NO: 559154 - protein, 9 aa, Homo Sapiens
QCFRPFPEA

SEQ ID NO: 559155 - protein, 9 aa, Homo Sapiens
PPDLSCLHA

SEQ ID NO: 559156 - protein, 9 aa, Homo Sapiens
VLNQDKWKR

SEQ ID NO: 559157 - protein, 9 aa, Homo Sapiens
APVECQLGH

SEQ ID NO: 559158 - protein, 9 aa, Homo Sapiens
LPYVFKFKD

SEQ ID NO: 559159 - protein, 9 aa, Homo Sapiens
LLSLSARPS

SEQ ID NO: 559160 - protein, 9 aa, Homo Sapiens
VKHPPAASV

SEQ ID NO: 559161 - protein, 9 aa, Homo Sapiens
QTVVVKQIT

SEQ ID NO: 559162 - protein, 9 aa, Homo Sapiens
QLGHPAGGH

SEQ ID NO: 559163 - protein, 9 aa, Homo Sapiens
KTVTTLSIK

SEQ ID NO: 559164 - protein, 9 aa, Homo Sapiens
HTGEKPYER

SEQ ID NO: 559165 - protein, 9 aa, Homo Sapiens
ESVLGNYSC

SEQ ID NO: 559166 - protein, 9 aa, Homo Sapiens
GTVEHSNPS

SEQ ID NO: 559167 - protein, 9 aa, Homo Sapiens
NPSCWGFLE

SEQ ID NO: 559168 - protein, 9 aa, Homo Sapiens
LSMLTDSLF

SEQ ID NO: 559169 - protein, 9 aa, Homo Sapiens
DRSEDEDII

SEQ ID NO: 559170 - protein, 9 aa, Homo Sapiens
DPGQQETDR

SEQ ID NO: 559171 - protein, 9 aa, Homo Sapiens
RLSLCLPGP

SEQ ID NO: 559172 - protein, 9 aa, Homo Sapiens
LNNFTVEEL

SEQ ID NO: 559173 - protein, 9 aa, Homo Sapiens
DRLRPFTYY

SEQ ID NO: 559174 - protein, 9 aa, Homo Sapiens
DFVLELTRM

SEQ ID NO: 559175 - protein, 9 aa, Homo Sapiens
NQFTYYFTT

SEQ ID NO: 559176 - protein, 9 aa, Homo Sapiens
GALFSLLVI

SEQ ID NO: 559177 - protein, 9 aa, Homo Sapiens
LSQLTTDNI

SEQ ID NO: 559178 - protein, 9 aa, Homo Sapiens
EREDEVLLA

SEQ ID NO: 559179 - protein, 9 aa, Homo Sapiens
HTRLFCMVR

SEQ ID NO: 559180 - protein, 9 aa, Homo Sapiens
YLCHLSMLT

SEQ ID NO: 559181 - protein, 9 aa, Homo Sapiens
ICHLHLFWH

SEQ ID NO: 559182 - protein, 9 aa, Homo Sapiens
SIVSVISGI

SEQ ID NO: 559183 - protein, 9 aa, Homo Sapiens
GGVYNQFIP

SEQ ID NO: 559184 - protein, 9 aa, Homo Sapiens
TDLQKIIGM

SEQ ID NO: 559185 - protein, 9 aa, Homo Sapiens
PGQQETDRS

SEQ ID NO: 559186 - protein, 9 aa, Homo Sapiens
ECQLGHPAG

SEQ ID NO: 559187 - protein, 9 aa, Homo Sapiens
SVIEFSRAL

SEQ ID NO: 559188 - protein, 9 aa, Homo Sapiens
SPDNDLCVS

SEQ ID NO: 559189 - protein, 9 aa, Homo Sapiens
DFIDAIAPN

SEQ ID NO: 559190 - protein, 9 aa, Homo Sapiens
SSERMDQDH

SEQ ID NO: 559191 - protein, 9 aa, Homo Sapiens
FCMVRAQAW

SEQ ID NO: 559192 - protein, 9 aa, Homo Sapiens
AAILSLSIV

SEQ ID NO: 559193 - protein, 9 aa, Homo Sapiens
QQHAPVECQ

SEQ ID NO: 559194 - protein, 9 aa, Homo Sapiens
ISARPPDLS

SEQ ID NO: 559195 - protein, 9 aa, Homo Sapiens
GPLGPSPDN

SEQ ID NO: 559196 - protein, 9 aa, Homo Sapiens
FHSEIEDFV

SEQ ID NO: 559197 - protein, 9 aa, Homo Sapiens
NFSVWIGSS

SEQ ID NO: 559198 - protein, 9 aa, Homo Sapiens
SDALLAFLD

SEQ ID NO: 559199 - protein, 9 aa, Homo Sapiens
TLFSRGSRT

SEQ ID NO: 559200 - protein, 9 aa, Homo Sapiens
PSVQRDVLR

SEQ ID NO: 559201 - protein, 9 aa, Homo Sapiens
DAGHTMGFW

SEQ ID NO: 559202 - protein, 9 aa, Homo Sapiens
DILEESAIH

SEQ ID NO: 559203 - protein, 9 aa, Homo Sapiens
QNYRLRELF

SEQ ID NO: 559204 - protein, 9 aa, Homo Sapiens
LDGLLSLSA

SEQ ID NO: 559205 - protein, 9 aa, Homo Sapiens
TGVALRFES

SEQ ID NO: 559206 - protein, 9 aa, Homo Sapiens
AHKPYICGD

SEQ ID NO: 559207 - protein, 9 aa, Homo Sapiens
VIHNENTMP

SEQ ID NO: 559208 - protein, 9 aa, Homo Sapiens
KGALFSLLV

SEQ ID NO: 559209 - protein, 9 aa, Homo Sapiens
PISARPPDL

SEQ ID NO: 559210 - protein, 9 aa, Homo Sapiens
PPAASVQIH

SEQ ID NO: 559211 - protein, 9 aa, Homo Sapiens
EIGHSPPHA

SEQ ID NO: 559212 - protein, 9 aa, Homo Sapiens
RVQEGERVV

SEQ ID NO: 559213 - protein, 9 aa, Homo Sapiens
EPDGQLEEP

SEQ ID NO: 559214 - protein, 9 aa, Homo Sapiens
TYYFTTTNH

SEQ ID NO: 559215 - protein, 9 aa, Homo Sapiens
NNFTVEELK

SEQ ID NO: 559216 - protein, 9 aa, Homo Sapiens
QQTVFTILP

SEQ ID NO: 559217 - protein, 9 aa, Homo Sapiens
PFMQYNTTR

SEQ ID NO: 559218 - protein, 9 aa, Homo Sapiens
GEKPYERKE

SEQ ID NO: 559219 - protein, 9 aa, Homo Sapiens
VVNLAFQQH

SEQ ID NO: 559220 - protein, 9 aa, Homo Sapiens
DTGSEGQED

SEQ ID NO: 559221 - protein, 9 aa, Homo Sapiens
KLNYLCHLS

SEQ ID NO: 559222 - protein, 9 aa, Homo Sapiens
HNENTMPRV

SEQ ID NO: 559223 - protein, 9 aa, Homo Sapiens
VCLVRRGHE

SEQ ID NO: 559224 - protein, 9 aa, Homo Sapiens
CYPQDDPDI

SEQ ID NO: 559225 - protein, 9 aa, Homo Sapiens
KDKGGKAKN

SEQ ID NO: 559226 - protein, 9 aa, Homo Sapiens
SDLDGLLSL

SEQ ID NO: 559227 - protein, 9 aa, Homo Sapiens
NRHKGYERN

SEQ ID NO: 559228 - protein, 9 aa, Homo Sapiens
CLVRRGHEI

SEQ ID NO: 559229 - protein, 9 aa, Homo Sapiens
AGFTKLTLL

SEQ ID NO: 559230 - protein, 9 aa, Homo Sapiens
LTKLNYLCH

SEQ ID NO: 559231 - protein, 9 aa, Homo Sapiens
ICNHNGLNA

SEQ ID NO: 559232 - protein, 9 aa, Homo Sapiens
YYFTTTNHS

SEQ ID NO: 559233 - protein, 9 aa, Homo Sapiens
PDNDLCVSE

SEQ ID NO: 559234 - protein, 9 aa, Homo Sapiens
KWKRETVQW

SEQ ID NO: 559235 - protein, 9 aa, Homo Sapiens
FVLRQHEIG

SEQ ID NO: 559236 - protein, 9 aa, Homo Sapiens
KRETVQWLL

SEQ ID NO: 559237 - protein, 9 aa, Homo Sapiens
MGFWLTKLN

SEQ ID NO: 559238 - protein, 9 aa, Homo Sapiens
GEHGCVRLS

SEQ ID NO: 559239 - protein, 9 aa, Homo Sapiens
RTNVISASR

SEQ ID NO: 559240 - protein, 9 aa, Homo Sapiens
LLSTEKIKA

SEQ ID NO: 559241 - protein, 9 aa, Homo Sapiens
PHAYTPMSG

SEQ ID NO: 559242 - protein, 9 aa, Homo Sapiens
DLAPNTLRM

SEQ ID NO: 559243 - protein, 9 aa, Homo Sapiens
DVMAHACLQ

SEQ ID NO: 559244 - protein, 9 aa, Homo Sapiens
PQGILKLDH

SEQ ID NO: 559245 - protein, 9 aa, Homo Sapiens
FTYYKLRLK

SEQ ID NO: 559246 - protein, 9 aa, Homo Sapiens
DQDVPDLNN

SEQ ID NO: 559247 - protein, 9 aa, Homo Sapiens
PPQEEDRFQ

SEQ ID NO: 559248 - protein, 9 aa, Homo Sapiens
LKMGQHNSN

SEQ ID NO: 559249 - protein, 9 aa, Homo Sapiens
SLSARPSPT

SEQ ID NO: 559250 - protein, 9 aa, Homo Sapiens
AVMKALWKH

SEQ ID NO: 559251 - protein, 9 aa, Homo Sapiens
RHKGYERNR

SEQ ID NO: 559252 - protein, 9 aa, Homo Sapiens
QQPISARPP

SEQ ID NO: 559253 - protein, 9 aa, Homo Sapiens
ILPSHVQPA

SEQ ID NO: 559254 - protein, 9 aa, Homo Sapiens
RITDPERQD

SEQ ID NO: 559255 - protein, 9 aa, Homo Sapiens
HSEIEDFVL

SEQ ID NO: 559256 - protein, 9 aa, Homo Sapiens
GGEPTPELV

SEQ ID NO: 559257 - protein, 9 aa, Homo Sapiens
YYFTRDKRI

SEQ ID NO: 559258 - protein, 9 aa, Homo Sapiens
LCHLSMLTD

SEQ ID NO: 559259 - protein, 9 aa, Homo Sapiens
VKEFQCEVC

SEQ ID NO: 559260 - protein, 9 aa, Homo Sapiens
SCNTRFYLN

SEQ ID NO: 559261 - protein, 9 aa, Homo Sapiens
ESPISDEVE

SEQ ID NO: 559262 - protein, 9 aa, Homo Sapiens
QELVTSPHI

SEQ ID NO: 559263 - protein, 9 aa, Homo Sapiens
VTSPHIYTD

SEQ ID NO: 559264 - protein, 9 aa, Homo Sapiens
FCGALLGTV

SEQ ID NO: 559265 - protein, 9 aa, Homo Sapiens
MGQHNSNVQ

SEQ ID NO: 559266 - protein, 9 aa, Homo Sapiens
LVTSPHIYT

SEQ ID NO: 559267 - protein, 9 aa, Homo Sapiens
LSLSARPSP

SEQ ID NO: 559268 - protein, 9 aa, Homo Sapiens
GIPGGVYNQ

SEQ ID NO: 559269 - protein, 9 aa, Homo Sapiens
ALFYEFEGR

SEQ ID NO: 559270 - protein, 9 aa, Homo Sapiens
MQTDLQKII

SEQ ID NO: 559271 - protein, 9 aa, Homo Sapiens
QEQHESRTF

SEQ ID NO: 559272 - protein, 9 aa, Homo Sapiens
LRMFTSNSE

SEQ ID NO: 559273 - protein, 9 aa, Homo Sapiens
WKRETVQWL

SEQ ID NO: 559274 - protein, 9 aa, Homo Sapiens
ESRRITDPE

SEQ ID NO: 559275 - protein, 9 aa, Homo Sapiens
RLFCMVRAQ

SEQ ID NO: 559276 - protein, 9 aa, Homo Sapiens
AGGIPGGVY

SEQ ID NO: 559277 - protein, 9 aa, Homo Sapiens
LLASSSRYP

SEQ ID NO: 559278 - protein, 9 aa, Homo Sapiens
EKDQVPEPD

SEQ ID NO: 559279 - protein, 9 aa, Homo Sapiens
RMDQDHSSS

SEQ ID NO: 559280 - protein, 9 aa, Homo Sapiens
CSSPSWQEQ

SEQ ID NO: 559281 - protein, 9 aa, Homo Sapiens
IYTDKELKG

SEQ ID NO: 559282 - protein, 9 aa, Homo Sapiens
SLSIVSVIS

SEQ ID NO: 559283 - protein, 9 aa, Homo Sapiens
LSLSIVSVI

SEQ ID NO: 559284 - protein, 9 aa, Homo Sapiens
TGEKPYERK

SEQ ID NO: 559285 - protein, 9 aa, Homo Sapiens
NRTNVISAS

SEQ ID NO: 559286 - protein, 9 aa, Homo Sapiens
SSPSWQEQH

SEQ ID NO: 559287 - protein, 9 aa, Homo Sapiens
SPPHAYTPM

SEQ ID NO: 559288 - protein, 9 aa, Homo Sapiens
APNTLRMFT

SEQ ID NO: 559289 - protein, 9 aa, Homo Sapiens
FMQYNTTRA

SEQ ID NO: 559290 - protein, 9 aa, Homo Sapiens
SRAIGDAAH

SEQ ID NO: 559291 - protein, 9 aa, Homo Sapiens
SEIGHSPPH

SEQ ID NO: 559292 - protein, 9 aa, Homo Sapiens
PFPEALFYE

SEQ ID NO: 559293 - protein, 9 aa, Homo Sapiens
LEGGEPTPE

SEQ ID NO: 559294 - protein, 9 aa, Homo Sapiens
LLAFLDPLS

SEQ ID NO: 559295 - protein, 9 aa, Homo Sapiens
DLEGGEPTP

SEQ ID NO: 559296 - protein, 9 aa, Homo Sapiens
VEHSNPSCW

SEQ ID NO: 559297 - protein, 9 aa, Homo Sapiens
INICNHNGL

SEQ ID NO: 559298 - protein, 9 aa, Homo Sapiens
SERMDQDHS

SEQ ID NO: 559299 - protein, 9 aa, Homo Sapiens
TTDNIGNSK

SEQ ID NO: 559300 - protein, 9 aa, Homo Sapiens
DLDGLLSLS

SEQ ID NO: 559301 - protein, 9 aa, Homo Sapiens
SARPPDLSC

SEQ ID NO: 559302 - protein, 9 aa, Homo Sapiens
FIDAIAPNA

SEQ ID NO: 559303 - protein, 9 aa, Homo Sapiens
PAPERSRAS

SEQ ID NO: 559304 - protein, 9 aa, Homo Sapiens
AAHCRVLPE

SEQ ID NO: 559305 - protein, 9 aa, Homo Sapiens
INRTNVISA

SEQ ID NO: 559306 - protein, 9 aa, Homo Sapiens
HKGYERNRH

SEQ ID NO: 559307 - protein, 9 aa, Homo Sapiens
PGGVYNQFI

SEQ ID NO: 559308 - protein, 9 aa, Homo Sapiens
DAKLPYVFK

SEQ ID NO: 559309 - protein, 9 aa, Homo Sapiens
SNPSCWGFL

SEQ ID NO: 559310 - protein, 9 aa, Homo Sapiens
LRMSRPRLS

SEQ ID NO: 559311 - protein, 9 aa, Homo Sapiens
QTVFTILPS

SEQ ID NO: 559312 - protein, 9 aa, Homo Sapiens
QVLNQDKWK

SEQ ID NO: 559313 - protein, 9 aa, Homo Sapiens
TITYSACAS

SEQ ID NO: 559314 - protein, 9 aa, Homo Sapiens
RDAGHTMGF

SEQ ID NO: 559315 - protein, 9 aa, Homo Sapiens
GHSSSAMLI

SEQ ID NO: 559316 - protein, 9 aa, Homo Sapiens
LASSSRYPD

SEQ ID NO: 559317 - protein, 9 aa, Homo Sapiens
PFTYYKLRL

SEQ ID NO: 559318 - protein, 9 aa, Homo Sapiens
WLTKLNYLC

SEQ ID NO: 559319 - protein, 9 aa, Homo Sapiens
LFCMVRAQA

SEQ ID NO: 559320 - protein, 9 aa, Homo Sapiens
RLLRQIVIH

SEQ ID NO: 559321 - protein, 9 aa, Homo Sapiens
KLVLGWDHA

SEQ ID NO: 559322 - protein, 9 aa, Homo Sapiens
LHKAVMKAL

SEQ ID NO: 559323 - protein, 9 aa, Homo Sapiens
GVVEYDAAG

SEQ ID NO: 559324 - protein, 9 aa, Homo Sapiens
VPTLPEWED

SEQ ID NO: 559325 - protein, 9 aa, Homo Sapiens
IGMEFSEEK

SEQ ID NO: 559326 - protein, 9 aa, Homo Sapiens
VVEYDAAGF

SEQ ID NO: 559327 - protein, 9 aa, Homo Sapiens
NCSSPSWQE

SEQ ID NO: 559328 - protein, 9 aa, Homo Sapiens
FQQHAPVEC

SEQ ID NO: 559329 - protein, 9 aa, Homo Sapiens
PLGPSPDND

SEQ ID NO: 559330 - protein, 9 aa, Homo Sapiens
SLEEEGSLI

SEQ ID NO: 559331 - protein, 9 aa, Homo Sapiens
SSSKTVTTL

SEQ ID NO: 559332 - protein, 9 aa, Homo Sapiens
PSPDNDLCV

SEQ ID NO: 559333 - protein, 9 aa, Homo Sapiens
SDEVERLQS

SEQ ID NO: 559334 - protein, 9 aa, Homo Sapiens
RDPAPERSR

SEQ ID NO: 559335 - protein, 9 aa, Homo Sapiens
RSEDEDIIG

SEQ ID NO: 559336 - protein, 9 aa, Homo Sapiens
SSILASLRA

SEQ ID NO: 559337 - protein, 9 aa, Homo Sapiens
AQLRAVVVA

SEQ ID NO: 559338 - protein, 9 aa, Homo Sapiens
QYLHKAVMK

SEQ ID NO: 559339 - protein, 9 aa, Homo Sapiens
QLTTDNIGN

SEQ ID NO: 559340 - protein, 9 aa, Homo Sapiens
EALFYEFEG

SEQ ID NO: 559341 - protein, 9 aa, Homo Sapiens
AHCRVLPEG

SEQ ID NO: 559342 - protein, 9 aa, Homo Sapiens
LIPQGILKL

SEQ ID NO: 559343 - protein, 9 aa, Homo Sapiens
PISDEVERL

SEQ ID NO: 559344 - protein, 9 aa, Homo Sapiens
MLTDSLFLP

SEQ ID NO: 559345 - protein, 9 aa, Homo Sapiens
HANQFTYYF

SEQ ID NO: 559346 - protein, 9 aa, Homo Sapiens
KAKNTAAAG

SEQ ID NO: 559347 - protein, 9 aa, Homo Sapiens
SAMLILLSV

SEQ ID NO: 559348 - protein, 9 aa, Homo Sapiens
FVKLMQNYR

SEQ ID NO: 559349 - protein, 9 aa, Homo Sapiens
ERMDQDHSS

SEQ ID NO: 559350 - protein, 9 aa, Homo Sapiens
LPVLDFIDA

SEQ ID NO: 559351 - protein, 9 aa, Homo Sapiens
HPPAASVQI

SEQ ID NO: 559352 - protein, 9 aa, Homo Sapiens
EKPYERKEC

SEQ ID NO: 559353 - protein, 9 aa, Homo Sapiens
RFYLNGADS

SEQ ID NO: 559354 - protein, 9 aa, Homo Sapiens
TSSQQPISA

SEQ ID NO: 559355 - protein, 9 aa, Homo Sapiens
RHTRLFCMV

SEQ ID NO: 559356 - protein, 9 aa, Homo Sapiens
VERLQSKLS

SEQ ID NO: 559357 - protein, 9 aa, Homo Sapiens
SPTSRRRWC

SEQ ID NO: 559358 - protein, 9 aa, Homo Sapiens
DHACNSSTL

SEQ ID NO: 559359 - protein, 9 aa, Homo Sapiens
RMPVYSLMA

SEQ ID NO: 559360 - protein, 9 aa, Homo Sapiens
QIVIHNENT

SEQ ID NO: 559361 - protein, 9 aa, Homo Sapiens
VFVKLMQNY

SEQ ID NO: 559362 - protein, 9 aa, Homo Sapiens
PSDLEGGEP

SEQ ID NO: 559363 - protein, 9 aa, Homo Sapiens
YFAYLQIRK

SEQ ID NO: 559364 - protein, 9 aa, Homo Sapiens
IEPQRVQEG

SEQ ID NO: 559365 - protein, 9 aa, Homo Sapiens
GKAKNTAAA

SEQ ID NO: 559366 - protein, 9 aa, Homo Sapiens
MKQDGLNCT

SEQ ID NO: 559367 - protein, 9 aa, Homo Sapiens
RAIGDAAHK

SEQ ID NO: 559368 - protein, 9 aa, Homo Sapiens
ALLAFLDPL

SEQ ID NO: 559369 - protein, 9 aa, Homo Sapiens
RERMPVYSL

SEQ ID NO: 559370 - protein, 9 aa, Homo Sapiens
VQRDVLRGG

SEQ ID NO: 559371 - protein, 9 aa, Homo Sapiens
TVVVKQITI

SEQ ID NO: 559372 - protein, 9 aa, Homo Sapiens
PNTLRMFTS

SEQ ID NO: 559373 - protein, 9 aa, Homo Sapiens
TKNNPFKAR

SEQ ID NO: 559374 - protein, 9 aa, Homo Sapiens
GFWLTKLNY

SEQ ID NO: 559375 - protein, 9 aa, Homo Sapiens
HSPPHAYTP

SEQ ID NO: 559376 - protein, 9 aa, Homo Sapiens
DGQLEEPTL

SEQ ID NO: 559377 - protein, 9 aa, Homo Sapiens
AKKGALFSL

SEQ ID NO: 559378 - protein, 9 aa, Homo Sapiens
VSASDILEE

SEQ ID NO: 559379 - protein, 9 aa, Homo Sapiens
IGNSKAGNG

SEQ ID NO: 559380 - protein, 9 aa, Homo Sapiens
NPFKARVSS

SEQ ID NO: 559381 - protein, 9 aa, Homo Sapiens
LDRERMPVY

SEQ ID NO: 559382 - protein, 9 aa, Homo Sapiens
HAYTPMSGN

SEQ ID NO: 559383 - protein, 9 aa, Homo Sapiens
KPCFMGEHS

SEQ ID NO: 559384 - protein, 9 aa, Homo Sapiens
ITYSACASQ

SEQ ID NO: 559385 - protein, 9 aa, Homo Sapiens
MFTSNSEIK

SEQ ID NO: 559386 - protein, 9 aa, Homo Sapiens
AVGDVVNLA

SEQ ID NO: 559387 - protein, 9 aa, Homo Sapiens
GDAAHKPYI

SEQ ID NO: 559388 - protein, 9 aa, Homo Sapiens
PLQIVPTLP

SEQ ID NO: 559389 - protein, 9 aa, Homo Sapiens
AGHTMGFWL

SEQ ID NO: 559390 - protein, 9 aa, Homo Sapiens
VHPSDLEGG

SEQ ID NO: 559391 - protein, 9 aa, Homo Sapiens
LSARPSPTS

SEQ ID NO: 559392 - protein, 9 aa, Homo Sapiens
PSCWGFLED

SEQ ID NO: 559393 - protein, 9 aa, Homo Sapiens
LTTDNIGNS

SEQ ID NO: 559394 - protein, 9 aa, Homo Sapiens
CVFVKLMQN

SEQ ID NO: 559395 - protein, 9 aa, Homo Sapiens
VTLSIEPQR

SEQ ID NO: 559396 - protein, 9 aa, Homo Sapiens
SWKPSSERM

SEQ ID NO: 559397 - protein, 9 aa, Homo Sapiens
ALRFESVLG

SEQ ID NO: 559398 - protein, 9 aa, Homo Sapiens
LLDDMTKNN

SEQ ID NO: 559399 - protein, 9 aa, Homo Sapiens
PSPTSRRRW

SEQ ID NO: 559400 - protein, 9 aa, Homo Sapiens
NPVVSSQFC

SEQ ID NO: 559401 - protein, 9 aa, Homo Sapiens
EVTSPPQEE

SEQ ID NO: 559402 - protein, 9 aa, Homo Sapiens
QTDLQKIIG

SEQ ID NO: 559403 - protein, 9 aa, Homo Sapiens
PHIYTDKEL

SEQ ID NO: 559404 - protein, 9 aa, Homo Sapiens
LAAVCLVRR

SEQ ID NO: 559405 - protein, 9 aa, Homo Sapiens
TRDKRICHL

SEQ ID NO: 559406 - protein, 9 aa, Homo Sapiens
RICHLHLFW

SEQ ID NO: 559407 - protein, 9 aa, Homo Sapiens
DKWKRETVQ

SEQ ID NO: 559408 - protein, 9 aa, Homo Sapiens
KDQVPEPDG

SEQ ID NO: 559409 - protein, 9 aa, Homo Sapiens
CDAKLPYVF

SEQ ID NO: 559410 - protein, 9 aa, Homo Sapiens
NPYFAYLQI

SEQ ID NO: 559411 - protein, 9 aa, Homo Sapiens
QRDVLRGGT

SEQ ID NO: 559412 - protein, 9 aa, Homo Sapiens
QIVPTLPEW

SEQ ID NO: 559413 - protein, 9 aa, Homo Sapiens
SQQPISARP

SEQ ID NO: 559414 - protein, 9 aa, Homo Sapiens
SPLQIVPTL

SEQ ID NO: 559415 - protein, 9 aa, Homo Sapiens
FQQDVMAHA

SEQ ID NO: 559416 - protein, 9 aa, Homo Sapiens
LLRQIVIHN

SEQ ID NO: 559417 - protein, 9 aa, Homo Sapiens
GAAHCRVLP

SEQ ID NO: 559418 - protein, 9 aa, Homo Sapiens
KHPPAASVQ

SEQ ID NO: 559419 - protein, 9 aa, Homo Sapiens
PNPCHGAAH

SEQ ID NO: 559420 - protein, 9 aa, Homo Sapiens
KGGKAKNTA

SEQ ID NO: 559421 - protein, 9 aa, Homo Sapiens
QITIHTKLP

SEQ ID NO: 559422 - protein, 9 aa, Homo Sapiens
VADYRRRKK

SEQ ID NO: 559423 - protein, 9 aa, Homo Sapiens
KPSSERMDQ

SEQ ID NO: 559424 - protein, 9 aa, Homo Sapiens
QQETDRSED

SEQ ID NO: 559425 - protein, 9 aa, Homo Sapiens
VLDFIDAIA

SEQ ID NO: 559426 - protein, 9 aa, Homo Sapiens
SVYESRRIT

SEQ ID NO: 559427 - protein, 9 aa, Homo Sapiens
WDHACNSST

SEQ ID NO: 559428 - protein, 9 aa, Homo Sapiens
GCYPQDDPD

SEQ ID NO: 559429 - protein, 9 aa, Homo Sapiens
QLRAVVVAD

SEQ ID NO: 559430 - protein, 9 aa, Homo Sapiens
STSLPVLDF

SEQ ID NO: 559431 - protein, 9 aa, Homo Sapiens
TRLFCMVRA

SEQ ID NO: 559432 - protein, 9 aa, Homo Sapiens
TNVISASRK

SEQ ID NO: 559433 - protein, 9 aa, Homo Sapiens
WQEQHESRT

SEQ ID NO: 559434 - protein, 9 aa, Homo Sapiens
QHEIGEWEA

SEQ ID NO: 559435 - protein, 9 aa, Homo Sapiens
EEGSLIMFS

SEQ ID NO: 559436 - protein, 9 aa, Homo Sapiens
MGDNTITYS

SEQ ID NO: 559437 - protein, 9 aa, Homo Sapiens
MNVGCYPQD

SEQ ID NO: 559438 - protein, 9 aa, Homo Sapiens
MAHACLQKL

SEQ ID NO: 559439 - protein, 9 aa, Homo Sapiens
FWLTKLNYL

SEQ ID NO: 559440 - protein, 9 aa, Homo Sapiens
FLPLLSTEK

SEQ ID NO: 559441 - protein, 9 aa, Homo Sapiens
HGAAHCRVL

SEQ ID NO: 559442 - protein, 9 aa, Homo Sapiens
HTSSQQPIS

SEQ ID NO: 559443 - protein, 9 aa, Homo Sapiens
SCLHANQFT

SEQ ID NO: 559444 - protein, 9 aa, Homo Sapiens
QKIIGMEFS

SEQ ID NO: 559445 - protein, 9 aa, Homo Sapiens
DAPTLFSRG

SEQ ID NO: 559446 - protein, 9 aa, Homo Sapiens
FKPCFMGEH

SEQ ID NO: 559447 - protein, 9 aa, Homo Sapiens
ILEESAIHS

SEQ ID NO: 559448 - protein, 9 aa, Homo Sapiens
LRFESVLGN

SEQ ID NO: 559449 - protein, 9 aa, Homo Sapiens
SSQFCGALL

SEQ ID NO: 559450 - protein, 9 aa, Homo Sapiens
PRLSLCLPG

SEQ ID NO: 559451 - protein, 9 aa, Homo Sapiens
DALLAFLDP

SEQ ID NO: 559452 - protein, 9 aa, Homo Sapiens
LRAVVVADY

SEQ ID NO: 559453 - protein, 9 aa, Homo Sapiens
KGYERNRHF

SEQ ID NO: 559454 - protein, 9 aa, Homo Sapiens
VALRFESVL

SEQ ID NO: 559455 - protein, 9 aa, Homo Sapiens
SDTGSEGQE

SEQ ID NO: 559456 - protein, 9 aa, Homo Sapiens
SDLEGGEPT

SEQ ID NO: 559457 - protein, 9 aa, Homo Sapiens
DSLFLPISH

SEQ ID NO: 559458 - protein, 9 aa, Homo Sapiens
AILSLSIVS

SEQ ID NO: 559459 - protein, 9 aa, Homo Sapiens
WCGRSRAPD

SEQ ID NO: 559460 - protein, 9 aa, Homo Sapiens
EDEVLLASS

SEQ ID NO: 559461 - protein, 9 aa, Homo Sapiens
VKLMQNYRL

SEQ ID NO: 559462 - protein, 9 aa, Homo Sapiens
MPVYSLMAK

SEQ ID NO: 559463 - protein, 9 aa, Homo Sapiens
QFCGALLGT

SEQ ID NO: 559464 - protein, 9 aa, Homo Sapiens
VLRGGTIIQ

SEQ ID NO: 559465 - protein, 9 aa, Homo Sapiens
IGHSPPHAY

SEQ ID NO: 559466 - protein, 9 aa, Homo Sapiens
DINRTNVIS

SEQ ID NO: 559467 - protein, 9 aa, Homo Sapiens
LRQIVIHNE

SEQ ID NO: 559468 - protein, 9 aa, Homo Sapiens
LNQDKWKRE

SEQ ID NO: 559469 - protein, 9 aa, Homo Sapiens
NPCHGAAHC

SEQ ID NO: 559470 - protein, 9 aa, Homo Sapiens
TDNIGNSKA

SEQ ID NO: 559471 - protein, 9 aa, Homo Sapiens
RPFMQYNTT

SEQ ID NO: 559472 - protein, 9 aa, Homo Sapiens
DRERMPVYS

SEQ ID NO: 559473 - protein, 9 aa, Homo Sapiens
KQITIHTKL

SEQ ID NO: 559474 - protein, 9 aa, Homo Sapiens
FTYYFTTTN

SEQ ID NO: 559475 - protein, 9 aa, Homo Sapiens
DLQKIIGME

SEQ ID NO: 559476 - protein, 9 aa, Homo Sapiens
IVSVISGIN

SEQ ID NO: 559477 - protein, 9 aa, Homo Sapiens
NTTRAGGVE

SEQ ID NO: 559478 - protein, 9 aa, Homo Sapiens
AKLPYVFKF

SEQ ID NO: 559479 - protein, 9 aa, Homo Sapiens
KNLIPQGIL

SEQ ID NO: 559480 - protein, 9 aa, Homo Sapiens
HCRVLPEGG

SEQ ID NO: 559481 - protein, 9 aa, Homo Sapiens
LMQNYRLRE

SEQ ID NO: 559482 - protein, 9 aa, Homo Sapiens
PCHGAAHCR

SEQ ID NO: 559483 - protein, 9 aa, Homo Sapiens
VSSQFCGAL

SEQ ID NO: 559484 - protein, 9 aa, Homo Sapiens
FLDPLSTAW

SEQ ID NO: 559485 - protein, 9 aa, Homo Sapiens
NTITYSACA

SEQ ID NO: 559486 - protein, 9 aa, Homo Sapiens
VSSSKTVTT

SEQ ID NO: 559487 - protein, 9 aa, Homo Sapiens
PYERKECGK

SEQ ID NO: 559488 - protein, 9 aa, Homo Sapiens
GSEGQEDDE

SEQ ID NO: 559489 - protein, 9 aa, Homo Sapiens
NLAFQQHAP

SEQ ID NO: 559490 - protein, 9 aa, Homo Sapiens
RDVLRGGTI

SEQ ID NO: 559491 - protein, 9 aa, Homo Sapiens
SWQEQHESR

SEQ ID NO: 559492 - protein, 9 aa, Homo Sapiens
GVYNQFIPL

SEQ ID NO: 559493 - protein, 9 aa, Homo Sapiens
EESAIHSPG

SEQ ID NO: 559494 - protein, 9 aa, Homo Sapiens
GHSPPHAYT

SEQ ID NO: 559495 - protein, 9 aa, Homo Sapiens
ARPPDLSCL

SEQ ID NO: 559496 - protein, 9 aa, Homo Sapiens
WLFRDAGHT

SEQ ID NO: 559497 - protein, 9 aa, Homo Sapiens
PAASVQIHQ

SEQ ID NO: 559498 - protein, 9 aa, Homo Sapiens
VKQITIHTK

SEQ ID NO: 559499 - protein, 9 aa, Homo Sapiens
SVWIGSSIL

SEQ ID NO: 559500 - protein, 9 aa, Homo Sapiens
WIGSSILAS

SEQ ID NO: 559501 - protein, 9 aa, Homo Sapiens
DKRICHLHL

SEQ ID NO: 559502 - protein, 9 aa, Homo Sapiens
LALLDRERM

SEQ ID NO: 559503 - protein, 9 aa, Homo Sapiens
QETDRSEDE

SEQ ID NO: 559504 - protein, 9 aa, Homo Sapiens
DEVLLASSS

SEQ ID NO: 559505 - protein, 9 aa, Homo Sapiens
MGEHSEIQC

SEQ ID NO: 559506 - protein, 9 aa, Homo Sapiens
PLLSTEKIK

SEQ ID NO: 559507 - protein, 9 aa, Homo Sapiens
EGQEDDEGE

SEQ ID NO: 559508 - protein, 9 aa, Homo Sapiens
ALFSLLVIL

SEQ ID NO: 559509 - protein, 9 aa, Homo Sapiens
IIGMEFSEE

SEQ ID NO: 559510 - protein, 9 aa, Homo Sapiens
QCEVCGREF

SEQ ID NO: 559511 - protein, 9 aa, Homo Sapiens
SVQRDVLRG

SEQ ID NO: 559512 - protein, 9 aa, Homo Sapiens
QVPEPDGQL

SEQ ID NO: 559513 - protein, 9 aa, Homo Sapiens
LSIVSVISG

SEQ ID NO: 559514 - protein, 9 aa, Homo Sapiens
PSWQEQHES

SEQ ID NO: 559515 - protein, 9 aa, Homo Sapiens
DTLSFVLRQ

SEQ ID NO: 559516 - protein, 9 aa, Homo Sapiens
IPGGVYNQF

SEQ ID NO: 559517 - protein, 9 aa, Homo Sapiens
HKAVMKALW

SEQ ID NO: 559518 - protein, 9 aa, Homo Sapiens
GHPAGGHRV

SEQ ID NO: 559519 - protein, 9 aa, Homo Sapiens
LSIEPQRVQ

SEQ ID NO: 559520 - protein, 9 aa, Homo Sapiens
FTILPSHVQ

SEQ ID NO: 559521 - protein, 9 aa, Homo Sapiens
KSWKPSSER

SEQ ID NO: 559522 - protein, 9 aa, Homo Sapiens
HSSSAMLIL

SEQ ID NO: 559523 - protein, 9 aa, Homo Sapiens
IHNENTMPR

SEQ ID NO: 559524 - protein, 9 aa, Homo Sapiens
SFSCNTRFY

SEQ ID NO: 559525 - protein, 9 aa, Homo Sapiens
YNQFIPLQV

SEQ ID NO: 559526 - protein, 9 aa, Homo Sapiens
VVKQITIHT

SEQ ID NO: 559527 - protein, 9 aa, Homo Sapiens
VPDLNNFTV

SEQ ID NO: 559528 - protein, 9 aa, Homo Sapiens
SACASQIFF

SEQ ID NO: 559529 - protein, 9 aa, Homo Sapiens
KENRHKGYE

SEQ ID NO: 559530 - protein, 9 aa, Homo Sapiens
VEYDAAGFT

SEQ ID NO: 559531 - protein, 9 aa, Homo Sapiens
APERSRASS

SEQ ID NO: 559532 - protein, 9 aa, Homo Sapiens
LSFVLRQHE

SEQ ID NO: 559533 - protein, 9 aa, Homo Sapiens
KIIGMEFSE

SEQ ID NO: 559534 - protein, 9 aa, Homo Sapiens
SKTVTTLSI

SEQ ID NO: 559535 - protein, 9 aa, Homo Sapiens
GVKEFQCEV

SEQ ID NO: 559536 - protein, 9 aa, Homo Sapiens
FTRDKRICH

SEQ ID NO: 559537 - protein, 9 aa, Homo Sapiens
FSCNTRFYL

SEQ ID NO: 559538 - protein, 9 aa, Homo Sapiens
RDINRTNVI

SEQ ID NO: 559539 - protein, 9 aa, Homo Sapiens
LAPNTLRMF

SEQ ID NO: 559540 - protein, 9 aa, Homo Sapiens
QEEDRFQEL

SEQ ID NO: 559541 - protein, 9 aa, Homo Sapiens
VLGWDHACN

SEQ ID NO: 559542 - protein, 9 aa, Homo Sapiens
KAVMKALWK

SEQ ID NO: 559543 - protein, 9 aa, Homo Sapiens
CHLHLFWHQ

SEQ ID NO: 559544 - protein, 9 aa, Homo Sapiens
DQVPEPDGQ

SEQ ID NO: 559545 - protein, 9 aa, Homo Sapiens
HVKHPPAAS

SEQ ID NO: 559546 - protein, 9 aa, Homo Sapiens
GLNCTEGPI

SEQ ID NO: 559547 - protein, 9 aa, Homo Sapiens
QLQYLHKAV

SEQ ID NO: 559548 - protein, 9 aa, Homo Sapiens
KPYERKECG

SEQ ID NO: 559549 - protein, 9 aa, Homo Sapiens
LFSLLVILI

SEQ ID NO: 559550 - protein, 9 aa, Homo Sapiens
HLSMLTDSL

SEQ ID NO: 559551 - protein, 9 aa, Homo Sapiens
IPQGILKLD

SEQ ID NO: 559552 - protein, 9 aa, Homo Sapiens
AAKKGALFS

SEQ ID NO: 559553 - protein, 9 aa, Homo Sapiens
HNSNVQWRA

SEQ ID NO: 559554 - protein, 9 aa, Homo Sapiens
VPEPDGQLE

SEQ ID NO: 559555 - protein, 9 aa, Homo Sapiens
PTLPEWEDS

SEQ ID NO: 559556 - protein, 9 aa, Homo Sapiens
EKEVTSPPQ

SEQ ID NO: 559557 - protein, 9 aa, Homo Sapiens
RGHEIILAA

SEQ ID NO: 559558 - protein, 9 aa, Homo Sapiens
LGPSPDNDL

SEQ ID NO: 559559 - protein, 9 aa, Homo Sapiens
VTTLSIKEA

SEQ ID NO: 559560 - protein, 9 aa, Homo Sapiens
RFESVLGNY

SEQ ID NO: 559561 - protein, 9 aa, Homo Sapiens
TDSLFLPIS

SEQ ID NO: 559562 - protein, 9 aa, Homo Sapiens
GHTMGFWLT

SEQ ID NO: 559563 - protein, 9 aa, Homo Sapiens
DLSCLHANQ

SEQ ID NO: 559564 - protein, 9 aa, Homo Sapiens
TYYKLRLKA

SEQ ID NO: 559565 - protein, 9 aa, Homo Sapiens
LCRHTRLFC

SEQ ID NO: 559566 - protein, 9 aa, Homo Sapiens
DNIGNSKAG

SEQ ID NO: 559567 - protein, 9 aa, Homo Sapiens
LEEAIHKYD

SEQ ID NO: 559568 - protein, 9 aa, Homo Sapiens
TGVVEYDAA

SEQ ID NO: 559569 - protein, 9 aa, Homo Sapiens
MSRPRLSLC

SEQ ID NO: 559570 - protein, 9 aa, Homo Sapiens
TLSFVLRQH

SEQ ID NO: 559571 - protein, 9 aa, Homo Sapiens
TGSEGQEDD

SEQ ID NO: 559572 - protein, 9 aa, Homo Sapiens
ASDILEESA

SEQ ID NO: 559573 - protein, 9 aa, Homo Sapiens
SHTSSQQPI

SEQ ID NO: 559574 - protein, 9 aa, Homo Sapiens
EVERLQSKL

SEQ ID NO: 559575 - protein, 9 aa, Homo Sapiens
GGKAKNTAA

SEQ ID NO: 559576 - protein, 9 aa, Homo Sapiens
VVADYRRRK

SEQ ID NO: 559577 - protein, 9 aa, Homo Sapiens
TLSIEPQRV

SEQ ID NO: 559578 - protein, 9 aa, Homo Sapiens
RPPDLSCLH

SEQ ID NO: 559579 - protein, 9 aa, Homo Sapiens
EKNGFLPLL

SEQ ID NO: 559580 - protein, 9 aa, Homo Sapiens
SSDALLAFL

SEQ ID NO: 559581 - protein, 9 aa, Homo Sapiens
RSMNVGCYP

SEQ ID NO: 559582 - protein, 9 aa, Homo Sapiens
VGDVVNLAF

SEQ ID NO: 559583 - protein, 9 aa, Homo Sapiens
SSLEEEGSL

SEQ ID NO: 559584 - protein, 9 aa, Homo Sapiens
ERSRASSSG

SEQ ID NO: 559585 - protein, 9 aa, Homo Sapiens
TSRRRWCGR

SEQ ID NO: 559586 - protein, 9 aa, Homo Sapiens
SRRITDPER

SEQ ID NO: 559587 - protein, 9 aa, Homo Sapiens
PCFMGEHSE

SEQ ID NO: 559588 - protein, 9 aa, Homo Sapiens
DRANPYFAY

SEQ ID NO: 559589 - protein, 9 aa, Homo Sapiens
ANPYFAYLQ

SEQ ID NO: 559590 - protein, 9 aa, Homo Sapiens
LLLKMGQHN

SEQ ID NO: 559591 - protein, 9 aa, Homo Sapiens
IRPFMQYNT

SEQ ID NO: 559592 - protein, 9 aa, Homo Sapiens
DGLLSLSAR

SEQ ID NO: 559593 - protein, 9 aa, Homo Sapiens
GILKLDHPR

SEQ ID NO: 559594 - protein, 9 aa, Homo Sapiens
LVLGWDHAC

SEQ ID NO: 559595 - protein, 9 aa, Homo Sapiens
ADYRRRKKK

SEQ ID NO: 559596 - protein, 9 aa, Homo Sapiens
EHSNPSCWG

SEQ ID NO: 559597 - protein, 9 aa, Homo Sapiens
PYFAYLQIR

SEQ ID NO: 559598 - protein, 9 aa, Homo Sapiens
NHNGLNALH

SEQ ID NO: 559599 - protein, 9 aa, Homo Sapiens
LHANQFTYY

SEQ ID NO: 559600 - protein, 9 aa, Homo Sapiens
SEGDAPTLF

SEQ ID NO: 559601 - protein, 9 aa, Homo Sapiens
SPPQEEDRF

SEQ ID NO: 559602 - protein, 9 aa, Homo Sapiens
RSRASSSGG

SEQ ID NO: 559603 - protein, 9 aa, Homo Sapiens
PPHAYTPMS

SEQ ID NO: 559604 - protein, 9 aa, Homo Sapiens
RPFPEALFY

SEQ ID NO: 559605 - protein, 9 aa, Homo Sapiens
TSLPVLDFI

SEQ ID NO: 559606 - protein, 9 aa, Homo Sapiens
GWDHACNSS

SEQ ID NO: 559607 - protein, 9 aa, Homo Sapiens
GVDINICNH

SEQ ID NO: 559608 - protein, 9 aa, Homo Sapiens
ISDEVERLQ

SEQ ID NO: 559609 - protein, 9 aa, Homo Sapiens
EFSRALKEL

SEQ ID NO: 559610 - protein, 9 aa, Homo Sapiens
RRRWCGRSR

SEQ ID NO: 559611 - protein, 9 aa, Homo Sapiens
SSDTGSEGQ

SEQ ID NO: 559612 - protein, 9 aa, Homo Sapiens
IEDFVLELT

SEQ ID NO: 559613 - protein, 9 aa, Homo Sapiens
GLLSLSARP

SEQ ID NO: 559614 - protein, 9 aa, Homo Sapiens
LEESAIHSP

SEQ ID NO: 559615 - protein, 9 aa, Homo Sapiens
REDEVLLAS

SEQ ID NO: 559616 - protein, 9 aa, Homo Sapiens
FRDAGHTMG

SEQ ID NO: 559617 - protein, 9 aa, Homo Sapiens
QRVQEGERV

SEQ ID NO: 559618 - protein, 9 aa, Homo Sapiens
FSVWIGSSI

SEQ ID NO: 559619 - protein, 9 aa, Homo Sapiens
EFQQDVMAH

SEQ ID NO: 559620 - protein, 9 aa, Homo Sapiens
RRITDPERQ

SEQ ID NO: 559621 - protein, 9 aa, Homo Sapiens
NVISASRKT

SEQ ID NO: 559622 - protein, 9 aa, Homo Sapiens
VWIGSSILA

SEQ ID NO: 559623 - protein, 9 aa, Homo Sapiens
HPSDLEGGE

SEQ ID NO: 559624 - protein, 9 aa, Homo Sapiens
APTLFSRGS

SEQ ID NO: 559625 - protein, 9 aa, Homo Sapiens
LDFIDAIAP

SEQ ID NO: 559626 - protein, 9 aa, Homo Sapiens
FESVLGNYS

SEQ ID NO: 559627 - protein, 9 aa, Homo Sapiens
LDDMTKNNP

SEQ ID NO: 559628 - protein, 9 aa, Homo Sapiens
KLEEAIHKY

SEQ ID NO: 559629 - protein, 9 aa, Homo Sapiens
VECQLGHPA

SEQ ID NO: 559630 - protein, 9 aa, Homo Sapiens
AQQTVFTIL

SEQ ID NO: 559631 - protein, 9 aa, Homo Sapiens
SPHIYTDKE

SEQ ID NO: 559632 - protein, 9 aa, Homo Sapiens
TLSIKEASK

SEQ ID NO: 559633 - protein, 9 aa, Homo Sapiens
TLRMFTSNS

SEQ ID NO: 559634 - protein, 9 aa, Homo Sapiens
AIGDAAHKP

SEQ ID NO: 559635 - protein, 9 aa, Homo Sapiens
ERKECGKAF

SEQ ID NO: 559636 - protein, 9 aa, Homo Sapiens
GQEDDEGEE

SEQ ID NO: 559637 - protein, 9 aa, Homo Sapiens
NTAAAGGKK

SEQ ID NO: 559638 - protein, 9 aa, Homo Sapiens
LGWDHACNS

SEQ ID NO: 559639 - protein, 9 aa, Homo Sapiens
SSKTVTTLS

SEQ ID NO: 559640 - protein, 9 aa, Homo Sapiens
RPFTYYKLR

SEQ ID NO: 559641 - protein, 9 aa, Homo Sapiens
FAYLQIRKK

SEQ ID NO: 559642 - protein, 9 aa, Homo Sapiens
LAFLDPLST

SEQ ID NO: 559643 - protein, 9 aa, Homo Sapiens
SPISDEVER

SEQ ID NO: 559644 - protein, 9 aa, Homo Sapiens
LQIVPTLPE

SEQ ID NO: 559645 - protein, 9 aa, Homo Sapiens
YLHKAVMKA

SEQ ID NO: 559646 - protein, 9 aa, Homo Sapiens
EIRRSVIEF

SEQ ID NO: 559647 - protein, 9 aa, Homo Sapiens
LFLPISHCQ

SEQ ID NO: 559648 - protein, 9 aa, Homo Sapiens
TSPHIYTDK

SEQ ID NO: 559649 - protein, 9 aa, Homo Sapiens
GSQTVVVKQ

SEQ ID NO: 559650 - protein, 9 aa, Homo Sapiens
KRICHLHLF

SEQ ID NO: 559651 - protein, 9 aa, Homo Sapiens
SSQQPISAR

SEQ ID NO: 559652 - protein, 9 aa, Homo Sapiens
KEFQCEVCG

SEQ ID NO: 559653 - protein, 9 aa, Homo Sapiens
YSACASQIF

SEQ ID NO: 559654 - protein, 9 aa, Homo Sapiens
GVALRFESV

SEQ ID NO: 559655 - protein, 9 aa, Homo Sapiens
NQDKWKRET

SEQ ID NO: 559656 - protein, 9 aa, Homo Sapiens
PDGQLEEPT

SEQ ID NO: 559657 - protein, 9 aa, Homo Sapiens
QHNSNVQWR

SEQ ID NO: 559658 - protein, 9 aa, Homo Sapiens
CGALLGTVC

SEQ ID NO: 559659 - protein, 9 aa, Homo Sapiens
HKGVKEFQC

SEQ ID NO: 559660 - protein, 9 aa, Homo Sapiens
QPISARPPD

SEQ ID NO: 559661 - protein, 9 aa, Homo Sapiens
VVVADYRRR

SEQ ID NO: 559662 - protein, 9 aa, Homo Sapiens
LKLDHPRIH

SEQ ID NO: 559663 - protein, 9 aa, Homo Sapiens
EHSEIQCII

SEQ ID NO: 559664 - protein, 9 aa, Homo Sapiens
AASVQIHQV

SEQ ID NO: 559665 - protein, 9 aa, Homo Sapiens
CHGAAHCRV

SEQ ID NO: 559666 - protein, 9 aa, Homo Sapiens
FMGEHSEIQ

SEQ ID NO: 559667 - protein, 9 aa, Homo Sapiens
QKENRHKGY

SEQ ID NO: 559668 - protein, 9 aa, Homo Sapiens
VSRAIGDAA

SEQ ID NO: 559669 - protein, 9 aa, Homo Sapiens
DKGGKAKNT

SEQ ID NO: 559670 - protein, 9 aa, Homo Sapiens
TTLSIKEAS

SEQ ID NO: 559671 - protein, 9 aa, Homo Sapiens
AKNTAAAGG

SEQ ID NO: 559672 - protein, 9 aa, Homo Sapiens
SDRANPYFA

SEQ ID NO: 559673 - protein, 9 aa, Homo Sapiens
VLRQHEIGE

SEQ ID NO: 559674 - protein, 9 aa, Homo Sapiens
NIGNSKAGN

SEQ ID NO: 559675 - protein, 9 aa, Homo Sapiens
SLPVLDFID

SEQ ID NO: 559676 - protein, 9 aa, Homo Sapiens
DTGVALRFE

SEQ ID NO: 559677 - protein, 9 aa, Homo Sapiens
CNTRFYLNG

SEQ ID NO: 559678 - protein, 9 aa, Homo Sapiens
AAGFTKLTL

SEQ ID NO: 559679 - protein, 9 aa, Homo Sapiens
HSPLQIVPT

SEQ ID NO: 559680 - protein, 9 aa, Homo Sapiens
QHAPVECQL

SEQ ID NO: 559681 - protein, 9 aa, Homo Sapiens
RPRLSLCLP

SEQ ID NO: 559682 - protein, 9 aa, Homo Sapiens
PSSERMDQD

SEQ ID NO: 559683 - protein, 9 aa, Homo Sapiens
PTSRRRWCG

SEQ ID NO: 559684 - protein, 9 aa, Homo Sapiens
QQDVMAHAC

SEQ ID NO: 559685 - protein, 9 aa, Homo Sapiens
GDAPTLFSR

SEQ ID NO: 559686 - protein, 9 aa, Homo Sapiens
LNYLCHLSM

SEQ ID NO: 559687 - protein, 9 aa, Homo Sapiens
SQKENRHKG

SEQ ID NO: 559688 - protein, 9 aa, Homo Sapiens
SLLVILISE

SEQ ID NO: 559689 - protein, 9 aa, Homo Sapiens
ANQFTYYFT

SEQ ID NO: 559690 - protein, 9 aa, Homo Sapiens
PDLNNFTVE

SEQ ID NO: 559691 - protein, 9 aa, Homo Sapiens
LRQHEIGEW

SEQ ID NO: 559692 - protein, 9 aa, Homo Sapiens
LSCLHANQF

SEQ ID NO: 559693 - protein, 9 aa, Homo Sapiens
QFTYYFTTT

SEQ ID NO: 559694 - protein, 9 aa, Homo Sapiens
SIEPQRVQE

SEQ ID NO: 559695 - protein, 9 aa, Homo Sapiens
QDVPDLNNF

SEQ ID NO: 559696 - protein, 9 aa, Homo Sapiens
SMLTDSLFL

SEQ ID NO: 559697 - protein, 9 aa, Homo Sapiens
DLAVGDVVN

SEQ ID NO: 559698 - protein, 9 aa, Homo Sapiens
QDGLNCTEG

SEQ ID NO: 559699 - protein, 9 aa, Homo Sapiens
LRGGTIIQD

SEQ ID NO: 559700 - protein, 9 aa, Homo Sapiens
ITDPERQDL

SEQ ID NO: 559701 - protein, 9 aa, Homo Sapiens
TLPEWEDSL

SEQ ID NO: 559702 - protein, 9 aa, Homo Sapiens
EAIHKYDSV

SEQ ID NO: 559703 - protein, 9 aa, Homo Sapiens
FPEALFYEF

SEQ ID NO: 559704 - protein, 9 aa, Homo Sapiens
PEPDGQLEE

SEQ ID NO: 559705 - protein, 9 aa, Homo Sapiens
AAVCLVRRG

SEQ ID NO: 559706 - protein, 9 aa, Homo Sapiens
LLKMGQHNS

SEQ ID NO: 559707 - protein, 9 aa, Homo Sapiens
FVLELTRME

SEQ ID NO: 559708 - protein, 9 aa, Homo Sapiens
TSSDALLAF

SEQ ID NO: 559709 - protein, 9 aa, Homo Sapiens
CRHTRLFCM

SEQ ID NO: 559710 - protein, 9 aa, Homo Sapiens
AHACLQKLK

SEQ ID NO: 559711 - protein, 9 aa, Homo Sapiens
SSVYESRRI

SEQ ID NO: 559712 - protein, 9 aa, Homo Sapiens
TSPPQEEDR

SEQ ID NO: 559713 - protein, 9 aa, Homo Sapiens
NDLCVSESL

SEQ ID NO: 559714 - protein, 9 aa, Homo Sapiens
CMVRAQAWS

SEQ ID NO: 559715 - protein, 9 aa, Homo Sapiens
ILKLDHPRI

SEQ ID NO: 559716 - protein, 9 aa, Homo Sapiens
RMFTSNSEI

SEQ ID NO: 559717 - protein, 9 aa, Homo Sapiens
TKLNYLCHL

SEQ ID NO: 559718 - protein, 9 aa, Homo Sapiens
NYLCHLSML

SEQ ID NO: 559719 - protein, 9 aa, Homo Sapiens
ISFSCNTRF

SEQ ID NO: 559720 - protein, 9 aa, Homo Sapiens
RQIVIHNEN

SEQ ID NO: 559721 - protein, 9 aa, Homo Sapiens
PDLSCLHAN

SEQ ID NO: 559722 - protein, 9 aa, Homo Sapiens
VRRGHEIIL

SEQ ID NO: 559723 - protein, 9 aa, Homo Sapiens
ILSLSIVSV

SEQ ID NO: 559724 - protein, 9 aa, Homo Sapiens
QDVMAHACL

SEQ ID NO: 559725 - protein, 9 aa, Homo Sapiens
FRPFPEALF

SEQ ID NO: 559726 - protein, 9 aa, Homo Sapiens
ERMPVYSLM

SEQ ID NO: 559727 - protein, 9 aa, Homo Sapiens
TVFTILPSH

SEQ ID NO: 559728 - protein, 9 aa, Homo Sapiens
KKGALFSLL

SEQ ID NO: 559729 - protein, 9 aa, Homo Sapiens
SLFLPISHC

SEQ ID NO: 559730 - protein, 9 aa, Homo Sapiens
FSLLVILIS

SEQ ID NO: 559731 - protein, 9 aa, Homo Sapiens
TILPSHVQP

SEQ ID NO: 559732 - protein, 9 aa, Homo Sapiens
VLLASSSRY

SEQ ID NO: 559733 - protein, 9 aa, Homo Sapiens
QGILKLDHP

SEQ ID NO: 559734 - protein, 9 aa, Homo Sapiens
CFMGEHSEI

SEQ ID NO: 559735 - protein, 9 aa, Homo Sapiens
PEKNGFLPL

SEQ ID NO: 559736 - protein, 9 aa, Homo Sapiens
VTSPPQEED

SEQ ID NO: 559737 - protein, 9 aa, Homo Sapiens
ILLSVVFVG

SEQ ID NO: 559738 - protein, 9 aa, Homo Sapiens
VTQKLEEAI

SEQ ID NO: 559739 - protein, 9 aa, Homo Sapiens
YPQDDPDIT

SEQ ID NO: 559740 - protein, 9 aa, Homo Sapiens
GPSPDNDLC

SEQ ID NO: 559741 - protein, 9 aa, Homo Sapiens
EFQCEVCGR

SEQ ID NO: 559742 - protein, 9 aa, Homo Sapiens
DEVERLQSK

SEQ ID NO: 559743 - protein, 9 aa, Homo Sapiens
GCVRLSFQG

SEQ ID NO: 559744 - protein, 9 aa, Homo Sapiens
ETDRSEDED

SEQ ID NO: 559745 - protein, 9 aa, Homo Sapiens
CQLGHPAGG

SEQ ID NO: 559746 - protein, 9 aa, Homo Sapiens
PVVSSQFCG

SEQ ID NO: 559747 - protein, 9 aa, Homo Sapiens
IEFSRALKE

SEQ ID NO: 559748 - protein, 9 aa, Homo Sapiens
KMGQHNSNV

SEQ ID NO: 559749 - protein, 9 aa, Homo Sapiens
VRLSFQGPL

SEQ ID NO: 559750 - protein, 9 aa, Homo Sapiens
VNLAFQQHA

SEQ ID NO: 559751 - protein, 9 aa, Homo Sapiens
YNTTRAGGV

SEQ ID NO: 559752 - protein, 9 aa, Homo Sapiens
VGCYPQDDP

SEQ ID NO: 559753 - protein, 9 aa, Homo Sapiens
SQFCGALLG

SEQ ID NO: 559754 - protein, 9 aa, Homo Sapiens
EPQRVQEGE

SEQ ID NO: 559755 - protein, 9 aa, Homo Sapiens
DDMTKNNPF

SEQ ID NO: 559756 - protein, 9 aa, Homo Sapiens
HSNPSCWGF

SEQ ID NO: 559757 - protein, 9 aa, Homo Sapiens
KEVTSPPQE

SEQ ID NO: 559758 - protein, 9 aa, Homo Sapiens
ALLDRERMP

SEQ ID NO: 559759 - protein, 9 aa, Homo Sapiens
AVSASDILE

SEQ ID NO: 559760 - protein, 9 aa, Homo Sapiens
EQHESRTFA

SEQ ID NO: 559761 - protein, 9 aa, Homo Sapiens
TRFYLNGAD

SEQ ID NO: 559762 - protein, 9 aa, Homo Sapiens
GFLPLLSTE

SEQ ID NO: 559763 - protein, 9 aa, Homo Sapiens
EGSLIMFSR

SEQ ID NO: 559764 - protein, 9 aa, Homo Sapiens
PVLDFIDAI

SEQ ID NO: 559765 - protein, 9 aa, Homo Sapiens
DAAGFTKLT

SEQ ID NO: 559766 - protein, 9 aa, Homo Sapiens
RNFSVWIGS

SEQ ID NO: 559767 - protein, 9 aa, Homo Sapiens
AMLILLSVV

SEQ ID NO: 559768 - protein, 9 aa, Homo Sapiens
PRDPAPERS

SEQ ID NO: 559769 - protein, 9 aa, Homo Sapiens
TVEHSNPSC

SEQ ID NO: 559770 - protein, 9 aa, Homo Sapiens
PSSLEEEGS

SEQ ID NO: 559771 - protein, 9 aa, Homo Sapiens
TDRSEDEDI

SEQ ID NO: 559772 - protein, 9 aa, Homo Sapiens
NQLQYLHKA

SEQ ID NO: 559773 - protein, 9 aa, Homo Sapiens
DINICNHNG

SEQ ID NO: 559774 - protein, 9 aa, Homo Sapiens
SARPSPTSR

SEQ ID NO: 559775 - protein, 9 aa, Homo Sapiens
DNTITYSAC

SEQ ID NO: 559776 - protein, 9 aa, Homo Sapiens
GDVVNLAFQ

SEQ ID NO: 559777 - protein, 9 aa, Homo Sapiens
VVVKQITIH

SEQ ID NO: 559778 - protein, 9 aa, Homo Sapiens
DAAHKPYIC

SEQ ID NO: 559779 - protein, 9 aa, Homo Sapiens
LLDRERMPV

SEQ ID NO: 559780 - protein, 9 aa, Homo Sapiens
QDKWKRETV

SEQ ID NO: 559781 - protein, 9 aa, Homo Sapiens
KVRDINRTN

SEQ ID NO: 559782 - protein, 9 aa, Homo Sapiens
NTLRMFTSN

SEQ ID NO: 559783 - protein, 9 aa, Homo Sapiens
KLPYVFKFK

SEQ ID NO: 559784 - protein, 9 aa, Homo Sapiens
KNTAAAGGK

SEQ ID NO: 559785 - protein, 9 aa, Homo Sapiens
YERKECGKA

SEQ ID NO: 559786 - protein, 9 aa, Homo Sapiens
VDRLRPFTY

SEQ ID NO: 559787 - protein, 9 aa, Homo Sapiens
ELDKVTQFK

SEQ ID NO: 559788 - protein, 9 aa, Homo Sapiens
GRNAPEQVK

SEQ ID NO: 559789 - protein, 9 aa, Homo Sapiens
DDGNLGSLY

SEQ ID NO: 559790 - protein, 9 aa, Homo Sapiens
LFLLLGLSC

SEQ ID NO: 559791 - protein, 9 aa, Homo Sapiens
AYFTDSCSS

SEQ ID NO: 559792 - protein, 9 aa, Homo Sapiens
KVTFPAYFT

SEQ ID NO: 559793 - protein, 9 aa, Homo Sapiens
GISLSTQQA

SEQ ID NO: 559794 - protein, 9 aa, Homo Sapiens
CPVFYKVDG

SEQ ID NO: 559795 - protein, 9 aa, Homo Sapiens
GRASFPRFR

SEQ ID NO: 559796 - protein, 9 aa, Homo Sapiens
SLYDFWEYH

SEQ ID NO: 559797 - protein, 9 aa, Homo Sapiens
YIALSTANL

SEQ ID NO: 559798 - protein, 9 aa, Homo Sapiens
TGRASFPRF

SEQ ID NO: 559799 - protein, 9 aa, Homo Sapiens
WAGPHHWRF

SEQ ID NO: 559800 - protein, 9 aa, Homo Sapiens
NQSLETQEV

SEQ ID NO: 559801 - protein, 9 aa, Homo Sapiens
AEGPPKCVS

SEQ ID NO: 559802 - protein, 9 aa, Homo Sapiens
SKDNQIKLM

SEQ ID NO: 559803 - protein, 9 aa, Homo Sapiens
SRDTLRAQP

SEQ ID NO: 559804 - protein, 9 aa, Homo Sapiens
SQPVSREPL

SEQ ID NO: 559805 - protein, 9 aa, Homo Sapiens
KVDIGLLSS

SEQ ID NO: 559806 - protein, 9 aa, Homo Sapiens
KKSNMGDYS

SEQ ID NO: 559807 - protein, 9 aa, Homo Sapiens
RSLLQQGFL

SEQ ID NO: 559808 - protein, 9 aa, Homo Sapiens
LSDNSGCDA

SEQ ID NO: 559809 - protein, 9 aa, Homo Sapiens
PSVMLRAGL

SEQ ID NO: 559810 - protein, 9 aa, Homo Sapiens
LLSSPGETG

SEQ ID NO: 559811 - protein, 9 aa, Homo Sapiens
IIITQQHYI

SEQ ID NO: 559812 - protein, 9 aa, Homo Sapiens
NGFKVLLIS

SEQ ID NO: 559813 - protein, 9 aa, Homo Sapiens
ASGHVASQV

SEQ ID NO: 559814 - protein, 9 aa, Homo Sapiens
HIEGRNAPE

SEQ ID NO: 559815 - protein, 9 aa, Homo Sapiens
QIGRLVDRL

SEQ ID NO: 559816 - protein, 9 aa, Homo Sapiens
RTESIVVQA

SEQ ID NO: 559817 - protein, 9 aa, Homo Sapiens
GFKVLLISD

SEQ ID NO: 559818 - protein, 9 aa, Homo Sapiens
RPLLRAFCS

SEQ ID NO: 559819 - protein, 9 aa, Homo Sapiens
DHRPLLRAF

SEQ ID NO: 559820 - protein, 9 aa, Homo Sapiens
NRHKMFHTG

SEQ ID NO: 559821 - protein, 9 aa, Homo Sapiens
ASQSQRSPL

SEQ ID NO: 559822 - protein, 9 aa, Homo Sapiens
TPKRKLRPY

SEQ ID NO: 559823 - protein, 9 aa, Homo Sapiens
GLQQACRLK

SEQ ID NO: 559824 - protein, 9 aa, Homo Sapiens
ILHLPDTND

SEQ ID NO: 559825 - protein, 9 aa, Homo Sapiens
MSNMNISYK

SEQ ID NO: 559826 - protein, 9 aa, Homo Sapiens
IQPRTKRSL

SEQ ID NO: 559827 - protein, 9 aa, Homo Sapiens
MMMEDTESQ

SEQ ID NO: 559828 - protein, 9 aa, Homo Sapiens
LTYQFLPYI

SEQ ID NO: 559829 - protein, 9 aa, Homo Sapiens
LGKFRRLPS

SEQ ID NO: 559830 - protein, 9 aa, Homo Sapiens
PWINNCVGH

SEQ ID NO: 559831 - protein, 9 aa, Homo Sapiens
GEEPYQCSE

SEQ ID NO: 559832 - protein, 9 aa, Homo Sapiens
GEEAWRAHL

SEQ ID NO: 559833 - protein, 9 aa, Homo Sapiens
PHHWRFRPR

SEQ ID NO: 559834 - protein, 9 aa, Homo Sapiens
SIVVQAENL

SEQ ID NO: 559835 - protein, 9 aa, Homo Sapiens
TKVTFPAYF

SEQ ID NO: 559836 - protein, 9 aa, Homo Sapiens
TAYSEIIVA

SEQ ID NO: 559837 - protein, 9 aa, Homo Sapiens
SPYEDILWY

SEQ ID NO: 559838 - protein, 9 aa, Homo Sapiens
IECNRDDCT

SEQ ID NO: 559839 - protein, 9 aa, Homo Sapiens
GLELANGFK

SEQ ID NO: 559840 - protein, 9 aa, Homo Sapiens
LPGSPGAEG

SEQ ID NO: 559841 - protein, 9 aa, Homo Sapiens
FILNLNEPD

SEQ ID NO: 559842 - protein, 9 aa, Homo Sapiens
RIEGYEDQV

SEQ ID NO: 559843 - protein, 9 aa, Homo Sapiens
TGSGGPQAN

SEQ ID NO: 559844 - protein, 9 aa, Homo Sapiens
TIGWSRRCA

SEQ ID NO: 559845 - protein, 9 aa, Homo Sapiens
MHETSQYHL

SEQ ID NO: 559846 - protein, 9 aa, Homo Sapiens
RRLISLVVC

SEQ ID NO: 559847 - protein, 9 aa, Homo Sapiens
ANLTRQQKI

SEQ ID NO: 559848 - protein, 9 aa, Homo Sapiens
NVLMAKVLL

SEQ ID NO: 559849 - protein, 9 aa, Homo Sapiens
TGSGGHSQP

SEQ ID NO: 559850 - protein, 9 aa, Homo Sapiens
APYRPLERG

SEQ ID NO: 559851 - protein, 9 aa, Homo Sapiens
ETEARCLMP

SEQ ID NO: 559852 - protein, 9 aa, Homo Sapiens
RCAQITTTI

SEQ ID NO: 559853 - protein, 9 aa, Homo Sapiens
RLEREQKKL

SEQ ID NO: 559854 - protein, 9 aa, Homo Sapiens
VVQAENLVK

SEQ ID NO: 559855 - protein, 9 aa, Homo Sapiens
ETSAKKVKW

SEQ ID NO: 559856 - protein, 9 aa, Homo Sapiens
ISLSTQQAQ

SEQ ID NO: 559857 - protein, 9 aa, Homo Sapiens
SSPGETGVP

SEQ ID NO: 559858 - protein, 9 aa, Homo Sapiens
LQHLATFIM

SEQ ID NO: 559859 - protein, 9 aa, Homo Sapiens
NYIECNRDD

SEQ ID NO: 559860 - protein, 9 aa, Homo Sapiens
RFSRRLISL

SEQ ID NO: 559861 - protein, 9 aa, Homo Sapiens
HLSGAAGHS

SEQ ID NO: 559862 - protein, 9 aa, Homo Sapiens
EADTWRHGE

SEQ ID NO: 559863 - protein, 9 aa, Homo Sapiens
LNSSFETSA

SEQ ID NO: 559864 - protein, 9 aa, Homo Sapiens
KRNLSEADT

SEQ ID NO: 559865 - protein, 9 aa, Homo Sapiens
EARCLMPSS

SEQ ID NO: 559866 - protein, 9 aa, Homo Sapiens
GLLLQLSQQ

SEQ ID NO: 559867 - protein, 9 aa, Homo Sapiens
VIPPTTHLG

SEQ ID NO: 559868 - protein, 9 aa, Homo Sapiens
TYQFLPYIS

SEQ ID NO: 559869 - protein, 9 aa, Homo Sapiens
EDVAKLETE

SEQ ID NO: 559870 - protein, 9 aa, Homo Sapiens
HWKHLDEEQ

SEQ ID NO: 559871 - protein, 9 aa, Homo Sapiens
NSESINQSL

SEQ ID NO: 559872 - protein, 9 aa, Homo Sapiens
RTKRSLLQQ

SEQ ID NO: 559873 - protein, 9 aa, Homo Sapiens
HYIYDISAK

SEQ ID NO: 559874 - protein, 9 aa, Homo Sapiens
DLSAEHLIL

SEQ ID NO: 559875 - protein, 9 aa, Homo Sapiens
KKSLLPLWK

SEQ ID NO: 559876 - protein, 9 aa, Homo Sapiens
LMSNMNISY

SEQ ID NO: 559877 - protein, 9 aa, Homo Sapiens
HLILSDVQR

SEQ ID NO: 559878 - protein, 9 aa, Homo Sapiens
EECPISKKK

SEQ ID NO: 559879 - protein, 9 aa, Homo Sapiens
SQRSPLSDN

SEQ ID NO: 559880 - protein, 9 aa, Homo Sapiens
LWYPSTPPP

SEQ ID NO: 559881 - protein, 9 aa, Homo Sapiens
NQIKLMNEI

SEQ ID NO: 559882 - protein, 9 aa, Homo Sapiens
LQPLLAEAV

SEQ ID NO: 559883 - protein, 9 aa, Homo Sapiens
QQKIHIEKK

SEQ ID NO: 559884 - protein, 9 aa, Homo Sapiens
FCDLFLLLG

SEQ ID NO: 559885 - protein, 9 aa, Homo Sapiens
PGEEAWRAH

SEQ ID NO: 559886 - protein, 9 aa, Homo Sapiens
GEPVLTYQF

SEQ ID NO: 559887 - protein, 9 aa, Homo Sapiens
LGFLVLKKR

SEQ ID NO: 559888 - protein, 9 aa, Homo Sapiens
NHYQKREYQ

SEQ ID NO: 559889 - protein, 9 aa, Homo Sapiens
FHELVPGPE

SEQ ID NO: 559890 - protein, 9 aa, Homo Sapiens
LTLNGKTCQ

SEQ ID NO: 559891 - protein, 9 aa, Homo Sapiens
KSMMMEDTE

SEQ ID NO: 559892 - protein, 9 aa, Homo Sapiens
WRLFHELVP

SEQ ID NO: 559893 - protein, 9 aa, Homo Sapiens
GAAGHSVCQ

SEQ ID NO: 559894 - protein, 9 aa, Homo Sapiens
HYFCDLFLL

SEQ ID NO: 559895 - protein, 9 aa, Homo Sapiens
TSNSESINQ

SEQ ID NO: 559896 - protein, 9 aa, Homo Sapiens
SQYHLQHLA

SEQ ID NO: 559897 - protein, 9 aa, Homo Sapiens
GLLSSPGET

SEQ ID NO: 559898 - protein, 9 aa, Homo Sapiens
APSPSKSSV

SEQ ID NO: 559899 - protein, 8 aa, Homo Sapiens
GVKASQTG

SEQ ID NO: 559900 - protein, 9 aa, Homo Sapiens
MFHTGEKLY

SEQ ID NO: 559901 - protein, 9 aa, Homo Sapiens
REILKDVSL

SEQ ID NO: 559902 - protein, 9 aa, Homo Sapiens
PLSDNSGCD

SEQ ID NO: 559903 - protein, 9 aa, Homo Sapiens
HKMFHTGEK

SEQ ID NO: 559904 - protein, 9 aa, Homo Sapiens
RIQPNDCPV

SEQ ID NO: 559905 - protein, 9 aa, Homo Sapiens
AAPSPSKSS

SEQ ID NO: 559906 - protein, 9 aa, Homo Sapiens
SKSSVSTSP

SEQ ID NO: 559907 - protein, 9 aa, Homo Sapiens
EAWRAHLMG

SEQ ID NO: 559908 - protein, 9 aa, Homo Sapiens
INQSLETQE

SEQ ID NO: 559909 - protein, 9 aa, Homo Sapiens
DGNLGSLYI

SEQ ID NO: 559910 - protein, 9 aa, Homo Sapiens
CVSLVGADD

SEQ ID NO: 559911 - protein, 9 aa, Homo Sapiens
NLTRQQKIH

SEQ ID NO: 559912 - protein, 9 aa, Homo Sapiens
AYVTGWGTQ

SEQ ID NO: 559913 - protein, 9 aa, Homo Sapiens
TDHDDNQSR

SEQ ID NO: 559914 - protein, 9 aa, Homo Sapiens
KRSLLQQGF

SEQ ID NO: 559915 - protein, 9 aa, Homo Sapiens
HSQPVSREP

SEQ ID NO: 559916 - protein, 9 aa, Homo Sapiens
LRAFCSDIH

SEQ ID NO: 559917 - protein, 9 aa, Homo Sapiens
WEYHLPYLY

SEQ ID NO: 559918 - protein, 9 aa, Homo Sapiens
SFETSAKKV

SEQ ID NO: 559919 - protein, 9 aa, Homo Sapiens
DIGLLSSPG

SEQ ID NO: 559920 - protein, 9 aa, Homo Sapiens
QWKSEAAPY

SEQ ID NO: 559921 - protein, 9 aa, Homo Sapiens
QFANLTRQQ

SEQ ID NO: 559922 - protein, 9 aa, Homo Sapiens
PVRIEGYED

SEQ ID NO: 559923 - protein, 9 aa, Homo Sapiens
HLVKMVILI

SEQ ID NO: 559924 - protein, 9 aa, Homo Sapiens
TESQMMALI

SEQ ID NO: 559925 - protein, 9 aa, Homo Sapiens
SMWAGPHHW

SEQ ID NO: 559926 - protein, 9 aa, Homo Sapiens
SSPKKEETE

SEQ ID NO: 559927 - protein, 9 aa, Homo Sapiens
FSRRLISLV

SEQ ID NO: 559928 - protein, 9 aa, Homo Sapiens
HRAVVLGLQ

SEQ ID NO: 559929 - protein, 9 aa, Homo Sapiens
GKFRRLPSR

SEQ ID NO: 559930 - protein, 9 aa, Homo Sapiens
LDQFTPVRI

SEQ ID NO: 559931 - protein, 9 aa, Homo Sapiens
AEAPEAPEA

SEQ ID NO: 559932 - protein, 9 aa, Homo Sapiens
EIIVAAPNC

SEQ ID NO: 559933 - protein, 9 aa, Homo Sapiens
AYSEIIVAA

SEQ ID NO: 559934 - protein, 9 aa, Homo Sapiens
NLSEADTWR

SEQ ID NO: 559935 - protein, 9 aa, Homo Sapiens
STWQQSGPS

SEQ ID NO: 559936 - protein, 9 aa, Homo Sapiens
TLSVLKNTP

SEQ ID NO: 559937 - protein, 9 aa, Homo Sapiens
AKICSRDTL

SEQ ID NO: 559938 - protein, 9 aa, Homo Sapiens
SGHVASQVS

SEQ ID NO: 559939 - protein, 9 aa, Homo Sapiens
QSQRSPLSD

SEQ ID NO: 559940 - protein, 9 aa, Homo Sapiens
QMMALIVCL

SEQ ID NO: 559941 - protein, 9 aa, Homo Sapiens
YQFLPYISY

SEQ ID NO: 559942 - protein, 9 aa, Homo Sapiens
VLTYQFLPY

SEQ ID NO: 559943 - protein, 9 aa, Homo Sapiens
LAEAVDSIF

SEQ ID NO: 559944 - protein, 9 aa, Homo Sapiens
PVLTWKKDG

SEQ ID NO: 559945 - protein, 9 aa, Homo Sapiens
MLRAGLLAK

SEQ ID NO: 559946 - protein, 9 aa, Homo Sapiens
QYHLQHLAT

SEQ ID NO: 559947 - protein, 9 aa, Homo Sapiens
SPPMTLKQI

SEQ ID NO: 559948 - protein, 9 aa, Homo Sapiens
QGNSTFPNS

SEQ ID NO: 559949 - protein, 9 aa, Homo Sapiens
GWSRRCAQI

SEQ ID NO: 559950 - protein, 9 aa, Homo Sapiens
PRPVLTWKK

SEQ ID NO: 559951 - protein, 9 aa, Homo Sapiens
CSRDTLRAQ

SEQ ID NO: 559952 - protein, 9 aa, Homo Sapiens
FPNSFGFNI

SEQ ID NO: 559953 - protein, 9 aa, Homo Sapiens
NLDQFTPVR

SEQ ID NO: 559954 - protein, 9 aa, Homo Sapiens
AQPPGAAPS

SEQ ID NO: 559955 - protein, 9 aa, Homo Sapiens
QDVTVVEGG

SEQ ID NO: 559956 - protein, 9 aa, Homo Sapiens
PRCGVPDHL

SEQ ID NO: 559957 - protein, 9 aa, Homo Sapiens
SQMMALIVC

SEQ ID NO: 559958 - protein, 9 aa, Homo Sapiens
FWEYHLPYL

SEQ ID NO: 559959 - protein, 9 aa, Homo Sapiens
DTESQMMAL

SEQ ID NO: 559960 - protein, 9 aa, Homo Sapiens
SCRQQWTRE

SEQ ID NO: 559961 - protein, 9 aa, Homo Sapiens
ESQMMALIV

SEQ ID NO: 559962 - protein, 9 aa, Homo Sapiens
PAKICSRDT

SEQ ID NO: 559963 - protein, 9 aa, Homo Sapiens
LYIYVLLIV

SEQ ID NO: 559964 - protein, 9 aa, Homo Sapiens
MTLKQILVR

SEQ ID NO: 559965 - protein, 9 aa, Homo Sapiens
MLCAGDTGS

SEQ ID NO: 559966 - protein, 9 aa, Homo Sapiens
LQLSQQAKN

SEQ ID NO: 559967 - protein, 9 aa, Homo Sapiens
SRRLISLVV

SEQ ID NO: 559968 - protein, 9 aa, Homo Sapiens
EPYQCSECG

SEQ ID NO: 559969 - protein, 9 aa, Homo Sapiens
LLRAFCSDI

SEQ ID NO: 559970 - protein, 9 aa, Homo Sapiens
LRIQPNDCP

SEQ ID NO: 559971 - protein, 9 aa, Homo Sapiens
YLGKFRRLP

SEQ ID NO: 559972 - protein, 9 aa, Homo Sapiens
QIKLMNEIL

SEQ ID NO: 559973 - protein, 9 aa, Homo Sapiens
EKRSPPMTL

SEQ ID NO: 559974 - protein, 9 aa, Homo Sapiens
ECNRDDCTV

SEQ ID NO: 559975 - protein, 9 aa, Homo Sapiens
TLRAQPPGA

SEQ ID NO: 559976 - protein, 9 aa, Homo Sapiens
PLLAEAVDS

SEQ ID NO: 559977 - protein, 9 aa, Homo Sapiens
KREYQCIKC

SEQ ID NO: 559978 - protein, 9 aa, Homo Sapiens
EDNFSYIAL

SEQ ID NO: 559979 - protein, 9 aa, Homo Sapiens
ITDHDDNQS

SEQ ID NO: 559980 - protein, 9 aa, Homo Sapiens
VDIGLLSSP

SEQ ID NO: 559981 - protein, 9 aa, Homo Sapiens
KKKSNMGDY

SEQ ID NO: 559982 - protein, 9 aa, Homo Sapiens
DSVLSTPKR

SEQ ID NO: 559983 - protein, 9 aa, Homo Sapiens
RQDNQKMIV

SEQ ID NO: 559984 - protein, 9 aa, Homo Sapiens
HHWRFRPRR

SEQ ID NO: 559985 - protein, 9 aa, Homo Sapiens
SNMNISYKI

SEQ ID NO: 559986 - protein, 9 aa, Homo Sapiens
EEPYQCSEC

SEQ ID NO: 559987 - protein, 9 aa, Homo Sapiens
GSLYIYVLL

SEQ ID NO: 559988 - protein, 9 aa, Homo Sapiens
EQIGRLVDR

SEQ ID NO: 559989 - protein, 9 aa, Homo Sapiens
LSGAAGHSV

SEQ ID NO: 559990 - protein, 9 aa, Homo Sapiens
LKNTPIHVV

SEQ ID NO: 559991 - protein, 9 aa, Homo Sapiens
TEARCLMPS

SEQ ID NO: 559992 - protein, 9 aa, Homo Sapiens
HFLWTWLMT

SEQ ID NO: 559993 - protein, 9 aa, Homo Sapiens
EDILWYPST

SEQ ID NO: 559994 - protein, 9 aa, Homo Sapiens
ISKKKSNMG

SEQ ID NO: 559995 - protein, 9 aa, Homo Sapiens
MALIVCLGF

SEQ ID NO: 559996 - protein, 9 aa, Homo Sapiens
HVASQVSTS

SEQ ID NO: 559997 - protein, 9 aa, Homo Sapiens
ITQQHYIYD

SEQ ID NO: 559998 - protein, 9 aa, Homo Sapiens
SILNRHKMF

SEQ ID NO: 559999 - protein, 9 aa, Homo Sapiens
FKVLLISDP

SEQ ID NO: 560000 - protein, 9 aa, Homo Sapiens
RLISLVVCP

SEQ ID NO: 560001 - protein, 9 aa, Homo Sapiens
SNPSVMLRA

SEQ ID NO: 560002 - protein, 9 aa, Homo Sapiens
SKVDIGLLS

SEQ ID NO: 560003 - protein, 9 aa, Homo Sapiens
GGHSQPVSR

SEQ ID NO: 560004 - protein, 9 aa, Homo Sapiens
SVLSTPKRK

SEQ ID NO: 560005 - protein, 9 aa, Homo Sapiens
PRTKRSLLQ

SEQ ID NO: 560006 - protein, 9 aa, Homo Sapiens
VKDILHLPD

SEQ ID NO: 560007 - protein, 9 aa, Homo Sapiens
VASQVSTSL

SEQ ID NO: 560008 - protein, 9 aa, Homo Sapiens
SESINQSLE

SEQ ID NO: 560009 - protein, 9 aa, Homo Sapiens
LSTPKRKLR

SEQ ID NO: 560010 - protein, 9 aa, Homo Sapiens
LLLQLSQQA

SEQ ID NO: 560011 - protein, 9 aa, Homo Sapiens
DFWEYHLPY

SEQ ID NO: 560012 - protein, 9 aa, Homo Sapiens
YIECNRDDC

SEQ ID NO: 560013 - protein, 9 aa, Homo Sapiens
KSLLPLWKR

SEQ ID NO: 560014 - protein, 9 aa, Homo Sapiens
GKKTLFILN

SEQ ID NO: 560015 - protein, 9 aa, Homo Sapiens
SEIIVAAPN

SEQ ID NO: 560016 - protein, 9 aa, Homo Sapiens
HMKSKDNQI

SEQ ID NO: 560017 - protein, 9 aa, Homo Sapiens
SAEHLILSD

SEQ ID NO: 560018 - protein, 9 aa, Homo Sapiens
LLQLSQQAK

SEQ ID NO: 560019 - protein, 9 aa, Homo Sapiens
QEQIGRLVD

SEQ ID NO: 560020 - protein, 9 aa, Homo Sapiens
HPLLSAQGV

SEQ ID NO: 560021 - protein, 9 aa, Homo Sapiens
KMIVKSMMM

SEQ ID NO: 560022 - protein, 9 aa, Homo Sapiens
VTGWGTQEY

SEQ ID NO: 560023 - protein, 9 aa, Homo Sapiens
GHSQPVSRE

SEQ ID NO: 560024 - protein, 9 aa, Homo Sapiens
VILIEPEGA

SEQ ID NO: 560025 - protein, 9 aa, Homo Sapiens
VLTWKKDGA

SEQ ID NO: 560026 - protein, 9 aa, Homo Sapiens
TTIVIPPTT

SEQ ID NO: 560027 - protein, 9 aa, Homo Sapiens
PKRKLRPYF

SEQ ID NO: 560028 - protein, 9 aa, Homo Sapiens
LTRQQKIHI

SEQ ID NO: 560029 - protein, 9 aa, Homo Sapiens
KRLEREQKK

SEQ ID NO: 560030 - protein, 9 aa, Homo Sapiens
FPLTQDVTV

SEQ ID NO: 560031 - protein, 9 aa, Homo Sapiens
IALSTANLP

SEQ ID NO: 560032 - protein, 9 aa, Homo Sapiens
CAQITTTIV

SEQ ID NO: 560033 - protein, 9 aa, Homo Sapiens
TLELDKVTQ

SEQ ID NO: 560034 - protein, 9 aa, Homo Sapiens
FETSAKKVK

SEQ ID NO: 560035 - protein, 9 aa, Homo Sapiens
VKSMMMEDT

SEQ ID NO: 560036 - protein, 9 aa, Homo Sapiens
MVILIEPEG

SEQ ID NO: 560037 - protein, 9 aa, Homo Sapiens
DNFSYIALS

SEQ ID NO: 560038 - protein, 9 aa, Homo Sapiens
RGNYIECNR

SEQ ID NO: 560039 - protein, 9 aa, Homo Sapiens
EDTESQMMA

SEQ ID NO: 560040 - protein, 9 aa, Homo Sapiens
FRVENSFDF

SEQ ID NO: 560041 - protein, 9 aa, Homo Sapiens
SINQSLETQ

SEQ ID NO: 560042 - protein, 9 aa, Homo Sapiens
EKCFHRALE

SEQ ID NO: 560043 - protein, 9 aa, Homo Sapiens
HRPLLRAFC

SEQ ID NO: 560044 - protein, 9 aa, Homo Sapiens
LGLQQACRL

SEQ ID NO: 560045 - protein, 9 aa, Homo Sapiens
KSSVSTSPS

SEQ ID NO: 560046 - protein, 9 aa, Homo Sapiens
SLHPLLSAQ

SEQ ID NO: 560047 - protein, 9 aa, Homo Sapiens
GQFPLTQDV

SEQ ID NO: 560048 - protein, 9 aa, Homo Sapiens
DPTLSVLKN

SEQ ID NO: 560049 - protein, 9 aa, Homo Sapiens
LDLSAEHLI

SEQ ID NO: 560050 - protein, 9 aa, Homo Sapiens
AFCSDIHSN

SEQ ID NO: 560051 - protein, 9 aa, Homo Sapiens
HLPYLYSCI

SEQ ID NO: 560052 - protein, 9 aa, Homo Sapiens
GTQEYAGHT

SEQ ID NO: 560053 - protein, 9 aa, Homo Sapiens
SVLKNTPIH

SEQ ID NO: 560054 - protein, 9 aa, Homo Sapiens
DTKVTFPAY

SEQ ID NO: 560055 - protein, 9 aa, Homo Sapiens
TWLMTRSQE

SEQ ID NO: 560056 - protein, 9 aa, Homo Sapiens
LYDFWEYHL

SEQ ID NO: 560057 - protein, 9 aa, Homo Sapiens
RVENSFDFM

SEQ ID NO: 560058 - protein, 9 aa, Homo Sapiens
QHWKHLDEE

SEQ ID NO: 560059 - protein, 9 aa, Homo Sapiens
GFSVKDILH

SEQ ID NO: 560060 - protein, 9 aa, Homo Sapiens
GPPKCVSLV

SEQ ID NO: 560061 - protein, 9 aa, Homo Sapiens
VQWKSEAAP

SEQ ID NO: 560062 - protein, 9 aa, Homo Sapiens
FQGKPRPVL

SEQ ID NO: 560063 - protein, 9 aa, Homo Sapiens
NDCPVFYKV

SEQ ID NO: 560064 - protein, 9 aa, Homo Sapiens
IVPLPGSPG

SEQ ID NO: 560065 - protein, 9 aa, Homo Sapiens
ALIVCLGFL

SEQ ID NO: 560066 - protein, 9 aa, Homo Sapiens
GPHHWRFRP

SEQ ID NO: 560067 - protein, 9 aa, Homo Sapiens
DILHLPDTN

SEQ ID NO: 560068 - protein, 9 aa, Homo Sapiens
QDNQKMIVK

SEQ ID NO: 560069 - protein, 9 aa, Homo Sapiens
QPVSREPLP

SEQ ID NO: 560070 - protein, 9 aa, Homo Sapiens
SQVSTSLLV

SEQ ID NO: 560071 - protein, 9 aa, Homo Sapiens
REQKKLYQS

SEQ ID NO: 560072 - protein, 9 aa, Homo Sapiens
LFHELVPGP

SEQ ID NO: 560073 - protein, 9 aa, Homo Sapiens
ESINQSLET

SEQ ID NO: 560074 - protein, 9 aa, Homo Sapiens
FSVKDILHL

SEQ ID NO: 560075 - protein, 9 aa, Homo Sapiens
RAGLLAKKA

SEQ ID NO: 560076 - protein, 9 aa, Homo Sapiens
EGPPKCVSL

SEQ ID NO: 560077 - protein, 9 aa, Homo Sapiens
TAYVTGWGT

SEQ ID NO: 560078 - protein, 9 aa, Homo Sapiens
IGLLSSPGE

SEQ ID NO: 560079 - protein, 9 aa, Homo Sapiens
NSSFETSAK

SEQ ID NO: 560080 - protein, 9 aa, Homo Sapiens
EPVLTYQFL

SEQ ID NO: 560081 - protein, 9 aa, Homo Sapiens
KCFHRALEK

SEQ ID NO: 560082 - protein, 9 aa, Homo Sapiens
QPRTKRSLL

SEQ ID NO: 560083 - protein, 9 aa, Homo Sapiens
TKRQDNQKM

SEQ ID NO: 560084 - protein, 9 aa, Homo Sapiens
YHLQHLATF

SEQ ID NO: 560085 - protein, 9 aa, Homo Sapiens
CGVPDHLMG

SEQ ID NO: 560086 - protein, 9 aa, Homo Sapiens
KRKLRPYFE

SEQ ID NO: 560087 - protein, 9 aa, Homo Sapiens
LSVLKNTPI

SEQ ID NO: 560088 - protein, 9 aa, Homo Sapiens
SPSTARTIG

SEQ ID NO: 560089 - protein, 9 aa, Homo Sapiens
ATGRASFPR

SEQ ID NO: 560090 - protein, 9 aa, Homo Sapiens
KMFHTGEKL

SEQ ID NO: 560091 - protein, 9 aa, Homo Sapiens
MIVKSMMME

SEQ ID NO: 560092 - protein, 9 aa, Homo Sapiens
GSGGPQANL

SEQ ID NO: 560093 - protein, 9 aa, Homo Sapiens
TSAKTLELD

SEQ ID NO: 560094 - protein, 9 aa, Homo Sapiens
LDKVTQFKT

SEQ ID NO: 560095 - protein, 9 aa, Homo Sapiens
QWRLFHELV

SEQ ID NO: 560096 - protein, 9 aa, Homo Sapiens
FPAYFTDSC

SEQ ID NO: 560097 - protein, 9 aa, Homo Sapiens
SSFETSAKK

SEQ ID NO: 560098 - protein, 9 aa, Homo Sapiens
VCLGFLVLK

SEQ ID NO: 560099 - protein, 9 aa, Homo Sapiens
QQHYIYDIS

SEQ ID NO: 560100 - protein, 9 aa, Homo Sapiens
EAPEAASPA

SEQ ID NO: 560101 - protein, 9 aa, Homo Sapiens
WQQSGPSHS

SEQ ID NO: 560102 - protein, 9 aa, Homo Sapiens
LSSPGETGV

SEQ ID NO: 560103 - protein, 9 aa, Homo Sapiens
FPRFRQCVN

SEQ ID NO: 560104 - protein, 9 aa, Homo Sapiens
FSKRTESIV

SEQ ID NO: 560105 - protein, 9 aa, Homo Sapiens
KPRPVLTWK

SEQ ID NO: 560106 - protein, 9 aa, Homo Sapiens
CNRDDCTVS

SEQ ID NO: 560107 - protein, 9 aa, Homo Sapiens
KRTESIVVQ

SEQ ID NO: 560108 - protein, 9 aa, Homo Sapiens
LELANGFKV

SEQ ID NO: 560109 - protein, 9 aa, Homo Sapiens
VLMAKVLLL

SEQ ID NO: 560110 - protein, 9 aa, Homo Sapiens
LLHRAVVLG

SEQ ID NO: 560111 - protein, 9 aa, Homo Sapiens
YHLPYLYSC

SEQ ID NO: 560112 - protein, 9 aa, Homo Sapiens
TTTIVIPPT

SEQ ID NO: 560113 - protein, 9 aa, Homo Sapiens
FHRALEKDT

SEQ ID NO: 560114 - protein, 9 aa, Homo Sapiens
TLKQILVRD

SEQ ID NO: 560115 - protein, 9 aa, Homo Sapiens
REYQCIKCM

SEQ ID NO: 560116 - protein, 9 aa, Homo Sapiens
STFPNSFGF

SEQ ID NO: 560117 - protein, 9 aa, Homo Sapiens
SFDFMENIS

SEQ ID NO: 560118 - protein, 9 aa, Homo Sapiens
IQPNDCPVF

SEQ ID NO: 560119 - protein, 9 aa, Homo Sapiens
QPLLAEAVD

SEQ ID NO: 560120 - protein, 9 aa, Homo Sapiens
LNRHKMFHT

SEQ ID NO: 560121 - protein, 9 aa, Homo Sapiens
FSSLQPLLA

SEQ ID NO: 560122 - protein, 9 aa, Homo Sapiens
PLPGSPGAE

SEQ ID NO: 560123 - protein, 9 aa, Homo Sapiens
SFPRFRQCV

SEQ ID NO: 560124 - protein, 9 aa, Homo Sapiens
NFSYIALST

SEQ ID NO: 560125 - protein, 9 aa, Homo Sapiens
HQQHWKHLD

SEQ ID NO: 560126 - protein, 9 aa, Homo Sapiens
SAKTLELDK

SEQ ID NO: 560127 - protein, 9 aa, Homo Sapiens
LVKMVILIE

SEQ ID NO: 560128 - protein, 9 aa, Homo Sapiens
QQHWKHLDE

SEQ ID NO: 560129 - protein, 9 aa, Homo Sapiens
LRAQPPGAA

SEQ ID NO: 560130 - protein, 9 aa, Homo Sapiens
AGDTGSGGP

SEQ ID NO: 560131 - protein, 9 aa, Homo Sapiens
HLQHLATFI

SEQ ID NO: 560132 - protein, 9 aa, Homo Sapiens
EQEQIGRLV

SEQ ID NO: 560133 - protein, 9 aa, Homo Sapiens
VRIEGYEDQ

SEQ ID NO: 560134 - protein, 9 aa, Homo Sapiens
SKKKSNMGD

SEQ ID NO: 560135 - protein, 9 aa, Homo Sapiens
AKLETEMEQ

SEQ ID NO: 560136 - protein, 9 aa, Homo Sapiens
SDPTLSVLK

SEQ ID NO: 560137 - protein, 9 aa, Homo Sapiens
PVLTYQFLP

SEQ ID NO: 560138 - protein, 9 aa, Homo Sapiens
QKKLYQSAT

SEQ ID NO: 560139 - protein, 9 aa, Homo Sapiens
DNQIKLMNE

SEQ ID NO: 560140 - protein, 9 aa, Homo Sapiens
LHRAVVLGL

SEQ ID NO: 560141 - protein, 9 aa, Homo Sapiens
KFRRLPSRS

SEQ ID NO: 560142 - protein, 9 aa, Homo Sapiens
AKKVKWSST

SEQ ID NO: 560143 - protein, 9 aa, Homo Sapiens
ETSQYHLQH

SEQ ID NO: 560144 - protein, 9 aa, Homo Sapiens
TQDVTVVEG

SEQ ID NO: 560145 - protein, 9 aa, Homo Sapiens
NPSVMLRAG

SEQ ID NO: 560146 - protein, 9 aa, Homo Sapiens
GNLGSLYIY

SEQ ID NO: 560147 - protein, 9 aa, Homo Sapiens
RPVLTWKKD

SEQ ID NO: 560148 - protein, 9 aa, Homo Sapiens
INNCVGHYN

SEQ ID NO: 560149 - protein, 9 aa, Homo Sapiens
EREQKKLYQ

SEQ ID NO: 560150 - protein, 9 aa, Homo Sapiens
LEHQQHWKH

SEQ ID NO: 560151 - protein, 9 aa, Homo Sapiens
YVTGWGTQE

SEQ ID NO: 560152 - protein, 9 aa, Homo Sapiens
KMVILIEPE

SEQ ID NO: 560153 - protein, 9 aa, Homo Sapiens
PGHFGLLLQ

SEQ ID NO: 560154 - protein, 9 aa, Homo Sapiens
KCVSLVGAD

SEQ ID NO: 560155 - protein, 9 aa, Homo Sapiens
PAYFTDSCS

SEQ ID NO: 560156 - protein, 9 aa, Homo Sapiens
GHSVCQDVN

SEQ ID NO: 560157 - protein, 9 aa, Homo Sapiens
PTLSVLKNT

SEQ ID NO: 560158 - protein, 9 aa, Homo Sapiens
WTWLMTRSQ

SEQ ID NO: 560159 - protein, 9 aa, Homo Sapiens
QKREYQCIK

SEQ ID NO: 560160 - protein, 9 aa, Homo Sapiens
IVKSMMMED

SEQ ID NO: 560161 - protein, 9 aa, Homo Sapiens
GATGQWRLF

SEQ ID NO: 560162 - protein, 9 aa, Homo Sapiens
PKKEETEAR

SEQ ID NO: 560163 - protein, 9 aa, Homo Sapiens
FHLSGAAGH

SEQ ID NO: 560164 - protein, 9 aa, Homo Sapiens
SARHFLWTW

SEQ ID NO: 560165 - protein, 9 aa, Homo Sapiens
IVCLGFLVL

SEQ ID NO: 560166 - protein, 9 aa, Homo Sapiens
QWTREILKD

SEQ ID NO: 560167 - protein, 9 aa, Homo Sapiens
SKVFRVENS

SEQ ID NO: 560168 - protein, 9 aa, Homo Sapiens
TTSNSESIN

SEQ ID NO: 560169 - protein, 9 aa, Homo Sapiens
IEPEGAPNI

SEQ ID NO: 560170 - protein, 9 aa, Homo Sapiens
LSTQQAQKL

SEQ ID NO: 560171 - protein, 9 aa, Homo Sapiens
VLGLQQACR

SEQ ID NO: 560172 - protein, 9 aa, Homo Sapiens
HLPDTNDEE

SEQ ID NO: 560173 - protein, 9 aa, Homo Sapiens
LIEPEGAPN

SEQ ID NO: 560174 - protein, 9 aa, Homo Sapiens
PKCVSLVGA

SEQ ID NO: 560175 - protein, 9 aa, Homo Sapiens
QRSPLSDNS

SEQ ID NO: 560176 - protein, 9 aa, Homo Sapiens
WKHLDEEQA

SEQ ID NO: 560177 - protein, 9 aa, Homo Sapiens
FRRLPSRSP

SEQ ID NO: 560178 - protein, 9 aa, Homo Sapiens
SPKKEETEA

SEQ ID NO: 560179 - protein, 9 aa, Homo Sapiens
APEAPEAAS

SEQ ID NO: 560180 - protein, 9 aa, Homo Sapiens
TMSMWAGPH

SEQ ID NO: 560181 - protein, 9 aa, Homo Sapiens
SGPSHSSLD

SEQ ID NO: 560182 - protein, 9 aa, Homo Sapiens
PPGAAPSPS

SEQ ID NO: 560183 - protein, 9 aa, Homo Sapiens
AKPAEAPEA

SEQ ID NO: 560184 - protein, 9 aa, Homo Sapiens
ECKEKRSPP

SEQ ID NO: 560185 - protein, 9 aa, Homo Sapiens
CPISKKKSN

SEQ ID NO: 560186 - protein, 9 aa, Homo Sapiens
STPKRKLRP

SEQ ID NO: 560187 - protein, 9 aa, Homo Sapiens
RASFPRFRQ

SEQ ID NO: 560188 - protein, 9 aa, Homo Sapiens
LTQDVTVVE

SEQ ID NO: 560189 - protein, 9 aa, Homo Sapiens
VENSFDFME

SEQ ID NO: 560190 - protein, 9 aa, Homo Sapiens
DTWRHGENT

SEQ ID NO: 560191 - protein, 9 aa, Homo Sapiens
ISYKIRNLS

SEQ ID NO: 560192 - protein, 9 aa, Homo Sapiens
AEKCFHRAL

SEQ ID NO: 560193 - protein, 9 aa, Homo Sapiens
YKIRNLSTT

SEQ ID NO: 560194 - protein, 9 aa, Homo Sapiens
VCLDLSAEH

SEQ ID NO: 560195 - protein, 9 aa, Homo Sapiens
QAPGISLST

SEQ ID NO: 560196 - protein, 9 aa, Homo Sapiens
QLSQQAKNG

SEQ ID NO: 560197 - protein, 9 aa, Homo Sapiens
KIVPLPGSP

SEQ ID NO: 560198 - protein, 9 aa, Homo Sapiens
RKLRPYFEG

SEQ ID NO: 560199 - protein, 9 aa, Homo Sapiens
SRRCAQITT

SEQ ID NO: 560200 - protein, 9 aa, Homo Sapiens
VVLGLQQAC

SEQ ID NO: 560201 - protein, 9 aa, Homo Sapiens
SVMLRAGLL

SEQ ID NO: 560202 - protein, 9 aa, Homo Sapiens
HETSQYHLQ

SEQ ID NO: 560203 - protein, 9 aa, Homo Sapiens
YFCDLFLLL

SEQ ID NO: 560204 - protein, 9 aa, Homo Sapiens
DNQKMIVKS

SEQ ID NO: 560205 - protein, 9 aa, Homo Sapiens
DSITDHDDN

SEQ ID NO: 560206 - protein, 9 aa, Homo Sapiens
SKRTESIVV

SEQ ID NO: 560207 - protein, 9 aa, Homo Sapiens
INVLMAKVL

SEQ ID NO: 560208 - protein, 9 aa, Homo Sapiens
NMNISYKIR

SEQ ID NO: 560209 - protein, 9 aa, Homo Sapiens
EETEARCLM

SEQ ID NO: 560210 - protein, 9 aa, Homo Sapiens
GNYIECNRD

SEQ ID NO: 560211 - protein, 9 aa, Homo Sapiens
YEDILWYPS

SEQ ID NO: 560212 - protein, 9 aa, Homo Sapiens
VAKLETEME

SEQ ID NO: 560213 - protein, 9 aa, Homo Sapiens
APEQVKMLQ

SEQ ID NO: 560214 - protein, 9 aa, Homo Sapiens
TGWGTQEYA

SEQ ID NO: 560215 - protein, 9 aa, Homo Sapiens
IVVQAENLV

SEQ ID NO: 560216 - protein, 9 aa, Homo Sapiens
CAGDTGSGG

SEQ ID NO: 560217 - protein, 9 aa, Homo Sapiens
GDTGSGGPQ

SEQ ID NO: 560218 - protein, 9 aa, Homo Sapiens
KKLYQSATQ

SEQ ID NO: 560219 - protein, 9 aa, Homo Sapiens
ESIVVQAEN

SEQ ID NO: 560220 - protein, 9 aa, Homo Sapiens
PGISLSTQQ

SEQ ID NO: 560221 - protein, 9 aa, Homo Sapiens
DQAPGISLS

SEQ ID NO: 560222 - protein, 9 aa, Homo Sapiens
KRQDNQKMI

SEQ ID NO: 560223 - protein, 9 aa, Homo Sapiens
PISKKKSNM

SEQ ID NO: 560224 - protein, 9 aa, Homo Sapiens
SAKKVKWSS

SEQ ID NO: 560225 - protein, 9 aa, Homo Sapiens
TPVRIEGYE

SEQ ID NO: 560226 - protein, 9 aa, Homo Sapiens
QPRFSRRLI

SEQ ID NO: 560227 - protein, 9 aa, Homo Sapiens
VEKECKEKR

SEQ ID NO: 560228 - protein, 9 aa, Homo Sapiens
TFPAYFTDS

SEQ ID NO: 560229 - protein, 9 aa, Homo Sapiens
VFRVENSFD

SEQ ID NO: 560230 - protein, 9 aa, Homo Sapiens
AWRAHLMGP

SEQ ID NO: 560231 - protein, 9 aa, Homo Sapiens
SGGHSQPVS

SEQ ID NO: 560232 - protein, 9 aa, Homo Sapiens
TSAKKVKWS

SEQ ID NO: 560233 - protein, 9 aa, Homo Sapiens
QFPLTQDVT

SEQ ID NO: 560234 - protein, 9 aa, Homo Sapiens
FHTGEKLYK

SEQ ID NO: 560235 - protein, 9 aa, Homo Sapiens
KKTLFILNL

SEQ ID NO: 560236 - protein, 9 aa, Homo Sapiens
TKKSLLPLW

SEQ ID NO: 560237 - protein, 9 aa, Homo Sapiens
GKPRPVLTW

SEQ ID NO: 560238 - protein, 9 aa, Homo Sapiens
RGLELANGF

SEQ ID NO: 560239 - protein, 9 aa, Homo Sapiens
QGQFPLTQD

SEQ ID NO: 560240 - protein, 9 aa, Homo Sapiens
TSQYHLQHL

SEQ ID NO: 560241 - protein, 9 aa, Homo Sapiens
WKSEAAPYR

SEQ ID NO: 560242 - protein, 9 aa, Homo Sapiens
PSTARTIGW

SEQ ID NO: 560243 - protein, 9 aa, Homo Sapiens
TIVIPPTTH

SEQ ID NO: 560244 - protein, 9 aa, Homo Sapiens
TARTIGWSR

SEQ ID NO: 560245 - protein, 9 aa, Homo Sapiens
ASQVSTSLL

SEQ ID NO: 560246 - protein, 9 aa, Homo Sapiens
RAVVLGLQQ

SEQ ID NO: 560247 - protein, 9 aa, Homo Sapiens
LIVCLGFLV

SEQ ID NO: 560248 - protein, 9 aa, Homo Sapiens
FTPVRIEGY

SEQ ID NO: 560249 - protein, 9 aa, Homo Sapiens
KHLDEEQAS

SEQ ID NO: 560250 - protein, 9 aa, Homo Sapiens
ILWYPSTPP

SEQ ID NO: 560251 - protein, 9 aa, Homo Sapiens
PLLRAFCSD

SEQ ID NO: 560252 - protein, 9 aa, Homo Sapiens
TVTAYSEII

SEQ ID NO: 560253 - protein, 9 aa, Homo Sapiens
RQQKIHIEK

SEQ ID NO: 560254 - protein, 9 aa, Homo Sapiens
TTKRQDNQK

SEQ ID NO: 560255 - protein, 9 aa, Homo Sapiens
WRAHLMGPA

SEQ ID NO: 560256 - protein, 9 aa, Homo Sapiens
QHYIYDISA

SEQ ID NO: 560257 - protein, 9 aa, Homo Sapiens
SVSTSPSTA

SEQ ID NO: 560258 - protein, 9 aa, Homo Sapiens
QAEGPPKCV

SEQ ID NO: 560259 - protein, 9 aa, Homo Sapiens
KTLFILNLN

SEQ ID NO: 560260 - protein, 9 aa, Homo Sapiens
RIIITQQHY

SEQ ID NO: 560261 - protein, 9 aa, Homo Sapiens
QPNDCPVFY

SEQ ID NO: 560262 - protein, 9 aa, Homo Sapiens
LSEADTWRH

SEQ ID NO: 560263 - protein, 9 aa, Homo Sapiens
QTKKSLLPL

SEQ ID NO: 560264 - protein, 9 aa, Homo Sapiens
ARHFLWTWL

SEQ ID NO: 560265 - protein, 9 aa, Homo Sapiens
PGYQLTLNG

SEQ ID NO: 560266 - protein, 9 aa, Homo Sapiens
QVSTSLLVP

SEQ ID NO: 560267 - protein, 9 aa, Homo Sapiens
AAKPAEAPE

SEQ ID NO: 560268 - protein, 9 aa, Homo Sapiens
LWTWLMTRS

SEQ ID NO: 560269 - protein, 9 aa, Homo Sapiens
PRFSRRLIS

SEQ ID NO: 560270 - protein, 9 aa, Homo Sapiens
SQSQRSPLS

SEQ ID NO: 560271 - protein, 9 aa, Homo Sapiens
DTGSGGPQA

SEQ ID NO: 560272 - protein, 9 aa, Homo Sapiens
QSLHPLLSA

SEQ ID NO: 560273 - protein, 9 aa, Homo Sapiens
AKRNLSEAD

SEQ ID NO: 560274 - protein, 9 aa, Homo Sapiens
ALRIQPNDC

SEQ ID NO: 560275 - protein, 9 aa, Homo Sapiens
LHLPDTNDE

SEQ ID NO: 560276 - protein, 9 aa, Homo Sapiens
EKECKEKRS

SEQ ID NO: 560277 - protein, 9 aa, Homo Sapiens
MAKVLLLVP

SEQ ID NO: 560278 - protein, 9 aa, Homo Sapiens
DKVTQFKTM

SEQ ID NO: 560279 - protein, 9 aa, Homo Sapiens
SPGEEAWRA

SEQ ID NO: 560280 - protein, 9 aa, Homo Sapiens
NISYKIRNL

SEQ ID NO: 560281 - protein, 9 aa, Homo Sapiens
SGAAGHSVC

SEQ ID NO: 560282 - protein, 9 aa, Homo Sapiens
SLLPLWKRS

SEQ ID NO: 560283 - protein, 9 aa, Homo Sapiens
RQQWTREIL

SEQ ID NO: 560284 - protein, 9 aa, Homo Sapiens
HDDNQSRLL

SEQ ID NO: 560285 - protein, 9 aa, Homo Sapiens
PRGNYIECN

SEQ ID NO: 560286 - protein, 9 aa, Homo Sapiens
RNLSEADTW

SEQ ID NO: 560287 - protein, 9 aa, Homo Sapiens
EAAPYRPLE

SEQ ID NO: 560288 - protein, 9 aa, Homo Sapiens
ARTIGWSRR

SEQ ID NO: 560289 - protein, 9 aa, Homo Sapiens
KTLELDKVT

SEQ ID NO: 560290 - protein, 9 aa, Homo Sapiens
RSPPMTLKQ

SEQ ID NO: 560291 - protein, 9 aa, Homo Sapiens
RLFHELVPG

SEQ ID NO: 560292 - protein, 9 aa, Homo Sapiens
VMLRAGLLA

SEQ ID NO: 560293 - protein, 9 aa, Homo Sapiens
LANGFKVLL

SEQ ID NO: 560294 - protein, 9 aa, Homo Sapiens
RAFCSDIHS

SEQ ID NO: 560295 - protein, 9 aa, Homo Sapiens
MEDTESQMM

SEQ ID NO: 560296 - protein, 9 aa, Homo Sapiens
TLNGKTCQD

SEQ ID NO: 560297 - protein, 9 aa, Homo Sapiens
GHFGLLLQL

SEQ ID NO: 560298 - protein, 9 aa, Homo Sapiens
LRAGLLAKK

SEQ ID NO: 560299 - protein, 9 aa, Homo Sapiens
VLGKKTLFI

SEQ ID NO: 560300 - protein, 9 aa, Homo Sapiens
WTREILKDV

SEQ ID NO: 560301 - protein, 9 aa, Homo Sapiens
CPPGYQLTL

SEQ ID NO: 560302 - protein, 9 aa, Homo Sapiens
CLEHQQHWK

SEQ ID NO: 560303 - protein, 9 aa, Homo Sapiens
MEQEQIGRL

SEQ ID NO: 560304 - protein, 9 aa, Homo Sapiens
FSYIALSTA

SEQ ID NO: 560305 - protein, 9 aa, Homo Sapiens
EHQQHWKHL

SEQ ID NO: 560306 - protein, 9 aa, Homo Sapiens
VKMVILIEP

SEQ ID NO: 560307 - protein, 9 aa, Homo Sapiens
YQLTLNGKT

SEQ ID NO: 560308 - protein, 9 aa, Homo Sapiens
GSPGAEGLP

SEQ ID NO: 560309 - protein, 9 aa, Homo Sapiens
KLETEMEQK

SEQ ID NO: 560310 - protein, 9 aa, Homo Sapiens
HRALEKDTE

SEQ ID NO: 560311 - protein, 9 aa, Homo Sapiens
FCSDIHSNE

SEQ ID NO: 560312 - protein, 9 aa, Homo Sapiens
KKEETEARC

SEQ ID NO: 560313 - protein, 9 aa, Homo Sapiens
TFPNSFGFN

SEQ ID NO: 560314 - protein, 9 aa, Homo Sapiens
DVAKLETEM

SEQ ID NO: 560315 - protein, 9 aa, Homo Sapiens
MWAGPHHWR

SEQ ID NO: 560316 - protein, 9 aa, Homo Sapiens
GKIVPLPGS

SEQ ID NO: 560317 - protein, 9 aa, Homo Sapiens
PPGYQLTLN

SEQ ID NO: 560318 - protein, 9 aa, Homo Sapiens
GHVASQVST

SEQ ID NO: 560319 - protein, 9 aa, Homo Sapiens
DCPVFYKVD

SEQ ID NO: 560320 - protein, 9 aa, Homo Sapiens
SVKDILHLP

SEQ ID NO: 560321 - protein, 9 aa, Homo Sapiens
LCAGDTGSG

SEQ ID NO: 560322 - protein, 9 aa, Homo Sapiens
STSPSTART

SEQ ID NO: 560323 - protein, 9 aa, Homo Sapiens
WSRRCAQIT

SEQ ID NO: 560324 - protein, 9 aa, Homo Sapiens
PTVTAYSEI

SEQ ID NO: 560325 - protein, 9 aa, Homo Sapiens
PEAPEAASP

SEQ ID NO: 560326 - protein, 9 aa, Homo Sapiens
SVDSITDHD

SEQ ID NO: 560327 - protein, 9 aa, Homo Sapiens
SPSKSSVST

SEQ ID NO: 560328 - protein, 9 aa, Homo Sapiens
AKTLELDKV

SEQ ID NO: 560329 - protein, 9 aa, Homo Sapiens
EILKDVSLY

SEQ ID NO: 560330 - protein, 9 aa, Homo Sapiens
GSGGHSQPV

SEQ ID NO: 560331 - protein, 9 aa, Homo Sapiens
ISLVVCPLY

SEQ ID NO: 560332 - protein, 9 aa, Homo Sapiens
SMMMEDTES

SEQ ID NO: 560333 - protein, 9 aa, Homo Sapiens
KRSPPMTLK

SEQ ID NO: 560334 - protein, 9 aa, Homo Sapiens
RCGVPDHLM

SEQ ID NO: 560335 - protein, 9 aa, Homo Sapiens
MMALIVCLG

SEQ ID NO: 560336 - protein, 9 aa, Homo Sapiens
QAEKCFHRA

SEQ ID NO: 560337 - protein, 9 aa, Homo Sapiens
SLYIYVLLI

SEQ ID NO: 560338 - protein, 9 aa, Homo Sapiens
NQKMIVKSM

SEQ ID NO: 560339 - protein, 9 aa, Homo Sapiens
PAEAPEAPE

SEQ ID NO: 560340 - protein, 9 aa, Homo Sapiens
EGRNAPEQV

SEQ ID NO: 560341 - protein, 9 aa, Homo Sapiens
FLWTWLMTR

SEQ ID NO: 560342 - protein, 9 aa, Homo Sapiens
VLKNTPIHV

SEQ ID NO: 560343 - protein, 9 aa, Homo Sapiens
STQQAQKLG

SEQ ID NO: 560344 - protein, 9 aa, Homo Sapiens
VDSITDHDD

SEQ ID NO: 560345 - protein, 9 aa, Homo Sapiens
QFTPVRIEG

SEQ ID NO: 560346 - protein, 9 aa, Homo Sapiens
DEDNFSYIA

SEQ ID NO: 560347 - protein, 9 aa, Homo Sapiens
RNAPEQVKM

SEQ ID NO: 560348 - protein, 9 aa, Homo Sapiens
LNGKTCQDI

SEQ ID NO: 560349 - protein, 9 aa, Homo Sapiens
HSVCQDVNE

SEQ ID NO: 560350 - protein, 9 aa, Homo Sapiens
EHLILSDVQ

SEQ ID NO: 560351 - protein, 9 aa, Homo Sapiens
TGEEPYQCS

SEQ ID NO: 560352 - protein, 9 aa, Homo Sapiens
LMAKVLLLV

SEQ ID NO: 560353 - protein, 9 aa, Homo Sapiens
EAPEAPEAA

SEQ ID NO: 560354 - protein, 9 aa, Homo Sapiens
ECATGRASF

SEQ ID NO: 560355 - protein, 9 aa, Homo Sapiens
SYKIRNLST

SEQ ID NO: 560356 - protein, 9 aa, Homo Sapiens
ANGFKVLLI

SEQ ID NO: 560357 - protein, 9 aa, Homo Sapiens
MKSKDNQIK

SEQ ID NO: 560358 - protein, 9 aa, Homo Sapiens
PEQVKMLQR

SEQ ID NO: 560359 - protein, 9 aa, Homo Sapiens
VTAYSEIIV

SEQ ID NO: 560360 - protein, 9 aa, Homo Sapiens
LEREQKKLY

SEQ ID NO: 560361 - protein, 9 aa, Homo Sapiens
SDDGNLGSL

SEQ ID NO: 560362 - protein, 9 aa, Homo Sapiens
THTGEEPYQ

SEQ ID NO: 560363 - protein, 9 aa, Homo Sapiens
AHMKSKDNQ

SEQ ID NO: 560364 - protein, 9 aa, Homo Sapiens
TESIVVQAE

SEQ ID NO: 560365 - protein, 9 aa, Homo Sapiens
RTIGWSRRC

SEQ ID NO: 560366 - protein, 9 aa, Homo Sapiens
RHKMFHTGE

SEQ ID NO: 560367 - protein, 9 aa, Homo Sapiens
WGTQEYAGH

SEQ ID NO: 560368 - protein, 9 aa, Homo Sapiens
PPMTLKQIL

SEQ ID NO: 560369 - protein, 9 aa, Homo Sapiens
SNSESINQS

SEQ ID NO: 560370 - protein, 9 aa, Homo Sapiens
PNSFGFNIQ

SEQ ID NO: 560371 - protein, 9 aa, Homo Sapiens
AEHLILSDV

SEQ ID NO: 560372 - protein, 9 aa, Homo Sapiens
PPKCVSLVG

SEQ ID NO: 560373 - protein, 9 aa, Homo Sapiens
GAAPSPSKS

SEQ ID NO: 560374 - protein, 9 aa, Homo Sapiens
TQQHYIYDI

SEQ ID NO: 560375 - protein, 9 aa, Homo Sapiens
MNISYKIRN

SEQ ID NO: 560376 - protein, 9 aa, Homo Sapiens
PLTQDVTVV

SEQ ID NO: 560377 - protein, 9 aa, Homo Sapiens
TSPSTARTI

SEQ ID NO: 560378 - protein, 9 aa, Homo Sapiens
DTLRAQPPG

SEQ ID NO: 560379 - protein, 9 aa, Homo Sapiens
AQITTTIVI

SEQ ID NO: 560380 - protein, 9 aa, Homo Sapiens
ECPISKKKS

SEQ ID NO: 560381 - protein, 9 aa, Homo Sapiens
LISLVVCPL

SEQ ID NO: 560382 - protein, 9 aa, Homo Sapiens
LINVLMAKV

SEQ ID NO: 560383 - protein, 9 aa, Homo Sapiens
SLSTQQAQK

SEQ ID NO: 560384 - protein, 9 aa, Homo Sapiens
YDFWEYHLP

SEQ ID NO: 560385 - protein, 9 aa, Homo Sapiens
TRQQKIHIE

SEQ ID NO: 560386 - protein, 9 aa, Homo Sapiens
IIVAAPNCT

SEQ ID NO: 560387 - protein, 9 aa, Homo Sapiens
GQMSTWQQS

SEQ ID NO: 560388 - protein, 9 aa, Homo Sapiens
TEDVAKLET

SEQ ID NO: 560389 - protein, 9 aa, Homo Sapiens
NHYFCDLFL

SEQ ID NO: 560390 - protein, 9 aa, Homo Sapiens
WINNCVGHY

SEQ ID NO: 560391 - protein, 9 aa, Homo Sapiens
ADTWRHGEN

SEQ ID NO: 560392 - protein, 9 aa, Homo Sapiens
QLTLNGKTC

SEQ ID NO: 560393 - protein, 9 aa, Homo Sapiens
KSKDNQIKL

SEQ ID NO: 560394 - protein, 9 aa, Homo Sapiens
GYQLTLNGK

SEQ ID NO: 560395 - protein, 9 aa, Homo Sapiens
PYEDILWYP

SEQ ID NO: 560396 - protein, 9 aa, Homo Sapiens
SEADTWRHG

SEQ ID NO: 560397 - protein, 9 aa, Homo Sapiens
RRCAQITTT

SEQ ID NO: 560398 - protein, 9 aa, Homo Sapiens
IITQQHYIY

SEQ ID NO: 560399 - protein, 9 aa, Homo Sapiens
FFSSLQPLL

SEQ ID NO: 560400 - protein, 9 aa, Homo Sapiens
GNSTFPNSF

SEQ ID NO: 560401 - protein, 9 aa, Homo Sapiens
HYQKREYQC

SEQ ID NO: 560402 - protein, 9 aa, Homo Sapiens
DHDDNQSRL

SEQ ID NO: 560403 - protein, 9 aa, Homo Sapiens
ATGQWRLFH

SEQ ID NO: 560404 - protein, 9 aa, Homo Sapiens
KVFRVENSF

SEQ ID NO: 560405 - protein, 9 aa, Homo Sapiens
AGHSVCQDV

SEQ ID NO: 560406 - protein, 9 aa, Homo Sapiens
MSTWQQSGP

SEQ ID NO: 560407 - protein, 9 aa, Homo Sapiens
ETEMEQKHR

SEQ ID NO: 560408 - protein, 9 aa, Homo Sapiens
KDILHLPDT

SEQ ID NO: 560409 - protein, 9 aa, Homo Sapiens
TQEYAGHTV

SEQ ID NO: 560410 - protein, 9 aa, Homo Sapiens
KSEAAPYRP

SEQ ID NO: 560411 - protein, 9 aa, Homo Sapiens
SLLQQGFLK

SEQ ID NO: 560412 - protein, 9 aa, Homo Sapiens
KICSRDTLR

SEQ ID NO: 560413 - protein, 9 aa, Homo Sapiens
PQAEGPPKC

SEQ ID NO: 560414 - protein, 9 aa, Homo Sapiens
RASGHVASQ

SEQ ID NO: 560415 - protein, 9 aa, Homo Sapiens
EEAWRAHLM

SEQ ID NO: 560416 - protein, 9 aa, Homo Sapiens
AVVLGLQQA

SEQ ID NO: 560417 - protein, 9 aa, Homo Sapiens
SLQPLLAEA

SEQ ID NO: 560418 - protein, 9 aa, Homo Sapiens
NSFDFMENI

SEQ ID NO: 560419 - protein, 9 aa, Homo Sapiens
YSEIIVAAP

SEQ ID NO: 560420 - protein, 9 aa, Homo Sapiens
RDTLRAQPP

SEQ ID NO: 560421 - protein, 9 aa, Homo Sapiens
TLFILNLNE

SEQ ID NO: 560422 - protein, 9 aa, Homo Sapiens
VVQWKSEAA

SEQ ID NO: 560423 - protein, 9 aa, Homo Sapiens
RSPLSDNSG

SEQ ID NO: 560424 - protein, 9 aa, Homo Sapiens
NMLCAGDTG

SEQ ID NO: 560425 - protein, 9 aa, Homo Sapiens
HFGLLLQLS

SEQ ID NO: 560426 - protein, 9 aa, Homo Sapiens
SYIALSTAN

SEQ ID NO: 560427 - protein, 9 aa, Homo Sapiens
LLSAQGVHI

SEQ ID NO: 560428 - protein, 9 aa, Homo Sapiens
DVTVVEGGT

SEQ ID NO: 560429 - protein, 9 aa, Homo Sapiens
ILNLNEPDN

SEQ ID NO: 560430 - protein, 9 aa, Homo Sapiens
SEAAPYRPL

SEQ ID NO: 560431 - protein, 9 aa, Homo Sapiens
KNHYQKREY

SEQ ID NO: 560432 - protein, 9 aa, Homo Sapiens
YIYDISAKT

SEQ ID NO: 560433 - protein, 9 aa, Homo Sapiens
RAHLMGPAG

SEQ ID NO: 560434 - protein, 9 aa, Homo Sapiens
QQSLHPLLS

SEQ ID NO: 560435 - protein, 9 aa, Homo Sapiens
IGWSRRCAQ

SEQ ID NO: 560436 - protein, 9 aa, Homo Sapiens
QITTTIVIP

SEQ ID NO: 560437 - protein, 9 aa, Homo Sapiens
NSTFPNSFG

SEQ ID NO: 560438 - protein, 9 aa, Homo Sapiens
SKNHYQKRE

SEQ ID NO: 560439 - protein, 9 aa, Homo Sapiens
RLPSRSPHG

SEQ ID NO: 560440 - protein, 9 aa, Homo Sapiens
MEEMEQEQI

SEQ ID NO: 560441 - protein, 9 aa, Homo Sapiens
LSAEHLILS

SEQ ID NO: 560442 - protein, 9 aa, Homo Sapiens
EQKKLYQSA

SEQ ID NO: 560443 - protein, 9 aa, Homo Sapiens
SSLQPLLAE

SEQ ID NO: 560444 - protein, 9 aa, Homo Sapiens
PFQGKPRPV

SEQ ID NO: 560445 - protein, 9 aa, Homo Sapiens
QMSTWQQSG

SEQ ID NO: 560446 - protein, 9 aa, Homo Sapiens
QPPGAAPSP

SEQ ID NO: 560447 - protein, 9 aa, Homo Sapiens
TGQWRLFHE

SEQ ID NO: 560448 - protein, 9 aa, Homo Sapiens
KDNQIKLMN

SEQ ID NO: 560449 - protein, 9 aa, Homo Sapiens
CATGRASFP

SEQ ID NO: 560450 - protein, 9 aa, Homo Sapiens
QQWTREILK

SEQ ID NO: 560451 - protein, 9 aa, Homo Sapiens
LLQQGFLKN

SEQ ID NO: 560452 - protein, 9 aa, Homo Sapiens
ILNRHKMFH

SEQ ID NO: 560453 - protein, 9 aa, Homo Sapiens
AKVLLLVPP

SEQ ID NO: 560454 - protein, 9 aa, Homo Sapiens
ALSTANLPN

SEQ ID NO: 560455 - protein, 9 aa, Homo Sapiens
MMEDTESQM

SEQ ID NO: 560456 - protein, 9 aa, Homo Sapiens
PNDCPVFYK

SEQ ID NO: 560457 - protein, 9 aa, Homo Sapiens
AAGHSVCQD

SEQ ID NO: 560458 - protein, 9 aa, Homo Sapiens
EMEQEQIGR

SEQ ID NO: 560459 - protein, 9 aa, Homo Sapiens
MSVDSITDH

SEQ ID NO: 560460 - protein, 9 aa, Homo Sapiens
QFLPYISYL

SEQ ID NO: 560461 - protein, 9 aa, Homo Sapiens
LGSLYIYVL

SEQ ID NO: 560462 - protein, 9 aa, Homo Sapiens
ICSRDTLRA

SEQ ID NO: 560463 - protein, 9 aa, Homo Sapiens
KEKRSPPMT

SEQ ID NO: 560464 - protein, 9 aa, Homo Sapiens
TEMEQKHRE

SEQ ID NO: 560465 - protein, 9 aa, Homo Sapiens
WYPSTPPPT

SEQ ID NO: 560466 - protein, 9 aa, Homo Sapiens
DLFLLLGLS

SEQ ID NO: 560467 - protein, 9 aa, Homo Sapiens
SPLSDNSGC

SEQ ID NO: 560468 - protein, 9 aa, Homo Sapiens
KEETEARCL

SEQ ID NO: 560469 - protein, 9 aa, Homo Sapiens
AGPHHWRFR

SEQ ID NO: 560470 - protein, 9 aa, Homo Sapiens
KVLLLVPPL

SEQ ID NO: 560471 - protein, 9 aa, Homo Sapiens
CDLFLLLGL

SEQ ID NO: 560472 - protein, 9 aa, Homo Sapiens
SDTKVTFPA

SEQ ID NO: 560473 - protein, 9 aa, Homo Sapiens
PLINVLMAK

SEQ ID NO: 560474 - protein, 9 aa, Homo Sapiens
FLLLGLSCS

SEQ ID NO: 560475 - protein, 9 aa, Homo Sapiens
FSPGEEAWR

SEQ ID NO: 560476 - protein, 9 aa, Homo Sapiens
KPAEAPEAP

SEQ ID NO: 560477 - protein, 9 aa, Homo Sapiens
SPGAEGLPG

SEQ ID NO: 560478 - protein, 9 aa, Homo Sapiens
TREILKDVS

SEQ ID NO: 560479 - protein, 9 aa, Homo Sapiens
QSGPSHSSL

SEQ ID NO: 560480 - protein, 9 aa, Homo Sapiens
VTFPAYFTD

SEQ ID NO: 560481 - protein, 9 aa, Homo Sapiens
PMTLKQILV

SEQ ID NO: 560482 - protein, 9 aa, Homo Sapiens
PGSPGAEGL

SEQ ID NO: 560483 - protein, 9 aa, Homo Sapiens
EEMEQEQIG

SEQ ID NO: 560484 - protein, 9 aa, Homo Sapiens
PSKSSVSTS

SEQ ID NO: 560485 - protein, 9 aa, Homo Sapiens
DILWYPSTP

SEQ ID NO: 560486 - protein, 9 aa, Homo Sapiens
SITDHDDNQ

SEQ ID NO: 560487 - protein, 9 aa, Homo Sapiens
LLAEAVDSI

SEQ ID NO: 560488 - protein, 9 aa, Homo Sapiens
VPLPGSPGA

SEQ ID NO: 560489 - protein, 9 aa, Homo Sapiens
IVIPPTTHL

SEQ ID NO: 560490 - protein, 9 aa, Homo Sapiens
PLLSAQGVH

SEQ ID NO: 560491 - protein, 9 aa, Homo Sapiens
FANLTRQQK

SEQ ID NO: 560492 - protein, 9 aa, Homo Sapiens
YLQAEKCFH

SEQ ID NO: 560493 - protein, 9 aa, Homo Sapiens
LLLGLSCSS

SEQ ID NO: 560494 - protein, 9 aa, Homo Sapiens
VSTSPSTAR

SEQ ID NO: 560495 - protein, 9 aa, Homo Sapiens
LELDKVTQF

SEQ ID NO: 560496 - protein, 9 aa, Homo Sapiens
MSMWAGPHH

SEQ ID NO: 560497 - protein, 9 aa, Homo Sapiens
AAPYRPLER

SEQ ID NO: 560498 - protein, 9 aa, Homo Sapiens
PGAAPSPSK

SEQ ID NO: 560499 - protein, 9 aa, Homo Sapiens
IPRGNYIEC

SEQ ID NO: 560500 - protein, 9 aa, Homo Sapiens
ILIEPEGAP

SEQ ID NO: 560501 - protein, 9 aa, Homo Sapiens
APGISLSTQ

SEQ ID NO: 560502 - protein, 9 aa, Homo Sapiens
NAPEQVKML

SEQ ID NO: 560503 - protein, 9 aa, Homo Sapiens
DQFTPVRIE

SEQ ID NO: 560504 - protein, 9 aa, Homo Sapiens
KNTPIHVVK

SEQ ID NO: 560505 - protein, 9 aa, Homo Sapiens
TSNPSVMLR

SEQ ID NO: 560506 - protein, 9 aa, Homo Sapiens
QGKPRPVLT

SEQ ID NO: 560507 - protein, 9 aa, Homo Sapiens
LHPLLSAQG

SEQ ID NO: 560508 - protein, 9 aa, Homo Sapiens
GWGTQEYAG

SEQ ID NO: 560509 - protein, 9 aa, Homo Sapiens
LGKKTLFIL

SEQ ID NO: 560510 - protein, 9 aa, Homo Sapiens
FGLLLQLSQ

SEQ ID NO: 560511 - protein, 9 aa, Homo Sapiens
LSAQGVHIF

SEQ ID NO: 560512 - protein, 9 aa, Homo Sapiens
RHFLWTWLM

SEQ ID NO: 560513 - protein, 9 aa, Homo Sapiens
TWQQSGPSH

SEQ ID NO: 560514 - protein, 9 aa, Homo Sapiens
EYHLPYLYS

SEQ ID NO: 560515 - protein, 9 aa, Homo Sapiens
LFILNLNEP

SEQ ID NO: 560516 - protein, 9 aa, Homo Sapiens
TKRSLLQQG

SEQ ID NO: 560517 - protein, 9 aa, Homo Sapiens
ITTTIVIPP

SEQ ID NO: 560518 - protein, 9 aa, Homo Sapiens
FLPYISYLV

SEQ ID NO: 560519 - protein, 9 aa, Homo Sapiens
LETEMEQKH

SEQ ID NO: 560520 - protein, 9 aa, Homo Sapiens
EYQCIKCMV

SEQ ID NO: 560521 - protein, 9 aa, Homo Sapiens
ASFPRFRQC

SEQ ID NO: 560522 - protein, 9 aa, Homo Sapiens
PPRCGVPDH

SEQ ID NO: 560523 - protein, 9 aa, Homo Sapiens
GQWRLFHEL

SEQ ID NO: 560524 - protein, 9 aa, Homo Sapiens
KMEEMEQEQ

SEQ ID NO: 560525 - protein, 9 aa, Homo Sapiens
QKMIVKSMM

SEQ ID NO: 560526 - protein, 9 aa, Homo Sapiens
CFHRALEKD

SEQ ID NO: 560527 - protein, 9 aa, Homo Sapiens
CRQQWTREI

SEQ ID NO: 560528 - protein, 9 aa, Homo Sapiens
RRLPSRSPH

SEQ ID NO: 560529 - protein, 9 aa, Homo Sapiens
YQKREYQCI

SEQ ID NO: 560530 - protein, 9 aa, Homo Sapiens
STARTIGWS

SEQ ID NO: 560531 - protein, 9 aa, Homo Sapiens
RAQPPGAAP

SEQ ID NO: 560532 - protein, 9 aa, Homo Sapiens
WLMTRSQEE

SEQ ID NO: 560533 - protein, 9 aa, Homo Sapiens
LQAEKCFHR

SEQ ID NO: 560534 - protein, 9 aa, Homo Sapiens
SSVSTSPST

SEQ ID NO: 560535 - protein, 9 aa, Homo Sapiens
CKEKRSPPM

SEQ ID NO: 560536 - protein, 9 aa, Homo Sapiens
QQSGPSHSS

SEQ ID NO: 560537 - protein, 9 aa, Homo Sapiens
CLGFLVLKK

SEQ ID NO: 560538 - protein, 9 aa, Homo Sapiens
IEGRNAPEQ

SEQ ID NO: 560539 - protein, 9 aa, Homo Sapiens
HTGEEPYQC

SEQ ID NO: 560540 - protein, 9 aa, Homo Sapiens
IHIEGRNAP

SEQ ID NO: 560541 - protein, 9 aa, Homo Sapiens
CLDLSAEHL

SEQ ID NO: 560542 - protein, 9 aa, Homo Sapiens
ENSFDFMEN

SEQ ID NO: 560543 - protein, 9 aa, Homo Sapiens
TQFANLTRQ

SEQ ID NO: 560544 - protein, 9 aa, Homo Sapiens
KECKEKRSP

SEQ ID NO: 560545 - protein, 9 aa, Homo Sapiens
NLGSLYIYV

SEQ ID NO: 560546 - protein, 9 aa, Homo Sapiens
ELANGFKVL

SEQ ID NO: 560547 - protein, 9 aa, Homo Sapiens
DTGSGGHSQ

SEQ ID NO: 560548 - protein, 9 aa, Homo Sapiens
YPSTPPPTP

SEQ ID NO: 560549 - protein, 9 aa, Homo Sapiens
VLSTPKRKL

SEQ ID NO: 560550 - protein, 9 aa, Homo Sapiens
RWDGSWHYV

SEQ ID NO: 560551 - protein, 9 aa, Homo Sapiens
DEYKNDYCE

SEQ ID NO: 560552 - protein, 9 aa, Homo Sapiens
VATSFFLFS

SEQ ID NO: 560553 - protein, 9 aa, Homo Sapiens
LMVHKRSQT

SEQ ID NO: 560554 - protein, 9 aa, Homo Sapiens
YRSICWLDR

SEQ ID NO: 560555 - protein, 9 aa, Homo Sapiens
GTEAEFLKG

SEQ ID NO: 560556 - protein, 9 aa, Homo Sapiens
LIADKWPAV

SEQ ID NO: 560557 - protein, 9 aa, Homo Sapiens
PSSYGSDSE

SEQ ID NO: 560558 - protein, 9 aa, Homo Sapiens
CWLDRCIAA

SEQ ID NO: 560559 - protein, 9 aa, Homo Sapiens
DRRYVDEYK

SEQ ID NO: 560560 - protein, 9 aa, Homo Sapiens
AGTEAEFLK

SEQ ID NO: 560561 - protein, 9 aa, Homo Sapiens
QLPSNQYQF

SEQ ID NO: 560562 - protein, 9 aa, Homo Sapiens
KQFLAEEAV

SEQ ID NO: 560563 - protein, 9 aa, Homo Sapiens
EYKNDYCEG

SEQ ID NO: 560564 - protein, 9 aa, Homo Sapiens
DGSWHYVHL

SEQ ID NO: 560565 - protein, 9 aa, Homo Sapiens
YQFTRKNGT

SEQ ID NO: 560566 - protein, 9 aa, Homo Sapiens
YVHLRHPGC

SEQ ID NO: 560567 - protein, 9 aa, Homo Sapiens
GPPTASHTE

SEQ ID NO: 560568 - protein, 9 aa, Homo Sapiens
EARSQAKSP

SEQ ID NO: 560569 - protein, 9 aa, Homo Sapiens
EEAMYRSIC

SEQ ID NO: 560570 - protein, 9 aa, Homo Sapiens
YAFKALNQG

SEQ ID NO: 560571 - protein, 9 aa, Homo Sapiens
QTGERPFQC

SEQ ID NO: 560572 - protein, 9 aa, Homo Sapiens
TREYYMLQE

SEQ ID NO: 560573 - protein, 9 aa, Homo Sapiens
PGPLQPKRK

SEQ ID NO: 560574 - protein, 9 aa, Homo Sapiens
AFIFGYIQI

SEQ ID NO: 560575 - protein, 9 aa, Homo Sapiens
QLVTGEGNE

SEQ ID NO: 560576 - protein, 9 aa, Homo Sapiens
IEEARSQAK

SEQ ID NO: 560577 - protein, 9 aa, Homo Sapiens
GSSYSCGSG

SEQ ID NO: 560578 - protein, 9 aa, Homo Sapiens
TPPSSYGSD

SEQ ID NO: 560579 - protein, 9 aa, Homo Sapiens
PPSPGPLQP

SEQ ID NO: 560580 - protein, 9 aa, Homo Sapiens
PDSRPPLPE

SEQ ID NO: 560581 - protein, 9 aa, Homo Sapiens
RPPLPEPPS

SEQ ID NO: 560582 - protein, 9 aa, Homo Sapiens
FIFGYIQIS

SEQ ID NO: 560583 - protein, 9 aa, Homo Sapiens
RWHIATKQA

SEQ ID NO: 560584 - protein, 9 aa, Homo Sapiens
TPDSRPPLP

SEQ ID NO: 560585 - protein, 9 aa, Homo Sapiens
GENPYKCNQ

SEQ ID NO: 560586 - protein, 9 aa, Homo Sapiens
PSNEELNVK

SEQ ID NO: 560587 - protein, 9 aa, Homo Sapiens
SNQYQFTRK

SEQ ID NO: 560588 - protein, 9 aa, Homo Sapiens
WHYVHLRHP

SEQ ID NO: 560589 - protein, 9 aa, Homo Sapiens
YVDEYKNDY

SEQ ID NO: 560590 - protein, 9 aa, Homo Sapiens
AKFQLQKLL

SEQ ID NO: 560591 - protein, 9 aa, Homo Sapiens
GEGNELYHC

SEQ ID NO: 560592 - protein, 9 aa, Homo Sapiens
NELALRQVV

SEQ ID NO: 560593 - protein, 9 aa, Homo Sapiens
SAKFQLQKL

SEQ ID NO: 560594 - protein, 9 aa, Homo Sapiens
LVTGEGNEL

SEQ ID NO: 560595 - protein, 9 aa, Homo Sapiens
NVKKIEFEQ

SEQ ID NO: 560596 - protein, 9 aa, Homo Sapiens
EYAFKALNQ

SEQ ID NO: 560597 - protein, 9 aa, Homo Sapiens
NQLVTGEGN

SEQ ID NO: 560598 - protein, 9 aa, Homo Sapiens
GTPDSRPPL

SEQ ID NO: 560599 - protein, 9 aa, Homo Sapiens
ENPYKCNQC

SEQ ID NO: 560600 - protein, 9 aa, Homo Sapiens
AVPRKLDSV

SEQ ID NO: 560601 - protein, 9 aa, Homo Sapiens
SYGSDSEGS

SEQ ID NO: 560602 - protein, 9 aa, Homo Sapiens
ELALRQVVE

SEQ ID NO: 560603 - protein, 9 aa, Homo Sapiens
ICWLDRCIA

SEQ ID NO: 560604 - protein, 9 aa, Homo Sapiens
NPSNEELNV

SEQ ID NO: 560605 - protein, 9 aa, Homo Sapiens
SNEELNVKK

SEQ ID NO: 560606 - protein, 9 aa, Homo Sapiens
PPSSYGSDS

SEQ ID NO: 560607 - protein, 9 aa, Homo Sapiens
NRWHIATKQ

SEQ ID NO: 560608 - protein, 9 aa, Homo Sapiens
IIWNLHQRS

SEQ ID NO: 560609 - protein, 9 aa, Homo Sapiens
HTRAVWYVE

SEQ ID NO: 560610 - protein, 9 aa, Homo Sapiens
PTPPSSYGS

SEQ ID NO: 560611 - protein, 9 aa, Homo Sapiens
ADKWPAVPR

SEQ ID NO: 560612 - protein, 9 aa, Homo Sapiens
VPQLQWELI

SEQ ID NO: 560613 - protein, 9 aa, Homo Sapiens
AEFLKGNAE

SEQ ID NO: 560614 - protein, 9 aa, Homo Sapiens
SFKNQLVTG

SEQ ID NO: 560615 - protein, 9 aa, Homo Sapiens
SHHINRWHI

SEQ ID NO: 560616 - protein, 9 aa, Homo Sapiens
SVATSFFLF

SEQ ID NO: 560617 - protein, 9 aa, Homo Sapiens
EFLKGNAEA

SEQ ID NO: 560618 - protein, 9 aa, Homo Sapiens
KERNVSVAT

SEQ ID NO: 560619 - protein, 9 aa, Homo Sapiens
GCLSMLSGP

SEQ ID NO: 560620 - protein, 9 aa, Homo Sapiens
LNQGGLTSV

SEQ ID NO: 560621 - protein, 9 aa, Homo Sapiens
RKPQWPEQP

SEQ ID NO: 560622 - protein, 9 aa, Homo Sapiens
PPTASHTEP

SEQ ID NO: 560623 - protein, 9 aa, Homo Sapiens
WELIHLPHL

SEQ ID NO: 560624 - protein, 9 aa, Homo Sapiens
NGISPEIVE

SEQ ID NO: 560625 - protein, 9 aa, Homo Sapiens
EAEFLKGNA

SEQ ID NO: 560626 - protein, 9 aa, Homo Sapiens
LPPTPPSSY

SEQ ID NO: 560627 - protein, 9 aa, Homo Sapiens
HYVHLRHPG

SEQ ID NO: 560628 - protein, 9 aa, Homo Sapiens
LFIMEMQHE

SEQ ID NO: 560629 - protein, 9 aa, Homo Sapiens
AVIIWNLHQ

SEQ ID NO: 560630 - protein, 9 aa, Homo Sapiens
PPLPEPPSP

SEQ ID NO: 560631 - protein, 9 aa, Homo Sapiens
VHLRHPGCL

SEQ ID NO: 560632 - protein, 9 aa, Homo Sapiens
AEEAVIIWN

SEQ ID NO: 560633 - protein, 9 aa, Homo Sapiens
YKWPPDETR

SEQ ID NO: 560634 - protein, 9 aa, Homo Sapiens
SMLSGPPEL

SEQ ID NO: 560635 - protein, 9 aa, Homo Sapiens
DSRPPLPEP

SEQ ID NO: 560636 - protein, 9 aa, Homo Sapiens
IWNLHQRSA

SEQ ID NO: 560637 - protein, 9 aa, Homo Sapiens
PCPGPPTAS

SEQ ID NO: 560638 - protein, 9 aa, Homo Sapiens
KCSSAKAFN

SEQ ID NO: 560639 - protein, 9 aa, Homo Sapiens
AFVQKTSAF

SEQ ID NO: 560640 - protein, 9 aa, Homo Sapiens
SSAKAFNTE

SEQ ID NO: 560641 - protein, 9 aa, Homo Sapiens
SPGPLQPKR

SEQ ID NO: 560642 - protein, 9 aa, Homo Sapiens
MEMQHEFEE

SEQ ID NO: 560643 - protein, 9 aa, Homo Sapiens
HKRSQTGER

SEQ ID NO: 560644 - protein, 9 aa, Homo Sapiens
HLRHPGCLS

SEQ ID NO: 560645 - protein, 9 aa, Homo Sapiens
PPDETREYY

SEQ ID NO: 560646 - protein, 9 aa, Homo Sapiens
TASHTEPPS

SEQ ID NO: 560647 - protein, 9 aa, Homo Sapiens
LGGGSSYSC

SEQ ID NO: 560648 - protein, 9 aa, Homo Sapiens
KALNQGGLT

SEQ ID NO: 560649 - protein, 9 aa, Homo Sapiens
YSCGSGLGV

SEQ ID NO: 560650 - protein, 9 aa, Homo Sapiens
ALRQVVEAD

SEQ ID NO: 560651 - protein, 9 aa, Homo Sapiens
VGIGVAAFI

SEQ ID NO: 560652 - protein, 9 aa, Homo Sapiens
GSHHINRWH

SEQ ID NO: 560653 - protein, 9 aa, Homo Sapiens
SCGSGLGVG

SEQ ID NO: 560654 - protein, 9 aa, Homo Sapiens
DNSGSYQGL

SEQ ID NO: 560655 - protein, 9 aa, Homo Sapiens
EMQHEFEEA

SEQ ID NO: 560656 - protein, 9 aa, Homo Sapiens
GVAAFIFGY

SEQ ID NO: 560657 - protein, 9 aa, Homo Sapiens
RSAKFQLQK

SEQ ID NO: 560658 - protein, 9 aa, Homo Sapiens
KWPPDETRE

SEQ ID NO: 560659 - protein, 9 aa, Homo Sapiens
SSYSCGSGL

SEQ ID NO: 560660 - protein, 9 aa, Homo Sapiens
WPAVPRKLD

SEQ ID NO: 560661 - protein, 9 aa, Homo Sapiens
HRRIHTGEN

SEQ ID NO: 560662 - protein, 9 aa, Homo Sapiens
MVHKRSQTG

SEQ ID NO: 560663 - protein, 9 aa, Homo Sapiens
RSQAKSPAR

SEQ ID NO: 560664 - protein, 9 aa, Homo Sapiens
QFLAEEAVI

SEQ ID NO: 560665 - protein, 9 aa, Homo Sapiens
KLLVPQLQW

SEQ ID NO: 560666 - protein, 9 aa, Homo Sapiens
FKALNQGGL

SEQ ID NO: 560667 - protein, 9 aa, Homo Sapiens
AAFIFGYIQ

SEQ ID NO: 560668 - protein, 9 aa, Homo Sapiens
GAGTEAEFL

SEQ ID NO: 560669 - protein, 9 aa, Homo Sapiens
QYQFTRKNG

SEQ ID NO: 560670 - protein, 9 aa, Homo Sapiens
ETREYYMLQ

SEQ ID NO: 560671 - protein, 9 aa, Homo Sapiens
TRAVWYVEA

SEQ ID NO: 560672 - protein, 9 aa, Homo Sapiens
YKQFLAEEA

SEQ ID NO: 560673 - protein, 9 aa, Homo Sapiens
TLSFNGISP

SEQ ID NO: 560674 - protein, 9 aa, Homo Sapiens
SDNSGSYQG

SEQ ID NO: 560675 - protein, 9 aa, Homo Sapiens
NSDNSGSYQ

SEQ ID NO: 560676 - protein, 9 aa, Homo Sapiens
ENNSDNSGS

SEQ ID NO: 560677 - protein, 9 aa, Homo Sapiens
PEPPSPGPL

SEQ ID NO: 560678 - protein, 9 aa, Homo Sapiens
PAVPRKLDS

SEQ ID NO: 560679 - protein, 9 aa, Homo Sapiens
ELNVKKIEF

SEQ ID NO: 560680 - protein, 9 aa, Homo Sapiens
EEARSQAKS

SEQ ID NO: 560681 - protein, 9 aa, Homo Sapiens
VAAFIFGYI

SEQ ID NO: 560682 - protein, 9 aa, Homo Sapiens
VVEADINGL

SEQ ID NO: 560683 - protein, 9 aa, Homo Sapiens
AKAFNTEIS

SEQ ID NO: 560684 - protein, 9 aa, Homo Sapiens
PDETREYYM

SEQ ID NO: 560685 - protein, 9 aa, Homo Sapiens
GSYQGLEHR

SEQ ID NO: 560686 - protein, 9 aa, Homo Sapiens
SYSCGSGLG

SEQ ID NO: 560687 - protein, 9 aa, Homo Sapiens
TLFIMEMQH

SEQ ID NO: 560688 - protein, 9 aa, Homo Sapiens
SRPPLPEPP

SEQ ID NO: 560689 - protein, 9 aa, Homo Sapiens
PQSRSREHQ

SEQ ID NO: 560690 - protein, 9 aa, Homo Sapiens
TSAFLWLLL

SEQ ID NO: 560691 - protein, 9 aa, Homo Sapiens
FLWLLLLGT

SEQ ID NO: 560692 - protein, 9 aa, Homo Sapiens
VEYAFKALN

SEQ ID NO: 560693 - protein, 9 aa, Homo Sapiens
CGSGLGVGG

SEQ ID NO: 560694 - protein, 9 aa, Homo Sapiens
LQWELIHLP

SEQ ID NO: 560695 - protein, 9 aa, Homo Sapiens
KWPAVPRKL

SEQ ID NO: 560696 - protein, 9 aa, Homo Sapiens
NLHQRSAKF

SEQ ID NO: 560697 - protein, 9 aa, Homo Sapiens
LSMLSGPPE

SEQ ID NO: 560698 - protein, 9 aa, Homo Sapiens
NPYKCNQCE

SEQ ID NO: 560699 - protein, 9 aa, Homo Sapiens
SAFLWLLLL

SEQ ID NO: 560700 - protein, 9 aa, Homo Sapiens
PLQPKRKPQ

SEQ ID NO: 560701 - protein, 9 aa, Homo Sapiens
RSICWLDRC

SEQ ID NO: 560702 - protein, 9 aa, Homo Sapiens
FIMEMQHEF

SEQ ID NO: 560703 - protein, 9 aa, Homo Sapiens
GPLQPKRKP

SEQ ID NO: 560704 - protein, 9 aa, Homo Sapiens
GSWHYVHLR

SEQ ID NO: 560705 - protein, 9 aa, Homo Sapiens
HHINRWHIA

SEQ ID NO: 560706 - protein, 9 aa, Homo Sapiens
ENELALRQV

SEQ ID NO: 560707 - protein, 9 aa, Homo Sapiens
QLQKLLVPQ

SEQ ID NO: 560708 - protein, 9 aa, Homo Sapiens
NSGSYQGLE

SEQ ID NO: 560709 - protein, 9 aa, Homo Sapiens
AMYRSICWL

SEQ ID NO: 560710 - protein, 9 aa, Homo Sapiens
RQVVEADIN

SEQ ID NO: 560711 - protein, 9 aa, Homo Sapiens
WNLHQRSAK

SEQ ID NO: 560712 - protein, 9 aa, Homo Sapiens
VPRKLDSVF

SEQ ID NO: 560713 - protein, 9 aa, Homo Sapiens
EPPSPGPLQ

SEQ ID NO: 560714 - protein, 9 aa, Homo Sapiens
IADKWPAVP

SEQ ID NO: 560715 - protein, 9 aa, Homo Sapiens
FKNQLVTGE

SEQ ID NO: 560716 - protein, 9 aa, Homo Sapiens
YGSDSEGSL

SEQ ID NO: 560717 - protein, 9 aa, Homo Sapiens
PLPEPPSPG

SEQ ID NO: 560718 - protein, 9 aa, Homo Sapiens
VQKTSAFLW

SEQ ID NO: 560719 - protein, 9 aa, Homo Sapiens
WPEQPQSRS

SEQ ID NO: 560720 - protein, 9 aa, Homo Sapiens
WYVEADWDT

SEQ ID NO: 560721 - protein, 9 aa, Homo Sapiens
AFNTEISSS

SEQ ID NO: 560722 - protein, 9 aa, Homo Sapiens
SHTEPPSEP

SEQ ID NO: 560723 - protein, 9 aa, Homo Sapiens
VDEYKNDYC

SEQ ID NO: 560724 - protein, 9 aa, Homo Sapiens
YKNDYCEGY

SEQ ID NO: 560725 - protein, 9 aa, Homo Sapiens
SRWDGSWHY

SEQ ID NO: 560726 - protein, 9 aa, Homo Sapiens
ASHTEPPSE

SEQ ID NO: 560727 - protein, 9 aa, Homo Sapiens
VSVATSFFL

SEQ ID NO: 560728 - protein, 9 aa, Homo Sapiens
MYRSICWLD

SEQ ID NO: 560729 - protein, 9 aa, Homo Sapiens
QKTSAFLWL

SEQ ID NO: 560730 - protein, 9 aa, Homo Sapiens
LQPKRKPQW

SEQ ID NO: 560731 - protein, 9 aa, Homo Sapiens
KTSAFLWLL

SEQ ID NO: 560732 - protein, 9 aa, Homo Sapiens
QRSAKFQLQ

SEQ ID NO: 560733 - protein, 9 aa, Homo Sapiens
SAKAFNTEI

SEQ ID NO: 560734 - protein, 9 aa, Homo Sapiens
KAFNTEISS

SEQ ID NO: 560735 - protein, 9 aa, Homo Sapiens
QKLLVPQLQ

SEQ ID NO: 560736 - protein, 9 aa, Homo Sapiens
CLSMLSGPP

SEQ ID NO: 560737 - protein, 9 aa, Homo Sapiens
LHQRSAKFQ

SEQ ID NO: 560738 - protein, 9 aa, Homo Sapiens
HQRSAKFQL

SEQ ID NO: 560739 - protein, 9 aa, Homo Sapiens
AFKALNQGG

SEQ ID NO: 560740 - protein, 9 aa, Homo Sapiens
SICWLDRCI

SEQ ID NO: 560741 - protein, 9 aa, Homo Sapiens
RYVDEYKND

SEQ ID NO: 560742 - protein, 9 aa, Homo Sapiens
LPSNQYQFT

SEQ ID NO: 560743 - protein, 9 aa, Homo Sapiens
AVWYVEADW

SEQ ID NO: 560744 - protein, 9 aa, Homo Sapiens
QTLSFNGIS

SEQ ID NO: 560745 - protein, 9 aa, Homo Sapiens
GISPEIVEK

SEQ ID NO: 560746 - protein, 9 aa, Homo Sapiens
DTLFIMEMQ

SEQ ID NO: 560747 - protein, 9 aa, Homo Sapiens
QWPEQPQSR

SEQ ID NO: 560748 - protein, 9 aa, Homo Sapiens
VTGEGNELY

SEQ ID NO: 560749 - protein, 9 aa, Homo Sapiens
PPTPPSSYG

SEQ ID NO: 560750 - protein, 9 aa, Homo Sapiens
LNVKKIEFE

SEQ ID NO: 560751 - protein, 9 aa, Homo Sapiens
KNDYCEGYV

SEQ ID NO: 560752 - protein, 9 aa, Homo Sapiens
RRIHTGENP

SEQ ID NO: 560753 - protein, 9 aa, Homo Sapiens
PSNQYQFTR

SEQ ID NO: 560754 - protein, 9 aa, Homo Sapiens
QPQSRSREH

SEQ ID NO: 560755 - protein, 9 aa, Homo Sapiens
NQTLSFNGI

SEQ ID NO: 560756 - protein, 9 aa, Homo Sapiens
QVEYAFKAL

SEQ ID NO: 560757 - protein, 9 aa, Homo Sapiens
PQWPEQPQS

SEQ ID NO: 560758 - protein, 9 aa, Homo Sapiens
EQPQSRSRE

SEQ ID NO: 560759 - protein, 9 aa, Homo Sapiens
FVQKTSAFL

SEQ ID NO: 560760 - protein, 9 aa, Homo Sapiens
NQYQFTRKN

SEQ ID NO: 560761 - protein, 9 aa, Homo Sapiens
LRQVVEADI

SEQ ID NO: 560762 - protein, 9 aa, Homo Sapiens
VKKIEFEQF

SEQ ID NO: 560763 - protein, 9 aa, Homo Sapiens
ARSQAKSPA

SEQ ID NO: 560764 - protein, 9 aa, Homo Sapiens
KRSQTGERP

SEQ ID NO: 560765 - protein, 9 aa, Homo Sapiens
QHEFEEAKS

SEQ ID NO: 560766 - protein, 9 aa, Homo Sapiens
RSQTGERPF

SEQ ID NO: 560767 - protein, 9 aa, Homo Sapiens
PSPGPLQPK

SEQ ID NO: 560768 - protein, 9 aa, Homo Sapiens
FQLQKLLVP

SEQ ID NO: 560769 - protein, 9 aa, Homo Sapiens
MQHEFEEAK

SEQ ID NO: 560770 - protein, 9 aa, Homo Sapiens
PEQPQSRSR

SEQ ID NO: 560771 - protein, 9 aa, Homo Sapiens
WPPDETREY

SEQ ID NO: 560772 - protein, 9 aa, Homo Sapiens
PTASHTEPP

SEQ ID NO: 560773 - protein, 9 aa, Homo Sapiens
TEAEFLKGN

SEQ ID NO: 560774 - protein, 9 aa, Homo Sapiens
QPKRKPQWP

SEQ ID NO: 560775 - protein, 9 aa, Homo Sapiens
LVPQLQWEL

SEQ ID NO: 560776 - protein, 9 aa, Homo Sapiens
ATSFFLFSR

SEQ ID NO: 560777 - protein, 9 aa, Homo Sapiens
FLAEEAVII

SEQ ID NO: 560778 - protein, 9 aa, Homo Sapiens
WDGSWHYVH

SEQ ID NO: 560779 - protein, 9 aa, Homo Sapiens
KPQWPEQPQ

SEQ ID NO: 560780 - protein, 9 aa, Homo Sapiens
YVEADWDTK

SEQ ID NO: 560781 - protein, 9 aa, Homo Sapiens
VIIWNLHQR

SEQ ID NO: 560782 - protein, 9 aa, Homo Sapiens
QLQWELIHL

SEQ ID NO: 560783 - protein, 9 aa, Homo Sapiens
EADWDTKHV

SEQ ID NO: 560784 - protein, 9 aa, Homo Sapiens
DKWPAVPRK

SEQ ID NO: 560785 - protein, 9 aa, Homo Sapiens
AGAGTEAEF

SEQ ID NO: 560786 - protein, 9 aa, Homo Sapiens
KFQLQKLLV

SEQ ID NO: 560787 - protein, 9 aa, Homo Sapiens
LSFNGISPE

SEQ ID NO: 560788 - protein, 9 aa, Homo Sapiens
QFTRKNGTN

SEQ ID NO: 560789 - protein, 9 aa, Homo Sapiens
FNTEISSSD

SEQ ID NO: 560790 - protein, 9 aa, Homo Sapiens
RHPGCLSML

SEQ ID NO: 560791 - protein, 9 aa, Homo Sapiens
ERNVSVATS

SEQ ID NO: 560792 - protein, 9 aa, Homo Sapiens
SQTGERPFQ

SEQ ID NO: 560793 - protein, 9 aa, Homo Sapiens
KRKPQWPEQ

SEQ ID NO: 560794 - protein, 9 aa, Homo Sapiens
VHKRSQTGE

SEQ ID NO: 560795 - protein, 9 aa, Homo Sapiens
SFNGISPEI

SEQ ID NO: 560796 - protein, 9 aa, Homo Sapiens
LRHPGCLSM

SEQ ID NO: 560797 - protein, 9 aa, Homo Sapiens
PGPPTASHT

SEQ ID NO: 560798 - protein, 9 aa, Homo Sapiens
PQLQWELIH

SEQ ID NO: 560799 - protein, 9 aa, Homo Sapiens
PGCLSMLSG

SEQ ID NO: 560800 - protein, 9 aa, Homo Sapiens
HINRWHIAT

SEQ ID NO: 560801 - protein, 9 aa, Homo Sapiens
GGSSYSCGS

SEQ ID NO: 560802 - protein, 9 aa, Homo Sapiens
ISPEIVEKD

SEQ ID NO: 560803 - protein, 9 aa, Homo Sapiens
FNGISPEIV

SEQ ID NO: 560804 - protein, 9 aa, Homo Sapiens
SSYGSDSEG

SEQ ID NO: 560805 - protein, 9 aa, Homo Sapiens
HPGCLSMLS

SEQ ID NO: 560806 - protein, 9 aa, Homo Sapiens
QWELIHLPH

SEQ ID NO: 560807 - protein, 9 aa, Homo Sapiens
NTEISSSDN

SEQ ID NO: 560808 - protein, 9 aa, Homo Sapiens
LLVPQLQWE

SEQ ID NO: 560809 - protein, 9 aa, Homo Sapiens
DETREYYML

SEQ ID NO: 560810 - protein, 9 aa, Homo Sapiens
HIATKQANG

SEQ ID NO: 560811 - protein, 9 aa, Homo Sapiens
TGEGNELYH

SEQ ID NO: 560812 - protein, 9 aa, Homo Sapiens
GGGSSYSCG

SEQ ID NO: 560813 - protein, 9 aa, Homo Sapiens
TSFFLFSRA

SEQ ID NO: 560814 - protein, 9 aa, Homo Sapiens
EEAVIIWNL

SEQ ID NO: 560815 - protein, 9 aa, Homo Sapiens
EAVIIWNLH

SEQ ID NO: 560816 - protein, 9 aa, Homo Sapiens
NVSVATSFF

SEQ ID NO: 560817 - protein, 9 aa, Homo Sapiens
KNQLVTGEG

SEQ ID NO: 560818 - protein, 9 aa, Homo Sapiens
RNVSVATSF

SEQ ID NO: 560819 - protein, 9 aa, Homo Sapiens
PKRKPQWPE

SEQ ID NO: 560820 - protein, 9 aa, Homo Sapiens
CPGPPTASH

SEQ ID NO: 560821 - protein, 9 aa, Homo Sapiens
FTRKNGTNV

SEQ ID NO: 560822 - protein, 9 aa, Homo Sapiens
YVGIGVAAF

SEQ ID NO: 560823 - protein, 9 aa, Homo Sapiens
INRWHIATK

SEQ ID NO: 560824 - protein, 9 aa, Homo Sapiens
WHIATKQAN

SEQ ID NO: 560825 - protein, 9 aa, Homo Sapiens
IGVAAFIFG

SEQ ID NO: 560826 - protein, 9 aa, Homo Sapiens
EAMYRSICW

SEQ ID NO: 560827 - protein, 9 aa, Homo Sapiens
NEELNVKKI

SEQ ID NO: 560828 - protein, 9 aa, Homo Sapiens
QVVEADING

SEQ ID NO: 560829 - protein, 9 aa, Homo Sapiens
EELNVKKIE

SEQ ID NO: 560830 - protein, 9 aa, Homo Sapiens
VLMVHKRSQ

SEQ ID NO: 560831 - protein, 9 aa, Homo Sapiens
NNSDNSGSY

SEQ ID NO: 560832 - protein, 9 aa, Homo Sapiens
LALRQVVEA

SEQ ID NO: 560833 - protein, 9 aa, Homo Sapiens
VWYVEADWD

SEQ ID NO: 560834 - protein, 9 aa, Homo Sapiens
SWHYVHLRH

SEQ ID NO: 560835 - protein, 9 aa, Homo Sapiens
RAVWYVEAD

SEQ ID NO: 560836 - protein, 9 aa, Homo Sapiens
LQKLLVPQL

SEQ ID NO: 560837 - protein, 9 aa, Homo Sapiens
IMEMQHEFE

SEQ ID NO: 560838 - protein, 9 aa, Homo Sapiens
SYQGLEHRG

SEQ ID NO: 560839 - protein, 9 aa, Homo Sapiens
LPEPPSPGP

SEQ ID NO: 560840 - protein, 9 aa, Homo Sapiens
AFLWLLLLG

SEQ ID NO: 560841 - protein, 9 aa, Homo Sapiens
SGSYQGLEH

SEQ ID NO: 560842 - protein, 9 aa, Homo Sapiens
VEADWDTKH

SEQ ID NO: 560843 - protein, 9 aa, Homo Sapiens
CSSAKAFNT

SEQ ID NO: 560844 - protein, 9 aa, Homo Sapiens
REYYMLQEQ

SEQ ID NO: 560845 - protein, 9 aa, Homo Sapiens
LAEEAVIIW

SEQ ID NO: 560846 - protein, 9 aa, Homo Sapiens
ALNQGGLTS

SEQ ID NO: 560847 - protein, 9 aa, Homo Sapiens
FLKGNAEAQ

SEQ ID NO: 560848 - protein, 9 aa, Homo Sapiens
RRYVDEYKN

SEQ ID NO: 560849 - protein, 9 aa, Homo Sapiens
GIGVAAFIF

SEQ ID NO: 560850 - protein, 9 aa, Homo Sapiens
VLQPRTQVG

SEQ ID NO: 560851 - protein, 9 aa, Homo Sapiens
MTEVDRLRN

SEQ ID NO: 560852 - protein, 9 aa, Homo Sapiens
DLQFAKEMA

SEQ ID NO: 560853 - protein, 9 aa, Homo Sapiens
TQLSTRKKE

SEQ ID NO: 560854 - protein, 9 aa, Homo Sapiens
LQFAKEMAE

SEQ ID NO: 560855 - protein, 9 aa, Homo Sapiens
IDDFSNKER

SEQ ID NO: 560856 - protein, 9 aa, Homo Sapiens
TVIYYDVAR

SEQ ID NO: 560857 - protein, 9 aa, Homo Sapiens
REREQQDLQ

SEQ ID NO: 560858 - protein, 9 aa, Homo Sapiens
QPRTQVGTM

SEQ ID NO: 560859 - protein, 9 aa, Homo Sapiens
NLILGDDTS

SEQ ID NO: 560860 - protein, 9 aa, Homo Sapiens
AHQLTCRIY

SEQ ID NO: 560861 - protein, 9 aa, Homo Sapiens
ILGDDTSLA

SEQ ID NO: 560862 - protein, 9 aa, Homo Sapiens
LILGDDTSL

SEQ ID NO: 560863 - protein, 9 aa, Homo Sapiens
PVTCLQQNR

SEQ ID NO: 560864 - protein, 9 aa, Homo Sapiens
GEKGHSWGG

SEQ ID NO: 560865 - protein, 9 aa, Homo Sapiens
PRPLQRVRH

SEQ ID NO: 560866 - protein, 9 aa, Homo Sapiens
KEKANSSKF

SEQ ID NO: 560867 - protein, 9 aa, Homo Sapiens
GTRGTGWPL

SEQ ID NO: 560868 - protein, 9 aa, Homo Sapiens
ATNVGSSGR

SEQ ID NO: 560869 - protein, 9 aa, Homo Sapiens
TKLQSVSIA

SEQ ID NO: 560870 - protein, 9 aa, Homo Sapiens
TQVGTMSPA

SEQ ID NO: 560871 - protein, 9 aa, Homo Sapiens
PPRPLQRVR

SEQ ID NO: 560872 - protein, 9 aa, Homo Sapiens
LKLQAHQLT

SEQ ID NO: 560873 - protein, 9 aa, Homo Sapiens
TCLQQNRRP

SEQ ID NO: 560874 - protein, 9 aa, Homo Sapiens
DLYNAVSTS

SEQ ID NO: 560875 - protein, 9 aa, Homo Sapiens
SGTYCVNLI

SEQ ID NO: 560876 - protein, 9 aa, Homo Sapiens
EKLTEFVYK

SEQ ID NO: 560877 - protein, 9 aa, Homo Sapiens
SEEVTYVTL

SEQ ID NO: 560878 - protein, 9 aa, Homo Sapiens
VSIAIHLCD

SEQ ID NO: 560879 - protein, 9 aa, Homo Sapiens
KKAAALDLY

SEQ ID NO: 560880 - protein, 9 aa, Homo Sapiens
RLKEKLDEY

SEQ ID NO: 560881 - protein, 9 aa, Homo Sapiens
EVDRLRNWQ

SEQ ID NO: 560882 - protein, 9 aa, Homo Sapiens
TRKKEKANS

SEQ ID NO: 560883 - protein, 9 aa, Homo Sapiens
GTYCVNLIL

SEQ ID NO: 560884 - protein, 9 aa, Homo Sapiens
WIYGVLNNP

SEQ ID NO: 560885 - protein, 9 aa, Homo Sapiens
MGEKGHSWG

SEQ ID NO: 560886 - protein, 9 aa, Homo Sapiens
SCPSQHQGL

SEQ ID NO: 560887 - protein, 9 aa, Homo Sapiens
KTKLQSVSI

SEQ ID NO: 560888 - protein, 9 aa, Homo Sapiens
LRNWQGDGR

SEQ ID NO: 560889 - protein, 9 aa, Homo Sapiens
EQQDLQFAK

SEQ ID NO: 560890 - protein, 9 aa, Homo Sapiens
TGWPLAGQQ

SEQ ID NO: 560891 - protein, 9 aa, Homo Sapiens
GQQPGSCPS

SEQ ID NO: 560892 - protein, 9 aa, Homo Sapiens
QGDGRNTQL

SEQ ID NO: 560893 - protein, 9 aa, Homo Sapiens
SWGGTRGTG

SEQ ID NO: 560894 - protein, 9 aa, Homo Sapiens
NDAEKLTEF

SEQ ID NO: 560895 - protein, 9 aa, Homo Sapiens
GRNTQLSTR

SEQ ID NO: 560896 - protein, 9 aa, Homo Sapiens
PGAGVMADT

SEQ ID NO: 560897 - protein, 9 aa, Homo Sapiens
EREQQDLQF

SEQ ID NO: 560898 - protein, 9 aa, Homo Sapiens
YVTLTFQDS

SEQ ID NO: 560899 - protein, 9 aa, Homo Sapiens
WGNDAEKLT

SEQ ID NO: 560900 - protein, 9 aa, Homo Sapiens
TYVTLTFQD

SEQ ID NO: 560901 - protein, 9 aa, Homo Sapiens
EAPSAPVTC

SEQ ID NO: 560902 - protein, 9 aa, Homo Sapiens
TPSATNVGS

SEQ ID NO: 560903 - protein, 9 aa, Homo Sapiens
SILEDPAVP

SEQ ID NO: 560904 - protein, 9 aa, Homo Sapiens
VDRLRNWQG

SEQ ID NO: 560905 - protein, 9 aa, Homo Sapiens
CSCFYPEPH

SEQ ID NO: 560906 - protein, 9 aa, Homo Sapiens
YYDVARDID

SEQ ID NO: 560907 - protein, 9 aa, Homo Sapiens
KFSVLSCKL

SEQ ID NO: 560908 - protein, 9 aa, Homo Sapiens
SIAIHLCDK

SEQ ID NO: 560909 - protein, 9 aa, Homo Sapiens
KERLKEKLD

SEQ ID NO: 560910 - protein, 9 aa, Homo Sapiens
LQSVSIAIH

SEQ ID NO: 560911 - protein, 9 aa, Homo Sapiens
KLQSVSIAI

SEQ ID NO: 560912 - protein, 9 aa, Homo Sapiens
RLPPPRPLQ

SEQ ID NO: 560913 - protein, 9 aa, Homo Sapiens
AEKLTEFVY

SEQ ID NO: 560914 - protein, 9 aa, Homo Sapiens
AGVMADTEP

SEQ ID NO: 560915 - protein, 9 aa, Homo Sapiens
PLKLQAHQL

SEQ ID NO: 560916 - protein, 9 aa, Homo Sapiens
GDGRNTQLS

SEQ ID NO: 560917 - protein, 9 aa, Homo Sapiens
NKERLKEKL

SEQ ID NO: 560918 - protein, 9 aa, Homo Sapiens
YGVLNNPGP

SEQ ID NO: 560919 - protein, 9 aa, Homo Sapiens
EPHNINIYT

SEQ ID NO: 560920 - protein, 9 aa, Homo Sapiens
SNKERLKEK

SEQ ID NO: 560921 - protein, 9 aa, Homo Sapiens
IKTVIYYDV

SEQ ID NO: 560922 - protein, 9 aa, Homo Sapiens
TYCVNLILG

SEQ ID NO: 560923 - protein, 9 aa, Homo Sapiens
PGRLPPPRP

SEQ ID NO: 560924 - protein, 9 aa, Homo Sapiens
QSVSIAIHL

SEQ ID NO: 560925 - protein, 9 aa, Homo Sapiens
RTQVGTMSP

SEQ ID NO: 560926 - protein, 9 aa, Homo Sapiens
PTPSATNVG

SEQ ID NO: 560927 - protein, 9 aa, Homo Sapiens
VPGHRMGEK

SEQ ID NO: 560928 - protein, 9 aa, Homo Sapiens
MADTEPILA

SEQ ID NO: 560929 - protein, 9 aa, Homo Sapiens
TCRIYWQFS

SEQ ID NO: 560930 - protein, 9 aa, Homo Sapiens
DDFSNKERL

SEQ ID NO: 560931 - protein, 9 aa, Homo Sapiens
EVTYVTLTF

SEQ ID NO: 560932 - protein, 9 aa, Homo Sapiens
CPSQHQGLP

SEQ ID NO: 560933 - protein, 9 aa, Homo Sapiens
IPSIKTVIY

SEQ ID NO: 560934 - protein, 9 aa, Homo Sapiens
ALVLQPRTQ

SEQ ID NO: 560935 - protein, 9 aa, Homo Sapiens
PHNINIYTY

SEQ ID NO: 560936 - protein, 9 aa, Homo Sapiens
HNINIYTYD

SEQ ID NO: 560937 - protein, 9 aa, Homo Sapiens
GHSWGGTRG

SEQ ID NO: 560938 - protein, 9 aa, Homo Sapiens
LTCRIYWQF

SEQ ID NO: 560939 - protein, 9 aa, Homo Sapiens
CALVLQPRT

SEQ ID NO: 560940 - protein, 9 aa, Homo Sapiens
SCFYPEPHN

SEQ ID NO: 560941 - protein, 9 aa, Homo Sapiens
TPGAGVMAD

SEQ ID NO: 560942 - protein, 9 aa, Homo Sapiens
RSGLKFSVL

SEQ ID NO: 560943 - protein, 9 aa, Homo Sapiens
VALFRDWIY

SEQ ID NO: 560944 - protein, 9 aa, Homo Sapiens
GVMADTEPI

SEQ ID NO: 560945 - protein, 9 aa, Homo Sapiens
DLRMNGLSE

SEQ ID NO: 560946 - protein, 9 aa, Homo Sapiens
GNDAEKLTE

SEQ ID NO: 560947 - protein, 9 aa, Homo Sapiens
KLQAHQLTC

SEQ ID NO: 560948 - protein, 9 aa, Homo Sapiens
VFSHGDLRM

SEQ ID NO: 560949 - protein, 9 aa, Homo Sapiens
IYYDVARDI

SEQ ID NO: 560950 - protein, 9 aa, Homo Sapiens
KGHSWGGTR

SEQ ID NO: 560951 - protein, 9 aa, Homo Sapiens
DFSNKERLK

SEQ ID NO: 560952 - protein, 9 aa, Homo Sapiens
WQGDGRNTQ

SEQ ID NO: 560953 - protein, 9 aa, Homo Sapiens
LRMNGLSES

SEQ ID NO: 560954 - protein, 9 aa, Homo Sapiens
PSAPVTCLQ

SEQ ID NO: 560955 - protein, 9 aa, Homo Sapiens
YCVNLILGD

SEQ ID NO: 560956 - protein, 9 aa, Homo Sapiens
SVSIAIHLC

SEQ ID NO: 560957 - protein, 9 aa, Homo Sapiens
PSIKTVIYY

SEQ ID NO: 560958 - protein, 9 aa, Homo Sapiens
RLRNWQGDG

SEQ ID NO: 560959 - protein, 9 aa, Homo Sapiens
RGTGWPLAG

SEQ ID NO: 560960 - protein, 9 aa, Homo Sapiens
QQNRRPLKL

SEQ ID NO: 560961 - protein, 9 aa, Homo Sapiens
RARSGLKFS

SEQ ID NO: 560962 - protein, 9 aa, Homo Sapiens
PRTQVGTMS

SEQ ID NO: 560963 - protein, 9 aa, Homo Sapiens
SGLKFSVLS

SEQ ID NO: 560964 - protein, 9 aa, Homo Sapiens
LPPPRPLQR

SEQ ID NO: 560965 - protein, 9 aa, Homo Sapiens
AGQQPGSCP

SEQ ID NO: 560966 - protein, 9 aa, Homo Sapiens
DRLRNWQGD

SEQ ID NO: 560967 - protein, 9 aa, Homo Sapiens
RDWIYGVLN

SEQ ID NO: 560968 - protein, 9 aa, Homo Sapiens
EKGHSWGGT

SEQ ID NO: 560969 - protein, 9 aa, Homo Sapiens
TEVDRLRNW

SEQ ID NO: 560970 - protein, 9 aa, Homo Sapiens
GPTPSATNV

SEQ ID NO: 560971 - protein, 9 aa, Homo Sapiens
SHGDLRMNG

SEQ ID NO: 560972 - protein, 9 aa, Homo Sapiens
NRRPLKLQA

SEQ ID NO: 560973 - protein, 9 aa, Homo Sapiens
FSNKERLKE

SEQ ID NO: 560974 - protein, 9 aa, Homo Sapiens
PEPHNINIY

SEQ ID NO: 560975 - protein, 9 aa, Homo Sapiens
QNRRPLKLQ

SEQ ID NO: 560976 - protein, 9 aa, Homo Sapiens
ADSILEDPA

SEQ ID NO: 560977 - protein, 9 aa, Homo Sapiens
HRARSGLKF

SEQ ID NO: 560978 - protein, 9 aa, Homo Sapiens
TEFVYKNQK

SEQ ID NO: 560979 - protein, 9 aa, Homo Sapiens
EEVTYVTLT

SEQ ID NO: 560980 - protein, 9 aa, Homo Sapiens
LFRDWIYGV

SEQ ID NO: 560981 - protein, 9 aa, Homo Sapiens
REQQDLQFA

SEQ ID NO: 560982 - protein, 9 aa, Homo Sapiens
GRLPPPRPL

SEQ ID NO: 560983 - protein, 9 aa, Homo Sapiens
QFAKEMAED

SEQ ID NO: 560984 - protein, 9 aa, Homo Sapiens
IYGVLNNPG

SEQ ID NO: 560985 - protein, 9 aa, Homo Sapiens
VTCLQQNRR

SEQ ID NO: 560986 - protein, 9 aa, Homo Sapiens
TRGTGWPLA

SEQ ID NO: 560987 - protein, 9 aa, Homo Sapiens
QAHQLTCRI

SEQ ID NO: 560988 - protein, 9 aa, Homo Sapiens
WPLAGQQPG

SEQ ID NO: 560989 - protein, 9 aa, Homo Sapiens
AALDLYNAV

SEQ ID NO: 560990 - protein, 9 aa, Homo Sapiens
GTGWPLAGQ

SEQ ID NO: 560991 - protein, 9 aa, Homo Sapiens
DSILEDPAV

SEQ ID NO: 560992 - protein, 9 aa, Homo Sapiens
QLSTRKKEK

SEQ ID NO: 560993 - protein, 9 aa, Homo Sapiens
HQGLPGRLP

SEQ ID NO: 560994 - protein, 9 aa, Homo Sapiens
SIKTVIYYD

SEQ ID NO: 560995 - protein, 9 aa, Homo Sapiens
DAEKLTEFV

SEQ ID NO: 560996 - protein, 9 aa, Homo Sapiens
GAGVMADTE

SEQ ID NO: 560997 - protein, 9 aa, Homo Sapiens
PLAGQQPGS

SEQ ID NO: 560998 - protein, 9 aa, Homo Sapiens
PSQHQGLPG

SEQ ID NO: 560999 - protein, 9 aa, Homo Sapiens
LVLQPRTQV

SEQ ID NO: 561000 - protein, 9 aa, Homo Sapiens
RNWQGDGRN

SEQ ID NO: 561001 - protein, 9 aa, Homo Sapiens
HSWGGTRGT

SEQ ID NO: 561002 - protein, 9 aa, Homo Sapiens
GGTRGTGWP

SEQ ID NO: 561003 - protein, 9 aa, Homo Sapiens
SATNVGSSG

SEQ ID NO: 561004 - protein, 9 aa, Homo Sapiens
SAPVTCLQQ

SEQ ID NO: 561005 - protein, 9 aa, Homo Sapiens
FRDWIYGVL

SEQ ID NO: 561006 - protein, 9 aa, Homo Sapiens
LEDPAVPGH

SEQ ID NO: 561007 - protein, 9 aa, Homo Sapiens
LQAHQLTCR

SEQ ID NO: 561008 - protein, 9 aa, Homo Sapiens
AKKAAALDL

SEQ ID NO: 561009 - protein, 9 aa, Homo Sapiens
GWPLAGQQP

SEQ ID NO: 561010 - protein, 9 aa, Homo Sapiens
AAALDLYNA

SEQ ID NO: 561011 - protein, 9 aa, Homo Sapiens
APSAPVTCL

SEQ ID NO: 561012 - protein, 9 aa, Homo Sapiens
HRMGEKGHS

SEQ ID NO: 561013 - protein, 9 aa, Homo Sapiens
LKFSVLSCK

SEQ ID NO: 561014 - protein, 9 aa, Homo Sapiens
PGHRMGEKG

SEQ ID NO: 561015 - protein, 9 aa, Homo Sapiens
MNGLSESEG

SEQ ID NO: 561016 - protein, 9 aa, Homo Sapiens
PAVPGHRMG

SEQ ID NO: 561017 - protein, 9 aa, Homo Sapiens
FYPEPHNIN

SEQ ID NO: 561018 - protein, 9 aa, Homo Sapiens
HGDLRMNGL

SEQ ID NO: 561019 - protein, 9 aa, Homo Sapiens
QDLQFAKEM

SEQ ID NO: 561020 - protein, 9 aa, Homo Sapiens
LDLYNAVST

SEQ ID NO: 561021 - protein, 9 aa, Homo Sapiens
LPGRLPPPR

SEQ ID NO: 561022 - protein, 9 aa, Homo Sapiens
IAIHLCDKK

SEQ ID NO: 561023 - protein, 9 aa, Homo Sapiens
FSVLSCKLA

SEQ ID NO: 561024 - protein, 9 aa, Homo Sapiens
YPEPHNINI

SEQ ID NO: 561025 - protein, 9 aa, Homo Sapiens
HQLTCRIYW

SEQ ID NO: 561026 - protein, 9 aa, Homo Sapiens
APVTCLQQN

SEQ ID NO: 561027 - protein, 9 aa, Homo Sapiens
KLTEFVYKN

SEQ ID NO: 561028 - protein, 9 aa, Homo Sapiens
FSHGDLRMN

SEQ ID NO: 561029 - protein, 9 aa, Homo Sapiens
CFYPEPHNI

SEQ ID NO: 561030 - protein, 9 aa, Homo Sapiens
KEAPSAPVT

SEQ ID NO: 561031 - protein, 9 aa, Homo Sapiens
PGPTPSATN

SEQ ID NO: 561032 - protein, 9 aa, Homo Sapiens
RPLKLQAHQ

SEQ ID NO: 561033 - protein, 9 aa, Homo Sapiens
DPAVPGHRM

SEQ ID NO: 561034 - protein, 9 aa, Homo Sapiens
VNLILGDDT

SEQ ID NO: 561035 - protein, 9 aa, Homo Sapiens
RMGEKGHSW

SEQ ID NO: 561036 - protein, 9 aa, Homo Sapiens
QHQGLPGRL

SEQ ID NO: 561037 - protein, 9 aa, Homo Sapiens
LAGQQPGSC

SEQ ID NO: 561038 - protein, 9 aa, Homo Sapiens
GDLRMNGLS

SEQ ID NO: 561039 - protein, 9 aa, Homo Sapiens
RMNGLSESE

SEQ ID NO: 561040 - protein, 9 aa, Homo Sapiens
AVPGHRMGE

SEQ ID NO: 561041 - protein, 9 aa, Homo Sapiens
RKKEKANSS

SEQ ID NO: 561042 - protein, 9 aa, Homo Sapiens
VTYVTLTFQ

SEQ ID NO: 561043 - protein, 9 aa, Homo Sapiens
RPLQRVRHT

SEQ ID NO: 561044 - protein, 9 aa, Homo Sapiens
QLTCRIYWQ

SEQ ID NO: 561045 - protein, 9 aa, Homo Sapiens
STRKKEKAN

SEQ ID NO: 561046 - protein, 9 aa, Homo Sapiens
VIYYDVARD

SEQ ID NO: 561047 - protein, 9 aa, Homo Sapiens
GLPGRLPPP

SEQ ID NO: 561048 - protein, 9 aa, Homo Sapiens
ADTEPILAA

SEQ ID NO: 561049 - protein, 9 aa, Homo Sapiens
PSATNVGSS

SEQ ID NO: 561050 - protein, 9 aa, Homo Sapiens
CLQQNRRPL

SEQ ID NO: 561051 - protein, 9 aa, Homo Sapiens
LSTRKKEKA

SEQ ID NO: 561052 - protein, 9 aa, Homo Sapiens
PPPRPLQRV

SEQ ID NO: 561053 - protein, 9 aa, Homo Sapiens
PGSCPSQHQ

SEQ ID NO: 561054 - protein, 9 aa, Homo Sapiens
EDPAVPGHR

SEQ ID NO: 561055 - protein, 9 aa, Homo Sapiens
VTLTFQDSA

SEQ ID NO: 561056 - protein, 9 aa, Homo Sapiens
LTEFVYKNQ

SEQ ID NO: 561057 - protein, 9 aa, Homo Sapiens
ALDLYNAVS

SEQ ID NO: 561058 - protein, 9 aa, Homo Sapiens
CVNLILGDD

SEQ ID NO: 561059 - protein, 9 aa, Homo Sapiens
DTEPILAAT

SEQ ID NO: 561060 - protein, 9 aa, Homo Sapiens
LYNAVSTSF

SEQ ID NO: 561061 - protein, 9 aa, Homo Sapiens
QQDLQFAKE

SEQ ID NO: 561062 - protein, 9 aa, Homo Sapiens
WGGTRGTGW

SEQ ID NO: 561063 - protein, 9 aa, Homo Sapiens
SMTEVDRLR

SEQ ID NO: 561064 - protein, 9 aa, Homo Sapiens
QPGSCPSQH

SEQ ID NO: 561065 - protein, 9 aa, Homo Sapiens
GLKFSVLSC

SEQ ID NO: 561066 - protein, 9 aa, Homo Sapiens
KKEKANSSK

SEQ ID NO: 561067 - protein, 9 aa, Homo Sapiens
NTQLSTRKK

SEQ ID NO: 561068 - protein, 9 aa, Homo Sapiens
DGRNTQLST

SEQ ID NO: 561069 - protein, 9 aa, Homo Sapiens
ILEDPAVPG

SEQ ID NO: 561070 - protein, 9 aa, Homo Sapiens
ERLKEKLDE

SEQ ID NO: 561071 - protein, 9 aa, Homo Sapiens
LQQNRRPLK

SEQ ID NO: 561072 - protein, 9 aa, Homo Sapiens
GHRMGEKGH

SEQ ID NO: 561073 - protein, 9 aa, Homo Sapiens
LQPRTQVGT

SEQ ID NO: 561074 - protein, 9 aa, Homo Sapiens
GSCPSQHQG

SEQ ID NO: 561075 - protein, 9 aa, Homo Sapiens
NWQGDGRNT

SEQ ID NO: 561076 - protein, 9 aa, Homo Sapiens
QGLPGRLPP

SEQ ID NO: 561077 - protein, 9 aa, Homo Sapiens
QQPGSCPSQ

SEQ ID NO: 561078 - protein, 9 aa, Homo Sapiens
MSEEVTYVT

SEQ ID NO: 561079 - protein, 9 aa, Homo Sapiens
VMADTEPIL

SEQ ID NO: 561080 - protein, 9 aa, Homo Sapiens
DWIYGVLNN

SEQ ID NO: 561081 - protein, 9 aa, Homo Sapiens
RRPLKLQAH

SEQ ID NO: 561082 - protein, 9 aa, Homo Sapiens
ALFRDWIYG

SEQ ID NO: 561083 - protein, 9 aa, Homo Sapiens
KTVIYYDVA

SEQ ID NO: 561084 - protein, 9 aa, Homo Sapiens
RNTQLSTRK

SEQ ID NO: 561085 - protein, 9 aa, Homo Sapiens
MPGPTPSAT

SEQ ID NO: 561086 - protein, 9 aa, Homo Sapiens
KAAALDLYN

SEQ ID NO: 561087 - protein, 9 aa, Homo Sapiens
ARSGLKFSV

SEQ ID NO: 561088 - protein, 9 aa, Homo Sapiens
SQHQGLPGR

SEQ ID NO: 561089 - protein, 9 aa, Homo Sapiens
QRYLECRSL

SEQ ID NO: 561090 - protein, 9 aa, Homo Sapiens
LSAHDKGSP

SEQ ID NO: 561091 - protein, 9 aa, Homo Sapiens
NCLKSPVKP

SEQ ID NO: 561092 - protein, 9 aa, Homo Sapiens
FLELLNCLK

SEQ ID NO: 561093 - protein, 9 aa, Homo Sapiens
ISFFYEIIS

SEQ ID NO: 561094 - protein, 9 aa, Homo Sapiens
AAGASTFQD

SEQ ID NO: 561095 - protein, 9 aa, Homo Sapiens
STRLRLHAF

SEQ ID NO: 561096 - protein, 9 aa, Homo Sapiens
SLSVAPLAV

SEQ ID NO: 561097 - protein, 9 aa, Homo Sapiens
IADQLNADF

SEQ ID NO: 561098 - protein, 9 aa, Homo Sapiens
KITEAKLAG

SEQ ID NO: 561099 - protein, 9 aa, Homo Sapiens
NADFALIHK

SEQ ID NO: 561100 - protein, 9 aa, Homo Sapiens
TMIIHKNWV

SEQ ID NO: 561101 - protein, 9 aa, Homo Sapiens
LPISFFYEI

SEQ ID NO: 561102 - protein, 9 aa, Homo Sapiens
SEREHQALQ

SEQ ID NO: 561103 - protein, 9 aa, Homo Sapiens
EPVPEEEDL

SEQ ID NO: 561104 - protein, 9 aa, Homo Sapiens
EVRRGELQG

SEQ ID NO: 561105 - protein, 9 aa, Homo Sapiens
QLNADFALI

SEQ ID NO: 561106 - protein, 9 aa, Homo Sapiens
DGIDALPIS

SEQ ID NO: 561107 - protein, 9 aa, Homo Sapiens
DAVIEKFAR

SEQ ID NO: 561108 - protein, 9 aa, Homo Sapiens
LQAVQKECS

SEQ ID NO: 561109 - protein, 9 aa, Homo Sapiens
PSPSASERE

SEQ ID NO: 561110 - protein, 9 aa, Homo Sapiens
SGESSFVFP

SEQ ID NO: 561111 - protein, 9 aa, Homo Sapiens
SIQFEVRRG

SEQ ID NO: 561112 - protein, 9 aa, Homo Sapiens
NFQHFVDRI

SEQ ID NO: 561113 - protein, 9 aa, Homo Sapiens
LPDIEPVPE

SEQ ID NO: 561114 - protein, 9 aa, Homo Sapiens
QKEPREKDK

SEQ ID NO: 561115 - protein, 9 aa, Homo Sapiens
KETGLQGAQ

SEQ ID NO: 561116 - protein, 9 aa, Homo Sapiens
SPSASEREH

SEQ ID NO: 561117 - protein, 9 aa, Homo Sapiens
AGTLSPSRS

SEQ ID NO: 561118 - protein, 9 aa, Homo Sapiens
SRSKSRSQF

SEQ ID NO: 561119 - protein, 9 aa, Homo Sapiens
LVKKKVYSL

SEQ ID NO: 561120 - protein, 9 aa, Homo Sapiens
QSGNSERKQ

SEQ ID NO: 561121 - protein, 9 aa, Homo Sapiens
PDSKTQSGE

SEQ ID NO: 561122 - protein, 9 aa, Homo Sapiens
YIIPLPDIE

SEQ ID NO: 561123 - protein, 9 aa, Homo Sapiens
PLPDIEPVP

SEQ ID NO: 561124 - protein, 9 aa, Homo Sapiens
NSERKQKEP

SEQ ID NO: 561125 - protein, 9 aa, Homo Sapiens
GFLATCQDY

SEQ ID NO: 561126 - protein, 9 aa, Homo Sapiens
FYAYYHPST

SEQ ID NO: 561127 - protein, 9 aa, Homo Sapiens
GCQDQLQGY

SEQ ID NO: 561128 - protein, 9 aa, Homo Sapiens
ELLNCLKSP

SEQ ID NO: 561129 - protein, 9 aa, Homo Sapiens
QHFVDRISN

SEQ ID NO: 561130 - protein, 9 aa, Homo Sapiens
LTLSAHDKG

SEQ ID NO: 561131 - protein, 9 aa, Homo Sapiens
PGSVPNPSK

SEQ ID NO: 561132 - protein, 9 aa, Homo Sapiens
TTPDSKTQS

SEQ ID NO: 561133 - protein, 9 aa, Homo Sapiens
KGDDNPKES

SEQ ID NO: 561134 - protein, 9 aa, Homo Sapiens
HDKGSPPRS

SEQ ID NO: 561135 - protein, 9 aa, Homo Sapiens
DRDFFRSVF

SEQ ID NO: 561136 - protein, 9 aa, Homo Sapiens
NYMHQQVCD

SEQ ID NO: 561137 - protein, 9 aa, Homo Sapiens
SIHGFLATC

SEQ ID NO: 561138 - protein, 9 aa, Homo Sapiens
LSVAPLAVN

SEQ ID NO: 561139 - protein, 9 aa, Homo Sapiens
ERKQKEPRE

SEQ ID NO: 561140 - protein, 9 aa, Homo Sapiens
KSPVKPQGI

SEQ ID NO: 561141 - protein, 9 aa, Homo Sapiens
CIVVIMALV

SEQ ID NO: 561142 - protein, 9 aa, Homo Sapiens
HTTPDSKTQ

SEQ ID NO: 561143 - protein, 9 aa, Homo Sapiens
RGPSPSASE

SEQ ID NO: 561144 - protein, 9 aa, Homo Sapiens
DTVYALKDK

SEQ ID NO: 561145 - protein, 9 aa, Homo Sapiens
PISFFYEII

SEQ ID NO: 561146 - protein, 9 aa, Homo Sapiens
TVENFQHFV

SEQ ID NO: 561147 - protein, 9 aa, Homo Sapiens
SLSYSNPVE

SEQ ID NO: 561148 - protein, 9 aa, Homo Sapiens
KDKVQELRQ

SEQ ID NO: 561149 - protein, 9 aa, Homo Sapiens
YPCAAGAST

SEQ ID NO: 561150 - protein, 9 aa, Homo Sapiens
SQFSSRSRS

SEQ ID NO: 561151 - protein, 9 aa, Homo Sapiens
YCYDPVDDY

SEQ ID NO: 561152 - protein, 9 aa, Homo Sapiens
HQQVCDALF

SEQ ID NO: 561153 - protein, 9 aa, Homo Sapiens
TSIADQLNA

SEQ ID NO: 561154 - protein, 9 aa, Homo Sapiens
KMVANMFCI

SEQ ID NO: 561155 - protein, 9 aa, Homo Sapiens
FVGYCGPRE

SEQ ID NO: 561156 - protein, 9 aa, Homo Sapiens
QTAFYAYYH

SEQ ID NO: 561157 - protein, 9 aa, Homo Sapiens
KLAGCQDQL

SEQ ID NO: 561158 - protein, 9 aa, Homo Sapiens
NMFCIVVIM

SEQ ID NO: 561159 - protein, 9 aa, Homo Sapiens
IEPVPEEED

SEQ ID NO: 561160 - protein, 9 aa, Homo Sapiens
PCAAGASTF

SEQ ID NO: 561161 - protein, 9 aa, Homo Sapiens
DVKGDDNPK

SEQ ID NO: 561162 - protein, 9 aa, Homo Sapiens
AYYHPSTEA

SEQ ID NO: 561163 - protein, 9 aa, Homo Sapiens
KKKVYSLIG

SEQ ID NO: 561164 - protein, 9 aa, Homo Sapiens
ALKDKVQEL

SEQ ID NO: 561165 - protein, 9 aa, Homo Sapiens
SGTPQAGTL

SEQ ID NO: 561166 - protein, 9 aa, Homo Sapiens
FARIKREIE

SEQ ID NO: 561167 - protein, 9 aa, Homo Sapiens
PSDFSIHGF

SEQ ID NO: 561168 - protein, 9 aa, Homo Sapiens
CRSLSYSNP

SEQ ID NO: 561169 - protein, 9 aa, Homo Sapiens
SSVNYSTSG

SEQ ID NO: 561170 - protein, 9 aa, Homo Sapiens
DDYWMHVQN

SEQ ID NO: 561171 - protein, 9 aa, Homo Sapiens
GLQGAQLAS

SEQ ID NO: 561172 - protein, 9 aa, Homo Sapiens
ASTFQDFSH

SEQ ID NO: 561173 - protein, 9 aa, Homo Sapiens
TGLQGAQLA

SEQ ID NO: 561174 - protein, 9 aa, Homo Sapiens
KGSPPRSAS

SEQ ID NO: 561175 - protein, 9 aa, Homo Sapiens
EREHQALQD

SEQ ID NO: 561176 - protein, 9 aa, Homo Sapiens
PDIEPVPEE

SEQ ID NO: 561177 - protein, 9 aa, Homo Sapiens
IIHKNWVDL

SEQ ID NO: 561178 - protein, 9 aa, Homo Sapiens
GFRLVKKKV

SEQ ID NO: 561179 - protein, 9 aa, Homo Sapiens
AQLASFPDT

SEQ ID NO: 561180 - protein, 9 aa, Homo Sapiens
APGHGSTRL

SEQ ID NO: 561181 - protein, 9 aa, Homo Sapiens
FYEIISEGI

SEQ ID NO: 561182 - protein, 9 aa, Homo Sapiens
HFVDRISNG

SEQ ID NO: 561183 - protein, 9 aa, Homo Sapiens
RSLSYSNPV

SEQ ID NO: 561184 - protein, 9 aa, Homo Sapiens
ENFQHFVDR

SEQ ID NO: 561185 - protein, 9 aa, Homo Sapiens
VKGDDNPKE

SEQ ID NO: 561186 - protein, 9 aa, Homo Sapiens
YSTSGESSF

SEQ ID NO: 561187 - protein, 9 aa, Homo Sapiens
TLSAHDKGS

SEQ ID NO: 561188 - protein, 9 aa, Homo Sapiens
CAAGASTFQ

SEQ ID NO: 561189 - protein, 9 aa, Homo Sapiens
DQLNADFAL

SEQ ID NO: 561190 - protein, 9 aa, Homo Sapiens
IDALPISFF

SEQ ID NO: 561191 - protein, 9 aa, Homo Sapiens
AYVDFARQK

SEQ ID NO: 561192 - protein, 9 aa, Homo Sapiens
VNYMHQQVC

SEQ ID NO: 561193 - protein, 9 aa, Homo Sapiens
PLAVNVMGT

SEQ ID NO: 561194 - protein, 9 aa, Homo Sapiens
IEKFARIKR

SEQ ID NO: 561195 - protein, 9 aa, Homo Sapiens
QSGEKYTDP

SEQ ID NO: 561196 - protein, 9 aa, Homo Sapiens
QAVQKECSK

SEQ ID NO: 561197 - protein, 9 aa, Homo Sapiens
YEIISEGIS

SEQ ID NO: 561198 - protein, 9 aa, Homo Sapiens
ARPPGSVPN

SEQ ID NO: 561199 - protein, 9 aa, Homo Sapiens
AFYAYYHPS

SEQ ID NO: 561200 - protein, 9 aa, Homo Sapiens
GASTFQDFS

SEQ ID NO: 561201 - protein, 9 aa, Homo Sapiens
YAYYHPSTE

SEQ ID NO: 561202 - protein, 9 aa, Homo Sapiens
RAPGHGSTR

SEQ ID NO: 561203 - protein, 9 aa, Homo Sapiens
PPTAYVDFA

SEQ ID NO: 561204 - protein, 9 aa, Homo Sapiens
TPDSKTQSG

SEQ ID NO: 561205 - protein, 9 aa, Homo Sapiens
SVNYSTSGE

SEQ ID NO: 561206 - protein, 9 aa, Homo Sapiens
DDNPKESSP

SEQ ID NO: 561207 - protein, 9 aa, Homo Sapiens
RQRYLECRS

SEQ ID NO: 561208 - protein, 9 aa, Homo Sapiens
SERKQKEPR

SEQ ID NO: 561209 - protein, 9 aa, Homo Sapiens
SFFYEIISE

SEQ ID NO: 561210 - protein, 9 aa, Homo Sapiens
TVYALKDKV

SEQ ID NO: 561211 - protein, 9 aa, Homo Sapiens
QKECSKENV

SEQ ID NO: 561212 - protein, 9 aa, Homo Sapiens
PGEDVKGDD

SEQ ID NO: 561213 - protein, 9 aa, Homo Sapiens
SKETGLQGA

SEQ ID NO: 561214 - protein, 9 aa, Homo Sapiens
ACKMVNYMH

SEQ ID NO: 561215 - protein, 9 aa, Homo Sapiens
AGCQDQLQG

SEQ ID NO: 561216 - protein, 9 aa, Homo Sapiens
GTLSPSRSR

SEQ ID NO: 561217 - protein, 9 aa, Homo Sapiens
AGASTFQDF

SEQ ID NO: 561218 - protein, 9 aa, Homo Sapiens
HYPCAAGAS

SEQ ID NO: 561219 - protein, 9 aa, Homo Sapiens
RLVKKKVYS

SEQ ID NO: 561220 - protein, 9 aa, Homo Sapiens
PQAGTLSPS

SEQ ID NO: 561221 - protein, 9 aa, Homo Sapiens
FSIHGFLAT

SEQ ID NO: 561222 - protein, 9 aa, Homo Sapiens
ILQAVQKEC

SEQ ID NO: 561223 - protein, 9 aa, Homo Sapiens
LNCLKSPVK

SEQ ID NO: 561224 - protein, 9 aa, Homo Sapiens
MHQQVCDAL

SEQ ID NO: 561225 - protein, 9 aa, Homo Sapiens
LQGAQLASF

SEQ ID NO: 561226 - protein, 9 aa, Homo Sapiens
DALPISFFY

SEQ ID NO: 561227 - protein, 9 aa, Homo Sapiens
LKSPVKPQG

SEQ ID NO: 561228 - protein, 9 aa, Homo Sapiens
EQTAFYAYY

SEQ ID NO: 561229 - protein, 9 aa, Homo Sapiens
NRSAVDRDF

SEQ ID NO: 561230 - protein, 9 aa, Homo Sapiens
ANMFCIVVI

SEQ ID NO: 561231 - protein, 9 aa, Homo Sapiens
ASEREHQAL

SEQ ID NO: 561232 - protein, 9 aa, Homo Sapiens
DIEPVPEEE

SEQ ID NO: 561233 - protein, 9 aa, Homo Sapiens
LNADFALIH

SEQ ID NO: 561234 - protein, 9 aa, Homo Sapiens
VYSLIGTTV

SEQ ID NO: 561235 - protein, 9 aa, Homo Sapiens
VYALKDKVQ

SEQ ID NO: 561236 - protein, 9 aa, Homo Sapiens
MVANMFCIV

SEQ ID NO: 561237 - protein, 9 aa, Homo Sapiens
KMVNYMHQQ

SEQ ID NO: 561238 - protein, 9 aa, Homo Sapiens
AVQKECSKE

SEQ ID NO: 561239 - protein, 9 aa, Homo Sapiens
PTAYVDFAR

SEQ ID NO: 561240 - protein, 9 aa, Homo Sapiens
PNPSKSSVS

SEQ ID NO: 561241 - protein, 9 aa, Homo Sapiens
TWENTKESA

SEQ ID NO: 561242 - protein, 9 aa, Homo Sapiens
VDRDFFRSV

SEQ ID NO: 561243 - protein, 9 aa, Homo Sapiens
IIPLPDIEP

SEQ ID NO: 561244 - protein, 9 aa, Homo Sapiens
FEVRRGELQ

SEQ ID NO: 561245 - protein, 9 aa, Homo Sapiens
CKMVNYMHQ

SEQ ID NO: 561246 - protein, 9 aa, Homo Sapiens
MFCIVVIMA

SEQ ID NO: 561247 - protein, 9 aa, Homo Sapiens
VDFARQKLD

SEQ ID NO: 561248 - protein, 9 aa, Homo Sapiens
CAPPTAYVD

SEQ ID NO: 561249 - protein, 9 aa, Homo Sapiens
QFSSRSRSR

SEQ ID NO: 561250 - protein, 9 aa, Homo Sapiens
LKDKVQELR

SEQ ID NO: 561251 - protein, 9 aa, Homo Sapiens
VQKECSKEN

SEQ ID NO: 561252 - protein, 9 aa, Homo Sapiens
NYSTSGESS

SEQ ID NO: 561253 - protein, 9 aa, Homo Sapiens
GNSERKQKE

SEQ ID NO: 561254 - protein, 9 aa, Homo Sapiens
EIISEGISL

SEQ ID NO: 561255 - protein, 9 aa, Homo Sapiens
VPNPSKSSV

SEQ ID NO: 561256 - protein, 9 aa, Homo Sapiens
SVAPLAVNV

SEQ ID NO: 561257 - protein, 9 aa, Homo Sapiens
KTQSGEKYT

SEQ ID NO: 561258 - protein, 9 aa, Homo Sapiens
RGELQGPTP

SEQ ID NO: 561259 - protein, 9 aa, Homo Sapiens
VDDYWMHVQ

SEQ ID NO: 561260 - protein, 9 aa, Homo Sapiens
SVPNPSKSS

SEQ ID NO: 561261 - protein, 9 aa, Homo Sapiens
SDFSIHGFL

SEQ ID NO: 561262 - protein, 9 aa, Homo Sapiens
TAYVDFARQ

SEQ ID NO: 561263 - protein, 9 aa, Homo Sapiens
TEAKLAGCQ

SEQ ID NO: 561264 - protein, 9 aa, Homo Sapiens
ERAPGHGST

SEQ ID NO: 561265 - protein, 9 aa, Homo Sapiens
RSKSRSQFS

SEQ ID NO: 561266 - protein, 9 aa, Homo Sapiens
NEILQAVQK

SEQ ID NO: 561267 - protein, 9 aa, Homo Sapiens
FCIVVIMAL

SEQ ID NO: 561268 - protein, 9 aa, Homo Sapiens
GHGSTRLRL

SEQ ID NO: 561269 - protein, 9 aa, Homo Sapiens
DKVQELRQD

SEQ ID NO: 561270 - protein, 9 aa, Homo Sapiens
MIIHKNWVD

SEQ ID NO: 561271 - protein, 9 aa, Homo Sapiens
KVYSLIGTT

SEQ ID NO: 561272 - protein, 9 aa, Homo Sapiens
EKFARIKRE

SEQ ID NO: 561273 - protein, 9 aa, Homo Sapiens
LPKSLSVAP

SEQ ID NO: 561274 - protein, 9 aa, Homo Sapiens
EAKLAGCQD

SEQ ID NO: 561275 - protein, 9 aa, Homo Sapiens
RPPGSVPNP

SEQ ID NO: 561276 - protein, 9 aa, Homo Sapiens
EDVKGDDNP

SEQ ID NO: 561277 - protein, 9 aa, Homo Sapiens
VENFQHFVD

SEQ ID NO: 561278 - protein, 9 aa, Homo Sapiens
AIYCYDPVD

SEQ ID NO: 561279 - protein, 9 aa, Homo Sapiens
YLECRSLSY

SEQ ID NO: 561280 - protein, 9 aa, Homo Sapiens
TSGESSFVF

SEQ ID NO: 561281 - protein, 9 aa, Homo Sapiens
QPFVGYCGP

SEQ ID NO: 561282 - protein, 9 aa, Homo Sapiens
KFARIKREI

SEQ ID NO: 561283 - protein, 9 aa, Homo Sapiens
AVDRDFFRS

SEQ ID NO: 561284 - protein, 9 aa, Homo Sapiens
IIMTMIIHK

SEQ ID NO: 561285 - protein, 9 aa, Homo Sapiens
NPSKSSVSS

SEQ ID NO: 561286 - protein, 9 aa, Homo Sapiens
CLKSPVKPQ

SEQ ID NO: 561287 - protein, 9 aa, Homo Sapiens
YVDFARQKL

SEQ ID NO: 561288 - protein, 9 aa, Homo Sapiens
YALKDKVQE

SEQ ID NO: 561289 - protein, 9 aa, Homo Sapiens
YDPVDDYWM

SEQ ID NO: 561290 - protein, 9 aa, Homo Sapiens
GELQGPTPL

SEQ ID NO: 561291 - protein, 9 aa, Homo Sapiens
GESSFVFPL

SEQ ID NO: 561292 - protein, 9 aa, Homo Sapiens
YYHPSTEAL

SEQ ID NO: 561293 - protein, 9 aa, Homo Sapiens
VKKKVYSLI

SEQ ID NO: 561294 - protein, 9 aa, Homo Sapiens
YQIIMTMII

SEQ ID NO: 561295 - protein, 9 aa, Homo Sapiens
KVQELRQDN

SEQ ID NO: 561296 - protein, 9 aa, Homo Sapiens
IHKNWVDLA

SEQ ID NO: 561297 - protein, 9 aa, Homo Sapiens
ETGLQGAQL

SEQ ID NO: 561298 - protein, 9 aa, Homo Sapiens
LPSDFSIHG

SEQ ID NO: 561299 - protein, 9 aa, Homo Sapiens
LLNCLKSPV

SEQ ID NO: 561300 - protein, 9 aa, Homo Sapiens
APLAVNVMG

SEQ ID NO: 561301 - protein, 9 aa, Homo Sapiens
PKSLSVAPL

SEQ ID NO: 561302 - protein, 9 aa, Homo Sapiens
QAGTLSPSR

SEQ ID NO: 561303 - protein, 9 aa, Homo Sapiens
AVIEKFARI

SEQ ID NO: 561304 - protein, 9 aa, Homo Sapiens
ALPISFFYE

SEQ ID NO: 561305 - protein, 9 aa, Homo Sapiens
RIKREIEKL

SEQ ID NO: 561306 - protein, 9 aa, Homo Sapiens
RSAVDRDFF

SEQ ID NO: 561307 - protein, 9 aa, Homo Sapiens
GTPQAGTLS

SEQ ID NO: 561308 - protein, 9 aa, Homo Sapiens
RKQKEPREK

SEQ ID NO: 561309 - protein, 9 aa, Homo Sapiens
CYDPVDDYW

SEQ ID NO: 561310 - protein, 9 aa, Homo Sapiens
QIIMTMIIH

SEQ ID NO: 561311 - protein, 9 aa, Homo Sapiens
MVNYMHQQV

SEQ ID NO: 561312 - protein, 9 aa, Homo Sapiens
DPVDDYWMH

SEQ ID NO: 561313 - protein, 9 aa, Homo Sapiens
STFQDFSHI

SEQ ID NO: 561314 - protein, 9 aa, Homo Sapiens
SKSRSQFSS

SEQ ID NO: 561315 - protein, 9 aa, Homo Sapiens
SIADQLNAD

SEQ ID NO: 561316 - protein, 9 aa, Homo Sapiens
VGYCGPREL

SEQ ID NO: 561317 - protein, 9 aa, Homo Sapiens
RDFFRSVFY

SEQ ID NO: 561318 - protein, 9 aa, Homo Sapiens
SAVDRDFFR

SEQ ID NO: 561319 - protein, 9 aa, Homo Sapiens
SRSQFSSRS

SEQ ID NO: 561320 - protein, 9 aa, Homo Sapiens
FQHFVDRIS

SEQ ID NO: 561321 - protein, 9 aa, Homo Sapiens
DSKTQSGEK

SEQ ID NO: 561322 - protein, 9 aa, Homo Sapiens
AKLAGCQDQ

SEQ ID NO: 561323 - protein, 9 aa, Homo Sapiens
SASEREHQA

SEQ ID NO: 561324 - protein, 9 aa, Homo Sapiens
VIEKFARIK

SEQ ID NO: 561325 - protein, 9 aa, Homo Sapiens
GYCGPRELS

SEQ ID NO: 561326 - protein, 9 aa, Homo Sapiens
TQSGEKYTD

SEQ ID NO: 561327 - protein, 9 aa, Homo Sapiens
GSTRLRLHA

SEQ ID NO: 561328 - protein, 9 aa, Homo Sapiens
LSPSRSRDS

SEQ ID NO: 561329 - protein, 9 aa, Homo Sapiens
IYCYDPVDD

SEQ ID NO: 561330 - protein, 9 aa, Homo Sapiens
ADQLNADFA

SEQ ID NO: 561331 - protein, 9 aa, Homo Sapiens
CGPRELSER

SEQ ID NO: 561332 - protein, 9 aa, Homo Sapiens
ECRSLSYSN

SEQ ID NO: 561333 - protein, 9 aa, Homo Sapiens
GIDALPISF

SEQ ID NO: 561334 - protein, 9 aa, Homo Sapiens
VNYSTSGES

SEQ ID NO: 561335 - protein, 9 aa, Homo Sapiens
LERAPGHGS

SEQ ID NO: 561336 - protein, 9 aa, Homo Sapiens
WENTKESAA

SEQ ID NO: 561337 - protein, 9 aa, Homo Sapiens
PPGSVPNPS

SEQ ID NO: 561338 - protein, 9 aa, Homo Sapiens
FVDRISNGG

SEQ ID NO: 561339 - protein, 9 aa, Homo Sapiens
GSVPNPSKS

SEQ ID NO: 561340 - protein, 9 aa, Homo Sapiens
GPSPSASER

SEQ ID NO: 561341 - protein, 9 aa, Homo Sapiens
TNEILQAVQ

SEQ ID NO: 561342 - protein, 9 aa, Homo Sapiens
PFVGYCGPR

SEQ ID NO: 561343 - protein, 9 aa, Homo Sapiens
PVDDYWMHV

SEQ ID NO: 561344 - protein, 9 aa, Homo Sapiens
QFEVRRGEL

SEQ ID NO: 561345 - protein, 9 aa, Homo Sapiens
IHGFLATCQ

SEQ ID NO: 561346 - protein, 9 aa, Homo Sapiens
YCGPRELSE

SEQ ID NO: 561347 - protein, 9 aa, Homo Sapiens
KSLSVAPLA

SEQ ID NO: 561348 - protein, 9 aa, Homo Sapiens
SAATHSSNF

SEQ ID NO: 561349 - protein, 9 aa, Homo Sapiens
VCAPPTAYV

SEQ ID NO: 561350 - protein, 9 aa, Homo Sapiens
SKTQSGEKY

SEQ ID NO: 561351 - protein, 9 aa, Homo Sapiens
YMHQQVCDA

SEQ ID NO: 561352 - protein, 9 aa, Homo Sapiens
EILQAVQKE

SEQ ID NO: 561353 - protein, 9 aa, Homo Sapiens
HGFLATCQD

SEQ ID NO: 561354 - protein, 9 aa, Homo Sapiens
IMTMIIHKN

SEQ ID NO: 561355 - protein, 9 aa, Homo Sapiens
LECRSLSYS

SEQ ID NO: 561356 - protein, 9 aa, Homo Sapiens
KSRSQFSSR

SEQ ID NO: 561357 - protein, 9 aa, Homo Sapiens
DFFRSVFYR

SEQ ID NO: 561358 - protein, 9 aa, Homo Sapiens
DFSIHGFLA

SEQ ID NO: 561359 - protein, 9 aa, Homo Sapiens
TLSPSRSRD

SEQ ID NO: 561360 - protein, 9 aa, Homo Sapiens
ESAATHSSN

SEQ ID NO: 561361 - protein, 9 aa, Homo Sapiens
SAHDKGSPP

SEQ ID NO: 561362 - protein, 9 aa, Homo Sapiens
ADFALIHKE

SEQ ID NO: 561363 - protein, 9 aa, Homo Sapiens
GEDVKGDDN

SEQ ID NO: 561364 - protein, 9 aa, Homo Sapiens
RRGELQGPT

SEQ ID NO: 561365 - protein, 9 aa, Homo Sapiens
ARIKREIEK

SEQ ID NO: 561366 - protein, 9 aa, Homo Sapiens
VRRGELQGP

SEQ ID NO: 561367 - protein, 9 aa, Homo Sapiens
DKGSPPRSA

SEQ ID NO: 561368 - protein, 9 aa, Homo Sapiens
FFYEIISEG

SEQ ID NO: 561369 - protein, 9 aa, Homo Sapiens
MTMIIHKNW

SEQ ID NO: 561370 - protein, 9 aa, Homo Sapiens
IQFEVRRGE

SEQ ID NO: 561371 - protein, 9 aa, Homo Sapiens
VLTLSAHDK

SEQ ID NO: 561372 - protein, 9 aa, Homo Sapiens
LELLNCLKS

SEQ ID NO: 561373 - protein, 9 aa, Homo Sapiens
SQQPFVGYC

SEQ ID NO: 561374 - protein, 9 aa, Homo Sapiens
RYLECRSLS

SEQ ID NO: 561375 - protein, 9 aa, Homo Sapiens
VAPLAVNVM

SEQ ID NO: 561376 - protein, 9 aa, Homo Sapiens
KQKEPREKD

SEQ ID NO: 561377 - protein, 9 aa, Homo Sapiens
QGAQLASFP

SEQ ID NO: 561378 - protein, 9 aa, Homo Sapiens
ENTKESAAT

SEQ ID NO: 561379 - protein, 9 aa, Homo Sapiens
PGHGSTRLR

SEQ ID NO: 561380 - protein, 9 aa, Homo Sapiens
VDRISNGGL

SEQ ID NO: 561381 - protein, 9 aa, Homo Sapiens
VANMFCIVV

SEQ ID NO: 561382 - protein, 9 aa, Homo Sapiens
ITEAKLAGC

SEQ ID NO: 561383 - protein, 9 aa, Homo Sapiens
QQPFVGYCG

SEQ ID NO: 561384 - protein, 9 aa, Homo Sapiens
KESAATHSS

SEQ ID NO: 561385 - protein, 9 aa, Homo Sapiens
SEQTAFYAY

SEQ ID NO: 561386 - protein, 9 aa, Homo Sapiens
RSQFSSRSR

SEQ ID NO: 561387 - protein, 9 aa, Homo Sapiens
PSASEREHQ

SEQ ID NO: 561388 - protein, 9 aa, Homo Sapiens
DNPKESSPF

SEQ ID NO: 561389 - protein, 9 aa, Homo Sapiens
LAGCQDQLQ

SEQ ID NO: 561390 - protein, 9 aa, Homo Sapiens
GAQLASFPD

SEQ ID NO: 561391 - protein, 9 aa, Homo Sapiens
STSGESSFV

SEQ ID NO: 561392 - protein, 9 aa, Homo Sapiens
MNRSAVDRD

SEQ ID NO: 561393 - protein, 9 aa, Homo Sapiens
TPQAGTLSP

SEQ ID NO: 561394 - protein, 9 aa, Homo Sapiens
KKVYSLIGT

SEQ ID NO: 561395 - protein, 9 aa, Homo Sapiens
FSSRSRSRS

SEQ ID NO: 561396 - protein, 9 aa, Homo Sapiens
SGNSERKQK

SEQ ID NO: 561397 - protein, 9 aa, Homo Sapiens
NTKESAATH

SEQ ID NO: 561398 - protein, 9 aa, Homo Sapiens
HGSTRLRLH

SEQ ID NO: 561399 - protein, 9 aa, Homo Sapiens
TKESAATHS

SEQ ID NO: 561400 - protein, 9 aa, Homo Sapiens
IPLPDIEPV

SEQ ID NO: 561401 - protein, 9 aa, Homo Sapiens
AATHSSNFL

SEQ ID NO: 561402 - protein, 9 aa, Homo Sapiens
APPTAYVDF

SEQ ID NO: 561403 - protein, 9 aa, Homo Sapiens
GKMVANMFC

SEQ ID NO: 561404 - protein, 9 aa, Homo Sapiens
TAFYAYYHP

SEQ ID NO: 561405 - protein, 9 aa, Homo Sapiens
AHDKGSPPR

SEQ ID NO: 561406 - protein, 9 aa, Homo Sapiens
GDDNPKESS

SEQ ID NO: 561407 - protein, 9 aa, Homo Sapiens
FRLVKKKVY

SEQ ID NO: 561408 - protein, 9 aa, Homo Sapiens
DVFLLKTQS

SEQ ID NO: 561409 - protein, 9 aa, Homo Sapiens
SEVSICTAD

SEQ ID NO: 561410 - protein, 9 aa, Homo Sapiens
LFLPISHCQ

SEQ ID NO: 561411 - protein, 9 aa, Homo Sapiens
TTIDADDPN

SEQ ID NO: 561412 - protein, 9 aa, Homo Sapiens
DSEYWQVLT

SEQ ID NO: 561413 - protein, 9 aa, Homo Sapiens
ALNKYHYSR

SEQ ID NO: 561414 - protein, 9 aa, Homo Sapiens
NSVLLGEST

SEQ ID NO: 561415 - protein, 9 aa, Homo Sapiens
TIDADDPNA

SEQ ID NO: 561416 - protein, 9 aa, Homo Sapiens
IRLYGRNFS

SEQ ID NO: 561417 - protein, 9 aa, Homo Sapiens
PISHCQCIL

SEQ ID NO: 561418 - protein, 9 aa, Homo Sapiens
SICTADSRD

SEQ ID NO: 561419 - protein, 9 aa, Homo Sapiens
TMGFWLTKL

SEQ ID NO: 561420 - protein, 9 aa, Homo Sapiens
RGGGNQKVG

SEQ ID NO: 561421 - protein, 9 aa, Homo Sapiens
ELLDRPRAE

SEQ ID NO: 561422 - protein, 9 aa, Homo Sapiens
LNLRTSKVG

SEQ ID NO: 561423 - protein, 9 aa, Homo Sapiens
GQNCETDVN

SEQ ID NO: 561424 - protein, 9 aa, Homo Sapiens
QQHQHQHQQ

SEQ ID NO: 561425 - protein, 9 aa, Homo Sapiens
VTTIDADDP

SEQ ID NO: 561426 - protein, 9 aa, Homo Sapiens
WQVLTTVIP

SEQ ID NO: 561427 - protein, 9 aa, Homo Sapiens
PPPPQDLLG

SEQ ID NO: 561428 - protein, 9 aa, Homo Sapiens
MGFWLTKLN

SEQ ID NO: 561429 - protein, 9 aa, Homo Sapiens
RAAASTATE

SEQ ID NO: 561430 - protein, 9 aa, Homo Sapiens
QDLLGRRRW

SEQ ID NO: 561431 - protein, 9 aa, Homo Sapiens
QQQHQHQHQ

SEQ ID NO: 561432 - protein, 9 aa, Homo Sapiens
VRTNELLKV

SEQ ID NO: 561433 - protein, 9 aa, Homo Sapiens
KTCWWSQPY

SEQ ID NO: 561434 - protein, 9 aa, Homo Sapiens
LPISHCQCI

SEQ ID NO: 561435 - protein, 9 aa, Homo Sapiens
TELVGFPAG

SEQ ID NO: 561436 - protein, 9 aa, Homo Sapiens
IVLPARSTN

SEQ ID NO: 561437 - protein, 9 aa, Homo Sapiens
SFDFSPAEL

SEQ ID NO: 561438 - protein, 9 aa, Homo Sapiens
MCDPLVLPS

SEQ ID NO: 561439 - protein, 9 aa, Homo Sapiens
HTMGFWLTK

SEQ ID NO: 561440 - protein, 9 aa, Homo Sapiens
LPARSTNSV

SEQ ID NO: 561441 - protein, 9 aa, Homo Sapiens
AQPPPPQDL

SEQ ID NO: 561442 - protein, 9 aa, Homo Sapiens
ESPWMVVFS

SEQ ID NO: 561443 - protein, 9 aa, Homo Sapiens
REPLGYQDR

SEQ ID NO: 561444 - protein, 9 aa, Homo Sapiens
CHLSMLTDS

SEQ ID NO: 561445 - protein, 9 aa, Homo Sapiens
HCELPKLEK

SEQ ID NO: 561446 - protein, 9 aa, Homo Sapiens
EKKHFGLES

SEQ ID NO: 561447 - protein, 9 aa, Homo Sapiens
LSYADGDDC

SEQ ID NO: 561448 - protein, 9 aa, Homo Sapiens
SPAELPRTS

SEQ ID NO: 561449 - protein, 9 aa, Homo Sapiens
LTDSLFLPI

SEQ ID NO: 561450 - protein, 9 aa, Homo Sapiens
RSPTQRCRL

SEQ ID NO: 561451 - protein, 9 aa, Homo Sapiens
CIWHSFDFS

SEQ ID NO: 561452 - protein, 9 aa, Homo Sapiens
HSFDFSPAE

SEQ ID NO: 561453 - protein, 9 aa, Homo Sapiens
MQGHTMGFW

SEQ ID NO: 561454 - protein, 9 aa, Homo Sapiens
MAEDVNREE

SEQ ID NO: 561455 - protein, 9 aa, Homo Sapiens
FIVVAGHDG

SEQ ID NO: 561456 - protein, 9 aa, Homo Sapiens
SPWMVVFSL

SEQ ID NO: 561457 - protein, 9 aa, Homo Sapiens
KIALHTWIR

SEQ ID NO: 561458 - protein, 9 aa, Homo Sapiens
LGRACGISR

SEQ ID NO: 561459 - protein, 9 aa, Homo Sapiens
FFIVVAGHD

SEQ ID NO: 561460 - protein, 9 aa, Homo Sapiens
VERVQPFYD

SEQ ID NO: 561461 - protein, 9 aa, Homo Sapiens
AGGMTPTAF

SEQ ID NO: 561462 - protein, 9 aa, Homo Sapiens
SEYWQVLTT

SEQ ID NO: 561463 - protein, 9 aa, Homo Sapiens
GHDGVLVGR

SEQ ID NO: 561464 - protein, 9 aa, Homo Sapiens
QALGRACGI

SEQ ID NO: 561465 - protein, 9 aa, Homo Sapiens
HITAKIALH

SEQ ID NO: 561466 - protein, 9 aa, Homo Sapiens
WWSQPYFRA

SEQ ID NO: 561467 - protein, 9 aa, Homo Sapiens
GNIQLSYAD

SEQ ID NO: 561468 - protein, 9 aa, Homo Sapiens
KGNIQLSYA

SEQ ID NO: 561469 - protein, 9 aa, Homo Sapiens
NYLCHLSML

SEQ ID NO: 561470 - protein, 9 aa, Homo Sapiens
GRACGISRP

SEQ ID NO: 561471 - protein, 9 aa, Homo Sapiens
RLYGRNFSK

SEQ ID NO: 561472 - protein, 9 aa, Homo Sapiens
HFGLESPWM

SEQ ID NO: 561473 - protein, 9 aa, Homo Sapiens
EALNKYHYS

SEQ ID NO: 561474 - protein, 9 aa, Homo Sapiens
ATEVTFGSS

SEQ ID NO: 561475 - protein, 9 aa, Homo Sapiens
HTWIRPVEM

SEQ ID NO: 561476 - protein, 9 aa, Homo Sapiens
ELPRTSHIT

SEQ ID NO: 561477 - protein, 9 aa, Homo Sapiens
FLPISHCQC

SEQ ID NO: 561478 - protein, 9 aa, Homo Sapiens
AAASTATEV

SEQ ID NO: 561479 - protein, 9 aa, Homo Sapiens
MMALVLLSF

SEQ ID NO: 561480 - protein, 9 aa, Homo Sapiens
LHTWIRPVE

SEQ ID NO: 561481 - protein, 9 aa, Homo Sapiens
RNFSKEDHV

SEQ ID NO: 561482 - protein, 9 aa, Homo Sapiens
LESPWMVVF

SEQ ID NO: 561483 - protein, 9 aa, Homo Sapiens
PTAFSSQHT

SEQ ID NO: 561484 - protein, 9 aa, Homo Sapiens
SGGVLRGGG

SEQ ID NO: 561485 - protein, 9 aa, Homo Sapiens
EVSICTADS

SEQ ID NO: 561486 - protein, 9 aa, Homo Sapiens
NSNDVFLLK

SEQ ID NO: 561487 - protein, 9 aa, Homo Sapiens
SKVGNFDIG

SEQ ID NO: 561488 - protein, 9 aa, Homo Sapiens
SHITAKIAL

SEQ ID NO: 561489 - protein, 9 aa, Homo Sapiens
QPYFRAIGD

SEQ ID NO: 561490 - protein, 9 aa, Homo Sapiens
ANMFYIVVM

SEQ ID NO: 561491 - protein, 9 aa, Homo Sapiens
MVVFSLATA

SEQ ID NO: 561492 - protein, 9 aa, Homo Sapiens
DALKEFVDL

SEQ ID NO: 561493 - protein, 9 aa, Homo Sapiens
NMFYIVVMM

SEQ ID NO: 561494 - protein, 9 aa, Homo Sapiens
YWQVLTTVI

SEQ ID NO: 561495 - protein, 9 aa, Homo Sapiens
QQKHDLLTE

SEQ ID NO: 561496 - protein, 9 aa, Homo Sapiens
LSMLTDSLF

SEQ ID NO: 561497 - protein, 9 aa, Homo Sapiens
NKYHYSRRR

SEQ ID NO: 561498 - protein, 9 aa, Homo Sapiens
SAEKKHFGL

SEQ ID NO: 561499 - protein, 9 aa, Homo Sapiens
PFYDALKEF

SEQ ID NO: 561500 - protein, 9 aa, Homo Sapiens
GGVLRGGGN

SEQ ID NO: 561501 - protein, 9 aa, Homo Sapiens
VSICTADSR

SEQ ID NO: 561502 - protein, 9 aa, Homo Sapiens
QDRAGAAAP

SEQ ID NO: 561503 - protein, 9 aa, Homo Sapiens
GGMTPTAFS

SEQ ID NO: 561504 - protein, 9 aa, Homo Sapiens
YLCHLSMLT

SEQ ID NO: 561505 - protein, 9 aa, Homo Sapiens
WLSEVSICT

SEQ ID NO: 561506 - protein, 9 aa, Homo Sapiens
VAGHDGVLV

SEQ ID NO: 561507 - protein, 9 aa, Homo Sapiens
VVFSLATAI

SEQ ID NO: 561508 - protein, 9 aa, Homo Sapiens
TSLNLRTSK

SEQ ID NO: 561509 - protein, 9 aa, Homo Sapiens
ISRPVIACS

SEQ ID NO: 561510 - protein, 9 aa, Homo Sapiens
CSSHEIQHI

SEQ ID NO: 561511 - protein, 9 aa, Homo Sapiens
PRTSHITAK

SEQ ID NO: 561512 - protein, 9 aa, Homo Sapiens
QLQSLGVEE

SEQ ID NO: 561513 - protein, 9 aa, Homo Sapiens
QPFYDALKE

SEQ ID NO: 561514 - protein, 9 aa, Homo Sapiens
NCETDVNEC

SEQ ID NO: 561515 - protein, 9 aa, Homo Sapiens
EPLGYQDRA

SEQ ID NO: 561516 - protein, 9 aa, Homo Sapiens
KDSEYWQVL

SEQ ID NO: 561517 - protein, 9 aa, Homo Sapiens
TYIRLYGRN

SEQ ID NO: 561518 - protein, 9 aa, Homo Sapiens
DLHCELPKL

SEQ ID NO: 561519 - protein, 9 aa, Homo Sapiens
AASTATEVT

SEQ ID NO: 561520 - protein, 9 aa, Homo Sapiens
AEKKHFGLE

SEQ ID NO: 561521 - protein, 9 aa, Homo Sapiens
HIFCDTPPV

SEQ ID NO: 561522 - protein, 9 aa, Homo Sapiens
PARSTNSVL

SEQ ID NO: 561523 - protein, 9 aa, Homo Sapiens
DLLGRRRWL

SEQ ID NO: 561524 - protein, 9 aa, Homo Sapiens
RPRAERAII

SEQ ID NO: 561525 - protein, 9 aa, Homo Sapiens
GVLVGRTQR

SEQ ID NO: 561526 - protein, 9 aa, Homo Sapiens
AELPRTSHI

SEQ ID NO: 561527 - protein, 9 aa, Homo Sapiens
NLRTSKVGN

SEQ ID NO: 561528 - protein, 9 aa, Homo Sapiens
QNCETDVNE

SEQ ID NO: 561529 - protein, 9 aa, Homo Sapiens
SSEMQGHTM

SEQ ID NO: 561530 - protein, 9 aa, Homo Sapiens
WHSFDFSPA

SEQ ID NO: 561531 - protein, 9 aa, Homo Sapiens
WLNFAASRS

SEQ ID NO: 561532 - protein, 9 aa, Homo Sapiens
QGAVRTNEL

SEQ ID NO: 561533 - protein, 9 aa, Homo Sapiens
ICTADSRDP

SEQ ID NO: 561534 - protein, 9 aa, Homo Sapiens
KLNYLCHLS

SEQ ID NO: 561535 - protein, 9 aa, Homo Sapiens
LMCIWHSFD

SEQ ID NO: 561536 - protein, 9 aa, Homo Sapiens
FGSSEMQGH

SEQ ID NO: 561537 - protein, 9 aa, Homo Sapiens
ALHTWIRPV

SEQ ID NO: 561538 - protein, 9 aa, Homo Sapiens
QPPPPQDLL

SEQ ID NO: 561539 - protein, 9 aa, Homo Sapiens
CRLARAAAS

SEQ ID NO: 561540 - protein, 9 aa, Homo Sapiens
GAAAPPRHQ

SEQ ID NO: 561541 - protein, 9 aa, Homo Sapiens
LTRMAEDVN

SEQ ID NO: 561542 - protein, 9 aa, Homo Sapiens
LTKLNYLCH

SEQ ID NO: 561543 - protein, 9 aa, Homo Sapiens
LLKTQSCCY

SEQ ID NO: 561544 - protein, 9 aa, Homo Sapiens
GGNQKVGAI

SEQ ID NO: 561545 - protein, 9 aa, Homo Sapiens
CWWSQPYFR

SEQ ID NO: 561546 - protein, 9 aa, Homo Sapiens
TGFTGQNCE

SEQ ID NO: 561547 - protein, 9 aa, Homo Sapiens
FYDALKEFV

SEQ ID NO: 561548 - protein, 9 aa, Homo Sapiens
GTYVMTVTT

SEQ ID NO: 561549 - protein, 9 aa, Homo Sapiens
SYQGCMARI

SEQ ID NO: 561550 - protein, 9 aa, Homo Sapiens
VMTVTTIDA

SEQ ID NO: 561551 - protein, 9 aa, Homo Sapiens
IPLTELVGF

SEQ ID NO: 561552 - protein, 9 aa, Homo Sapiens
LYGRNFSKE

SEQ ID NO: 561553 - protein, 9 aa, Homo Sapiens
NFLKMSLMC

SEQ ID NO: 561554 - protein, 9 aa, Homo Sapiens
DNADLHCEL

SEQ ID NO: 561555 - protein, 9 aa, Homo Sapiens
LARAAASTA

SEQ ID NO: 561556 - protein, 9 aa, Homo Sapiens
LCHLSMLTD

SEQ ID NO: 561557 - protein, 9 aa, Homo Sapiens
AFSSQHTAG

SEQ ID NO: 561558 - protein, 9 aa, Homo Sapiens
GAVRTNELL

SEQ ID NO: 561559 - protein, 9 aa, Homo Sapiens
EYWQVLTTV

SEQ ID NO: 561560 - protein, 9 aa, Homo Sapiens
YIVVMMALV

SEQ ID NO: 561561 - protein, 9 aa, Homo Sapiens
VLVGRTQRE

SEQ ID NO: 561562 - protein, 9 aa, Homo Sapiens
FLLKTQSCC

SEQ ID NO: 561563 - protein, 9 aa, Homo Sapiens
RTQREPLGY

SEQ ID NO: 561564 - protein, 9 aa, Homo Sapiens
PFQRQGGHQ

SEQ ID NO: 561565 - protein, 9 aa, Homo Sapiens
RTSKVGNFD

SEQ ID NO: 561566 - protein, 9 aa, Homo Sapiens
FYIVVMMAL

SEQ ID NO: 561567 - protein, 9 aa, Homo Sapiens
QKHDLLTEP

SEQ ID NO: 561568 - protein, 9 aa, Homo Sapiens
IVVMMALVL

SEQ ID NO: 561569 - protein, 9 aa, Homo Sapiens
VLTTVIPSS

SEQ ID NO: 561570 - protein, 9 aa, Homo Sapiens
LNELHEALN

SEQ ID NO: 561571 - protein, 9 aa, Homo Sapiens
MSTLMCDPL

SEQ ID NO: 561572 - protein, 9 aa, Homo Sapiens
ERVQPFYDA

SEQ ID NO: 561573 - protein, 9 aa, Homo Sapiens
IALHTWIRP

SEQ ID NO: 561574 - protein, 9 aa, Homo Sapiens
FSPAELPRT

SEQ ID NO: 561575 - protein, 9 aa, Homo Sapiens
STNSVLLGE

SEQ ID NO: 561576 - protein, 9 aa, Homo Sapiens
LQSLGVEEA

SEQ ID NO: 561577 - protein, 9 aa, Homo Sapiens
LVRDNADLH

SEQ ID NO: 561578 - protein, 9 aa, Homo Sapiens
PVWLNFAAS

SEQ ID NO: 561579 - protein, 9 aa, Homo Sapiens
LGVEEAERG

SEQ ID NO: 561580 - protein, 9 aa, Homo Sapiens
IQLSYADGD

SEQ ID NO: 561581 - protein, 9 aa, Homo Sapiens
PWMVVFSLA

SEQ ID NO: 561582 - protein, 9 aa, Homo Sapiens
ARAAASTAT

SEQ ID NO: 561583 - protein, 9 aa, Homo Sapiens
LFEVQWQLA

SEQ ID NO: 561584 - protein, 9 aa, Homo Sapiens
GCMARIFFF

SEQ ID NO: 561585 - protein, 9 aa, Homo Sapiens
NMPGIPLTE

SEQ ID NO: 561586 - protein, 9 aa, Homo Sapiens
FDFSPAELP

SEQ ID NO: 561587 - protein, 9 aa, Homo Sapiens
ITAKIALHT

SEQ ID NO: 561588 - protein, 9 aa, Homo Sapiens
GVEEAERGL

SEQ ID NO: 561589 - protein, 9 aa, Homo Sapiens
TSKVGNFDI

SEQ ID NO: 561590 - protein, 9 aa, Homo Sapiens
TYVMTVTTI

SEQ ID NO: 561591 - protein, 9 aa, Homo Sapiens
ISYQGCMAR

SEQ ID NO: 561592 - protein, 9 aa, Homo Sapiens
SKDSEYWQV

SEQ ID NO: 561593 - protein, 9 aa, Homo Sapiens
WLTKLNYLC

SEQ ID NO: 561594 - protein, 9 aa, Homo Sapiens
SPTQRCRLA

SEQ ID NO: 561595 - protein, 9 aa, Homo Sapiens
AEDVNREER

SEQ ID NO: 561596 - protein, 9 aa, Homo Sapiens
FTGQNCETD

SEQ ID NO: 561597 - protein, 9 aa, Homo Sapiens
MTVTTIDAD

SEQ ID NO: 561598 - protein, 9 aa, Homo Sapiens
ASTATEVTF

SEQ ID NO: 561599 - protein, 9 aa, Homo Sapiens
MTPTAFSSQ

SEQ ID NO: 561600 - protein, 9 aa, Homo Sapiens
PPQDLLGRR

SEQ ID NO: 561601 - protein, 9 aa, Homo Sapiens
TATEVTFGS

SEQ ID NO: 561602 - protein, 9 aa, Homo Sapiens
MLTDSLFLP

SEQ ID NO: 561603 - protein, 9 aa, Homo Sapiens
KATSLEKQQ

SEQ ID NO: 561604 - protein, 9 aa, Homo Sapiens
DSSAEKKHF

SEQ ID NO: 561605 - protein, 9 aa, Homo Sapiens
WSQPYFRAI

SEQ ID NO: 561606 - protein, 9 aa, Homo Sapiens
ADGDDCGHG

SEQ ID NO: 561607 - protein, 9 aa, Homo Sapiens
LPVWLNFAA

SEQ ID NO: 561608 - protein, 9 aa, Homo Sapiens
QDPFQRQGG

SEQ ID NO: 561609 - protein, 9 aa, Homo Sapiens
SLATAILNF

SEQ ID NO: 561610 - protein, 9 aa, Homo Sapiens
GRNFSKEDH

SEQ ID NO: 561611 - protein, 9 aa, Homo Sapiens
TEVTFGSSE

SEQ ID NO: 561612 - protein, 9 aa, Homo Sapiens
LLKVALRSL

SEQ ID NO: 561613 - protein, 9 aa, Homo Sapiens
DPLVLPSSR

SEQ ID NO: 561614 - protein, 9 aa, Homo Sapiens
YQDRAGAAA

SEQ ID NO: 561615 - protein, 9 aa, Homo Sapiens
LGYQDRAGA

SEQ ID NO: 561616 - protein, 9 aa, Homo Sapiens
FLNSNDVFL

SEQ ID NO: 561617 - protein, 9 aa, Homo Sapiens
QSLGVEEAE

SEQ ID NO: 561618 - protein, 9 aa, Homo Sapiens
GFWLTKLNY

SEQ ID NO: 561619 - protein, 9 aa, Homo Sapiens
LMCDPLVLP

SEQ ID NO: 561620 - protein, 9 aa, Homo Sapiens
LVLPSSRVT

SEQ ID NO: 561621 - protein, 9 aa, Homo Sapiens
NIQLSYADG

SEQ ID NO: 561622 - protein, 9 aa, Homo Sapiens
IWHSFDFSP

SEQ ID NO: 561623 - protein, 9 aa, Homo Sapiens
AAPPRHQPR

SEQ ID NO: 561624 - protein, 9 aa, Homo Sapiens
MPGIPLTEL

SEQ ID NO: 561625 - protein, 9 aa, Homo Sapiens
DVNREERIE

SEQ ID NO: 561626 - protein, 9 aa, Homo Sapiens
GSLFEVQWQ

SEQ ID NO: 561627 - protein, 9 aa, Homo Sapiens
MARIFFFHL

SEQ ID NO: 561628 - protein, 9 aa, Homo Sapiens
YGRNFSKED

SEQ ID NO: 561629 - protein, 9 aa, Homo Sapiens
RTSHITAKI

SEQ ID NO: 561630 - protein, 9 aa, Homo Sapiens
HDGVLVGRT

SEQ ID NO: 561631 - protein, 9 aa, Homo Sapiens
AASRSPTQR

SEQ ID NO: 561632 - protein, 9 aa, Homo Sapiens
DFFIVVAGH

SEQ ID NO: 561633 - protein, 9 aa, Homo Sapiens
GGHQVLEAY

SEQ ID NO: 561634 - protein, 9 aa, Homo Sapiens
RACGISRPV

SEQ ID NO: 561635 - protein, 9 aa, Homo Sapiens
ACGISRPVI

SEQ ID NO: 561636 - protein, 9 aa, Homo Sapiens
LTGFTGQNC

SEQ ID NO: 561637 - protein, 9 aa, Homo Sapiens
GQDPFQRQG

SEQ ID NO: 561638 - protein, 9 aa, Homo Sapiens
YADGDDCGH

SEQ ID NO: 561639 - protein, 9 aa, Homo Sapiens
ATAILNFLK

SEQ ID NO: 561640 - protein, 9 aa, Homo Sapiens
RVQPFYDAL

SEQ ID NO: 561641 - protein, 9 aa, Homo Sapiens
TAKIALHTW

SEQ ID NO: 561642 - protein, 9 aa, Homo Sapiens
YFRAIGDFL

SEQ ID NO: 561643 - protein, 9 aa, Homo Sapiens
SRSPTQRCR

SEQ ID NO: 561644 - protein, 9 aa, Homo Sapiens
FGLESPWMV

SEQ ID NO: 561645 - protein, 9 aa, Homo Sapiens
HEIQHIFCD

SEQ ID NO: 561646 - protein, 9 aa, Homo Sapiens
GMTPTAFSS

SEQ ID NO: 561647 - protein, 9 aa, Homo Sapiens
EKQQKHDLL

SEQ ID NO: 561648 - protein, 9 aa, Homo Sapiens
LKMSLMCIW

SEQ ID NO: 561649 - protein, 9 aa, Homo Sapiens
VFLLKTQSC

SEQ ID NO: 561650 - protein, 9 aa, Homo Sapiens
PLTELVGFP

SEQ ID NO: 561651 - protein, 9 aa, Homo Sapiens
PLGYQDRAG

SEQ ID NO: 561652 - protein, 9 aa, Homo Sapiens
FWLTKLNYL

SEQ ID NO: 561653 - protein, 9 aa, Homo Sapiens
VQPFYDALK

SEQ ID NO: 561654 - protein, 9 aa, Homo Sapiens
LHCELPKLE

SEQ ID NO: 561655 - protein, 9 aa, Homo Sapiens
SSWLSEVSI

SEQ ID NO: 561656 - protein, 9 aa, Homo Sapiens
AAAPPRHQP

SEQ ID NO: 561657 - protein, 9 aa, Homo Sapiens
QGHTMGFWL

SEQ ID NO: 561658 - protein, 9 aa, Homo Sapiens
TFGSSEMQG

SEQ ID NO: 561659 - protein, 9 aa, Homo Sapiens
QRCRLARAA

SEQ ID NO: 561660 - protein, 9 aa, Homo Sapiens
ELLKVALRS

SEQ ID NO: 561661 - protein, 9 aa, Homo Sapiens
DSLFLPISH

SEQ ID NO: 561662 - protein, 9 aa, Homo Sapiens
RAGAAAPPR

SEQ ID NO: 561663 - protein, 9 aa, Homo Sapiens
PTQRCRLAR

SEQ ID NO: 561664 - protein, 9 aa, Homo Sapiens
GLESPWMVV

SEQ ID NO: 561665 - protein, 9 aa, Homo Sapiens
HQHQHQQQQ

SEQ ID NO: 561666 - protein, 9 aa, Homo Sapiens
TNSVLLGES

SEQ ID NO: 561667 - protein, 9 aa, Homo Sapiens
VLPVWLNFA

SEQ ID NO: 561668 - protein, 9 aa, Homo Sapiens
VQWQLAQLE

SEQ ID NO: 561669 - protein, 9 aa, Homo Sapiens
TSHITAKIA

SEQ ID NO: 561670 - protein, 9 aa, Homo Sapiens
APPRHQPRA

SEQ ID NO: 561671 - protein, 9 aa, Homo Sapiens
PGIPLTELV

SEQ ID NO: 561672 - protein, 9 aa, Homo Sapiens
PAELPRTSH

SEQ ID NO: 561673 - protein, 9 aa, Homo Sapiens
GIPLTELVG

SEQ ID NO: 561674 - protein, 9 aa, Homo Sapiens
EMQGHTMGF

SEQ ID NO: 561675 - protein, 9 aa, Homo Sapiens
IQHIFCDTP

SEQ ID NO: 561676 - protein, 9 aa, Homo Sapiens
AILNFLKMS

SEQ ID NO: 561677 - protein, 9 aa, Homo Sapiens
NFAASRSPT

SEQ ID NO: 561678 - protein, 9 aa, Homo Sapiens
NELLKVALR

SEQ ID NO: 561679 - protein, 9 aa, Homo Sapiens
FSLATAILN

SEQ ID NO: 561680 - protein, 9 aa, Homo Sapiens
MCIWHSFDF

SEQ ID NO: 561681 - protein, 9 aa, Homo Sapiens
NFSKEDHVL

SEQ ID NO: 561682 - protein, 9 aa, Homo Sapiens
AKIALHTWI

SEQ ID NO: 561683 - protein, 9 aa, Homo Sapiens
VLRGGGNQK

SEQ ID NO: 561684 - protein, 9 aa, Homo Sapiens
GISRPVIAC

SEQ ID NO: 561685 - protein, 9 aa, Homo Sapiens
RMAEDVNRE

SEQ ID NO: 561686 - protein, 9 aa, Homo Sapiens
YQGCMARIF

SEQ ID NO: 561687 - protein, 9 aa, Homo Sapiens
LNFLKMSLM

SEQ ID NO: 561688 - protein, 9 aa, Homo Sapiens
QRQGGHQVL

SEQ ID NO: 561689 - protein, 9 aa, Homo Sapiens
TPTAFSSQH

SEQ ID NO: 561690 - protein, 9 aa, Homo Sapiens
GSSEMQGHT

SEQ ID NO: 561691 - protein, 9 aa, Homo Sapiens
SHEIQHIFC

SEQ ID NO: 561692 - protein, 9 aa, Homo Sapiens
NELHEALNK

SEQ ID NO: 561693 - protein, 9 aa, Homo Sapiens
DPFQRQGGH

SEQ ID NO: 561694 - protein, 9 aa, Homo Sapiens
VGRTQREPL

SEQ ID NO: 561695 - protein, 9 aa, Homo Sapiens
KMSLMCIWH

SEQ ID NO: 561696 - protein, 9 aa, Homo Sapiens
VEEAERGLS

SEQ ID NO: 561697 - protein, 9 aa, Homo Sapiens
IFCDTPPVL

SEQ ID NO: 561698 - protein, 9 aa, Homo Sapiens
RLARAAAST

SEQ ID NO: 561699 - protein, 9 aa, Homo Sapiens
VVMMALVLL

SEQ ID NO: 561700 - protein, 9 aa, Homo Sapiens
QLSYADGDD

SEQ ID NO: 561701 - protein, 9 aa, Homo Sapiens
QWQLAQLEA

SEQ ID NO: 561702 - protein, 9 aa, Homo Sapiens
SYADGDDCG

SEQ ID NO: 561703 - protein, 9 aa, Homo Sapiens
IVVAGHDGV

SEQ ID NO: 561704 - protein, 9 aa, Homo Sapiens
GFTGQNCET

SEQ ID NO: 561705 - protein, 9 aa, Homo Sapiens
LATAILNFL

SEQ ID NO: 561706 - protein, 9 aa, Homo Sapiens
TNELLKVAL

SEQ ID NO: 561707 - protein, 9 aa, Homo Sapiens
MSLMCIWHS

SEQ ID NO: 561708 - protein, 9 aa, Homo Sapiens
WQLAQLEAR

SEQ ID NO: 561709 - protein, 9 aa, Homo Sapiens
TDSLFLPIS

SEQ ID NO: 561710 - protein, 9 aa, Homo Sapiens
VFSLATAIL

SEQ ID NO: 561711 - protein, 9 aa, Homo Sapiens
CDPLVLPSS

SEQ ID NO: 561712 - protein, 9 aa, Homo Sapiens
SNDVFLLKT

SEQ ID NO: 561713 - protein, 9 aa, Homo Sapiens
SSAEKKHFG

SEQ ID NO: 561714 - protein, 9 aa, Homo Sapiens
ARSTNSVLL

SEQ ID NO: 561715 - protein, 9 aa, Homo Sapiens
RAERAIIHV

SEQ ID NO: 561716 - protein, 9 aa, Homo Sapiens
ELHEALNKY

SEQ ID NO: 561717 - protein, 9 aa, Homo Sapiens
TQREPLGYQ

SEQ ID NO: 561718 - protein, 9 aa, Homo Sapiens
TAILNFLKM

SEQ ID NO: 561719 - protein, 9 aa, Homo Sapiens
SLGVEEAER

SEQ ID NO: 561720 - protein, 9 aa, Homo Sapiens
EDVNREERI

SEQ ID NO: 561721 - protein, 9 aa, Homo Sapiens
RQGGHQVLE

SEQ ID NO: 561722 - protein, 9 aa, Homo Sapiens
QVQLQSLGV

SEQ ID NO: 561723 - protein, 9 aa, Homo Sapiens
KHFGLESPW

SEQ ID NO: 561724 - protein, 9 aa, Homo Sapiens
DRPRAERAI

SEQ ID NO: 561725 - protein, 9 aa, Homo Sapiens
SLNLRTSKV

SEQ ID NO: 561726 - protein, 9 aa, Homo Sapiens
AGAAAPPRH

SEQ ID NO: 561727 - protein, 9 aa, Homo Sapiens
YIRLYGRNF

SEQ ID NO: 561728 - protein, 9 aa, Homo Sapiens
SLEKQQKHD

SEQ ID NO: 561729 - protein, 9 aa, Homo Sapiens
EIQHIFCDT

SEQ ID NO: 561730 - protein, 9 aa, Homo Sapiens
QQQQHQHQH

SEQ ID NO: 561731 - protein, 9 aa, Homo Sapiens
ALGRACGIS

SEQ ID NO: 561732 - protein, 9 aa, Homo Sapiens
LLGRRRWLS

SEQ ID NO: 561733 - protein, 9 aa, Homo Sapiens
ASRSPTQRC

SEQ ID NO: 561734 - protein, 9 aa, Homo Sapiens
RSTNSVLLG

SEQ ID NO: 561735 - protein, 9 aa, Homo Sapiens
TSLEKQQKH

SEQ ID NO: 561736 - protein, 9 aa, Homo Sapiens
VRDNADLHC

SEQ ID NO: 561737 - protein, 9 aa, Homo Sapiens
HLSMLTDSL

SEQ ID NO: 561738 - protein, 9 aa, Homo Sapiens
FAASRSPTQ

SEQ ID NO: 561739 - protein, 9 aa, Homo Sapiens
QGGHQVLEA

SEQ ID NO: 561740 - protein, 9 aa, Homo Sapiens
QREPLGYQD

SEQ ID NO: 561741 - protein, 9 aa, Homo Sapiens
TSGGVLRGG

SEQ ID NO: 561742 - protein, 9 aa, Homo Sapiens
GYQDRAGAA

SEQ ID NO: 561743 - protein, 9 aa, Homo Sapiens
GVLRGGGNQ

SEQ ID NO: 561744 - protein, 9 aa, Homo Sapiens
LPRTSHITA

SEQ ID NO: 561745 - protein, 9 aa, Homo Sapiens
GRTQREPLG

SEQ ID NO: 561746 - protein, 9 aa, Homo Sapiens
EVTFGSSEM

SEQ ID NO: 561747 - protein, 9 aa, Homo Sapiens
KQQKHDLLT

SEQ ID NO: 561748 - protein, 9 aa, Homo Sapiens
LVGRTQREP

SEQ ID NO: 561749 - protein, 9 aa, Homo Sapiens
DFSPAELPR

SEQ ID NO: 561750 - protein, 9 aa, Homo Sapiens
TRMAEDVNR

SEQ ID NO: 561751 - protein, 9 aa, Homo Sapiens
PPPQDLLGR

SEQ ID NO: 561752 - protein, 9 aa, Homo Sapiens
FEVQWQLAQ

SEQ ID NO: 561753 - protein, 9 aa, Homo Sapiens
YVMTVTTID

SEQ ID NO: 561754 - protein, 9 aa, Homo Sapiens
VTFGSSEMQ

SEQ ID NO: 561755 - protein, 9 aa, Homo Sapiens
ELVGFPAGF

SEQ ID NO: 561756 - protein, 9 aa, Homo Sapiens
FLKMSLMCI

SEQ ID NO: 561757 - protein, 9 aa, Homo Sapiens
CLTGFTGQN

SEQ ID NO: 561758 - protein, 9 aa, Homo Sapiens
QVLTTVIPS

SEQ ID NO: 561759 - protein, 9 aa, Homo Sapiens
WMVVFSLAT

SEQ ID NO: 561760 - protein, 9 aa, Homo Sapiens
VLPARSTNS

SEQ ID NO: 561761 - protein, 9 aa, Homo Sapiens
LDRPRAERA

SEQ ID NO: 561762 - protein, 9 aa, Homo Sapiens
EGSLFEVQW

SEQ ID NO: 561763 - protein, 9 aa, Homo Sapiens
KKHFGLESP

SEQ ID NO: 561764 - protein, 9 aa, Homo Sapiens
YDALKEFVD

SEQ ID NO: 561765 - protein, 9 aa, Homo Sapiens
LSEVSICTA

SEQ ID NO: 561766 - protein, 9 aa, Homo Sapiens
ADLHCELPK

SEQ ID NO: 561767 - protein, 9 aa, Homo Sapiens
RDNADLHCE

SEQ ID NO: 561768 - protein, 9 aa, Homo Sapiens
MFYIVVMMA

SEQ ID NO: 561769 - protein, 9 aa, Homo Sapiens
TQRCRLARA

SEQ ID NO: 561770 - protein, 9 aa, Homo Sapiens
PLVLPSSRV

SEQ ID NO: 561771 - protein, 9 aa, Homo Sapiens
LNKYHYSRR

SEQ ID NO: 561772 - protein, 9 aa, Homo Sapiens
LNFAASRSP

SEQ ID NO: 561773 - protein, 9 aa, Homo Sapiens
RTNELLKVA

SEQ ID NO: 561774 - protein, 9 aa, Homo Sapiens
HEALNKYHY

SEQ ID NO: 561775 - protein, 9 aa, Homo Sapiens
SWLSEVSIC

SEQ ID NO: 561776 - protein, 9 aa, Homo Sapiens
GGGNQKVGA

SEQ ID NO: 561777 - protein, 9 aa, Homo Sapiens
SSHEIQHIF

SEQ ID NO: 561778 - protein, 9 aa, Homo Sapiens
CGISRPVIA

SEQ ID NO: 561779 - protein, 9 aa, Homo Sapiens
DGVLVGRTQ

SEQ ID NO: 561780 - protein, 9 aa, Homo Sapiens
RIFFFHLLG

SEQ ID NO: 561781 - protein, 9 aa, Homo Sapiens
LNYLCHLSM

SEQ ID NO: 561782 - protein, 9 aa, Homo Sapiens
PRAERAIIH

SEQ ID NO: 561783 - protein, 9 aa, Homo Sapiens
SMLTDSLFL

SEQ ID NO: 561784 - protein, 9 aa, Homo Sapiens
TLMCDPLVL

SEQ ID NO: 561785 - protein, 9 aa, Homo Sapiens
SLFEVQWQL

SEQ ID NO: 561786 - protein, 9 aa, Homo Sapiens
SEMQGHTMG

SEQ ID NO: 561787 - protein, 9 aa, Homo Sapiens
LHEALNKYH

SEQ ID NO: 561788 - protein, 9 aa, Homo Sapiens
PQDLLGRRR

SEQ ID NO: 561789 - protein, 9 aa, Homo Sapiens
LEKQQKHDL

SEQ ID NO: 561790 - protein, 9 aa, Homo Sapiens
QGCMARIFF

SEQ ID NO: 561791 - protein, 9 aa, Homo Sapiens
ARIFFFHLL

SEQ ID NO: 561792 - protein, 9 aa, Homo Sapiens
VMMALVLLS

SEQ ID NO: 561793 - protein, 9 aa, Homo Sapiens
TKLNYLCHL

SEQ ID NO: 561794 - protein, 9 aa, Homo Sapiens
NADLHCELP

SEQ ID NO: 561795 - protein, 9 aa, Homo Sapiens
TGQNCETDV

SEQ ID NO: 561796 - protein, 9 aa, Homo Sapiens
ILNFLKMSL

SEQ ID NO: 561797 - protein, 9 aa, Homo Sapiens
LRGGGNQKV

SEQ ID NO: 561798 - protein, 9 aa, Homo Sapiens
SLFLPISHC

SEQ ID NO: 561799 - protein, 9 aa, Homo Sapiens
AELLDRPRA

SEQ ID NO: 561800 - protein, 9 aa, Homo Sapiens
LRTSKVGNF

SEQ ID NO: 561801 - protein, 9 aa, Homo Sapiens
TCWWSQPYF

SEQ ID NO: 561802 - protein, 9 aa, Homo Sapiens
DRAGAAAPP

SEQ ID NO: 561803 - protein, 9 aa, Homo Sapiens
CMARIFFFH

SEQ ID NO: 561804 - protein, 9 aa, Homo Sapiens
ATSLEKQQK

SEQ ID NO: 561805 - protein, 9 aa, Homo Sapiens
STATEVTFG

SEQ ID NO: 561806 - protein, 9 aa, Homo Sapiens
SQPYFRAIG

SEQ ID NO: 561807 - protein, 9 aa, Homo Sapiens
VWLNFAASR

SEQ ID NO: 561808 - protein, 9 aa, Homo Sapiens
TAFSSQHTA

SEQ ID NO: 561809 - protein, 9 aa, Homo Sapiens
PYFRAIGDF

SEQ ID NO: 561810 - protein, 9 aa, Homo Sapiens
GHTMGFWLT

SEQ ID NO: 561811 - protein, 9 aa, Homo Sapiens
RCRLARAAA

SEQ ID NO: 561812 - protein, 9 aa, Homo Sapiens
LLDRPRAER

SEQ ID NO: 561813 - protein, 9 aa, Homo Sapiens
STLMCDPLV

SEQ ID NO: 561814 - protein, 9 aa, Homo Sapiens
VNREERIEE

SEQ ID NO: 561815 - protein, 9 aa, Homo Sapiens
FQRQGGHQV

SEQ ID NO: 561816 - protein, 9 aa, Homo Sapiens
QHIFCDTPP

SEQ ID NO: 561817 - protein, 9 aa, Homo Sapiens
QHQHQHQQQ

SEQ ID NO: 561818 - protein, 9 aa, Homo Sapiens
EVQWQLAQL

SEQ ID NO: 561819 - protein, 9 aa, Homo Sapiens
VQLQSLGVE

SEQ ID NO: 561820 - protein, 9 aa, Homo Sapiens
FAELLDRPR

SEQ ID NO: 561821 - protein, 9 aa, Homo Sapiens
AVRTNELLK

SEQ ID NO: 561822 - protein, 9 aa, Homo Sapiens
KVGNFDIGL

SEQ ID NO: 561823 - protein, 9 aa, Homo Sapiens
LTELVGFPA

SEQ ID NO: 561824 - protein, 9 aa, Homo Sapiens
NDVFLLKTQ

SEQ ID NO: 561825 - protein, 9 aa, Homo Sapiens
TVTTIDADD

SEQ ID NO: 561826 - protein, 9 aa, Homo Sapiens
SLMCIWHSF

SEQ ID NO: 561827 - protein, 9 aa, Homo Sapiens
VVAGHDGVL

SEQ ID NO: 561828 - protein, 9 aa, Homo Sapiens
NREERIEEQ

SEQ ID NO: 561829 - protein, 9 aa, Homo Sapiens
AGHDGVLVG

SEQ ID NO: 561830 - protein, 9 aa, Homo Sapiens
RSCWIWKRQ

SEQ ID NO: 561831 - protein, 9 aa, Homo Sapiens
LGADVRDPL

SEQ ID NO: 561832 - protein, 9 aa, Homo Sapiens
SCLPRSEEA

SEQ ID NO: 561833 - protein, 9 aa, Homo Sapiens
RNLNGHEFS

SEQ ID NO: 561834 - protein, 9 aa, Homo Sapiens
RMAFGLGGK

SEQ ID NO: 561835 - protein, 9 aa, Homo Sapiens
SDPVNHYHI

SEQ ID NO: 561836 - protein, 9 aa, Homo Sapiens
LEEMGIADF

SEQ ID NO: 561837 - protein, 9 aa, Homo Sapiens
AALPPRDPC

SEQ ID NO: 561838 - protein, 9 aa, Homo Sapiens
VHKAVSAIM

SEQ ID NO: 561839 - protein, 9 aa, Homo Sapiens
WQGSPGELD

SEQ ID NO: 561840 - protein, 9 aa, Homo Sapiens
QGSPGELDS

SEQ ID NO: 561841 - protein, 9 aa, Homo Sapiens
ILIRRYANY

SEQ ID NO: 561842 - protein, 9 aa, Homo Sapiens
MSCCRGQKV

SEQ ID NO: 561843 - protein, 9 aa, Homo Sapiens
EQSGTGIQS

SEQ ID NO: 561844 - protein, 9 aa, Homo Sapiens
SQRDRSCWI

SEQ ID NO: 561845 - protein, 9 aa, Homo Sapiens
WSWARDELM

SEQ ID NO: 561846 - protein, 9 aa, Homo Sapiens
TLPVYTRKE

SEQ ID NO: 561847 - protein, 9 aa, Homo Sapiens
ALPPRDPCS

SEQ ID NO: 561848 - protein, 9 aa, Homo Sapiens
VRCIIPKER

SEQ ID NO: 561849 - protein, 9 aa, Homo Sapiens
ILCPDRHLV

SEQ ID NO: 561850 - protein, 9 aa, Homo Sapiens
AEVGGMVAL

SEQ ID NO: 561851 - protein, 9 aa, Homo Sapiens
TISQGRKAA

SEQ ID NO: 561852 - protein, 9 aa, Homo Sapiens
ELLAVLLNI

SEQ ID NO: 561853 - protein, 9 aa, Homo Sapiens
NATISQGRK

SEQ ID NO: 561854 - protein, 9 aa, Homo Sapiens
EEMGIADFF

SEQ ID NO: 561855 - protein, 9 aa, Homo Sapiens
GSCFPKKPS

SEQ ID NO: 561856 - protein, 9 aa, Homo Sapiens
FCRCCCTHV

SEQ ID NO: 561857 - protein, 9 aa, Homo Sapiens
ANYRHPDMW

SEQ ID NO: 561858 - protein, 9 aa, Homo Sapiens
HKAVSAIMQ

SEQ ID NO: 561859 - protein, 9 aa, Homo Sapiens
SWARDELMR

SEQ ID NO: 561860 - protein, 9 aa, Homo Sapiens
NLNGHEFSG

SEQ ID NO: 561861 - protein, 9 aa, Homo Sapiens
GHEFSGRAL

SEQ ID NO: 561862 - protein, 9 aa, Homo Sapiens
FVRCIIPKE

SEQ ID NO: 561863 - protein, 9 aa, Homo Sapiens
SSLPTRQEP

SEQ ID NO: 561864 - protein, 9 aa, Homo Sapiens
LAPRLGPGL

SEQ ID NO: 561865 - protein, 9 aa, Homo Sapiens
LLAVLLNIR

SEQ ID NO: 561866 - protein, 9 aa, Homo Sapiens
EMGIADFFT

SEQ ID NO: 561867 - protein, 9 aa, Homo Sapiens
ENKYLKDFE

SEQ ID NO: 561868 - protein, 9 aa, Homo Sapiens
YSVENAFID

SEQ ID NO: 561869 - protein, 9 aa, Homo Sapiens
SVLLSHQRT

SEQ ID NO: 561870 - protein, 9 aa, Homo Sapiens
RSDPVNHYH

SEQ ID NO: 561871 - protein, 9 aa, Homo Sapiens
ELQNHTISQ

SEQ ID NO: 561872 - protein, 9 aa, Homo Sapiens
QSGTGIQSE

SEQ ID NO: 561873 - protein, 9 aa, Homo Sapiens
TGIQSESET

SEQ ID NO: 561874 - protein, 9 aa, Homo Sapiens
QNLENKYLK

SEQ ID NO: 561875 - protein, 9 aa, Homo Sapiens
QRDRSCWIW

SEQ ID NO: 561876 - protein, 9 aa, Homo Sapiens
CPDRHLVTP

SEQ ID NO: 561877 - protein, 9 aa, Homo Sapiens
FSWQSVLLS

SEQ ID NO: 561878 - protein, 9 aa, Homo Sapiens
RDRSCWIWK

SEQ ID NO: 561879 - protein, 9 aa, Homo Sapiens
LQNHTISQH

SEQ ID NO: 561880 - protein, 9 aa, Homo Sapiens
GPCSRLSSP

SEQ ID NO: 561881 - protein, 9 aa, Homo Sapiens
SALDRMAFG

SEQ ID NO: 561882 - protein, 9 aa, Homo Sapiens
PTRQEPSSF

SEQ ID NO: 561883 - protein, 9 aa, Homo Sapiens
ADFFTNQAN

SEQ ID NO: 561884 - protein, 9 aa, Homo Sapiens
TEQSGTGIQ

SEQ ID NO: 561885 - protein, 9 aa, Homo Sapiens
RDPCSGAPL

SEQ ID NO: 561886 - protein, 9 aa, Homo Sapiens
PNNPATKDT

SEQ ID NO: 561887 - protein, 9 aa, Homo Sapiens
RLRSVNPNN

SEQ ID NO: 561888 - protein, 9 aa, Homo Sapiens
SILCPDRHL

SEQ ID NO: 561889 - protein, 9 aa, Homo Sapiens
SSSFDMAHV

SEQ ID NO: 561890 - protein, 9 aa, Homo Sapiens
QGRKAALPP

SEQ ID NO: 561891 - protein, 9 aa, Homo Sapiens
GADVRDPLD

SEQ ID NO: 561892 - protein, 9 aa, Homo Sapiens
GRKAALPPR

SEQ ID NO: 561893 - protein, 9 aa, Homo Sapiens
LENKYLKDF

SEQ ID NO: 561894 - protein, 9 aa, Homo Sapiens
RKAALPPRD

SEQ ID NO: 561895 - protein, 9 aa, Homo Sapiens
SQGRKAALP

SEQ ID NO: 561896 - protein, 9 aa, Homo Sapiens
RSPIIHAPK

SEQ ID NO: 561897 - protein, 9 aa, Homo Sapiens
AESPGPCSR

SEQ ID NO: 561898 - protein, 9 aa, Homo Sapiens
KFCRCCCTH

SEQ ID NO: 561899 - protein, 9 aa, Homo Sapiens
AFGLGGKLV

SEQ ID NO: 561900 - protein, 9 aa, Homo Sapiens
PSSSLPTRQ

SEQ ID NO: 561901 - protein, 9 aa, Homo Sapiens
IIHAPKRRD

SEQ ID NO: 561902 - protein, 9 aa, Homo Sapiens
DFFTNQANF

SEQ ID NO: 561903 - protein, 9 aa, Homo Sapiens
NPATKDTFH

SEQ ID NO: 561904 - protein, 9 aa, Homo Sapiens
SAIMQKVQE

SEQ ID NO: 561905 - protein, 9 aa, Homo Sapiens
FDMAHVFGG

SEQ ID NO: 561906 - protein, 9 aa, Homo Sapiens
NITLPVYTR

SEQ ID NO: 561907 - protein, 9 aa, Homo Sapiens
TRQEPSSFR

SEQ ID NO: 561908 - protein, 9 aa, Homo Sapiens
CSGAPLERI

SEQ ID NO: 561909 - protein, 9 aa, Homo Sapiens
MAFGLGGKL

SEQ ID NO: 561910 - protein, 9 aa, Homo Sapiens
STQKFCRCC

SEQ ID NO: 561911 - protein, 9 aa, Homo Sapiens
MRNLNGHEF

SEQ ID NO: 561912 - protein, 9 aa, Homo Sapiens
PVYTRKERC

SEQ ID NO: 561913 - protein, 9 aa, Homo Sapiens
KKPSCLPRS

SEQ ID NO: 561914 - protein, 9 aa, Homo Sapiens
LGPGLSPSP

SEQ ID NO: 561915 - protein, 9 aa, Homo Sapiens
HLVTPPVAI

SEQ ID NO: 561916 - protein, 9 aa, Homo Sapiens
RCIIPKERK

SEQ ID NO: 561917 - protein, 9 aa, Homo Sapiens
SWQSVLLSH

SEQ ID NO: 561918 - protein, 9 aa, Homo Sapiens
VSQRDRSCW

SEQ ID NO: 561919 - protein, 9 aa, Homo Sapiens
RHEGKKMAL

SEQ ID NO: 561920 - protein, 9 aa, Homo Sapiens
RRYANYRHP

SEQ ID NO: 561921 - protein, 9 aa, Homo Sapiens
VYTRKERCL

SEQ ID NO: 561922 - protein, 9 aa, Homo Sapiens
FFTNQANFS

SEQ ID NO: 561923 - protein, 9 aa, Homo Sapiens
VKKDLKSFN

SEQ ID NO: 561924 - protein, 9 aa, Homo Sapiens
SLCRHEGKK

SEQ ID NO: 561925 - protein, 9 aa, Homo Sapiens
SCCRGQKVA

SEQ ID NO: 561926 - protein, 9 aa, Homo Sapiens
AMRNLNGHE

SEQ ID NO: 561927 - protein, 9 aa, Homo Sapiens
PAPSSSLPT

SEQ ID NO: 561928 - protein, 9 aa, Homo Sapiens
PGLSPSPTS

SEQ ID NO: 561929 - protein, 9 aa, Homo Sapiens
MQKVQEDPQ

SEQ ID NO: 561930 - protein, 9 aa, Homo Sapiens
LTVDWSWAR

SEQ ID NO: 561931 - protein, 9 aa, Homo Sapiens
EKLTVDWSW

SEQ ID NO: 561932 - protein, 9 aa, Homo Sapiens
RLGADVRDP

SEQ ID NO: 561933 - protein, 9 aa, Homo Sapiens
SPGELDSDT

SEQ ID NO: 561934 - protein, 9 aa, Homo Sapiens
VLLNIRFVY

SEQ ID NO: 561935 - protein, 9 aa, Homo Sapiens
SRLGADVRD

SEQ ID NO: 561936 - protein, 9 aa, Homo Sapiens
QNHTISQHA

SEQ ID NO: 561937 - protein, 9 aa, Homo Sapiens
SSFDMAHVF

SEQ ID NO: 561938 - protein, 9 aa, Homo Sapiens
LTINASPAA

SEQ ID NO: 561939 - protein, 9 aa, Homo Sapiens
FNISLCRHE

SEQ ID NO: 561940 - protein, 9 aa, Homo Sapiens
KIFVKKDLK

SEQ ID NO: 561941 - protein, 9 aa, Homo Sapiens
GPGLSPSPT

SEQ ID NO: 561942 - protein, 9 aa, Homo Sapiens
KSRSPIIHA

SEQ ID NO: 561943 - protein, 9 aa, Homo Sapiens
SPIIHAPKR

SEQ ID NO: 561944 - protein, 9 aa, Homo Sapiens
NLENKYLKD

SEQ ID NO: 561945 - protein, 9 aa, Homo Sapiens
VNPNNPATK

SEQ ID NO: 561946 - protein, 9 aa, Homo Sapiens
DMAHVFGGG

SEQ ID NO: 561947 - protein, 9 aa, Homo Sapiens
AVSAIMQKV

SEQ ID NO: 561948 - protein, 9 aa, Homo Sapiens
GNATISQGR

SEQ ID NO: 561949 - protein, 9 aa, Homo Sapiens
VLLSHQRTH

SEQ ID NO: 561950 - protein, 9 aa, Homo Sapiens
LRSVNPNNP

SEQ ID NO: 561951 - protein, 9 aa, Homo Sapiens
ESALDRMAF

SEQ ID NO: 561952 - protein, 9 aa, Homo Sapiens
LPVYTRKER

SEQ ID NO: 561953 - protein, 9 aa, Homo Sapiens
CCRGQKVAG

SEQ ID NO: 561954 - protein, 9 aa, Homo Sapiens
KLTVDWSWA

SEQ ID NO: 561955 - protein, 9 aa, Homo Sapiens
FGLGGKLVL

SEQ ID NO: 561956 - protein, 9 aa, Homo Sapiens
NSSSFDMAH

SEQ ID NO: 561957 - protein, 9 aa, Homo Sapiens
NNPATKDTF

SEQ ID NO: 561958 - protein, 9 aa, Homo Sapiens
INASPAAMG

SEQ ID NO: 561959 - protein, 9 aa, Homo Sapiens
NISLCRHEG

SEQ ID NO: 561960 - protein, 9 aa, Homo Sapiens
SPGPCSRLS

SEQ ID NO: 561961 - protein, 9 aa, Homo Sapiens
APSSSLPTR

SEQ ID NO: 561962 - protein, 9 aa, Homo Sapiens
KAALPPRDP

SEQ ID NO: 561963 - protein, 9 aa, Homo Sapiens
HEFSGRALR

SEQ ID NO: 561964 - protein, 9 aa, Homo Sapiens
QVPPLTINA

SEQ ID NO: 561965 - protein, 9 aa, Homo Sapiens
DVRDPLDCR

SEQ ID NO: 561966 - protein, 9 aa, Homo Sapiens
LAVLLNIRF

SEQ ID NO: 561967 - protein, 9 aa, Homo Sapiens
PCSRLSSPK

SEQ ID NO: 561968 - protein, 9 aa, Homo Sapiens
TIKNQNLEN

SEQ ID NO: 561969 - protein, 9 aa, Homo Sapiens
KDLKSFNED

SEQ ID NO: 561970 - protein, 9 aa, Homo Sapiens
SFDMAHVFG

SEQ ID NO: 561971 - protein, 9 aa, Homo Sapiens
ADVRDPLDC

SEQ ID NO: 561972 - protein, 9 aa, Homo Sapiens
NHYHIGSGY

SEQ ID NO: 561973 - protein, 9 aa, Homo Sapiens
CFPKKPSCL

SEQ ID NO: 561974 - protein, 9 aa, Homo Sapiens
QKFCRCCCT

SEQ ID NO: 561975 - protein, 9 aa, Homo Sapiens
VRDPLDCRR

SEQ ID NO: 561976 - protein, 9 aa, Homo Sapiens
IDEKEDTCA

SEQ ID NO: 561977 - protein, 9 aa, Homo Sapiens
IRRYANYRH

SEQ ID NO: 561978 - protein, 9 aa, Homo Sapiens
IMQKVQEDP

SEQ ID NO: 561979 - protein, 9 aa, Homo Sapiens
LSSRLGADV

SEQ ID NO: 561980 - protein, 9 aa, Homo Sapiens
GYSVENAFI

SEQ ID NO: 561981 - protein, 9 aa, Homo Sapiens
CRHEGKKMA

SEQ ID NO: 561982 - protein, 9 aa, Homo Sapiens
WPRWQGSPG

SEQ ID NO: 561983 - protein, 9 aa, Homo Sapiens
KNQNLENKY

SEQ ID NO: 561984 - protein, 9 aa, Homo Sapiens
LIRRYANYR

SEQ ID NO: 561985 - protein, 9 aa, Homo Sapiens
VDWSWARDE

SEQ ID NO: 561986 - protein, 9 aa, Homo Sapiens
NPNNPATKD

SEQ ID NO: 561987 - protein, 9 aa, Homo Sapiens
HFFNISLCR

SEQ ID NO: 561988 - protein, 9 aa, Homo Sapiens
DWSWARDEL

SEQ ID NO: 561989 - protein, 9 aa, Homo Sapiens
AFIDEKEDT

SEQ ID NO: 561990 - protein, 9 aa, Homo Sapiens
TQKFCRCCC

SEQ ID NO: 561991 - protein, 9 aa, Homo Sapiens
CCTHVTTYE

SEQ ID NO: 561992 - protein, 9 aa, Homo Sapiens
DILIRRYAN

SEQ ID NO: 561993 - protein, 9 aa, Homo Sapiens
ENAFIDEKE

SEQ ID NO: 561994 - protein, 9 aa, Homo Sapiens
LPGNATISQ

SEQ ID NO: 561995 - protein, 9 aa, Homo Sapiens
TELQNHTIS

SEQ ID NO: 561996 - protein, 9 aa, Homo Sapiens
PDRHLVTPP

SEQ ID NO: 561997 - protein, 9 aa, Homo Sapiens
NAFIDEKED

SEQ ID NO: 561998 - protein, 9 aa, Homo Sapiens
IHAPKRRDR

SEQ ID NO: 561999 - protein, 9 aa, Homo Sapiens
FPKKPSCLP

SEQ ID NO: 562000 - protein, 9 aa, Homo Sapiens
WQSVLLSHQ

SEQ ID NO: 562001 - protein, 9 aa, Homo Sapiens
MGIADFFTN

SEQ ID NO: 562002 - protein, 9 aa, Homo Sapiens
PGPCSRLSS

SEQ ID NO: 562003 - protein, 9 aa, Homo Sapiens
NYRHPDMWK

SEQ ID NO: 562004 - protein, 9 aa, Homo Sapiens
KRSDPVNHY

SEQ ID NO: 562005 - protein, 9 aa, Homo Sapiens
LNGHEFSGR

SEQ ID NO: 562006 - protein, 9 aa, Homo Sapiens
IFVKKDLKS

SEQ ID NO: 562007 - protein, 9 aa, Homo Sapiens
CRCCCTHVT

SEQ ID NO: 562008 - protein, 9 aa, Homo Sapiens
SVENAFIDE

SEQ ID NO: 562009 - protein, 9 aa, Homo Sapiens
SRSPIIHAP

SEQ ID NO: 562010 - protein, 9 aa, Homo Sapiens
QTELQNHTI

SEQ ID NO: 562011 - protein, 9 aa, Homo Sapiens
GIQSESETE

SEQ ID NO: 562012 - protein, 9 aa, Homo Sapiens
ALDRMAFGL

SEQ ID NO: 562013 - protein, 9 aa, Homo Sapiens
GELLAVLLN

SEQ ID NO: 562014 - protein, 9 aa, Homo Sapiens
APRLGPGLS

SEQ ID NO: 562015 - protein, 9 aa, Homo Sapiens
CSRLSSPKP

SEQ ID NO: 562016 - protein, 9 aa, Homo Sapiens
ASPAAMGVA

SEQ ID NO: 562017 - protein, 9 aa, Homo Sapiens
DRSCWIWKR

SEQ ID NO: 562018 - protein, 9 aa, Homo Sapiens
FPCGELLAV

SEQ ID NO: 562019 - protein, 9 aa, Homo Sapiens
QSVLLSHQR

SEQ ID NO: 562020 - protein, 9 aa, Homo Sapiens
EVGGMVALF

SEQ ID NO: 562021 - protein, 9 aa, Homo Sapiens
RHLVTPPVA

SEQ ID NO: 562022 - protein, 9 aa, Homo Sapiens
RYANYRHPD

SEQ ID NO: 562023 - protein, 9 aa, Homo Sapiens
PRLGPGLSP

SEQ ID NO: 562024 - protein, 9 aa, Homo Sapiens
HVFGGGANS

SEQ ID NO: 562025 - protein, 9 aa, Homo Sapiens
YANYRHPDM

SEQ ID NO: 562026 - protein, 9 aa, Homo Sapiens
ITLPVYTRK

SEQ ID NO: 562027 - protein, 9 aa, Homo Sapiens
HFVRCIIPK

SEQ ID NO: 562028 - protein, 9 aa, Homo Sapiens
QSESETESE

SEQ ID NO: 562029 - protein, 9 aa, Homo Sapiens
SAMRNLNGH

SEQ ID NO: 562030 - protein, 9 aa, Homo Sapiens
FIDEKEDTC

SEQ ID NO: 562031 - protein, 9 aa, Homo Sapiens
SCWIWKRQE

SEQ ID NO: 562032 - protein, 9 aa, Homo Sapiens
KVSQRDRSC

SEQ ID NO: 562033 - protein, 9 aa, Homo Sapiens
CGELLAVLL

SEQ ID NO: 562034 - protein, 9 aa, Homo Sapiens
CIIPKERKA

SEQ ID NO: 562035 - protein, 9 aa, Homo Sapiens
CCCTHVTTY

SEQ ID NO: 562036 - protein, 9 aa, Homo Sapiens
PKERKAPGV

SEQ ID NO: 562037 - protein, 9 aa, Homo Sapiens
IQSESETES

SEQ ID NO: 562038 - protein, 9 aa, Homo Sapiens
CWIWKRQER

SEQ ID NO: 562039 - protein, 9 aa, Homo Sapiens
PCSGAPLER

SEQ ID NO: 562040 - protein, 9 aa, Homo Sapiens
RSVNPNNPA

SEQ ID NO: 562041 - protein, 9 aa, Homo Sapiens
DRMAFGLGG

SEQ ID NO: 562042 - protein, 8 aa, Homo Sapiens
TSTTNTMC

SEQ ID NO: 562043 - protein, 9 aa, Homo Sapiens
LPPRDPCSG

SEQ ID NO: 562044 - protein, 9 aa, Homo Sapiens
DRHLVTPPV

SEQ ID NO: 562045 - protein, 9 aa, Homo Sapiens
LCPDRHLVT

SEQ ID NO: 562046 - protein, 9 aa, Homo Sapiens
DPCSGAPLE

SEQ ID NO: 562047 - protein, 9 aa, Homo Sapiens
QAEVGGMVA

SEQ ID NO: 562048 - protein, 9 aa, Homo Sapiens
SSSLPTRQE

SEQ ID NO: 562049 - protein, 9 aa, Homo Sapiens
KAVSAIMQK

SEQ ID NO: 562050 - protein, 9 aa, Homo Sapiens
FFNISLCRH

SEQ ID NO: 562051 - protein, 9 aa, Homo Sapiens
EQAEVGGMV

SEQ ID NO: 562052 - protein, 9 aa, Homo Sapiens
GSPGELDSD

SEQ ID NO: 562053 - protein, 9 aa, Homo Sapiens
NASPAAMGV

SEQ ID NO: 562054 - protein, 9 aa, Homo Sapiens
FVKKDLKSF

SEQ ID NO: 562055 - protein, 9 aa, Homo Sapiens
ATISQGRKA

SEQ ID NO: 562056 - protein, 9 aa, Homo Sapiens
NGHEFSGRA

SEQ ID NO: 562057 - protein, 9 aa, Homo Sapiens
VSAIMQKVQ

SEQ ID NO: 562058 - protein, 9 aa, Homo Sapiens
SGTGIQSES

SEQ ID NO: 562059 - protein, 9 aa, Homo Sapiens
PPRDPCSGA

SEQ ID NO: 562060 - protein, 9 aa, Homo Sapiens
GTGIQSESE

SEQ ID NO: 562061 - protein, 9 aa, Homo Sapiens
ISQGRKAAL

SEQ ID NO: 562062 - protein, 9 aa, Homo Sapiens
PVNHYHIGS

SEQ ID NO: 562063 - protein, 9 aa, Homo Sapiens
RWQGSPGEL

SEQ ID NO: 562064 - protein, 9 aa, Homo Sapiens
IPKERKAPG

SEQ ID NO: 562065 - protein, 9 aa, Homo Sapiens
PCGELLAVL

SEQ ID NO: 562066 - protein, 9 aa, Homo Sapiens
DLKSFNEDF

SEQ ID NO: 562067 - protein, 9 aa, Homo Sapiens
NQNLENKYL

SEQ ID NO: 562068 - protein, 9 aa, Homo Sapiens
PGELDSDTQ

SEQ ID NO: 562069 - protein, 9 aa, Homo Sapiens
VNHYHIGSG

SEQ ID NO: 562070 - protein, 9 aa, Homo Sapiens
AVLLNIRFV

SEQ ID NO: 562071 - protein, 9 aa, Homo Sapiens
HAPKRRDRR

SEQ ID NO: 562072 - protein, 9 aa, Homo Sapiens
KKDLKSFNE

SEQ ID NO: 562073 - protein, 9 aa, Homo Sapiens
VGGMVALFF

SEQ ID NO: 562074 - protein, 9 aa, Homo Sapiens
FKRSDPVNH

SEQ ID NO: 562075 - protein, 9 aa, Homo Sapiens
GIADFFTNQ

SEQ ID NO: 562076 - protein, 9 aa, Homo Sapiens
ESPGPCSRL

SEQ ID NO: 562077 - protein, 9 aa, Homo Sapiens
KPSCLPRSE

SEQ ID NO: 562078 - protein, 9 aa, Homo Sapiens
TINASPAAM

SEQ ID NO: 562079 - protein, 9 aa, Homo Sapiens
LKSFNEDFL

SEQ ID NO: 562080 - protein, 9 aa, Homo Sapiens
SVNPNNPAT

SEQ ID NO: 562081 - protein, 9 aa, Homo Sapiens
GLSPSPTSP

SEQ ID NO: 562082 - protein, 9 aa, Homo Sapiens
PKKPSCLPR

SEQ ID NO: 562083 - protein, 9 aa, Homo Sapiens
APKRRDRRS

SEQ ID NO: 562084 - protein, 9 aa, Homo Sapiens
TRKERCLQV

SEQ ID NO: 562085 - protein, 9 aa, Homo Sapiens
KERKAPGVM

SEQ ID NO: 562086 - protein, 9 aa, Homo Sapiens
ISLCRHEGK

SEQ ID NO: 562087 - protein, 9 aa, Homo Sapiens
PLAPRLGPG

SEQ ID NO: 562088 - protein, 9 aa, Homo Sapiens
RAESPGPCS

SEQ ID NO: 562089 - protein, 9 aa, Homo Sapiens
PLTINASPA

SEQ ID NO: 562090 - protein, 9 aa, Homo Sapiens
YTRKERCLQ

SEQ ID NO: 562091 - protein, 9 aa, Homo Sapiens
PSCLPRSEE

SEQ ID NO: 562092 - protein, 9 aa, Homo Sapiens
PPLTINASP

SEQ ID NO: 562093 - protein, 9 aa, Homo Sapiens
KSFNEDFLK

SEQ ID NO: 562094 - protein, 9 aa, Homo Sapiens
LSILCPDRH

SEQ ID NO: 562095 - protein, 9 aa, Homo Sapiens
PRDPCSGAP

SEQ ID NO: 562096 - protein, 9 aa, Homo Sapiens
GELDSDTQG

SEQ ID NO: 562097 - protein, 9 aa, Homo Sapiens
IIPKERKAP

SEQ ID NO: 562098 - protein, 9 aa, Homo Sapiens
AHVFGGGAN

SEQ ID NO: 562099 - protein, 9 aa, Homo Sapiens
LPTRQEPSS

SEQ ID NO: 562100 - protein, 9 aa, Homo Sapiens
VENAFIDEK

SEQ ID NO: 562101 - protein, 9 aa, Homo Sapiens
AIMQKVQED

SEQ ID NO: 562102 - protein, 9 aa, Homo Sapiens
RKERCLQVV

SEQ ID NO: 562103 - protein, 9 aa, Homo Sapiens
NKYLKDFEI

SEQ ID NO: 562104 - protein, 9 aa, Homo Sapiens
IADFFTNQA

SEQ ID NO: 562105 - protein, 9 aa, Homo Sapiens
RLGPGLSPS

SEQ ID NO: 562106 - protein, 9 aa, Homo Sapiens
HYHIGSGYV

SEQ ID NO: 562107 - protein, 9 aa, Homo Sapiens
VPPLTINAS

SEQ ID NO: 562108 - protein, 9 aa, Homo Sapiens
PGNATISQG

SEQ ID NO: 562109 - protein, 9 aa, Homo Sapiens
SSRLGADVR

SEQ ID NO: 562110 - protein, 9 aa, Homo Sapiens
LDRMAFGLG

SEQ ID NO: 562111 - protein, 9 aa, Homo Sapiens
LCRHEGKKM

SEQ ID NO: 562112 - protein, 9 aa, Homo Sapiens
SRAESPGPC

SEQ ID NO: 562113 - protein, 9 aa, Homo Sapiens
NHTISQHAQ

SEQ ID NO: 562114 - protein, 9 aa, Homo Sapiens
RCCCTHVTT

SEQ ID NO: 562115 - protein, 9 aa, Homo Sapiens
IKNQNLENK

SEQ ID NO: 562116 - protein, 9 aa, Homo Sapiens
SCFPKKPSC

SEQ ID NO: 562117 - protein, 9 aa, Homo Sapiens
PRWQGSPGE

SEQ ID NO: 562118 - protein, 9 aa, Homo Sapiens
WARDELMRK

SEQ ID NO: 562119 - protein, 9 aa, Homo Sapiens
TVDWSWARD

SEQ ID NO: 562120 - protein, 9 aa, Homo Sapiens
SLPTRQEPS

SEQ ID NO: 562121 - protein, 9 aa, Homo Sapiens
MAHVFGGGA

SEQ ID NO: 562122 - protein, 9 aa, Homo Sapiens
DPVNHYHIG

SEQ ID NO: 562123 - protein, 9 aa, Homo Sapiens
PIIHAPKRR

SEQ ID NO: 562124 - protein, 9 aa, Homo Sapiens
QLKIYSQVK

SEQ ID NO: 562125 - protein, 9 aa, Homo Sapiens
AKKKSSPER

SEQ ID NO: 562126 - protein, 9 aa, Homo Sapiens
VLSMAERQA

SEQ ID NO: 562127 - protein, 9 aa, Homo Sapiens
EGCSEETSF

SEQ ID NO: 562128 - protein, 9 aa, Homo Sapiens
AAKAADMDP

SEQ ID NO: 562129 - protein, 9 aa, Homo Sapiens
GIIYLIFIG

SEQ ID NO: 562130 - protein, 9 aa, Homo Sapiens
NKPVFYPNP

SEQ ID NO: 562131 - protein, 9 aa, Homo Sapiens
KSSPERESS

SEQ ID NO: 562132 - protein, 9 aa, Homo Sapiens
RSKELEQKL

SEQ ID NO: 562133 - protein, 9 aa, Homo Sapiens
YSQVKAEIQ

SEQ ID NO: 562134 - protein, 9 aa, Homo Sapiens
INFSSSVLE

SEQ ID NO: 562135 - protein, 9 aa, Homo Sapiens
TAGAGCGDE

SEQ ID NO: 562136 - protein, 9 aa, Homo Sapiens
VFYPNPPKT

SEQ ID NO: 562137 - protein, 9 aa, Homo Sapiens
TTAWVLSMA

SEQ ID NO: 562138 - protein, 9 aa, Homo Sapiens
FYSHQLKIY

SEQ ID NO: 562139 - protein, 9 aa, Homo Sapiens
GWVHADSCH

SEQ ID NO: 562140 - protein, 9 aa, Homo Sapiens
LGGIIYLIF

SEQ ID NO: 562141 - protein, 9 aa, Homo Sapiens
FFFFSLFFF

SEQ ID NO: 562142 - protein, 9 aa, Homo Sapiens
NGLEGCSEE

SEQ ID NO: 562143 - protein, 9 aa, Homo Sapiens
QFFFFFSLF

SEQ ID NO: 562144 - protein, 9 aa, Homo Sapiens
SAPPAPMQQ

SEQ ID NO: 562145 - protein, 9 aa, Homo Sapiens
AAEKVGALG

SEQ ID NO: 562146 - protein, 9 aa, Homo Sapiens
LRTQSDGIP

SEQ ID NO: 562147 - protein, 9 aa, Homo Sapiens
AFLEPGNIE

SEQ ID NO: 562148 - protein, 9 aa, Homo Sapiens
PETSKYECR

SEQ ID NO: 562149 - protein, 9 aa, Homo Sapiens
IYSQVKAEI

SEQ ID NO: 562150 - protein, 9 aa, Homo Sapiens
LGHPRSVSE

SEQ ID NO: 562151 - protein, 9 aa, Homo Sapiens
APSTGSSLE

SEQ ID NO: 562152 - protein, 9 aa, Homo Sapiens
FSSSVLEIV

SEQ ID NO: 562153 - protein, 9 aa, Homo Sapiens
GAPSTGSSL

SEQ ID NO: 562154 - protein, 9 aa, Homo Sapiens
AMAEGSIFS

SEQ ID NO: 562155 - protein, 9 aa, Homo Sapiens
IAFLEPGNI

SEQ ID NO: 562156 - protein, 9 aa, Homo Sapiens
VNTVLHNLS

SEQ ID NO: 562157 - protein, 9 aa, Homo Sapiens
KVGALGHPR

SEQ ID NO: 562158 - protein, 9 aa, Homo Sapiens
HCVYDLYLR

SEQ ID NO: 562159 - protein, 9 aa, Homo Sapiens
PSTGSSLEL

SEQ ID NO: 562160 - protein, 9 aa, Homo Sapiens
LIFIGSTIP

SEQ ID NO: 562161 - protein, 9 aa, Homo Sapiens
AGAGCGDEK

SEQ ID NO: 562162 - protein, 9 aa, Homo Sapiens
ISNDIVNTV

SEQ ID NO: 562163 - protein, 9 aa, Homo Sapiens
YLGGIIYLI

SEQ ID NO: 562164 - protein, 9 aa, Homo Sapiens
RTAGAGCGD

SEQ ID NO: 562165 - protein, 9 aa, Homo Sapiens
LSGCRLLFL

SEQ ID NO: 562166 - protein, 9 aa, Homo Sapiens
KAADMDPVN

SEQ ID NO: 562167 - protein, 9 aa, Homo Sapiens
KIYSQVKAE

SEQ ID NO: 562168 - protein, 9 aa, Homo Sapiens
WWFLGWVHA

SEQ ID NO: 562169 - protein, 9 aa, Homo Sapiens
IPQAKVQIL

SEQ ID NO: 562170 - protein, 9 aa, Homo Sapiens
AGCGDEKRL

SEQ ID NO: 562171 - protein, 9 aa, Homo Sapiens
ALDFNSAPP

SEQ ID NO: 562172 - protein, 9 aa, Homo Sapiens
KKWVGAPST

SEQ ID NO: 562173 - protein, 9 aa, Homo Sapiens
APPAPMQQK

SEQ ID NO: 562174 - protein, 9 aa, Homo Sapiens
VHADSCHYE

SEQ ID NO: 562175 - protein, 9 aa, Homo Sapiens
AWVLSMAER

SEQ ID NO: 562176 - protein, 9 aa, Homo Sapiens
YSHQLKIYS

SEQ ID NO: 562177 - protein, 9 aa, Homo Sapiens
SGCRLLFLF

SEQ ID NO: 562178 - protein, 9 aa, Homo Sapiens
SPAEDNREV

SEQ ID NO: 562179 - protein, 9 aa, Homo Sapiens
DFNSAPPAP

SEQ ID NO: 562180 - protein, 9 aa, Homo Sapiens
DGIPQAKVQ

SEQ ID NO: 562181 - protein, 9 aa, Homo Sapiens
CGDEKRLTL

SEQ ID NO: 562182 - protein, 9 aa, Homo Sapiens
GCGDEKRLT

SEQ ID NO: 562183 - protein, 9 aa, Homo Sapiens
LPETSKYEC

SEQ ID NO: 562184 - protein, 9 aa, Homo Sapiens
DLYLRKSWT

SEQ ID NO: 562185 - protein, 9 aa, Homo Sapiens
IVNTVLHNL

SEQ ID NO: 562186 - protein, 9 aa, Homo Sapiens
LMSIAFLEP

SEQ ID NO: 562187 - protein, 9 aa, Homo Sapiens
GHLSGCRLL

SEQ ID NO: 562188 - protein, 9 aa, Homo Sapiens
FYPNPPKTF

SEQ ID NO: 562189 - protein, 9 aa, Homo Sapiens
NTVLHNLSS

SEQ ID NO: 562190 - protein, 9 aa, Homo Sapiens
CSEETSFHD

SEQ ID NO: 562191 - protein, 9 aa, Homo Sapiens
IYLIFIGST

SEQ ID NO: 562192 - protein, 9 aa, Homo Sapiens
GCAMAEGSI

SEQ ID NO: 562193 - protein, 9 aa, Homo Sapiens
SCHYEFPLL

SEQ ID NO: 562194 - protein, 9 aa, Homo Sapiens
KYECRVEMV

SEQ ID NO: 562195 - protein, 9 aa, Homo Sapiens
IIYLIFIGS

SEQ ID NO: 562196 - protein, 9 aa, Homo Sapiens
EPGNIESDL

SEQ ID NO: 562197 - protein, 9 aa, Homo Sapiens
LTTAWVLSM

SEQ ID NO: 562198 - protein, 9 aa, Homo Sapiens
VYDLYLRKS

SEQ ID NO: 562199 - protein, 9 aa, Homo Sapiens
GCSEETSFH

SEQ ID NO: 562200 - protein, 9 aa, Homo Sapiens
SKELEQKLL

SEQ ID NO: 562201 - protein, 9 aa, Homo Sapiens
HADSCHYEF

SEQ ID NO: 562202 - protein, 9 aa, Homo Sapiens
FNSAPPAPM

SEQ ID NO: 562203 - protein, 9 aa, Homo Sapiens
WGWWFLGWV

SEQ ID NO: 562204 - protein, 9 aa, Homo Sapiens
TAWVLSMAE

SEQ ID NO: 562205 - protein, 9 aa, Homo Sapiens
FLMSIAFLE

SEQ ID NO: 562206 - protein, 9 aa, Homo Sapiens
KKSSPERES

SEQ ID NO: 562207 - protein, 9 aa, Homo Sapiens
ADMDPVNSY

SEQ ID NO: 562208 - protein, 9 aa, Homo Sapiens
AKAADMDPV

SEQ ID NO: 562209 - protein, 9 aa, Homo Sapiens
ALRNGLEGC

SEQ ID NO: 562210 - protein, 9 aa, Homo Sapiens
SIFSLGGLQ

SEQ ID NO: 562211 - protein, 9 aa, Homo Sapiens
RFQARSKEL

SEQ ID NO: 562212 - protein, 9 aa, Homo Sapiens
SIAFLEPGN

SEQ ID NO: 562213 - protein, 9 aa, Homo Sapiens
CRLLFLFLS

SEQ ID NO: 562214 - protein, 9 aa, Homo Sapiens
VVGSWGWWF

SEQ ID NO: 562215 - protein, 9 aa, Homo Sapiens
KSLSEQTQP

SEQ ID NO: 562216 - protein, 9 aa, Homo Sapiens
FLGWVHADS

SEQ ID NO: 562217 - protein, 9 aa, Homo Sapiens
YLRKSWTIQ

SEQ ID NO: 562218 - protein, 9 aa, Homo Sapiens
SWGWWFLGW

SEQ ID NO: 562219 - protein, 9 aa, Homo Sapiens
SSVLEIVEN

SEQ ID NO: 562220 - protein, 9 aa, Homo Sapiens
SNDIVNTVL

SEQ ID NO: 562221 - protein, 9 aa, Homo Sapiens
GAGCGDEKR

SEQ ID NO: 562222 - protein, 9 aa, Homo Sapiens
NINFSSSVL

SEQ ID NO: 562223 - protein, 9 aa, Homo Sapiens
QAAAKAADM

SEQ ID NO: 562224 - protein, 9 aa, Homo Sapiens
FQARSKELE

SEQ ID NO: 562225 - protein, 9 aa, Homo Sapiens
QCVTPVQTI

SEQ ID NO: 562226 - protein, 9 aa, Homo Sapiens
FFFFFSLFF

SEQ ID NO: 562227 - protein, 9 aa, Homo Sapiens
VTLPQCSLP

SEQ ID NO: 562228 - protein, 9 aa, Homo Sapiens
CRVEMVHQS

SEQ ID NO: 562229 - protein, 9 aa, Homo Sapiens
MAERQAVNA

SEQ ID NO: 562230 - protein, 9 aa, Homo Sapiens
GWWFLGWVH

SEQ ID NO: 562231 - protein, 9 aa, Homo Sapiens
ARTAGAGCG

SEQ ID NO: 562232 - protein, 9 aa, Homo Sapiens
GALGHPRSV

SEQ ID NO: 562233 - protein, 9 aa, Homo Sapiens
FLEPGNIES

SEQ ID NO: 562234 - protein, 9 aa, Homo Sapiens
TERFQARSK

SEQ ID NO: 562235 - protein, 9 aa, Homo Sapiens
KPVFYPNPP

SEQ ID NO: 562236 - protein, 9 aa, Homo Sapiens
SDGIPQAKV

SEQ ID NO: 562237 - protein, 9 aa, Homo Sapiens
SKYECRVEM

SEQ ID NO: 562238 - protein, 9 aa, Homo Sapiens
ADSCHYEFP

SEQ ID NO: 562239 - protein, 9 aa, Homo Sapiens
MSIAFLEPG

SEQ ID NO: 562240 - protein, 9 aa, Homo Sapiens
LEGCSEETS

SEQ ID NO: 562241 - protein, 9 aa, Homo Sapiens
SKSLSEQTQ

SEQ ID NO: 562242 - protein, 9 aa, Homo Sapiens
ECRVEMVHQ

SEQ ID NO: 562243 - protein, 9 aa, Homo Sapiens
HQLKIYSQV

SEQ ID NO: 562244 - protein, 9 aa, Homo Sapiens
LKIYSQVKA

SEQ ID NO: 562245 - protein, 9 aa, Homo Sapiens
SMAERQAVN

SEQ ID NO: 562246 - protein, 9 aa, Homo Sapiens
YDLYLRKSW

SEQ ID NO: 562247 - protein, 9 aa, Homo Sapiens
LEPGNIESD

SEQ ID NO: 562248 - protein, 9 aa, Homo Sapiens
GIPQAKVQI

SEQ ID NO: 562249 - protein, 9 aa, Homo Sapiens
KNKPVFYPN

SEQ ID NO: 562250 - protein, 9 aa, Homo Sapiens
EGSIFSLGG

SEQ ID NO: 562251 - protein, 9 aa, Homo Sapiens
NREVTLPQC

SEQ ID NO: 562252 - protein, 9 aa, Homo Sapiens
CVTPVQTIV

SEQ ID NO: 562253 - protein, 9 aa, Homo Sapiens
RTQSDGIPQ

SEQ ID NO: 562254 - protein, 9 aa, Homo Sapiens
QARSKELEQ

SEQ ID NO: 562255 - protein, 9 aa, Homo Sapiens
RKSWTIQVG

SEQ ID NO: 562256 - protein, 9 aa, Homo Sapiens
SPERESSGS

SEQ ID NO: 562257 - protein, 9 aa, Homo Sapiens
NSAPPAPMQ

SEQ ID NO: 562258 - protein, 9 aa, Homo Sapiens
AADMDPVNS

SEQ ID NO: 562259 - protein, 9 aa, Homo Sapiens
KELEQKLLC

SEQ ID NO: 562260 - protein, 9 aa, Homo Sapiens
WVGAPSTGS

SEQ ID NO: 562261 - protein, 9 aa, Homo Sapiens
NDIVNTVLH

SEQ ID NO: 562262 - protein, 9 aa, Homo Sapiens
LFMVVGSWG

SEQ ID NO: 562263 - protein, 9 aa, Homo Sapiens
RLLFLFLSP

SEQ ID NO: 562264 - protein, 9 aa, Homo Sapiens
LQAAAKAAD

SEQ ID NO: 562265 - protein, 9 aa, Homo Sapiens
FMVVGSWGW

SEQ ID NO: 562266 - protein, 9 aa, Homo Sapiens
NFSSSVLEI

SEQ ID NO: 562267 - protein, 9 aa, Homo Sapiens
KVLNINFSS

SEQ ID NO: 562268 - protein, 9 aa, Homo Sapiens
TQSDGIPQA

SEQ ID NO: 562269 - protein, 9 aa, Homo Sapiens
FFFSLFFFL

SEQ ID NO: 562270 - protein, 9 aa, Homo Sapiens
VGSWGWWFL

SEQ ID NO: 562271 - protein, 9 aa, Homo Sapiens
STGSSLELG

SEQ ID NO: 562272 - protein, 9 aa, Homo Sapiens
GGIIYLIFI

SEQ ID NO: 562273 - protein, 9 aa, Homo Sapiens
SSSVLEIVE

SEQ ID NO: 562274 - protein, 9 aa, Homo Sapiens
LNINFSSSV

SEQ ID NO: 562275 - protein, 9 aa, Homo Sapiens
MAEGSIFSL

SEQ ID NO: 562276 - protein, 9 aa, Homo Sapiens
QQFFFFFSL

SEQ ID NO: 562277 - protein, 9 aa, Homo Sapiens
LRKSWTIQV

SEQ ID NO: 562278 - protein, 9 aa, Homo Sapiens
VGALGHPRS

SEQ ID NO: 562279 - protein, 9 aa, Homo Sapiens
PQAKVQILP

SEQ ID NO: 562280 - protein, 9 aa, Homo Sapiens
ETSKYECRV

SEQ ID NO: 562281 - protein, 9 aa, Homo Sapiens
FSLFFFLRR

SEQ ID NO: 562282 - protein, 9 aa, Homo Sapiens
EDNREVTLP

SEQ ID NO: 562283 - protein, 9 aa, Homo Sapiens
PAKKKSSPE

SEQ ID NO: 562284 - protein, 9 aa, Homo Sapiens
WFLGWVHAD

SEQ ID NO: 562285 - protein, 9 aa, Homo Sapiens
SHQLKIYSQ

SEQ ID NO: 562286 - protein, 9 aa, Homo Sapiens
KWVGAPSTG

SEQ ID NO: 562287 - protein, 9 aa, Homo Sapiens
EKVGALGHP

SEQ ID NO: 562288 - protein, 9 aa, Homo Sapiens
GQQFFFFFS

SEQ ID NO: 562289 - protein, 9 aa, Homo Sapiens
PARTAGAGC

SEQ ID NO: 562290 - protein, 9 aa, Homo Sapiens
PNPPKTFAP

SEQ ID NO: 562291 - protein, 9 aa, Homo Sapiens
GSIFSLGGL

SEQ ID NO: 562292 - protein, 9 aa, Homo Sapiens
LALDFNSAP

SEQ ID NO: 562293 - protein, 9 aa, Homo Sapiens
AEKVGALGH

SEQ ID NO: 562294 - protein, 9 aa, Homo Sapiens
VGAPSTGSS

SEQ ID NO: 562295 - protein, 9 aa, Homo Sapiens
PVFYPNPPK

SEQ ID NO: 562296 - protein, 9 aa, Homo Sapiens
KKKSSPERE

SEQ ID NO: 562297 - protein, 9 aa, Homo Sapiens
RNGLEGCSE

SEQ ID NO: 562298 - protein, 9 aa, Homo Sapiens
DSCHYEFPL

SEQ ID NO: 562299 - protein, 9 aa, Homo Sapiens
SLFFFLRRS

SEQ ID NO: 562300 - protein, 9 aa, Homo Sapiens
PPAPMQQKL

SEQ ID NO: 562301 - protein, 9 aa, Homo Sapiens
LISNDIVNT

SEQ ID NO: 562302 - protein, 9 aa, Homo Sapiens
IFIGSTIPR

SEQ ID NO: 562303 - protein, 9 aa, Homo Sapiens
YECRVEMVH

SEQ ID NO: 562304 - protein, 9 aa, Homo Sapiens
IFSLGGLQQ

SEQ ID NO: 562305 - protein, 9 aa, Homo Sapiens
ERFQARSKE

SEQ ID NO: 562306 - protein, 9 aa, Homo Sapiens
CVYDLYLRK

SEQ ID NO: 562307 - protein, 9 aa, Homo Sapiens
TSKYECRVE

SEQ ID NO: 562308 - protein, 9 aa, Homo Sapiens
NPPKTFAPN

SEQ ID NO: 562309 - protein, 9 aa, Homo Sapiens
AEDNREVTL

SEQ ID NO: 562310 - protein, 9 aa, Homo Sapiens
EVTLPQCSL

SEQ ID NO: 562311 - protein, 9 aa, Homo Sapiens
LGWVHADSC

SEQ ID NO: 562312 - protein, 9 aa, Homo Sapiens
FFSLFFFLR

SEQ ID NO: 562313 - protein, 9 aa, Homo Sapiens
CAMAEGSIF

SEQ ID NO: 562314 - protein, 9 aa, Homo Sapiens
HLSGCRLLF

SEQ ID NO: 562315 - protein, 9 aa, Homo Sapiens
LSMAERQAV

SEQ ID NO: 562316 - protein, 9 aa, Homo Sapiens
LRNGLEGCS

SEQ ID NO: 562317 - protein, 9 aa, Homo Sapiens
TVLHNLSSA

SEQ ID NO: 562318 - protein, 9 aa, Homo Sapiens
ERESSGSES

SEQ ID NO: 562319 - protein, 9 aa, Homo Sapiens
QSDGIPQAK

SEQ ID NO: 562320 - protein, 9 aa, Homo Sapiens
GSWGWWFLG

SEQ ID NO: 562321 - protein, 9 aa, Homo Sapiens
LDFNSAPPA

SEQ ID NO: 562322 - protein, 9 aa, Homo Sapiens
DIVNTVLHN

SEQ ID NO: 562323 - protein, 9 aa, Homo Sapiens
GCRLLFLFL

SEQ ID NO: 562324 - protein, 9 aa, Homo Sapiens
ARSKELEQK

SEQ ID NO: 562325 - protein, 9 aa, Homo Sapiens
WVHADSCHY

SEQ ID NO: 562326 - protein, 9 aa, Homo Sapiens
YPNPPKTFA

SEQ ID NO: 562327 - protein, 9 aa, Homo Sapiens
DNREVTLPQ

SEQ ID NO: 562328 - protein, 9 aa, Homo Sapiens
WVLSMAERQ

SEQ ID NO: 562329 - protein, 9 aa, Homo Sapiens
PERESSGSE

SEQ ID NO: 562330 - protein, 9 aa, Homo Sapiens
PAEDNREVT

SEQ ID NO: 562331 - protein, 9 aa, Homo Sapiens
SSPERESSG

SEQ ID NO: 562332 - protein, 9 aa, Homo Sapiens
YLIFIGSTI

SEQ ID NO: 562333 - protein, 9 aa, Homo Sapiens
VLNINFSSS

SEQ ID NO: 562334 - protein, 9 aa, Homo Sapiens
AEGSIFSLG

SEQ ID NO: 562335 - protein, 9 aa, Homo Sapiens
REVTLPQCS

SEQ ID NO: 562336 - protein, 9 aa, Homo Sapiens
AAAKAADMD

SEQ ID NO: 562337 - protein, 9 aa, Homo Sapiens
MVVGSWGWW

SEQ ID NO: 562338 - protein, 9 aa, Homo Sapiens
FKKWVGAPS

SEQ ID NO: 562339 - protein, 9 aa, Homo Sapiens
GLEGCSEET

SEQ ID NO: 562340 - protein, 9 aa, Homo Sapiens
DMDPVNSYQ

SEQ ID NO: 562341 - protein, 9 aa, Homo Sapiens
LYLRKSWTI

SEQ ID NO: 562342 - protein, 9 aa, Homo Sapiens
GHPRSVSET

SEQ ID NO: 562343 - protein, 9 aa, Homo Sapiens
SRAAMAPGS

SEQ ID NO: 562344 - protein, 9 aa, Homo Sapiens
IGDFGLATE

SEQ ID NO: 562345 - protein, 9 aa, Homo Sapiens
IQEPLARAK

SEQ ID NO: 562346 - protein, 9 aa, Homo Sapiens
KANPGQEMQ

SEQ ID NO: 562347 - protein, 9 aa, Homo Sapiens
EEDQDPSCS

SEQ ID NO: 562348 - protein, 9 aa, Homo Sapiens
LAKTPMRHG

SEQ ID NO: 562349 - protein, 9 aa, Homo Sapiens
SIEHETAII

SEQ ID NO: 562350 - protein, 9 aa, Homo Sapiens
LSDSRAAMA

SEQ ID NO: 562351 - protein, 9 aa, Homo Sapiens
LLPFVLEPA

SEQ ID NO: 562352 - protein, 9 aa, Homo Sapiens
QDPSCSRLS

SEQ ID NO: 562353 - protein, 9 aa, Homo Sapiens
QEPLARAKR

SEQ ID NO: 562354 - protein, 9 aa, Homo Sapiens
EWDILLKGV

SEQ ID NO: 562355 - protein, 9 aa, Homo Sapiens
VVLSGTAIY

SEQ ID NO: 562356 - protein, 9 aa, Homo Sapiens
HETAIIKTA

SEQ ID NO: 562357 - protein, 9 aa, Homo Sapiens
PLLPFVLEP

SEQ ID NO: 562358 - protein, 9 aa, Homo Sapiens
LARAKRRPI

SEQ ID NO: 562359 - protein, 9 aa, Homo Sapiens
QEMQEGKAN

SEQ ID NO: 562360 - protein, 9 aa, Homo Sapiens
RALFVCPSQ

SEQ ID NO: 562361 - protein, 9 aa, Homo Sapiens
ALFVCPSQP

SEQ ID NO: 562362 - protein, 9 aa, Homo Sapiens
VLSDSRAAM

SEQ ID NO: 562363 - protein, 9 aa, Homo Sapiens
SRLSRELLD

SEQ ID NO: 562364 - protein, 9 aa, Homo Sapiens
GVPGQASPL

SEQ ID NO: 562365 - protein, 9 aa, Homo Sapiens
LATEKSRWS

SEQ ID NO: 562366 - protein, 9 aa, Homo Sapiens
KGVQCSIIS

SEQ ID NO: 562367 - protein, 9 aa, Homo Sapiens
MCVTGTALK

SEQ ID NO: 562368 - protein, 9 aa, Homo Sapiens
IEHETAIIK

SEQ ID NO: 562369 - protein, 9 aa, Homo Sapiens
EMQEGKANP

SEQ ID NO: 562370 - protein, 9 aa, Homo Sapiens
VLEPAMCVT

SEQ ID NO: 562371 - protein, 9 aa, Homo Sapiens
AKTPMRHGV

SEQ ID NO: 562372 - protein, 9 aa, Homo Sapiens
SCSRLSREL

SEQ ID NO: 562373 - protein, 9 aa, Homo Sapiens
VTGTALKRS

SEQ ID NO: 562374 - protein, 9 aa, Homo Sapiens
YFSIEHETA

SEQ ID NO: 562375 - protein, 9 aa, Homo Sapiens
PYFSIEHET

SEQ ID NO: 562376 - protein, 9 aa, Homo Sapiens
GQASPLLPF

SEQ ID NO: 562377 - protein, 9 aa, Homo Sapiens
LKGVQCSII

SEQ ID NO: 562378 - protein, 9 aa, Homo Sapiens
PAMCVTGTA

SEQ ID NO: 562379 - protein, 9 aa, Homo Sapiens
RHGVPGQAS

SEQ ID NO: 562380 - protein, 9 aa, Homo Sapiens
EKSRWSGSH

SEQ ID NO: 562381 - protein, 9 aa, Homo Sapiens
ILLKGVQCS

SEQ ID NO: 562382 - protein, 9 aa, Homo Sapiens
MQEGKANPG

SEQ ID NO: 562383 - protein, 9 aa, Homo Sapiens
YNFPTVQHQ

SEQ ID NO: 562384 - protein, 9 aa, Homo Sapiens
AIYNFPTVQ

SEQ ID NO: 562385 - protein, 9 aa, Homo Sapiens
DGNLLRRAL

SEQ ID NO: 562386 - protein, 9 aa, Homo Sapiens
LSGTAIYNF

SEQ ID NO: 562387 - protein, 9 aa, Homo Sapiens
LLRRALFVC

SEQ ID NO: 562388 - protein, 9 aa, Homo Sapiens
PMRHGVPGQ

SEQ ID NO: 562389 - protein, 9 aa, Homo Sapiens
ARAKRRPIV

SEQ ID NO: 562390 - protein, 9 aa, Homo Sapiens
GLATEKSRW

SEQ ID NO: 562391 - protein, 9 aa, Homo Sapiens
GVQCSIISV

SEQ ID NO: 562392 - protein, 9 aa, Homo Sapiens
DFGLATEKS

SEQ ID NO: 562393 - protein, 9 aa, Homo Sapiens
GDFGLATEK

SEQ ID NO: 562394 - protein, 9 aa, Homo Sapiens
DQDPSCSRL

SEQ ID NO: 562395 - protein, 9 aa, Homo Sapiens
EDQDPSCSR

SEQ ID NO: 562396 - protein, 9 aa, Homo Sapiens
IYNFPTVQH

SEQ ID NO: 562397 - protein, 9 aa, Homo Sapiens
SDSRAAMAP

SEQ ID NO: 562398 - protein, 9 aa, Homo Sapiens
GTAIYNFPT

SEQ ID NO: 562399 - protein, 9 aa, Homo Sapiens
ASPLLPFVL

SEQ ID NO: 562400 - protein, 9 aa, Homo Sapiens
QASPLLPFV

SEQ ID NO: 562401 - protein, 9 aa, Homo Sapiens
RAAMAPGSS

SEQ ID NO: 562402 - protein, 9 aa, Homo Sapiens
TPMRHGVPG

SEQ ID NO: 562403 - protein, 9 aa, Homo Sapiens
FQEMQEGKA

SEQ ID NO: 562404 - protein, 9 aa, Homo Sapiens
LRRALFVCP

SEQ ID NO: 562405 - protein, 9 aa, Homo Sapiens
DSRAAMAPG

SEQ ID NO: 562406 - protein, 9 aa, Homo Sapiens
VLSGTAIYN

SEQ ID NO: 562407 - protein, 9 aa, Homo Sapiens
GKANPGQEM

SEQ ID NO: 562408 - protein, 9 aa, Homo Sapiens
NVLSDSRAA

SEQ ID NO: 562409 - protein, 9 aa, Homo Sapiens
ATEKSRWSG

SEQ ID NO: 562410 - protein, 9 aa, Homo Sapiens
RRALFVCPS

SEQ ID NO: 562411 - protein, 9 aa, Homo Sapiens
LLKGVQCSI

SEQ ID NO: 562412 - protein, 9 aa, Homo Sapiens
HGVPGQASP

SEQ ID NO: 562413 - protein, 9 aa, Homo Sapiens
AMCVTGTAL

SEQ ID NO: 562414 - protein, 9 aa, Homo Sapiens
QEGKANPGQ

SEQ ID NO: 562415 - protein, 9 aa, Homo Sapiens
TAIYNFPTV

SEQ ID NO: 562416 - protein, 9 aa, Homo Sapiens
GNLLRRALF

SEQ ID NO: 562417 - protein, 9 aa, Homo Sapiens
LEPAMCVTG

SEQ ID NO: 562418 - protein, 9 aa, Homo Sapiens
PFVLEPAMC

SEQ ID NO: 562419 - protein, 9 aa, Homo Sapiens
PGQASPLLP

SEQ ID NO: 562420 - protein, 9 aa, Homo Sapiens
DILLKGVQC

SEQ ID NO: 562421 - protein, 9 aa, Homo Sapiens
QPYFSIEHE

SEQ ID NO: 562422 - protein, 9 aa, Homo Sapiens
SGTAIYNFP

SEQ ID NO: 562423 - protein, 9 aa, Homo Sapiens
VPGQASPLL

SEQ ID NO: 562424 - protein, 9 aa, Homo Sapiens
LPFVLEPAM

SEQ ID NO: 562425 - protein, 9 aa, Homo Sapiens
TEKSRWSGS

SEQ ID NO: 562426 - protein, 9 aa, Homo Sapiens
EPAMCVTGT

SEQ ID NO: 562427 - protein, 9 aa, Homo Sapiens
GQPYFSIEH

SEQ ID NO: 562428 - protein, 9 aa, Homo Sapiens
EGKANPGQE

SEQ ID NO: 562429 - protein, 9 aa, Homo Sapiens
AAMAPGSSH

SEQ ID NO: 562430 - protein, 9 aa, Homo Sapiens
EHETAIIKT

SEQ ID NO: 562431 - protein, 9 aa, Homo Sapiens
DPSCSRLSR

SEQ ID NO: 562432 - protein, 9 aa, Homo Sapiens
SPLLPFVLE

SEQ ID NO: 562433 - protein, 9 aa, Homo Sapiens
KLAKTPMRH

SEQ ID NO: 562434 - protein, 9 aa, Homo Sapiens
FVLEPAMCV

SEQ ID NO: 562435 - protein, 9 aa, Homo Sapiens
EIQEPLARA

SEQ ID NO: 562436 - protein, 9 aa, Homo Sapiens
WDILLKGVQ

SEQ ID NO: 562437 - protein, 9 aa, Homo Sapiens
EPLARAKRR

SEQ ID NO: 562438 - protein, 9 aa, Homo Sapiens
KTPMRHGVP

SEQ ID NO: 562439 - protein, 9 aa, Homo Sapiens
YDGNLLRRA

SEQ ID NO: 562440 - protein, 9 aa, Homo Sapiens
SEWDILLKG

SEQ ID NO: 562441 - protein, 9 aa, Homo Sapiens
NLLRRALFV

SEQ ID NO: 562442 - protein, 9 aa, Homo Sapiens
MRHGVPGQA

SEQ ID NO: 562443 - protein, 9 aa, Homo Sapiens
PSCSRLSRE

SEQ ID NO: 562444 - protein, 9 aa, Homo Sapiens
CVTGTALKR

SEQ ID NO: 562445 - protein, 9 aa, Homo Sapiens
FGLATEKSR

SEQ ID NO: 562446 - protein, 9 aa, Homo Sapiens
TFQEMQEGK

SEQ ID NO: 562447 - protein, 9 aa, Homo Sapiens
CSRLSRELL

SEQ ID NO: 562448 - protein, 9 aa, Homo Sapiens
FSIEHETAI

SEQ ID NO: 562449 - protein, 9 aa, Homo Sapiens
PLARAKRRP

SEQ ID NO: 562450 - protein, 9 aa, Homo Sapiens
RNVLSDSRA

SEQ ID NO: 562451 - protein, 9 aa, Homo Sapiens
PHWGAEQLL

SEQ ID NO: 562452 - protein, 9 aa, Homo Sapiens
FAKGTVFGR

SEQ ID NO: 562453 - protein, 9 aa, Homo Sapiens
HEELIAQKK

SEQ ID NO: 562454 - protein, 9 aa, Homo Sapiens
CTVPCAVPC

SEQ ID NO: 562455 - protein, 9 aa, Homo Sapiens
TLEYRPIID

SEQ ID NO: 562456 - protein, 9 aa, Homo Sapiens
QNALHHHHS

SEQ ID NO: 562457 - protein, 9 aa, Homo Sapiens
LVGVQEKQC

SEQ ID NO: 562458 - protein, 9 aa, Homo Sapiens
ENGSVGLKN

SEQ ID NO: 562459 - protein, 9 aa, Homo Sapiens
SIFQEEGGV

SEQ ID NO: 562460 - protein, 9 aa, Homo Sapiens
FTNMEDPGE

SEQ ID NO: 562461 - protein, 9 aa, Homo Sapiens
NILHHEELI

SEQ ID NO: 562462 - protein, 9 aa, Homo Sapiens
VPCTVPCAV

SEQ ID NO: 562463 - protein, 9 aa, Homo Sapiens
ELQQTLVPV

SEQ ID NO: 562464 - protein, 9 aa, Homo Sapiens
KILYNRQKH

SEQ ID NO: 562465 - protein, 9 aa, Homo Sapiens
PLLICHRFI

SEQ ID NO: 562466 - protein, 9 aa, Homo Sapiens
VGEAVANEN

SEQ ID NO: 562467 - protein, 9 aa, Homo Sapiens
ERPNALLSS

SEQ ID NO: 562468 - protein, 9 aa, Homo Sapiens
PCTVPCAVP

SEQ ID NO: 562469 - protein, 9 aa, Homo Sapiens
GSGGAAAAP

SEQ ID NO: 562470 - protein, 9 aa, Homo Sapiens
WMDICRLWG

SEQ ID NO: 562471 - protein, 9 aa, Homo Sapiens
YVRVMLVPS

SEQ ID NO: 562472 - protein, 9 aa, Homo Sapiens
AHRTVQQSG

SEQ ID NO: 562473 - protein, 9 aa, Homo Sapiens
GLCKTICGV

SEQ ID NO: 562474 - protein, 9 aa, Homo Sapiens
LFPVLERRG

SEQ ID NO: 562475 - protein, 9 aa, Homo Sapiens
NVYGLKRIV

SEQ ID NO: 562476 - protein, 9 aa, Homo Sapiens
NKENGSVGL

SEQ ID NO: 562477 - protein, 9 aa, Homo Sapiens
TLDLSMHEH

SEQ ID NO: 562478 - protein, 9 aa, Homo Sapiens
QEEGGVCSP

SEQ ID NO: 562479 - protein, 9 aa, Homo Sapiens
VGITAKLLQ

SEQ ID NO: 562480 - protein, 9 aa, Homo Sapiens
RGAWEPGNQ

SEQ ID NO: 562481 - protein, 9 aa, Homo Sapiens
TPLKSDERP

SEQ ID NO: 562482 - protein, 9 aa, Homo Sapiens
APYLLDTGL

SEQ ID NO: 562483 - protein, 9 aa, Homo Sapiens
EPGNQLGPV

SEQ ID NO: 562484 - protein, 9 aa, Homo Sapiens
LAHPHWGAE

SEQ ID NO: 562485 - protein, 9 aa, Homo Sapiens
SSQYVIQMQ

SEQ ID NO: 562486 - protein, 9 aa, Homo Sapiens
EEDPAAVSF

SEQ ID NO: 562487 - protein, 9 aa, Homo Sapiens
RQRIHTGEK

SEQ ID NO: 562488 - protein, 9 aa, Homo Sapiens
IRASKSAAQ

SEQ ID NO: 562489 - protein, 9 aa, Homo Sapiens
KTETSLTTK

SEQ ID NO: 562490 - protein, 9 aa, Homo Sapiens
SFQGYLRQT

SEQ ID NO: 562491 - protein, 9 aa, Homo Sapiens
VPSALDTNS

SEQ ID NO: 562492 - protein, 9 aa, Homo Sapiens
LLQWRTNST

SEQ ID NO: 562493 - protein, 9 aa, Homo Sapiens
YHLGLCYEK

SEQ ID NO: 562494 - protein, 9 aa, Homo Sapiens
RAQDINRRT

SEQ ID NO: 562495 - protein, 9 aa, Homo Sapiens
ASKSAAQNL

SEQ ID NO: 562496 - protein, 9 aa, Homo Sapiens
YFEMENDLP

SEQ ID NO: 562497 - protein, 9 aa, Homo Sapiens
GNQLGPVEV

SEQ ID NO: 562498 - protein, 9 aa, Homo Sapiens
GRVWMDICR

SEQ ID NO: 562499 - protein, 9 aa, Homo Sapiens
VWMDICRLW

SEQ ID NO: 562500 - protein, 9 aa, Homo Sapiens
RGSGGAAAA

SEQ ID NO: 562501 - protein, 9 aa, Homo Sapiens
EYVRVMLVP

SEQ ID NO: 562502 - protein, 9 aa, Homo Sapiens
PHPTTPHPT

SEQ ID NO: 562503 - protein, 9 aa, Homo Sapiens
WEPGNQLGP

SEQ ID NO: 562504 - protein, 9 aa, Homo Sapiens
TNMEDPGEH

SEQ ID NO: 562505 - protein, 9 aa, Homo Sapiens
DEEKGEFLP

SEQ ID NO: 562506 - protein, 9 aa, Homo Sapiens
GSITISKCA

SEQ ID NO: 562507 - protein, 9 aa, Homo Sapiens
FLDMFIYAI

SEQ ID NO: 562508 - protein, 9 aa, Homo Sapiens
YFTNMEDPG

SEQ ID NO: 562509 - protein, 9 aa, Homo Sapiens
RRELQQTLV

SEQ ID NO: 562510 - protein, 9 aa, Homo Sapiens
PGNQLGPVE

SEQ ID NO: 562511 - protein, 9 aa, Homo Sapiens
LQKEIRRKF

SEQ ID NO: 562512 - protein, 9 aa, Homo Sapiens
FEGWKAAVP

SEQ ID NO: 562513 - protein, 9 aa, Homo Sapiens
PGPPSTTDM

SEQ ID NO: 562514 - protein, 9 aa, Homo Sapiens
MDICRLWGH

SEQ ID NO: 562515 - protein, 9 aa, Homo Sapiens
RDKREKVSL

SEQ ID NO: 562516 - protein, 9 aa, Homo Sapiens
LPQEQKVQI

SEQ ID NO: 562517 - protein, 9 aa, Homo Sapiens
GQPGSQVPD

SEQ ID NO: 562518 - protein, 9 aa, Homo Sapiens
HSNSSHHHH

SEQ ID NO: 562519 - protein, 9 aa, Homo Sapiens
SFRKLQKLN

SEQ ID NO: 562520 - protein, 9 aa, Homo Sapiens
QWRTNSTRH

SEQ ID NO: 562521 - protein, 9 aa, Homo Sapiens
GEREATSSP

SEQ ID NO: 562522 - protein, 9 aa, Homo Sapiens
MAPAMEPET

SEQ ID NO: 562523 - protein, 9 aa, Homo Sapiens
LDLSMHEHR

SEQ ID NO: 562524 - protein, 9 aa, Homo Sapiens
AVANENWDL

SEQ ID NO: 562525 - protein, 9 aa, Homo Sapiens
EKQCVDGEW

SEQ ID NO: 562526 - protein, 9 aa, Homo Sapiens
EPGPPSTTD

SEQ ID NO: 562527 - protein, 9 aa, Homo Sapiens
TLAAPYLLD

SEQ ID NO: 562528 - protein, 9 aa, Homo Sapiens
EDEDSDKDC

SEQ ID NO: 562529 - protein, 9 aa, Homo Sapiens
IKAHRTVQQ

SEQ ID NO: 562530 - protein, 9 aa, Homo Sapiens
TSASFSENV

SEQ ID NO: 562531 - protein, 9 aa, Homo Sapiens
GPPSTTDMH

SEQ ID NO: 562532 - protein, 9 aa, Homo Sapiens
IYCHPEASV

SEQ ID NO: 562533 - protein, 9 aa, Homo Sapiens
VKVGEAVAN

SEQ ID NO: 562534 - protein, 9 aa, Homo Sapiens
IKKYSHVNK

SEQ ID NO: 562535 - protein, 9 aa, Homo Sapiens
EYFTNMEDP

SEQ ID NO: 562536 - protein, 9 aa, Homo Sapiens
YTGEKPYEC

SEQ ID NO: 562537 - protein, 9 aa, Homo Sapiens
ALPALAPLT

SEQ ID NO: 562538 - protein, 9 aa, Homo Sapiens
TETGEREAT

SEQ ID NO: 562539 - protein, 9 aa, Homo Sapiens
QNGTKTCME

SEQ ID NO: 562540 - protein, 9 aa, Homo Sapiens
PDVKNEDED

SEQ ID NO: 562541 - protein, 9 aa, Homo Sapiens
LYNRQKHYD

SEQ ID NO: 562542 - protein, 9 aa, Homo Sapiens
FGTCISHVC

SEQ ID NO: 562543 - protein, 9 aa, Homo Sapiens
CHPEASVLL

SEQ ID NO: 562544 - protein, 9 aa, Homo Sapiens
AGRSHPKWH

SEQ ID NO: 562545 - protein, 9 aa, Homo Sapiens
FPVLERRGL

SEQ ID NO: 562546 - protein, 9 aa, Homo Sapiens
SQTDRQGQG

SEQ ID NO: 562547 - protein, 9 aa, Homo Sapiens
ILYNRQKHY

SEQ ID NO: 562548 - protein, 9 aa, Homo Sapiens
YLLDTGLGI

SEQ ID NO: 562549 - protein, 9 aa, Homo Sapiens
QLPRRLPDS

SEQ ID NO: 562550 - protein, 9 aa, Homo Sapiens
PGIFRGDKW

SEQ ID NO: 562551 - protein, 9 aa, Homo Sapiens
PTEKGATCL

SEQ ID NO: 562552 - protein, 9 aa, Homo Sapiens
SDERPNALL

SEQ ID NO: 562553 - protein, 9 aa, Homo Sapiens
MQPTTTPHP

SEQ ID NO: 562554 - protein, 9 aa, Homo Sapiens
ESVPVLPRS

SEQ ID NO: 562555 - protein, 9 aa, Homo Sapiens
TNSTRHTSR

SEQ ID NO: 562556 - protein, 9 aa, Homo Sapiens
RTNSTRHTS

SEQ ID NO: 562557 - protein, 9 aa, Homo Sapiens
KIGFRLMER

SEQ ID NO: 562558 - protein, 9 aa, Homo Sapiens
KIEVSFRKL

SEQ ID NO: 562559 - protein, 9 aa, Homo Sapiens
KMSNLIRRQ

SEQ ID NO: 562560 - protein, 9 aa, Homo Sapiens
MEKIGFRLM

SEQ ID NO: 562561 - protein, 9 aa, Homo Sapiens
WGGAMEKIG

SEQ ID NO: 562562 - protein, 9 aa, Homo Sapiens
KLMSRKTYV

SEQ ID NO: 562563 - protein, 9 aa, Homo Sapiens
GVCSPDAAA

SEQ ID NO: 562564 - protein, 9 aa, Homo Sapiens
DISVPQQQG

SEQ ID NO: 562565 - protein, 9 aa, Homo Sapiens
SFSENVYGL

SEQ ID NO: 562566 - protein, 9 aa, Homo Sapiens
RFVKVGEAV

SEQ ID NO: 562567 - protein, 9 aa, Homo Sapiens
PYSCSTTAV

SEQ ID NO: 562568 - protein, 9 aa, Homo Sapiens
ACLGRVWMD

SEQ ID NO: 562569 - protein, 9 aa, Homo Sapiens
GRSKDELAL

SEQ ID NO: 562570 - protein, 9 aa, Homo Sapiens
SITISKCAA

SEQ ID NO: 562571 - protein, 9 aa, Homo Sapiens
PQALSPMYP

SEQ ID NO: 562572 - protein, 9 aa, Homo Sapiens
QHLLAHPHW

SEQ ID NO: 562573 - protein, 9 aa, Homo Sapiens
ILSRIMAGL

SEQ ID NO: 562574 - protein, 9 aa, Homo Sapiens
RPALLQWRT

SEQ ID NO: 562575 - protein, 9 aa, Homo Sapiens
SHPKWHRAS

SEQ ID NO: 562576 - protein, 9 aa, Homo Sapiens
ASFSENVYG

SEQ ID NO: 562577 - protein, 9 aa, Homo Sapiens
ESSCCRPSC

SEQ ID NO: 562578 - protein, 9 aa, Homo Sapiens
VLPRSGEAG

SEQ ID NO: 562579 - protein, 9 aa, Homo Sapiens
AAPGERGRT

SEQ ID NO: 562580 - protein, 9 aa, Homo Sapiens
LQQTLVPVM

SEQ ID NO: 562581 - protein, 9 aa, Homo Sapiens
VFFSHTIKA

SEQ ID NO: 562582 - protein, 9 aa, Homo Sapiens
KEIRRKFGS

SEQ ID NO: 562583 - protein, 9 aa, Homo Sapiens
CLSNLGNTC

SEQ ID NO: 562584 - protein, 9 aa, Homo Sapiens
FTHLFPVLE

SEQ ID NO: 562585 - protein, 9 aa, Homo Sapiens
THLFPVLER

SEQ ID NO: 562586 - protein, 9 aa, Homo Sapiens
SRYHLGLCY

SEQ ID NO: 562587 - protein, 9 aa, Homo Sapiens
FLSSLKGGV

SEQ ID NO: 562588 - protein, 9 aa, Homo Sapiens
FKTETSLTT

SEQ ID NO: 562589 - protein, 9 aa, Homo Sapiens
PRSGEAGVS

SEQ ID NO: 562590 - protein, 9 aa, Homo Sapiens
TGKAQKGGT

SEQ ID NO: 562591 - protein, 9 aa, Homo Sapiens
LDPAGSWTC

SEQ ID NO: 562592 - protein, 9 aa, Homo Sapiens
NALHHHHSN

SEQ ID NO: 562593 - protein, 9 aa, Homo Sapiens
PFAKGTVFG

SEQ ID NO: 562594 - protein, 9 aa, Homo Sapiens
KEQEILSRI

SEQ ID NO: 562595 - protein, 9 aa, Homo Sapiens
SIEEIEEEY

SEQ ID NO: 562596 - protein, 9 aa, Homo Sapiens
EGWKAAVPS

SEQ ID NO: 562597 - protein, 9 aa, Homo Sapiens
SYHPGIFRG

SEQ ID NO: 562598 - protein, 9 aa, Homo Sapiens
YILRAQDIN

SEQ ID NO: 562599 - protein, 9 aa, Homo Sapiens
MDYSNSCLQ

SEQ ID NO: 562600 - protein, 9 aa, Homo Sapiens
ASVGSREMG

SEQ ID NO: 562601 - protein, 9 aa, Homo Sapiens
ALLQWRTNS

SEQ ID NO: 562602 - protein, 9 aa, Homo Sapiens
SMMDYSNSC

SEQ ID NO: 562603 - protein, 9 aa, Homo Sapiens
QSQVENTKL

SEQ ID NO: 562604 - protein, 9 aa, Homo Sapiens
KMNMNILHH

SEQ ID NO: 562605 - protein, 9 aa, Homo Sapiens
VIQMQPTNR

SEQ ID NO: 562606 - protein, 9 aa, Homo Sapiens
GTKTCMEGW

SEQ ID NO: 562607 - protein, 9 aa, Homo Sapiens
TDRQGQGSH

SEQ ID NO: 562608 - protein, 9 aa, Homo Sapiens
GRSHPKWHR

SEQ ID NO: 562609 - protein, 9 aa, Homo Sapiens
IYRAELRGI

SEQ ID NO: 562610 - protein, 9 aa, Homo Sapiens
AGSWTCGQP

SEQ ID NO: 562611 - protein, 9 aa, Homo Sapiens
KKRTCFTHL

SEQ ID NO: 562612 - protein, 9 aa, Homo Sapiens
DWAHTGSRS

SEQ ID NO: 562613 - protein, 9 aa, Homo Sapiens
ENERLRPAL

SEQ ID NO: 562614 - protein, 9 aa, Homo Sapiens
RSSEAGKKD

SEQ ID NO: 562615 - protein, 9 aa, Homo Sapiens
CDQNGTKTC

SEQ ID NO: 562616 - protein, 9 aa, Homo Sapiens
GSWTCGQPG

SEQ ID NO: 562617 - protein, 9 aa, Homo Sapiens
TYTGEKPYE

SEQ ID NO: 562618 - protein, 9 aa, Homo Sapiens
LGIAMGKLH

SEQ ID NO: 562619 - protein, 9 aa, Homo Sapiens
TCFTHLFPV

SEQ ID NO: 562620 - protein, 9 aa, Homo Sapiens
CFFNSVGIT

SEQ ID NO: 562621 - protein, 9 aa, Homo Sapiens
RTAPACLGR

SEQ ID NO: 562622 - protein, 9 aa, Homo Sapiens
QPGSQVPDL

SEQ ID NO: 562623 - protein, 9 aa, Homo Sapiens
DMKEQEILS

SEQ ID NO: 562624 - protein, 9 aa, Homo Sapiens
SHLKSSSLP

SEQ ID NO: 562625 - protein, 9 aa, Homo Sapiens
VSFQGYLRQ

SEQ ID NO: 562626 - protein, 9 aa, Homo Sapiens
VQEKQCVDG

SEQ ID NO: 562627 - protein, 9 aa, Homo Sapiens
AGSITISKC

SEQ ID NO: 562628 - protein, 9 aa, Homo Sapiens
HLGLCYEKG

SEQ ID NO: 562629 - protein, 9 aa, Homo Sapiens
FDNQLTIRS

SEQ ID NO: 562630 - protein, 9 aa, Homo Sapiens
TEIKKYSHV

SEQ ID NO: 562631 - protein, 9 aa, Homo Sapiens
QDINRRTGR

SEQ ID NO: 562632 - protein, 9 aa, Homo Sapiens
AVPCTVPCA

SEQ ID NO: 562633 - protein, 9 aa, Homo Sapiens
YHPGIFRGD

SEQ ID NO: 562634 - protein, 9 aa, Homo Sapiens
NMNILHHEE

SEQ ID NO: 562635 - protein, 9 aa, Homo Sapiens
GEAVANENW

SEQ ID NO: 562636 - protein, 9 aa, Homo Sapiens
SLTTKPSLP

SEQ ID NO: 562637 - protein, 9 aa, Homo Sapiens
NTLRSKKVY

SEQ ID NO: 562638 - protein, 9 aa, Homo Sapiens
FSENVYGLK

SEQ ID NO: 562639 - protein, 9 aa, Homo Sapiens
ESLFKTETS

SEQ ID NO: 562640 - protein, 9 aa, Homo Sapiens
EVGEQSHLK

SEQ ID NO: 562641 - protein, 9 aa, Homo Sapiens
FLPQEQKVQ

SEQ ID NO: 562642 - protein, 9 aa, Homo Sapiens
VYNVAPIAG

SEQ ID NO: 562643 - protein, 9 aa, Homo Sapiens
GTSLRCWVV

SEQ ID NO: 562644 - protein, 9 aa, Homo Sapiens
RYHLGLCYE

SEQ ID NO: 562645 - protein, 9 aa, Homo Sapiens
DSDKDCEII

SEQ ID NO: 562646 - protein, 9 aa, Homo Sapiens
HLFPVLERR

SEQ ID NO: 562647 - protein, 9 aa, Homo Sapiens
HPGIFRGDK

SEQ ID NO: 562648 - protein, 9 aa, Homo Sapiens
NSVGITAKL

SEQ ID NO: 562649 - protein, 9 aa, Homo Sapiens
GAWEPGNQL

SEQ ID NO: 562650 - protein, 9 aa, Homo Sapiens
QEKQCVDGE

SEQ ID NO: 562651 - protein, 9 aa, Homo Sapiens
PHTAPAWRR

SEQ ID NO: 562652 - protein, 9 aa, Homo Sapiens
ATETGEREA

SEQ ID NO: 562653 - protein, 9 aa, Homo Sapiens
VLCKEGIKA

SEQ ID NO: 562654 - protein, 9 aa, Homo Sapiens
FNEYISFVE

SEQ ID NO: 562655 - protein, 9 aa, Homo Sapiens
CISHVCAVF

SEQ ID NO: 562656 - protein, 9 aa, Homo Sapiens
TKTCMEGWM

SEQ ID NO: 562657 - protein, 9 aa, Homo Sapiens
VPTEKGATC

SEQ ID NO: 562658 - protein, 9 aa, Homo Sapiens
AALTLSVPT

SEQ ID NO: 562659 - protein, 9 aa, Homo Sapiens
TCLSNLGNT

SEQ ID NO: 562660 - protein, 9 aa, Homo Sapiens
HPATETGER

SEQ ID NO: 562661 - protein, 9 aa, Homo Sapiens
GATCLSNLG

SEQ ID NO: 562662 - protein, 9 aa, Homo Sapiens
MEDPGEHHF

SEQ ID NO: 562663 - protein, 9 aa, Homo Sapiens
TYVFFSHTI

SEQ ID NO: 562664 - protein, 9 aa, Homo Sapiens
DICRLWGHV

SEQ ID NO: 562665 - protein, 9 aa, Homo Sapiens
SMHEHRKRE

SEQ ID NO: 562666 - protein, 9 aa, Homo Sapiens
TVTGENLLP

SEQ ID NO: 562667 - protein, 9 aa, Homo Sapiens
LQLDEEKGE

SEQ ID NO: 562668 - protein, 9 aa, Homo Sapiens
NQLGPVEVK

SEQ ID NO: 562669 - protein, 9 aa, Homo Sapiens
YNRQKHYDP

SEQ ID NO: 562670 - protein, 9 aa, Homo Sapiens
EDPAAVSFQ

SEQ ID NO: 562671 - protein, 9 aa, Homo Sapiens
SSSLPQALS

SEQ ID NO: 562672 - protein, 9 aa, Homo Sapiens
FTPLKSDER

SEQ ID NO: 562673 - protein, 9 aa, Homo Sapiens
ALHHHHSNS

SEQ ID NO: 562674 - protein, 9 aa, Homo Sapiens
NLIRRQRIH

SEQ ID NO: 562675 - protein, 9 aa, Homo Sapiens
ISETEEVAL

SEQ ID NO: 562676 - protein, 9 aa, Homo Sapiens
MYPHTAPAW

SEQ ID NO: 562677 - protein, 9 aa, Homo Sapiens
KVYNVAPIA

SEQ ID NO: 562678 - protein, 9 aa, Homo Sapiens
LKSDERPNA

SEQ ID NO: 562679 - protein, 9 aa, Homo Sapiens
CSTTAVVTN

SEQ ID NO: 562680 - protein, 9 aa, Homo Sapiens
QPTTTPHPT

SEQ ID NO: 562681 - protein, 9 aa, Homo Sapiens
CGQPGSQVP

SEQ ID NO: 562682 - protein, 9 aa, Homo Sapiens
EMENDLPQK

SEQ ID NO: 562683 - protein, 9 aa, Homo Sapiens
STVTGENLL

SEQ ID NO: 562684 - protein, 9 aa, Homo Sapiens
KENKRDKRE

SEQ ID NO: 562685 - protein, 9 aa, Homo Sapiens
SQKAQPGIS

SEQ ID NO: 562686 - protein, 9 aa, Homo Sapiens
DMFIYAIFG

SEQ ID NO: 562687 - protein, 9 aa, Homo Sapiens
KGKLEYVRV

SEQ ID NO: 562688 - protein, 9 aa, Homo Sapiens
PALLQWRTN

SEQ ID NO: 562689 - protein, 9 aa, Homo Sapiens
GSVGLKNSM

SEQ ID NO: 562690 - protein, 9 aa, Homo Sapiens
STTDMHLVT

SEQ ID NO: 562691 - protein, 9 aa, Homo Sapiens
GIFRGDKWS

SEQ ID NO: 562692 - protein, 9 aa, Homo Sapiens
HAVPCTVPC

SEQ ID NO: 562693 - protein, 9 aa, Homo Sapiens
QTDRQGQGS

SEQ ID NO: 562694 - protein, 9 aa, Homo Sapiens
LSSCIPLLI

SEQ ID NO: 562695 - protein, 9 aa, Homo Sapiens
KAQPGISET

SEQ ID NO: 562696 - protein, 9 aa, Homo Sapiens
APACLGRVW

SEQ ID NO: 562697 - protein, 9 aa, Homo Sapiens
SFQLPRRLP

SEQ ID NO: 562698 - protein, 9 aa, Homo Sapiens
ILDEKIYCH

SEQ ID NO: 562699 - protein, 9 aa, Homo Sapiens
RQKHYDPRT

SEQ ID NO: 562700 - protein, 9 aa, Homo Sapiens
GGTAGRSHP

SEQ ID NO: 562701 - protein, 9 aa, Homo Sapiens
QQTLVPVMK

SEQ ID NO: 562702 - protein, 9 aa, Homo Sapiens
GAALTLSVP

SEQ ID NO: 562703 - protein, 9 aa, Homo Sapiens
AQPGISETE

SEQ ID NO: 562704 - protein, 9 aa, Homo Sapiens
ALAPLTSPA

SEQ ID NO: 562705 - protein, 9 aa, Homo Sapiens
TCISHVCAV

SEQ ID NO: 562706 - protein, 9 aa, Homo Sapiens
SVGLKNSME

SEQ ID NO: 562707 - protein, 9 aa, Homo Sapiens
EAVANENWD

SEQ ID NO: 562708 - protein, 9 aa, Homo Sapiens
STSIYFEME

SEQ ID NO: 562709 - protein, 9 aa, Homo Sapiens
IKMSNLIRR

SEQ ID NO: 562710 - protein, 9 aa, Homo Sapiens
ETGKAQKGG

SEQ ID NO: 562711 - protein, 9 aa, Homo Sapiens
QPGISETEE

SEQ ID NO: 562712 - protein, 9 aa, Homo Sapiens
GTLDLSMHE

SEQ ID NO: 562713 - protein, 9 aa, Homo Sapiens
RRLPDSPVF

SEQ ID NO: 562714 - protein, 9 aa, Homo Sapiens
GISETEEVA

SEQ ID NO: 562715 - protein, 9 aa, Homo Sapiens
AQLQLDEEK

SEQ ID NO: 562716 - protein, 9 aa, Homo Sapiens
PACLGRVWM

SEQ ID NO: 562717 - protein, 9 aa, Homo Sapiens
TICGVCCKA

SEQ ID NO: 562718 - protein, 9 aa, Homo Sapiens
QEVGEQSHL

SEQ ID NO: 562719 - protein, 9 aa, Homo Sapiens
TVIPGAALT

SEQ ID NO: 562720 - protein, 9 aa, Homo Sapiens
LLICHRFIF

SEQ ID NO: 562721 - protein, 9 aa, Homo Sapiens
TGSRSSEAG

SEQ ID NO: 562722 - protein, 9 aa, Homo Sapiens
EKIGFRLME

SEQ ID NO: 562723 - protein, 9 aa, Homo Sapiens
DVSTGKVTL

SEQ ID NO: 562724 - protein, 9 aa, Homo Sapiens
KFGSFIWEQ

SEQ ID NO: 562725 - protein, 9 aa, Homo Sapiens
CSTVTGENL

SEQ ID NO: 562726 - protein, 9 aa, Homo Sapiens
IQMQPTNRC

SEQ ID NO: 562727 - protein, 9 aa, Homo Sapiens
ISFVEKYIE

SEQ ID NO: 562728 - protein, 9 aa, Homo Sapiens
SKDELALYL

SEQ ID NO: 562729 - protein, 9 aa, Homo Sapiens
SQYVIQMQP

SEQ ID NO: 562730 - protein, 9 aa, Homo Sapiens
EEKGEFLPI

SEQ ID NO: 562731 - protein, 9 aa, Homo Sapiens
HPTTPHPTT

SEQ ID NO: 562732 - protein, 9 aa, Homo Sapiens
RRKFGSFIW

SEQ ID NO: 562733 - protein, 9 aa, Homo Sapiens
EIKKYSHVN

SEQ ID NO: 562734 - protein, 9 aa, Homo Sapiens
RLDPAGSWT

SEQ ID NO: 562735 - protein, 9 aa, Homo Sapiens
EKIYCHPEA

SEQ ID NO: 562736 - protein, 9 aa, Homo Sapiens
APLTSPAKT

SEQ ID NO: 562737 - protein, 9 aa, Homo Sapiens
VYGLKRIVM

SEQ ID NO: 562738 - protein, 9 aa, Homo Sapiens
DEKIYCHPE

SEQ ID NO: 562739 - protein, 9 aa, Homo Sapiens
VGEQSHLKS

SEQ ID NO: 562740 - protein, 9 aa, Homo Sapiens
LSPYSCSTT

SEQ ID NO: 562741 - protein, 9 aa, Homo Sapiens
ICGVCCKAE

SEQ ID NO: 562742 - protein, 9 aa, Homo Sapiens
LCKTICGVC

SEQ ID NO: 562743 - protein, 9 aa, Homo Sapiens
QKHYDPRTG

SEQ ID NO: 562744 - protein, 9 aa, Homo Sapiens
LRAQDINRR

SEQ ID NO: 562745 - protein, 9 aa, Homo Sapiens
SLRCWVVLG

SEQ ID NO: 562746 - protein, 9 aa, Homo Sapiens
DNQLTIRSP

SEQ ID NO: 562747 - protein, 9 aa, Homo Sapiens
IFQEEGGVC

SEQ ID NO: 562748 - protein, 9 aa, Homo Sapiens
PPPSQLSSH

SEQ ID NO: 562749 - protein, 9 aa, Homo Sapiens
CLGRVWMDI

SEQ ID NO: 562750 - protein, 9 aa, Homo Sapiens
ENTKLFSKK

SEQ ID NO: 562751 - protein, 9 aa, Homo Sapiens
EGGVCSPDA

SEQ ID NO: 562752 - protein, 9 aa, Homo Sapiens
LIRHQRTYT

SEQ ID NO: 562753 - protein, 9 aa, Homo Sapiens
MNMNILHHE

SEQ ID NO: 562754 - protein, 9 aa, Homo Sapiens
HPHWGAEQL

SEQ ID NO: 562755 - protein, 9 aa, Homo Sapiens
KSMMDYSNS

SEQ ID NO: 562756 - protein, 9 aa, Homo Sapiens
ITISKCAAE

SEQ ID NO: 562757 - protein, 9 aa, Homo Sapiens
QMQPTNRCL

SEQ ID NO: 562758 - protein, 9 aa, Homo Sapiens
LLLFLDMFI

SEQ ID NO: 562759 - protein, 9 aa, Homo Sapiens
AVPSALDTN

SEQ ID NO: 562760 - protein, 9 aa, Homo Sapiens
AETGKAQKG

SEQ ID NO: 562761 - protein, 9 aa, Homo Sapiens
EDSDKDCEI

SEQ ID NO: 562762 - protein, 9 aa, Homo Sapiens
HGGIRASKS

SEQ ID NO: 562763 - protein, 9 aa, Homo Sapiens
EKGEFLPIQ

SEQ ID NO: 562764 - protein, 9 aa, Homo Sapiens
GGRLDPAGS

SEQ ID NO: 562765 - protein, 9 aa, Homo Sapiens
DTLAAPYLL

SEQ ID NO: 562766 - protein, 9 aa, Homo Sapiens
AFTPLKSDE

SEQ ID NO: 562767 - protein, 9 aa, Homo Sapiens
LGRVWMDIC

SEQ ID NO: 562768 - protein, 9 aa, Homo Sapiens
SRKTYVFFS

SEQ ID NO: 562769 - protein, 9 aa, Homo Sapiens
LFSKKQTKS

SEQ ID NO: 562770 - protein, 9 aa, Homo Sapiens
SQVENTKLF

SEQ ID NO: 562771 - protein, 9 aa, Homo Sapiens
LEQCNTEIK

SEQ ID NO: 562772 - protein, 9 aa, Homo Sapiens
SRSSEAGKK

SEQ ID NO: 562773 - protein, 9 aa, Homo Sapiens
KVQIREKPC

SEQ ID NO: 562774 - protein, 9 aa, Homo Sapiens
LKNSMENGR

SEQ ID NO: 562775 - protein, 9 aa, Homo Sapiens
PRGSGGAAA

SEQ ID NO: 562776 - protein, 9 aa, Homo Sapiens
LLSPYSCST

SEQ ID NO: 562777 - protein, 9 aa, Homo Sapiens
LKSSSLPQA

SEQ ID NO: 562778 - protein, 9 aa, Homo Sapiens
FAGSITISK

SEQ ID NO: 562779 - protein, 9 aa, Homo Sapiens
ALTLSVPTP

SEQ ID NO: 562780 - protein, 9 aa, Homo Sapiens
NEYISFVEK

SEQ ID NO: 562781 - protein, 9 aa, Homo Sapiens
SNSSHHHHH

SEQ ID NO: 562782 - protein, 9 aa, Homo Sapiens
GVQEKQCVD

SEQ ID NO: 562783 - protein, 9 aa, Homo Sapiens
FPPFAKGTV

SEQ ID NO: 562784 - protein, 9 aa, Homo Sapiens
QKVQIREKP

SEQ ID NO: 562785 - protein, 9 aa, Homo Sapiens
IEEEYQRAR

SEQ ID NO: 562786 - protein, 9 aa, Homo Sapiens
LSMHEHRKR

SEQ ID NO: 562787 - protein, 9 aa, Homo Sapiens
SVGITAKLL

SEQ ID NO: 562788 - protein, 9 aa, Homo Sapiens
PDWAHTGSR

SEQ ID NO: 562789 - protein, 9 aa, Homo Sapiens
KTYVFFSHT

SEQ ID NO: 562790 - protein, 9 aa, Homo Sapiens
MMDYSNSCL

SEQ ID NO: 562791 - protein, 9 aa, Homo Sapiens
TSLRCWVVL

SEQ ID NO: 562792 - protein, 9 aa, Homo Sapiens
HHSNSSHHH

SEQ ID NO: 562793 - protein, 9 aa, Homo Sapiens
GSYHPGIFR

SEQ ID NO: 562794 - protein, 9 aa, Homo Sapiens
EKGATCLSN

SEQ ID NO: 562795 - protein, 9 aa, Homo Sapiens
FGSFIWEQD

SEQ ID NO: 562796 - protein, 9 aa, Homo Sapiens
PPGQPPPSQ

SEQ ID NO: 562797 - protein, 9 aa, Homo Sapiens
MKEQEILSR

SEQ ID NO: 562798 - protein, 9 aa, Homo Sapiens
ASGLCKTIC

SEQ ID NO: 562799 - protein, 9 aa, Homo Sapiens
TVFGRFDET

SEQ ID NO: 562800 - protein, 9 aa, Homo Sapiens
ASQSKGHQR

SEQ ID NO: 562801 - protein, 9 aa, Homo Sapiens
AAFAGSITI

SEQ ID NO: 562802 - protein, 9 aa, Homo Sapiens
PLKSDERPN

SEQ ID NO: 562803 - protein, 9 aa, Homo Sapiens
IGFRLMERA

SEQ ID NO: 562804 - protein, 9 aa, Homo Sapiens
SENVYGLKR

SEQ ID NO: 562805 - protein, 9 aa, Homo Sapiens
DEDSDKDCE

SEQ ID NO: 562806 - protein, 9 aa, Homo Sapiens
KLEQCNTEI

SEQ ID NO: 562807 - protein, 9 aa, Homo Sapiens
LPRRLPDSP

SEQ ID NO: 562808 - protein, 9 aa, Homo Sapiens
SLFGDISVP

SEQ ID NO: 562809 - protein, 9 aa, Homo Sapiens
SSLPQALSP

SEQ ID NO: 562810 - protein, 9 aa, Homo Sapiens
HTAPAWRRT

SEQ ID NO: 562811 - protein, 9 aa, Homo Sapiens
APAWRRTAP

SEQ ID NO: 562812 - protein, 9 aa, Homo Sapiens
LRPALLQWR

SEQ ID NO: 562813 - protein, 9 aa, Homo Sapiens
GITAKLLQQ

SEQ ID NO: 562814 - protein, 9 aa, Homo Sapiens
PFLPQEQKV

SEQ ID NO: 562815 - protein, 9 aa, Homo Sapiens
FNSVGITAK

SEQ ID NO: 562816 - protein, 9 aa, Homo Sapiens
LFKTETSLT

SEQ ID NO: 562817 - protein, 9 aa, Homo Sapiens
VPVLPRSGE

SEQ ID NO: 562818 - protein, 9 aa, Homo Sapiens
DVKNEDEDS

SEQ ID NO: 562819 - protein, 9 aa, Homo Sapiens
TRHTSRSSS

SEQ ID NO: 562820 - protein, 9 aa, Homo Sapiens
VPCAVPCTV

SEQ ID NO: 562821 - protein, 9 aa, Homo Sapiens
EQKVQIREK

SEQ ID NO: 562822 - protein, 9 aa, Homo Sapiens
LCKEGIKAH

SEQ ID NO: 562823 - protein, 9 aa, Homo Sapiens
EEGGVCSPD

SEQ ID NO: 562824 - protein, 9 aa, Homo Sapiens
VGVQEKQCV

SEQ ID NO: 562825 - protein, 9 aa, Homo Sapiens
KIYCHPEAS

SEQ ID NO: 562826 - protein, 9 aa, Homo Sapiens
KAAVPSALD

SEQ ID NO: 562827 - protein, 9 aa, Homo Sapiens
NKRDKREKV

SEQ ID NO: 562828 - protein, 9 aa, Homo Sapiens
KLQKLNQEK

SEQ ID NO: 562829 - protein, 9 aa, Homo Sapiens
PVLPRSGEA

SEQ ID NO: 562830 - protein, 9 aa, Homo Sapiens
NGSVGLKNS

SEQ ID NO: 562831 - protein, 9 aa, Homo Sapiens
QQSQVENTK

SEQ ID NO: 562832 - protein, 9 aa, Homo Sapiens
ACDQNGTKT

SEQ ID NO: 562833 - protein, 9 aa, Homo Sapiens
LHHEELIAQ

SEQ ID NO: 562834 - protein, 9 aa, Homo Sapiens
KKVYNVAPI

SEQ ID NO: 562835 - protein, 9 aa, Homo Sapiens
TKSMMDYSN

SEQ ID NO: 562836 - protein, 9 aa, Homo Sapiens
PLTSPAKTL

SEQ ID NO: 562837 - protein, 9 aa, Homo Sapiens
PGQPPPSQL

SEQ ID NO: 562838 - protein, 9 aa, Homo Sapiens
PDSPVFDAP

SEQ ID NO: 562839 - protein, 9 aa, Homo Sapiens
QYVIQMQPT

SEQ ID NO: 562840 - protein, 9 aa, Homo Sapiens
QLTIRSPSK

SEQ ID NO: 562841 - protein, 9 aa, Homo Sapiens
CIPLLICHR

SEQ ID NO: 562842 - protein, 9 aa, Homo Sapiens
AHPHWGAEQ

SEQ ID NO: 562843 - protein, 9 aa, Homo Sapiens
LDEEKGEFL

SEQ ID NO: 562844 - protein, 9 aa, Homo Sapiens
MNILHHEEL

SEQ ID NO: 562845 - protein, 9 aa, Homo Sapiens
HEHRKRENA

SEQ ID NO: 562846 - protein, 9 aa, Homo Sapiens
RTCFTHLFP

SEQ ID NO: 562847 - protein, 9 aa, Homo Sapiens
PAWRRTAPA

SEQ ID NO: 562848 - protein, 9 aa, Homo Sapiens
RRQRIHTGE

SEQ ID NO: 562849 - protein, 9 aa, Homo Sapiens
IRKENKRDK

SEQ ID NO: 562850 - protein, 9 aa, Homo Sapiens
NMQQSQVEN

SEQ ID NO: 562851 - protein, 9 aa, Homo Sapiens
CFTHLFPVL

SEQ ID NO: 562852 - protein, 9 aa, Homo Sapiens
FEMENDLPQ

SEQ ID NO: 562853 - protein, 9 aa, Homo Sapiens
AAAPGERGR

SEQ ID NO: 562854 - protein, 9 aa, Homo Sapiens
TIRSPSKRE

SEQ ID NO: 562855 - protein, 9 aa, Homo Sapiens
DPAAVSFQG

SEQ ID NO: 562856 - protein, 9 aa, Homo Sapiens
RKENKRDKR

SEQ ID NO: 562857 - protein, 9 aa, Homo Sapiens
KGTVFGRFD

SEQ ID NO: 562858 - protein, 9 aa, Homo Sapiens
EQEILSRIM

SEQ ID NO: 562859 - protein, 9 aa, Homo Sapiens
AFAGSITIS

SEQ ID NO: 562860 - protein, 9 aa, Homo Sapiens
GIKAHRTVQ

SEQ ID NO: 562861 - protein, 9 aa, Homo Sapiens
SKSIEEIEE

SEQ ID NO: 562862 - protein, 9 aa, Homo Sapiens
EAETGKAQK

SEQ ID NO: 562863 - protein, 9 aa, Homo Sapiens
IPLLICHRF

SEQ ID NO: 562864 - protein, 9 aa, Homo Sapiens
IRRQRIHTG

SEQ ID NO: 562865 - protein, 9 aa, Homo Sapiens
SVGSREMGE

SEQ ID NO: 562866 - protein, 9 aa, Homo Sapiens
RNSTSIYFE

SEQ ID NO: 562867 - protein, 9 aa, Homo Sapiens
LHPATETGE

SEQ ID NO: 562868 - protein, 9 aa, Homo Sapiens
CKTICGVCC

SEQ ID NO: 562869 - protein, 9 aa, Homo Sapiens
CRGAWEPGN

SEQ ID NO: 562870 - protein, 9 aa, Homo Sapiens
LHHHHSNSS

SEQ ID NO: 562871 - protein, 9 aa, Homo Sapiens
WRTNSTRHT

SEQ ID NO: 562872 - protein, 9 aa, Homo Sapiens
GGAAAAPGE

SEQ ID NO: 562873 - protein, 9 aa, Homo Sapiens
HHHHSNSSH

SEQ ID NO: 562874 - protein, 9 aa, Homo Sapiens
KAQKGGTAG

SEQ ID NO: 562875 - protein, 9 aa, Homo Sapiens
TSLTTKPSL

SEQ ID NO: 562876 - protein, 9 aa, Homo Sapiens
AKGTVFGRF

SEQ ID NO: 562877 - protein, 9 aa, Homo Sapiens
LEYVRVMLV

SEQ ID NO: 562878 - protein, 9 aa, Homo Sapiens
VKNEDEDSD

SEQ ID NO: 562879 - protein, 9 aa, Homo Sapiens
FSKKQTKSM

SEQ ID NO: 562880 - protein, 9 aa, Homo Sapiens
HRASQSKGH

SEQ ID NO: 562881 - protein, 9 aa, Homo Sapiens
FEYFTNMED

SEQ ID NO: 562882 - protein, 9 aa, Homo Sapiens
DINRRTGRP

SEQ ID NO: 562883 - protein, 9 aa, Homo Sapiens
SISSQYVIQ

SEQ ID NO: 562884 - protein, 9 aa, Homo Sapiens
AWEPGNQLG

SEQ ID NO: 562885 - protein, 9 aa, Homo Sapiens
SNLIRRQRI

SEQ ID NO: 562886 - protein, 9 aa, Homo Sapiens
LAAPYLLDT

SEQ ID NO: 562887 - protein, 9 aa, Homo Sapiens
KENGSVGLK

SEQ ID NO: 562888 - protein, 9 aa, Homo Sapiens
GIRASKSAA

SEQ ID NO: 562889 - protein, 9 aa, Homo Sapiens
ARRELQQTL

SEQ ID NO: 562890 - protein, 9 aa, Homo Sapiens
PARRELQQT

SEQ ID NO: 562891 - protein, 9 aa, Homo Sapiens
SPYSCSTTA

SEQ ID NO: 562892 - protein, 9 aa, Homo Sapiens
YACDQNGTK

SEQ ID NO: 562893 - protein, 9 aa, Homo Sapiens
KSIEEIEEE

SEQ ID NO: 562894 - protein, 9 aa, Homo Sapiens
VSFRKLQKL

SEQ ID NO: 562895 - protein, 9 aa, Homo Sapiens
SLFKTETSL

SEQ ID NO: 562896 - protein, 9 aa, Homo Sapiens
FRKLQKLNQ

SEQ ID NO: 562897 - protein, 9 aa, Homo Sapiens
IAMGKLHLA

SEQ ID NO: 562898 - protein, 9 aa, Homo Sapiens
HLIRHQRTY

SEQ ID NO: 562899 - protein, 9 aa, Homo Sapiens
IEEIEEEYQ

SEQ ID NO: 562900 - protein, 9 aa, Homo Sapiens
PIFNEYISF

SEQ ID NO: 562901 - protein, 9 aa, Homo Sapiens
HIVKGKLEY

SEQ ID NO: 562902 - protein, 9 aa, Homo Sapiens
HYACDQNGT

SEQ ID NO: 562903 - protein, 9 aa, Homo Sapiens
SQSKGHQRL

SEQ ID NO: 562904 - protein, 9 aa, Homo Sapiens
KQTKSMMDY

SEQ ID NO: 562905 - protein, 9 aa, Homo Sapiens
YYLVGVQEK

SEQ ID NO: 562906 - protein, 9 aa, Homo Sapiens
SGRSKDELA

SEQ ID NO: 562907 - protein, 9 aa, Homo Sapiens
IQGCSTVTG

SEQ ID NO: 562908 - protein, 9 aa, Homo Sapiens
SQSRYHLGL

SEQ ID NO: 562909 - protein, 9 aa, Homo Sapiens
ISSQYVIQM

SEQ ID NO: 562910 - protein, 9 aa, Homo Sapiens
GAAAAPGER

SEQ ID NO: 562911 - protein, 9 aa, Homo Sapiens
GQPPPSQLS

SEQ ID NO: 562912 - protein, 9 aa, Homo Sapiens
NTKLFSKKQ

SEQ ID NO: 562913 - protein, 9 aa, Homo Sapiens
RSHPKWHRA

SEQ ID NO: 562914 - protein, 9 aa, Homo Sapiens
EHRKRENAF

SEQ ID NO: 562915 - protein, 9 aa, Homo Sapiens
CKEGIKAHR

SEQ ID NO: 562916 - protein, 9 aa, Homo Sapiens
HTGSRSSEA

SEQ ID NO: 562917 - protein, 9 aa, Homo Sapiens
LLDTGLGIA

SEQ ID NO: 562918 - protein, 9 aa, Homo Sapiens
PSQLSSHRG

SEQ ID NO: 562919 - protein, 9 aa, Homo Sapiens
KGGTAGRSH

SEQ ID NO: 562920 - protein, 9 aa, Homo Sapiens
QTLVPVMKK

SEQ ID NO: 562921 - protein, 9 aa, Homo Sapiens
RASQSKGHQ

SEQ ID NO: 562922 - protein, 9 aa, Homo Sapiens
AAPYLLDTG

SEQ ID NO: 562923 - protein, 9 aa, Homo Sapiens
KGATCLSNL

SEQ ID NO: 562924 - protein, 9 aa, Homo Sapiens
ILRAQDINR

SEQ ID NO: 562925 - protein, 9 aa, Homo Sapiens
FCFFNSVGI

SEQ ID NO: 562926 - protein, 9 aa, Homo Sapiens
PQEQKVQIR

SEQ ID NO: 562927 - protein, 9 aa, Homo Sapiens
IRSPSKREL

SEQ ID NO: 562928 - protein, 9 aa, Homo Sapiens
SAAQNLHQN

SEQ ID NO: 562929 - protein, 9 aa, Homo Sapiens
GLLLFLDMF

SEQ ID NO: 562930 - protein, 9 aa, Homo Sapiens
RASKSAAQN

SEQ ID NO: 562931 - protein, 9 aa, Homo Sapiens
GLKNSMENG

SEQ ID NO: 562932 - protein, 9 aa, Homo Sapiens
FKLENERLR

SEQ ID NO: 562933 - protein, 9 aa, Homo Sapiens
WTCGQPGSQ

SEQ ID NO: 562934 - protein, 9 aa, Homo Sapiens
LDEKIYCHP

SEQ ID NO: 562935 - protein, 9 aa, Homo Sapiens
LRSKKVYNV

SEQ ID NO: 562936 - protein, 9 aa, Homo Sapiens
CLALHCIAS

SEQ ID NO: 562937 - protein, 9 aa, Homo Sapiens
LPRSGEAGV

SEQ ID NO: 562938 - protein, 9 aa, Homo Sapiens
PGAALTLSV

SEQ ID NO: 562939 - protein, 9 aa, Homo Sapiens
FGDISVPQQ

SEQ ID NO: 562940 - protein, 9 aa, Homo Sapiens
AHTGSRSSE

SEQ ID NO: 562941 - protein, 9 aa, Homo Sapiens
AFGTCISHV

SEQ ID NO: 562942 - protein, 9 aa, Homo Sapiens
AAAAPGERG

SEQ ID NO: 562943 - protein, 9 aa, Homo Sapiens
GEQSHLKSS

SEQ ID NO: 562944 - protein, 9 aa, Homo Sapiens
DPAGSWTCG

SEQ ID NO: 562945 - protein, 9 aa, Homo Sapiens
FQEEGGVCS

SEQ ID NO: 562946 - protein, 9 aa, Homo Sapiens
LIRRQRIHT

SEQ ID NO: 562947 - protein, 9 aa, Homo Sapiens
GLCYEKGLG

SEQ ID NO: 562948 - protein, 9 aa, Homo Sapiens
TGLGIAMGK

SEQ ID NO: 562949 - protein, 9 aa, Homo Sapiens
KLFSKKQTK

SEQ ID NO: 562950 - protein, 9 aa, Homo Sapiens
FVKVGEAVA

SEQ ID NO: 562951 - protein, 9 aa, Homo Sapiens
SGGAAAAPG

SEQ ID NO: 562952 - protein, 9 aa, Homo Sapiens
RRTAPACLG

SEQ ID NO: 562953 - protein, 9 aa, Homo Sapiens
GGIRASKSA

SEQ ID NO: 562954 - protein, 9 aa, Homo Sapiens
PCAVPCTVP

SEQ ID NO: 562955 - protein, 9 aa, Homo Sapiens
GSRSSEAGK

SEQ ID NO: 562956 - protein, 9 aa, Homo Sapiens
HQRTYTGEK

SEQ ID NO: 562957 - protein, 9 aa, Homo Sapiens
TEKGATCLS

SEQ ID NO: 562958 - protein, 9 aa, Homo Sapiens
ISKCAAERT

SEQ ID NO: 562959 - protein, 9 aa, Homo Sapiens
QEILSRIMA

SEQ ID NO: 562960 - protein, 9 aa, Homo Sapiens
VFDNQLTIR

SEQ ID NO: 562961 - protein, 9 aa, Homo Sapiens
LTLSVPTPD

SEQ ID NO: 562962 - protein, 9 aa, Homo Sapiens
HPEASVLLA

SEQ ID NO: 562963 - protein, 9 aa, Homo Sapiens
SSLKGGVLK

SEQ ID NO: 562964 - protein, 9 aa, Homo Sapiens
KNEDEDSDK

SEQ ID NO: 562965 - protein, 9 aa, Homo Sapiens
MSNLIRRQR

SEQ ID NO: 562966 - protein, 9 aa, Homo Sapiens
GTVFGRFDE

SEQ ID NO: 562967 - protein, 9 aa, Homo Sapiens
LTIRSPSKR

SEQ ID NO: 562968 - protein, 9 aa, Homo Sapiens
EGIKAHRTV

SEQ ID NO: 562969 - protein, 9 aa, Homo Sapiens
QLDEEKGEF

SEQ ID NO: 562970 - protein, 9 aa, Homo Sapiens
RSPSKRELA

SEQ ID NO: 562971 - protein, 9 aa, Homo Sapiens
VGLKNSMEN

SEQ ID NO: 562972 - protein, 9 aa, Homo Sapiens
LQWRTNSTR

SEQ ID NO: 562973 - protein, 9 aa, Homo Sapiens
SKKQTKSMM

SEQ ID NO: 562974 - protein, 9 aa, Homo Sapiens
VYILRAQDI

SEQ ID NO: 562975 - protein, 9 aa, Homo Sapiens
VQIREKPCE

SEQ ID NO: 562976 - protein, 9 aa, Homo Sapiens
PRRLPDSPV

SEQ ID NO: 562977 - protein, 9 aa, Homo Sapiens
IFNEYISFV

SEQ ID NO: 562978 - protein, 9 aa, Homo Sapiens
QAKAFGTCI

SEQ ID NO: 562979 - protein, 9 aa, Homo Sapiens
EEIEEEYQR

SEQ ID NO: 562980 - protein, 9 aa, Homo Sapiens
QSRYHLGLC

SEQ ID NO: 562981 - protein, 9 aa, Homo Sapiens
EDMKEQEIL

SEQ ID NO: 562982 - protein, 9 aa, Homo Sapiens
VIPGAALTL

SEQ ID NO: 562983 - protein, 9 aa, Homo Sapiens
DQNGTKTCM

SEQ ID NO: 562984 - protein, 9 aa, Homo Sapiens
KAHRTVQQS

SEQ ID NO: 562985 - protein, 9 aa, Homo Sapiens
ICRLWGHVQ

SEQ ID NO: 562986 - protein, 9 aa, Homo Sapiens
TLRSKKVYN

SEQ ID NO: 562987 - protein, 9 aa, Homo Sapiens
LPALAPLTS

SEQ ID NO: 562988 - protein, 9 aa, Homo Sapiens
KRDKREKVS

SEQ ID NO: 562989 - protein, 9 aa, Homo Sapiens
VAQHLLAHP

SEQ ID NO: 562990 - protein, 9 aa, Homo Sapiens
ISVPQQQGS

SEQ ID NO: 562991 - protein, 9 aa, Homo Sapiens
PMYPHTAPA

SEQ ID NO: 562992 - protein, 9 aa, Homo Sapiens
KQCVDGEWS

SEQ ID NO: 562993 - protein, 9 aa, Homo Sapiens
GCSTVTGEN

SEQ ID NO: 562994 - protein, 9 aa, Homo Sapiens
PAAVSFQGY

SEQ ID NO: 562995 - protein, 9 aa, Homo Sapiens
TTPLPVTSL

SEQ ID NO: 562996 - protein, 9 aa, Homo Sapiens
IEVSFRKLQ

SEQ ID NO: 562997 - protein, 9 aa, Homo Sapiens
TAPACLGRV

SEQ ID NO: 562998 - protein, 9 aa, Homo Sapiens
RKKRTCFTH

SEQ ID NO: 562999 - protein, 9 aa, Homo Sapiens
HLKSSSLPQ

SEQ ID NO: 563000 - protein, 9 aa, Homo Sapiens
YLVGVQEKQ

SEQ ID NO: 563001 - protein, 9 aa, Homo Sapiens
KSAAQNLHQ

SEQ ID NO: 563002 - protein, 9 aa, Homo Sapiens
LSPMYPHTA

SEQ ID NO: 563003 - protein, 9 aa, Homo Sapiens
RCWVVLGFL

SEQ ID NO: 563004 - protein, 9 aa, Homo Sapiens
KAFGTCISH

SEQ ID NO: 563005 - protein, 9 aa, Homo Sapiens
PVLERRGLR

SEQ ID NO: 563006 - protein, 9 aa, Homo Sapiens
LEYRPIIDK

SEQ ID NO: 563007 - protein, 9 aa, Homo Sapiens
GAMEKIGFR

SEQ ID NO: 563008 - protein, 9 aa, Homo Sapiens
KLEYVRVML

SEQ ID NO: 563009 - protein, 9 aa, Homo Sapiens
PGSQVPDLQ

SEQ ID NO: 563010 - protein, 9 aa, Homo Sapiens
VCSPDAAAY

SEQ ID NO: 563011 - protein, 9 aa, Homo Sapiens
QIYRAELRG

SEQ ID NO: 563012 - protein, 9 aa, Homo Sapiens
FVEKYIEEQ

SEQ ID NO: 563013 - protein, 9 aa, Homo Sapiens
IFRGDKWSC

SEQ ID NO: 563014 - protein, 9 aa, Homo Sapiens
ENKRDKREK

SEQ ID NO: 563015 - protein, 9 aa, Homo Sapiens
LMSRKTYVF

SEQ ID NO: 563016 - protein, 9 aa, Homo Sapiens
TTPHPTTPH

SEQ ID NO: 563017 - protein, 9 aa, Homo Sapiens
HHHSNSSHH

SEQ ID NO: 563018 - protein, 9 aa, Homo Sapiens
LLAHPHWGA

SEQ ID NO: 563019 - protein, 9 aa, Homo Sapiens
LSRIMAGLL

SEQ ID NO: 563020 - protein, 9 aa, Homo Sapiens
GDISVPQQQ

SEQ ID NO: 563021 - protein, 9 aa, Homo Sapiens
RSKDELALY

SEQ ID NO: 563022 - protein, 9 aa, Homo Sapiens
HWCIQGCST

SEQ ID NO: 563023 - protein, 9 aa, Homo Sapiens
QKAQPGISE

SEQ ID NO: 563024 - protein, 9 aa, Homo Sapiens
QCNTEIKKY

SEQ ID NO: 563025 - protein, 9 aa, Homo Sapiens
KEGIKAHRT

SEQ ID NO: 563026 - protein, 9 aa, Homo Sapiens
SKKVYNVAP

SEQ ID NO: 563027 - protein, 9 aa, Homo Sapiens
LGLCYEKGL

SEQ ID NO: 563028 - protein, 9 aa, Homo Sapiens
EYISFVEKY

SEQ ID NO: 563029 - protein, 9 aa, Homo Sapiens
GTCISHVCA

SEQ ID NO: 563030 - protein, 9 aa, Homo Sapiens
PVYILRAQD

SEQ ID NO: 563031 - protein, 9 aa, Homo Sapiens
WGGRLDPAG

SEQ ID NO: 563032 - protein, 9 aa, Homo Sapiens
LPDSPVFDA

SEQ ID NO: 563033 - protein, 9 aa, Homo Sapiens
SKSAAQNLH

SEQ ID NO: 563034 - protein, 9 aa, Homo Sapiens
NTEIKKYSH

SEQ ID NO: 563035 - protein, 9 aa, Homo Sapiens
TCGQPGSQV

SEQ ID NO: 563036 - protein, 9 aa, Homo Sapiens
QALSPMYPH

SEQ ID NO: 563037 - protein, 9 aa, Homo Sapiens
PQQQGSLSN

SEQ ID NO: 563038 - protein, 9 aa, Homo Sapiens
GKLEYVRVM

SEQ ID NO: 563039 - protein, 9 aa, Homo Sapiens
YNVAPIAGE

SEQ ID NO: 563040 - protein, 9 aa, Homo Sapiens
LTSPAKTLE

SEQ ID NO: 563041 - protein, 9 aa, Homo Sapiens
LPQALSPMY

SEQ ID NO: 563042 - protein, 9 aa, Homo Sapiens
PSTTDMHLV

SEQ ID NO: 563043 - protein, 9 aa, Homo Sapiens
EIEEEYQRA

SEQ ID NO: 563044 - protein, 9 aa, Homo Sapiens
GTAGRSHPK

SEQ ID NO: 563045 - protein, 9 aa, Homo Sapiens
KKQTKSMMD

SEQ ID NO: 563046 - protein, 9 aa, Homo Sapiens
RHQRTYTGE

SEQ ID NO: 563047 - protein, 9 aa, Homo Sapiens
RLPDSPVFD

SEQ ID NO: 563048 - protein, 9 aa, Homo Sapiens
IYFEMENDL

SEQ ID NO: 563049 - protein, 9 aa, Homo Sapiens
NGTKTCMEG

SEQ ID NO: 563050 - protein, 9 aa, Homo Sapiens
KLENERLRP

SEQ ID NO: 563051 - protein, 9 aa, Homo Sapiens
IRHQRTYTG

SEQ ID NO: 563052 - protein, 9 aa, Homo Sapiens
LESVPVLPR

SEQ ID NO: 563053 - protein, 9 aa, Homo Sapiens
TTVIPGAAL

SEQ ID NO: 563054 - protein, 9 aa, Homo Sapiens
DKILYNRQK

SEQ ID NO: 563055 - protein, 9 aa, Homo Sapiens
LAPLTSPAK

SEQ ID NO: 563056 - protein, 9 aa, Homo Sapiens
AEPGPPSTT

SEQ ID NO: 563057 - protein, 9 aa, Homo Sapiens
DTGLGIAMG

SEQ ID NO: 563058 - protein, 9 aa, Homo Sapiens
SSCIPLLIC

SEQ ID NO: 563059 - protein, 9 aa, Homo Sapiens
SGLCKTICG

SEQ ID NO: 563060 - protein, 9 aa, Homo Sapiens
AQKGGTAGR

SEQ ID NO: 563061 - protein, 9 aa, Homo Sapiens
GIAMGKLHL

SEQ ID NO: 563062 - protein, 9 aa, Homo Sapiens
PPSQLSSHR

SEQ ID NO: 563063 - protein, 9 aa, Homo Sapiens
MSRKTYVFF

SEQ ID NO: 563064 - protein, 9 aa, Homo Sapiens
EIRKENKRD

SEQ ID NO: 563065 - protein, 9 aa, Homo Sapiens
TSIYFEMEN

SEQ ID NO: 563066 - protein, 9 aa, Homo Sapiens
QKEIRRKFG

SEQ ID NO: 563067 - protein, 9 aa, Homo Sapiens
LRCWVVLGF

SEQ ID NO: 563068 - protein, 9 aa, Homo Sapiens
TLVPVMKKL

SEQ ID NO: 563069 - protein, 9 aa, Homo Sapiens
PALAPLTSP

SEQ ID NO: 563070 - protein, 9 aa, Homo Sapiens
TVPCAVPCT

SEQ ID NO: 563071 - protein, 9 aa, Homo Sapiens
QVENTKLFS

SEQ ID NO: 563072 - protein, 9 aa, Homo Sapiens
EQCNTEIKK

SEQ ID NO: 563073 - protein, 9 aa, Homo Sapiens
NMEDPGEHH

SEQ ID NO: 563074 - protein, 9 aa, Homo Sapiens
KVGEAVANE

SEQ ID NO: 563075 - protein, 9 aa, Homo Sapiens
CESSCCRPS

SEQ ID NO: 563076 - protein, 9 aa, Homo Sapiens
AQDINRRTG

SEQ ID NO: 563077 - protein, 9 aa, Homo Sapiens
AAVPSALDT

SEQ ID NO: 563078 - protein, 9 aa, Homo Sapiens
YCHPEASVL

SEQ ID NO: 563079 - protein, 9 aa, Homo Sapiens
TGEREATSS

SEQ ID NO: 563080 - protein, 9 aa, Homo Sapiens
VPQQQGSLS

SEQ ID NO: 563081 - protein, 9 aa, Homo Sapiens
PATETGERE

SEQ ID NO: 563082 - protein, 9 aa, Homo Sapiens
PPSTTDMHL

SEQ ID NO: 563083 - protein, 9 aa, Homo Sapiens
AVSFQGYLR

SEQ ID NO: 563084 - protein, 9 aa, Homo Sapiens
QTKSMMDYS

SEQ ID NO: 563085 - protein, 9 aa, Homo Sapiens
APAMEPETL

SEQ ID NO: 563086 - protein, 9 aa, Homo Sapiens
DFEGWKAAV

SEQ ID NO: 563087 - protein, 9 aa, Homo Sapiens
ISHVCAVFI

SEQ ID NO: 563088 - protein, 9 aa, Homo Sapiens
SVPVLPRSG

SEQ ID NO: 563089 - protein, 9 aa, Homo Sapiens
LENERLRPA

SEQ ID NO: 563090 - protein, 9 aa, Homo Sapiens
KGEFLPIQP

SEQ ID NO: 563091 - protein, 9 aa, Homo Sapiens
ALSPMYPHT

SEQ ID NO: 563092 - protein, 9 aa, Homo Sapiens
RKFGSFIWE

SEQ ID NO: 563093 - protein, 9 aa, Homo Sapiens
LCYEKGLGV

SEQ ID NO: 563094 - protein, 9 aa, Homo Sapiens
KRTCFTHLF

SEQ ID NO: 563095 - protein, 9 aa, Homo Sapiens
ENVYGLKRI

SEQ ID NO: 563096 - protein, 9 aa, Homo Sapiens
YVIQMQPTN

SEQ ID NO: 563097 - protein, 9 aa, Homo Sapiens
ETGEREATS

SEQ ID NO: 563098 - protein, 9 aa, Homo Sapiens
EVSFRKLQK

SEQ ID NO: 563099 - protein, 9 aa, Homo Sapiens
SASFSENVY

SEQ ID NO: 563100 - protein, 9 aa, Homo Sapiens
SLPQALSPM

SEQ ID NO: 563101 - protein, 9 aa, Homo Sapiens
KWHRASQSK

SEQ ID NO: 563102 - protein, 9 aa, Homo Sapiens
KVTLEYRPI

SEQ ID NO: 563103 - protein, 9 aa, Homo Sapiens
VFEYFTNME

SEQ ID NO: 563104 - protein, 9 aa, Homo Sapiens
QPPPSQLSS

SEQ ID NO: 563105 - protein, 9 aa, Homo Sapiens
FWGGAMEKI

SEQ ID NO: 563106 - protein, 9 aa, Homo Sapiens
DGAEPGPPS

SEQ ID NO: 563107 - protein, 9 aa, Homo Sapiens
AKAFGTCIS

SEQ ID NO: 563108 - protein, 9 aa, Homo Sapiens
MGTSLRCWV

SEQ ID NO: 563109 - protein, 9 aa, Homo Sapiens
RVWMDICRL

SEQ ID NO: 563110 - protein, 9 aa, Homo Sapiens
LFGDISVPQ

SEQ ID NO: 563111 - protein, 9 aa, Homo Sapiens
QLQLDEEKG

SEQ ID NO: 563112 - protein, 9 aa, Homo Sapiens
RLRPALLQW

SEQ ID NO: 563113 - protein, 9 aa, Homo Sapiens
AALLSPYSC

SEQ ID NO: 563114 - protein, 9 aa, Homo Sapiens
GASGLCKTI

SEQ ID NO: 563115 - protein, 9 aa, Homo Sapiens
VKGKLEYVR

SEQ ID NO: 563116 - protein, 9 aa, Homo Sapiens
EQSHLKSSS

SEQ ID NO: 563117 - protein, 9 aa, Homo Sapiens
DERPNALLS

SEQ ID NO: 563118 - protein, 9 aa, Homo Sapiens
IVKGKLEYV

SEQ ID NO: 563119 - protein, 9 aa, Homo Sapiens
ICHRFIFKG

SEQ ID NO: 563120 - protein, 9 aa, Homo Sapiens
PEAETGKAQ

SEQ ID NO: 563121 - protein, 9 aa, Homo Sapiens
LDMFIYAIF

SEQ ID NO: 563122 - protein, 9 aa, Homo Sapiens
QEQKVQIRE

SEQ ID NO: 563123 - protein, 9 aa, Homo Sapiens
GEEDPAAVS

SEQ ID NO: 563124 - protein, 9 aa, Homo Sapiens
IRRKFGSFI

SEQ ID NO: 563125 - protein, 9 aa, Homo Sapiens
ETSLTTKPS

SEQ ID NO: 563126 - protein, 9 aa, Homo Sapiens
KSSSLPQAL

SEQ ID NO: 563127 - protein, 9 aa, Homo Sapiens
IGLLLFLDM

SEQ ID NO: 563128 - protein, 9 aa, Homo Sapiens
RSKSIEEIE

SEQ ID NO: 563129 - protein, 9 aa, Homo Sapiens
LLFLDMFIY

SEQ ID NO: 563130 - protein, 9 aa, Homo Sapiens
NSTSIYFEM

SEQ ID NO: 563131 - protein, 9 aa, Homo Sapiens
KTICGVCCK

SEQ ID NO: 563132 - protein, 9 aa, Homo Sapiens
DLSMHEHRK

SEQ ID NO: 563133 - protein, 9 aa, Homo Sapiens
STRHTSRSS

SEQ ID NO: 563134 - protein, 9 aa, Homo Sapiens
NEDEDSDKD

SEQ ID NO: 563135 - protein, 9 aa, Homo Sapiens
HPKWHRASQ

SEQ ID NO: 563136 - protein, 9 aa, Homo Sapiens
SIYFEMEND

SEQ ID NO: 563137 - protein, 9 aa, Homo Sapiens
SSQKAQPGI

SEQ ID NO: 563138 - protein, 9 aa, Homo Sapiens
SVPQQQGSL

SEQ ID NO: 563139 - protein, 9 aa, Homo Sapiens
LSSLKGGVL

SEQ ID NO: 563140 - protein, 9 aa, Homo Sapiens
RELQQTLVP

SEQ ID NO: 563141 - protein, 9 aa, Homo Sapiens
PKWHRASQS

SEQ ID NO: 563142 - protein, 9 aa, Homo Sapiens
PPFAKGTVF

SEQ ID NO: 563143 - protein, 9 aa, Homo Sapiens
NERLRPALL

SEQ ID NO: 563144 - protein, 9 aa, Homo Sapiens
GLGIAMGKL

SEQ ID NO: 563145 - protein, 9 aa, Homo Sapiens
VANENWDLK

SEQ ID NO: 563146 - protein, 9 aa, Homo Sapiens
WKAAVPSAL

SEQ ID NO: 563147 - protein, 9 aa, Homo Sapiens
TETSLTTKP

SEQ ID NO: 563148 - protein, 9 aa, Homo Sapiens
TISKCAAER

SEQ ID NO: 563149 - protein, 9 aa, Homo Sapiens
IPGAALTLS

SEQ ID NO: 563150 - protein, 9 aa, Homo Sapiens
VSTGKVTLE

SEQ ID NO: 563151 - protein, 9 aa, Homo Sapiens
STGKVTLEY

SEQ ID NO: 563152 - protein, 9 aa, Homo Sapiens
CIQGCSTVT

SEQ ID NO: 563153 - protein, 9 aa, Homo Sapiens
WAHTGSRSS

SEQ ID NO: 563154 - protein, 9 aa, Homo Sapiens
TKLFSKKQT

SEQ ID NO: 563155 - protein, 9 aa, Homo Sapiens
GAEPGPPST

SEQ ID NO: 563156 - protein, 9 aa, Homo Sapiens
EREATSSPR

SEQ ID NO: 563157 - protein, 9 aa, Homo Sapiens
TAGRSHPKW

SEQ ID NO: 563158 - protein, 9 aa, Homo Sapiens
SPMYPHTAP

SEQ ID NO: 563159 - protein, 9 aa, Homo Sapiens
QSHLKSSSL

SEQ ID NO: 563160 - protein, 9 aa, Homo Sapiens
PYLLDTGLG

SEQ ID NO: 563161 - protein, 9 aa, Homo Sapiens
ILHHEELIA

SEQ ID NO: 563162 - protein, 9 aa, Homo Sapiens
GKAQKGGTA

SEQ ID NO: 563163 - protein, 9 aa, Homo Sapiens
GRLDPAGSW

SEQ ID NO: 563164 - protein, 9 aa, Homo Sapiens
WRRTAPACL

SEQ ID NO: 563165 - protein, 9 aa, Homo Sapiens
SCIPLLICH

SEQ ID NO: 563166 - protein, 9 aa, Homo Sapiens
RKTYVFFSH

SEQ ID NO: 563167 - protein, 9 aa, Homo Sapiens
LFLDMFIYA

SEQ ID NO: 563168 - protein, 9 aa, Homo Sapiens
PAGSWTCGQ

SEQ ID NO: 563169 - protein, 9 aa, Homo Sapiens
ALLSPYSCS

SEQ ID NO: 563170 - protein, 9 aa, Homo Sapiens
AQHLLAHPH

SEQ ID NO: 563171 - protein, 9 aa, Homo Sapiens
SCSTTAVVT

SEQ ID NO: 563172 - protein, 9 aa, Homo Sapiens
KSDERPNAL

SEQ ID NO: 563173 - protein, 9 aa, Homo Sapiens
QRTYTGEKP

SEQ ID NO: 563174 - protein, 9 aa, Homo Sapiens
RSKKVYNVA

SEQ ID NO: 563175 - protein, 9 aa, Homo Sapiens
WHRASQSKG

SEQ ID NO: 563176 - protein, 9 aa, Homo Sapiens
QPPGQPPPS

SEQ ID NO: 563177 - protein, 9 aa, Homo Sapiens
VTLEYRPII

SEQ ID NO: 563178 - protein, 9 aa, Homo Sapiens
TAPAWRRTA

SEQ ID NO: 563179 - protein, 9 aa, Homo Sapiens
RTYTGEKPY

SEQ ID NO: 563180 - protein, 9 aa, Homo Sapiens
FQLPRRLPD

SEQ ID NO: 563181 - protein, 9 aa, Homo Sapiens
GGVCSPDAA

SEQ ID NO: 563182 - protein, 9 aa, Homo Sapiens
EILSRIMAG

SEQ ID NO: 563183 - protein, 9 aa, Homo Sapiens
GGAMEKIGF

SEQ ID NO: 563184 - protein, 8 aa, Homo Sapiens
ALKNINYL

SEQ ID NO: 563185 - protein, 9 aa, Homo Sapiens
SWTCGQPGS

SEQ ID NO: 563186 - protein, 9 aa, Homo Sapiens
AAVSFQGYL

SEQ ID NO: 563187 - protein, 9 aa, Homo Sapiens
RSGEAGVSF

SEQ ID NO: 563188 - protein, 9 aa, Homo Sapiens
NKIEVSFRK

SEQ ID NO: 563189 - protein, 9 aa, Homo Sapiens
YVFFSHTIK

SEQ ID NO: 563190 - protein, 9 aa, Homo Sapiens
WCIQGCSTV

SEQ ID NO: 563191 - protein, 9 aa, Homo Sapiens
NQLTIRSPS

SEQ ID NO: 563192 - protein, 9 aa, Homo Sapiens
AWRRTAPAC

SEQ ID NO: 563193 - protein, 9 aa, Homo Sapiens
FFNSVGITA

SEQ ID NO: 563194 - protein, 9 aa, Homo Sapiens
RRSKSIEEI

SEQ ID NO: 563195 - protein, 9 aa, Homo Sapiens
TSPAKTLEL

SEQ ID NO: 563196 - protein, 9 aa, Homo Sapiens
CRLWGHVQG

SEQ ID NO: 563197 - protein, 9 aa, Homo Sapiens
LDTGLGIAM

SEQ ID NO: 563198 - protein, 9 aa, Homo Sapiens
STEKPTIST

SEQ ID NO: 563199 - protein, 9 aa, Homo Sapiens
GFCFFNSVG

SEQ ID NO: 563200 - protein, 9 aa, Homo Sapiens
VENTKLFSK

SEQ ID NO: 563201 - protein, 9 aa, Homo Sapiens
EIRRKFGSF

SEQ ID NO: 563202 - protein, 9 aa, Homo Sapiens
YSCSTTAVV

SEQ ID NO: 563203 - protein, 9 aa, Homo Sapiens
YPHTAPAWR

SEQ ID NO: 563204 - protein, 9 aa, Homo Sapiens
HLLAHPHWG

SEQ ID NO: 563205 - protein, 9 aa, Homo Sapiens
NIGLLLFLD

SEQ ID NO: 563206 - protein, 9 aa, Homo Sapiens
QKGGTAGRS

SEQ ID NO: 563207 - protein, 9 aa, Homo Sapiens
NRQKHYDPR

SEQ ID NO: 563208 - protein, 9 aa, Homo Sapiens
PGISETEEV

SEQ ID NO: 563209 - protein, 9 aa, Homo Sapiens
CNTEIKKYS

SEQ ID NO: 563210 - protein, 9 aa, Homo Sapiens
ATCLSNLGN

SEQ ID NO: 563211 - protein, 9 aa, Homo Sapiens
AMEKIGFRL

SEQ ID NO: 563212 - protein, 9 aa, Homo Sapiens
KHYDPRTGI

SEQ ID NO: 563213 - protein, 9 aa, Homo Sapiens
TPHPTTPHP

SEQ ID NO: 563214 - protein, 9 aa, Homo Sapiens
NSTRHTSRS

SEQ ID NO: 563215 - protein, 9 aa, Homo Sapiens
QGCSTVTGE

SEQ ID NO: 563216 - protein, 9 aa, Homo Sapiens
MQQSQVENT

SEQ ID NO: 563217 - protein, 9 aa, Homo Sapiens
SQLSSHRGD

SEQ ID NO: 563218 - protein, 9 aa, Homo Sapiens
SFVEKYIEE

SEQ ID NO: 563219 - protein, 9 aa, Homo Sapiens
GWKAAVPSA

SEQ ID NO: 563220 - protein, 9 aa, Homo Sapiens
LFPPFAKGT

SEQ ID NO: 563221 - protein, 9 aa, Homo Sapiens
LICHRFIFK

SEQ ID NO: 563222 - protein, 9 aa, Homo Sapiens
RKLQKLNQE

SEQ ID NO: 563223 - protein, 9 aa, Homo Sapiens
YISFVEKYI

SEQ ID NO: 563224 - protein, 9 aa, Homo Sapiens
DKREKVSLF

SEQ ID NO: 563225 - protein, 9 aa, Homo Sapiens
ERLRPALLQ

SEQ ID NO: 563226 - protein, 9 aa, Homo Sapiens
MHEHRKREN

SEQ ID NO: 563227 - protein, 9 aa, Homo Sapiens
GVFEYFTNM

SEQ ID NO: 563228 - protein, 9 aa, Homo Sapiens
HHEELIAQK

SEQ ID NO: 563229 - protein, 9 aa, Homo Sapiens
SSQTGTCVA

SEQ ID NO: 563230 - protein, 9 aa, Homo Sapiens
MTQDEVSEI

SEQ ID NO: 563231 - protein, 9 aa, Homo Sapiens
PGDAAGRVP

SEQ ID NO: 563232 - protein, 9 aa, Homo Sapiens
PATSSYSAS

SEQ ID NO: 563233 - protein, 9 aa, Homo Sapiens
ADAQEQRGV

SEQ ID NO: 563234 - protein, 9 aa, Homo Sapiens
DTNNSGPEL

SEQ ID NO: 563235 - protein, 9 aa, Homo Sapiens
AIMRIMKMR

SEQ ID NO: 563236 - protein, 9 aa, Homo Sapiens
QVDITGGEP

SEQ ID NO: 563237 - protein, 9 aa, Homo Sapiens
GVNDQDFAV

SEQ ID NO: 563238 - protein, 9 aa, Homo Sapiens
AKIDNLLPG

SEQ ID NO: 563239 - protein, 9 aa, Homo Sapiens
PPSTRCLSQ

SEQ ID NO: 563240 - protein, 9 aa, Homo Sapiens
KGGNVWVTL

SEQ ID NO: 563241 - protein, 9 aa, Homo Sapiens
TVSLMRVLI

SEQ ID NO: 563242 - protein, 9 aa, Homo Sapiens
YIHTHTFYV

SEQ ID NO: 563243 - protein, 9 aa, Homo Sapiens
SLPGSHPDF

SEQ ID NO: 563244 - protein, 9 aa, Homo Sapiens
QAHITRAPH

SEQ ID NO: 563245 - protein, 9 aa, Homo Sapiens
LNNRWDACA

SEQ ID NO: 563246 - protein, 9 aa, Homo Sapiens
DACASEPEY

SEQ ID NO: 563247 - protein, 9 aa, Homo Sapiens
CEVPGPDCR

SEQ ID NO: 563248 - protein, 9 aa, Homo Sapiens
VQSTEGEAA

SEQ ID NO: 563249 - protein, 9 aa, Homo Sapiens
GQHSCQPVS

SEQ ID NO: 563250 - protein, 9 aa, Homo Sapiens
NSSASLKSS

SEQ ID NO: 563251 - protein, 9 aa, Homo Sapiens
LHHYGHLKG

SEQ ID NO: 563252 - protein, 9 aa, Homo Sapiens
LLRRGDASL

SEQ ID NO: 563253 - protein, 9 aa, Homo Sapiens
RHFKDVKLK

SEQ ID NO: 563254 - protein, 9 aa, Homo Sapiens
RHCEAKCLV

SEQ ID NO: 563255 - protein, 9 aa, Homo Sapiens
DFPVSCQIH

SEQ ID NO: 563256 - protein, 9 aa, Homo Sapiens
TCECEVPGP

SEQ ID NO: 563257 - protein, 9 aa, Homo Sapiens
VVQSTSKSS

SEQ ID NO: 563258 - protein, 9 aa, Homo Sapiens
ELNKIRTPE

SEQ ID NO: 563259 - protein, 9 aa, Homo Sapiens
SKSSQTGTC

SEQ ID NO: 563260 - protein, 9 aa, Homo Sapiens
GLLPSGQHS

SEQ ID NO: 563261 - protein, 9 aa, Homo Sapiens
AALFTIHKE

SEQ ID NO: 563262 - protein, 9 aa, Homo Sapiens
IQAAIMRIM

SEQ ID NO: 563263 - protein, 9 aa, Homo Sapiens
SPALNASPI

SEQ ID NO: 563264 - protein, 9 aa, Homo Sapiens
VPDRQEEIS

SEQ ID NO: 563265 - protein, 9 aa, Homo Sapiens
LLIQAAIMR

SEQ ID NO: 563266 - protein, 9 aa, Homo Sapiens
VSLMRVLIP

SEQ ID NO: 563267 - protein, 9 aa, Homo Sapiens
SGADKSLPG

SEQ ID NO: 563268 - protein, 9 aa, Homo Sapiens
VLFEQAFTF

SEQ ID NO: 563269 - protein, 9 aa, Homo Sapiens
TSSYSASAE

SEQ ID NO: 563270 - protein, 9 aa, Homo Sapiens
SPKPMVTPG

SEQ ID NO: 563271 - protein, 9 aa, Homo Sapiens
LNASPISNT

SEQ ID NO: 563272 - protein, 9 aa, Homo Sapiens
SLMRVLIPK

SEQ ID NO: 563273 - protein, 9 aa, Homo Sapiens
IYIYTHIYI

SEQ ID NO: 563274 - protein, 9 aa, Homo Sapiens
KSLPGSHPD

SEQ ID NO: 563275 - protein, 9 aa, Homo Sapiens
ACASEPEYM

SEQ ID NO: 563276 - protein, 9 aa, Homo Sapiens
NVTCECEVP

SEQ ID NO: 563277 - protein, 9 aa, Homo Sapiens
ASPISNTGI

SEQ ID NO: 563278 - protein, 9 aa, Homo Sapiens
TPCPPPPAP

SEQ ID NO: 563279 - protein, 9 aa, Homo Sapiens
QSTEGEAAH

SEQ ID NO: 563280 - protein, 9 aa, Homo Sapiens
GLLRRGDAS

SEQ ID NO: 563281 - protein, 9 aa, Homo Sapiens
CHGPATSSY

SEQ ID NO: 563282 - protein, 9 aa, Homo Sapiens
KENEREKEK

SEQ ID NO: 563283 - protein, 9 aa, Homo Sapiens
RENSSASLK

SEQ ID NO: 563284 - protein, 9 aa, Homo Sapiens
PQRCTPCPP

SEQ ID NO: 563285 - protein, 9 aa, Homo Sapiens
AHITRAPHN

SEQ ID NO: 563286 - protein, 9 aa, Homo Sapiens
SLPPGFGGI

SEQ ID NO: 563287 - protein, 9 aa, Homo Sapiens
GTYGNQRHR

SEQ ID NO: 563288 - protein, 9 aa, Homo Sapiens
NHRMKKESP

SEQ ID NO: 563289 - protein, 9 aa, Homo Sapiens
IVKVSPREN

SEQ ID NO: 563290 - protein, 9 aa, Homo Sapiens
QMLLTNVGA

SEQ ID NO: 563291 - protein, 9 aa, Homo Sapiens
HRMKKESPS

SEQ ID NO: 563292 - protein, 9 aa, Homo Sapiens
CPPPPAPSP

SEQ ID NO: 563293 - protein, 9 aa, Homo Sapiens
VNDQDFAVS

SEQ ID NO: 563294 - protein, 9 aa, Homo Sapiens
FTFHGKSFH

SEQ ID NO: 563295 - protein, 9 aa, Homo Sapiens
YLAGYTIYF

SEQ ID NO: 563296 - protein, 9 aa, Homo Sapiens
SCGPVCREG

SEQ ID NO: 563297 - protein, 9 aa, Homo Sapiens
LCLHFTLLI

SEQ ID NO: 563298 - protein, 9 aa, Homo Sapiens
MRIMKMRKV

SEQ ID NO: 563299 - protein, 9 aa, Homo Sapiens
EGNRYLAGY

SEQ ID NO: 563300 - protein, 9 aa, Homo Sapiens
PVCREGCVC

SEQ ID NO: 563301 - protein, 9 aa, Homo Sapiens
RGVQMLLTN

SEQ ID NO: 563302 - protein, 9 aa, Homo Sapiens
NTVSLMRVL

SEQ ID NO: 563303 - protein, 9 aa, Homo Sapiens
LIQAAIMRI

SEQ ID NO: 563304 - protein, 9 aa, Homo Sapiens
TASGPQVDI

SEQ ID NO: 563305 - protein, 9 aa, Homo Sapiens
GVQMLLTNV

SEQ ID NO: 563306 - protein, 9 aa, Homo Sapiens
AHSPQQRTD

SEQ ID NO: 563307 - protein, 9 aa, Homo Sapiens
QFEGVGEAG

SEQ ID NO: 563308 - protein, 9 aa, Homo Sapiens
EGEAAHVPA

SEQ ID NO: 563309 - protein, 9 aa, Homo Sapiens
KKESPSHVQ

SEQ ID NO: 563310 - protein, 9 aa, Homo Sapiens
PAPSPDAGT

SEQ ID NO: 563311 - protein, 9 aa, Homo Sapiens
GCHGPATSS

SEQ ID NO: 563312 - protein, 9 aa, Homo Sapiens
GRVPQRCTP

SEQ ID NO: 563313 - protein, 9 aa, Homo Sapiens
PGFGGIGED

SEQ ID NO: 563314 - protein, 9 aa, Homo Sapiens
RVQIGTHVN

SEQ ID NO: 563315 - protein, 9 aa, Homo Sapiens
KVLFEQAFT

SEQ ID NO: 563316 - protein, 9 aa, Homo Sapiens
KGPHQARAA

SEQ ID NO: 563317 - protein, 9 aa, Homo Sapiens
QRGVNDQDF

SEQ ID NO: 563318 - protein, 9 aa, Homo Sapiens
KEKKENERE

SEQ ID NO: 563319 - protein, 9 aa, Homo Sapiens
STRCLSQLE

SEQ ID NO: 563320 - protein, 9 aa, Homo Sapiens
AGRVPQRCT

SEQ ID NO: 563321 - protein, 9 aa, Homo Sapiens
GPELNKIRT

SEQ ID NO: 563322 - protein, 9 aa, Homo Sapiens
KATARSVPD

SEQ ID NO: 563323 - protein, 9 aa, Homo Sapiens
RGVNDQDFA

SEQ ID NO: 563324 - protein, 9 aa, Homo Sapiens
PSCGPVCRE

SEQ ID NO: 563325 - protein, 9 aa, Homo Sapiens
FEQAFTFHG

SEQ ID NO: 563326 - protein, 9 aa, Homo Sapiens
HFTLLIRAA

SEQ ID NO: 563327 - protein, 9 aa, Homo Sapiens
GGLMTQDEV

SEQ ID NO: 563328 - protein, 9 aa, Homo Sapiens
IWMGQEPGV

SEQ ID NO: 563329 - protein, 9 aa, Homo Sapiens
KDVKLKLEF

SEQ ID NO: 563330 - protein, 9 aa, Homo Sapiens
IYIHTHTFY

SEQ ID NO: 563331 - protein, 9 aa, Homo Sapiens
ATSSYSASA

SEQ ID NO: 563332 - protein, 9 aa, Homo Sapiens
ATARSVPDR

SEQ ID NO: 563333 - protein, 9 aa, Homo Sapiens
VQMLLTNVG

SEQ ID NO: 563334 - protein, 9 aa, Homo Sapiens
GIGEDYSEE

SEQ ID NO: 563335 - protein, 9 aa, Homo Sapiens
VLNTVSLMR

SEQ ID NO: 563336 - protein, 9 aa, Homo Sapiens
EHFHRPLRH

SEQ ID NO: 563337 - protein, 9 aa, Homo Sapiens
ENEREKEKR

SEQ ID NO: 563338 - protein, 9 aa, Homo Sapiens
DGNVTCECE

SEQ ID NO: 563339 - protein, 9 aa, Homo Sapiens
PGLLRRGDA

SEQ ID NO: 563340 - protein, 9 aa, Homo Sapiens
GSPALNASP

SEQ ID NO: 563341 - protein, 9 aa, Homo Sapiens
GADKSLPGS

SEQ ID NO: 563342 - protein, 9 aa, Homo Sapiens
CVKELGFPR

SEQ ID NO: 563343 - protein, 9 aa, Homo Sapiens
LLTNVGAFA

SEQ ID NO: 563344 - protein, 9 aa, Homo Sapiens
DEVSEIKSS

SEQ ID NO: 563345 - protein, 9 aa, Homo Sapiens
NVGAFAAFS

SEQ ID NO: 563346 - protein, 9 aa, Homo Sapiens
VTLFKNNEP

SEQ ID NO: 563347 - protein, 9 aa, Homo Sapiens
PDAGTYGNQ

SEQ ID NO: 563348 - protein, 9 aa, Homo Sapiens
IGIPNQFEG

SEQ ID NO: 563349 - protein, 9 aa, Homo Sapiens
GDAAGRVPQ

SEQ ID NO: 563350 - protein, 9 aa, Homo Sapiens
QAAIMRIMK

SEQ ID NO: 563351 - protein, 9 aa, Homo Sapiens
LPSGQHSCQ

SEQ ID NO: 563352 - protein, 9 aa, Homo Sapiens
HCEAKCLVQ

SEQ ID NO: 563353 - protein, 9 aa, Homo Sapiens
DAGTYGNQR

SEQ ID NO: 563354 - protein, 9 aa, Homo Sapiens
ILNNRWDAC

SEQ ID NO: 563355 - protein, 9 aa, Homo Sapiens
SPDAGTYGN

SEQ ID NO: 563356 - protein, 9 aa, Homo Sapiens
NAHSPQQRT

SEQ ID NO: 563357 - protein, 9 aa, Homo Sapiens
APHNPGHVI

SEQ ID NO: 563358 - protein, 9 aa, Homo Sapiens
SVPDRQEEI

SEQ ID NO: 563359 - protein, 9 aa, Homo Sapiens
LHFTLLIRA

SEQ ID NO: 563360 - protein, 9 aa, Homo Sapiens
YTIYFHCDN

SEQ ID NO: 563361 - protein, 9 aa, Homo Sapiens
PALNASPIS

SEQ ID NO: 563362 - protein, 9 aa, Homo Sapiens
PCIWMGQEP

SEQ ID NO: 563363 - protein, 9 aa, Homo Sapiens
LKGPHQARA

SEQ ID NO: 563364 - protein, 9 aa, Homo Sapiens
TARSVPDRQ

SEQ ID NO: 563365 - protein, 9 aa, Homo Sapiens
HLKGPHQAR

SEQ ID NO: 563366 - protein, 9 aa, Homo Sapiens
EQRGVNDQD

SEQ ID NO: 563367 - protein, 9 aa, Homo Sapiens
GGLTCALGI

SEQ ID NO: 563368 - protein, 9 aa, Homo Sapiens
HIYIHTHTF

SEQ ID NO: 563369 - protein, 9 aa, Homo Sapiens
HNAHSPQQR

SEQ ID NO: 563370 - protein, 9 aa, Homo Sapiens
DFAGGGLTC

SEQ ID NO: 563371 - protein, 9 aa, Homo Sapiens
KESPSHVQA

SEQ ID NO: 563372 - protein, 9 aa, Homo Sapiens
MKKESPSHV

SEQ ID NO: 563373 - protein, 9 aa, Homo Sapiens
NRYLAGYTI

SEQ ID NO: 563374 - protein, 9 aa, Homo Sapiens
GYTIYFHCD

SEQ ID NO: 563375 - protein, 9 aa, Homo Sapiens
ALHHYGHLK

SEQ ID NO: 563376 - protein, 9 aa, Homo Sapiens
LESPKPMVT

SEQ ID NO: 563377 - protein, 9 aa, Homo Sapiens
VDITGGEPA

SEQ ID NO: 563378 - protein, 9 aa, Homo Sapiens
HGPATSSYS

SEQ ID NO: 563379 - protein, 9 aa, Homo Sapiens
FPVSCQIHG

SEQ ID NO: 563380 - protein, 9 aa, Homo Sapiens
FTLLIRAAV

SEQ ID NO: 563381 - protein, 9 aa, Homo Sapiens
VKELGFPRV

SEQ ID NO: 563382 - protein, 9 aa, Homo Sapiens
RCLSQLESG

SEQ ID NO: 563383 - protein, 9 aa, Homo Sapiens
ELGFPRVQI

SEQ ID NO: 563384 - protein, 9 aa, Homo Sapiens
HHYGHLKGP

SEQ ID NO: 563385 - protein, 9 aa, Homo Sapiens
EKKENEREK

SEQ ID NO: 563386 - protein, 9 aa, Homo Sapiens
PPGLLRRGD

SEQ ID NO: 563387 - protein, 9 aa, Homo Sapiens
RPLRHCEAK

SEQ ID NO: 563388 - protein, 9 aa, Homo Sapiens
ECEVPGPDC

SEQ ID NO: 563389 - protein, 9 aa, Homo Sapiens
IYTHIYIHT

SEQ ID NO: 563390 - protein, 9 aa, Homo Sapiens
VTCECEVPG

SEQ ID NO: 563391 - protein, 9 aa, Homo Sapiens
FGGIGEDYS

SEQ ID NO: 563392 - protein, 9 aa, Homo Sapiens
STSKSSQTG

SEQ ID NO: 563393 - protein, 9 aa, Homo Sapiens
RSVPDRQEE

SEQ ID NO: 563394 - protein, 9 aa, Homo Sapiens
LKLEFYADY

SEQ ID NO: 563395 - protein, 9 aa, Homo Sapiens
GNVTCECEV

SEQ ID NO: 563396 - protein, 9 aa, Homo Sapiens
DVKLKLEFY

SEQ ID NO: 563397 - protein, 9 aa, Homo Sapiens
PCPPPPAPS

SEQ ID NO: 563398 - protein, 9 aa, Homo Sapiens
HITRAPHNP

SEQ ID NO: 563399 - protein, 9 aa, Homo Sapiens
ADFAGGGLT

SEQ ID NO: 563400 - protein, 9 aa, Homo Sapiens
SGPQVDITG

SEQ ID NO: 563401 - protein, 9 aa, Homo Sapiens
PMVTPGSTL

SEQ ID NO: 563402 - protein, 9 aa, Homo Sapiens
LRRGDASLG

SEQ ID NO: 563403 - protein, 9 aa, Homo Sapiens
FVGCLVRLE

SEQ ID NO: 563404 - protein, 9 aa, Homo Sapiens
YTHIYIHTH

SEQ ID NO: 563405 - protein, 9 aa, Homo Sapiens
DAQEQRGVN

SEQ ID NO: 563406 - protein, 9 aa, Homo Sapiens
TLFKNNEPV

SEQ ID NO: 563407 - protein, 9 aa, Homo Sapiens
FIGIPNQFE

SEQ ID NO: 563408 - protein, 9 aa, Homo Sapiens
LAGYTIYFH

SEQ ID NO: 563409 - protein, 9 aa, Homo Sapiens
CQHNAHSPQ

SEQ ID NO: 563410 - protein, 9 aa, Homo Sapiens
LGFPRVQIG

SEQ ID NO: 563411 - protein, 9 aa, Homo Sapiens
DSGADKSLP

SEQ ID NO: 563412 - protein, 9 aa, Homo Sapiens
VCREGCVCN

SEQ ID NO: 563413 - protein, 9 aa, Homo Sapiens
PRENSSASL

SEQ ID NO: 563414 - protein, 9 aa, Homo Sapiens
QHSCQPVST

SEQ ID NO: 563415 - protein, 9 aa, Homo Sapiens
KVSPRENSS

SEQ ID NO: 563416 - protein, 9 aa, Homo Sapiens
AGYTIYFHC

SEQ ID NO: 563417 - protein, 9 aa, Homo Sapiens
NLLPGDAAG

SEQ ID NO: 563418 - protein, 9 aa, Homo Sapiens
CVCLCLHFT

SEQ ID NO: 563419 - protein, 9 aa, Homo Sapiens
ITRAPHNPG

SEQ ID NO: 563420 - protein, 9 aa, Homo Sapiens
MIKATARSV

SEQ ID NO: 563421 - protein, 9 aa, Homo Sapiens
ADKSLPGSH

SEQ ID NO: 563422 - protein, 9 aa, Homo Sapiens
CGPVCREGC

SEQ ID NO: 563423 - protein, 9 aa, Homo Sapiens
LLPGDAAGR

SEQ ID NO: 563424 - protein, 9 aa, Homo Sapiens
PQVDITGGE

SEQ ID NO: 563425 - protein, 9 aa, Homo Sapiens
LTCALGIIM

SEQ ID NO: 563426 - protein, 9 aa, Homo Sapiens
HSPQQRTDV

SEQ ID NO: 563427 - protein, 9 aa, Homo Sapiens
TLLIRAAVN

SEQ ID NO: 563428 - protein, 9 aa, Homo Sapiens
GGGLTCALG

SEQ ID NO: 563429 - protein, 9 aa, Homo Sapiens
VNHRMKKES

SEQ ID NO: 563430 - protein, 9 aa, Homo Sapiens
GNRYLAGYT

SEQ ID NO: 563431 - protein, 9 aa, Homo Sapiens
VDSGADKSL

SEQ ID NO: 563432 - protein, 9 aa, Homo Sapiens
ENSSASLKS

SEQ ID NO: 563433 - protein, 9 aa, Homo Sapiens
FEGVGEAGD

SEQ ID NO: 563434 - protein, 9 aa, Homo Sapiens
SQTGTCVAV

SEQ ID NO: 563435 - protein, 9 aa, Homo Sapiens
DFDNFVGCL

SEQ ID NO: 563436 - protein, 9 aa, Homo Sapiens
LPCIWMGQE

SEQ ID NO: 563437 - protein, 9 aa, Homo Sapiens
EKEKEKKEN

SEQ ID NO: 563438 - protein, 9 aa, Homo Sapiens
CTPCPPPPA

SEQ ID NO: 563439 - protein, 9 aa, Homo Sapiens
LFTIHKESI

SEQ ID NO: 563440 - protein, 9 aa, Homo Sapiens
EQAFTFHGK

SEQ ID NO: 563441 - protein, 9 aa, Homo Sapiens
LTNVGAFAA

SEQ ID NO: 563442 - protein, 9 aa, Homo Sapiens
AHVPATYQL

SEQ ID NO: 563443 - protein, 9 aa, Homo Sapiens
TRAPHNPGH

SEQ ID NO: 563444 - protein, 9 aa, Homo Sapiens
NQFEGVGEA

SEQ ID NO: 563445 - protein, 9 aa, Homo Sapiens
PDFPVSCQI

SEQ ID NO: 563446 - protein, 9 aa, Homo Sapiens
TNVGAFAAF

SEQ ID NO: 563447 - protein, 9 aa, Homo Sapiens
GFPRVQIGT

SEQ ID NO: 563448 - protein, 9 aa, Homo Sapiens
KPPGLLRRG

SEQ ID NO: 563449 - protein, 9 aa, Homo Sapiens
ALFTIHKES

SEQ ID NO: 563450 - protein, 9 aa, Homo Sapiens
VGCLVRLET

SEQ ID NO: 563451 - protein, 9 aa, Homo Sapiens
LMTQDEVSE

SEQ ID NO: 563452 - protein, 9 aa, Homo Sapiens
EGVGEAGDE

SEQ ID NO: 563453 - protein, 9 aa, Homo Sapiens
IIDFDNFVG

SEQ ID NO: 563454 - protein, 9 aa, Homo Sapiens
NSGPELNKI

SEQ ID NO: 563455 - protein, 9 aa, Homo Sapiens
GNVWVTLFK

SEQ ID NO: 563456 - protein, 9 aa, Homo Sapiens
IGEDYSEEG

SEQ ID NO: 563457 - protein, 9 aa, Homo Sapiens
YIYTHIYIH

SEQ ID NO: 563458 - protein, 9 aa, Homo Sapiens
ESPSHVQAM

SEQ ID NO: 563459 - protein, 9 aa, Homo Sapiens
KELGFPRVQ

SEQ ID NO: 563460 - protein, 9 aa, Homo Sapiens
HKESIEDRL

SEQ ID NO: 563461 - protein, 9 aa, Homo Sapiens
IAGGLMTQD

SEQ ID NO: 563462 - protein, 9 aa, Homo Sapiens
EAAHVPATY

SEQ ID NO: 563463 - protein, 9 aa, Homo Sapiens
MQAHITRAP

SEQ ID NO: 563464 - protein, 9 aa, Homo Sapiens
FTIHKESIE

SEQ ID NO: 563465 - protein, 9 aa, Homo Sapiens
GNQRHRCQH

SEQ ID NO: 563466 - protein, 9 aa, Homo Sapiens
RPSCGPVCR

SEQ ID NO: 563467 - protein, 9 aa, Homo Sapiens
HYGHLKGPH

SEQ ID NO: 563468 - protein, 9 aa, Homo Sapiens
RWDACASEP

SEQ ID NO: 563469 - protein, 9 aa, Homo Sapiens
TSKSSQTGT

SEQ ID NO: 563470 - protein, 9 aa, Homo Sapiens
GCLVRLETL

SEQ ID NO: 563471 - protein, 9 aa, Homo Sapiens
LLTLPPSTR

SEQ ID NO: 563472 - protein, 9 aa, Homo Sapiens
CLHFTLLIR

SEQ ID NO: 563473 - protein, 9 aa, Homo Sapiens
KLKLEFYAD

SEQ ID NO: 563474 - protein, 9 aa, Homo Sapiens
NRWDACASE

SEQ ID NO: 563475 - protein, 9 aa, Homo Sapiens
GELESPKPM

SEQ ID NO: 563476 - protein, 9 aa, Homo Sapiens
NNRWDACAS

SEQ ID NO: 563477 - protein, 9 aa, Homo Sapiens
FKDVKLKLE

SEQ ID NO: 563478 - protein, 9 aa, Homo Sapiens
SGCHGPATS

SEQ ID NO: 563479 - protein, 9 aa, Homo Sapiens
HFHRPLRHC

SEQ ID NO: 563480 - protein, 9 aa, Homo Sapiens
AFTFHGKSF

SEQ ID NO: 563481 - protein, 9 aa, Homo Sapiens
PKPMVTPGS

SEQ ID NO: 563482 - protein, 9 aa, Homo Sapiens
APSPDAGTY

SEQ ID NO: 563483 - protein, 9 aa, Homo Sapiens
AAHVPATYQ

SEQ ID NO: 563484 - protein, 9 aa, Homo Sapiens
GSHPDFPVS

SEQ ID NO: 563485 - protein, 9 aa, Homo Sapiens
NFVGCLVRL

SEQ ID NO: 563486 - protein, 9 aa, Homo Sapiens
PPGFGGIGE

SEQ ID NO: 563487 - protein, 9 aa, Homo Sapiens
PGSHPDFPV

SEQ ID NO: 563488 - protein, 9 aa, Homo Sapiens
GGNVWVTLF

SEQ ID NO: 563489 - protein, 9 aa, Homo Sapiens
DNFVGCLVR

SEQ ID NO: 563490 - protein, 9 aa, Homo Sapiens
RGDASLGLR

SEQ ID NO: 563491 - protein, 9 aa, Homo Sapiens
YKPPGLLRR

SEQ ID NO: 563492 - protein, 9 aa, Homo Sapiens
SPISNTGIL

SEQ ID NO: 563493 - protein, 9 aa, Homo Sapiens
PPPAPSPDA

SEQ ID NO: 563494 - protein, 9 aa, Homo Sapiens
QEQRGVNDQ

SEQ ID NO: 563495 - protein, 9 aa, Homo Sapiens
DNLLPGDAA

SEQ ID NO: 563496 - protein, 9 aa, Homo Sapiens
HFKDVKLKL

SEQ ID NO: 563497 - protein, 9 aa, Homo Sapiens
SPSHVQAMH

SEQ ID NO: 563498 - protein, 9 aa, Homo Sapiens
PSPDAGTYG

SEQ ID NO: 563499 - protein, 9 aa, Homo Sapiens
ASGPQVDIT

SEQ ID NO: 563500 - protein, 9 aa, Homo Sapiens
LFEQAFTFH

SEQ ID NO: 563501 - protein, 9 aa, Homo Sapiens
PRPSCGPVC

SEQ ID NO: 563502 - protein, 9 aa, Homo Sapiens
GPQVDITGG

SEQ ID NO: 563503 - protein, 9 aa, Homo Sapiens
GPATSSYSA

SEQ ID NO: 563504 - protein, 9 aa, Homo Sapiens
KIDNLLPGD

SEQ ID NO: 563505 - protein, 9 aa, Homo Sapiens
HSCQPVSTA

SEQ ID NO: 563506 - protein, 9 aa, Homo Sapiens
ESIEDRLKE

SEQ ID NO: 563507 - protein, 9 aa, Homo Sapiens
TYGNQRHRC

SEQ ID NO: 563508 - protein, 9 aa, Homo Sapiens
CECEVPGPD

SEQ ID NO: 563509 - protein, 9 aa, Homo Sapiens
CASEPEYME

SEQ ID NO: 563510 - protein, 9 aa, Homo Sapiens
GIPNQFEGV

SEQ ID NO: 563511 - protein, 9 aa, Homo Sapiens
LLTVLPCIW

SEQ ID NO: 563512 - protein, 9 aa, Homo Sapiens
WVTLFKNNE

SEQ ID NO: 563513 - protein, 9 aa, Homo Sapiens
LPPSTRCLS

SEQ ID NO: 563514 - protein, 9 aa, Homo Sapiens
FAGGGLTCA

SEQ ID NO: 563515 - protein, 9 aa, Homo Sapiens
MRVLIPKLP

SEQ ID NO: 563516 - protein, 9 aa, Homo Sapiens
LTVLPCIWM

SEQ ID NO: 563517 - protein, 9 aa, Homo Sapiens
RCTPCPPPP

SEQ ID NO: 563518 - protein, 9 aa, Homo Sapiens
GPVCREGCV

SEQ ID NO: 563519 - protein, 9 aa, Homo Sapiens
ASGCHGPAT

SEQ ID NO: 563520 - protein, 9 aa, Homo Sapiens
SGPELNKIR

SEQ ID NO: 563521 - protein, 9 aa, Homo Sapiens
VPQRCTPCP

SEQ ID NO: 563522 - protein, 9 aa, Homo Sapiens
RHRCQHNAH

SEQ ID NO: 563523 - protein, 9 aa, Homo Sapiens
LRHCEAKCL

SEQ ID NO: 563524 - protein, 9 aa, Homo Sapiens
RCQHNAHSP

SEQ ID NO: 563525 - protein, 9 aa, Homo Sapiens
SPRENSSAS

SEQ ID NO: 563526 - protein, 9 aa, Homo Sapiens
TQDEVSEIK

SEQ ID NO: 563527 - protein, 9 aa, Homo Sapiens
AGGGLTCAL

SEQ ID NO: 563528 - protein, 9 aa, Homo Sapiens
TCALGIIMA

SEQ ID NO: 563529 - protein, 9 aa, Homo Sapiens
TRCLSQLES

SEQ ID NO: 563530 - protein, 9 aa, Homo Sapiens
PNQFEGVGE

SEQ ID NO: 563531 - protein, 9 aa, Homo Sapiens
SPRPSCGPV

SEQ ID NO: 563532 - protein, 9 aa, Homo Sapiens
DKSLPGSHP

SEQ ID NO: 563533 - protein, 9 aa, Homo Sapiens
LMRVLIPKL

SEQ ID NO: 563534 - protein, 9 aa, Homo Sapiens
QDEVSEIKS

SEQ ID NO: 563535 - protein, 9 aa, Homo Sapiens
KSSQTGTCV

SEQ ID NO: 563536 - protein, 9 aa, Homo Sapiens
AGTYGNQRH

SEQ ID NO: 563537 - protein, 9 aa, Homo Sapiens
IHTHTFYVS

SEQ ID NO: 563538 - protein, 9 aa, Homo Sapiens
RYLAGYTIY

SEQ ID NO: 563539 - protein, 9 aa, Homo Sapiens
LPPGFGGIG

SEQ ID NO: 563540 - protein, 9 aa, Homo Sapiens
PSGQHSCQP

SEQ ID NO: 563541 - protein, 9 aa, Homo Sapiens
GLMTQDEVS

SEQ ID NO: 563542 - protein, 9 aa, Homo Sapiens
NEREKEKRE

SEQ ID NO: 563543 - protein, 9 aa, Homo Sapiens
HRPLRHCEA

SEQ ID NO: 563544 - protein, 9 aa, Homo Sapiens
VKLKLEFYA

SEQ ID NO: 563545 - protein, 9 aa, Homo Sapiens
TFHGKSFHR

SEQ ID NO: 563546 - protein, 9 aa, Homo Sapiens
VCLCLHFTL

SEQ ID NO: 563547 - protein, 9 aa, Homo Sapiens
HPDFPVSCQ

SEQ ID NO: 563548 - protein, 9 aa, Homo Sapiens
GFGGIGEDY

SEQ ID NO: 563549 - protein, 9 aa, Homo Sapiens
WMGQEPGVA

SEQ ID NO: 563550 - protein, 9 aa, Homo Sapiens
ALNASPISN

SEQ ID NO: 563551 - protein, 9 aa, Homo Sapiens
YGHLKGPHQ

SEQ ID NO: 563552 - protein, 9 aa, Homo Sapiens
TVLPCIWMG

SEQ ID NO: 563553 - protein, 9 aa, Homo Sapiens
QGSPALNAS

SEQ ID NO: 563554 - protein, 9 aa, Homo Sapiens
VWVTLFKNN

SEQ ID NO: 563555 - protein, 9 aa, Homo Sapiens
AAGRVPQRC

SEQ ID NO: 563556 - protein, 9 aa, Homo Sapiens
NASPISNTG

SEQ ID NO: 563557 - protein, 9 aa, Homo Sapiens
THIYIHTHT

SEQ ID NO: 563558 - protein, 9 aa, Homo Sapiens
DAAGRVPQR

SEQ ID NO: 563559 - protein, 9 aa, Homo Sapiens
SCQPVSTAE

SEQ ID NO: 563560 - protein, 9 aa, Homo Sapiens
AVDSGADKS

SEQ ID NO: 563561 - protein, 9 aa, Homo Sapiens
PRVQIGTHV

SEQ ID NO: 563562 - protein, 9 aa, Homo Sapiens
NVWVTLFKN

SEQ ID NO: 563563 - protein, 9 aa, Homo Sapiens
SGQHSCQPV

SEQ ID NO: 563564 - protein, 9 aa, Homo Sapiens
GHLKGPHQA

SEQ ID NO: 563565 - protein, 9 aa, Homo Sapiens
PVSCQIHGN

SEQ ID NO: 563566 - protein, 9 aa, Homo Sapiens
PHNPGHVIQ

SEQ ID NO: 563567 - protein, 9 aa, Homo Sapiens
EKEKKENER

SEQ ID NO: 563568 - protein, 9 aa, Homo Sapiens
RAPHNPGHV

SEQ ID NO: 563569 - protein, 9 aa, Homo Sapiens
AQEQRGVND

SEQ ID NO: 563570 - protein, 9 aa, Homo Sapiens
KESIEDRLK

SEQ ID NO: 563571 - protein, 9 aa, Homo Sapiens
GSSTTSSGA

SEQ ID NO: 563572 - protein, 9 aa, Homo Sapiens
AAIMRIMKM

SEQ ID NO: 563573 - protein, 9 aa, Homo Sapiens
IDNLLPGDA

SEQ ID NO: 563574 - protein, 9 aa, Homo Sapiens
TEGEAAHVP

SEQ ID NO: 563575 - protein, 9 aa, Homo Sapiens
KPMVTPGST

SEQ ID NO: 563576 - protein, 9 aa, Homo Sapiens
FPRVQIGTH

SEQ ID NO: 563577 - protein, 9 aa, Homo Sapiens
DITGGEPAW

SEQ ID NO: 563578 - protein, 9 aa, Homo Sapiens
ITGGEPAWD

SEQ ID NO: 563579 - protein, 9 aa, Homo Sapiens
IPNQFEGVG

SEQ ID NO: 563580 - protein, 9 aa, Homo Sapiens
CKGGNVWVT

SEQ ID NO: 563581 - protein, 9 aa, Homo Sapiens
KDGNVTCEC

SEQ ID NO: 563582 - protein, 9 aa, Homo Sapiens
AGGLMTQDE

SEQ ID NO: 563583 - protein, 9 aa, Homo Sapiens
TIHKESIED

SEQ ID NO: 563584 - protein, 9 aa, Homo Sapiens
MVTPGSTLT

SEQ ID NO: 563585 - protein, 9 aa, Homo Sapiens
GGIGEDYSE

SEQ ID NO: 563586 - protein, 9 aa, Homo Sapiens
TLPPSTRCL

SEQ ID NO: 563587 - protein, 9 aa, Homo Sapiens
IKATARSVP

SEQ ID NO: 563588 - protein, 9 aa, Homo Sapiens
QSTSKSSQT

SEQ ID NO: 563589 - protein, 9 aa, Homo Sapiens
KLEFYADYS

SEQ ID NO: 563590 - protein, 9 aa, Homo Sapiens
CLCLHFTLL

SEQ ID NO: 563591 - protein, 9 aa, Homo Sapiens
RVPQRCTPC

SEQ ID NO: 563592 - protein, 9 aa, Homo Sapiens
LTLPPSTRC

SEQ ID NO: 563593 - protein, 9 aa, Homo Sapiens
LLPSGQHSC

SEQ ID NO: 563594 - protein, 9 aa, Homo Sapiens
HRCQHNAHS

SEQ ID NO: 563595 - protein, 9 aa, Homo Sapiens
VSPRENSSA

SEQ ID NO: 563596 - protein, 9 aa, Homo Sapiens
PLRHCEAKC

SEQ ID NO: 563597 - protein, 9 aa, Homo Sapiens
PSTRCLSQL

SEQ ID NO: 563598 - protein, 9 aa, Homo Sapiens
CIWMGQEPG

SEQ ID NO: 563599 - protein, 9 aa, Homo Sapiens
VKVSPRENS

SEQ ID NO: 563600 - protein, 9 aa, Homo Sapiens
KKENEREKE

SEQ ID NO: 563601 - protein, 9 aa, Homo Sapiens
TNNSGPELN

SEQ ID NO: 563602 - protein, 9 aa, Homo Sapiens
VQSTSKSSQ

SEQ ID NO: 563603 - protein, 9 aa, Homo Sapiens
ERTPLANEK

SEQ ID NO: 563604 - protein, 9 aa, Homo Sapiens
IDFDNFVGC

SEQ ID NO: 563605 - protein, 9 aa, Homo Sapiens
KEKEKKENE

SEQ ID NO: 563606 - protein, 9 aa, Homo Sapiens
FDNFVGCLV

SEQ ID NO: 563607 - protein, 9 aa, Homo Sapiens
NQRHRCQHN

SEQ ID NO: 563608 - protein, 9 aa, Homo Sapiens
KLLIQAAIM

SEQ ID NO: 563609 - protein, 9 aa, Homo Sapiens
LNKIRTPEK

SEQ ID NO: 563610 - protein, 9 aa, Homo Sapiens
PELNKIRTP

SEQ ID NO: 563611 - protein, 9 aa, Homo Sapiens
RVLIPKLPQ

SEQ ID NO: 563612 - protein, 9 aa, Homo Sapiens
QHNAHSPQQ

SEQ ID NO: 563613 - protein, 9 aa, Homo Sapiens
VLPCIWMGQ

SEQ ID NO: 563614 - protein, 9 aa, Homo Sapiens
QRCTPCPPP

SEQ ID NO: 563615 - protein, 9 aa, Homo Sapiens
FHRPLRHCE

SEQ ID NO: 563616 - protein, 9 aa, Homo Sapiens
GEAAHVPAT

SEQ ID NO: 563617 - protein, 9 aa, Homo Sapiens
GLTCALGII

SEQ ID NO: 563618 - protein, 9 aa, Homo Sapiens
PPAPSPDAG

SEQ ID NO: 563619 - protein, 9 aa, Homo Sapiens
LPGSHPDFP

SEQ ID NO: 563620 - protein, 9 aa, Homo Sapiens
ESPKPMVTP

SEQ ID NO: 563621 - protein, 9 aa, Homo Sapiens
IHKESIEDR

SEQ ID NO: 563622 - protein, 9 aa, Homo Sapiens
ARSVPDRQE

SEQ ID NO: 563623 - protein, 9 aa, Homo Sapiens
ELESPKPMV

SEQ ID NO: 563624 - protein, 9 aa, Homo Sapiens
STEGEAAHV

SEQ ID NO: 563625 - protein, 9 aa, Homo Sapiens
WDACASEPE

SEQ ID NO: 563626 - protein, 9 aa, Homo Sapiens
RMKKESPSH

SEQ ID NO: 563627 - protein, 9 aa, Homo Sapiens
PHEYKFPKM

SEQ ID NO: 563628 - protein, 9 aa, Homo Sapiens
PPPPAPSPD

SEQ ID NO: 563629 - protein, 9 aa, Homo Sapiens
IMRIMKMRK

SEQ ID NO: 563630 - protein, 9 aa, Homo Sapiens
LPGDAAGRV

SEQ ID NO: 563631 - protein, 9 aa, Homo Sapiens
RRGDASLGL

SEQ ID NO: 563632 - protein, 9 aa, Homo Sapiens
NNSGPELNK

SEQ ID NO: 563633 - protein, 9 aa, Homo Sapiens
LNTVSLMRV

SEQ ID NO: 563634 - protein, 9 aa, Homo Sapiens
MAKIDNLLP

SEQ ID NO: 563635 - protein, 9 aa, Homo Sapiens
SHPDFPVSC

SEQ ID NO: 563636 - protein, 9 aa, Homo Sapiens
QAFTFHGKS

SEQ ID NO: 563637 - protein, 9 aa, Homo Sapiens
YGNQRHRCQ

SEQ ID NO: 563638 - protein, 9 aa, Homo Sapiens
QRHRCQHNA

SEQ ID NO: 563639 - protein, 9 aa, Homo Sapiens
MLLTNVGAF

SEQ ID NO: 563640 - protein, 9 aa, Homo Sapiens
LCQHTCEST

SEQ ID NO: 563641 - protein, 9 aa, Homo Sapiens
DVARLVLSD

SEQ ID NO: 563642 - protein, 9 aa, Homo Sapiens
ARPAVLGLT

SEQ ID NO: 563643 - protein, 9 aa, Homo Sapiens
LAEGVNKLK

SEQ ID NO: 563644 - protein, 9 aa, Homo Sapiens
TLIYTCASE

SEQ ID NO: 563645 - protein, 9 aa, Homo Sapiens
YFFLESSTG

SEQ ID NO: 563646 - protein, 9 aa, Homo Sapiens
LLADIKRLK

SEQ ID NO: 563647 - protein, 9 aa, Homo Sapiens
KASAVDDDD

SEQ ID NO: 563648 - protein, 9 aa, Homo Sapiens
SAVNSSHSK

SEQ ID NO: 563649 - protein, 9 aa, Homo Sapiens
AVDDDDKVY

SEQ ID NO: 563650 - protein, 9 aa, Homo Sapiens
QMKRRKYSF

SEQ ID NO: 563651 - protein, 9 aa, Homo Sapiens
YSFIYKTHL

SEQ ID NO: 563652 - protein, 9 aa, Homo Sapiens
QKAIDVYEQ

SEQ ID NO: 563653 - protein, 9 aa, Homo Sapiens
AATEQKWHL

SEQ ID NO: 563654 - protein, 9 aa, Homo Sapiens
ALFALGQFT

SEQ ID NO: 563655 - protein, 9 aa, Homo Sapiens
REKCYKCDE

SEQ ID NO: 563656 - protein, 9 aa, Homo Sapiens
CFMPQLRVL

SEQ ID NO: 563657 - protein, 9 aa, Homo Sapiens
QLIFNAYNS

SEQ ID NO: 563658 - protein, 9 aa, Homo Sapiens
TTCSKENFL

SEQ ID NO: 563659 - protein, 9 aa, Homo Sapiens
EHVCFMPQL

SEQ ID NO: 563660 - protein, 9 aa, Homo Sapiens
GLDCALVEH

SEQ ID NO: 563661 - protein, 9 aa, Homo Sapiens
EHELALQQT

SEQ ID NO: 563662 - protein, 9 aa, Homo Sapiens
LQIQAAVTA

SEQ ID NO: 563663 - protein, 9 aa, Homo Sapiens
HGLDCALVE

SEQ ID NO: 563664 - protein, 9 aa, Homo Sapiens
LSVRISCRL

SEQ ID NO: 563665 - protein, 9 aa, Homo Sapiens
GGHRFIYLQ

SEQ ID NO: 563666 - protein, 9 aa, Homo Sapiens
VLPDHLYPL

SEQ ID NO: 563667 - protein, 9 aa, Homo Sapiens
GQFTENLQP

SEQ ID NO: 563668 - protein, 9 aa, Homo Sapiens
KNSLPISKI

SEQ ID NO: 563669 - protein, 9 aa, Homo Sapiens
RISCRLTGS

SEQ ID NO: 563670 - protein, 9 aa, Homo Sapiens
RPMNQRERG

SEQ ID NO: 563671 - protein, 9 aa, Homo Sapiens
NSPIHTSAC

SEQ ID NO: 563672 - protein, 9 aa, Homo Sapiens
AAVTAGDVH

SEQ ID NO: 563673 - protein, 9 aa, Homo Sapiens
LNEELRTLS

SEQ ID NO: 563674 - protein, 9 aa, Homo Sapiens
TFTGAQVRQ

SEQ ID NO: 563675 - protein, 9 aa, Homo Sapiens
KWHLEEKQR

SEQ ID NO: 563676 - protein, 9 aa, Homo Sapiens
SKASAVDDD

SEQ ID NO: 563677 - protein, 9 aa, Homo Sapiens
WKQLENLCF

SEQ ID NO: 563678 - protein, 9 aa, Homo Sapiens
EEFRHSSNP

SEQ ID NO: 563679 - protein, 9 aa, Homo Sapiens
LHLNSPIHT

SEQ ID NO: 563680 - protein, 9 aa, Homo Sapiens
DLHVHRADV

SEQ ID NO: 563681 - protein, 9 aa, Homo Sapiens
QENLRMFYL

SEQ ID NO: 563682 - protein, 9 aa, Homo Sapiens
YLSLITRDS

SEQ ID NO: 563683 - protein, 9 aa, Homo Sapiens
RTINSMFLG

SEQ ID NO: 563684 - protein, 9 aa, Homo Sapiens
EKRQRAEER

SEQ ID NO: 563685 - protein, 9 aa, Homo Sapiens
PVFGRVHFS

SEQ ID NO: 563686 - protein, 9 aa, Homo Sapiens
LEKTKLQDL

SEQ ID NO: 563687 - protein, 9 aa, Homo Sapiens
DDSLKTPPL

SEQ ID NO: 563688 - protein, 9 aa, Homo Sapiens
RTLSLSVRI

SEQ ID NO: 563689 - protein, 9 aa, Homo Sapiens
VTTEEQVLG

SEQ ID NO: 563690 - protein, 9 aa, Homo Sapiens
LLNFLAEGV

SEQ ID NO: 563691 - protein, 9 aa, Homo Sapiens
TELEMNQPQ

SEQ ID NO: 563692 - protein, 9 aa, Homo Sapiens
LITRDSISA

SEQ ID NO: 563693 - protein, 9 aa, Homo Sapiens
RAHLANHEE

SEQ ID NO: 563694 - protein, 9 aa, Homo Sapiens
SCFPNVFTA

SEQ ID NO: 563695 - protein, 9 aa, Homo Sapiens
RIAPGPALL

SEQ ID NO: 563696 - protein, 9 aa, Homo Sapiens
ARLVLSDPQ

SEQ ID NO: 563697 - protein, 9 aa, Homo Sapiens
RPAVLGLTG

SEQ ID NO: 563698 - protein, 9 aa, Homo Sapiens
REAFLVNCD

SEQ ID NO: 563699 - protein, 9 aa, Homo Sapiens
SSHSKSNRA

SEQ ID NO: 563700 - protein, 9 aa, Homo Sapiens
QMEKSPIDA

SEQ ID NO: 563701 - protein, 9 aa, Homo Sapiens
KLPVVDEND

SEQ ID NO: 563702 - protein, 9 aa, Homo Sapiens
SWVFGTIDP

SEQ ID NO: 563703 - protein, 9 aa, Homo Sapiens
NQRERGLRC

SEQ ID NO: 563704 - protein, 9 aa, Homo Sapiens
ALQQTVEAG

SEQ ID NO: 563705 - protein, 9 aa, Homo Sapiens
PAAVSHSEK

SEQ ID NO: 563706 - protein, 9 aa, Homo Sapiens
QHTCESTLG

SEQ ID NO: 563707 - protein, 9 aa, Homo Sapiens
PIELDTLVR

SEQ ID NO: 563708 - protein, 9 aa, Homo Sapiens
QLENLCFRE

SEQ ID NO: 563709 - protein, 9 aa, Homo Sapiens
VITIQASNC

SEQ ID NO: 563710 - protein, 9 aa, Homo Sapiens
NSSHSKSNR

SEQ ID NO: 563711 - protein, 9 aa, Homo Sapiens
LTYRGAVYV

SEQ ID NO: 563712 - protein, 9 aa, Homo Sapiens
EQYQKAIDV

SEQ ID NO: 563713 - protein, 9 aa, Homo Sapiens
ACLCEYQWM

SEQ ID NO: 563714 - protein, 9 aa, Homo Sapiens
EHPRAEVRR

SEQ ID NO: 563715 - protein, 9 aa, Homo Sapiens
SGGSGHEKD

SEQ ID NO: 563716 - protein, 9 aa, Homo Sapiens
STLGSYRCS

SEQ ID NO: 563717 - protein, 9 aa, Homo Sapiens
AVLGLTGLA

SEQ ID NO: 563718 - protein, 9 aa, Homo Sapiens
TIDPTSGVA

SEQ ID NO: 563719 - protein, 9 aa, Homo Sapiens
QLRVLAQVL

SEQ ID NO: 563720 - protein, 9 aa, Homo Sapiens
RAKETKGGV

SEQ ID NO: 563721 - protein, 9 aa, Homo Sapiens
ASAVDDDDK

SEQ ID NO: 563722 - protein, 9 aa, Homo Sapiens
TIFMAPQKY

SEQ ID NO: 563723 - protein, 9 aa, Homo Sapiens
ALLEHPRAE

SEQ ID NO: 563724 - protein, 9 aa, Homo Sapiens
NHEELISKS

SEQ ID NO: 563725 - protein, 9 aa, Homo Sapiens
ERGLRCQPV

SEQ ID NO: 563726 - protein, 9 aa, Homo Sapiens
RGLRCQPVV

SEQ ID NO: 563727 - protein, 9 aa, Homo Sapiens
GRVHFSKQL

SEQ ID NO: 563728 - protein, 9 aa, Homo Sapiens
LPPSVDDSL

SEQ ID NO: 563729 - protein, 9 aa, Homo Sapiens
VFQLLYIVP

SEQ ID NO: 563730 - protein, 9 aa, Homo Sapiens
FNAYNSIRS

SEQ ID NO: 563731 - protein, 9 aa, Homo Sapiens
LVNCDLTLR

SEQ ID NO: 563732 - protein, 9 aa, Homo Sapiens
LGLHLNSPI

SEQ ID NO: 563733 - protein, 9 aa, Homo Sapiens
VHFSKQLIH

SEQ ID NO: 563734 - protein, 9 aa, Homo Sapiens
VTSRVKERQ

SEQ ID NO: 563735 - protein, 9 aa, Homo Sapiens
RADVARLVL

SEQ ID NO: 563736 - protein, 9 aa, Homo Sapiens
AVSHSEKYT

SEQ ID NO: 563737 - protein, 9 aa, Homo Sapiens
PQLPVFGRV

SEQ ID NO: 563738 - protein, 9 aa, Homo Sapiens
LAEETQIYK

SEQ ID NO: 563739 - protein, 9 aa, Homo Sapiens
ELKKLAEET

SEQ ID NO: 563740 - protein, 9 aa, Homo Sapiens
LQDLTRKLK

SEQ ID NO: 563741 - protein, 9 aa, Homo Sapiens
PISKINFIK

SEQ ID NO: 563742 - protein, 9 aa, Homo Sapiens
NCDLTLRAQ

SEQ ID NO: 563743 - protein, 9 aa, Homo Sapiens
GSEQLTYRG

SEQ ID NO: 563744 - protein, 9 aa, Homo Sapiens
TMGRHGGHR

SEQ ID NO: 563745 - protein, 9 aa, Homo Sapiens
KQAKETSNI

SEQ ID NO: 563746 - protein, 9 aa, Homo Sapiens
IAPGPALLL

SEQ ID NO: 563747 - protein, 9 aa, Homo Sapiens
CALVEHVCF

SEQ ID NO: 563748 - protein, 9 aa, Homo Sapiens
KKRSSKEEA

SEQ ID NO: 563749 - protein, 9 aa, Homo Sapiens
CYKCDECGK

SEQ ID NO: 563750 - protein, 9 aa, Homo Sapiens
KRREKEAEK

SEQ ID NO: 563751 - protein, 9 aa, Homo Sapiens
SLPISKINF

SEQ ID NO: 563752 - protein, 9 aa, Homo Sapiens
KEKDSLLAD

SEQ ID NO: 563753 - protein, 9 aa, Homo Sapiens
VNATEGEGP

SEQ ID NO: 563754 - protein, 9 aa, Homo Sapiens
SPIDAITGE

SEQ ID NO: 563755 - protein, 9 aa, Homo Sapiens
LPDHLYPLH

SEQ ID NO: 563756 - protein, 9 aa, Homo Sapiens
REGLGKFSE

SEQ ID NO: 563757 - protein, 9 aa, Homo Sapiens
LCEYQWMRK

SEQ ID NO: 563758 - protein, 9 aa, Homo Sapiens
PALLLCCPV

SEQ ID NO: 563759 - protein, 9 aa, Homo Sapiens
LSTSRFQSV

SEQ ID NO: 563760 - protein, 9 aa, Homo Sapiens
LAMLGAGLM

SEQ ID NO: 563761 - protein, 9 aa, Homo Sapiens
SPIHTSACL

SEQ ID NO: 563762 - protein, 9 aa, Homo Sapiens
KLTFTGAQV

SEQ ID NO: 563763 - protein, 9 aa, Homo Sapiens
KQLDELLST

SEQ ID NO: 563764 - protein, 9 aa, Homo Sapiens
EELISKSFQ

SEQ ID NO: 563765 - protein, 9 aa, Homo Sapiens
NATEGEGPA

SEQ ID NO: 563766 - protein, 9 aa, Homo Sapiens
SHSEKYTHR

SEQ ID NO: 563767 - protein, 9 aa, Homo Sapiens
TRDSISAPS

SEQ ID NO: 563768 - protein, 9 aa, Homo Sapiens
KTKLQDLTR

SEQ ID NO: 563769 - protein, 9 aa, Homo Sapiens
ISFVRLGHC

SEQ ID NO: 563770 - protein, 9 aa, Homo Sapiens
LASLRLLPQ

SEQ ID NO: 563771 - protein, 9 aa, Homo Sapiens
NSLPISKIN

SEQ ID NO: 563772 - protein, 9 aa, Homo Sapiens
PLASLRLLP

SEQ ID NO: 563773 - protein, 9 aa, Homo Sapiens
THLTSLEDE

SEQ ID NO: 563774 - protein, 9 aa, Homo Sapiens
SVLQENLRM

SEQ ID NO: 563775 - protein, 9 aa, Homo Sapiens
LTSLEDELQ

SEQ ID NO: 563776 - protein, 9 aa, Homo Sapiens
SCRLTGSRK

SEQ ID NO: 563777 - protein, 9 aa, Homo Sapiens
SSSAENTRH

SEQ ID NO: 563778 - protein, 9 aa, Homo Sapiens
RMFYLSLIT

SEQ ID NO: 563779 - protein, 9 aa, Homo Sapiens
SKQLIHGLD

SEQ ID NO: 563780 - protein, 9 aa, Homo Sapiens
TNAWVFQLL

SEQ ID NO: 563781 - protein, 9 aa, Homo Sapiens
QLDELLSTK

SEQ ID NO: 563782 - protein, 9 aa, Homo Sapiens
KNIIQLIFN

SEQ ID NO: 563783 - protein, 9 aa, Homo Sapiens
PLPPSVDDS

SEQ ID NO: 563784 - protein, 9 aa, Homo Sapiens
PNVFTASKL

SEQ ID NO: 563785 - protein, 9 aa, Homo Sapiens
VLGQRLPIQ

SEQ ID NO: 563786 - protein, 9 aa, Homo Sapiens
QSCLIMTMS

SEQ ID NO: 563787 - protein, 9 aa, Homo Sapiens
YTIFMAPQK

SEQ ID NO: 563788 - protein, 9 aa, Homo Sapiens
AVNSSHSKS

SEQ ID NO: 563789 - protein, 9 aa, Homo Sapiens
KAIDVYEQV

SEQ ID NO: 563790 - protein, 9 aa, Homo Sapiens
TTEEQVLGQ

SEQ ID NO: 563791 - protein, 9 aa, Homo Sapiens
FPNVFTASK

SEQ ID NO: 563792 - protein, 9 aa, Homo Sapiens
ISLGSRIPG

SEQ ID NO: 563793 - protein, 9 aa, Homo Sapiens
RSSKEEASM

SEQ ID NO: 563794 - protein, 9 aa, Homo Sapiens
PSVNATEGE

SEQ ID NO: 563795 - protein, 9 aa, Homo Sapiens
LVEHVCFMP

SEQ ID NO: 563796 - protein, 9 aa, Homo Sapiens
HSTSALTEL

SEQ ID NO: 563797 - protein, 9 aa, Homo Sapiens
TQVSSGNPV

SEQ ID NO: 563798 - protein, 9 aa, Homo Sapiens
VKHLAMLGA

SEQ ID NO: 563799 - protein, 9 aa, Homo Sapiens
LGSRIPGTR

SEQ ID NO: 563800 - protein, 9 aa, Homo Sapiens
GLHLNSPIH

SEQ ID NO: 563801 - protein, 9 aa, Homo Sapiens
TCSKENFLF

SEQ ID NO: 563802 - protein, 9 aa, Homo Sapiens
SALTELEMN

SEQ ID NO: 563803 - protein, 9 aa, Homo Sapiens
PPRSLAILS

SEQ ID NO: 563804 - protein, 9 aa, Homo Sapiens
ISCRLTGSR

SEQ ID NO: 563805 - protein, 9 aa, Homo Sapiens
LQQTVEAGV

SEQ ID NO: 563806 - protein, 9 aa, Homo Sapiens
GPAAVSHSE

SEQ ID NO: 563807 - protein, 9 aa, Homo Sapiens
KEVTSRVKE

SEQ ID NO: 563808 - protein, 9 aa, Homo Sapiens
CSLLNFLAE

SEQ ID NO: 563809 - protein, 9 aa, Homo Sapiens
WQKDAERTI

SEQ ID NO: 563810 - protein, 9 aa, Homo Sapiens
NYEHELALQ

SEQ ID NO: 563811 - protein, 9 aa, Homo Sapiens
EQVLGQRLP

SEQ ID NO: 563812 - protein, 9 aa, Homo Sapiens
NFLAEGVNK

SEQ ID NO: 563813 - protein, 9 aa, Homo Sapiens
NQLKQYKQA

SEQ ID NO: 563814 - protein, 9 aa, Homo Sapiens
REFKTPTNF

SEQ ID NO: 563815 - protein, 9 aa, Homo Sapiens
YHPGVFCGD

SEQ ID NO: 563816 - protein, 9 aa, Homo Sapiens
GHRFIYLQE

SEQ ID NO: 563817 - protein, 9 aa, Homo Sapiens
EKSGEAADG

SEQ ID NO: 563818 - protein, 9 aa, Homo Sapiens
ASNCTELDM

SEQ ID NO: 563819 - protein, 9 aa, Homo Sapiens
SAENTRHNG

SEQ ID NO: 563820 - protein, 9 aa, Homo Sapiens
SSTTPPPPT

SEQ ID NO: 563821 - protein, 9 aa, Homo Sapiens
TAGDVHTVR

SEQ ID NO: 563822 - protein, 9 aa, Homo Sapiens
GVFCGDKWS

SEQ ID NO: 563823 - protein, 9 aa, Homo Sapiens
HFTFEEFRH

SEQ ID NO: 563824 - protein, 9 aa, Homo Sapiens
LGSSSQGLP

SEQ ID NO: 563825 - protein, 9 aa, Homo Sapiens
DSLSTSRFQ

SEQ ID NO: 563826 - protein, 9 aa, Homo Sapiens
VDDSLKTPP

SEQ ID NO: 563827 - protein, 9 aa, Homo Sapiens
KSGEAADGA

SEQ ID NO: 563828 - protein, 9 aa, Homo Sapiens
SLGSSSQGL

SEQ ID NO: 563829 - protein, 9 aa, Homo Sapiens
DDDDKVYYF

SEQ ID NO: 563830 - protein, 9 aa, Homo Sapiens
TTPPPPTRR

SEQ ID NO: 563831 - protein, 9 aa, Homo Sapiens
QLTYRGAVY

SEQ ID NO: 563832 - protein, 9 aa, Homo Sapiens
AIDVYEQVG

SEQ ID NO: 563833 - protein, 9 aa, Homo Sapiens
DDTHPLASL

SEQ ID NO: 563834 - protein, 9 aa, Homo Sapiens
ARIAPGPAL

SEQ ID NO: 563835 - protein, 9 aa, Homo Sapiens
AHLANHEEL

SEQ ID NO: 563836 - protein, 9 aa, Homo Sapiens
SPRTGGSGL

SEQ ID NO: 563837 - protein, 9 aa, Homo Sapiens
LGQRLPIQS

SEQ ID NO: 563838 - protein, 9 aa, Homo Sapiens
GRHGGHRFI

SEQ ID NO: 563839 - protein, 9 aa, Homo Sapiens
SLSKKSLKV

SEQ ID NO: 563840 - protein, 9 aa, Homo Sapiens
ESTLGSYRC

SEQ ID NO: 563841 - protein, 9 aa, Homo Sapiens
AEKKRSSKE

SEQ ID NO: 563842 - protein, 9 aa, Homo Sapiens
NEELRTLSL

SEQ ID NO: 563843 - protein, 9 aa, Homo Sapiens
LPLLVALLE

SEQ ID NO: 563844 - protein, 9 aa, Homo Sapiens
TLVRKGRFA

SEQ ID NO: 563845 - protein, 9 aa, Homo Sapiens
KKHTLQNRN

SEQ ID NO: 563846 - protein, 9 aa, Homo Sapiens
QLLYIVPEL

SEQ ID NO: 563847 - protein, 9 aa, Homo Sapiens
LGLTGLALL

SEQ ID NO: 563848 - protein, 9 aa, Homo Sapiens
LDELLSTKK

SEQ ID NO: 563849 - protein, 9 aa, Homo Sapiens
YRGAVYVYF

SEQ ID NO: 563850 - protein, 9 aa, Homo Sapiens
HRFIYLQEA

SEQ ID NO: 563851 - protein, 9 aa, Homo Sapiens
YHISLGSRI

SEQ ID NO: 563852 - protein, 9 aa, Homo Sapiens
AFLVNCDLT

SEQ ID NO: 563853 - protein, 9 aa, Homo Sapiens
FTASKLVRV

SEQ ID NO: 563854 - protein, 9 aa, Homo Sapiens
LVLSDPQLP

SEQ ID NO: 563855 - protein, 9 aa, Homo Sapiens
NFSEGNNWE

SEQ ID NO: 563856 - protein, 9 aa, Homo Sapiens
GSYHPGVFC

SEQ ID NO: 563857 - protein, 9 aa, Homo Sapiens
VTAGDVHTV

SEQ ID NO: 563858 - protein, 9 aa, Homo Sapiens
SPSAASTSG

SEQ ID NO: 563859 - protein, 9 aa, Homo Sapiens
SLTQVSSGN

SEQ ID NO: 563860 - protein, 9 aa, Homo Sapiens
FANQLKQYK

SEQ ID NO: 563861 - protein, 9 aa, Homo Sapiens
ITRDSISAP

SEQ ID NO: 563862 - protein, 9 aa, Homo Sapiens
SSQGLPTNV

SEQ ID NO: 563863 - protein, 9 aa, Homo Sapiens
FSLSNLVSG

SEQ ID NO: 563864 - protein, 9 aa, Homo Sapiens
SKNIIQLIF

SEQ ID NO: 563865 - protein, 9 aa, Homo Sapiens
DKRIKHLIK

SEQ ID NO: 563866 - protein, 9 aa, Homo Sapiens
LNFLAEGVN

SEQ ID NO: 563867 - protein, 9 aa, Homo Sapiens
RREKEAEKR

SEQ ID NO: 563868 - protein, 9 aa, Homo Sapiens
HRDSWVFGT

SEQ ID NO: 563869 - protein, 9 aa, Homo Sapiens
AEDDTHPLA

SEQ ID NO: 563870 - protein, 9 aa, Homo Sapiens
VALLEHPRA

SEQ ID NO: 563871 - protein, 9 aa, Homo Sapiens
TLSLSVRIS

SEQ ID NO: 563872 - protein, 9 aa, Homo Sapiens
LDLHVHRAD

SEQ ID NO: 563873 - protein, 9 aa, Homo Sapiens
TNFSEGNNW

SEQ ID NO: 563874 - protein, 9 aa, Homo Sapiens
TSACLCEYQ

SEQ ID NO: 563875 - protein, 9 aa, Homo Sapiens
EPSCDRLID

SEQ ID NO: 563876 - protein, 9 aa, Homo Sapiens
LLNEELRTL

SEQ ID NO: 563877 - protein, 9 aa, Homo Sapiens
SVDDSLKTP

SEQ ID NO: 563878 - protein, 9 aa, Homo Sapiens
IVQTTCSKE

SEQ ID NO: 563879 - protein, 9 aa, Homo Sapiens
PFDSTLRKG

SEQ ID NO: 563880 - protein, 9 aa, Homo Sapiens
QVREGLGKF

SEQ ID NO: 563881 - protein, 9 aa, Homo Sapiens
LNSPIHTSA

SEQ ID NO: 563882 - protein, 9 aa, Homo Sapiens
RLGHCSFSK

SEQ ID NO: 563883 - protein, 9 aa, Homo Sapiens
PAYPPRSLA

SEQ ID NO: 563884 - protein, 9 aa, Homo Sapiens
EKEAEKRQR

SEQ ID NO: 563885 - protein, 9 aa, Homo Sapiens
SIVQTTCSK

SEQ ID NO: 563886 - protein, 9 aa, Homo Sapiens
HEELISKSF

SEQ ID NO: 563887 - protein, 9 aa, Homo Sapiens
LQNSLADVE

SEQ ID NO: 563888 - protein, 9 aa, Homo Sapiens
SKEEASMKK

SEQ ID NO: 563889 - protein, 9 aa, Homo Sapiens
VLAQVLPDH

SEQ ID NO: 563890 - protein, 9 aa, Homo Sapiens
PVFPPSGGS

SEQ ID NO: 563891 - protein, 9 aa, Homo Sapiens
TIQASNCTE

SEQ ID NO: 563892 - protein, 9 aa, Homo Sapiens
PPSGGSGHE

SEQ ID NO: 563893 - protein, 9 aa, Homo Sapiens
QASNCTELD

SEQ ID NO: 563894 - protein, 9 aa, Homo Sapiens
RERGLRCQP

SEQ ID NO: 563895 - protein, 9 aa, Homo Sapiens
IQLIFNAYN

SEQ ID NO: 563896 - protein, 9 aa, Homo Sapiens
RVPYHISLG

SEQ ID NO: 563897 - protein, 9 aa, Homo Sapiens
HLNSPIHTS

SEQ ID NO: 563898 - protein, 9 aa, Homo Sapiens
LTELEMNQP

SEQ ID NO: 563899 - protein, 9 aa, Homo Sapiens
EKSPIDAIT

SEQ ID NO: 563900 - protein, 9 aa, Homo Sapiens
CREAFLVNC

SEQ ID NO: 563901 - protein, 9 aa, Homo Sapiens
TSRFQSVKS

SEQ ID NO: 563902 - protein, 9 aa, Homo Sapiens
SISAPSVNA

SEQ ID NO: 563903 - protein, 9 aa, Homo Sapiens
ENLRMFYLS

SEQ ID NO: 563904 - protein, 9 aa, Homo Sapiens
FACLGLHLN

SEQ ID NO: 563905 - protein, 9 aa, Homo Sapiens
TEQKWHLEE

SEQ ID NO: 563906 - protein, 9 aa, Homo Sapiens
PIIHQILHW

SEQ ID NO: 563907 - protein, 9 aa, Homo Sapiens
LPVFGRVHF

SEQ ID NO: 563908 - protein, 9 aa, Homo Sapiens
SQGLPTNVK

SEQ ID NO: 563909 - protein, 9 aa, Homo Sapiens
LIYTCASEF

SEQ ID NO: 563910 - protein, 9 aa, Homo Sapiens
LVTNAWVFQ

SEQ ID NO: 563911 - protein, 9 aa, Homo Sapiens
PYHISLGSR

SEQ ID NO: 563912 - protein, 9 aa, Homo Sapiens
AGVSEWLGL

SEQ ID NO: 563913 - protein, 9 aa, Homo Sapiens
CESTLGSYR

SEQ ID NO: 563914 - protein, 9 aa, Homo Sapiens
IDVYEQVGT

SEQ ID NO: 563915 - protein, 9 aa, Homo Sapiens
KRQRAEERK

SEQ ID NO: 563916 - protein, 9 aa, Homo Sapiens
QLKQYKQAK

SEQ ID NO: 563917 - protein, 9 aa, Homo Sapiens
YKKHTLQNR

SEQ ID NO: 563918 - protein, 9 aa, Homo Sapiens
ADIKRLKQD

SEQ ID NO: 563919 - protein, 9 aa, Homo Sapiens
ENLCFREKK

SEQ ID NO: 563920 - protein, 9 aa, Homo Sapiens
FTENLQPHI

SEQ ID NO: 563921 - protein, 9 aa, Homo Sapiens
LIHGLDCAL

SEQ ID NO: 563922 - protein, 9 aa, Homo Sapiens
TLQNRNDLN

SEQ ID NO: 563923 - protein, 9 aa, Homo Sapiens
ANQLKQYKQ

SEQ ID NO: 563924 - protein, 9 aa, Homo Sapiens
SSAENTRHN

SEQ ID NO: 563925 - protein, 9 aa, Homo Sapiens
KRIKHLIKT

SEQ ID NO: 563926 - protein, 9 aa, Homo Sapiens
KDSLLADIK

SEQ ID NO: 563927 - protein, 9 aa, Homo Sapiens
LGVGIAQSR

SEQ ID NO: 563928 - protein, 9 aa, Homo Sapiens
LDTLVRKGR

SEQ ID NO: 563929 - protein, 9 aa, Homo Sapiens
LSLTQVSSG

SEQ ID NO: 563930 - protein, 9 aa, Homo Sapiens
SAVDDDDKV

SEQ ID NO: 563931 - protein, 9 aa, Homo Sapiens
DSWVFGTID

SEQ ID NO: 563932 - protein, 9 aa, Homo Sapiens
GTARIAPGP

SEQ ID NO: 563933 - protein, 9 aa, Homo Sapiens
ALVEHVCFM

SEQ ID NO: 563934 - protein, 9 aa, Homo Sapiens
RHNGSNDSD

SEQ ID NO: 563935 - protein, 9 aa, Homo Sapiens
QNSLADVEN

SEQ ID NO: 563936 - protein, 9 aa, Homo Sapiens
LQNRNDLNQ

SEQ ID NO: 563937 - protein, 9 aa, Homo Sapiens
VLSDPQLPV

SEQ ID NO: 563938 - protein, 9 aa, Homo Sapiens
FTFEEFRHS

SEQ ID NO: 563939 - protein, 9 aa, Homo Sapiens
PDHLYPLHL

SEQ ID NO: 563940 - protein, 9 aa, Homo Sapiens
EAEKRQRAE

SEQ ID NO: 563941 - protein, 9 aa, Homo Sapiens
EKDSLLADI

SEQ ID NO: 563942 - protein, 9 aa, Homo Sapiens
LVRKGRFAE

SEQ ID NO: 563943 - protein, 9 aa, Homo Sapiens
AIKQQMEKS

SEQ ID NO: 563944 - protein, 9 aa, Homo Sapiens
SVNATEGEG

SEQ ID NO: 563945 - protein, 9 aa, Homo Sapiens
CLPNLTHLT

SEQ ID NO: 563946 - protein, 9 aa, Homo Sapiens
FTGAQVRQL

SEQ ID NO: 563947 - protein, 9 aa, Homo Sapiens
LSLSVRISC

SEQ ID NO: 563948 - protein, 9 aa, Homo Sapiens
LANHEELIS

SEQ ID NO: 563949 - protein, 9 aa, Homo Sapiens
CLCEYQWMR

SEQ ID NO: 563950 - protein, 9 aa, Homo Sapiens
DVENFINSL

SEQ ID NO: 563951 - protein, 9 aa, Homo Sapiens
ISCFPNVFT

SEQ ID NO: 563952 - protein, 9 aa, Homo Sapiens
SLLADIKRL

SEQ ID NO: 563953 - protein, 9 aa, Homo Sapiens
LPYIIYFFL

SEQ ID NO: 563954 - protein, 9 aa, Homo Sapiens
ATEGEGPAA

SEQ ID NO: 563955 - protein, 9 aa, Homo Sapiens
QAAVTAGDV

SEQ ID NO: 563956 - protein, 9 aa, Homo Sapiens
TFEEFRHSS

SEQ ID NO: 563957 - protein, 9 aa, Homo Sapiens
DWQKDAERT

SEQ ID NO: 563958 - protein, 9 aa, Homo Sapiens
SMQDLSQVR

SEQ ID NO: 563959 - protein, 9 aa, Homo Sapiens
DLNQSCLIM

SEQ ID NO: 563960 - protein, 9 aa, Homo Sapiens
HLAMLGAGL

SEQ ID NO: 563961 - protein, 9 aa, Homo Sapiens
HLTSLEDEL

SEQ ID NO: 563962 - protein, 9 aa, Homo Sapiens
LSQVREGLG

SEQ ID NO: 563963 - protein, 9 aa, Homo Sapiens
QLSLTQVSS

SEQ ID NO: 563964 - protein, 9 aa, Homo Sapiens
YTCASEFDF

SEQ ID NO: 563965 - protein, 9 aa, Homo Sapiens
SLGSRIPGT

SEQ ID NO: 563966 - protein, 9 aa, Homo Sapiens
KQQMEKSPI

SEQ ID NO: 563967 - protein, 9 aa, Homo Sapiens
TYSIVQTTC

SEQ ID NO: 563968 - protein, 9 aa, Homo Sapiens
THPLASLRL

SEQ ID NO: 563969 - protein, 9 aa, Homo Sapiens
CLDEMSNLK

SEQ ID NO: 563970 - protein, 9 aa, Homo Sapiens
LTQVSSGNP

SEQ ID NO: 563971 - protein, 9 aa, Homo Sapiens
VPIIHQILH

SEQ ID NO: 563972 - protein, 9 aa, Homo Sapiens
AADGARPQA

SEQ ID NO: 563973 - protein, 9 aa, Homo Sapiens
SASRKKLPV

SEQ ID NO: 563974 - protein, 9 aa, Homo Sapiens
GLTGLALLL

SEQ ID NO: 563975 - protein, 9 aa, Homo Sapiens
THNCGHSEE

SEQ ID NO: 563976 - protein, 9 aa, Homo Sapiens
LDKRIKHLI

SEQ ID NO: 563977 - protein, 9 aa, Homo Sapiens
MLGAGLMGA

SEQ ID NO: 563978 - protein, 9 aa, Homo Sapiens
YPPRSLAIL

SEQ ID NO: 563979 - protein, 9 aa, Homo Sapiens
ELGVGIAQS

SEQ ID NO: 563980 - protein, 9 aa, Homo Sapiens
AAGVSEWLG

SEQ ID NO: 563981 - protein, 9 aa, Homo Sapiens
LVKEVTSRV

SEQ ID NO: 563982 - protein, 9 aa, Homo Sapiens
LADVENFIN

SEQ ID NO: 563983 - protein, 9 aa, Homo Sapiens
VARLVLSDP

SEQ ID NO: 563984 - protein, 9 aa, Homo Sapiens
LEHPRAEVR

SEQ ID NO: 563985 - protein, 9 aa, Homo Sapiens
CQHTCESTL

SEQ ID NO: 563986 - protein, 9 aa, Homo Sapiens
RVHFSKQLI

SEQ ID NO: 563987 - protein, 9 aa, Homo Sapiens
KCYKCDECG

SEQ ID NO: 563988 - protein, 9 aa, Homo Sapiens
EDDTHPLAS

SEQ ID NO: 563989 - protein, 9 aa, Homo Sapiens
SPQQASPRT

SEQ ID NO: 563990 - protein, 9 aa, Homo Sapiens
SACLCEYQW

SEQ ID NO: 563991 - protein, 9 aa, Homo Sapiens
FVRLGHCSF

SEQ ID NO: 563992 - protein, 9 aa, Homo Sapiens
ASTSGNDSK

SEQ ID NO: 563993 - protein, 9 aa, Homo Sapiens
DCALVEHVC

SEQ ID NO: 563994 - protein, 9 aa, Homo Sapiens
IQAAVTAGD

SEQ ID NO: 563995 - protein, 9 aa, Homo Sapiens
TARIAPGPA

SEQ ID NO: 563996 - protein, 9 aa, Homo Sapiens
NLTHLTSLE

SEQ ID NO: 563997 - protein, 9 aa, Homo Sapiens
HLYPLHLQP

SEQ ID NO: 563998 - protein, 9 aa, Homo Sapiens
LKVWNKDSI

SEQ ID NO: 563999 - protein, 9 aa, Homo Sapiens
EEASMKKVV

SEQ ID NO: 564000 - protein, 9 aa, Homo Sapiens
FEEFRHSSN

SEQ ID NO: 564001 - protein, 9 aa, Homo Sapiens
DAERTINSM

SEQ ID NO: 564002 - protein, 9 aa, Homo Sapiens
LRMFYLSLI

SEQ ID NO: 564003 - protein, 9 aa, Homo Sapiens
ASRKKLPVV

SEQ ID NO: 564004 - protein, 9 aa, Homo Sapiens
FRHSSNPLS

SEQ ID NO: 564005 - protein, 9 aa, Homo Sapiens
DELGVGIAQ

SEQ ID NO: 564006 - protein, 9 aa, Homo Sapiens
EVTSRVKER

SEQ ID NO: 564007 - protein, 9 aa, Homo Sapiens
HNCGHSEEA

SEQ ID NO: 564008 - protein, 9 aa, Homo Sapiens
DTLIYTCAS

SEQ ID NO: 564009 - protein, 9 aa, Homo Sapiens
SRKKLPVVD

SEQ ID NO: 564010 - protein, 9 aa, Homo Sapiens
KEAEKRQRA

SEQ ID NO: 564011 - protein, 9 aa, Homo Sapiens
ITIQASNCT

SEQ ID NO: 564012 - protein, 9 aa, Homo Sapiens
PTNFSEGNN

SEQ ID NO: 564013 - protein, 9 aa, Homo Sapiens
RNDLNQSCL

SEQ ID NO: 564014 - protein, 9 aa, Homo Sapiens
VDDDDKVYY

SEQ ID NO: 564015 - protein, 9 aa, Homo Sapiens
FLAEGVNKL

SEQ ID NO: 564016 - protein, 9 aa, Homo Sapiens
SLRMAPAYP

SEQ ID NO: 564017 - protein, 9 aa, Homo Sapiens
RFQSVKSIS

SEQ ID NO: 564018 - protein, 9 aa, Homo Sapiens
VYEQVGTNA

SEQ ID NO: 564019 - protein, 9 aa, Homo Sapiens
PVVDENDTC

SEQ ID NO: 564020 - protein, 9 aa, Homo Sapiens
DIFRRAKET

SEQ ID NO: 564021 - protein, 9 aa, Homo Sapiens
SEWLGLRDG

SEQ ID NO: 564022 - protein, 9 aa, Homo Sapiens
HSSNPLSLL

SEQ ID NO: 564023 - protein, 9 aa, Homo Sapiens
ILLDKRIKH

SEQ ID NO: 564024 - protein, 9 aa, Homo Sapiens
SYHPGVFCG

SEQ ID NO: 564025 - protein, 9 aa, Homo Sapiens
AENTRHNGS

SEQ ID NO: 564026 - protein, 9 aa, Homo Sapiens
QKDAERTIN

SEQ ID NO: 564027 - protein, 9 aa, Homo Sapiens
QKWHLEEKQ

SEQ ID NO: 564028 - protein, 9 aa, Homo Sapiens
IIYFFLESS

SEQ ID NO: 564029 - protein, 9 aa, Homo Sapiens
KDAERTINS

SEQ ID NO: 564030 - protein, 9 aa, Homo Sapiens
SAASTSGND

SEQ ID NO: 564031 - protein, 9 aa, Homo Sapiens
ERTINSMFL

SEQ ID NO: 564032 - protein, 9 aa, Homo Sapiens
ALTELEMNQ

SEQ ID NO: 564033 - protein, 9 aa, Homo Sapiens
FGTIDPTSG

SEQ ID NO: 564034 - protein, 9 aa, Homo Sapiens
DSLKTPPLA

SEQ ID NO: 564035 - protein, 9 aa, Homo Sapiens
LLEHPRAEV

SEQ ID NO: 564036 - protein, 9 aa, Homo Sapiens
SLSNLVSGT

SEQ ID NO: 564037 - protein, 9 aa, Homo Sapiens
FEGPILLDK

SEQ ID NO: 564038 - protein, 9 aa, Homo Sapiens
VSHSEKYTH

SEQ ID NO: 564039 - protein, 9 aa, Homo Sapiens
VCFMPQLRV

SEQ ID NO: 564040 - protein, 9 aa, Homo Sapiens
SEKYTHRYL

SEQ ID NO: 564041 - protein, 9 aa, Homo Sapiens
SLKVWNKDS

SEQ ID NO: 564042 - protein, 9 aa, Homo Sapiens
AEKSGEAAD

SEQ ID NO: 564043 - protein, 9 aa, Homo Sapiens
MSASRKKLP

SEQ ID NO: 564044 - protein, 9 aa, Homo Sapiens
NLVSGTESI

SEQ ID NO: 564045 - protein, 9 aa, Homo Sapiens
APGPALLLC

SEQ ID NO: 564046 - protein, 9 aa, Homo Sapiens
VFCGDKWSC

SEQ ID NO: 564047 - protein, 9 aa, Homo Sapiens
ELEMNQPQH

SEQ ID NO: 564048 - protein, 9 aa, Homo Sapiens
VSGTESIKG

SEQ ID NO: 564049 - protein, 9 aa, Homo Sapiens
LVALLEHPR

SEQ ID NO: 564050 - protein, 9 aa, Homo Sapiens
LALQQTVEA

SEQ ID NO: 564051 - protein, 9 aa, Homo Sapiens
EAEKSGEAA

SEQ ID NO: 564052 - protein, 9 aa, Homo Sapiens
AERTINSMF

SEQ ID NO: 564053 - protein, 9 aa, Homo Sapiens
IDAATEQKW

SEQ ID NO: 564054 - protein, 9 aa, Homo Sapiens
NLCFREKKF

SEQ ID NO: 564055 - protein, 9 aa, Homo Sapiens
RKKLPVVDE

SEQ ID NO: 564056 - protein, 9 aa, Homo Sapiens
FPPSGGSGH

SEQ ID NO: 564057 - protein, 9 aa, Homo Sapiens
AEGVNKLKI

SEQ ID NO: 564058 - protein, 9 aa, Homo Sapiens
IEDVTPIPF

SEQ ID NO: 564059 - protein, 9 aa, Homo Sapiens
DECGKDCRL

SEQ ID NO: 564060 - protein, 9 aa, Homo Sapiens
LHVHRADVA

SEQ ID NO: 564061 - protein, 9 aa, Homo Sapiens
DTLVRKGRF

SEQ ID NO: 564062 - protein, 9 aa, Homo Sapiens
GVSEWLGLR

SEQ ID NO: 564063 - protein, 9 aa, Homo Sapiens
VSSGNPVYE

SEQ ID NO: 564064 - protein, 9 aa, Homo Sapiens
HTSACLCEY

SEQ ID NO: 564065 - protein, 9 aa, Homo Sapiens
QDLSQVREG

SEQ ID NO: 564066 - protein, 9 aa, Homo Sapiens
SLLNFLAEG

SEQ ID NO: 564067 - protein, 9 aa, Homo Sapiens
SNLVSGTES

SEQ ID NO: 564068 - protein, 9 aa, Homo Sapiens
TRPVVPIIH

SEQ ID NO: 564069 - protein, 9 aa, Homo Sapiens
SLSTSRFQS

SEQ ID NO: 564070 - protein, 9 aa, Homo Sapiens
QQMEKSPID

SEQ ID NO: 564071 - protein, 9 aa, Homo Sapiens
FDSTLRKGV

SEQ ID NO: 564072 - protein, 9 aa, Homo Sapiens
PSCDRLIDP

SEQ ID NO: 564073 - protein, 9 aa, Homo Sapiens
LRVLAQVLP

SEQ ID NO: 564074 - protein, 9 aa, Homo Sapiens
QYQKAIDVY

SEQ ID NO: 564075 - protein, 9 aa, Homo Sapiens
IQASNCTEL

SEQ ID NO: 564076 - protein, 9 aa, Homo Sapiens
EEAGVICSA

SEQ ID NO: 564077 - protein, 9 aa, Homo Sapiens
YQKAIDVYE

SEQ ID NO: 564078 - protein, 9 aa, Homo Sapiens
EAFLVNCDL

SEQ ID NO: 564079 - protein, 9 aa, Homo Sapiens
ETQIYKKHT

SEQ ID NO: 564080 - protein, 9 aa, Homo Sapiens
VFTASKLVR

SEQ ID NO: 564081 - protein, 9 aa, Homo Sapiens
EYQWMRKPS

SEQ ID NO: 564082 - protein, 9 aa, Homo Sapiens
DPQLPVFGR

SEQ ID NO: 564083 - protein, 9 aa, Homo Sapiens
ELLSTKKRE

SEQ ID NO: 564084 - protein, 9 aa, Homo Sapiens
NTRHNGSND

SEQ ID NO: 564085 - protein, 9 aa, Homo Sapiens
GGSGHEKDQ

SEQ ID NO: 564086 - protein, 9 aa, Homo Sapiens
QKEKDSLLA

SEQ ID NO: 564087 - protein, 9 aa, Homo Sapiens
CASEFDFME

SEQ ID NO: 564088 - protein, 9 aa, Homo Sapiens
QNRPLSGPR

SEQ ID NO: 564089 - protein, 9 aa, Homo Sapiens
VFPPSGGSG

SEQ ID NO: 564090 - protein, 9 aa, Homo Sapiens
MFYLSLITR

SEQ ID NO: 564091 - protein, 9 aa, Homo Sapiens
DSLLADIKR

SEQ ID NO: 564092 - protein, 9 aa, Homo Sapiens
RKGRFAEVY

SEQ ID NO: 564093 - protein, 9 aa, Homo Sapiens
ADVARLVLS

SEQ ID NO: 564094 - protein, 9 aa, Homo Sapiens
IELDTLVRK

SEQ ID NO: 564095 - protein, 9 aa, Homo Sapiens
TENLQPHIS

SEQ ID NO: 564096 - protein, 9 aa, Homo Sapiens
LENLCFREK

SEQ ID NO: 564097 - protein, 9 aa, Homo Sapiens
EFFSLSNLV

SEQ ID NO: 564098 - protein, 9 aa, Homo Sapiens
EWLGLRDGC

SEQ ID NO: 564099 - protein, 9 aa, Homo Sapiens
EQKWHLEEK

SEQ ID NO: 564100 - protein, 9 aa, Homo Sapiens
CGHSEEAGV

SEQ ID NO: 564101 - protein, 9 aa, Homo Sapiens
NQSCLIMTM

SEQ ID NO: 564102 - protein, 9 aa, Homo Sapiens
ELQIQAAVT

SEQ ID NO: 564103 - protein, 9 aa, Homo Sapiens
GLRCQPVVT

SEQ ID NO: 564104 - protein, 9 aa, Homo Sapiens
KYSFIYKTH

SEQ ID NO: 564105 - protein, 9 aa, Homo Sapiens
EELRTLSLS

SEQ ID NO: 564106 - protein, 9 aa, Homo Sapiens
SLKTPPLAT

SEQ ID NO: 564107 - protein, 9 aa, Homo Sapiens
HLANHEELI

SEQ ID NO: 564108 - protein, 9 aa, Homo Sapiens
LPNLTHLTS

SEQ ID NO: 564109 - protein, 9 aa, Homo Sapiens
SKKSLKVWN

SEQ ID NO: 564110 - protein, 9 aa, Homo Sapiens
HPGVFCGDK

SEQ ID NO: 564111 - protein, 9 aa, Homo Sapiens
KPRYTIFMA

SEQ ID NO: 564112 - protein, 9 aa, Homo Sapiens
QYKQAKETS

SEQ ID NO: 564113 - protein, 9 aa, Homo Sapiens
QFTENLQPH

SEQ ID NO: 564114 - protein, 9 aa, Homo Sapiens
VGIAQSRRT

SEQ ID NO: 564115 - protein, 9 aa, Homo Sapiens
STSALTELE

SEQ ID NO: 564116 - protein, 9 aa, Homo Sapiens
ELDTLVRKG

SEQ ID NO: 564117 - protein, 9 aa, Homo Sapiens
QNRNDLNQS

SEQ ID NO: 564118 - protein, 9 aa, Homo Sapiens
STSGNDSKA

SEQ ID NO: 564119 - protein, 9 aa, Homo Sapiens
DTHPLASLR

SEQ ID NO: 564120 - protein, 9 aa, Homo Sapiens
LDEMSNLKN

SEQ ID NO: 564121 - protein, 9 aa, Homo Sapiens
CFPNVFTAS

SEQ ID NO: 564122 - protein, 9 aa, Homo Sapiens
CDECGKDCR

SEQ ID NO: 564123 - protein, 9 aa, Homo Sapiens
AVTAGDVHT

SEQ ID NO: 564124 - protein, 9 aa, Homo Sapiens
ADVENFINS

SEQ ID NO: 564125 - protein, 9 aa, Homo Sapiens
SRFQSVKSI

SEQ ID NO: 564126 - protein, 9 aa, Homo Sapiens
PGVFCGDKW

SEQ ID NO: 564127 - protein, 9 aa, Homo Sapiens
HNGSNDSDR

SEQ ID NO: 564128 - protein, 9 aa, Homo Sapiens
RPLSGPRSA

SEQ ID NO: 564129 - protein, 9 aa, Homo Sapiens
IYFFLESST

SEQ ID NO: 564130 - protein, 9 aa, Homo Sapiens
RYTIFMAPQ

SEQ ID NO: 564131 - protein, 9 aa, Homo Sapiens
EKTKLQDLT

SEQ ID NO: 564132 - protein, 9 aa, Homo Sapiens
LCFREKKFA

SEQ ID NO: 564133 - protein, 9 aa, Homo Sapiens
KTTKPRYTI

SEQ ID NO: 564134 - protein, 9 aa, Homo Sapiens
FLVNCDLTL

SEQ ID NO: 564135 - protein, 9 aa, Homo Sapiens
QLIHGLDCA

SEQ ID NO: 564136 - protein, 9 aa, Homo Sapiens
RDSWVFGTI

SEQ ID NO: 564137 - protein, 9 aa, Homo Sapiens
RRKYSFIYK

SEQ ID NO: 564138 - protein, 9 aa, Homo Sapiens
FMPQLRVLA

SEQ ID NO: 564139 - protein, 9 aa, Homo Sapiens
NRPLSGPRS

SEQ ID NO: 564140 - protein, 9 aa, Homo Sapiens
SNCTELDMT

SEQ ID NO: 564141 - protein, 9 aa, Homo Sapiens
KHLAMLGAG

SEQ ID NO: 564142 - protein, 9 aa, Homo Sapiens
RSAVNSSHS

SEQ ID NO: 564143 - protein, 9 aa, Homo Sapiens
AKETKGGVP

SEQ ID NO: 564144 - protein, 9 aa, Homo Sapiens
PAVLGLTGL

SEQ ID NO: 564145 - protein, 9 aa, Homo Sapiens
KQYKQAKET

SEQ ID NO: 564146 - protein, 9 aa, Homo Sapiens
LIFNAYNSI

SEQ ID NO: 564147 - protein, 9 aa, Homo Sapiens
ASEFDFMEK

SEQ ID NO: 564148 - protein, 9 aa, Homo Sapiens
LKKLAEETQ

SEQ ID NO: 564149 - protein, 9 aa, Homo Sapiens
RVKERQENG

SEQ ID NO: 564150 - protein, 9 aa, Homo Sapiens
VFGTIDPTS

SEQ ID NO: 564151 - protein, 9 aa, Homo Sapiens
KHTLQNRND

SEQ ID NO: 564152 - protein, 9 aa, Homo Sapiens
IHGLDCALV

SEQ ID NO: 564153 - protein, 9 aa, Homo Sapiens
KEEASMKKV

SEQ ID NO: 564154 - protein, 9 aa, Homo Sapiens
EFKTPTNFS

SEQ ID NO: 564155 - protein, 9 aa, Homo Sapiens
LPIQSERHQ

SEQ ID NO: 564156 - protein, 9 aa, Homo Sapiens
GPALLLCCP

SEQ ID NO: 564157 - protein, 9 aa, Homo Sapiens
DEMSNLKNS

SEQ ID NO: 564158 - protein, 9 aa, Homo Sapiens
IKQQMEKSP

SEQ ID NO: 564159 - protein, 9 aa, Homo Sapiens
RHGGHRFIY

SEQ ID NO: 564160 - protein, 9 aa, Homo Sapiens
SAPSVNATE

SEQ ID NO: 564161 - protein, 9 aa, Homo Sapiens
KQLIHGLDC

SEQ ID NO: 564162 - protein, 9 aa, Homo Sapiens
HISLGSRIP

SEQ ID NO: 564163 - protein, 9 aa, Homo Sapiens
WVFQLLYIV

SEQ ID NO: 564164 - protein, 9 aa, Homo Sapiens
YKCDECGKD

SEQ ID NO: 564165 - protein, 9 aa, Homo Sapiens
LGLRDGCMH

SEQ ID NO: 564166 - protein, 9 aa, Homo Sapiens
AQVLPDHLY

SEQ ID NO: 564167 - protein, 9 aa, Homo Sapiens
NKTTKPRYT

SEQ ID NO: 564168 - protein, 9 aa, Homo Sapiens
EKYTHRYLS

SEQ ID NO: 564169 - protein, 9 aa, Homo Sapiens
PIPFDSTLR

SEQ ID NO: 564170 - protein, 9 aa, Homo Sapiens
QVLGQRLPI

SEQ ID NO: 564171 - protein, 9 aa, Homo Sapiens
AQLSLTQVS

SEQ ID NO: 564172 - protein, 9 aa, Homo Sapiens
KETKGGVPE

SEQ ID NO: 564173 - protein, 9 aa, Homo Sapiens
LPISKINFI

SEQ ID NO: 564174 - protein, 9 aa, Homo Sapiens
KRSSKEEAS

SEQ ID NO: 564175 - protein, 9 aa, Homo Sapiens
GVGIAQSRR

SEQ ID NO: 564176 - protein, 9 aa, Homo Sapiens
DHLYPLHLQ

SEQ ID NO: 564177 - protein, 9 aa, Homo Sapiens
EDVTPIPFD

SEQ ID NO: 564178 - protein, 9 aa, Homo Sapiens
RPVVPIIHQ

SEQ ID NO: 564179 - protein, 9 aa, Homo Sapiens
LFALGQFTE

SEQ ID NO: 564180 - protein, 9 aa, Homo Sapiens
QILHWIFAC

SEQ ID NO: 564181 - protein, 9 aa, Homo Sapiens
MEKSPIDAI

SEQ ID NO: 564182 - protein, 9 aa, Homo Sapiens
HVCFMPQLR

SEQ ID NO: 564183 - protein, 9 aa, Homo Sapiens
KSLKVWNKD

SEQ ID NO: 564184 - protein, 9 aa, Homo Sapiens
SLADVENFI

SEQ ID NO: 564185 - protein, 9 aa, Homo Sapiens
HRVPYHISL

SEQ ID NO: 564186 - protein, 9 aa, Homo Sapiens
PSVDDSLKT

SEQ ID NO: 564187 - protein, 9 aa, Homo Sapiens
YSIVQTTCS

SEQ ID NO: 564188 - protein, 9 aa, Homo Sapiens
PMNQRERGL

SEQ ID NO: 564189 - protein, 9 aa, Homo Sapiens
QVSSGNPVY

SEQ ID NO: 564190 - protein, 9 aa, Homo Sapiens
HPLASLRLL

SEQ ID NO: 564191 - protein, 9 aa, Homo Sapiens
TYRGAVYVY

SEQ ID NO: 564192 - protein, 9 aa, Homo Sapiens
GEPSCDRLI

SEQ ID NO: 564193 - protein, 9 aa, Homo Sapiens
FFLESSTGH

SEQ ID NO: 564194 - protein, 9 aa, Homo Sapiens
ANHEELISK

SEQ ID NO: 564195 - protein, 9 aa, Homo Sapiens
VQTTCSKEN

SEQ ID NO: 564196 - protein, 9 aa, Homo Sapiens
PVVPIIHQI

SEQ ID NO: 564197 - protein, 9 aa, Homo Sapiens
EFRHSSNPL

SEQ ID NO: 564198 - protein, 9 aa, Homo Sapiens
SSSQGLPTN

SEQ ID NO: 564199 - protein, 9 aa, Homo Sapiens
VVPIIHQIL

SEQ ID NO: 564200 - protein, 9 aa, Homo Sapiens
VPYHISLGS

SEQ ID NO: 564201 - protein, 9 aa, Homo Sapiens
TEGEGPAAV

SEQ ID NO: 564202 - protein, 9 aa, Homo Sapiens
RLCQHTCES

SEQ ID NO: 564203 - protein, 9 aa, Homo Sapiens
PIHTSACLC

SEQ ID NO: 564204 - protein, 9 aa, Homo Sapiens
SVRISCRLT

SEQ ID NO: 564205 - protein, 9 aa, Homo Sapiens
IQGNKLTFT

SEQ ID NO: 564206 - protein, 9 aa, Homo Sapiens
EEQVLGQRL

SEQ ID NO: 564207 - protein, 9 aa, Homo Sapiens
DAATEQKWH

SEQ ID NO: 564208 - protein, 9 aa, Homo Sapiens
LSDPQLPVF

SEQ ID NO: 564209 - protein, 9 aa, Homo Sapiens
LTHLTSLED

SEQ ID NO: 564210 - protein, 9 aa, Homo Sapiens
CDRLIDPHR

SEQ ID NO: 564211 - protein, 9 aa, Homo Sapiens
TSLEDELQE

SEQ ID NO: 564212 - protein, 9 aa, Homo Sapiens
TEEQVLGQR

SEQ ID NO: 564213 - protein, 9 aa, Homo Sapiens
LNQSCLIMT

SEQ ID NO: 564214 - protein, 9 aa, Homo Sapiens
QWKQLENLC

SEQ ID NO: 564215 - protein, 9 aa, Homo Sapiens
VISFVRLGH

SEQ ID NO: 564216 - protein, 9 aa, Homo Sapiens
QIQAAVTAG

SEQ ID NO: 564217 - protein, 9 aa, Homo Sapiens
LSNLVSGTE

SEQ ID NO: 564218 - protein, 9 aa, Homo Sapiens
ISKINFIKN

SEQ ID NO: 564219 - protein, 9 aa, Homo Sapiens
YKQAKETSN

SEQ ID NO: 564220 - protein, 9 aa, Homo Sapiens
KRRKYSFIY

SEQ ID NO: 564221 - protein, 9 aa, Homo Sapiens
HGGHRFIYL

SEQ ID NO: 564222 - protein, 9 aa, Homo Sapiens
FYLSLITRD

SEQ ID NO: 564223 - protein, 9 aa, Homo Sapiens
VNSSHSKSN

SEQ ID NO: 564224 - protein, 9 aa, Homo Sapiens
CEYQWMRKP

SEQ ID NO: 564225 - protein, 9 aa, Homo Sapiens
EGPILLDKR

SEQ ID NO: 564226 - protein, 9 aa, Homo Sapiens
NIIQLIFNA

SEQ ID NO: 564227 - protein, 9 aa, Homo Sapiens
SEEAGVICS

SEQ ID NO: 564228 - protein, 9 aa, Homo Sapiens
TCESTLGSY

SEQ ID NO: 564229 - protein, 9 aa, Homo Sapiens
HRADVARLV

SEQ ID NO: 564230 - protein, 9 aa, Homo Sapiens
TKKREKKKK

SEQ ID NO: 564231 - protein, 9 aa, Homo Sapiens
WVFGTIDPT

SEQ ID NO: 564232 - protein, 9 aa, Homo Sapiens
SPARPAVLG

SEQ ID NO: 564233 - protein, 9 aa, Homo Sapiens
RVLAQVLPD

SEQ ID NO: 564234 - protein, 9 aa, Homo Sapiens
QLPVFGRVH

SEQ ID NO: 564235 - protein, 9 aa, Homo Sapiens
LYPLHLQPL

SEQ ID NO: 564236 - protein, 9 aa, Homo Sapiens
LGHCSFSKS

SEQ ID NO: 564237 - protein, 9 aa, Homo Sapiens
QKDVKHLAM

SEQ ID NO: 564238 - protein, 9 aa, Homo Sapiens
GLQNSLADV

SEQ ID NO: 564239 - protein, 9 aa, Homo Sapiens
QTTCSKENF

SEQ ID NO: 564240 - protein, 9 aa, Homo Sapiens
SFVRLGHCS

SEQ ID NO: 564241 - protein, 9 aa, Homo Sapiens
NAWVFQLLY

SEQ ID NO: 564242 - protein, 9 aa, Homo Sapiens
LSPQQASPR

SEQ ID NO: 564243 - protein, 9 aa, Homo Sapiens
HTLQNRNDL

SEQ ID NO: 564244 - protein, 9 aa, Homo Sapiens
FALGQFTEN

SEQ ID NO: 564245 - protein, 9 aa, Homo Sapiens
MKRRKYSFI

SEQ ID NO: 564246 - protein, 9 aa, Homo Sapiens
AWVFQLLYI

SEQ ID NO: 564247 - protein, 9 aa, Homo Sapiens
VLQENLRMF

SEQ ID NO: 564248 - protein, 9 aa, Homo Sapiens
PNLTHLTSL

SEQ ID NO: 564249 - protein, 9 aa, Homo Sapiens
EQLTYRGAV

SEQ ID NO: 564250 - protein, 9 aa, Homo Sapiens
QIYKKHTLQ

SEQ ID NO: 564251 - protein, 9 aa, Homo Sapiens
AEKRQRAEE

SEQ ID NO: 564252 - protein, 9 aa, Homo Sapiens
TSRVKERQE

SEQ ID NO: 564253 - protein, 9 aa, Homo Sapiens
RRAKETKGG

SEQ ID NO: 564254 - protein, 9 aa, Homo Sapiens
VTNAWVFQL

SEQ ID NO: 564255 - protein, 9 aa, Homo Sapiens
SFIYKTHLF

SEQ ID NO: 564256 - protein, 9 aa, Homo Sapiens
STTPPPPTR

SEQ ID NO: 564257 - protein, 9 aa, Homo Sapiens
VRISCRLTG

SEQ ID NO: 564258 - protein, 9 aa, Homo Sapiens
TTRPVVPII

SEQ ID NO: 564259 - protein, 9 aa, Homo Sapiens
KVWNKDSIA

SEQ ID NO: 564260 - protein, 9 aa, Homo Sapiens
NLKNSLPIS

SEQ ID NO: 564261 - protein, 9 aa, Homo Sapiens
NSLSKKSLK

SEQ ID NO: 564262 - protein, 9 aa, Homo Sapiens
TQIYKKHTL

SEQ ID NO: 564263 - protein, 9 aa, Homo Sapiens
PYIIYFFLE

SEQ ID NO: 564264 - protein, 9 aa, Homo Sapiens
KKLAEETQI

SEQ ID NO: 564265 - protein, 9 aa, Homo Sapiens
LLSTKKREK

SEQ ID NO: 564266 - protein, 9 aa, Homo Sapiens
IPFDSTLRK

SEQ ID NO: 564267 - protein, 9 aa, Homo Sapiens
HCSFSKSRI

SEQ ID NO: 564268 - protein, 9 aa, Homo Sapiens
RKYSFIYKT

SEQ ID NO: 564269 - protein, 9 aa, Homo Sapiens
EGPAAVSHS

SEQ ID NO: 564270 - protein, 9 aa, Homo Sapiens
HQILHWIFA

SEQ ID NO: 564271 - protein, 9 aa, Homo Sapiens
ETKGGVPEE

SEQ ID NO: 564272 - protein, 9 aa, Homo Sapiens
AMLGAGLMG

SEQ ID NO: 564273 - protein, 9 aa, Homo Sapiens
LSSTTPPPP

SEQ ID NO: 564274 - protein, 9 aa, Homo Sapiens
HSEEAGVIC

SEQ ID NO: 564275 - protein, 9 aa, Homo Sapiens
TCTSLGSSS

SEQ ID NO: 564276 - protein, 9 aa, Homo Sapiens
MPQLRVLAQ

SEQ ID NO: 564277 - protein, 9 aa, Homo Sapiens
CTSLGSSSQ

SEQ ID NO: 564278 - protein, 9 aa, Homo Sapiens
GNKLTFTGA

SEQ ID NO: 564279 - protein, 9 aa, Homo Sapiens
KQLENLCFR

SEQ ID NO: 564280 - protein, 9 aa, Homo Sapiens
ALGQFTENL

SEQ ID NO: 564281 - protein, 9 aa, Homo Sapiens
ENTRHNGSN

SEQ ID NO: 564282 - protein, 9 aa, Homo Sapiens
ATEQKWHLE

SEQ ID NO: 564283 - protein, 9 aa, Homo Sapiens
DELLSTKKR

SEQ ID NO: 564284 - protein, 9 aa, Homo Sapiens
GLRDGCMHC

SEQ ID NO: 564285 - protein, 9 aa, Homo Sapiens
CFREKKFAV

SEQ ID NO: 564286 - protein, 9 aa, Homo Sapiens
HVHRADVAR

SEQ ID NO: 564287 - protein, 9 aa, Homo Sapiens
SGNDSKAET

SEQ ID NO: 564288 - protein, 9 aa, Homo Sapiens
ADGARPQAL

SEQ ID NO: 564289 - protein, 9 aa, Homo Sapiens
DLTRKLKER

SEQ ID NO: 564290 - protein, 9 aa, Homo Sapiens
GQRLPIQSE

SEQ ID NO: 564291 - protein, 9 aa, Homo Sapiens
AAVSHSEKY

SEQ ID NO: 564292 - protein, 9 aa, Homo Sapiens
DRMDELGVG

SEQ ID NO: 564293 - protein, 9 aa, Homo Sapiens
FSEGNNWEI

SEQ ID NO: 564294 - protein, 9 aa, Homo Sapiens
PSAASTSGN

SEQ ID NO: 564295 - protein, 9 aa, Homo Sapiens
LDCALVEHV

SEQ ID NO: 564296 - protein, 9 aa, Homo Sapiens
QIQGNKLTF

SEQ ID NO: 564297 - protein, 9 aa, Homo Sapiens
MAPAYPPRS

SEQ ID NO: 564298 - protein, 9 aa, Homo Sapiens
LSKKSLKVW

SEQ ID NO: 564299 - protein, 9 aa, Homo Sapiens
QLLNEELRT

SEQ ID NO: 564300 - protein, 9 aa, Homo Sapiens
WLGLRDGCM

SEQ ID NO: 564301 - protein, 9 aa, Homo Sapiens
VSEWLGLRD

SEQ ID NO: 564302 - protein, 9 aa, Homo Sapiens
EKCYKCDEC

SEQ ID NO: 564303 - protein, 9 aa, Homo Sapiens
ELRTLSLSV

SEQ ID NO: 564304 - protein, 9 aa, Homo Sapiens
RLPIQSERH

SEQ ID NO: 564305 - protein, 9 aa, Homo Sapiens
DVKHLAMLG

SEQ ID NO: 564306 - protein, 9 aa, Homo Sapiens
RDSISAPSV

SEQ ID NO: 564307 - protein, 9 aa, Homo Sapiens
FRRAKETKG

SEQ ID NO: 564308 - protein, 9 aa, Homo Sapiens
SLITRDSIS

SEQ ID NO: 564309 - protein, 9 aa, Homo Sapiens
NLRMFYLSL

SEQ ID NO: 564310 - protein, 9 aa, Homo Sapiens
TKGGVPEEA

SEQ ID NO: 564311 - protein, 9 aa, Homo Sapiens
HFSKQLIHG

SEQ ID NO: 564312 - protein, 9 aa, Homo Sapiens
STKKREKKK

SEQ ID NO: 564313 - protein, 9 aa, Homo Sapiens
LSLITRDSI

SEQ ID NO: 564314 - protein, 9 aa, Homo Sapiens
ISAPSVNAT

SEQ ID NO: 564315 - protein, 9 aa, Homo Sapiens
KDVKHLAML

SEQ ID NO: 564316 - protein, 9 aa, Homo Sapiens
IRSAVNSSH

SEQ ID NO: 564317 - protein, 9 aa, Homo Sapiens
ASPRTGGSG

SEQ ID NO: 564318 - protein, 9 aa, Homo Sapiens
LKNSLPISK

SEQ ID NO: 564319 - protein, 9 aa, Homo Sapiens
LTFTGAQVR

SEQ ID NO: 564320 - protein, 9 aa, Homo Sapiens
KKLPVVDEN

SEQ ID NO: 564321 - protein, 9 aa, Homo Sapiens
LPVVDENDT

SEQ ID NO: 564322 - protein, 9 aa, Homo Sapiens
EREFKTPTN

SEQ ID NO: 564323 - protein, 9 aa, Homo Sapiens
PLLVALLEH

SEQ ID NO: 564324 - protein, 9 aa, Homo Sapiens
SCDRLIDPH

SEQ ID NO: 564325 - protein, 9 aa, Homo Sapiens
TSLGSSSQG

SEQ ID NO: 564326 - protein, 9 aa, Homo Sapiens
IIHQILHWI

SEQ ID NO: 564327 - protein, 9 aa, Homo Sapiens
GTIDPTSGV

SEQ ID NO: 564328 - protein, 9 aa, Homo Sapiens
DLSQVREGL

SEQ ID NO: 564329 - protein, 9 aa, Homo Sapiens
ITYSIVQTT

SEQ ID NO: 564330 - protein, 9 aa, Homo Sapiens
PSGGSGHEK

SEQ ID NO: 564331 - protein, 9 aa, Homo Sapiens
PARPAVLGL

SEQ ID NO: 564332 - protein, 9 aa, Homo Sapiens
RLSPQQASP

SEQ ID NO: 564333 - protein, 9 aa, Homo Sapiens
VGSEQLTYR

SEQ ID NO: 564334 - protein, 9 aa, Homo Sapiens
ELALQQTVE

SEQ ID NO: 564335 - protein, 9 aa, Homo Sapiens
IIQLIFNAY

SEQ ID NO: 564336 - protein, 9 aa, Homo Sapiens
MQDLSQVRE

SEQ ID NO: 564337 - protein, 9 aa, Homo Sapiens
TASKLVRVV

SEQ ID NO: 564338 - protein, 9 aa, Homo Sapiens
CRAHLANHE

SEQ ID NO: 564339 - protein, 9 aa, Homo Sapiens
VRLGHCSFS

SEQ ID NO: 564340 - protein, 9 aa, Homo Sapiens
FQLLYIVPE

SEQ ID NO: 564341 - protein, 9 aa, Homo Sapiens
KDSLSTSRF

SEQ ID NO: 564342 - protein, 9 aa, Homo Sapiens
SSKEEASMK

SEQ ID NO: 564343 - protein, 9 aa, Homo Sapiens
SNLKNSLPI

SEQ ID NO: 564344 - protein, 9 aa, Homo Sapiens
TPTNFSEGN

SEQ ID NO: 564345 - protein, 9 aa, Homo Sapiens
RMAPAYPPR

SEQ ID NO: 564346 - protein, 9 aa, Homo Sapiens
FFSLSNLVS

SEQ ID NO: 564347 - protein, 9 aa, Homo Sapiens
WHLEEKQRV

SEQ ID NO: 564348 - protein, 9 aa, Homo Sapiens
SQVREGLGK

SEQ ID NO: 564349 - protein, 9 aa, Homo Sapiens
LPVFPPSGG

SEQ ID NO: 564350 - protein, 9 aa, Homo Sapiens
GSSSQGLPT

SEQ ID NO: 564351 - protein, 9 aa, Homo Sapiens
VTPIPFDST

SEQ ID NO: 564352 - protein, 9 aa, Homo Sapiens
LAQVLPDHL

SEQ ID NO: 564353 - protein, 9 aa, Homo Sapiens
LLDKRIKHL

SEQ ID NO: 564354 - protein, 9 aa, Homo Sapiens
HELALQQTV

SEQ ID NO: 564355 - protein, 9 aa, Homo Sapiens
PQLRVLAQV

SEQ ID NO: 564356 - protein, 9 aa, Homo Sapiens
VKERQENGA

SEQ ID NO: 564357 - protein, 9 aa, Homo Sapiens
HTCESTLGS

SEQ ID NO: 564358 - protein, 9 aa, Homo Sapiens
PGPALLLCC

SEQ ID NO: 564359 - protein, 9 aa, Homo Sapiens
LAEDDTHPL

SEQ ID NO: 564360 - protein, 9 aa, Homo Sapiens
LQMKRRKYS

SEQ ID NO: 564361 - protein, 9 aa, Homo Sapiens
EMSNLKNSL

SEQ ID NO: 564362 - protein, 9 aa, Homo Sapiens
CLIMTMSSI

SEQ ID NO: 564363 - protein, 9 aa, Homo Sapiens
PPSVDDSLK

SEQ ID NO: 564364 - protein, 9 aa, Homo Sapiens
CTELDMTDF

SEQ ID NO: 564365 - protein, 9 aa, Homo Sapiens
RGAVYVYFG

SEQ ID NO: 564366 - protein, 9 aa, Homo Sapiens
SKINFIKND

SEQ ID NO: 564367 - protein, 9 aa, Homo Sapiens
AYPPRSLAI

SEQ ID NO: 564368 - protein, 9 aa, Homo Sapiens
LQENLRMFY

SEQ ID NO: 564369 - protein, 9 aa, Homo Sapiens
MNGQNRPLS

SEQ ID NO: 564370 - protein, 9 aa, Homo Sapiens
QQASPRTGG

SEQ ID NO: 564371 - protein, 9 aa, Homo Sapiens
ARLSPQQAS

SEQ ID NO: 564372 - protein, 9 aa, Homo Sapiens
NSLADVENF

SEQ ID NO: 564373 - protein, 9 aa, Homo Sapiens
QVLPDHLYP

SEQ ID NO: 564374 - protein, 9 aa, Homo Sapiens
TCASEFDFM

SEQ ID NO: 564375 - protein, 9 aa, Homo Sapiens
KTPTNFSEG

SEQ ID NO: 564376 - protein, 9 aa, Homo Sapiens
GHSEEAGVI

SEQ ID NO: 564377 - protein, 9 aa, Homo Sapiens
SEFDFMEKA

SEQ ID NO: 564378 - protein, 9 aa, Homo Sapiens
WIFACLGLH

SEQ ID NO: 564379 - protein, 9 aa, Homo Sapiens
EGEGPAAVS

SEQ ID NO: 564380 - protein, 9 aa, Homo Sapiens
FSKQLIHGL

SEQ ID NO: 564381 - protein, 9 aa, Homo Sapiens
TKLQDLTRK

SEQ ID NO: 564382 - protein, 9 aa, Homo Sapiens
SGEAADGAR

SEQ ID NO: 564383 - protein, 9 aa, Homo Sapiens
GEGPAAVSH

SEQ ID NO: 564384 - protein, 9 aa, Homo Sapiens
LCSLLNFLA

SEQ ID NO: 564385 - protein, 9 aa, Homo Sapiens
PILLDKRIK

SEQ ID NO: 564386 - protein, 9 aa, Homo Sapiens
APSVNATEG

SEQ ID NO: 564387 - protein, 9 aa, Homo Sapiens
NGQNRPLSG

SEQ ID NO: 564388 - protein, 9 aa, Homo Sapiens
REKEAEKRQ

SEQ ID NO: 564389 - protein, 9 aa, Homo Sapiens
GNDSKAETV

SEQ ID NO: 564390 - protein, 9 aa, Homo Sapiens
LKQYKQAKE

SEQ ID NO: 564391 - protein, 9 aa, Homo Sapiens
QRLPIQSER

SEQ ID NO: 564392 - protein, 9 aa, Homo Sapiens
AASTSGNDS

SEQ ID NO: 564393 - protein, 9 aa, Homo Sapiens
AAQLSLTQV

SEQ ID NO: 564394 - protein, 9 aa, Homo Sapiens
LSTKKREKK

SEQ ID NO: 564395 - protein, 9 aa, Homo Sapiens
IFRRAKETK

SEQ ID NO: 564396 - protein, 9 aa, Homo Sapiens
PRYTIFMAP

SEQ ID NO: 564397 - protein, 9 aa, Homo Sapiens
TTKPRYTIF

SEQ ID NO: 564398 - protein, 9 aa, Homo Sapiens
QQTVEAGVN

SEQ ID NO: 564399 - protein, 9 aa, Homo Sapiens
IFNAYNSIR

SEQ ID NO: 564400 - protein, 9 aa, Homo Sapiens
LVSGTESIK

SEQ ID NO: 564401 - protein, 9 aa, Homo Sapiens
LHWIFACLG

SEQ ID NO: 564402 - protein, 9 aa, Homo Sapiens
SEGNNWEIF

SEQ ID NO: 564403 - protein, 9 aa, Homo Sapiens
RFIYLQEAL

SEQ ID NO: 564404 - protein, 9 aa, Homo Sapiens
FKTPTNFSE

SEQ ID NO: 564405 - protein, 9 aa, Homo Sapiens
QGNKLTFTG

SEQ ID NO: 564406 - protein, 9 aa, Homo Sapiens
TIRSAVNSS

SEQ ID NO: 564407 - protein, 9 aa, Homo Sapiens
LLVALLEHP

SEQ ID NO: 564408 - protein, 9 aa, Homo Sapiens
IYKKHTLQN

SEQ ID NO: 564409 - protein, 9 aa, Homo Sapiens
NKLTFTGAQ

SEQ ID NO: 564410 - protein, 9 aa, Homo Sapiens
NVFTASKLV

SEQ ID NO: 564411 - protein, 9 aa, Homo Sapiens
GPILLDKRI

SEQ ID NO: 564412 - protein, 9 aa, Homo Sapiens
TRHNGSNDS

SEQ ID NO: 564413 - protein, 9 aa, Homo Sapiens
APAYPPRSL

SEQ ID NO: 564414 - protein, 9 aa, Homo Sapiens
YEHELALQQ

SEQ ID NO: 564415 - protein, 9 aa, Homo Sapiens
ELEKTKLQD

SEQ ID NO: 564416 - protein, 9 aa, Homo Sapiens
KKDSLSTSR

SEQ ID NO: 564417 - protein, 9 aa, Homo Sapiens
TSGNDSKAE

SEQ ID NO: 564418 - protein, 9 aa, Homo Sapiens
CDLTLRAQL

SEQ ID NO: 564419 - protein, 9 aa, Homo Sapiens
SCLIMTMSS

SEQ ID NO: 564420 - protein, 9 aa, Homo Sapiens
NDLNQSCLI

SEQ ID NO: 564421 - protein, 9 aa, Homo Sapiens
ILPVFPPSG

SEQ ID NO: 564422 - protein, 9 aa, Homo Sapiens
QRERGLRCQ

SEQ ID NO: 564423 - protein, 9 aa, Homo Sapiens
VLGLTGLAL

SEQ ID NO: 564424 - protein, 9 aa, Homo Sapiens
YIIYFFLES

SEQ ID NO: 564425 - protein, 9 aa, Homo Sapiens
TSALTELEM

SEQ ID NO: 564426 - protein, 9 aa, Homo Sapiens
SREKCYKCD

SEQ ID NO: 564427 - protein, 9 aa, Homo Sapiens
KLQDLTRKL

SEQ ID NO: 564428 - protein, 9 aa, Homo Sapiens
QASPRTGGS

SEQ ID NO: 564429 - protein, 9 aa, Homo Sapiens
GQNRPLSGP

SEQ ID NO: 564430 - protein, 9 aa, Homo Sapiens
STSRFQSVK

SEQ ID NO: 564431 - protein, 9 aa, Homo Sapiens
TPIPFDSTL

SEQ ID NO: 564432 - protein, 9 aa, Homo Sapiens
HSEKYTHRY

SEQ ID NO: 564433 - protein, 9 aa, Homo Sapiens
VEHVCFMPQ

SEQ ID NO: 564434 - protein, 9 aa, Homo Sapiens
MNQRERGLR

SEQ ID NO: 564435 - protein, 9 aa, Homo Sapiens
LEMNQPQHA

SEQ ID NO: 564436 - protein, 9 aa, Homo Sapiens
LGQFTENLQ

SEQ ID NO: 564437 - protein, 9 aa, Homo Sapiens
EAADGARPQ

SEQ ID NO: 564438 - protein, 9 aa, Homo Sapiens
NRNDLNQSC

SEQ ID NO: 564439 - protein, 9 aa, Homo Sapiens
SRVKERQEN

SEQ ID NO: 564440 - protein, 9 aa, Homo Sapiens
LRTLSLSVR

SEQ ID NO: 564441 - protein, 9 aa, Homo Sapiens
VNCDLTLRA

SEQ ID NO: 564442 - protein, 9 aa, Homo Sapiens
VFGRVHFSK

SEQ ID NO: 564443 - protein, 9 aa, Homo Sapiens
GEAADGARP

SEQ ID NO: 564444 - protein, 9 aa, Homo Sapiens
ILHWIFACL

SEQ ID NO: 564445 - protein, 9 aa, Homo Sapiens
VKEVTSRVK

SEQ ID NO: 564446 - protein, 9 aa, Homo Sapiens
IHQILHWIF

SEQ ID NO: 564447 - protein, 9 aa, Homo Sapiens
VHRADVARL

SEQ ID NO: 564448 - protein, 9 aa, Homo Sapiens
ESKASAVDD

SEQ ID NO: 564449 - protein, 9 aa, Homo Sapiens
EETQIYKKH

SEQ ID NO: 564450 - protein, 9 aa, Homo Sapiens
KCDECGKDC

SEQ ID NO: 564451 - protein, 9 aa, Homo Sapiens
AEETQIYKK

SEQ ID NO: 564452 - protein, 9 aa, Homo Sapiens
RMDELGVGI

SEQ ID NO: 564453 - protein, 9 aa, Homo Sapiens
TKPRYTIFM

SEQ ID NO: 564454 - protein, 9 aa, Homo Sapiens
SDPQLPVFG

SEQ ID NO: 564455 - protein, 9 aa, Homo Sapiens
EAGVICSAP

SEQ ID NO: 564456 - protein, 9 aa, Homo Sapiens
MDELGVGIA

SEQ ID NO: 564457 - protein, 9 aa, Homo Sapiens
PQQASPRTG

SEQ ID NO: 564458 - protein, 9 aa, Homo Sapiens
VREGLGKFS

SEQ ID NO: 564459 - protein, 9 aa, Homo Sapiens
NCGHSEEAG

SEQ ID NO: 564460 - protein, 9 aa, Homo Sapiens
DSISAPSVN

SEQ ID NO: 564461 - protein, 9 aa, Homo Sapiens
LRMAPAYPP

SEQ ID NO: 564462 - protein, 9 aa, Homo Sapiens
IHTSACLCE

SEQ ID NO: 564463 - protein, 9 aa, Homo Sapiens
KLAEETQIY

SEQ ID NO: 564464 - protein, 9 aa, Homo Sapiens
VENFINSLS

SEQ ID NO: 564465 - protein, 9 aa, Homo Sapiens
RLVLSDPQL

SEQ ID NO: 564466 - protein, 9 aa, Homo Sapiens
DVTPIPFDS

SEQ ID NO: 564467 - protein, 9 aa, Homo Sapiens
MGRHGGHRF

SEQ ID NO: 564468 - protein, 9 aa, Homo Sapiens
KKSLKVWNK

SEQ ID NO: 564469 - protein, 9 aa, Homo Sapiens
MSNLKNSLP

SEQ ID NO: 564470 - protein, 9 aa, Homo Sapiens
RHSSNPLSL

SEQ ID NO: 564471 - protein, 9 aa, Homo Sapiens
FGRVHFSKQ

SEQ ID NO: 564472 - protein, 9 aa, Homo Sapiens
WLPYIIYFF

SEQ ID NO: 564473 - protein, 9 aa, Homo Sapiens
IYTCASEFD

SEQ ID NO: 564474 - protein, 9 aa, Homo Sapiens
EKKRSSKEE

SEQ ID NO: 564475 - protein, 9 aa, Homo Sapiens
LADIKRLKQ

SEQ ID NO: 564476 - protein, 9 aa, Homo Sapiens
SLSVRISCR

SEQ ID NO: 564477 - protein, 9 aa, Homo Sapiens
IFACLGLHL

SEQ ID NO: 564478 - protein, 9 aa, Homo Sapiens
DVYEQVGTN

SEQ ID NO: 564479 - protein, 9 aa, Homo Sapiens
SHSKSNRAE

SEQ ID NO: 564480 - protein, 9 aa, Homo Sapiens
CLGLHLNSP

SEQ ID NO: 564481 - protein, 9 aa, Homo Sapiens
RESKASAVD

SEQ ID NO: 564482 - protein, 9 aa, Homo Sapiens
FLESSTGHS

SEQ ID NO: 564483 - protein, 9 aa, Homo Sapiens
KSPIDAITG

SEQ ID NO: 564484 - protein, 9 aa, Homo Sapiens
HWIFACLGL

SEQ ID NO: 564485 - protein, 9 aa, Homo Sapiens
SEQLTYRGA

SEQ ID NO: 564486 - protein, 9 aa, Homo Sapiens
EDRMDELGV

SEQ ID NO: 564487 - protein, 9 aa, Homo Sapiens
QDLTRKLKE

SEQ ID NO: 564488 - protein, 9 aa, Homo Sapiens
ACLGLHLNS

SEQ ID NO: 564489 - protein, 9 aa, Homo Sapiens
VRKGRFAEV

SEQ ID NO: 564490 - protein, 9 aa, Homo Sapiens
NCTELDMTD

SEQ ID NO: 564491 - protein, 9 aa, Homo Sapiens
GHCSFSKSR

SEQ ID NO: 564492 - protein, 9 aa, Homo Sapiens
GQILRRKPK

SEQ ID NO: 564493 - protein, 9 aa, Homo Sapiens
HHGSGVGAG

SEQ ID NO: 564494 - protein, 9 aa, Homo Sapiens
NLPFQRITR

SEQ ID NO: 564495 - protein, 9 aa, Homo Sapiens
CMSEQSLSR

SEQ ID NO: 564496 - protein, 9 aa, Homo Sapiens
RKTGSEEST

SEQ ID NO: 564497 - protein, 9 aa, Homo Sapiens
PHSLDIRKF

SEQ ID NO: 564498 - protein, 9 aa, Homo Sapiens
GNSLDTVPH

SEQ ID NO: 564499 - protein, 9 aa, Homo Sapiens
GEDAACITY

SEQ ID NO: 564500 - protein, 9 aa, Homo Sapiens
GRSLASFAR

SEQ ID NO: 564501 - protein, 9 aa, Homo Sapiens
INTSMIGPK

SEQ ID NO: 564502 - protein, 9 aa, Homo Sapiens
HQLHGVHSS

SEQ ID NO: 564503 - protein, 9 aa, Homo Sapiens
LTATFPYLI

SEQ ID NO: 564504 - protein, 9 aa, Homo Sapiens
VEKLKDEVV

SEQ ID NO: 564505 - protein, 9 aa, Homo Sapiens
NRFDQLCQI

SEQ ID NO: 564506 - protein, 9 aa, Homo Sapiens
PHLQRQNSN

SEQ ID NO: 564507 - protein, 9 aa, Homo Sapiens
FDFLLAWRK

SEQ ID NO: 564508 - protein, 9 aa, Homo Sapiens
GKLSTTQKC

SEQ ID NO: 564509 - protein, 9 aa, Homo Sapiens
SASTPVTAA

SEQ ID NO: 564510 - protein, 9 aa, Homo Sapiens
FIVGIDSRS

SEQ ID NO: 564511 - protein, 9 aa, Homo Sapiens
APPLPESSL

SEQ ID NO: 564512 - protein, 9 aa, Homo Sapiens
IKAGVNYNM

SEQ ID NO: 564513 - protein, 9 aa, Homo Sapiens
LNLPFQRIT

SEQ ID NO: 564514 - protein, 9 aa, Homo Sapiens
TAWTGIALL

SEQ ID NO: 564515 - protein, 9 aa, Homo Sapiens
YPTHQLHGV

SEQ ID NO: 564516 - protein, 9 aa, Homo Sapiens
IEVVYSRLP

SEQ ID NO: 564517 - protein, 9 aa, Homo Sapiens
LVLSVNRFD

SEQ ID NO: 564518 - protein, 9 aa, Homo Sapiens
ACGFHTVTT

SEQ ID NO: 564519 - protein, 9 aa, Homo Sapiens
KRGIKSKVL

SEQ ID NO: 564520 - protein, 9 aa, Homo Sapiens
CSAYTAWTG

SEQ ID NO: 564521 - protein, 9 aa, Homo Sapiens
GHGVCDCNR

SEQ ID NO: 564522 - protein, 9 aa, Homo Sapiens
LKLKACGFH

SEQ ID NO: 564523 - protein, 9 aa, Homo Sapiens
VKETVSQRP

SEQ ID NO: 564524 - protein, 9 aa, Homo Sapiens
VGAGHYTAY

SEQ ID NO: 564525 - protein, 9 aa, Homo Sapiens
AHRMHLALK

SEQ ID NO: 564526 - protein, 9 aa, Homo Sapiens
TAGGGQILR

SEQ ID NO: 564527 - protein, 9 aa, Homo Sapiens
VNVGSSLWT

SEQ ID NO: 564528 - protein, 9 aa, Homo Sapiens
KLVYGMVSY

SEQ ID NO: 564529 - protein, 9 aa, Homo Sapiens
SLFIREFIL

SEQ ID NO: 564530 - protein, 9 aa, Homo Sapiens
GLGKLSTTQ

SEQ ID NO: 564531 - protein, 9 aa, Homo Sapiens
LEPLDLLLL

SEQ ID NO: 564532 - protein, 9 aa, Homo Sapiens
NPPPHTSCA

SEQ ID NO: 564533 - protein, 9 aa, Homo Sapiens
LPGYPGRPE

SEQ ID NO: 564534 - protein, 9 aa, Homo Sapiens
RATQHPGEL

SEQ ID NO: 564535 - protein, 9 aa, Homo Sapiens
RGGDGAPRH

SEQ ID NO: 564536 - protein, 9 aa, Homo Sapiens
YTYNGIFTT

SEQ ID NO: 564537 - protein, 9 aa, Homo Sapiens
PEPKGSIGF

SEQ ID NO: 564538 - protein, 9 aa, Homo Sapiens
FYRRQSNLR

SEQ ID NO: 564539 - protein, 9 aa, Homo Sapiens
VLSVNRFDQ

SEQ ID NO: 564540 - protein, 9 aa, Homo Sapiens
RKFTLEKSL

SEQ ID NO: 564541 - protein, 9 aa, Homo Sapiens
DLTSSFSKD

SEQ ID NO: 564542 - protein, 9 aa, Homo Sapiens
SIKWYENSN

SEQ ID NO: 564543 - protein, 9 aa, Homo Sapiens
HDCSAYTAW

SEQ ID NO: 564544 - protein, 9 aa, Homo Sapiens
VAWKADGSS

SEQ ID NO: 564545 - protein, 9 aa, Homo Sapiens
HYTALADWT

SEQ ID NO: 564546 - protein, 9 aa, Homo Sapiens
ISDTHLGEI

SEQ ID NO: 564547 - protein, 9 aa, Homo Sapiens
ILEKSLMNA

SEQ ID NO: 564548 - protein, 9 aa, Homo Sapiens
ENSNLLPFN

SEQ ID NO: 564549 - protein, 9 aa, Homo Sapiens
HLTDLVLKS

SEQ ID NO: 564550 - protein, 9 aa, Homo Sapiens
NVGNSLGIA

SEQ ID NO: 564551 - protein, 9 aa, Homo Sapiens
LSLKSFLNL

SEQ ID NO: 564552 - protein, 9 aa, Homo Sapiens
HGSEERIKH

SEQ ID NO: 564553 - protein, 9 aa, Homo Sapiens
YPGRPEPKG

SEQ ID NO: 564554 - protein, 9 aa, Homo Sapiens
YTRMAAAIL

SEQ ID NO: 564555 - protein, 9 aa, Homo Sapiens
PLQDQLLPS

SEQ ID NO: 564556 - protein, 9 aa, Homo Sapiens
EERIKHFIP

SEQ ID NO: 564557 - protein, 9 aa, Homo Sapiens
TQHPGELKH

SEQ ID NO: 564558 - protein, 9 aa, Homo Sapiens
YGMVSYLND

SEQ ID NO: 564559 - protein, 9 aa, Homo Sapiens
VRGGDGAPR

SEQ ID NO: 564560 - protein, 9 aa, Homo Sapiens
AVNMLCTPK

SEQ ID NO: 564561 - protein, 9 aa, Homo Sapiens
TLVETATEA

SEQ ID NO: 564562 - protein, 9 aa, Homo Sapiens
STTQKCMSE

SEQ ID NO: 564563 - protein, 9 aa, Homo Sapiens
VYSRLPVYR

SEQ ID NO: 564564 - protein, 9 aa, Homo Sapiens
EPHYTALAD

SEQ ID NO: 564565 - protein, 9 aa, Homo Sapiens
SDTHLGEIM

SEQ ID NO: 564566 - protein, 9 aa, Homo Sapiens
FHTVTTYVP

SEQ ID NO: 564567 - protein, 9 aa, Homo Sapiens
GGDGAPRHG

SEQ ID NO: 564568 - protein, 9 aa, Homo Sapiens
GCFRFGTYL

SEQ ID NO: 564569 - protein, 9 aa, Homo Sapiens
AYTAWTGIA

SEQ ID NO: 564570 - protein, 9 aa, Homo Sapiens
LTERAMKIL

SEQ ID NO: 564571 - protein, 9 aa, Homo Sapiens
LCTPKGLSF

SEQ ID NO: 564572 - protein, 9 aa, Homo Sapiens
TSMIGPKNI

SEQ ID NO: 564573 - protein, 9 aa, Homo Sapiens
FAPLLELTC

SEQ ID NO: 564574 - protein, 9 aa, Homo Sapiens
LDTVPHSLD

SEQ ID NO: 564575 - protein, 9 aa, Homo Sapiens
TQEAPPSSH

SEQ ID NO: 564576 - protein, 9 aa, Homo Sapiens
FITFITCVN

SEQ ID NO: 564577 - protein, 9 aa, Homo Sapiens
FCPHGPRCH

SEQ ID NO: 564578 - protein, 9 aa, Homo Sapiens
IKRAANHLE

SEQ ID NO: 564579 - protein, 9 aa, Homo Sapiens
HGSGVGAGH

SEQ ID NO: 564580 - protein, 9 aa, Homo Sapiens
SRLPVYRKL

SEQ ID NO: 564581 - protein, 9 aa, Homo Sapiens
YIKRAANHL

SEQ ID NO: 564582 - protein, 9 aa, Homo Sapiens
GTVESAHLS

SEQ ID NO: 564583 - protein, 9 aa, Homo Sapiens
VSTGHAIPL

SEQ ID NO: 564584 - protein, 9 aa, Homo Sapiens
DQLLPSDGI

SEQ ID NO: 564585 - protein, 9 aa, Homo Sapiens
HSLFTREFI

SEQ ID NO: 564586 - protein, 9 aa, Homo Sapiens
PLPESSLTD

SEQ ID NO: 564587 - protein, 9 aa, Homo Sapiens
RISDTHLGE

SEQ ID NO: 564588 - protein, 9 aa, Homo Sapiens
IKSKVLPLQ

SEQ ID NO: 564589 - protein, 9 aa, Homo Sapiens
LKEDNLLNV

SEQ ID NO: 564590 - protein, 9 aa, Homo Sapiens
STRSSLELQ

SEQ ID NO: 564591 - protein, 9 aa, Homo Sapiens
TCVDIRWQW

SEQ ID NO: 564592 - protein, 9 aa, Homo Sapiens
ERIKHFIPQ

SEQ ID NO: 564593 - protein, 9 aa, Homo Sapiens
ADTVIIFDR

SEQ ID NO: 564594 - protein, 9 aa, Homo Sapiens
PEEAILNDI

SEQ ID NO: 564595 - protein, 9 aa, Homo Sapiens
NVGSSLWTL

SEQ ID NO: 564596 - protein, 9 aa, Homo Sapiens
FGTYLVAHK

SEQ ID NO: 564597 - protein, 9 aa, Homo Sapiens
ANKAIKQQI

SEQ ID NO: 564598 - protein, 9 aa, Homo Sapiens
KWYENSNLL

SEQ ID NO: 564599 - protein, 9 aa, Homo Sapiens
LLAWRKTGS

SEQ ID NO: 564600 - protein, 9 aa, Homo Sapiens
MQPHLQRQN

SEQ ID NO: 564601 - protein, 9 aa, Homo Sapiens
LRCEQPCFK

SEQ ID NO: 564602 - protein, 9 aa, Homo Sapiens
GVNYNMQVY

SEQ ID NO: 564603 - protein, 9 aa, Homo Sapiens
AACITYIRL

SEQ ID NO: 564604 - protein, 9 aa, Homo Sapiens
HGPRCHFIH

SEQ ID NO: 564605 - protein, 9 aa, Homo Sapiens
NEGLEKLHD

SEQ ID NO: 564606 - protein, 9 aa, Homo Sapiens
HLSASTPVT

SEQ ID NO: 564607 - protein, 9 aa, Homo Sapiens
TTQKCMSEQ

SEQ ID NO: 564608 - protein, 9 aa, Homo Sapiens
SLFTREFIL

SEQ ID NO: 564609 - protein, 9 aa, Homo Sapiens
FIREFILEK

SEQ ID NO: 564610 - protein, 9 aa, Homo Sapiens
QSLSRAVPA

SEQ ID NO: 564611 - protein, 9 aa, Homo Sapiens
DLRCEQPCF

SEQ ID NO: 564612 - protein, 9 aa, Homo Sapiens
LFITFITCV

SEQ ID NO: 564613 - protein, 9 aa, Homo Sapiens
WLLLCPMSH

SEQ ID NO: 564614 - protein, 9 aa, Homo Sapiens
LVAVNRTDT

SEQ ID NO: 564615 - protein, 9 aa, Homo Sapiens
TERAMKILC

SEQ ID NO: 564616 - protein, 9 aa, Homo Sapiens
SLKSFLNLP

SEQ ID NO: 564617 - protein, 9 aa, Homo Sapiens
LQRQNSNPG

SEQ ID NO: 564618 - protein, 9 aa, Homo Sapiens
RGIKSKVLP

SEQ ID NO: 564619 - protein, 9 aa, Homo Sapiens
PMAPGQEAQ

SEQ ID NO: 564620 - protein, 9 aa, Homo Sapiens
QRQNSNPGH

SEQ ID NO: 564621 - protein, 9 aa, Homo Sapiens
RPEPKGSIG

SEQ ID NO: 564622 - protein, 9 aa, Homo Sapiens
PATTGLPPA

SEQ ID NO: 564623 - protein, 9 aa, Homo Sapiens
NIEVVYSRL

SEQ ID NO: 564624 - protein, 9 aa, Homo Sapiens
ILRRKPKPD

SEQ ID NO: 564625 - protein, 9 aa, Homo Sapiens
IRKFTLEKS

SEQ ID NO: 564626 - protein, 9 aa, Homo Sapiens
VVNVGSSLW

SEQ ID NO: 564627 - protein, 9 aa, Homo Sapiens
GLNEGLEKL

SEQ ID NO: 564628 - protein, 9 aa, Homo Sapiens
LPVYRKLRL

SEQ ID NO: 564629 - protein, 9 aa, Homo Sapiens
LSTTQKCMS

SEQ ID NO: 564630 - protein, 9 aa, Homo Sapiens
ITRLENPQV

SEQ ID NO: 564631 - protein, 9 aa, Homo Sapiens
DGLNEGLEK

SEQ ID NO: 564632 - protein, 9 aa, Homo Sapiens
LLRRATQHP

SEQ ID NO: 564633 - protein, 9 aa, Homo Sapiens
YCVAAILWT

SEQ ID NO: 564634 - protein, 9 aa, Homo Sapiens
TLPHSLFIR

SEQ ID NO: 564635 - protein, 9 aa, Homo Sapiens
VPEPYTYNG

SEQ ID NO: 564636 - protein, 9 aa, Homo Sapiens
VDIRWQWML

SEQ ID NO: 564637 - protein, 9 aa, Homo Sapiens
ARWLTDVYL

SEQ ID NO: 564638 - protein, 9 aa, Homo Sapiens
EKSLMNATN

SEQ ID NO: 564639 - protein, 9 aa, Homo Sapiens
LRRKPKPDS

SEQ ID NO: 564640 - protein, 9 aa, Homo Sapiens
TYLVAHKLM

SEQ ID NO: 564641 - protein, 9 aa, Homo Sapiens
TSILTPVFA

SEQ ID NO: 564642 - protein, 9 aa, Homo Sapiens
RRATQHPGE

SEQ ID NO: 564643 - protein, 9 aa, Homo Sapiens
ATQHPGELK

SEQ ID NO: 564644 - protein, 9 aa, Homo Sapiens
PVPEPYTYN

SEQ ID NO: 564645 - protein, 9 aa, Homo Sapiens
VHLTDLVLK

SEQ ID NO: 564646 - protein, 9 aa, Homo Sapiens
CPMSHVLFR

SEQ ID NO: 564647 - protein, 9 aa, Homo Sapiens
KACGFHTVT

SEQ ID NO: 564648 - protein, 9 aa, Homo Sapiens
FLDYLCCLP

SEQ ID NO: 564649 - protein, 9 aa, Homo Sapiens
NRKPLVIIA

SEQ ID NO: 564650 - protein, 9 aa, Homo Sapiens
PESSLTDTQ

SEQ ID NO: 564651 - protein, 9 aa, Homo Sapiens
LMSVVNVGS

SEQ ID NO: 564652 - protein, 9 aa, Homo Sapiens
KLKDEVVKE

SEQ ID NO: 564653 - protein, 9 aa, Homo Sapiens
LEIANANRK

SEQ ID NO: 564654 - protein, 9 aa, Homo Sapiens
STSYRNELQ

SEQ ID NO: 564655 - protein, 9 aa, Homo Sapiens
MEMGFPRRN

SEQ ID NO: 564656 - protein, 9 aa, Homo Sapiens
PPPHTSCAN

SEQ ID NO: 564657 - protein, 9 aa, Homo Sapiens
RSSLELQMQ

SEQ ID NO: 564658 - protein, 9 aa, Homo Sapiens
FPEEAILND

SEQ ID NO: 564659 - protein, 9 aa, Homo Sapiens
ILTERAMKI

SEQ ID NO: 564660 - protein, 9 aa, Homo Sapiens
PFFYRLDLT

SEQ ID NO: 564661 - protein, 9 aa, Homo Sapiens
SHFYRRQSN

SEQ ID NO: 564662 - protein, 9 aa, Homo Sapiens
VGNSLGIAS

SEQ ID NO: 564663 - protein, 9 aa, Homo Sapiens
NVLINTSMI

SEQ ID NO: 564664 - protein, 9 aa, Homo Sapiens
LENPQVWID

SEQ ID NO: 564665 - protein, 9 aa, Homo Sapiens
NTSMIGPKN

SEQ ID NO: 564666 - protein, 9 aa, Homo Sapiens
LTSSFSKDF

SEQ ID NO: 564667 - protein, 9 aa, Homo Sapiens
PLEPLDLLL

SEQ ID NO: 564668 - protein, 9 aa, Homo Sapiens
DYLCCLPKG

SEQ ID NO: 564669 - protein, 9 aa, Homo Sapiens
WQWMLVIFC

SEQ ID NO: 564670 - protein, 9 aa, Homo Sapiens
HTSCANKLS

SEQ ID NO: 564671 - protein, 9 aa, Homo Sapiens
REFILEKSL

SEQ ID NO: 564672 - protein, 9 aa, Homo Sapiens
ESAHLSAST

SEQ ID NO: 564673 - protein, 9 aa, Homo Sapiens
QLMEMGFPR

SEQ ID NO: 564674 - protein, 9 aa, Homo Sapiens
APPSSHSSP

SEQ ID NO: 564675 - protein, 9 aa, Homo Sapiens
QPGRSLASF

SEQ ID NO: 564676 - protein, 9 aa, Homo Sapiens
WTAAHSLFT

SEQ ID NO: 564677 - protein, 9 aa, Homo Sapiens
PTQEAPPSS

SEQ ID NO: 564678 - protein, 9 aa, Homo Sapiens
SRWPLQDQL

SEQ ID NO: 564679 - protein, 9 aa, Homo Sapiens
NVGNSLDTV

SEQ ID NO: 564680 - protein, 9 aa, Homo Sapiens
NLMNATNVG

SEQ ID NO: 564681 - protein, 9 aa, Homo Sapiens
SCPQQVPMA

SEQ ID NO: 564682 - protein, 9 aa, Homo Sapiens
YRRQSNLRV

SEQ ID NO: 564683 - protein, 9 aa, Homo Sapiens
PALEIANAN

SEQ ID NO: 564684 - protein, 9 aa, Homo Sapiens
ESEKGDLRC

SEQ ID NO: 564685 - protein, 9 aa, Homo Sapiens
ENNFLDYLC

SEQ ID NO: 564686 - protein, 9 aa, Homo Sapiens
DCSAYTAWT

SEQ ID NO: 564687 - protein, 9 aa, Homo Sapiens
RRKPKPDSD

SEQ ID NO: 564688 - protein, 9 aa, Homo Sapiens
VYCVAAILW

SEQ ID NO: 564689 - protein, 9 aa, Homo Sapiens
PMSHVLFRA

SEQ ID NO: 564690 - protein, 9 aa, Homo Sapiens
RWQWMLVIF

SEQ ID NO: 564691 - protein, 9 aa, Homo Sapiens
PRRNIEFAL

SEQ ID NO: 564692 - protein, 9 aa, Homo Sapiens
RMAAAILKI

SEQ ID NO: 564693 - protein, 9 aa, Homo Sapiens
AAILWTAAK

SEQ ID NO: 564694 - protein, 9 aa, Homo Sapiens
DSRSFDLYD

SEQ ID NO: 564695 - protein, 9 aa, Homo Sapiens
TEAKEKAKE

SEQ ID NO: 564696 - protein, 9 aa, Homo Sapiens
DIRKFTLEK

SEQ ID NO: 564697 - protein, 9 aa, Homo Sapiens
KSFLNLPFQ

SEQ ID NO: 564698 - protein, 9 aa, Homo Sapiens
GATAEPHYT

SEQ ID NO: 564699 - protein, 9 aa, Homo Sapiens
TQKCMSEQS

SEQ ID NO: 564700 - protein, 9 aa, Homo Sapiens
FPRRNIEFA

SEQ ID NO: 564701 - protein, 9 aa, Homo Sapiens
MLCTPKGLS

SEQ ID NO: 564702 - protein, 9 aa, Homo Sapiens
RCEQPCFKS

SEQ ID NO: 564703 - protein, 9 aa, Homo Sapiens
DAVNMLCTP

SEQ ID NO: 564704 - protein, 9 aa, Homo Sapiens
DEVVKETVS

SEQ ID NO: 564705 - protein, 9 aa, Homo Sapiens
TMCVMNMNS

SEQ ID NO: 564706 - protein, 9 aa, Homo Sapiens
RWPLQDQLL

SEQ ID NO: 564707 - protein, 9 aa, Homo Sapiens
VPMAPGQEA

SEQ ID NO: 564708 - protein, 9 aa, Homo Sapiens
TLEKSLMSV

SEQ ID NO: 564709 - protein, 9 aa, Homo Sapiens
AAVPTLGPA

SEQ ID NO: 564710 - protein, 9 aa, Homo Sapiens
PSSVSTGHA

SEQ ID NO: 564711 - protein, 9 aa, Homo Sapiens
IDSRSFDLY

SEQ ID NO: 564712 - protein, 9 aa, Homo Sapiens
RFDQLCQIS

SEQ ID NO: 564713 - protein, 9 aa, Homo Sapiens
TRMAAAILK

SEQ ID NO: 564714 - protein, 9 aa, Homo Sapiens
NMLCTPKGL

SEQ ID NO: 564715 - protein, 9 aa, Homo Sapiens
TREFILEKN

SEQ ID NO: 564716 - protein, 9 aa, Homo Sapiens
KADGSSVKA

SEQ ID NO: 564717 - protein, 9 aa, Homo Sapiens
VSGVPLDDR

SEQ ID NO: 564718 - protein, 9 aa, Homo Sapiens
LEKSLMSVV

SEQ ID NO: 564719 - protein, 9 aa, Homo Sapiens
LNDISSNVT

SEQ ID NO: 564720 - protein, 9 aa, Homo Sapiens
GFCPHGPRC

SEQ ID NO: 564721 - protein, 9 aa, Homo Sapiens
TAEPHYTAL

SEQ ID NO: 564722 - protein, 9 aa, Homo Sapiens
ILWTAAKFS

SEQ ID NO: 564723 - protein, 9 aa, Homo Sapiens
PHYTALADW

SEQ ID NO: 564724 - protein, 9 aa, Homo Sapiens
TSVSVTVLD

SEQ ID NO: 564725 - protein, 9 aa, Homo Sapiens
HSGKLVYGM

SEQ ID NO: 564726 - protein, 9 aa, Homo Sapiens
QKCMSEQSL

SEQ ID NO: 564727 - protein, 9 aa, Homo Sapiens
FPGPLKEDN

SEQ ID NO: 564728 - protein, 9 aa, Homo Sapiens
SILTPVFAR

SEQ ID NO: 564729 - protein, 9 aa, Homo Sapiens
TIGFCPHGP

SEQ ID NO: 564730 - protein, 9 aa, Homo Sapiens
PLDLLLLRR

SEQ ID NO: 564731 - protein, 9 aa, Homo Sapiens
TNHGSEERI

SEQ ID NO: 564732 - protein, 9 aa, Homo Sapiens
AGATAEPHY

SEQ ID NO: 564733 - protein, 9 aa, Homo Sapiens
SCQALGTMC

SEQ ID NO: 564734 - protein, 9 aa, Homo Sapiens
AGGGQILRR

SEQ ID NO: 564735 - protein, 9 aa, Homo Sapiens
KLVLSVNRF

SEQ ID NO: 564736 - protein, 9 aa, Homo Sapiens
RKEAASWAH

SEQ ID NO: 564737 - protein, 9 aa, Homo Sapiens
LAWRKTGSE

SEQ ID NO: 564738 - protein, 9 aa, Homo Sapiens
LDIRKFTLE

SEQ ID NO: 564739 - protein, 9 aa, Homo Sapiens
GAPRHGGDN

SEQ ID NO: 564740 - protein, 9 aa, Homo Sapiens
ANRKPLVII

SEQ ID NO: 564741 - protein, 9 aa, Homo Sapiens
KLKACGFHT

SEQ ID NO: 564742 - protein, 9 aa, Homo Sapiens
DENNFLDYL

SEQ ID NO: 564743 - protein, 9 aa, Homo Sapiens
NMQVYPDEG

SEQ ID NO: 564744 - protein, 9 aa, Homo Sapiens
KTLVETATE

SEQ ID NO: 564745 - protein, 9 aa, Homo Sapiens
LEKRGIKSK

SEQ ID NO: 564746 - protein, 9 aa, Homo Sapiens
SKTLVETAT

SEQ ID NO: 564747 - protein, 9 aa, Homo Sapiens
CPHGPRCHF

SEQ ID NO: 564748 - protein, 9 aa, Homo Sapiens
LWTAAHSLF

SEQ ID NO: 564749 - protein, 9 aa, Homo Sapiens
LQDQLLPSD

SEQ ID NO: 564750 - protein, 9 aa, Homo Sapiens
SLDTVPHSL

SEQ ID NO: 564751 - protein, 9 aa, Homo Sapiens
SLSRAVPAT

SEQ ID NO: 564752 - protein, 9 aa, Homo Sapiens
LCPMSHVLF

SEQ ID NO: 564753 - protein, 9 aa, Homo Sapiens
KGRFSTRSS

SEQ ID NO: 564754 - protein, 9 aa, Homo Sapiens
QNSNPGHAG

SEQ ID NO: 564755 - protein, 9 aa, Homo Sapiens
AGDNPPPHT

SEQ ID NO: 564756 - protein, 9 aa, Homo Sapiens
WTVVHLTDL

SEQ ID NO: 564757 - protein, 9 aa, Homo Sapiens
KFDFLLAWR

SEQ ID NO: 564758 - protein, 9 aa, Homo Sapiens
HTVTTYVPW

SEQ ID NO: 564759 - protein, 9 aa, Homo Sapiens
EKRGIKSKV

SEQ ID NO: 564760 - protein, 9 aa, Homo Sapiens
SGKLVYGMV

SEQ ID NO: 564761 - protein, 9 aa, Homo Sapiens
NNFLDYLCC

SEQ ID NO: 564762 - protein, 9 aa, Homo Sapiens
VAVNRTDTE

SEQ ID NO: 564763 - protein, 9 aa, Homo Sapiens
FITCVNVIT

SEQ ID NO: 564764 - protein, 9 aa, Homo Sapiens
SFPGPLKED

SEQ ID NO: 564765 - protein, 9 aa, Homo Sapiens
PPTQEAPPS

SEQ ID NO: 564766 - protein, 9 aa, Homo Sapiens
VVYSRLPVY

SEQ ID NO: 564767 - protein, 9 aa, Homo Sapiens
GAGHYTAYA

SEQ ID NO: 564768 - protein, 9 aa, Homo Sapiens
TYIRLTQYI

SEQ ID NO: 564769 - protein, 9 aa, Homo Sapiens
GFHTVTTYV

SEQ ID NO: 564770 - protein, 9 aa, Homo Sapiens
SPLEPLDLL

SEQ ID NO: 564771 - protein, 9 aa, Homo Sapiens
CAAVTLEME

SEQ ID NO: 564772 - protein, 9 aa, Homo Sapiens
ASVYCVAAI

SEQ ID NO: 564773 - protein, 9 aa, Homo Sapiens
KVVYLTATF

SEQ ID NO: 564774 - protein, 9 aa, Homo Sapiens
HRMHLALKA

SEQ ID NO: 564775 - protein, 9 aa, Homo Sapiens
CGFHTVTTY

SEQ ID NO: 564776 - protein, 9 aa, Homo Sapiens
LDLTSSFSK

SEQ ID NO: 564777 - protein, 9 aa, Homo Sapiens
CGKLWTAAH

SEQ ID NO: 564778 - protein, 9 aa, Homo Sapiens
LINTSMIGP

SEQ ID NO: 564779 - protein, 9 aa, Homo Sapiens
NAGDANKAI

SEQ ID NO: 564780 - protein, 9 aa, Homo Sapiens
LMNATNVGN

SEQ ID NO: 564781 - protein, 9 aa, Homo Sapiens
EAPPSSHSS

SEQ ID NO: 564782 - protein, 9 aa, Homo Sapiens
PQQVPMAPG

SEQ ID NO: 564783 - protein, 9 aa, Homo Sapiens
PDITRLENP

SEQ ID NO: 564784 - protein, 9 aa, Homo Sapiens
CTPKGLSFR

SEQ ID NO: 564785 - protein, 9 aa, Homo Sapiens
EVVYSRLPV

SEQ ID NO: 564786 - protein, 9 aa, Homo Sapiens
RQSNLRVPC

SEQ ID NO: 564787 - protein, 9 aa, Homo Sapiens
LFIREFILE

SEQ ID NO: 564788 - protein, 9 aa, Homo Sapiens
YDLEKRGIK

SEQ ID NO: 564789 - protein, 9 aa, Homo Sapiens
CHGHGVCDC

SEQ ID NO: 564790 - protein, 9 aa, Homo Sapiens
LKACGFHTV

SEQ ID NO: 564791 - protein, 9 aa, Homo Sapiens
QLHGVHSSL

SEQ ID NO: 564792 - protein, 9 aa, Homo Sapiens
VVYLTATFP

SEQ ID NO: 564793 - protein, 9 aa, Homo Sapiens
EVVKETVSQ

SEQ ID NO: 564794 - protein, 9 aa, Homo Sapiens
VGLGKLSTT

SEQ ID NO: 564795 - protein, 9 aa, Homo Sapiens
AHSLFTREF

SEQ ID NO: 564796 - protein, 9 aa, Homo Sapiens
DNPPPHTSC

SEQ ID NO: 564797 - protein, 9 aa, Homo Sapiens
YLCCLPKGP

SEQ ID NO: 564798 - protein, 9 aa, Homo Sapiens
TVPHSLDIR

SEQ ID NO: 564799 - protein, 9 aa, Homo Sapiens
QHPGELKHM

SEQ ID NO: 564800 - protein, 9 aa, Homo Sapiens
EPYTYNGIF

SEQ ID NO: 564801 - protein, 9 aa, Homo Sapiens
AVPTLGPAA

SEQ ID NO: 564802 - protein, 9 aa, Homo Sapiens
THLGEIMVG

SEQ ID NO: 564803 - protein, 9 aa, Homo Sapiens
GSSLWTLPH

SEQ ID NO: 564804 - protein, 9 aa, Homo Sapiens
FRFGTYLVA

SEQ ID NO: 564805 - protein, 9 aa, Homo Sapiens
VHHGSGVGA

SEQ ID NO: 564806 - protein, 9 aa, Homo Sapiens
EMGFPRRNI

SEQ ID NO: 564807 - protein, 9 aa, Homo Sapiens
RLDLTSSFS

SEQ ID NO: 564808 - protein, 9 aa, Homo Sapiens
DANKAIKQQ

SEQ ID NO: 564809 - protein, 9 aa, Homo Sapiens
IGFCPHGPR

SEQ ID NO: 564810 - protein, 9 aa, Homo Sapiens
KSKVLPLQL

SEQ ID NO: 564811 - protein, 9 aa, Homo Sapiens
GDGLNEGLE

SEQ ID NO: 564812 - protein, 9 aa, Homo Sapiens
HTIGFCPHG

SEQ ID NO: 564813 - protein, 9 aa, Homo Sapiens
LIPNAGDAN

SEQ ID NO: 564814 - protein, 9 aa, Homo Sapiens
NYNMQVYPD

SEQ ID NO: 564815 - protein, 9 aa, Homo Sapiens
GGWTVVHLT

SEQ ID NO: 564816 - protein, 9 aa, Homo Sapiens
TVIIFDRDW

SEQ ID NO: 564817 - protein, 9 aa, Homo Sapiens
ITYIRLTQY

SEQ ID NO: 564818 - protein, 9 aa, Homo Sapiens
SSTSVSVTV

SEQ ID NO: 564819 - protein, 9 aa, Homo Sapiens
ASESSLRLR

SEQ ID NO: 564820 - protein, 9 aa, Homo Sapiens
QVHSGKLVY

SEQ ID NO: 564821 - protein, 9 aa, Homo Sapiens
EFILEKSLM

SEQ ID NO: 564822 - protein, 9 aa, Homo Sapiens
VPHSLDIRK

SEQ ID NO: 564823 - protein, 9 aa, Homo Sapiens
IFDRDWNPH

SEQ ID NO: 564824 - protein, 9 aa, Homo Sapiens
AGDANKAIK

SEQ ID NO: 564825 - protein, 9 aa, Homo Sapiens
SLWTLPHSL

SEQ ID NO: 564826 - protein, 9 aa, Homo Sapiens
RNYIKRAAN

SEQ ID NO: 564827 - protein, 9 aa, Homo Sapiens
LVYPTHQLH

SEQ ID NO: 564828 - protein, 9 aa, Homo Sapiens
IIGDGLNEG

SEQ ID NO: 564829 - protein, 9 aa, Homo Sapiens
NSLDTVPHS

SEQ ID NO: 564830 - protein, 9 aa, Homo Sapiens
LSPAAVPTL

SEQ ID NO: 564831 - protein, 9 aa, Homo Sapiens
HLGEIMVGK

SEQ ID NO: 564832 - protein, 9 aa, Homo Sapiens
ITNHGSEER

SEQ ID NO: 564833 - protein, 9 aa, Homo Sapiens
CECGKLWTA

SEQ ID NO: 564834 - protein, 9 aa, Homo Sapiens
PEPYTYNGI

SEQ ID NO: 564835 - protein, 9 aa, Homo Sapiens
QNKILSLVR

SEQ ID NO: 564836 - protein, 9 aa, Homo Sapiens
ILEKNLMNA

SEQ ID NO: 564837 - protein, 9 aa, Homo Sapiens
SEQSLSRAV

SEQ ID NO: 564838 - protein, 9 aa, Homo Sapiens
CSYTRMAAA

SEQ ID NO: 564839 - protein, 9 aa, Homo Sapiens
PLKEDNLLN

SEQ ID NO: 564840 - protein, 9 aa, Homo Sapiens
VNRFDQLCQ

SEQ ID NO: 564841 - protein, 9 aa, Homo Sapiens
DCNRHCYCE

SEQ ID NO: 564842 - protein, 9 aa, Homo Sapiens
EAILNDISS

SEQ ID NO: 564843 - protein, 9 aa, Homo Sapiens
MAPGQEAQR

SEQ ID NO: 564844 - protein, 9 aa, Homo Sapiens
VYLTATFPY

SEQ ID NO: 564845 - protein, 9 aa, Homo Sapiens
VAAILWTAA

SEQ ID NO: 564846 - protein, 9 aa, Homo Sapiens
AGCFRFGTY

SEQ ID NO: 564847 - protein, 9 aa, Homo Sapiens
RSFDLYDPP

SEQ ID NO: 564848 - protein, 9 aa, Homo Sapiens
PGRPEPKGS

SEQ ID NO: 564849 - protein, 9 aa, Homo Sapiens
GRFSTRSSL

SEQ ID NO: 564850 - protein, 9 aa, Homo Sapiens
ALGTMCVMN

SEQ ID NO: 564851 - protein, 9 aa, Homo Sapiens
DTVIIFDRD

SEQ ID NO: 564852 - protein, 9 aa, Homo Sapiens
SLMNATNVG

SEQ ID NO: 564853 - protein, 9 aa, Homo Sapiens
VLINTSMIG

SEQ ID NO: 564854 - protein, 9 aa, Homo Sapiens
LCSYTRMAA

SEQ ID NO: 564855 - protein, 9 aa, Homo Sapiens
SFARMSTDE

SEQ ID NO: 564856 - protein, 9 aa, Homo Sapiens
QSNLRVPCA

SEQ ID NO: 564857 - protein, 9 aa, Homo Sapiens
IGDGLNEGL

SEQ ID NO: 564858 - protein, 9 aa, Homo Sapiens
PHSLFIREF

SEQ ID NO: 564859 - protein, 9 aa, Homo Sapiens
ELQQKEVEI

SEQ ID NO: 564860 - protein, 9 aa, Homo Sapiens
LEKNLMNAT

SEQ ID NO: 564861 - protein, 9 aa, Homo Sapiens
NYIKRAANH

SEQ ID NO: 564862 - protein, 9 aa, Homo Sapiens
NKILSLVRK

SEQ ID NO: 564863 - protein, 9 aa, Homo Sapiens
SSLTDTQVQ

SEQ ID NO: 564864 - protein, 9 aa, Homo Sapiens
VNYNMQVYP

SEQ ID NO: 564865 - protein, 9 aa, Homo Sapiens
LNEGLEKLH

SEQ ID NO: 564866 - protein, 9 aa, Homo Sapiens
RVPCAAVTL

SEQ ID NO: 564867 - protein, 9 aa, Homo Sapiens
SRAVPATTG

SEQ ID NO: 564868 - protein, 9 aa, Homo Sapiens
SYTRMAAAI

SEQ ID NO: 564869 - protein, 9 aa, Homo Sapiens
TSCQALGTM

SEQ ID NO: 564870 - protein, 9 aa, Homo Sapiens
FSFFFFFFF

SEQ ID NO: 564871 - protein, 9 aa, Homo Sapiens
RHVSGVPLD

SEQ ID NO: 564872 - protein, 9 aa, Homo Sapiens
CCECGKLWT

SEQ ID NO: 564873 - protein, 9 aa, Homo Sapiens
ILCAKLRHP

SEQ ID NO: 564874 - protein, 9 aa, Homo Sapiens
RSLASFARM

SEQ ID NO: 564875 - protein, 9 aa, Homo Sapiens
AVNRTDTEY

SEQ ID NO: 564876 - protein, 9 aa, Homo Sapiens
LKSFLNLPF

SEQ ID NO: 564877 - protein, 9 aa, Homo Sapiens
VYGMVSYLN

SEQ ID NO: 564878 - protein, 9 aa, Homo Sapiens
VESAHLSAS

SEQ ID NO: 564879 - protein, 9 aa, Homo Sapiens
GFPRRNIEF

SEQ ID NO: 564880 - protein, 9 aa, Homo Sapiens
ATNVGNSLG

SEQ ID NO: 564881 - protein, 9 aa, Homo Sapiens
ATNVGNSLD

SEQ ID NO: 564882 - protein, 9 aa, Homo Sapiens
RAMKILCAK

SEQ ID NO: 564883 - protein, 9 aa, Homo Sapiens
RRQSNLRVP

SEQ ID NO: 564884 - protein, 9 aa, Homo Sapiens
YNMQVYPDE

SEQ ID NO: 564885 - protein, 9 aa, Homo Sapiens
VRTASESSL

SEQ ID NO: 564886 - protein, 9 aa, Homo Sapiens
VHQNKILSL

SEQ ID NO: 564887 - protein, 9 aa, Homo Sapiens
NHLEALAAI

SEQ ID NO: 564888 - protein, 9 aa, Homo Sapiens
GVGAGHYTA

SEQ ID NO: 564889 - protein, 9 aa, Homo Sapiens
DAACITYIR

SEQ ID NO: 564890 - protein, 9 aa, Homo Sapiens
LTSCQALGT

SEQ ID NO: 564891 - protein, 9 aa, Homo Sapiens
CVAAILWTA

SEQ ID NO: 564892 - protein, 9 aa, Homo Sapiens
NPQVWIDAG

SEQ ID NO: 564893 - protein, 9 aa, Homo Sapiens
RTASESSLR

SEQ ID NO: 564894 - protein, 9 aa, Homo Sapiens
CQALGTMCV

SEQ ID NO: 564895 - protein, 9 aa, Homo Sapiens
YAGCFRFGT

SEQ ID NO: 564896 - protein, 9 aa, Homo Sapiens
KILCAKLRH

SEQ ID NO: 564897 - protein, 9 aa, Homo Sapiens
YLTATFPYL

SEQ ID NO: 564898 - protein, 9 aa, Homo Sapiens
LCCLPKGPA

SEQ ID NO: 564899 - protein, 9 aa, Homo Sapiens
LIKAGVNYN

SEQ ID NO: 564900 - protein, 9 aa, Homo Sapiens
DIRWQWMLV

SEQ ID NO: 564901 - protein, 9 aa, Homo Sapiens
SSVSTGHAI

SEQ ID NO: 564902 - protein, 9 aa, Homo Sapiens
VGNSLDTVP

SEQ ID NO: 564903 - protein, 9 aa, Homo Sapiens
RLSLKSFLN

SEQ ID NO: 564904 - protein, 9 aa, Homo Sapiens
SFPVGLGKL

SEQ ID NO: 564905 - protein, 9 aa, Homo Sapiens
ADGSSVKAG

SEQ ID NO: 564906 - protein, 9 aa, Homo Sapiens
AAAPPLPES

SEQ ID NO: 564907 - protein, 9 aa, Homo Sapiens
EKGDLRCEQ

SEQ ID NO: 564908 - protein, 9 aa, Homo Sapiens
LPPTQEAPP

SEQ ID NO: 564909 - protein, 9 aa, Homo Sapiens
QDAVNMLCT

SEQ ID NO: 564910 - protein, 9 aa, Homo Sapiens
SRISDTHLG

SEQ ID NO: 564911 - protein, 9 aa, Homo Sapiens
MAAAILKIP

SEQ ID NO: 564912 - protein, 9 aa, Homo Sapiens
SLASFARMS

SEQ ID NO: 564913 - protein, 9 aa, Homo Sapiens
AVQNVLINT

SEQ ID NO: 564914 - protein, 9 aa, Homo Sapiens
IMSGSMMSL

SEQ ID NO: 564915 - protein, 9 aa, Homo Sapiens
QSLLVAVNR

SEQ ID NO: 564916 - protein, 9 aa, Homo Sapiens
YTAWTGIAL

SEQ ID NO: 564917 - protein, 9 aa, Homo Sapiens
GSSVKAGVE

SEQ ID NO: 564918 - protein, 9 aa, Homo Sapiens
PHTSCANKL

SEQ ID NO: 564919 - protein, 9 aa, Homo Sapiens
TPKGLSFRT

SEQ ID NO: 564920 - protein, 9 aa, Homo Sapiens
CPQQVPMAP

SEQ ID NO: 564921 - protein, 9 aa, Homo Sapiens
AAPPLPESS

SEQ ID NO: 564922 - protein, 9 aa, Homo Sapiens
KLWTAAHSL

SEQ ID NO: 564923 - protein, 9 aa, Homo Sapiens
GVCDCNRHC

SEQ ID NO: 564924 - protein, 9 aa, Homo Sapiens
PHDCSAYTA

SEQ ID NO: 564925 - protein, 9 aa, Homo Sapiens
SMMSLNHEA

SEQ ID NO: 564926 - protein, 9 aa, Homo Sapiens
RAVPATTGL

SEQ ID NO: 564927 - protein, 9 aa, Homo Sapiens
HLQRQNSNP

SEQ ID NO: 564928 - protein, 9 aa, Homo Sapiens
AWRKTGSEE

SEQ ID NO: 564929 - protein, 9 aa, Homo Sapiens
YYSIKWYEN

SEQ ID NO: 564930 - protein, 9 aa, Homo Sapiens
VQNVLINTS

SEQ ID NO: 564931 - protein, 9 aa, Homo Sapiens
LEKSLMNAT

SEQ ID NO: 564932 - protein, 9 aa, Homo Sapiens
QILRRKPKP

SEQ ID NO: 564933 - protein, 9 aa, Homo Sapiens
FYRLDLTSS

SEQ ID NO: 564934 - protein, 9 aa, Homo Sapiens
LDLLLLRRL

SEQ ID NO: 564935 - protein, 9 aa, Homo Sapiens
LPESSLTDT

SEQ ID NO: 564936 - protein, 9 aa, Homo Sapiens
LSASTPVTA

SEQ ID NO: 564937 - protein, 9 aa, Homo Sapiens
LGKLSTTQK

SEQ ID NO: 564938 - protein, 9 aa, Homo Sapiens
IISHYRHVS

SEQ ID NO: 564939 - protein, 9 aa, Homo Sapiens
RSWLLLCPM

SEQ ID NO: 564940 - protein, 9 aa, Homo Sapiens
NATNVGNSL

SEQ ID NO: 564941 - protein, 9 aa, Homo Sapiens
DNLLNVPKP

SEQ ID NO: 564942 - protein, 9 aa, Homo Sapiens
NFLDYLCCL

SEQ ID NO: 564943 - protein, 9 aa, Homo Sapiens
LVETATEAK

SEQ ID NO: 564944 - protein, 9 aa, Homo Sapiens
VHSGKLVYG

SEQ ID NO: 564945 - protein, 9 aa, Homo Sapiens
STSVSVTVL

SEQ ID NO: 564946 - protein, 9 aa, Homo Sapiens
ASWAHRMHL

SEQ ID NO: 564947 - protein, 9 aa, Homo Sapiens
GNSLGIASH

SEQ ID NO: 564948 - protein, 9 aa, Homo Sapiens
SSGKVVYLT

SEQ ID NO: 564949 - protein, 9 aa, Homo Sapiens
AMKILCAKL

SEQ ID NO: 564950 - protein, 9 aa, Homo Sapiens
SVKAGVETT

SEQ ID NO: 564951 - protein, 9 aa, Homo Sapiens
KLSTTQKCM

SEQ ID NO: 564952 - protein, 9 aa, Homo Sapiens
FHTIGFCPH

SEQ ID NO: 564953 - protein, 9 aa, Homo Sapiens
WRKTGSEES

SEQ ID NO: 564954 - protein, 9 aa, Homo Sapiens
RQVPVPEPY

SEQ ID NO: 564955 - protein, 9 aa, Homo Sapiens
DLEKRGIKS

SEQ ID NO: 564956 - protein, 9 aa, Homo Sapiens
PCAAVTLEM

SEQ ID NO: 564957 - protein, 9 aa, Homo Sapiens
GYPGRPEPK

SEQ ID NO: 564958 - protein, 9 aa, Homo Sapiens
FSTRSSLEL

SEQ ID NO: 564959 - protein, 9 aa, Homo Sapiens
GTMCVMNMN

SEQ ID NO: 564960 - protein, 9 aa, Homo Sapiens
CITYIRLTQ

SEQ ID NO: 564961 - protein, 9 aa, Homo Sapiens
REFILEKNL

SEQ ID NO: 564962 - protein, 9 aa, Homo Sapiens
YSRLPVYRK

SEQ ID NO: 564963 - protein, 9 aa, Homo Sapiens
PPFFYRLDL

SEQ ID NO: 564964 - protein, 9 aa, Homo Sapiens
AILNDISSN

SEQ ID NO: 564965 - protein, 9 aa, Homo Sapiens
YPLVYPTHQ

SEQ ID NO: 564966 - protein, 9 aa, Homo Sapiens
GGGQILRRK

SEQ ID NO: 564967 - protein, 9 aa, Homo Sapiens
WKADGSSVK

SEQ ID NO: 564968 - protein, 9 aa, Homo Sapiens
FTREFILEK

SEQ ID NO: 564969 - protein, 9 aa, Homo Sapiens
WPLQDQLLP

SEQ ID NO: 564970 - protein, 9 aa, Homo Sapiens
RAANHLEAL

SEQ ID NO: 564971 - protein, 9 aa, Homo Sapiens
GTYLVAHKL

SEQ ID NO: 564972 - protein, 9 aa, Homo Sapiens
ASRWPLQDQ

SEQ ID NO: 564973 - protein, 9 aa, Homo Sapiens
VGIDSRSFD

SEQ ID NO: 564974 - protein, 9 aa, Homo Sapiens
QEAPPSSHS

SEQ ID NO: 564975 - protein, 9 aa, Homo Sapiens
ILTPVFARW

SEQ ID NO: 564976 - protein, 9 aa, Homo Sapiens
ILCSYTRMA

SEQ ID NO: 564977 - protein, 9 aa, Homo Sapiens
RDWNPHQDL

SEQ ID NO: 564978 - protein, 9 aa, Homo Sapiens
PLLELTCSD

SEQ ID NO: 564979 - protein, 9 aa, Homo Sapiens
FFYRLDLTS

SEQ ID NO: 564980 - protein, 9 aa, Homo Sapiens
AVPATTGLP

SEQ ID NO: 564981 - protein, 9 aa, Homo Sapiens
EDNLLNVPK

SEQ ID NO: 564982 - protein, 9 aa, Homo Sapiens
SWLLLCPMS

SEQ ID NO: 564983 - protein, 9 aa, Homo Sapiens
SGKVVYLTA

SEQ ID NO: 564984 - protein, 9 aa, Homo Sapiens
SHYRHVSGV

SEQ ID NO: 564985 - protein, 9 aa, Homo Sapiens
SAYTAWTGI

SEQ ID NO: 564986 - protein, 9 aa, Homo Sapiens
NKAIKQQIM

SEQ ID NO: 564987 - protein, 9 aa, Homo Sapiens
GSEERIKHF

SEQ ID NO: 564988 - protein, 9 aa, Homo Sapiens
LLLCPMSHV

SEQ ID NO: 564989 - protein, 9 aa, Homo Sapiens
KKLVLSVNR

SEQ ID NO: 564990 - protein, 9 aa, Homo Sapiens
AHLSASTPV

SEQ ID NO: 564991 - protein, 9 aa, Homo Sapiens
PGRSLASFA

SEQ ID NO: 564992 - protein, 9 aa, Homo Sapiens
KNLMNATNV

SEQ ID NO: 564993 - protein, 9 aa, Homo Sapiens
SFLNLPFQR

SEQ ID NO: 564994 - protein, 9 aa, Homo Sapiens
VETATEAKE

SEQ ID NO: 564995 - protein, 9 aa, Homo Sapiens
KDEVVKETV

SEQ ID NO: 564996 - protein, 9 aa, Homo Sapiens
IRWQWMLVI

SEQ ID NO: 564997 - protein, 9 aa, Homo Sapiens
GSGVGAGHY

SEQ ID NO: 564998 - protein, 9 aa, Homo Sapiens
FLNLPFQRI

SEQ ID NO: 564999 - protein, 9 aa, Homo Sapiens
MSSSTSVSV

SEQ ID NO: 565000 - protein, 9 aa, Homo Sapiens
SVVNVGSSL

SEQ ID NO: 565001 - protein, 9 aa, Homo Sapiens
QALGTMCVM

SEQ ID NO: 565002 - protein, 9 aa, Homo Sapiens
VVGGWTVVH

SEQ ID NO: 565003 - protein, 9 aa, Homo Sapiens
TASESSLRL

SEQ ID NO: 565004 - protein, 9 aa, Homo Sapiens
SGSMMSLNH

SEQ ID NO: 565005 - protein, 9 aa, Homo Sapiens
DLLLLRRLD

SEQ ID NO: 565006 - protein, 9 aa, Homo Sapiens
EEAILNDIS

SEQ ID NO: 565007 - protein, 9 aa, Homo Sapiens
DITRLENPQ

SEQ ID NO: 565008 - protein, 9 aa, Homo Sapiens
VCDCNRHCY

SEQ ID NO: 565009 - protein, 9 aa, Homo Sapiens
GIDSRSFDL

SEQ ID NO: 565010 - protein, 9 aa, Homo Sapiens
LLLRRLDRE

SEQ ID NO: 565011 - protein, 9 aa, Homo Sapiens
HVSGVPLDD

SEQ ID NO: 565012 - protein, 9 aa, Homo Sapiens
YRNELQQKE

SEQ ID NO: 565013 - protein, 9 aa, Homo Sapiens
SWAHRMHLA

SEQ ID NO: 565014 - protein, 9 aa, Homo Sapiens
GEIMVGKAV

SEQ ID NO: 565015 - protein, 9 aa, Homo Sapiens
ALEIANANR

SEQ ID NO: 565016 - protein, 9 aa, Homo Sapiens
WAHRMHLAL

SEQ ID NO: 565017 - protein, 9 aa, Homo Sapiens
VYPTHQLHG

SEQ ID NO: 565018 - protein, 9 aa, Homo Sapiens
GWTVVHLTD

SEQ ID NO: 565019 - protein, 9 aa, Homo Sapiens
CFRFGTYLV

SEQ ID NO: 565020 - protein, 9 aa, Homo Sapiens
QPHLQRQNS

SEQ ID NO: 565021 - protein, 9 aa, Homo Sapiens
ILNDISSNV

SEQ ID NO: 565022 - protein, 9 aa, Homo Sapiens
SFSFFFFFF

SEQ ID NO: 565023 - protein, 9 aa, Homo Sapiens
SLMSVVNVG

SEQ ID NO: 565024 - protein, 9 aa, Homo Sapiens
SSSTSVSVT

SEQ ID NO: 565025 - protein, 9 aa, Homo Sapiens
LILCSYTRM

SEQ ID NO: 565026 - protein, 9 aa, Homo Sapiens
LVRKSQEIT

SEQ ID NO: 565027 - protein, 9 aa, Homo Sapiens
EIANANRKP

SEQ ID NO: 565028 - protein, 9 aa, Homo Sapiens
SYRNELQQK

SEQ ID NO: 565029 - protein, 9 aa, Homo Sapiens
PNAGDANKA

SEQ ID NO: 565030 - protein, 9 aa, Homo Sapiens
DFAPLLELT

SEQ ID NO: 565031 - protein, 9 aa, Homo Sapiens
ATTGLPPAK

SEQ ID NO: 565032 - protein, 9 aa, Homo Sapiens
ANANRKPLV

SEQ ID NO: 565033 - protein, 9 aa, Homo Sapiens
RIKHFIPQM

SEQ ID NO: 565034 - protein, 9 aa, Homo Sapiens
QNVLINTSM

SEQ ID NO: 565035 - protein, 9 aa, Homo Sapiens
SGVPLDDRK

SEQ ID NO: 565036 - protein, 9 aa, Homo Sapiens
AEPHYTALA

SEQ ID NO: 565037 - protein, 9 aa, Homo Sapiens
IIFDRDWNP

SEQ ID NO: 565038 - protein, 9 aa, Homo Sapiens
IKWYENSNL

SEQ ID NO: 565039 - protein, 9 aa, Homo Sapiens
ISHYRHVSG

SEQ ID NO: 565040 - protein, 9 aa, Homo Sapiens
EPLDLLLLR

SEQ ID NO: 565041 - protein, 9 aa, Homo Sapiens
APLLELTCS

SEQ ID NO: 565042 - protein, 9 aa, Homo Sapiens
FILEKSLMN

SEQ ID NO: 565043 - protein, 9 aa, Homo Sapiens
GKLVYGMVS

SEQ ID NO: 565044 - protein, 9 aa, Homo Sapiens
LLELTCSDI

SEQ ID NO: 565045 - protein, 9 aa, Homo Sapiens
LLLLRRLDR

SEQ ID NO: 565046 - protein, 9 aa, Homo Sapiens
FTLEKSLMS

SEQ ID NO: 565047 - protein, 9 aa, Homo Sapiens
APGQEAQRV

SEQ ID NO: 565048 - protein, 9 aa, Homo Sapiens
ATIMSGSMM

SEQ ID NO: 565049 - protein, 9 aa, Homo Sapiens
FYCCECGKL

SEQ ID NO: 565050 - protein, 9 aa, Homo Sapiens
YSIKWYENS

SEQ ID NO: 565051 - protein, 9 aa, Homo Sapiens
TLPPTQEAP

SEQ ID NO: 565052 - protein, 9 aa, Homo Sapiens
KSSGKVVYL

SEQ ID NO: 565053 - protein, 9 aa, Homo Sapiens
SEKGDLRCE

SEQ ID NO: 565054 - protein, 9 aa, Homo Sapiens
KSLMSVVNV

SEQ ID NO: 565055 - protein, 9 aa, Homo Sapiens
GGQILRRKP

SEQ ID NO: 565056 - protein, 9 aa, Homo Sapiens
SLELQMQEG

SEQ ID NO: 565057 - protein, 9 aa, Homo Sapiens
PPHTSCANK

SEQ ID NO: 565058 - protein, 9 aa, Homo Sapiens
GFQSLLVAV

SEQ ID NO: 565059 - protein, 9 aa, Homo Sapiens
VFARWLTDV

SEQ ID NO: 565060 - protein, 9 aa, Homo Sapiens
VIIFDRDWN

SEQ ID NO: 565061 - protein, 9 aa, Homo Sapiens
SGVGAGHYT

SEQ ID NO: 565062 - protein, 9 aa, Homo Sapiens
THQLHGVHS

SEQ ID NO: 565063 - protein, 9 aa, Homo Sapiens
LSRAVPATT

SEQ ID NO: 565064 - protein, 9 aa, Homo Sapiens
DFLLAWRKT

SEQ ID NO: 565065 - protein, 9 aa, Homo Sapiens
RFGTYLVAH

SEQ ID NO: 565066 - protein, 9 aa, Homo Sapiens
AGHYTAYAT

SEQ ID NO: 565067 - protein, 9 aa, Homo Sapiens
NDISSNVTF

SEQ ID NO: 565068 - protein, 9 aa, Homo Sapiens
IANANRKPL

SEQ ID NO: 565069 - protein, 9 aa, Homo Sapiens
YRHVSGVPL

SEQ ID NO: 565070 - protein, 9 aa, Homo Sapiens
HAPVRGGDG

SEQ ID NO: 565071 - protein, 9 aa, Homo Sapiens
DGAPRHGGD

SEQ ID NO: 565072 - protein, 9 aa, Homo Sapiens
VPATTGLPP

SEQ ID NO: 565073 - protein, 9 aa, Homo Sapiens
PPSSHSSPQ

SEQ ID NO: 565074 - protein, 9 aa, Homo Sapiens
AWKADGSSV

SEQ ID NO: 565075 - protein, 9 aa, Homo Sapiens
QQSTSYRNE

SEQ ID NO: 565076 - protein, 9 aa, Homo Sapiens
QTLTLSPAA

SEQ ID NO: 565077 - protein, 9 aa, Homo Sapiens
MSGSMMSLN

SEQ ID NO: 565078 - protein, 9 aa, Homo Sapiens
FDRDWNPHQ

SEQ ID NO: 565079 - protein, 9 aa, Homo Sapiens
SSLELQMQE

SEQ ID NO: 565080 - protein, 9 aa, Homo Sapiens
QVPVPEPYT

SEQ ID NO: 565081 - protein, 9 aa, Homo Sapiens
AIIGDGLNE

SEQ ID NO: 565082 - protein, 9 aa, Homo Sapiens
LELTCSDIS

SEQ ID NO: 565083 - protein, 9 aa, Homo Sapiens
TIMSGSMMS

SEQ ID NO: 565084 - protein, 9 aa, Homo Sapiens
LKDEVVKET

SEQ ID NO: 565085 - protein, 9 aa, Homo Sapiens
DLFITFITC

SEQ ID NO: 565086 - protein, 9 aa, Homo Sapiens
YPDITRLEN

SEQ ID NO: 565087 - protein, 9 aa, Homo Sapiens
PTHQLHGVH

SEQ ID NO: 565088 - protein, 9 aa, Homo Sapiens
EDAACITYI

SEQ ID NO: 565089 - protein, 9 aa, Homo Sapiens
GRPEPKGSI

SEQ ID NO: 565090 - protein, 9 aa, Homo Sapiens
NHGSEERIK

SEQ ID NO: 565091 - protein, 9 aa, Homo Sapiens
TNVGNSLGI

SEQ ID NO: 565092 - protein, 9 aa, Homo Sapiens
VGGWTVVHL

SEQ ID NO: 565093 - protein, 9 aa, Homo Sapiens
RFSTRSSLE

SEQ ID NO: 565094 - protein, 9 aa, Homo Sapiens
LLVAVNRTD

SEQ ID NO: 565095 - protein, 9 aa, Homo Sapiens
SESSLRLRW

SEQ ID NO: 565096 - protein, 9 aa, Homo Sapiens
NELQQKEVE

SEQ ID NO: 565097 - protein, 9 aa, Homo Sapiens
GAGATAEPH

SEQ ID NO: 565098 - protein, 9 aa, Homo Sapiens
YENSNLLPF

SEQ ID NO: 565099 - protein, 9 aa, Homo Sapiens
RTLLRRATQ

SEQ ID NO: 565100 - protein, 9 aa, Homo Sapiens
KEDNLLNVP

SEQ ID NO: 565101 - protein, 9 aa, Homo Sapiens
NLRVPCAAV

SEQ ID NO: 565102 - protein, 9 aa, Homo Sapiens
CAIIGDGLN

SEQ ID NO: 565103 - protein, 9 aa, Homo Sapiens
LDLFITFIT

SEQ ID NO: 565104 - protein, 9 aa, Homo Sapiens
AANHLEALA

SEQ ID NO: 565105 - protein, 9 aa, Homo Sapiens
KEAASWAHR

SEQ ID NO: 565106 - protein, 9 aa, Homo Sapiens
PPLPESSLT

SEQ ID NO: 565107 - protein, 9 aa, Homo Sapiens
VNRTDTEYV

SEQ ID NO: 565108 - protein, 9 aa, Homo Sapiens
ECGKLWTAA

SEQ ID NO: 565109 - protein, 9 aa, Homo Sapiens
KGDLRCEQP

SEQ ID NO: 565110 - protein, 9 aa, Homo Sapiens
ENIEVVYSR

SEQ ID NO: 565111 - protein, 9 aa, Homo Sapiens
TRSSLELQM

SEQ ID NO: 565112 - protein, 9 aa, Homo Sapiens
FARWLTDVY

SEQ ID NO: 565113 - protein, 9 aa, Homo Sapiens
ACITYIRLT

SEQ ID NO: 565114 - protein, 9 aa, Homo Sapiens
LGEIMVGKA

SEQ ID NO: 565115 - protein, 9 aa, Homo Sapiens
QWMLVIFCL

SEQ ID NO: 565116 - protein, 9 aa, Homo Sapiens
SSLRLRWVP

SEQ ID NO: 565117 - protein, 9 aa, Homo Sapiens
RNELQQKEV

SEQ ID NO: 565118 - protein, 9 aa, Homo Sapiens
LPHSLFIRE

SEQ ID NO: 565119 - protein, 9 aa, Homo Sapiens
YRLDLTSSF

SEQ ID NO: 565120 - protein, 9 aa, Homo Sapiens
IGEDAACIT

SEQ ID NO: 565121 - protein, 9 aa, Homo Sapiens
AAHSLFTRE

SEQ ID NO: 565122 - protein, 9 aa, Homo Sapiens
PGPLKEDNL

SEQ ID NO: 565123 - protein, 9 aa, Homo Sapiens
PAGDNPPPH

SEQ ID NO: 565124 - protein, 9 aa, Homo Sapiens
ESSLRLRWV

SEQ ID NO: 565125 - protein, 9 aa, Homo Sapiens
RLPVYRKLR

SEQ ID NO: 565126 - protein, 9 aa, Homo Sapiens
LMEMGFPRR

SEQ ID NO: 565127 - protein, 9 aa, Homo Sapiens
LRVPCAAVT

SEQ ID NO: 565128 - protein, 9 aa, Homo Sapiens
DTHLGEIMV

SEQ ID NO: 565129 - protein, 9 aa, Homo Sapiens
PHGPRCHFI

SEQ ID NO: 565130 - protein, 9 aa, Homo Sapiens
SEERIKHFI

SEQ ID NO: 565131 - protein, 9 aa, Homo Sapiens
ITFITCVNV

SEQ ID NO: 565132 - protein, 9 aa, Homo Sapiens
WTLPHSLFI

SEQ ID NO: 565133 - protein, 9 aa, Homo Sapiens
TPVFARWLT

SEQ ID NO: 565134 - protein, 9 aa, Homo Sapiens
LTPVFARWL

SEQ ID NO: 565135 - protein, 9 aa, Homo Sapiens
LWTLPHSLF

SEQ ID NO: 565136 - protein, 9 aa, Homo Sapiens
TFITCVNVI

SEQ ID NO: 565137 - protein, 9 aa, Homo Sapiens
YCCECGKLW

SEQ ID NO: 565138 - protein, 9 aa, Homo Sapiens
TATEAKEKA

SEQ ID NO: 565139 - protein, 9 aa, Homo Sapiens
ESSLTDTQV

SEQ ID NO: 565140 - protein, 9 aa, Homo Sapiens
LASFARMST

SEQ ID NO: 565141 - protein, 9 aa, Homo Sapiens
VGSSLWTLP

SEQ ID NO: 565142 - protein, 9 aa, Homo Sapiens
IREFILEKS

SEQ ID NO: 565143 - protein, 9 aa, Homo Sapiens
PVFARWLTD

SEQ ID NO: 565144 - protein, 9 aa, Homo Sapiens
APVRGGDGA

SEQ ID NO: 565145 - protein, 9 aa, Homo Sapiens
WYENSNLLP

SEQ ID NO: 565146 - protein, 9 aa, Homo Sapiens
KFTLEKSLM

SEQ ID NO: 565147 - protein, 9 aa, Homo Sapiens
EQSLSRAVP

SEQ ID NO: 565148 - protein, 9 aa, Homo Sapiens
QDQLLPSDG

SEQ ID NO: 565149 - protein, 9 aa, Homo Sapiens
GPLKEDNLL

SEQ ID NO: 565150 - protein, 9 aa, Homo Sapiens
VPCAAVTLE

SEQ ID NO: 565151 - protein, 9 aa, Homo Sapiens
PGYPGRPEP

SEQ ID NO: 565152 - protein, 9 aa, Homo Sapiens
TSYRNELQQ

SEQ ID NO: 565153 - protein, 9 aa, Homo Sapiens
CDCNRHCYC

SEQ ID NO: 565154 - protein, 9 aa, Homo Sapiens
LSVNRFDQL

SEQ ID NO: 565155 - protein, 9 aa, Homo Sapiens
DTVPHSLDI

SEQ ID NO: 565156 - protein, 9 aa, Homo Sapiens
TCSDISVST

SEQ ID NO: 565157 - protein, 9 aa, Homo Sapiens
TVESAHLSA

SEQ ID NO: 565158 - protein, 9 aa, Homo Sapiens
EKNLMNATN

SEQ ID NO: 565159 - protein, 9 aa, Homo Sapiens
ELTCSDISV

SEQ ID NO: 565160 - protein, 9 aa, Homo Sapiens
CVDIRWQWM

SEQ ID NO: 565161 - protein, 9 aa, Homo Sapiens
VTVRTASES

SEQ ID NO: 565162 - protein, 9 aa, Homo Sapiens
EKSLMSVVN

SEQ ID NO: 565163 - protein, 9 aa, Homo Sapiens
SVSTGHAIP

SEQ ID NO: 565164 - protein, 9 aa, Homo Sapiens
PVGLGKLST

SEQ ID NO: 565165 - protein, 9 aa, Homo Sapiens
TAAHSLFTR

SEQ ID NO: 565166 - protein, 9 aa, Homo Sapiens
VVKETVSQR

SEQ ID NO: 565167 - protein, 9 aa, Homo Sapiens
MSVVNVGSS

SEQ ID NO: 565168 - protein, 9 aa, Homo Sapiens
TLLRRATQH

SEQ ID NO: 565169 - protein, 9 aa, Homo Sapiens
GDGAPRHGG

SEQ ID NO: 565170 - protein, 9 aa, Homo Sapiens
SPAAVPTLG

SEQ ID NO: 565171 - protein, 9 aa, Homo Sapiens
SSVKAGVET

SEQ ID NO: 565172 - protein, 9 aa, Homo Sapiens
PLVYPTHQL

SEQ ID NO: 565173 - protein, 9 aa, Homo Sapiens
SRSFDLYDP

SEQ ID NO: 565174 - protein, 9 aa, Homo Sapiens
FPVGLGKLS

SEQ ID NO: 565175 - protein, 9 aa, Homo Sapiens
HSLDIRKFT

SEQ ID NO: 565176 - protein, 9 aa, Homo Sapiens
PFPEEAILN

SEQ ID NO: 565177 - protein, 9 aa, Homo Sapiens
ANHLEALAA

SEQ ID NO: 565178 - protein, 9 aa, Homo Sapiens
DRDWNPHQD

SEQ ID NO: 565179 - protein, 9 aa, Homo Sapiens
LDYLCCLPK

SEQ ID NO: 565180 - protein, 9 aa, Homo Sapiens
IPNAGDANK

SEQ ID NO: 565181 - protein, 9 aa, Homo Sapiens
LGTMCVMNM

SEQ ID NO: 565182 - protein, 9 aa, Homo Sapiens
HSLFIREFI

SEQ ID NO: 565183 - protein, 9 aa, Homo Sapiens
QVPMAPGQE

SEQ ID NO: 565184 - protein, 9 aa, Homo Sapiens
IVGIDSRSF

SEQ ID NO: 565185 - protein, 9 aa, Homo Sapiens
KAGVNYNMQ

SEQ ID NO: 565186 - protein, 9 aa, Homo Sapiens
MGFPRRNIE

SEQ ID NO: 565187 - protein, 9 aa, Homo Sapiens
PYTYNGIFT

SEQ ID NO: 565188 - protein, 9 aa, Homo Sapiens
HGHGVCDCN

SEQ ID NO: 565189 - protein, 9 aa, Homo Sapiens
GDANKAIKQ

SEQ ID NO: 565190 - protein, 9 aa, Homo Sapiens
TCVNVITMS

SEQ ID NO: 565191 - protein, 9 aa, Homo Sapiens
FSHFYRRQS

SEQ ID NO: 565192 - protein, 9 aa, Homo Sapiens
QQVPMAPGQ

SEQ ID NO: 565193 - protein, 9 aa, Homo Sapiens
AASWAHRMH

SEQ ID NO: 565194 - protein, 9 aa, Homo Sapiens
ITCVNVITM

SEQ ID NO: 565195 - protein, 9 aa, Homo Sapiens
NANRKPLVI

SEQ ID NO: 565196 - protein, 9 aa, Homo Sapiens
GDLRCEQPC

SEQ ID NO: 565197 - protein, 9 aa, Homo Sapiens
EKLKDEVVK

SEQ ID NO: 565198 - protein, 9 aa, Homo Sapiens
FLLAWRKTG

SEQ ID NO: 565199 - protein, 9 aa, Homo Sapiens
GSMMSLNHE

SEQ ID NO: 565200 - protein, 9 aa, Homo Sapiens
LFTREFILE

SEQ ID NO: 565201 - protein, 9 aa, Homo Sapiens
TLTLSPAAV

SEQ ID NO: 565202 - protein, 9 aa, Homo Sapiens
ERAMKILCA

SEQ ID NO: 565203 - protein, 9 aa, Homo Sapiens
RQNSNPGHA

SEQ ID NO: 565204 - protein, 9 aa, Homo Sapiens
LATIMSGSM

SEQ ID NO: 565205 - protein, 9 aa, Homo Sapiens
HGVCDCNRH

SEQ ID NO: 565206 - protein, 9 aa, Homo Sapiens
ATAEPHYTA

SEQ ID NO: 565207 - protein, 9 aa, Homo Sapiens
GKLWTAAHS

SEQ ID NO: 565208 - protein, 9 aa, Homo Sapiens
SVNRFDQLC

SEQ ID NO: 565209 - protein, 9 aa, Homo Sapiens
SVYCVAAIL

SEQ ID NO: 565210 - protein, 9 aa, Homo Sapiens
ASFARMSTD

SEQ ID NO: 565211 - protein, 9 aa, Homo Sapiens
MMSLNHEAP

SEQ ID NO: 565212 - protein, 9 aa, Homo Sapiens
KRAANHLEA

SEQ ID NO: 565213 - protein, 9 aa, Homo Sapiens
LTCSDISVS

SEQ ID NO: 565214 - protein, 9 aa, Homo Sapiens
HQNKILSLV

SEQ ID NO: 565215 - protein, 9 aa, Homo Sapiens
SFDLYDPPP

SEQ ID NO: 565216 - protein, 9 aa, Homo Sapiens
SFFFFFFFF

SEQ ID NO: 565217 - protein, 9 aa, Homo Sapiens
ATEAKEKAK

SEQ ID NO: 565218 - protein, 9 aa, Homo Sapiens
QSTSYRNEL

SEQ ID NO: 565219 - protein, 9 aa, Homo Sapiens
SAHLSASTP

SEQ ID NO: 565220 - protein, 9 aa, Homo Sapiens
NSNPGHAGP

SEQ ID NO: 565221 - protein, 9 aa, Homo Sapiens
AWTGIALLY

SEQ ID NO: 565222 - protein, 9 aa, Homo Sapiens
PAAVPTLGP

SEQ ID NO: 565223 - protein, 9 aa, Homo Sapiens
DGSSVKAGV

SEQ ID NO: 565224 - protein, 9 aa, Homo Sapiens
CEQPCFKSD

SEQ ID NO: 565225 - protein, 9 aa, Homo Sapiens
AGVNYNMQV

SEQ ID NO: 565226 - protein, 9 aa, Homo Sapiens
VVHLTDLVL

SEQ ID NO: 565227 - protein, 9 aa, Homo Sapiens
QLLPSDGIS

SEQ ID NO: 565228 - protein, 9 aa, Homo Sapiens
TVVHLTDLV

SEQ ID NO: 565229 - protein, 9 aa, Homo Sapiens
SSLWTLPHS

SEQ ID NO: 565230 - protein, 9 aa, Homo Sapiens
RLENPQVWI

SEQ ID NO: 565231 - protein, 9 aa, Homo Sapiens
VPVPEPYTY

SEQ ID NO: 565232 - protein, 9 aa, Homo Sapiens
MGGCVSQWK

SEQ ID NO: 565233 - protein, 9 aa, Homo Sapiens
LLCPMSHVL

SEQ ID NO: 565234 - protein, 9 aa, Homo Sapiens
PVRGGDGAP

SEQ ID NO: 565235 - protein, 9 aa, Homo Sapiens
EFILEKNLM

SEQ ID NO: 565236 - protein, 9 aa, Homo Sapiens
GKVVYLTAT

SEQ ID NO: 565237 - protein, 9 aa, Homo Sapiens
MSHVLFRAI

SEQ ID NO: 565238 - protein, 9 aa, Homo Sapiens
LRRATQHPG

SEQ ID NO: 565239 - protein, 9 aa, Homo Sapiens
PYYSIKWYE

SEQ ID NO: 565240 - protein, 9 aa, Homo Sapiens
ETATEAKEK

SEQ ID NO: 565241 - protein, 9 aa, Homo Sapiens
KSLMNATNV

SEQ ID NO: 565242 - protein, 9 aa, Homo Sapiens
AILWTAAKF

SEQ ID NO: 565243 - protein, 9 aa, Homo Sapiens
SLDIRKFTL

SEQ ID NO: 565244 - protein, 9 aa, Homo Sapiens
VNMLCTPKG

SEQ ID NO: 565245 - protein, 9 aa, Homo Sapiens
FARMSTDEC

SEQ ID NO: 565246 - protein, 9 aa, Homo Sapiens
EAASWAHRM

SEQ ID NO: 565247 - protein, 9 aa, Homo Sapiens
TVRTASESS

SEQ ID NO: 565248 - protein, 9 aa, Homo Sapiens
CNRHCYCEE

SEQ ID NO: 565249 - protein, 9 aa, Homo Sapiens
HYRHVSGVP

SEQ ID NO: 565250 - protein, 9 aa, Homo Sapiens
TNVGNSLDT

SEQ ID NO: 565251 - protein, 9 aa, Homo Sapiens
HFYRRQSNL

SEQ ID NO: 565252 - protein, 9 aa, Homo Sapiens
MKILCAKLR

SEQ ID NO: 565253 - protein, 9 aa, Homo Sapiens
KCMSEQSLS

SEQ ID NO: 565254 - protein, 9 aa, Homo Sapiens
FQSLLVAVN

SEQ ID NO: 565255 - protein, 9 aa, Homo Sapiens
GDNPPPHTS

SEQ ID NO: 565256 - protein, 9 aa, Homo Sapiens
TTCVDIRWQ

SEQ ID NO: 565257 - protein, 9 aa, Homo Sapiens
VQLMEMGFP

SEQ ID NO: 565258 - protein, 9 aa, Homo Sapiens
LVYGMVSYL

SEQ ID NO: 565259 - protein, 9 aa, Homo Sapiens
ENPQVWIDA

SEQ ID NO: 565260 - protein, 9 aa, Homo Sapiens
TRLENPQVW

SEQ ID NO: 565261 - protein, 9 aa, Homo Sapiens
FILEKNLMN

SEQ ID NO: 565262 - protein, 9 aa, Homo Sapiens
SNLRVPCAA

SEQ ID NO: 565263 - protein, 9 aa, Homo Sapiens
SLLVAVNRT

SEQ ID NO: 565264 - protein, 9 aa, Homo Sapiens
MSEQSLSRA

SEQ ID NO: 565265 - protein, 9 aa, Homo Sapiens
GIKSKVLPL

SEQ ID NO: 565266 - protein, 9 aa, Homo Sapiens
MNATNVGNS

SEQ ID NO: 565267 - protein, 9 aa, Homo Sapiens
EPKGSIGFP

SEQ ID NO: 565268 - protein, 9 aa, Homo Sapiens
TSRSLDQSP

SEQ ID NO: 565269 - protein, 9 aa, Homo Sapiens
AYGSSFYAL

SEQ ID NO: 565270 - protein, 9 aa, Homo Sapiens
ISAFSVGST

SEQ ID NO: 565271 - protein, 9 aa, Homo Sapiens
MPYPSKSNH

SEQ ID NO: 565272 - protein, 9 aa, Homo Sapiens
VSLPELEDW

SEQ ID NO: 565273 - protein, 9 aa, Homo Sapiens
GTARAREAV

SEQ ID NO: 565274 - protein, 9 aa, Homo Sapiens
GTLQYTAPE

SEQ ID NO: 565275 - protein, 9 aa, Homo Sapiens
KTGQQVEPE

SEQ ID NO: 565276 - protein, 9 aa, Homo Sapiens
ALAAGGAGE

SEQ ID NO: 565277 - protein, 9 aa, Homo Sapiens
EAQKLLEVK

SEQ ID NO: 565278 - protein, 9 aa, Homo Sapiens
ARASPAPGS

SEQ ID NO: 565279 - protein, 9 aa, Homo Sapiens
SSPVATLPP

SEQ ID NO: 565280 - protein, 9 aa, Homo Sapiens
SAASVCGHW

SEQ ID NO: 565281 - protein, 9 aa, Homo Sapiens
GEELLQGNS

SEQ ID NO: 565282 - protein, 9 aa, Homo Sapiens
PQGGSVPSG

SEQ ID NO: 565283 - protein, 9 aa, Homo Sapiens
MDYWGTMIP

SEQ ID NO: 565284 - protein, 9 aa, Homo Sapiens
LMEQASSWE

SEQ ID NO: 565285 - protein, 9 aa, Homo Sapiens
AWLAASLPS

SEQ ID NO: 565286 - protein, 9 aa, Homo Sapiens
LVAHEARGL

SEQ ID NO: 565287 - protein, 9 aa, Homo Sapiens
PGAPQGGSV

SEQ ID NO: 565288 - protein, 9 aa, Homo Sapiens
LGAREGLIV

SEQ ID NO: 565289 - protein, 9 aa, Homo Sapiens
GHKIHWIES

SEQ ID NO: 565290 - protein, 9 aa, Homo Sapiens
DPLVQGGQG

SEQ ID NO: 565291 - protein, 9 aa, Homo Sapiens
EKAHVASPG

SEQ ID NO: 565292 - protein, 9 aa, Homo Sapiens
LGLLRGNKL

SEQ ID NO: 565293 - protein, 9 aa, Homo Sapiens
ASAVPRPQR

SEQ ID NO: 565294 - protein, 9 aa, Homo Sapiens
PFGSMNSSA

SEQ ID NO: 565295 - protein, 9 aa, Homo Sapiens
AAENSAPGT

SEQ ID NO: 565296 - protein, 9 aa, Homo Sapiens
LLQGNSSQG

SEQ ID NO: 565297 - protein, 9 aa, Homo Sapiens
CWRTARSCC

SEQ ID NO: 565298 - protein, 9 aa, Homo Sapiens
RKTGQQVEP

SEQ ID NO: 565299 - protein, 9 aa, Homo Sapiens
AAHMSASTG

SEQ ID NO: 565300 - protein, 9 aa, Homo Sapiens
KSLNESEAL

SEQ ID NO: 565301 - protein, 9 aa, Homo Sapiens
EVLGLLRGN

SEQ ID NO: 565302 - protein, 9 aa, Homo Sapiens
QGGLDLALS

SEQ ID NO: 565303 - protein, 9 aa, Homo Sapiens
NLAYDNGIN

SEQ ID NO: 565304 - protein, 9 aa, Homo Sapiens
VQVSAGPLA

SEQ ID NO: 565305 - protein, 9 aa, Homo Sapiens
EDTVLLQPN

SEQ ID NO: 565306 - protein, 9 aa, Homo Sapiens
CGTLQYTAP

SEQ ID NO: 565307 - protein, 9 aa, Homo Sapiens
SVILRIGKR

SEQ ID NO: 565308 - protein, 9 aa, Homo Sapiens
GYHVAFLEA

SEQ ID NO: 565309 - protein, 9 aa, Homo Sapiens
PAPGSSVLW

SEQ ID NO: 565310 - protein, 9 aa, Homo Sapiens
RRQVEEKHN

SEQ ID NO: 565311 - protein, 9 aa, Homo Sapiens
YNNILPYEA

SEQ ID NO: 565312 - protein, 9 aa, Homo Sapiens
GNGLSLSFR

SEQ ID NO: 565313 - protein, 9 aa, Homo Sapiens
EGHKIHWIE

SEQ ID NO: 565314 - protein, 9 aa, Homo Sapiens
VRAWGLLPQ

SEQ ID NO: 565315 - protein, 9 aa, Homo Sapiens
IWALSVILR

SEQ ID NO: 565316 - protein, 9 aa, Homo Sapiens
ELPKKMAKR

SEQ ID NO: 565317 - protein, 9 aa, Homo Sapiens
AQPGALRGK

SEQ ID NO: 565318 - protein, 9 aa, Homo Sapiens
PLIKLSGAH

SEQ ID NO: 565319 - protein, 9 aa, Homo Sapiens
LPSPAASRW

SEQ ID NO: 565320 - protein, 9 aa, Homo Sapiens
QRLVEGQAA

SEQ ID NO: 565321 - protein, 9 aa, Homo Sapiens
CCGYVEHVL

SEQ ID NO: 565322 - protein, 9 aa, Homo Sapiens
MAWQVSLPE

SEQ ID NO: 565323 - protein, 9 aa, Homo Sapiens
WPSLSLSAP

SEQ ID NO: 565324 - protein, 9 aa, Homo Sapiens
AAFTLTSRT

SEQ ID NO: 565325 - protein, 9 aa, Homo Sapiens
LSLSRLKFM

SEQ ID NO: 565326 - protein, 9 aa, Homo Sapiens
CKVCPSWLS

SEQ ID NO: 565327 - protein, 9 aa, Homo Sapiens
QRASSAQVR

SEQ ID NO: 565328 - protein, 9 aa, Homo Sapiens
AEGALVGPL

SEQ ID NO: 565329 - protein, 9 aa, Homo Sapiens
DSLAEQGLP

SEQ ID NO: 565330 - protein, 9 aa, Homo Sapiens
ASGTRWRVR

SEQ ID NO: 565331 - protein, 9 aa, Homo Sapiens
LGRINQGTA

SEQ ID NO: 565332 - protein, 9 aa, Homo Sapiens
LDLALSSVS

SEQ ID NO: 565333 - protein, 9 aa, Homo Sapiens
NTAAENSAP

SEQ ID NO: 565334 - protein, 9 aa, Homo Sapiens
QKDKPGVFT

SEQ ID NO: 565335 - protein, 9 aa, Homo Sapiens
GGPSTLRMV

SEQ ID NO: 565336 - protein, 9 aa, Homo Sapiens
GTLALGSPS

SEQ ID NO: 565337 - protein, 9 aa, Homo Sapiens
IRDQPTGRQ

SEQ ID NO: 565338 - protein, 9 aa, Homo Sapiens
PRSSASTAW

SEQ ID NO: 565339 - protein, 9 aa, Homo Sapiens
REGHAAVSA

SEQ ID NO: 565340 - protein, 9 aa, Homo Sapiens
NSRYLNEKA

SEQ ID NO: 565341 - protein, 9 aa, Homo Sapiens
SHPGHRGHG

SEQ ID NO: 565342 - protein, 9 aa, Homo Sapiens
SLSRLKFMH

SEQ ID NO: 565343 - protein, 9 aa, Homo Sapiens
KHCERTHGP

SEQ ID NO: 565344 - protein, 9 aa, Homo Sapiens
RGAWPTWWR

SEQ ID NO: 565345 - protein, 9 aa, Homo Sapiens
DRTKKGQEE

SEQ ID NO: 565346 - protein, 9 aa, Homo Sapiens
CGMFVICNT

SEQ ID NO: 565347 - protein, 9 aa, Homo Sapiens
ALATSHRTK

SEQ ID NO: 565348 - protein, 9 aa, Homo Sapiens
QQAGIPVYL

SEQ ID NO: 565349 - protein, 9 aa, Homo Sapiens
GHRGHGGTA

SEQ ID NO: 565350 - protein, 9 aa, Homo Sapiens
LPYEATRVK

SEQ ID NO: 565351 - protein, 9 aa, Homo Sapiens
EKKAAQAVN

SEQ ID NO: 565352 - protein, 9 aa, Homo Sapiens
TAWLAASLP

SEQ ID NO: 565353 - protein, 9 aa, Homo Sapiens
RGHGGTARA

SEQ ID NO: 565354 - protein, 9 aa, Homo Sapiens
QPTAPRNSK

SEQ ID NO: 565355 - protein, 9 aa, Homo Sapiens
RCWRTARSC

SEQ ID NO: 565356 - protein, 9 aa, Homo Sapiens
SSTGWVAQT

SEQ ID NO: 565357 - protein, 9 aa, Homo Sapiens
SPGYLNRIH

SEQ ID NO: 565358 - protein, 9 aa, Homo Sapiens
HCERTHGPL

SEQ ID NO: 565359 - protein, 9 aa, Homo Sapiens
YHVAFLEAD

SEQ ID NO: 565360 - protein, 9 aa, Homo Sapiens
GGPGVGLVA

SEQ ID NO: 565361 - protein, 9 aa, Homo Sapiens
GPLARVQAP

SEQ ID NO: 565362 - protein, 9 aa, Homo Sapiens
RTHGPLSKL

SEQ ID NO: 565363 - protein, 9 aa, Homo Sapiens
SSGASSPHG

SEQ ID NO: 565364 - protein, 9 aa, Homo Sapiens
DSTCLSSSS

SEQ ID NO: 565365 - protein, 9 aa, Homo Sapiens
EVQMKRVGP

SEQ ID NO: 565366 - protein, 9 aa, Homo Sapiens
GLRRFRTIE

SEQ ID NO: 565367 - protein, 9 aa, Homo Sapiens
FPEYLTNKT

SEQ ID NO: 565368 - protein, 9 aa, Homo Sapiens
TSIFPPTRA

SEQ ID NO: 565369 - protein, 9 aa, Homo Sapiens
TSICYCAWC

SEQ ID NO: 565370 - protein, 9 aa, Homo Sapiens
FFTMIFAIF

SEQ ID NO: 565371 - protein, 9 aa, Homo Sapiens
GGDRAVRAG

SEQ ID NO: 565372 - protein, 9 aa, Homo Sapiens
ERPLAGVQR

SEQ ID NO: 565373 - protein, 9 aa, Homo Sapiens
EKHNEEIQF

SEQ ID NO: 565374 - protein, 9 aa, Homo Sapiens
AVHVALVFA

SEQ ID NO: 565375 - protein, 9 aa, Homo Sapiens
RDCTPSTES

SEQ ID NO: 565376 - protein, 9 aa, Homo Sapiens
PARASPAPG

SEQ ID NO: 565377 - protein, 9 aa, Homo Sapiens
CGHWGILLL

SEQ ID NO: 565378 - protein, 9 aa, Homo Sapiens
IIFPHQPLS

SEQ ID NO: 565379 - protein, 9 aa, Homo Sapiens
CCNTMRGTT

SEQ ID NO: 565380 - protein, 9 aa, Homo Sapiens
VTSPGCAAC

SEQ ID NO: 565381 - protein, 9 aa, Homo Sapiens
LALGSPSVS

SEQ ID NO: 565382 - protein, 9 aa, Homo Sapiens
DIIFPHQPL

SEQ ID NO: 565383 - protein, 9 aa, Homo Sapiens
CARNLLSTS

SEQ ID NO: 565384 - protein, 9 aa, Homo Sapiens
VGPLARVQA

SEQ ID NO: 565385 - protein, 9 aa, Homo Sapiens
SPAPGSSVL

SEQ ID NO: 565386 - protein, 9 aa, Homo Sapiens
APEDTVLLQ

SEQ ID NO: 565387 - protein, 9 aa, Homo Sapiens
STTPSTCSS

SEQ ID NO: 565388 - protein, 9 aa, Homo Sapiens
HMSASTGTE

SEQ ID NO: 565389 - protein, 9 aa, Homo Sapiens
SWRGAWPTW

SEQ ID NO: 565390 - protein, 9 aa, Homo Sapiens
QASSWEKEE

SEQ ID NO: 565391 - protein, 9 aa, Homo Sapiens
GTMSTTPGL

SEQ ID NO: 565392 - protein, 9 aa, Homo Sapiens
SAGGDRAVR

SEQ ID NO: 565393 - protein, 9 aa, Homo Sapiens
PVATLPPHH

SEQ ID NO: 565394 - protein, 9 aa, Homo Sapiens
AADAGRTAV

SEQ ID NO: 565395 - protein, 9 aa, Homo Sapiens
LKQKGYNVK

SEQ ID NO: 565396 - protein, 9 aa, Homo Sapiens
LSLTHKTGM

SEQ ID NO: 565397 - protein, 9 aa, Homo Sapiens
CPGSIRCGR

SEQ ID NO: 565398 - protein, 9 aa, Homo Sapiens
GPLCHAGRP

SEQ ID NO: 565399 - protein, 9 aa, Homo Sapiens
AASHPGHRG

SEQ ID NO: 565400 - protein, 9 aa, Homo Sapiens
FLDLHLRLR

SEQ ID NO: 565401 - protein, 9 aa, Homo Sapiens
RTAARSWRG

SEQ ID NO: 565402 - protein, 9 aa, Homo Sapiens
HKTGMGSGS

SEQ ID NO: 565403 - protein, 9 aa, Homo Sapiens
MVFLPEPGC

SEQ ID NO: 565404 - protein, 9 aa, Homo Sapiens
DAAHMSAST

SEQ ID NO: 565405 - protein, 9 aa, Homo Sapiens
RRNSRYLNE

SEQ ID NO: 565406 - protein, 9 aa, Homo Sapiens
MAAPQIRTM

SEQ ID NO: 565407 - protein, 9 aa, Homo Sapiens
KPDVPEKSE

SEQ ID NO: 565408 - protein, 9 aa, Homo Sapiens
RAWGLLPQL

SEQ ID NO: 565409 - protein, 9 aa, Homo Sapiens
VLSDCKVCP

SEQ ID NO: 565410 - protein, 9 aa, Homo Sapiens
SVLWLSQRP

SEQ ID NO: 565411 - protein, 9 aa, Homo Sapiens
RASCCRTRP

SEQ ID NO: 565412 - protein, 9 aa, Homo Sapiens
IKLFVEQIP

SEQ ID NO: 565413 - protein, 9 aa, Homo Sapiens
GIPVYLKRK

SEQ ID NO: 565414 - protein, 9 aa, Homo Sapiens
QGHASTDQE

SEQ ID NO: 565415 - protein, 9 aa, Homo Sapiens
PGCLRPPPA

SEQ ID NO: 565416 - protein, 9 aa, Homo Sapiens
EELSQEGGA

SEQ ID NO: 565417 - protein, 9 aa, Homo Sapiens
HSELPVAGG

SEQ ID NO: 565418 - protein, 9 aa, Homo Sapiens
KMVGYHVAF

SEQ ID NO: 565419 - protein, 9 aa, Homo Sapiens
VFAQVRRAH

SEQ ID NO: 565420 - protein, 9 aa, Homo Sapiens
GLIVAVHVA

SEQ ID NO: 565421 - protein, 9 aa, Homo Sapiens
DVDRTKKGQ

SEQ ID NO: 565422 - protein, 9 aa, Homo Sapiens
QTESSVTVK

SEQ ID NO: 565423 - protein, 9 aa, Homo Sapiens
TLQYTGERG

SEQ ID NO: 565424 - protein, 9 aa, Homo Sapiens
RAGAADAGR

SEQ ID NO: 565425 - protein, 9 aa, Homo Sapiens
TVKLWDKSI

SEQ ID NO: 565426 - protein, 9 aa, Homo Sapiens
WTRVGFLAC

SEQ ID NO: 565427 - protein, 9 aa, Homo Sapiens
HAAVSALER

SEQ ID NO: 565428 - protein, 9 aa, Homo Sapiens
YRCTFTAGR

SEQ ID NO: 565429 - protein, 9 aa, Homo Sapiens
SVSFLGPPL

SEQ ID NO: 565430 - protein, 9 aa, Homo Sapiens
FEAKIGQGT

SEQ ID NO: 565431 - protein, 9 aa, Homo Sapiens
CPCAPTASA

SEQ ID NO: 565432 - protein, 9 aa, Homo Sapiens
RVVSQWYTS

SEQ ID NO: 565433 - protein, 9 aa, Homo Sapiens
TFLELADPL

SEQ ID NO: 565434 - protein, 9 aa, Homo Sapiens
PASGAASHP

SEQ ID NO: 565435 - protein, 9 aa, Homo Sapiens
AKASTHEVQ

SEQ ID NO: 565436 - protein, 9 aa, Homo Sapiens
CGPASQSAL

SEQ ID NO: 565437 - protein, 9 aa, Homo Sapiens
QPTGRQVRI

SEQ ID NO: 565438 - protein, 9 aa, Homo Sapiens
LLLPAAPSW

SEQ ID NO: 565439 - protein, 9 aa, Homo Sapiens
RRFRTIELN

SEQ ID NO: 565440 - protein, 9 aa, Homo Sapiens
NGEILLSPE

SEQ ID NO: 565441 - protein, 9 aa, Homo Sapiens
SSAPPAATD

SEQ ID NO: 565442 - protein, 9 aa, Homo Sapiens
PGSSVLWLS

SEQ ID NO: 565443 - protein, 9 aa, Homo Sapiens
VQRLVLGQI

SEQ ID NO: 565444 - protein, 9 aa, Homo Sapiens
DVSTGKVTL

SEQ ID NO: 565445 - protein, 9 aa, Homo Sapiens
VLFTFKGVI

SEQ ID NO: 565446 - protein, 9 aa, Homo Sapiens
SELPVAGGA

SEQ ID NO: 565447 - protein, 9 aa, Homo Sapiens
LREGHAAVS

SEQ ID NO: 565448 - protein, 9 aa, Homo Sapiens
RKGPLASVD

SEQ ID NO: 565449 - protein, 9 aa, Homo Sapiens
YDCGMFVIC

SEQ ID NO: 565450 - protein, 9 aa, Homo Sapiens
KIELPKKMA

SEQ ID NO: 565451 - protein, 9 aa, Homo Sapiens
RVEALPTPA

SEQ ID NO: 565452 - protein, 9 aa, Homo Sapiens
PQWECELEL

SEQ ID NO: 565453 - protein, 9 aa, Homo Sapiens
GNKLSTIQS

SEQ ID NO: 565454 - protein, 9 aa, Homo Sapiens
GAQPGALRG

SEQ ID NO: 565455 - protein, 9 aa, Homo Sapiens
HPPSEITAS

SEQ ID NO: 565456 - protein, 9 aa, Homo Sapiens
APSWLCLEW

SEQ ID NO: 565457 - protein, 9 aa, Homo Sapiens
SSSRCHDSV

SEQ ID NO: 565458 - protein, 9 aa, Homo Sapiens
NYAFEKPDV

SEQ ID NO: 565459 - protein, 9 aa, Homo Sapiens
VKMVGYHVA

SEQ ID NO: 565460 - protein, 9 aa, Homo Sapiens
PLPLLKGVP

SEQ ID NO: 565461 - protein, 9 aa, Homo Sapiens
CCPGSIRCG

SEQ ID NO: 565462 - protein, 9 aa, Homo Sapiens
FTERKECTP

SEQ ID NO: 565463 - protein, 9 aa, Homo Sapiens
STGTTSASA

SEQ ID NO: 565464 - protein, 9 aa, Homo Sapiens
RIPVARVEA

SEQ ID NO: 565465 - protein, 9 aa, Homo Sapiens
PSGPPISAF

SEQ ID NO: 565466 - protein, 9 aa, Homo Sapiens
KAHVASPGD

SEQ ID NO: 565467 - protein, 9 aa, Homo Sapiens
STLLRSSSA

SEQ ID NO: 565468 - protein, 9 aa, Homo Sapiens
MPASLGRIN

SEQ ID NO: 565469 - protein, 9 aa, Homo Sapiens
LGLRGAARR

SEQ ID NO: 565470 - protein, 9 aa, Homo Sapiens
KEGILNRYV

SEQ ID NO: 565471 - protein, 9 aa, Homo Sapiens
DKSIRECVH

SEQ ID NO: 565472 - protein, 9 aa, Homo Sapiens
ALVAQQRQR

SEQ ID NO: 565473 - protein, 9 aa, Homo Sapiens
VLGLLRGNK

SEQ ID NO: 565474 - protein, 9 aa, Homo Sapiens
WRATSARCW

SEQ ID NO: 565475 - protein, 9 aa, Homo Sapiens
TVSRSCSTL

SEQ ID NO: 565476 - protein, 9 aa, Homo Sapiens
ERTHGPLSK

SEQ ID NO: 565477 - protein, 9 aa, Homo Sapiens
DTGQASAGG

SEQ ID NO: 565478 - protein, 9 aa, Homo Sapiens
STCSSVARV

SEQ ID NO: 565479 - protein, 9 aa, Homo Sapiens
KSAEAKHQW

SEQ ID NO: 565480 - protein, 9 aa, Homo Sapiens
SYDCGMFVI

SEQ ID NO: 565481 - protein, 9 aa, Homo Sapiens
TRGCCGYVE

SEQ ID NO: 565482 - protein, 9 aa, Homo Sapiens
TEMQESFVR

SEQ ID NO: 565483 - protein, 9 aa, Homo Sapiens
ASPAPGSSV

SEQ ID NO: 565484 - protein, 9 aa, Homo Sapiens
RMKFFKRYL

SEQ ID NO: 565485 - protein, 9 aa, Homo Sapiens
LSQRPSLAV

SEQ ID NO: 565486 - protein, 9 aa, Homo Sapiens
QIQNTAAEN

SEQ ID NO: 565487 - protein, 9 aa, Homo Sapiens
IFPPTRANR

SEQ ID NO: 565488 - protein, 9 aa, Homo Sapiens
RGGDKWVFS

SEQ ID NO: 565489 - protein, 9 aa, Homo Sapiens
LTSRTRSRL

SEQ ID NO: 565490 - protein, 9 aa, Homo Sapiens
KKAQLMYLS

SEQ ID NO: 565491 - protein, 9 aa, Homo Sapiens
PEQTASEQE

SEQ ID NO: 565492 - protein, 9 aa, Homo Sapiens
SLPELEDWL

SEQ ID NO: 565493 - protein, 9 aa, Homo Sapiens
GAHLVDDSD

SEQ ID NO: 565494 - protein, 9 aa, Homo Sapiens
EKNYAFEKP

SEQ ID NO: 565495 - protein, 9 aa, Homo Sapiens
VFLPEPGCL

SEQ ID NO: 565496 - protein, 9 aa, Homo Sapiens
KAAQAVNRK

SEQ ID NO: 565497 - protein, 9 aa, Homo Sapiens
TCSSVARVA

SEQ ID NO: 565498 - protein, 9 aa, Homo Sapiens
ASAASVCGH

SEQ ID NO: 565499 - protein, 9 aa, Homo Sapiens
EQPDSCQAY

SEQ ID NO: 565500 - protein, 9 aa, Homo Sapiens
HLVDDSDPD

SEQ ID NO: 565501 - protein, 9 aa, Homo Sapiens
SSSTGWVAQ

SEQ ID NO: 565502 - protein, 9 aa, Homo Sapiens
GPLASVDAL

SEQ ID NO: 565503 - protein, 9 aa, Homo Sapiens
LNESEALPE

SEQ ID NO: 565504 - protein, 9 aa, Homo Sapiens
VHAGPLCHA

SEQ ID NO: 565505 - protein, 9 aa, Homo Sapiens
PSTGTTSAS

SEQ ID NO: 565506 - protein, 9 aa, Homo Sapiens
AALREVLDP

SEQ ID NO: 565507 - protein, 9 aa, Homo Sapiens
RVFTRDSTC

SEQ ID NO: 565508 - protein, 9 aa, Homo Sapiens
VVSQWYTSA

SEQ ID NO: 565509 - protein, 9 aa, Homo Sapiens
GPEELSQEG

SEQ ID NO: 565510 - protein, 9 aa, Homo Sapiens
LNRYVDREF

SEQ ID NO: 565511 - protein, 9 aa, Homo Sapiens
LVQGGQGGL

SEQ ID NO: 565512 - protein, 9 aa, Homo Sapiens
SFWLRMVSF

SEQ ID NO: 565513 - protein, 9 aa, Homo Sapiens
RATSARCWR

SEQ ID NO: 565514 - protein, 9 aa, Homo Sapiens
GRRAGKGLA

SEQ ID NO: 565515 - protein, 9 aa, Homo Sapiens
VWLEELRRL

SEQ ID NO: 565516 - protein, 9 aa, Homo Sapiens
RYLEKYESS

SEQ ID NO: 565517 - protein, 9 aa, Homo Sapiens
RWRVRASFL

SEQ ID NO: 565518 - protein, 9 aa, Homo Sapiens
ERKECTPSC

SEQ ID NO: 565519 - protein, 9 aa, Homo Sapiens
REAVHAGPL

SEQ ID NO: 565520 - protein, 9 aa, Homo Sapiens
FSVLSQGHA

SEQ ID NO: 565521 - protein, 9 aa, Homo Sapiens
PPISAFSVG

SEQ ID NO: 565522 - protein, 9 aa, Homo Sapiens
CLSSSSILL

SEQ ID NO: 565523 - protein, 9 aa, Homo Sapiens
DVSKHKWNL

SEQ ID NO: 565524 - protein, 9 aa, Homo Sapiens
RWQLDKSKP

SEQ ID NO: 565525 - protein, 9 aa, Homo Sapiens
QGGQGGLDL

SEQ ID NO: 565526 - protein, 9 aa, Homo Sapiens
HGPAWARAT

SEQ ID NO: 565527 - protein, 9 aa, Homo Sapiens
ASSPHGTLA

SEQ ID NO: 565528 - protein, 9 aa, Homo Sapiens
SELPLASSH

SEQ ID NO: 565529 - protein, 9 aa, Homo Sapiens
DAGRTAVTS

SEQ ID NO: 565530 - protein, 9 aa, Homo Sapiens
LSLSFRRPL

SEQ ID NO: 565531 - protein, 9 aa, Homo Sapiens
GKPFPKTTS

SEQ ID NO: 565532 - protein, 9 aa, Homo Sapiens
KKGQEEEED

SEQ ID NO: 565533 - protein, 9 aa, Homo Sapiens
AVWTRVGFL

SEQ ID NO: 565534 - protein, 9 aa, Homo Sapiens
GILNRYVDR

SEQ ID NO: 565535 - protein, 9 aa, Homo Sapiens
APCLRRPLL

SEQ ID NO: 565536 - protein, 9 aa, Homo Sapiens
STGYSGLDT

SEQ ID NO: 565537 - protein, 9 aa, Homo Sapiens
VRDRSPMVF

SEQ ID NO: 565538 - protein, 9 aa, Homo Sapiens
RFRLVAGLL

SEQ ID NO: 565539 - protein, 9 aa, Homo Sapiens
PEPGCLRPP

SEQ ID NO: 565540 - protein, 9 aa, Homo Sapiens
PRVVSQWYT

SEQ ID NO: 565541 - protein, 9 aa, Homo Sapiens
SAGPLAYAR

SEQ ID NO: 565542 - protein, 9 aa, Homo Sapiens
GGLRRFRTI

SEQ ID NO: 565543 - protein, 9 aa, Homo Sapiens
RSRLPLSSS

SEQ ID NO: 565544 - protein, 9 aa, Homo Sapiens
SFCCSTVSR

SEQ ID NO: 565545 - protein, 9 aa, Homo Sapiens
SVSVQVSAG

SEQ ID NO: 565546 - protein, 9 aa, Homo Sapiens
TAPSLRSFP

SEQ ID NO: 565547 - protein, 9 aa, Homo Sapiens
QPRVVSQWY

SEQ ID NO: 565548 - protein, 9 aa, Homo Sapiens
GSSRSVRFT

SEQ ID NO: 565549 - protein, 9 aa, Homo Sapiens
WLSVSAAGV

SEQ ID NO: 565550 - protein, 9 aa, Homo Sapiens
PLARVHALV

SEQ ID NO: 565551 - protein, 9 aa, Homo Sapiens
RCHDSVVSM

SEQ ID NO: 565552 - protein, 9 aa, Homo Sapiens
VRNEMQKLH

SEQ ID NO: 565553 - protein, 9 aa, Homo Sapiens
RAREAVHAG

SEQ ID NO: 565554 - protein, 9 aa, Homo Sapiens
TFIRRNSRY

SEQ ID NO: 565555 - protein, 9 aa, Homo Sapiens
GIGRGAVPS

SEQ ID NO: 565556 - protein, 9 aa, Homo Sapiens
LSSSSILLC

SEQ ID NO: 565557 - protein, 9 aa, Homo Sapiens
YRIAGVGID

SEQ ID NO: 565558 - protein, 9 aa, Homo Sapiens
CAAVGVGLP

SEQ ID NO: 565559 - protein, 9 aa, Homo Sapiens
SEARNTDTG

SEQ ID NO: 565560 - protein, 9 aa, Homo Sapiens
LWISYSFMM

SEQ ID NO: 565561 - protein, 9 aa, Homo Sapiens
SGASSPHGT

SEQ ID NO: 565562 - protein, 9 aa, Homo Sapiens
PDGKSGRAT

SEQ ID NO: 565563 - protein, 9 aa, Homo Sapiens
VQAPVLLEC

SEQ ID NO: 565564 - protein, 9 aa, Homo Sapiens
WAPAPRRQR

SEQ ID NO: 565565 - protein, 9 aa, Homo Sapiens
AAGHSELPV

SEQ ID NO: 565566 - protein, 9 aa, Homo Sapiens
SLESYGTSI

SEQ ID NO: 565567 - protein, 9 aa, Homo Sapiens
IQNTAAENS

SEQ ID NO: 565568 - protein, 9 aa, Homo Sapiens
PQIRTMLSS

SEQ ID NO: 565569 - protein, 9 aa, Homo Sapiens
ICPRDDSNC

SEQ ID NO: 565570 - protein, 9 aa, Homo Sapiens
RFRPWRSRF

SEQ ID NO: 565571 - protein, 9 aa, Homo Sapiens
STAWLAASL

SEQ ID NO: 565572 - protein, 9 aa, Homo Sapiens
LEWIGGLGK

SEQ ID NO: 565573 - protein, 9 aa, Homo Sapiens
SRSLDQSPG

SEQ ID NO: 565574 - protein, 9 aa, Homo Sapiens
EEGTELQAT

SEQ ID NO: 565575 - protein, 9 aa, Homo Sapiens
RASFLTRPA

SEQ ID NO: 565576 - protein, 9 aa, Homo Sapiens
ERINPELKQ

SEQ ID NO: 565577 - protein, 9 aa, Homo Sapiens
RRAGKGLAT

SEQ ID NO: 565578 - protein, 9 aa, Homo Sapiens
ASVCGHWGI

SEQ ID NO: 565579 - protein, 9 aa, Homo Sapiens
DLALSSVSF

SEQ ID NO: 565580 - protein, 9 aa, Homo Sapiens
KSKPTCARN

SEQ ID NO: 565581 - protein, 9 aa, Homo Sapiens
AGVQRLVLG

SEQ ID NO: 565582 - protein, 9 aa, Homo Sapiens
FLPEPGCLR

SEQ ID NO: 565583 - protein, 9 aa, Homo Sapiens
GTEVQMKRV

SEQ ID NO: 565584 - protein, 9 aa, Homo Sapiens
HSVDIAAFN

SEQ ID NO: 565585 - protein, 9 aa, Homo Sapiens
QAGIPVYLK

SEQ ID NO: 565586 - protein, 9 aa, Homo Sapiens
MNQSGMEIP

SEQ ID NO: 565587 - protein, 9 aa, Homo Sapiens
GLGKVCGTK

SEQ ID NO: 565588 - protein, 9 aa, Homo Sapiens
VTEMQESFV

SEQ ID NO: 565589 - protein, 9 aa, Homo Sapiens
PPLLLLPVR

SEQ ID NO: 565590 - protein, 9 aa, Homo Sapiens
EAVPGQQKP

SEQ ID NO: 565591 - protein, 9 aa, Homo Sapiens
SPHPPSEIT

SEQ ID NO: 565592 - protein, 9 aa, Homo Sapiens
GPAEAVPGQ

SEQ ID NO: 565593 - protein, 9 aa, Homo Sapiens
YSGLDTGNG

SEQ ID NO: 565594 - protein, 9 aa, Homo Sapiens
DYRWQLDKS

SEQ ID NO: 565595 - protein, 9 aa, Homo Sapiens
EGALVGPLA

SEQ ID NO: 565596 - protein, 9 aa, Homo Sapiens
IVGPQWECE

SEQ ID NO: 565597 - protein, 9 aa, Homo Sapiens
PVAVEGHKI

SEQ ID NO: 565598 - protein, 9 aa, Homo Sapiens
TSWRRSMKT

SEQ ID NO: 565599 - protein, 9 aa, Homo Sapiens
SSWEKEEQE

SEQ ID NO: 565600 - protein, 9 aa, Homo Sapiens
WARATWAAC

SEQ ID NO: 565601 - protein, 9 aa, Homo Sapiens
QAALGAREG

SEQ ID NO: 565602 - protein, 9 aa, Homo Sapiens
WDKSIRECV

SEQ ID NO: 565603 - protein, 9 aa, Homo Sapiens
VEGQAALGA

SEQ ID NO: 565604 - protein, 9 aa, Homo Sapiens
ASLGRINQG

SEQ ID NO: 565605 - protein, 9 aa, Homo Sapiens
SLWISYSFM

SEQ ID NO: 565606 - protein, 9 aa, Homo Sapiens
APRRQRASS

SEQ ID NO: 565607 - protein, 9 aa, Homo Sapiens
SGAHLVDDS

SEQ ID NO: 565608 - protein, 9 aa, Homo Sapiens
KDPIQDSLA

SEQ ID NO: 565609 - protein, 9 aa, Homo Sapiens
LASSHSFLD

SEQ ID NO: 565610 - protein, 9 aa, Homo Sapiens
IVAVHVALV

SEQ ID NO: 565611 - protein, 9 aa, Homo Sapiens
ALSVILRIG

SEQ ID NO: 565612 - protein, 9 aa, Homo Sapiens
EGLIVAVHV

SEQ ID NO: 565613 - protein, 9 aa, Homo Sapiens
GQHKDKVDR

SEQ ID NO: 565614 - protein, 9 aa, Homo Sapiens
WVAQTPWTM

SEQ ID NO: 565615 - protein, 9 aa, Homo Sapiens
AVPSQHLRA

SEQ ID NO: 565616 - protein, 9 aa, Homo Sapiens
AYRCTFTAG

SEQ ID NO: 565617 - protein, 9 aa, Homo Sapiens
WWRGPKRRR

SEQ ID NO: 565618 - protein, 9 aa, Homo Sapiens
PVVGGPGVG

SEQ ID NO: 565619 - protein, 9 aa, Homo Sapiens
YIGKTMDYW

SEQ ID NO: 565620 - protein, 9 aa, Homo Sapiens
AVTSPGCAA

SEQ ID NO: 565621 - protein, 9 aa, Homo Sapiens
AQAVNRKVE

SEQ ID NO: 565622 - protein, 9 aa, Homo Sapiens
EEMIFGEMK

SEQ ID NO: 565623 - protein, 9 aa, Homo Sapiens
RRYVRGSFL

SEQ ID NO: 565624 - protein, 9 aa, Homo Sapiens
VEEVQGPEV

SEQ ID NO: 565625 - protein, 9 aa, Homo Sapiens
LGIHIVGPQ

SEQ ID NO: 565626 - protein, 9 aa, Homo Sapiens
SAEAKHQWV

SEQ ID NO: 565627 - protein, 9 aa, Homo Sapiens
VQGPEVVGE

SEQ ID NO: 565628 - protein, 9 aa, Homo Sapiens
WLGEELLQG

SEQ ID NO: 565629 - protein, 9 aa, Homo Sapiens
AHMSASTGT

SEQ ID NO: 565630 - protein, 9 aa, Homo Sapiens
ARVEALPTP

SEQ ID NO: 565631 - protein, 9 aa, Homo Sapiens
QNTAAENSA

SEQ ID NO: 565632 - protein, 9 aa, Homo Sapiens
FTRDSTCLS

SEQ ID NO: 565633 - protein, 9 aa, Homo Sapiens
VAVHVALVF

SEQ ID NO: 565634 - protein, 9 aa, Homo Sapiens
QVRAARPAG

SEQ ID NO: 565635 - protein, 9 aa, Homo Sapiens
HLRLRAPCL

SEQ ID NO: 565636 - protein, 9 aa, Homo Sapiens
AKIGQGTEP

SEQ ID NO: 565637 - protein, 9 aa, Homo Sapiens
LSGEKRPDS

SEQ ID NO: 565638 - protein, 9 aa, Homo Sapiens
IELPKKMAK

SEQ ID NO: 565639 - protein, 9 aa, Homo Sapiens
NYIWALSVI

SEQ ID NO: 565640 - protein, 9 aa, Homo Sapiens
EWIGGLGKV

SEQ ID NO: 565641 - protein, 9 aa, Homo Sapiens
PTRANRGGN

SEQ ID NO: 565642 - protein, 9 aa, Homo Sapiens
PSCRFCCWT

SEQ ID NO: 565643 - protein, 9 aa, Homo Sapiens
AVKGKLLEH

SEQ ID NO: 565644 - protein, 9 aa, Homo Sapiens
VLLECAAVG

SEQ ID NO: 565645 - protein, 9 aa, Homo Sapiens
GEALAAGGA

SEQ ID NO: 565646 - protein, 9 aa, Homo Sapiens
PISAFSVGS

SEQ ID NO: 565647 - protein, 9 aa, Homo Sapiens
SRMVSFWLR

SEQ ID NO: 565648 - protein, 9 aa, Homo Sapiens
SPEWLEWIG

SEQ ID NO: 565649 - protein, 9 aa, Homo Sapiens
SFLGKGGFA

SEQ ID NO: 565650 - protein, 9 aa, Homo Sapiens
TPSTESAAA

SEQ ID NO: 565651 - protein, 9 aa, Homo Sapiens
ECTPSCHSD

SEQ ID NO: 565652 - protein, 9 aa, Homo Sapiens
RVAAVSPEW

SEQ ID NO: 565653 - protein, 9 aa, Homo Sapiens
CPRDDSNCS

SEQ ID NO: 565654 - protein, 9 aa, Homo Sapiens
AGPLSAPLL

SEQ ID NO: 565655 - protein, 9 aa, Homo Sapiens
LLRGNKLST

SEQ ID NO: 565656 - protein, 9 aa, Homo Sapiens
GVGLVAEGA

SEQ ID NO: 565657 - protein, 9 aa, Homo Sapiens
AAVSALERP

SEQ ID NO: 565658 - protein, 9 aa, Homo Sapiens
HPGHRGHGG

SEQ ID NO: 565659 - protein, 9 aa, Homo Sapiens
NCSLVSSTE

SEQ ID NO: 565660 - protein, 9 aa, Homo Sapiens
GHWGILLLP

SEQ ID NO: 565661 - protein, 9 aa, Homo Sapiens
ECAAVGVGL

SEQ ID NO: 565662 - protein, 9 aa, Homo Sapiens
KYDVNYAFG

SEQ ID NO: 565663 - protein, 9 aa, Homo Sapiens
ATDAAHMSA

SEQ ID NO: 565664 - protein, 9 aa, Homo Sapiens
GCLRPPPAR

SEQ ID NO: 565665 - protein, 9 aa, Homo Sapiens
WRGAWPTWW

SEQ ID NO: 565666 - protein, 9 aa, Homo Sapiens
HLLQNKWSR

SEQ ID NO: 565667 - protein, 9 aa, Homo Sapiens
CERTEFAEH

SEQ ID NO: 565668 - protein, 9 aa, Homo Sapiens
DGCAQPVPA

SEQ ID NO: 565669 - protein, 9 aa, Homo Sapiens
ACWRATSAR

SEQ ID NO: 565670 - protein, 9 aa, Homo Sapiens
QRRRRKKTC

SEQ ID NO: 565671 - protein, 9 aa, Homo Sapiens
DVEEVQGPE

SEQ ID NO: 565672 - protein, 9 aa, Homo Sapiens
NGLSLSFRR

SEQ ID NO: 565673 - protein, 9 aa, Homo Sapiens
LGEALAAGG

SEQ ID NO: 565674 - protein, 9 aa, Homo Sapiens
QSPGYLNRI

SEQ ID NO: 565675 - protein, 9 aa, Homo Sapiens
KDVSKHKWN

SEQ ID NO: 565676 - protein, 9 aa, Homo Sapiens
TAARSWRGA

SEQ ID NO: 565677 - protein, 9 aa, Homo Sapiens
NSAPGTQQD

SEQ ID NO: 565678 - protein, 9 aa, Homo Sapiens
LESYGTSIF

SEQ ID NO: 565679 - protein, 9 aa, Homo Sapiens
RDDSNCSLV

SEQ ID NO: 565680 - protein, 9 aa, Homo Sapiens
LKGVPASEL

SEQ ID NO: 565681 - protein, 9 aa, Homo Sapiens
SQGHASTDQ

SEQ ID NO: 565682 - protein, 9 aa, Homo Sapiens
AQVRALVAQ

SEQ ID NO: 565683 - protein, 9 aa, Homo Sapiens
GGGLRRFRT

SEQ ID NO: 565684 - protein, 9 aa, Homo Sapiens
RCERTEFAE

SEQ ID NO: 565685 - protein, 9 aa, Homo Sapiens
REVLDPEQN

SEQ ID NO: 565686 - protein, 9 aa, Homo Sapiens
SALGLKGSL

SEQ ID NO: 565687 - protein, 9 aa, Homo Sapiens
LHLRLRAPC

SEQ ID NO: 565688 - protein, 9 aa, Homo Sapiens
TWAACWRAT

SEQ ID NO: 565689 - protein, 9 aa, Homo Sapiens
SRASCCRTR

SEQ ID NO: 565690 - protein, 9 aa, Homo Sapiens
IAGVGIDQP

SEQ ID NO: 565691 - protein, 9 aa, Homo Sapiens
HAAGHSELP

SEQ ID NO: 565692 - protein, 9 aa, Homo Sapiens
KRMKFFKRY

SEQ ID NO: 565693 - protein, 9 aa, Homo Sapiens
PLASVDALV

SEQ ID NO: 565694 - protein, 9 aa, Homo Sapiens
KFFKRYLDY

SEQ ID NO: 565695 - protein, 9 aa, Homo Sapiens
ELRRLYCSR

SEQ ID NO: 565696 - protein, 9 aa, Homo Sapiens
VPRPQRRRR

SEQ ID NO: 565697 - protein, 9 aa, Homo Sapiens
CFFTMIFAI

SEQ ID NO: 565698 - protein, 9 aa, Homo Sapiens
PGVDLLVPL

SEQ ID NO: 565699 - protein, 9 aa, Homo Sapiens
PLLKGVPAS

SEQ ID NO: 565700 - protein, 9 aa, Homo Sapiens
QGWDSLWIS

SEQ ID NO: 565701 - protein, 9 aa, Homo Sapiens
PEDTVLLQP

SEQ ID NO: 565702 - protein, 9 aa, Homo Sapiens
CAWCEAEDL

SEQ ID NO: 565703 - protein, 9 aa, Homo Sapiens
IGGLGKVCG

SEQ ID NO: 565704 - protein, 9 aa, Homo Sapiens
SGLDTGNGL

SEQ ID NO: 565705 - protein, 9 aa, Homo Sapiens
SLSSSRCHD

SEQ ID NO: 565706 - protein, 9 aa, Homo Sapiens
KWVFSTKRV

SEQ ID NO: 565707 - protein, 9 aa, Homo Sapiens
ERRQVEEKH

SEQ ID NO: 565708 - protein, 9 aa, Homo Sapiens
LDQSPGYLN

SEQ ID NO: 565709 - protein, 9 aa, Homo Sapiens
LSFRRPLRL

SEQ ID NO: 565710 - protein, 9 aa, Homo Sapiens
MVGYHVAFL

SEQ ID NO: 565711 - protein, 9 aa, Homo Sapiens
CRTRPARCP

SEQ ID NO: 565712 - protein, 9 aa, Homo Sapiens
KLAYRCTFT

SEQ ID NO: 565713 - protein, 9 aa, Homo Sapiens
MVSFCCSTV

SEQ ID NO: 565714 - protein, 9 aa, Homo Sapiens
SSILLCSRS

SEQ ID NO: 565715 - protein, 9 aa, Homo Sapiens
SRFLRRQSR

SEQ ID NO: 565716 - protein, 9 aa, Homo Sapiens
RRFGQKSAE

SEQ ID NO: 565717 - protein, 9 aa, Homo Sapiens
VSTGKVTLE

SEQ ID NO: 565718 - protein, 9 aa, Homo Sapiens
STGKVTLEY

SEQ ID NO: 565719 - protein, 9 aa, Homo Sapiens
QYVRSRWKL

SEQ ID NO: 565720 - protein, 9 aa, Homo Sapiens
LPEPGCLRP

SEQ ID NO: 565721 - protein, 9 aa, Homo Sapiens
LVFAQVRRA

SEQ ID NO: 565722 - protein, 9 aa, Homo Sapiens
SQWYTSASL

SEQ ID NO: 565723 - protein, 9 aa, Homo Sapiens
FRKQYVRSR

SEQ ID NO: 565724 - protein, 9 aa, Homo Sapiens
FTMIFAIFS

SEQ ID NO: 565725 - protein, 9 aa, Homo Sapiens
GGTARAREA

SEQ ID NO: 565726 - protein, 9 aa, Homo Sapiens
RTKKGQEEE

SEQ ID NO: 565727 - protein, 9 aa, Homo Sapiens
RFGQKSAEA

SEQ ID NO: 565728 - protein, 9 aa, Homo Sapiens
EGHAAVSAL

SEQ ID NO: 565729 - protein, 9 aa, Homo Sapiens
EWLEWIGGL

SEQ ID NO: 565730 - protein, 9 aa, Homo Sapiens
CGTKLAYRC

SEQ ID NO: 565731 - protein, 9 aa, Homo Sapiens
SPGCAACPG

SEQ ID NO: 565732 - protein, 9 aa, Homo Sapiens
SVDALVAHE

SEQ ID NO: 565733 - protein, 9 aa, Homo Sapiens
AGGDRAVRA

SEQ ID NO: 565734 - protein, 9 aa, Homo Sapiens
AHLVDDSDP

SEQ ID NO: 565735 - protein, 9 aa, Homo Sapiens
LQGRRAGKG

SEQ ID NO: 565736 - protein, 9 aa, Homo Sapiens
LERPLAGVQ

SEQ ID NO: 565737 - protein, 9 aa, Homo Sapiens
KNYAFEKPD

SEQ ID NO: 565738 - protein, 9 aa, Homo Sapiens
EEKHNEEIQ

SEQ ID NO: 565739 - protein, 9 aa, Homo Sapiens
LLTSPSTGT

SEQ ID NO: 565740 - protein, 9 aa, Homo Sapiens
GADVLPVVG

SEQ ID NO: 565741 - protein, 9 aa, Homo Sapiens
DRSPMVFLP

SEQ ID NO: 565742 - protein, 9 aa, Homo Sapiens
WSSCRGRCW

SEQ ID NO: 565743 - protein, 9 aa, Homo Sapiens
AQPVPASVP

SEQ ID NO: 565744 - protein, 9 aa, Homo Sapiens
WGTMIPSEA

SEQ ID NO: 565745 - protein, 9 aa, Homo Sapiens
AVRAGAADA

SEQ ID NO: 565746 - protein, 9 aa, Homo Sapiens
DNLLPTLVP

SEQ ID NO: 565747 - protein, 9 aa, Homo Sapiens
SWLSVSAAG

SEQ ID NO: 565748 - protein, 9 aa, Homo Sapiens
FCCWTSGMW

SEQ ID NO: 565749 - protein, 9 aa, Homo Sapiens
DTDLSLTHK

SEQ ID NO: 565750 - protein, 9 aa, Homo Sapiens
TAGRFRPWR

SEQ ID NO: 565751 - protein, 9 aa, Homo Sapiens
AGRFRPWRS

SEQ ID NO: 565752 - protein, 9 aa, Homo Sapiens
LELVSRAVV

SEQ ID NO: 565753 - protein, 9 aa, Homo Sapiens
LARVQAPVL

SEQ ID NO: 565754 - protein, 9 aa, Homo Sapiens
LLKGVPASE

SEQ ID NO: 565755 - protein, 9 aa, Homo Sapiens
LGKVCGTKL

SEQ ID NO: 565756 - protein, 9 aa, Homo Sapiens
TRTLYQYSS

SEQ ID NO: 565757 - protein, 9 aa, Homo Sapiens
VSFWLRMVS

SEQ ID NO: 565758 - protein, 9 aa, Homo Sapiens
LPLSSSTGW

SEQ ID NO: 565759 - protein, 9 aa, Homo Sapiens
TAYLLDNLL

SEQ ID NO: 565760 - protein, 9 aa, Homo Sapiens
AGVGIDQPP

SEQ ID NO: 565761 - protein, 9 aa, Homo Sapiens
GPKRRRRPH

SEQ ID NO: 565762 - protein, 9 aa, Homo Sapiens
HVALVFAQV

SEQ ID NO: 565763 - protein, 9 aa, Homo Sapiens
STGWVAQTP

SEQ ID NO: 565764 - protein, 9 aa, Homo Sapiens
SCCSPSCCQ

SEQ ID NO: 565765 - protein, 9 aa, Homo Sapiens
GGSVPSGIG

SEQ ID NO: 565766 - protein, 9 aa, Homo Sapiens
RQVEEKHNE

SEQ ID NO: 565767 - protein, 9 aa, Homo Sapiens
PTASAVPRP

SEQ ID NO: 565768 - protein, 9 aa, Homo Sapiens
VARVEALPT

SEQ ID NO: 565769 - protein, 9 aa, Homo Sapiens
ARSWRGAWP

SEQ ID NO: 565770 - protein, 9 aa, Homo Sapiens
PYPSKSNHE

SEQ ID NO: 565771 - protein, 9 aa, Homo Sapiens
YWGHQLAAL

SEQ ID NO: 565772 - protein, 9 aa, Homo Sapiens
VPKPLFTLE

SEQ ID NO: 565773 - protein, 9 aa, Homo Sapiens
CNTMRGTTA

SEQ ID NO: 565774 - protein, 9 aa, Homo Sapiens
YAFEKPDVP

SEQ ID NO: 565775 - protein, 9 aa, Homo Sapiens
GMWSAASGT

SEQ ID NO: 565776 - protein, 9 aa, Homo Sapiens
ACWLCCPGS

SEQ ID NO: 565777 - protein, 9 aa, Homo Sapiens
FWLLVGGPS

SEQ ID NO: 565778 - protein, 9 aa, Homo Sapiens
PGCAACPGA

SEQ ID NO: 565779 - protein, 9 aa, Homo Sapiens
AEKAHVASP

SEQ ID NO: 565780 - protein, 9 aa, Homo Sapiens
PVLTNVYWG

SEQ ID NO: 565781 - protein, 9 aa, Homo Sapiens
ESCCSPSCC

SEQ ID NO: 565782 - protein, 9 aa, Homo Sapiens
KSNHEVLEF

SEQ ID NO: 565783 - protein, 9 aa, Homo Sapiens
KLSGAHLVD

SEQ ID NO: 565784 - protein, 9 aa, Homo Sapiens
VCPSWLSVS

SEQ ID NO: 565785 - protein, 9 aa, Homo Sapiens
ESFVRPEGA

SEQ ID NO: 565786 - protein, 9 aa, Homo Sapiens
PGALRGKCY

SEQ ID NO: 565787 - protein, 9 aa, Homo Sapiens
SVPASGAAS

SEQ ID NO: 565788 - protein, 9 aa, Homo Sapiens
PLQGRRAGK

SEQ ID NO: 565789 - protein, 9 aa, Homo Sapiens
LSPELSYTT

SEQ ID NO: 565790 - protein, 9 aa, Homo Sapiens
FSRRVLSDC

SEQ ID NO: 565791 - protein, 9 aa, Homo Sapiens
FLELADPLV

SEQ ID NO: 565792 - protein, 9 aa, Homo Sapiens
SICYCAWCE

SEQ ID NO: 565793 - protein, 9 aa, Homo Sapiens
PVAGGAAEG

SEQ ID NO: 565794 - protein, 9 aa, Homo Sapiens
RPWRSRFLR

SEQ ID NO: 565795 - protein, 9 aa, Homo Sapiens
VSVQVSAGP

SEQ ID NO: 565796 - protein, 9 aa, Homo Sapiens
SLDQSPGYL

SEQ ID NO: 565797 - protein, 9 aa, Homo Sapiens
SVPSGIGRG

SEQ ID NO: 565798 - protein, 9 aa, Homo Sapiens
VGPQWECEL

SEQ ID NO: 565799 - protein, 9 aa, Homo Sapiens
SKSLNESEA

SEQ ID NO: 565800 - protein, 9 aa, Homo Sapiens
LSSSTGWVA

SEQ ID NO: 565801 - protein, 9 aa, Homo Sapiens
TESAAAFTL

SEQ ID NO: 565802 - protein, 9 aa, Homo Sapiens
PLAGVQRLV

SEQ ID NO: 565803 - protein, 9 aa, Homo Sapiens
QVSLPELED

SEQ ID NO: 565804 - protein, 9 aa, Homo Sapiens
YLKRKIARL

SEQ ID NO: 565805 - protein, 9 aa, Homo Sapiens
AEQLMNLAY

SEQ ID NO: 565806 - protein, 9 aa, Homo Sapiens
SEITASIVK

SEQ ID NO: 565807 - protein, 9 aa, Homo Sapiens
SKSNHEVLE

SEQ ID NO: 565808 - protein, 9 aa, Homo Sapiens
QGRRAGKGL

SEQ ID NO: 565809 - protein, 9 aa, Homo Sapiens
TYPDGKSGR

SEQ ID NO: 565810 - protein, 9 aa, Homo Sapiens
VGTMSTTPG

SEQ ID NO: 565811 - protein, 9 aa, Homo Sapiens
YHSLTGGKP

SEQ ID NO: 565812 - protein, 9 aa, Homo Sapiens
GAPQGGSVP

SEQ ID NO: 565813 - protein, 9 aa, Homo Sapiens
LFVEQIPRH

SEQ ID NO: 565814 - protein, 9 aa, Homo Sapiens
VDALVAHEA

SEQ ID NO: 565815 - protein, 9 aa, Homo Sapiens
LAGVQRLVL

SEQ ID NO: 565816 - protein, 9 aa, Homo Sapiens
RINQGTARL

SEQ ID NO: 565817 - protein, 9 aa, Homo Sapiens
WISYSFMMH

SEQ ID NO: 565818 - protein, 9 aa, Homo Sapiens
CSRSLRLLV

SEQ ID NO: 565819 - protein, 9 aa, Homo Sapiens
LRARKGPLA

SEQ ID NO: 565820 - protein, 9 aa, Homo Sapiens
EGTELQATV

SEQ ID NO: 565821 - protein, 9 aa, Homo Sapiens
SVQVSAGPL

SEQ ID NO: 565822 - protein, 9 aa, Homo Sapiens
GLDLALSSV

SEQ ID NO: 565823 - protein, 9 aa, Homo Sapiens
ELSQEGGAP

SEQ ID NO: 565824 - protein, 9 aa, Homo Sapiens
RCPCAPTAS

SEQ ID NO: 565825 - protein, 9 aa, Homo Sapiens
LTGGKPFPK

SEQ ID NO: 565826 - protein, 9 aa, Homo Sapiens
AVPRPQRRR

SEQ ID NO: 565827 - protein, 9 aa, Homo Sapiens
CCWTSGMWS

SEQ ID NO: 565828 - protein, 9 aa, Homo Sapiens
VWTRVGFLA

SEQ ID NO: 565829 - protein, 9 aa, Homo Sapiens
VGADVLPVV

SEQ ID NO: 565830 - protein, 9 aa, Homo Sapiens
TICGTLQYT

SEQ ID NO: 565831 - protein, 9 aa, Homo Sapiens
RRTWPRSSA

SEQ ID NO: 565832 - protein, 9 aa, Homo Sapiens
PTTSTTPST

SEQ ID NO: 565833 - protein, 9 aa, Homo Sapiens
SGEKRPDSE

SEQ ID NO: 565834 - protein, 9 aa, Homo Sapiens
FIRRNSRYL

SEQ ID NO: 565835 - protein, 9 aa, Homo Sapiens
TAPEVLSGG

SEQ ID NO: 565836 - protein, 9 aa, Homo Sapiens
PRPQRRRRK

SEQ ID NO: 565837 - protein, 9 aa, Homo Sapiens
AREAVHAGP

SEQ ID NO: 565838 - protein, 9 aa, Homo Sapiens
SFLTRPARR

SEQ ID NO: 565839 - protein, 9 aa, Homo Sapiens
DCGMFVICN

SEQ ID NO: 565840 - protein, 9 aa, Homo Sapiens
SAAGSMSTQ

SEQ ID NO: 565841 - protein, 9 aa, Homo Sapiens
TWPRSSAST

SEQ ID NO: 565842 - protein, 9 aa, Homo Sapiens
KPLFTLERV

SEQ ID NO: 565843 - protein, 9 aa, Homo Sapiens
PPFGSMNSS

SEQ ID NO: 565844 - protein, 9 aa, Homo Sapiens
ITSSPHLLQ

SEQ ID NO: 565845 - protein, 9 aa, Homo Sapiens
PVPASVPAS

SEQ ID NO: 565846 - protein, 9 aa, Homo Sapiens
VHALVLHHA

SEQ ID NO: 565847 - protein, 9 aa, Homo Sapiens
WLCCPGSIR

SEQ ID NO: 565848 - protein, 9 aa, Homo Sapiens
EAFVKMVGY

SEQ ID NO: 565849 - protein, 9 aa, Homo Sapiens
TSPSTGTTS

SEQ ID NO: 565850 - protein, 9 aa, Homo Sapiens
TCLSSSSIL

SEQ ID NO: 565851 - protein, 9 aa, Homo Sapiens
PLSAPLLLL

SEQ ID NO: 565852 - protein, 9 aa, Homo Sapiens
GRTAVTSPG

SEQ ID NO: 565853 - protein, 9 aa, Homo Sapiens
ARNTDTGQA

SEQ ID NO: 565854 - protein, 9 aa, Homo Sapiens
LAVVGPVGS

SEQ ID NO: 565855 - protein, 9 aa, Homo Sapiens
APSLRSFPR

SEQ ID NO: 565856 - protein, 9 aa, Homo Sapiens
TEVQMKRVG

SEQ ID NO: 565857 - protein, 9 aa, Homo Sapiens
TPSCHSDID

SEQ ID NO: 565858 - protein, 9 aa, Homo Sapiens
VLCAIERMI

SEQ ID NO: 565859 - protein, 9 aa, Homo Sapiens
EKRPDSETM

SEQ ID NO: 565860 - protein, 9 aa, Homo Sapiens
NESEALPEK

SEQ ID NO: 565861 - protein, 9 aa, Homo Sapiens
WLRMVSFCC

SEQ ID NO: 565862 - protein, 9 aa, Homo Sapiens
AGIPVYLKR

SEQ ID NO: 565863 - protein, 9 aa, Homo Sapiens
EKYESSSFW

SEQ ID NO: 565864 - protein, 9 aa, Homo Sapiens
HEGLPAVWT

SEQ ID NO: 565865 - protein, 9 aa, Homo Sapiens
RRPHSWCWT

SEQ ID NO: 565866 - protein, 9 aa, Homo Sapiens
AIKLFVEQI

SEQ ID NO: 565867 - protein, 9 aa, Homo Sapiens
SLSFRRPLR

SEQ ID NO: 565868 - protein, 9 aa, Homo Sapiens
GVQRLVLGQ

SEQ ID NO: 565869 - protein, 9 aa, Homo Sapiens
IPVARVEAL

SEQ ID NO: 565870 - protein, 9 aa, Homo Sapiens
RRAHEGLPA

SEQ ID NO: 565871 - protein, 9 aa, Homo Sapiens
WCWTTWSSC

SEQ ID NO: 565872 - protein, 9 aa, Homo Sapiens
STKRVPKPL

SEQ ID NO: 565873 - protein, 9 aa, Homo Sapiens
QDSLAEQGL

SEQ ID NO: 565874 - protein, 9 aa, Homo Sapiens
RRPLRLGLR

SEQ ID NO: 565875 - protein, 9 aa, Homo Sapiens
PTAPRNSKF

SEQ ID NO: 565876 - protein, 9 aa, Homo Sapiens
GFLACVGAD

SEQ ID NO: 565877 - protein, 9 aa, Homo Sapiens
EEHVHSVDI

SEQ ID NO: 565878 - protein, 9 aa, Homo Sapiens
ERLMEQASS

SEQ ID NO: 565879 - protein, 9 aa, Homo Sapiens
VGFLACVGA

SEQ ID NO: 565880 - protein, 9 aa, Homo Sapiens
PLASSHSFL

SEQ ID NO: 565881 - protein, 9 aa, Homo Sapiens
VGLRFRLVA

SEQ ID NO: 565882 - protein, 9 aa, Homo Sapiens
TLTSRTRSR

SEQ ID NO: 565883 - protein, 9 aa, Homo Sapiens
AVHAGPLCH

SEQ ID NO: 565884 - protein, 9 aa, Homo Sapiens
RPARCPCAP

SEQ ID NO: 565885 - protein, 9 aa, Homo Sapiens
NFRKQYVRS

SEQ ID NO: 565886 - protein, 9 aa, Homo Sapiens
LCHAGRPGS

SEQ ID NO: 565887 - protein, 9 aa, Homo Sapiens
QNQAVKGKL

SEQ ID NO: 565888 - protein, 9 aa, Homo Sapiens
PSSVSTGHA

SEQ ID NO: 565889 - protein, 9 aa, Homo Sapiens
AATDAAHMS

SEQ ID NO: 565890 - protein, 9 aa, Homo Sapiens
GRFRPWRSR

SEQ ID NO: 565891 - protein, 9 aa, Homo Sapiens
DMSTFIRRN

SEQ ID NO: 565892 - protein, 9 aa, Homo Sapiens
SPAESSPWP

SEQ ID NO: 565893 - protein, 9 aa, Homo Sapiens
RRRRKKTCA

SEQ ID NO: 565894 - protein, 9 aa, Homo Sapiens
RSWRGAWPT

SEQ ID NO: 565895 - protein, 9 aa, Homo Sapiens
TPWTMLACT

SEQ ID NO: 565896 - protein, 9 aa, Homo Sapiens
GPQCFPSDH

SEQ ID NO: 565897 - protein, 9 aa, Homo Sapiens
TFRFCAHCI

SEQ ID NO: 565898 - protein, 9 aa, Homo Sapiens
SAPTTSTTP

SEQ ID NO: 565899 - protein, 9 aa, Homo Sapiens
RANRGGNGL

SEQ ID NO: 565900 - protein, 9 aa, Homo Sapiens
PQRRRRKKT

SEQ ID NO: 565901 - protein, 9 aa, Homo Sapiens
LYCSRFSRR

SEQ ID NO: 565902 - protein, 9 aa, Homo Sapiens
RVQAPVLLE

SEQ ID NO: 565903 - protein, 9 aa, Homo Sapiens
VSFLGPPLP

SEQ ID NO: 565904 - protein, 9 aa, Homo Sapiens
EGGQVGLRF

SEQ ID NO: 565905 - protein, 9 aa, Homo Sapiens
SSRMVSFWL

SEQ ID NO: 565906 - protein, 9 aa, Homo Sapiens
EGLGAQVRA

SEQ ID NO: 565907 - protein, 9 aa, Homo Sapiens
LLPAAPSWL

SEQ ID NO: 565908 - protein, 9 aa, Homo Sapiens
ARSCCNTMR

SEQ ID NO: 565909 - protein, 9 aa, Homo Sapiens
RNEMQKLHA

SEQ ID NO: 565910 - protein, 9 aa, Homo Sapiens
RGKCYLIGS

SEQ ID NO: 565911 - protein, 9 aa, Homo Sapiens
VQYPECRDM

SEQ ID NO: 565912 - protein, 9 aa, Homo Sapiens
LVSRAVVFL

SEQ ID NO: 565913 - protein, 9 aa, Homo Sapiens
KPFPKTTST

SEQ ID NO: 565914 - protein, 9 aa, Homo Sapiens
PIQDSLAEQ

SEQ ID NO: 565915 - protein, 9 aa, Homo Sapiens
QTSRSLDQS

SEQ ID NO: 565916 - protein, 9 aa, Homo Sapiens
LSQEGGAPL

SEQ ID NO: 565917 - protein, 9 aa, Homo Sapiens
TSTTPSTCS

SEQ ID NO: 565918 - protein, 9 aa, Homo Sapiens
VSELPLASS

SEQ ID NO: 565919 - protein, 9 aa, Homo Sapiens
QVRALVAQQ

SEQ ID NO: 565920 - protein, 9 aa, Homo Sapiens
WLAASLPSP

SEQ ID NO: 565921 - protein, 9 aa, Homo Sapiens
AIELTRTLY

SEQ ID NO: 565922 - protein, 9 aa, Homo Sapiens
GTTAPRRAP

SEQ ID NO: 565923 - protein, 9 aa, Homo Sapiens
SGPPISAFS

SEQ ID NO: 565924 - protein, 9 aa, Homo Sapiens
RLYCSRFSR

SEQ ID NO: 565925 - protein, 9 aa, Homo Sapiens
VSSRMVSFW

SEQ ID NO: 565926 - protein, 9 aa, Homo Sapiens
LRPPPARAS

SEQ ID NO: 565927 - protein, 9 aa, Homo Sapiens
WTSCTASCS

SEQ ID NO: 565928 - protein, 9 aa, Homo Sapiens
FTLERVAAV

SEQ ID NO: 565929 - protein, 9 aa, Homo Sapiens
RAYSSPVAT

SEQ ID NO: 565930 - protein, 9 aa, Homo Sapiens
GGQGGLDLA

SEQ ID NO: 565931 - protein, 9 aa, Homo Sapiens
FRRPLRLGL

SEQ ID NO: 565932 - protein, 9 aa, Homo Sapiens
LVLGQIGGL

SEQ ID NO: 565933 - protein, 9 aa, Homo Sapiens
EVVGEFPII

SEQ ID NO: 565934 - protein, 9 aa, Homo Sapiens
AHCIALPSG

SEQ ID NO: 565935 - protein, 9 aa, Homo Sapiens
ISKSLNESE

SEQ ID NO: 565936 - protein, 9 aa, Homo Sapiens
WRSRFLRRQ

SEQ ID NO: 565937 - protein, 9 aa, Homo Sapiens
AFTLTSRTR

SEQ ID NO: 565938 - protein, 9 aa, Homo Sapiens
VEKNYAFEK

SEQ ID NO: 565939 - protein, 9 aa, Homo Sapiens
GGLGEALAA

SEQ ID NO: 565940 - protein, 9 aa, Homo Sapiens
RGTTAPRRA

SEQ ID NO: 565941 - protein, 9 aa, Homo Sapiens
RLPLSSSTG

SEQ ID NO: 565942 - protein, 9 aa, Homo Sapiens
LGEELLQGN

SEQ ID NO: 565943 - protein, 9 aa, Homo Sapiens
IFPHQPLSR

SEQ ID NO: 565944 - protein, 9 aa, Homo Sapiens
PAAALREVL

SEQ ID NO: 565945 - protein, 9 aa, Homo Sapiens
SSPHGTLAL

SEQ ID NO: 565946 - protein, 9 aa, Homo Sapiens
IHIVGPQWE

SEQ ID NO: 565947 - protein, 9 aa, Homo Sapiens
PGPEELSQE

SEQ ID NO: 565948 - protein, 9 aa, Homo Sapiens
ASSHSFLDL

SEQ ID NO: 565949 - protein, 9 aa, Homo Sapiens
SAAGVRDRS

SEQ ID NO: 565950 - protein, 9 aa, Homo Sapiens
TTPGLPTRP

SEQ ID NO: 565951 - protein, 9 aa, Homo Sapiens
LPLASSHSF

SEQ ID NO: 565952 - protein, 9 aa, Homo Sapiens
ECELELVSR

SEQ ID NO: 565953 - protein, 9 aa, Homo Sapiens
SSVSTGHAI

SEQ ID NO: 565954 - protein, 9 aa, Homo Sapiens
LEVKMEAEK

SEQ ID NO: 565955 - protein, 9 aa, Homo Sapiens
GEGPLARVH

SEQ ID NO: 565956 - protein, 9 aa, Homo Sapiens
PSSRVFTRD

SEQ ID NO: 565957 - protein, 9 aa, Homo Sapiens
AFVKMVGYH

SEQ ID NO: 565958 - protein, 9 aa, Homo Sapiens
AASGTRWRV

SEQ ID NO: 565959 - protein, 9 aa, Homo Sapiens
RTMLSSGVC

SEQ ID NO: 565960 - protein, 9 aa, Homo Sapiens
FEKPDVPEK

SEQ ID NO: 565961 - protein, 9 aa, Homo Sapiens
PAPRRQRAS

SEQ ID NO: 565962 - protein, 9 aa, Homo Sapiens
QKIELPKKM

SEQ ID NO: 565963 - protein, 9 aa, Homo Sapiens
SAAAFTLTS

SEQ ID NO: 565964 - protein, 9 aa, Homo Sapiens
AAAFTLTSR

SEQ ID NO: 565965 - protein, 9 aa, Homo Sapiens
TTWSSCRGR

SEQ ID NO: 565966 - protein, 9 aa, Homo Sapiens
LDLHLRLRA

SEQ ID NO: 565967 - protein, 9 aa, Homo Sapiens
TLALGSPSV

SEQ ID NO: 565968 - protein, 9 aa, Homo Sapiens
PSTLRMVAV

SEQ ID NO: 565969 - protein, 9 aa, Homo Sapiens
RSHIVKLSL

SEQ ID NO: 565970 - protein, 9 aa, Homo Sapiens
APVLLECAA

SEQ ID NO: 565971 - protein, 9 aa, Homo Sapiens
MFVICNTEA

SEQ ID NO: 565972 - protein, 9 aa, Homo Sapiens
SKYDVNYAF

SEQ ID NO: 565973 - protein, 9 aa, Homo Sapiens
TAPRRAPHR

SEQ ID NO: 565974 - protein, 9 aa, Homo Sapiens
GHSELPVAG

SEQ ID NO: 565975 - protein, 9 aa, Homo Sapiens
VRRAHEGLP

SEQ ID NO: 565976 - protein, 9 aa, Homo Sapiens
ECRDMQPYM

SEQ ID NO: 565977 - protein, 9 aa, Homo Sapiens
CERTHGPLS

SEQ ID NO: 565978 - protein, 9 aa, Homo Sapiens
ILPYEATRV

SEQ ID NO: 565979 - protein, 9 aa, Homo Sapiens
GWVAQTPWT

SEQ ID NO: 565980 - protein, 9 aa, Homo Sapiens
SGAASHPGH

SEQ ID NO: 565981 - protein, 9 aa, Homo Sapiens
CSTVSRSCS

SEQ ID NO: 565982 - protein, 9 aa, Homo Sapiens
MRIPVARVE

SEQ ID NO: 565983 - protein, 9 aa, Homo Sapiens
PELEDWLQC

SEQ ID NO: 565984 - protein, 9 aa, Homo Sapiens
WRTARSCCN

SEQ ID NO: 565985 - protein, 9 aa, Homo Sapiens
KSWAPAPRR

SEQ ID NO: 565986 - protein, 9 aa, Homo Sapiens
ADPLVQGGQ

SEQ ID NO: 565987 - protein, 9 aa, Homo Sapiens
RAVVFLTFL

SEQ ID NO: 565988 - protein, 9 aa, Homo Sapiens
KGQEEEEDQ

SEQ ID NO: 565989 - protein, 9 aa, Homo Sapiens
SMPASLGRI

SEQ ID NO: 565990 - protein, 9 aa, Homo Sapiens
TLERVAAVS

SEQ ID NO: 565991 - protein, 9 aa, Homo Sapiens
SAFSVGSTY

SEQ ID NO: 565992 - protein, 9 aa, Homo Sapiens
VSQWYTSAS

SEQ ID NO: 565993 - protein, 9 aa, Homo Sapiens
SLAEQGLPH

SEQ ID NO: 565994 - protein, 9 aa, Homo Sapiens
SVCGHWGIL

SEQ ID NO: 565995 - protein, 9 aa, Homo Sapiens
SPAASRWWP

SEQ ID NO: 565996 - protein, 9 aa, Homo Sapiens
PDAIKLFVE

SEQ ID NO: 565997 - protein, 9 aa, Homo Sapiens
RHCFFTMIF

SEQ ID NO: 565998 - protein, 9 aa, Homo Sapiens
GQKSAEAKH

SEQ ID NO: 565999 - protein, 9 aa, Homo Sapiens
ASVDALVAH

SEQ ID NO: 566000 - protein, 9 aa, Homo Sapiens
GDPAAALRE

SEQ ID NO: 566001 - protein, 9 aa, Homo Sapiens
FGQKSAEAK

SEQ ID NO: 566002 - protein, 9 aa, Homo Sapiens
LLLALHGPA

SEQ ID NO: 566003 - protein, 9 aa, Homo Sapiens
LLQPNTAPG

SEQ ID NO: 566004 - protein, 9 aa, Homo Sapiens
TWSSCRGRC

SEQ ID NO: 566005 - protein, 9 aa, Homo Sapiens
KLHAEAPHI

SEQ ID NO: 566006 - protein, 9 aa, Homo Sapiens
RRLYCSRFS

SEQ ID NO: 566007 - protein, 9 aa, Homo Sapiens
GGGGLRRFR

SEQ ID NO: 566008 - protein, 9 aa, Homo Sapiens
SPWPSLSLS

SEQ ID NO: 566009 - protein, 9 aa, Homo Sapiens
VAPRSRASC

SEQ ID NO: 566010 - protein, 9 aa, Homo Sapiens
DDSNCSLVS

SEQ ID NO: 566011 - protein, 9 aa, Homo Sapiens
PGVFTQVTY

SEQ ID NO: 566012 - protein, 9 aa, Homo Sapiens
CTGMWGALL

SEQ ID NO: 566013 - protein, 9 aa, Homo Sapiens
ELADPLVQG

SEQ ID NO: 566014 - protein, 9 aa, Homo Sapiens
RNLLSTSWR

SEQ ID NO: 566015 - protein, 9 aa, Homo Sapiens
VRSRWKLSF

SEQ ID NO: 566016 - protein, 9 aa, Homo Sapiens
SCCRTRPAR

SEQ ID NO: 566017 - protein, 9 aa, Homo Sapiens
VLLQPNTAP

SEQ ID NO: 566018 - protein, 9 aa, Homo Sapiens
QSALGLKGS

SEQ ID NO: 566019 - protein, 9 aa, Homo Sapiens
IVKLSLSRL

SEQ ID NO: 566020 - protein, 9 aa, Homo Sapiens
RPSCRFCCW

SEQ ID NO: 566021 - protein, 9 aa, Homo Sapiens
ITKFEEHVH

SEQ ID NO: 566022 - protein, 9 aa, Homo Sapiens
EGQAALGAR

SEQ ID NO: 566023 - protein, 9 aa, Homo Sapiens
LSVILRIGK

SEQ ID NO: 566024 - protein, 9 aa, Homo Sapiens
LLPVRAWGL

SEQ ID NO: 566025 - protein, 9 aa, Homo Sapiens
CIALPSGLS

SEQ ID NO: 566026 - protein, 9 aa, Homo Sapiens
LREWLGQHK

SEQ ID NO: 566027 - protein, 9 aa, Homo Sapiens
TQQDGCAQP

SEQ ID NO: 566028 - protein, 9 aa, Homo Sapiens
SASTAWLAA

SEQ ID NO: 566029 - protein, 9 aa, Homo Sapiens
FVKMVGYHV

SEQ ID NO: 566030 - protein, 9 aa, Homo Sapiens
LREVLDPEQ

SEQ ID NO: 566031 - protein, 9 aa, Homo Sapiens
PLVQGGQGG

SEQ ID NO: 566032 - protein, 9 aa, Homo Sapiens
LRRLYCSRF

SEQ ID NO: 566033 - protein, 9 aa, Homo Sapiens
ELLQGNSSQ

SEQ ID NO: 566034 - protein, 9 aa, Homo Sapiens
WLEWIGGLG

SEQ ID NO: 566035 - protein, 9 aa, Homo Sapiens
NEMQKLHAE

SEQ ID NO: 566036 - protein, 9 aa, Homo Sapiens
WDSLWISYS

SEQ ID NO: 566037 - protein, 9 aa, Homo Sapiens
CQAYGSSFY

SEQ ID NO: 566038 - protein, 9 aa, Homo Sapiens
PWPSLSLSA

SEQ ID NO: 566039 - protein, 9 aa, Homo Sapiens
PSQHLRASA

SEQ ID NO: 566040 - protein, 9 aa, Homo Sapiens
ALREVLDPE

SEQ ID NO: 566041 - protein, 9 aa, Homo Sapiens
TPGLPTRPC

SEQ ID NO: 566042 - protein, 9 aa, Homo Sapiens
AREGLIVAV

SEQ ID NO: 566043 - protein, 9 aa, Homo Sapiens
DVESKRCER

SEQ ID NO: 566044 - protein, 9 aa, Homo Sapiens
LTEDIIFPH

SEQ ID NO: 566045 - protein, 9 aa, Homo Sapiens
PYEATRVKL

SEQ ID NO: 566046 - protein, 9 aa, Homo Sapiens
EILLSPELS

SEQ ID NO: 566047 - protein, 9 aa, Homo Sapiens
SRRRYVRGS

SEQ ID NO: 566048 - protein, 9 aa, Homo Sapiens
HGTLALGSP

SEQ ID NO: 566049 - protein, 9 aa, Homo Sapiens
AVSALERPL

SEQ ID NO: 566050 - protein, 9 aa, Homo Sapiens
RTRSRLPLS

SEQ ID NO: 566051 - protein, 9 aa, Homo Sapiens
GPQWECELE

SEQ ID NO: 566052 - protein, 9 aa, Homo Sapiens
LDKSKPTCA

SEQ ID NO: 566053 - protein, 9 aa, Homo Sapiens
AALGAREGL

SEQ ID NO: 566054 - protein, 9 aa, Homo Sapiens
PPAATDAAH

SEQ ID NO: 566055 - protein, 9 aa, Homo Sapiens
TTSICYCAW

SEQ ID NO: 566056 - protein, 9 aa, Homo Sapiens
REGLIVAVH

SEQ ID NO: 566057 - protein, 9 aa, Homo Sapiens
GPLSAPLLL

SEQ ID NO: 566058 - protein, 9 aa, Homo Sapiens
DKSKPTCAR

SEQ ID NO: 566059 - protein, 9 aa, Homo Sapiens
SRSAPTTST

SEQ ID NO: 566060 - protein, 9 aa, Homo Sapiens
PAESSPWPS

SEQ ID NO: 566061 - protein, 9 aa, Homo Sapiens
LAASLPSPA

SEQ ID NO: 566062 - protein, 9 aa, Homo Sapiens
SAPGTQQDG

SEQ ID NO: 566063 - protein, 9 aa, Homo Sapiens
SCGPASQSA

SEQ ID NO: 566064 - protein, 9 aa, Homo Sapiens
HHAAGHSEL

SEQ ID NO: 566065 - protein, 9 aa, Homo Sapiens
SMNSSAAGS

SEQ ID NO: 566066 - protein, 9 aa, Homo Sapiens
SSASTAWLA

SEQ ID NO: 566067 - protein, 9 aa, Homo Sapiens
PLFTLERVA

SEQ ID NO: 566068 - protein, 9 aa, Homo Sapiens
PFIRDQPTG

SEQ ID NO: 566069 - protein, 9 aa, Homo Sapiens
RPARRTWPR

SEQ ID NO: 566070 - protein, 9 aa, Homo Sapiens
CWLCCPGSI

SEQ ID NO: 566071 - protein, 9 aa, Homo Sapiens
SIFPPTRAN

SEQ ID NO: 566072 - protein, 9 aa, Homo Sapiens
IGKTMDYWG

SEQ ID NO: 566073 - protein, 9 aa, Homo Sapiens
KSIRECVHS

SEQ ID NO: 566074 - protein, 9 aa, Homo Sapiens
CPGAPQGGS

SEQ ID NO: 566075 - protein, 9 aa, Homo Sapiens
QVGLRFRLV

SEQ ID NO: 566076 - protein, 9 aa, Homo Sapiens
MIFGEMKMI

SEQ ID NO: 566077 - protein, 9 aa, Homo Sapiens
TTAPRRAPH

SEQ ID NO: 566078 - protein, 9 aa, Homo Sapiens
YWGTMIPSE

SEQ ID NO: 566079 - protein, 9 aa, Homo Sapiens
KTMDYWGTM

SEQ ID NO: 566080 - protein, 9 aa, Homo Sapiens
GAKASTHEV

SEQ ID NO: 566081 - protein, 9 aa, Homo Sapiens
ATSARCWRT

SEQ ID NO: 566082 - protein, 9 aa, Homo Sapiens
AENSAPGTQ

SEQ ID NO: 566083 - protein, 9 aa, Homo Sapiens
KVCPSWLSV

SEQ ID NO: 566084 - protein, 9 aa, Homo Sapiens
AGAADAGRT

SEQ ID NO: 566085 - protein, 9 aa, Homo Sapiens
SFPRDCTPS

SEQ ID NO: 566086 - protein, 9 aa, Homo Sapiens
TCARNLLST

SEQ ID NO: 566087 - protein, 9 aa, Homo Sapiens
LLVPLQGRR

SEQ ID NO: 566088 - protein, 9 aa, Homo Sapiens
KSGRATCEM

SEQ ID NO: 566089 - protein, 9 aa, Homo Sapiens
LLECAAVGV

SEQ ID NO: 566090 - protein, 9 aa, Homo Sapiens
VPSGIGRGA

SEQ ID NO: 566091 - protein, 9 aa, Homo Sapiens
VSAAGVRDR

SEQ ID NO: 566092 - protein, 9 aa, Homo Sapiens
LASVDALVA

SEQ ID NO: 566093 - protein, 9 aa, Homo Sapiens
PAASRWWPR

SEQ ID NO: 566094 - protein, 9 aa, Homo Sapiens
NSSAAGSMS

SEQ ID NO: 566095 - protein, 9 aa, Homo Sapiens
LWLSQRPSL

SEQ ID NO: 566096 - protein, 9 aa, Homo Sapiens
GHASTDQEI

SEQ ID NO: 566097 - protein, 9 aa, Homo Sapiens
GLRGAARRK

SEQ ID NO: 566098 - protein, 9 aa, Homo Sapiens
RTIELNSTI

SEQ ID NO: 566099 - protein, 9 aa, Homo Sapiens
VPASGAASH

SEQ ID NO: 566100 - protein, 9 aa, Homo Sapiens
SRCHDSVVS

SEQ ID NO: 566101 - protein, 9 aa, Homo Sapiens
RSLDQSPGY

SEQ ID NO: 566102 - protein, 9 aa, Homo Sapiens
LPELEDWLQ

SEQ ID NO: 566103 - protein, 9 aa, Homo Sapiens
RFCAHCIAL

SEQ ID NO: 566104 - protein, 9 aa, Homo Sapiens
PASVQTESS

SEQ ID NO: 566105 - protein, 9 aa, Homo Sapiens
VARVAPRSR

SEQ ID NO: 566106 - protein, 9 aa, Homo Sapiens
ELLSNSKYD

SEQ ID NO: 566107 - protein, 9 aa, Homo Sapiens
SWLCLEWDL

SEQ ID NO: 566108 - protein, 9 aa, Homo Sapiens
KRVPKPLFT

SEQ ID NO: 566109 - protein, 9 aa, Homo Sapiens
QSRSVLFTF

SEQ ID NO: 566110 - protein, 9 aa, Homo Sapiens
RVGFLACVG

SEQ ID NO: 566111 - protein, 9 aa, Homo Sapiens
AASLPSPAA

SEQ ID NO: 566112 - protein, 9 aa, Homo Sapiens
VLSQGHAST

SEQ ID NO: 566113 - protein, 9 aa, Homo Sapiens
PARRTWPRS

SEQ ID NO: 566114 - protein, 9 aa, Homo Sapiens
SLRLLVWLE

SEQ ID NO: 566115 - protein, 9 aa, Homo Sapiens
LSSSRCHDS

SEQ ID NO: 566116 - protein, 9 aa, Homo Sapiens
WLEELRRLY

SEQ ID NO: 566117 - protein, 9 aa, Homo Sapiens
YTAPEVLSG

SEQ ID NO: 566118 - protein, 9 aa, Homo Sapiens
AVVGPVGSG

SEQ ID NO: 566119 - protein, 9 aa, Homo Sapiens
KITYRIAGV

SEQ ID NO: 566120 - protein, 9 aa, Homo Sapiens
VTHVTEMQE

SEQ ID NO: 566121 - protein, 9 aa, Homo Sapiens
ALERPLAGV

SEQ ID NO: 566122 - protein, 9 aa, Homo Sapiens
LEYRPIIDK

SEQ ID NO: 566123 - protein, 9 aa, Homo Sapiens
ELTRTLYQY

SEQ ID NO: 566124 - protein, 9 aa, Homo Sapiens
SQSALGLKG

SEQ ID NO: 566125 - protein, 9 aa, Homo Sapiens
RVRASFLTR

SEQ ID NO: 566126 - protein, 9 aa, Homo Sapiens
CKNWDHVLC

SEQ ID NO: 566127 - protein, 9 aa, Homo Sapiens
DSETMLIFQ

SEQ ID NO: 566128 - protein, 9 aa, Homo Sapiens
EMIFGEMKM

SEQ ID NO: 566129 - protein, 9 aa, Homo Sapiens
GAASHPGHR

SEQ ID NO: 566130 - protein, 9 aa, Homo Sapiens
STGTEVQMK

SEQ ID NO: 566131 - protein, 9 aa, Homo Sapiens
VVGPVGSGK

SEQ ID NO: 566132 - protein, 9 aa, Homo Sapiens
ANRGGNGLS

SEQ ID NO: 566133 - protein, 9 aa, Homo Sapiens
SSSSILLCS

SEQ ID NO: 566134 - protein, 9 aa, Homo Sapiens
WIGGLGKVC

SEQ ID NO: 566135 - protein, 9 aa, Homo Sapiens
SHSFLDLHL

SEQ ID NO: 566136 - protein, 9 aa, Homo Sapiens
PEWLEWIGG

SEQ ID NO: 566137 - protein, 9 aa, Homo Sapiens
STESAAAFT

SEQ ID NO: 566138 - protein, 9 aa, Homo Sapiens
RKKTCAPAC

SEQ ID NO: 566139 - protein, 9 aa, Homo Sapiens
PGSIRCGRP

SEQ ID NO: 566140 - protein, 9 aa, Homo Sapiens
RSSASTAWL

SEQ ID NO: 566141 - protein, 9 aa, Homo Sapiens
HVLCAIERM

SEQ ID NO: 566142 - protein, 9 aa, Homo Sapiens
QRLVLGQIG

SEQ ID NO: 566143 - protein, 9 aa, Homo Sapiens
RASSAQVRA

SEQ ID NO: 566144 - protein, 9 aa, Homo Sapiens
SALERPLAG

SEQ ID NO: 566145 - protein, 9 aa, Homo Sapiens
RYNNILPYE

SEQ ID NO: 566146 - protein, 9 aa, Homo Sapiens
GGLGKVCGT

SEQ ID NO: 566147 - protein, 9 aa, Homo Sapiens
RYVDREFVI

SEQ ID NO: 566148 - protein, 9 aa, Homo Sapiens
CHAGRPGSG

SEQ ID NO: 566149 - protein, 9 aa, Homo Sapiens
RAPCLRRPL

SEQ ID NO: 566150 - protein, 9 aa, Homo Sapiens
APGSSVLWL

SEQ ID NO: 566151 - protein, 9 aa, Homo Sapiens
APPAATDAA

SEQ ID NO: 566152 - protein, 9 aa, Homo Sapiens
NVYWGHQLA

SEQ ID NO: 566153 - protein, 9 aa, Homo Sapiens
VLPVVGGPG

SEQ ID NO: 566154 - protein, 9 aa, Homo Sapiens
SCRGRCWTS

SEQ ID NO: 566155 - protein, 9 aa, Homo Sapiens
GQVGLRFRL

SEQ ID NO: 566156 - protein, 9 aa, Homo Sapiens
GPTAPSLRS

SEQ ID NO: 566157 - protein, 9 aa, Homo Sapiens
ASQSALGLK

SEQ ID NO: 566158 - protein, 9 aa, Homo Sapiens
KAQLMYLSL

SEQ ID NO: 566159 - protein, 9 aa, Homo Sapiens
QAPVLLECA

SEQ ID NO: 566160 - protein, 9 aa, Homo Sapiens
QLMYLSLPK

SEQ ID NO: 566161 - protein, 9 aa, Homo Sapiens
SIRCGRPRP

SEQ ID NO: 566162 - protein, 9 aa, Homo Sapiens
RRRPHSWCW

SEQ ID NO: 566163 - protein, 9 aa, Homo Sapiens
SAPPAATDA

SEQ ID NO: 566164 - protein, 9 aa, Homo Sapiens
RGSFLGKGG

SEQ ID NO: 566165 - protein, 9 aa, Homo Sapiens
QGDPAAALR

SEQ ID NO: 566166 - protein, 9 aa, Homo Sapiens
MSTFIRRNS

SEQ ID NO: 566167 - protein, 9 aa, Homo Sapiens
RPLRLGLRG

SEQ ID NO: 566168 - protein, 9 aa, Homo Sapiens
AYSSPVATL

SEQ ID NO: 566169 - protein, 9 aa, Homo Sapiens
LTRPARRTW

SEQ ID NO: 566170 - protein, 9 aa, Homo Sapiens
FCAHCIALP

SEQ ID NO: 566171 - protein, 9 aa, Homo Sapiens
KLSISKSLN

SEQ ID NO: 566172 - protein, 9 aa, Homo Sapiens
THKTGMGSG

SEQ ID NO: 566173 - protein, 9 aa, Homo Sapiens
LRLRAPCLR

SEQ ID NO: 566174 - protein, 9 aa, Homo Sapiens
VELEKKAAQ

SEQ ID NO: 566175 - protein, 9 aa, Homo Sapiens
RTARSCCNT

SEQ ID NO: 566176 - protein, 9 aa, Homo Sapiens
GRPRPSCRF

SEQ ID NO: 566177 - protein, 9 aa, Homo Sapiens
FWGAKASTH

SEQ ID NO: 566178 - protein, 9 aa, Homo Sapiens
PAVWTRVGF

SEQ ID NO: 566179 - protein, 9 aa, Homo Sapiens
ARNLLSTSW

SEQ ID NO: 566180 - protein, 9 aa, Homo Sapiens
NNTAYLLDN

SEQ ID NO: 566181 - protein, 9 aa, Homo Sapiens
LSNSKYDVN

SEQ ID NO: 566182 - protein, 9 aa, Homo Sapiens
YEATRVKLS

SEQ ID NO: 566183 - protein, 9 aa, Homo Sapiens
NVQYPECRD

SEQ ID NO: 566184 - protein, 9 aa, Homo Sapiens
RVPKPLFTL

SEQ ID NO: 566185 - protein, 9 aa, Homo Sapiens
SPVLTNVYW

SEQ ID NO: 566186 - protein, 9 aa, Homo Sapiens
NLLPTLVPG

SEQ ID NO: 566187 - protein, 9 aa, Homo Sapiens
KYESSSFWG

SEQ ID NO: 566188 - protein, 9 aa, Homo Sapiens
ASSWEKEEQ

SEQ ID NO: 566189 - protein, 9 aa, Homo Sapiens
GSFLGKGGF

SEQ ID NO: 566190 - protein, 9 aa, Homo Sapiens
ELSYTTKHL

SEQ ID NO: 566191 - protein, 9 aa, Homo Sapiens
KQYVRSRWK

SEQ ID NO: 566192 - protein, 9 aa, Homo Sapiens
KVCGTKLAY

SEQ ID NO: 566193 - protein, 9 aa, Homo Sapiens
LHGPAWARA

SEQ ID NO: 566194 - protein, 9 aa, Homo Sapiens
ALVGPLARV

SEQ ID NO: 566195 - protein, 9 aa, Homo Sapiens
RNTDTGQAS

SEQ ID NO: 566196 - protein, 9 aa, Homo Sapiens
ASGAASHPG

SEQ ID NO: 566197 - protein, 9 aa, Homo Sapiens
NTAYLLDNL

SEQ ID NO: 566198 - protein, 9 aa, Homo Sapiens
GLATLRARK

SEQ ID NO: 566199 - protein, 9 aa, Homo Sapiens
LRGNKLSTI

SEQ ID NO: 566200 - protein, 9 aa, Homo Sapiens
PLPSSRVFT

SEQ ID NO: 566201 - protein, 9 aa, Homo Sapiens
MVSFWLRMV

SEQ ID NO: 566202 - protein, 9 aa, Homo Sapiens
ARATWAACW

SEQ ID NO: 566203 - protein, 9 aa, Homo Sapiens
VEGHKIHWI

SEQ ID NO: 566204 - protein, 9 aa, Homo Sapiens
LRYLEKYES

SEQ ID NO: 566205 - protein, 9 aa, Homo Sapiens
PAAPSWLCL

SEQ ID NO: 566206 - protein, 9 aa, Homo Sapiens
TCAPACWLC

SEQ ID NO: 566207 - protein, 9 aa, Homo Sapiens
SEQETPPPL

SEQ ID NO: 566208 - protein, 9 aa, Homo Sapiens
MYLSLPKTP

SEQ ID NO: 566209 - protein, 9 aa, Homo Sapiens
QRQRLVEGQ

SEQ ID NO: 566210 - protein, 9 aa, Homo Sapiens
QVRRAHEGL

SEQ ID NO: 566211 - protein, 9 aa, Homo Sapiens
GWDSLWISY

SEQ ID NO: 566212 - protein, 9 aa, Homo Sapiens
GGDKWVFST

SEQ ID NO: 566213 - protein, 9 aa, Homo Sapiens
TAPRNSKFA

SEQ ID NO: 566214 - protein, 9 aa, Homo Sapiens
VRALVAQQR

SEQ ID NO: 566215 - protein, 9 aa, Homo Sapiens
CLEWDLAPP

SEQ ID NO: 566216 - protein, 9 aa, Homo Sapiens
KNYIWALSV

SEQ ID NO: 566217 - protein, 9 aa, Homo Sapiens
SVSELPLAS

SEQ ID NO: 566218 - protein, 9 aa, Homo Sapiens
LVPLQGRRA

SEQ ID NO: 566219 - protein, 9 aa, Homo Sapiens
YGTSIFPPT

SEQ ID NO: 566220 - protein, 9 aa, Homo Sapiens
QPGALRGKC

SEQ ID NO: 566221 - protein, 9 aa, Homo Sapiens
AWCEAEDLD

SEQ ID NO: 566222 - protein, 9 aa, Homo Sapiens
ALGAREGLI

SEQ ID NO: 566223 - protein, 9 aa, Homo Sapiens
ILLLPAAPS

SEQ ID NO: 566224 - protein, 9 aa, Homo Sapiens
KLFVEQIPR

SEQ ID NO: 566225 - protein, 9 aa, Homo Sapiens
CRFCCWTSG

SEQ ID NO: 566226 - protein, 9 aa, Homo Sapiens
PISLSSSRC

SEQ ID NO: 566227 - protein, 9 aa, Homo Sapiens
VATLPPHHP

SEQ ID NO: 566228 - protein, 9 aa, Homo Sapiens
APRRAPHRT

SEQ ID NO: 566229 - protein, 9 aa, Homo Sapiens
QGTEPSIRM

SEQ ID NO: 566230 - protein, 9 aa, Homo Sapiens
QGNSSQGSF

SEQ ID NO: 566231 - protein, 9 aa, Homo Sapiens
GAAEGLGAQ

SEQ ID NO: 566232 - protein, 9 aa, Homo Sapiens
VVFLTFLEL

SEQ ID NO: 566233 - protein, 9 aa, Homo Sapiens
DTVLLQPNT

SEQ ID NO: 566234 - protein, 9 aa, Homo Sapiens
IKLSGAHLV

SEQ ID NO: 566235 - protein, 9 aa, Homo Sapiens
AAGVRDRSP

SEQ ID NO: 566236 - protein, 9 aa, Homo Sapiens
AAGGAGEGP

SEQ ID NO: 566237 - protein, 9 aa, Homo Sapiens
FAQVRRAHE

SEQ ID NO: 566238 - protein, 9 aa, Homo Sapiens
ARCWRTARS

SEQ ID NO: 566239 - protein, 9 aa, Homo Sapiens
ESYGTSIFP

SEQ ID NO: 566240 - protein, 9 aa, Homo Sapiens
NRYVDREFV

SEQ ID NO: 566241 - protein, 9 aa, Homo Sapiens
CGRPRPSCR

SEQ ID NO: 566242 - protein, 9 aa, Homo Sapiens
VRGSFLGKG

SEQ ID NO: 566243 - protein, 9 aa, Homo Sapiens
APTASAVPR

SEQ ID NO: 566244 - protein, 9 aa, Homo Sapiens
ARVQAPVLL

SEQ ID NO: 566245 - protein, 9 aa, Homo Sapiens
TGTEVQMKR

SEQ ID NO: 566246 - protein, 9 aa, Homo Sapiens
WLCLEWDLA

SEQ ID NO: 566247 - protein, 9 aa, Homo Sapiens
PLCHAGRPG

SEQ ID NO: 566248 - protein, 9 aa, Homo Sapiens
HSLTGGKPF

SEQ ID NO: 566249 - protein, 9 aa, Homo Sapiens
RSAPTTSTT

SEQ ID NO: 566250 - protein, 9 aa, Homo Sapiens
LPKKMAKRY

SEQ ID NO: 566251 - protein, 9 aa, Homo Sapiens
LLALHGPAW

SEQ ID NO: 566252 - protein, 9 aa, Homo Sapiens
AACWRATSA

SEQ ID NO: 566253 - protein, 9 aa, Homo Sapiens
QESCCSPSC

SEQ ID NO: 566254 - protein, 9 aa, Homo Sapiens
RNSRYLNEK

SEQ ID NO: 566255 - protein, 9 aa, Homo Sapiens
TARSCCNTM

SEQ ID NO: 566256 - protein, 9 aa, Homo Sapiens
NQSGMEIPV

SEQ ID NO: 566257 - protein, 9 aa, Homo Sapiens
SVSAAGVRD

SEQ ID NO: 566258 - protein, 9 aa, Homo Sapiens
EAKHQWVHR

SEQ ID NO: 566259 - protein, 9 aa, Homo Sapiens
VPVAVEGHK

SEQ ID NO: 566260 - protein, 9 aa, Homo Sapiens
CAPTASAVP

SEQ ID NO: 566261 - protein, 9 aa, Homo Sapiens
TLEYRPIID

SEQ ID NO: 566262 - protein, 9 aa, Homo Sapiens
RFLRRQSRS

SEQ ID NO: 566263 - protein, 9 aa, Homo Sapiens
KNWDHVLCA

SEQ ID NO: 566264 - protein, 9 aa, Homo Sapiens
GQEEEEDQG

SEQ ID NO: 566265 - protein, 9 aa, Homo Sapiens
AQLMYLSLP

SEQ ID NO: 566266 - protein, 9 aa, Homo Sapiens
FTLTSRTRS

SEQ ID NO: 566267 - protein, 9 aa, Homo Sapiens
LKITSSPHL

SEQ ID NO: 566268 - protein, 9 aa, Homo Sapiens
QYTAPEVLS

SEQ ID NO: 566269 - protein, 9 aa, Homo Sapiens
EALAAGGAG

SEQ ID NO: 566270 - protein, 9 aa, Homo Sapiens
NNILPYEAT

SEQ ID NO: 566271 - protein, 9 aa, Homo Sapiens
PVYLKRKIA

SEQ ID NO: 566272 - protein, 9 aa, Homo Sapiens
RQRASSAQV

SEQ ID NO: 566273 - protein, 9 aa, Homo Sapiens
WGILLLPAA

SEQ ID NO: 566274 - protein, 9 aa, Homo Sapiens
MSTTPGLPT

SEQ ID NO: 566275 - protein, 9 aa, Homo Sapiens
GKVCGTKLA

SEQ ID NO: 566276 - protein, 9 aa, Homo Sapiens
PGHRGHGGT

SEQ ID NO: 566277 - protein, 9 aa, Homo Sapiens
SPMVFLPEP

SEQ ID NO: 566278 - protein, 9 aa, Homo Sapiens
QQRQRLVEG

SEQ ID NO: 566279 - protein, 9 aa, Homo Sapiens
WAACWRATS

SEQ ID NO: 566280 - protein, 9 aa, Homo Sapiens
YVEHVLCSP

SEQ ID NO: 566281 - protein, 9 aa, Homo Sapiens
AGPLCHAGR

SEQ ID NO: 566282 - protein, 9 aa, Homo Sapiens
TGMWGALLL

SEQ ID NO: 566283 - protein, 9 aa, Homo Sapiens
ENRFFPEYL

SEQ ID NO: 566284 - protein, 9 aa, Homo Sapiens
RSCCNTMRG

SEQ ID NO: 566285 - protein, 9 aa, Homo Sapiens
DPIQDSLAE

SEQ ID NO: 566286 - protein, 9 aa, Homo Sapiens
WRGPKRRRR

SEQ ID NO: 566287 - protein, 9 aa, Homo Sapiens
TNVYWGHQL

SEQ ID NO: 566288 - protein, 9 aa, Homo Sapiens
LRSFPRDCT

SEQ ID NO: 566289 - protein, 9 aa, Homo Sapiens
SFRRPLRLG

SEQ ID NO: 566290 - protein, 9 aa, Homo Sapiens
YIWALSVIL

SEQ ID NO: 566291 - protein, 9 aa, Homo Sapiens
RASAASVCG

SEQ ID NO: 566292 - protein, 9 aa, Homo Sapiens
PLVGTMSTT

SEQ ID NO: 566293 - protein, 9 aa, Homo Sapiens
TEDIIFPHQ

SEQ ID NO: 566294 - protein, 9 aa, Homo Sapiens
AQKLLEVKM

SEQ ID NO: 566295 - protein, 9 aa, Homo Sapiens
LLSPELSYT

SEQ ID NO: 566296 - protein, 9 aa, Homo Sapiens
VDRTKKGQE

SEQ ID NO: 566297 - protein, 9 aa, Homo Sapiens
PKPLFTLER

SEQ ID NO: 566298 - protein, 9 aa, Homo Sapiens
AHEGLPAVW

SEQ ID NO: 566299 - protein, 9 aa, Homo Sapiens
RAHEGLPAV

SEQ ID NO: 566300 - protein, 9 aa, Homo Sapiens
PGAQPGALR

SEQ ID NO: 566301 - protein, 9 aa, Homo Sapiens
VAHEARGLR

SEQ ID NO: 566302 - protein, 9 aa, Homo Sapiens
WWLGEELLQ

SEQ ID NO: 566303 - protein, 9 aa, Homo Sapiens
SSVARVAPR

SEQ ID NO: 566304 - protein, 9 aa, Homo Sapiens
ICYCAWCEA

SEQ ID NO: 566305 - protein, 9 aa, Homo Sapiens
ASVPASGAA

SEQ ID NO: 566306 - protein, 9 aa, Homo Sapiens
VAAVSPEWL

SEQ ID NO: 566307 - protein, 9 aa, Homo Sapiens
GQAALGARE

SEQ ID NO: 566308 - protein, 9 aa, Homo Sapiens
SLRSFPRDC

SEQ ID NO: 566309 - protein, 9 aa, Homo Sapiens
PHGTLALGS

SEQ ID NO: 566310 - protein, 9 aa, Homo Sapiens
LPAAPSWLC

SEQ ID NO: 566311 - protein, 9 aa, Homo Sapiens
TSSPHLLQN

SEQ ID NO: 566312 - protein, 9 aa, Homo Sapiens
WECELELVS

SEQ ID NO: 566313 - protein, 9 aa, Homo Sapiens
HEARGLREG

SEQ ID NO: 566314 - protein, 9 aa, Homo Sapiens
SIRECVHSY

SEQ ID NO: 566315 - protein, 9 aa, Homo Sapiens
RSRASCCRT

SEQ ID NO: 566316 - protein, 9 aa, Homo Sapiens
TRVGFLACV

SEQ ID NO: 566317 - protein, 9 aa, Homo Sapiens
VFSTKRVPK

SEQ ID NO: 566318 - protein, 9 aa, Homo Sapiens
SSSAPPAAT

SEQ ID NO: 566319 - protein, 9 aa, Homo Sapiens
PDSCQAYGS

SEQ ID NO: 566320 - protein, 9 aa, Homo Sapiens
ILLCSRSLR

SEQ ID NO: 566321 - protein, 9 aa, Homo Sapiens
SLTGGKPFP

SEQ ID NO: 566322 - protein, 9 aa, Homo Sapiens
TGYSGLDTG

SEQ ID NO: 566323 - protein, 9 aa, Homo Sapiens
PHPPSEITA

SEQ ID NO: 566324 - protein, 9 aa, Homo Sapiens
LSSVSFLGP

SEQ ID NO: 566325 - protein, 9 aa, Homo Sapiens
LEKKAAQAV

SEQ ID NO: 566326 - protein, 9 aa, Homo Sapiens
LGQHKDKVD

SEQ ID NO: 566327 - protein, 9 aa, Homo Sapiens
PFTRGCCGY

SEQ ID NO: 566328 - protein, 9 aa, Homo Sapiens
FVICNTEAL

SEQ ID NO: 566329 - protein, 9 aa, Homo Sapiens
ILLSPELSY

SEQ ID NO: 566330 - protein, 9 aa, Homo Sapiens
RPLAGVQRL

SEQ ID NO: 566331 - protein, 9 aa, Homo Sapiens
LERVAAVSP

SEQ ID NO: 566332 - protein, 9 aa, Homo Sapiens
GGNGLSLSF

SEQ ID NO: 566333 - protein, 9 aa, Homo Sapiens
SRFSRRVLS

SEQ ID NO: 566334 - protein, 9 aa, Homo Sapiens
GPGVGLVAE

SEQ ID NO: 566335 - protein, 9 aa, Homo Sapiens
SSAAGSMST

SEQ ID NO: 566336 - protein, 9 aa, Homo Sapiens
GLGQESCCS

SEQ ID NO: 566337 - protein, 9 aa, Homo Sapiens
WTMLACTGM

SEQ ID NO: 566338 - protein, 9 aa, Homo Sapiens
PSVSELPLA

SEQ ID NO: 566339 - protein, 9 aa, Homo Sapiens
ASTAWLAAS

SEQ ID NO: 566340 - protein, 9 aa, Homo Sapiens
RSFPRDCTP

SEQ ID NO: 566341 - protein, 9 aa, Homo Sapiens
FEEHVHSVD

SEQ ID NO: 566342 - protein, 9 aa, Homo Sapiens
AGHSELPVA

SEQ ID NO: 566343 - protein, 9 aa, Homo Sapiens
KECTPSCHS

SEQ ID NO: 566344 - protein, 9 aa, Homo Sapiens
MQKLHAEAP

SEQ ID NO: 566345 - protein, 9 aa, Homo Sapiens
DLHLRLRAP

SEQ ID NO: 566346 - protein, 9 aa, Homo Sapiens
GRATCEMCG

SEQ ID NO: 566347 - protein, 9 aa, Homo Sapiens
WQVSLPELE

SEQ ID NO: 566348 - protein, 9 aa, Homo Sapiens
GVPASELHE

SEQ ID NO: 566349 - protein, 9 aa, Homo Sapiens
TSCTASCSR

SEQ ID NO: 566350 - protein, 9 aa, Homo Sapiens
GKDVSKHKW

SEQ ID NO: 566351 - protein, 9 aa, Homo Sapiens
AALATSHRT

SEQ ID NO: 566352 - protein, 9 aa, Homo Sapiens
RFRTIELNS

SEQ ID NO: 566353 - protein, 9 aa, Homo Sapiens
GKSGRATCE

SEQ ID NO: 566354 - protein, 9 aa, Homo Sapiens
GQQVEPESE

SEQ ID NO: 566355 - protein, 9 aa, Homo Sapiens
NSKYDVNYA

SEQ ID NO: 566356 - protein, 9 aa, Homo Sapiens
YRWQLDKSK

SEQ ID NO: 566357 - protein, 9 aa, Homo Sapiens
TLYQYSSYL

SEQ ID NO: 566358 - protein, 9 aa, Homo Sapiens
PRDDSNCSL

SEQ ID NO: 566359 - protein, 9 aa, Homo Sapiens
TRSRLPLSS

SEQ ID NO: 566360 - protein, 9 aa, Homo Sapiens
DAIKLFVEQ

SEQ ID NO: 566361 - protein, 9 aa, Homo Sapiens
GLGEALAAG

SEQ ID NO: 566362 - protein, 9 aa, Homo Sapiens
CWTSCTASC

SEQ ID NO: 566363 - protein, 9 aa, Homo Sapiens
VALVFAQVR

SEQ ID NO: 566364 - protein, 9 aa, Homo Sapiens
TWWRGPKRR

SEQ ID NO: 566365 - protein, 9 aa, Homo Sapiens
CELELVSRA

SEQ ID NO: 566366 - protein, 9 aa, Homo Sapiens
PACWLCCPG

SEQ ID NO: 566367 - protein, 9 aa, Homo Sapiens
LVGTMSTTP

SEQ ID NO: 566368 - protein, 9 aa, Homo Sapiens
RQSRSVLFT

SEQ ID NO: 566369 - protein, 9 aa, Homo Sapiens
GYSGLDTGN

SEQ ID NO: 566370 - protein, 9 aa, Homo Sapiens
CAHCIALPS

SEQ ID NO: 566371 - protein, 9 aa, Homo Sapiens
ASTHEVQSE

SEQ ID NO: 566372 - protein, 9 aa, Homo Sapiens
GPPISAFSV

SEQ ID NO: 566373 - protein, 9 aa, Homo Sapiens
GYVEHVLCS

SEQ ID NO: 566374 - protein, 9 aa, Homo Sapiens
EQETPPPLL

SEQ ID NO: 566375 - protein, 9 aa, Homo Sapiens
KGVPASELH

SEQ ID NO: 566376 - protein, 9 aa, Homo Sapiens
SRSVLFTFK

SEQ ID NO: 566377 - protein, 9 aa, Homo Sapiens
KLWDKSIRE

SEQ ID NO: 566378 - protein, 9 aa, Homo Sapiens
LACTGMWGA

SEQ ID NO: 566379 - protein, 9 aa, Homo Sapiens
TSRTRSRLP

SEQ ID NO: 566380 - protein, 9 aa, Homo Sapiens
VRHCFFTMI

SEQ ID NO: 566381 - protein, 9 aa, Homo Sapiens
ALVLHHAAG

SEQ ID NO: 566382 - protein, 9 aa, Homo Sapiens
TAAENSAPG

SEQ ID NO: 566383 - protein, 9 aa, Homo Sapiens
WFSVLSQGH

SEQ ID NO: 566384 - protein, 9 aa, Homo Sapiens
GRCWTSCTA

SEQ ID NO: 566385 - protein, 9 aa, Homo Sapiens
ELPLASSHS

SEQ ID NO: 566386 - protein, 9 aa, Homo Sapiens
HRGHGGTAR

SEQ ID NO: 566387 - protein, 9 aa, Homo Sapiens
LRFRLVAGL

SEQ ID NO: 566388 - protein, 9 aa, Homo Sapiens
PAATDAAHM

SEQ ID NO: 566389 - protein, 9 aa, Homo Sapiens
NKLSTIQSA

SEQ ID NO: 566390 - protein, 9 aa, Homo Sapiens
TMSTTPGLP

SEQ ID NO: 566391 - protein, 9 aa, Homo Sapiens
CTPSTESAA

SEQ ID NO: 566392 - protein, 9 aa, Homo Sapiens
QESFVRPEG

SEQ ID NO: 566393 - protein, 9 aa, Homo Sapiens
EARNTDTGQ

SEQ ID NO: 566394 - protein, 9 aa, Homo Sapiens
SDTDLSLTH

SEQ ID NO: 566395 - protein, 9 aa, Homo Sapiens
ASFLTRPAR

SEQ ID NO: 566396 - protein, 9 aa, Homo Sapiens
GTRWRVRAS

SEQ ID NO: 566397 - protein, 9 aa, Homo Sapiens
AQVRRAHEG

SEQ ID NO: 566398 - protein, 9 aa, Homo Sapiens
LGGSGSCFL

SEQ ID NO: 566399 - protein, 9 aa, Homo Sapiens
WQLDKSKPT

SEQ ID NO: 566400 - protein, 9 aa, Homo Sapiens
LLPGVDLLV

SEQ ID NO: 566401 - protein, 9 aa, Homo Sapiens
YPSKSNHEV

SEQ ID NO: 566402 - protein, 9 aa, Homo Sapiens
SAVPRPQRR

SEQ ID NO: 566403 - protein, 9 aa, Homo Sapiens
VQAENRFFP

SEQ ID NO: 566404 - protein, 9 aa, Homo Sapiens
PVLLECAAV

SEQ ID NO: 566405 - protein, 9 aa, Homo Sapiens
LGQIGGLGE

SEQ ID NO: 566406 - protein, 9 aa, Homo Sapiens
RKQYVRSRW

SEQ ID NO: 566407 - protein, 9 aa, Homo Sapiens
GPPLPSSRV

SEQ ID NO: 566408 - protein, 9 aa, Homo Sapiens
RRRYVRGSF

SEQ ID NO: 566409 - protein, 9 aa, Homo Sapiens
SWEKEEQEI

SEQ ID NO: 566410 - protein, 9 aa, Homo Sapiens
YVRGSFLGK

SEQ ID NO: 566411 - protein, 9 aa, Homo Sapiens
GVFTQVTYY

SEQ ID NO: 566412 - protein, 9 aa, Homo Sapiens
LAYRCTFTA

SEQ ID NO: 566413 - protein, 9 aa, Homo Sapiens
TCDVESKRC

SEQ ID NO: 566414 - protein, 9 aa, Homo Sapiens
GASSPHGTL

SEQ ID NO: 566415 - protein, 9 aa, Homo Sapiens
FLACVGADV

SEQ ID NO: 566416 - protein, 9 aa, Homo Sapiens
GPEVVGEFP

SEQ ID NO: 566417 - protein, 9 aa, Homo Sapiens
TPLPLLKGV

SEQ ID NO: 566418 - protein, 9 aa, Homo Sapiens
DLLVPLQGR

SEQ ID NO: 566419 - protein, 9 aa, Homo Sapiens
WLGQHKDKV

SEQ ID NO: 566420 - protein, 9 aa, Homo Sapiens
WPTWWRGPK

SEQ ID NO: 566421 - protein, 9 aa, Homo Sapiens
AGRTAVTSP

SEQ ID NO: 566422 - protein, 9 aa, Homo Sapiens
CVGADVLPV

SEQ ID NO: 566423 - protein, 9 aa, Homo Sapiens
SGMWSAASG

SEQ ID NO: 566424 - protein, 9 aa, Homo Sapiens
DCKVCPSWL

SEQ ID NO: 566425 - protein, 9 aa, Homo Sapiens
CTASCSRSA

SEQ ID NO: 566426 - protein, 9 aa, Homo Sapiens
GLDTGNGLS

SEQ ID NO: 566427 - protein, 9 aa, Homo Sapiens
VGGPGVGLV

SEQ ID NO: 566428 - protein, 9 aa, Homo Sapiens
ALSSVSFLG

SEQ ID NO: 566429 - protein, 9 aa, Homo Sapiens
ASAGGDRAV

SEQ ID NO: 566430 - protein, 9 aa, Homo Sapiens
LCCPGSIRC

SEQ ID NO: 566431 - protein, 9 aa, Homo Sapiens
AGGAGEGPL

SEQ ID NO: 566432 - protein, 9 aa, Homo Sapiens
SYGTSIFPP

SEQ ID NO: 566433 - protein, 9 aa, Homo Sapiens
EATRVKLSN

SEQ ID NO: 566434 - protein, 9 aa, Homo Sapiens
NSYDCGMFV

SEQ ID NO: 566435 - protein, 9 aa, Homo Sapiens
ALLLTSPST

SEQ ID NO: 566436 - protein, 9 aa, Homo Sapiens
TTPSTCSSV

SEQ ID NO: 566437 - protein, 9 aa, Homo Sapiens
IRRNSRYLN

SEQ ID NO: 566438 - protein, 9 aa, Homo Sapiens
VGLVAEGAL

SEQ ID NO: 566439 - protein, 9 aa, Homo Sapiens
VSRSCSTLL

SEQ ID NO: 566440 - protein, 9 aa, Homo Sapiens
RATWAACWR

SEQ ID NO: 566441 - protein, 9 aa, Homo Sapiens
WDHVLCAIE

SEQ ID NO: 566442 - protein, 9 aa, Homo Sapiens
SRRVLSDCK

SEQ ID NO: 566443 - protein, 9 aa, Homo Sapiens
SFLDLHLRL

SEQ ID NO: 566444 - protein, 9 aa, Homo Sapiens
VILRIGKRP

SEQ ID NO: 566445 - protein, 9 aa, Homo Sapiens
ALGLKGSLK

SEQ ID NO: 566446 - protein, 9 aa, Homo Sapiens
AWQVSLPEL

SEQ ID NO: 566447 - protein, 9 aa, Homo Sapiens
SVLSQGHAS

SEQ ID NO: 566448 - protein, 9 aa, Homo Sapiens
TRANRGGNG

SEQ ID NO: 566449 - protein, 9 aa, Homo Sapiens
RVHALVLHH

SEQ ID NO: 566450 - protein, 9 aa, Homo Sapiens
RTLYQYSSY

SEQ ID NO: 566451 - protein, 9 aa, Homo Sapiens
SCSRSAPTT

SEQ ID NO: 566452 - protein, 9 aa, Homo Sapiens
YVDREFVIM

SEQ ID NO: 566453 - protein, 9 aa, Homo Sapiens
EAKIGQGTE

SEQ ID NO: 566454 - protein, 9 aa, Homo Sapiens
RRQRASSAQ

SEQ ID NO: 566455 - protein, 9 aa, Homo Sapiens
PSLAVSSRM

SEQ ID NO: 566456 - protein, 9 aa, Homo Sapiens
RDSTCLSSS

SEQ ID NO: 566457 - protein, 9 aa, Homo Sapiens
PCSSPVLTN

SEQ ID NO: 566458 - protein, 9 aa, Homo Sapiens
LPVAGGAAE

SEQ ID NO: 566459 - protein, 9 aa, Homo Sapiens
LPSSRVFTR

SEQ ID NO: 566460 - protein, 9 aa, Homo Sapiens
RGLREGHAA

SEQ ID NO: 566461 - protein, 9 aa, Homo Sapiens
PSLESYGTS

SEQ ID NO: 566462 - protein, 9 aa, Homo Sapiens
PVARVEALP

SEQ ID NO: 566463 - protein, 9 aa, Homo Sapiens
AHVASPGDS

SEQ ID NO: 566464 - protein, 9 aa, Homo Sapiens
ELKQKGYNV

SEQ ID NO: 566465 - protein, 9 aa, Homo Sapiens
GILLLPAAP

SEQ ID NO: 566466 - protein, 9 aa, Homo Sapiens
STSWRRSMK

SEQ ID NO: 566467 - protein, 9 aa, Homo Sapiens
QLAALATSH

SEQ ID NO: 566468 - protein, 9 aa, Homo Sapiens
RSVLFTFKG

SEQ ID NO: 566469 - protein, 9 aa, Homo Sapiens
TASCSRSAP

SEQ ID NO: 566470 - protein, 9 aa, Homo Sapiens
PSGIGRGAV

SEQ ID NO: 566471 - protein, 9 aa, Homo Sapiens
HLRASAASV

SEQ ID NO: 566472 - protein, 9 aa, Homo Sapiens
LATLREWLG

SEQ ID NO: 566473 - protein, 9 aa, Homo Sapiens
LPGVDLLVP

SEQ ID NO: 566474 - protein, 9 aa, Homo Sapiens
LEKYESSSF

SEQ ID NO: 566475 - protein, 9 aa, Homo Sapiens
SRVFTRDST

SEQ ID NO: 566476 - protein, 9 aa, Homo Sapiens
PAPGPTAPS

SEQ ID NO: 566477 - protein, 9 aa, Homo Sapiens
IDRKTGQQV

SEQ ID NO: 566478 - protein, 9 aa, Homo Sapiens
CYCAWCEAE

SEQ ID NO: 566479 - protein, 9 aa, Homo Sapiens
WPRSSASTA

SEQ ID NO: 566480 - protein, 9 aa, Homo Sapiens
RAPHRTAAR

SEQ ID NO: 566481 - protein, 9 aa, Homo Sapiens
SPHGTLALG

SEQ ID NO: 566482 - protein, 9 aa, Homo Sapiens
WCEAEDLDA

SEQ ID NO: 566483 - protein, 9 aa, Homo Sapiens
YPDGKSGRA

SEQ ID NO: 566484 - protein, 9 aa, Homo Sapiens
EQASSWEKE

SEQ ID NO: 566485 - protein, 9 aa, Homo Sapiens
LRRFRTIEL

SEQ ID NO: 566486 - protein, 9 aa, Homo Sapiens
TESSVTVKI

SEQ ID NO: 566487 - protein, 9 aa, Homo Sapiens
HGGTARARE

SEQ ID NO: 566488 - protein, 9 aa, Homo Sapiens
DKWVFSTKR

SEQ ID NO: 566489 - protein, 9 aa, Homo Sapiens
LCLEWDLAP

SEQ ID NO: 566490 - protein, 9 aa, Homo Sapiens
KPTCARNLL

SEQ ID NO: 566491 - protein, 9 aa, Homo Sapiens
AWPTWWRGP

SEQ ID NO: 566492 - protein, 9 aa, Homo Sapiens
KGLATLRAR

SEQ ID NO: 566493 - protein, 9 aa, Homo Sapiens
LWDKSIREC

SEQ ID NO: 566494 - protein, 9 aa, Homo Sapiens
QTPWTMLAC

SEQ ID NO: 566495 - protein, 9 aa, Homo Sapiens
EPGCLRPPP

SEQ ID NO: 566496 - protein, 9 aa, Homo Sapiens
GRGAVPSQH

SEQ ID NO: 566497 - protein, 9 aa, Homo Sapiens
SWCWTTWSS

SEQ ID NO: 566498 - protein, 9 aa, Homo Sapiens
GQKDKPGVF

SEQ ID NO: 566499 - protein, 9 aa, Homo Sapiens
PSWLCLEWD

SEQ ID NO: 566500 - protein, 9 aa, Homo Sapiens
KTCAPACWL

SEQ ID NO: 566501 - protein, 9 aa, Homo Sapiens
LPEQTASEQ

SEQ ID NO: 566502 - protein, 9 aa, Homo Sapiens
TRWRVRASF

SEQ ID NO: 566503 - protein, 9 aa, Homo Sapiens
SFKDPIQDS

SEQ ID NO: 566504 - protein, 9 aa, Homo Sapiens
MAKRYPAYE

SEQ ID NO: 566505 - protein, 9 aa, Homo Sapiens
QSPAESSPW

SEQ ID NO: 566506 - protein, 9 aa, Homo Sapiens
APRSRASCC

SEQ ID NO: 566507 - protein, 9 aa, Homo Sapiens
CSSPVLTNV

SEQ ID NO: 566508 - protein, 9 aa, Homo Sapiens
SPSTGTTSA

SEQ ID NO: 566509 - protein, 9 aa, Homo Sapiens
LAPPSSGAS

SEQ ID NO: 566510 - protein, 9 aa, Homo Sapiens
ALVFAQVRR

SEQ ID NO: 566511 - protein, 9 aa, Homo Sapiens
LTHKTGMGS

SEQ ID NO: 566512 - protein, 9 aa, Homo Sapiens
ATLRARKGP

SEQ ID NO: 566513 - protein, 9 aa, Homo Sapiens
DLSLTHKTG

SEQ ID NO: 566514 - protein, 9 aa, Homo Sapiens
ITYRIAGVG

SEQ ID NO: 566515 - protein, 9 aa, Homo Sapiens
FKDPIQDSL

SEQ ID NO: 566516 - protein, 9 aa, Homo Sapiens
AEAVPGQQK

SEQ ID NO: 566517 - protein, 9 aa, Homo Sapiens
KKAAQAVNR

SEQ ID NO: 566518 - protein, 9 aa, Homo Sapiens
LSVSAAGVR

SEQ ID NO: 566519 - protein, 9 aa, Homo Sapiens
QCFPSDHAP

SEQ ID NO: 566520 - protein, 9 aa, Homo Sapiens
ENSAPGTQQ

SEQ ID NO: 566521 - protein, 9 aa, Homo Sapiens
STFIRRNSR

SEQ ID NO: 566522 - protein, 9 aa, Homo Sapiens
EMQESFVRP

SEQ ID NO: 566523 - protein, 9 aa, Homo Sapiens
HAEAPHIVV

SEQ ID NO: 566524 - protein, 9 aa, Homo Sapiens
EEVQGPEVV

SEQ ID NO: 566525 - protein, 9 aa, Homo Sapiens
ASCCRTRPA

SEQ ID NO: 566526 - protein, 9 aa, Homo Sapiens
TPSTCSSVA

SEQ ID NO: 566527 - protein, 9 aa, Homo Sapiens
QPVPASVPA

SEQ ID NO: 566528 - protein, 9 aa, Homo Sapiens
CRGGDKWVF

SEQ ID NO: 566529 - protein, 9 aa, Homo Sapiens
SVARVAPRS

SEQ ID NO: 566530 - protein, 9 aa, Homo Sapiens
AQTPWTMLA

SEQ ID NO: 566531 - protein, 9 aa, Homo Sapiens
ARRTWPRSS

SEQ ID NO: 566532 - protein, 9 aa, Homo Sapiens
LWDLTEDII

SEQ ID NO: 566533 - protein, 9 aa, Homo Sapiens
TMRGTTAPR

SEQ ID NO: 566534 - protein, 9 aa, Homo Sapiens
SILLCSRSL

SEQ ID NO: 566535 - protein, 9 aa, Homo Sapiens
SPELSYTTK

SEQ ID NO: 566536 - protein, 9 aa, Homo Sapiens
ATLPPHHPG

SEQ ID NO: 566537 - protein, 9 aa, Homo Sapiens
LLSTSWRRS

SEQ ID NO: 566538 - protein, 9 aa, Homo Sapiens
GEAQKLLEV

SEQ ID NO: 566539 - protein, 9 aa, Homo Sapiens
PTAPSLRSF

SEQ ID NO: 566540 - protein, 9 aa, Homo Sapiens
SAQVRAARP

SEQ ID NO: 566541 - protein, 9 aa, Homo Sapiens
GVRDRSPMV

SEQ ID NO: 566542 - protein, 9 aa, Homo Sapiens
GLSLSFRRP

SEQ ID NO: 566543 - protein, 9 aa, Homo Sapiens
GGQVGLRFR

SEQ ID NO: 566544 - protein, 9 aa, Homo Sapiens
LEQPDSCQA

SEQ ID NO: 566545 - protein, 9 aa, Homo Sapiens
RATCEMCGM

SEQ ID NO: 566546 - protein, 9 aa, Homo Sapiens
VSRAVVFLT

SEQ ID NO: 566547 - protein, 9 aa, Homo Sapiens
VAGGAAEGL

SEQ ID NO: 566548 - protein, 9 aa, Homo Sapiens
TVLLQPNTA

SEQ ID NO: 566549 - protein, 9 aa, Homo Sapiens
RVGPKSWAP

SEQ ID NO: 566550 - protein, 9 aa, Homo Sapiens
AICPRDDSN

SEQ ID NO: 566551 - protein, 9 aa, Homo Sapiens
QAVKGKLLE

SEQ ID NO: 566552 - protein, 9 aa, Homo Sapiens
ARGPQCFPS

SEQ ID NO: 566553 - protein, 9 aa, Homo Sapiens
AVVFLTFLE

SEQ ID NO: 566554 - protein, 9 aa, Homo Sapiens
ASTGTEVQM

SEQ ID NO: 566555 - protein, 9 aa, Homo Sapiens
SSPHLLQNK

SEQ ID NO: 566556 - protein, 9 aa, Homo Sapiens
SAASGTRWR

SEQ ID NO: 566557 - protein, 9 aa, Homo Sapiens
MAEQLMNLA

SEQ ID NO: 566558 - protein, 9 aa, Homo Sapiens
PAWARATWA

SEQ ID NO: 566559 - protein, 9 aa, Homo Sapiens
ESAAAFTLT

SEQ ID NO: 566560 - protein, 9 aa, Homo Sapiens
CTFTAGRFR

SEQ ID NO: 566561 - protein, 9 aa, Homo Sapiens
GCAQPVPAS

SEQ ID NO: 566562 - protein, 9 aa, Homo Sapiens
FPSDHAPLS

SEQ ID NO: 566563 - protein, 9 aa, Homo Sapiens
EHVHSVDIA

SEQ ID NO: 566564 - protein, 9 aa, Homo Sapiens
VDLLVPLQG

SEQ ID NO: 566565 - protein, 9 aa, Homo Sapiens
DLAPPSSGA

SEQ ID NO: 566566 - protein, 9 aa, Homo Sapiens
HSFLDLHLR

SEQ ID NO: 566567 - protein, 9 aa, Homo Sapiens
GAGEGPLAR

SEQ ID NO: 566568 - protein, 9 aa, Homo Sapiens
EWLGQHKDK

SEQ ID NO: 566569 - protein, 9 aa, Homo Sapiens
KRCERTEFA

SEQ ID NO: 566570 - protein, 9 aa, Homo Sapiens
RVLSDCKVC

SEQ ID NO: 566571 - protein, 9 aa, Homo Sapiens
GSPSVSELP

SEQ ID NO: 566572 - protein, 9 aa, Homo Sapiens
AGGAAEGLG

SEQ ID NO: 566573 - protein, 9 aa, Homo Sapiens
YESSSFWGG

SEQ ID NO: 566574 - protein, 9 aa, Homo Sapiens
ELELVSRAV

SEQ ID NO: 566575 - protein, 9 aa, Homo Sapiens
ISYSFMMHT

SEQ ID NO: 566576 - protein, 9 aa, Homo Sapiens
GKTMDYWGT

SEQ ID NO: 566577 - protein, 9 aa, Homo Sapiens
HALVLHHAA

SEQ ID NO: 566578 - protein, 9 aa, Homo Sapiens
MNLAYDNGI

SEQ ID NO: 566579 - protein, 9 aa, Homo Sapiens
TDTGQASAG

SEQ ID NO: 566580 - protein, 9 aa, Homo Sapiens
QLMNLAYDN

SEQ ID NO: 566581 - protein, 9 aa, Homo Sapiens
QVEEKHNEE

SEQ ID NO: 566582 - protein, 9 aa, Homo Sapiens
MWSAASGTR

SEQ ID NO: 566583 - protein, 9 aa, Homo Sapiens
TMIFAIFSA

SEQ ID NO: 566584 - protein, 9 aa, Homo Sapiens
PDSETMLIF

SEQ ID NO: 566585 - protein, 9 aa, Homo Sapiens
GGKPFPKTT

SEQ ID NO: 566586 - protein, 9 aa, Homo Sapiens
TKKGQEEEE

SEQ ID NO: 566587 - protein, 9 aa, Homo Sapiens
FRPWRSRFL

SEQ ID NO: 566588 - protein, 9 aa, Homo Sapiens
WTTWSSCRG

SEQ ID NO: 566589 - protein, 9 aa, Homo Sapiens
STCLSSSSI

SEQ ID NO: 566590 - protein, 9 aa, Homo Sapiens
NWDHVLCAI

SEQ ID NO: 566591 - protein, 9 aa, Homo Sapiens
HSWCWTTWS

SEQ ID NO: 566592 - protein, 9 aa, Homo Sapiens
GCCGYVEHV

SEQ ID NO: 566593 - protein, 9 aa, Homo Sapiens
SLTHKTGMG

SEQ ID NO: 566594 - protein, 9 aa, Homo Sapiens
KKTCAPACW

SEQ ID NO: 566595 - protein, 9 aa, Homo Sapiens
SRAVVFLTF

SEQ ID NO: 566596 - protein, 9 aa, Homo Sapiens
LLDNLLPTL

SEQ ID NO: 566597 - protein, 9 aa, Homo Sapiens
GSSVLWLSQ

SEQ ID NO: 566598 - protein, 9 aa, Homo Sapiens
LDNLLPTLV

SEQ ID NO: 566599 - protein, 9 aa, Homo Sapiens
VSKHKWNLA

SEQ ID NO: 566600 - protein, 9 aa, Homo Sapiens
VEEKHNEEI

SEQ ID NO: 566601 - protein, 9 aa, Homo Sapiens
RGRCWTSCT

SEQ ID NO: 566602 - protein, 9 aa, Homo Sapiens
STVSRSCST

SEQ ID NO: 566603 - protein, 9 aa, Homo Sapiens
GTELQATVR

SEQ ID NO: 566604 - protein, 9 aa, Homo Sapiens
TLQYTAPEV

SEQ ID NO: 566605 - protein, 9 aa, Homo Sapiens
NRSHIVKLS

SEQ ID NO: 566606 - protein, 9 aa, Homo Sapiens
CGYVEHVLC

SEQ ID NO: 566607 - protein, 9 aa, Homo Sapiens
GRQVRIQLK

SEQ ID NO: 566608 - protein, 9 aa, Homo Sapiens
PSPAASRWW

SEQ ID NO: 566609 - protein, 9 aa, Homo Sapiens
SWRRSMKTC

SEQ ID NO: 566610 - protein, 9 aa, Homo Sapiens
PGQQKPQEQ

SEQ ID NO: 566611 - protein, 9 aa, Homo Sapiens
PPSEITASI

SEQ ID NO: 566612 - protein, 9 aa, Homo Sapiens
LADPLVQGG

SEQ ID NO: 566613 - protein, 9 aa, Homo Sapiens
SELLSNSKY

SEQ ID NO: 566614 - protein, 9 aa, Homo Sapiens
SSPWPSLSL

SEQ ID NO: 566615 - protein, 9 aa, Homo Sapiens
VKLSLSRLK

SEQ ID NO: 566616 - protein, 9 aa, Homo Sapiens
AWARATWAA

SEQ ID NO: 566617 - protein, 9 aa, Homo Sapiens
LLRSSSAPP

SEQ ID NO: 566618 - protein, 9 aa, Homo Sapiens
PLLLLPVRA

SEQ ID NO: 566619 - protein, 9 aa, Homo Sapiens
KMAKRYPAY

SEQ ID NO: 566620 - protein, 9 aa, Homo Sapiens
IRECVHSYC

SEQ ID NO: 566621 - protein, 9 aa, Homo Sapiens
QIGGLGEAL

SEQ ID NO: 566622 - protein, 9 aa, Homo Sapiens
RGPKRRRRP

SEQ ID NO: 566623 - protein, 9 aa, Homo Sapiens
PASQSALGL

SEQ ID NO: 566624 - protein, 9 aa, Homo Sapiens
DHVLCAIER

SEQ ID NO: 566625 - protein, 9 aa, Homo Sapiens
SPSVSELPL

SEQ ID NO: 566626 - protein, 9 aa, Homo Sapiens
VSFCCSTVS

SEQ ID NO: 566627 - protein, 9 aa, Homo Sapiens
RVAPRSRAS

SEQ ID NO: 566628 - protein, 9 aa, Homo Sapiens
SQHLRASAA

SEQ ID NO: 566629 - protein, 9 aa, Homo Sapiens
LRLLVWLEE

SEQ ID NO: 566630 - protein, 9 aa, Homo Sapiens
AAEGLGAQV

SEQ ID NO: 566631 - protein, 9 aa, Homo Sapiens
TGRQVRIQL

SEQ ID NO: 566632 - protein, 9 aa, Homo Sapiens
EWDLAPPSS

SEQ ID NO: 566633 - protein, 9 aa, Homo Sapiens
KAKKAQLMY

SEQ ID NO: 566634 - protein, 9 aa, Homo Sapiens
APTTSTTPS

SEQ ID NO: 566635 - protein, 9 aa, Homo Sapiens
LLSNSKYDV

SEQ ID NO: 566636 - protein, 9 aa, Homo Sapiens
VFTQVTYYR

SEQ ID NO: 566637 - protein, 9 aa, Homo Sapiens
AAPSWLCLE

SEQ ID NO: 566638 - protein, 9 aa, Homo Sapiens
SQRPSLAVS

SEQ ID NO: 566639 - protein, 9 aa, Homo Sapiens
PPSGPPISA

SEQ ID NO: 566640 - protein, 9 aa, Homo Sapiens
ADVLPVVGG

SEQ ID NO: 566641 - protein, 9 aa, Homo Sapiens
EMAEQLMNL

SEQ ID NO: 566642 - protein, 9 aa, Homo Sapiens
CRGRCWTSC

SEQ ID NO: 566643 - protein, 9 aa, Homo Sapiens
LVWLEELRR

SEQ ID NO: 566644 - protein, 9 aa, Homo Sapiens
ARKGPLASV

SEQ ID NO: 566645 - protein, 9 aa, Homo Sapiens
QLDKSKPTC

SEQ ID NO: 566646 - protein, 9 aa, Homo Sapiens
DQPTGRQVR

SEQ ID NO: 566647 - protein, 9 aa, Homo Sapiens
ISTGYSGLD

SEQ ID NO: 566648 - protein, 9 aa, Homo Sapiens
GGAAEGLGA

SEQ ID NO: 566649 - protein, 9 aa, Homo Sapiens
FPRDCTPST

SEQ ID NO: 566650 - protein, 9 aa, Homo Sapiens
GLGAQVRAL

SEQ ID NO: 566651 - protein, 9 aa, Homo Sapiens
GSIRCGRPR

SEQ ID NO: 566652 - protein, 9 aa, Homo Sapiens
QKLLEVKME

SEQ ID NO: 566653 - protein, 9 aa, Homo Sapiens
FRFCAHCIA

SEQ ID NO: 566654 - protein, 9 aa, Homo Sapiens
VSTGHAIPL

SEQ ID NO: 566655 - protein, 9 aa, Homo Sapiens
TYRIAGVGI

SEQ ID NO: 566656 - protein, 9 aa, Homo Sapiens
RFCCWTSGM

SEQ ID NO: 566657 - protein, 9 aa, Homo Sapiens
RRRKKTCAP

SEQ ID NO: 566658 - protein, 9 aa, Homo Sapiens
QGGSVPSGI

SEQ ID NO: 566659 - protein, 9 aa, Homo Sapiens
PTGRQVRIQ

SEQ ID NO: 566660 - protein, 9 aa, Homo Sapiens
LCSRSLRLL

SEQ ID NO: 566661 - protein, 9 aa, Homo Sapiens
WGHQLAALA

SEQ ID NO: 566662 - protein, 9 aa, Homo Sapiens
HPISLSSSR

SEQ ID NO: 566663 - protein, 9 aa, Homo Sapiens
TMLACTGMW

SEQ ID NO: 566664 - protein, 9 aa, Homo Sapiens
IPVYLKRKI

SEQ ID NO: 566665 - protein, 9 aa, Homo Sapiens
PSSGASSPH

SEQ ID NO: 566666 - protein, 9 aa, Homo Sapiens
KGPLASVDA

SEQ ID NO: 566667 - protein, 9 aa, Homo Sapiens
EALPTPATN

SEQ ID NO: 566668 - protein, 9 aa, Homo Sapiens
LVGPLARVQ

SEQ ID NO: 566669 - protein, 9 aa, Homo Sapiens
PPSSGASSP

SEQ ID NO: 566670 - protein, 9 aa, Homo Sapiens
GEILLSPEL

SEQ ID NO: 566671 - protein, 9 aa, Homo Sapiens
GQGTEPSIR

SEQ ID NO: 566672 - protein, 9 aa, Homo Sapiens
EVKMEAEKI

SEQ ID NO: 566673 - protein, 9 aa, Homo Sapiens
PQCFPSDHA

SEQ ID NO: 566674 - protein, 9 aa, Homo Sapiens
RSRWKLSFS

SEQ ID NO: 566675 - protein, 9 aa, Homo Sapiens
PARCPCAPT

SEQ ID NO: 566676 - protein, 9 aa, Homo Sapiens
TVRHCFFTM

SEQ ID NO: 566677 - protein, 9 aa, Homo Sapiens
QDGCAQPVP

SEQ ID NO: 566678 - protein, 9 aa, Homo Sapiens
YCSRFSRRV

SEQ ID NO: 566679 - protein, 9 aa, Homo Sapiens
VLHHAAGHS

SEQ ID NO: 566680 - protein, 9 aa, Homo Sapiens
LELADPLVQ

SEQ ID NO: 566681 - protein, 9 aa, Homo Sapiens
VLGQIGGLG

SEQ ID NO: 566682 - protein, 9 aa, Homo Sapiens
TASAVPRPQ

SEQ ID NO: 566683 - protein, 9 aa, Homo Sapiens
VFTRDSTCL

SEQ ID NO: 566684 - protein, 9 aa, Homo Sapiens
HIVGPQWEC

SEQ ID NO: 566685 - protein, 9 aa, Homo Sapiens
DALVAHEAR

SEQ ID NO: 566686 - protein, 9 aa, Homo Sapiens
GPLARVHAL

SEQ ID NO: 566687 - protein, 9 aa, Homo Sapiens
YDVNYAFGR

SEQ ID NO: 566688 - protein, 9 aa, Homo Sapiens
GALVGPLAR

SEQ ID NO: 566689 - protein, 9 aa, Homo Sapiens
AYLLDNLLP

SEQ ID NO: 566690 - protein, 9 aa, Homo Sapiens
DSNCSLVSS

SEQ ID NO: 566691 - protein, 9 aa, Homo Sapiens
LLVWLEELR

SEQ ID NO: 566692 - protein, 9 aa, Homo Sapiens
WGAKASTHE

SEQ ID NO: 566693 - protein, 9 aa, Homo Sapiens
PSWLSVSAA

SEQ ID NO: 566694 - protein, 9 aa, Homo Sapiens
LLLTSPSTG

SEQ ID NO: 566695 - protein, 9 aa, Homo Sapiens
YMAAPQIRT

SEQ ID NO: 566696 - protein, 9 aa, Homo Sapiens
SSVSFLGPP

SEQ ID NO: 566697 - protein, 9 aa, Homo Sapiens
AASVCGHWG

SEQ ID NO: 566698 - protein, 9 aa, Homo Sapiens
TRDSTCLSS

SEQ ID NO: 566699 - protein, 9 aa, Homo Sapiens
EEEMIFGEM

SEQ ID NO: 566700 - protein, 9 aa, Homo Sapiens
GDKWVFSTK

SEQ ID NO: 566701 - protein, 9 aa, Homo Sapiens
SQEGGAPLS

SEQ ID NO: 566702 - protein, 9 aa, Homo Sapiens
RALVAQQRQ

SEQ ID NO: 566703 - protein, 9 aa, Homo Sapiens
AEGLGAQVR

SEQ ID NO: 566704 - protein, 9 aa, Homo Sapiens
MRGTTAPRR

SEQ ID NO: 566705 - protein, 9 aa, Homo Sapiens
GHGGTARAR

SEQ ID NO: 566706 - protein, 9 aa, Homo Sapiens
GTSIFPPTR

SEQ ID NO: 566707 - protein, 9 aa, Homo Sapiens
MEQASSWEK

SEQ ID NO: 566708 - protein, 9 aa, Homo Sapiens
LECAAVGVG

SEQ ID NO: 566709 - protein, 9 aa, Homo Sapiens
FRTIELNST

SEQ ID NO: 566710 - protein, 9 aa, Homo Sapiens
RLVLGQIGG

SEQ ID NO: 566711 - protein, 9 aa, Homo Sapiens
VCGTKLAYR

SEQ ID NO: 566712 - protein, 9 aa, Homo Sapiens
ATLREWLGQ

SEQ ID NO: 566713 - protein, 9 aa, Homo Sapiens
ESSPWPSLS

SEQ ID NO: 566714 - protein, 9 aa, Homo Sapiens
VASPGDSPV

SEQ ID NO: 566715 - protein, 9 aa, Homo Sapiens
GPSTLRMVA

SEQ ID NO: 566716 - protein, 9 aa, Homo Sapiens
RAVRAGAAD

SEQ ID NO: 566717 - protein, 9 aa, Homo Sapiens
QKITYRIAG

SEQ ID NO: 566718 - protein, 9 aa, Homo Sapiens
LLSGEKRPD

SEQ ID NO: 566719 - protein, 9 aa, Homo Sapiens
GLVAEGALV

SEQ ID NO: 566720 - protein, 9 aa, Homo Sapiens
VPSQHLRAS

SEQ ID NO: 566721 - protein, 9 aa, Homo Sapiens
VKMEAEKIT

SEQ ID NO: 566722 - protein, 9 aa, Homo Sapiens
GMFVICNTE

SEQ ID NO: 566723 - protein, 9 aa, Homo Sapiens
FFPEYLTNK

SEQ ID NO: 566724 - protein, 9 aa, Homo Sapiens
LVGGPSTLR

SEQ ID NO: 566725 - protein, 9 aa, Homo Sapiens
EMQKLHAEA

SEQ ID NO: 566726 - protein, 9 aa, Homo Sapiens
VEALPTPAT

SEQ ID NO: 566727 - protein, 9 aa, Homo Sapiens
GTEPSIRMF

SEQ ID NO: 566728 - protein, 9 aa, Homo Sapiens
DGKSGRATC

SEQ ID NO: 566729 - protein, 9 aa, Homo Sapiens
AESSPWPSL

SEQ ID NO: 566730 - protein, 9 aa, Homo Sapiens
SNCSLVSST

SEQ ID NO: 566731 - protein, 9 aa, Homo Sapiens
ASLPSPAAS

SEQ ID NO: 566732 - protein, 9 aa, Homo Sapiens
PPPARASPA

SEQ ID NO: 566733 - protein, 9 aa, Homo Sapiens
APQIRTMLS

SEQ ID NO: 566734 - protein, 9 aa, Homo Sapiens
AFEKPDVPE

SEQ ID NO: 566735 - protein, 9 aa, Homo Sapiens
VRASFLTRP

SEQ ID NO: 566736 - protein, 9 aa, Homo Sapiens
SPHLLQNKW

SEQ ID NO: 566737 - protein, 9 aa, Homo Sapiens
PVRAWGLLP

SEQ ID NO: 566738 - protein, 9 aa, Homo Sapiens
CCSTVSRSC

SEQ ID NO: 566739 - protein, 9 aa, Homo Sapiens
PHRTAARSW

SEQ ID NO: 566740 - protein, 9 aa, Homo Sapiens
LALHGPAWA

SEQ ID NO: 566741 - protein, 9 aa, Homo Sapiens
LDAEKAHVA

SEQ ID NO: 566742 - protein, 9 aa, Homo Sapiens
IGRGAVPSQ

SEQ ID NO: 566743 - protein, 9 aa, Homo Sapiens
IQDSLAEQG

SEQ ID NO: 566744 - protein, 9 aa, Homo Sapiens
RINPELKQK

SEQ ID NO: 566745 - protein, 9 aa, Homo Sapiens
LRRQSRSVL

SEQ ID NO: 566746 - protein, 9 aa, Homo Sapiens
EVQGPEVVG

SEQ ID NO: 566747 - protein, 9 aa, Homo Sapiens
ASCSRSAPT

SEQ ID NO: 566748 - protein, 9 aa, Homo Sapiens
SASTGTEVQ

SEQ ID NO: 566749 - protein, 9 aa, Homo Sapiens
LRAPCLRRP

SEQ ID NO: 566750 - protein, 9 aa, Homo Sapiens
FCCSTVSRS

SEQ ID NO: 566751 - protein, 9 aa, Homo Sapiens
AVEGHKIHW

SEQ ID NO: 566752 - protein, 9 aa, Homo Sapiens
PLRLGLRGA

SEQ ID NO: 566753 - protein, 9 aa, Homo Sapiens
CAQPVPASV

SEQ ID NO: 566754 - protein, 9 aa, Homo Sapiens
AGEGPLARV

SEQ ID NO: 566755 - protein, 9 aa, Homo Sapiens
THGPLSKLY

SEQ ID NO: 566756 - protein, 9 aa, Homo Sapiens
PRRQRASSA

SEQ ID NO: 566757 - protein, 9 aa, Homo Sapiens
STHEVQSEQ

SEQ ID NO: 566758 - protein, 9 aa, Homo Sapiens
FLGPPLPSS

SEQ ID NO: 566759 - protein, 9 aa, Homo Sapiens
LIKLSGAHL

SEQ ID NO: 566760 - protein, 9 aa, Homo Sapiens
CCRTRPARC

SEQ ID NO: 566761 - protein, 9 aa, Homo Sapiens
KLLEVKMEA

SEQ ID NO: 566762 - protein, 9 aa, Homo Sapiens
PPARASPAP

SEQ ID NO: 566763 - protein, 9 aa, Homo Sapiens
SLPSPAASR

SEQ ID NO: 566764 - protein, 9 aa, Homo Sapiens
LALSSVSFL

SEQ ID NO: 566765 - protein, 9 aa, Homo Sapiens
AQQRQRLVE

SEQ ID NO: 566766 - protein, 9 aa, Homo Sapiens
QASAGGDRA

SEQ ID NO: 566767 - protein, 9 aa, Homo Sapiens
CAACPGAPQ

SEQ ID NO: 566768 - protein, 9 aa, Homo Sapiens
SWAPAPRRQ

SEQ ID NO: 566769 - protein, 9 aa, Homo Sapiens
ERVAAVSPE

SEQ ID NO: 566770 - protein, 9 aa, Homo Sapiens
DRAVRAGAA

SEQ ID NO: 566771 - protein, 9 aa, Homo Sapiens
GMWGALLLT

SEQ ID NO: 566772 - protein, 9 aa, Homo Sapiens
QWFSVLSQG

SEQ ID NO: 566773 - protein, 9 aa, Homo Sapiens
KDKPGVFTQ

SEQ ID NO: 566774 - protein, 9 aa, Homo Sapiens
TGWVAQTPW

SEQ ID NO: 566775 - protein, 9 aa, Homo Sapiens
AGVRDRSPM

SEQ ID NO: 566776 - protein, 9 aa, Homo Sapiens
KASTHEVQS

SEQ ID NO: 566777 - protein, 9 aa, Homo Sapiens
TDAAHMSAS

SEQ ID NO: 566778 - protein, 9 aa, Homo Sapiens
PKKMAKRYP

SEQ ID NO: 566779 - protein, 9 aa, Homo Sapiens
QMKRVGPKS

SEQ ID NO: 566780 - protein, 9 aa, Homo Sapiens
TERKECTPS

SEQ ID NO: 566781 - protein, 9 aa, Homo Sapiens
MIFAIFSAI

SEQ ID NO: 566782 - protein, 9 aa, Homo Sapiens
SSAQVRAAR

SEQ ID NO: 566783 - protein, 9 aa, Homo Sapiens
RLDAEKAHV

SEQ ID NO: 566784 - protein, 9 aa, Homo Sapiens
ACVGADVLP

SEQ ID NO: 566785 - protein, 9 aa, Homo Sapiens
QTASEQETP

SEQ ID NO: 566786 - protein, 9 aa, Homo Sapiens
APKRMKFFK

SEQ ID NO: 566787 - protein, 9 aa, Homo Sapiens
PGVGLVAEG

SEQ ID NO: 566788 - protein, 9 aa, Homo Sapiens
FQKHCERTH

SEQ ID NO: 566789 - protein, 9 aa, Homo Sapiens
PEELSQEGG

SEQ ID NO: 566790 - protein, 9 aa, Homo Sapiens
WGALLLTSP

SEQ ID NO: 566791 - protein, 9 aa, Homo Sapiens
VQTESSVTV

SEQ ID NO: 566792 - protein, 9 aa, Homo Sapiens
FLTFLELAD

SEQ ID NO: 566793 - protein, 9 aa, Homo Sapiens
ALHGPAWAR

SEQ ID NO: 566794 - protein, 9 aa, Homo Sapiens
APHRTAARS

SEQ ID NO: 566795 - protein, 9 aa, Homo Sapiens
TSGMWSAAS

SEQ ID NO: 566796 - protein, 9 aa, Homo Sapiens
LSAPLLLLA

SEQ ID NO: 566797 - protein, 9 aa, Homo Sapiens
DTGNGLSDS

SEQ ID NO: 566798 - protein, 9 aa, Homo Sapiens
TLRARKGPL

SEQ ID NO: 566799 - protein, 9 aa, Homo Sapiens
KRPDSETML

SEQ ID NO: 566800 - protein, 9 aa, Homo Sapiens
YCAWCEAED

SEQ ID NO: 566801 - protein, 9 aa, Homo Sapiens
PRPSCRFCC

SEQ ID NO: 566802 - protein, 9 aa, Homo Sapiens
GTLQYTGER

SEQ ID NO: 566803 - protein, 9 aa, Homo Sapiens
RRVLSDCKV

SEQ ID NO: 566804 - protein, 9 aa, Homo Sapiens
SRLPLSSST

SEQ ID NO: 566805 - protein, 9 aa, Homo Sapiens
NRFFPEYLT

SEQ ID NO: 566806 - protein, 9 aa, Homo Sapiens
TKRVPKPLF

SEQ ID NO: 566807 - protein, 9 aa, Homo Sapiens
SCSTLLRSS

SEQ ID NO: 566808 - protein, 9 aa, Homo Sapiens
PMVFLPEPG

SEQ ID NO: 566809 - protein, 9 aa, Homo Sapiens
HVELEKKAA

SEQ ID NO: 566810 - protein, 9 aa, Homo Sapiens
WDLAPPSSG

SEQ ID NO: 566811 - protein, 9 aa, Homo Sapiens
WRVRASFLT

SEQ ID NO: 566812 - protein, 9 aa, Homo Sapiens
LSQGHASTD

SEQ ID NO: 566813 - protein, 9 aa, Homo Sapiens
SVLFTFKGV

SEQ ID NO: 566814 - protein, 9 aa, Homo Sapiens
TLREWLGQH

SEQ ID NO: 566815 - protein, 9 aa, Homo Sapiens
LSDCKVCPS

SEQ ID NO: 566816 - protein, 9 aa, Homo Sapiens
FWLRMVSFC

SEQ ID NO: 566817 - protein, 9 aa, Homo Sapiens
FCKNWDHVL

SEQ ID NO: 566818 - protein, 9 aa, Homo Sapiens
HEVLEFVTS

SEQ ID NO: 566819 - protein, 9 aa, Homo Sapiens
APGTQQDGC

SEQ ID NO: 566820 - protein, 9 aa, Homo Sapiens
CSRFSRRVL

SEQ ID NO: 566821 - protein, 9 aa, Homo Sapiens
YLLDNLLPT

SEQ ID NO: 566822 - protein, 9 aa, Homo Sapiens
ESKRCERTE

SEQ ID NO: 566823 - protein, 9 aa, Homo Sapiens
SPGPEELSQ

SEQ ID NO: 566824 - protein, 9 aa, Homo Sapiens
LRMVSFCCS

SEQ ID NO: 566825 - protein, 9 aa, Homo Sapiens
HCIALPSGL

SEQ ID NO: 566826 - protein, 9 aa, Homo Sapiens
QKHCERTHG

SEQ ID NO: 566827 - protein, 9 aa, Homo Sapiens
LARVHALVL

SEQ ID NO: 566828 - protein, 9 aa, Homo Sapiens
KLSLSRLKF

SEQ ID NO: 566829 - protein, 9 aa, Homo Sapiens
DVLPVVGGP

SEQ ID NO: 566830 - protein, 9 aa, Homo Sapiens
MWGALLLTS

SEQ ID NO: 566831 - protein, 9 aa, Homo Sapiens
PWRSRFLRR

SEQ ID NO: 566832 - protein, 9 aa, Homo Sapiens
QGSVSVQVS

SEQ ID NO: 566833 - protein, 9 aa, Homo Sapiens
PELKQKGYN

SEQ ID NO: 566834 - protein, 9 aa, Homo Sapiens
WDLTEDIIF

SEQ ID NO: 566835 - protein, 9 aa, Homo Sapiens
LTNVYWGHQ

SEQ ID NO: 566836 - protein, 9 aa, Homo Sapiens
APGPTAPSL

SEQ ID NO: 566837 - protein, 9 aa, Homo Sapiens
RARGPQCFP

SEQ ID NO: 566838 - protein, 9 aa, Homo Sapiens
GSVSVQVSA

SEQ ID NO: 566839 - protein, 9 aa, Homo Sapiens
VESKRCERT

SEQ ID NO: 566840 - protein, 9 aa, Homo Sapiens
NHEVLEFVT

SEQ ID NO: 566841 - protein, 9 aa, Homo Sapiens
PSTCSSVAR

SEQ ID NO: 566842 - protein, 9 aa, Homo Sapiens
LVAEGALVG

SEQ ID NO: 566843 - protein, 9 aa, Homo Sapiens
DPAAALREV

SEQ ID NO: 566844 - protein, 9 aa, Homo Sapiens
GALRGKCYL

SEQ ID NO: 566845 - protein, 9 aa, Homo Sapiens
RPDSETMLI

SEQ ID NO: 566846 - protein, 9 aa, Homo Sapiens
QPNTAPGTP

SEQ ID NO: 566847 - protein, 9 aa, Homo Sapiens
LTPLPLLKG

SEQ ID NO: 566848 - protein, 9 aa, Homo Sapiens
AARSWRGAW

SEQ ID NO: 566849 - protein, 9 aa, Homo Sapiens
NRGGNGLSL

SEQ ID NO: 566850 - protein, 9 aa, Homo Sapiens
GEMKMIWMR

SEQ ID NO: 566851 - protein, 9 aa, Homo Sapiens
APQGGSVPS

SEQ ID NO: 566852 - protein, 9 aa, Homo Sapiens
EGPLARVHA

SEQ ID NO: 566853 - protein, 9 aa, Homo Sapiens
CDVESKRCE

SEQ ID NO: 566854 - protein, 9 aa, Homo Sapiens
AGKGLATLR

SEQ ID NO: 566855 - protein, 9 aa, Homo Sapiens
GALLLTSPS

SEQ ID NO: 566856 - protein, 9 aa, Homo Sapiens
SISKSLNES

SEQ ID NO: 566857 - protein, 9 aa, Homo Sapiens
LLQNKWSRD

SEQ ID NO: 566858 - protein, 9 aa, Homo Sapiens
APPSSGASS

SEQ ID NO: 566859 - protein, 9 aa, Homo Sapiens
FTAGRFRPW

SEQ ID NO: 566860 - protein, 9 aa, Homo Sapiens
HSPHPPSEI

SEQ ID NO: 566861 - protein, 9 aa, Homo Sapiens
AACPGAPQG

SEQ ID NO: 566862 - protein, 9 aa, Homo Sapiens
QIRTMLSSG

SEQ ID NO: 566863 - protein, 9 aa, Homo Sapiens
LHHAAGHSE

SEQ ID NO: 566864 - protein, 9 aa, Homo Sapiens
FIRDQPTGR

SEQ ID NO: 566865 - protein, 9 aa, Homo Sapiens
HLGIHIVGP

SEQ ID NO: 566866 - protein, 9 aa, Homo Sapiens
SGRATCEMC

SEQ ID NO: 566867 - protein, 9 aa, Homo Sapiens
SRWKLSFSI

SEQ ID NO: 566868 - protein, 9 aa, Homo Sapiens
TASEQETPP

SEQ ID NO: 566869 - protein, 9 aa, Homo Sapiens
ICGTLQYTA

SEQ ID NO: 566870 - protein, 9 aa, Homo Sapiens
EITASIVKT

SEQ ID NO: 566871 - protein, 9 aa, Homo Sapiens
MAGPLSAPL

SEQ ID NO: 566872 - protein, 9 aa, Homo Sapiens
CWTSGMWSA

SEQ ID NO: 566873 - protein, 9 aa, Homo Sapiens
ICGTLQYTG

SEQ ID NO: 566874 - protein, 9 aa, Homo Sapiens
IELTRTLYQ

SEQ ID NO: 566875 - protein, 9 aa, Homo Sapiens
GLPAVWTRV

SEQ ID NO: 566876 - protein, 9 aa, Homo Sapiens
QGPEVVGEF

SEQ ID NO: 566877 - protein, 9 aa, Homo Sapiens
LSISKSLNE

SEQ ID NO: 566878 - protein, 9 aa, Homo Sapiens
TRPARCPCA

SEQ ID NO: 566879 - protein, 9 aa, Homo Sapiens
FPPTRANRG

SEQ ID NO: 566880 - protein, 9 aa, Homo Sapiens
CSRSAPTTS

SEQ ID NO: 566881 - protein, 9 aa, Homo Sapiens
HVTEMQESF

SEQ ID NO: 566882 - protein, 9 aa, Homo Sapiens
RGNKLSTIQ

SEQ ID NO: 566883 - protein, 9 aa, Homo Sapiens
INPELKQKG

SEQ ID NO: 566884 - protein, 9 aa, Homo Sapiens
ILNRYVDRE

SEQ ID NO: 566885 - protein, 9 aa, Homo Sapiens
RSLRLLVWL

SEQ ID NO: 566886 - protein, 9 aa, Homo Sapiens
VAQQRQRLV

SEQ ID NO: 566887 - protein, 9 aa, Homo Sapiens
SSVLWLSQR

SEQ ID NO: 566888 - protein, 9 aa, Homo Sapiens
AVPGQQKPQ

SEQ ID NO: 566889 - protein, 9 aa, Homo Sapiens
GPKSWAPAP

SEQ ID NO: 566890 - protein, 9 aa, Homo Sapiens
CWTTWSSCR

SEQ ID NO: 566891 - protein, 9 aa, Homo Sapiens
WALSVILRI

SEQ ID NO: 566892 - protein, 9 aa, Homo Sapiens
ELVSRAVVF

SEQ ID NO: 566893 - protein, 9 aa, Homo Sapiens
GDRAVRAGA

SEQ ID NO: 566894 - protein, 9 aa, Homo Sapiens
GKGLATLRA

SEQ ID NO: 566895 - protein, 9 aa, Homo Sapiens
NQAVKGKLL

SEQ ID NO: 566896 - protein, 9 aa, Homo Sapiens
AGPAEAVPG

SEQ ID NO: 566897 - protein, 9 aa, Homo Sapiens
VPASVQTES

SEQ ID NO: 566898 - protein, 9 aa, Homo Sapiens
SLNESEALP

SEQ ID NO: 566899 - protein, 9 aa, Homo Sapiens
YVRSRWKLS

SEQ ID NO: 566900 - protein, 9 aa, Homo Sapiens
KIGQGTEPS

SEQ ID NO: 566901 - protein, 9 aa, Homo Sapiens
DYWGTMIPS

SEQ ID NO: 566902 - protein, 9 aa, Homo Sapiens
HKIHWIESK

SEQ ID NO: 566903 - protein, 9 aa, Homo Sapiens
QETPPPLLT

SEQ ID NO: 566904 - protein, 9 aa, Homo Sapiens
IGGLGEALA

SEQ ID NO: 566905 - protein, 9 aa, Homo Sapiens
CWRATSARC

SEQ ID NO: 566906 - protein, 9 aa, Homo Sapiens
PECRDMQPY

SEQ ID NO: 566907 - protein, 9 aa, Homo Sapiens
DRKTGQQVE

SEQ ID NO: 566908 - protein, 9 aa, Homo Sapiens
PAEAVPGQQ

SEQ ID NO: 566909 - protein, 9 aa, Homo Sapiens
THVTEMQES

SEQ ID NO: 566910 - protein, 9 aa, Homo Sapiens
PSLRSFPRD

SEQ ID NO: 566911 - protein, 9 aa, Homo Sapiens
MSASTGTEV

SEQ ID NO: 566912 - protein, 9 aa, Homo Sapiens
PKRMKFFKR

SEQ ID NO: 566913 - protein, 9 aa, Homo Sapiens
PKRRRRPHS

SEQ ID NO: 566914 - protein, 9 aa, Homo Sapiens
VPASVPASG

SEQ ID NO: 566915 - protein, 9 aa, Homo Sapiens
LLLPVRAWG

SEQ ID NO: 566916 - protein, 9 aa, Homo Sapiens
YLEKYESSS

SEQ ID NO: 566917 - protein, 9 aa, Homo Sapiens
GPAWARATW

SEQ ID NO: 566918 - protein, 9 aa, Homo Sapiens
VSAGPLAYA

SEQ ID NO: 566919 - protein, 9 aa, Homo Sapiens
AHEARGLRE

SEQ ID NO: 566920 - protein, 9 aa, Homo Sapiens
FGSMNSSAA

SEQ ID NO: 566921 - protein, 9 aa, Homo Sapiens
QHLRASAAS

SEQ ID NO: 566922 - protein, 9 aa, Homo Sapiens
ARAREAVHA

SEQ ID NO: 566923 - protein, 9 aa, Homo Sapiens
HWGILLLPA

SEQ ID NO: 566924 - protein, 9 aa, Homo Sapiens
QPDSCQAYG

SEQ ID NO: 566925 - protein, 9 aa, Homo Sapiens
LVAQQRQRL

SEQ ID NO: 566926 - protein, 9 aa, Homo Sapiens
RRRRPHSWC

SEQ ID NO: 566927 - protein, 9 aa, Homo Sapiens
PHLLQNKWS

SEQ ID NO: 566928 - protein, 9 aa, Homo Sapiens
VRAGAADAG

SEQ ID NO: 566929 - protein, 9 aa, Homo Sapiens
TAVTSPGCA

SEQ ID NO: 566930 - protein, 9 aa, Homo Sapiens
EGLPAVWTR

SEQ ID NO: 566931 - protein, 9 aa, Homo Sapiens
AFQKHCERT

SEQ ID NO: 566932 - protein, 9 aa, Homo Sapiens
SARCWRTAR

SEQ ID NO: 566933 - protein, 9 aa, Homo Sapiens
LTFLELADP

SEQ ID NO: 566934 - protein, 9 aa, Homo Sapiens
SYSFMMHTS

SEQ ID NO: 566935 - protein, 9 aa, Homo Sapiens
CSSVARVAP

SEQ ID NO: 566936 - protein, 9 aa, Homo Sapiens
KNVQYPECR

SEQ ID NO: 566937 - protein, 9 aa, Homo Sapiens
FTQVTYYRN

SEQ ID NO: 566938 - protein, 9 aa, Homo Sapiens
SPVATLPPH

SEQ ID NO: 566939 - protein, 9 aa, Homo Sapiens
ARCPCAPTA

SEQ ID NO: 566940 - protein, 9 aa, Homo Sapiens
SCRFCCWTS

SEQ ID NO: 566941 - protein, 9 aa, Homo Sapiens
VPGQQKPQE

SEQ ID NO: 566942 - protein, 9 aa, Homo Sapiens
PRSRASCCR

SEQ ID NO: 566943 - protein, 9 aa, Homo Sapiens
LAVSSRMVS

SEQ ID NO: 566944 - protein, 9 aa, Homo Sapiens
GCAACPGAP

SEQ ID NO: 566945 - protein, 9 aa, Homo Sapiens
RLVEGQAAL

SEQ ID NO: 566946 - protein, 9 aa, Homo Sapiens
SKPTCARNL

SEQ ID NO: 566947 - protein, 9 aa, Homo Sapiens
LPVVGGPGV

SEQ ID NO: 566948 - protein, 9 aa, Homo Sapiens
VSALERPLA

SEQ ID NO: 566949 - protein, 9 aa, Homo Sapiens
GLREGHAAV

SEQ ID NO: 566950 - protein, 9 aa, Homo Sapiens
TGGKPFPKT

SEQ ID NO: 566951 - protein, 9 aa, Homo Sapiens
RSCSTLLRS

SEQ ID NO: 566952 - protein, 9 aa, Homo Sapiens
RLRAPCLRR

SEQ ID NO: 566953 - protein, 9 aa, Homo Sapiens
FTRGCCGYV

SEQ ID NO: 566954 - protein, 9 aa, Homo Sapiens
QYPECRDMQ

SEQ ID NO: 566955 - protein, 9 aa, Homo Sapiens
PTCARNLLS

SEQ ID NO: 566956 - protein, 9 aa, Homo Sapiens
LMNLAYDNG

SEQ ID NO: 566957 - protein, 9 aa, Homo Sapiens
CSTLLRSSS

SEQ ID NO: 566958 - protein, 9 aa, Homo Sapiens
RGPQCFPSD

SEQ ID NO: 566959 - protein, 9 aa, Homo Sapiens
VVGGPGVGL

SEQ ID NO: 566960 - protein, 9 aa, Homo Sapiens
VLTNVYWGH

SEQ ID NO: 566961 - protein, 9 aa, Homo Sapiens
VAQTPWTML

SEQ ID NO: 566962 - protein, 9 aa, Homo Sapiens
NLLSTSWRR

SEQ ID NO: 566963 - protein, 9 aa, Homo Sapiens
LACVGADVL

SEQ ID NO: 566964 - protein, 9 aa, Homo Sapiens
ALGSPSVSE

SEQ ID NO: 566965 - protein, 9 aa, Homo Sapiens
RSPMVFLPE

SEQ ID NO: 566966 - protein, 9 aa, Homo Sapiens
IFCKNWDHV

SEQ ID NO: 566967 - protein, 9 aa, Homo Sapiens
LRASAASVC

SEQ ID NO: 566968 - protein, 9 aa, Homo Sapiens
SVQTESSVT

SEQ ID NO: 566969 - protein, 9 aa, Homo Sapiens
SCCNTMRGT

SEQ ID NO: 566970 - protein, 9 aa, Homo Sapiens
AQVRAARPA

SEQ ID NO: 566971 - protein, 9 aa, Homo Sapiens
TGQQVEPES

SEQ ID NO: 566972 - protein, 9 aa, Homo Sapiens
LRARGPQCF

SEQ ID NO: 566973 - protein, 9 aa, Homo Sapiens
DEMAEQLMN

SEQ ID NO: 566974 - protein, 9 aa, Homo Sapiens
TKFEEHVHS

SEQ ID NO: 566975 - protein, 9 aa, Homo Sapiens
LSGAHLVDD

SEQ ID NO: 566976 - protein, 9 aa, Homo Sapiens
TLLRSSSAP

SEQ ID NO: 566977 - protein, 9 aa, Homo Sapiens
APACWLCCP

SEQ ID NO: 566978 - protein, 9 aa, Homo Sapiens
MKFFKRYLD

SEQ ID NO: 566979 - protein, 9 aa, Homo Sapiens
LDAIELTRT

SEQ ID NO: 566980 - protein, 9 aa, Homo Sapiens
TARAREAVH

SEQ ID NO: 566981 - protein, 9 aa, Homo Sapiens
VAVEGHKIH

SEQ ID NO: 566982 - protein, 9 aa, Homo Sapiens
ARVHALVLH

SEQ ID NO: 566983 - protein, 9 aa, Homo Sapiens
PERINPELK

SEQ ID NO: 566984 - protein, 9 aa, Homo Sapiens
PKSWAPAPR

SEQ ID NO: 566985 - protein, 9 aa, Homo Sapiens
GAVPSQHLR

SEQ ID NO: 566986 - protein, 9 aa, Homo Sapiens
EELLQGNSS

SEQ ID NO: 566987 - protein, 9 aa, Homo Sapiens
GPASQSALG

SEQ ID NO: 566988 - protein, 9 aa, Homo Sapiens
VGGPSTLRM

SEQ ID NO: 566989 - protein, 9 aa, Homo Sapiens
KWNLAIAGG

SEQ ID NO: 566990 - protein, 9 aa, Homo Sapiens
HRTAARSWR

SEQ ID NO: 566991 - protein, 9 aa, Homo Sapiens
RPPPARASP

SEQ ID NO: 566992 - protein, 9 aa, Homo Sapiens
KRVGPKSWA

SEQ ID NO: 566993 - protein, 9 aa, Homo Sapiens
LMYLSLPKT

SEQ ID NO: 566994 - protein, 9 aa, Homo Sapiens
IRCGRPRPS

SEQ ID NO: 566995 - protein, 9 aa, Homo Sapiens
HAGPLCHAG

SEQ ID NO: 566996 - protein, 9 aa, Homo Sapiens
RCTFTAGRF

SEQ ID NO: 566997 - protein, 9 aa, Homo Sapiens
AAVSPEWLE

SEQ ID NO: 566998 - protein, 9 aa, Homo Sapiens
PCAPTASAV

SEQ ID NO: 566999 - protein, 9 aa, Homo Sapiens
AAALREVLD

SEQ ID NO: 567000 - protein, 9 aa, Homo Sapiens
SSRCHDSVV

SEQ ID NO: 567001 - protein, 9 aa, Homo Sapiens
GTQQDGCAQ

SEQ ID NO: 567002 - protein, 9 aa, Homo Sapiens
YQQAGIPVY

SEQ ID NO: 567003 - protein, 9 aa, Homo Sapiens
LQPNTAPGT

SEQ ID NO: 567004 - protein, 9 aa, Homo Sapiens
ACPGAPQGG

SEQ ID NO: 567005 - protein, 9 aa, Homo Sapiens
WNLAIAGGV

SEQ ID NO: 567006 - protein, 9 aa, Homo Sapiens
RCWTSCTAS

SEQ ID NO: 567007 - protein, 9 aa, Homo Sapiens
SRSCSTLLR

SEQ ID NO: 567008 - protein, 9 aa, Homo Sapiens
FSTKRVPKP

SEQ ID NO: 567009 - protein, 9 aa, Homo Sapiens
VSPEWLEWI

SEQ ID NO: 567010 - protein, 9 aa, Homo Sapiens
KKMAKRYPA

SEQ ID NO: 567011 - protein, 9 aa, Homo Sapiens
SFLGPPLPS

SEQ ID NO: 567012 - protein, 9 aa, Homo Sapiens
CPSWLSVSA

SEQ ID NO: 567013 - protein, 9 aa, Homo Sapiens
RYVRGSFLG

SEQ ID NO: 567014 - protein, 9 aa, Homo Sapiens
DSLWISYSF

SEQ ID NO: 567015 - protein, 9 aa, Homo Sapiens
EQLMNLAYD

SEQ ID NO: 567016 - protein, 9 aa, Homo Sapiens
RSRFLRRQS

SEQ ID NO: 567017 - protein, 9 aa, Homo Sapiens
PTWWRGPKR

SEQ ID NO: 567018 - protein, 9 aa, Homo Sapiens
CGTLQYTGE

SEQ ID NO: 567019 - protein, 9 aa, Homo Sapiens
TRPARRTWP

SEQ ID NO: 567020 - protein, 9 aa, Homo Sapiens
TFTAGRFRP

SEQ ID NO: 567021 - protein, 9 aa, Homo Sapiens
RMVSFCCST

SEQ ID NO: 567022 - protein, 9 aa, Homo Sapiens
QQDGCAQPV

SEQ ID NO: 567023 - protein, 9 aa, Homo Sapiens
QKLHAEAPH

SEQ ID NO: 567024 - protein, 9 aa, Homo Sapiens
AFSVGSTYD

SEQ ID NO: 567025 - protein, 9 aa, Homo Sapiens
DSCQAYGSS

SEQ ID NO: 567026 - protein, 9 aa, Homo Sapiens
LLEVKMEAE

SEQ ID NO: 567027 - protein, 9 aa, Homo Sapiens
VEQIPRHLE

SEQ ID NO: 567028 - protein, 9 aa, Homo Sapiens
RLMEQASSW

SEQ ID NO: 567029 - protein, 9 aa, Homo Sapiens
VFLTFLELA

SEQ ID NO: 567030 - protein, 9 aa, Homo Sapiens
FVEQIPRHL

SEQ ID NO: 567031 - protein, 9 aa, Homo Sapiens
RPRPSCRFC

SEQ ID NO: 567032 - protein, 9 aa, Homo Sapiens
RQRLVEGQA

SEQ ID NO: 567033 - protein, 9 aa, Homo Sapiens
RDRSPMVFL

SEQ ID NO: 567034 - protein, 9 aa, Homo Sapiens
EVPASVQTE

SEQ ID NO: 567035 - protein, 9 aa, Homo Sapiens
KFEEHVHSV

SEQ ID NO: 567036 - protein, 9 aa, Homo Sapiens
DQSPGYLNR

SEQ ID NO: 567037 - protein, 9 aa, Homo Sapiens
LSTSWRRSM

SEQ ID NO: 567038 - protein, 9 aa, Homo Sapiens
SNSKYDVNY

SEQ ID NO: 567039 - protein, 9 aa, Homo Sapiens
ARGLREGHA

SEQ ID NO: 567040 - protein, 9 aa, Homo Sapiens
PSTESAAAF

SEQ ID NO: 567041 - protein, 9 aa, Homo Sapiens
SHIVKLSLS

SEQ ID NO: 567042 - protein, 9 aa, Homo Sapiens
EQIPRHLEE

SEQ ID NO: 567043 - protein, 9 aa, Homo Sapiens
PSPGPEELS

SEQ ID NO: 567044 - protein, 9 aa, Homo Sapiens
TSARCWRTA

SEQ ID NO: 567045 - protein, 9 aa, Homo Sapiens
GAADAGRTA

SEQ ID NO: 567046 - protein, 9 aa, Homo Sapiens
GLLRGNKLS

SEQ ID NO: 567047 - protein, 9 aa, Homo Sapiens
DAEKAHVAS

SEQ ID NO: 567048 - protein, 9 aa, Homo Sapiens
KPGVFTQVT

SEQ ID NO: 567049 - protein, 9 aa, Homo Sapiens
LPVRAWGLL

SEQ ID NO: 567050 - protein, 9 aa, Homo Sapiens
PLSSSTGWV

SEQ ID NO: 567051 - protein, 9 aa, Homo Sapiens
THEVQSEQS

SEQ ID NO: 567052 - protein, 9 aa, Homo Sapiens
LDVDRTKKG

SEQ ID NO: 567053 - protein, 9 aa, Homo Sapiens
QQVEPESEF

SEQ ID NO: 567054 - protein, 9 aa, Homo Sapiens
IALPSGLSD

SEQ ID NO: 567055 - protein, 9 aa, Homo Sapiens
RTRPARCPC

SEQ ID NO: 567056 - protein, 9 aa, Homo Sapiens
AAPQIRTML

SEQ ID NO: 567057 - protein, 9 aa, Homo Sapiens
RYHSLTGGK

SEQ ID NO: 567058 - protein, 9 aa, Homo Sapiens
LRLGLRGAA

SEQ ID NO: 567059 - protein, 9 aa, Homo Sapiens
VKGKLLEHS

SEQ ID NO: 567060 - protein, 9 aa, Homo Sapiens
DKPGVFTQV

SEQ ID NO: 567061 - protein, 9 aa, Homo Sapiens
GLRFRLVAG

SEQ ID NO: 567062 - protein, 9 aa, Homo Sapiens
EELRRLYCS

SEQ ID NO: 567063 - protein, 9 aa, Homo Sapiens
VAEGALVGP

SEQ ID NO: 567064 - protein, 9 aa, Homo Sapiens
VKLWDKSIR

SEQ ID NO: 567065 - protein, 9 aa, Homo Sapiens
STTPGLPTR

SEQ ID NO: 567066 - protein, 9 aa, Homo Sapiens
TGQASAGGD

SEQ ID NO: 567067 - protein, 9 aa, Homo Sapiens
HIVKLSLSR

SEQ ID NO: 567068 - protein, 9 aa, Homo Sapiens
YPECRDMQP

SEQ ID NO: 567069 - protein, 9 aa, Homo Sapiens
ELEKKAAQA

SEQ ID NO: 567070 - protein, 9 aa, Homo Sapiens
ACTGMWGAL

SEQ ID NO: 567071 - protein, 9 aa, Homo Sapiens
PPLPSSRVF

SEQ ID NO: 567072 - protein, 9 aa, Homo Sapiens
AAQAVNRKV

SEQ ID NO: 567073 - protein, 9 aa, Homo Sapiens
IFGEMKMIW

SEQ ID NO: 567074 - protein, 9 aa, Homo Sapiens
MLACTGMWG

SEQ ID NO: 567075 - protein, 9 aa, Homo Sapiens
VPLQGRRAG

SEQ ID NO: 567076 - protein, 9 aa, Homo Sapiens
APAPRRQRA

SEQ ID NO: 567077 - protein, 9 aa, Homo Sapiens
SSRVFTRDS

SEQ ID NO: 567078 - protein, 9 aa, Homo Sapiens
ADAGRTAVT

SEQ ID NO: 567079 - protein, 9 aa, Homo Sapiens
EDIIFPHQP

SEQ ID NO: 567080 - protein, 9 aa, Homo Sapiens
LATLRARKG

SEQ ID NO: 567081 - protein, 9 aa, Homo Sapiens
LVLHHAAGH

SEQ ID NO: 567082 - protein, 9 aa, Homo Sapiens
NTMRGTTAP

SEQ ID NO: 567083 - protein, 9 aa, Homo Sapiens
VGPKSWAPA

SEQ ID NO: 567084 - protein, 9 aa, Homo Sapiens
TLPPHHPGA

SEQ ID NO: 567085 - protein, 9 aa, Homo Sapiens
TTSTTPSTC

SEQ ID NO: 567086 - protein, 9 aa, Homo Sapiens
RPQRRRRKK

SEQ ID NO: 567087 - protein, 9 aa, Homo Sapiens
ASEQETPPP

SEQ ID NO: 567088 - protein, 9 aa, Homo Sapiens
PSKSNHEVL

SEQ ID NO: 567089 - protein, 9 aa, Homo Sapiens
ATWAACWRA

SEQ ID NO: 567090 - protein, 9 aa, Homo Sapiens
AEAKHQWVH

SEQ ID NO: 567091 - protein, 9 aa, Homo Sapiens
TMDYWGTMI

SEQ ID NO: 567092 - protein, 9 aa, Homo Sapiens
LEELRRLYC

SEQ ID NO: 567093 - protein, 9 aa, Homo Sapiens
GTKLAYRCT

SEQ ID NO: 567094 - protein, 9 aa, Homo Sapiens
ASVQTESSV

SEQ ID NO: 567095 - protein, 9 aa, Homo Sapiens
EARGLREGH

SEQ ID NO: 567096 - protein, 9 aa, Homo Sapiens
RAGKGLATL

SEQ ID NO: 567097 - protein, 9 aa, Homo Sapiens
LGPPLPSSR

SEQ ID NO: 567098 - protein, 9 aa, Homo Sapiens
VTLEYRPII

SEQ ID NO: 567099 - protein, 9 aa, Homo Sapiens
PEVVGEFPI

SEQ ID NO: 567100 - protein, 9 aa, Homo Sapiens
LIVAVHVAL

SEQ ID NO: 567101 - protein, 9 aa, Homo Sapiens
WVFSTKRVP

SEQ ID NO: 567102 - protein, 9 aa, Homo Sapiens
PHSWCWTTW

SEQ ID NO: 567103 - protein, 9 aa, Homo Sapiens
SAPLLLLAI

SEQ ID NO: 567104 - protein, 9 aa, Homo Sapiens
PLARVQAPV

SEQ ID NO: 567105 - protein, 9 aa, Homo Sapiens
LHAEAPHIV

SEQ ID NO: 567106 - protein, 9 aa, Homo Sapiens
SCTASCSRS

SEQ ID NO: 567107 - protein, 9 aa, Homo Sapiens
DAIELTRTL

SEQ ID NO: 567108 - protein, 9 aa, Homo Sapiens
SSPVLTNVY

SEQ ID NO: 567109 - protein, 9 aa, Homo Sapiens
CLRPPPARA

SEQ ID NO: 567110 - protein, 9 aa, Homo Sapiens
QAENRFFPE

SEQ ID NO: 567111 - protein, 9 aa, Homo Sapiens
LRGKCYLIG

SEQ ID NO: 567112 - protein, 9 aa, Homo Sapiens
ASSAQVRAA

SEQ ID NO: 567113 - protein, 9 aa, Homo Sapiens
KAGPAEAVP

SEQ ID NO: 567114 - protein, 9 aa, Homo Sapiens
QKSAEAKHQ

SEQ ID NO: 567115 - protein, 9 aa, Homo Sapiens
ELPVAGGAA

SEQ ID NO: 567116 - protein, 9 aa, Homo Sapiens
RDQPTGRQV

SEQ ID NO: 567117 - protein, 9 aa, Homo Sapiens
TKLAYRCTF

SEQ ID NO: 567118 - protein, 9 aa, Homo Sapiens
AAVGVGLPA

SEQ ID NO: 567119 - protein, 9 aa, Homo Sapiens
GSVPSGIGR

SEQ ID NO: 567120 - protein, 9 aa, Homo Sapiens
PELSYTTKH

SEQ ID NO: 567121 - protein, 9 aa, Homo Sapiens
LLCSRSLRL

SEQ ID NO: 567122 - protein, 9 aa, Homo Sapiens
EAVHAGPLC

SEQ ID NO: 567123 - protein, 9 aa, Homo Sapiens
GAWPTWWRG

SEQ ID NO: 567124 - protein, 9 aa, Homo Sapiens
RPSLAVSSR

SEQ ID NO: 567125 - protein, 9 aa, Homo Sapiens
IRTMLSSGV

SEQ ID NO: 567126 - protein, 9 aa, Homo Sapiens
LLVGGPSTL

SEQ ID NO: 567127 - protein, 9 aa, Homo Sapiens
HKWNLAIAG

SEQ ID NO: 567128 - protein, 9 aa, Homo Sapiens
TQKITYRIA

SEQ ID NO: 567129 - protein, 9 aa, Homo Sapiens
RTWPRSSAS

SEQ ID NO: 567130 - protein, 9 aa, Homo Sapiens
SGTRWRVRA

SEQ ID NO: 567131 - protein, 9 aa, Homo Sapiens
FGEMKMIWM

SEQ ID NO: 567132 - protein, 9 aa, Homo Sapiens
KAIDRKTGQ

SEQ ID NO: 567133 - protein, 9 aa, Homo Sapiens
HCFFTMIFA

SEQ ID NO: 567134 - protein, 9 aa, Homo Sapiens
RTAVTSPGC

SEQ ID NO: 567135 - protein, 9 aa, Homo Sapiens
LPAVWTRVG

SEQ ID NO: 567136 - protein, 9 aa, Homo Sapiens
VQMKRVGPK

SEQ ID NO: 567137 - protein, 9 aa, Homo Sapiens
GEKRPDSET

SEQ ID NO: 567138 - protein, 9 aa, Homo Sapiens
VCGHWGILL

SEQ ID NO: 567139 - protein, 9 aa, Homo Sapiens
NPELKQKGY

SEQ ID NO: 567140 - protein, 9 aa, Homo Sapiens
TDLSLTHKT

SEQ ID NO: 567141 - protein, 9 aa, Homo Sapiens
VGYHVAFLE

SEQ ID NO: 567142 - protein, 9 aa, Homo Sapiens
ALRGKCYLI

SEQ ID NO: 567143 - protein, 9 aa, Homo Sapiens
RPHSWCWTT

SEQ ID NO: 567144 - protein, 9 aa, Homo Sapiens
PRRAPHRTA

SEQ ID NO: 567145 - protein, 9 aa, Homo Sapiens
HVASPGDSP

SEQ ID NO: 567146 - protein, 9 aa, Homo Sapiens
LPLLKGVPA

SEQ ID NO: 567147 - protein, 9 aa, Homo Sapiens
PFTERKECT

SEQ ID NO: 567148 - protein, 9 aa, Homo Sapiens
RKECTPSCH

SEQ ID NO: 567149 - protein, 9 aa, Homo Sapiens
AENRFFPEY

SEQ ID NO: 567150 - protein, 9 aa, Homo Sapiens
PEYLTNKTE

SEQ ID NO: 567151 - protein, 9 aa, Homo Sapiens
SCQAYGSSF

SEQ ID NO: 567152 - protein, 9 aa, Homo Sapiens
LDTGNGLSD

SEQ ID NO: 567153 - protein, 9 aa, Homo Sapiens
SSSILLCSR

SEQ ID NO: 567154 - protein, 9 aa, Homo Sapiens
GQASAGGDR

SEQ ID NO: 567155 - protein, 9 aa, Homo Sapiens
SGIGRGAVP

SEQ ID NO: 567156 - protein, 9 aa, Homo Sapiens
EKPDVPEKS

SEQ ID NO: 567157 - protein, 9 aa, Homo Sapiens
SKHKWNLAI

SEQ ID NO: 567158 - protein, 9 aa, Homo Sapiens
VQGGQGGLD

SEQ ID NO: 567159 - protein, 9 aa, Homo Sapiens
CAPACWLCC

SEQ ID NO: 567160 - protein, 9 aa, Homo Sapiens
LAALATSHR

SEQ ID NO: 567161 - protein, 9 aa, Homo Sapiens
LGQESCCSP

SEQ ID NO: 567162 - protein, 9 aa, Homo Sapiens
INQGTARLA

SEQ ID NO: 567163 - protein, 9 aa, Homo Sapiens
AVSPEWLEW

SEQ ID NO: 567164 - protein, 9 aa, Homo Sapiens
ARVAPRSRA

SEQ ID NO: 567165 - protein, 9 aa, Homo Sapiens
RSSSAPPAA

SEQ ID NO: 567166 - protein, 9 aa, Homo Sapiens
RIAGVGIDQ

SEQ ID NO: 567167 - protein, 9 aa, Homo Sapiens
KQKGYNVKS

SEQ ID NO: 567168 - protein, 9 aa, Homo Sapiens
CTPSCHSDI

SEQ ID NO: 567169 - protein, 9 aa, Homo Sapiens
CFPSDHAPL

SEQ ID NO: 567170 - protein, 9 aa, Homo Sapiens
RFSRRVLSD

SEQ ID NO: 567171 - protein, 9 aa, Homo Sapiens
LGAQVRALV

SEQ ID NO: 567172 - protein, 9 aa, Homo Sapiens
FRLVAGLLH

SEQ ID NO: 567173 - protein, 9 aa, Homo Sapiens
TEPSIRMFQ

SEQ ID NO: 567174 - protein, 9 aa, Homo Sapiens
SVSTGHAIP

SEQ ID NO: 567175 - protein, 9 aa, Homo Sapiens
TMLSSGVCT

SEQ ID NO: 567176 - protein, 9 aa, Homo Sapiens
WLSQRPSLA

SEQ ID NO: 567177 - protein, 9 aa, Homo Sapiens
RLGLRGAAR

SEQ ID NO: 567178 - protein, 9 aa, Homo Sapiens
KIHWIESKA

SEQ ID NO: 567179 - protein, 9 aa, Homo Sapiens
REWLGQHKD

SEQ ID NO: 567180 - protein, 9 aa, Homo Sapiens
SSHSFLDLH

SEQ ID NO: 567181 - protein, 9 aa, Homo Sapiens
TSPGCAACP

SEQ ID NO: 567182 - protein, 9 aa, Homo Sapiens
LTSPSTGTT

SEQ ID NO: 567183 - protein, 9 aa, Homo Sapiens
AVSSRMVSF

SEQ ID NO: 567184 - protein, 9 aa, Homo Sapiens
SDCKVCPSW

SEQ ID NO: 567185 - protein, 9 aa, Homo Sapiens
HQLAALATS

SEQ ID NO: 567186 - protein, 9 aa, Homo Sapiens
GQESCCSPS

SEQ ID NO: 567187 - protein, 9 aa, Homo Sapiens
RCGRPRPSC

SEQ ID NO: 567188 - protein, 9 aa, Homo Sapiens
GQGGLDLAL

SEQ ID NO: 567189 - protein, 9 aa, Homo Sapiens
LLLLPVRAW

SEQ ID NO: 567190 - protein, 9 aa, Homo Sapiens
RRQSRSVLF

SEQ ID NO: 567191 - protein, 9 aa, Homo Sapiens
HEVQSEQSS

SEQ ID NO: 567192 - protein, 9 aa, Homo Sapiens
SRTRSRLPL

SEQ ID NO: 567193 - protein, 9 aa, Homo Sapiens
RGAVPSQHL

SEQ ID NO: 567194 - protein, 9 aa, Homo Sapiens
PSEITASIV

SEQ ID NO: 567195 - protein, 9 aa, Homo Sapiens
KRRRRPHSW

SEQ ID NO: 567196 - protein, 9 aa, Homo Sapiens
KVTLEYRPI

SEQ ID NO: 567197 - protein, 9 aa, Homo Sapiens
IGQGTEPSI

SEQ ID NO: 567198 - protein, 9 aa, Homo Sapiens
PGTQQDGCA

SEQ ID NO: 567199 - protein, 9 aa, Homo Sapiens
WTSGMWSAA

SEQ ID NO: 567200 - protein, 9 aa, Homo Sapiens
GAQVRALVA

SEQ ID NO: 567201 - protein, 9 aa, Homo Sapiens
LQGNSSQGS

SEQ ID NO: 567202 - protein, 9 aa, Homo Sapiens
PGPTAPSLR

SEQ ID NO: 567203 - protein, 9 aa, Homo Sapiens
QWECELELV

SEQ ID NO: 567204 - protein, 9 aa, Homo Sapiens
PASLGRINQ

SEQ ID NO: 567205 - protein, 9 aa, Homo Sapiens
WSAASGTRW

SEQ ID NO: 567206 - protein, 9 aa, Homo Sapiens
LTRTLYQYS

SEQ ID NO: 567207 - protein, 9 aa, Homo Sapiens
PRDCTPSTE

SEQ ID NO: 567208 - protein, 9 aa, Homo Sapiens
GHQLAALAT

SEQ ID NO: 567209 - protein, 9 aa, Homo Sapiens
VLWLSQRPS

SEQ ID NO: 567210 - protein, 9 aa, Homo Sapiens
RGGNGLSLS

SEQ ID NO: 567211 - protein, 9 aa, Homo Sapiens
RGCCGYVEH

SEQ ID NO: 567212 - protein, 9 aa, Homo Sapiens
YSSPVATLP

SEQ ID NO: 567213 - protein, 9 aa, Homo Sapiens
ITASIVKTN

SEQ ID NO: 567214 - protein, 9 aa, Homo Sapiens
MKRVGPKSW

SEQ ID NO: 567215 - protein, 9 aa, Homo Sapiens
SNHEVLEFV

SEQ ID NO: 567216 - protein, 9 aa, Homo Sapiens
FLTRPARRT

SEQ ID NO: 567217 - protein, 9 aa, Homo Sapiens
KITSSPHLL

SEQ ID NO: 567218 - protein, 9 aa, Homo Sapiens
GHAAVSALE

SEQ ID NO: 567219 - protein, 9 aa, Homo Sapiens
QAYGSSFYA

SEQ ID NO: 567220 - protein, 9 aa, Homo Sapiens
SRSLRLLVW

SEQ ID NO: 567221 - protein, 9 aa, Homo Sapiens
GRINQGTAR

SEQ ID NO: 567222 - protein, 9 aa, Homo Sapiens
QVSAGPLAY

SEQ ID NO: 567223 - protein, 9 aa, Homo Sapiens
SSCRGRCWT

SEQ ID NO: 567224 - protein, 9 aa, Homo Sapiens
PPTRANRGG

SEQ ID NO: 567225 - protein, 9 aa, Homo Sapiens
SLAVSSRMV

SEQ ID NO: 567226 - protein, 9 aa, Homo Sapiens
GSMNSSAAG

SEQ ID NO: 567227 - protein, 9 aa, Homo Sapiens
GGAGEGPLA

SEQ ID NO: 567228 - protein, 9 aa, Homo Sapiens
MQESFVRPE

SEQ ID NO: 567229 - protein, 9 aa, Homo Sapiens
AIDRKTGQQ

SEQ ID NO: 567230 - protein, 9 aa, Homo Sapiens
AKKAQLMYL

SEQ ID NO: 567231 - protein, 9 aa, Homo Sapiens
RFFPEYLTN

SEQ ID NO: 567232 - protein, 9 aa, Homo Sapiens
MNSSAAGSM

SEQ ID NO: 567233 - protein, 9 aa, Homo Sapiens
VYWGHQLAA

SEQ ID NO: 567234 - protein, 9 aa, Homo Sapiens
FLRRQSRSV

SEQ ID NO: 567235 - protein, 9 aa, Homo Sapiens
LVEGQAALG

SEQ ID NO: 567236 - protein, 9 aa, Homo Sapiens
LRGAARRKR

SEQ ID NO: 567237 - protein, 9 aa, Homo Sapiens
KHKWNLAIA

SEQ ID NO: 567238 - protein, 9 aa, Homo Sapiens
LGSPSVSEL

SEQ ID NO: 567239 - protein, 9 aa, Homo Sapiens
WLLVGGPST

SEQ ID NO: 567240 - protein, 9 aa, Homo Sapiens
RARKGPLAS

SEQ ID NO: 567241 - protein, 9 aa, Homo Sapiens
NILPYEATR

SEQ ID NO: 567242 - protein, 9 aa, Homo Sapiens
DCTPSTESA

SEQ ID NO: 567243 - protein, 9 aa, Homo Sapiens
SKRCERTEF

SEQ ID NO: 567244 - protein, 9 aa, Homo Sapiens
HVHSVDIAA

SEQ ID NO: 567245 - protein, 9 aa, Homo Sapiens
GGLDLALSS

SEQ ID NO: 567246 - protein, 9 aa, Homo Sapiens
GQIGGLGEA

SEQ ID NO: 567247 - protein, 9 aa, Homo Sapiens
VHSVDIAAF

SEQ ID NO: 567248 - protein, 9 aa, Homo Sapiens
RLLVWLEEL

SEQ ID NO: 567249 - protein, 9 aa, Homo Sapiens
LFTLERVAA

SEQ ID NO: 567250 - protein, 9 aa, Homo Sapiens
VYLKRKIAR

SEQ ID NO: 567251 - protein, 9 aa, Homo Sapiens
PWTMLACTG

SEQ ID NO: 567252 - protein, 9 aa, Homo Sapiens
ISLSSSRCH

SEQ ID NO: 567253 - protein, 9 aa, Homo Sapiens
LFWLLVGGP

SEQ ID NO: 567254 - protein, 9 aa, Homo Sapiens
NTDTGQASA

SEQ ID NO: 567255 - protein, 9 aa, Homo Sapiens
PASVPASGA

SEQ ID NO: 567256 - protein, 9 aa, Homo Sapiens
RASPAPGSS

SEQ ID NO: 567257 - protein, 9 aa, Homo Sapiens
ALVAHEARG

SEQ ID NO: 567258 - protein, 9 aa, Homo Sapiens
ASHPGHRGH

SEQ ID NO: 567259 - protein, 9 aa, Homo Sapiens
EGILNRYVD

SEQ ID NO: 567260 - protein, 9 aa, Homo Sapiens
RMVSFWLRM

SEQ ID NO: 567261 - protein, 9 aa, Homo Sapiens
LAAGGAGEG

SEQ ID NO: 567262 - protein, 9 aa, Homo Sapiens
LQYTAPEVL

SEQ ID NO: 567263 - protein, 9 aa, Homo Sapiens
DLTEDIIFP

SEQ ID NO: 567264 - protein, 9 aa, Homo Sapiens
QRPSLAVSS

SEQ ID NO: 567265 - protein, 9 aa, Homo Sapiens
LEWDLAPPS

SEQ ID NO: 567266 - protein, 9 aa, Homo Sapiens
SLGRINQGT

SEQ ID NO: 567267 - protein, 9 aa, Homo Sapiens
EQTASEQET

SEQ ID NO: 567268 - protein, 9 aa, Homo Sapiens
RRKKTCAPA

SEQ ID NO: 567269 - protein, 9 aa, Homo Sapiens
QNSYDCGMF

SEQ ID NO: 567270 - protein, 9 aa, Homo Sapiens
GVDLLVPLQ

SEQ ID NO: 567271 - protein, 9 aa, Homo Sapiens
VHVALVFAQ

SEQ ID NO: 567272 - protein, 9 aa, Homo Sapiens
GIHIVGPQW

SEQ ID NO: 567273 - protein, 9 aa, Homo Sapiens
RRAPHRTAA

SEQ ID NO: 567274 - protein, 9 aa, Homo Sapiens
GAREGLIVA

SEQ ID NO: 567275 - protein, 9 aa, Homo Sapiens
KHVFPSIHN

SEQ ID NO: 567276 - protein, 9 aa, Homo Sapiens
CVFCWWHHT

SEQ ID NO: 567277 - protein, 9 aa, Homo Sapiens
SICNDKTEI

SEQ ID NO: 567278 - protein, 9 aa, Homo Sapiens
LLEAMGPDF

SEQ ID NO: 567279 - protein, 9 aa, Homo Sapiens
LPIEVDLAH

SEQ ID NO: 567280 - protein, 9 aa, Homo Sapiens
NVIQTFDIA

SEQ ID NO: 567281 - protein, 9 aa, Homo Sapiens
QTHLSQNDP

SEQ ID NO: 567282 - protein, 9 aa, Homo Sapiens
RLREERNKA

SEQ ID NO: 567283 - protein, 9 aa, Homo Sapiens
ISTLQQTIL

SEQ ID NO: 567284 - protein, 9 aa, Homo Sapiens
KKMSINAEE

SEQ ID NO: 567285 - protein, 9 aa, Homo Sapiens
IGKQGCRPR

SEQ ID NO: 567286 - protein, 9 aa, Homo Sapiens
RTTRFQGYT

SEQ ID NO: 567287 - protein, 9 aa, Homo Sapiens
FSKSSMSSD

SEQ ID NO: 567288 - protein, 9 aa, Homo Sapiens
QCSYASTDT

SEQ ID NO: 567289 - protein, 9 aa, Homo Sapiens
LRDADVLPI

SEQ ID NO: 567290 - protein, 9 aa, Homo Sapiens
AIPMGELST

SEQ ID NO: 567291 - protein, 9 aa, Homo Sapiens
AEDKREYRG

SEQ ID NO: 567292 - protein, 9 aa, Homo Sapiens
NLTLMSGFL

SEQ ID NO: 567293 - protein, 9 aa, Homo Sapiens
ELNKEVSSN

SEQ ID NO: 567294 - protein, 9 aa, Homo Sapiens
LRAARARPW

SEQ ID NO: 567295 - protein, 9 aa, Homo Sapiens
IANLAAFMI

SEQ ID NO: 567296 - protein, 9 aa, Homo Sapiens
LLCKQQQKD

SEQ ID NO: 567297 - protein, 9 aa, Homo Sapiens
QKEISESNT

SEQ ID NO: 567298 - protein, 9 aa, Homo Sapiens
FSWQSVLLS

SEQ ID NO: 567299 - protein, 9 aa, Homo Sapiens
LVIRNGKKM

SEQ ID NO: 567300 - protein, 9 aa, Homo Sapiens
KEYRRIIVL

SEQ ID NO: 567301 - protein, 9 aa, Homo Sapiens
EQNNKSLLK

SEQ ID NO: 567302 - protein, 9 aa, Homo Sapiens
YSAKDADSP

SEQ ID NO: 567303 - protein, 9 aa, Homo Sapiens
TLQALPLQI

SEQ ID NO: 567304 - protein, 9 aa, Homo Sapiens
GSGRAGIGP

SEQ ID NO: 567305 - protein, 9 aa, Homo Sapiens
DDRLREERN

SEQ ID NO: 567306 - protein, 9 aa, Homo Sapiens
LTTVVSCGP

SEQ ID NO: 567307 - protein, 9 aa, Homo Sapiens
PYDSFAHYF

SEQ ID NO: 567308 - protein, 9 aa, Homo Sapiens
TKSKLEEAL

SEQ ID NO: 567309 - protein, 9 aa, Homo Sapiens
FCCVETSTC

SEQ ID NO: 567310 - protein, 9 aa, Homo Sapiens
KSAEDKREY

SEQ ID NO: 567311 - protein, 9 aa, Homo Sapiens
PRAPESPQV

SEQ ID NO: 567312 - protein, 9 aa, Homo Sapiens
TSTCTQKTW

SEQ ID NO: 567313 - protein, 9 aa, Homo Sapiens
CKQQQKDGT

SEQ ID NO: 567314 - protein, 9 aa, Homo Sapiens
AAACVLSFI

SEQ ID NO: 567315 - protein, 9 aa, Homo Sapiens
EPPSPKPEP

SEQ ID NO: 567316 - protein, 9 aa, Homo Sapiens
KEISESNTA

SEQ ID NO: 567317 - protein, 9 aa, Homo Sapiens
GPECNPAIQ

SEQ ID NO: 567318 - protein, 9 aa, Homo Sapiens
PKLGNWPSS

SEQ ID NO: 567319 - protein, 9 aa, Homo Sapiens
YCRLLTPGD

SEQ ID NO: 567320 - protein, 9 aa, Homo Sapiens
DVLPIEVDL

SEQ ID NO: 567321 - protein, 9 aa, Homo Sapiens
DKEVRSWQG

SEQ ID NO: 567322 - protein, 9 aa, Homo Sapiens
RPSTPGDPR

SEQ ID NO: 567323 - protein, 9 aa, Homo Sapiens
GNHITKSAE

SEQ ID NO: 567324 - protein, 9 aa, Homo Sapiens
VETSTCTQK

SEQ ID NO: 567325 - protein, 9 aa, Homo Sapiens
NGKKMSINA

SEQ ID NO: 567326 - protein, 9 aa, Homo Sapiens
TLQQTILKI

SEQ ID NO: 567327 - protein, 9 aa, Homo Sapiens
LAQNGFSAQ

SEQ ID NO: 567328 - protein, 9 aa, Homo Sapiens
SASATALAN

SEQ ID NO: 567329 - protein, 9 aa, Homo Sapiens
NAVLFAQAN

SEQ ID NO: 567330 - protein, 9 aa, Homo Sapiens
EDSARDIRE

SEQ ID NO: 567331 - protein, 9 aa, Homo Sapiens
AFIFSVTAQ

SEQ ID NO: 567332 - protein, 9 aa, Homo Sapiens
LAVLEDSAR

SEQ ID NO: 567333 - protein, 9 aa, Homo Sapiens
QGYTLPQGT

SEQ ID NO: 567334 - protein, 9 aa, Homo Sapiens
IGNHITKSA

SEQ ID NO: 567335 - protein, 9 aa, Homo Sapiens
SSNTAMIQT

SEQ ID NO: 567336 - protein, 9 aa, Homo Sapiens
RSGGFYSAK

SEQ ID NO: 567337 - protein, 9 aa, Homo Sapiens
RSRSASRSH

SEQ ID NO: 567338 - protein, 9 aa, Homo Sapiens
HITKSAEDK

SEQ ID NO: 567339 - protein, 9 aa, Homo Sapiens
PSPKPEPQL

SEQ ID NO: 567340 - protein, 9 aa, Homo Sapiens
ESPQVPSPP

SEQ ID NO: 567341 - protein, 9 aa, Homo Sapiens
NPRGAFIFS

SEQ ID NO: 567342 - protein, 9 aa, Homo Sapiens
QALEPPSPK

SEQ ID NO: 567343 - protein, 9 aa, Homo Sapiens
LFVISSHLG

SEQ ID NO: 567344 - protein, 9 aa, Homo Sapiens
QALSTLLCK

SEQ ID NO: 567345 - protein, 9 aa, Homo Sapiens
GNGAELSIL

SEQ ID NO: 567346 - protein, 9 aa, Homo Sapiens
SRSHSRSFS

SEQ ID NO: 567347 - protein, 9 aa, Homo Sapiens
FIFSVTAQD

SEQ ID NO: 567348 - protein, 9 aa, Homo Sapiens
HLSQNDPIF

SEQ ID NO: 567349 - protein, 9 aa, Homo Sapiens
PKPEPQLLD

SEQ ID NO: 567350 - protein, 9 aa, Homo Sapiens
TALANAGSP

SEQ ID NO: 567351 - protein, 9 aa, Homo Sapiens
RAGIGPKDS

SEQ ID NO: 567352 - protein, 9 aa, Homo Sapiens
PAIQTVRMK

SEQ ID NO: 567353 - protein, 9 aa, Homo Sapiens
TTHPRRQTW

SEQ ID NO: 567354 - protein, 9 aa, Homo Sapiens
TVVSCGPPG

SEQ ID NO: 567355 - protein, 9 aa, Homo Sapiens
QLTLQALPL

SEQ ID NO: 567356 - protein, 9 aa, Homo Sapiens
QSVLLSHQR

SEQ ID NO: 567357 - protein, 9 aa, Homo Sapiens
IGPKDSRLS

SEQ ID NO: 567358 - protein, 9 aa, Homo Sapiens
FVISSHLGQ

SEQ ID NO: 567359 - protein, 9 aa, Homo Sapiens
STLLCKQQQ

SEQ ID NO: 567360 - protein, 9 aa, Homo Sapiens
REERNKAKK

SEQ ID NO: 567361 - protein, 9 aa, Homo Sapiens
DSNVIQTFD

SEQ ID NO: 567362 - protein, 9 aa, Homo Sapiens
SGGFYSAKD

SEQ ID NO: 567363 - protein, 9 aa, Homo Sapiens
VIQTFDIAR

SEQ ID NO: 567364 - protein, 9 aa, Homo Sapiens
GAFIFSVTA

SEQ ID NO: 567365 - protein, 9 aa, Homo Sapiens
SWQSVLLSH

SEQ ID NO: 567366 - protein, 9 aa, Homo Sapiens
GELSTYTLS

SEQ ID NO: 567367 - protein, 9 aa, Homo Sapiens
LDVLERCPH

SEQ ID NO: 567368 - protein, 9 aa, Homo Sapiens
TAYEKRKAK

SEQ ID NO: 567369 - protein, 9 aa, Homo Sapiens
ATALANAGS

SEQ ID NO: 567370 - protein, 9 aa, Homo Sapiens
ALHYQLAQN

SEQ ID NO: 567371 - protein, 9 aa, Homo Sapiens
GIGPKDSRL

SEQ ID NO: 567372 - protein, 9 aa, Homo Sapiens
VWPKLGNWP

SEQ ID NO: 567373 - protein, 9 aa, Homo Sapiens
ARPWHLTRR

SEQ ID NO: 567374 - protein, 9 aa, Homo Sapiens
ETISTLQQT

SEQ ID NO: 567375 - protein, 9 aa, Homo Sapiens
NLLMDFGVT

SEQ ID NO: 567376 - protein, 9 aa, Homo Sapiens
ERCPHRPIL

SEQ ID NO: 567377 - protein, 9 aa, Homo Sapiens
GRAGIGPKD

SEQ ID NO: 567378 - protein, 9 aa, Homo Sapiens
VAPLNAHDQ

SEQ ID NO: 567379 - protein, 9 aa, Homo Sapiens
KWDSNVIQT

SEQ ID NO: 567380 - protein, 9 aa, Homo Sapiens
LTLMSGFLL

SEQ ID NO: 567381 - protein, 9 aa, Homo Sapiens
KQQQKDGTF

SEQ ID NO: 567382 - protein, 9 aa, Homo Sapiens
CVLSFILWA

SEQ ID NO: 567383 - protein, 9 aa, Homo Sapiens
SLLNCVITV

SEQ ID NO: 567384 - protein, 9 aa, Homo Sapiens
LTRPSTPGD

SEQ ID NO: 567385 - protein, 9 aa, Homo Sapiens
GTANLLMDF

SEQ ID NO: 567386 - protein, 9 aa, Homo Sapiens
LGTTGNGVV

SEQ ID NO: 567387 - protein, 9 aa, Homo Sapiens
AQNGFSAQI

SEQ ID NO: 567388 - protein, 9 aa, Homo Sapiens
SPKPEPQLL

SEQ ID NO: 567389 - protein, 9 aa, Homo Sapiens
YDSFAHYFA

SEQ ID NO: 567390 - protein, 9 aa, Homo Sapiens
CRLLTPGDY

SEQ ID NO: 567391 - protein, 9 aa, Homo Sapiens
VLTRPSTPG

SEQ ID NO: 567392 - protein, 9 aa, Homo Sapiens
PDFSAHDPT

SEQ ID NO: 567393 - protein, 9 aa, Homo Sapiens
LVDKLLVRV

SEQ ID NO: 567394 - protein, 9 aa, Homo Sapiens
WHLTRREEG

SEQ ID NO: 567395 - protein, 9 aa, Homo Sapiens
NLACSTLLR

SEQ ID NO: 567396 - protein, 9 aa, Homo Sapiens
MGELSTYTL

SEQ ID NO: 567397 - protein, 9 aa, Homo Sapiens
EGPECNPAI

SEQ ID NO: 567398 - protein, 9 aa, Homo Sapiens
VLPIEVDLA

SEQ ID NO: 567399 - protein, 9 aa, Homo Sapiens
SSKMEETKS

SEQ ID NO: 567400 - protein, 9 aa, Homo Sapiens
VLERCPHRP

SEQ ID NO: 567401 - protein, 9 aa, Homo Sapiens
LMRTTRFQG

SEQ ID NO: 567402 - protein, 9 aa, Homo Sapiens
VLEDSARDI

SEQ ID NO: 567403 - protein, 9 aa, Homo Sapiens
RSHSRSFSK

SEQ ID NO: 567404 - protein, 9 aa, Homo Sapiens
ALVIRNGKK

SEQ ID NO: 567405 - protein, 9 aa, Homo Sapiens
EQPDSWQPY

SEQ ID NO: 567406 - protein, 9 aa, Homo Sapiens
CNDKTEIER

SEQ ID NO: 567407 - protein, 9 aa, Homo Sapiens
YLAHVWPKL

SEQ ID NO: 567408 - protein, 9 aa, Homo Sapiens
KEVSSNTAM

SEQ ID NO: 567409 - protein, 9 aa, Homo Sapiens
LTQLTLQAL

SEQ ID NO: 567410 - protein, 9 aa, Homo Sapiens
NEKHKKCFL

SEQ ID NO: 567411 - protein, 9 aa, Homo Sapiens
IHSICNDKT

SEQ ID NO: 567412 - protein, 9 aa, Homo Sapiens
CLYSGHTVM

SEQ ID NO: 567413 - protein, 9 aa, Homo Sapiens
TTGNGVVLW

SEQ ID NO: 567414 - protein, 9 aa, Homo Sapiens
VDKLLVRVV

SEQ ID NO: 567415 - protein, 9 aa, Homo Sapiens
SATALANAG

SEQ ID NO: 567416 - protein, 9 aa, Homo Sapiens
ALSTLLCKQ

SEQ ID NO: 567417 - protein, 9 aa, Homo Sapiens
LLCTARVFF

SEQ ID NO: 567418 - protein, 9 aa, Homo Sapiens
QFSNINKEE

SEQ ID NO: 567419 - protein, 9 aa, Homo Sapiens
EIAAACIHM

SEQ ID NO: 567420 - protein, 9 aa, Homo Sapiens
VRVVLDKCM

SEQ ID NO: 567421 - protein, 9 aa, Homo Sapiens
VIFLASYIA

SEQ ID NO: 567422 - protein, 9 aa, Homo Sapiens
AGMMIAAAC

SEQ ID NO: 567423 - protein, 9 aa, Homo Sapiens
DVLERCPHR

SEQ ID NO: 567424 - protein, 9 aa, Homo Sapiens
RFQGYTLPQ

SEQ ID NO: 567425 - protein, 9 aa, Homo Sapiens
AFAGTANLL

SEQ ID NO: 567426 - protein, 9 aa, Homo Sapiens
GTTGNGVVL

SEQ ID NO: 567427 - protein, 9 aa, Homo Sapiens
SHSRSFSKS

SEQ ID NO: 567428 - protein, 9 aa, Homo Sapiens
MSSDSSESP

SEQ ID NO: 567429 - protein, 9 aa, Homo Sapiens
VNLTLMSGF

SEQ ID NO: 567430 - protein, 9 aa, Homo Sapiens
VVQFSNINK

SEQ ID NO: 567431 - protein, 9 aa, Homo Sapiens
SRQEHDKEV

SEQ ID NO: 567432 - protein, 9 aa, Homo Sapiens
NHITKSAED

SEQ ID NO: 567433 - protein, 9 aa, Homo Sapiens
RPWHLTRRE

SEQ ID NO: 567434 - protein, 9 aa, Homo Sapiens
EPSCDRLID

SEQ ID NO: 567435 - protein, 9 aa, Homo Sapiens
LSAKEKKLA

SEQ ID NO: 567436 - protein, 9 aa, Homo Sapiens
PDTGQTFCP

SEQ ID NO: 567437 - protein, 9 aa, Homo Sapiens
PGDPRDMEA

SEQ ID NO: 567438 - protein, 9 aa, Homo Sapiens
VLRDADVLP

SEQ ID NO: 567439 - protein, 9 aa, Homo Sapiens
HNMCGDCLY

SEQ ID NO: 567440 - protein, 9 aa, Homo Sapiens
WPKLGNWPS

SEQ ID NO: 567441 - protein, 9 aa, Homo Sapiens
NKSLLKELA

SEQ ID NO: 567442 - protein, 9 aa, Homo Sapiens
YIANLAAFM

SEQ ID NO: 567443 - protein, 9 aa, Homo Sapiens
CWWHHTNPV

SEQ ID NO: 567444 - protein, 9 aa, Homo Sapiens
HYQLAQNGF

SEQ ID NO: 567445 - protein, 9 aa, Homo Sapiens
LLGTTGNGV

SEQ ID NO: 567446 - protein, 9 aa, Homo Sapiens
IYLAHVWPK

SEQ ID NO: 567447 - protein, 9 aa, Homo Sapiens
EYRRIIVLL

SEQ ID NO: 567448 - protein, 9 aa, Homo Sapiens
RRIIVLLCT

SEQ ID NO: 567449 - protein, 9 aa, Homo Sapiens
KPEPQLLDP

SEQ ID NO: 567450 - protein, 9 aa, Homo Sapiens
RAPESPQVP

SEQ ID NO: 567451 - protein, 9 aa, Homo Sapiens
HVFPSIHNA

SEQ ID NO: 567452 - protein, 9 aa, Homo Sapiens
RAMVLDAND

SEQ ID NO: 567453 - protein, 9 aa, Homo Sapiens
ENNPRGAFI

SEQ ID NO: 567454 - protein, 9 aa, Homo Sapiens
VISSHLGQL

SEQ ID NO: 567455 - protein, 9 aa, Homo Sapiens
RQTWFCCVE

SEQ ID NO: 567456 - protein, 9 aa, Homo Sapiens
NTAYEKRKA

SEQ ID NO: 567457 - protein, 9 aa, Homo Sapiens
LTLQALPLQ

SEQ ID NO: 567458 - protein, 9 aa, Homo Sapiens
EIGKQGCRP

SEQ ID NO: 567459 - protein, 9 aa, Homo Sapiens
KLLVRVVLD

SEQ ID NO: 567460 - protein, 9 aa, Homo Sapiens
AGIGPKDSR

SEQ ID NO: 567461 - protein, 9 aa, Homo Sapiens
CPHRPILQA

SEQ ID NO: 567462 - protein, 9 aa, Homo Sapiens
AKEKKLAFG

SEQ ID NO: 567463 - protein, 9 aa, Homo Sapiens
LLVRVVLDK

SEQ ID NO: 567464 - protein, 9 aa, Homo Sapiens
ISVAPLNAH

SEQ ID NO: 567465 - protein, 9 aa, Homo Sapiens
KGFSKSSMS

SEQ ID NO: 567466 - protein, 9 aa, Homo Sapiens
TLLCKQQQK

SEQ ID NO: 567467 - protein, 9 aa, Homo Sapiens
HKKCFLEHS

SEQ ID NO: 567468 - protein, 9 aa, Homo Sapiens
EAMGPDFSA

SEQ ID NO: 567469 - protein, 9 aa, Homo Sapiens
SAKDADSPP

SEQ ID NO: 567470 - protein, 9 aa, Homo Sapiens
QIHSICNDK

SEQ ID NO: 567471 - protein, 9 aa, Homo Sapiens
GGQTHLSQN

SEQ ID NO: 567472 - protein, 9 aa, Homo Sapiens
VPRAPESPQ

SEQ ID NO: 567473 - protein, 9 aa, Homo Sapiens
RNKAKKNKD

SEQ ID NO: 567474 - protein, 9 aa, Homo Sapiens
RIRAMVLDA

SEQ ID NO: 567475 - protein, 9 aa, Homo Sapiens
CFLEHSSLE

SEQ ID NO: 567476 - protein, 9 aa, Homo Sapiens
TGTARIRAM

SEQ ID NO: 567477 - protein, 9 aa, Homo Sapiens
AELSILIST

SEQ ID NO: 567478 - protein, 9 aa, Homo Sapiens
PWHLTRREE

SEQ ID NO: 567479 - protein, 9 aa, Homo Sapiens
SSHLGQLRR

SEQ ID NO: 567480 - protein, 9 aa, Homo Sapiens
AWGGDYCRL

SEQ ID NO: 567481 - protein, 9 aa, Homo Sapiens
KLIEQNNKS

SEQ ID NO: 567482 - protein, 9 aa, Homo Sapiens
QKDIYLAHV

SEQ ID NO: 567483 - protein, 9 aa, Homo Sapiens
LREERNKAK

SEQ ID NO: 567484 - protein, 9 aa, Homo Sapiens
GKGFSKSSM

SEQ ID NO: 567485 - protein, 9 aa, Homo Sapiens
TTVVSCGPP

SEQ ID NO: 567486 - protein, 9 aa, Homo Sapiens
AHDQTLLEQ

SEQ ID NO: 567487 - protein, 9 aa, Homo Sapiens
QQTILKISQ

SEQ ID NO: 567488 - protein, 9 aa, Homo Sapiens
TGNGVVLWT

SEQ ID NO: 567489 - protein, 9 aa, Homo Sapiens
EHDKEVRSW

SEQ ID NO: 567490 - protein, 9 aa, Homo Sapiens
ECNPAIQTV

SEQ ID NO: 567491 - protein, 9 aa, Homo Sapiens
NINKEEFQL

SEQ ID NO: 567492 - protein, 9 aa, Homo Sapiens
GNWPSSSTT

SEQ ID NO: 567493 - protein, 9 aa, Homo Sapiens
NNPRGAFIF

SEQ ID NO: 567494 - protein, 9 aa, Homo Sapiens
KEKKLAFGN

SEQ ID NO: 567495 - protein, 9 aa, Homo Sapiens
NGVVLWTVF

SEQ ID NO: 567496 - protein, 9 aa, Homo Sapiens
DSQTLLTTV

SEQ ID NO: 567497 - protein, 9 aa, Homo Sapiens
LGNWPSSST

SEQ ID NO: 567498 - protein, 9 aa, Homo Sapiens
RTGTARIRA

SEQ ID NO: 567499 - protein, 9 aa, Homo Sapiens
ELGSGRAGI

SEQ ID NO: 567500 - protein, 9 aa, Homo Sapiens
TLMRTTRFQ

SEQ ID NO: 567501 - protein, 9 aa, Homo Sapiens
TGQTFCPSS

SEQ ID NO: 567502 - protein, 9 aa, Homo Sapiens
SYASTDTYK

SEQ ID NO: 567503 - protein, 9 aa, Homo Sapiens
SILISTASS

SEQ ID NO: 567504 - protein, 9 aa, Homo Sapiens
RGAFIFSVT

SEQ ID NO: 567505 - protein, 9 aa, Homo Sapiens
WPSSSTTHP

SEQ ID NO: 567506 - protein, 9 aa, Homo Sapiens
STCTQKTWA

SEQ ID NO: 567507 - protein, 9 aa, Homo Sapiens
KCFLEHSSL

SEQ ID NO: 567508 - protein, 9 aa, Homo Sapiens
HSRSFSKSR

SEQ ID NO: 567509 - protein, 9 aa, Homo Sapiens
HSICNDKTE

SEQ ID NO: 567510 - protein, 9 aa, Homo Sapiens
YQLAQNGFS

SEQ ID NO: 567511 - protein, 9 aa, Homo Sapiens
PPDTGQTFC

SEQ ID NO: 567512 - protein, 9 aa, Homo Sapiens
LEAMGPDFS

SEQ ID NO: 567513 - protein, 9 aa, Homo Sapiens
KVGEIGKQG

SEQ ID NO: 567514 - protein, 9 aa, Homo Sapiens
ACSTLLREG

SEQ ID NO: 567515 - protein, 9 aa, Homo Sapiens
PQQPLVGAS

SEQ ID NO: 567516 - protein, 9 aa, Homo Sapiens
APESPQVPS

SEQ ID NO: 567517 - protein, 9 aa, Homo Sapiens
CNPAIQTVR

SEQ ID NO: 567518 - protein, 9 aa, Homo Sapiens
IGVVQFSNI

SEQ ID NO: 567519 - protein, 9 aa, Homo Sapiens
HVWPKLGNW

SEQ ID NO: 567520 - protein, 9 aa, Homo Sapiens
VVLWTVFRS

SEQ ID NO: 567521 - protein, 9 aa, Homo Sapiens
FYSAKDADS

SEQ ID NO: 567522 - protein, 9 aa, Homo Sapiens
HEDTNLACS

SEQ ID NO: 567523 - protein, 9 aa, Homo Sapiens
HDKEVRSWQ

SEQ ID NO: 567524 - protein, 9 aa, Homo Sapiens
NNKSLLKEL

SEQ ID NO: 567525 - protein, 9 aa, Homo Sapiens
AELNKEVSS

SEQ ID NO: 567526 - protein, 9 aa, Homo Sapiens
DSWQPYGSS

SEQ ID NO: 567527 - protein, 9 aa, Homo Sapiens
VGNGAELSI

SEQ ID NO: 567528 - protein, 9 aa, Homo Sapiens
ASTDTYKLK

SEQ ID NO: 567529 - protein, 9 aa, Homo Sapiens
LVGASRGEE

SEQ ID NO: 567530 - protein, 9 aa, Homo Sapiens
SLSAKEKKL

SEQ ID NO: 567531 - protein, 9 aa, Homo Sapiens
TKSAEDKRE

SEQ ID NO: 567532 - protein, 9 aa, Homo Sapiens
IFLASYIAN

SEQ ID NO: 567533 - protein, 9 aa, Homo Sapiens
VLLCTARVF

SEQ ID NO: 567534 - protein, 9 aa, Homo Sapiens
IAAACVLSF

SEQ ID NO: 567535 - protein, 9 aa, Homo Sapiens
TQKTWAAAC

SEQ ID NO: 567536 - protein, 9 aa, Homo Sapiens
NPAIQTVRM

SEQ ID NO: 567537 - protein, 9 aa, Homo Sapiens
ACVLSFILW

SEQ ID NO: 567538 - protein, 9 aa, Homo Sapiens
RIIVLLCTA

SEQ ID NO: 567539 - protein, 9 aa, Homo Sapiens
VFPSIHNAV

SEQ ID NO: 567540 - protein, 9 aa, Homo Sapiens
DTNLACSTL

SEQ ID NO: 567541 - protein, 9 aa, Homo Sapiens
SASRSHSRS

SEQ ID NO: 567542 - protein, 9 aa, Homo Sapiens
QNNKSLLKE

SEQ ID NO: 567543 - protein, 9 aa, Homo Sapiens
GQTHLSQND

SEQ ID NO: 567544 - protein, 9 aa, Homo Sapiens
CCQCSYAST

SEQ ID NO: 567545 - protein, 9 aa, Homo Sapiens
GAELSILIS

SEQ ID NO: 567546 - protein, 9 aa, Homo Sapiens
QTFCPSSFQ

SEQ ID NO: 567547 - protein, 9 aa, Homo Sapiens
GSHNMCGDC

SEQ ID NO: 567548 - protein, 9 aa, Homo Sapiens
TPGDPRDME

SEQ ID NO: 567549 - protein, 9 aa, Homo Sapiens
PMGELSTYT

SEQ ID NO: 567550 - protein, 9 aa, Homo Sapiens
DRLREERNK

SEQ ID NO: 567551 - protein, 9 aa, Homo Sapiens
QALPLQILV

SEQ ID NO: 567552 - protein, 9 aa, Homo Sapiens
KMEETKSKL

SEQ ID NO: 567553 - protein, 9 aa, Homo Sapiens
NPYDSFAHY

SEQ ID NO: 567554 - protein, 9 aa, Homo Sapiens
PQVPSPPPS

SEQ ID NO: 567555 - protein, 9 aa, Homo Sapiens
PSSSTTHPR

SEQ ID NO: 567556 - protein, 9 aa, Homo Sapiens
PGPQQPLVG

SEQ ID NO: 567557 - protein, 9 aa, Homo Sapiens
CIHMMPNAV

SEQ ID NO: 567558 - protein, 9 aa, Homo Sapiens
KSSMSSDSS

SEQ ID NO: 567559 - protein, 9 aa, Homo Sapiens
LPLQILVKE

SEQ ID NO: 567560 - protein, 9 aa, Homo Sapiens
NGAELSILI

SEQ ID NO: 567561 - protein, 9 aa, Homo Sapiens
AVLRDADVL

SEQ ID NO: 567562 - protein, 9 aa, Homo Sapiens
KSLLKELAG

SEQ ID NO: 567563 - protein, 9 aa, Homo Sapiens
YASTDTYKL

SEQ ID NO: 567564 - protein, 9 aa, Homo Sapiens
CGDCLYSGH

SEQ ID NO: 567565 - protein, 9 aa, Homo Sapiens
LCKQQQKDG

SEQ ID NO: 567566 - protein, 9 aa, Homo Sapiens
RARPWHLTR

SEQ ID NO: 567567 - protein, 9 aa, Homo Sapiens
VIRNGKKMS

SEQ ID NO: 567568 - protein, 9 aa, Homo Sapiens
AVQWNPYDS

SEQ ID NO: 567569 - protein, 9 aa, Homo Sapiens
QLAQNGFSA

SEQ ID NO: 567570 - protein, 9 aa, Homo Sapiens
LNCVITVSP

SEQ ID NO: 567571 - protein, 9 aa, Homo Sapiens
VQFSNINKE

SEQ ID NO: 567572 - protein, 9 aa, Homo Sapiens
LNAHDQTLL

SEQ ID NO: 567573 - protein, 9 aa, Homo Sapiens
AKDADSPPE

SEQ ID NO: 567574 - protein, 9 aa, Homo Sapiens
IEQNNKSLL

SEQ ID NO: 567575 - protein, 9 aa, Homo Sapiens
SQNDPIFVL

SEQ ID NO: 567576 - protein, 9 aa, Homo Sapiens
TGGQTHLSQ

SEQ ID NO: 567577 - protein, 9 aa, Homo Sapiens
PSCDRLIDP

SEQ ID NO: 567578 - protein, 9 aa, Homo Sapiens
QGCRPRAFC

SEQ ID NO: 567579 - protein, 9 aa, Homo Sapiens
ALEPPSPKP

SEQ ID NO: 567580 - protein, 9 aa, Homo Sapiens
TNLACSTLL

SEQ ID NO: 567581 - protein, 9 aa, Homo Sapiens
QTLLTTVVS

SEQ ID NO: 567582 - protein, 9 aa, Homo Sapiens
AAFAGTANL

SEQ ID NO: 567583 - protein, 9 aa, Homo Sapiens
VVLTRPSTP

SEQ ID NO: 567584 - protein, 9 aa, Homo Sapiens
SNTAYEKRK

SEQ ID NO: 567585 - protein, 9 aa, Homo Sapiens
LNKEVSSNT

SEQ ID NO: 567586 - protein, 9 aa, Homo Sapiens
LSILISTAS

SEQ ID NO: 567587 - protein, 9 aa, Homo Sapiens
NAGSPGPPR

SEQ ID NO: 567588 - protein, 9 aa, Homo Sapiens
AMVLDANDN

SEQ ID NO: 567589 - protein, 9 aa, Homo Sapiens
DTGQTFCPS

SEQ ID NO: 567590 - protein, 9 aa, Homo Sapiens
TICSLNSHI

SEQ ID NO: 567591 - protein, 9 aa, Homo Sapiens
MAAFAGTAN

SEQ ID NO: 567592 - protein, 9 aa, Homo Sapiens
VVLDKCMEE

SEQ ID NO: 567593 - protein, 9 aa, Homo Sapiens
AACVLSFIL

SEQ ID NO: 567594 - protein, 9 aa, Homo Sapiens
AGTANLLMD

SEQ ID NO: 567595 - protein, 9 aa, Homo Sapiens
CCVETSTCT

SEQ ID NO: 567596 - protein, 9 aa, Homo Sapiens
TDTYKLKRH

SEQ ID NO: 567597 - protein, 9 aa, Homo Sapiens
DADVLPIEV

SEQ ID NO: 567598 - protein, 9 aa, Homo Sapiens
RSASRSHSR

SEQ ID NO: 567599 - protein, 9 aa, Homo Sapiens
SVAPLNAHD

SEQ ID NO: 567600 - protein, 9 aa, Homo Sapiens
TQLTLQALP

SEQ ID NO: 567601 - protein, 9 aa, Homo Sapiens
LEQPDSWQP

SEQ ID NO: 567602 - protein, 9 aa, Homo Sapiens
MGPDFSAHD

SEQ ID NO: 567603 - protein, 9 aa, Homo Sapiens
LRLSRQEHD

SEQ ID NO: 567604 - protein, 9 aa, Homo Sapiens
FHKEIAAAC

SEQ ID NO: 567605 - protein, 9 aa, Homo Sapiens
AMGPDFSAH

SEQ ID NO: 567606 - protein, 9 aa, Homo Sapiens
TYTLSREPL

SEQ ID NO: 567607 - protein, 9 aa, Homo Sapiens
PENNPRGAF

SEQ ID NO: 567608 - protein, 9 aa, Homo Sapiens
SNINKEEFQ

SEQ ID NO: 567609 - protein, 9 aa, Homo Sapiens
VSSNTAMIQ

SEQ ID NO: 567610 - protein, 9 aa, Homo Sapiens
ARDIREALH

SEQ ID NO: 567611 - protein, 9 aa, Homo Sapiens
GEIGKQGCR

SEQ ID NO: 567612 - protein, 9 aa, Homo Sapiens
SRSASRSHS

SEQ ID NO: 567613 - protein, 9 aa, Homo Sapiens
AVIFLASYI

SEQ ID NO: 567614 - protein, 9 aa, Homo Sapiens
GQTFCPSSF

SEQ ID NO: 567615 - protein, 9 aa, Homo Sapiens
CVETSTCTQ

SEQ ID NO: 567616 - protein, 9 aa, Homo Sapiens
SKSSMSSDS

SEQ ID NO: 567617 - protein, 9 aa, Homo Sapiens
SARDIREAL

SEQ ID NO: 567618 - protein, 9 aa, Homo Sapiens
SSLSAKEKK

SEQ ID NO: 567619 - protein, 9 aa, Homo Sapiens
LASYIANLA

SEQ ID NO: 567620 - protein, 9 aa, Homo Sapiens
PLVGASRGE

SEQ ID NO: 567621 - protein, 9 aa, Homo Sapiens
MEETKSKLE

SEQ ID NO: 567622 - protein, 9 aa, Homo Sapiens
PRGAFIFSV

SEQ ID NO: 567623 - protein, 9 aa, Homo Sapiens
NKEVSSNTA

SEQ ID NO: 567624 - protein, 9 aa, Homo Sapiens
SPPDTGQTF

SEQ ID NO: 567625 - protein, 9 aa, Homo Sapiens
FSNINKEEF

SEQ ID NO: 567626 - protein, 9 aa, Homo Sapiens
VLLSHQRTH

SEQ ID NO: 567627 - protein, 9 aa, Homo Sapiens
LQALPLQIL

SEQ ID NO: 567628 - protein, 9 aa, Homo Sapiens
RDADVLPIE

SEQ ID NO: 567629 - protein, 9 aa, Homo Sapiens
KKCFLEHSS

SEQ ID NO: 567630 - protein, 9 aa, Homo Sapiens
SNTAMIQTS

SEQ ID NO: 567631 - protein, 9 aa, Homo Sapiens
LEDSARDIR

SEQ ID NO: 567632 - protein, 9 aa, Homo Sapiens
QTWFCCVET

SEQ ID NO: 567633 - protein, 9 aa, Homo Sapiens
WDSNVIQTF

SEQ ID NO: 567634 - protein, 9 aa, Homo Sapiens
QWNPYDSFA

SEQ ID NO: 567635 - protein, 9 aa, Homo Sapiens
GFSKSSMSS

SEQ ID NO: 567636 - protein, 9 aa, Homo Sapiens
GAVQWNPYD

SEQ ID NO: 567637 - protein, 9 aa, Homo Sapiens
GMMIAAACV

SEQ ID NO: 567638 - protein, 9 aa, Homo Sapiens
TILKISQQQ

SEQ ID NO: 567639 - protein, 9 aa, Homo Sapiens
KHEDTNLAC

SEQ ID NO: 567640 - protein, 9 aa, Homo Sapiens
EDTNLACST

SEQ ID NO: 567641 - protein, 9 aa, Homo Sapiens
QTILKISQQ

SEQ ID NO: 567642 - protein, 9 aa, Homo Sapiens
THPGPQQPL

SEQ ID NO: 567643 - protein, 9 aa, Homo Sapiens
SNVIQTFDI

SEQ ID NO: 567644 - protein, 9 aa, Homo Sapiens
NWPSSSTTH

SEQ ID NO: 567645 - protein, 9 aa, Homo Sapiens
DKLLVRVVL

SEQ ID NO: 567646 - protein, 9 aa, Homo Sapiens
SHLGQLRRT

SEQ ID NO: 567647 - protein, 9 aa, Homo Sapiens
LGSGRAGIG

SEQ ID NO: 567648 - protein, 9 aa, Homo Sapiens
STTHPRRQT

SEQ ID NO: 567649 - protein, 9 aa, Homo Sapiens
ASYIANLAA

SEQ ID NO: 567650 - protein, 9 aa, Homo Sapiens
ESNTAYEKR

SEQ ID NO: 567651 - protein, 9 aa, Homo Sapiens
ICNDKTEIE

SEQ ID NO: 567652 - protein, 9 aa, Homo Sapiens
TANLLMDFG

SEQ ID NO: 567653 - protein, 9 aa, Homo Sapiens
WVGNGAELS

SEQ ID NO: 567654 - protein, 9 aa, Homo Sapiens
HPRRQTWFC

SEQ ID NO: 567655 - protein, 9 aa, Homo Sapiens
LSRQEHDKE

SEQ ID NO: 567656 - protein, 9 aa, Homo Sapiens
FAGTANLLM

SEQ ID NO: 567657 - protein, 9 aa, Homo Sapiens
PSTPGDPRD

SEQ ID NO: 567658 - protein, 9 aa, Homo Sapiens
SWQPYGSSF

SEQ ID NO: 567659 - protein, 9 aa, Homo Sapiens
EERNKAKKN

SEQ ID NO: 567660 - protein, 9 aa, Homo Sapiens
TWFCCVETS

SEQ ID NO: 567661 - protein, 9 aa, Homo Sapiens
LEPPSPKPE

SEQ ID NO: 567662 - protein, 9 aa, Homo Sapiens
IQCQEDECA

SEQ ID NO: 567663 - protein, 9 aa, Homo Sapiens
DCLYSGHTV

SEQ ID NO: 567664 - protein, 9 aa, Homo Sapiens
DEGPECNPA

SEQ ID NO: 567665 - protein, 8 aa, Homo Sapiens
KETPLSNC

SEQ ID NO: 567666 - protein, 9 aa, Homo Sapiens
GNGVVLWTV

SEQ ID NO: 567667 - protein, 9 aa, Homo Sapiens
MVSLLNCVI

SEQ ID NO: 567668 - protein, 9 aa, Homo Sapiens
GTARIRAMV

SEQ ID NO: 567669 - protein, 9 aa, Homo Sapiens
LLNCVITVS

SEQ ID NO: 567670 - protein, 9 aa, Homo Sapiens
NCVITVSPQ

SEQ ID NO: 567671 - protein, 9 aa, Homo Sapiens
MMIAAACVL

SEQ ID NO: 567672 - protein, 9 aa, Homo Sapiens
AARARPWHL

SEQ ID NO: 567673 - protein, 9 aa, Homo Sapiens
RRQTWFCCV

SEQ ID NO: 567674 - protein, 9 aa, Homo Sapiens
AHVWPKLGN

SEQ ID NO: 567675 - protein, 9 aa, Homo Sapiens
AACIHMMPN

SEQ ID NO: 567676 - protein, 9 aa, Homo Sapiens
LLTTVVSCG

SEQ ID NO: 567677 - protein, 9 aa, Homo Sapiens
GENEKHKKC

SEQ ID NO: 567678 - protein, 9 aa, Homo Sapiens
ADVLPIEVD

SEQ ID NO: 567679 - protein, 9 aa, Homo Sapiens
VITVSPQNM

SEQ ID NO: 567680 - protein, 9 aa, Homo Sapiens
CDRLIDPHR

SEQ ID NO: 567681 - protein, 9 aa, Homo Sapiens
HDQTLLEQM

SEQ ID NO: 567682 - protein, 9 aa, Homo Sapiens
KTEIERLKS

SEQ ID NO: 567683 - protein, 9 aa, Homo Sapiens
PESPQVPSP

SEQ ID NO: 567684 - protein, 9 aa, Homo Sapiens
ETSTCTQKT

SEQ ID NO: 567685 - protein, 9 aa, Homo Sapiens
LKVGEIGKQ

SEQ ID NO: 567686 - protein, 9 aa, Homo Sapiens
ETKSKLEEA

SEQ ID NO: 567687 - protein, 9 aa, Homo Sapiens
GGFYSAKDA

SEQ ID NO: 567688 - protein, 9 aa, Homo Sapiens
ALPLQILVK

SEQ ID NO: 567689 - protein, 9 aa, Homo Sapiens
GGDYCRLLT

SEQ ID NO: 567690 - protein, 9 aa, Homo Sapiens
ISSHLGQLR

SEQ ID NO: 567691 - protein, 9 aa, Homo Sapiens
PPSPKPEPQ

SEQ ID NO: 567692 - protein, 9 aa, Homo Sapiens
TLMSGFLLM

SEQ ID NO: 567693 - protein, 9 aa, Homo Sapiens
SIHNAVLFA

SEQ ID NO: 567694 - protein, 9 aa, Homo Sapiens
NDKTEIERL

SEQ ID NO: 567695 - protein, 9 aa, Homo Sapiens
IIVLLCTAR

SEQ ID NO: 567696 - protein, 9 aa, Homo Sapiens
LVRVVLDKC

SEQ ID NO: 567697 - protein, 9 aa, Homo Sapiens
LAHVWPKLG

SEQ ID NO: 567698 - protein, 9 aa, Homo Sapiens
TRPSTPGDP

SEQ ID NO: 567699 - protein, 9 aa, Homo Sapiens
STLQQTILK

SEQ ID NO: 567700 - protein, 9 aa, Homo Sapiens
LSTYTLSRE

SEQ ID NO: 567701 - protein, 9 aa, Homo Sapiens
APLNAHDQT

SEQ ID NO: 567702 - protein, 9 aa, Homo Sapiens
QVPSPPPSP

SEQ ID NO: 567703 - protein, 9 aa, Homo Sapiens
ASATALANA

SEQ ID NO: 567704 - protein, 9 aa, Homo Sapiens
CLEQPDSWQ

SEQ ID NO: 567705 - protein, 9 aa, Homo Sapiens
GKQGCRPRA

SEQ ID NO: 567706 - protein, 9 aa, Homo Sapiens
AIQTVRMKE

SEQ ID NO: 567707 - protein, 9 aa, Homo Sapiens
PDSWQPYGS

SEQ ID NO: 567708 - protein, 9 aa, Homo Sapiens
LACSTLLRE

SEQ ID NO: 567709 - protein, 9 aa, Homo Sapiens
VLAVLEDSA

SEQ ID NO: 567710 - protein, 9 aa, Homo Sapiens
HKEIAAACI

SEQ ID NO: 567711 - protein, 9 aa, Homo Sapiens
PSIHNAVLF

SEQ ID NO: 567712 - protein, 9 aa, Homo Sapiens
SYIANLAAF

SEQ ID NO: 567713 - protein, 9 aa, Homo Sapiens
QNGFSAQIL

SEQ ID NO: 567714 - protein, 9 aa, Homo Sapiens
KDADSPPER

SEQ ID NO: 567715 - protein, 9 aa, Homo Sapiens
KKLAFGNVL

SEQ ID NO: 567716 - protein, 9 aa, Homo Sapiens
SPQVPSPPP

SEQ ID NO: 567717 - protein, 9 aa, Homo Sapiens
WQPYGSSFY

SEQ ID NO: 567718 - protein, 9 aa, Homo Sapiens
MVNLTLMSG

SEQ ID NO: 567719 - protein, 9 aa, Homo Sapiens
GVVQFSNIN

SEQ ID NO: 567720 - protein, 9 aa, Homo Sapiens
IGAVQWNPY

SEQ ID NO: 567721 - protein, 9 aa, Homo Sapiens
EETKSKLEE

SEQ ID NO: 567722 - protein, 9 aa, Homo Sapiens
PLNAHDQTL

SEQ ID NO: 567723 - protein, 9 aa, Homo Sapiens
KKWDSNVIQ

SEQ ID NO: 567724 - protein, 9 aa, Homo Sapiens
PECNPAIQT

SEQ ID NO: 567725 - protein, 9 aa, Homo Sapiens
STPGDPRDM

SEQ ID NO: 567726 - protein, 9 aa, Homo Sapiens
IVLLCTARV

SEQ ID NO: 567727 - protein, 9 aa, Homo Sapiens
ENEKHKKCF

SEQ ID NO: 567728 - protein, 9 aa, Homo Sapiens
SQTLLTTVV

SEQ ID NO: 567729 - protein, 9 aa, Homo Sapiens
IRAMVLDAN

SEQ ID NO: 567730 - protein, 9 aa, Homo Sapiens
TAWGGDYCR

SEQ ID NO: 567731 - protein, 9 aa, Homo Sapiens
IRNGKKMSI

SEQ ID NO: 567732 - protein, 9 aa, Homo Sapiens
EVSSNTAMI

SEQ ID NO: 567733 - protein, 9 aa, Homo Sapiens
GEPSCDRLI

SEQ ID NO: 567734 - protein, 9 aa, Homo Sapiens
NAHDQTLLE

SEQ ID NO: 567735 - protein, 9 aa, Homo Sapiens
CVITVSPQN

SEQ ID NO: 567736 - protein, 9 aa, Homo Sapiens
SVLLSHQRT

SEQ ID NO: 567737 - protein, 9 aa, Homo Sapiens
SSTTHPRRQ

SEQ ID NO: 567738 - protein, 9 aa, Homo Sapiens
VFCWWHHTN

SEQ ID NO: 567739 - protein, 9 aa, Homo Sapiens
DKTEIERLK

SEQ ID NO: 567740 - protein, 9 aa, Homo Sapiens
SKMEETKSK

SEQ ID NO: 567741 - protein, 9 aa, Homo Sapiens
SSPPDTGQT

SEQ ID NO: 567742 - protein, 9 aa, Homo Sapiens
WNPYDSFAH

SEQ ID NO: 567743 - protein, 9 aa, Homo Sapiens
LMSGFLLMG

SEQ ID NO: 567744 - protein, 9 aa, Homo Sapiens
VQWNPYDSF

SEQ ID NO: 567745 - protein, 9 aa, Homo Sapiens
MRTTRFQGY

SEQ ID NO: 567746 - protein, 9 aa, Homo Sapiens
TISTLQQTI

SEQ ID NO: 567747 - protein, 9 aa, Homo Sapiens
ARARPWHLT

SEQ ID NO: 567748 - protein, 9 aa, Homo Sapiens
RQEHDKEVR

SEQ ID NO: 567749 - protein, 9 aa, Homo Sapiens
TRFQGYTLP

SEQ ID NO: 567750 - protein, 9 aa, Homo Sapiens
NKLIEQNNK

SEQ ID NO: 567751 - protein, 9 aa, Homo Sapiens
KQGCRPRAF

SEQ ID NO: 567752 - protein, 9 aa, Homo Sapiens
FSAHDPTET

SEQ ID NO: 567753 - protein, 9 aa, Homo Sapiens
SGRAGIGPK

SEQ ID NO: 567754 - protein, 9 aa, Homo Sapiens
RLSRQEHDK

SEQ ID NO: 567755 - protein, 9 aa, Homo Sapiens
THLSQNDPI

SEQ ID NO: 567756 - protein, 9 aa, Homo Sapiens
ANLLMDFGV

SEQ ID NO: 567757 - protein, 9 aa, Homo Sapiens
SCDRLIDPH

SEQ ID NO: 567758 - protein, 9 aa, Homo Sapiens
TFCPSSFQS

SEQ ID NO: 567759 - protein, 9 aa, Homo Sapiens
QEHDKEVRS

SEQ ID NO: 567760 - protein, 9 aa, Homo Sapiens
QPDSWQPYG

SEQ ID NO: 567761 - protein, 9 aa, Homo Sapiens
ALANAGSPG

SEQ ID NO: 567762 - protein, 9 aa, Homo Sapiens
LLFVISSHL

SEQ ID NO: 567763 - protein, 9 aa, Homo Sapiens
WGGDYCRLL

SEQ ID NO: 567764 - protein, 9 aa, Homo Sapiens
KHKKCFLEH

SEQ ID NO: 567765 - protein, 9 aa, Homo Sapiens
ELSILISTA

SEQ ID NO: 567766 - protein, 9 aa, Homo Sapiens
THPRRQTWF

SEQ ID NO: 567767 - protein, 9 aa, Homo Sapiens
GPDFSAHDP

SEQ ID NO: 567768 - protein, 9 aa, Homo Sapiens
ARIRAMVLD

SEQ ID NO: 567769 - protein, 9 aa, Homo Sapiens
LANAGSPGP

SEQ ID NO: 567770 - protein, 9 aa, Homo Sapiens
SAEDKREYR

SEQ ID NO: 567771 - protein, 9 aa, Homo Sapiens
SHNMCGDCL

SEQ ID NO: 567772 - protein, 9 aa, Homo Sapiens
IAAACIHMM

SEQ ID NO: 567773 - protein, 9 aa, Homo Sapiens
ELSTYTLSR

SEQ ID NO: 567774 - protein, 9 aa, Homo Sapiens
QALVIRNGK

SEQ ID NO: 567775 - protein, 9 aa, Homo Sapiens
GDCLYSGHT

SEQ ID NO: 567776 - protein, 9 aa, Homo Sapiens
DYCRLLTPG

SEQ ID NO: 567777 - protein, 9 aa, Homo Sapiens
SCLEQPDSW

SEQ ID NO: 567778 - protein, 9 aa, Homo Sapiens
CSTLLREGA

SEQ ID NO: 567779 - protein, 9 aa, Homo Sapiens
FQGYTLPQG

SEQ ID NO: 567780 - protein, 9 aa, Homo Sapiens
IPMGELSTY

SEQ ID NO: 567781 - protein, 9 aa, Homo Sapiens
FCWWHHTNP

SEQ ID NO: 567782 - protein, 9 aa, Homo Sapiens
EKKLAFGNV

SEQ ID NO: 567783 - protein, 9 aa, Homo Sapiens
VSLLNCVIT

SEQ ID NO: 567784 - protein, 9 aa, Homo Sapiens
IHNAVLFAQ

SEQ ID NO: 567785 - protein, 9 aa, Homo Sapiens
QQPLVGASR

SEQ ID NO: 567786 - protein, 9 aa, Homo Sapiens
YTLDVLERC

SEQ ID NO: 567787 - protein, 9 aa, Homo Sapiens
IQTFDIARL

SEQ ID NO: 567788 - protein, 9 aa, Homo Sapiens
EKHKKCFLE

SEQ ID NO: 567789 - protein, 9 aa, Homo Sapiens
QTFDIARLT

SEQ ID NO: 567790 - protein, 9 aa, Homo Sapiens
AAACIHMMP

SEQ ID NO: 567791 - protein, 9 aa, Homo Sapiens
GKKMSINAE

SEQ ID NO: 567792 - protein, 9 aa, Homo Sapiens
ANAGSPGPP

SEQ ID NO: 567793 - protein, 9 aa, Homo Sapiens
WHHTNPVGT

SEQ ID NO: 567794 - protein, 9 aa, Homo Sapiens
QNDPIFVLL

SEQ ID NO: 567795 - protein, 9 aa, Homo Sapiens
KEIAAACIH

SEQ ID NO: 567796 - protein, 9 aa, Homo Sapiens
FPSIHNAVL

SEQ ID NO: 567797 - protein, 9 aa, Homo Sapiens
FLASYIANL

SEQ ID NO: 567798 - protein, 9 aa, Homo Sapiens
RCPHRPILQ

SEQ ID NO: 567799 - protein, 9 aa, Homo Sapiens
WQSVLLSHQ

SEQ ID NO: 567800 - protein, 9 aa, Homo Sapiens
SSSTTHPRR

SEQ ID NO: 567801 - protein, 9 aa, Homo Sapiens
KDIYLAHVW

SEQ ID NO: 567802 - protein, 9 aa, Homo Sapiens
GPQQPLVGA

SEQ ID NO: 567803 - protein, 9 aa, Homo Sapiens
TTAWGGDYC

SEQ ID NO: 567804 - protein, 9 aa, Homo Sapiens
LIEQNNKSL

SEQ ID NO: 567805 - protein, 9 aa, Homo Sapiens
STDTYKLKR

SEQ ID NO: 567806 - protein, 9 aa, Homo Sapiens
TTRFQGYTL

SEQ ID NO: 567807 - protein, 9 aa, Homo Sapiens
NMCGDCLYS

SEQ ID NO: 567808 - protein, 9 aa, Homo Sapiens
TARIRAMVL

SEQ ID NO: 567809 - protein, 9 aa, Homo Sapiens
NKAKKNKDK

SEQ ID NO: 567810 - protein, 9 aa, Homo Sapiens
DFSAHDPTE

SEQ ID NO: 567811 - protein, 9 aa, Homo Sapiens
EISESNTAY

SEQ ID NO: 567812 - protein, 9 aa, Homo Sapiens
STYTLSREP

SEQ ID NO: 567813 - protein, 9 aa, Homo Sapiens
TCTQKTWAA

SEQ ID NO: 567814 - protein, 9 aa, Homo Sapiens
WWHHTNPVG

SEQ ID NO: 567815 - protein, 9 aa, Homo Sapiens
ASRSHSRSF

SEQ ID NO: 567816 - protein, 9 aa, Homo Sapiens
ERNKAKKNK

SEQ ID NO: 567817 - protein, 9 aa, Homo Sapiens
HNAVLFAQA

SEQ ID NO: 567818 - protein, 9 aa, Homo Sapiens
SMSSDSSES

SEQ ID NO: 567819 - protein, 9 aa, Homo Sapiens
NGFSAQILD

SEQ ID NO: 567820 - protein, 9 aa, Homo Sapiens
HLGQLRRTQ

SEQ ID NO: 567821 - protein, 9 aa, Homo Sapiens
ISESNTAYE

SEQ ID NO: 567822 - protein, 9 aa, Homo Sapiens
ITKSAEDKR

SEQ ID NO: 567823 - protein, 9 aa, Homo Sapiens
SAKEKKLAF

SEQ ID NO: 567824 - protein, 9 aa, Homo Sapiens
CTQKTWAAA

SEQ ID NO: 567825 - protein, 9 aa, Homo Sapiens
DIYLAHVWP

SEQ ID NO: 567826 - protein, 9 aa, Homo Sapiens
RVVLDKCME

SEQ ID NO: 567827 - protein, 9 aa, Homo Sapiens
DDSQTLLTT

SEQ ID NO: 567828 - protein, 9 aa, Homo Sapiens
ITVSPQNMG

SEQ ID NO: 567829 - protein, 9 aa, Homo Sapiens
GDYCRLLTP

SEQ ID NO: 567830 - protein, 9 aa, Homo Sapiens
LSTLLCKQQ

SEQ ID NO: 567831 - protein, 9 aa, Homo Sapiens
HPGPQQPLV

SEQ ID NO: 567832 - protein, 9 aa, Homo Sapiens
DSARDIREA

SEQ ID NO: 567833 - protein, 9 aa, Homo Sapiens
LSQNDPIFV

SEQ ID NO: 567834 - protein, 9 aa, Homo Sapiens
WFCCVETST

SEQ ID NO: 567835 - protein, 9 aa, Homo Sapiens
TLDVLERCP

SEQ ID NO: 567836 - protein, 9 aa, Homo Sapiens
VGEIGKQGC

SEQ ID NO: 567837 - protein, 9 aa, Homo Sapiens
AVLEDSARD

SEQ ID NO: 567838 - protein, 9 aa, Homo Sapiens
MCGDCLYSG

SEQ ID NO: 567839 - protein, 9 aa, Homo Sapiens
SESNTAYEK

SEQ ID NO: 567840 - protein, 9 aa, Homo Sapiens
CQCSYASTD

SEQ ID NO: 567841 - protein, 9 aa, Homo Sapiens
TLLFVISSH

SEQ ID NO: 567842 - protein, 9 aa, Homo Sapiens
TLLTTVVSC

SEQ ID NO: 567843 - protein, 9 aa, Homo Sapiens
VVSSKMEET

SEQ ID NO: 567844 - protein, 9 aa, Homo Sapiens
LERCPHRPI

SEQ ID NO: 567845 - protein, 9 aa, Homo Sapiens
CSYASTDTY

SEQ ID NO: 567846 - protein, 9 aa, Homo Sapiens
SSMSSDSSE

SEQ ID NO: 567847 - protein, 9 aa, Homo Sapiens
MIAAACVLS

SEQ ID NO: 567848 - protein, 9 aa, Homo Sapiens
RNGKKMSIN

SEQ ID NO: 567849 - protein, 9 aa, Homo Sapiens
QPLVGASRG

SEQ ID NO: 567850 - protein, 9 aa, Homo Sapiens
QIGVVQFSN

SEQ ID NO: 567851 - protein, 9 aa, Homo Sapiens
PRRQTWFCC

SEQ ID NO: 567852 - protein, 9 aa, Homo Sapiens
YRRIIVLLC

SEQ ID NO: 567853 - protein, 9 aa, Homo Sapiens
LQQTILKIS

SEQ ID NO: 567854 - protein, 9 aa, Homo Sapiens
GVVLWTVFR

SEQ ID NO: 567855 - protein, 9 aa, Homo Sapiens
VSSKMEETK

SEQ ID NO: 567856 - protein, 9 aa, Homo Sapiens
LHYQLAQNG

SEQ ID NO: 567857 - protein, 9 aa, Homo Sapiens
RAARARPWH

SEQ ID NO: 567858 - protein, 9 aa, Homo Sapiens
KLAFGNVLV

SEQ ID NO: 567859 - protein, 9 aa, Homo Sapiens
KLGNWPSSS

SEQ ID NO: 567860 - protein, 9 aa, Homo Sapiens
ACIHMMPNA

SEQ ID NO: 567861 - protein, 9 aa, Homo Sapiens
GFYSAKDAD

SEQ ID NO: 567862 - protein, 9 aa, Homo Sapiens
SRLVLPPVP

SEQ ID NO: 567863 - protein, 9 aa, Homo Sapiens
FFLYFKHTH

SEQ ID NO: 567864 - protein, 9 aa, Homo Sapiens
TSTREDLVG

SEQ ID NO: 567865 - protein, 9 aa, Homo Sapiens
LIEESTTYH

SEQ ID NO: 567866 - protein, 9 aa, Homo Sapiens
MEAGQRLAA

SEQ ID NO: 567867 - protein, 9 aa, Homo Sapiens
HHGNGQSYQ

SEQ ID NO: 567868 - protein, 9 aa, Homo Sapiens
DRRLAPCSR

SEQ ID NO: 567869 - protein, 9 aa, Homo Sapiens
ALALEPPLI

SEQ ID NO: 567870 - protein, 9 aa, Homo Sapiens
PVTLTETET

SEQ ID NO: 567871 - protein, 9 aa, Homo Sapiens
VARVHPHRK

SEQ ID NO: 567872 - protein, 9 aa, Homo Sapiens
TIGGFEGFQ

SEQ ID NO: 567873 - protein, 9 aa, Homo Sapiens
ELARMEAGQ

SEQ ID NO: 567874 - protein, 9 aa, Homo Sapiens
LPQPALPGT

SEQ ID NO: 567875 - protein, 9 aa, Homo Sapiens
WHTSVARVH

SEQ ID NO: 567876 - protein, 9 aa, Homo Sapiens
PSQGFLSRW

SEQ ID NO: 567877 - protein, 9 aa, Homo Sapiens
SFFFFLYFK

SEQ ID NO: 567878 - protein, 9 aa, Homo Sapiens
WQHTSLLSG

SEQ ID NO: 567879 - protein, 9 aa, Homo Sapiens
CLRSPQCQL

SEQ ID NO: 567880 - protein, 9 aa, Homo Sapiens
SPQCQLGGE

SEQ ID NO: 567881 - protein, 9 aa, Homo Sapiens
EFLVDRHGE

SEQ ID NO: 567882 - protein, 9 aa, Homo Sapiens
NHRDTATKI

SEQ ID NO: 567883 - protein, 9 aa, Homo Sapiens
PQCQLGGEL

SEQ ID NO: 567884 - protein, 9 aa, Homo Sapiens
FDGSRLVLP

SEQ ID NO: 567885 - protein, 9 aa, Homo Sapiens
LPPRLPAIA

SEQ ID NO: 567886 - protein, 9 aa, Homo Sapiens
DWLTTFQEN

SEQ ID NO: 567887 - protein, 9 aa, Homo Sapiens
VGFVDRRLA

SEQ ID NO: 567888 - protein, 9 aa, Homo Sapiens
ARALARNHR

SEQ ID NO: 567889 - protein, 9 aa, Homo Sapiens
THIFSHAHT

SEQ ID NO: 567890 - protein, 9 aa, Homo Sapiens
GELARMEAG

SEQ ID NO: 567891 - protein, 9 aa, Homo Sapiens
KHTHIFSHA

SEQ ID NO: 567892 - protein, 9 aa, Homo Sapiens
SVRQLIENA

SEQ ID NO: 567893 - protein, 9 aa, Homo Sapiens
IRRVFWLVV

SEQ ID NO: 567894 - protein, 9 aa, Homo Sapiens
PVRPSHQAC

SEQ ID NO: 567895 - protein, 9 aa, Homo Sapiens
GDCKAPHAM

SEQ ID NO: 567896 - protein, 9 aa, Homo Sapiens
LAAEYRHAS

SEQ ID NO: 567897 - protein, 9 aa, Homo Sapiens
HASFFFFLY

SEQ ID NO: 567898 - protein, 9 aa, Homo Sapiens
EHYFIEVNS

SEQ ID NO: 567899 - protein, 9 aa, Homo Sapiens
STIGGFEGF

SEQ ID NO: 567900 - protein, 9 aa, Homo Sapiens
IHLPQPALP

SEQ ID NO: 567901 - protein, 9 aa, Homo Sapiens
LAPCSRWHT

SEQ ID NO: 567902 - protein, 9 aa, Homo Sapiens
SPCLRSPQC

SEQ ID NO: 567903 - protein, 9 aa, Homo Sapiens
RKAYECNEC

SEQ ID NO: 567904 - protein, 9 aa, Homo Sapiens
CQLGGELAR

SEQ ID NO: 567905 - protein, 9 aa, Homo Sapiens
IFSHAHTPS

SEQ ID NO: 567906 - protein, 9 aa, Homo Sapiens
VDRHGEHYF

SEQ ID NO: 567907 - protein, 9 aa, Homo Sapiens
IAVGFVDRR

SEQ ID NO: 567908 - protein, 9 aa, Homo Sapiens
TSVARVHPH

SEQ ID NO: 567909 - protein, 9 aa, Homo Sapiens
ETNFPPEYE

SEQ ID NO: 567910 - protein, 9 aa, Homo Sapiens
PHPWQHTSL

SEQ ID NO: 567911 - protein, 9 aa, Homo Sapiens
GHSQDWLTT

SEQ ID NO: 567912 - protein, 9 aa, Homo Sapiens
PSSSPCLRS

SEQ ID NO: 567913 - protein, 9 aa, Homo Sapiens
KIRRVFWLV

SEQ ID NO: 567914 - protein, 9 aa, Homo Sapiens
GFVDRRLAP

SEQ ID NO: 567915 - protein, 9 aa, Homo Sapiens
GPVRPSHQA

SEQ ID NO: 567916 - protein, 9 aa, Homo Sapiens
TREDLVGGE

SEQ ID NO: 567917 - protein, 9 aa, Homo Sapiens
EQAFKGDCK

SEQ ID NO: 567918 - protein, 9 aa, Homo Sapiens
AFKGDCKAP

SEQ ID NO: 567919 - protein, 9 aa, Homo Sapiens
VQECHHGNG

SEQ ID NO: 567920 - protein, 9 aa, Homo Sapiens
RLAPCSRWH

SEQ ID NO: 567921 - protein, 9 aa, Homo Sapiens
ETETNFPPE

SEQ ID NO: 567922 - protein, 9 aa, Homo Sapiens
RNHRDTATK

SEQ ID NO: 567923 - protein, 9 aa, Homo Sapiens
DTEEVNSDD

SEQ ID NO: 567924 - protein, 9 aa, Homo Sapiens
ARVHPHRKL

SEQ ID NO: 567925 - protein, 9 aa, Homo Sapiens
RPGVQECHH

SEQ ID NO: 567926 - protein, 9 aa, Homo Sapiens
WLKSSIKRT

SEQ ID NO: 567927 - protein, 9 aa, Homo Sapiens
QRPGVQECH

SEQ ID NO: 567928 - protein, 9 aa, Homo Sapiens
SPKAVTMMP

SEQ ID NO: 567929 - protein, 9 aa, Homo Sapiens
NATLSVRQL

SEQ ID NO: 567930 - protein, 9 aa, Homo Sapiens
RSTTSGLIE

SEQ ID NO: 567931 - protein, 9 aa, Homo Sapiens
TNFPPEYEK

SEQ ID NO: 567932 - protein, 9 aa, Homo Sapiens
QAMGHSQDW

SEQ ID NO: 567933 - protein, 9 aa, Homo Sapiens
QFSSRSRSR

SEQ ID NO: 567934 - protein, 9 aa, Homo Sapiens
KKMTGLQCS

SEQ ID NO: 567935 - protein, 9 aa, Homo Sapiens
GGFEGFQAV

SEQ ID NO: 567936 - protein, 9 aa, Homo Sapiens
TETNFPPEY

SEQ ID NO: 567937 - protein, 9 aa, Homo Sapiens
GFEGFQAVS

SEQ ID NO: 567938 - protein, 9 aa, Homo Sapiens
RLVLPPVPA

SEQ ID NO: 567939 - protein, 9 aa, Homo Sapiens
IELPPDDIE

SEQ ID NO: 567940 - protein, 9 aa, Homo Sapiens
QGFLSRWLK

SEQ ID NO: 567941 - protein, 9 aa, Homo Sapiens
VHPHRKLPA

SEQ ID NO: 567942 - protein, 9 aa, Homo Sapiens
YNATLSVRQ

SEQ ID NO: 567943 - protein, 9 aa, Homo Sapiens
PRLPAIAVG

SEQ ID NO: 567944 - protein, 9 aa, Homo Sapiens
LDTEEVNSD

SEQ ID NO: 567945 - protein, 9 aa, Homo Sapiens
LGGELARME

SEQ ID NO: 567946 - protein, 9 aa, Homo Sapiens
QAFKGDCKA

SEQ ID NO: 567947 - protein, 9 aa, Homo Sapiens
GSRLVLPPV

SEQ ID NO: 567948 - protein, 9 aa, Homo Sapiens
VNSDDPVEA

SEQ ID NO: 567949 - protein, 9 aa, Homo Sapiens
SKIRRVFWL

SEQ ID NO: 567950 - protein, 9 aa, Homo Sapiens
ALPGTSANC

SEQ ID NO: 567951 - protein, 9 aa, Homo Sapiens
SPHPWQHTS

SEQ ID NO: 567952 - protein, 9 aa, Homo Sapiens
TGRKAYECN

SEQ ID NO: 567953 - protein, 9 aa, Homo Sapiens
TTSGLIEES

SEQ ID NO: 567954 - protein, 9 aa, Homo Sapiens
QECHHGNGQ

SEQ ID NO: 567955 - protein, 9 aa, Homo Sapiens
LARMEAGQR

SEQ ID NO: 567956 - protein, 9 aa, Homo Sapiens
YPDLMSRKI

SEQ ID NO: 567957 - protein, 9 aa, Homo Sapiens
FKGDCKAPH

SEQ ID NO: 567958 - protein, 9 aa, Homo Sapiens
GLAFIASPK

SEQ ID NO: 567959 - protein, 9 aa, Homo Sapiens
PFDGSRLVL

SEQ ID NO: 567960 - protein, 9 aa, Homo Sapiens
HTGRKAYEC

SEQ ID NO: 567961 - protein, 9 aa, Homo Sapiens
VLGNAGYKK

SEQ ID NO: 567962 - protein, 9 aa, Homo Sapiens
FSHAHTPSP

SEQ ID NO: 567963 - protein, 9 aa, Homo Sapiens
ATASTSTRE

SEQ ID NO: 567964 - protein, 9 aa, Homo Sapiens
IELLDTEEV

SEQ ID NO: 567965 - protein, 9 aa, Homo Sapiens
RVHPHRKLP

SEQ ID NO: 567966 - protein, 9 aa, Homo Sapiens
AFIASPKAV

SEQ ID NO: 567967 - protein, 9 aa, Homo Sapiens
KLPAPSSSP

SEQ ID NO: 567968 - protein, 9 aa, Homo Sapiens
STREDLVGG

SEQ ID NO: 567969 - protein, 9 aa, Homo Sapiens
GRKAYECNE

SEQ ID NO: 567970 - protein, 9 aa, Homo Sapiens
LEQAFKGDC

SEQ ID NO: 567971 - protein, 9 aa, Homo Sapiens
TSGLIEEST

SEQ ID NO: 567972 - protein, 9 aa, Homo Sapiens
TGPVRPSHQ

SEQ ID NO: 567973 - protein, 9 aa, Homo Sapiens
LSVRQLIEN

SEQ ID NO: 567974 - protein, 9 aa, Homo Sapiens
NAGYKKMTG

SEQ ID NO: 567975 - protein, 9 aa, Homo Sapiens
LVDRHGEHY

SEQ ID NO: 567976 - protein, 9 aa, Homo Sapiens
LPAPSSSPC

SEQ ID NO: 567977 - protein, 9 aa, Homo Sapiens
PSHQACLLL

SEQ ID NO: 567978 - protein, 9 aa, Homo Sapiens
SRWHTSVAR

SEQ ID NO: 567979 - protein, 9 aa, Homo Sapiens
TEEVNSDDP

SEQ ID NO: 567980 - protein, 9 aa, Homo Sapiens
FFFFLYFKH

SEQ ID NO: 567981 - protein, 9 aa, Homo Sapiens
CCRLPPRLP

SEQ ID NO: 567982 - protein, 9 aa, Homo Sapiens
ATLSVRQLI

SEQ ID NO: 567983 - protein, 9 aa, Homo Sapiens
PGLAFIASP

SEQ ID NO: 567984 - protein, 9 aa, Homo Sapiens
LPPVPASLV

SEQ ID NO: 567985 - protein, 9 aa, Homo Sapiens
GLIEESTTY

SEQ ID NO: 567986 - protein, 9 aa, Homo Sapiens
DRHGEHYFI

SEQ ID NO: 567987 - protein, 9 aa, Homo Sapiens
ARIHLPQPA

SEQ ID NO: 567988 - protein, 9 aa, Homo Sapiens
IHTGRKAYE

SEQ ID NO: 567989 - protein, 9 aa, Homo Sapiens
ITGPVRPSH

SEQ ID NO: 567990 - protein, 9 aa, Homo Sapiens
LEPPLIPKL

SEQ ID NO: 567991 - protein, 9 aa, Homo Sapiens
AGAPALALE

SEQ ID NO: 567992 - protein, 9 aa, Homo Sapiens
SRWLKSSIK

SEQ ID NO: 567993 - protein, 9 aa, Homo Sapiens
GVQECHHGN

SEQ ID NO: 567994 - protein, 9 aa, Homo Sapiens
HTSLLSGAD

SEQ ID NO: 567995 - protein, 9 aa, Homo Sapiens
WLTTFQENQ

SEQ ID NO: 567996 - protein, 9 aa, Homo Sapiens
VRQLIENAD

SEQ ID NO: 567997 - protein, 9 aa, Homo Sapiens
ICNPLHYPD

SEQ ID NO: 567998 - protein, 9 aa, Homo Sapiens
RLPAIAVGF

SEQ ID NO: 567999 - protein, 9 aa, Homo Sapiens
PHRKLPAPS

SEQ ID NO: 568000 - protein, 9 aa, Homo Sapiens
LHYPDLMSR

SEQ ID NO: 568001 - protein, 9 aa, Homo Sapiens
AYECNECGK

SEQ ID NO: 568002 - protein, 9 aa, Homo Sapiens
SHAHTPSPH

SEQ ID NO: 568003 - protein, 9 aa, Homo Sapiens
LSRWLKSSI

SEQ ID NO: 568004 - protein, 9 aa, Homo Sapiens
RSKIRRVFW

SEQ ID NO: 568005 - protein, 9 aa, Homo Sapiens
PALALEPPL

SEQ ID NO: 568006 - protein, 9 aa, Homo Sapiens
LPAIAVGFV

SEQ ID NO: 568007 - protein, 9 aa, Homo Sapiens
PLHYPDLMS

SEQ ID NO: 568008 - protein, 9 aa, Homo Sapiens
LIHTGRKAY

SEQ ID NO: 568009 - protein, 9 aa, Homo Sapiens
STTSGLIEE

SEQ ID NO: 568010 - protein, 9 aa, Homo Sapiens
TETETNFPP

SEQ ID NO: 568011 - protein, 9 aa, Homo Sapiens
QPALPGTSA

SEQ ID NO: 568012 - protein, 9 aa, Homo Sapiens
VDRRLAPCS

SEQ ID NO: 568013 - protein, 9 aa, Homo Sapiens
LPPDDIEVV

SEQ ID NO: 568014 - protein, 9 aa, Homo Sapiens
PQPALPGTS

SEQ ID NO: 568015 - protein, 9 aa, Homo Sapiens
ASPKAVTMM

SEQ ID NO: 568016 - protein, 9 aa, Homo Sapiens
VFWLVVVLG

SEQ ID NO: 568017 - protein, 9 aa, Homo Sapiens
PCLRSPQCQ

SEQ ID NO: 568018 - protein, 9 aa, Homo Sapiens
HPHRKLPAP

SEQ ID NO: 568019 - protein, 9 aa, Homo Sapiens
GQRLAAEYR

SEQ ID NO: 568020 - protein, 9 aa, Homo Sapiens
PGVQECHHG

SEQ ID NO: 568021 - protein, 9 aa, Homo Sapiens
HLPQPALPG

SEQ ID NO: 568022 - protein, 9 aa, Homo Sapiens
GPGLAFIAS

SEQ ID NO: 568023 - protein, 9 aa, Homo Sapiens
LLDTEEVNS

SEQ ID NO: 568024 - protein, 9 aa, Homo Sapiens
HPWQHTSLL

SEQ ID NO: 568025 - protein, 9 aa, Homo Sapiens
ANCCRLPPR

SEQ ID NO: 568026 - protein, 9 aa, Homo Sapiens
MGHSQDWLT

SEQ ID NO: 568027 - protein, 9 aa, Homo Sapiens
HTHIFSHAH

SEQ ID NO: 568028 - protein, 9 aa, Homo Sapiens
SVARVHPHR

SEQ ID NO: 568029 - protein, 9 aa, Homo Sapiens
PPRLPAIAV

SEQ ID NO: 568030 - protein, 9 aa, Homo Sapiens
EEVNSDDPV

SEQ ID NO: 568031 - protein, 9 aa, Homo Sapiens
GTSANCCRL

SEQ ID NO: 568032 - protein, 9 aa, Homo Sapiens
NCCRLPPRL

SEQ ID NO: 568033 - protein, 9 aa, Homo Sapiens
GPLRDLIEL

SEQ ID NO: 568034 - protein, 9 aa, Homo Sapiens
RLPPRLPAI

SEQ ID NO: 568035 - protein, 9 aa, Homo Sapiens
GFLSRWLKS

SEQ ID NO: 568036 - protein, 9 aa, Homo Sapiens
RSQFSSRSR

SEQ ID NO: 568037 - protein, 9 aa, Homo Sapiens
ALEPPLIPK

SEQ ID NO: 568038 - protein, 9 aa, Homo Sapiens
ASFFFFLYF

SEQ ID NO: 568039 - protein, 9 aa, Homo Sapiens
LGNAGYKKM

SEQ ID NO: 568040 - protein, 9 aa, Homo Sapiens
EVNSDDPVE

SEQ ID NO: 568041 - protein, 9 aa, Homo Sapiens
AAEYRHASF

SEQ ID NO: 568042 - protein, 9 aa, Homo Sapiens
RQLIENADE

SEQ ID NO: 568043 - protein, 9 aa, Homo Sapiens
LRSPQCQLG

SEQ ID NO: 568044 - protein, 9 aa, Homo Sapiens
RSPQCQLGG

SEQ ID NO: 568045 - protein, 9 aa, Homo Sapiens
EARALARNH

SEQ ID NO: 568046 - protein, 9 aa, Homo Sapiens
RIHLPQPAL

SEQ ID NO: 568047 - protein, 9 aa, Homo Sapiens
PLRDLIELP

SEQ ID NO: 568048 - protein, 9 aa, Homo Sapiens
SHQACLLLQ

SEQ ID NO: 568049 - protein, 9 aa, Homo Sapiens
NRSKIRRVF

SEQ ID NO: 568050 - protein, 9 aa, Homo Sapiens
VRPSHQACL

SEQ ID NO: 568051 - protein, 9 aa, Homo Sapiens
HSQDWLTTF

SEQ ID NO: 568052 - protein, 9 aa, Homo Sapiens
DLMSRKICW

SEQ ID NO: 568053 - protein, 9 aa, Homo Sapiens
PWQHTSLLS

SEQ ID NO: 568054 - protein, 9 aa, Homo Sapiens
YKKMTGLQC

SEQ ID NO: 568055 - protein, 9 aa, Homo Sapiens
RSKSRSQFS

SEQ ID NO: 568056 - protein, 9 aa, Homo Sapiens
RPSHQACLL

SEQ ID NO: 568057 - protein, 9 aa, Homo Sapiens
FLYFKHTHI

SEQ ID NO: 568058 - protein, 9 aa, Homo Sapiens
HYPDLMSRK

SEQ ID NO: 568059 - protein, 9 aa, Homo Sapiens
KMTGLQCSS

SEQ ID NO: 568060 - protein, 9 aa, Homo Sapiens
RDLIELPPD

SEQ ID NO: 568061 - protein, 9 aa, Homo Sapiens
AGQRLAAEY

SEQ ID NO: 568062 - protein, 9 aa, Homo Sapiens
FVDRRLAPC

SEQ ID NO: 568063 - protein, 9 aa, Homo Sapiens
RLAAEYRHA

SEQ ID NO: 568064 - protein, 9 aa, Homo Sapiens
ASTSTREDL

SEQ ID NO: 568065 - protein, 9 aa, Homo Sapiens
PAPSSSPCL

SEQ ID NO: 568066 - protein, 9 aa, Homo Sapiens
QCQLGGELA

SEQ ID NO: 568067 - protein, 9 aa, Homo Sapiens
SPSSVSTGD

SEQ ID NO: 568068 - protein, 9 aa, Homo Sapiens
PALPGTSAN

SEQ ID NO: 568069 - protein, 9 aa, Homo Sapiens
PDLMSRKIC

SEQ ID NO: 568070 - protein, 9 aa, Homo Sapiens
APCSRWHTS

SEQ ID NO: 568071 - protein, 9 aa, Homo Sapiens
FLVDRHGEH

SEQ ID NO: 568072 - protein, 9 aa, Homo Sapiens
MSTIGGFEG

SEQ ID NO: 568073 - protein, 9 aa, Homo Sapiens
VTLTETETN

SEQ ID NO: 568074 - protein, 9 aa, Homo Sapiens
YRHASFFFF

SEQ ID NO: 568075 - protein, 9 aa, Homo Sapiens
RWHTSVARV

SEQ ID NO: 568076 - protein, 9 aa, Homo Sapiens
AEYRHASFF

SEQ ID NO: 568077 - protein, 9 aa, Homo Sapiens
YFKHTHIFS

SEQ ID NO: 568078 - protein, 9 aa, Homo Sapiens
PGTSANCCR

SEQ ID NO: 568079 - protein, 9 aa, Homo Sapiens
IGGFEGFQA

SEQ ID NO: 568080 - protein, 9 aa, Homo Sapiens
AVGFVDRRL

SEQ ID NO: 568081 - protein, 9 aa, Homo Sapiens
TPSPHPWQH

SEQ ID NO: 568082 - protein, 9 aa, Homo Sapiens
TASTSTRED

SEQ ID NO: 568083 - protein, 9 aa, Homo Sapiens
ARSTTSGLI

SEQ ID NO: 568084 - protein, 9 aa, Homo Sapiens
APSSSPCLR

SEQ ID NO: 568085 - protein, 9 aa, Homo Sapiens
ELLDTEEVN

SEQ ID NO: 568086 - protein, 9 aa, Homo Sapiens
EYRHASFFF

SEQ ID NO: 568087 - protein, 9 aa, Homo Sapiens
QHTSLLSGA

SEQ ID NO: 568088 - protein, 9 aa, Homo Sapiens
LRDLIELPP

SEQ ID NO: 568089 - protein, 9 aa, Homo Sapiens
HTPSPHPWQ

SEQ ID NO: 568090 - protein, 9 aa, Homo Sapiens
LTETETNFP

SEQ ID NO: 568091 - protein, 9 aa, Homo Sapiens
PCSRWHTSV

SEQ ID NO: 568092 - protein, 9 aa, Homo Sapiens
LIELPPDDI

SEQ ID NO: 568093 - protein, 9 aa, Homo Sapiens
DLIELPPDD

SEQ ID NO: 568094 - protein, 9 aa, Homo Sapiens
HAHTPSPHP

SEQ ID NO: 568095 - protein, 9 aa, Homo Sapiens
CSRWHTSVA

SEQ ID NO: 568096 - protein, 9 aa, Homo Sapiens
SRSKSRSQF

SEQ ID NO: 568097 - protein, 9 aa, Homo Sapiens
FKHTHIFSH

SEQ ID NO: 568098 - protein, 9 aa, Homo Sapiens
DGSRLVLPP

SEQ ID NO: 568099 - protein, 9 aa, Homo Sapiens
LPGTSANCC

SEQ ID NO: 568100 - protein, 9 aa, Homo Sapiens
RWLKSSIKR

SEQ ID NO: 568101 - protein, 9 aa, Homo Sapiens
HITGPVRPS

SEQ ID NO: 568102 - protein, 9 aa, Homo Sapiens
LAFIASPKA

SEQ ID NO: 568103 - protein, 9 aa, Homo Sapiens
SQGFLSRWL

SEQ ID NO: 568104 - protein, 9 aa, Homo Sapiens
FLSRWLKSS

SEQ ID NO: 568105 - protein, 9 aa, Homo Sapiens
SRSQFSSRS

SEQ ID NO: 568106 - protein, 9 aa, Homo Sapiens
RRLAPCSRW

SEQ ID NO: 568107 - protein, 9 aa, Homo Sapiens
HRKLPAPSS

SEQ ID NO: 568108 - protein, 9 aa, Homo Sapiens
AHTPSPHPW

SEQ ID NO: 568109 - protein, 9 aa, Homo Sapiens
RHASFFFFL

SEQ ID NO: 568110 - protein, 9 aa, Homo Sapiens
SKSRSQFSS

SEQ ID NO: 568111 - protein, 9 aa, Homo Sapiens
GYKKMTGLQ

SEQ ID NO: 568112 - protein, 9 aa, Homo Sapiens
TLTETETNF

SEQ ID NO: 568113 - protein, 9 aa, Homo Sapiens
SANCCRLPP

SEQ ID NO: 568114 - protein, 9 aa, Homo Sapiens
FWLVVVLGS

SEQ ID NO: 568115 - protein, 9 aa, Homo Sapiens
EAGQRLAAE

SEQ ID NO: 568116 - protein, 9 aa, Homo Sapiens
HTSVARVHP

SEQ ID NO: 568117 - protein, 9 aa, Homo Sapiens
ELPPDDIEV

SEQ ID NO: 568118 - protein, 9 aa, Homo Sapiens
ARNHRDTAT

SEQ ID NO: 568119 - protein, 9 aa, Homo Sapiens
QLIHTGRKA

SEQ ID NO: 568120 - protein, 9 aa, Homo Sapiens
FFFLYFKHT

SEQ ID NO: 568121 - protein, 9 aa, Homo Sapiens
RRVFWLVVV

SEQ ID NO: 568122 - protein, 9 aa, Homo Sapiens
HIFSHAHTP

SEQ ID NO: 568123 - protein, 9 aa, Homo Sapiens
SQFSSRSRS

SEQ ID NO: 568124 - protein, 9 aa, Homo Sapiens
RHGEHYFIE

SEQ ID NO: 568125 - protein, 9 aa, Homo Sapiens
FSSRSRSRS

SEQ ID NO: 568126 - protein, 9 aa, Homo Sapiens
SQDWLTTFQ

SEQ ID NO: 568127 - protein, 9 aa, Homo Sapiens
GGELARMEA

SEQ ID NO: 568128 - protein, 9 aa, Homo Sapiens
STSTREDLV

SEQ ID NO: 568129 - protein, 9 aa, Homo Sapiens
LARNHRDTA

SEQ ID NO: 568130 - protein, 9 aa, Homo Sapiens
LALEPPLIP

SEQ ID NO: 568131 - protein, 9 aa, Homo Sapiens
RALARNHRD

SEQ ID NO: 568132 - protein, 9 aa, Homo Sapiens
GEHYFIEVN

SEQ ID NO: 568133 - protein, 9 aa, Homo Sapiens
DCKAPHAMI

SEQ ID NO: 568134 - protein, 9 aa, Homo Sapiens
HGEHYFIEV

SEQ ID NO: 568135 - protein, 9 aa, Homo Sapiens
ILEQAFKGD

SEQ ID NO: 568136 - protein, 9 aa, Homo Sapiens
QRLAAEYRH

SEQ ID NO: 568137 - protein, 9 aa, Homo Sapiens
QLGGELARM

SEQ ID NO: 568138 - protein, 9 aa, Homo Sapiens
SSSPCLRSP

SEQ ID NO: 568139 - protein, 9 aa, Homo Sapiens
SGLIEESTT

SEQ ID NO: 568140 - protein, 9 aa, Homo Sapiens
LAGAPALAL

SEQ ID NO: 568141 - protein, 9 aa, Homo Sapiens
KSRSQFSSR

SEQ ID NO: 568142 - protein, 9 aa, Homo Sapiens
RVFWLVVVL

SEQ ID NO: 568143 - protein, 9 aa, Homo Sapiens
PYNATLSVR

SEQ ID NO: 568144 - protein, 9 aa, Homo Sapiens
FIASPKAVT

SEQ ID NO: 568145 - protein, 9 aa, Homo Sapiens
IASPKAVTM

SEQ ID NO: 568146 - protein, 9 aa, Homo Sapiens
KAYECNECG

SEQ ID NO: 568147 - protein, 9 aa, Homo Sapiens
CRLPPRLPA

SEQ ID NO: 568148 - protein, 9 aa, Homo Sapiens
AMGHSQDWL

SEQ ID NO: 568149 - protein, 9 aa, Homo Sapiens
ALARNHRDT

SEQ ID NO: 568150 - protein, 9 aa, Homo Sapiens
GNAGYKKMT

SEQ ID NO: 568151 - protein, 9 aa, Homo Sapiens
LVLPPVPAS

SEQ ID NO: 568152 - protein, 9 aa, Homo Sapiens
PAIAVGFVD

SEQ ID NO: 568153 - protein, 9 aa, Homo Sapiens
AIAVGFVDR

SEQ ID NO: 568154 - protein, 9 aa, Homo Sapiens
NPLHYPDLM

SEQ ID NO: 568155 - protein, 9 aa, Homo Sapiens
TEARALARN

SEQ ID NO: 568156 - protein, 9 aa, Homo Sapiens
RKLPAPSSS

SEQ ID NO: 568157 - protein, 9 aa, Homo Sapiens
ARMEAGQRL

SEQ ID NO: 568158 - protein, 9 aa, Homo Sapiens
CNPLHYPDL

SEQ ID NO: 568159 - protein, 9 aa, Homo Sapiens
AVATASTST

SEQ ID NO: 568160 - protein, 9 aa, Homo Sapiens
KGDCKAPHA

SEQ ID NO: 568161 - protein, 9 aa, Homo Sapiens
QDWLTTFQE

SEQ ID NO: 568162 - protein, 9 aa, Homo Sapiens
PSPHPWQHT

SEQ ID NO: 568163 - protein, 9 aa, Homo Sapiens
VATASTSTR

SEQ ID NO: 568164 - protein, 9 aa, Homo Sapiens
TSANCCRLP

SEQ ID NO: 568165 - protein, 9 aa, Homo Sapiens
AGYKKMTGL

SEQ ID NO: 568166 - protein, 9 aa, Homo Sapiens
APALALEPP

SEQ ID NO: 568167 - protein, 9 aa, Homo Sapiens
SSPCLRSPQ

SEQ ID NO: 568168 - protein, 9 aa, Homo Sapiens
TLSVRQLIE

SEQ ID NO: 568169 - protein, 9 aa, Homo Sapiens
LYFKHTHIF

SEQ ID NO: 568170 - protein, 9 aa, Homo Sapiens
CHHGNGQSY

SEQ ID NO: 568171 - protein, 9 aa, Homo Sapiens
GAPALALEP

SEQ ID NO: 568172 - protein, 9 aa, Homo Sapiens
VLPPVPASL

SEQ ID NO: 568173 - protein, 9 aa, Homo Sapiens
ECHHGNGQS

SEQ ID NO: 568174 - protein, 9 aa, Homo Sapiens
IEESTTYHS

SEQ ID NO: 568175 - protein, 9 aa, Homo Sapiens
QKEVVKGPG

SEQ ID NO: 568176 - protein, 9 aa, Homo Sapiens
RMEAGQRLA

SEQ ID NO: 568177 - protein, 9 aa, Homo Sapiens
PWTLVNGTG

SEQ ID NO: 568178 - protein, 9 aa, Homo Sapiens
QQGRQLDMA

SEQ ID NO: 568179 - protein, 9 aa, Homo Sapiens
PCQDQYFVE

SEQ ID NO: 568180 - protein, 9 aa, Homo Sapiens
SFYALEKKH

SEQ ID NO: 568181 - protein, 9 aa, Homo Sapiens
REDLSYALE

SEQ ID NO: 568182 - protein, 9 aa, Homo Sapiens
FHLKVKGYP

SEQ ID NO: 568183 - protein, 9 aa, Homo Sapiens
QIMVGLMYI

SEQ ID NO: 568184 - protein, 9 aa, Homo Sapiens
RQLDMAEEE

SEQ ID NO: 568185 - protein, 9 aa, Homo Sapiens
CREDLSYAL

SEQ ID NO: 568186 - protein, 9 aa, Homo Sapiens
DSMVRGMEA

SEQ ID NO: 568187 - protein, 9 aa, Homo Sapiens
EEPTSYYSS

SEQ ID NO: 568188 - protein, 9 aa, Homo Sapiens
KVHGKIGLI

SEQ ID NO: 568189 - protein, 9 aa, Homo Sapiens
GYNLANTAG

SEQ ID NO: 568190 - protein, 9 aa, Homo Sapiens
QSLRIKQQE

SEQ ID NO: 568191 - protein, 9 aa, Homo Sapiens
DLSYALEAF

SEQ ID NO: 568192 - protein, 9 aa, Homo Sapiens
IKHIVWPSL

SEQ ID NO: 568193 - protein, 9 aa, Homo Sapiens
FLRGVEKKV

SEQ ID NO: 568194 - protein, 9 aa, Homo Sapiens
WTLVNGTGK

SEQ ID NO: 568195 - protein, 9 aa, Homo Sapiens
RIIVRNAVG

SEQ ID NO: 568196 - protein, 9 aa, Homo Sapiens
KKRIKHIVW

SEQ ID NO: 568197 - protein, 9 aa, Homo Sapiens
YYSSPGSTA

SEQ ID NO: 568198 - protein, 9 aa, Homo Sapiens
EAEFQQMLK

SEQ ID NO: 568199 - protein, 9 aa, Homo Sapiens
EFQQMLKQL

SEQ ID NO: 568200 - protein, 9 aa, Homo Sapiens
RYEFRIIVR

SEQ ID NO: 568201 - protein, 9 aa, Homo Sapiens
QSVLERDNR

SEQ ID NO: 568202 - protein, 9 aa, Homo Sapiens
YPWTLVNGT

SEQ ID NO: 568203 - protein, 9 aa, Homo Sapiens
VRNAVGTIS

SEQ ID NO: 568204 - protein, 9 aa, Homo Sapiens
HEEEKNVLS

SEQ ID NO: 568205 - protein, 9 aa, Homo Sapiens
GDYVSHGGP

SEQ ID NO: 568206 - protein, 9 aa, Homo Sapiens
EMQGQNKYF

SEQ ID NO: 568207 - protein, 9 aa, Homo Sapiens
KQSVLERDN

SEQ ID NO: 568208 - protein, 9 aa, Homo Sapiens
RDPSHRHQS

SEQ ID NO: 568209 - protein, 9 aa, Homo Sapiens
LVNGTGKHG

SEQ ID NO: 568210 - protein, 9 aa, Homo Sapiens
IQSQTGEMQ

SEQ ID NO: 568211 - protein, 9 aa, Homo Sapiens
IVRNAVGTI

SEQ ID NO: 568212 - protein, 9 aa, Homo Sapiens
FRIIVRNAV

SEQ ID NO: 568213 - protein, 9 aa, Homo Sapiens
MVGLMYIGF

SEQ ID NO: 568214 - protein, 9 aa, Homo Sapiens
NTAGCWTYL

SEQ ID NO: 568215 - protein, 9 aa, Homo Sapiens
AKPVATKIA

SEQ ID NO: 568216 - protein, 9 aa, Homo Sapiens
QSQTGEMQG

SEQ ID NO: 568217 - protein, 9 aa, Homo Sapiens
AEEEPDGTL

SEQ ID NO: 568218 - protein, 9 aa, Homo Sapiens
EVMDSMVRG

SEQ ID NO: 568219 - protein, 9 aa, Homo Sapiens
KQQEVCKLQ

SEQ ID NO: 568220 - protein, 9 aa, Homo Sapiens
SLEVMDSMV

SEQ ID NO: 568221 - protein, 9 aa, Homo Sapiens
YEFRIIVRN

SEQ ID NO: 568222 - protein, 9 aa, Homo Sapiens
LYKERQYEA

SEQ ID NO: 568223 - protein, 9 aa, Homo Sapiens
RAKVHGKIG

SEQ ID NO: 568224 - protein, 9 aa, Homo Sapiens
MPGDYVSHG

SEQ ID NO: 568225 - protein, 9 aa, Homo Sapiens
ANKQSVLER

SEQ ID NO: 568226 - protein, 9 aa, Homo Sapiens
SHRHQSHEE

SEQ ID NO: 568227 - protein, 9 aa, Homo Sapiens
SYYSSPGST

SEQ ID NO: 568228 - protein, 9 aa, Homo Sapiens
LPLLPHRVC

SEQ ID NO: 568229 - protein, 9 aa, Homo Sapiens
TSYYSSPGS

SEQ ID NO: 568230 - protein, 9 aa, Homo Sapiens
DQYFVEGQS

SEQ ID NO: 568231 - protein, 9 aa, Homo Sapiens
MVQLIHYMH

SEQ ID NO: 568232 - protein, 9 aa, Homo Sapiens
RGVEKKVMV

SEQ ID NO: 568233 - protein, 9 aa, Homo Sapiens
EILHQILLY

SEQ ID NO: 568234 - protein, 9 aa, Homo Sapiens
GEDRLFRIL

SEQ ID NO: 568235 - protein, 9 aa, Homo Sapiens
EEEKNVLSL

SEQ ID NO: 568236 - protein, 9 aa, Homo Sapiens
FRILDSLQH

SEQ ID NO: 568237 - protein, 9 aa, Homo Sapiens
LKQLKKQQE

SEQ ID NO: 568238 - protein, 9 aa, Homo Sapiens
GQSLRIKQQ

SEQ ID NO: 568239 - protein, 9 aa, Homo Sapiens
KERQYEAAC

SEQ ID NO: 568240 - protein, 9 aa, Homo Sapiens
VGLMYIGFG

SEQ ID NO: 568241 - protein, 9 aa, Homo Sapiens
PGEDRLFRI

SEQ ID NO: 568242 - protein, 9 aa, Homo Sapiens
LAKFHLKVK

SEQ ID NO: 568243 - protein, 9 aa, Homo Sapiens
ANAMKISAS

SEQ ID NO: 568244 - protein, 9 aa, Homo Sapiens
QILLYETLK

SEQ ID NO: 568245 - protein, 9 aa, Homo Sapiens
QSHEEDDND

SEQ ID NO: 568246 - protein, 9 aa, Homo Sapiens
KHIVWPSLP

SEQ ID NO: 568247 - protein, 9 aa, Homo Sapiens
PGDYVSHGG

SEQ ID NO: 568248 - protein, 9 aa, Homo Sapiens
EKNVLSLLA

SEQ ID NO: 568249 - protein, 9 aa, Homo Sapiens
FYALEKKHV

SEQ ID NO: 568250 - protein, 9 aa, Homo Sapiens
LRIKQQEVC

SEQ ID NO: 568251 - protein, 9 aa, Homo Sapiens
VHGKIGLIE

SEQ ID NO: 568252 - protein, 9 aa, Homo Sapiens
LDMAEEEPD

SEQ ID NO: 568253 - protein, 9 aa, Homo Sapiens
NGTGKHGTS

SEQ ID NO: 568254 - protein, 9 aa, Homo Sapiens
HGGPMGMSM

SEQ ID NO: 568255 - protein, 9 aa, Homo Sapiens
DHEEEKNVL

SEQ ID NO: 568256 - protein, 9 aa, Homo Sapiens
VLWKKRIKH

SEQ ID NO: 568257 - protein, 9 aa, Homo Sapiens
TRLAKFHLK

SEQ ID NO: 568258 - protein, 9 aa, Homo Sapiens
TKIATVRPP

SEQ ID NO: 568259 - protein, 9 aa, Homo Sapiens
FQQMLKQLK

SEQ ID NO: 568260 - protein, 9 aa, Homo Sapiens
HGKIGLIEE

SEQ ID NO: 568261 - protein, 9 aa, Homo Sapiens
DMAEEEPDG

SEQ ID NO: 568262 - protein, 9 aa, Homo Sapiens
KFHLKVKGY

SEQ ID NO: 568263 - protein, 9 aa, Homo Sapiens
KVRKKEVPA

SEQ ID NO: 568264 - protein, 9 aa, Homo Sapiens
HLKVKGYPA

SEQ ID NO: 568265 - protein, 9 aa, Homo Sapiens
KFLRGVEKK

SEQ ID NO: 568266 - protein, 9 aa, Homo Sapiens
AMKISASLM

SEQ ID NO: 568267 - protein, 9 aa, Homo Sapiens
GTRLAKFHL

SEQ ID NO: 568268 - protein, 9 aa, Homo Sapiens
RILDSLQHS

SEQ ID NO: 568269 - protein, 9 aa, Homo Sapiens
GCWTYLTGV

SEQ ID NO: 568270 - protein, 9 aa, Homo Sapiens
SQTGEMQGQ

SEQ ID NO: 568271 - protein, 9 aa, Homo Sapiens
NFRAKVHGK

SEQ ID NO: 568272 - protein, 9 aa, Homo Sapiens
ATKIATVRP

SEQ ID NO: 568273 - protein, 9 aa, Homo Sapiens
VFTKFQLLS

SEQ ID NO: 568274 - protein, 9 aa, Homo Sapiens
HIVWPSLPD

SEQ ID NO: 568275 - protein, 9 aa, Homo Sapiens
QGRQLDMAE

SEQ ID NO: 568276 - protein, 9 aa, Homo Sapiens
TTHKRIHIG

SEQ ID NO: 568277 - protein, 9 aa, Homo Sapiens
CQDQYFVEG

SEQ ID NO: 568278 - protein, 9 aa, Homo Sapiens
PGTRLAKFH

SEQ ID NO: 568279 - protein, 9 aa, Homo Sapiens
VSHGGPMGM

SEQ ID NO: 568280 - protein, 9 aa, Homo Sapiens
LKEKDELFS

SEQ ID NO: 568281 - protein, 9 aa, Homo Sapiens
AGCWTYLTG

SEQ ID NO: 568282 - protein, 9 aa, Homo Sapiens
GRQLDMAEE

SEQ ID NO: 568283 - protein, 9 aa, Homo Sapiens
RHQSHEEDD

SEQ ID NO: 568284 - protein, 9 aa, Homo Sapiens
TGEMQGQNK

SEQ ID NO: 568285 - protein, 9 aa, Homo Sapiens
PLLPHRVCK

SEQ ID NO: 568286 - protein, 9 aa, Homo Sapiens
VYNFRAKVH

SEQ ID NO: 568287 - protein, 9 aa, Homo Sapiens
NLANTAGCW

SEQ ID NO: 568288 - protein, 9 aa, Homo Sapiens
TKFQLLSYF

SEQ ID NO: 568289 - protein, 9 aa, Homo Sapiens
ILLYETLKV

SEQ ID NO: 568290 - protein, 9 aa, Homo Sapiens
YVSHGGPMG

SEQ ID NO: 568291 - protein, 9 aa, Homo Sapiens
FTKFQLLSY

SEQ ID NO: 568292 - protein, 9 aa, Homo Sapiens
LTTHKRIHI

SEQ ID NO: 568293 - protein, 9 aa, Homo Sapiens
MQGQNKYFQ

SEQ ID NO: 568294 - protein, 9 aa, Homo Sapiens
SLRIKQQEV

SEQ ID NO: 568295 - protein, 9 aa, Homo Sapiens
SSFYALEKK

SEQ ID NO: 568296 - protein, 9 aa, Homo Sapiens
YALEAFFLL

SEQ ID NO: 568297 - protein, 9 aa, Homo Sapiens
LLYKERQYE

SEQ ID NO: 568298 - protein, 9 aa, Homo Sapiens
TLVNGTGKH

SEQ ID NO: 568299 - protein, 9 aa, Homo Sapiens
ETVFTKFQL

SEQ ID NO: 568300 - protein, 9 aa, Homo Sapiens
PTSYYSSPG

SEQ ID NO: 568301 - protein, 9 aa, Homo Sapiens
LVEEPTSYY

SEQ ID NO: 568302 - protein, 9 aa, Homo Sapiens
QAMVQLIHY

SEQ ID NO: 568303 - protein, 9 aa, Homo Sapiens
PGSLPLLPH

SEQ ID NO: 568304 - protein, 9 aa, Homo Sapiens
THKRIHIGE

SEQ ID NO: 568305 - protein, 9 aa, Homo Sapiens
KNVLSLLAK

SEQ ID NO: 568306 - protein, 9 aa, Homo Sapiens
DRYEFRIIV

SEQ ID NO: 568307 - protein, 9 aa, Homo Sapiens
RQYEAACSK

SEQ ID NO: 568308 - protein, 9 aa, Homo Sapiens
EVANAMKIS

SEQ ID NO: 568309 - protein, 9 aa, Homo Sapiens
MDSMVRGME

SEQ ID NO: 568310 - protein, 9 aa, Homo Sapiens
VRKKEVPAE

SEQ ID NO: 568311 - protein, 9 aa, Homo Sapiens
ERQYEAACS

SEQ ID NO: 568312 - protein, 9 aa, Homo Sapiens
VANAMKISA

SEQ ID NO: 568313 - protein, 9 aa, Homo Sapiens
AKVHGKIGL

SEQ ID NO: 568314 - protein, 9 aa, Homo Sapiens
KGCREDLSY

SEQ ID NO: 568315 - protein, 9 aa, Homo Sapiens
MLKQLKKQQ

SEQ ID NO: 568316 - protein, 9 aa, Homo Sapiens
IGEKSYKCE

SEQ ID NO: 568317 - protein, 9 aa, Homo Sapiens
EVPAEGAAD

SEQ ID NO: 568318 - protein, 9 aa, Homo Sapiens
EDLSYALEA

SEQ ID NO: 568319 - protein, 9 aa, Homo Sapiens
VLSLLAKDP

SEQ ID NO: 568320 - protein, 9 aa, Homo Sapiens
IMVGLMYIG

SEQ ID NO: 568321 - protein, 9 aa, Homo Sapiens
WKKRIKHIV

SEQ ID NO: 568322 - protein, 9 aa, Homo Sapiens
RIKQQEVCK

SEQ ID NO: 568323 - protein, 9 aa, Homo Sapiens
LLYETLKVI

SEQ ID NO: 568324 - protein, 9 aa, Homo Sapiens
QTGEMQGQN

SEQ ID NO: 568325 - protein, 9 aa, Homo Sapiens
VGQSLRIKQ

SEQ ID NO: 568326 - protein, 9 aa, Homo Sapiens
LGCLLYKER

SEQ ID NO: 568327 - protein, 9 aa, Homo Sapiens
LFRILDSLQ

SEQ ID NO: 568328 - protein, 9 aa, Homo Sapiens
EKKVMVVSC

SEQ ID NO: 568329 - protein, 9 aa, Homo Sapiens
KEVANAMKI

SEQ ID NO: 568330 - protein, 9 aa, Homo Sapiens
HRHQSHEED

SEQ ID NO: 568331 - protein, 9 aa, Homo Sapiens
KIATVRPPV

SEQ ID NO: 568332 - protein, 9 aa, Homo Sapiens
GVEKKVMVV

SEQ ID NO: 568333 - protein, 9 aa, Homo Sapiens
VATKIATVR

SEQ ID NO: 568334 - protein, 9 aa, Homo Sapiens
TLETVFTKF

SEQ ID NO: 568335 - protein, 9 aa, Homo Sapiens
EGQSYNCPY

SEQ ID NO: 568336 - protein, 9 aa, Homo Sapiens
GEMQGQNKY

SEQ ID NO: 568337 - protein, 9 aa, Homo Sapiens
IKQQEVCKL

SEQ ID NO: 568338 - protein, 9 aa, Homo Sapiens
FVEGQSYNC

SEQ ID NO: 568339 - protein, 9 aa, Homo Sapiens
LRGVEKKVM

SEQ ID NO: 568340 - protein, 9 aa, Homo Sapiens
DPSHRHQSH

SEQ ID NO: 568341 - protein, 9 aa, Homo Sapiens
NKQSVLERD

SEQ ID NO: 568342 - protein, 9 aa, Homo Sapiens
LPHRVCKIL

SEQ ID NO: 568343 - protein, 9 aa, Homo Sapiens
EFRIIVRNA

SEQ ID NO: 568344 - protein, 9 aa, Homo Sapiens
AAKPVATKI

SEQ ID NO: 568345 - protein, 9 aa, Homo Sapiens
LHQILLYET

SEQ ID NO: 568346 - protein, 9 aa, Homo Sapiens
LMYIGFGIV

SEQ ID NO: 568347 - protein, 9 aa, Homo Sapiens
KKEVPAEGA

SEQ ID NO: 568348 - protein, 9 aa, Homo Sapiens
QYFVEGQSY

SEQ ID NO: 568349 - protein, 9 aa, Homo Sapiens
KEVPAEGAA

SEQ ID NO: 568350 - protein, 9 aa, Homo Sapiens
KDELFSQLQ

SEQ ID NO: 568351 - protein, 9 aa, Homo Sapiens
RKKEVPAEG

SEQ ID NO: 568352 - protein, 9 aa, Homo Sapiens
PHRVCKILR

SEQ ID NO: 568353 - protein, 9 aa, Homo Sapiens
RHSLEVMDS

SEQ ID NO: 568354 - protein, 9 aa, Homo Sapiens
KKVMVVSCV

SEQ ID NO: 568355 - protein, 9 aa, Homo Sapiens
DRLFRILDS

SEQ ID NO: 568356 - protein, 9 aa, Homo Sapiens
ILHQILLYE

SEQ ID NO: 568357 - protein, 9 aa, Homo Sapiens
LLPHRVCKI

SEQ ID NO: 568358 - protein, 9 aa, Homo Sapiens
DYVSHGGPM

SEQ ID NO: 568359 - protein, 9 aa, Homo Sapiens
GYPWTLVNG

SEQ ID NO: 568360 - protein, 9 aa, Homo Sapiens
LKVRKKEVP

SEQ ID NO: 568361 - protein, 9 aa, Homo Sapiens
YIQSQTGEM

SEQ ID NO: 568362 - protein, 9 aa, Homo Sapiens
YKERQYEAA

SEQ ID NO: 568363 - protein, 9 aa, Homo Sapiens
NAMKISASL

SEQ ID NO: 568364 - protein, 9 aa, Homo Sapiens
FKEVANAMK

SEQ ID NO: 568365 - protein, 9 aa, Homo Sapiens
MAEEEPDGT

SEQ ID NO: 568366 - protein, 9 aa, Homo Sapiens
KRHSLEVMD

SEQ ID NO: 568367 - protein, 9 aa, Homo Sapiens
QLKEKDELF

SEQ ID NO: 568368 - protein, 9 aa, Homo Sapiens
KEKDELFSQ

SEQ ID NO: 568369 - protein, 9 aa, Homo Sapiens
DKANKQSVL

SEQ ID NO: 568370 - protein, 9 aa, Homo Sapiens
LEKKHVGFS

SEQ ID NO: 568371 - protein, 9 aa, Homo Sapiens
EKKHVGFSL

SEQ ID NO: 568372 - protein, 9 aa, Homo Sapiens
QLDMAEEEP

SEQ ID NO: 568373 - protein, 9 aa, Homo Sapiens
RLAKFHLKV

SEQ ID NO: 568374 - protein, 8 aa, Homo Sapiens
KISMINYK

SEQ ID NO: 568375 - protein, 9 aa, Homo Sapiens
GCLLYKERQ

SEQ ID NO: 568376 - protein, 9 aa, Homo Sapiens
LIHYMHTYC

SEQ ID NO: 568377 - protein, 9 aa, Homo Sapiens
TAGCWTYLT

SEQ ID NO: 568378 - protein, 9 aa, Homo Sapiens
SLPLLPHRV

SEQ ID NO: 568379 - protein, 9 aa, Homo Sapiens
KPVATKIAT

SEQ ID NO: 568380 - protein, 9 aa, Homo Sapiens
QQEVCKLQE

SEQ ID NO: 568381 - protein, 9 aa, Homo Sapiens
EDRLFRILD

SEQ ID NO: 568382 - protein, 9 aa, Homo Sapiens
LWKKRIKHI

SEQ ID NO: 568383 - protein, 9 aa, Homo Sapiens
SYALEAFFL

SEQ ID NO: 568384 - protein, 9 aa, Homo Sapiens
KFQLLSYFD

SEQ ID NO: 568385 - protein, 9 aa, Homo Sapiens
FQLLSYFDQ

SEQ ID NO: 568386 - protein, 9 aa, Homo Sapiens
ALEKKHVGF

SEQ ID NO: 568387 - protein, 9 aa, Homo Sapiens
TVFTKFQLL

SEQ ID NO: 568388 - protein, 9 aa, Homo Sapiens
VEKKVMVVS

SEQ ID NO: 568389 - protein, 9 aa, Homo Sapiens
HYMHTYCLP

SEQ ID NO: 568390 - protein, 9 aa, Homo Sapiens
QMLKQLKKQ

SEQ ID NO: 568391 - protein, 9 aa, Homo Sapiens
TFKEVANAM

SEQ ID NO: 568392 - protein, 9 aa, Homo Sapiens
MQAMVQLIH

SEQ ID NO: 568393 - protein, 9 aa, Homo Sapiens
VMDSMVRGM

SEQ ID NO: 568394 - protein, 9 aa, Homo Sapiens
VEGQSYNCP

SEQ ID NO: 568395 - protein, 9 aa, Homo Sapiens
IQIMVGLMY

SEQ ID NO: 568396 - protein, 9 aa, Homo Sapiens
AKFHLKVKG

SEQ ID NO: 568397 - protein, 9 aa, Homo Sapiens
LSLLAKDPW

SEQ ID NO: 568398 - protein, 9 aa, Homo Sapiens
TDKANKQSV

SEQ ID NO: 568399 - protein, 9 aa, Homo Sapiens
LSYALEAFF

SEQ ID NO: 568400 - protein, 9 aa, Homo Sapiens
IHIGEKSYK

SEQ ID NO: 568401 - protein, 9 aa, Homo Sapiens
AEFQQMLKQ

SEQ ID NO: 568402 - protein, 9 aa, Homo Sapiens
YNLANTAGC

SEQ ID NO: 568403 - protein, 9 aa, Homo Sapiens
CLLYKERQY

SEQ ID NO: 568404 - protein, 9 aa, Homo Sapiens
GLMYIGFGI

SEQ ID NO: 568405 - protein, 9 aa, Homo Sapiens
YIGFGIVLC

SEQ ID NO: 568406 - protein, 9 aa, Homo Sapiens
SHGGPMGMS

SEQ ID NO: 568407 - protein, 9 aa, Homo Sapiens
KKHVGFSLD

SEQ ID NO: 568408 - protein, 9 aa, Homo Sapiens
MKISASLMG

SEQ ID NO: 568409 - protein, 9 aa, Homo Sapiens
DELFSQLQE

SEQ ID NO: 568410 - protein, 9 aa, Homo Sapiens
ILDSLQHSP

SEQ ID NO: 568411 - protein, 9 aa, Homo Sapiens
YETLKVIKE

SEQ ID NO: 568412 - protein, 9 aa, Homo Sapiens
HQILLYETL

SEQ ID NO: 568413 - protein, 9 aa, Homo Sapiens
YNFRAKVHG

SEQ ID NO: 568414 - protein, 9 aa, Homo Sapiens
LETVFTKFQ

SEQ ID NO: 568415 - protein, 9 aa, Homo Sapiens
HRDPSHRHQ

SEQ ID NO: 568416 - protein, 9 aa, Homo Sapiens
HQSHEEDDN

SEQ ID NO: 568417 - protein, 9 aa, Homo Sapiens
FRAKVHGKI

SEQ ID NO: 568418 - protein, 9 aa, Homo Sapiens
ELFSQLQEE

SEQ ID NO: 568419 - protein, 9 aa, Homo Sapiens
PSHRHQSHE

SEQ ID NO: 568420 - protein, 9 aa, Homo Sapiens
EKDELFSQL

SEQ ID NO: 568421 - protein, 9 aa, Homo Sapiens
QDQYFVEGQ

SEQ ID NO: 568422 - protein, 9 aa, Homo Sapiens
YFVEGQSYN

SEQ ID NO: 568423 - protein, 9 aa, Homo Sapiens
EEKNVLSLL

SEQ ID NO: 568424 - protein, 9 aa, Homo Sapiens
LFSQLQEEL

SEQ ID NO: 568425 - protein, 9 aa, Homo Sapiens
QLIHYMHTY

SEQ ID NO: 568426 - protein, 9 aa, Homo Sapiens
HIGEKSYKC

SEQ ID NO: 568427 - protein, 9 aa, Homo Sapiens
KRIKHIVWP

SEQ ID NO: 568428 - protein, 9 aa, Homo Sapiens
GSLPLLPHR

SEQ ID NO: 568429 - protein, 9 aa, Homo Sapiens
QQMLKQLKK

SEQ ID NO: 568430 - protein, 9 aa, Homo Sapiens
RLFRILDSL

SEQ ID NO: 568431 - protein, 9 aa, Homo Sapiens
IATVRPPVA

SEQ ID NO: 568432 - protein, 9 aa, Homo Sapiens
AMVQLIHYM

SEQ ID NO: 568433 - protein, 9 aa, Homo Sapiens
YSSPGSTAT

SEQ ID NO: 568434 - protein, 9 aa, Homo Sapiens
LYETLKVIK

SEQ ID NO: 568435 - protein, 9 aa, Homo Sapiens
EPTSYYSSP

SEQ ID NO: 568436 - protein, 9 aa, Homo Sapiens
KANKQSVLE

SEQ ID NO: 568437 - protein, 9 aa, Homo Sapiens
ANTAGCWTY

SEQ ID NO: 568438 - protein, 9 aa, Homo Sapiens
HSLEVMDSM

SEQ ID NO: 568439 - protein, 9 aa, Homo Sapiens
YALEKKHVG

SEQ ID NO: 568440 - protein, 9 aa, Homo Sapiens
GSSFYALEK

SEQ ID NO: 568441 - protein, 9 aa, Homo Sapiens
IGYPWTLVN

SEQ ID NO: 568442 - protein, 9 aa, Homo Sapiens
HRVCKILRR

SEQ ID NO: 568443 - protein, 9 aa, Homo Sapiens
IHYMHTYCL

SEQ ID NO: 568444 - protein, 9 aa, Homo Sapiens
SMPGDYVSH

SEQ ID NO: 568445 - protein, 9 aa, Homo Sapiens
NVLSLLAKD

SEQ ID NO: 568446 - protein, 9 aa, Homo Sapiens
MYIGFGIVL

SEQ ID NO: 568447 - protein, 9 aa, Homo Sapiens
LEVMDSMVR

SEQ ID NO: 568448 - protein, 9 aa, Homo Sapiens
KVMVVSCVY

SEQ ID NO: 568449 - protein, 9 aa, Homo Sapiens
PVATKIATV

SEQ ID NO: 568450 - protein, 9 aa, Homo Sapiens
LANTAGCWT

SEQ ID NO: 568451 - protein, 9 aa, Homo Sapiens
FSQLQEELG

SEQ ID NO: 568452 - protein, 9 aa, Homo Sapiens
VEEPTSYYS

SEQ ID NO: 568453 - protein, 9 aa, Homo Sapiens
RLKVRKKEV

SEQ ID NO: 568454 - protein, 9 aa, Homo Sapiens
RIKHIVWPS

SEQ ID NO: 568455 - protein, 9 aa, Homo Sapiens
GCREDLSYA

SEQ ID NO: 568456 - protein, 9 aa, Homo Sapiens
VNGTGKHGT

SEQ ID NO: 568457 - protein, 9 aa, Homo Sapiens
KQLKKQQEE

SEQ ID NO: 568458 - protein, 9 aa, Homo Sapiens
VPAEGAADL

SEQ ID NO: 568459 - protein, 9 aa, Homo Sapiens
IIVRNAVGT

SEQ ID NO: 568460 - protein, 9 aa, Homo Sapiens
VQLIHYMHT

SEQ ID NO: 568461 - protein, 9 aa, Homo Sapiens
AARRPSSRR

SEQ ID NO: 568462 - protein, 9 aa, Homo Sapiens
FPRLPGVLC

SEQ ID NO: 568463 - protein, 9 aa, Homo Sapiens
RRSSPRPET

SEQ ID NO: 568464 - protein, 9 aa, Homo Sapiens
TAVAAALAR

SEQ ID NO: 568465 - protein, 9 aa, Homo Sapiens
GTELSRMGV

SEQ ID NO: 568466 - protein, 9 aa, Homo Sapiens
IPTSVLLRG

SEQ ID NO: 568467 - protein, 9 aa, Homo Sapiens
LFMYNSFGC

SEQ ID NO: 568468 - protein, 9 aa, Homo Sapiens
FPRFTWELH

SEQ ID NO: 568469 - protein, 9 aa, Homo Sapiens
ASRPTWASG

SEQ ID NO: 568470 - protein, 9 aa, Homo Sapiens
EITALVSRV

SEQ ID NO: 568471 - protein, 9 aa, Homo Sapiens
TTTVELPLS

SEQ ID NO: 568472 - protein, 9 aa, Homo Sapiens
WEFLASHFP

SEQ ID NO: 568473 - protein, 9 aa, Homo Sapiens
LSDSEDSSS

SEQ ID NO: 568474 - protein, 9 aa, Homo Sapiens
DVIFLAEMI

SEQ ID NO: 568475 - protein, 9 aa, Homo Sapiens
ALSLGFGGV

SEQ ID NO: 568476 - protein, 9 aa, Homo Sapiens
QLSELKDPM

SEQ ID NO: 568477 - protein, 9 aa, Homo Sapiens
ILKSAELVC

SEQ ID NO: 568478 - protein, 9 aa, Homo Sapiens
IDACEKGTV

SEQ ID NO: 568479 - protein, 9 aa, Homo Sapiens
QLSFLGCCL

SEQ ID NO: 568480 - protein, 9 aa, Homo Sapiens
RGVSAWLRP

SEQ ID NO: 568481 - protein, 9 aa, Homo Sapiens
QQGSLFSWT

SEQ ID NO: 568482 - protein, 9 aa, Homo Sapiens
IPHPIDACE

SEQ ID NO: 568483 - protein, 9 aa, Homo Sapiens
THRREACLH

SEQ ID NO: 568484 - protein, 9 aa, Homo Sapiens
PHQERRQMG

SEQ ID NO: 568485 - protein, 9 aa, Homo Sapiens
SSSEEEEED

SEQ ID NO: 568486 - protein, 9 aa, Homo Sapiens
QSYIKNLGN

SEQ ID NO: 568487 - protein, 9 aa, Homo Sapiens
SIGLVFSIV

SEQ ID NO: 568488 - protein, 9 aa, Homo Sapiens
SYVAWGELD

SEQ ID NO: 568489 - protein, 9 aa, Homo Sapiens
CSTLGVFGI

SEQ ID NO: 568490 - protein, 9 aa, Homo Sapiens
SRPTWASGS

SEQ ID NO: 568491 - protein, 9 aa, Homo Sapiens
PSGIRGASA

SEQ ID NO: 568492 - protein, 9 aa, Homo Sapiens
AVSEQGNNI

SEQ ID NO: 568493 - protein, 9 aa, Homo Sapiens
YYSLGMTGI

SEQ ID NO: 568494 - protein, 9 aa, Homo Sapiens
ELTPQLLKI

SEQ ID NO: 568495 - protein, 9 aa, Homo Sapiens
TPHLQGKPG

SEQ ID NO: 568496 - protein, 9 aa, Homo Sapiens
AAAATNTSK

SEQ ID NO: 568497 - protein, 9 aa, Homo Sapiens
QQQLALLQQ

SEQ ID NO: 568498 - protein, 9 aa, Homo Sapiens
LIFFLFLVA

SEQ ID NO: 568499 - protein, 9 aa, Homo Sapiens
PVPTRLGKK

SEQ ID NO: 568500 - protein, 9 aa, Homo Sapiens
RISVSSPGS

SEQ ID NO: 568501 - protein, 9 aa, Homo Sapiens
LGEDDPRLH

SEQ ID NO: 568502 - protein, 9 aa, Homo Sapiens
PMTEQRKQK

SEQ ID NO: 568503 - protein, 9 aa, Homo Sapiens
LKRNKIDAH

SEQ ID NO: 568504 - protein, 9 aa, Homo Sapiens
GGISSFWIK

SEQ ID NO: 568505 - protein, 9 aa, Homo Sapiens
NRAELTPQL

SEQ ID NO: 568506 - protein, 9 aa, Homo Sapiens
PRFTWELHS

SEQ ID NO: 568507 - protein, 9 aa, Homo Sapiens
GWCIQEHQS

SEQ ID NO: 568508 - protein, 9 aa, Homo Sapiens
ELEEHTEKA

SEQ ID NO: 568509 - protein, 9 aa, Homo Sapiens
EPTADSSLP

SEQ ID NO: 568510 - protein, 9 aa, Homo Sapiens
EGNEHRELS

SEQ ID NO: 568511 - protein, 9 aa, Homo Sapiens
LFCSTLGVF

SEQ ID NO: 568512 - protein, 9 aa, Homo Sapiens
EQEARRRIE

SEQ ID NO: 568513 - protein, 9 aa, Homo Sapiens
SSASMCFAG

SEQ ID NO: 568514 - protein, 9 aa, Homo Sapiens
IFFLFLVAV

SEQ ID NO: 568515 - protein, 9 aa, Homo Sapiens
PLSLTPESL

SEQ ID NO: 568516 - protein, 9 aa, Homo Sapiens
RPETSCATP

SEQ ID NO: 568517 - protein, 9 aa, Homo Sapiens
YELEEHTEK

SEQ ID NO: 568518 - protein, 9 aa, Homo Sapiens
RPSSRRSSP

SEQ ID NO: 568519 - protein, 9 aa, Homo Sapiens
DQQGSLFSW

SEQ ID NO: 568520 - protein, 9 aa, Homo Sapiens
TLWLHAGEI

SEQ ID NO: 568521 - protein, 9 aa, Homo Sapiens
GRSGGRSPP

SEQ ID NO: 568522 - protein, 9 aa, Homo Sapiens
GNNIPHSHD

SEQ ID NO: 568523 - protein, 9 aa, Homo Sapiens
TSTMWSLRL

SEQ ID NO: 568524 - protein, 9 aa, Homo Sapiens
FSTKYKIMT

SEQ ID NO: 568525 - protein, 9 aa, Homo Sapiens
GCMRGNSPC

SEQ ID NO: 568526 - protein, 9 aa, Homo Sapiens
NNIIDYPQM

SEQ ID NO: 568527 - protein, 9 aa, Homo Sapiens
LPHQERRQM

SEQ ID NO: 568528 - protein, 9 aa, Homo Sapiens
EEAQPGKKQ

SEQ ID NO: 568529 - protein, 9 aa, Homo Sapiens
AIQPNDISN

SEQ ID NO: 568530 - protein, 9 aa, Homo Sapiens
QVFFALSLG

SEQ ID NO: 568531 - protein, 9 aa, Homo Sapiens
WQSHRDIPT

SEQ ID NO: 568532 - protein, 9 aa, Homo Sapiens
SSRRSSPRP

SEQ ID NO: 568533 - protein, 9 aa, Homo Sapiens
LATLWLHAG

SEQ ID NO: 568534 - protein, 9 aa, Homo Sapiens
VVDIKLFLR

SEQ ID NO: 568535 - protein, 9 aa, Homo Sapiens
QGTELSRMG

SEQ ID NO: 568536 - protein, 9 aa, Homo Sapiens
QGDKHEELE

SEQ ID NO: 568537 - protein, 9 aa, Homo Sapiens
TKYKIMTKY

SEQ ID NO: 568538 - protein, 9 aa, Homo Sapiens
SKPSCFPKA

SEQ ID NO: 568539 - protein, 9 aa, Homo Sapiens
GKFFTVYKP

SEQ ID NO: 568540 - protein, 9 aa, Homo Sapiens
GQQDWEFLA

SEQ ID NO: 568541 - protein, 9 aa, Homo Sapiens
KTDQQGSLF

SEQ ID NO: 568542 - protein, 9 aa, Homo Sapiens
PMAFRYLTN

SEQ ID NO: 568543 - protein, 9 aa, Homo Sapiens
WLRPVGAVW

SEQ ID NO: 568544 - protein, 9 aa, Homo Sapiens
ITALVSRVG

SEQ ID NO: 568545 - protein, 9 aa, Homo Sapiens
PLLFESSRN

SEQ ID NO: 568546 - protein, 9 aa, Homo Sapiens
FDILKSAEL

SEQ ID NO: 568547 - protein, 9 aa, Homo Sapiens
RLPHQERRQ

SEQ ID NO: 568548 - protein, 9 aa, Homo Sapiens
KAEFIEEAQ

SEQ ID NO: 568549 - protein, 9 aa, Homo Sapiens
GAVWTPPSS

SEQ ID NO: 568550 - protein, 9 aa, Homo Sapiens
FFALSLGFG

SEQ ID NO: 568551 - protein, 9 aa, Homo Sapiens
KFFTVYKPN

SEQ ID NO: 568552 - protein, 9 aa, Homo Sapiens
KTPHLQGKP

SEQ ID NO: 568553 - protein, 9 aa, Homo Sapiens
SIQSYIKNL

SEQ ID NO: 568554 - protein, 9 aa, Homo Sapiens
RSTGIPNEP

SEQ ID NO: 568555 - protein, 9 aa, Homo Sapiens
NKIDAHPEL

SEQ ID NO: 568556 - protein, 9 aa, Homo Sapiens
VPKMLATLW

SEQ ID NO: 568557 - protein, 9 aa, Homo Sapiens
SHSAARRPS

SEQ ID NO: 568558 - protein, 9 aa, Homo Sapiens
HSIGLVFSI

SEQ ID NO: 568559 - protein, 9 aa, Homo Sapiens
LYELEEHTE

SEQ ID NO: 568560 - protein, 9 aa, Homo Sapiens
FLQTSRLPH

SEQ ID NO: 568561 - protein, 9 aa, Homo Sapiens
DLKKKDNTN

SEQ ID NO: 568562 - protein, 9 aa, Homo Sapiens
AELTPQLLK

SEQ ID NO: 568563 - protein, 9 aa, Homo Sapiens
VDIKLFLRI

SEQ ID NO: 568564 - protein, 9 aa, Homo Sapiens
ELHSIGLVF

SEQ ID NO: 568565 - protein, 9 aa, Homo Sapiens
PLGEDDPRL

SEQ ID NO: 568566 - protein, 9 aa, Homo Sapiens
AGAVKEQYP

SEQ ID NO: 568567 - protein, 9 aa, Homo Sapiens
GCHSLSPEE

SEQ ID NO: 568568 - protein, 9 aa, Homo Sapiens
SDKMDVIFL

SEQ ID NO: 568569 - protein, 9 aa, Homo Sapiens
SQFNTFSIS

SEQ ID NO: 568570 - protein, 9 aa, Homo Sapiens
WELHSIGLV

SEQ ID NO: 568571 - protein, 9 aa, Homo Sapiens
YNCEECRSK

SEQ ID NO: 568572 - protein, 9 aa, Homo Sapiens
EVRSRRISV

SEQ ID NO: 568573 - protein, 9 aa, Homo Sapiens
SLFSWTTTV

SEQ ID NO: 568574 - protein, 9 aa, Homo Sapiens
AECEEDGKY

SEQ ID NO: 568575 - protein, 9 aa, Homo Sapiens
CHSLSPEEN

SEQ ID NO: 568576 - protein, 9 aa, Homo Sapiens
PESLFRTVV

SEQ ID NO: 568577 - protein, 9 aa, Homo Sapiens
ACEKGTVHL

SEQ ID NO: 568578 - protein, 9 aa, Homo Sapiens
KKDNTNLFL

SEQ ID NO: 568579 - protein, 9 aa, Homo Sapiens
PPWFLPCAF

SEQ ID NO: 568580 - protein, 9 aa, Homo Sapiens
QFGQQDWEF

SEQ ID NO: 568581 - protein, 9 aa, Homo Sapiens
PPPLLFESS

SEQ ID NO: 568582 - protein, 9 aa, Homo Sapiens
NTEKCGGCM

SEQ ID NO: 568583 - protein, 9 aa, Homo Sapiens
LTPQLLKIL

SEQ ID NO: 568584 - protein, 9 aa, Homo Sapiens
AEVRSRRIS

SEQ ID NO: 568585 - protein, 9 aa, Homo Sapiens
RTCTSQKVV

SEQ ID NO: 568586 - protein, 9 aa, Homo Sapiens
RRSGPVTAW

SEQ ID NO: 568587 - protein, 9 aa, Homo Sapiens
PWFLPCAFS

SEQ ID NO: 568588 - protein, 9 aa, Homo Sapiens
CHEKYAKQI

SEQ ID NO: 568589 - protein, 9 aa, Homo Sapiens
FTNSVFLLW

SEQ ID NO: 568590 - protein, 9 aa, Homo Sapiens
LGVFGILTE

SEQ ID NO: 568591 - protein, 9 aa, Homo Sapiens
HYQQSADSS

SEQ ID NO: 568592 - protein, 9 aa, Homo Sapiens
EEQRKNFQT

SEQ ID NO: 568593 - protein, 9 aa, Homo Sapiens
CEQKEDLKK

SEQ ID NO: 568594 - protein, 9 aa, Homo Sapiens
KNTEKCGGC

SEQ ID NO: 568595 - protein, 9 aa, Homo Sapiens
SYIKNLGNP

SEQ ID NO: 568596 - protein, 9 aa, Homo Sapiens
SAEPSPQAK

SEQ ID NO: 568597 - protein, 9 aa, Homo Sapiens
QLRDMHQGT

SEQ ID NO: 568598 - protein, 9 aa, Homo Sapiens
GVLVSYPSA

SEQ ID NO: 568599 - protein, 9 aa, Homo Sapiens
LVSYPSAGG

SEQ ID NO: 568600 - protein, 9 aa, Homo Sapiens
KMLATLWLH

SEQ ID NO: 568601 - protein, 9 aa, Homo Sapiens
VAVQQLSFL

SEQ ID NO: 568602 - protein, 9 aa, Homo Sapiens
REYSEVAPI

SEQ ID NO: 568603 - protein, 9 aa, Homo Sapiens
IQEHQSKDI

SEQ ID NO: 568604 - protein, 9 aa, Homo Sapiens
FRYLTNDEE

SEQ ID NO: 568605 - protein, 9 aa, Homo Sapiens
KIMTKYDKS

SEQ ID NO: 568606 - protein, 9 aa, Homo Sapiens
GERHGSHYQ

SEQ ID NO: 568607 - protein, 9 aa, Homo Sapiens
VWTPPSSAS

SEQ ID NO: 568608 - protein, 9 aa, Homo Sapiens
TSAEPSPQA

SEQ ID NO: 568609 - protein, 9 aa, Homo Sapiens
LPAFPRLPG

SEQ ID NO: 568610 - protein, 9 aa, Homo Sapiens
RSRRISVSS

SEQ ID NO: 568611 - protein, 9 aa, Homo Sapiens
DISGGREIF

SEQ ID NO: 568612 - protein, 9 aa, Homo Sapiens
KGTVHLDCD

SEQ ID NO: 568613 - protein, 9 aa, Homo Sapiens
VPTRLGKKK

SEQ ID NO: 568614 - protein, 9 aa, Homo Sapiens
SCFPKAMET

SEQ ID NO: 568615 - protein, 9 aa, Homo Sapiens
LGERTFVRY

SEQ ID NO: 568616 - protein, 9 aa, Homo Sapiens
NEHRELSAR

SEQ ID NO: 568617 - protein, 9 aa, Homo Sapiens
QGNNIPHSH

SEQ ID NO: 568618 - protein, 9 aa, Homo Sapiens
ALIFFLFLV

SEQ ID NO: 568619 - protein, 9 aa, Homo Sapiens
PSTPAGTRT

SEQ ID NO: 568620 - protein, 9 aa, Homo Sapiens
RSMATAGST

SEQ ID NO: 568621 - protein, 9 aa, Homo Sapiens
RAIYYSLGM

SEQ ID NO: 568622 - protein, 9 aa, Homo Sapiens
IYLGVNEEQ

SEQ ID NO: 568623 - protein, 9 aa, Homo Sapiens
TVYLEKKQD

SEQ ID NO: 568624 - protein, 9 aa, Homo Sapiens
LRFVYVPSF

SEQ ID NO: 568625 - protein, 9 aa, Homo Sapiens
SLFMYNSFG

SEQ ID NO: 568626 - protein, 9 aa, Homo Sapiens
GFSSVDINL

SEQ ID NO: 568627 - protein, 9 aa, Homo Sapiens
SESSTTSSE

SEQ ID NO: 568628 - protein, 9 aa, Homo Sapiens
ISGGREIFK

SEQ ID NO: 568629 - protein, 9 aa, Homo Sapiens
WCIQEHQSK

SEQ ID NO: 568630 - protein, 9 aa, Homo Sapiens
QNRGKFFTV

SEQ ID NO: 568631 - protein, 9 aa, Homo Sapiens
IQSYIKNLG

SEQ ID NO: 568632 - protein, 9 aa, Homo Sapiens
WSLRLPHQE

SEQ ID NO: 568633 - protein, 9 aa, Homo Sapiens
EDAKAMPLT

SEQ ID NO: 568634 - protein, 9 aa, Homo Sapiens
SELKDPMTE

SEQ ID NO: 568635 - protein, 9 aa, Homo Sapiens
LISLTAKIR

SEQ ID NO: 568636 - protein, 9 aa, Homo Sapiens
SLTPESLFR

SEQ ID NO: 568637 - protein, 9 aa, Homo Sapiens
LFLVAVQQL

SEQ ID NO: 568638 - protein, 9 aa, Homo Sapiens
KRKAEQEAR

SEQ ID NO: 568639 - protein, 9 aa, Homo Sapiens
PAAPAVTPV

SEQ ID NO: 568640 - protein, 9 aa, Homo Sapiens
WKEEEKTPH

SEQ ID NO: 568641 - protein, 9 aa, Homo Sapiens
PTWASGSHS

SEQ ID NO: 568642 - protein, 9 aa, Homo Sapiens
GSHYQQSAD

SEQ ID NO: 568643 - protein, 9 aa, Homo Sapiens
PVGAVWTPP

SEQ ID NO: 568644 - protein, 9 aa, Homo Sapiens
YVAWGELDY

SEQ ID NO: 568645 - protein, 9 aa, Homo Sapiens
IKFRNKQST

SEQ ID NO: 568646 - protein, 9 aa, Homo Sapiens
ETSAEPSPQ

SEQ ID NO: 568647 - protein, 9 aa, Homo Sapiens
KSAELVCLT

SEQ ID NO: 568648 - protein, 9 aa, Homo Sapiens
FGQQDWEFL

SEQ ID NO: 568649 - protein, 9 aa, Homo Sapiens
TSSASRSMA

SEQ ID NO: 568650 - protein, 9 aa, Homo Sapiens
TMTPAAPAV

SEQ ID NO: 568651 - protein, 9 aa, Homo Sapiens
ELKDPMTEQ

SEQ ID NO: 568652 - protein, 9 aa, Homo Sapiens
EDDSHGSAG

SEQ ID NO: 568653 - protein, 9 aa, Homo Sapiens
QTSRLPHGN

SEQ ID NO: 568654 - protein, 9 aa, Homo Sapiens
NTFSISKIH

SEQ ID NO: 568655 - protein, 9 aa, Homo Sapiens
SPQAKQLKL

SEQ ID NO: 568656 - protein, 9 aa, Homo Sapiens
GAVKEQYPG

SEQ ID NO: 568657 - protein, 9 aa, Homo Sapiens
ASVVDIKLF

SEQ ID NO: 568658 - protein, 9 aa, Homo Sapiens
DAKAMPLTW

SEQ ID NO: 568659 - protein, 9 aa, Homo Sapiens
YLELAGAVK

SEQ ID NO: 568660 - protein, 9 aa, Homo Sapiens
VFSIVFMGW

SEQ ID NO: 568661 - protein, 9 aa, Homo Sapiens
FMGWCIQEH

SEQ ID NO: 568662 - protein, 9 aa, Homo Sapiens
TGIPNEPTA

SEQ ID NO: 568663 - protein, 9 aa, Homo Sapiens
AGQGDKHEE

SEQ ID NO: 568664 - protein, 9 aa, Homo Sapiens
LVAVQQLSF

SEQ ID NO: 568665 - protein, 9 aa, Homo Sapiens
SVDLIRERL

SEQ ID NO: 568666 - protein, 9 aa, Homo Sapiens
SWSPDISGG

SEQ ID NO: 568667 - protein, 9 aa, Homo Sapiens
PTPLPFWEL

SEQ ID NO: 568668 - protein, 9 aa, Homo Sapiens
QFVSYVAWG

SEQ ID NO: 568669 - protein, 9 aa, Homo Sapiens
GNEHRELSA

SEQ ID NO: 568670 - protein, 9 aa, Homo Sapiens
MWSLRLPHQ

SEQ ID NO: 568671 - protein, 9 aa, Homo Sapiens
RNKIDAHPE

SEQ ID NO: 568672 - protein, 9 aa, Homo Sapiens
EEKTPHLQG

SEQ ID NO: 568673 - protein, 9 aa, Homo Sapiens
MLATLWLHA

SEQ ID NO: 568674 - protein, 9 aa, Homo Sapiens
LQANFQTHR

SEQ ID NO: 568675 - protein, 9 aa, Homo Sapiens
AKAMPLTWV

SEQ ID NO: 568676 - protein, 9 aa, Homo Sapiens
RNKQSTIFP

SEQ ID NO: 568677 - protein, 9 aa, Homo Sapiens
SWKEEEKTP

SEQ ID NO: 568678 - protein, 9 aa, Homo Sapiens
IDAHPELAL

SEQ ID NO: 568679 - protein, 9 aa, Homo Sapiens
EQKEDLKKK

SEQ ID NO: 568680 - protein, 9 aa, Homo Sapiens
EATYLELAG

SEQ ID NO: 568681 - protein, 9 aa, Homo Sapiens
NDEEDDSHG

SEQ ID NO: 568682 - protein, 9 aa, Homo Sapiens
ISLFMYNSF

SEQ ID NO: 568683 - protein, 9 aa, Homo Sapiens
KEEEKTPHL

SEQ ID NO: 568684 - protein, 9 aa, Homo Sapiens
RLGKKKKKT

SEQ ID NO: 568685 - protein, 9 aa, Homo Sapiens
PFWELFCST

SEQ ID NO: 568686 - protein, 9 aa, Homo Sapiens
DSEDSSSEE

SEQ ID NO: 568687 - protein, 9 aa, Homo Sapiens
NEPTADSSL

SEQ ID NO: 568688 - protein, 9 aa, Homo Sapiens
MCFAGRSGG

SEQ ID NO: 568689 - protein, 9 aa, Homo Sapiens
KPSCFPKAM

SEQ ID NO: 568690 - protein, 9 aa, Homo Sapiens
AEQNRGKFF

SEQ ID NO: 568691 - protein, 9 aa, Homo Sapiens
ATQVFFALS

SEQ ID NO: 568692 - protein, 9 aa, Homo Sapiens
VRTCTSQKV

SEQ ID NO: 568693 - protein, 9 aa, Homo Sapiens
ELPLSLTPE

SEQ ID NO: 568694 - protein, 9 aa, Homo Sapiens
QRAIYYSLG

SEQ ID NO: 568695 - protein, 9 aa, Homo Sapiens
IQPNDISNK

SEQ ID NO: 568696 - protein, 9 aa, Homo Sapiens
GRSGCHSLS

SEQ ID NO: 568697 - protein, 9 aa, Homo Sapiens
QSLGERTFV

SEQ ID NO: 568698 - protein, 9 aa, Homo Sapiens
RLDQRCSKL

SEQ ID NO: 568699 - protein, 9 aa, Homo Sapiens
LSKPSCFPK

SEQ ID NO: 568700 - protein, 9 aa, Homo Sapiens
VIFLAEMIE

SEQ ID NO: 568701 - protein, 9 aa, Homo Sapiens
NFPEPLSEN

SEQ ID NO: 568702 - protein, 9 aa, Homo Sapiens
CIQEHQSKD

SEQ ID NO: 568703 - protein, 9 aa, Homo Sapiens
AGGATRPSA

SEQ ID NO: 568704 - protein, 9 aa, Homo Sapiens
CDAAPFPMA

SEQ ID NO: 568705 - protein, 9 aa, Homo Sapiens
TTVPKMLAT

SEQ ID NO: 568706 - protein, 9 aa, Homo Sapiens
QFLQTSRLP

SEQ ID NO: 568707 - protein, 9 aa, Homo Sapiens
TSHPMLRFV

SEQ ID NO: 568708 - protein, 9 aa, Homo Sapiens
QLALLQQFQ

SEQ ID NO: 568709 - protein, 9 aa, Homo Sapiens
VIGAIQPND

SEQ ID NO: 568710 - protein, 9 aa, Homo Sapiens
DRLDQRCSK

SEQ ID NO: 568711 - protein, 9 aa, Homo Sapiens
YIVIGAIQP

SEQ ID NO: 568712 - protein, 9 aa, Homo Sapiens
GCCLQRLFT

SEQ ID NO: 568713 - protein, 9 aa, Homo Sapiens
TMWSLRLPH

SEQ ID NO: 568714 - protein, 9 aa, Homo Sapiens
SHMGTSTMW

SEQ ID NO: 568715 - protein, 9 aa, Homo Sapiens
KHEDAKAMP

SEQ ID NO: 568716 - protein, 9 aa, Homo Sapiens
LFTNSVFLL

SEQ ID NO: 568717 - protein, 9 aa, Homo Sapiens
GSPACQEGL

SEQ ID NO: 568718 - protein, 9 aa, Homo Sapiens
KTSIISLFM

SEQ ID NO: 568719 - protein, 9 aa, Homo Sapiens
TSKMDQGSN

SEQ ID NO: 568720 - protein, 9 aa, Homo Sapiens
LAEMIEKFG

SEQ ID NO: 568721 - protein, 9 aa, Homo Sapiens
TRLGKKKKK

SEQ ID NO: 568722 - protein, 9 aa, Homo Sapiens
EKGTVHLDC

SEQ ID NO: 568723 - protein, 9 aa, Homo Sapiens
RCSKLRVVG

SEQ ID NO: 568724 - protein, 9 aa, Homo Sapiens
PRPETSCAT

SEQ ID NO: 568725 - protein, 9 aa, Homo Sapiens
GDPTSSDRI

SEQ ID NO: 568726 - protein, 9 aa, Homo Sapiens
MKQGVIKNL

SEQ ID NO: 568727 - protein, 9 aa, Homo Sapiens
RLPHGNPST

SEQ ID NO: 568728 - protein, 9 aa, Homo Sapiens
EQGNNIPHS

SEQ ID NO: 568729 - protein, 9 aa, Homo Sapiens
HRDFSAECE

SEQ ID NO: 568730 - protein, 9 aa, Homo Sapiens
FAVSEQGNN

SEQ ID NO: 568731 - protein, 9 aa, Homo Sapiens
TSCATPSTP

SEQ ID NO: 568732 - protein, 9 aa, Homo Sapiens
SRLPHGNPS

SEQ ID NO: 568733 - protein, 9 aa, Homo Sapiens
PFPMAFRYL

SEQ ID NO: 568734 - protein, 9 aa, Homo Sapiens
TKYDKSGRL

SEQ ID NO: 568735 - protein, 9 aa, Homo Sapiens
TTYIVIGAI

SEQ ID NO: 568736 - protein, 9 aa, Homo Sapiens
GGREIFKPR

SEQ ID NO: 568737 - protein, 9 aa, Homo Sapiens
EDSSSEEEE

SEQ ID NO: 568738 - protein, 9 aa, Homo Sapiens
GSLFSWTTT

SEQ ID NO: 568739 - protein, 9 aa, Homo Sapiens
VMITPFLFI

SEQ ID NO: 568740 - protein, 9 aa, Homo Sapiens
EPSGIRGAS

SEQ ID NO: 568741 - protein, 9 aa, Homo Sapiens
SASRSMATA

SEQ ID NO: 568742 - protein, 9 aa, Homo Sapiens
RSPPPLLFE

SEQ ID NO: 568743 - protein, 9 aa, Homo Sapiens
TPAAPAVTP

SEQ ID NO: 568744 - protein, 9 aa, Homo Sapiens
PPDRRFDAY

SEQ ID NO: 568745 - protein, 9 aa, Homo Sapiens
GLQDALESR

SEQ ID NO: 568746 - protein, 9 aa, Homo Sapiens
DCHEKYAKQ

SEQ ID NO: 568747 - protein, 9 aa, Homo Sapiens
HMGTSTMWS

SEQ ID NO: 568748 - protein, 9 aa, Homo Sapiens
SLDGAHFPD

SEQ ID NO: 568749 - protein, 9 aa, Homo Sapiens
KRNKIDAHP

SEQ ID NO: 568750 - protein, 9 aa, Homo Sapiens
EEHTEKAVE

SEQ ID NO: 568751 - protein, 9 aa, Homo Sapiens
LLFCQSQFN

SEQ ID NO: 568752 - protein, 9 aa, Homo Sapiens
SLEKAAAAT

SEQ ID NO: 568753 - protein, 9 aa, Homo Sapiens
ESLFRTVVF

SEQ ID NO: 568754 - protein, 9 aa, Homo Sapiens
EMMENFPEP

SEQ ID NO: 568755 - protein, 9 aa, Homo Sapiens
SLGFGGVIA

SEQ ID NO: 568756 - protein, 9 aa, Homo Sapiens
AMKQGVIKN

SEQ ID NO: 568757 - protein, 9 aa, Homo Sapiens
GCQARFLLV

SEQ ID NO: 568758 - protein, 9 aa, Homo Sapiens
TYLELAGAV

SEQ ID NO: 568759 - protein, 9 aa, Homo Sapiens
LREPSGIRG

SEQ ID NO: 568760 - protein, 9 aa, Homo Sapiens
EEEKTPHLQ

SEQ ID NO: 568761 - protein, 9 aa, Homo Sapiens
ISLTAKIRE

SEQ ID NO: 568762 - protein, 9 aa, Homo Sapiens
GTSTMWSLR

SEQ ID NO: 568763 - protein, 9 aa, Homo Sapiens
YAKQIKFTL

SEQ ID NO: 568764 - protein, 9 aa, Homo Sapiens
RLFTNSVFL

SEQ ID NO: 568765 - protein, 9 aa, Homo Sapiens
MHQGTELSR

SEQ ID NO: 568766 - protein, 9 aa, Homo Sapiens
HPELALQFL

SEQ ID NO: 568767 - protein, 9 aa, Homo Sapiens
TSRLPHGNP

SEQ ID NO: 568768 - protein, 9 aa, Homo Sapiens
SLTAKIREY

SEQ ID NO: 568769 - protein, 9 aa, Homo Sapiens
MLRFVYVPS

SEQ ID NO: 568770 - protein, 9 aa, Homo Sapiens
KIREYSEVA

SEQ ID NO: 568771 - protein, 9 aa, Homo Sapiens
STKYKIMTK

SEQ ID NO: 568772 - protein, 9 aa, Homo Sapiens
PTSSDRIPG

SEQ ID NO: 568773 - protein, 9 aa, Homo Sapiens
DILKSAELV

SEQ ID NO: 568774 - protein, 9 aa, Homo Sapiens
NIIDYPQMA

SEQ ID NO: 568775 - protein, 9 aa, Homo Sapiens
ESRLGRSVA

SEQ ID NO: 568776 - protein, 9 aa, Homo Sapiens
ENFPEPLSE

SEQ ID NO: 568777 - protein, 9 aa, Homo Sapiens
TLVIDIMDA

SEQ ID NO: 568778 - protein, 9 aa, Homo Sapiens
NAGQIPLGE

SEQ ID NO: 568779 - protein, 9 aa, Homo Sapiens
TAKIREYSE

SEQ ID NO: 568780 - protein, 9 aa, Homo Sapiens
ASGSHSAAR

SEQ ID NO: 568781 - protein, 9 aa, Homo Sapiens
KVVCFFGCP

SEQ ID NO: 568782 - protein, 9 aa, Homo Sapiens
LKDPMTEQR

SEQ ID NO: 568783 - protein, 9 aa, Homo Sapiens
SWSGCSRGV

SEQ ID NO: 568784 - protein, 9 aa, Homo Sapiens
RDFSAECEE

SEQ ID NO: 568785 - protein, 9 aa, Homo Sapiens
SQKVVCFFG

SEQ ID NO: 568786 - protein, 9 aa, Homo Sapiens
IKTDQQGSL

SEQ ID NO: 568787 - protein, 9 aa, Homo Sapiens
GERTFVRYL

SEQ ID NO: 568788 - protein, 9 aa, Homo Sapiens
QSKDIQIPH

SEQ ID NO: 568789 - protein, 9 aa, Homo Sapiens
SRRISVSSP

SEQ ID NO: 568790 - protein, 9 aa, Homo Sapiens
AQVFDILKS

SEQ ID NO: 568791 - protein, 9 aa, Homo Sapiens
EGLKAGDLI

SEQ ID NO: 568792 - protein, 9 aa, Homo Sapiens
FSIVFMGWC

SEQ ID NO: 568793 - protein, 9 aa, Homo Sapiens
TGFPPPDRR

SEQ ID NO: 568794 - protein, 9 aa, Homo Sapiens
SSGSLEKAA

SEQ ID NO: 568795 - protein, 9 aa, Homo Sapiens
TAWWCASRP

SEQ ID NO: 568796 - protein, 9 aa, Homo Sapiens
GISSFWIKN

SEQ ID NO: 568797 - protein, 9 aa, Homo Sapiens
ILCNSVDLI

SEQ ID NO: 568798 - protein, 9 aa, Homo Sapiens
QEARRRIEE

SEQ ID NO: 568799 - protein, 9 aa, Homo Sapiens
LLFESSRNP

SEQ ID NO: 568800 - protein, 9 aa, Homo Sapiens
LPFWELFCS

SEQ ID NO: 568801 - protein, 9 aa, Homo Sapiens
PSPQAKQLK

SEQ ID NO: 568802 - protein, 9 aa, Homo Sapiens
HQGTELSRM

SEQ ID NO: 568803 - protein, 9 aa, Homo Sapiens
ECEEDGKYE

SEQ ID NO: 568804 - protein, 9 aa, Homo Sapiens
PAFPRLPGV

SEQ ID NO: 568805 - protein, 9 aa, Homo Sapiens
AFRYLTNDE

SEQ ID NO: 568806 - protein, 9 aa, Homo Sapiens
SMATAGSTR

SEQ ID NO: 568807 - protein, 9 aa, Homo Sapiens
DVILCNSVD

SEQ ID NO: 568808 - protein, 9 aa, Homo Sapiens
PGPTPLPFW

SEQ ID NO: 568809 - protein, 9 aa, Homo Sapiens
SEQGNNIPH

SEQ ID NO: 568810 - protein, 9 aa, Homo Sapiens
TSIISLFMY

SEQ ID NO: 568811 - protein, 9 aa, Homo Sapiens
LSLTPESLF

SEQ ID NO: 568812 - protein, 9 aa, Homo Sapiens
HEDAKAMPL

SEQ ID NO: 568813 - protein, 9 aa, Homo Sapiens
PFFLSKPSC

SEQ ID NO: 568814 - protein, 9 aa, Homo Sapiens
VTAWWCASR

SEQ ID NO: 568815 - protein, 9 aa, Homo Sapiens
QRLFTNSVF

SEQ ID NO: 568816 - protein, 9 aa, Homo Sapiens
TALVSRVGH

SEQ ID NO: 568817 - protein, 9 aa, Homo Sapiens
QIPHPIDAC

SEQ ID NO: 568818 - protein, 9 aa, Homo Sapiens
GVIKNLKIK

SEQ ID NO: 568819 - protein, 9 aa, Homo Sapiens
MITPFLFIL

SEQ ID NO: 568820 - protein, 9 aa, Homo Sapiens
HEKYAKQIK

SEQ ID NO: 568821 - protein, 9 aa, Homo Sapiens
TWELHSIGL

SEQ ID NO: 568822 - protein, 9 aa, Homo Sapiens
LTNDEEDDS

SEQ ID NO: 568823 - protein, 9 aa, Homo Sapiens
ARRPSSRRS

SEQ ID NO: 568824 - protein, 9 aa, Homo Sapiens
KCGGCMRGN

SEQ ID NO: 568825 - protein, 9 aa, Homo Sapiens
RRPSSRRSS

SEQ ID NO: 568826 - protein, 9 aa, Homo Sapiens
QFNTFSISK

SEQ ID NO: 568827 - protein, 9 aa, Homo Sapiens
SHPMLRFVY

SEQ ID NO: 568828 - protein, 9 aa, Homo Sapiens
STGIPNEPT

SEQ ID NO: 568829 - protein, 9 aa, Homo Sapiens
TRTPRTSSA

SEQ ID NO: 568830 - protein, 9 aa, Homo Sapiens
ATAVAAALA

SEQ ID NO: 568831 - protein, 9 aa, Homo Sapiens
RSWSGCSRG

SEQ ID NO: 568832 - protein, 9 aa, Homo Sapiens
SQALLTVYL

SEQ ID NO: 568833 - protein, 9 aa, Homo Sapiens
CSRGVSAWL

SEQ ID NO: 568834 - protein, 9 aa, Homo Sapiens
RIPGEPVPV

SEQ ID NO: 568835 - protein, 9 aa, Homo Sapiens
AWLRPVGAV

SEQ ID NO: 568836 - protein, 9 aa, Homo Sapiens
VIDIMDASY

SEQ ID NO: 568837 - protein, 9 aa, Homo Sapiens
PSSRRSSPR

SEQ ID NO: 568838 - protein, 9 aa, Homo Sapiens
TPFLFILAS

SEQ ID NO: 568839 - protein, 9 aa, Homo Sapiens
LFLRIWDLF

SEQ ID NO: 568840 - protein, 9 aa, Homo Sapiens
KYKIMTKYD

SEQ ID NO: 568841 - protein, 9 aa, Homo Sapiens
SGCHSLSPE

SEQ ID NO: 568842 - protein, 9 aa, Homo Sapiens
ELSARFLIV

SEQ ID NO: 568843 - protein, 9 aa, Homo Sapiens
LEKAAAATN

SEQ ID NO: 568844 - protein, 9 aa, Homo Sapiens
RMKREITAL

SEQ ID NO: 568845 - protein, 9 aa, Homo Sapiens
QGSLFSWTT

SEQ ID NO: 568846 - protein, 9 aa, Homo Sapiens
RHGSHYQQS

SEQ ID NO: 568847 - protein, 9 aa, Homo Sapiens
SMCFAGRSG

SEQ ID NO: 568848 - protein, 9 aa, Homo Sapiens
DEKRKAEQE

SEQ ID NO: 568849 - protein, 9 aa, Homo Sapiens
KQGVIKNLK

SEQ ID NO: 568850 - protein, 9 aa, Homo Sapiens
FILASYMHI

SEQ ID NO: 568851 - protein, 9 aa, Homo Sapiens
KITVRIHGG

SEQ ID NO: 568852 - protein, 9 aa, Homo Sapiens
APGFGRSGC

SEQ ID NO: 568853 - protein, 9 aa, Homo Sapiens
NLKIKYRHC

SEQ ID NO: 568854 - protein, 9 aa, Homo Sapiens
DQRCSKLRV

SEQ ID NO: 568855 - protein, 9 aa, Homo Sapiens
MTPAAPAVT

SEQ ID NO: 568856 - protein, 9 aa, Homo Sapiens
LGGLQDALE

SEQ ID NO: 568857 - protein, 9 aa, Homo Sapiens
VFLLWGCQA

SEQ ID NO: 568858 - protein, 9 aa, Homo Sapiens
IKQFVSYVA

SEQ ID NO: 568859 - protein, 9 aa, Homo Sapiens
VDINLLVAA

SEQ ID NO: 568860 - protein, 9 aa, Homo Sapiens
AQAEVRSRR

SEQ ID NO: 568861 - protein, 9 aa, Homo Sapiens
QSHRDIPTS

SEQ ID NO: 568862 - protein, 9 aa, Homo Sapiens
PVTAWWCAS

SEQ ID NO: 568863 - protein, 9 aa, Homo Sapiens
LLWGCQARF

SEQ ID NO: 568864 - protein, 9 aa, Homo Sapiens
DAAPFPMAF

SEQ ID NO: 568865 - protein, 9 aa, Homo Sapiens
QSTIFPRFT

SEQ ID NO: 568866 - protein, 9 aa, Homo Sapiens
FCSTLGVFG

SEQ ID NO: 568867 - protein, 9 aa, Homo Sapiens
CFAGRSGGR

SEQ ID NO: 568868 - protein, 9 aa, Homo Sapiens
HPMLRFVYV

SEQ ID NO: 568869 - protein, 9 aa, Homo Sapiens
RYRSWSGCS

SEQ ID NO: 568870 - protein, 9 aa, Homo Sapiens
SRSMATAGS

SEQ ID NO: 568871 - protein, 9 aa, Homo Sapiens
IDYPQMAPV

SEQ ID NO: 568872 - protein, 9 aa, Homo Sapiens
SSASRSMAT

SEQ ID NO: 568873 - protein, 9 aa, Homo Sapiens
VVCFFGCPP

SEQ ID NO: 568874 - protein, 9 aa, Homo Sapiens
FSAECEEDG

SEQ ID NO: 568875 - protein, 9 aa, Homo Sapiens
DLREPSGIR

SEQ ID NO: 568876 - protein, 9 aa, Homo Sapiens
AAPAVTPVD

SEQ ID NO: 568877 - protein, 9 aa, Homo Sapiens
ESSTTSSEA

SEQ ID NO: 568878 - protein, 9 aa, Homo Sapiens
CGGCMRGNS

SEQ ID NO: 568879 - protein, 9 aa, Homo Sapiens
MGWCIQEHQ

SEQ ID NO: 568880 - protein, 9 aa, Homo Sapiens
GEDDPRLHL

SEQ ID NO: 568881 - protein, 9 aa, Homo Sapiens
TPLPFWELF

SEQ ID NO: 568882 - protein, 9 aa, Homo Sapiens
SGDPTSSDR

SEQ ID NO: 568883 - protein, 9 aa, Homo Sapiens
QSWKEEEKT

SEQ ID NO: 568884 - protein, 9 aa, Homo Sapiens
TIFPRFTWE

SEQ ID NO: 568885 - protein, 9 aa, Homo Sapiens
LRLPHQERR

SEQ ID NO: 568886 - protein, 9 aa, Homo Sapiens
SEYKYNCEE

SEQ ID NO: 568887 - protein, 9 aa, Homo Sapiens
KQSTIFPRF

SEQ ID NO: 568888 - protein, 9 aa, Homo Sapiens
EHQSKDIQI

SEQ ID NO: 568889 - protein, 9 aa, Homo Sapiens
FLLWGCQAR

SEQ ID NO: 568890 - protein, 9 aa, Homo Sapiens
KEMKAEFIE

SEQ ID NO: 568891 - protein, 9 aa, Homo Sapiens
RSGPVTAWW

SEQ ID NO: 568892 - protein, 9 aa, Homo Sapiens
YQQSADSSR

SEQ ID NO: 568893 - protein, 9 aa, Homo Sapiens
PEPLSENEL

SEQ ID NO: 568894 - protein, 9 aa, Homo Sapiens
PSAGGATRP

SEQ ID NO: 568895 - protein, 9 aa, Homo Sapiens
IISLFMYNS

SEQ ID NO: 568896 - protein, 9 aa, Homo Sapiens
IVFMGWCIQ

SEQ ID NO: 568897 - protein, 9 aa, Homo Sapiens
IQIPHPIDA

SEQ ID NO: 568898 - protein, 9 aa, Homo Sapiens
SKDIQIPHP

SEQ ID NO: 568899 - protein, 9 aa, Homo Sapiens
KQFVSYVAW

SEQ ID NO: 568900 - protein, 9 aa, Homo Sapiens
STRYRSWSG

SEQ ID NO: 568901 - protein, 9 aa, Homo Sapiens
VQQLSFLGC

SEQ ID NO: 568902 - protein, 9 aa, Homo Sapiens
FRNKQSTIF

SEQ ID NO: 568903 - protein, 9 aa, Homo Sapiens
AWWCASRPT

SEQ ID NO: 568904 - protein, 9 aa, Homo Sapiens
EQNRGKFFT

SEQ ID NO: 568905 - protein, 9 aa, Homo Sapiens
EEGSPACQE

SEQ ID NO: 568906 - protein, 9 aa, Homo Sapiens
MGTSTMWSL

SEQ ID NO: 568907 - protein, 9 aa, Homo Sapiens
FIEEAQPGK

SEQ ID NO: 568908 - protein, 9 aa, Homo Sapiens
SGCSRGVSA

SEQ ID NO: 568909 - protein, 9 aa, Homo Sapiens
PCWSSWIPT

SEQ ID NO: 568910 - protein, 9 aa, Homo Sapiens
GVSAWLRPV

SEQ ID NO: 568911 - protein, 9 aa, Homo Sapiens
EKYAKQIKF

SEQ ID NO: 568912 - protein, 9 aa, Homo Sapiens
TYIVIGAIQ

SEQ ID NO: 568913 - protein, 9 aa, Homo Sapiens
TTVELPLSL

SEQ ID NO: 568914 - protein, 9 aa, Homo Sapiens
PPPDRRFDA

SEQ ID NO: 568915 - protein, 9 aa, Homo Sapiens
EVVSIQSYI

SEQ ID NO: 568916 - protein, 9 aa, Homo Sapiens
AGQIPLGED

SEQ ID NO: 568917 - protein, 9 aa, Homo Sapiens
LCNSVDLIR

SEQ ID NO: 568918 - protein, 9 aa, Homo Sapiens
SHYQQSADS

SEQ ID NO: 568919 - protein, 9 aa, Homo Sapiens
SGKTSIISL

SEQ ID NO: 568920 - protein, 9 aa, Homo Sapiens
SAWLRPVGA

SEQ ID NO: 568921 - protein, 9 aa, Homo Sapiens
MENFPEPLS

SEQ ID NO: 568922 - protein, 9 aa, Homo Sapiens
PACQEGLKA

SEQ ID NO: 568923 - protein, 9 aa, Homo Sapiens
VDLIRERLT

SEQ ID NO: 568924 - protein, 9 aa, Homo Sapiens
GQIPLGEDD

SEQ ID NO: 568925 - protein, 9 aa, Homo Sapiens
DWEFLASHF

SEQ ID NO: 568926 - protein, 9 aa, Homo Sapiens
FWELFCSTL

SEQ ID NO: 568927 - protein, 9 aa, Homo Sapiens
QKVVCFFGC

SEQ ID NO: 568928 - protein, 9 aa, Homo Sapiens
KWQSHRDIP

SEQ ID NO: 568929 - protein, 9 aa, Homo Sapiens
PGFGRSGCH

SEQ ID NO: 568930 - protein, 9 aa, Homo Sapiens
KYNCEECRS

SEQ ID NO: 568931 - protein, 9 aa, Homo Sapiens
SVVDIKLFL

SEQ ID NO: 568932 - protein, 9 aa, Homo Sapiens
FLAEMIEKF

SEQ ID NO: 568933 - protein, 9 aa, Homo Sapiens
ITVRIHGGI

SEQ ID NO: 568934 - protein, 9 aa, Homo Sapiens
VNEEQRKNF

SEQ ID NO: 568935 - protein, 9 aa, Homo Sapiens
RSGGRSPPP

SEQ ID NO: 568936 - protein, 9 aa, Homo Sapiens
IREYSEVAP

SEQ ID NO: 568937 - protein, 9 aa, Homo Sapiens
KMDQGSNAF

SEQ ID NO: 568938 - protein, 9 aa, Homo Sapiens
LVMITPFLF

SEQ ID NO: 568939 - protein, 9 aa, Homo Sapiens
CLQRLFTNS

SEQ ID NO: 568940 - protein, 9 aa, Homo Sapiens
GIRGASASA

SEQ ID NO: 568941 - protein, 9 aa, Homo Sapiens
CNRAELTPQ

SEQ ID NO: 568942 - protein, 9 aa, Homo Sapiens
SSSGSLEKA

SEQ ID NO: 568943 - protein, 9 aa, Homo Sapiens
PHPIDACEK

SEQ ID NO: 568944 - protein, 9 aa, Homo Sapiens
STMWSLRLP

SEQ ID NO: 568945 - protein, 9 aa, Homo Sapiens
LVIDIMDAS

SEQ ID NO: 568946 - protein, 9 aa, Homo Sapiens
ALIKQFVSY

SEQ ID NO: 568947 - protein, 9 aa, Homo Sapiens
EKAAAATNT

SEQ ID NO: 568948 - protein, 9 aa, Homo Sapiens
DINLLVAAL

SEQ ID NO: 568949 - protein, 9 aa, Homo Sapiens
TWASGSHSA

SEQ ID NO: 568950 - protein, 9 aa, Homo Sapiens
TPQLLKILH

SEQ ID NO: 568951 - protein, 9 aa, Homo Sapiens
TVRIHGGIS

SEQ ID NO: 568952 - protein, 9 aa, Homo Sapiens
AFPRLPGVL

SEQ ID NO: 568953 - protein, 9 aa, Homo Sapiens
GGLQDALES

SEQ ID NO: 568954 - protein, 9 aa, Homo Sapiens
RPTWASGSH

SEQ ID NO: 568955 - protein, 9 aa, Homo Sapiens
HLPAFPRLP

SEQ ID NO: 568956 - protein, 9 aa, Homo Sapiens
VSYPSAGGA

SEQ ID NO: 568957 - protein, 9 aa, Homo Sapiens
RKAEQEARR

SEQ ID NO: 568958 - protein, 9 aa, Homo Sapiens
QANFQTHRR

SEQ ID NO: 568959 - protein, 9 aa, Homo Sapiens
PSSASMCFA

SEQ ID NO: 568960 - protein, 9 aa, Homo Sapiens
RSSPRPETS

SEQ ID NO: 568961 - protein, 9 aa, Homo Sapiens
EFLASHFPN

SEQ ID NO: 568962 - protein, 9 aa, Homo Sapiens
LKDCHEKYA

SEQ ID NO: 568963 - protein, 9 aa, Homo Sapiens
FLGCCLQRL

SEQ ID NO: 568964 - protein, 9 aa, Homo Sapiens
CTSQKVVCF

SEQ ID NO: 568965 - protein, 9 aa, Homo Sapiens
DIQIPHPID

SEQ ID NO: 568966 - protein, 9 aa, Homo Sapiens
VFFALSLGF

SEQ ID NO: 568967 - protein, 9 aa, Homo Sapiens
CMRGNSPCW

SEQ ID NO: 568968 - protein, 9 aa, Homo Sapiens
SHGSAGQGD

SEQ ID NO: 568969 - protein, 9 aa, Homo Sapiens
LEEHTEKAV

SEQ ID NO: 568970 - protein, 9 aa, Homo Sapiens
VSEQGNNIP

SEQ ID NO: 568971 - protein, 9 aa, Homo Sapiens
RIHGGISSF

SEQ ID NO: 568972 - protein, 9 aa, Homo Sapiens
EPPVPTRLG

SEQ ID NO: 568973 - protein, 9 aa, Homo Sapiens
PFLFILASY

SEQ ID NO: 568974 - protein, 9 aa, Homo Sapiens
AKTLVIDIM

SEQ ID NO: 568975 - protein, 9 aa, Homo Sapiens
QQLALLQQF

SEQ ID NO: 568976 - protein, 9 aa, Homo Sapiens
LALLQQFQT

SEQ ID NO: 568977 - protein, 9 aa, Homo Sapiens
SLFSLDGAH

SEQ ID NO: 568978 - protein, 9 aa, Homo Sapiens
RPVGAVWTP

SEQ ID NO: 568979 - protein, 9 aa, Homo Sapiens
QQDWEFLAS

SEQ ID NO: 568980 - protein, 9 aa, Homo Sapiens
VCPSNNIID

SEQ ID NO: 568981 - protein, 9 aa, Homo Sapiens
TNSVFLLWG

SEQ ID NO: 568982 - protein, 9 aa, Homo Sapiens
YLGVNEEQR

SEQ ID NO: 568983 - protein, 9 aa, Homo Sapiens
ALLTVYLEK

SEQ ID NO: 568984 - protein, 9 aa, Homo Sapiens
STLGVFGIL

SEQ ID NO: 568985 - protein, 9 aa, Homo Sapiens
FSSVDINLL

SEQ ID NO: 568986 - protein, 9 aa, Homo Sapiens
APAVTPVDE

SEQ ID NO: 568987 - protein, 9 aa, Homo Sapiens
LSELKDPMT

SEQ ID NO: 568988 - protein, 9 aa, Homo Sapiens
DPTSSDRIP

SEQ ID NO: 568989 - protein, 9 aa, Homo Sapiens
MRGNSPCWS

SEQ ID NO: 568990 - protein, 9 aa, Homo Sapiens
KDPMTEQRK

SEQ ID NO: 568991 - protein, 9 aa, Homo Sapiens
NKQSTIFPR

SEQ ID NO: 568992 - protein, 9 aa, Homo Sapiens
SDRIPGEPV

SEQ ID NO: 568993 - protein, 9 aa, Homo Sapiens
YEPPVPTRL

SEQ ID NO: 568994 - protein, 9 aa, Homo Sapiens
HLDCDAAPF

SEQ ID NO: 568995 - protein, 9 aa, Homo Sapiens
EQRRRSGPV

SEQ ID NO: 568996 - protein, 9 aa, Homo Sapiens
FLFLVAVQQ

SEQ ID NO: 568997 - protein, 9 aa, Homo Sapiens
PDISGGREI

SEQ ID NO: 568998 - protein, 9 aa, Homo Sapiens
KDIQIPHPI

SEQ ID NO: 568999 - protein, 9 aa, Homo Sapiens
PRLPGVLCD

SEQ ID NO: 569000 - protein, 9 aa, Homo Sapiens
IKLFLRIWD

SEQ ID NO: 569001 - protein, 9 aa, Homo Sapiens
ARAKTLVID

SEQ ID NO: 569002 - protein, 9 aa, Homo Sapiens
AHPELALQF

SEQ ID NO: 569003 - protein, 9 aa, Homo Sapiens
DMHQGTELS

SEQ ID NO: 569004 - protein, 9 aa, Homo Sapiens
EIKTDQQGS

SEQ ID NO: 569005 - protein, 9 aa, Homo Sapiens
LDQRCSKLR

SEQ ID NO: 569006 - protein, 9 aa, Homo Sapiens
FPPPDRRFD

SEQ ID NO: 569007 - protein, 9 aa, Homo Sapiens
FTWELHSIG

SEQ ID NO: 569008 - protein, 9 aa, Homo Sapiens
CQEGLKAGD

SEQ ID NO: 569009 - protein, 9 aa, Homo Sapiens
PLVTMTPAA

SEQ ID NO: 569010 - protein, 9 aa, Homo Sapiens
ASMCFAGRS

SEQ ID NO: 569011 - protein, 9 aa, Homo Sapiens
IPNEPTADS

SEQ ID NO: 569012 - protein, 9 aa, Homo Sapiens
YIKNLGNPP

SEQ ID NO: 569013 - protein, 9 aa, Homo Sapiens
IRGASASAR

SEQ ID NO: 569014 - protein, 9 aa, Homo Sapiens
AMPLTWVQD

SEQ ID NO: 569015 - protein, 9 aa, Homo Sapiens
QDWEFLASH

SEQ ID NO: 569016 - protein, 9 aa, Homo Sapiens
EQEQRRRSG

SEQ ID NO: 569017 - protein, 9 aa, Homo Sapiens
KMDVIFLAE

SEQ ID NO: 569018 - protein, 9 aa, Homo Sapiens
SRRSSPRPE

SEQ ID NO: 569019 - protein, 9 aa, Homo Sapiens
HRDIPTSVL

SEQ ID NO: 569020 - protein, 9 aa, Homo Sapiens
VTMTPAAPA

SEQ ID NO: 569021 - protein, 9 aa, Homo Sapiens
SNNIIDYPQ

SEQ ID NO: 569022 - protein, 9 aa, Homo Sapiens
NSPCWSSWI

SEQ ID NO: 569023 - protein, 9 aa, Homo Sapiens
YPSAGGATR

SEQ ID NO: 569024 - protein, 9 aa, Homo Sapiens
SYPSAGGAT

SEQ ID NO: 569025 - protein, 9 aa, Homo Sapiens
SEEEEEDKM

SEQ ID NO: 569026 - protein, 9 aa, Homo Sapiens
YKYNCEECR

SEQ ID NO: 569027 - protein, 9 aa, Homo Sapiens
EDEKRKAEQ

SEQ ID NO: 569028 - protein, 9 aa, Homo Sapiens
WCASRPTWA

SEQ ID NO: 569029 - protein, 9 aa, Homo Sapiens
GFGRSGCHS

SEQ ID NO: 569030 - protein, 9 aa, Homo Sapiens
FLVAVQQLS

SEQ ID NO: 569031 - protein, 9 aa, Homo Sapiens
SHRDIPTSV

SEQ ID NO: 569032 - protein, 9 aa, Homo Sapiens
FLFILASYM

SEQ ID NO: 569033 - protein, 9 aa, Homo Sapiens
STIFPRFTW

SEQ ID NO: 569034 - protein, 9 aa, Homo Sapiens
QKEDLKKKD

SEQ ID NO: 569035 - protein, 9 aa, Homo Sapiens
RTFVRYLLK

SEQ ID NO: 569036 - protein, 9 aa, Homo Sapiens
KFRNKQSTI

SEQ ID NO: 569037 - protein, 9 aa, Homo Sapiens
LSLGFGGVI

SEQ ID NO: 569038 - protein, 9 aa, Homo Sapiens
SPDISGGRE

SEQ ID NO: 569039 - protein, 9 aa, Homo Sapiens
VLVSYPSAG

SEQ ID NO: 569040 - protein, 9 aa, Homo Sapiens
MATAGSTRY

SEQ ID NO: 569041 - protein, 9 aa, Homo Sapiens
LDCDAAPFP

SEQ ID NO: 569042 - protein, 9 aa, Homo Sapiens
HRELSARFL

SEQ ID NO: 569043 - protein, 9 aa, Homo Sapiens
AAPFPMAFR

SEQ ID NO: 569044 - protein, 9 aa, Homo Sapiens
ATAGSTRYR

SEQ ID NO: 569045 - protein, 9 aa, Homo Sapiens
GAIQPNDIS

SEQ ID NO: 569046 - protein, 9 aa, Homo Sapiens
KYAKQIKFT

SEQ ID NO: 569047 - protein, 9 aa, Homo Sapiens
FVSYVAWGE

SEQ ID NO: 569048 - protein, 9 aa, Homo Sapiens
QALLTVYLE

SEQ ID NO: 569049 - protein, 9 aa, Homo Sapiens
TVHLDCDAA

SEQ ID NO: 569050 - protein, 9 aa, Homo Sapiens
LLYELEEHT

SEQ ID NO: 569051 - protein, 9 aa, Homo Sapiens
CCLQRLFTN

SEQ ID NO: 569052 - protein, 9 aa, Homo Sapiens
ALLQQFQTL

SEQ ID NO: 569053 - protein, 9 aa, Homo Sapiens
ITPFLFILA

SEQ ID NO: 569054 - protein, 9 aa, Homo Sapiens
AKIREYSEV

SEQ ID NO: 569055 - protein, 9 aa, Homo Sapiens
EKTPHLQGK

SEQ ID NO: 569056 - protein, 8 aa, Homo Sapiens
GSKERFHW

SEQ ID NO: 569057 - protein, 9 aa, Homo Sapiens
CQARFLLVG

SEQ ID NO: 569058 - protein, 9 aa, Homo Sapiens
VFMGWCIQE

SEQ ID NO: 569059 - protein, 9 aa, Homo Sapiens
KYGFSSVDI

SEQ ID NO: 569060 - protein, 9 aa, Homo Sapiens
GSHSAARRP

SEQ ID NO: 569061 - protein, 9 aa, Homo Sapiens
RAELTPQLL

SEQ ID NO: 569062 - protein, 9 aa, Homo Sapiens
SRGVSAWLR

SEQ ID NO: 569063 - protein, 9 aa, Homo Sapiens
LESRLGRSV

SEQ ID NO: 569064 - protein, 9 aa, Homo Sapiens
REPSGIRGA

SEQ ID NO: 569065 - protein, 9 aa, Homo Sapiens
GDKHEELEP

SEQ ID NO: 569066 - protein, 9 aa, Homo Sapiens
RSGCHSLSP

SEQ ID NO: 569067 - protein, 9 aa, Homo Sapiens
IFLAEMIEK

SEQ ID NO: 569068 - protein, 9 aa, Homo Sapiens
FESSRNPWT

SEQ ID NO: 569069 - protein, 9 aa, Homo Sapiens
DCDAAPFPM

SEQ ID NO: 569070 - protein, 9 aa, Homo Sapiens
HGGISSFWI

SEQ ID NO: 569071 - protein, 9 aa, Homo Sapiens
VIKNLKIKY

SEQ ID NO: 569072 - protein, 9 aa, Homo Sapiens
TPSQALLTV

SEQ ID NO: 569073 - protein, 9 aa, Homo Sapiens
IGLVFSIVF

SEQ ID NO: 569074 - protein, 9 aa, Homo Sapiens
DKHEELEPK

SEQ ID NO: 569075 - protein, 9 aa, Homo Sapiens
QDALESRLG

SEQ ID NO: 569076 - protein, 9 aa, Homo Sapiens
YGFSSVDIN

SEQ ID NO: 569077 - protein, 9 aa, Homo Sapiens
ELAGAVKEQ

SEQ ID NO: 569078 - protein, 9 aa, Homo Sapiens
MMENFPEPL

SEQ ID NO: 569079 - protein, 9 aa, Homo Sapiens
CEEDGKYEG

SEQ ID NO: 569080 - protein, 9 aa, Homo Sapiens
TLGVFGILT

SEQ ID NO: 569081 - protein, 9 aa, Homo Sapiens
HGSHYQQSA

SEQ ID NO: 569082 - protein, 9 aa, Homo Sapiens
WELFCSTLG

SEQ ID NO: 569083 - protein, 9 aa, Homo Sapiens
RQFGQQDWE

SEQ ID NO: 569084 - protein, 9 aa, Homo Sapiens
ERHGSHYQQ

SEQ ID NO: 569085 - protein, 9 aa, Homo Sapiens
FSLDGAHFP

SEQ ID NO: 569086 - protein, 9 aa, Homo Sapiens
QKWQSHRDI

SEQ ID NO: 569087 - protein, 9 aa, Homo Sapiens
AGSTRYRSW

SEQ ID NO: 569088 - protein, 9 aa, Homo Sapiens
DAHPELALQ

SEQ ID NO: 569089 - protein, 9 aa, Homo Sapiens
RREACLHVS

SEQ ID NO: 569090 - protein, 9 aa, Homo Sapiens
CATPSTPAG

SEQ ID NO: 569091 - protein, 9 aa, Homo Sapiens
KKYGFSSVD

SEQ ID NO: 569092 - protein, 9 aa, Homo Sapiens
LPHGNPSTQ

SEQ ID NO: 569093 - protein, 9 aa, Homo Sapiens
ANFQTHRRE

SEQ ID NO: 569094 - protein, 9 aa, Homo Sapiens
CSKLRVVGG

SEQ ID NO: 569095 - protein, 9 aa, Homo Sapiens
QHLPAFPRL

SEQ ID NO: 569096 - protein, 9 aa, Homo Sapiens
IPLGEDDPR

SEQ ID NO: 569097 - protein, 9 aa, Homo Sapiens
IKNLGNPPQ

SEQ ID NO: 569098 - protein, 9 aa, Homo Sapiens
LIKFRNKQS

SEQ ID NO: 569099 - protein, 9 aa, Homo Sapiens
SGGRSPPPL

SEQ ID NO: 569100 - protein, 9 aa, Homo Sapiens
VHLDCDAAP

SEQ ID NO: 569101 - protein, 9 aa, Homo Sapiens
DLIRERLTV

SEQ ID NO: 569102 - protein, 9 aa, Homo Sapiens
LVFSIVFMG

SEQ ID NO: 569103 - protein, 9 aa, Homo Sapiens
RVDRLDQRC

SEQ ID NO: 569104 - protein, 9 aa, Homo Sapiens
LFILASYMH

SEQ ID NO: 569105 - protein, 9 aa, Homo Sapiens
PAGTRTPRT

SEQ ID NO: 569106 - protein, 9 aa, Homo Sapiens
RPPWFLPCA

SEQ ID NO: 569107 - protein, 9 aa, Homo Sapiens
EFIEEAQPG

SEQ ID NO: 569108 - protein, 9 aa, Homo Sapiens
FFLFLVAVQ

SEQ ID NO: 569109 - protein, 9 aa, Homo Sapiens
GNSPCWSSW

SEQ ID NO: 569110 - protein, 9 aa, Homo Sapiens
SIVFMGWCI

SEQ ID NO: 569111 - protein, 9 aa, Homo Sapiens
LFESSRNPW

SEQ ID NO: 569112 - protein, 9 aa, Homo Sapiens
CQSQFNTFS

SEQ ID NO: 569113 - protein, 9 aa, Homo Sapiens
PHGNPSTQL

SEQ ID NO: 569114 - protein, 9 aa, Homo Sapiens
SEDSSSEEE

SEQ ID NO: 569115 - protein, 9 aa, Homo Sapiens
LGKKKKKTK

SEQ ID NO: 569116 - protein, 9 aa, Homo Sapiens
VSYVAWGEL

SEQ ID NO: 569117 - protein, 9 aa, Homo Sapiens
RRISVSSPG

SEQ ID NO: 569118 - protein, 9 aa, Homo Sapiens
LKKKDNTNL

SEQ ID NO: 569119 - protein, 9 aa, Homo Sapiens
GLLYELEEH

SEQ ID NO: 569120 - protein, 9 aa, Homo Sapiens
YLTNDEEDD

SEQ ID NO: 569121 - protein, 9 aa, Homo Sapiens
DRIPGEPVP

SEQ ID NO: 569122 - protein, 9 aa, Homo Sapiens
PSNNIIDYP

SEQ ID NO: 569123 - protein, 9 aa, Homo Sapiens
FGRSGCHSL

SEQ ID NO: 569124 - protein, 9 aa, Homo Sapiens
PNEPTADSS

SEQ ID NO: 569125 - protein, 9 aa, Homo Sapiens
AGERHGSHY

SEQ ID NO: 569126 - protein, 9 aa, Homo Sapiens
LDGAHFPDR

SEQ ID NO: 569127 - protein, 9 aa, Homo Sapiens
KAAAATNTS

SEQ ID NO: 569128 - protein, 9 aa, Homo Sapiens
EHRELSARF

SEQ ID NO: 569129 - protein, 9 aa, Homo Sapiens
AEPSPQAKQ

SEQ ID NO: 569130 - protein, 9 aa, Homo Sapiens
GFPPPDRRF

SEQ ID NO: 569131 - protein, 9 aa, Homo Sapiens
NEEQRKNFQ

SEQ ID NO: 569132 - protein, 9 aa, Homo Sapiens
EHTEKAVEC

SEQ ID NO: 569133 - protein, 9 aa, Homo Sapiens
GTVHLDCDA

SEQ ID NO: 569134 - protein, 9 aa, Homo Sapiens
CAFSDGYVC

SEQ ID NO: 569135 - protein, 9 aa, Homo Sapiens
SLRLPHQER

SEQ ID NO: 569136 - protein, 9 aa, Homo Sapiens
LRDMHQGTE

SEQ ID NO: 569137 - protein, 9 aa, Homo Sapiens
VILCNSVDL

SEQ ID NO: 569138 - protein, 9 aa, Homo Sapiens
REITALVSR

SEQ ID NO: 569139 - protein, 9 aa, Homo Sapiens
YRSWSGCSR

SEQ ID NO: 569140 - protein, 9 aa, Homo Sapiens
EETSAEPSP

SEQ ID NO: 569141 - protein, 9 aa, Homo Sapiens
LIKQFVSYV

SEQ ID NO: 569142 - protein, 9 aa, Homo Sapiens
KNLKIKYRH

SEQ ID NO: 569143 - protein, 9 aa, Homo Sapiens
GSLEKAAAA

SEQ ID NO: 569144 - protein, 9 aa, Homo Sapiens
SSPRPETSC

SEQ ID NO: 569145 - protein, 9 aa, Homo Sapiens
FLPCAFSDG

SEQ ID NO: 569146 - protein, 9 aa, Homo Sapiens
GSTRYRSWS

SEQ ID NO: 569147 - protein, 9 aa, Homo Sapiens
NSVFLLWGC

SEQ ID NO: 569148 - protein, 9 aa, Homo Sapiens
LNAGQIPLG

SEQ ID NO: 569149 - protein, 9 aa, Homo Sapiens
HQSKDIQIP

SEQ ID NO: 569150 - protein, 9 aa, Homo Sapiens
QTGFPPPDR

SEQ ID NO: 569151 - protein, 9 aa, Homo Sapiens
LHSIGLVFS

SEQ ID NO: 569152 - protein, 9 aa, Homo Sapiens
LPLSLTPES

SEQ ID NO: 569153 - protein, 9 aa, Homo Sapiens
GRMKREITA

SEQ ID NO: 569154 - protein, 9 aa, Homo Sapiens
VYVPSFLYK

SEQ ID NO: 569155 - protein, 9 aa, Homo Sapiens
SPACQEGLK

SEQ ID NO: 569156 - protein, 9 aa, Homo Sapiens
MKNTEKCGG

SEQ ID NO: 569157 - protein, 9 aa, Homo Sapiens
AGRSGGRSP

SEQ ID NO: 569158 - protein, 9 aa, Homo Sapiens
DSHGSAGQG

SEQ ID NO: 569159 - protein, 9 aa, Homo Sapiens
QEGLKAGDL

SEQ ID NO: 569160 - protein, 9 aa, Homo Sapiens
EQRKNFQTI

SEQ ID NO: 569161 - protein, 9 aa, Homo Sapiens
AEQEARRRI

SEQ ID NO: 569162 - protein, 9 aa, Homo Sapiens
AVQQLSFLG

SEQ ID NO: 569163 - protein, 9 aa, Homo Sapiens
QRCSKLRVV

SEQ ID NO: 569164 - protein, 9 aa, Homo Sapiens
LLAEQNRGK

SEQ ID NO: 569165 - protein, 9 aa, Homo Sapiens
QQLSFLGCC

SEQ ID NO: 569166 - protein, 9 aa, Homo Sapiens
GQGDKHEEL

SEQ ID NO: 569167 - protein, 9 aa, Homo Sapiens
FLIKFRNKQ

SEQ ID NO: 569168 - protein, 9 aa, Homo Sapiens
EGSPACQEG

SEQ ID NO: 569169 - protein, 9 aa, Homo Sapiens
GGCMRGNSP

SEQ ID NO: 569170 - protein, 9 aa, Homo Sapiens
TPESLFRTV

SEQ ID NO: 569171 - protein, 9 aa, Homo Sapiens
PPVPTRLGK

SEQ ID NO: 569172 - protein, 9 aa, Homo Sapiens
SGSHSAARR

SEQ ID NO: 569173 - protein, 9 aa, Homo Sapiens
PCAFSDGYV

SEQ ID NO: 569174 - protein, 9 aa, Homo Sapiens
SQHLPAFPR

SEQ ID NO: 569175 - protein, 9 aa, Homo Sapiens
CGQRAIYYS

SEQ ID NO: 569176 - protein, 9 aa, Homo Sapiens
LAEQNRGKF

SEQ ID NO: 569177 - protein, 9 aa, Homo Sapiens
QTHRREACL

SEQ ID NO: 569178 - protein, 9 aa, Homo Sapiens
TELSRMGVS

SEQ ID NO: 569179 - protein, 9 aa, Homo Sapiens
SSEEEEEDK

SEQ ID NO: 569180 - protein, 9 aa, Homo Sapiens
GSAGQGDKH

SEQ ID NO: 569181 - protein, 9 aa, Homo Sapiens
EEDDSHGSA

SEQ ID NO: 569182 - protein, 9 aa, Homo Sapiens
YSLGMTGIP

SEQ ID NO: 569183 - protein, 9 aa, Homo Sapiens
LGVNEEQRK

SEQ ID NO: 569184 - protein, 9 aa, Homo Sapiens
KIDAHPELA

SEQ ID NO: 569185 - protein, 9 aa, Homo Sapiens
KAMPLTWVQ

SEQ ID NO: 569186 - protein, 9 aa, Homo Sapiens
NSVDLIRER

SEQ ID NO: 569187 - protein, 9 aa, Homo Sapiens
NCEECRSKQ

SEQ ID NO: 569188 - protein, 9 aa, Homo Sapiens
PLPFWELFC

SEQ ID NO: 569189 - protein, 9 aa, Homo Sapiens
RTSSASRSM

SEQ ID NO: 569190 - protein, 9 aa, Homo Sapiens
QQQQLALLQ

SEQ ID NO: 569191 - protein, 9 aa, Homo Sapiens
TNDEEDDSH

SEQ ID NO: 569192 - protein, 9 aa, Homo Sapiens
IIDYPQMAP

SEQ ID NO: 569193 - protein, 9 aa, Homo Sapiens
IGAIQPNDI

SEQ ID NO: 569194 - protein, 9 aa, Homo Sapiens
KEDLKKKDN

SEQ ID NO: 569195 - protein, 9 aa, Homo Sapiens
FQSLGERTF

SEQ ID NO: 569196 - protein, 9 aa, Homo Sapiens
LTPESLFRT

SEQ ID NO: 569197 - protein, 9 aa, Homo Sapiens
HYKHEDAKA

SEQ ID NO: 569198 - protein, 9 aa, Homo Sapiens
VRSTGIPNE

SEQ ID NO: 569199 - protein, 9 aa, Homo Sapiens
RGASASARV

SEQ ID NO: 569200 - protein, 9 aa, Homo Sapiens
TCGQRAIYY

SEQ ID NO: 569201 - protein, 9 aa, Homo Sapiens
SPRPETSCA

SEQ ID NO: 569202 - protein, 9 aa, Homo Sapiens
SGGREIFKP

SEQ ID NO: 569203 - protein, 9 aa, Homo Sapiens
MFQSLGERT

SEQ ID NO: 569204 - protein, 9 aa, Homo Sapiens
QGVIKNLKI

SEQ ID NO: 569205 - protein, 9 aa, Homo Sapiens
GQRAIYYSL

SEQ ID NO: 569206 - protein, 9 aa, Homo Sapiens
LTAKIREYS

SEQ ID NO: 569207 - protein, 9 aa, Homo Sapiens
YKIMTKYDK

SEQ ID NO: 569208 - protein, 9 aa, Homo Sapiens
TSSDRIPGE

SEQ ID NO: 569209 - protein, 9 aa, Homo Sapiens
WTTTVELPL

SEQ ID NO: 569210 - protein, 9 aa, Homo Sapiens
ASRSMATAG

SEQ ID NO: 569211 - protein, 9 aa, Homo Sapiens
NFQTHRREA

SEQ ID NO: 569212 - protein, 9 aa, Homo Sapiens
VGAVWTPPS

SEQ ID NO: 569213 - protein, 9 aa, Homo Sapiens
QERRQMGDL

SEQ ID NO: 569214 - protein, 9 aa, Homo Sapiens
LAGAVKEQY

SEQ ID NO: 569215 - protein, 9 aa, Homo Sapiens
IHGGISSFW

SEQ ID NO: 569216 - protein, 9 aa, Homo Sapiens
IFPRFTWEL

SEQ ID NO: 569217 - protein, 9 aa, Homo Sapiens
MAFRYLTND

SEQ ID NO: 569218 - protein, 9 aa, Homo Sapiens
EYKYNCEEC

SEQ ID NO: 569219 - protein, 9 aa, Homo Sapiens
HSAARRPSS

SEQ ID NO: 569220 - protein, 9 aa, Homo Sapiens
RRRSGPVTA

SEQ ID NO: 569221 - protein, 9 aa, Homo Sapiens
LRPVGAVWT

SEQ ID NO: 569222 - protein, 9 aa, Homo Sapiens
VRIHGGISS

SEQ ID NO: 569223 - protein, 9 aa, Homo Sapiens
GRSPPPLLF

SEQ ID NO: 569224 - protein, 9 aa, Homo Sapiens
QEQRRRSGP

SEQ ID NO: 569225 - protein, 9 aa, Homo Sapiens
QLLKILHSQ

SEQ ID NO: 569226 - protein, 9 aa, Homo Sapiens
LEMMENFPE

SEQ ID NO: 569227 - protein, 9 aa, Homo Sapiens
SLGERTFVR

SEQ ID NO: 569228 - protein, 9 aa, Homo Sapiens
SSVDINLLV

SEQ ID NO: 569229 - protein, 9 aa, Homo Sapiens
SKMDQGSNA

SEQ ID NO: 569230 - protein, 9 aa, Homo Sapiens
DALESRLGR

SEQ ID NO: 569231 - protein, 9 aa, Homo Sapiens
AHRDFSAEC

SEQ ID NO: 569232 - protein, 9 aa, Homo Sapiens
CFPKAMETT

SEQ ID NO: 569233 - protein, 9 aa, Homo Sapiens
DYPQMAPVA

SEQ ID NO: 569234 - protein, 9 aa, Homo Sapiens
AVWTPPSSA

SEQ ID NO: 569235 - protein, 9 aa, Homo Sapiens
RDMHQGTEL

SEQ ID NO: 569236 - protein, 9 aa, Homo Sapiens
LFSLDGAHF

SEQ ID NO: 569237 - protein, 9 aa, Homo Sapiens
EPLSENELL

SEQ ID NO: 569238 - protein, 9 aa, Homo Sapiens
FLSKPSCFP

SEQ ID NO: 569239 - protein, 9 aa, Homo Sapiens
LSARFLIVT

SEQ ID NO: 569240 - protein, 9 aa, Homo Sapiens
FNTFSISKI

SEQ ID NO: 569241 - protein, 9 aa, Homo Sapiens
ALVSRVGHE

SEQ ID NO: 569242 - protein, 9 aa, Homo Sapiens
SGIRGASAS

SEQ ID NO: 569243 - protein, 9 aa, Homo Sapiens
SGSLEKAAA

SEQ ID NO: 569244 - protein, 9 aa, Homo Sapiens
SPCWSSWIP

SEQ ID NO: 569245 - protein, 9 aa, Homo Sapiens
GKTSIISLF

SEQ ID NO: 569246 - protein, 9 aa, Homo Sapiens
ERTFVRYLL

SEQ ID NO: 569247 - protein, 9 aa, Homo Sapiens
PSCFPKAME

SEQ ID NO: 569248 - protein, 9 aa, Homo Sapiens
PRTSSASRS

SEQ ID NO: 569249 - protein, 9 aa, Homo Sapiens
LTVYLEKKQ

SEQ ID NO: 569250 - protein, 9 aa, Homo Sapiens
VVSIQSYIK

SEQ ID NO: 569251 - protein, 9 aa, Homo Sapiens
SLFRTVVFP

SEQ ID NO: 569252 - protein, 9 aa, Homo Sapiens
TCTSQKVVC

SEQ ID NO: 569253 - protein, 9 aa, Homo Sapiens
FPMAFRYLT

SEQ ID NO: 569254 - protein, 9 aa, Homo Sapiens
LCSEYKYNC

SEQ ID NO: 569255 - protein, 9 aa, Homo Sapiens
MKREITALV

SEQ ID NO: 569256 - protein, 9 aa, Homo Sapiens
QAEVRSRRI

SEQ ID NO: 569257 - protein, 9 aa, Homo Sapiens
KHEELEPKN

SEQ ID NO: 569258 - protein, 9 aa, Homo Sapiens
PQAKQLKLK

SEQ ID NO: 569259 - protein, 9 aa, Homo Sapiens
HPIDACEKG

SEQ ID NO: 569260 - protein, 9 aa, Homo Sapiens
SAGQGDKHE

SEQ ID NO: 569261 - protein, 9 aa, Homo Sapiens
SWTTTVELP

SEQ ID NO: 569262 - protein, 9 aa, Homo Sapiens
SCATPSTPA

SEQ ID NO: 569263 - protein, 9 aa, Homo Sapiens
SAGGATRPS

SEQ ID NO: 569264 - protein, 9 aa, Homo Sapiens
GCSRGVSAW

SEQ ID NO: 569265 - protein, 9 aa, Homo Sapiens
RGNSPCWSS

SEQ ID NO: 569266 - protein, 9 aa, Homo Sapiens
LPCAFSDGY

SEQ ID NO: 569267 - protein, 9 aa, Homo Sapiens
ELFCSTLGV

SEQ ID NO: 569268 - protein, 9 aa, Homo Sapiens
QRRRSGPVT

SEQ ID NO: 569269 - protein, 9 aa, Homo Sapiens
HGSAGQGDK

SEQ ID NO: 569270 - protein, 9 aa, Homo Sapiens
WASGSHSAA

SEQ ID NO: 569271 - protein, 9 aa, Homo Sapiens
AEFIEEAQP

SEQ ID NO: 569272 - protein, 9 aa, Homo Sapiens
KEGNEHREL

SEQ ID NO: 569273 - protein, 9 aa, Homo Sapiens
SPPPLLFES

SEQ ID NO: 569274 - protein, 9 aa, Homo Sapiens
WTPPSSASM

SEQ ID NO: 569275 - protein, 9 aa, Homo Sapiens
RLPGVLCDS

SEQ ID NO: 569276 - protein, 9 aa, Homo Sapiens
TEKCGGCMR

SEQ ID NO: 569277 - protein, 9 aa, Homo Sapiens
KKKDNTNLF

SEQ ID NO: 569278 - protein, 9 aa, Homo Sapiens
LVTMTPAAP

SEQ ID NO: 569279 - protein, 9 aa, Homo Sapiens
GIPNEPTAD

SEQ ID NO: 569280 - protein, 9 aa, Homo Sapiens
VDRLDQRCS

SEQ ID NO: 569281 - protein, 9 aa, Homo Sapiens
TRYRSWSGC

SEQ ID NO: 569282 - protein, 9 aa, Homo Sapiens
QEHQSKDIQ

SEQ ID NO: 569283 - protein, 9 aa, Homo Sapiens
ATYLELAGA

SEQ ID NO: 569284 - protein, 9 aa, Homo Sapiens
GVFGILTEN

SEQ ID NO: 569285 - protein, 9 aa, Homo Sapiens
DEEDDSHGS

SEQ ID NO: 569286 - protein, 9 aa, Homo Sapiens
SAARRPSSR

SEQ ID NO: 569287 - protein, 9 aa, Homo Sapiens
VELPLSLTP

SEQ ID NO: 569288 - protein, 9 aa, Homo Sapiens
DFSAECEED

SEQ ID NO: 569289 - protein, 9 aa, Homo Sapiens
TAGSTRYRS

SEQ ID NO: 569290 - protein, 9 aa, Homo Sapiens
CNSVDLIRE

SEQ ID NO: 569291 - protein, 9 aa, Homo Sapiens
PMLRFVYVP

SEQ ID NO: 569292 - protein, 9 aa, Homo Sapiens
ATPSTPAGT

SEQ ID NO: 569293 - protein, 9 aa, Homo Sapiens
LWGCQARFL

SEQ ID NO: 569294 - protein, 9 aa, Homo Sapiens
DTPSQALLT

SEQ ID NO: 569295 - protein, 9 aa, Homo Sapiens
DGAHFPDRE

SEQ ID NO: 569296 - protein, 9 aa, Homo Sapiens
PETSCATPS

SEQ ID NO: 569297 - protein, 9 aa, Homo Sapiens
VFDILKSAE

SEQ ID NO: 569298 - protein, 9 aa, Homo Sapiens
VARAKTLVI

SEQ ID NO: 569299 - protein, 9 aa, Homo Sapiens
GPVTAWWCA

SEQ ID NO: 569300 - protein, 9 aa, Homo Sapiens
AKQIKFTLF

SEQ ID NO: 569301 - protein, 9 aa, Homo Sapiens
PQLLKILHS

SEQ ID NO: 569302 - protein, 9 aa, Homo Sapiens
LGCCLQRLF

SEQ ID NO: 569303 - protein, 9 aa, Homo Sapiens
PPLLFESSR

SEQ ID NO: 569304 - protein, 9 aa, Homo Sapiens
DDSHGSAGQ

SEQ ID NO: 569305 - protein, 9 aa, Homo Sapiens
WSGCSRGVS

SEQ ID NO: 569306 - protein, 9 aa, Homo Sapiens
SFLGCCLQR

SEQ ID NO: 569307 - protein, 9 aa, Homo Sapiens
TDQQGSLFS

SEQ ID NO: 569308 - protein, 9 aa, Homo Sapiens
FPEPLSENE

SEQ ID NO: 569309 - protein, 9 aa, Homo Sapiens
AEQFLIKFR

SEQ ID NO: 569310 - protein, 9 aa, Homo Sapiens
FCQSQFNTF

SEQ ID NO: 569311 - protein, 9 aa, Homo Sapiens
IMTKYDKSG

SEQ ID NO: 569312 - protein, 9 aa, Homo Sapiens
SGPVTAWWC

SEQ ID NO: 569313 - protein, 9 aa, Homo Sapiens
EPSPQAKQL

SEQ ID NO: 569314 - protein, 9 aa, Homo Sapiens
FVYVPSFLY

SEQ ID NO: 569315 - protein, 9 aa, Homo Sapiens
SVDINLLVA

SEQ ID NO: 569316 - protein, 9 aa, Homo Sapiens
FAGRSGGRS

SEQ ID NO: 569317 - protein, 9 aa, Homo Sapiens
DRRFDAYCF

SEQ ID NO: 569318 - protein, 9 aa, Homo Sapiens
PIDACEKGT

SEQ ID NO: 569319 - protein, 9 aa, Homo Sapiens
EMKAEFIEE

SEQ ID NO: 569320 - protein, 9 aa, Homo Sapiens
KDCHEKYAK

SEQ ID NO: 569321 - protein, 9 aa, Homo Sapiens
SASMCFAGR

SEQ ID NO: 569322 - protein, 9 aa, Homo Sapiens
TVELPLSLT

SEQ ID NO: 569323 - protein, 9 aa, Homo Sapiens
EKCGGCMRG

SEQ ID NO: 569324 - protein, 9 aa, Homo Sapiens
TLCSEYKYN

SEQ ID NO: 569325 - protein, 9 aa, Homo Sapiens
DACEKGTVH

SEQ ID NO: 569326 - protein, 9 aa, Homo Sapiens
AFSDGYVCI

SEQ ID NO: 569327 - protein, 9 aa, Homo Sapiens
IKNLKIKYR

SEQ ID NO: 569328 - protein, 9 aa, Homo Sapiens
RRFDAYCFK

SEQ ID NO: 569329 - protein, 9 aa, Homo Sapiens
LKSAELVCL

SEQ ID NO: 569330 - protein, 9 aa, Homo Sapiens
KTLVIDIMD

SEQ ID NO: 569331 - protein, 9 aa, Homo Sapiens
PKMLATLWL

SEQ ID NO: 569332 - protein, 9 aa, Homo Sapiens
ACQEGLKAG

SEQ ID NO: 569333 - protein, 9 aa, Homo Sapiens
RYLTNDEED

SEQ ID NO: 569334 - protein, 9 aa, Homo Sapiens
VSAWLRPVG

SEQ ID NO: 569335 - protein, 9 aa, Homo Sapiens
STPAGTRTP

SEQ ID NO: 569336 - protein, 9 aa, Homo Sapiens
GGRSPPPLL

SEQ ID NO: 569337 - protein, 9 aa, Homo Sapiens
CSEYKYNCE

SEQ ID NO: 569338 - protein, 9 aa, Homo Sapiens
EDLKKKDNT

SEQ ID NO: 569339 - protein, 9 aa, Homo Sapiens
VRSRRISVS

SEQ ID NO: 569340 - protein, 9 aa, Homo Sapiens
MKAEFIEEA

SEQ ID NO: 569341 - protein, 9 aa, Homo Sapiens
WFLPCAFSD

SEQ ID NO: 569342 - protein, 9 aa, Homo Sapiens
GLVFSIVFM

SEQ ID NO: 569343 - protein, 9 aa, Homo Sapiens
RAKTLVIDI

SEQ ID NO: 569344 - protein, 9 aa, Homo Sapiens
LQTSRLPHG

SEQ ID NO: 569345 - protein, 9 aa, Homo Sapiens
LSFLGCCLQ

SEQ ID NO: 569346 - protein, 9 aa, Homo Sapiens
IVIGAIQPN

SEQ ID NO: 569347 - protein, 9 aa, Homo Sapiens
DPMTEQRKQ

SEQ ID NO: 569348 - protein, 9 aa, Homo Sapiens
WSPDISGGR

SEQ ID NO: 569349 - protein, 9 aa, Homo Sapiens
SAQVFDILK

SEQ ID NO: 569350 - protein, 9 aa, Homo Sapiens
EQFLIKFRN

SEQ ID NO: 569351 - protein, 9 aa, Homo Sapiens
SSDRIPGEP

SEQ ID NO: 569352 - protein, 9 aa, Homo Sapiens
RFVYVPSFL

SEQ ID NO: 569353 - protein, 9 aa, Homo Sapiens
SIISLFMYN

SEQ ID NO: 569354 - protein, 9 aa, Homo Sapiens
KLFLRIWDL

SEQ ID NO: 569355 - protein, 9 aa, Homo Sapiens
TSQKVVCFF

SEQ ID NO: 569356 - protein, 9 aa, Homo Sapiens
GTRTPRTSS

SEQ ID NO: 569357 - protein, 9 aa, Homo Sapiens
AGTRTPRTS

SEQ ID NO: 569358 - protein, 9 aa, Homo Sapiens
AIYYSLGMT

SEQ ID NO: 569359 - protein, 9 aa, Homo Sapiens
PTRLGKKKK

SEQ ID NO: 569360 - protein, 9 aa, Homo Sapiens
CEKGTVHLD

SEQ ID NO: 569361 - protein, 9 aa, Homo Sapiens
YKHEDAKAM

SEQ ID NO: 569362 - protein, 9 aa, Homo Sapiens
QSQFNTFSI

SEQ ID NO: 569363 - protein, 9 aa, Homo Sapiens
SAECEEDGK

SEQ ID NO: 569364 - protein, 9 aa, Homo Sapiens
GPTPLPFWE

SEQ ID NO: 569365 - protein, 9 aa, Homo Sapiens
LFSWTTTVE

SEQ ID NO: 569366 - protein, 9 aa, Homo Sapiens
SDSEDSSSE

SEQ ID NO: 569367 - protein, 9 aa, Homo Sapiens
ERRQMGDLQ

SEQ ID NO: 569368 - protein, 9 aa, Homo Sapiens
PSQALLTVY

SEQ ID NO: 569369 - protein, 9 aa, Homo Sapiens
LLTVYLEKK

SEQ ID NO: 569370 - protein, 9 aa, Homo Sapiens
CPSNNIIDY

SEQ ID NO: 569371 - protein, 9 aa, Homo Sapiens
FLRIWDLFF

SEQ ID NO: 569372 - protein, 9 aa, Homo Sapiens
TPAGTRTPR

SEQ ID NO: 569373 - protein, 9 aa, Homo Sapiens
PPSSASMCF

SEQ ID NO: 569374 - protein, 9 aa, Homo Sapiens
PSWSPDISG

SEQ ID NO: 569375 - protein, 9 aa, Homo Sapiens
RFTWELHSI

SEQ ID NO: 569376 - protein, 9 aa, Homo Sapiens
LFRTVVFPI

SEQ ID NO: 569377 - protein, 9 aa, Homo Sapiens
LQRLFTNSV

SEQ ID NO: 569378 - protein, 9 aa, Homo Sapiens
GVNEEQRKN

SEQ ID NO: 569379 - protein, 9 aa, Homo Sapiens
LVARAKTLV

SEQ ID NO: 569380 - protein, 9 aa, Homo Sapiens
APFPMAFRY

SEQ ID NO: 569381 - protein, 9 aa, Homo Sapiens
HTEKAVECY

SEQ ID NO: 569382 - protein, 9 aa, Homo Sapiens
RIYLGVNEE

SEQ ID NO: 569383 - protein, 9 aa, Homo Sapiens
GQLSELKDP

SEQ ID NO: 569384 - protein, 9 aa, Homo Sapiens
FFLSKPSCF

SEQ ID NO: 569385 - protein, 9 aa, Homo Sapiens
TPSTPAGTR

SEQ ID NO: 569386 - protein, 9 aa, Homo Sapiens
DIPTSVLLR

SEQ ID NO: 569387 - protein, 9 aa, Homo Sapiens
TVPKMLATL

SEQ ID NO: 569388 - protein, 9 aa, Homo Sapiens
KREITALVS

SEQ ID NO: 569389 - protein, 9 aa, Homo Sapiens
MDVIFLAEM

SEQ ID NO: 569390 - protein, 9 aa, Homo Sapiens
QIPLGEDDP

SEQ ID NO: 569391 - protein, 9 aa, Homo Sapiens
SVFLLWGCQ

SEQ ID NO: 569392 - protein, 9 aa, Homo Sapiens
TQVFFALSL

SEQ ID NO: 569393 - protein, 9 aa, Homo Sapiens
TPPSSASMC

SEQ ID NO: 569394 - protein, 9 aa, Homo Sapiens
FALSLGFGG

SEQ ID NO: 569395 - protein, 9 aa, Homo Sapiens
DIKLFLRIW

SEQ ID NO: 569396 - protein, 9 aa, Homo Sapiens
LFCQSQFNT

SEQ ID NO: 569397 - protein, 9 aa, Homo Sapiens
FQTHRREAC

SEQ ID NO: 569398 - protein, 9 aa, Homo Sapiens
KAEQEARRR

SEQ ID NO: 569399 - protein, 9 aa, Homo Sapiens
HRREACLHV

SEQ ID NO: 569400 - protein, 9 aa, Homo Sapiens
RELSARFLI

SEQ ID NO: 569401 - protein, 9 aa, Homo Sapiens
NRGKFFTVY

SEQ ID NO: 569402 - protein, 9 aa, Homo Sapiens
LELAGAVKE

SEQ ID NO: 569403 - protein, 9 aa, Homo Sapiens
WWCASRPTW

SEQ ID NO: 569404 - protein, 9 aa, Homo Sapiens
PDRRFDAYC

SEQ ID NO: 569405 - protein, 9 aa, Homo Sapiens
RGKFFTVYK

SEQ ID NO: 569406 - protein, 9 aa, Homo Sapiens
TPRTSSASR

SEQ ID NO: 569407 - protein, 9 aa, Homo Sapiens
IYYSLGMTG

SEQ ID NO: 569408 - protein, 9 aa, Homo Sapiens
IEEAQPGKK

SEQ ID NO: 569409 - protein, 9 aa, Homo Sapiens
ATLWLHAGE

SEQ ID NO: 569410 - protein, 9 aa, Homo Sapiens
ALESRLGRS

SEQ ID NO: 569411 - protein, 9 aa, Homo Sapiens
WGCQARFLL

SEQ ID NO: 569412 - protein, 9 aa, Homo Sapiens
VSIQSYIKN

SEQ ID NO: 569413 - protein, 9 aa, Homo Sapiens
CASRPTWAS

SEQ ID NO: 569414 - protein, 9 aa, Homo Sapiens
ETSCATPST

SEQ ID NO: 569415 - protein, 9 aa, Homo Sapiens
RTPRTSSAS

SEQ ID NO: 569416 - protein, 9 aa, Homo Sapiens
DKMDVIFLA

SEQ ID NO: 569417 - protein, 9 aa, Homo Sapiens
FSWTTTVEL

SEQ ID NO: 569418 - protein, 9 aa, Homo Sapiens
QFLIKFRNK

SEQ ID NO: 569419 - protein, 9 aa, Homo Sapiens
FRTVVFPII

SEQ ID NO: 569420 - protein, 9 aa, Homo Sapiens
MTKYDKSGR

SEQ ID NO: 569421 - protein, 9 aa, Homo Sapiens
QVFDILKSA

SEQ ID NO: 569422 - protein, 9 aa, Homo Sapiens
HQERRQMGD

SEQ ID NO: 569423 - protein, 9 aa, Homo Sapiens
MATAVAAAL

SEQ ID NO: 569424 - protein, 9 aa, Homo Sapiens
LQDALESRL

SEQ ID NO: 569425 - protein, 9 aa, Homo Sapiens
RDIPTSVLL

SEQ ID NO: 569426 - protein, 9 aa, Homo Sapiens
EKRKAEQEA

SEQ ID NO: 569427 - protein, 9 aa, Homo Sapiens
TAVPYFSTL

SEQ ID NO: 569428 - protein, 9 aa, Homo Sapiens
QAVQHVEIG

SEQ ID NO: 569429 - protein, 9 aa, Homo Sapiens
IFLSPDQPA

SEQ ID NO: 569430 - protein, 9 aa, Homo Sapiens
VQHVEIGPS

SEQ ID NO: 569431 - protein, 9 aa, Homo Sapiens
FVTVGIVAA

SEQ ID NO: 569432 - protein, 9 aa, Homo Sapiens
SLAVCEEYS

SEQ ID NO: 569433 - protein, 9 aa, Homo Sapiens
MLLLQGYSQ

SEQ ID NO: 569434 - protein, 9 aa, Homo Sapiens
LEAKNKPDV

SEQ ID NO: 569435 - protein, 9 aa, Homo Sapiens
RYFEGFCLA

SEQ ID NO: 569436 - protein, 9 aa, Homo Sapiens
TMFSTLRYF

SEQ ID NO: 569437 - protein, 9 aa, Homo Sapiens
EDGKYGAQN

SEQ ID NO: 569438 - protein, 9 aa, Homo Sapiens
MPELRYVVS

SEQ ID NO: 569439 - protein, 9 aa, Homo Sapiens
AAGAMARVP

SEQ ID NO: 569440 - protein, 9 aa, Homo Sapiens
ITPLLEDAL

SEQ ID NO: 569441 - protein, 9 aa, Homo Sapiens
AMSQGGHLM

SEQ ID NO: 569442 - protein, 9 aa, Homo Sapiens
KSCVAVSFA

SEQ ID NO: 569443 - protein, 9 aa, Homo Sapiens
STTDCGGSK

SEQ ID NO: 569444 - protein, 9 aa, Homo Sapiens
HDLVFSFGD

SEQ ID NO: 569445 - protein, 9 aa, Homo Sapiens
CEIERDPCL

SEQ ID NO: 569446 - protein, 9 aa, Homo Sapiens
KTAVPYFST

SEQ ID NO: 569447 - protein, 9 aa, Homo Sapiens
YAITPLLED

SEQ ID NO: 569448 - protein, 9 aa, Homo Sapiens
GSPGSMGKL

SEQ ID NO: 569449 - protein, 9 aa, Homo Sapiens
ISCPRNPDL

SEQ ID NO: 569450 - protein, 9 aa, Homo Sapiens
KVYDQMPEL

SEQ ID NO: 569451 - protein, 9 aa, Homo Sapiens
RAWWPLQGT

SEQ ID NO: 569452 - protein, 9 aa, Homo Sapiens
IKEKQVWVF

SEQ ID NO: 569453 - protein, 9 aa, Homo Sapiens
YPLLVHTDL

SEQ ID NO: 569454 - protein, 9 aa, Homo Sapiens
GSEQRPKLF

SEQ ID NO: 569455 - protein, 9 aa, Homo Sapiens
DHDLVFSFG

SEQ ID NO: 569456 - protein, 9 aa, Homo Sapiens
ERDPCLEAK

SEQ ID NO: 569457 - protein, 9 aa, Homo Sapiens
QEQVRAMSQ

SEQ ID NO: 569458 - protein, 9 aa, Homo Sapiens
RYKELLLKK

SEQ ID NO: 569459 - protein, 9 aa, Homo Sapiens
THSKSCVAV

SEQ ID NO: 569460 - protein, 9 aa, Homo Sapiens
EVFFDVELP

SEQ ID NO: 569461 - protein, 9 aa, Homo Sapiens
NWESGYFVG

SEQ ID NO: 569462 - protein, 9 aa, Homo Sapiens
GVNWESGYF

SEQ ID NO: 569463 - protein, 9 aa, Homo Sapiens
SNGFGNAHS

SEQ ID NO: 569464 - protein, 9 aa, Homo Sapiens
GKDYIYAIT

SEQ ID NO: 569465 - protein, 9 aa, Homo Sapiens
CLEAKNKPD

SEQ ID NO: 569466 - protein, 9 aa, Homo Sapiens
STSVEILAA

SEQ ID NO: 569467 - protein, 9 aa, Homo Sapiens
FVGIKRQRR

SEQ ID NO: 569468 - protein, 9 aa, Homo Sapiens
VRAMSQGGH

SEQ ID NO: 569469 - protein, 9 aa, Homo Sapiens
TLRYFEGFC

SEQ ID NO: 569470 - protein, 9 aa, Homo Sapiens
VCEEYSARP

SEQ ID NO: 569471 - protein, 9 aa, Homo Sapiens
SKDHPLTCD

SEQ ID NO: 569472 - protein, 9 aa, Homo Sapiens
ETTESVDSE

SEQ ID NO: 569473 - protein, 9 aa, Homo Sapiens
SCVAVSFAT

SEQ ID NO: 569474 - protein, 9 aa, Homo Sapiens
ESGYFVGIK

SEQ ID NO: 569475 - protein, 9 aa, Homo Sapiens
PHMLLLQGY

SEQ ID NO: 569476 - protein, 9 aa, Homo Sapiens
PGIFRGDKW

SEQ ID NO: 569477 - protein, 9 aa, Homo Sapiens
QDRALPPPP

SEQ ID NO: 569478 - protein, 9 aa, Homo Sapiens
SSSASSPEI

SEQ ID NO: 569479 - protein, 9 aa, Homo Sapiens
DFISCPRNP

SEQ ID NO: 569480 - protein, 9 aa, Homo Sapiens
LSTDTMPIT

SEQ ID NO: 569481 - protein, 9 aa, Homo Sapiens
GLLDGIELR

SEQ ID NO: 569482 - protein, 9 aa, Homo Sapiens
NSIKEKQVW

SEQ ID NO: 569483 - protein, 9 aa, Homo Sapiens
SAPASQDRA

SEQ ID NO: 569484 - protein, 9 aa, Homo Sapiens
SFGSPGSMG

SEQ ID NO: 569485 - protein, 9 aa, Homo Sapiens
QHVEIGPSS

SEQ ID NO: 569486 - protein, 9 aa, Homo Sapiens
LKLAGWQCP

SEQ ID NO: 569487 - protein, 9 aa, Homo Sapiens
CVAVSFATS

SEQ ID NO: 569488 - protein, 9 aa, Homo Sapiens
ETHSKSCVA

SEQ ID NO: 569489 - protein, 9 aa, Homo Sapiens
CQEVFDSNV

SEQ ID NO: 569490 - protein, 9 aa, Homo Sapiens
EKQVWVFSR

SEQ ID NO: 569491 - protein, 9 aa, Homo Sapiens
VFFDVELPK

SEQ ID NO: 569492 - protein, 9 aa, Homo Sapiens
LAVCEEYSA

SEQ ID NO: 569493 - protein, 9 aa, Homo Sapiens
TWSKHAQKP

SEQ ID NO: 569494 - protein, 9 aa, Homo Sapiens
FGSEQRPKL

SEQ ID NO: 569495 - protein, 9 aa, Homo Sapiens
HVEIGPSSL

SEQ ID NO: 569496 - protein, 9 aa, Homo Sapiens
QRPKLFHPL

SEQ ID NO: 569497 - protein, 9 aa, Homo Sapiens
VFLISGDSL

SEQ ID NO: 569498 - protein, 9 aa, Homo Sapiens
EIERWFTQN

SEQ ID NO: 569499 - protein, 9 aa, Homo Sapiens
LLAAGAMAR

SEQ ID NO: 569500 - protein, 9 aa, Homo Sapiens
RSTTDCGGS

SEQ ID NO: 569501 - protein, 9 aa, Homo Sapiens
FGFTRYLQS

SEQ ID NO: 569502 - protein, 9 aa, Homo Sapiens
DDNGPVSIL

SEQ ID NO: 569503 - protein, 9 aa, Homo Sapiens
SYHPGIFRG

SEQ ID NO: 569504 - protein, 9 aa, Homo Sapiens
KFSKIASFI

SEQ ID NO: 569505 - protein, 9 aa, Homo Sapiens
AGCFVLIVL

SEQ ID NO: 569506 - protein, 9 aa, Homo Sapiens
FISCPRNPD

SEQ ID NO: 569507 - protein, 9 aa, Homo Sapiens
NDKGQWNGM

SEQ ID NO: 569508 - protein, 9 aa, Homo Sapiens
DGIELRKSS

SEQ ID NO: 569509 - protein, 9 aa, Homo Sapiens
KEVFFDVEL

SEQ ID NO: 569510 - protein, 9 aa, Homo Sapiens
DLPCEIERD

SEQ ID NO: 569511 - protein, 9 aa, Homo Sapiens
EQVRAMSQG

SEQ ID NO: 569512 - protein, 9 aa, Homo Sapiens
TRPRRRAWW

SEQ ID NO: 569513 - protein, 9 aa, Homo Sapiens
FDSNVSIQV

SEQ ID NO: 569514 - protein, 9 aa, Homo Sapiens
KHFLPLTRP

SEQ ID NO: 569515 - protein, 9 aa, Homo Sapiens
PPSAPASQD

SEQ ID NO: 569516 - protein, 9 aa, Homo Sapiens
LVASNGFGN

SEQ ID NO: 569517 - protein, 9 aa, Homo Sapiens
VGIVAAGCF

SEQ ID NO: 569518 - protein, 9 aa, Homo Sapiens
KELLLKKPG

SEQ ID NO: 569519 - protein, 9 aa, Homo Sapiens
NKKNSDDNG

SEQ ID NO: 569520 - protein, 9 aa, Homo Sapiens
RNPDLPVPL

SEQ ID NO: 569521 - protein, 9 aa, Homo Sapiens
EFVHSESSS

SEQ ID NO: 569522 - protein, 9 aa, Homo Sapiens
EQQKKRKRE

SEQ ID NO: 569523 - protein, 9 aa, Homo Sapiens
LISGDSLDN

SEQ ID NO: 569524 - protein, 9 aa, Homo Sapiens
QNDKGQWNG

SEQ ID NO: 569525 - protein, 9 aa, Homo Sapiens
TQNSIKEKQ

SEQ ID NO: 569526 - protein, 9 aa, Homo Sapiens
SESETTESV

SEQ ID NO: 569527 - protein, 9 aa, Homo Sapiens
VPYFSTLVW

SEQ ID NO: 569528 - protein, 9 aa, Homo Sapiens
PRRRAWWPL

SEQ ID NO: 569529 - protein, 9 aa, Homo Sapiens
EQRPKLFHP

SEQ ID NO: 569530 - protein, 9 aa, Homo Sapiens
TESVDSEND

SEQ ID NO: 569531 - protein, 9 aa, Homo Sapiens
EEYSARPGG

SEQ ID NO: 569532 - protein, 9 aa, Homo Sapiens
HPGIFRGDK

SEQ ID NO: 569533 - protein, 9 aa, Homo Sapiens
IVAAGCFVL

SEQ ID NO: 569534 - protein, 9 aa, Homo Sapiens
GNAHSSWIP

SEQ ID NO: 569535 - protein, 9 aa, Homo Sapiens
LLKKPGKAV

SEQ ID NO: 569536 - protein, 9 aa, Homo Sapiens
SEQRPKLFH

SEQ ID NO: 569537 - protein, 9 aa, Homo Sapiens
FSTLVWFIG

SEQ ID NO: 569538 - protein, 9 aa, Homo Sapiens
GDPAKPRTW

SEQ ID NO: 569539 - protein, 9 aa, Homo Sapiens
LRYFEGFCL

SEQ ID NO: 569540 - protein, 9 aa, Homo Sapiens
TDCGGSKDH

SEQ ID NO: 569541 - protein, 9 aa, Homo Sapiens
LVFSFGDLN

SEQ ID NO: 569542 - protein, 9 aa, Homo Sapiens
DKHFLPLTR

SEQ ID NO: 569543 - protein, 9 aa, Homo Sapiens
INIFLSPDQ

SEQ ID NO: 569544 - protein, 9 aa, Homo Sapiens
IDEFVHSES

SEQ ID NO: 569545 - protein, 9 aa, Homo Sapiens
GDSLDNCVE

SEQ ID NO: 569546 - protein, 9 aa, Homo Sapiens
FGSPGSMGK

SEQ ID NO: 569547 - protein, 9 aa, Homo Sapiens
GNYPLLVHT

SEQ ID NO: 569548 - protein, 9 aa, Homo Sapiens
RKSSKREKK

SEQ ID NO: 569549 - protein, 9 aa, Homo Sapiens
TRYLQSNMM

SEQ ID NO: 569550 - protein, 9 aa, Homo Sapiens
KSFGSPGSM

SEQ ID NO: 569551 - protein, 9 aa, Homo Sapiens
VKIADFGFT

SEQ ID NO: 569552 - protein, 9 aa, Homo Sapiens
VYDQMPELR

SEQ ID NO: 569553 - protein, 9 aa, Homo Sapiens
FSKIASFIP

SEQ ID NO: 569554 - protein, 9 aa, Homo Sapiens
FAPGNYPLL

SEQ ID NO: 569555 - protein, 9 aa, Homo Sapiens
LLDGIELRK

SEQ ID NO: 569556 - protein, 9 aa, Homo Sapiens
YFVGIKRQR

SEQ ID NO: 569557 - protein, 9 aa, Homo Sapiens
GIFRGDKWS

SEQ ID NO: 569558 - protein, 9 aa, Homo Sapiens
WWPLQGTLA

SEQ ID NO: 569559 - protein, 9 aa, Homo Sapiens
EVQYKEYNK

SEQ ID NO: 569560 - protein, 9 aa, Homo Sapiens
MARVPAASL

SEQ ID NO: 569561 - protein, 9 aa, Homo Sapiens
TTDCGGSKD

SEQ ID NO: 569562 - protein, 9 aa, Homo Sapiens
GSMGKLLCE

SEQ ID NO: 569563 - protein, 9 aa, Homo Sapiens
RCNKKNSDD

SEQ ID NO: 569564 - protein, 9 aa, Homo Sapiens
PGSMGKLLC

SEQ ID NO: 569565 - protein, 9 aa, Homo Sapiens
EYSARPGGE

SEQ ID NO: 569566 - protein, 9 aa, Homo Sapiens
EIGPSSLIV

SEQ ID NO: 569567 - protein, 9 aa, Homo Sapiens
KIADFGFTR

SEQ ID NO: 569568 - protein, 9 aa, Homo Sapiens
HSESSSTKM

SEQ ID NO: 569569 - protein, 9 aa, Homo Sapiens
LTRPRRRAW

SEQ ID NO: 569570 - protein, 9 aa, Homo Sapiens
LTELSTDTM

SEQ ID NO: 569571 - protein, 9 aa, Homo Sapiens
PGINIFLSP

SEQ ID NO: 569572 - protein, 9 aa, Homo Sapiens
SFRVKWLRR

SEQ ID NO: 569573 - protein, 9 aa, Homo Sapiens
KKNSDDNGP

SEQ ID NO: 569574 - protein, 9 aa, Homo Sapiens
AMARVPAAS

SEQ ID NO: 569575 - protein, 9 aa, Homo Sapiens
NFAPGNYPL

SEQ ID NO: 569576 - protein, 9 aa, Homo Sapiens
YVCPVEPQK

SEQ ID NO: 569577 - protein, 9 aa, Homo Sapiens
LPPSGAFGL

SEQ ID NO: 569578 - protein, 9 aa, Homo Sapiens
FVHSESSST

SEQ ID NO: 569579 - protein, 9 aa, Homo Sapiens
PEIERWFTQ

SEQ ID NO: 569580 - protein, 9 aa, Homo Sapiens
AVPYFSTLV

SEQ ID NO: 569581 - protein, 9 aa, Homo Sapiens
SLYQSPHML

SEQ ID NO: 569582 - protein, 9 aa, Homo Sapiens
KNSDDNGPV

SEQ ID NO: 569583 - protein, 9 aa, Homo Sapiens
SIKEKQVWV

SEQ ID NO: 569584 - protein, 9 aa, Homo Sapiens
SPEIERWFT

SEQ ID NO: 569585 - protein, 9 aa, Homo Sapiens
RKEEQQKKR

SEQ ID NO: 569586 - protein, 9 aa, Homo Sapiens
RAMSQGGHL

SEQ ID NO: 569587 - protein, 9 aa, Homo Sapiens
ERWFTQNSI

SEQ ID NO: 569588 - protein, 9 aa, Homo Sapiens
IADFGFTRY

SEQ ID NO: 569589 - protein, 9 aa, Homo Sapiens
TPLKLAGWQ

SEQ ID NO: 569590 - protein, 9 aa, Homo Sapiens
KEILPEVQY

SEQ ID NO: 569591 - protein, 9 aa, Homo Sapiens
NVSIQVHLA

SEQ ID NO: 569592 - protein, 9 aa, Homo Sapiens
MSQGGHLMS

SEQ ID NO: 569593 - protein, 9 aa, Homo Sapiens
KQVWVFSRT

SEQ ID NO: 569594 - protein, 9 aa, Homo Sapiens
DTAKEVFFD

SEQ ID NO: 569595 - protein, 9 aa, Homo Sapiens
DSNVSIQVH

SEQ ID NO: 569596 - protein, 9 aa, Homo Sapiens
VPEMPKKFS

SEQ ID NO: 569597 - protein, 9 aa, Homo Sapiens
KEKQVWVFS

SEQ ID NO: 569598 - protein, 9 aa, Homo Sapiens
SQDRALPPP

SEQ ID NO: 569599 - protein, 9 aa, Homo Sapiens
VHSESSSTK

SEQ ID NO: 569600 - protein, 9 aa, Homo Sapiens
ATPAVPHLP

SEQ ID NO: 569601 - protein, 9 aa, Homo Sapiens
SKSCVAVSF

SEQ ID NO: 569602 - protein, 9 aa, Homo Sapiens
SGEKYCGER

SEQ ID NO: 569603 - protein, 9 aa, Homo Sapiens
MGKDYIYAI

SEQ ID NO: 569604 - protein, 9 aa, Homo Sapiens
TPAVPHLPP

SEQ ID NO: 569605 - protein, 9 aa, Homo Sapiens
ISGEKYCGE

SEQ ID NO: 569606 - protein, 9 aa, Homo Sapiens
ILPEVQYKE

SEQ ID NO: 569607 - protein, 9 aa, Homo Sapiens
QNSIKEKQV

SEQ ID NO: 569608 - protein, 9 aa, Homo Sapiens
GSYHPGIFR

SEQ ID NO: 569609 - protein, 9 aa, Homo Sapiens
APGNYPLLV

SEQ ID NO: 569610 - protein, 9 aa, Homo Sapiens
PRNPDLPVP

SEQ ID NO: 569611 - protein, 9 aa, Homo Sapiens
DQMPELRYV

SEQ ID NO: 569612 - protein, 9 aa, Homo Sapiens
YFSTLVWFI

SEQ ID NO: 569613 - protein, 9 aa, Homo Sapiens
IERDPCLEA

SEQ ID NO: 569614 - protein, 9 aa, Homo Sapiens
ISGDSLDNC

SEQ ID NO: 569615 - protein, 9 aa, Homo Sapiens
LVQAVQHVE

SEQ ID NO: 569616 - protein, 9 aa, Homo Sapiens
KEEQQKKRK

SEQ ID NO: 569617 - protein, 9 aa, Homo Sapiens
VPGINIFLS

SEQ ID NO: 569618 - protein, 9 aa, Homo Sapiens
CEEYSARPG

SEQ ID NO: 569619 - protein, 9 aa, Homo Sapiens
LYQSPHMLL

SEQ ID NO: 569620 - protein, 9 aa, Homo Sapiens
SFGDLNFRI

SEQ ID NO: 569621 - protein, 9 aa, Homo Sapiens
SMGKLLCEV

SEQ ID NO: 569622 - protein, 9 aa, Homo Sapiens
DTMPITWDQ

SEQ ID NO: 569623 - protein, 9 aa, Homo Sapiens
FLISGDSLD

SEQ ID NO: 569624 - protein, 9 aa, Homo Sapiens
SGDSLDNCV

SEQ ID NO: 569625 - protein, 9 aa, Homo Sapiens
LLLKKPGKA

SEQ ID NO: 569626 - protein, 9 aa, Homo Sapiens
PLKLAGWQC

SEQ ID NO: 569627 - protein, 9 aa, Homo Sapiens
STLVWFIGS

SEQ ID NO: 569628 - protein, 9 aa, Homo Sapiens
GSKDHPLTC

SEQ ID NO: 569629 - protein, 9 aa, Homo Sapiens
PATPAVPHL

SEQ ID NO: 569630 - protein, 9 aa, Homo Sapiens
LSPDQPANV

SEQ ID NO: 569631 - protein, 9 aa, Homo Sapiens
LLTELSTDT

SEQ ID NO: 569632 - protein, 9 aa, Homo Sapiens
QQKKRKREK

SEQ ID NO: 569633 - protein, 9 aa, Homo Sapiens
ELSTDTMPI

SEQ ID NO: 569634 - protein, 9 aa, Homo Sapiens
NAHSSWIPF

SEQ ID NO: 569635 - protein, 9 aa, Homo Sapiens
VPHLPPSGA

SEQ ID NO: 569636 - protein, 9 aa, Homo Sapiens
VEISGEKYC

SEQ ID NO: 569637 - protein, 9 aa, Homo Sapiens
RPRRRAWWP

SEQ ID NO: 569638 - protein, 9 aa, Homo Sapiens
FGNAHSSWI

SEQ ID NO: 569639 - protein, 9 aa, Homo Sapiens
YVEISGEKY

SEQ ID NO: 569640 - protein, 9 aa, Homo Sapiens
FGDPAKPRT

SEQ ID NO: 569641 - protein, 9 aa, Homo Sapiens
VTVGIVAAG

SEQ ID NO: 569642 - protein, 9 aa, Homo Sapiens
NSDDNGPVS

SEQ ID NO: 569643 - protein, 9 aa, Homo Sapiens
YIYAITPLL

SEQ ID NO: 569644 - protein, 9 aa, Homo Sapiens
VTPLKLAGW

SEQ ID NO: 569645 - protein, 9 aa, Homo Sapiens
PYFSTLVWF

SEQ ID NO: 569646 - protein, 9 aa, Homo Sapiens
IELRKSSKR

SEQ ID NO: 569647 - protein, 9 aa, Homo Sapiens
LDGIELRKS

SEQ ID NO: 569648 - protein, 9 aa, Homo Sapiens
VQYKEYNKS

SEQ ID NO: 569649 - protein, 9 aa, Homo Sapiens
GIVAAGCFV

SEQ ID NO: 569650 - protein, 9 aa, Homo Sapiens
DFGFTRYLQ

SEQ ID NO: 569651 - protein, 9 aa, Homo Sapiens
VFDSNVSIQ

SEQ ID NO: 569652 - protein, 9 aa, Homo Sapiens
SCPRNPDLP

SEQ ID NO: 569653 - protein, 9 aa, Homo Sapiens
PSCNNRHFW

SEQ ID NO: 569654 - protein, 9 aa, Homo Sapiens
PGNYPLLVH

SEQ ID NO: 569655 - protein, 9 aa, Homo Sapiens
VAVSFATSY

SEQ ID NO: 569656 - protein, 9 aa, Homo Sapiens
GDKHFLPLT

SEQ ID NO: 569657 - protein, 9 aa, Homo Sapiens
SDDNGPVSI

SEQ ID NO: 569658 - protein, 9 aa, Homo Sapiens
SKRYKELLL

SEQ ID NO: 569659 - protein, 9 aa, Homo Sapiens
NKRERKEEQ

SEQ ID NO: 569660 - protein, 9 aa, Homo Sapiens
STDTMPITW

SEQ ID NO: 569661 - protein, 9 aa, Homo Sapiens
RADTAKEVF

SEQ ID NO: 569662 - protein, 9 aa, Homo Sapiens
PKDYVEISG

SEQ ID NO: 569663 - protein, 9 aa, Homo Sapiens
EISGEKYCG

SEQ ID NO: 569664 - protein, 9 aa, Homo Sapiens
ILDHDLVFS

SEQ ID NO: 569665 - protein, 9 aa, Homo Sapiens
KEQEQVRAM

SEQ ID NO: 569666 - protein, 9 aa, Homo Sapiens
AKPRTWSKH

SEQ ID NO: 569667 - protein, 9 aa, Homo Sapiens
ERKEEQQKK

SEQ ID NO: 569668 - protein, 9 aa, Homo Sapiens
QMPELRYVV

SEQ ID NO: 569669 - protein, 9 aa, Homo Sapiens
PLLVHTDLP

SEQ ID NO: 569670 - protein, 9 aa, Homo Sapiens
ADTAKEVFF

SEQ ID NO: 569671 - protein, 9 aa, Homo Sapiens
YSLYQSPHM

SEQ ID NO: 569672 - protein, 9 aa, Homo Sapiens
WFTQNSIKE

SEQ ID NO: 569673 - protein, 9 aa, Homo Sapiens
TELSTDTMP

SEQ ID NO: 569674 - protein, 9 aa, Homo Sapiens
EVPGINIFL

SEQ ID NO: 569675 - protein, 9 aa, Homo Sapiens
VAAGCFVLI

SEQ ID NO: 569676 - protein, 9 aa, Homo Sapiens
FQIDEFVHS

SEQ ID NO: 569677 - protein, 9 aa, Homo Sapiens
LAGWQCPEC

SEQ ID NO: 569678 - protein, 9 aa, Homo Sapiens
AVTPLKLAG

SEQ ID NO: 569679 - protein, 9 aa, Homo Sapiens
DRALPPPPY

SEQ ID NO: 569680 - protein, 9 aa, Homo Sapiens
KLFHPLPFQ

SEQ ID NO: 569681 - protein, 9 aa, Homo Sapiens
WESGYFVGI

SEQ ID NO: 569682 - protein, 9 aa, Homo Sapiens
ASNGFGNAH

SEQ ID NO: 569683 - protein, 9 aa, Homo Sapiens
EMPKKFSKI

SEQ ID NO: 569684 - protein, 9 aa, Homo Sapiens
EEQQKKRKR

SEQ ID NO: 569685 - protein, 9 aa, Homo Sapiens
RRRAWWPLQ

SEQ ID NO: 569686 - protein, 9 aa, Homo Sapiens
AVCEEYSAR

SEQ ID NO: 569687 - protein, 9 aa, Homo Sapiens
NPDLPVPLQ

SEQ ID NO: 569688 - protein, 9 aa, Homo Sapiens
SSASSPEIE

SEQ ID NO: 569689 - protein, 9 aa, Homo Sapiens
YQSPHMLLL

SEQ ID NO: 569690 - protein, 9 aa, Homo Sapiens
HLPPSGAFG

SEQ ID NO: 569691 - protein, 9 aa, Homo Sapiens
PEMPKKFSK

SEQ ID NO: 569692 - protein, 9 aa, Homo Sapiens
IYAITPLLE

SEQ ID NO: 569693 - protein, 9 aa, Homo Sapiens
PLQGTLAGK

SEQ ID NO: 569694 - protein, 9 aa, Homo Sapiens
DCGGSKDHP

SEQ ID NO: 569695 - protein, 9 aa, Homo Sapiens
ASSPEIERW

SEQ ID NO: 569696 - protein, 9 aa, Homo Sapiens
KRCNKKNSD

SEQ ID NO: 569697 - protein, 9 aa, Homo Sapiens
DLVFSFGDL

SEQ ID NO: 569698 - protein, 9 aa, Homo Sapiens
PELRYVVSM

SEQ ID NO: 569699 - protein, 9 aa, Homo Sapiens
CLPSCNNRH

SEQ ID NO: 569700 - protein, 9 aa, Homo Sapiens
ELRYVVSMG

SEQ ID NO: 569701 - protein, 9 aa, Homo Sapiens
IERWFTQNS

SEQ ID NO: 569702 - protein, 9 aa, Homo Sapiens
EIERDPCLE

SEQ ID NO: 569703 - protein, 9 aa, Homo Sapiens
HSKSCVAVS

SEQ ID NO: 569704 - protein, 9 aa, Homo Sapiens
GIELRKSSK

SEQ ID NO: 569705 - protein, 9 aa, Homo Sapiens
GAMARVPAA

SEQ ID NO: 569706 - protein, 9 aa, Homo Sapiens
AITPLLEDA

SEQ ID NO: 569707 - protein, 9 aa, Homo Sapiens
GYFVGIKRQ

SEQ ID NO: 569708 - protein, 9 aa, Homo Sapiens
MSKRYKELL

SEQ ID NO: 569709 - protein, 9 aa, Homo Sapiens
KRERKEEQQ

SEQ ID NO: 569710 - protein, 9 aa, Homo Sapiens
LPLTRPRRR

SEQ ID NO: 569711 - protein, 9 aa, Homo Sapiens
LPEVQYKEY

SEQ ID NO: 569712 - protein, 9 aa, Homo Sapiens
DYIYAITPL

SEQ ID NO: 569713 - protein, 9 aa, Homo Sapiens
SGYFVGIKR

SEQ ID NO: 569714 - protein, 9 aa, Homo Sapiens
VEIGPSSLI

SEQ ID NO: 569715 - protein, 9 aa, Homo Sapiens
AKEVFFDVE

SEQ ID NO: 569716 - protein, 9 aa, Homo Sapiens
SVDSENDMG

SEQ ID NO: 569717 - protein, 9 aa, Homo Sapiens
MPKKFSKIA

SEQ ID NO: 569718 - protein, 9 aa, Homo Sapiens
PEVQYKEYN

SEQ ID NO: 569719 - protein, 9 aa, Homo Sapiens
LPCEIERDP

SEQ ID NO: 569720 - protein, 9 aa, Homo Sapiens
CKVFLISGD

SEQ ID NO: 569721 - protein, 9 aa, Homo Sapiens
KPRTWSKHA

SEQ ID NO: 569722 - protein, 9 aa, Homo Sapiens
EQEQVRAMS

SEQ ID NO: 569723 - protein, 9 aa, Homo Sapiens
RRAWWPLQG

SEQ ID NO: 569724 - protein, 9 aa, Homo Sapiens
YHPGIFRGD

SEQ ID NO: 569725 - protein, 9 aa, Homo Sapiens
DYVEISGEK

SEQ ID NO: 569726 - protein, 9 aa, Homo Sapiens
IFRGDKWSC

SEQ ID NO: 569727 - protein, 9 aa, Homo Sapiens
ADFGFTRYL

SEQ ID NO: 569728 - protein, 9 aa, Homo Sapiens
AVSFATSYA

SEQ ID NO: 569729 - protein, 9 aa, Homo Sapiens
PKLFHPLPF

SEQ ID NO: 569730 - protein, 9 aa, Homo Sapiens
QVRAMSQGG

SEQ ID NO: 569731 - protein, 9 aa, Homo Sapiens
EILPEVQYK

SEQ ID NO: 569732 - protein, 9 aa, Homo Sapiens
VNWESGYFV

SEQ ID NO: 569733 - protein, 9 aa, Homo Sapiens
AAGCFVLIV

SEQ ID NO: 569734 - protein, 9 aa, Homo Sapiens
LFHPLPFQN

SEQ ID NO: 569735 - protein, 9 aa, Homo Sapiens
VASNGFGNA

SEQ ID NO: 569736 - protein, 9 aa, Homo Sapiens
NGFGNAHSS

SEQ ID NO: 569737 - protein, 9 aa, Homo Sapiens
ELRKSSKRE

SEQ ID NO: 569738 - protein, 9 aa, Homo Sapiens
RERKEEQQK

SEQ ID NO: 569739 - protein, 9 aa, Homo Sapiens
DEFVHSESS

SEQ ID NO: 569740 - protein, 9 aa, Homo Sapiens
NIFLSPDQP

SEQ ID NO: 569741 - protein, 9 aa, Homo Sapiens
TVGIVAAGC

SEQ ID NO: 569742 - protein, 9 aa, Homo Sapiens
LLLTELSTD

SEQ ID NO: 569743 - protein, 9 aa, Homo Sapiens
DSLDNCVEV

SEQ ID NO: 569744 - protein, 9 aa, Homo Sapiens
FSTLRYFEG

SEQ ID NO: 569745 - protein, 9 aa, Homo Sapiens
SASSPEIER

SEQ ID NO: 569746 - protein, 9 aa, Homo Sapiens
GINIFLSPD

SEQ ID NO: 569747 - protein, 9 aa, Homo Sapiens
LCQEVFDSN

SEQ ID NO: 569748 - protein, 9 aa, Homo Sapiens
HMLLLQGYS

SEQ ID NO: 569749 - protein, 9 aa, Homo Sapiens
PLTRPRRRA

SEQ ID NO: 569750 - protein, 9 aa, Homo Sapiens
LRKSSKREK

SEQ ID NO: 569751 - protein, 9 aa, Homo Sapiens
TDTMPITWD

SEQ ID NO: 569752 - protein, 9 aa, Homo Sapiens
FSFGDLNFR

SEQ ID NO: 569753 - protein, 9 aa, Homo Sapiens
SNVSIQVHL

SEQ ID NO: 569754 - protein, 9 aa, Homo Sapiens
LAAGAMARV

SEQ ID NO: 569755 - protein, 9 aa, Homo Sapiens
RPKLFHPLP

SEQ ID NO: 569756 - protein, 9 aa, Homo Sapiens
FSFRVKWLR

SEQ ID NO: 569757 - protein, 9 aa, Homo Sapiens
PASQDRALP

SEQ ID NO: 569758 - protein, 9 aa, Homo Sapiens
AVPEMPKKF

SEQ ID NO: 569759 - protein, 9 aa, Homo Sapiens
AVQHVEIGP

SEQ ID NO: 569760 - protein, 9 aa, Homo Sapiens
AQNDKGQWN

SEQ ID NO: 569761 - protein, 9 aa, Homo Sapiens
YSARPGGES

SEQ ID NO: 569762 - protein, 9 aa, Homo Sapiens
FFDVELPKT

SEQ ID NO: 569763 - protein, 9 aa, Homo Sapiens
RDFISCPRN

SEQ ID NO: 569764 - protein, 9 aa, Homo Sapiens
PRTWSKHAQ

SEQ ID NO: 569765 - protein, 9 aa, Homo Sapiens
VFSFGDLNF

SEQ ID NO: 569766 - protein, 9 aa, Homo Sapiens
CNKKNSDDN

SEQ ID NO: 569767 - protein, 9 aa, Homo Sapiens
HFLPLTRPR

SEQ ID NO: 569768 - protein, 9 aa, Homo Sapiens
KDYIYAITP

SEQ ID NO: 569769 - protein, 9 aa, Homo Sapiens
AGAMARVPA

SEQ ID NO: 569770 - protein, 9 aa, Homo Sapiens
PCLEAKNKP

SEQ ID NO: 569771 - protein, 9 aa, Homo Sapiens
SPHMLLLQG

SEQ ID NO: 569772 - protein, 9 aa, Homo Sapiens
PAKPRTWSK

SEQ ID NO: 569773 - protein, 9 aa, Homo Sapiens
EVFDSNVSI

SEQ ID NO: 569774 - protein, 9 aa, Homo Sapiens
ASQDRALPP

SEQ ID NO: 569775 - protein, 9 aa, Homo Sapiens
FTQNSIKEK

SEQ ID NO: 569776 - protein, 9 aa, Homo Sapiens
KLAGWQCPE

SEQ ID NO: 569777 - protein, 9 aa, Homo Sapiens
GFTRYLQSN

SEQ ID NO: 569778 - protein, 9 aa, Homo Sapiens
YGAQNDKGQ

SEQ ID NO: 569779 - protein, 9 aa, Homo Sapiens
FLPLTRPRR

SEQ ID NO: 569780 - protein, 9 aa, Homo Sapiens
TTESVDSEN

SEQ ID NO: 569781 - protein, 9 aa, Homo Sapiens
WPLQGTLAG

SEQ ID NO: 569782 - protein, 9 aa, Homo Sapiens
NYPLLVHTD

SEQ ID NO: 569783 - protein, 9 aa, Homo Sapiens
SCLPSCNNR

SEQ ID NO: 569784 - protein, 9 aa, Homo Sapiens
AVPHLPPSG

SEQ ID NO: 569785 - protein, 9 aa, Homo Sapiens
RSLAVCEEY

SEQ ID NO: 569786 - protein, 9 aa, Homo Sapiens
LRYVVSMGS

SEQ ID NO: 569787 - protein, 9 aa, Homo Sapiens
AWWPLQGTL

SEQ ID NO: 569788 - protein, 9 aa, Homo Sapiens
LPSCNNRHF

SEQ ID NO: 569789 - protein, 9 aa, Homo Sapiens
DNFAPGNYP

SEQ ID NO: 569790 - protein, 9 aa, Homo Sapiens
DIAVTPLKL

SEQ ID NO: 569791 - protein, 9 aa, Homo Sapiens
KRYKELLLK

SEQ ID NO: 569792 - protein, 9 aa, Homo Sapiens
SPGSMGKLL

SEQ ID NO: 569793 - protein, 9 aa, Homo Sapiens
ELLLKKPGK

SEQ ID NO: 569794 - protein, 9 aa, Homo Sapiens
ARVPAASLV

SEQ ID NO: 569795 - protein, 9 aa, Homo Sapiens
MFSTLRYFE

SEQ ID NO: 569796 - protein, 9 aa, Homo Sapiens
PCEIERDPC

SEQ ID NO: 569797 - protein, 9 aa, Homo Sapiens
GFGNAHSSW

SEQ ID NO: 569798 - protein, 9 aa, Homo Sapiens
GGSKDHPLT

SEQ ID NO: 569799 - protein, 9 aa, Homo Sapiens
YKEYNKSWQ

SEQ ID NO: 569800 - protein, 9 aa, Homo Sapiens
MGKLLCEVT

SEQ ID NO: 569801 - protein, 9 aa, Homo Sapiens
PHLPPSGAF

SEQ ID NO: 569802 - protein, 9 aa, Homo Sapiens
GAQNDKGQW

SEQ ID NO: 569803 - protein, 9 aa, Homo Sapiens
STLRYFEGF

SEQ ID NO: 569804 - protein, 9 aa, Homo Sapiens
SESSSTKMQ

SEQ ID NO: 569805 - protein, 9 aa, Homo Sapiens
CPRNPDLPV

SEQ ID NO: 569806 - protein, 9 aa, Homo Sapiens
VTMFSTLRY

SEQ ID NO: 569807 - protein, 9 aa, Homo Sapiens
RDPCLEAKN

SEQ ID NO: 569808 - protein, 9 aa, Homo Sapiens
QEVFDSNVS

SEQ ID NO: 569809 - protein, 9 aa, Homo Sapiens
FRVKWLRRS

SEQ ID NO: 569810 - protein, 9 aa, Homo Sapiens
KKFSKIASF

SEQ ID NO: 569811 - protein, 9 aa, Homo Sapiens
KDYVEISGE

SEQ ID NO: 569812 - protein, 9 aa, Homo Sapiens
APASQDRAL

SEQ ID NO: 569813 - protein, 9 aa, Homo Sapiens
LDHDLVFSF

SEQ ID NO: 569814 - protein, 9 aa, Homo Sapiens
FTRYLQSNM

SEQ ID NO: 569815 - protein, 9 aa, Homo Sapiens
SETTESVDS

SEQ ID NO: 569816 - protein, 9 aa, Homo Sapiens
TLVWFIGSH

SEQ ID NO: 569817 - protein, 9 aa, Homo Sapiens
CPKDYVEIS

SEQ ID NO: 569818 - protein, 9 aa, Homo Sapiens
DPAKPRTWS

SEQ ID NO: 569819 - protein, 9 aa, Homo Sapiens
DPCLEAKNK

SEQ ID NO: 569820 - protein, 9 aa, Homo Sapiens
QSPHMLLLQ

SEQ ID NO: 569821 - protein, 9 aa, Homo Sapiens
ESETTESVD

SEQ ID NO: 569822 - protein, 9 aa, Homo Sapiens
PSAPASQDR

SEQ ID NO: 569823 - protein, 9 aa, Homo Sapiens
RWFTQNSIK

SEQ ID NO: 569824 - protein, 9 aa, Homo Sapiens
YFEGFCLAG

SEQ ID NO: 569825 - protein, 9 aa, Homo Sapiens
KVFLISGDS

SEQ ID NO: 569826 - protein, 9 aa, Homo Sapiens
QYKEYNKSW

SEQ ID NO: 569827 - protein, 9 aa, Homo Sapiens
TAKEVFFDV

SEQ ID NO: 569828 - protein, 9 aa, Homo Sapiens
ESVDSENDM

SEQ ID NO: 569829 - protein, 9 aa, Homo Sapiens
QIDEFVHSE

SEQ ID NO: 569830 - protein, 9 aa, Homo Sapiens
IAVTPLKLA

SEQ ID NO: 569831 - protein, 9 aa, Homo Sapiens
CGGSKDHPL

SEQ ID NO: 569832 - protein, 9 aa, Homo Sapiens
FLSPDQPAN

SEQ ID NO: 569833 - protein, 9 aa, Homo Sapiens
YKELLLKKP

SEQ ID NO: 569834 - protein, 9 aa, Homo Sapiens
RVPAASLVT

SEQ ID NO: 569835 - protein, 9 aa, Homo Sapiens
PKKFSKIAS

SEQ ID NO: 569836 - protein, 9 aa, Homo Sapiens
SSPEIERWF

SEQ ID NO: 569837 - protein, 9 aa, Homo Sapiens
VDSENDMGE

SEQ ID NO: 569838 - protein, 9 aa, Homo Sapiens
VQAVQHVEI

SEQ ID NO: 569839 - protein, 9 aa, Homo Sapiens
RVKWLRRSR

SEQ ID NO: 569840 - protein, 9 aa, Homo Sapiens
YDQMPELRY

SEQ ID NO: 569841 - protein, 9 aa, Homo Sapiens
PAVPHLPPS

SEQ ID NO: 569842 - protein, 9 aa, Homo Sapiens
RTWSKHAQK

SEQ ID NO: 569843 - protein, 9 aa, Homo Sapiens
VDNFQDKPA

SEQ ID NO: 569844 - protein, 9 aa, Homo Sapiens
TKIGYRLQG

SEQ ID NO: 569845 - protein, 9 aa, Homo Sapiens
YNSSYIQNA

SEQ ID NO: 569846 - protein, 9 aa, Homo Sapiens
AESQWYKDD

SEQ ID NO: 569847 - protein, 9 aa, Homo Sapiens
RHSPRAFIP

SEQ ID NO: 569848 - protein, 9 aa, Homo Sapiens
VLEATRCEA

SEQ ID NO: 569849 - protein, 9 aa, Homo Sapiens
VTRHKGVKK

SEQ ID NO: 569850 - protein, 9 aa, Homo Sapiens
SPPKCAKNT

SEQ ID NO: 569851 - protein, 9 aa, Homo Sapiens
GVGTRNYYT

SEQ ID NO: 569852 - protein, 9 aa, Homo Sapiens
PCHLLRMPL

SEQ ID NO: 569853 - protein, 9 aa, Homo Sapiens
PEPSQLPFL

SEQ ID NO: 569854 - protein, 9 aa, Homo Sapiens
AEDMPDRCA

SEQ ID NO: 569855 - protein, 9 aa, Homo Sapiens
WSCRLPLGH

SEQ ID NO: 569856 - protein, 9 aa, Homo Sapiens
VENVQTEFQ

SEQ ID NO: 569857 - protein, 9 aa, Homo Sapiens
DWSDQSPQA

SEQ ID NO: 569858 - protein, 9 aa, Homo Sapiens
DPEVLQDSL

SEQ ID NO: 569859 - protein, 9 aa, Homo Sapiens
LDADISEQK

SEQ ID NO: 569860 - protein, 9 aa, Homo Sapiens
LQRLSLEVK

SEQ ID NO: 569861 - protein, 9 aa, Homo Sapiens
FKPDNPNLL

SEQ ID NO: 569862 - protein, 9 aa, Homo Sapiens
CLLELGRIT

SEQ ID NO: 569863 - protein, 9 aa, Homo Sapiens
QTEFQEKMK

SEQ ID NO: 569864 - protein, 9 aa, Homo Sapiens
LPLPISKEG

SEQ ID NO: 569865 - protein, 9 aa, Homo Sapiens
LRHSPRAFI

SEQ ID NO: 569866 - protein, 9 aa, Homo Sapiens
NVPVLQRLS

SEQ ID NO: 569867 - protein, 9 aa, Homo Sapiens
NLVLEPQPW

SEQ ID NO: 569868 - protein, 9 aa, Homo Sapiens
QSSLRWSCR

SEQ ID NO: 569869 - protein, 9 aa, Homo Sapiens
ADISEQKRQ

SEQ ID NO: 569870 - protein, 9 aa, Homo Sapiens
MEVEDPEVL

SEQ ID NO: 569871 - protein, 9 aa, Homo Sapiens
GPEPSQLPF

SEQ ID NO: 569872 - protein, 9 aa, Homo Sapiens
INFINNYKI

SEQ ID NO: 569873 - protein, 9 aa, Homo Sapiens
GVLMEVEDP

SEQ ID NO: 569874 - protein, 9 aa, Homo Sapiens
SALAAAAAA

SEQ ID NO: 569875 - protein, 9 aa, Homo Sapiens
SDNSSIKSS

SEQ ID NO: 569876 - protein, 9 aa, Homo Sapiens
LGHFQFPLQ

SEQ ID NO: 569877 - protein, 9 aa, Homo Sapiens
CLKFLAAKG

SEQ ID NO: 569878 - protein, 9 aa, Homo Sapiens
FQDAEDMPD

SEQ ID NO: 569879 - protein, 9 aa, Homo Sapiens
LPRIFTSVT

SEQ ID NO: 569880 - protein, 9 aa, Homo Sapiens
DNSSIKSSC

SEQ ID NO: 569881 - protein, 9 aa, Homo Sapiens
LPLGHFQFP

SEQ ID NO: 569882 - protein, 9 aa, Homo Sapiens
EVRLGVSLR

SEQ ID NO: 569883 - protein, 9 aa, Homo Sapiens
SSIKSSCSS

SEQ ID NO: 569884 - protein, 9 aa, Homo Sapiens
KCAKNTETQ

SEQ ID NO: 569885 - protein, 9 aa, Homo Sapiens
EATRCEASW

SEQ ID NO: 569886 - protein, 9 aa, Homo Sapiens
CKFKPDNPN

SEQ ID NO: 569887 - protein, 9 aa, Homo Sapiens
GVSLRGAFS

SEQ ID NO: 569888 - protein, 9 aa, Homo Sapiens
SIREQHGKL

SEQ ID NO: 569889 - protein, 9 aa, Homo Sapiens
ELHKLAKMC

SEQ ID NO: 569890 - protein, 9 aa, Homo Sapiens
MLQDINFIN

SEQ ID NO: 569891 - protein, 9 aa, Homo Sapiens
FLWLVWRSS

SEQ ID NO: 569892 - protein, 9 aa, Homo Sapiens
RQPRSPPKV

SEQ ID NO: 569893 - protein, 9 aa, Homo Sapiens
TRCEASWTR

SEQ ID NO: 569894 - protein, 9 aa, Homo Sapiens
PVLQRLSLE

SEQ ID NO: 569895 - protein, 9 aa, Homo Sapiens
LWLVWRSSP

SEQ ID NO: 569896 - protein, 9 aa, Homo Sapiens
QEKMKTQKK

SEQ ID NO: 569897 - protein, 9 aa, Homo Sapiens
TMENTSAVC

SEQ ID NO: 569898 - protein, 9 aa, Homo Sapiens
FQMSSFLQV

SEQ ID NO: 569899 - protein, 9 aa, Homo Sapiens
ENTSAVCFW

SEQ ID NO: 569900 - protein, 9 aa, Homo Sapiens
EDPEVLQDS

SEQ ID NO: 569901 - protein, 9 aa, Homo Sapiens
SDRIKQFKE

SEQ ID NO: 569902 - protein, 9 aa, Homo Sapiens
ILIHWQALE

SEQ ID NO: 569903 - protein, 9 aa, Homo Sapiens
IDQNQNLHD

SEQ ID NO: 569904 - protein, 9 aa, Homo Sapiens
LIHWQALES

SEQ ID NO: 569905 - protein, 9 aa, Homo Sapiens
LCPGSTAIN

SEQ ID NO: 569906 - protein, 9 aa, Homo Sapiens
LQQVDITVM

SEQ ID NO: 569907 - protein, 9 aa, Homo Sapiens
SRAVTRHKG

SEQ ID NO: 569908 - protein, 9 aa, Homo Sapiens
IIPGFVERL

SEQ ID NO: 569909 - protein, 9 aa, Homo Sapiens
GLLCPGSTA

SEQ ID NO: 569910 - protein, 9 aa, Homo Sapiens
ENFEDPVLD

SEQ ID NO: 569911 - protein, 9 aa, Homo Sapiens
PESDRIKQF

SEQ ID NO: 569912 - protein, 9 aa, Homo Sapiens
RNYYTKIGY

SEQ ID NO: 569913 - protein, 9 aa, Homo Sapiens
VGTRNYYTK

SEQ ID NO: 569914 - protein, 9 aa, Homo Sapiens
QKRQVTCYI

SEQ ID NO: 569915 - protein, 9 aa, Homo Sapiens
KPQAHPYFW

SEQ ID NO: 569916 - protein, 9 aa, Homo Sapiens
RLSLEVKKG

SEQ ID NO: 569917 - protein, 9 aa, Homo Sapiens
LQERSIREQ

SEQ ID NO: 569918 - protein, 9 aa, Homo Sapiens
WGSALAAAA

SEQ ID NO: 569919 - protein, 9 aa, Homo Sapiens
TRFDFTTTR

SEQ ID NO: 569920 - protein, 9 aa, Homo Sapiens
GLQQVDITV

SEQ ID NO: 569921 - protein, 9 aa, Homo Sapiens
FISFGIEPN

SEQ ID NO: 569922 - protein, 9 aa, Homo Sapiens
LKFLAAKGI

SEQ ID NO: 569923 - protein, 9 aa, Homo Sapiens
AAELSKLRR

SEQ ID NO: 569924 - protein, 9 aa, Homo Sapiens
QAALLIIPG

SEQ ID NO: 569925 - protein, 9 aa, Homo Sapiens
ENIDACLKF

SEQ ID NO: 569926 - protein, 9 aa, Homo Sapiens
NSSIKSSCS

SEQ ID NO: 569927 - protein, 9 aa, Homo Sapiens
HLQKLPTEG

SEQ ID NO: 569928 - protein, 9 aa, Homo Sapiens
QLPFLWLVW

SEQ ID NO: 569929 - protein, 9 aa, Homo Sapiens
PDLPRIFTS

SEQ ID NO: 569930 - protein, 9 aa, Homo Sapiens
SHLQPCHLL

SEQ ID NO: 569931 - protein, 9 aa, Homo Sapiens
QEGCGYNSS

SEQ ID NO: 569932 - protein, 9 aa, Homo Sapiens
QERGPEPSQ

SEQ ID NO: 569933 - protein, 9 aa, Homo Sapiens
NQNLHDDSK

SEQ ID NO: 569934 - protein, 9 aa, Homo Sapiens
AALLIIPGF

SEQ ID NO: 569935 - protein, 9 aa, Homo Sapiens
HKGVKKLMD

SEQ ID NO: 569936 - protein, 9 aa, Homo Sapiens
MREMRAGGC

SEQ ID NO: 569937 - protein, 9 aa, Homo Sapiens
TTTRTSTPV

SEQ ID NO: 569938 - protein, 9 aa, Homo Sapiens
PVLEATRCE

SEQ ID NO: 569939 - protein, 9 aa, Homo Sapiens
LTVRLEGDE

SEQ ID NO: 569940 - protein, 9 aa, Homo Sapiens
WQALESDYV

SEQ ID NO: 569941 - protein, 9 aa, Homo Sapiens
QQVDITVMK

SEQ ID NO: 569942 - protein, 9 aa, Homo Sapiens
LKSLLTNMA

SEQ ID NO: 569943 - protein, 9 aa, Homo Sapiens
EGSSGNQPP

SEQ ID NO: 569944 - protein, 9 aa, Homo Sapiens
FILIHWQAL

SEQ ID NO: 569945 - protein, 9 aa, Homo Sapiens
HDDSKQSNL

SEQ ID NO: 569946 - protein, 9 aa, Homo Sapiens
EQDFFGENF

SEQ ID NO: 569947 - protein, 9 aa, Homo Sapiens
RHQWTHTGE

SEQ ID NO: 569948 - protein, 9 aa, Homo Sapiens
SSPESAALT

SEQ ID NO: 569949 - protein, 9 aa, Homo Sapiens
LLRHQWTHT

SEQ ID NO: 569950 - protein, 9 aa, Homo Sapiens
ALCRCSQLS

SEQ ID NO: 569951 - protein, 9 aa, Homo Sapiens
VPVLQRLSL

SEQ ID NO: 569952 - protein, 9 aa, Homo Sapiens
ISEQKRQVT

SEQ ID NO: 569953 - protein, 9 aa, Homo Sapiens
EGALLPGDM

SEQ ID NO: 569954 - protein, 9 aa, Homo Sapiens
DSPVGLAAH

SEQ ID NO: 569955 - protein, 9 aa, Homo Sapiens
WVDWSDQSP

SEQ ID NO: 569956 - protein, 9 aa, Homo Sapiens
WLVWRSSPQ

SEQ ID NO: 569957 - protein, 9 aa, Homo Sapiens
PFLWLVWRS

SEQ ID NO: 569958 - protein, 9 aa, Homo Sapiens
EWPTKPQAH

SEQ ID NO: 569959 - protein, 9 aa, Homo Sapiens
SKEGALLPG

SEQ ID NO: 569960 - protein, 9 aa, Homo Sapiens
KLPTEGLSS

SEQ ID NO: 569961 - protein, 9 aa, Homo Sapiens
FQFPLQSHL

SEQ ID NO: 569962 - protein, 9 aa, Homo Sapiens
RWSCRLPLG

SEQ ID NO: 569963 - protein, 9 aa, Homo Sapiens
SLAFISFGI

SEQ ID NO: 569964 - protein, 9 aa, Homo Sapiens
GNLVLEPQP

SEQ ID NO: 569965 - protein, 9 aa, Homo Sapiens
LQSSLRWSC

SEQ ID NO: 569966 - protein, 9 aa, Homo Sapiens
NPNLLATAS

SEQ ID NO: 569967 - protein, 9 aa, Homo Sapiens
ISKEGALLP

SEQ ID NO: 569968 - protein, 9 aa, Homo Sapiens
SAVPSAESQ

SEQ ID NO: 569969 - protein, 9 aa, Homo Sapiens
QLISSTIKT

SEQ ID NO: 569970 - protein, 9 aa, Homo Sapiens
LRHQWTHTG

SEQ ID NO: 569971 - protein, 9 aa, Homo Sapiens
VMKENFWDQ

SEQ ID NO: 569972 - protein, 9 aa, Homo Sapiens
KFKPDNPNL

SEQ ID NO: 569973 - protein, 9 aa, Homo Sapiens
QIPESDRIK

SEQ ID NO: 569974 - protein, 9 aa, Homo Sapiens
FQEKMKTQK

SEQ ID NO: 569975 - protein, 9 aa, Homo Sapiens
ELGRITARY

SEQ ID NO: 569976 - protein, 9 aa, Homo Sapiens
EQKRQVTCY

SEQ ID NO: 569977 - protein, 9 aa, Homo Sapiens
LSRKAESDM

SEQ ID NO: 569978 - protein, 9 aa, Homo Sapiens
DREHSRLSP

SEQ ID NO: 569979 - protein, 9 aa, Homo Sapiens
LGVSLRGAF

SEQ ID NO: 569980 - protein, 9 aa, Homo Sapiens
LQDINFINN

SEQ ID NO: 569981 - protein, 9 aa, Homo Sapiens
ALLIIPGFV

SEQ ID NO: 569982 - protein, 9 aa, Homo Sapiens
QMSSFLQVS

SEQ ID NO: 569983 - protein, 9 aa, Homo Sapiens
AAAELSKLR

SEQ ID NO: 569984 - protein, 9 aa, Homo Sapiens
AAQIPESDR

SEQ ID NO: 569985 - protein, 9 aa, Homo Sapiens
QVDITVMKE

SEQ ID NO: 569986 - protein, 9 aa, Homo Sapiens
AQYCRAAAE

SEQ ID NO: 569987 - protein, 9 aa, Homo Sapiens
KPYKCSERG

SEQ ID NO: 569988 - protein, 9 aa, Homo Sapiens
DGEVRLGVS

SEQ ID NO: 569989 - protein, 9 aa, Homo Sapiens
AAHILEKFS

SEQ ID NO: 569990 - protein, 9 aa, Homo Sapiens
ERGPEPSQL

SEQ ID NO: 569991 - protein, 9 aa, Homo Sapiens
PESAALTVR

SEQ ID NO: 569992 - protein, 9 aa, Homo Sapiens
MRAGGCCHA

SEQ ID NO: 569993 - protein, 9 aa, Homo Sapiens
VWRSSPQNF

SEQ ID NO: 569994 - protein, 9 aa, Homo Sapiens
SAESQWYKD

SEQ ID NO: 569995 - protein, 9 aa, Homo Sapiens
SRLSPQDDT

SEQ ID NO: 569996 - protein, 9 aa, Homo Sapiens
MENTSAVCF

SEQ ID NO: 569997 - protein, 9 aa, Homo Sapiens
QYCRAAAEL

SEQ ID NO: 569998 - protein, 9 aa, Homo Sapiens
EHSTTGHCP

SEQ ID NO: 569999 - protein, 9 aa, Homo Sapiens
CPEQDFFGE

SEQ ID NO: 570000 - protein, 9 aa, Homo Sapiens
CRLPLGHFQ

SEQ ID NO: 570001 - protein, 9 aa, Homo Sapiens
KLAKMCWHS

SEQ ID NO: 570002 - protein, 9 aa, Homo Sapiens
IGTLKSLLT

SEQ ID NO: 570003 - protein, 9 aa, Homo Sapiens
KMKTQKKLQ

SEQ ID NO: 570004 - protein, 9 aa, Homo Sapiens
ERSIREQHG

SEQ ID NO: 570005 - protein, 9 aa, Homo Sapiens
LEWPTKPQA

SEQ ID NO: 570006 - protein, 9 aa, Homo Sapiens
EINQAALLI

SEQ ID NO: 570007 - protein, 9 aa, Homo Sapiens
HWQALESDY

SEQ ID NO: 570008 - protein, 9 aa, Homo Sapiens
RLGVSLRGA

SEQ ID NO: 570009 - protein, 9 aa, Homo Sapiens
NQAALLIIP

SEQ ID NO: 570010 - protein, 9 aa, Homo Sapiens
REHSRLSPQ

SEQ ID NO: 570011 - protein, 9 aa, Homo Sapiens
RPVLEATRC

SEQ ID NO: 570012 - protein, 9 aa, Homo Sapiens
YRHLRPGGN

SEQ ID NO: 570013 - protein, 9 aa, Homo Sapiens
NLSRKAESD

SEQ ID NO: 570014 - protein, 9 aa, Homo Sapiens
PLGHFQFPL

SEQ ID NO: 570015 - protein, 9 aa, Homo Sapiens
GNQPPYLDA

SEQ ID NO: 570016 - protein, 9 aa, Homo Sapiens
YYTKIGYRL

SEQ ID NO: 570017 - protein, 9 aa, Homo Sapiens
NIVKHLQKL

SEQ ID NO: 570018 - protein, 9 aa, Homo Sapiens
QNQNLHDDS

SEQ ID NO: 570019 - protein, 9 aa, Homo Sapiens
VVQEGCGYN

SEQ ID NO: 570020 - protein, 9 aa, Homo Sapiens
GTRNYYTKI

SEQ ID NO: 570021 - protein, 9 aa, Homo Sapiens
EMFFQMSSF

SEQ ID NO: 570022 - protein, 9 aa, Homo Sapiens
LPISKEGAL

SEQ ID NO: 570023 - protein, 9 aa, Homo Sapiens
CGYNSSYIQ

SEQ ID NO: 570024 - protein, 9 aa, Homo Sapiens
LMEVEDPEV

SEQ ID NO: 570025 - protein, 9 aa, Homo Sapiens
LPALCRCSQ

SEQ ID NO: 570026 - protein, 9 aa, Homo Sapiens
RFDFTTTRT

SEQ ID NO: 570027 - protein, 9 aa, Homo Sapiens
HVDNFQDKP

SEQ ID NO: 570028 - protein, 9 aa, Homo Sapiens
SGNQPPYLD

SEQ ID NO: 570029 - protein, 9 aa, Homo Sapiens
ERQPRSPPK

SEQ ID NO: 570030 - protein, 9 aa, Homo Sapiens
QERSIREQH

SEQ ID NO: 570031 - protein, 9 aa, Homo Sapiens
SPESAALTV

SEQ ID NO: 570032 - protein, 9 aa, Homo Sapiens
FFQMSSFLQ

SEQ ID NO: 570033 - protein, 9 aa, Homo Sapiens
HSTTGHCPS

SEQ ID NO: 570034 - protein, 9 aa, Homo Sapiens
WGGGLLCPG

SEQ ID NO: 570035 - protein, 9 aa, Homo Sapiens
ANFQDAEDM

SEQ ID NO: 570036 - protein, 9 aa, Homo Sapiens
LIIPGFVER

SEQ ID NO: 570037 - protein, 9 aa, Homo Sapiens
LRPGGNLVL

SEQ ID NO: 570038 - protein, 9 aa, Homo Sapiens
DITVMKENF

SEQ ID NO: 570039 - protein, 9 aa, Homo Sapiens
LRWSCRLPL

SEQ ID NO: 570040 - protein, 9 aa, Homo Sapiens
HKLAKMCWH

SEQ ID NO: 570041 - protein, 9 aa, Homo Sapiens
DRIKQFKEF

SEQ ID NO: 570042 - protein, 9 aa, Homo Sapiens
ACLKFLAAK

SEQ ID NO: 570043 - protein, 9 aa, Homo Sapiens
SSGNQPPYL

SEQ ID NO: 570044 - protein, 9 aa, Homo Sapiens
ISLAFISFG

SEQ ID NO: 570045 - protein, 9 aa, Homo Sapiens
VSPPQLISS

SEQ ID NO: 570046 - protein, 9 aa, Homo Sapiens
SKSVSPPKC

SEQ ID NO: 570047 - protein, 9 aa, Homo Sapiens
CRAAAELSK

SEQ ID NO: 570048 - protein, 9 aa, Homo Sapiens
AVPSAESQW

SEQ ID NO: 570049 - protein, 9 aa, Homo Sapiens
DADISEQKR

SEQ ID NO: 570050 - protein, 9 aa, Homo Sapiens
SAVCFWRRD

SEQ ID NO: 570051 - protein, 9 aa, Homo Sapiens
SVVQEGCGY

SEQ ID NO: 570052 - protein, 9 aa, Homo Sapiens
TLVRLRHSP

SEQ ID NO: 570053 - protein, 9 aa, Homo Sapiens
SVSPPKCAK

SEQ ID NO: 570054 - protein, 9 aa, Homo Sapiens
EHSRLSPQD

SEQ ID NO: 570055 - protein, 9 aa, Homo Sapiens
FGIEPNYDF

SEQ ID NO: 570056 - protein, 9 aa, Homo Sapiens
LAKMCWHSL

SEQ ID NO: 570057 - protein, 9 aa, Homo Sapiens
VLEWPTKPQ

SEQ ID NO: 570058 - protein, 9 aa, Homo Sapiens
ITVMKENFW

SEQ ID NO: 570059 - protein, 9 aa, Homo Sapiens
HSRLSPQDD

SEQ ID NO: 570060 - protein, 9 aa, Homo Sapiens
LHKLAKMCW

SEQ ID NO: 570061 - protein, 9 aa, Homo Sapiens
TGHCPSLHI

SEQ ID NO: 570062 - protein, 9 aa, Homo Sapiens
QWTHTGERP

SEQ ID NO: 570063 - protein, 9 aa, Homo Sapiens
HYLFIGTLK

SEQ ID NO: 570064 - protein, 9 aa, Homo Sapiens
RLPLGHFQF

SEQ ID NO: 570065 - protein, 9 aa, Homo Sapiens
LAFISFGIE

SEQ ID NO: 570066 - protein, 9 aa, Homo Sapiens
TKPQAHPYF

SEQ ID NO: 570067 - protein, 9 aa, Homo Sapiens
ILPALCRCS

SEQ ID NO: 570068 - protein, 9 aa, Homo Sapiens
VGEHSTTGH

SEQ ID NO: 570069 - protein, 9 aa, Homo Sapiens
KFLAAKGIN

SEQ ID NO: 570070 - protein, 9 aa, Homo Sapiens
AILPALCRC

SEQ ID NO: 570071 - protein, 9 aa, Homo Sapiens
KPDNPNLLA

SEQ ID NO: 570072 - protein, 9 aa, Homo Sapiens
QKKLQSSLR

SEQ ID NO: 570073 - protein, 9 aa, Homo Sapiens
AGARTQERG

SEQ ID NO: 570074 - protein, 9 aa, Homo Sapiens
DDSKQSNLT

SEQ ID NO: 570075 - protein, 9 aa, Homo Sapiens
HTGERPFNC

SEQ ID NO: 570076 - protein, 9 aa, Homo Sapiens
AESDMLTAC

SEQ ID NO: 570077 - protein, 9 aa, Homo Sapiens
HAGARTQER

SEQ ID NO: 570078 - protein, 9 aa, Homo Sapiens
GSSGNQPPY

SEQ ID NO: 570079 - protein, 9 aa, Homo Sapiens
ARTQERGPE

SEQ ID NO: 570080 - protein, 9 aa, Homo Sapiens
PTKPQAHPY

SEQ ID NO: 570081 - protein, 9 aa, Homo Sapiens
FTTTRTSTP

SEQ ID NO: 570082 - protein, 9 aa, Homo Sapiens
LLCPGSTAI

SEQ ID NO: 570083 - protein, 9 aa, Homo Sapiens
AVTRHKGVK

SEQ ID NO: 570084 - protein, 9 aa, Homo Sapiens
ALWVDWSDQ

SEQ ID NO: 570085 - protein, 9 aa, Homo Sapiens
TSAVCFWRR

SEQ ID NO: 570086 - protein, 9 aa, Homo Sapiens
KRQVTCYIT

SEQ ID NO: 570087 - protein, 9 aa, Homo Sapiens
QKLPTEGLS

SEQ ID NO: 570088 - protein, 9 aa, Homo Sapiens
PRLFILIHW

SEQ ID NO: 570089 - protein, 9 aa, Homo Sapiens
CRCSQLSTF

SEQ ID NO: 570090 - protein, 9 aa, Homo Sapiens
HQWTHTGER

SEQ ID NO: 570091 - protein, 9 aa, Homo Sapiens
SAILPALCR

SEQ ID NO: 570092 - protein, 9 aa, Homo Sapiens
AELSKLRRA

SEQ ID NO: 570093 - protein, 9 aa, Homo Sapiens
NVEMFFQMS

SEQ ID NO: 570094 - protein, 9 aa, Homo Sapiens
INQAALLII

SEQ ID NO: 570095 - protein, 9 aa, Homo Sapiens
GPDLPRIFT

SEQ ID NO: 570096 - protein, 9 aa, Homo Sapiens
VSLRGAFSN

SEQ ID NO: 570097 - protein, 9 aa, Homo Sapiens
KTQKKLQSS

SEQ ID NO: 570098 - protein, 9 aa, Homo Sapiens
QNLHDDSKQ

SEQ ID NO: 570099 - protein, 9 aa, Homo Sapiens
THTGERPFN

SEQ ID NO: 570100 - protein, 9 aa, Homo Sapiens
QDAEDMPDR

SEQ ID NO: 570101 - protein, 9 aa, Homo Sapiens
MNLQERSIR

SEQ ID NO: 570102 - protein, 9 aa, Homo Sapiens
CGMREMRAG

SEQ ID NO: 570103 - protein, 9 aa, Homo Sapiens
QELHKLAKM

SEQ ID NO: 570104 - protein, 9 aa, Homo Sapiens
PPQLISSTI

SEQ ID NO: 570105 - protein, 9 aa, Homo Sapiens
GCGYNSSYI

SEQ ID NO: 570106 - protein, 9 aa, Homo Sapiens
YLFIGTLKS

SEQ ID NO: 570107 - protein, 9 aa, Homo Sapiens
RTSTPVTSN

SEQ ID NO: 570108 - protein, 9 aa, Homo Sapiens
MCWHSLLSV

SEQ ID NO: 570109 - protein, 9 aa, Homo Sapiens
DQNQNLHDD

SEQ ID NO: 570110 - protein, 9 aa, Homo Sapiens
LLCGMREMR

SEQ ID NO: 570111 - protein, 9 aa, Homo Sapiens
VEMFFQMSS

SEQ ID NO: 570112 - protein, 9 aa, Homo Sapiens
RAVTRHKGV

SEQ ID NO: 570113 - protein, 9 aa, Homo Sapiens
GVEEGSSGN

SEQ ID NO: 570114 - protein, 9 aa, Homo Sapiens
NQPPYLDAK

SEQ ID NO: 570115 - protein, 9 aa, Homo Sapiens
TQKKLQSSL

SEQ ID NO: 570116 - protein, 9 aa, Homo Sapiens
NYYTKIGYR

SEQ ID NO: 570117 - protein, 9 aa, Homo Sapiens
RGPEPSQLP

SEQ ID NO: 570118 - protein, 9 aa, Homo Sapiens
LELGRITAR

SEQ ID NO: 570119 - protein, 9 aa, Homo Sapiens
YGVLMEVED

SEQ ID NO: 570120 - protein, 9 aa, Homo Sapiens
HSPRAFIPP

SEQ ID NO: 570121 - protein, 9 aa, Homo Sapiens
RIKQFKEFL

SEQ ID NO: 570122 - protein, 9 aa, Homo Sapiens
TRTSTPVTS

SEQ ID NO: 570123 - protein, 9 aa, Homo Sapiens
KSLLTNMAG

SEQ ID NO: 570124 - protein, 9 aa, Homo Sapiens
ALLCGMREM

SEQ ID NO: 570125 - protein, 9 aa, Homo Sapiens
YTKIGYRLQ

SEQ ID NO: 570126 - protein, 9 aa, Homo Sapiens
ENVQTEFQE

SEQ ID NO: 570127 - protein, 9 aa, Homo Sapiens
FALLWGSAL

SEQ ID NO: 570128 - protein, 9 aa, Homo Sapiens
TRHKGVKKL

SEQ ID NO: 570129 - protein, 9 aa, Homo Sapiens
RLFILIHWQ

SEQ ID NO: 570130 - protein, 9 aa, Homo Sapiens
NTSAVCFWR

SEQ ID NO: 570131 - protein, 9 aa, Homo Sapiens
EKPYKCSER

SEQ ID NO: 570132 - protein, 9 aa, Homo Sapiens
IPESDRIKQ

SEQ ID NO: 570133 - protein, 9 aa, Homo Sapiens
EVEDPEVLQ

SEQ ID NO: 570134 - protein, 9 aa, Homo Sapiens
GALLPGDMG

SEQ ID NO: 570135 - protein, 9 aa, Homo Sapiens
EFQEKMKTQ

SEQ ID NO: 570136 - protein, 9 aa, Homo Sapiens
GGNLVLEPQ

SEQ ID NO: 570137 - protein, 9 aa, Homo Sapiens
SMLQDINFI

SEQ ID NO: 570138 - protein, 9 aa, Homo Sapiens
DFTTTRTST

SEQ ID NO: 570139 - protein, 9 aa, Homo Sapiens
MFFQMSSFL

SEQ ID NO: 570140 - protein, 9 aa, Homo Sapiens
FGENFEDPV

SEQ ID NO: 570141 - protein, 9 aa, Homo Sapiens
TVMKENFWD

SEQ ID NO: 570142 - protein, 9 aa, Homo Sapiens
TVRLEGDEL

SEQ ID NO: 570143 - protein, 9 aa, Homo Sapiens
AKMCWHSLL

SEQ ID NO: 570144 - protein, 9 aa, Homo Sapiens
GYNSSYIQN

SEQ ID NO: 570145 - protein, 9 aa, Homo Sapiens
VLQRLSLEV

SEQ ID NO: 570146 - protein, 9 aa, Homo Sapiens
GSALAAAAA

SEQ ID NO: 570147 - protein, 9 aa, Homo Sapiens
QDFFGENFE

SEQ ID NO: 570148 - protein, 9 aa, Homo Sapiens
KLQSSLRWS

SEQ ID NO: 570149 - protein, 9 aa, Homo Sapiens
FFGENFEDP

SEQ ID NO: 570150 - protein, 9 aa, Homo Sapiens
GVKKLMDEV

SEQ ID NO: 570151 - protein, 9 aa, Homo Sapiens
RSIREQHGK

SEQ ID NO: 570152 - protein, 9 aa, Homo Sapiens
YCRAAAELS

SEQ ID NO: 570153 - protein, 9 aa, Homo Sapiens
IENIDACLK

SEQ ID NO: 570154 - protein, 9 aa, Homo Sapiens
RVTLVRLRH

SEQ ID NO: 570155 - protein, 9 aa, Homo Sapiens
IKSSCSSSW

SEQ ID NO: 570156 - protein, 9 aa, Homo Sapiens
SPVGLAAHI

SEQ ID NO: 570157 - protein, 9 aa, Homo Sapiens
CFALLWGSA

SEQ ID NO: 570158 - protein, 9 aa, Homo Sapiens
IDREHSRLS

SEQ ID NO: 570159 - protein, 9 aa, Homo Sapiens
ACVGEHSTT

SEQ ID NO: 570160 - protein, 9 aa, Homo Sapiens
SRKAESDML

SEQ ID NO: 570161 - protein, 9 aa, Homo Sapiens
SCRLPLGHF

SEQ ID NO: 570162 - protein, 9 aa, Homo Sapiens
DISEQKRQV

SEQ ID NO: 570163 - protein, 9 aa, Homo Sapiens
AALTVRLEG

SEQ ID NO: 570164 - protein, 9 aa, Homo Sapiens
PQLISSTIK

SEQ ID NO: 570165 - protein, 9 aa, Homo Sapiens
RKAESDMLT

SEQ ID NO: 570166 - protein, 9 aa, Homo Sapiens
SQWYKDDKR

SEQ ID NO: 570167 - protein, 9 aa, Homo Sapiens
AVCFWRRDT

SEQ ID NO: 570168 - protein, 9 aa, Homo Sapiens
VDITVMKEN

SEQ ID NO: 570169 - protein, 9 aa, Homo Sapiens
TRNYYTKIG

SEQ ID NO: 570170 - protein, 9 aa, Homo Sapiens
HILEKFSTW

SEQ ID NO: 570171 - protein, 9 aa, Homo Sapiens
ILSMLQDIN

SEQ ID NO: 570172 - protein, 9 aa, Homo Sapiens
DLPRIFTSV

SEQ ID NO: 570173 - protein, 9 aa, Homo Sapiens
FDCKFKPDN

SEQ ID NO: 570174 - protein, 9 aa, Homo Sapiens
WRSSPQNFQ

SEQ ID NO: 570175 - protein, 9 aa, Homo Sapiens
RITARYGVE

SEQ ID NO: 570176 - protein, 9 aa, Homo Sapiens
RHKGVKKLM

SEQ ID NO: 570177 - protein, 9 aa, Homo Sapiens
TARYGVEPP

SEQ ID NO: 570178 - protein, 9 aa, Homo Sapiens
PKCAKNTET

SEQ ID NO: 570179 - protein, 9 aa, Homo Sapiens
AILSMLQDI

SEQ ID NO: 570180 - protein, 9 aa, Homo Sapiens
REMRAGGCC

SEQ ID NO: 570181 - protein, 9 aa, Homo Sapiens
CAKNTETQP

SEQ ID NO: 570182 - protein, 9 aa, Homo Sapiens
SLRWSCRLP

SEQ ID NO: 570183 - protein, 9 aa, Homo Sapiens
SHAGARTQE

SEQ ID NO: 570184 - protein, 9 aa, Homo Sapiens
QDINFINNY

SEQ ID NO: 570185 - protein, 9 aa, Homo Sapiens
ESAALTVRL

SEQ ID NO: 570186 - protein, 9 aa, Homo Sapiens
EMRAGGCCH

SEQ ID NO: 570187 - protein, 9 aa, Homo Sapiens
LWGSALAAA

SEQ ID NO: 570188 - protein, 9 aa, Homo Sapiens
AHILEKFST

SEQ ID NO: 570189 - protein, 9 aa, Homo Sapiens
SANFQDAED

SEQ ID NO: 570190 - protein, 9 aa, Homo Sapiens
AFISFGIEP

SEQ ID NO: 570191 - protein, 9 aa, Homo Sapiens
GENFEDPVL

SEQ ID NO: 570192 - protein, 9 aa, Homo Sapiens
VTLVRLRHS

SEQ ID NO: 570193 - protein, 9 aa, Homo Sapiens
IVKHLQKLP

SEQ ID NO: 570194 - protein, 9 aa, Homo Sapiens
GGGLLCPGS

SEQ ID NO: 570195 - protein, 9 aa, Homo Sapiens
ANLSRKAES

SEQ ID NO: 570196 - protein, 9 aa, Homo Sapiens
LESDNSSIK

SEQ ID NO: 570197 - protein, 9 aa, Homo Sapiens
SNSANFQDA

SEQ ID NO: 570198 - protein, 9 aa, Homo Sapiens
STTGHCPSL

SEQ ID NO: 570199 - protein, 9 aa, Homo Sapiens
PSAESQWYK

SEQ ID NO: 570200 - protein, 9 aa, Homo Sapiens
GGLLCPGST

SEQ ID NO: 570201 - protein, 9 aa, Homo Sapiens
QSHLQPCHL

SEQ ID NO: 570202 - protein, 9 aa, Homo Sapiens
VEDPEVLQD

SEQ ID NO: 570203 - protein, 9 aa, Homo Sapiens
LEATRCEAS

SEQ ID NO: 570204 - protein, 9 aa, Homo Sapiens
YHSHAGART

SEQ ID NO: 570205 - protein, 9 aa, Homo Sapiens
LFIGTLKSL

SEQ ID NO: 570206 - protein, 9 aa, Homo Sapiens
SEQKRQVTC

SEQ ID NO: 570207 - protein, 9 aa, Homo Sapiens
LCRCSQLST

SEQ ID NO: 570208 - protein, 9 aa, Homo Sapiens
TLKSLLTNM

SEQ ID NO: 570209 - protein, 9 aa, Homo Sapiens
PALCRCSQL

SEQ ID NO: 570210 - protein, 9 aa, Homo Sapiens
ESQWYKDDK

SEQ ID NO: 570211 - protein, 9 aa, Homo Sapiens
ALTVRLEGD

SEQ ID NO: 570212 - protein, 9 aa, Homo Sapiens
KAESDMLTA

SEQ ID NO: 570213 - protein, 9 aa, Homo Sapiens
SSVLEWPTK

SEQ ID NO: 570214 - protein, 9 aa, Homo Sapiens
RSSPQNFQG

SEQ ID NO: 570215 - protein, 9 aa, Homo Sapiens
KCSERGRAF

SEQ ID NO: 570216 - protein, 9 aa, Homo Sapiens
PYKCSERGR

SEQ ID NO: 570217 - protein, 9 aa, Homo Sapiens
DACLKFLAA

SEQ ID NO: 570218 - protein, 9 aa, Homo Sapiens
PDNPNLLAT

SEQ ID NO: 570219 - protein, 9 aa, Homo Sapiens
SPPQLISST

SEQ ID NO: 570220 - protein, 9 aa, Homo Sapiens
MSSFLQVSF

SEQ ID NO: 570221 - protein, 9 aa, Homo Sapiens
LLIIPGFVE

SEQ ID NO: 570222 - protein, 9 aa, Homo Sapiens
LAAHILEKF

SEQ ID NO: 570223 - protein, 9 aa, Homo Sapiens
HFQFPLQSH

SEQ ID NO: 570224 - protein, 9 aa, Homo Sapiens
TTGHCPSLH

SEQ ID NO: 570225 - protein, 9 aa, Homo Sapiens
RPGGNLVLE

SEQ ID NO: 570226 - protein, 9 aa, Homo Sapiens
NLHDDSKQS

SEQ ID NO: 570227 - protein, 9 aa, Homo Sapiens
LHDDSKQSN

SEQ ID NO: 570228 - protein, 9 aa, Homo Sapiens
DNVEMFFQM

SEQ ID NO: 570229 - protein, 9 aa, Homo Sapiens
RAAAELSKL

SEQ ID NO: 570230 - protein, 9 aa, Homo Sapiens
LSMLQDINF

SEQ ID NO: 570231 - protein, 9 aa, Homo Sapiens
RCEASWTRD

SEQ ID NO: 570232 - protein, 9 aa, Homo Sapiens
VEEGSSGNQ

SEQ ID NO: 570233 - protein, 9 aa, Homo Sapiens
VPSAESQWY

SEQ ID NO: 570234 - protein, 9 aa, Homo Sapiens
LISSTIKTH

SEQ ID NO: 570235 - protein, 9 aa, Homo Sapiens
TTRTSTPVT

SEQ ID NO: 570236 - protein, 9 aa, Homo Sapiens
RLSPQDDTN

SEQ ID NO: 570237 - protein, 9 aa, Homo Sapiens
NIDACLKFL

SEQ ID NO: 570238 - protein, 9 aa, Homo Sapiens
ERGRAFSQN

SEQ ID NO: 570239 - protein, 9 aa, Homo Sapiens
KEGALLPGD

SEQ ID NO: 570240 - protein, 9 aa, Homo Sapiens
SIKSSCSSS

SEQ ID NO: 570241 - protein, 9 aa, Homo Sapiens
PVGLAAHIL

SEQ ID NO: 570242 - protein, 9 aa, Homo Sapiens
HSHAGARTQ

SEQ ID NO: 570243 - protein, 9 aa, Homo Sapiens
GSSVSPPQL

SEQ ID NO: 570244 - protein, 9 aa, Homo Sapiens
PLQSHLQPC

SEQ ID NO: 570245 - protein, 9 aa, Homo Sapiens
TQERGPEPS

SEQ ID NO: 570246 - protein, 9 aa, Homo Sapiens
DNPNLLATA

SEQ ID NO: 570247 - protein, 9 aa, Homo Sapiens
IDACLKFLA

SEQ ID NO: 570248 - protein, 9 aa, Homo Sapiens
DINFINNYK

SEQ ID NO: 570249 - protein, 9 aa, Homo Sapiens
VKHLQKLPT

SEQ ID NO: 570250 - protein, 9 aa, Homo Sapiens
RHLRPGGNL

SEQ ID NO: 570251 - protein, 9 aa, Homo Sapiens
KHLQKLPTE

SEQ ID NO: 570252 - protein, 9 aa, Homo Sapiens
LPFLWLVWR

SEQ ID NO: 570253 - protein, 9 aa, Homo Sapiens
GSTAINSTA

SEQ ID NO: 570254 - protein, 9 aa, Homo Sapiens
LQPCHLLRM

SEQ ID NO: 570255 - protein, 9 aa, Homo Sapiens
AQIPESDRI

SEQ ID NO: 570256 - protein, 9 aa, Homo Sapiens
WTHTGERPF

SEQ ID NO: 570257 - protein, 9 aa, Homo Sapiens
LGRITARYG

SEQ ID NO: 570258 - protein, 9 aa, Homo Sapiens
LLWGSALAA

SEQ ID NO: 570259 - protein, 9 aa, Homo Sapiens
SQLPFLWLV

SEQ ID NO: 570260 - protein, 9 aa, Homo Sapiens
PGGNLVLEP

SEQ ID NO: 570261 - protein, 9 aa, Homo Sapiens
GTLKSLLTN

SEQ ID NO: 570262 - protein, 9 aa, Homo Sapiens
HLQPCHLLR

SEQ ID NO: 570263 - protein, 9 aa, Homo Sapiens
WPTKPQAHP

SEQ ID NO: 570264 - protein, 9 aa, Homo Sapiens
PGSTAINST

SEQ ID NO: 570265 - protein, 9 aa, Homo Sapiens
SAALTVRLE

SEQ ID NO: 570266 - protein, 9 aa, Homo Sapiens
RIFTSVTSY

SEQ ID NO: 570267 - protein, 9 aa, Homo Sapiens
TGERPFNCK

SEQ ID NO: 570268 - protein, 9 aa, Homo Sapiens
LQSHLQPCH

SEQ ID NO: 570269 - protein, 9 aa, Homo Sapiens
GEVRLGVSL

SEQ ID NO: 570270 - protein, 9 aa, Homo Sapiens
KMCWHSLLS

SEQ ID NO: 570271 - protein, 9 aa, Homo Sapiens
AAWGGGLLC

SEQ ID NO: 570272 - protein, 9 aa, Homo Sapiens
WSDQSPQAR

SEQ ID NO: 570273 - protein, 9 aa, Homo Sapiens
FDFTTTRTS

SEQ ID NO: 570274 - protein, 9 aa, Homo Sapiens
CVGEHSTTG

SEQ ID NO: 570275 - protein, 9 aa, Homo Sapiens
LEALWVDWS

SEQ ID NO: 570276 - protein, 9 aa, Homo Sapiens
VQEGCGYNS

SEQ ID NO: 570277 - protein, 9 aa, Homo Sapiens
CPGSTAINS

SEQ ID NO: 570278 - protein, 9 aa, Homo Sapiens
IIDREHSRL

SEQ ID NO: 570279 - protein, 9 aa, Homo Sapiens
IHWQALESD

SEQ ID NO: 570280 - protein, 9 aa, Homo Sapiens
FIGTLKSLL

SEQ ID NO: 570281 - protein, 9 aa, Homo Sapiens
SFGIEPNYD

SEQ ID NO: 570282 - protein, 9 aa, Homo Sapiens
GIEPNYDFL

SEQ ID NO: 570283 - protein, 9 aa, Homo Sapiens
LVWRSSPQN

SEQ ID NO: 570284 - protein, 9 aa, Homo Sapiens
ESDRIKQFK

SEQ ID NO: 570285 - protein, 9 aa, Homo Sapiens
LVRLRHSPR

SEQ ID NO: 570286 - protein, 9 aa, Homo Sapiens
VRLGVSLRG

SEQ ID NO: 570287 - protein, 9 aa, Homo Sapiens
RANVPVLQR

SEQ ID NO: 570288 - protein, 9 aa, Homo Sapiens
LWVDWSDQS

SEQ ID NO: 570289 - protein, 9 aa, Homo Sapiens
NSANFQDAE

SEQ ID NO: 570290 - protein, 9 aa, Homo Sapiens
DAEDMPDRC

SEQ ID NO: 570291 - protein, 9 aa, Homo Sapiens
LCGMREMRA

SEQ ID NO: 570292 - protein, 9 aa, Homo Sapiens
SMNLQERSI

SEQ ID NO: 570293 - protein, 9 aa, Homo Sapiens
EGCGYNSSY

SEQ ID NO: 570294 - protein, 9 aa, Homo Sapiens
VRLRHSPRA

SEQ ID NO: 570295 - protein, 9 aa, Homo Sapiens
LQKLPTEGL

SEQ ID NO: 570296 - protein, 9 aa, Homo Sapiens
EEGSSGNQP

SEQ ID NO: 570297 - protein, 9 aa, Homo Sapiens
HIIDREHSR

SEQ ID NO: 570298 - protein, 9 aa, Homo Sapiens
PSQLPFLWL

SEQ ID NO: 570299 - protein, 9 aa, Homo Sapiens
MKTQKKLQS

SEQ ID NO: 570300 - protein, 9 aa, Homo Sapiens
QDGEVRLGV

SEQ ID NO: 570301 - protein, 9 aa, Homo Sapiens
SDQSPQARV

SEQ ID NO: 570302 - protein, 9 aa, Homo Sapiens
LSAILPALC

SEQ ID NO: 570303 - protein, 9 aa, Homo Sapiens
RTQERGPEP

SEQ ID NO: 570304 - protein, 9 aa, Homo Sapiens
VSPPKCAKN

SEQ ID NO: 570305 - protein, 9 aa, Homo Sapiens
QAQYCRAAA

SEQ ID NO: 570306 - protein, 9 aa, Homo Sapiens
KKLQSSLRW

SEQ ID NO: 570307 - protein, 9 aa, Homo Sapiens
TANLSRKAE

SEQ ID NO: 570308 - protein, 9 aa, Homo Sapiens
ISFGIEPNY

SEQ ID NO: 570309 - protein, 9 aa, Homo Sapiens
SERGRAFSQ

SEQ ID NO: 570310 - protein, 9 aa, Homo Sapiens
CSERGRAFS

SEQ ID NO: 570311 - protein, 9 aa, Homo Sapiens
ALLWGSALA

SEQ ID NO: 570312 - protein, 9 aa, Homo Sapiens
NVQTEFQEK

SEQ ID NO: 570313 - protein, 9 aa, Homo Sapiens
YKCSERGRA

SEQ ID NO: 570314 - protein, 9 aa, Homo Sapiens
SSLRWSCRL

SEQ ID NO: 570315 - protein, 9 aa, Homo Sapiens
QFPLQSHLQ

SEQ ID NO: 570316 - protein, 9 aa, Homo Sapiens
LLELGRITA

SEQ ID NO: 570317 - protein, 9 aa, Homo Sapiens
GLAAHILEK

SEQ ID NO: 570318 - protein, 9 aa, Homo Sapiens
SVSPPQLIS

SEQ ID NO: 570319 - protein, 9 aa, Homo Sapiens
LPTEGLSSV

SEQ ID NO: 570320 - protein, 9 aa, Homo Sapiens
ITARYGVEP

SEQ ID NO: 570321 - protein, 9 aa, Homo Sapiens
VLMEVEDPE

SEQ ID NO: 570322 - protein, 9 aa, Homo Sapiens
TEFQEKMKT

SEQ ID NO: 570323 - protein, 9 aa, Homo Sapiens
NLQERSIRE

SEQ ID NO: 570324 - protein, 9 aa, Homo Sapiens
GRITARYGV

SEQ ID NO: 570325 - protein, 9 aa, Homo Sapiens
PEQDFFGEN

SEQ ID NO: 570326 - protein, 9 aa, Homo Sapiens
QRLSLEVKK

SEQ ID NO: 570327 - protein, 9 aa, Homo Sapiens
GRPVLEATR

SEQ ID NO: 570328 - protein, 9 aa, Homo Sapiens
ANVPVLQRL

SEQ ID NO: 570329 - protein, 9 aa, Homo Sapiens
PRIFTSVTS

SEQ ID NO: 570330 - protein, 9 aa, Homo Sapiens
EKMKTQKKL

SEQ ID NO: 570331 - protein, 9 aa, Homo Sapiens
VGLAAHILE

SEQ ID NO: 570332 - protein, 9 aa, Homo Sapiens
RGRAFSQNA

SEQ ID NO: 570333 - protein, 9 aa, Homo Sapiens
NFQDAEDMP

SEQ ID NO: 570334 - protein, 9 aa, Homo Sapiens
IFTSVTSYY

SEQ ID NO: 570335 - protein, 9 aa, Homo Sapiens
QPCHLLRMP

SEQ ID NO: 570336 - protein, 9 aa, Homo Sapiens
LFILIHWQA

SEQ ID NO: 570337 - protein, 9 aa, Homo Sapiens
ATRCEASWT

SEQ ID NO: 570338 - protein, 9 aa, Homo Sapiens
PLPISKEGA

SEQ ID NO: 570339 - protein, 9 aa, Homo Sapiens
KGVKKLMDE

SEQ ID NO: 570340 - protein, 9 aa, Homo Sapiens
ESDNSSIKS

SEQ ID NO: 570341 - protein, 9 aa, Homo Sapiens
ESDMLTACK

SEQ ID NO: 570342 - protein, 9 aa, Homo Sapiens
VDWSDQSPQ

SEQ ID NO: 570343 - protein, 9 aa, Homo Sapiens
FPLQSHLQP

SEQ ID NO: 570344 - protein, 9 aa, Homo Sapiens
EALWVDWSD

SEQ ID NO: 570345 - protein, 9 aa, Homo Sapiens
KSVSPPKCA

SEQ ID NO: 570346 - protein, 9 aa, Homo Sapiens
VCFWRRDTG

SEQ ID NO: 570347 - protein, 9 aa, Homo Sapiens
DCKFKPDNP

SEQ ID NO: 570348 - protein, 9 aa, Homo Sapiens
GEHSTTGHC

SEQ ID NO: 570349 - protein, 9 aa, Homo Sapiens
SVLEWPTKP

SEQ ID NO: 570350 - protein, 9 aa, Homo Sapiens
RLRHSPRAF

SEQ ID NO: 570351 - protein, 9 aa, Homo Sapiens
GARTQERGP

SEQ ID NO: 570352 - protein, 9 aa, Homo Sapiens
CFWRRDTGQ

SEQ ID NO: 570353 - protein, 9 aa, Homo Sapiens
EPSQLPFLW

SEQ ID NO: 570354 - protein, 9 aa, Homo Sapiens
LSMNLQERS

SEQ ID NO: 570355 - protein, 9 aa, Homo Sapiens
ASAVPSAES

SEQ ID NO: 570356 - protein, 9 aa, Homo Sapiens
ACFALLWGS

SEQ ID NO: 570357 - protein, 9 aa, Homo Sapiens
HLRPGGNLV

SEQ ID NO: 570358 - protein, 9 aa, Homo Sapiens
AWGGGLLCP

SEQ ID NO: 570359 - protein, 9 aa, Homo Sapiens
GMREMRAGG

SEQ ID NO: 570360 - protein, 9 aa, Homo Sapiens
FTSVTSYYS

SEQ ID NO: 570361 - protein, 9 aa, Homo Sapiens
ALESDNSSI

SEQ ID NO: 570362 - protein, 9 aa, Homo Sapiens
PPKCAKNTE

SEQ ID NO: 570363 - protein, 9 aa, Homo Sapiens
SSVSPPQLI

SEQ ID NO: 570364 - protein, 9 aa, Homo Sapiens
DNFQDKPAI

SEQ ID NO: 570365 - protein, 9 aa, Homo Sapiens
TSVTSYYSG

SEQ ID NO: 570366 - protein, 9 aa, Homo Sapiens
DFFGENFED

SEQ ID NO: 570367 - protein, 9 aa, Homo Sapiens
PISKEGALL

SEQ ID NO: 570368 - protein, 9 aa, Homo Sapiens
VQTEFQEKM

SEQ ID NO: 570369 - protein, 9 aa, Homo Sapiens
GHFQFPLQS

SEQ ID NO: 570370 - protein, 9 aa, Homo Sapiens
WGRLHSHCP

SEQ ID NO: 570371 - protein, 9 aa, Homo Sapiens
PITTTLKCK

SEQ ID NO: 570372 - protein, 9 aa, Homo Sapiens
KIKSAWMNG

SEQ ID NO: 570373 - protein, 9 aa, Homo Sapiens
AQYHSRLDE

SEQ ID NO: 570374 - protein, 9 aa, Homo Sapiens
LLAATEASV

SEQ ID NO: 570375 - protein, 9 aa, Homo Sapiens
IGGNGSLTG

SEQ ID NO: 570376 - protein, 9 aa, Homo Sapiens
KKHFTPWLR

SEQ ID NO: 570377 - protein, 9 aa, Homo Sapiens
DRLSWECCD

SEQ ID NO: 570378 - protein, 9 aa, Homo Sapiens
AQELQGQIE

SEQ ID NO: 570379 - protein, 9 aa, Homo Sapiens
LHKFFSDAQ

SEQ ID NO: 570380 - protein, 9 aa, Homo Sapiens
SGGNMTLQC

SEQ ID NO: 570381 - protein, 9 aa, Homo Sapiens
STPSIEDKS

SEQ ID NO: 570382 - protein, 9 aa, Homo Sapiens
NSLAQYHSR

SEQ ID NO: 570383 - protein, 9 aa, Homo Sapiens
TWSSMTPHQ

SEQ ID NO: 570384 - protein, 9 aa, Homo Sapiens
CQTWSSMTP

SEQ ID NO: 570385 - protein, 9 aa, Homo Sapiens
GNGSLTGAN

SEQ ID NO: 570386 - protein, 9 aa, Homo Sapiens
DQSSPVPRA

SEQ ID NO: 570387 - protein, 9 aa, Homo Sapiens
WINVATPGS

SEQ ID NO: 570388 - protein, 9 aa, Homo Sapiens
KPERRPPQG

SEQ ID NO: 570389 - protein, 9 aa, Homo Sapiens
MTLQCGSQK

SEQ ID NO: 570390 - protein, 9 aa, Homo Sapiens
GGNMTLQCG

SEQ ID NO: 570391 - protein, 9 aa, Homo Sapiens
PFCTEFTGI

SEQ ID NO: 570392 - protein, 9 aa, Homo Sapiens
YGVPACSHV

SEQ ID NO: 570393 - protein, 9 aa, Homo Sapiens
GNMTLQCGS

SEQ ID NO: 570394 - protein, 9 aa, Homo Sapiens
LHSHCPRHC

SEQ ID NO: 570395 - protein, 9 aa, Homo Sapiens
PVPRAPSPI

SEQ ID NO: 570396 - protein, 9 aa, Homo Sapiens
QAMIRGMVD

SEQ ID NO: 570397 - protein, 9 aa, Homo Sapiens
ENSLAQYHS

SEQ ID NO: 570398 - protein, 9 aa, Homo Sapiens
ECGLLLIPD

SEQ ID NO: 570399 - protein, 9 aa, Homo Sapiens
PWGRLHSHC

SEQ ID NO: 570400 - protein, 9 aa, Homo Sapiens
RGRVHSPGN

SEQ ID NO: 570401 - protein, 9 aa, Homo Sapiens
MVDEEGNQF

SEQ ID NO: 570402 - protein, 9 aa, Homo Sapiens
LCVIGGNGS

SEQ ID NO: 570403 - protein, 9 aa, Homo Sapiens
RHSKYSVTK

SEQ ID NO: 570404 - protein, 9 aa, Homo Sapiens
NLCVIGGNG

SEQ ID NO: 570405 - protein, 9 aa, Homo Sapiens
DAQELQGQI

SEQ ID NO: 570406 - protein, 9 aa, Homo Sapiens
KQNQELKTI

SEQ ID NO: 570407 - protein, 9 aa, Homo Sapiens
LLEIAIRAD

SEQ ID NO: 570408 - protein, 9 aa, Homo Sapiens
LAATEASVE

SEQ ID NO: 570409 - protein, 9 aa, Homo Sapiens
IIVLTTTGC

SEQ ID NO: 570410 - protein, 9 aa, Homo Sapiens
FLCPWRAES

SEQ ID NO: 570411 - protein, 9 aa, Homo Sapiens
MRDLMKITR

SEQ ID NO: 570412 - protein, 9 aa, Homo Sapiens
TLRHSKYSV

SEQ ID NO: 570413 - protein, 9 aa, Homo Sapiens
HFLGQLLEI

SEQ ID NO: 570414 - protein, 9 aa, Homo Sapiens
CHLSTLKLS

SEQ ID NO: 570415 - protein, 9 aa, Homo Sapiens
LEIAIRADV

SEQ ID NO: 570416 - protein, 9 aa, Homo Sapiens
SFWINVATP

SEQ ID NO: 570417 - protein, 9 aa, Homo Sapiens
IEDKSEEPP

SEQ ID NO: 570418 - protein, 9 aa, Homo Sapiens
FFSDAQELQ

SEQ ID NO: 570419 - protein, 9 aa, Homo Sapiens
STLKLSVQR

SEQ ID NO: 570420 - protein, 9 aa, Homo Sapiens
RYDFRQSCW

SEQ ID NO: 570421 - protein, 9 aa, Homo Sapiens
YCCHLSTLK

SEQ ID NO: 570422 - protein, 9 aa, Homo Sapiens
LISTPSIED

SEQ ID NO: 570423 - protein, 9 aa, Homo Sapiens
CKQEEVSAI

SEQ ID NO: 570424 - protein, 9 aa, Homo Sapiens
SGQCPSLLF

SEQ ID NO: 570425 - protein, 9 aa, Homo Sapiens
RVHSPGNFD

SEQ ID NO: 570426 - protein, 9 aa, Homo Sapiens
FTPWLRMRD

SEQ ID NO: 570427 - protein, 9 aa, Homo Sapiens
ITTTLKCKQ

SEQ ID NO: 570428 - protein, 9 aa, Homo Sapiens
AGSGSFWIN

SEQ ID NO: 570429 - protein, 9 aa, Homo Sapiens
MIRGMVDEE

SEQ ID NO: 570430 - protein, 9 aa, Homo Sapiens
TEFTGIIQA

SEQ ID NO: 570431 - protein, 9 aa, Homo Sapiens
TTTGCSAQL

SEQ ID NO: 570432 - protein, 9 aa, Homo Sapiens
LDYCCHLST

SEQ ID NO: 570433 - protein, 9 aa, Homo Sapiens
GMVDEEGNQ

SEQ ID NO: 570434 - protein, 9 aa, Homo Sapiens
AMIRGMVDE

SEQ ID NO: 570435 - protein, 9 aa, Homo Sapiens
VTGRTCQTW

SEQ ID NO: 570436 - protein, 9 aa, Homo Sapiens
TTTLKCKQE

SEQ ID NO: 570437 - protein, 9 aa, Homo Sapiens
TPSIEDKSE

SEQ ID NO: 570438 - protein, 9 aa, Homo Sapiens
QCGSQKGYH

SEQ ID NO: 570439 - protein, 9 aa, Homo Sapiens
AATEASVEE

SEQ ID NO: 570440 - protein, 9 aa, Homo Sapiens
VIGGNGSLT

SEQ ID NO: 570441 - protein, 9 aa, Homo Sapiens
ISTPSIEDK

SEQ ID NO: 570442 - protein, 9 aa, Homo Sapiens
PAHTCPYGV

SEQ ID NO: 570443 - protein, 9 aa, Homo Sapiens
WECCDLAQC

SEQ ID NO: 570444 - protein, 9 aa, Homo Sapiens
RRYDFRQSC

SEQ ID NO: 570445 - protein, 9 aa, Homo Sapiens
HSHCPRHCP

SEQ ID NO: 570446 - protein, 9 aa, Homo Sapiens
VTDFMKLEE

SEQ ID NO: 570447 - protein, 9 aa, Homo Sapiens
GLLLIPDKG

SEQ ID NO: 570448 - protein, 9 aa, Homo Sapiens
CPWRAESGQ

SEQ ID NO: 570449 - protein, 9 aa, Homo Sapiens
CPPAHTCPY

SEQ ID NO: 570450 - protein, 9 aa, Homo Sapiens
AHLSRVSPE

SEQ ID NO: 570451 - protein, 9 aa, Homo Sapiens
LVTDFMKLE

SEQ ID NO: 570452 - protein, 9 aa, Homo Sapiens
KFFSDAQEL

SEQ ID NO: 570453 - protein, 9 aa, Homo Sapiens
RALGFKPRK

SEQ ID NO: 570454 - protein, 9 aa, Homo Sapiens
AMRALGFKP

SEQ ID NO: 570455 - protein, 9 aa, Homo Sapiens
EENSLAQYH

SEQ ID NO: 570456 - protein, 9 aa, Homo Sapiens
IVLTTTGCS

SEQ ID NO: 570457 - protein, 9 aa, Homo Sapiens
DVEGPWFRR

SEQ ID NO: 570458 - protein, 9 aa, Homo Sapiens
SIEDKSEEP

SEQ ID NO: 570459 - protein, 9 aa, Homo Sapiens
THLVTDFMK

SEQ ID NO: 570460 - protein, 9 aa, Homo Sapiens
DWKKHFTPW

SEQ ID NO: 570461 - protein, 9 aa, Homo Sapiens
VHSPGNFDW

SEQ ID NO: 570462 - protein, 9 aa, Homo Sapiens
LTTTGCSAQ

SEQ ID NO: 570463 - protein, 9 aa, Homo Sapiens
LLLGMKQNQ

SEQ ID NO: 570464 - protein, 9 aa, Homo Sapiens
LLLIPDKGK

SEQ ID NO: 570465 - protein, 9 aa, Homo Sapiens
WRAESGQCP

SEQ ID NO: 570466 - protein, 9 aa, Homo Sapiens
LSTLKLSVQ

SEQ ID NO: 570467 - protein, 9 aa, Homo Sapiens
RMRDLMKIT

SEQ ID NO: 570468 - protein, 9 aa, Homo Sapiens
SHCPRHCPP

SEQ ID NO: 570469 - protein, 9 aa, Homo Sapiens
RAPSPIAQA

SEQ ID NO: 570470 - protein, 9 aa, Homo Sapiens
LSRVSPERP

SEQ ID NO: 570471 - protein, 9 aa, Homo Sapiens
MRALGFKPR

SEQ ID NO: 570472 - protein, 9 aa, Homo Sapiens
LLGMKQNQE

SEQ ID NO: 570473 - protein, 9 aa, Homo Sapiens
VQRGRVHSP

SEQ ID NO: 570474 - protein, 9 aa, Homo Sapiens
WLRMRDLMK

SEQ ID NO: 570475 - protein, 9 aa, Homo Sapiens
AESGQCPSL

SEQ ID NO: 570476 - protein, 9 aa, Homo Sapiens
GQECGLLLI

SEQ ID NO: 570477 - protein, 9 aa, Homo Sapiens
TPWLRMRDL

SEQ ID NO: 570478 - protein, 9 aa, Homo Sapiens
LRMRDLMKI

SEQ ID NO: 570479 - protein, 9 aa, Homo Sapiens
CTEFTGIIQ

SEQ ID NO: 570480 - protein, 9 aa, Homo Sapiens
WFRRYDFRQ

SEQ ID NO: 570481 - protein, 9 aa, Homo Sapiens
SWECCDLAQ

SEQ ID NO: 570482 - protein, 9 aa, Homo Sapiens
GKEPKIKSA

SEQ ID NO: 570483 - protein, 9 aa, Homo Sapiens
FCTEFTGII

SEQ ID NO: 570484 - protein, 9 aa, Homo Sapiens
KRSSKEEAS

SEQ ID NO: 570485 - protein, 9 aa, Homo Sapiens
FDITHLVTD

SEQ ID NO: 570486 - protein, 9 aa, Homo Sapiens
LEEENSLAQ

SEQ ID NO: 570487 - protein, 9 aa, Homo Sapiens
GTWASRELL

SEQ ID NO: 570488 - protein, 9 aa, Homo Sapiens
LGQLLEIAI

SEQ ID NO: 570489 - protein, 9 aa, Homo Sapiens
TVTGRTCQT

SEQ ID NO: 570490 - protein, 9 aa, Homo Sapiens
HLSRVSPER

SEQ ID NO: 570491 - protein, 9 aa, Homo Sapiens
LLLLGMKQN

SEQ ID NO: 570492 - protein, 9 aa, Homo Sapiens
EASVEEAPA

SEQ ID NO: 570493 - protein, 9 aa, Homo Sapiens
ALGFKPRKE

SEQ ID NO: 570494 - protein, 9 aa, Homo Sapiens
TDFMKLEEP

SEQ ID NO: 570495 - protein, 9 aa, Homo Sapiens
QECGLLLIP

SEQ ID NO: 570496 - protein, 9 aa, Homo Sapiens
CGLLLIPDK

SEQ ID NO: 570497 - protein, 9 aa, Homo Sapiens
GPWFRRYDF

SEQ ID NO: 570498 - protein, 9 aa, Homo Sapiens
ELISTPSIE

SEQ ID NO: 570499 - protein, 9 aa, Homo Sapiens
CVIGGNGSL

SEQ ID NO: 570500 - protein, 9 aa, Homo Sapiens
PPWGRLHSH

SEQ ID NO: 570501 - protein, 9 aa, Homo Sapiens
KEEASMKKV

SEQ ID NO: 570502 - protein, 9 aa, Homo Sapiens
QSSPVPRAP

SEQ ID NO: 570503 - protein, 9 aa, Homo Sapiens
GLLLLGMKQ

SEQ ID NO: 570504 - protein, 9 aa, Homo Sapiens
HFTPWLRMR

SEQ ID NO: 570505 - protein, 9 aa, Homo Sapiens
VSPERPRPE

SEQ ID NO: 570506 - protein, 9 aa, Homo Sapiens
FKPRKEEMK

SEQ ID NO: 570507 - protein, 9 aa, Homo Sapiens
TLKCKQEEV

SEQ ID NO: 570508 - protein, 9 aa, Homo Sapiens
ERRPPQGGN

SEQ ID NO: 570509 - protein, 9 aa, Homo Sapiens
MKQNQELKT

SEQ ID NO: 570510 - protein, 9 aa, Homo Sapiens
TGCSAQLLS

SEQ ID NO: 570511 - protein, 9 aa, Homo Sapiens
PYGVPACSH

SEQ ID NO: 570512 - protein, 9 aa, Homo Sapiens
QFDITHLVT

SEQ ID NO: 570513 - protein, 9 aa, Homo Sapiens
ASGGNMTLQ

SEQ ID NO: 570514 - protein, 9 aa, Homo Sapiens
VTSTLRHSK

SEQ ID NO: 570515 - protein, 9 aa, Homo Sapiens
TGQECGLLL

SEQ ID NO: 570516 - protein, 9 aa, Homo Sapiens
SKEEASMKK

SEQ ID NO: 570517 - protein, 9 aa, Homo Sapiens
KKRSSKEEA

SEQ ID NO: 570518 - protein, 9 aa, Homo Sapiens
EPKIKSAWM

SEQ ID NO: 570519 - protein, 9 aa, Homo Sapiens
KEPKIKSAW

SEQ ID NO: 570520 - protein, 9 aa, Homo Sapiens
PRAPSPIAQ

SEQ ID NO: 570521 - protein, 9 aa, Homo Sapiens
RTCQTWSSM

SEQ ID NO: 570522 - protein, 9 aa, Homo Sapiens
DLMKITRRK

SEQ ID NO: 570523 - protein, 9 aa, Homo Sapiens
SSPVPRAPS

SEQ ID NO: 570524 - protein, 9 aa, Homo Sapiens
IRGMVDEEG

SEQ ID NO: 570525 - protein, 9 aa, Homo Sapiens
VLTTTGCSA

SEQ ID NO: 570526 - protein, 9 aa, Homo Sapiens
TPFCTEFTG

SEQ ID NO: 570527 - protein, 9 aa, Homo Sapiens
GKPERRPPQ

SEQ ID NO: 570528 - protein, 9 aa, Homo Sapiens
PPPGKPERR

SEQ ID NO: 570529 - protein, 9 aa, Homo Sapiens
AHTCPYGVP

SEQ ID NO: 570530 - protein, 9 aa, Homo Sapiens
SLAQYHSRL

SEQ ID NO: 570531 - protein, 9 aa, Homo Sapiens
SVEEAPAEV

SEQ ID NO: 570532 - protein, 9 aa, Homo Sapiens
SPVPRAPSP

SEQ ID NO: 570533 - protein, 9 aa, Homo Sapiens
NMTLQCGSQ

SEQ ID NO: 570534 - protein, 9 aa, Homo Sapiens
ATEASVEEA

SEQ ID NO: 570535 - protein, 9 aa, Homo Sapiens
KHFTPWLRM

SEQ ID NO: 570536 - protein, 9 aa, Homo Sapiens
LSWECCDLA

SEQ ID NO: 570537 - protein, 9 aa, Homo Sapiens
RGMVDEEGN

SEQ ID NO: 570538 - protein, 9 aa, Homo Sapiens
TTLKCKQEE

SEQ ID NO: 570539 - protein, 9 aa, Homo Sapiens
SDAQELQGQ

SEQ ID NO: 570540 - protein, 9 aa, Homo Sapiens
GQLLEIAIR

SEQ ID NO: 570541 - protein, 9 aa, Homo Sapiens
RLHSHCPRH

SEQ ID NO: 570542 - protein, 9 aa, Homo Sapiens
ITHLVTDFM

SEQ ID NO: 570543 - protein, 9 aa, Homo Sapiens
SRELLRPRC

SEQ ID NO: 570544 - protein, 9 aa, Homo Sapiens
GRVHSPGNF

SEQ ID NO: 570545 - protein, 9 aa, Homo Sapiens
CPYGVPACS

SEQ ID NO: 570546 - protein, 9 aa, Homo Sapiens
LKCKQEEVS

SEQ ID NO: 570547 - protein, 9 aa, Homo Sapiens
SSKEEASMK

SEQ ID NO: 570548 - protein, 9 aa, Homo Sapiens
RDRLSWECC

SEQ ID NO: 570549 - protein, 9 aa, Homo Sapiens
FTGIIQAMV

SEQ ID NO: 570550 - protein, 9 aa, Homo Sapiens
DYCCHLSTL

SEQ ID NO: 570551 - protein, 9 aa, Homo Sapiens
ASVEEAPAE

SEQ ID NO: 570552 - protein, 9 aa, Homo Sapiens
GRTCQTWSS

SEQ ID NO: 570553 - protein, 9 aa, Homo Sapiens
HLSTLKLSV

SEQ ID NO: 570554 - protein, 9 aa, Homo Sapiens
EIAIRADVP

SEQ ID NO: 570555 - protein, 9 aa, Homo Sapiens
SQAMIRGMV

SEQ ID NO: 570556 - protein, 9 aa, Homo Sapiens
EPITTTLKC

SEQ ID NO: 570557 - protein, 9 aa, Homo Sapiens
TLQCGSQKG

SEQ ID NO: 570558 - protein, 9 aa, Homo Sapiens
CCHLSTLKL

SEQ ID NO: 570559 - protein, 9 aa, Homo Sapiens
IKSAWMNGE

SEQ ID NO: 570560 - protein, 9 aa, Homo Sapiens
VEGPWFRRY

SEQ ID NO: 570561 - protein, 9 aa, Homo Sapiens
DITHLVTDF

SEQ ID NO: 570562 - protein, 9 aa, Homo Sapiens
STLRHSKYS

SEQ ID NO: 570563 - protein, 9 aa, Homo Sapiens
TNLCVIGGN

SEQ ID NO: 570564 - protein, 9 aa, Homo Sapiens
WGKEPKIKS

SEQ ID NO: 570565 - protein, 9 aa, Homo Sapiens
LLIPDKGKA

SEQ ID NO: 570566 - protein, 9 aa, Homo Sapiens
TTGCSAQLL

SEQ ID NO: 570567 - protein, 9 aa, Homo Sapiens
TCQTWSSMT

SEQ ID NO: 570568 - protein, 9 aa, Homo Sapiens
RELLRPRCR

SEQ ID NO: 570569 - protein, 9 aa, Homo Sapiens
DELISTPSI

SEQ ID NO: 570570 - protein, 9 aa, Homo Sapiens
HKFFSDAQE

SEQ ID NO: 570571 - protein, 9 aa, Homo Sapiens
VVTSTLRHS

SEQ ID NO: 570572 - protein, 9 aa, Homo Sapiens
FSDAQELQG

SEQ ID NO: 570573 - protein, 9 aa, Homo Sapiens
PWLRMRDLM

SEQ ID NO: 570574 - protein, 9 aa, Homo Sapiens
PPAHTCPYG

SEQ ID NO: 570575 - protein, 9 aa, Homo Sapiens
CCDLAQCQT

SEQ ID NO: 570576 - protein, 9 aa, Homo Sapiens
APSPIAQAT

SEQ ID NO: 570577 - protein, 9 aa, Homo Sapiens
SPGNFDWSL

SEQ ID NO: 570578 - protein, 9 aa, Homo Sapiens
HSKYSVTKL

SEQ ID NO: 570579 - protein, 9 aa, Homo Sapiens
YWPYLTAEA

SEQ ID NO: 570580 - protein, 9 aa, Homo Sapiens
KAHLSRVSP

SEQ ID NO: 570581 - protein, 9 aa, Homo Sapiens
SGSFWINVA

SEQ ID NO: 570582 - protein, 9 aa, Homo Sapiens
QELQGQIEE

SEQ ID NO: 570583 - protein, 9 aa, Homo Sapiens
GDWKKHFTP

SEQ ID NO: 570584 - protein, 9 aa, Homo Sapiens
HTCPYGVPA

SEQ ID NO: 570585 - protein, 9 aa, Homo Sapiens
GMKQNQELK

SEQ ID NO: 570586 - protein, 9 aa, Homo Sapiens
TWASRELLR

SEQ ID NO: 570587 - protein, 9 aa, Homo Sapiens
ECCDLAQCQ

SEQ ID NO: 570588 - protein, 9 aa, Homo Sapiens
PSIEDKSEE

SEQ ID NO: 570589 - protein, 9 aa, Homo Sapiens
GFKPRKEEM

SEQ ID NO: 570590 - protein, 9 aa, Homo Sapiens
APAGSGSFW

SEQ ID NO: 570591 - protein, 9 aa, Homo Sapiens
PWFRRYDFR

SEQ ID NO: 570592 - protein, 9 aa, Homo Sapiens
RSSKEEASM

SEQ ID NO: 570593 - protein, 9 aa, Homo Sapiens
EEENSLAQY

SEQ ID NO: 570594 - protein, 9 aa, Homo Sapiens
GCSAQLLSR

SEQ ID NO: 570595 - protein, 9 aa, Homo Sapiens
QNQELKTIQ

SEQ ID NO: 570596 - protein, 9 aa, Homo Sapiens
PGNFDWSLT

SEQ ID NO: 570597 - protein, 9 aa, Homo Sapiens
EEASMKKVV

SEQ ID NO: 570598 - protein, 9 aa, Homo Sapiens
PERRPPQGG

SEQ ID NO: 570599 - protein, 9 aa, Homo Sapiens
LHFLGQLLE

SEQ ID NO: 570600 - protein, 9 aa, Homo Sapiens
HCPRHCPPW

SEQ ID NO: 570601 - protein, 9 aa, Homo Sapiens
NRDRLSWEC

SEQ ID NO: 570602 - protein, 9 aa, Homo Sapiens
QLTPFCTEF

SEQ ID NO: 570603 - protein, 9 aa, Homo Sapiens
PAGSGSFWI

SEQ ID NO: 570604 - protein, 9 aa, Homo Sapiens
TEASVEEAP

SEQ ID NO: 570605 - protein, 9 aa, Homo Sapiens
VAMRALGFK

SEQ ID NO: 570606 - protein, 9 aa, Homo Sapiens
TGRTCQTWS

SEQ ID NO: 570607 - protein, 9 aa, Homo Sapiens
TCPYGVPAC

SEQ ID NO: 570608 - protein, 9 aa, Homo Sapiens
VEEAPAEVQ

SEQ ID NO: 570609 - protein, 9 aa, Homo Sapiens
LGMKQNQEL

SEQ ID NO: 570610 - protein, 9 aa, Homo Sapiens
QYHSRLDET

SEQ ID NO: 570611 - protein, 9 aa, Homo Sapiens
CLDYCCHLS

SEQ ID NO: 570612 - protein, 9 aa, Homo Sapiens
FLGQLLEIA

SEQ ID NO: 570613 - protein, 9 aa, Homo Sapiens
GGTWASREL

SEQ ID NO: 570614 - protein, 9 aa, Homo Sapiens
GGNGSLTGA

SEQ ID NO: 570615 - protein, 9 aa, Homo Sapiens
LGFKPRKEE

SEQ ID NO: 570616 - protein, 9 aa, Homo Sapiens
HLVTDFMKL

SEQ ID NO: 570617 - protein, 9 aa, Homo Sapiens
RDLMKITRR

SEQ ID NO: 570618 - protein, 9 aa, Homo Sapiens
GRLHSHCPR

SEQ ID NO: 570619 - protein, 9 aa, Homo Sapiens
QLLEIAIRA

SEQ ID NO: 570620 - protein, 9 aa, Homo Sapiens
VPRAPSPIA

SEQ ID NO: 570621 - protein, 9 aa, Homo Sapiens
FWINVATPG

SEQ ID NO: 570622 - protein, 9 aa, Homo Sapiens
ASRELLRPR

SEQ ID NO: 570623 - protein, 9 aa, Homo Sapiens
HSPGNFDWS

SEQ ID NO: 570624 - protein, 9 aa, Homo Sapiens
NGSLTGANL

SEQ ID NO: 570625 - protein, 9 aa, Homo Sapiens
WASRELLRP

SEQ ID NO: 570626 - protein, 9 aa, Homo Sapiens
LCPWRAESG

SEQ ID NO: 570627 - protein, 9 aa, Homo Sapiens
SPERPRPED

SEQ ID NO: 570628 - protein, 9 aa, Homo Sapiens
TSTLRHSKY

SEQ ID NO: 570629 - protein, 9 aa, Homo Sapiens
EGPWFRRYD

SEQ ID NO: 570630 - protein, 9 aa, Homo Sapiens
RVSPERPRP

SEQ ID NO: 570631 - protein, 9 aa, Homo Sapiens
SRVSPERPR

SEQ ID NO: 570632 - protein, 9 aa, Homo Sapiens
PGKPERRPP

SEQ ID NO: 570633 - protein, 9 aa, Homo Sapiens
SKYSVTKLI

SEQ ID NO: 570634 - protein, 9 aa, Homo Sapiens
KSAWMNGED

SEQ ID NO: 570635 - protein, 9 aa, Homo Sapiens
VDEEGNQFV

SEQ ID NO: 570636 - protein, 9 aa, Homo Sapiens
PKIKSAWMN

SEQ ID NO: 570637 - protein, 9 aa, Homo Sapiens
WKKHFTPWL

SEQ ID NO: 570638 - protein, 9 aa, Homo Sapiens
ESGQCPSLL

SEQ ID NO: 570639 - protein, 9 aa, Homo Sapiens
LAQYHSRLD

SEQ ID NO: 570640 - protein, 9 aa, Homo Sapiens
QTWSSMTPH

SEQ ID NO: 570641 - protein, 9 aa, Homo Sapiens
LIPDKGKAW

SEQ ID NO: 570642 - protein, 9 aa, Homo Sapiens
FRRYDFRQS

SEQ ID NO: 570643 - protein, 9 aa, Homo Sapiens
LLRPRCRPI

SEQ ID NO: 570644 - protein, 9 aa, Homo Sapiens
CSAQLLSRY

SEQ ID NO: 570645 - protein, 9 aa, Homo Sapiens
LTPFCTEFT

SEQ ID NO: 570646 - protein, 9 aa, Homo Sapiens
DWGKEPKIK

SEQ ID NO: 570647 - protein, 9 aa, Homo Sapiens
QRGRVHSPG

SEQ ID NO: 570648 - protein, 9 aa, Homo Sapiens
PPGKPERRP

SEQ ID NO: 570649 - protein, 9 aa, Homo Sapiens
ELLRPRCRP

SEQ ID NO: 570650 - protein, 9 aa, Homo Sapiens
GSFWINVAT

SEQ ID NO: 570651 - protein, 9 aa, Homo Sapiens
KCKQEEVSA

SEQ ID NO: 570652 - protein, 9 aa, Homo Sapiens
KPRKEEMKK

SEQ ID NO: 570653 - protein, 9 aa, Homo Sapiens
EKKRSSKEE

SEQ ID NO: 570654 - protein, 9 aa, Homo Sapiens
LQCGSQKGY

SEQ ID NO: 570655 - protein, 9 aa, Homo Sapiens
AEKKRSSKE

SEQ ID NO: 570656 - protein, 9 aa, Homo Sapiens
LRHSKYSVT

SEQ ID NO: 570657 - protein, 9 aa, Homo Sapiens
EFTGIIQAM

SEQ ID NO: 570658 - protein, 9 aa, Homo Sapiens
RLSWECCDL

SEQ ID NO: 570659 - protein, 9 aa, Homo Sapiens
LKAHLSRVS

SEQ ID NO: 570660 - protein, 9 aa, Homo Sapiens
RAESGQCPS

SEQ ID NO: 570661 - protein, 9 aa, Homo Sapiens
RRPPQGGNQ

SEQ ID NO: 570662 - protein, 9 aa, Homo Sapiens
PWRAESGQC

SEQ ID NO: 570663 - protein, 9 aa, Homo Sapiens
GSGSFWINV

SEQ ID NO: 570664 - protein, 9 aa, Homo Sapiens
FDKNIMQKT

SEQ ID NO: 570665 - protein, 9 aa, Homo Sapiens
VLAFPDDMD

SEQ ID NO: 570666 - protein, 9 aa, Homo Sapiens
NAKFDKNIM

SEQ ID NO: 570667 - protein, 9 aa, Homo Sapiens
LAFPDDMDL

SEQ ID NO: 570668 - protein, 9 aa, Homo Sapiens
LRNAKFDKN

SEQ ID NO: 570669 - protein, 9 aa, Homo Sapiens
MDLRVYGPA

SEQ ID NO: 570670 - protein, 9 aa, Homo Sapiens
AVLAFPDDM

SEQ ID NO: 570671 - protein, 9 aa, Homo Sapiens
PDDMDLRVY

SEQ ID NO: 570672 - protein, 9 aa, Homo Sapiens
KFDKNIMQK

SEQ ID NO: 570673 - protein, 9 aa, Homo Sapiens
FPDDMDLRV

SEQ ID NO: 570674 - protein, 9 aa, Homo Sapiens
RNAKFDKNI

SEQ ID NO: 570675 - protein, 9 aa, Homo Sapiens
DKNIMQKTN

SEQ ID NO: 570676 - protein, 9 aa, Homo Sapiens
KNIMQKTNQ

SEQ ID NO: 570677 - protein, 9 aa, Homo Sapiens
DDMDLRVYG

SEQ ID NO: 570678 - protein, 9 aa, Homo Sapiens
NIMQKTNQA

SEQ ID NO: 570679 - protein, 9 aa, Homo Sapiens
AFPDDMDLR

SEQ ID NO: 570680 - protein, 9 aa, Homo Sapiens
AKFDKNIMQ

SEQ ID NO: 570681 - protein, 9 aa, Homo Sapiens
DMDLRVYGP

SEQ ID NO: 570682 - protein, 9 aa, Homo Sapiens
HGDVCTHSV

SEQ ID NO: 570683 - protein, 9 aa, Homo Sapiens
NKIEDLSCG

SEQ ID NO: 570684 - protein, 9 aa, Homo Sapiens
IEDLSCGSC

SEQ ID NO: 570685 - protein, 9 aa, Homo Sapiens
HSVLGTALH

SEQ ID NO: 570686 - protein, 9 aa, Homo Sapiens
LGTALHGDV

SEQ ID NO: 570687 - protein, 9 aa, Homo Sapiens
VLGTALHGD

SEQ ID NO: 570688 - protein, 9 aa, Homo Sapiens
DLSCGSCMP

SEQ ID NO: 570689 - protein, 9 aa, Homo Sapiens
KIEDLSCGS

SEQ ID NO: 570690 - protein, 9 aa, Homo Sapiens
GTALHGDVC

SEQ ID NO: 570691 - protein, 9 aa, Homo Sapiens
ALHGDVCTH

SEQ ID NO: 570692 - protein, 9 aa, Homo Sapiens
LSCGSCMPY

SEQ ID NO: 570693 - protein, 9 aa, Homo Sapiens
SRHRIQSKQ

SEQ ID NO: 570694 - protein, 9 aa, Homo Sapiens
CGSCMPYLL

SEQ ID NO: 570695 - protein, 9 aa, Homo Sapiens
LHGDVCTHS

SEQ ID NO: 570696 - protein, 9 aa, Homo Sapiens
SVLGTALHG

SEQ ID NO: 570697 - protein, 9 aa, Homo Sapiens
EDLSCGSCM

SEQ ID NO: 570698 - protein, 9 aa, Homo Sapiens
GSCMPYLLE

SEQ ID NO: 570699 - protein, 9 aa, Homo Sapiens
SCGSCMPYL

SEQ ID NO: 570700 - protein, 9 aa, Homo Sapiens
TALHGDVCT

SEQ ID NO: 570701 - protein, 9 aa, Homo Sapiens
VLPEPTADV

SEQ ID NO: 570702 - protein, 9 aa, Homo Sapiens
DTRLAGEER

SEQ ID NO: 570703 - protein, 9 aa, Homo Sapiens
KLEGGDAVL

SEQ ID NO: 570704 - protein, 9 aa, Homo Sapiens
ISPSTLRKD

SEQ ID NO: 570705 - protein, 9 aa, Homo Sapiens
VRFVLPEPT

SEQ ID NO: 570706 - protein, 9 aa, Homo Sapiens
LRKDTRLAG

SEQ ID NO: 570707 - protein, 9 aa, Homo Sapiens
SHVRFVLPE

SEQ ID NO: 570708 - protein, 9 aa, Homo Sapiens
MIGKLEGGD

SEQ ID NO: 570709 - protein, 9 aa, Homo Sapiens
LEGGDAVLR

SEQ ID NO: 570710 - protein, 9 aa, Homo Sapiens
RKDTRLAGE

SEQ ID NO: 570711 - protein, 9 aa, Homo Sapiens
PPSHVRFVL

SEQ ID NO: 570712 - protein, 9 aa, Homo Sapiens
RFVLPEPTA

SEQ ID NO: 570713 - protein, 9 aa, Homo Sapiens
PSTLRKDTR

SEQ ID NO: 570714 - protein, 9 aa, Homo Sapiens
LPEPTADVN

SEQ ID NO: 570715 - protein, 9 aa, Homo Sapiens
VLTFRDVAI

SEQ ID NO: 570716 - protein, 9 aa, Homo Sapiens
GKLEGGDAV

SEQ ID NO: 570717 - protein, 9 aa, Homo Sapiens
PSHVRFVLP

SEQ ID NO: 570718 - protein, 9 aa, Homo Sapiens
TLRKDTRLA

SEQ ID NO: 570719 - protein, 9 aa, Homo Sapiens
KDTRLAGEE

SEQ ID NO: 570720 - protein, 9 aa, Homo Sapiens
SPSTLRKDT

SEQ ID NO: 570721 - protein, 9 aa, Homo Sapiens
FVLPEPTAD

SEQ ID NO: 570722 - protein, 9 aa, Homo Sapiens
STLRKDTRL

SEQ ID NO: 570723 - protein, 9 aa, Homo Sapiens
IGKLEGGDA

SEQ ID NO: 570724 - protein, 9 aa, Homo Sapiens
HVRFVLPEP

SEQ ID NO: 570725 - protein, 9 aa, Homo Sapiens
MMSYERSVM

SEQ ID NO: 570726 - protein, 9 aa, Homo Sapiens
SYERSVMSP

SEQ ID NO: 570727 - protein, 9 aa, Homo Sapiens
VMSPMAERS

SEQ ID NO: 570728 - protein, 9 aa, Homo Sapiens
ITTTSTVTP

SEQ ID NO: 570729 - protein, 9 aa, Homo Sapiens
ERSVMSPMA

SEQ ID NO: 570730 - protein, 9 aa, Homo Sapiens
SMMSYERSV

SEQ ID NO: 570731 - protein, 9 aa, Homo Sapiens
SFFLSSRMF

SEQ ID NO: 570732 - protein, 9 aa, Homo Sapiens
TTSTVTPTP

SEQ ID NO: 570733 - protein, 9 aa, Homo Sapiens
TPTAITTTS

SEQ ID NO: 570734 - protein, 9 aa, Homo Sapiens
LVGLTDRQE

SEQ ID NO: 570735 - protein, 9 aa, Homo Sapiens
DRQELKMPL

SEQ ID NO: 570736 - protein, 9 aa, Homo Sapiens
TTTSTVTPT

SEQ ID NO: 570737 - protein, 9 aa, Homo Sapiens
ELASFFLSS

SEQ ID NO: 570738 - protein, 9 aa, Homo Sapiens
SVMSPMAER

SEQ ID NO: 570739 - protein, 9 aa, Homo Sapiens
AITTTSTVT

SEQ ID NO: 570740 - protein, 9 aa, Homo Sapiens
HRHSVSLSP

SEQ ID NO: 570741 - protein, 9 aa, Homo Sapiens
GLSQYICYI

SEQ ID NO: 570742 - protein, 9 aa, Homo Sapiens
LSQYICYIF

SEQ ID NO: 570743 - protein, 9 aa, Homo Sapiens
QYICYIFQC

SEQ ID NO: 570744 - protein, 9 aa, Homo Sapiens
QQPLHRHSV

SEQ ID NO: 570745 - protein, 9 aa, Homo Sapiens
FILVGLTDR

SEQ ID NO: 570746 - protein, 9 aa, Homo Sapiens
QPLHRHSVS

SEQ ID NO: 570747 - protein, 9 aa, Homo Sapiens
YIFQCASES

SEQ ID NO: 570748 - protein, 9 aa, Homo Sapiens
TSTVTPTPT

SEQ ID NO: 570749 - protein, 9 aa, Homo Sapiens
STVTPTPTP

SEQ ID NO: 570750 - protein, 9 aa, Homo Sapiens
LHRHSVSLS

SEQ ID NO: 570751 - protein, 9 aa, Homo Sapiens
SQYICYIFQ

SEQ ID NO: 570752 - protein, 9 aa, Homo Sapiens
GLTDRQELK

SEQ ID NO: 570753 - protein, 9 aa, Homo Sapiens
PTAITTTST

SEQ ID NO: 570754 - protein, 9 aa, Homo Sapiens
RQELKMPLF

SEQ ID NO: 570755 - protein, 9 aa, Homo Sapiens
TAITTTSTV

SEQ ID NO: 570756 - protein, 9 aa, Homo Sapiens
GQGELASFF

SEQ ID NO: 570757 - protein, 9 aa, Homo Sapiens
RHSVSLSPP

SEQ ID NO: 570758 - protein, 9 aa, Homo Sapiens
LTDRQELKM

SEQ ID NO: 570759 - protein, 9 aa, Homo Sapiens
VGLTDRQEL

SEQ ID NO: 570760 - protein, 9 aa, Homo Sapiens
GELASFFLS

SEQ ID NO: 570761 - protein, 9 aa, Homo Sapiens
ASFFLSSRM

SEQ ID NO: 570762 - protein, 9 aa, Homo Sapiens
ICYIFQCAS

SEQ ID NO: 570763 - protein, 9 aa, Homo Sapiens
IFQCASESL

SEQ ID NO: 570764 - protein, 9 aa, Homo Sapiens
YICYIFQCA

SEQ ID NO: 570765 - protein, 9 aa, Homo Sapiens
MSYERSVMS

SEQ ID NO: 570766 - protein, 9 aa, Homo Sapiens
YERSVMSPM

SEQ ID NO: 570767 - protein, 9 aa, Homo Sapiens
FFLSSRMFG

SEQ ID NO: 570768 - protein, 9 aa, Homo Sapiens
QGELASFFL

SEQ ID NO: 570769 - protein, 9 aa, Homo Sapiens
TDRQELKMP

SEQ ID NO: 570770 - protein, 9 aa, Homo Sapiens
CYIFQCASE

SEQ ID NO: 570771 - protein, 9 aa, Homo Sapiens
FLSSRMFGR

SEQ ID NO: 570772 - protein, 9 aa, Homo Sapiens
LASFFLSSR

SEQ ID NO: 570773 - protein, 9 aa, Homo Sapiens
ILVGLTDRQ

SEQ ID NO: 570774 - protein, 9 aa, Homo Sapiens
RSVMSPMAE

SEQ ID NO: 570775 - protein, 9 aa, Homo Sapiens
PLHRHSVSL

SEQ ID NO: 570776 - protein, 9 aa, Homo Sapiens
TSLDYESGD

SEQ ID NO: 570777 - protein, 9 aa, Homo Sapiens
GWKSSISQA

SEQ ID NO: 570778 - protein, 9 aa, Homo Sapiens
GELAAGQEA

SEQ ID NO: 570779 - protein, 9 aa, Homo Sapiens
HVREAGISH

SEQ ID NO: 570780 - protein, 9 aa, Homo Sapiens
SSASSDGLH

SEQ ID NO: 570781 - protein, 9 aa, Homo Sapiens
QERERDRPR

SEQ ID NO: 570782 - protein, 9 aa, Homo Sapiens
TSETENASS

SEQ ID NO: 570783 - protein, 9 aa, Homo Sapiens
QLYIHHVHV

SEQ ID NO: 570784 - protein, 9 aa, Homo Sapiens
SAPQGPSGH

SEQ ID NO: 570785 - protein, 9 aa, Homo Sapiens
FTSLDYESG

SEQ ID NO: 570786 - protein, 9 aa, Homo Sapiens
YPPFTSDIL

SEQ ID NO: 570787 - protein, 9 aa, Homo Sapiens
TGWKSSISQ

SEQ ID NO: 570788 - protein, 9 aa, Homo Sapiens
SQGLSSSAL

SEQ ID NO: 570789 - protein, 9 aa, Homo Sapiens
LDYESGDIL

SEQ ID NO: 570790 - protein, 9 aa, Homo Sapiens
RDQERERDR

SEQ ID NO: 570791 - protein, 9 aa, Homo Sapiens
TSPGLRSSP

SEQ ID NO: 570792 - protein, 9 aa, Homo Sapiens
PRLCPSQGL

SEQ ID NO: 570793 - protein, 9 aa, Homo Sapiens
GVCGHGDTK

SEQ ID NO: 570794 - protein, 9 aa, Homo Sapiens
LSAPQGPSG

SEQ ID NO: 570795 - protein, 9 aa, Homo Sapiens
HGDTKAPEA

SEQ ID NO: 570796 - protein, 9 aa, Homo Sapiens
RQRRKRYAL

SEQ ID NO: 570797 - protein, 9 aa, Homo Sapiens
QESGCKIQV

SEQ ID NO: 570798 - protein, 9 aa, Homo Sapiens
QVAPDSGGL

SEQ ID NO: 570799 - protein, 9 aa, Homo Sapiens
HSARPRAVG

SEQ ID NO: 570800 - protein, 9 aa, Homo Sapiens
SMKNLHHSI

SEQ ID NO: 570801 - protein, 9 aa, Homo Sapiens
RDGGGAGDR

SEQ ID NO: 570802 - protein, 9 aa, Homo Sapiens
GRVLSAGVH

SEQ ID NO: 570803 - protein, 9 aa, Homo Sapiens
APEAPSCIQ

SEQ ID NO: 570804 - protein, 9 aa, Homo Sapiens
SPCHCHPSP

SEQ ID NO: 570805 - protein, 9 aa, Homo Sapiens
RAKYTASDL

SEQ ID NO: 570806 - protein, 9 aa, Homo Sapiens
VTHNICEEK

SEQ ID NO: 570807 - protein, 9 aa, Homo Sapiens
LKPEAIGVC

SEQ ID NO: 570808 - protein, 9 aa, Homo Sapiens
SVQYCYDGV

SEQ ID NO: 570809 - protein, 9 aa, Homo Sapiens
NHPIEAQAG

SEQ ID NO: 570810 - protein, 9 aa, Homo Sapiens
ESGDILEDD

SEQ ID NO: 570811 - protein, 9 aa, Homo Sapiens
LNYPPFTSD

SEQ ID NO: 570812 - protein, 9 aa, Homo Sapiens
QHNPTCSHH

SEQ ID NO: 570813 - protein, 9 aa, Homo Sapiens
PGSAQLYIH

SEQ ID NO: 570814 - protein, 9 aa, Homo Sapiens
SDGLHPVIT

SEQ ID NO: 570815 - protein, 9 aa, Homo Sapiens
VHSKASARG

SEQ ID NO: 570816 - protein, 9 aa, Homo Sapiens
LNDGSDSES

SEQ ID NO: 570817 - protein, 9 aa, Homo Sapiens
AQLYIHHVH

SEQ ID NO: 570818 - protein, 9 aa, Homo Sapiens
LSAGVHSKA

SEQ ID NO: 570819 - protein, 9 aa, Homo Sapiens
ASGWSVQYC

SEQ ID NO: 570820 - protein, 9 aa, Homo Sapiens
INPYWTPKK

SEQ ID NO: 570821 - protein, 9 aa, Homo Sapiens
GHQHNPTCS

SEQ ID NO: 570822 - protein, 9 aa, Homo Sapiens
LLDVHSRPC

SEQ ID NO: 570823 - protein, 9 aa, Homo Sapiens
EAIGVCGHG

SEQ ID NO: 570824 - protein, 9 aa, Homo Sapiens
TPKKTQQLL

SEQ ID NO: 570825 - protein, 9 aa, Homo Sapiens
LGRVLSAGV

SEQ ID NO: 570826 - protein, 9 aa, Homo Sapiens
IQSPDVLSA

SEQ ID NO: 570827 - protein, 9 aa, Homo Sapiens
GGSQGSRRH

SEQ ID NO: 570828 - protein, 9 aa, Homo Sapiens
VQYCYDGVG

SEQ ID NO: 570829 - protein, 9 aa, Homo Sapiens
DRAFVEHSA

SEQ ID NO: 570830 - protein, 9 aa, Homo Sapiens
GCSQGSLKP

SEQ ID NO: 570831 - protein, 9 aa, Homo Sapiens
TVDGGVGHN

SEQ ID NO: 570832 - protein, 9 aa, Homo Sapiens
RVKANLRQR

SEQ ID NO: 570833 - protein, 9 aa, Homo Sapiens
SPDVLSAPQ

SEQ ID NO: 570834 - protein, 9 aa, Homo Sapiens
DYESGDILE

SEQ ID NO: 570835 - protein, 9 aa, Homo Sapiens
EAPSCIQSP

SEQ ID NO: 570836 - protein, 9 aa, Homo Sapiens
SCIQSPDVL

SEQ ID NO: 570837 - protein, 9 aa, Homo Sapiens
LKNITPSDN

SEQ ID NO: 570838 - protein, 9 aa, Homo Sapiens
GSKGNPGYP

SEQ ID NO: 570839 - protein, 9 aa, Homo Sapiens
PQGPSGHKH

SEQ ID NO: 570840 - protein, 9 aa, Homo Sapiens
SDNGLYGCW

SEQ ID NO: 570841 - protein, 9 aa, Homo Sapiens
AVTRCSTLS

SEQ ID NO: 570842 - protein, 9 aa, Homo Sapiens
TENASSAWP

SEQ ID NO: 570843 - protein, 9 aa, Homo Sapiens
HSAQGPASP

SEQ ID NO: 570844 - protein, 9 aa, Homo Sapiens
LEELKEIDE

SEQ ID NO: 570845 - protein, 9 aa, Homo Sapiens
PGSKGNPGY

SEQ ID NO: 570846 - protein, 9 aa, Homo Sapiens
PGGELAAGQ

SEQ ID NO: 570847 - protein, 9 aa, Homo Sapiens
ARPRAVGCS

SEQ ID NO: 570848 - protein, 9 aa, Homo Sapiens
NLRQRRKRY

SEQ ID NO: 570849 - protein, 9 aa, Homo Sapiens
PEAIGVCGH

SEQ ID NO: 570850 - protein, 9 aa, Homo Sapiens
IINPTGWKS

SEQ ID NO: 570851 - protein, 9 aa, Homo Sapiens
PKKTQQLLN

SEQ ID NO: 570852 - protein, 9 aa, Homo Sapiens
AEPTDRAFV

SEQ ID NO: 570853 - protein, 9 aa, Homo Sapiens
RAVGCSQGS

SEQ ID NO: 570854 - protein, 9 aa, Homo Sapiens
YEIVNGIRI

SEQ ID NO: 570855 - protein, 9 aa, Homo Sapiens
AGQEALPEG

SEQ ID NO: 570856 - protein, 9 aa, Homo Sapiens
GVHSKASAR

SEQ ID NO: 570857 - protein, 9 aa, Homo Sapiens
EAQAGGSQG

SEQ ID NO: 570858 - protein, 9 aa, Homo Sapiens
CSQGSLKPE

SEQ ID NO: 570859 - protein, 9 aa, Homo Sapiens
LPEGRDGGG

SEQ ID NO: 570860 - protein, 9 aa, Homo Sapiens
FTSDILDKL

SEQ ID NO: 570861 - protein, 9 aa, Homo Sapiens
ERDQERERD

SEQ ID NO: 570862 - protein, 9 aa, Homo Sapiens
GLSSSALPT

SEQ ID NO: 570863 - protein, 9 aa, Homo Sapiens
PCHCHPSPD

SEQ ID NO: 570864 - protein, 9 aa, Homo Sapiens
SLARAKYTA

SEQ ID NO: 570865 - protein, 9 aa, Homo Sapiens
EISLARAKY

SEQ ID NO: 570866 - protein, 9 aa, Homo Sapiens
VGCSQGSLK

SEQ ID NO: 570867 - protein, 9 aa, Homo Sapiens
QGSLKPEAI

SEQ ID NO: 570868 - protein, 9 aa, Homo Sapiens
EGRDGGGAG

SEQ ID NO: 570869 - protein, 9 aa, Homo Sapiens
LIVRTVDGG

SEQ ID NO: 570870 - protein, 9 aa, Homo Sapiens
KGAEPTDRA

SEQ ID NO: 570871 - protein, 9 aa, Homo Sapiens
HNICEEKIN

SEQ ID NO: 570872 - protein, 9 aa, Homo Sapiens
SLDYESGDI

SEQ ID NO: 570873 - protein, 9 aa, Homo Sapiens
GVGISRGKG

SEQ ID NO: 570874 - protein, 9 aa, Homo Sapiens
NPTGWKSSI

SEQ ID NO: 570875 - protein, 9 aa, Homo Sapiens
EPTDRAFVE

SEQ ID NO: 570876 - protein, 9 aa, Homo Sapiens
WTPKKTQQL

SEQ ID NO: 570877 - protein, 9 aa, Homo Sapiens
RSSPAVTRC

SEQ ID NO: 570878 - protein, 9 aa, Homo Sapiens
VCWSLLDVH

SEQ ID NO: 570879 - protein, 9 aa, Homo Sapiens
VLSAGVHSK

SEQ ID NO: 570880 - protein, 9 aa, Homo Sapiens
AVGCSQGSL

SEQ ID NO: 570881 - protein, 9 aa, Homo Sapiens
VSTTSETEN

SEQ ID NO: 570882 - protein, 9 aa, Homo Sapiens
RTVDGGVGH

SEQ ID NO: 570883 - protein, 9 aa, Homo Sapiens
GISHEHPNH

SEQ ID NO: 570884 - protein, 9 aa, Homo Sapiens
SAEMDPRPG

SEQ ID NO: 570885 - protein, 9 aa, Homo Sapiens
SGDILEDDE

SEQ ID NO: 570886 - protein, 9 aa, Homo Sapiens
IMSSLPGSK

SEQ ID NO: 570887 - protein, 9 aa, Homo Sapiens
SETENASSA

SEQ ID NO: 570888 - protein, 9 aa, Homo Sapiens
LYIHHVHVR

SEQ ID NO: 570889 - protein, 9 aa, Homo Sapiens
VYTGHQHNP

SEQ ID NO: 570890 - protein, 9 aa, Homo Sapiens
TVIVPKMLM

SEQ ID NO: 570891 - protein, 9 aa, Homo Sapiens
GWSVQYCYD

SEQ ID NO: 570892 - protein, 9 aa, Homo Sapiens
AFVEHSARP

SEQ ID NO: 570893 - protein, 9 aa, Homo Sapiens
QYCYDGVGR

SEQ ID NO: 570894 - protein, 9 aa, Homo Sapiens
GPSGHKHGV

SEQ ID NO: 570895 - protein, 9 aa, Homo Sapiens
IVNGIRIYG

SEQ ID NO: 570896 - protein, 9 aa, Homo Sapiens
QEALPEGRD

SEQ ID NO: 570897 - protein, 9 aa, Homo Sapiens
RAFVEHSAR

SEQ ID NO: 570898 - protein, 9 aa, Homo Sapiens
PRAVGCSQG

SEQ ID NO: 570899 - protein, 9 aa, Homo Sapiens
EIVNGIRIY

SEQ ID NO: 570900 - protein, 9 aa, Homo Sapiens
HYNEYEIVN

SEQ ID NO: 570901 - protein, 9 aa, Homo Sapiens
IVPKMLMNF

SEQ ID NO: 570902 - protein, 9 aa, Homo Sapiens
EGPEVTGSR

SEQ ID NO: 570903 - protein, 9 aa, Homo Sapiens
GAEPTDRAF

SEQ ID NO: 570904 - protein, 9 aa, Homo Sapiens
ELAAGQEAL

SEQ ID NO: 570905 - protein, 9 aa, Homo Sapiens
GLRSSPAVT

SEQ ID NO: 570906 - protein, 9 aa, Homo Sapiens
QGPSGHKHG

SEQ ID NO: 570907 - protein, 9 aa, Homo Sapiens
GCKIQVAPD

SEQ ID NO: 570908 - protein, 9 aa, Homo Sapiens
ICEEKINNS

SEQ ID NO: 570909 - protein, 9 aa, Homo Sapiens
PGLRSSPAV

SEQ ID NO: 570910 - protein, 9 aa, Homo Sapiens
VGISRGKGA

SEQ ID NO: 570911 - protein, 9 aa, Homo Sapiens
ASSDGLHPV

SEQ ID NO: 570912 - protein, 9 aa, Homo Sapiens
LPTSPGLRS

SEQ ID NO: 570913 - protein, 9 aa, Homo Sapiens
PEAPSCIQS

SEQ ID NO: 570914 - protein, 9 aa, Homo Sapiens
DGLHPVITP

SEQ ID NO: 570915 - protein, 9 aa, Homo Sapiens
SEYILIVRT

SEQ ID NO: 570916 - protein, 9 aa, Homo Sapiens
SLLDVHSRP

SEQ ID NO: 570917 - protein, 9 aa, Homo Sapiens
AVTHNICEE

SEQ ID NO: 570918 - protein, 9 aa, Homo Sapiens
AIGVCGHGD

SEQ ID NO: 570919 - protein, 9 aa, Homo Sapiens
LRSSPAVTR

SEQ ID NO: 570920 - protein, 9 aa, Homo Sapiens
PIEAQAGGS

SEQ ID NO: 570921 - protein, 9 aa, Homo Sapiens
TGNLPQLQS

SEQ ID NO: 570922 - protein, 9 aa, Homo Sapiens
DQERERDRP

SEQ ID NO: 570923 - protein, 9 aa, Homo Sapiens
HHAYGDQYR

SEQ ID NO: 570924 - protein, 9 aa, Homo Sapiens
VSLNDGSDS

SEQ ID NO: 570925 - protein, 9 aa, Homo Sapiens
PEGRDGGGA

SEQ ID NO: 570926 - protein, 9 aa, Homo Sapiens
IDEGMWKKL

SEQ ID NO: 570927 - protein, 9 aa, Homo Sapiens
GAGDRAWLG

SEQ ID NO: 570928 - protein, 9 aa, Homo Sapiens
APQGPSGHK

SEQ ID NO: 570929 - protein, 9 aa, Homo Sapiens
KNLHHSISQ

SEQ ID NO: 570930 - protein, 9 aa, Homo Sapiens
HPIEAQAGG

SEQ ID NO: 570931 - protein, 9 aa, Homo Sapiens
NYPPFTSDI

SEQ ID NO: 570932 - protein, 9 aa, Homo Sapiens
MSSLPGSKG

SEQ ID NO: 570933 - protein, 9 aa, Homo Sapiens
GGAGDRAWL

SEQ ID NO: 570934 - protein, 9 aa, Homo Sapiens
PYWTPKKTQ

SEQ ID NO: 570935 - protein, 9 aa, Homo Sapiens
PSGHKHGVV

SEQ ID NO: 570936 - protein, 9 aa, Homo Sapiens
ASPCHCHPS

SEQ ID NO: 570937 - protein, 9 aa, Homo Sapiens
SALPTSPGL

SEQ ID NO: 570938 - protein, 9 aa, Homo Sapiens
SASSDGLHP

SEQ ID NO: 570939 - protein, 9 aa, Homo Sapiens
SSALPTSPG

SEQ ID NO: 570940 - protein, 9 aa, Homo Sapiens
APGSAQLYI

SEQ ID NO: 570941 - protein, 9 aa, Homo Sapiens
EYILIVRTV

SEQ ID NO: 570942 - protein, 9 aa, Homo Sapiens
KSSISQAYL

SEQ ID NO: 570943 - protein, 9 aa, Homo Sapiens
VREAGISHE

SEQ ID NO: 570944 - protein, 9 aa, Homo Sapiens
PFTSDILDK

SEQ ID NO: 570945 - protein, 9 aa, Homo Sapiens
EHSARPRAV

SEQ ID NO: 570946 - protein, 9 aa, Homo Sapiens
SSSMKNLHH

SEQ ID NO: 570947 - protein, 9 aa, Homo Sapiens
PSCIQSPDV

SEQ ID NO: 570948 - protein, 9 aa, Homo Sapiens
GPASPCHCH

SEQ ID NO: 570949 - protein, 9 aa, Homo Sapiens
FVEHSARPR

SEQ ID NO: 570950 - protein, 9 aa, Homo Sapiens
PTDRAFVEH

SEQ ID NO: 570951 - protein, 9 aa, Homo Sapiens
PSDNGLYGC

SEQ ID NO: 570952 - protein, 9 aa, Homo Sapiens
KPIIIGHHA

SEQ ID NO: 570953 - protein, 9 aa, Homo Sapiens
HQHNPTCSH

SEQ ID NO: 570954 - protein, 9 aa, Homo Sapiens
QKEISLARA

SEQ ID NO: 570955 - protein, 9 aa, Homo Sapiens
GSQGSRRHG

SEQ ID NO: 570956 - protein, 9 aa, Homo Sapiens
ALPTSPGLR

SEQ ID NO: 570957 - protein, 9 aa, Homo Sapiens
SLPGSKGNP

SEQ ID NO: 570958 - protein, 9 aa, Homo Sapiens
PPSLVYTGH

SEQ ID NO: 570959 - protein, 9 aa, Homo Sapiens
LQKEISLAR

SEQ ID NO: 570960 - protein, 9 aa, Homo Sapiens
PTCSHHSAQ

SEQ ID NO: 570961 - protein, 9 aa, Homo Sapiens
HEHPNHPIE

SEQ ID NO: 570962 - protein, 9 aa, Homo Sapiens
SPGLRSSPA

SEQ ID NO: 570963 - protein, 9 aa, Homo Sapiens
TSDILDKLM

SEQ ID NO: 570964 - protein, 9 aa, Homo Sapiens
SSSALPTSP

SEQ ID NO: 570965 - protein, 9 aa, Homo Sapiens
QGPASPCHC

SEQ ID NO: 570966 - protein, 9 aa, Homo Sapiens
DVLSAPQGP

SEQ ID NO: 570967 - protein, 9 aa, Homo Sapiens
VIVPKMLMN

SEQ ID NO: 570968 - protein, 9 aa, Homo Sapiens
TKVCWSLLD

SEQ ID NO: 570969 - protein, 9 aa, Homo Sapiens
AAPWSCALW

SEQ ID NO: 570970 - protein, 9 aa, Homo Sapiens
GGCPAVWLK

SEQ ID NO: 570971 - protein, 9 aa, Homo Sapiens
HGVGISRGK

SEQ ID NO: 570972 - protein, 9 aa, Homo Sapiens
PRPGGELAA

SEQ ID NO: 570973 - protein, 9 aa, Homo Sapiens
PAVWLKARY

SEQ ID NO: 570974 - protein, 9 aa, Homo Sapiens
RVLSAGVHS

SEQ ID NO: 570975 - protein, 9 aa, Homo Sapiens
ELTGNLPQL

SEQ ID NO: 570976 - protein, 9 aa, Homo Sapiens
ARAKYTASD

SEQ ID NO: 570977 - protein, 9 aa, Homo Sapiens
SARPRAVGC

SEQ ID NO: 570978 - protein, 9 aa, Homo Sapiens
HNPTCSHHS

SEQ ID NO: 570979 - protein, 9 aa, Homo Sapiens
NLHHSISQN

SEQ ID NO: 570980 - protein, 9 aa, Homo Sapiens
GSRRHGVGI

SEQ ID NO: 570981 - protein, 9 aa, Homo Sapiens
LHPVITPSW

SEQ ID NO: 570982 - protein, 9 aa, Homo Sapiens
WSVQYCYDG

SEQ ID NO: 570983 - protein, 9 aa, Homo Sapiens
EMDPRPGGE

SEQ ID NO: 570984 - protein, 9 aa, Homo Sapiens
IVRTVDGGV

SEQ ID NO: 570985 - protein, 9 aa, Homo Sapiens
WLKARYQTM

SEQ ID NO: 570986 - protein, 9 aa, Homo Sapiens
GRDGGGAGD

SEQ ID NO: 570987 - protein, 9 aa, Homo Sapiens
DTKAPEAPS

SEQ ID NO: 570988 - protein, 9 aa, Homo Sapiens
KGGCPAVWL

SEQ ID NO: 570989 - protein, 9 aa, Homo Sapiens
YTGHQHNPT

SEQ ID NO: 570990 - protein, 9 aa, Homo Sapiens
PSLVYTGHQ

SEQ ID NO: 570991 - protein, 9 aa, Homo Sapiens
SAGVHSKAS

SEQ ID NO: 570992 - protein, 9 aa, Homo Sapiens
SGHKHGVVP

SEQ ID NO: 570993 - protein, 9 aa, Homo Sapiens
DGGGAGDRA

SEQ ID NO: 570994 - protein, 9 aa, Homo Sapiens
RPRERDQER

SEQ ID NO: 570995 - protein, 9 aa, Homo Sapiens
RPGGELAAG

SEQ ID NO: 570996 - protein, 9 aa, Homo Sapiens
KANLRQRRK

SEQ ID NO: 570997 - protein, 9 aa, Homo Sapiens
HSKASARGA

SEQ ID NO: 570998 - protein, 9 aa, Homo Sapiens
ILIVRTVDG

SEQ ID NO: 570999 - protein, 9 aa, Homo Sapiens
AQAGGSQGS

SEQ ID NO: 571000 - protein, 9 aa, Homo Sapiens
VCGHGDTKA

SEQ ID NO: 571001 - protein, 9 aa, Homo Sapiens
IGVCGHGDT

SEQ ID NO: 571002 - protein, 9 aa, Homo Sapiens
IQVAPDSGG

SEQ ID NO: 571003 - protein, 9 aa, Homo Sapiens
VRVKANLRQ

SEQ ID NO: 571004 - protein, 9 aa, Homo Sapiens
EELTGNLPQ

SEQ ID NO: 571005 - protein, 9 aa, Homo Sapiens
WVKPIIIGH

SEQ ID NO: 571006 - protein, 9 aa, Homo Sapiens
DRAWLGRVL

SEQ ID NO: 571007 - protein, 9 aa, Homo Sapiens
TRCSTLSGT

SEQ ID NO: 571008 - protein, 9 aa, Homo Sapiens
AVWLKARYQ

SEQ ID NO: 571009 - protein, 9 aa, Homo Sapiens
SPAVTRCST

SEQ ID NO: 571010 - protein, 9 aa, Homo Sapiens
RRVSLNDGS

SEQ ID NO: 571011 - protein, 9 aa, Homo Sapiens
KVCWSLLDV

SEQ ID NO: 571012 - protein, 9 aa, Homo Sapiens
NPYWTPKKT

SEQ ID NO: 571013 - protein, 9 aa, Homo Sapiens
HVHVREAGI

SEQ ID NO: 571014 - protein, 9 aa, Homo Sapiens
AQGPASPCH

SEQ ID NO: 571015 - protein, 9 aa, Homo Sapiens
VWLKARYQT

SEQ ID NO: 571016 - protein, 9 aa, Homo Sapiens
ANLRQRRKR

SEQ ID NO: 571017 - protein, 9 aa, Homo Sapiens
SRRHGVGIS

SEQ ID NO: 571018 - protein, 9 aa, Homo Sapiens
PASPCHCHP

SEQ ID NO: 571019 - protein, 9 aa, Homo Sapiens
ESSASSDGL

SEQ ID NO: 571020 - protein, 9 aa, Homo Sapiens
THNICEEKI

SEQ ID NO: 571021 - protein, 9 aa, Homo Sapiens
AEMDPRPGG

SEQ ID NO: 571022 - protein, 9 aa, Homo Sapiens
SKGNPGYPG

SEQ ID NO: 571023 - protein, 9 aa, Homo Sapiens
QSPDVLSAP

SEQ ID NO: 571024 - protein, 9 aa, Homo Sapiens
QIEELTGNL

SEQ ID NO: 571025 - protein, 9 aa, Homo Sapiens
VLSAPQGPS

SEQ ID NO: 571026 - protein, 9 aa, Homo Sapiens
KAPEAPSCI

SEQ ID NO: 571027 - protein, 9 aa, Homo Sapiens
RPRAVGCSQ

SEQ ID NO: 571028 - protein, 9 aa, Homo Sapiens
GSAQLYIHH

SEQ ID NO: 571029 - protein, 9 aa, Homo Sapiens
PDPEGPEVT

SEQ ID NO: 571030 - protein, 9 aa, Homo Sapiens
SRGKGAEPT

SEQ ID NO: 571031 - protein, 9 aa, Homo Sapiens
AAGQEALPE

SEQ ID NO: 571032 - protein, 9 aa, Homo Sapiens
SLKPEAIGV

SEQ ID NO: 571033 - protein, 9 aa, Homo Sapiens
WLGRVLSAG

SEQ ID NO: 571034 - protein, 9 aa, Homo Sapiens
HHSISQNLL

SEQ ID NO: 571035 - protein, 9 aa, Homo Sapiens
ISHEHPNHP

SEQ ID NO: 571036 - protein, 9 aa, Homo Sapiens
GLHPVITPS

SEQ ID NO: 571037 - protein, 9 aa, Homo Sapiens
PDRSPDPEG

SEQ ID NO: 571038 - protein, 9 aa, Homo Sapiens
RHGVGISRG

SEQ ID NO: 571039 - protein, 9 aa, Homo Sapiens
RGAPGSAQL

SEQ ID NO: 571040 - protein, 9 aa, Homo Sapiens
LTGNLPQLQ

SEQ ID NO: 571041 - protein, 9 aa, Homo Sapiens
IINPYWTPK

SEQ ID NO: 571042 - protein, 9 aa, Homo Sapiens
GDRAWLGRV

SEQ ID NO: 571043 - protein, 9 aa, Homo Sapiens
HHVHVREAG

SEQ ID NO: 571044 - protein, 9 aa, Homo Sapiens
GAPGSAQLY

SEQ ID NO: 571045 - protein, 9 aa, Homo Sapiens
KLNYPPFTS

SEQ ID NO: 571046 - protein, 9 aa, Homo Sapiens
HPNHPIEAQ

SEQ ID NO: 571047 - protein, 9 aa, Homo Sapiens
SQGSRRHGV

SEQ ID NO: 571048 - protein, 9 aa, Homo Sapiens
RRHGVGISR

SEQ ID NO: 571049 - protein, 9 aa, Homo Sapiens
PTGWKSSIS

SEQ ID NO: 571050 - protein, 9 aa, Homo Sapiens
AGISHEHPN

SEQ ID NO: 571051 - protein, 9 aa, Homo Sapiens
RSRRVSLND

SEQ ID NO: 571052 - protein, 9 aa, Homo Sapiens
IIIGHHAYG

SEQ ID NO: 571053 - protein, 9 aa, Homo Sapiens
CSTLSGTWS

SEQ ID NO: 571054 - protein, 9 aa, Homo Sapiens
LAAGQEALP

SEQ ID NO: 571055 - protein, 9 aa, Homo Sapiens
GDTKAPEAP

SEQ ID NO: 571056 - protein, 9 aa, Homo Sapiens
NITPSDNGL

SEQ ID NO: 571057 - protein, 9 aa, Homo Sapiens
VAPDSGGLP

SEQ ID NO: 571058 - protein, 9 aa, Homo Sapiens
ELKEIDEGM

SEQ ID NO: 571059 - protein, 9 aa, Homo Sapiens
TPSDNGLYG

SEQ ID NO: 571060 - protein, 9 aa, Homo Sapiens
RSRPRERDQ

SEQ ID NO: 571061 - protein, 9 aa, Homo Sapiens
TDRAFVEHS

SEQ ID NO: 571062 - protein, 9 aa, Homo Sapiens
RAWLGRVLS

SEQ ID NO: 571063 - protein, 9 aa, Homo Sapiens
PPFTSDILD

SEQ ID NO: 571064 - protein, 9 aa, Homo Sapiens
SGWSVQYCY

SEQ ID NO: 571065 - protein, 9 aa, Homo Sapiens
SRRVSLNDG

SEQ ID NO: 571066 - protein, 9 aa, Homo Sapiens
ISRGKGAEP

SEQ ID NO: 571067 - protein, 9 aa, Homo Sapiens
AGVHSKASA

SEQ ID NO: 571068 - protein, 9 aa, Homo Sapiens
SLVYTGHQH

SEQ ID NO: 571069 - protein, 9 aa, Homo Sapiens
CIQSPDVLS

SEQ ID NO: 571070 - protein, 9 aa, Homo Sapiens
ISLARAKYT

SEQ ID NO: 571071 - protein, 9 aa, Homo Sapiens
GKGGCPAVW

SEQ ID NO: 571072 - protein, 9 aa, Homo Sapiens
NEYEIVNGI

SEQ ID NO: 571073 - protein, 9 aa, Homo Sapiens
ALPEGRDGG

SEQ ID NO: 571074 - protein, 9 aa, Homo Sapiens
GKGAEPTDR

SEQ ID NO: 571075 - protein, 9 aa, Homo Sapiens
SSPAVTRCS

SEQ ID NO: 571076 - protein, 9 aa, Homo Sapiens
KNITPSDNG

SEQ ID NO: 571077 - protein, 9 aa, Homo Sapiens
TGHQHNPTC

SEQ ID NO: 571078 - protein, 9 aa, Homo Sapiens
IIGHHAYGD

SEQ ID NO: 571079 - protein, 9 aa, Homo Sapiens
GHGDTKAPE

SEQ ID NO: 571080 - protein, 9 aa, Homo Sapiens
GNLPQLQSL

SEQ ID NO: 571081 - protein, 9 aa, Homo Sapiens
EYEIVNGIR

SEQ ID NO: 571082 - protein, 9 aa, Homo Sapiens
DPEGPEVTG

SEQ ID NO: 571083 - protein, 9 aa, Homo Sapiens
YAAVTHNIC

SEQ ID NO: 571084 - protein, 9 aa, Homo Sapiens
IHHVHVREA

SEQ ID NO: 571085 - protein, 9 aa, Homo Sapiens
VEHSARPRA

SEQ ID NO: 571086 - protein, 9 aa, Homo Sapiens
SSMKNLHHS

SEQ ID NO: 571087 - protein, 9 aa, Homo Sapiens
LCPSQGLSS

SEQ ID NO: 571088 - protein, 9 aa, Homo Sapiens
YFQIEELTG

SEQ ID NO: 571089 - protein, 9 aa, Homo Sapiens
DPRPGGELA

SEQ ID NO: 571090 - protein, 9 aa, Homo Sapiens
HKHGVVPVL

SEQ ID NO: 571091 - protein, 9 aa, Homo Sapiens
SAQLYIHHV

SEQ ID NO: 571092 - protein, 9 aa, Homo Sapiens
GGGAGDRAW

SEQ ID NO: 571093 - protein, 9 aa, Homo Sapiens
PDVLSAPQG

SEQ ID NO: 571094 - protein, 9 aa, Homo Sapiens
GGELAAGQE

SEQ ID NO: 571095 - protein, 9 aa, Homo Sapiens
PAVTRCSTL

SEQ ID NO: 571096 - protein, 9 aa, Homo Sapiens
SGCKIQVAP

SEQ ID NO: 571097 - protein, 9 aa, Homo Sapiens
SQGSLKPEA

SEQ ID NO: 571098 - protein, 9 aa, Homo Sapiens
VKANLRQRR

SEQ ID NO: 571099 - protein, 9 aa, Homo Sapiens
EAGISHEHP

SEQ ID NO: 571100 - protein, 9 aa, Homo Sapiens
RERDQERER

SEQ ID NO: 571101 - protein, 9 aa, Homo Sapiens
DPRLCPSQG

SEQ ID NO: 571102 - protein, 9 aa, Homo Sapiens
DVHSRPCLP

SEQ ID NO: 571103 - protein, 9 aa, Homo Sapiens
LSSSALPTS

SEQ ID NO: 571104 - protein, 9 aa, Homo Sapiens
STTSETENA

SEQ ID NO: 571105 - protein, 9 aa, Homo Sapiens
CKIQVAPDS

SEQ ID NO: 571106 - protein, 9 aa, Homo Sapiens
GHKHGVVPV

SEQ ID NO: 571107 - protein, 9 aa, Homo Sapiens
LARAKYTAS

SEQ ID NO: 571108 - protein, 9 aa, Homo Sapiens
PEGPEVTGS

SEQ ID NO: 571109 - protein, 9 aa, Homo Sapiens
CGHGDTKAP

SEQ ID NO: 571110 - protein, 9 aa, Homo Sapiens
TTSETENAS

SEQ ID NO: 571111 - protein, 9 aa, Homo Sapiens
VKPIIIGHH

SEQ ID NO: 571112 - protein, 9 aa, Homo Sapiens
APSCIQSPD

SEQ ID NO: 571113 - protein, 9 aa, Homo Sapiens
LPGSKGNPG

SEQ ID NO: 571114 - protein, 9 aa, Homo Sapiens
HSISQNLLK

SEQ ID NO: 571115 - protein, 9 aa, Homo Sapiens
IGHHAYGDQ

SEQ ID NO: 571116 - protein, 9 aa, Homo Sapiens
SKASARGAP

SEQ ID NO: 571117 - protein, 9 aa, Homo Sapiens
LHHSISQNL

SEQ ID NO: 571118 - protein, 9 aa, Homo Sapiens
YIHHVHVRE

SEQ ID NO: 571119 - protein, 9 aa, Homo Sapiens
IIMSSLPGS

SEQ ID NO: 571120 - protein, 9 aa, Homo Sapiens
WSLLDVHSR

SEQ ID NO: 571121 - protein, 9 aa, Homo Sapiens
HHSAQGPAS

SEQ ID NO: 571122 - protein, 9 aa, Homo Sapiens
QGSRRHGVG

SEQ ID NO: 571123 - protein, 9 aa, Homo Sapiens
SVSTTSETE

SEQ ID NO: 571124 - protein, 9 aa, Homo Sapiens
AAVTHNICE

SEQ ID NO: 571125 - protein, 9 aa, Homo Sapiens
SRSRRVSLN

SEQ ID NO: 571126 - protein, 9 aa, Homo Sapiens
WPDRSPDPE

SEQ ID NO: 571127 - protein, 9 aa, Homo Sapiens
PWSCALWSY

SEQ ID NO: 571128 - protein, 9 aa, Homo Sapiens
ITPSDNGLY

SEQ ID NO: 571129 - protein, 9 aa, Homo Sapiens
SRPRERDQE

SEQ ID NO: 571130 - protein, 9 aa, Homo Sapiens
MKNLHHSIS

SEQ ID NO: 571131 - protein, 9 aa, Homo Sapiens
WSCALWSYC

SEQ ID NO: 571132 - protein, 9 aa, Homo Sapiens
RSPDPEGPE

SEQ ID NO: 571133 - protein, 9 aa, Homo Sapiens
CEEKINNSQ

SEQ ID NO: 571134 - protein, 9 aa, Homo Sapiens
WKSSISQAY

SEQ ID NO: 571135 - protein, 9 aa, Homo Sapiens
NICEEKINN

SEQ ID NO: 571136 - protein, 9 aa, Homo Sapiens
GSLKPEAIG

SEQ ID NO: 571137 - protein, 9 aa, Homo Sapiens
IDPRLCPSQ

SEQ ID NO: 571138 - protein, 9 aa, Homo Sapiens
EIDEGMWKK

SEQ ID NO: 571139 - protein, 9 aa, Homo Sapiens
AGGSQGSRR

SEQ ID NO: 571140 - protein, 9 aa, Homo Sapiens
SDILDKLMY

SEQ ID NO: 571141 - protein, 9 aa, Homo Sapiens
ASARGAPGS

SEQ ID NO: 571142 - protein, 9 aa, Homo Sapiens
ETENASSAW

SEQ ID NO: 571143 - protein, 9 aa, Homo Sapiens
KEISLARAK

SEQ ID NO: 571144 - protein, 9 aa, Homo Sapiens
SSVSTTSET

SEQ ID NO: 571145 - protein, 9 aa, Homo Sapiens
REAGISHEH

SEQ ID NO: 571146 - protein, 9 aa, Homo Sapiens
ARGAPGSAQ

SEQ ID NO: 571147 - protein, 9 aa, Homo Sapiens
NDGSDSESS

SEQ ID NO: 571148 - protein, 9 aa, Homo Sapiens
SHHSAQGPA

SEQ ID NO: 571149 - protein, 9 aa, Homo Sapiens
CWSLLDVHS

SEQ ID NO: 571150 - protein, 9 aa, Homo Sapiens
FQIEELTGN

SEQ ID NO: 571151 - protein, 9 aa, Homo Sapiens
YWTPKKTQQ

SEQ ID NO: 571152 - protein, 9 aa, Homo Sapiens
SPDPEGPEV

SEQ ID NO: 571153 - protein, 9 aa, Homo Sapiens
AWLGRVLSA

SEQ ID NO: 571154 - protein, 9 aa, Homo Sapiens
GQEALPEGR

SEQ ID NO: 571155 - protein, 9 aa, Homo Sapiens
LDVHSRPCL

SEQ ID NO: 571156 - protein, 9 aa, Homo Sapiens
RLCPSQGLS

SEQ ID NO: 571157 - protein, 9 aa, Homo Sapiens
MDPRPGGEL

SEQ ID NO: 571158 - protein, 9 aa, Homo Sapiens
INPTGWKSS

SEQ ID NO: 571159 - protein, 9 aa, Homo Sapiens
QAGGSQGSR

SEQ ID NO: 571160 - protein, 9 aa, Homo Sapiens
RGKGAEPTD

SEQ ID NO: 571161 - protein, 9 aa, Homo Sapiens
PIIIGHHAY

SEQ ID NO: 571162 - protein, 9 aa, Homo Sapiens
IEAQAGGSQ

SEQ ID NO: 571163 - protein, 9 aa, Homo Sapiens
KPEAIGVCG

SEQ ID NO: 571164 - protein, 9 aa, Homo Sapiens
PRERDQERE

SEQ ID NO: 571165 - protein, 9 aa, Homo Sapiens
CSHHSAQGP

SEQ ID NO: 571166 - protein, 9 aa, Homo Sapiens
STLSGTWSH

SEQ ID NO: 571167 - protein, 9 aa, Homo Sapiens
CPSQGLSSS

SEQ ID NO: 571168 - protein, 9 aa, Homo Sapiens
DEGMWKKLQ

SEQ ID NO: 571169 - protein, 9 aa, Homo Sapiens
VHYNEYEIV

SEQ ID NO: 571170 - protein, 9 aa, Homo Sapiens
APPSLVYTG

SEQ ID NO: 571171 - protein, 9 aa, Homo Sapiens
LIINPYWTP

SEQ ID NO: 571172 - protein, 9 aa, Homo Sapiens
DRSPDPEGP

SEQ ID NO: 571173 - protein, 9 aa, Homo Sapiens
MAAPWSCAL

SEQ ID NO: 571174 - protein, 9 aa, Homo Sapiens
SARGAPGSA

SEQ ID NO: 571175 - protein, 9 aa, Homo Sapiens
EGMWKKLQE

SEQ ID NO: 571176 - protein, 9 aa, Homo Sapiens
CYDGVGRRA

SEQ ID NO: 571177 - protein, 9 aa, Homo Sapiens
SSISQAYLG

SEQ ID NO: 571178 - protein, 9 aa, Homo Sapiens
ESGCKIQVA

SEQ ID NO: 571179 - protein, 9 aa, Homo Sapiens
NGLYGCWFS

SEQ ID NO: 571180 - protein, 9 aa, Homo Sapiens
SSDGLHPVI

SEQ ID NO: 571181 - protein, 9 aa, Homo Sapiens
KEIDEGMWK

SEQ ID NO: 571182 - protein, 9 aa, Homo Sapiens
TCSHHSAQG

SEQ ID NO: 571183 - protein, 9 aa, Homo Sapiens
NPTCSHHSA

SEQ ID NO: 571184 - protein, 9 aa, Homo Sapiens
AGDRAWLGR

SEQ ID NO: 571185 - protein, 9 aa, Homo Sapiens
PTSPGLRSS

SEQ ID NO: 571186 - protein, 9 aa, Homo Sapiens
YESGDILED

SEQ ID NO: 571187 - protein, 9 aa, Homo Sapiens
QGLSSSALP

SEQ ID NO: 571188 - protein, 9 aa, Homo Sapiens
IEELTGNLP

SEQ ID NO: 571189 - protein, 9 aa, Homo Sapiens
QRRKRYALT

SEQ ID NO: 571190 - protein, 9 aa, Homo Sapiens
GCPAVWLKA

SEQ ID NO: 571191 - protein, 9 aa, Homo Sapiens
EHPNHPIEA

SEQ ID NO: 571192 - protein, 9 aa, Homo Sapiens
EALPEGRDG

SEQ ID NO: 571193 - protein, 9 aa, Homo Sapiens
DNGLYGCWF

SEQ ID NO: 571194 - protein, 9 aa, Homo Sapiens
RCSTLSGTW

SEQ ID NO: 571195 - protein, 9 aa, Homo Sapiens
PNHPIEAQA

SEQ ID NO: 571196 - protein, 9 aa, Homo Sapiens
GISRGKGAE

SEQ ID NO: 571197 - protein, 9 aa, Homo Sapiens
LVYTGHQHN

SEQ ID NO: 571198 - protein, 9 aa, Homo Sapiens
LRQRRKRYA

SEQ ID NO: 571199 - protein, 9 aa, Homo Sapiens
VTRCSTLSG

SEQ ID NO: 571200 - protein, 9 aa, Homo Sapiens
APWSCALWS

SEQ ID NO: 571201 - protein, 9 aa, Homo Sapiens
YCYDGVGRR

SEQ ID NO: 571202 - protein, 9 aa, Homo Sapiens
RVSLNDGSD

SEQ ID NO: 571203 - protein, 9 aa, Homo Sapiens
SHEHPNHPI

SEQ ID NO: 571204 - protein, 9 aa, Homo Sapiens
YILIVRTVD

SEQ ID NO: 571205 - protein, 9 aa, Homo Sapiens
SSLPGSKGN

SEQ ID NO: 571206 - protein, 9 aa, Homo Sapiens
SLNDGSDSE

SEQ ID NO: 571207 - protein, 9 aa, Homo Sapiens
KASARGAPG

SEQ ID NO: 571208 - protein, 9 aa, Homo Sapiens
VHVREAGIS

SEQ ID NO: 571209 - protein, 9 aa, Homo Sapiens
YNEYEIVNG

SEQ ID NO: 571210 - protein, 9 aa, Homo Sapiens
EELKEIDEG

SEQ ID NO: 571211 - protein, 9 aa, Homo Sapiens
GHHAYGDQY

SEQ ID NO: 571212 - protein, 9 aa, Homo Sapiens
TKAPEAPSC

SEQ ID NO: 571213 - protein, 9 aa, Homo Sapiens
CPAVWLKAR

SEQ ID NO: 571214 - protein, 9 aa, Homo Sapiens
KIQVAPDSG

SEQ ID NO: 571215 - protein, 9 aa, Homo Sapiens
SAQGPASPC

SEQ ID NO: 571216 - protein, 9 aa, Homo Sapiens
LKEIDEGMW

SEQ ID NO: 571217 - protein, 9 aa, Homo Sapiens
VRTVDGGVG

SEQ ID NO: 571218 - protein, 9 aa, Homo Sapiens
NVNNVSVKD

SEQ ID NO: 571219 - protein, 9 aa, Homo Sapiens
AACKRPGCS

SEQ ID NO: 571220 - protein, 9 aa, Homo Sapiens
NAACKRPGC

SEQ ID NO: 571221 - protein, 9 aa, Homo Sapiens
VLHEKGRRL

SEQ ID NO: 571222 - protein, 9 aa, Homo Sapiens
ALNKMFCEL

SEQ ID NO: 571223 - protein, 9 aa, Homo Sapiens
IGHHAYGDQ

SEQ ID NO: 571224 - protein, 9 aa, Homo Sapiens
LTGRRHISH

SEQ ID NO: 571225 - protein, 9 aa, Homo Sapiens
LTLRNTLIE

SEQ ID NO: 571226 - protein, 9 aa, Homo Sapiens
WVKPIIIGH

SEQ ID NO: 571227 - protein, 9 aa, Homo Sapiens
RDKKPQDLF

SEQ ID NO: 571228 - protein, 9 aa, Homo Sapiens
FRGYTLKAL

SEQ ID NO: 571229 - protein, 9 aa, Homo Sapiens
LLKQQDPHW

SEQ ID NO: 571230 - protein, 9 aa, Homo Sapiens
KKKEVSKMV

SEQ ID NO: 571231 - protein, 9 aa, Homo Sapiens
QAGATISTT

SEQ ID NO: 571232 - protein, 9 aa, Homo Sapiens
KRPGCSPDA

SEQ ID NO: 571233 - protein, 9 aa, Homo Sapiens
IKKKEVSKM

SEQ ID NO: 571234 - protein, 9 aa, Homo Sapiens
GFNVNNVSV

SEQ ID NO: 571235 - protein, 9 aa, Homo Sapiens
PGRALLAAG

SEQ ID NO: 571236 - protein, 9 aa, Homo Sapiens
SLLLKQQDP

SEQ ID NO: 571237 - protein, 9 aa, Homo Sapiens
SRLVQPKLL

SEQ ID NO: 571238 - protein, 9 aa, Homo Sapiens
HPYLESLHD

SEQ ID NO: 571239 - protein, 9 aa, Homo Sapiens
VITQPRRIS

SEQ ID NO: 571240 - protein, 9 aa, Homo Sapiens
EEQDASPRP

SEQ ID NO: 571241 - protein, 9 aa, Homo Sapiens
PRRHPPGLL

SEQ ID NO: 571242 - protein, 9 aa, Homo Sapiens
KQCRCADTR

SEQ ID NO: 571243 - protein, 9 aa, Homo Sapiens
NTEEKSKSR

SEQ ID NO: 571244 - protein, 9 aa, Homo Sapiens
RCNVITQPR

SEQ ID NO: 571245 - protein, 9 aa, Homo Sapiens
KMVVSKTYE

SEQ ID NO: 571246 - protein, 9 aa, Homo Sapiens
CQVSLLLKQ

SEQ ID NO: 571247 - protein, 9 aa, Homo Sapiens
KKEVSKMVV

SEQ ID NO: 571248 - protein, 9 aa, Homo Sapiens
PKQCRCADT

SEQ ID NO: 571249 - protein, 9 aa, Homo Sapiens
TEETLRHPW

SEQ ID NO: 571250 - protein, 9 aa, Homo Sapiens
GGVWGPGRG

SEQ ID NO: 571251 - protein, 9 aa, Homo Sapiens
TVLTLRNTL

SEQ ID NO: 571252 - protein, 9 aa, Homo Sapiens
ATISTTTTT

SEQ ID NO: 571253 - protein, 9 aa, Homo Sapiens
PYLESLHDT

SEQ ID NO: 571254 - protein, 9 aa, Homo Sapiens
KQQDPHWHV

SEQ ID NO: 571255 - protein, 9 aa, Homo Sapiens
SPGRALLAA

SEQ ID NO: 571256 - protein, 9 aa, Homo Sapiens
VPGAAHLLL

SEQ ID NO: 571257 - protein, 9 aa, Homo Sapiens
DVLGAAVPG

SEQ ID NO: 571258 - protein, 9 aa, Homo Sapiens
ARCNVITQP

SEQ ID NO: 571259 - protein, 9 aa, Homo Sapiens
NFGSVARMC

SEQ ID NO: 571260 - protein, 9 aa, Homo Sapiens
PQDDVLGAA

SEQ ID NO: 571261 - protein, 9 aa, Homo Sapiens
GGRGGGVWG

SEQ ID NO: 571262 - protein, 9 aa, Homo Sapiens
GGGVWGPGR

SEQ ID NO: 571263 - protein, 9 aa, Homo Sapiens
TVLHEKGRR

SEQ ID NO: 571264 - protein, 9 aa, Homo Sapiens
GCSPDAPQA

SEQ ID NO: 571265 - protein, 9 aa, Homo Sapiens
VPKQCRCAD

SEQ ID NO: 571266 - protein, 9 aa, Homo Sapiens
GVWGPGRGG

SEQ ID NO: 571267 - protein, 9 aa, Homo Sapiens
PAGLHTLLP

SEQ ID NO: 571268 - protein, 9 aa, Homo Sapiens
SKSRLVQPK

SEQ ID NO: 571269 - protein, 9 aa, Homo Sapiens
DQGSNRSSS

SEQ ID NO: 571270 - protein, 9 aa, Homo Sapiens
EPPQDDVLG

SEQ ID NO: 571271 - protein, 9 aa, Homo Sapiens
HEKGRRLAN

SEQ ID NO: 571272 - protein, 9 aa, Homo Sapiens
KSKSRLVQP

SEQ ID NO: 571273 - protein, 9 aa, Homo Sapiens
FITSEEQDA

SEQ ID NO: 571274 - protein, 9 aa, Homo Sapiens
QVSLLLKQQ

SEQ ID NO: 571275 - protein, 9 aa, Homo Sapiens
VLGAAVPGS

SEQ ID NO: 571276 - protein, 9 aa, Homo Sapiens
TTTQGGAPG

SEQ ID NO: 571277 - protein, 9 aa, Homo Sapiens
CEVVAFSDW

SEQ ID NO: 571278 - protein, 9 aa, Homo Sapiens
QDASPRPAP

SEQ ID NO: 571279 - protein, 9 aa, Homo Sapiens
GGAGGAARL

SEQ ID NO: 571280 - protein, 9 aa, Homo Sapiens
CKRPGCSPD

SEQ ID NO: 571281 - protein, 9 aa, Homo Sapiens
QDLIVPKQC

SEQ ID NO: 571282 - protein, 9 aa, Homo Sapiens
EVSKMVVSK

SEQ ID NO: 571283 - protein, 9 aa, Homo Sapiens
ALEDQGSNR

SEQ ID NO: 571284 - protein, 9 aa, Homo Sapiens
ALLAAGAPL

SEQ ID NO: 571285 - protein, 9 aa, Homo Sapiens
LAHPYLESL

SEQ ID NO: 571286 - protein, 9 aa, Homo Sapiens
NKMFCELAK

SEQ ID NO: 571287 - protein, 9 aa, Homo Sapiens
LLPREPPQD

SEQ ID NO: 571288 - protein, 9 aa, Homo Sapiens
ALHLACASD

SEQ ID NO: 571289 - protein, 9 aa, Homo Sapiens
EVVAFSDWK

SEQ ID NO: 571290 - protein, 9 aa, Homo Sapiens
LLLKQQDPH

SEQ ID NO: 571291 - protein, 9 aa, Homo Sapiens
RGYTLKALA

SEQ ID NO: 571292 - protein, 9 aa, Homo Sapiens
CASDHVKVV

SEQ ID NO: 571293 - protein, 9 aa, Homo Sapiens
SDWKLKPLI

SEQ ID NO: 571294 - protein, 9 aa, Homo Sapiens
EEKSKSRLV

SEQ ID NO: 571295 - protein, 9 aa, Homo Sapiens
GDNVGFNVN

SEQ ID NO: 571296 - protein, 9 aa, Homo Sapiens
PQAGATIST

SEQ ID NO: 571297 - protein, 9 aa, Homo Sapiens
TISTTTTTQ

SEQ ID NO: 571298 - protein, 9 aa, Homo Sapiens
RALLAAGAP

SEQ ID NO: 571299 - protein, 9 aa, Homo Sapiens
HHAYGDQYR

SEQ ID NO: 571300 - protein, 9 aa, Homo Sapiens
TGRRHISHS

SEQ ID NO: 571301 - protein, 9 aa, Homo Sapiens
CGSRDKKPQ

SEQ ID NO: 571302 - protein, 9 aa, Homo Sapiens
AFSDWKLKP

SEQ ID NO: 571303 - protein, 9 aa, Homo Sapiens
QGSNRSSSN

SEQ ID NO: 571304 - protein, 9 aa, Homo Sapiens
LHLACASDH

SEQ ID NO: 571305 - protein, 9 aa, Homo Sapiens
RSSSNSSQD

SEQ ID NO: 571306 - protein, 9 aa, Homo Sapiens
EQDASPRPA

SEQ ID NO: 571307 - protein, 9 aa, Homo Sapiens
GGAARLVPG

SEQ ID NO: 571308 - protein, 9 aa, Homo Sapiens
YTLKALAVL

SEQ ID NO: 571309 - protein, 9 aa, Homo Sapiens
MFCELAKTC

SEQ ID NO: 571310 - protein, 9 aa, Homo Sapiens
FCELAKTCP

SEQ ID NO: 571311 - protein, 9 aa, Homo Sapiens
HLACASDHV

SEQ ID NO: 571312 - protein, 9 aa, Homo Sapiens
GRRHISHSG

SEQ ID NO: 571313 - protein, 9 aa, Homo Sapiens
VLTLRNTLI

SEQ ID NO: 571314 - protein, 9 aa, Homo Sapiens
VSLLLKQQD

SEQ ID NO: 571315 - protein, 9 aa, Homo Sapiens
YLESLHDTE

SEQ ID NO: 571316 - protein, 9 aa, Homo Sapiens
GAGGAARLV

SEQ ID NO: 571317 - protein, 9 aa, Homo Sapiens
AGGAARLVP

SEQ ID NO: 571318 - protein, 9 aa, Homo Sapiens
FGSVARMCA

SEQ ID NO: 571319 - protein, 9 aa, Homo Sapiens
PGLLPREPP

SEQ ID NO: 571320 - protein, 9 aa, Homo Sapiens
PQDLFGPPG

SEQ ID NO: 571321 - protein, 9 aa, Homo Sapiens
REPPQDDVL

SEQ ID NO: 571322 - protein, 9 aa, Homo Sapiens
SHSGCALQM

SEQ ID NO: 571323 - protein, 9 aa, Homo Sapiens
NRSSSNSSQ

SEQ ID NO: 571324 - protein, 9 aa, Homo Sapiens
HHPRRHPPG

SEQ ID NO: 571325 - protein, 9 aa, Homo Sapiens
ARLVPGAAH

SEQ ID NO: 571326 - protein, 9 aa, Homo Sapiens
FTTEETLRH

SEQ ID NO: 571327 - protein, 9 aa, Homo Sapiens
GAARLVPGA

SEQ ID NO: 571328 - protein, 9 aa, Homo Sapiens
EDQGSNRSS

SEQ ID NO: 571329 - protein, 9 aa, Homo Sapiens
QGGAPGGAG

SEQ ID NO: 571330 - protein, 9 aa, Homo Sapiens
PIIIGHHAY

SEQ ID NO: 571331 - protein, 9 aa, Homo Sapiens
AGTESYSLL

SEQ ID NO: 571332 - protein, 9 aa, Homo Sapiens
PPQDDVLGA

SEQ ID NO: 571333 - protein, 9 aa, Homo Sapiens
AVPGSPGRA

SEQ ID NO: 571334 - protein, 9 aa, Homo Sapiens
VNNVSVKDV

SEQ ID NO: 571335 - protein, 9 aa, Homo Sapiens
KNTVLTLRN

SEQ ID NO: 571336 - protein, 9 aa, Homo Sapiens
QTVLHEKGR

SEQ ID NO: 571337 - protein, 9 aa, Homo Sapiens
ARFTTEETL

SEQ ID NO: 571338 - protein, 9 aa, Homo Sapiens
KARFTTEET

SEQ ID NO: 571339 - protein, 9 aa, Homo Sapiens
AAGGRGGGV

SEQ ID NO: 571340 - protein, 9 aa, Homo Sapiens
HSGCALQMF

SEQ ID NO: 571341 - protein, 9 aa, Homo Sapiens
SCQDLIVPK

SEQ ID NO: 571342 - protein, 9 aa, Homo Sapiens
TLRHPWLQD

SEQ ID NO: 571343 - protein, 9 aa, Homo Sapiens
RLVQPKLLS

SEQ ID NO: 571344 - protein, 9 aa, Homo Sapiens
PREPPQDDV

SEQ ID NO: 571345 - protein, 9 aa, Homo Sapiens
GAAHLLLHQ

SEQ ID NO: 571346 - protein, 9 aa, Homo Sapiens
MVVSKTYER

SEQ ID NO: 571347 - protein, 9 aa, Homo Sapiens
FSDWKLKPL

SEQ ID NO: 571348 - protein, 9 aa, Homo Sapiens
IIIGHHAYG

SEQ ID NO: 571349 - protein, 9 aa, Homo Sapiens
HPPGLLPRE

SEQ ID NO: 571350 - protein, 9 aa, Homo Sapiens
LFRGYTLKA

SEQ ID NO: 571351 - protein, 9 aa, Homo Sapiens
HRRQTVLHE

SEQ ID NO: 571352 - protein, 9 aa, Homo Sapiens
AHPYLESLH

SEQ ID NO: 571353 - protein, 9 aa, Homo Sapiens
NNVSVKDVR

SEQ ID NO: 571354 - protein, 9 aa, Homo Sapiens
RRQTVLHEK

SEQ ID NO: 571355 - protein, 9 aa, Homo Sapiens
LLLHQCHHP

SEQ ID NO: 571356 - protein, 9 aa, Homo Sapiens
LDPAGLHTL

SEQ ID NO: 571357 - protein, 9 aa, Homo Sapiens
ECQVSLLLK

SEQ ID NO: 571358 - protein, 9 aa, Homo Sapiens
DWKLKPLIY

SEQ ID NO: 571359 - protein, 9 aa, Homo Sapiens
AHRRQTVLH

SEQ ID NO: 571360 - protein, 9 aa, Homo Sapiens
HPRRHPPGL

SEQ ID NO: 571361 - protein, 9 aa, Homo Sapiens
FGAGTESYS

SEQ ID NO: 571362 - protein, 9 aa, Homo Sapiens
PPGLLPREP

SEQ ID NO: 571363 - protein, 9 aa, Homo Sapiens
TDDKNTVLT

SEQ ID NO: 571364 - protein, 9 aa, Homo Sapiens
DDKNTVLTL

SEQ ID NO: 571365 - protein, 9 aa, Homo Sapiens
VWGPGRGGA

SEQ ID NO: 571366 - protein, 9 aa, Homo Sapiens
RQTVLHEKG

SEQ ID NO: 571367 - protein, 9 aa, Homo Sapiens
KKPQDLFGP

SEQ ID NO: 571368 - protein, 9 aa, Homo Sapiens
KPIIIGHHA

SEQ ID NO: 571369 - protein, 9 aa, Homo Sapiens
HTLLPVFLR

SEQ ID NO: 571370 - protein, 9 aa, Homo Sapiens
SEEQDASPR

SEQ ID NO: 571371 - protein, 9 aa, Homo Sapiens
ISHSGCALQ

SEQ ID NO: 571372 - protein, 9 aa, Homo Sapiens
LNKMFCELA

SEQ ID NO: 571373 - protein, 9 aa, Homo Sapiens
RLVPGAAHL

SEQ ID NO: 571374 - protein, 9 aa, Homo Sapiens
TQGGAPGGA

SEQ ID NO: 571375 - protein, 9 aa, Homo Sapiens
LHEKGRRLA

SEQ ID NO: 571376 - protein, 9 aa, Homo Sapiens
AHLLLHQCH

SEQ ID NO: 571377 - protein, 9 aa, Homo Sapiens
TLVTITNNF

SEQ ID NO: 571378 - protein, 9 aa, Homo Sapiens
DPAGLHTLL

SEQ ID NO: 571379 - protein, 9 aa, Homo Sapiens
EETLRHPWL

SEQ ID NO: 571380 - protein, 9 aa, Homo Sapiens
DLIVPKQCR

SEQ ID NO: 571381 - protein, 9 aa, Homo Sapiens
KPQDLFGPP

SEQ ID NO: 571382 - protein, 9 aa, Homo Sapiens
NVITQPRRI

SEQ ID NO: 571383 - protein, 9 aa, Homo Sapiens
QDDVLGAAV

SEQ ID NO: 571384 - protein, 9 aa, Homo Sapiens
LESLHDTED

SEQ ID NO: 571385 - protein, 9 aa, Homo Sapiens
CELAKTCPV

SEQ ID NO: 571386 - protein, 9 aa, Homo Sapiens
CQLDPAGLH

SEQ ID NO: 571387 - protein, 9 aa, Homo Sapiens
VAFSDWKLK

SEQ ID NO: 571388 - protein, 9 aa, Homo Sapiens
GLLPREPPQ

SEQ ID NO: 571389 - protein, 9 aa, Homo Sapiens
ACASDHVKV

SEQ ID NO: 571390 - protein, 9 aa, Homo Sapiens
ISTTTTTQG

SEQ ID NO: 571391 - protein, 9 aa, Homo Sapiens
TQHNAACKR

SEQ ID NO: 571392 - protein, 9 aa, Homo Sapiens
DKNTVLTLR

SEQ ID NO: 571393 - protein, 9 aa, Homo Sapiens
GLHTLLPVF

SEQ ID NO: 571394 - protein, 9 aa, Homo Sapiens
LHQCHHPRR

SEQ ID NO: 571395 - protein, 9 aa, Homo Sapiens
DHVKVVTLL

SEQ ID NO: 571396 - protein, 9 aa, Homo Sapiens
VVAFSDWKL

SEQ ID NO: 571397 - protein, 9 aa, Homo Sapiens
SDHVKVVTL

SEQ ID NO: 571398 - protein, 9 aa, Homo Sapiens
GSPGRALLA

SEQ ID NO: 571399 - protein, 9 aa, Homo Sapiens
TEEKSKSRL

SEQ ID NO: 571400 - protein, 9 aa, Homo Sapiens
IVPKQCRCA

SEQ ID NO: 571401 - protein, 9 aa, Homo Sapiens
RFTTEETLR

SEQ ID NO: 571402 - protein, 9 aa, Homo Sapiens
LGAAVPGSP

SEQ ID NO: 571403 - protein, 9 aa, Homo Sapiens
RPGCSPDAP

SEQ ID NO: 571404 - protein, 9 aa, Homo Sapiens
SRDKKPQDL

SEQ ID NO: 571405 - protein, 9 aa, Homo Sapiens
GATISTTTT

SEQ ID NO: 571406 - protein, 9 aa, Homo Sapiens
ACKRPGCSP

SEQ ID NO: 571407 - protein, 9 aa, Homo Sapiens
ASDHVKVVT

SEQ ID NO: 571408 - protein, 9 aa, Homo Sapiens
ASPRPAPLL

SEQ ID NO: 571409 - protein, 9 aa, Homo Sapiens
RGARCNVIT

SEQ ID NO: 571410 - protein, 9 aa, Homo Sapiens
IIGHHAYGD

SEQ ID NO: 571411 - protein, 9 aa, Homo Sapiens
HQCHHPRRH

SEQ ID NO: 571412 - protein, 9 aa, Homo Sapiens
SPDAPQAGA

SEQ ID NO: 571413 - protein, 9 aa, Homo Sapiens
LIVPKQCRC

SEQ ID NO: 571414 - protein, 9 aa, Homo Sapiens
DKKPQDLFG

SEQ ID NO: 571415 - protein, 9 aa, Homo Sapiens
DDVLGAAVP

SEQ ID NO: 571416 - protein, 9 aa, Homo Sapiens
GRGGGVWGP

SEQ ID NO: 571417 - protein, 9 aa, Homo Sapiens
ITNNFGSVA

SEQ ID NO: 571418 - protein, 9 aa, Homo Sapiens
TESYSLLRF

SEQ ID NO: 571419 - protein, 9 aa, Homo Sapiens
HISHSGCAL

SEQ ID NO: 571420 - protein, 9 aa, Homo Sapiens
LEDQGSNRS

SEQ ID NO: 571421 - protein, 9 aa, Homo Sapiens
ITSEEQDAS

SEQ ID NO: 571422 - protein, 9 aa, Homo Sapiens
GAPGGAGGA

SEQ ID NO: 571423 - protein, 9 aa, Homo Sapiens
LACASDHVK

SEQ ID NO: 571424 - protein, 9 aa, Homo Sapiens
DASPRPAPL

SEQ ID NO: 571425 - protein, 9 aa, Homo Sapiens
QDLFGPPGP

SEQ ID NO: 571426 - protein, 9 aa, Homo Sapiens
RHISHSGCA

SEQ ID NO: 571427 - protein, 9 aa, Homo Sapiens
SKMVVSKTY

SEQ ID NO: 571428 - protein, 9 aa, Homo Sapiens
GYTLKALAV

SEQ ID NO: 571429 - protein, 9 aa, Homo Sapiens
HLLLHQCHH

SEQ ID NO: 571430 - protein, 9 aa, Homo Sapiens
STTTTTQGG

SEQ ID NO: 571431 - protein, 9 aa, Homo Sapiens
AGATISTTT

SEQ ID NO: 571432 - protein, 9 aa, Homo Sapiens
NVGFNVNNV

SEQ ID NO: 571433 - protein, 9 aa, Homo Sapiens
YSLLRFLLL

SEQ ID NO: 571434 - protein, 9 aa, Homo Sapiens
TLRNTLIES

SEQ ID NO: 571435 - protein, 9 aa, Homo Sapiens
PGGAGGAAR

SEQ ID NO: 571436 - protein, 9 aa, Homo Sapiens
LKQQDPHWH

SEQ ID NO: 571437 - protein, 9 aa, Homo Sapiens
ETLRHPWLQ

SEQ ID NO: 571438 - protein, 9 aa, Homo Sapiens
KSRLVQPKL

SEQ ID NO: 571439 - protein, 9 aa, Homo Sapiens
KMFCELAKT

SEQ ID NO: 571440 - protein, 9 aa, Homo Sapiens
TITNNFGSV

SEQ ID NO: 571441 - protein, 9 aa, Homo Sapiens
TTTTQGGAP

SEQ ID NO: 571442 - protein, 9 aa, Homo Sapiens
EKSKSRLVQ

SEQ ID NO: 571443 - protein, 9 aa, Homo Sapiens
RGGGVWGPG

SEQ ID NO: 571444 - protein, 9 aa, Homo Sapiens
ELAKTCPVQ

SEQ ID NO: 571445 - protein, 9 aa, Homo Sapiens
RHPPGLLPR

SEQ ID NO: 571446 - protein, 9 aa, Homo Sapiens
APGGAGGAA

SEQ ID NO: 571447 - protein, 9 aa, Homo Sapiens
QCHHPRRHP

SEQ ID NO: 571448 - protein, 9 aa, Homo Sapiens
VTITNNFGS

SEQ ID NO: 571449 - protein, 9 aa, Homo Sapiens
LHTLLPVFL

SEQ ID NO: 571450 - protein, 9 aa, Homo Sapiens
VSKMVVSKT

SEQ ID NO: 571451 - protein, 9 aa, Homo Sapiens
VPGSPGRAL

SEQ ID NO: 571452 - protein, 9 aa, Homo Sapiens
GGAPGGAGG

SEQ ID NO: 571453 - protein, 9 aa, Homo Sapiens
AGGRGGGVW

SEQ ID NO: 571454 - protein, 9 aa, Homo Sapiens
SYSLLRFLL

SEQ ID NO: 571455 - protein, 9 aa, Homo Sapiens
GSNRSSSNS

SEQ ID NO: 571456 - protein, 9 aa, Homo Sapiens
LVPGAAHLL

SEQ ID NO: 571457 - protein, 9 aa, Homo Sapiens
SNRSSSNSS

SEQ ID NO: 571458 - protein, 9 aa, Homo Sapiens
DNVGFNVNN

SEQ ID NO: 571459 - protein, 9 aa, Homo Sapiens
ALFRGYTLK

SEQ ID NO: 571460 - protein, 9 aa, Homo Sapiens
GARCNVITQ

SEQ ID NO: 571461 - protein, 9 aa, Homo Sapiens
CHHPRRHPP

SEQ ID NO: 571462 - protein, 9 aa, Homo Sapiens
CNVITQPRR

SEQ ID NO: 571463 - protein, 9 aa, Homo Sapiens
KEVSKMVVS

SEQ ID NO: 571464 - protein, 9 aa, Homo Sapiens
GEALAHPYL

SEQ ID NO: 571465 - protein, 9 aa, Homo Sapiens
TTTTTQGGA

SEQ ID NO: 571466 - protein, 9 aa, Homo Sapiens
PDAPQAGAT

SEQ ID NO: 571467 - protein, 9 aa, Homo Sapiens
HNAACKRPG

SEQ ID NO: 571468 - protein, 9 aa, Homo Sapiens
AAHLLLHQC

SEQ ID NO: 571469 - protein, 9 aa, Homo Sapiens
GTESYSLLR

SEQ ID NO: 571470 - protein, 9 aa, Homo Sapiens
PGAAHLLLH

SEQ ID NO: 571471 - protein, 9 aa, Homo Sapiens
NTVLTLRNT

SEQ ID NO: 571472 - protein, 9 aa, Homo Sapiens
AARLVPGAA

SEQ ID NO: 571473 - protein, 9 aa, Homo Sapiens
NNFGSVARM

SEQ ID NO: 571474 - protein, 9 aa, Homo Sapiens
VKPIIIGHH

SEQ ID NO: 571475 - protein, 9 aa, Homo Sapiens
APQAGATIS

SEQ ID NO: 571476 - protein, 9 aa, Homo Sapiens
TTQGGAPGG

SEQ ID NO: 571477 - protein, 9 aa, Homo Sapiens
LPREPPQDD

SEQ ID NO: 571478 - protein, 9 aa, Homo Sapiens
TSEEQDASP

SEQ ID NO: 571479 - protein, 9 aa, Homo Sapiens
RRHPPGLLP

SEQ ID NO: 571480 - protein, 9 aa, Homo Sapiens
ESYSLLRFL

SEQ ID NO: 571481 - protein, 9 aa, Homo Sapiens
CQDLIVPKQ

SEQ ID NO: 571482 - protein, 9 aa, Homo Sapiens
RRHISHSGC

SEQ ID NO: 571483 - protein, 9 aa, Homo Sapiens
TTEETLRHP

SEQ ID NO: 571484 - protein, 9 aa, Homo Sapiens
GAGTESYSL

SEQ ID NO: 571485 - protein, 9 aa, Homo Sapiens
GSRDKKPQD

SEQ ID NO: 571486 - protein, 9 aa, Homo Sapiens
LVTITNNFG

SEQ ID NO: 571487 - protein, 9 aa, Homo Sapiens
AGLHTLLPV

SEQ ID NO: 571488 - protein, 9 aa, Homo Sapiens
QLDPAGLHT

SEQ ID NO: 571489 - protein, 9 aa, Homo Sapiens
TNNFGSVAR

SEQ ID NO: 571490 - protein, 9 aa, Homo Sapiens
GHHAYGDQY

SEQ ID NO: 571491 - protein, 9 aa, Homo Sapiens
CSPDAPQAG

SEQ ID NO: 571492 - protein, 9 aa, Homo Sapiens
GRALLAAGA

SEQ ID NO: 571493 - protein, 9 aa, Homo Sapiens
PGCSPDAPQ

SEQ ID NO: 571494 - protein, 9 aa, Homo Sapiens
GAAVPGSPG

SEQ ID NO: 571495 - protein, 9 aa, Homo Sapiens
FNVNNVSVK

SEQ ID NO: 571496 - protein, 9 aa, Homo Sapiens
LLHQCHHPR

SEQ ID NO: 571497 - protein, 9 aa, Homo Sapiens
QHNAACKRP

SEQ ID NO: 571498 - protein, 9 aa, Homo Sapiens
VGFNVNNVS

SEQ ID NO: 571499 - protein, 9 aa, Homo Sapiens
WKLKPLIYV

SEQ ID NO: 571500 - protein, 9 aa, Homo Sapiens
AAVPGSPGR

SEQ ID NO: 571501 - protein, 9 aa, Homo Sapiens
PALNKMFCE

SEQ ID NO: 571502 - protein, 9 aa, Homo Sapiens
PGSPGRALL

SEQ ID NO: 571503 - protein, 9 aa, Homo Sapiens
ALAHPYLES

SEQ ID NO: 571504 - protein, 9 aa, Homo Sapiens
DAPQAGATI

SEQ ID NO: 571505 - protein, 9 aa, Homo Sapiens
TPGLHTTSH

SEQ ID NO: 571506 - protein, 9 aa, Homo Sapiens
RHYQKSTEL

SEQ ID NO: 571507 - protein, 9 aa, Homo Sapiens
IETFEDAQK

SEQ ID NO: 571508 - protein, 9 aa, Homo Sapiens
GQQGPVRSG

SEQ ID NO: 571509 - protein, 9 aa, Homo Sapiens
TVALREIRH

SEQ ID NO: 571510 - protein, 9 aa, Homo Sapiens
IGHHAYGDQ

SEQ ID NO: 571511 - protein, 9 aa, Homo Sapiens
LHTTSHCHV

SEQ ID NO: 571512 - protein, 9 aa, Homo Sapiens
SKKKVLLGV

SEQ ID NO: 571513 - protein, 9 aa, Homo Sapiens
WVKPIIIGH

SEQ ID NO: 571514 - protein, 9 aa, Homo Sapiens
TLVVRYRRN

SEQ ID NO: 571515 - protein, 9 aa, Homo Sapiens
PPGKPEGPP

SEQ ID NO: 571516 - protein, 9 aa, Homo Sapiens
TIGVEFGAQ

SEQ ID NO: 571517 - protein, 9 aa, Homo Sapiens
IRHYQKSTE

SEQ ID NO: 571518 - protein, 9 aa, Homo Sapiens
LVDIFFSLV

SEQ ID NO: 571519 - protein, 9 aa, Homo Sapiens
AVRSRKQGL

SEQ ID NO: 571520 - protein, 9 aa, Homo Sapiens
GLQGVLGPP

SEQ ID NO: 571521 - protein, 9 aa, Homo Sapiens
TPVQMAGKD

SEQ ID NO: 571522 - protein, 9 aa, Homo Sapiens
HTERTARGL

SEQ ID NO: 571523 - protein, 9 aa, Homo Sapiens
SKVIYTYCG

SEQ ID NO: 571524 - protein, 9 aa, Homo Sapiens
PEEEEDDWE

SEQ ID NO: 571525 - protein, 9 aa, Homo Sapiens
CTPGLHTTS

SEQ ID NO: 571526 - protein, 9 aa, Homo Sapiens
DSKVIYTYC

SEQ ID NO: 571527 - protein, 9 aa, Homo Sapiens
QGVLGPPGA

SEQ ID NO: 571528 - protein, 9 aa, Homo Sapiens
VDIFFSLVT

SEQ ID NO: 571529 - protein, 9 aa, Homo Sapiens
KMLFKKTHR

SEQ ID NO: 571530 - protein, 9 aa, Homo Sapiens
GLHTTSHCH

SEQ ID NO: 571531 - protein, 9 aa, Homo Sapiens
IDTLSSDFT

SEQ ID NO: 571532 - protein, 9 aa, Homo Sapiens
LKTSESSTT

SEQ ID NO: 571533 - protein, 9 aa, Homo Sapiens
STTLVVRYR

SEQ ID NO: 571534 - protein, 9 aa, Homo Sapiens
LEEAAVRSR

SEQ ID NO: 571535 - protein, 9 aa, Homo Sapiens
IIGHHAYGD

SEQ ID NO: 571536 - protein, 9 aa, Homo Sapiens
KDMLVFLDG

SEQ ID NO: 571537 - protein, 9 aa, Homo Sapiens
KEDDCEHGK

SEQ ID NO: 571538 - protein, 9 aa, Homo Sapiens
SGQQGPVRS

SEQ ID NO: 571539 - protein, 9 aa, Homo Sapiens
LHKEKTNKQ

SEQ ID NO: 571540 - protein, 9 aa, Homo Sapiens
VLGPPGAVG

SEQ ID NO: 571541 - protein, 9 aa, Homo Sapiens
VQMAGKDYP

SEQ ID NO: 571542 - protein, 9 aa, Homo Sapiens
KTSESSTTL

SEQ ID NO: 571543 - protein, 9 aa, Homo Sapiens
FDSGQQGPV

SEQ ID NO: 571544 - protein, 9 aa, Homo Sapiens
QITAIETFE

SEQ ID NO: 571545 - protein, 9 aa, Homo Sapiens
SLPPRARKP

SEQ ID NO: 571546 - protein, 9 aa, Homo Sapiens
RLSLPPRAR

SEQ ID NO: 571547 - protein, 9 aa, Homo Sapiens
QLLGREVPW

SEQ ID NO: 571548 - protein, 9 aa, Homo Sapiens
SLHKEKTNK

SEQ ID NO: 571549 - protein, 9 aa, Homo Sapiens
ENQGVPVLY

SEQ ID NO: 571550 - protein, 9 aa, Homo Sapiens
AEEHTERTA

SEQ ID NO: 571551 - protein, 9 aa, Homo Sapiens
FIFLNNAGA

SEQ ID NO: 571552 - protein, 9 aa, Homo Sapiens
GPDDAIDTL

SEQ ID NO: 571553 - protein, 9 aa, Homo Sapiens
FGAQMITID

SEQ ID NO: 571554 - protein, 9 aa, Homo Sapiens
LREIRHYQK

SEQ ID NO: 571555 - protein, 9 aa, Homo Sapiens
NQGVPVLYS

SEQ ID NO: 571556 - protein, 9 aa, Homo Sapiens
VRSGLRRAL

SEQ ID NO: 571557 - protein, 9 aa, Homo Sapiens
NQLLGREVP

SEQ ID NO: 571558 - protein, 9 aa, Homo Sapiens
EDDCEHGKD

SEQ ID NO: 571559 - protein, 9 aa, Homo Sapiens
YALGAFDGP

SEQ ID NO: 571560 - protein, 9 aa, Homo Sapiens
QLGAGLKML

SEQ ID NO: 571561 - protein, 9 aa, Homo Sapiens
GLKMLFKKT

SEQ ID NO: 571562 - protein, 9 aa, Homo Sapiens
EIRHYQKST

SEQ ID NO: 571563 - protein, 9 aa, Homo Sapiens
ESFPEEEED

SEQ ID NO: 571564 - protein, 9 aa, Homo Sapiens
MDPLRLSLP

SEQ ID NO: 571565 - protein, 9 aa, Homo Sapiens
RHTLPEDNE

SEQ ID NO: 571566 - protein, 9 aa, Homo Sapiens
SFPEEEEDD

SEQ ID NO: 571567 - protein, 9 aa, Homo Sapiens
TFDSGQQGP

SEQ ID NO: 571568 - protein, 9 aa, Homo Sapiens
IRHTLPEDN

SEQ ID NO: 571569 - protein, 9 aa, Homo Sapiens
EFGAQMITI

SEQ ID NO: 571570 - protein, 9 aa, Homo Sapiens
RFIDSKVIY

SEQ ID NO: 571571 - protein, 9 aa, Homo Sapiens
TQVLAEEHT

SEQ ID NO: 571572 - protein, 9 aa, Homo Sapiens
SLVDIFFSL

SEQ ID NO: 571573 - protein, 9 aa, Homo Sapiens
ELGGVINTS

SEQ ID NO: 571574 - protein, 9 aa, Homo Sapiens
PSKKKVLLG

SEQ ID NO: 571575 - protein, 9 aa, Homo Sapiens
NATFVLVGS

SEQ ID NO: 571576 - protein, 9 aa, Homo Sapiens
VPLLPIRHT

SEQ ID NO: 571577 - protein, 9 aa, Homo Sapiens
HLPSKKKVL

SEQ ID NO: 571578 - protein, 9 aa, Homo Sapiens
TQLCTPGLH

SEQ ID NO: 571579 - protein, 9 aa, Homo Sapiens
DDCEHGKDE

SEQ ID NO: 571580 - protein, 9 aa, Homo Sapiens
CEHGKDETH

SEQ ID NO: 571581 - protein, 9 aa, Homo Sapiens
KPIIIGHHA

SEQ ID NO: 571582 - protein, 9 aa, Homo Sapiens
GGVINTSQE

SEQ ID NO: 571583 - protein, 9 aa, Homo Sapiens
GAGLKMLFK

SEQ ID NO: 571584 - protein, 9 aa, Homo Sapiens
HHAYGDQYR

SEQ ID NO: 571585 - protein, 9 aa, Homo Sapiens
DTLSSDFTC

SEQ ID NO: 571586 - protein, 9 aa, Homo Sapiens
ATFVLVGSV

SEQ ID NO: 571587 - protein, 9 aa, Homo Sapiens
LLPIRHTLP

SEQ ID NO: 571588 - protein, 9 aa, Homo Sapiens
LGAGLKMLF

SEQ ID NO: 571589 - protein, 9 aa, Homo Sapiens
AGLKMLFKK

SEQ ID NO: 571590 - protein, 9 aa, Homo Sapiens
IFLNNAGAE

SEQ ID NO: 571591 - protein, 9 aa, Homo Sapiens
LGAFDGPHT

SEQ ID NO: 571592 - protein, 9 aa, Homo Sapiens
THLPSKKKV

SEQ ID NO: 571593 - protein, 9 aa, Homo Sapiens
FPEEEEDDW

SEQ ID NO: 571594 - protein, 9 aa, Homo Sapiens
MAGKDYPAL

SEQ ID NO: 571595 - protein, 9 aa, Homo Sapiens
LLWATLNAT

SEQ ID NO: 571596 - protein, 9 aa, Homo Sapiens
LAEEHTERT

SEQ ID NO: 571597 - protein, 9 aa, Homo Sapiens
HTTSHCHVN

SEQ ID NO: 571598 - protein, 9 aa, Homo Sapiens
EEAAVRSRK

SEQ ID NO: 571599 - protein, 9 aa, Homo Sapiens
ETLEEAAVR

SEQ ID NO: 571600 - protein, 9 aa, Homo Sapiens
PIRHTLPED

SEQ ID NO: 571601 - protein, 9 aa, Homo Sapiens
ALREIRHYQ

SEQ ID NO: 571602 - protein, 9 aa, Homo Sapiens
SSTTLVVRY

SEQ ID NO: 571603 - protein, 9 aa, Homo Sapiens
DPLRLSLPP

SEQ ID NO: 571604 - protein, 9 aa, Homo Sapiens
FSLVTIPKM

SEQ ID NO: 571605 - protein, 9 aa, Homo Sapiens
PDDAIDTLS

SEQ ID NO: 571606 - protein, 9 aa, Homo Sapiens
NNAGAERIT

SEQ ID NO: 571607 - protein, 9 aa, Homo Sapiens
INTSQEKIF

SEQ ID NO: 571608 - protein, 9 aa, Homo Sapiens
PVPLLPIRH

SEQ ID NO: 571609 - protein, 9 aa, Homo Sapiens
GVLGPPGAV

SEQ ID NO: 571610 - protein, 9 aa, Homo Sapiens
PIIIGHHAY

SEQ ID NO: 571611 - protein, 9 aa, Homo Sapiens
FIDSKVIYT

SEQ ID NO: 571612 - protein, 9 aa, Homo Sapiens
DAIDTLSSD

SEQ ID NO: 571613 - protein, 9 aa, Homo Sapiens
WATLNATFV

SEQ ID NO: 571614 - protein, 9 aa, Homo Sapiens
AIDTLSSDF

SEQ ID NO: 571615 - protein, 9 aa, Homo Sapiens
TNQLLGREV

SEQ ID NO: 571616 - protein, 9 aa, Homo Sapiens
SESSTTLVV

SEQ ID NO: 571617 - protein, 9 aa, Homo Sapiens
LKKTFDSGQ

SEQ ID NO: 571618 - protein, 9 aa, Homo Sapiens
MESRKDMLV

SEQ ID NO: 571619 - protein, 9 aa, Homo Sapiens
EHTERTARG

SEQ ID NO: 571620 - protein, 9 aa, Homo Sapiens
QQGPVRSGL

SEQ ID NO: 571621 - protein, 9 aa, Homo Sapiens
LPIRHTLPE

SEQ ID NO: 571622 - protein, 9 aa, Homo Sapiens
MFIFLNNAG

SEQ ID NO: 571623 - protein, 9 aa, Homo Sapiens
VALREIRHY

SEQ ID NO: 571624 - protein, 9 aa, Homo Sapiens
PELCYEADV

SEQ ID NO: 571625 - protein, 9 aa, Homo Sapiens
FLNNAGAER

SEQ ID NO: 571626 - protein, 9 aa, Homo Sapiens
RSGLRRALC

SEQ ID NO: 571627 - protein, 9 aa, Homo Sapiens
GAQMITIDG

SEQ ID NO: 571628 - protein, 9 aa, Homo Sapiens
IIIGHHAYG

SEQ ID NO: 571629 - protein, 9 aa, Homo Sapiens
LCTPGLHTT

SEQ ID NO: 571630 - protein, 9 aa, Homo Sapiens
QMITIDGKQ

SEQ ID NO: 571631 - protein, 9 aa, Homo Sapiens
SQITAIETF

SEQ ID NO: 571632 - protein, 9 aa, Homo Sapiens
LCYEADVQA

SEQ ID NO: 571633 - protein, 9 aa, Homo Sapiens
MLVFLDGGQ

SEQ ID NO: 571634 - protein, 9 aa, Homo Sapiens
ESSTTLVVR

SEQ ID NO: 571635 - protein, 9 aa, Homo Sapiens
AIETFEDAQ

SEQ ID NO: 571636 - protein, 9 aa, Homo Sapiens
VTNQLLGRE

SEQ ID NO: 571637 - protein, 9 aa, Homo Sapiens
TTLVVRYRR

SEQ ID NO: 571638 - protein, 9 aa, Homo Sapiens
LKMLFKKTH

SEQ ID NO: 571639 - protein, 9 aa, Homo Sapiens
EHGKDETHC

SEQ ID NO: 571640 - protein, 9 aa, Homo Sapiens
ATLNATFVL

SEQ ID NO: 571641 - protein, 9 aa, Homo Sapiens
DSGQQGPVR

SEQ ID NO: 571642 - protein, 9 aa, Homo Sapiens
AQMITIDGK

SEQ ID NO: 571643 - protein, 9 aa, Homo Sapiens
NTSQEKIFI

SEQ ID NO: 571644 - protein, 9 aa, Homo Sapiens
KVIYTYCGI

SEQ ID NO: 571645 - protein, 9 aa, Homo Sapiens
YEADVQAFS

SEQ ID NO: 571646 - protein, 9 aa, Homo Sapiens
AMFIFLNNA

SEQ ID NO: 571647 - protein, 9 aa, Homo Sapiens
TLNATFVLV

SEQ ID NO: 571648 - protein, 9 aa, Homo Sapiens
DMLVFLDGG

SEQ ID NO: 571649 - protein, 9 aa, Homo Sapiens
ELCYEADVQ

SEQ ID NO: 571650 - protein, 9 aa, Homo Sapiens
QKAMFIFLN

SEQ ID NO: 571651 - protein, 9 aa, Homo Sapiens
LRLSLPPRA

SEQ ID NO: 571652 - protein, 9 aa, Homo Sapiens
VIYTYCGIV

SEQ ID NO: 571653 - protein, 9 aa, Homo Sapiens
LNNAGAERI

SEQ ID NO: 571654 - protein, 9 aa, Homo Sapiens
DSQITAIET

SEQ ID NO: 571655 - protein, 9 aa, Homo Sapiens
GPVRSGLRR

SEQ ID NO: 571656 - protein, 9 aa, Homo Sapiens
QGPVRSGLR

SEQ ID NO: 571657 - protein, 9 aa, Homo Sapiens
QLCTPGLHT

SEQ ID NO: 571658 - protein, 9 aa, Homo Sapiens
DGPHTVEGQ

SEQ ID NO: 571659 - protein, 9 aa, Homo Sapiens
LVTIPKMLA

SEQ ID NO: 571660 - protein, 9 aa, Homo Sapiens
AGKDYPALL

SEQ ID NO: 571661 - protein, 9 aa, Homo Sapiens
KKTFDSGQQ

SEQ ID NO: 571662 - protein, 9 aa, Homo Sapiens
ETFEDAQKS

SEQ ID NO: 571663 - protein, 9 aa, Homo Sapiens
LWATLNATF

SEQ ID NO: 571664 - protein, 9 aa, Homo Sapiens
ALGAFDGPH

SEQ ID NO: 571665 - protein, 9 aa, Homo Sapiens
PLLPIRHTL

SEQ ID NO: 571666 - protein, 9 aa, Homo Sapiens
TLSSDFTCG

SEQ ID NO: 571667 - protein, 9 aa, Homo Sapiens
SRKDMLVFL

SEQ ID NO: 571668 - protein, 9 aa, Homo Sapiens
FDGPHTVEG

SEQ ID NO: 571669 - protein, 9 aa, Homo Sapiens
LPSKKKVLL

SEQ ID NO: 571670 - protein, 9 aa, Homo Sapiens
CYEADVQAF

SEQ ID NO: 571671 - protein, 9 aa, Homo Sapiens
TLEEAAVRS

SEQ ID NO: 571672 - protein, 9 aa, Homo Sapiens
HTQVLAEEH

SEQ ID NO: 571673 - protein, 9 aa, Homo Sapiens
EEHTERTAR

SEQ ID NO: 571674 - protein, 9 aa, Homo Sapiens
LSLPPRARK

SEQ ID NO: 571675 - protein, 9 aa, Homo Sapiens
LNATFVLVG

SEQ ID NO: 571676 - protein, 9 aa, Homo Sapiens
GKDETHCNK

SEQ ID NO: 571677 - protein, 9 aa, Homo Sapiens
VINTSQEKI

SEQ ID NO: 571678 - protein, 9 aa, Homo Sapiens
QPGLQGVLG

SEQ ID NO: 571679 - protein, 9 aa, Homo Sapiens
LLGREVPWD

SEQ ID NO: 571680 - protein, 9 aa, Homo Sapiens
HGKDETHCN

SEQ ID NO: 571681 - protein, 9 aa, Homo Sapiens
LQGVLGPPG

SEQ ID NO: 571682 - protein, 9 aa, Homo Sapiens
VRSRKQGLD

SEQ ID NO: 571683 - protein, 9 aa, Homo Sapiens
IGPDDAIDT

SEQ ID NO: 571684 - protein, 9 aa, Homo Sapiens
GPHTVEGQY

SEQ ID NO: 571685 - protein, 9 aa, Homo Sapiens
GAFDGPHTV

SEQ ID NO: 571686 - protein, 9 aa, Homo Sapiens
TSESSTTLV

SEQ ID NO: 571687 - protein, 9 aa, Homo Sapiens
GVINTSQEK

SEQ ID NO: 571688 - protein, 9 aa, Homo Sapiens
GKDYPALLS

SEQ ID NO: 571689 - protein, 9 aa, Homo Sapiens
LVFLDGGQL

SEQ ID NO: 571690 - protein, 9 aa, Homo Sapiens
VEFGAQMIT

SEQ ID NO: 571691 - protein, 9 aa, Homo Sapiens
ESRKDMLVF

SEQ ID NO: 571692 - protein, 9 aa, Homo Sapiens
TSQEKIFIA

SEQ ID NO: 571693 - protein, 9 aa, Homo Sapiens
PVQMAGKDY

SEQ ID NO: 571694 - protein, 9 aa, Homo Sapiens
KAMFIFLNN

SEQ ID NO: 571695 - protein, 9 aa, Homo Sapiens
REIRHYQKS

SEQ ID NO: 571696 - protein, 9 aa, Homo Sapiens
PGLHTTSHC

SEQ ID NO: 571697 - protein, 9 aa, Homo Sapiens
SSLHKEKTN

SEQ ID NO: 571698 - protein, 9 aa, Homo Sapiens
AETLEEAAV

SEQ ID NO: 571699 - protein, 9 aa, Homo Sapiens
ITAIETFED

SEQ ID NO: 571700 - protein, 9 aa, Homo Sapiens
IFFSLVTIP

SEQ ID NO: 571701 - protein, 9 aa, Homo Sapiens
VLAEEHTER

SEQ ID NO: 571702 - protein, 9 aa, Homo Sapiens
HYQKSTELL

SEQ ID NO: 571703 - protein, 9 aa, Homo Sapiens
SQEKIFIAA

SEQ ID NO: 571704 - protein, 9 aa, Homo Sapiens
KTFDSGQQG

SEQ ID NO: 571705 - protein, 9 aa, Homo Sapiens
RVRFIDSKV

SEQ ID NO: 571706 - protein, 9 aa, Homo Sapiens
DDAIDTLSS

SEQ ID NO: 571707 - protein, 9 aa, Homo Sapiens
MLFKKTHRI

SEQ ID NO: 571708 - protein, 9 aa, Homo Sapiens
AAVRSRKQG

SEQ ID NO: 571709 - protein, 9 aa, Homo Sapiens
LGGVINTSQ

SEQ ID NO: 571710 - protein, 9 aa, Homo Sapiens
LPELCYEAD

SEQ ID NO: 571711 - protein, 9 aa, Homo Sapiens
EADVQAFSR

SEQ ID NO: 571712 - protein, 9 aa, Homo Sapiens
AFDGPHTVE

SEQ ID NO: 571713 - protein, 9 aa, Homo Sapiens
QGVPVLYSC

SEQ ID NO: 571714 - protein, 9 aa, Homo Sapiens
TAIETFEDA

SEQ ID NO: 571715 - protein, 9 aa, Homo Sapiens
DIFFSLVTI

SEQ ID NO: 571716 - protein, 9 aa, Homo Sapiens
PPPGKPEGP

SEQ ID NO: 571717 - protein, 9 aa, Homo Sapiens
PLPELCYEA

SEQ ID NO: 571718 - protein, 9 aa, Homo Sapiens
PLRLSLPPR

SEQ ID NO: 571719 - protein, 9 aa, Homo Sapiens
TFVLVGSVI

SEQ ID NO: 571720 - protein, 9 aa, Homo Sapiens
HTLPEDNEE

SEQ ID NO: 571721 - protein, 9 aa, Homo Sapiens
VRFIDSKVI

SEQ ID NO: 571722 - protein, 9 aa, Homo Sapiens
PLKKTFDSG

SEQ ID NO: 571723 - protein, 9 aa, Homo Sapiens
VKPIIIGHH

SEQ ID NO: 571724 - protein, 9 aa, Homo Sapiens
PHTVEGQYY

SEQ ID NO: 571725 - protein, 9 aa, Homo Sapiens
EPLPELCYE

SEQ ID NO: 571726 - protein, 9 aa, Homo Sapiens
SLVTIPKML

SEQ ID NO: 571727 - protein, 9 aa, Homo Sapiens
FFSLVTIPK

SEQ ID NO: 571728 - protein, 9 aa, Homo Sapiens
DCEHGKDET

SEQ ID NO: 571729 - protein, 9 aa, Homo Sapiens
IGVEFGAQM

SEQ ID NO: 571730 - protein, 9 aa, Homo Sapiens
IDSKVIYTY

SEQ ID NO: 571731 - protein, 9 aa, Homo Sapiens
PGLQGVLGP

SEQ ID NO: 571732 - protein, 9 aa, Homo Sapiens
QVLAEEHTE

SEQ ID NO: 571733 - protein, 9 aa, Homo Sapiens
GHHAYGDQY

SEQ ID NO: 571734 - protein, 9 aa, Homo Sapiens
EAAVRSRKQ

SEQ ID NO: 571735 - protein, 9 aa, Homo Sapiens
KDETHCNKF

SEQ ID NO: 571736 - protein, 9 aa, Homo Sapiens
PVRSGLRRA

SEQ ID NO: 571737 - protein, 9 aa, Homo Sapiens
LGPPGAVGH

SEQ ID NO: 571738 - protein, 9 aa, Homo Sapiens
GQPGLQGVL

SEQ ID NO: 571739 - protein, 9 aa, Homo Sapiens
GVEFGAQMI

SEQ ID NO: 571740 - protein, 9 aa, Homo Sapiens
RKDMLVFLD

SEQ ID NO: 571741 - protein, 9 aa, Homo Sapiens
QMAGKDYPA

SEQ ID NO: 571742 - protein, 9 aa, Homo Sapiens
QQLGAGLKM

SEQ ID NO: 571743 - protein, 9 aa, Homo Sapiens
YMLHETAAP

SEQ ID NO: 571744 - protein, 9 aa, Homo Sapiens
QYYMLHETA

SEQ ID NO: 571745 - protein, 9 aa, Homo Sapiens
HETAAPSDI

SEQ ID NO: 571746 - protein, 9 aa, Homo Sapiens
LVGTIIGSG

SEQ ID NO: 571747 - protein, 9 aa, Homo Sapiens
GISILVGTI

SEQ ID NO: 571748 - protein, 9 aa, Homo Sapiens
DLMVIAQEQ

SEQ ID NO: 571749 - protein, 9 aa, Homo Sapiens
ISGISILVG

SEQ ID NO: 571750 - protein, 9 aa, Homo Sapiens
WVKPIIIGH

SEQ ID NO: 571751 - protein, 9 aa, Homo Sapiens
TNDLMVIAQ

SEQ ID NO: 571752 - protein, 9 aa, Homo Sapiens
QKEDPRTDV

SEQ ID NO: 571753 - protein, 9 aa, Homo Sapiens
LAQQKEDPR

SEQ ID NO: 571754 - protein, 9 aa, Homo Sapiens
TAAPSDIVG

SEQ ID NO: 571755 - protein, 9 aa, Homo Sapiens
KPIIIGHHA

SEQ ID NO: 571756 - protein, 9 aa, Homo Sapiens
AAPSDIVGA

SEQ ID NO: 571757 - protein, 9 aa, Homo Sapiens
HHAYGDQYR

SEQ ID NO: 571758 - protein, 9 aa, Homo Sapiens
ETAAPSDIV

SEQ ID NO: 571759 - protein, 9 aa, Homo Sapiens
QQKEDPRTD

SEQ ID NO: 571760 - protein, 9 aa, Homo Sapiens
NDLMVIAQE

SEQ ID NO: 571761 - protein, 9 aa, Homo Sapiens
ELAQQKEDP

SEQ ID NO: 571762 - protein, 9 aa, Homo Sapiens
LMVIAQEQK

SEQ ID NO: 571763 - protein, 9 aa, Homo Sapiens
NPGELAQQK

SEQ ID NO: 571764 - protein, 9 aa, Homo Sapiens
MLHETAAPS

SEQ ID NO: 571765 - protein, 9 aa, Homo Sapiens
QEQKAVFLV

SEQ ID NO: 571766 - protein, 9 aa, Homo Sapiens
IIIGHHAYG

SEQ ID NO: 571767 - protein, 9 aa, Homo Sapiens
LHETAAPSD

SEQ ID NO: 571768 - protein, 9 aa, Homo Sapiens
IAQEQKAVF

SEQ ID NO: 571769 - protein, 9 aa, Homo Sapiens
AQEQKAVFL

SEQ ID NO: 571770 - protein, 9 aa, Homo Sapiens
MNAFMICSK

SEQ ID NO: 571771 - protein, 9 aa, Homo Sapiens
KNPGELAQQ

SEQ ID NO: 571772 - protein, 9 aa, Homo Sapiens
PMNAFMICS

SEQ ID NO: 571773 - protein, 9 aa, Homo Sapiens
IIGHHAYGD

SEQ ID NO: 571774 - protein, 9 aa, Homo Sapiens
SGISILVGT

SEQ ID NO: 571775 - protein, 9 aa, Homo Sapiens
IGHHAYGDQ

SEQ ID NO: 571776 - protein, 9 aa, Homo Sapiens
CSKRHRALV

SEQ ID NO: 571777 - protein, 9 aa, Homo Sapiens
SILVGTIIG

SEQ ID NO: 571778 - protein, 9 aa, Homo Sapiens
AFMICSKRH

SEQ ID NO: 571779 - protein, 9 aa, Homo Sapiens
GELAQQKED

SEQ ID NO: 571780 - protein, 9 aa, Homo Sapiens
PIIIGHHAY

SEQ ID NO: 571781 - protein, 9 aa, Homo Sapiens
GLISGISIL

SEQ ID NO: 571782 - protein, 9 aa, Homo Sapiens
NAFMICSKR

SEQ ID NO: 571783 - protein, 9 aa, Homo Sapiens
ISILVGTII

SEQ ID NO: 571784 - protein, 9 aa, Homo Sapiens
MICSKRHRA

SEQ ID NO: 571785 - protein, 9 aa, Homo Sapiens
YYMLHETAA

SEQ ID NO: 571786 - protein, 9 aa, Homo Sapiens
VIAQEQKAV

SEQ ID NO: 571787 - protein, 9 aa, Homo Sapiens
ILVGTIIGS

SEQ ID NO: 571788 - protein, 9 aa, Homo Sapiens
GHHAYGDQY

SEQ ID NO: 571789 - protein, 9 aa, Homo Sapiens
FMICSKRHR

SEQ ID NO: 571790 - protein, 9 aa, Homo Sapiens
MVIAQEQKA

SEQ ID NO: 571791 - protein, 9 aa, Homo Sapiens
PGELAQQKE

SEQ ID NO: 571792 - protein, 9 aa, Homo Sapiens
LISGISILV

SEQ ID NO: 571793 - protein, 9 aa, Homo Sapiens
AQQKEDPRT

SEQ ID NO: 571794 - protein, 9 aa, Homo Sapiens
VKPIIIGHH

SEQ ID NO: 571795 - protein, 9 aa, Homo Sapiens
ICSKRHRAL

SEQ ID NO: 571796 - protein, 9 aa, Homo Sapiens
RPMNAFMIC

SEQ ID NO: 571797 - protein, 9 aa, Homo Sapiens
FLYLEEGTK

SEQ ID NO: 571798 - protein, 9 aa, Homo Sapiens
ASAEYIKMA

SEQ ID NO: 571799 - protein, 9 aa, Homo Sapiens
IGHHAYGDQ

SEQ ID NO: 571800 - protein, 9 aa, Homo Sapiens
LPFGGSVRT

SEQ ID NO: 571801 - protein, 9 aa, Homo Sapiens
WVKPIIIGH

SEQ ID NO: 571802 - protein, 9 aa, Homo Sapiens
EKYEQFLYL

SEQ ID NO: 571803 - protein, 9 aa, Homo Sapiens
YQGSYGVRL

SEQ ID NO: 571804 - protein, 9 aa, Homo Sapiens
YLEEGTKAH

SEQ ID NO: 571805 - protein, 9 aa, Homo Sapiens
GHHAYGDQY

SEQ ID NO: 571806 - protein, 9 aa, Homo Sapiens
YLPFGGSVR

SEQ ID NO: 571807 - protein, 9 aa, Homo Sapiens
FGGSVRTCL

SEQ ID NO: 571808 - protein, 9 aa, Homo Sapiens
PMTLLLLLL

SEQ ID NO: 571809 - protein, 9 aa, Homo Sapiens
LPMTLLLLL

SEQ ID NO: 571810 - protein, 9 aa, Homo Sapiens
RPTTEFTRR

SEQ ID NO: 571811 - protein, 9 aa, Homo Sapiens
VTPEDLKAS

SEQ ID NO: 571812 - protein, 9 aa, Homo Sapiens
ALVLSQLME

SEQ ID NO: 571813 - protein, 9 aa, Homo Sapiens
PFGGSVRTC

SEQ ID NO: 571814 - protein, 9 aa, Homo Sapiens
IIGHHAYGD

SEQ ID NO: 571815 - protein, 9 aa, Homo Sapiens
VEEQPIVEP

SEQ ID NO: 571816 - protein, 9 aa, Homo Sapiens
LFFGVFLPM

SEQ ID NO: 571817 - protein, 9 aa, Homo Sapiens
LDAMYYLHR

SEQ ID NO: 571818 - protein, 9 aa, Homo Sapiens
IVEPEETLE

SEQ ID NO: 571819 - protein, 9 aa, Homo Sapiens
MYYLHRMGI

SEQ ID NO: 571820 - protein, 9 aa, Homo Sapiens
TEFTRRPTT

SEQ ID NO: 571821 - protein, 9 aa, Homo Sapiens
MKEISVLPD

SEQ ID NO: 571822 - protein, 9 aa, Homo Sapiens
GAPVEEQPI

SEQ ID NO: 571823 - protein, 9 aa, Homo Sapiens
ESRVKLWCS

SEQ ID NO: 571824 - protein, 9 aa, Homo Sapiens
LIRQVLDAM

SEQ ID NO: 571825 - protein, 9 aa, Homo Sapiens
GGSVRTCLG

SEQ ID NO: 571826 - protein, 9 aa, Homo Sapiens
MEGFSMLEK

SEQ ID NO: 571827 - protein, 9 aa, Homo Sapiens
APVEEQPIV

SEQ ID NO: 571828 - protein, 9 aa, Homo Sapiens
PIVEPEETL

SEQ ID NO: 571829 - protein, 9 aa, Homo Sapiens
DLKASAEYI

SEQ ID NO: 571830 - protein, 9 aa, Homo Sapiens
ANIMKEISV

SEQ ID NO: 571831 - protein, 9 aa, Homo Sapiens
KPIIIGHHA

SEQ ID NO: 571832 - protein, 9 aa, Homo Sapiens
SRVKLWCST

SEQ ID NO: 571833 - protein, 9 aa, Homo Sapiens
HHAYGDQYR

SEQ ID NO: 571834 - protein, 9 aa, Homo Sapiens
NIMKEISVL

SEQ ID NO: 571835 - protein, 9 aa, Homo Sapiens
KSVFGEPPS

SEQ ID NO: 571836 - protein, 9 aa, Homo Sapiens
VRLGFLHSG

SEQ ID NO: 571837 - protein, 9 aa, Homo Sapiens
EECIIESRV

SEQ ID NO: 571838 - protein, 9 aa, Homo Sapiens
KTYQGSYGV

SEQ ID NO: 571839 - protein, 9 aa, Homo Sapiens
VLSQLMEGF

SEQ ID NO: 571840 - protein, 9 aa, Homo Sapiens
SVFGEPPSL

SEQ ID NO: 571841 - protein, 9 aa, Homo Sapiens
PEDLKASAE

SEQ ID NO: 571842 - protein, 9 aa, Homo Sapiens
LSQLMEGFS

SEQ ID NO: 571843 - protein, 9 aa, Homo Sapiens
KEANVKYPQ

SEQ ID NO: 571844 - protein, 9 aa, Homo Sapiens
LVLSQLMEG

SEQ ID NO: 571845 - protein, 9 aa, Homo Sapiens
PIIIGHHAY

SEQ ID NO: 571846 - protein, 9 aa, Homo Sapiens
SRRPTTEFT

SEQ ID NO: 571847 - protein, 9 aa, Homo Sapiens
FFGVFLPMT

SEQ ID NO: 571848 - protein, 9 aa, Homo Sapiens
GEPPSLLWM

SEQ ID NO: 571849 - protein, 9 aa, Homo Sapiens
GSVRTCLGK

SEQ ID NO: 571850 - protein, 9 aa, Homo Sapiens
EGMKSVFGE

SEQ ID NO: 571851 - protein, 9 aa, Homo Sapiens
NVKYPQIVI

SEQ ID NO: 571852 - protein, 9 aa, Homo Sapiens
IRQVLDAMY

SEQ ID NO: 571853 - protein, 9 aa, Homo Sapiens
SQLMEGFSM

SEQ ID NO: 571854 - protein, 9 aa, Homo Sapiens
EASRRPTTE

SEQ ID NO: 571855 - protein, 9 aa, Homo Sapiens
SVRTCLGKH

SEQ ID NO: 571856 - protein, 9 aa, Homo Sapiens
TYQGSYGVR

SEQ ID NO: 571857 - protein, 9 aa, Homo Sapiens
LKASAEYIK

SEQ ID NO: 571858 - protein, 9 aa, Homo Sapiens
KYPQIVIAF

SEQ ID NO: 571859 - protein, 9 aa, Homo Sapiens
TTEFTRRPT

SEQ ID NO: 571860 - protein, 9 aa, Homo Sapiens
QLMEGFSML

SEQ ID NO: 571861 - protein, 9 aa, Homo Sapiens
GVFLPMTLL

SEQ ID NO: 571862 - protein, 9 aa, Homo Sapiens
YGVRLGFLH

SEQ ID NO: 571863 - protein, 9 aa, Homo Sapiens
DAMYYLHRM

SEQ ID NO: 571864 - protein, 9 aa, Homo Sapiens
YPQIVIAFY

SEQ ID NO: 571865 - protein, 9 aa, Homo Sapiens
EPPSLLWMN

SEQ ID NO: 571866 - protein, 9 aa, Homo Sapiens
VLDAMYYLH

SEQ ID NO: 571867 - protein, 9 aa, Homo Sapiens
EEQPIVEPE

SEQ ID NO: 571868 - protein, 9 aa, Homo Sapiens
ANVKYPQIV

SEQ ID NO: 571869 - protein, 9 aa, Homo Sapiens
YEQFLYLEE

SEQ ID NO: 571870 - protein, 9 aa, Homo Sapiens
RRPTTEFTR

SEQ ID NO: 571871 - protein, 9 aa, Homo Sapiens
TPEDLKASA

SEQ ID NO: 571872 - protein, 9 aa, Homo Sapiens
VKYPQIVIA

SEQ ID NO: 571873 - protein, 9 aa, Homo Sapiens
GVRLGFLHS

SEQ ID NO: 571874 - protein, 9 aa, Homo Sapiens
GMKSVFGEP

SEQ ID NO: 571875 - protein, 9 aa, Homo Sapiens
GSYGVRLGF

SEQ ID NO: 571876 - protein, 9 aa, Homo Sapiens
QFLYLEEGT

SEQ ID NO: 571877 - protein, 9 aa, Homo Sapiens
RVKLWCSTT

SEQ ID NO: 571878 - protein, 9 aa, Homo Sapiens
LAKEANVKY

SEQ ID NO: 571879 - protein, 9 aa, Homo Sapiens
VFLPMTLLL

SEQ ID NO: 571880 - protein, 9 aa, Homo Sapiens
KASAEYIKM

SEQ ID NO: 571881 - protein, 9 aa, Homo Sapiens
AKEANVKYP

SEQ ID NO: 571882 - protein, 9 aa, Homo Sapiens
EQPIVEPEE

SEQ ID NO: 571883 - protein, 9 aa, Homo Sapiens
EISVLPDNL

SEQ ID NO: 571884 - protein, 9 aa, Homo Sapiens
SAEYIKMAD

SEQ ID NO: 571885 - protein, 9 aa, Homo Sapiens
VKLWCSTTA

SEQ ID NO: 571886 - protein, 9 aa, Homo Sapiens
IMKEISVLP

SEQ ID NO: 571887 - protein, 9 aa, Homo Sapiens
SYGVRLGFL

SEQ ID NO: 571888 - protein, 9 aa, Homo Sapiens
EQFLYLEEG

SEQ ID NO: 571889 - protein, 9 aa, Homo Sapiens
EGFSMLEKK

SEQ ID NO: 571890 - protein, 9 aa, Homo Sapiens
VLPDNLLRT

SEQ ID NO: 571891 - protein, 9 aa, Homo Sapiens
ASRRPTTEF

SEQ ID NO: 571892 - protein, 9 aa, Homo Sapiens
EANVKYPQI

SEQ ID NO: 571893 - protein, 9 aa, Homo Sapiens
FGEPPSLLW

SEQ ID NO: 571894 - protein, 9 aa, Homo Sapiens
LYLEEGTKA

SEQ ID NO: 571895 - protein, 9 aa, Homo Sapiens
ISVLPDNLL

SEQ ID NO: 571896 - protein, 9 aa, Homo Sapiens
EDLKASAEY

SEQ ID NO: 571897 - protein, 9 aa, Homo Sapiens
PTTEFTRRP

SEQ ID NO: 571898 - protein, 9 aa, Homo Sapiens
IIIGHHAYG

SEQ ID NO: 571899 - protein, 9 aa, Homo Sapiens
SVLPDNLLR

SEQ ID NO: 571900 - protein, 9 aa, Homo Sapiens
QVLDAMYYL

SEQ ID NO: 571901 - protein, 9 aa, Homo Sapiens
CIIESRVKL

SEQ ID NO: 571902 - protein, 9 aa, Homo Sapiens
KEKYEQFLY

SEQ ID NO: 571903 - protein, 9 aa, Homo Sapiens
QGSYGVRLG

SEQ ID NO: 571904 - protein, 9 aa, Homo Sapiens
LMEGFSMLE

SEQ ID NO: 571905 - protein, 9 aa, Homo Sapiens
PVEEQPIVE

SEQ ID NO: 571906 - protein, 9 aa, Homo Sapiens
IIESRVKLW

SEQ ID NO: 571907 - protein, 9 aa, Homo Sapiens
VFGEPPSLL

SEQ ID NO: 571908 - protein, 9 aa, Homo Sapiens
KYEQFLYLE

SEQ ID NO: 571909 - protein, 9 aa, Homo Sapiens
FGVFLPMTL

SEQ ID NO: 571910 - protein, 9 aa, Homo Sapiens
MTLLLLLLI

SEQ ID NO: 571911 - protein, 9 aa, Homo Sapiens
AMYYLHRMG

SEQ ID NO: 571912 - protein, 9 aa, Homo Sapiens
FLPMTLLLL

SEQ ID NO: 571913 - protein, 9 aa, Homo Sapiens
IESRVKLWC

SEQ ID NO: 571914 - protein, 9 aa, Homo Sapiens
ECIIESRVK

SEQ ID NO: 571915 - protein, 9 aa, Homo Sapiens
FHYLPFGGS

SEQ ID NO: 571916 - protein, 9 aa, Homo Sapiens
RQVLDAMYY

SEQ ID NO: 571917 - protein, 9 aa, Homo Sapiens
QPIVEPEET

SEQ ID NO: 571918 - protein, 9 aa, Homo Sapiens
KEISVLPDN

SEQ ID NO: 571919 - protein, 9 aa, Homo Sapiens
TEASRRPTT

SEQ ID NO: 571920 - protein, 9 aa, Homo Sapiens
VKPIIIGHH

SEQ ID NO: 571921 - protein, 9 aa, Homo Sapiens
HYLPFGGSV

SEQ ID NO: 571922 - protein, 9 aa, Homo Sapiens
MKSVFGEPP

SEQ ID NO: 571923 - protein, 9 aa, Homo Sapiens
EYKCRYPPG

SEQ ID NO: 571924 - protein, 9 aa, Homo Sapiens
CCQPTRYTD

SEQ ID NO: 571925 - protein, 9 aa, Homo Sapiens
LANSRMPTV

SEQ ID NO: 571926 - protein, 9 aa, Homo Sapiens
TGEEPTPGL

SEQ ID NO: 571927 - protein, 9 aa, Homo Sapiens
FRHAFRRIL

SEQ ID NO: 571928 - protein, 9 aa, Homo Sapiens
RKIQSWKLE

SEQ ID NO: 571929 - protein, 9 aa, Homo Sapiens
QLITYDEEG

SEQ ID NO: 571930 - protein, 9 aa, Homo Sapiens
IAAAFTGPV

SEQ ID NO: 571931 - protein, 9 aa, Homo Sapiens
RDFTPAELW

SEQ ID NO: 571932 - protein, 9 aa, Homo Sapiens
TEEEIWVFL

SEQ ID NO: 571933 - protein, 9 aa, Homo Sapiens
NLDIAAAFT

SEQ ID NO: 571934 - protein, 9 aa, Homo Sapiens
TVLTREDRL

SEQ ID NO: 571935 - protein, 9 aa, Homo Sapiens
DIAAAFTGP

SEQ ID NO: 571936 - protein, 9 aa, Homo Sapiens
TGPVDLCTY

SEQ ID NO: 571937 - protein, 9 aa, Homo Sapiens
YWMSQMCTV

SEQ ID NO: 571938 - protein, 9 aa, Homo Sapiens
HYLQTERLS

SEQ ID NO: 571939 - protein, 9 aa, Homo Sapiens
LTEYKCRYP

SEQ ID NO: 571940 - protein, 9 aa, Homo Sapiens
TPAELWRFD

SEQ ID NO: 571941 - protein, 9 aa, Homo Sapiens
GPSILSSDL

SEQ ID NO: 571942 - protein, 9 aa, Homo Sapiens
QDFRHAFRR

SEQ ID NO: 571943 - protein, 9 aa, Homo Sapiens
LITYDEEGG

SEQ ID NO: 571944 - protein, 9 aa, Homo Sapiens
RSLASMDAP

SEQ ID NO: 571945 - protein, 9 aa, Homo Sapiens
TKPITIGMH

SEQ ID NO: 571946 - protein, 9 aa, Homo Sapiens
AAAFTGPVD

SEQ ID NO: 571947 - protein, 9 aa, Homo Sapiens
YPPGWSGKS

SEQ ID NO: 571948 - protein, 9 aa, Homo Sapiens
IGPSILSSD

SEQ ID NO: 571949 - protein, 9 aa, Homo Sapiens
VLTREDRLK

SEQ ID NO: 571950 - protein, 9 aa, Homo Sapiens
MLLNIIFPM

SEQ ID NO: 571951 - protein, 9 aa, Homo Sapiens
TERLSQDPE

SEQ ID NO: 571952 - protein, 9 aa, Homo Sapiens
KPMCKAVTC

SEQ ID NO: 571953 - protein, 9 aa, Homo Sapiens
ALEEEETGE

SEQ ID NO: 571954 - protein, 9 aa, Homo Sapiens
NMEVDAAPA

SEQ ID NO: 571955 - protein, 9 aa, Homo Sapiens
DHKKFHPDC

SEQ ID NO: 571956 - protein, 9 aa, Homo Sapiens
KLKFTYALD

SEQ ID NO: 571957 - protein, 9 aa, Homo Sapiens
GLLANSRMP

SEQ ID NO: 571958 - protein, 9 aa, Homo Sapiens
WIVCMLLNI

SEQ ID NO: 571959 - protein, 9 aa, Homo Sapiens
DFRHAFRRI

SEQ ID NO: 571960 - protein, 9 aa, Homo Sapiens
ASMDAPRYQ

SEQ ID NO: 571961 - protein, 9 aa, Homo Sapiens
AELWRFDGV

SEQ ID NO: 571962 - protein, 9 aa, Homo Sapiens
ITYDEEGGG

SEQ ID NO: 571963 - protein, 9 aa, Homo Sapiens
VFLNMLGVY

SEQ ID NO: 571964 - protein, 9 aa, Homo Sapiens
EDHKKFHPD

SEQ ID NO: 571965 - protein, 9 aa, Homo Sapiens
AFTGPVDLC

SEQ ID NO: 571966 - protein, 9 aa, Homo Sapiens
EEEIWVFLN

SEQ ID NO: 571967 - protein, 9 aa, Homo Sapiens
VCMLLNIIF

SEQ ID NO: 571968 - protein, 9 aa, Homo Sapiens
PAELWRFDG

SEQ ID NO: 571969 - protein, 9 aa, Homo Sapiens
GNLHYLQTE

SEQ ID NO: 571970 - protein, 9 aa, Homo Sapiens
RLKYYRMMQ

SEQ ID NO: 571971 - protein, 9 aa, Homo Sapiens
HGGPCCQPT

SEQ ID NO: 571972 - protein, 9 aa, Homo Sapiens
QSWKLETTV

SEQ ID NO: 571973 - protein, 9 aa, Homo Sapiens
FTPAELWRF

SEQ ID NO: 571974 - protein, 9 aa, Homo Sapiens
KIQSWKLET

SEQ ID NO: 571975 - protein, 9 aa, Homo Sapiens
VSQVHVFQE

SEQ ID NO: 571976 - protein, 9 aa, Homo Sapiens
CKIGPSILS

SEQ ID NO: 571977 - protein, 9 aa, Homo Sapiens
SLASMDAPR

SEQ ID NO: 571978 - protein, 9 aa, Homo Sapiens
SILSSDLAN

SEQ ID NO: 571979 - protein, 9 aa, Homo Sapiens
KFHPDCGFL

SEQ ID NO: 571980 - protein, 9 aa, Homo Sapiens
LKFTYALDT

SEQ ID NO: 571981 - protein, 9 aa, Homo Sapiens
VVSQVHVFQ

SEQ ID NO: 571982 - protein, 9 aa, Homo Sapiens
NWDNEKPMC

SEQ ID NO: 571983 - protein, 9 aa, Homo Sapiens
SSDLANLGA

SEQ ID NO: 571984 - protein, 9 aa, Homo Sapiens
WKLETTVPP

SEQ ID NO: 571985 - protein, 9 aa, Homo Sapiens
FTGPVDLCT

SEQ ID NO: 571986 - protein, 9 aa, Homo Sapiens
REDRLKYYR

SEQ ID NO: 571987 - protein, 9 aa, Homo Sapiens
LDIAAAFTG

SEQ ID NO: 571988 - protein, 9 aa, Homo Sapiens
EQLITYDEE

SEQ ID NO: 571989 - protein, 9 aa, Homo Sapiens
LLANSRMPT

SEQ ID NO: 571990 - protein, 9 aa, Homo Sapiens
IWVFLNMLG

SEQ ID NO: 571991 - protein, 9 aa, Homo Sapiens
KPITIGMHA

SEQ ID NO: 571992 - protein, 9 aa, Homo Sapiens
LTREDRLKY

SEQ ID NO: 571993 - protein, 9 aa, Homo Sapiens
EKPMCKAVT

SEQ ID NO: 571994 - protein, 9 aa, Homo Sapiens
WVFLNMLGV

SEQ ID NO: 571995 - protein, 9 aa, Homo Sapiens
NLHYLQTER

SEQ ID NO: 571996 - protein, 9 aa, Homo Sapiens
QVHVFQENP

SEQ ID NO: 571997 - protein, 9 aa, Homo Sapiens
LSSDLANLG

SEQ ID NO: 571998 - protein, 9 aa, Homo Sapiens
YFESICLVM

SEQ ID NO: 571999 - protein, 9 aa, Homo Sapiens
SLAARMEKC

SEQ ID NO: 572000 - protein, 9 aa, Homo Sapiens
IQSWKLETT

SEQ ID NO: 572001 - protein, 9 aa, Homo Sapiens
IHEQLITYD

SEQ ID NO: 572002 - protein, 9 aa, Homo Sapiens
DNEKPMCKA

SEQ ID NO: 572003 - protein, 9 aa, Homo Sapiens
AHGGPCCQP

SEQ ID NO: 572004 - protein, 9 aa, Homo Sapiens
DRLNMEVDA

SEQ ID NO: 572005 - protein, 9 aa, Homo Sapiens
IVCMLLNII

SEQ ID NO: 572006 - protein, 9 aa, Homo Sapiens
NEKPMCKAV

SEQ ID NO: 572007 - protein, 9 aa, Homo Sapiens
WRFDGVQDP

SEQ ID NO: 572008 - protein, 9 aa, Homo Sapiens
WDNEKPMCK

SEQ ID NO: 572009 - protein, 9 aa, Homo Sapiens
GWGLLANSR

SEQ ID NO: 572010 - protein, 9 aa, Homo Sapiens
ELWRFDGVQ

SEQ ID NO: 572011 - protein, 9 aa, Homo Sapiens
LPIEDHKKF

SEQ ID NO: 572012 - protein, 9 aa, Homo Sapiens
CLVMATTST

SEQ ID NO: 572013 - protein, 9 aa, Homo Sapiens
YLQTERLSQ

SEQ ID NO: 572014 - protein, 9 aa, Homo Sapiens
VPEIHEQLI

SEQ ID NO: 572015 - protein, 9 aa, Homo Sapiens
ETTVPPISF

SEQ ID NO: 572016 - protein, 9 aa, Homo Sapiens
LLNIIFPMY

SEQ ID NO: 572017 - protein, 9 aa, Homo Sapiens
RLPIEDHKK

SEQ ID NO: 572018 - protein, 9 aa, Homo Sapiens
RAHGGPCCQ

SEQ ID NO: 572019 - protein, 9 aa, Homo Sapiens
SMDAPRYQH

SEQ ID NO: 572020 - protein, 9 aa, Homo Sapiens
EDRLKYYRM

SEQ ID NO: 572021 - protein, 9 aa, Homo Sapiens
AQEWRSLAS

SEQ ID NO: 572022 - protein, 9 aa, Homo Sapiens
CMLLNIIFP

SEQ ID NO: 572023 - protein, 9 aa, Homo Sapiens
LWRFDGVQD

SEQ ID NO: 572024 - protein, 9 aa, Homo Sapiens
QTERLSQDP

SEQ ID NO: 572025 - protein, 9 aa, Homo Sapiens
HVFQENPYT

SEQ ID NO: 572026 - protein, 9 aa, Homo Sapiens
KFTYALDTM

SEQ ID NO: 572027 - protein, 9 aa, Homo Sapiens
EKLKFTYAL

SEQ ID NO: 572028 - protein, 9 aa, Homo Sapiens
WRSLASMDA

SEQ ID NO: 572029 - protein, 9 aa, Homo Sapiens
EETGEEPTP

SEQ ID NO: 572030 - protein, 9 aa, Homo Sapiens
IEDHKKFHP

SEQ ID NO: 572031 - protein, 9 aa, Homo Sapiens
ALDTMEQAL

SEQ ID NO: 572032 - protein, 9 aa, Homo Sapiens
EEIWVFLNM

SEQ ID NO: 572033 - protein, 9 aa, Homo Sapiens
VFQENPYTF

SEQ ID NO: 572034 - protein, 9 aa, Homo Sapiens
ATEEEIWVF

SEQ ID NO: 572035 - protein, 9 aa, Homo Sapiens
AARMEKCLY

SEQ ID NO: 572036 - protein, 9 aa, Homo Sapiens
ISYFESICL

SEQ ID NO: 572037 - protein, 9 aa, Homo Sapiens
FTYALDTME

SEQ ID NO: 572038 - protein, 9 aa, Homo Sapiens
KLETTVPPI

SEQ ID NO: 572039 - protein, 9 aa, Homo Sapiens
EHRSLAARM

SEQ ID NO: 572040 - protein, 9 aa, Homo Sapiens
SRMPTVLQC

SEQ ID NO: 572041 - protein, 9 aa, Homo Sapiens
DRLKYYRMM

SEQ ID NO: 572042 - protein, 9 aa, Homo Sapiens
WGLLANSRM

SEQ ID NO: 572043 - protein, 9 aa, Homo Sapiens
ERLSQDPEP

SEQ ID NO: 572044 - protein, 9 aa, Homo Sapiens
NISYFESIC

SEQ ID NO: 572045 - protein, 9 aa, Homo Sapiens
EEETGEEPT

SEQ ID NO: 572046 - protein, 9 aa, Homo Sapiens
LEEEETGEE

SEQ ID NO: 572047 - protein, 9 aa, Homo Sapiens
LAARMEKCL

SEQ ID NO: 572048 - protein, 9 aa, Homo Sapiens
MSQMCTVCG

SEQ ID NO: 572049 - protein, 9 aa, Homo Sapiens
TTVLTREDR

SEQ ID NO: 572050 - protein, 9 aa, Homo Sapiens
GGPCCQPTR

SEQ ID NO: 572051 - protein, 9 aa, Homo Sapiens
MCKAVTCRA

SEQ ID NO: 572052 - protein, 9 aa, Homo Sapiens
YALDTMEQA

SEQ ID NO: 572053 - protein, 9 aa, Homo Sapiens
NQDFRHAFR

SEQ ID NO: 572054 - protein, 9 aa, Homo Sapiens
LNIIFPMYV

SEQ ID NO: 572055 - protein, 9 aa, Homo Sapiens
QEWRSLASM

SEQ ID NO: 572056 - protein, 9 aa, Homo Sapiens
AEHRSLAAR

SEQ ID NO: 572057 - protein, 9 aa, Homo Sapiens
EWRSLASMD

SEQ ID NO: 572058 - protein, 9 aa, Homo Sapiens
ICLVMATTS

SEQ ID NO: 572059 - protein, 9 aa, Homo Sapiens
LQTERLSQD

SEQ ID NO: 572060 - protein, 9 aa, Homo Sapiens
CQPTRYTDV

SEQ ID NO: 572061 - protein, 9 aa, Homo Sapiens
LETTVPPIS

SEQ ID NO: 572062 - protein, 9 aa, Homo Sapiens
TKYWMSQMC

SEQ ID NO: 572063 - protein, 9 aa, Homo Sapiens
RHAFRRILC

SEQ ID NO: 572064 - protein, 9 aa, Homo Sapiens
HKKFHPDCG

SEQ ID NO: 572065 - protein, 9 aa, Homo Sapiens
MCTVCGKGM

SEQ ID NO: 572066 - protein, 9 aa, Homo Sapiens
EEEETGEEP

SEQ ID NO: 572067 - protein, 9 aa, Homo Sapiens
RLNMEVDAA

SEQ ID NO: 572068 - protein, 9 aa, Homo Sapiens
QPTRYTDVA

SEQ ID NO: 572069 - protein, 9 aa, Homo Sapiens
LNMEVDAAP

SEQ ID NO: 572070 - protein, 9 aa, Homo Sapiens
RMEKCLYCF

SEQ ID NO: 572071 - protein, 9 aa, Homo Sapiens
CRYPPGWSG

SEQ ID NO: 572072 - protein, 9 aa, Homo Sapiens
ETGEEPTPG

SEQ ID NO: 572073 - protein, 9 aa, Homo Sapiens
HAFRRILCR

SEQ ID NO: 572074 - protein, 9 aa, Homo Sapiens
PITIGMHAH

SEQ ID NO: 572075 - protein, 9 aa, Homo Sapiens
ARMEKCLYC

SEQ ID NO: 572076 - protein, 9 aa, Homo Sapiens
CQLGDRLNM

SEQ ID NO: 572077 - protein, 9 aa, Homo Sapiens
LASMDAPRY

SEQ ID NO: 572078 - protein, 9 aa, Homo Sapiens
IGMHAHGDQ

SEQ ID NO: 572079 - protein, 9 aa, Homo Sapiens
PMCKAVTCR

SEQ ID NO: 572080 - protein, 9 aa, Homo Sapiens
GQALEEEET

SEQ ID NO: 572081 - protein, 9 aa, Homo Sapiens
SYFESICLV

SEQ ID NO: 572082 - protein, 9 aa, Homo Sapiens
YKCRYPPGW

SEQ ID NO: 572083 - protein, 9 aa, Homo Sapiens
HEQLITYDE

SEQ ID NO: 572084 - protein, 9 aa, Homo Sapiens
LGDRLNMEV

SEQ ID NO: 572085 - protein, 9 aa, Homo Sapiens
ESICLVMAT

SEQ ID NO: 572086 - protein, 9 aa, Homo Sapiens
WTKPITIGM

SEQ ID NO: 572087 - protein, 9 aa, Homo Sapiens
FNQDFRHAF

SEQ ID NO: 572088 - protein, 9 aa, Homo Sapiens
PSILSSDLA

SEQ ID NO: 572089 - protein, 9 aa, Homo Sapiens
TIFNQDFRH

SEQ ID NO: 572090 - protein, 9 aa, Homo Sapiens
AAFTGPVDL

SEQ ID NO: 572091 - protein, 9 aa, Homo Sapiens
QMCTVCGKG

SEQ ID NO: 572092 - protein, 9 aa, Homo Sapiens
EIHEQLITY

SEQ ID NO: 572093 - protein, 9 aa, Homo Sapiens
MEVDAAPAV

SEQ ID NO: 572094 - protein, 9 aa, Homo Sapiens
DFTPAELWR

SEQ ID NO: 572095 - protein, 9 aa, Homo Sapiens
QLGDRLNME

SEQ ID NO: 572096 - protein, 9 aa, Homo Sapiens
KIGPSILSS

SEQ ID NO: 572097 - protein, 9 aa, Homo Sapiens
TREDRLKYY

SEQ ID NO: 572098 - protein, 9 aa, Homo Sapiens
TLTEYKCRY

SEQ ID NO: 572099 - protein, 9 aa, Homo Sapiens
SWKLETTVP

SEQ ID NO: 572100 - protein, 9 aa, Homo Sapiens
AKVVSQVHV

SEQ ID NO: 572101 - protein, 9 aa, Homo Sapiens
ANSRMPTVL

SEQ ID NO: 572102 - protein, 9 aa, Homo Sapiens
VHVFQENPY

SEQ ID NO: 572103 - protein, 9 aa, Homo Sapiens
MHAHGDQYK

SEQ ID NO: 572104 - protein, 9 aa, Homo Sapiens
PCCQPTRYT

SEQ ID NO: 572105 - protein, 9 aa, Homo Sapiens
PEIHEQLIT

SEQ ID NO: 572106 - protein, 9 aa, Homo Sapiens
KVVSQVHVF

SEQ ID NO: 572107 - protein, 9 aa, Homo Sapiens
KYWMSQMCT

SEQ ID NO: 572108 - protein, 9 aa, Homo Sapiens
WMSQMCTVC

SEQ ID NO: 572109 - protein, 9 aa, Homo Sapiens
GPCCQPTRY

SEQ ID NO: 572110 - protein, 9 aa, Homo Sapiens
RYPPGWSGK

SEQ ID NO: 572111 - protein, 9 aa, Homo Sapiens
GMHAHGDQY

SEQ ID NO: 572112 - protein, 9 aa, Homo Sapiens
SICLVMATT

SEQ ID NO: 572113 - protein, 9 aa, Homo Sapiens
LDTMEQALN

SEQ ID NO: 572114 - protein, 9 aa, Homo Sapiens
SQMCTVCGK

SEQ ID NO: 572115 - protein, 9 aa, Homo Sapiens
SQVHVFQEN

SEQ ID NO: 572116 - protein, 9 aa, Homo Sapiens
SATEEEIWV

SEQ ID NO: 572117 - protein, 9 aa, Homo Sapiens
FESICLVMA

SEQ ID NO: 572118 - protein, 9 aa, Homo Sapiens
IFNQDFRHA

SEQ ID NO: 572119 - protein, 9 aa, Homo Sapiens
ITIGMHAHG

SEQ ID NO: 572120 - protein, 9 aa, Homo Sapiens
TIGMHAHGD

SEQ ID NO: 572121 - protein, 9 aa, Homo Sapiens
ILSSDLANL

SEQ ID NO: 572122 - protein, 9 aa, Homo Sapiens
TYALDTMEQ

SEQ ID NO: 572123 - protein, 9 aa, Homo Sapiens
KKFHPDCGF

SEQ ID NO: 572124 - protein, 9 aa, Homo Sapiens
TEYKCRYPP

SEQ ID NO: 572125 - protein, 9 aa, Homo Sapiens
EIWVFLNML

SEQ ID NO: 572126 - protein, 9 aa, Homo Sapiens
STKYWMSQM

SEQ ID NO: 572127 - protein, 9 aa, Homo Sapiens
PIEDHKKFH

SEQ ID NO: 572128 - protein, 9 aa, Homo Sapiens
QALEEEETG

SEQ ID NO: 572129 - protein, 9 aa, Homo Sapiens
NSRMPTVLQ

SEQ ID NO: 572130 - protein, 9 aa, Homo Sapiens
GDRLNMEVD

SEQ ID NO: 572131 - protein, 9 aa, Homo Sapiens
RSLAARMEK

SEQ ID NO: 572132 - protein, 9 aa, Homo Sapiens
LHYLQTERL

SEQ ID NO: 572133 - protein, 9 aa, Homo Sapiens
LCWIVCMLL

SEQ ID NO: 572134 - protein, 9 aa, Homo Sapiens
CWIVCMLLN

SEQ ID NO: 572135 - protein, 9 aa, Homo Sapiens
SGWGLLANS

SEQ ID NO: 572136 - protein, 9 aa, Homo Sapiens
HRSLAARME

SEQ ID NO: 572137 - protein, 9 aa, Homo Sapiens
GNWDNEKPM

SEQ ID NO: 572138 - protein, 9 aa, Homo Sapiens
KCRYPPGWS

SEQ ID NO: 572139 - protein, 9 aa, Homo Sapiens
QYELEGYNA

SEQ ID NO: 572140 - protein, 9 aa, Homo Sapiens
RVSFRPHIT

SEQ ID NO: 572141 - protein, 9 aa, Homo Sapiens
SAATNNNIC

SEQ ID NO: 572142 - protein, 9 aa, Homo Sapiens
SINGFSIHS

SEQ ID NO: 572143 - protein, 9 aa, Homo Sapiens
RLNIPFPYN

SEQ ID NO: 572144 - protein, 9 aa, Homo Sapiens
VGTEPSDAI

SEQ ID NO: 572145 - protein, 9 aa, Homo Sapiens
CTFAMAFII

SEQ ID NO: 572146 - protein, 9 aa, Homo Sapiens
PYTCSKCGK

SEQ ID NO: 572147 - protein, 9 aa, Homo Sapiens
ELEGYNAWR

SEQ ID NO: 572148 - protein, 9 aa, Homo Sapiens
HEVPLWVFG

SEQ ID NO: 572149 - protein, 9 aa, Homo Sapiens
TFAMAFIIS

SEQ ID NO: 572150 - protein, 9 aa, Homo Sapiens
NVLPLSRPS

SEQ ID NO: 572151 - protein, 9 aa, Homo Sapiens
MTLGLQRAR

SEQ ID NO: 572152 - protein, 9 aa, Homo Sapiens
VVKPVQSSG

SEQ ID NO: 572153 - protein, 9 aa, Homo Sapiens
GCLLEPTRS

SEQ ID NO: 572154 - protein, 9 aa, Homo Sapiens
SVALCQSGG

SEQ ID NO: 572155 - protein, 9 aa, Homo Sapiens
PNFRPGPRW

SEQ ID NO: 572156 - protein, 9 aa, Homo Sapiens
MATRTHQEY

SEQ ID NO: 572157 - protein, 9 aa, Homo Sapiens
LCQSGGYVA

SEQ ID NO: 572158 - protein, 9 aa, Homo Sapiens
PYLGPRTPD

SEQ ID NO: 572159 - protein, 9 aa, Homo Sapiens
GVVKPVQSS

SEQ ID NO: 572160 - protein, 9 aa, Homo Sapiens
QETLWELER

SEQ ID NO: 572161 - protein, 9 aa, Homo Sapiens
PSFRDRRVA

SEQ ID NO: 572162 - protein, 9 aa, Homo Sapiens
LICTFAMAF

SEQ ID NO: 572163 - protein, 9 aa, Homo Sapiens
SQYELEGYN

SEQ ID NO: 572164 - protein, 9 aa, Homo Sapiens
PTRSVSFLK

SEQ ID NO: 572165 - protein, 9 aa, Homo Sapiens
YENLSGLHQ

SEQ ID NO: 572166 - protein, 9 aa, Homo Sapiens
WWSHTQGEM

SEQ ID NO: 572167 - protein, 9 aa, Homo Sapiens
KCGKGFCAK

SEQ ID NO: 572168 - protein, 9 aa, Homo Sapiens
PTAINLVYT

SEQ ID NO: 572169 - protein, 9 aa, Homo Sapiens
LLDTADLLQ

SEQ ID NO: 572170 - protein, 9 aa, Homo Sapiens
SFRPHITEP

SEQ ID NO: 572171 - protein, 9 aa, Homo Sapiens
VSAATNNNI

SEQ ID NO: 572172 - protein, 9 aa, Homo Sapiens
CVRKSLICT

SEQ ID NO: 572173 - protein, 9 aa, Homo Sapiens
TADLLQLES

SEQ ID NO: 572174 - protein, 9 aa, Homo Sapiens
INGFSIHSQ

SEQ ID NO: 572175 - protein, 9 aa, Homo Sapiens
ALPELYKSV

SEQ ID NO: 572176 - protein, 9 aa, Homo Sapiens
EKPYTCSKC

SEQ ID NO: 572177 - protein, 9 aa, Homo Sapiens
TFKLPLMPV

SEQ ID NO: 572178 - protein, 9 aa, Homo Sapiens
ESSPDKWLT

SEQ ID NO: 572179 - protein, 9 aa, Homo Sapiens
DKWLTLSQI

SEQ ID NO: 572180 - protein, 9 aa, Homo Sapiens
VRKSLICTF

SEQ ID NO: 572181 - protein, 9 aa, Homo Sapiens
LEGYNAWRD

SEQ ID NO: 572182 - protein, 9 aa, Homo Sapiens
NSSKQYLRQ

SEQ ID NO: 572183 - protein, 9 aa, Homo Sapiens
TNNNICGVG

SEQ ID NO: 572184 - protein, 9 aa, Homo Sapiens
RPHITEPKM

SEQ ID NO: 572185 - protein, 9 aa, Homo Sapiens
SSPSKSPPM

SEQ ID NO: 572186 - protein, 9 aa, Homo Sapiens
TRTHQEYLK

SEQ ID NO: 572187 - protein, 9 aa, Homo Sapiens
HEAFLREAF

SEQ ID NO: 572188 - protein, 9 aa, Homo Sapiens
RDRRVAGSD

SEQ ID NO: 572189 - protein, 9 aa, Homo Sapiens
DRRVAGSDV

SEQ ID NO: 572190 - protein, 9 aa, Homo Sapiens
RLTQKWFPT

SEQ ID NO: 572191 - protein, 9 aa, Homo Sapiens
PMLGPQQAL

SEQ ID NO: 572192 - protein, 9 aa, Homo Sapiens
WQQETLWEL

SEQ ID NO: 572193 - protein, 9 aa, Homo Sapiens
VPFSAENVL

SEQ ID NO: 572194 - protein, 9 aa, Homo Sapiens
KWFPTAINL

SEQ ID NO: 572195 - protein, 9 aa, Homo Sapiens
LQLESSLQP

SEQ ID NO: 572196 - protein, 9 aa, Homo Sapiens
WLTLSQIYE

SEQ ID NO: 572197 - protein, 9 aa, Homo Sapiens
SPPMLGPQQ

SEQ ID NO: 572198 - protein, 9 aa, Homo Sapiens
RVKCEELHE

SEQ ID NO: 572199 - protein, 9 aa, Homo Sapiens
KWLTLSQIY

SEQ ID NO: 572200 - protein, 9 aa, Homo Sapiens
LHDWSVEHE

SEQ ID NO: 572201 - protein, 9 aa, Homo Sapiens
IWNGKQCIC

SEQ ID NO: 572202 - protein, 9 aa, Homo Sapiens
GEKFDTLAE

SEQ ID NO: 572203 - protein, 9 aa, Homo Sapiens
LWQQETLWE

SEQ ID NO: 572204 - protein, 9 aa, Homo Sapiens
ESLDSEEES

SEQ ID NO: 572205 - protein, 9 aa, Homo Sapiens
GNSGDWDSS

SEQ ID NO: 572206 - protein, 9 aa, Homo Sapiens
LMPVFEGLA

SEQ ID NO: 572207 - protein, 9 aa, Homo Sapiens
GGTAGGRAG

SEQ ID NO: 572208 - protein, 9 aa, Homo Sapiens
LPELYKSVQ

SEQ ID NO: 572209 - protein, 9 aa, Homo Sapiens
CQSGGYVAT

SEQ ID NO: 572210 - protein, 9 aa, Homo Sapiens
MLGPQQALS

SEQ ID NO: 572211 - protein, 9 aa, Homo Sapiens
KPTCRLNIP

SEQ ID NO: 572212 - protein, 9 aa, Homo Sapiens
FSIHSQGVD

SEQ ID NO: 572213 - protein, 9 aa, Homo Sapiens
LYKSVQNSE

SEQ ID NO: 572214 - protein, 9 aa, Homo Sapiens
CAGEVSAAT

SEQ ID NO: 572215 - protein, 9 aa, Homo Sapiens
RRVAGSDVD

SEQ ID NO: 572216 - protein, 9 aa, Homo Sapiens
NSGDWDSSS

SEQ ID NO: 572217 - protein, 9 aa, Homo Sapiens
LDSEEESGK

SEQ ID NO: 572218 - protein, 9 aa, Homo Sapiens
RLWQQETLW

SEQ ID NO: 572219 - protein, 9 aa, Homo Sapiens
SLICTFAMA

SEQ ID NO: 572220 - protein, 9 aa, Homo Sapiens
SFRDRRVAG

SEQ ID NO: 572221 - protein, 9 aa, Homo Sapiens
QRCYVYYYS

SEQ ID NO: 572222 - protein, 9 aa, Homo Sapiens
SPDKWLTLS

SEQ ID NO: 572223 - protein, 9 aa, Homo Sapiens
YKSVQNSEC

SEQ ID NO: 572224 - protein, 9 aa, Homo Sapiens
LTQKWFPTA

SEQ ID NO: 572225 - protein, 9 aa, Homo Sapiens
CICPQGYVG

SEQ ID NO: 572226 - protein, 9 aa, Homo Sapiens
TCRLNIPFP

SEQ ID NO: 572227 - protein, 9 aa, Homo Sapiens
ELHEVPLWV

SEQ ID NO: 572228 - protein, 9 aa, Homo Sapiens
QRVSFRPHI

SEQ ID NO: 572229 - protein, 9 aa, Homo Sapiens
TQKWFPTAI

SEQ ID NO: 572230 - protein, 9 aa, Homo Sapiens
LMGESQPYL

SEQ ID NO: 572231 - protein, 9 aa, Homo Sapiens
NFRPGPRWC

SEQ ID NO: 572232 - protein, 9 aa, Homo Sapiens
GRPINSSKQ

SEQ ID NO: 572233 - protein, 9 aa, Homo Sapiens
QTFKLPLMP

SEQ ID NO: 572234 - protein, 9 aa, Homo Sapiens
QSSGPEGVP

SEQ ID NO: 572235 - protein, 9 aa, Homo Sapiens
ARSLGRPIN

SEQ ID NO: 572236 - protein, 9 aa, Homo Sapiens
DITVIPNFR

SEQ ID NO: 572237 - protein, 9 aa, Homo Sapiens
PINSSKQYL

SEQ ID NO: 572238 - protein, 9 aa, Homo Sapiens
CEELHEVPL

SEQ ID NO: 572239 - protein, 9 aa, Homo Sapiens
THQEYLKDL

SEQ ID NO: 572240 - protein, 9 aa, Homo Sapiens
EHEAFLREA

SEQ ID NO: 572241 - protein, 9 aa, Homo Sapiens
CLLEPTRSV

SEQ ID NO: 572242 - protein, 9 aa, Homo Sapiens
SAENVLPLS

SEQ ID NO: 572243 - protein, 9 aa, Homo Sapiens
PSKSPPMLG

SEQ ID NO: 572244 - protein, 9 aa, Homo Sapiens
SSSFLSAHK

SEQ ID NO: 572245 - protein, 9 aa, Homo Sapiens
RGQRVSFRP

SEQ ID NO: 572246 - protein, 9 aa, Homo Sapiens
PDKWLTLSQ

SEQ ID NO: 572247 - protein, 9 aa, Homo Sapiens
EVSAATNNN

SEQ ID NO: 572248 - protein, 9 aa, Homo Sapiens
APVSSVALC

SEQ ID NO: 572249 - protein, 9 aa, Homo Sapiens
RKGCLLEPT

SEQ ID NO: 572250 - protein, 9 aa, Homo Sapiens
TAARNACRV

SEQ ID NO: 572251 - protein, 9 aa, Homo Sapiens
ATNNNICGV

SEQ ID NO: 572252 - protein, 9 aa, Homo Sapiens
YTGLKCERD

SEQ ID NO: 572253 - protein, 9 aa, Homo Sapiens
DLLQLESSL

SEQ ID NO: 572254 - protein, 9 aa, Homo Sapiens
SLGRPINSS

SEQ ID NO: 572255 - protein, 9 aa, Homo Sapiens
TRSVSFLKG

SEQ ID NO: 572256 - protein, 9 aa, Homo Sapiens
TIPSQRCYV

SEQ ID NO: 572257 - protein, 9 aa, Homo Sapiens
TAGGRAGGG

SEQ ID NO: 572258 - protein, 9 aa, Homo Sapiens
WELERLREL

SEQ ID NO: 572259 - protein, 9 aa, Homo Sapiens
GEKPYTCSK

SEQ ID NO: 572260 - protein, 9 aa, Homo Sapiens
EKFDTLAEL

SEQ ID NO: 572261 - protein, 9 aa, Homo Sapiens
GEVSAATNN

SEQ ID NO: 572262 - protein, 9 aa, Homo Sapiens
KCEELHEVP

SEQ ID NO: 572263 - protein, 9 aa, Homo Sapiens
ELLDTADLL

SEQ ID NO: 572264 - protein, 9 aa, Homo Sapiens
KPYTCSKCG

SEQ ID NO: 572265 - protein, 9 aa, Homo Sapiens
FKLPLMPVF

SEQ ID NO: 572266 - protein, 9 aa, Homo Sapiens
CRLNIPFPY

SEQ ID NO: 572267 - protein, 9 aa, Homo Sapiens
KDYKPTCRL

SEQ ID NO: 572268 - protein, 9 aa, Homo Sapiens
AARNACRVG

SEQ ID NO: 572269 - protein, 9 aa, Homo Sapiens
QIWNGKQCI

SEQ ID NO: 572270 - protein, 9 aa, Homo Sapiens
FRPHITEPK

SEQ ID NO: 572271 - protein, 9 aa, Homo Sapiens
SVEHEAFLR

SEQ ID NO: 572272 - protein, 9 aa, Homo Sapiens
DTADLLQLE

SEQ ID NO: 572273 - protein, 9 aa, Homo Sapiens
PLMPVFEGL

SEQ ID NO: 572274 - protein, 9 aa, Homo Sapiens
LPLMPVFEG

SEQ ID NO: 572275 - protein, 9 aa, Homo Sapiens
TCSKCGKGF

SEQ ID NO: 572276 - protein, 9 aa, Homo Sapiens
SVSINGFSI

SEQ ID NO: 572277 - protein, 9 aa, Homo Sapiens
FDTLAELVQ

SEQ ID NO: 572278 - protein, 9 aa, Homo Sapiens
IESSPDKWL

SEQ ID NO: 572279 - protein, 9 aa, Homo Sapiens
ETLWELERL

SEQ ID NO: 572280 - protein, 9 aa, Homo Sapiens
GSGGTAGGR

SEQ ID NO: 572281 - protein, 9 aa, Homo Sapiens
DYKPTCRLN

SEQ ID NO: 572282 - protein, 9 aa, Homo Sapiens
HDWSVEHEA

SEQ ID NO: 572283 - protein, 9 aa, Homo Sapiens
KSLICTFAM

SEQ ID NO: 572284 - protein, 9 aa, Homo Sapiens
LKCERDIDE

SEQ ID NO: 572285 - protein, 9 aa, Homo Sapiens
VSSVALCQS

SEQ ID NO: 572286 - protein, 9 aa, Homo Sapiens
RAMATRTHQ

SEQ ID NO: 572287 - protein, 9 aa, Homo Sapiens
GLEEGSGGT

SEQ ID NO: 572288 - protein, 9 aa, Homo Sapiens
ENVLPLSRP

SEQ ID NO: 572289 - protein, 9 aa, Homo Sapiens
SQRCYVYYY

SEQ ID NO: 572290 - protein, 9 aa, Homo Sapiens
KPVQSSGPE

SEQ ID NO: 572291 - protein, 9 aa, Homo Sapiens
TLGLQRARS

SEQ ID NO: 572292 - protein, 9 aa, Homo Sapiens
AIESSPDKW

SEQ ID NO: 572293 - protein, 9 aa, Homo Sapiens
CERDIDECS

SEQ ID NO: 572294 - protein, 9 aa, Homo Sapiens
FPTAINLVY

SEQ ID NO: 572295 - protein, 9 aa, Homo Sapiens
SGVVKPVQS

SEQ ID NO: 572296 - protein, 9 aa, Homo Sapiens
NGFSIHSQG

SEQ ID NO: 572297 - protein, 9 aa, Homo Sapiens
TGLKCERDI

SEQ ID NO: 572298 - protein, 9 aa, Homo Sapiens
YKPTCRLNI

SEQ ID NO: 572299 - protein, 9 aa, Homo Sapiens
KSVQNSECY

SEQ ID NO: 572300 - protein, 9 aa, Homo Sapiens
PELYKSVQN

SEQ ID NO: 572301 - protein, 9 aa, Homo Sapiens
GLKCERDID

SEQ ID NO: 572302 - protein, 9 aa, Homo Sapiens
ELYKSVQNS

SEQ ID NO: 572303 - protein, 9 aa, Homo Sapiens
CGLQSQYEL

SEQ ID NO: 572304 - protein, 9 aa, Homo Sapiens
KRVPFSAEN

SEQ ID NO: 572305 - protein, 9 aa, Homo Sapiens
PVQSSGPEG

SEQ ID NO: 572306 - protein, 9 aa, Homo Sapiens
EPTRSVSFL

SEQ ID NO: 572307 - protein, 9 aa, Homo Sapiens
LKDYKPTCR

SEQ ID NO: 572308 - protein, 9 aa, Homo Sapiens
SDYSKESLD

SEQ ID NO: 572309 - protein, 9 aa, Homo Sapiens
RPSFRDRRV

SEQ ID NO: 572310 - protein, 9 aa, Homo Sapiens
RNACRVGTE

SEQ ID NO: 572311 - protein, 9 aa, Homo Sapiens
LDTADLLQL

SEQ ID NO: 572312 - protein, 9 aa, Homo Sapiens
PGNSGDWDS

SEQ ID NO: 572313 - protein, 9 aa, Homo Sapiens
ADLLQLESS

SEQ ID NO: 572314 - protein, 9 aa, Homo Sapiens
KCERDIDEC

SEQ ID NO: 572315 - protein, 9 aa, Homo Sapiens
PHITEPKMM

SEQ ID NO: 572316 - protein, 9 aa, Homo Sapiens
ESQPYLGPR

SEQ ID NO: 572317 - protein, 9 aa, Homo Sapiens
IPNFRPGPR

SEQ ID NO: 572318 - protein, 9 aa, Homo Sapiens
GLHQQSIAV

SEQ ID NO: 572319 - protein, 9 aa, Homo Sapiens
VAGSDVDID

SEQ ID NO: 572320 - protein, 9 aa, Homo Sapiens
NGKQCICPQ

SEQ ID NO: 572321 - protein, 9 aa, Homo Sapiens
DWDSSSFLS

SEQ ID NO: 572322 - protein, 9 aa, Homo Sapiens
RKSLICTFA

SEQ ID NO: 572323 - protein, 9 aa, Homo Sapiens
AENVLPLSR

SEQ ID NO: 572324 - protein, 9 aa, Homo Sapiens
WDSSSFLSA

SEQ ID NO: 572325 - protein, 9 aa, Homo Sapiens
KFDTLAELV

SEQ ID NO: 572326 - protein, 9 aa, Homo Sapiens
PTCRLNIPF

SEQ ID NO: 572327 - protein, 9 aa, Homo Sapiens
QKWFPTAIN

SEQ ID NO: 572328 - protein, 9 aa, Homo Sapiens
DSSSFLSAH

SEQ ID NO: 572329 - protein, 9 aa, Homo Sapiens
TVIPNFRPG

SEQ ID NO: 572330 - protein, 9 aa, Homo Sapiens
SPSKSPPML

SEQ ID NO: 572331 - protein, 9 aa, Homo Sapiens
MGESQPYLG

SEQ ID NO: 572332 - protein, 9 aa, Homo Sapiens
YDITVIPNF

SEQ ID NO: 572333 - protein, 9 aa, Homo Sapiens
DYSKESLDS

SEQ ID NO: 572334 - protein, 9 aa, Homo Sapiens
VQNSECYNL

SEQ ID NO: 572335 - protein, 9 aa, Homo Sapiens
GFSIHSQGV

SEQ ID NO: 572336 - protein, 9 aa, Homo Sapiens
ICPQGYVGY

SEQ ID NO: 572337 - protein, 9 aa, Homo Sapiens
LEPTRSVSF

SEQ ID NO: 572338 - protein, 9 aa, Homo Sapiens
ENLSGLHQQ

SEQ ID NO: 572339 - protein, 9 aa, Homo Sapiens
QSQYELEGY

SEQ ID NO: 572340 - protein, 9 aa, Homo Sapiens
VSINGFSIH

SEQ ID NO: 572341 - protein, 9 aa, Homo Sapiens
ACRVGTEPS

SEQ ID NO: 572342 - protein, 9 aa, Homo Sapiens
YSKESLDSE

SEQ ID NO: 572343 - protein, 9 aa, Homo Sapiens
INSSKQYLR

SEQ ID NO: 572344 - protein, 9 aa, Homo Sapiens
CQTFKLPLM

SEQ ID NO: 572345 - protein, 9 aa, Homo Sapiens
PVSSVALCQ

SEQ ID NO: 572346 - protein, 9 aa, Homo Sapiens
QGEMAVGLG

SEQ ID NO: 572347 - protein, 9 aa, Homo Sapiens
FRAMATRTH

SEQ ID NO: 572348 - protein, 9 aa, Homo Sapiens
HQEYLKDLA

SEQ ID NO: 572349 - protein, 9 aa, Homo Sapiens
RPINSSKQY

SEQ ID NO: 572350 - protein, 9 aa, Homo Sapiens
RISVSINGF

SEQ ID NO: 572351 - protein, 9 aa, Homo Sapiens
LYGGEKFDT

SEQ ID NO: 572352 - protein, 9 aa, Homo Sapiens
YELEGYNAW

SEQ ID NO: 572353 - protein, 9 aa, Homo Sapiens
VQSSGPEGV

SEQ ID NO: 572354 - protein, 9 aa, Homo Sapiens
LLEPTRSVS

SEQ ID NO: 572355 - protein, 9 aa, Homo Sapiens
RVPFSAENV

SEQ ID NO: 572356 - protein, 9 aa, Homo Sapiens
WSVEHEAFL

SEQ ID NO: 572357 - protein, 9 aa, Homo Sapiens
GQRVSFRPH

SEQ ID NO: 572358 - protein, 9 aa, Homo Sapiens
LGRPINSSK

SEQ ID NO: 572359 - protein, 9 aa, Homo Sapiens
CSKCGKGFC

SEQ ID NO: 572360 - protein, 9 aa, Homo Sapiens
ATRTHQEYL

SEQ ID NO: 572361 - protein, 9 aa, Homo Sapiens
AATNNNICG

SEQ ID NO: 572362 - protein, 9 aa, Homo Sapiens
YLGPRTPDG

SEQ ID NO: 572363 - protein, 9 aa, Homo Sapiens
YTCSKCGKG

SEQ ID NO: 572364 - protein, 9 aa, Homo Sapiens
VTIPSQRCY

SEQ ID NO: 572365 - protein, 9 aa, Homo Sapiens
EGSGGTAGG

SEQ ID NO: 572366 - protein, 9 aa, Homo Sapiens
WYENLSGLH

SEQ ID NO: 572367 - protein, 9 aa, Homo Sapiens
SQPYLGPRT

SEQ ID NO: 572368 - protein, 9 aa, Homo Sapiens
QQETLWELE

SEQ ID NO: 572369 - protein, 9 aa, Homo Sapiens
SHTQGEMAV

SEQ ID NO: 572370 - protein, 9 aa, Homo Sapiens
VEHEAFLRE

SEQ ID NO: 572371 - protein, 9 aa, Homo Sapiens
SGGTAGGRA

SEQ ID NO: 572372 - protein, 9 aa, Homo Sapiens
RSLGRPINS

SEQ ID NO: 572373 - protein, 9 aa, Homo Sapiens
LQSQYELEG

SEQ ID NO: 572374 - protein, 9 aa, Homo Sapiens
RVGTEPSDA

SEQ ID NO: 572375 - protein, 9 aa, Homo Sapiens
ISVSINGFS

SEQ ID NO: 572376 - protein, 9 aa, Homo Sapiens
MAVGLGLGD

SEQ ID NO: 572377 - protein, 9 aa, Homo Sapiens
AGEVSAATN

SEQ ID NO: 572378 - protein, 9 aa, Homo Sapiens
ICTFAMAFI

SEQ ID NO: 572379 - protein, 9 aa, Homo Sapiens
WFPTAINLV

SEQ ID NO: 572380 - protein, 9 aa, Homo Sapiens
GTAGGRAGG

SEQ ID NO: 572381 - protein, 9 aa, Homo Sapiens
LWELERLRE

SEQ ID NO: 572382 - protein, 9 aa, Homo Sapiens
VKPVQSSGP

SEQ ID NO: 572383 - protein, 9 aa, Homo Sapiens
SSVALCQSG

SEQ ID NO: 572384 - protein, 9 aa, Homo Sapiens
ERDIDECSP

SEQ ID NO: 572385 - protein, 9 aa, Homo Sapiens
LEEGSGGTA

SEQ ID NO: 572386 - protein, 9 aa, Homo Sapiens
SGDWDSSSF

SEQ ID NO: 572387 - protein, 9 aa, Homo Sapiens
GGEKFDTLA

SEQ ID NO: 572388 - protein, 9 aa, Homo Sapiens
SVQNSECYN

SEQ ID NO: 572389 - protein, 9 aa, Homo Sapiens
GESQPYLGP

SEQ ID NO: 572390 - protein, 9 aa, Homo Sapiens
FSAENVLPL

SEQ ID NO: 572391 - protein, 9 aa, Homo Sapiens
DSEEESGKD

SEQ ID NO: 572392 - protein, 9 aa, Homo Sapiens
CYDITVIPN

SEQ ID NO: 572393 - protein, 9 aa, Homo Sapiens
HQQSIAVKF

SEQ ID NO: 572394 - protein, 9 aa, Homo Sapiens
TAINLVYTF

SEQ ID NO: 572395 - protein, 9 aa, Homo Sapiens
RVAGSDVDI

SEQ ID NO: 572396 - protein, 9 aa, Homo Sapiens
EELHEVPLW

SEQ ID NO: 572397 - protein, 9 aa, Homo Sapiens
NLSGLHQQS

SEQ ID NO: 572398 - protein, 9 aa, Homo Sapiens
PFSAENVLP

SEQ ID NO: 572399 - protein, 9 aa, Homo Sapiens
NACRVGTEP

SEQ ID NO: 572400 - protein, 9 aa, Homo Sapiens
KSPPMLGPQ

SEQ ID NO: 572401 - protein, 9 aa, Homo Sapiens
SKSPPMLGP

SEQ ID NO: 572402 - protein, 9 aa, Homo Sapiens
DTLAELVQY

SEQ ID NO: 572403 - protein, 9 aa, Homo Sapiens
GLQSQYELE

SEQ ID NO: 572404 - protein, 9 aa, Homo Sapiens
SKESLDSEE

SEQ ID NO: 572405 - protein, 9 aa, Homo Sapiens
CYVYYYSYL

SEQ ID NO: 572406 - protein, 9 aa, Homo Sapiens
LGPRTPDGR

SEQ ID NO: 572407 - protein, 9 aa, Homo Sapiens
EEGSGGTAG

SEQ ID NO: 572408 - protein, 9 aa, Homo Sapiens
LHEVPLWVF

SEQ ID NO: 572409 - protein, 9 aa, Homo Sapiens
RLHDWSVEH

SEQ ID NO: 572410 - protein, 9 aa, Homo Sapiens
KQCICPQGY

SEQ ID NO: 572411 - protein, 9 aa, Homo Sapiens
MRVKCEELH

SEQ ID NO: 572412 - protein, 9 aa, Homo Sapiens
PSQRCYVYY

SEQ ID NO: 572413 - protein, 9 aa, Homo Sapiens
GEMAVGLGL

SEQ ID NO: 572414 - protein, 9 aa, Homo Sapiens
SLDSEEESG

SEQ ID NO: 572415 - protein, 9 aa, Homo Sapiens
VIPNFRPGP

SEQ ID NO: 572416 - protein, 9 aa, Homo Sapiens
FRDRRVAGS

SEQ ID NO: 572417 - protein, 9 aa, Homo Sapiens
IPSQRCYVY

SEQ ID NO: 572418 - protein, 9 aa, Homo Sapiens
LSGLHQQSI

SEQ ID NO: 572419 - protein, 9 aa, Homo Sapiens
GVTIPSQRC

SEQ ID NO: 572420 - protein, 9 aa, Homo Sapiens
DLYGGEKFD

SEQ ID NO: 572421 - protein, 9 aa, Homo Sapiens
AMATRTHQE

SEQ ID NO: 572422 - protein, 9 aa, Homo Sapiens
EMAVGLGLG

SEQ ID NO: 572423 - protein, 9 aa, Homo Sapiens
DWSVEHEAF

SEQ ID NO: 572424 - protein, 9 aa, Homo Sapiens
SSGPEGVPH

SEQ ID NO: 572425 - protein, 9 aa, Homo Sapiens
HTQGEMAVG

SEQ ID NO: 572426 - protein, 9 aa, Homo Sapiens
LHQQSIAVK

SEQ ID NO: 572427 - protein, 9 aa, Homo Sapiens
QCICPQGYV

SEQ ID NO: 572428 - protein, 9 aa, Homo Sapiens
QPYLGPRTP

SEQ ID NO: 572429 - protein, 9 aa, Homo Sapiens
VKCEELHEV

SEQ ID NO: 572430 - protein, 9 aa, Homo Sapiens
GDWDSSSFL

SEQ ID NO: 572431 - protein, 9 aa, Homo Sapiens
KESLDSEEE

SEQ ID NO: 572432 - protein, 9 aa, Homo Sapiens
SKCGKGFCA

SEQ ID NO: 572433 - protein, 9 aa, Homo Sapiens
SGLHQQSIA

SEQ ID NO: 572434 - protein, 9 aa, Homo Sapiens
KGCLLEPTR

SEQ ID NO: 572435 - protein, 9 aa, Homo Sapiens
GKQCICPQG

SEQ ID NO: 572436 - protein, 9 aa, Homo Sapiens
ALCQSGGYV

SEQ ID NO: 572437 - protein, 9 aa, Homo Sapiens
VSFRPHITE

SEQ ID NO: 572438 - protein, 9 aa, Homo Sapiens
WNGKQCICP

SEQ ID NO: 572439 - protein, 9 aa, Homo Sapiens
ARNACRVGT

SEQ ID NO: 572440 - protein, 9 aa, Homo Sapiens
CRVGTEPSD

SEQ ID NO: 572441 - protein, 9 aa, Homo Sapiens
RCYVYYYSY

SEQ ID NO: 572442 - protein, 9 aa, Homo Sapiens
MPVFEGLAF

SEQ ID NO: 572443 - protein, 9 aa, Homo Sapiens
RTHQEYLKD

SEQ ID NO: 572444 - protein, 9 aa, Homo Sapiens
VALCQSGGY

SEQ ID NO: 572445 - protein, 9 aa, Homo Sapiens
LLQLESSLQ

SEQ ID NO: 572446 - protein, 9 aa, Homo Sapiens
TQGEMAVGL

SEQ ID NO: 572447 - protein, 9 aa, Homo Sapiens
TLWELERLR

SEQ ID NO: 572448 - protein, 9 aa, Homo Sapiens
ITVIPNFRP

SEQ ID NO: 572449 - protein, 9 aa, Homo Sapiens
SSPDKWLTL

SEQ ID NO: 572450 - protein, 9 aa, Homo Sapiens
YGGEKFDTL

SEQ ID NO: 572451 - protein, 9 aa, Homo Sapiens
PPMLGPQQA

SEQ ID NO: 572452 - protein, 9 aa, Homo Sapiens
GYTGLKCER

SEQ ID NO: 572453 - protein, 9 aa, Homo Sapiens
WSHTQGEMA

SEQ ID NO: 572454 - protein, 9 aa, Homo Sapiens
RDIDECSPL

SEQ ID NO: 572455 - protein, 9 aa, Homo Sapiens
KLPLMPVFE

SEQ ID NO: 572456 - protein, 9 aa, Homo Sapiens
TEDMATLML

SEQ ID NO: 572457 - protein, 9 aa, Homo Sapiens
PDCSAAYVV

SEQ ID NO: 572458 - protein, 9 aa, Homo Sapiens
IGHHAYGDQ

SEQ ID NO: 572459 - protein, 9 aa, Homo Sapiens
WVKPIIIGH

SEQ ID NO: 572460 - protein, 9 aa, Homo Sapiens
THRGCLHAP

SEQ ID NO: 572461 - protein, 9 aa, Homo Sapiens
MATLMLQNL

SEQ ID NO: 572462 - protein, 9 aa, Homo Sapiens
ALTEDMATL

SEQ ID NO: 572463 - protein, 9 aa, Homo Sapiens
PTHRGCLHA

SEQ ID NO: 572464 - protein, 9 aa, Homo Sapiens
DAMHTDPDC

SEQ ID NO: 572465 - protein, 9 aa, Homo Sapiens
CSAAYVVIE

SEQ ID NO: 572466 - protein, 9 aa, Homo Sapiens
LNATGPDEG

SEQ ID NO: 572467 - protein, 9 aa, Homo Sapiens
IIGHHAYGD

SEQ ID NO: 572468 - protein, 9 aa, Homo Sapiens
FDSANWQAY

SEQ ID NO: 572469 - protein, 9 aa, Homo Sapiens
YYGDILLKM

SEQ ID NO: 572470 - protein, 9 aa, Homo Sapiens
DYYGDILLK

SEQ ID NO: 572471 - protein, 9 aa, Homo Sapiens
LKQQQQQHG

SEQ ID NO: 572472 - protein, 9 aa, Homo Sapiens
HAPPSQATL

SEQ ID NO: 572473 - protein, 9 aa, Homo Sapiens
GRFLWSLPT

SEQ ID NO: 572474 - protein, 9 aa, Homo Sapiens
LLRLNATGP

SEQ ID NO: 572475 - protein, 9 aa, Homo Sapiens
LLLRLNATG

SEQ ID NO: 572476 - protein, 9 aa, Homo Sapiens
DILLKMENN

SEQ ID NO: 572477 - protein, 9 aa, Homo Sapiens
PSCNNRHFW

SEQ ID NO: 572478 - protein, 9 aa, Homo Sapiens
RLNATGPDE

SEQ ID NO: 572479 - protein, 9 aa, Homo Sapiens
NWQAYILLS

SEQ ID NO: 572480 - protein, 9 aa, Homo Sapiens
TVVGEEEED

SEQ ID NO: 572481 - protein, 9 aa, Homo Sapiens
HRGCLHAPP

SEQ ID NO: 572482 - protein, 9 aa, Homo Sapiens
NATGPDEGT

SEQ ID NO: 572483 - protein, 9 aa, Homo Sapiens
DCSAAYVVI

SEQ ID NO: 572484 - protein, 9 aa, Homo Sapiens
HHAYGDQYR

SEQ ID NO: 572485 - protein, 9 aa, Homo Sapiens
TCEHLHKNE

SEQ ID NO: 572486 - protein, 9 aa, Homo Sapiens
GPDEGTNGQ

SEQ ID NO: 572487 - protein, 9 aa, Homo Sapiens
HTDPDCSAA

SEQ ID NO: 572488 - protein, 9 aa, Homo Sapiens
VGLFSVDSE

SEQ ID NO: 572489 - protein, 9 aa, Homo Sapiens
AMHTDPDCS

SEQ ID NO: 572490 - protein, 9 aa, Homo Sapiens
GLFSVDSEE

SEQ ID NO: 572491 - protein, 9 aa, Homo Sapiens
DMATLMLQN

SEQ ID NO: 572492 - protein, 9 aa, Homo Sapiens
GEEEEDDDD

SEQ ID NO: 572493 - protein, 9 aa, Homo Sapiens
IDYYGDILL

SEQ ID NO: 572494 - protein, 9 aa, Homo Sapiens
GVGLFSVDS

SEQ ID NO: 572495 - protein, 9 aa, Homo Sapiens
PIIIGHHAY

SEQ ID NO: 572496 - protein, 9 aa, Homo Sapiens
SLPTCEHLH

SEQ ID NO: 572497 - protein, 9 aa, Homo Sapiens
YGDILLKME

SEQ ID NO: 572498 - protein, 9 aa, Homo Sapiens
GDILLKMEN

SEQ ID NO: 572499 - protein, 9 aa, Homo Sapiens
VDSEEDGYP

SEQ ID NO: 572500 - protein, 9 aa, Homo Sapiens
LPTCEHLHK

SEQ ID NO: 572501 - protein, 9 aa, Homo Sapiens
ATGPDEGTN

SEQ ID NO: 572502 - protein, 9 aa, Homo Sapiens
IIIGHHAYG

SEQ ID NO: 572503 - protein, 9 aa, Homo Sapiens
DPDCSAAYV

SEQ ID NO: 572504 - protein, 9 aa, Homo Sapiens
APPSQATLT

SEQ ID NO: 572505 - protein, 9 aa, Homo Sapiens
LWSLPTCEH

SEQ ID NO: 572506 - protein, 9 aa, Homo Sapiens
SCLPSCNNR

SEQ ID NO: 572507 - protein, 9 aa, Homo Sapiens
LPSCNNRHF

SEQ ID NO: 572508 - protein, 9 aa, Homo Sapiens
SANWQAYIL

SEQ ID NO: 572509 - protein, 9 aa, Homo Sapiens
KPIIIGHHA

SEQ ID NO: 572510 - protein, 9 aa, Homo Sapiens
KQQQQQHGS

SEQ ID NO: 572511 - protein, 9 aa, Homo Sapiens
CLHAPPSQA

SEQ ID NO: 572512 - protein, 9 aa, Homo Sapiens
SEEDGYPLT

SEQ ID NO: 572513 - protein, 9 aa, Homo Sapiens
TGPDEGTNG

SEQ ID NO: 572514 - protein, 9 aa, Homo Sapiens
NALTEDMAT

SEQ ID NO: 572515 - protein, 9 aa, Homo Sapiens
GCLHAPPSQ

SEQ ID NO: 572516 - protein, 9 aa, Homo Sapiens
VVGEEEEDD

SEQ ID NO: 572517 - protein, 9 aa, Homo Sapiens
EDMATLMLQ

SEQ ID NO: 572518 - protein, 9 aa, Homo Sapiens
LLKMENNVI

SEQ ID NO: 572519 - protein, 9 aa, Homo Sapiens
CLPSCNNRH

SEQ ID NO: 572520 - protein, 9 aa, Homo Sapiens
SVDSEEDGY

SEQ ID NO: 572521 - protein, 9 aa, Homo Sapiens
TDPDCSAAY

SEQ ID NO: 572522 - protein, 9 aa, Homo Sapiens
LTEDMATLM

SEQ ID NO: 572523 - protein, 9 aa, Homo Sapiens
WQAYILLSQ

SEQ ID NO: 572524 - protein, 9 aa, Homo Sapiens
RFLWSLPTC

SEQ ID NO: 572525 - protein, 9 aa, Homo Sapiens
FLWSLPTCE

SEQ ID NO: 572526 - protein, 9 aa, Homo Sapiens
LRLNATGPD

SEQ ID NO: 572527 - protein, 9 aa, Homo Sapiens
ANWQAYILL

SEQ ID NO: 572528 - protein, 9 aa, Homo Sapiens
VGEEEEDDD

SEQ ID NO: 572529 - protein, 9 aa, Homo Sapiens
GFDSANWQA

SEQ ID NO: 572530 - protein, 9 aa, Homo Sapiens
WSLPTCEHL

SEQ ID NO: 572531 - protein, 9 aa, Homo Sapiens
QLKQQQQQH

SEQ ID NO: 572532 - protein, 9 aa, Homo Sapiens
TLMLQNLSS

SEQ ID NO: 572533 - protein, 9 aa, Homo Sapiens
PTCEHLHKN

SEQ ID NO: 572534 - protein, 9 aa, Homo Sapiens
DSEEDGYPL

SEQ ID NO: 572535 - protein, 9 aa, Homo Sapiens
LKMENNVIF

SEQ ID NO: 572536 - protein, 9 aa, Homo Sapiens
ATLMLQNLS

SEQ ID NO: 572537 - protein, 9 aa, Homo Sapiens
ILLKMENNV

SEQ ID NO: 572538 - protein, 9 aa, Homo Sapiens
FSVDSEEDG

SEQ ID NO: 572539 - protein, 9 aa, Homo Sapiens
WGFDSANWQ

SEQ ID NO: 572540 - protein, 9 aa, Homo Sapiens
LFSVDSEED

SEQ ID NO: 572541 - protein, 9 aa, Homo Sapiens
DSANWQAYI

SEQ ID NO: 572542 - protein, 9 aa, Homo Sapiens
MHTDPDCSA

SEQ ID NO: 572543 - protein, 9 aa, Homo Sapiens
GHHAYGDQY

SEQ ID NO: 572544 - protein, 9 aa, Homo Sapiens
RGCLHAPPS

SEQ ID NO: 572545 - protein, 9 aa, Homo Sapiens
LHAPPSQAT

SEQ ID NO: 572546 - protein, 9 aa, Homo Sapiens
QAYILLSQD

SEQ ID NO: 572547 - protein, 9 aa, Homo Sapiens
VKPIIIGHH

SEQ ID NO: 572548 - protein, 9 aa, Homo Sapiens
LEKVHQLER

SEQ ID NO: 572549 - protein, 9 aa, Homo Sapiens
TSPTLGGWT

SEQ ID NO: 572550 - protein, 9 aa, Homo Sapiens
IGHHAYGDQ

SEQ ID NO: 572551 - protein, 9 aa, Homo Sapiens
WVKPIIIGH

SEQ ID NO: 572552 - protein, 9 aa, Homo Sapiens
TSEGGLANV

SEQ ID NO: 572553 - protein, 9 aa, Homo Sapiens
GWTPAGHCG

SEQ ID NO: 572554 - protein, 9 aa, Homo Sapiens
LSVFGQEVG

SEQ ID NO: 572555 - protein, 9 aa, Homo Sapiens
ARRWEEKRL

SEQ ID NO: 572556 - protein, 9 aa, Homo Sapiens
LRSVGWSNI

SEQ ID NO: 572557 - protein, 9 aa, Homo Sapiens
GLKPPGHGG

SEQ ID NO: 572558 - protein, 9 aa, Homo Sapiens
YVLLKEVVK

SEQ ID NO: 572559 - protein, 9 aa, Homo Sapiens
PSGGSEWGS

SEQ ID NO: 572560 - protein, 9 aa, Homo Sapiens
AAHGIANEV

SEQ ID NO: 572561 - protein, 9 aa, Homo Sapiens
IRRIAQMVN

SEQ ID NO: 572562 - protein, 9 aa, Homo Sapiens
TSWYTSAAS

SEQ ID NO: 572563 - protein, 9 aa, Homo Sapiens
PQEHPGLGG

SEQ ID NO: 572564 - protein, 9 aa, Homo Sapiens
RSKQEAWST

SEQ ID NO: 572565 - protein, 9 aa, Homo Sapiens
VFGQEVGSS

SEQ ID NO: 572566 - protein, 9 aa, Homo Sapiens
AISTVKQSW

SEQ ID NO: 572567 - protein, 9 aa, Homo Sapiens
CDPGEFLRH

SEQ ID NO: 572568 - protein, 9 aa, Homo Sapiens
PSDYVLLKE

SEQ ID NO: 572569 - protein, 9 aa, Homo Sapiens
VNLCKGKFD

SEQ ID NO: 572570 - protein, 9 aa, Homo Sapiens
IIGHHAYGD

SEQ ID NO: 572571 - protein, 9 aa, Homo Sapiens
HGGKHSSPM

SEQ ID NO: 572572 - protein, 9 aa, Homo Sapiens
DMAIRRIAQ

SEQ ID NO: 572573 - protein, 9 aa, Homo Sapiens
WIKESVNED

SEQ ID NO: 572574 - protein, 9 aa, Homo Sapiens
ASEDAAHGI

SEQ ID NO: 572575 - protein, 9 aa, Homo Sapiens
HLTSPTLGG

SEQ ID NO: 572576 - protein, 9 aa, Homo Sapiens
PGGLPAGCQ

SEQ ID NO: 572577 - protein, 9 aa, Homo Sapiens
VGSSHLTSP

SEQ ID NO: 572578 - protein, 9 aa, Homo Sapiens
PSGLKPPGH

SEQ ID NO: 572579 - protein, 9 aa, Homo Sapiens
ESVNEDLFS

SEQ ID NO: 572580 - protein, 9 aa, Homo Sapiens
PGHGGKHSS

SEQ ID NO: 572581 - protein, 9 aa, Homo Sapiens
QHIQTMTWL

SEQ ID NO: 572582 - protein, 9 aa, Homo Sapiens
AGCQLSVFG

SEQ ID NO: 572583 - protein, 9 aa, Homo Sapiens
SKQEAWSTH

SEQ ID NO: 572584 - protein, 9 aa, Homo Sapiens
RHDHVTCVS

SEQ ID NO: 572585 - protein, 9 aa, Homo Sapiens
QEAWSTHNT

SEQ ID NO: 572586 - protein, 9 aa, Homo Sapiens
YPLLMNHRV

SEQ ID NO: 572587 - protein, 9 aa, Homo Sapiens
PAGHCGEGA

SEQ ID NO: 572588 - protein, 9 aa, Homo Sapiens
SRLLQTSEG

SEQ ID NO: 572589 - protein, 9 aa, Homo Sapiens
EARRWEEKR

SEQ ID NO: 572590 - protein, 9 aa, Homo Sapiens
MTYPLKAIS

SEQ ID NO: 572591 - protein, 9 aa, Homo Sapiens
PGRPRSKQE

SEQ ID NO: 572592 - protein, 9 aa, Homo Sapiens
LKEVVKDTT

SEQ ID NO: 572593 - protein, 9 aa, Homo Sapiens
PSPSGGSEW

SEQ ID NO: 572594 - protein, 9 aa, Homo Sapiens
GLGGEAVGT

SEQ ID NO: 572595 - protein, 9 aa, Homo Sapiens
LLMNHRVCL

SEQ ID NO: 572596 - protein, 9 aa, Homo Sapiens
PGEFLRHDH

SEQ ID NO: 572597 - protein, 9 aa, Homo Sapiens
DLFSLSESA

SEQ ID NO: 572598 - protein, 9 aa, Homo Sapiens
RSVGWSNIF

SEQ ID NO: 572599 - protein, 9 aa, Homo Sapiens
EAWSTHNTV

SEQ ID NO: 572600 - protein, 9 aa, Homo Sapiens
SPSPSGGSE

SEQ ID NO: 572601 - protein, 9 aa, Homo Sapiens
SVFGQEVGS

SEQ ID NO: 572602 - protein, 9 aa, Homo Sapiens
LGGWTPAGH

SEQ ID NO: 572603 - protein, 9 aa, Homo Sapiens
LRYPLLMNH

SEQ ID NO: 572604 - protein, 9 aa, Homo Sapiens
GRPRSKQEA

SEQ ID NO: 572605 - protein, 9 aa, Homo Sapiens
QLSVFGQEV

SEQ ID NO: 572606 - protein, 9 aa, Homo Sapiens
SGGSEWGSP

SEQ ID NO: 572607 - protein, 9 aa, Homo Sapiens
GHCGEGACH

SEQ ID NO: 572608 - protein, 9 aa, Homo Sapiens
HRVCLFMVV

SEQ ID NO: 572609 - protein, 9 aa, Homo Sapiens
EVGSSHLTS

SEQ ID NO: 572610 - protein, 9 aa, Homo Sapiens
LLQTSEGGL

SEQ ID NO: 572611 - protein, 9 aa, Homo Sapiens
DYVLLKEVV

SEQ ID NO: 572612 - protein, 9 aa, Homo Sapiens
GGEAVGTGE

SEQ ID NO: 572613 - protein, 9 aa, Homo Sapiens
KAISTVKQS

SEQ ID NO: 572614 - protein, 9 aa, Homo Sapiens
SVGWSNIFQ

SEQ ID NO: 572615 - protein, 9 aa, Homo Sapiens
SEWGSPQRN

SEQ ID NO: 572616 - protein, 9 aa, Homo Sapiens
NSTSWYTSA

SEQ ID NO: 572617 - protein, 9 aa, Homo Sapiens
WSNIFQLPF

SEQ ID NO: 572618 - protein, 9 aa, Homo Sapiens
SNIFQLPFK

SEQ ID NO: 572619 - protein, 9 aa, Homo Sapiens
ENSTSWYTS

SEQ ID NO: 572620 - protein, 9 aa, Homo Sapiens
MAIRRIAQM

SEQ ID NO: 572621 - protein, 9 aa, Homo Sapiens
GCQLSVFGQ

SEQ ID NO: 572622 - protein, 9 aa, Homo Sapiens
SYLENSTSW

SEQ ID NO: 572623 - protein, 9 aa, Homo Sapiens
FGQEVGSSH

SEQ ID NO: 572624 - protein, 9 aa, Homo Sapiens
IASEDAAHG

SEQ ID NO: 572625 - protein, 9 aa, Homo Sapiens
VVNLCKGKF

SEQ ID NO: 572626 - protein, 9 aa, Homo Sapiens
EDLFSLSES

SEQ ID NO: 572627 - protein, 9 aa, Homo Sapiens
HGIANEVAA

SEQ ID NO: 572628 - protein, 9 aa, Homo Sapiens
LENSTSWYT

SEQ ID NO: 572629 - protein, 9 aa, Homo Sapiens
PIIIGHHAY

SEQ ID NO: 572630 - protein, 9 aa, Homo Sapiens
LKIMNTEQH

SEQ ID NO: 572631 - protein, 9 aa, Homo Sapiens
LTSPTLGGW

SEQ ID NO: 572632 - protein, 9 aa, Homo Sapiens
SEDAAHGIA

SEQ ID NO: 572633 - protein, 9 aa, Homo Sapiens
QTSEGGLAN

SEQ ID NO: 572634 - protein, 9 aa, Homo Sapiens
HIQTMTWLQ

SEQ ID NO: 572635 - protein, 9 aa, Homo Sapiens
RLLQTSEGG

SEQ ID NO: 572636 - protein, 9 aa, Homo Sapiens
KQEAWSTHN

SEQ ID NO: 572637 - protein, 9 aa, Homo Sapiens
MNTEQHIQT

SEQ ID NO: 572638 - protein, 9 aa, Homo Sapiens
CGEGACHCH

SEQ ID NO: 572639 - protein, 9 aa, Homo Sapiens
HKSRLLQTS

SEQ ID NO: 572640 - protein, 9 aa, Homo Sapiens
HPGLGGEAV

SEQ ID NO: 572641 - protein, 9 aa, Homo Sapiens
EKVHQLERD

SEQ ID NO: 572642 - protein, 9 aa, Homo Sapiens
LPAGCQLSV

SEQ ID NO: 572643 - protein, 9 aa, Homo Sapiens
VHQLERDNA

SEQ ID NO: 572644 - protein, 9 aa, Homo Sapiens
SRVPGGLPA

SEQ ID NO: 572645 - protein, 9 aa, Homo Sapiens
IIIGHHAYG

SEQ ID NO: 572646 - protein, 9 aa, Homo Sapiens
GEFLRHDHV

SEQ ID NO: 572647 - protein, 9 aa, Homo Sapiens
IMNTEQHIQ

SEQ ID NO: 572648 - protein, 9 aa, Homo Sapiens
SHLTSPTLG

SEQ ID NO: 572649 - protein, 9 aa, Homo Sapiens
GGSEWGSPQ

SEQ ID NO: 572650 - protein, 9 aa, Homo Sapiens
VGWSNIFQL

SEQ ID NO: 572651 - protein, 9 aa, Homo Sapiens
KEVVKDTTN

SEQ ID NO: 572652 - protein, 9 aa, Homo Sapiens
LLKEVVKDT

SEQ ID NO: 572653 - protein, 9 aa, Homo Sapiens
TGSRVPGGL

SEQ ID NO: 572654 - protein, 9 aa, Homo Sapiens
PLLMNHRVC

SEQ ID NO: 572655 - protein, 9 aa, Homo Sapiens
VNEDLFSLS

SEQ ID NO: 572656 - protein, 9 aa, Homo Sapiens
KVHQLERDN

SEQ ID NO: 572657 - protein, 9 aa, Homo Sapiens
SSYLENSTS

SEQ ID NO: 572658 - protein, 9 aa, Homo Sapiens
IRDMAIRRI

SEQ ID NO: 572659 - protein, 9 aa, Homo Sapiens
HQLERDNAE

SEQ ID NO: 572660 - protein, 9 aa, Homo Sapiens
KPIIIGHHA

SEQ ID NO: 572661 - protein, 9 aa, Homo Sapiens
ILDYVVNLC

SEQ ID NO: 572662 - protein, 9 aa, Homo Sapiens
LGGEAVGTG

SEQ ID NO: 572663 - protein, 9 aa, Homo Sapiens
GHGGKHSSP

SEQ ID NO: 572664 - protein, 9 aa, Homo Sapiens
DYVVNLCKG

SEQ ID NO: 572665 - protein, 9 aa, Homo Sapiens
YVVNLCKGK

SEQ ID NO: 572666 - protein, 9 aa, Homo Sapiens
GSRVPGGLP

SEQ ID NO: 572667 - protein, 9 aa, Homo Sapiens
NHRVCLFMV

SEQ ID NO: 572668 - protein, 9 aa, Homo Sapiens
SDYVLLKEV

SEQ ID NO: 572669 - protein, 9 aa, Homo Sapiens
NEDLFSLSE

SEQ ID NO: 572670 - protein, 9 aa, Homo Sapiens
FLRHDHVTC

SEQ ID NO: 572671 - protein, 9 aa, Homo Sapiens
GLPAGCQLS

SEQ ID NO: 572672 - protein, 9 aa, Homo Sapiens
QEVGSSHLT

SEQ ID NO: 572673 - protein, 9 aa, Homo Sapiens
YPLKAISTV

SEQ ID NO: 572674 - protein, 9 aa, Homo Sapiens
LQTSEGGLA

SEQ ID NO: 572675 - protein, 9 aa, Homo Sapiens
ASYLEKVHQ

SEQ ID NO: 572676 - protein, 9 aa, Homo Sapiens
EEEARRWEE

SEQ ID NO: 572677 - protein, 9 aa, Homo Sapiens
ARILDYVVN

SEQ ID NO: 572678 - protein, 9 aa, Homo Sapiens
TPQEHPGLG

SEQ ID NO: 572679 - protein, 9 aa, Homo Sapiens
RVPGGLPAG

SEQ ID NO: 572680 - protein, 9 aa, Homo Sapiens
RRWEEKRLR

SEQ ID NO: 572681 - protein, 9 aa, Homo Sapiens
AGHCGEGAC

SEQ ID NO: 572682 - protein, 9 aa, Homo Sapiens
TPAGHCGEG

SEQ ID NO: 572683 - protein, 9 aa, Homo Sapiens
GSSHLTSPT

SEQ ID NO: 572684 - protein, 9 aa, Homo Sapiens
CQLSVFGQE

SEQ ID NO: 572685 - protein, 9 aa, Homo Sapiens
GWSNIFQLP

SEQ ID NO: 572686 - protein, 9 aa, Homo Sapiens
PRSKQEAWS

SEQ ID NO: 572687 - protein, 9 aa, Homo Sapiens
KIMNTEQHI

SEQ ID NO: 572688 - protein, 9 aa, Homo Sapiens
IDLRSVGWS

SEQ ID NO: 572689 - protein, 9 aa, Homo Sapiens
WEEKRLRRL

SEQ ID NO: 572690 - protein, 9 aa, Homo Sapiens
HCGEGACHC

SEQ ID NO: 572691 - protein, 9 aa, Homo Sapiens
KESVNEDLF

SEQ ID NO: 572692 - protein, 9 aa, Homo Sapiens
IKESVNEDL

SEQ ID NO: 572693 - protein, 9 aa, Homo Sapiens
RPRSKQEAW

SEQ ID NO: 572694 - protein, 9 aa, Homo Sapiens
ISTVKQSWD

SEQ ID NO: 572695 - protein, 9 aa, Homo Sapiens
TYPLKAIST

SEQ ID NO: 572696 - protein, 9 aa, Homo Sapiens
TIRDMAIRR

SEQ ID NO: 572697 - protein, 9 aa, Homo Sapiens
WTPAGHCGE

SEQ ID NO: 572698 - protein, 9 aa, Homo Sapiens
GIASEDAAH

SEQ ID NO: 572699 - protein, 9 aa, Homo Sapiens
PTLGGWTPA

SEQ ID NO: 572700 - protein, 9 aa, Homo Sapiens
RILDYVVNL

SEQ ID NO: 572701 - protein, 9 aa, Homo Sapiens
EHPGLGGEA

SEQ ID NO: 572702 - protein, 9 aa, Homo Sapiens
SPTLGGWTP

SEQ ID NO: 572703 - protein, 9 aa, Homo Sapiens
TLGGWTPAG

SEQ ID NO: 572704 - protein, 9 aa, Homo Sapiens
VPGGLPAGC

SEQ ID NO: 572705 - protein, 9 aa, Homo Sapiens
RWEEKRLRR

SEQ ID NO: 572706 - protein, 9 aa, Homo Sapiens
RRIAQMVNS

SEQ ID NO: 572707 - protein, 9 aa, Homo Sapiens
TMTYPLKAI

SEQ ID NO: 572708 - protein, 9 aa, Homo Sapiens
RIAQMVNSQ

SEQ ID NO: 572709 - protein, 9 aa, Homo Sapiens
DPGEFLRHD

SEQ ID NO: 572710 - protein, 9 aa, Homo Sapiens
KSRLLQTSE

SEQ ID NO: 572711 - protein, 9 aa, Homo Sapiens
LCDPGEFLR

SEQ ID NO: 572712 - protein, 9 aa, Homo Sapiens
EEARRWEEK

SEQ ID NO: 572713 - protein, 9 aa, Homo Sapiens
SYLEKVHQL

SEQ ID NO: 572714 - protein, 9 aa, Homo Sapiens
AIRRIAQMV

SEQ ID NO: 572715 - protein, 9 aa, Homo Sapiens
LASYLEKVH

SEQ ID NO: 572716 - protein, 9 aa, Homo Sapiens
HHAYGDQYR

SEQ ID NO: 572717 - protein, 9 aa, Homo Sapiens
VLLKEVVKD

SEQ ID NO: 572718 - protein, 9 aa, Homo Sapiens
TEQHIQTMT

SEQ ID NO: 572719 - protein, 9 aa, Homo Sapiens
MNHRVCLFM

SEQ ID NO: 572720 - protein, 9 aa, Homo Sapiens
ASSYLENST

SEQ ID NO: 572721 - protein, 9 aa, Homo Sapiens
SGLKPPGHG

SEQ ID NO: 572722 - protein, 9 aa, Homo Sapiens
QEHPGLGGE

SEQ ID NO: 572723 - protein, 9 aa, Homo Sapiens
KPPGHGGKH

SEQ ID NO: 572724 - protein, 9 aa, Homo Sapiens
EQHIQTMTW

SEQ ID NO: 572725 - protein, 9 aa, Homo Sapiens
PLKAISTVK

SEQ ID NO: 572726 - protein, 9 aa, Homo Sapiens
DLRSVGWSN

SEQ ID NO: 572727 - protein, 9 aa, Homo Sapiens
SVNEDLFSL

SEQ ID NO: 572728 - protein, 9 aa, Homo Sapiens
PPGHGGKHS

SEQ ID NO: 572729 - protein, 9 aa, Homo Sapiens
PGLGGEAVG

SEQ ID NO: 572730 - protein, 9 aa, Homo Sapiens
EFLRHDHVT

SEQ ID NO: 572731 - protein, 9 aa, Homo Sapiens
RYPLLMNHR

SEQ ID NO: 572732 - protein, 9 aa, Homo Sapiens
NTEQHIQTM

SEQ ID NO: 572733 - protein, 9 aa, Homo Sapiens
GQEVGSSHL

SEQ ID NO: 572734 - protein, 9 aa, Homo Sapiens
YLENSTSWY

SEQ ID NO: 572735 - protein, 9 aa, Homo Sapiens
GSEWGSPQR

SEQ ID NO: 572736 - protein, 9 aa, Homo Sapiens
GGLPAGCQL

SEQ ID NO: 572737 - protein, 9 aa, Homo Sapiens
GGWTPAGHC

SEQ ID NO: 572738 - protein, 9 aa, Homo Sapiens
SSHLTSPTL

SEQ ID NO: 572739 - protein, 9 aa, Homo Sapiens
LKAISTVKQ

SEQ ID NO: 572740 - protein, 9 aa, Homo Sapiens
SPSGGSEWG

SEQ ID NO: 572741 - protein, 9 aa, Homo Sapiens
LRHDHVTCV

SEQ ID NO: 572742 - protein, 9 aa, Homo Sapiens
QEEEEARRW

SEQ ID NO: 572743 - protein, 9 aa, Homo Sapiens
WHKSRLLQT

SEQ ID NO: 572744 - protein, 9 aa, Homo Sapiens
LDYVVNLCK

SEQ ID NO: 572745 - protein, 9 aa, Homo Sapiens
GARILDYVV

SEQ ID NO: 572746 - protein, 9 aa, Homo Sapiens
GHHAYGDQY

SEQ ID NO: 572747 - protein, 9 aa, Homo Sapiens
AHGIANEVA

SEQ ID NO: 572748 - protein, 9 aa, Homo Sapiens
PAGCQLSVF

SEQ ID NO: 572749 - protein, 9 aa, Homo Sapiens
EEEEARRWE

SEQ ID NO: 572750 - protein, 9 aa, Homo Sapiens
RDMAIRRIA

SEQ ID NO: 572751 - protein, 9 aa, Homo Sapiens
NPSDYVLLK

SEQ ID NO: 572752 - protein, 9 aa, Homo Sapiens
STSWYTSAA

SEQ ID NO: 572753 - protein, 9 aa, Homo Sapiens
YLEKVHQLE

SEQ ID NO: 572754 - protein, 9 aa, Homo Sapiens
EWGSPQRNG

SEQ ID NO: 572755 - protein, 9 aa, Homo Sapiens
VKPIIIGHH

SEQ ID NO: 572756 - protein, 9 aa, Homo Sapiens
LKPPGHGGK

SEQ ID NO: 572757 - protein, 9 aa, Homo Sapiens
HRHTGIHTD

SEQ ID NO: 572758 - protein, 9 aa, Homo Sapiens
VVMGGKEDN

SEQ ID NO: 572759 - protein, 9 aa, Homo Sapiens
IGHHAYGDQ

SEQ ID NO: 572760 - protein, 9 aa, Homo Sapiens
DTHRNTQAH

SEQ ID NO: 572761 - protein, 9 aa, Homo Sapiens
AHTGIHTDT

SEQ ID NO: 572762 - protein, 9 aa, Homo Sapiens
WVKPIIIGH

SEQ ID NO: 572763 - protein, 9 aa, Homo Sapiens
TGIHTDTHR

SEQ ID NO: 572764 - protein, 9 aa, Homo Sapiens
RHTHTQAYT

SEQ ID NO: 572765 - protein, 9 aa, Homo Sapiens
SSLAQNHGK

SEQ ID NO: 572766 - protein, 9 aa, Homo Sapiens
HRHTHTQAY

SEQ ID NO: 572767 - protein, 9 aa, Homo Sapiens
LRRTLDQRQ

SEQ ID NO: 572768 - protein, 9 aa, Homo Sapiens
TGMHRHTHT

SEQ ID NO: 572769 - protein, 9 aa, Homo Sapiens
GSSLAQNHG

SEQ ID NO: 572770 - protein, 9 aa, Homo Sapiens
AYTRECLGT

SEQ ID NO: 572771 - protein, 9 aa, Homo Sapiens
KCQHLEEQR

SEQ ID NO: 572772 - protein, 9 aa, Homo Sapiens
SHRHTHTHR

SEQ ID NO: 572773 - protein, 9 aa, Homo Sapiens
SGGSSLSPV

SEQ ID NO: 572774 - protein, 9 aa, Homo Sapiens
FSKWWQQFN

SEQ ID NO: 572775 - protein, 9 aa, Homo Sapiens
EDNGYLLEK

SEQ ID NO: 572776 - protein, 9 aa, Homo Sapiens
QGSSLAQNH

SEQ ID NO: 572777 - protein, 9 aa, Homo Sapiens
IHTDTHRNT

SEQ ID NO: 572778 - protein, 9 aa, Homo Sapiens
GKVNFSKWW

SEQ ID NO: 572779 - protein, 9 aa, Homo Sapiens
IIGHHAYGD

SEQ ID NO: 572780 - protein, 9 aa, Homo Sapiens
DGKVNFSKW

SEQ ID NO: 572781 - protein, 9 aa, Homo Sapiens
HRHIHSRTH

SEQ ID NO: 572782 - protein, 9 aa, Homo Sapiens
DSKSCHLEP

SEQ ID NO: 572783 - protein, 9 aa, Homo Sapiens
GHSLAVGCL

SEQ ID NO: 572784 - protein, 9 aa, Homo Sapiens
TRECLGTHT

SEQ ID NO: 572785 - protein, 9 aa, Homo Sapiens
HTGMHRHTH

SEQ ID NO: 572786 - protein, 9 aa, Homo Sapiens
DNGYLLEKK

SEQ ID NO: 572787 - protein, 9 aa, Homo Sapiens
AYTQTHIQA

SEQ ID NO: 572788 - protein, 9 aa, Homo Sapiens
ECLGTHTVV

SEQ ID NO: 572789 - protein, 9 aa, Homo Sapiens
HGKLEAQIE

SEQ ID NO: 572790 - protein, 9 aa, Homo Sapiens
THRHIHSRT

SEQ ID NO: 572791 - protein, 9 aa, Homo Sapiens
RQLAKCQHL

SEQ ID NO: 572792 - protein, 9 aa, Homo Sapiens
GTHTVVVMG

SEQ ID NO: 572793 - protein, 9 aa, Homo Sapiens
QNHGKLEAQ

SEQ ID NO: 572794 - protein, 9 aa, Homo Sapiens
QAHTGIHTD

SEQ ID NO: 572795 - protein, 9 aa, Homo Sapiens
THTVVVMGG

SEQ ID NO: 572796 - protein, 9 aa, Homo Sapiens
HTQAYTLTY

SEQ ID NO: 572797 - protein, 9 aa, Homo Sapiens
THRYTHRHT

SEQ ID NO: 572798 - protein, 9 aa, Homo Sapiens
SRTGHSLAV

SEQ ID NO: 572799 - protein, 9 aa, Homo Sapiens
SLAQNHGKL

SEQ ID NO: 572800 - protein, 9 aa, Homo Sapiens
LGTHTVVVM

SEQ ID NO: 572801 - protein, 9 aa, Homo Sapiens
GMHRHTHTQ

SEQ ID NO: 572802 - protein, 9 aa, Homo Sapiens
THRHTHTHR

SEQ ID NO: 572803 - protein, 9 aa, Homo Sapiens
AKCQHLEEQ

SEQ ID NO: 572804 - protein, 9 aa, Homo Sapiens
THRHTQAYT

SEQ ID NO: 572805 - protein, 9 aa, Homo Sapiens
CQHLEEQRL

SEQ ID NO: 572806 - protein, 9 aa, Homo Sapiens
LHSKVVVAL

SEQ ID NO: 572807 - protein, 9 aa, Homo Sapiens
AYTLTYTGT

SEQ ID NO: 572808 - protein, 9 aa, Homo Sapiens
QTHIQAQTG

SEQ ID NO: 572809 - protein, 9 aa, Homo Sapiens
MHRHTHTQA

SEQ ID NO: 572810 - protein, 9 aa, Homo Sapiens
TGTHRHTHT

SEQ ID NO: 572811 - protein, 9 aa, Homo Sapiens
LAKCQHLEE

SEQ ID NO: 572812 - protein, 9 aa, Homo Sapiens
TGHSLAVGC

SEQ ID NO: 572813 - protein, 9 aa, Homo Sapiens
RECLGTHTV

SEQ ID NO: 572814 - protein, 9 aa, Homo Sapiens
RHTGIHTDT

SEQ ID NO: 572815 - protein, 9 aa, Homo Sapiens
HRHTQAYTQ

SEQ ID NO: 572816 - protein, 9 aa, Homo Sapiens
GSSLSPVIY

SEQ ID NO: 572817 - protein, 9 aa, Homo Sapiens
TDTHRNTQA

SEQ ID NO: 572818 - protein, 9 aa, Homo Sapiens
HHAYGDQYR

SEQ ID NO: 572819 - protein, 9 aa, Homo Sapiens
YTHRHTQAY

SEQ ID NO: 572820 - protein, 9 aa, Homo Sapiens
RTGHSLAVG

SEQ ID NO: 572821 - protein, 9 aa, Homo Sapiens
QAYTLTYTG

SEQ ID NO: 572822 - protein, 9 aa, Homo Sapiens
VMGGKEDNG

SEQ ID NO: 572823 - protein, 9 aa, Homo Sapiens
AVLHSKVVV

SEQ ID NO: 572824 - protein, 9 aa, Homo Sapiens
LMVRSGGSS

SEQ ID NO: 572825 - protein, 9 aa, Homo Sapiens
TDTHSHRHT

SEQ ID NO: 572826 - protein, 9 aa, Homo Sapiens
HRHTGMHRH

SEQ ID NO: 572827 - protein, 9 aa, Homo Sapiens
LVCAVLHSK

SEQ ID NO: 572828 - protein, 9 aa, Homo Sapiens
HRYTHRHTQ

SEQ ID NO: 572829 - protein, 9 aa, Homo Sapiens
THRHTGIHT

SEQ ID NO: 572830 - protein, 9 aa, Homo Sapiens
HAYTRECLG

SEQ ID NO: 572831 - protein, 9 aa, Homo Sapiens
GGKEDNGYL

SEQ ID NO: 572832 - protein, 9 aa, Homo Sapiens
YTQTHIQAQ

SEQ ID NO: 572833 - protein, 9 aa, Homo Sapiens
SKWWQQFNI

SEQ ID NO: 572834 - protein, 9 aa, Homo Sapiens
HIQAQTGTH

SEQ ID NO: 572835 - protein, 9 aa, Homo Sapiens
NGYLLEKKI

SEQ ID NO: 572836 - protein, 9 aa, Homo Sapiens
PIIIGHHAY

SEQ ID NO: 572837 - protein, 9 aa, Homo Sapiens
VNFSKWWQQ

SEQ ID NO: 572838 - protein, 9 aa, Homo Sapiens
KVNFSKWWQ

SEQ ID NO: 572839 - protein, 9 aa, Homo Sapiens
RQALVMQLF

SEQ ID NO: 572840 - protein, 9 aa, Homo Sapiens
ERERQLAKC

SEQ ID NO: 572841 - protein, 9 aa, Homo Sapiens
RTLDQRQAL

SEQ ID NO: 572842 - protein, 9 aa, Homo Sapiens
DTHSHRHTH

SEQ ID NO: 572843 - protein, 9 aa, Homo Sapiens
MVRSGGSSL

SEQ ID NO: 572844 - protein, 9 aa, Homo Sapiens
ERQLAKCQH

SEQ ID NO: 572845 - protein, 9 aa, Homo Sapiens
KVVVALILQ

SEQ ID NO: 572846 - protein, 9 aa, Homo Sapiens
LTYTGTHRH

SEQ ID NO: 572847 - protein, 9 aa, Homo Sapiens
GTHRHTHTH

SEQ ID NO: 572848 - protein, 9 aa, Homo Sapiens
RYTHRHTQA

SEQ ID NO: 572849 - protein, 9 aa, Homo Sapiens
SKVVVALIL

SEQ ID NO: 572850 - protein, 9 aa, Homo Sapiens
AQNHGKLEA

SEQ ID NO: 572851 - protein, 9 aa, Homo Sapiens
VTPLVDSKS

SEQ ID NO: 572852 - protein, 9 aa, Homo Sapiens
GIHTDTHRN

SEQ ID NO: 572853 - protein, 9 aa, Homo Sapiens
IIIGHHAYG

SEQ ID NO: 572854 - protein, 9 aa, Homo Sapiens
QAQTGTHRH

SEQ ID NO: 572855 - protein, 9 aa, Homo Sapiens
CAVLHSKVV

SEQ ID NO: 572856 - protein, 9 aa, Homo Sapiens
IHSRTHAYT

SEQ ID NO: 572857 - protein, 9 aa, Homo Sapiens
HTHTHRHTG

SEQ ID NO: 572858 - protein, 9 aa, Homo Sapiens
IQAQTGTHR

SEQ ID NO: 572859 - protein, 9 aa, Homo Sapiens
HTHTQAYTL

SEQ ID NO: 572860 - protein, 9 aa, Homo Sapiens
SLAVGCLHR

SEQ ID NO: 572861 - protein, 9 aa, Homo Sapiens
THTHRYTHR

SEQ ID NO: 572862 - protein, 9 aa, Homo Sapiens
LDQRQALVM

SEQ ID NO: 572863 - protein, 9 aa, Homo Sapiens
TVVVMGGKE

SEQ ID NO: 572864 - protein, 9 aa, Homo Sapiens
HTHRHTGIH

SEQ ID NO: 572865 - protein, 9 aa, Homo Sapiens
QLAKCQHLE

SEQ ID NO: 572866 - protein, 9 aa, Homo Sapiens
RSGGSSLSP

SEQ ID NO: 572867 - protein, 9 aa, Homo Sapiens
RHTHTHRHT

SEQ ID NO: 572868 - protein, 9 aa, Homo Sapiens
NHGKLEAQI

SEQ ID NO: 572869 - protein, 9 aa, Homo Sapiens
AVGCLHRYV

SEQ ID NO: 572870 - protein, 9 aa, Homo Sapiens
HTDTDTHSH

SEQ ID NO: 572871 - protein, 9 aa, Homo Sapiens
RHTGMHRHT

SEQ ID NO: 572872 - protein, 9 aa, Homo Sapiens
TQAYTQTHI

SEQ ID NO: 572873 - protein, 9 aa, Homo Sapiens
KPIIIGHHA

SEQ ID NO: 572874 - protein, 9 aa, Homo Sapiens
KWWQQFNIL

SEQ ID NO: 572875 - protein, 9 aa, Homo Sapiens
RHIHSRTHA

SEQ ID NO: 572876 - protein, 9 aa, Homo Sapiens
QAYTQTHIQ

SEQ ID NO: 572877 - protein, 9 aa, Homo Sapiens
HSRTHAYTR

SEQ ID NO: 572878 - protein, 9 aa, Homo Sapiens
IVTPLVDSK

SEQ ID NO: 572879 - protein, 9 aa, Homo Sapiens
TPLVDSKSC

SEQ ID NO: 572880 - protein, 9 aa, Homo Sapiens
RHTHTHRYT

SEQ ID NO: 572881 - protein, 9 aa, Homo Sapiens
HSLAVGCLH

SEQ ID NO: 572882 - protein, 9 aa, Homo Sapiens
VGCLHRYVG

SEQ ID NO: 572883 - protein, 9 aa, Homo Sapiens
RERQLAKCQ

SEQ ID NO: 572884 - protein, 9 aa, Homo Sapiens
TQAYTLTYT

SEQ ID NO: 572885 - protein, 9 aa, Homo Sapiens
DTDTHSHRH

SEQ ID NO: 572886 - protein, 9 aa, Homo Sapiens
HTDTHRNTQ

SEQ ID NO: 572887 - protein, 9 aa, Homo Sapiens
HTHTHRYTH

SEQ ID NO: 572888 - protein, 9 aa, Homo Sapiens
HTHRYTHRH

SEQ ID NO: 572889 - protein, 9 aa, Homo Sapiens
SRTHAYTRE

SEQ ID NO: 572890 - protein, 9 aa, Homo Sapiens
TLDQRQALV

SEQ ID NO: 572891 - protein, 9 aa, Homo Sapiens
THAYTRECL

SEQ ID NO: 572892 - protein, 9 aa, Homo Sapiens
MGGKEDNGY

SEQ ID NO: 572893 - protein, 9 aa, Homo Sapiens
THTHRHTGI

SEQ ID NO: 572894 - protein, 9 aa, Homo Sapiens
THTQAYTLT

SEQ ID NO: 572895 - protein, 9 aa, Homo Sapiens
NTQAHTGIH

SEQ ID NO: 572896 - protein, 9 aa, Homo Sapiens
YTGTHRHTH

SEQ ID NO: 572897 - protein, 9 aa, Homo Sapiens
HTVVVMGGK

SEQ ID NO: 572898 - protein, 9 aa, Homo Sapiens
LAQNHGKLE

SEQ ID NO: 572899 - protein, 9 aa, Homo Sapiens
TQAHTGIHT

SEQ ID NO: 572900 - protein, 9 aa, Homo Sapiens
TGIHTDTDT

SEQ ID NO: 572901 - protein, 9 aa, Homo Sapiens
RTHAYTREC

SEQ ID NO: 572902 - protein, 9 aa, Homo Sapiens
HRNTQAHTG

SEQ ID NO: 572903 - protein, 9 aa, Homo Sapiens
HTGIHTDTD

SEQ ID NO: 572904 - protein, 9 aa, Homo Sapiens
CLGTHTVVV

SEQ ID NO: 572905 - protein, 9 aa, Homo Sapiens
GTHRHIHSR

SEQ ID NO: 572906 - protein, 9 aa, Homo Sapiens
TYTGTHRHT

SEQ ID NO: 572907 - protein, 9 aa, Homo Sapiens
QTGTHRHIH

SEQ ID NO: 572908 - protein, 9 aa, Homo Sapiens
THRNTQAHT

SEQ ID NO: 572909 - protein, 9 aa, Homo Sapiens
HTGIHTDTH

SEQ ID NO: 572910 - protein, 9 aa, Homo Sapiens
LAVGCLHRY

SEQ ID NO: 572911 - protein, 9 aa, Homo Sapiens
VLHSKVVVA

SEQ ID NO: 572912 - protein, 9 aa, Homo Sapiens
QRQALVMQL

SEQ ID NO: 572913 - protein, 9 aa, Homo Sapiens
NFSKWWQQF

SEQ ID NO: 572914 - protein, 9 aa, Homo Sapiens
YTLTYTGTH

SEQ ID NO: 572915 - protein, 9 aa, Homo Sapiens
HTQAYTQTH

SEQ ID NO: 572916 - protein, 9 aa, Homo Sapiens
TLTYTGTHR

SEQ ID NO: 572917 - protein, 9 aa, Homo Sapiens
WWQQFNILD

SEQ ID NO: 572918 - protein, 9 aa, Homo Sapiens
KEDNGYLLE

SEQ ID NO: 572919 - protein, 9 aa, Homo Sapiens
GGSSLSPVI

SEQ ID NO: 572920 - protein, 9 aa, Homo Sapiens
HRHTHTHRY

SEQ ID NO: 572921 - protein, 9 aa, Homo Sapiens
TDTDTHSHR

SEQ ID NO: 572922 - protein, 9 aa, Homo Sapiens
SVIVTPLVD

SEQ ID NO: 572923 - protein, 9 aa, Homo Sapiens
SSLSPVIYD

SEQ ID NO: 572924 - protein, 9 aa, Homo Sapiens
AQTGTHRHI

SEQ ID NO: 572925 - protein, 9 aa, Homo Sapiens
HRHTHTHRH

SEQ ID NO: 572926 - protein, 9 aa, Homo Sapiens
DQRQALVMQ

SEQ ID NO: 572927 - protein, 9 aa, Homo Sapiens
IHTDTDTHS

SEQ ID NO: 572928 - protein, 9 aa, Homo Sapiens
VRSGGSSLS

SEQ ID NO: 572929 - protein, 9 aa, Homo Sapiens
THIQAQTGT

SEQ ID NO: 572930 - protein, 9 aa, Homo Sapiens
HSHRHTHTH

SEQ ID NO: 572931 - protein, 9 aa, Homo Sapiens
HIHSRTHAY

SEQ ID NO: 572932 - protein, 9 aa, Homo Sapiens
THSHRHTHT

SEQ ID NO: 572933 - protein, 9 aa, Homo Sapiens
RHTQAYTQT

SEQ ID NO: 572934 - protein, 9 aa, Homo Sapiens
TGTHRHIHS

SEQ ID NO: 572935 - protein, 9 aa, Homo Sapiens
YTRECLGTH

SEQ ID NO: 572936 - protein, 9 aa, Homo Sapiens
GIHTDTDTH

SEQ ID NO: 572937 - protein, 9 aa, Homo Sapiens
TQTHIQAQT

SEQ ID NO: 572938 - protein, 9 aa, Homo Sapiens
LVDSKSCHL

SEQ ID NO: 572939 - protein, 9 aa, Homo Sapiens
QALVMQLFQ

SEQ ID NO: 572940 - protein, 9 aa, Homo Sapiens
VIVTPLVDS

SEQ ID NO: 572941 - protein, 9 aa, Homo Sapiens
HSKVVVALI

SEQ ID NO: 572942 - protein, 9 aa, Homo Sapiens
RNTQAHTGI

SEQ ID NO: 572943 - protein, 9 aa, Homo Sapiens
VDSKSCHLE

SEQ ID NO: 572944 - protein, 9 aa, Homo Sapiens
VCAVLHSKV

SEQ ID NO: 572945 - protein, 9 aa, Homo Sapiens
GHHAYGDQY

SEQ ID NO: 572946 - protein, 9 aa, Homo Sapiens
GYLLEKKIY

SEQ ID NO: 572947 - protein, 9 aa, Homo Sapiens
PLVDSKSCH

SEQ ID NO: 572948 - protein, 9 aa, Homo Sapiens
GKEDNGYLL

SEQ ID NO: 572949 - protein, 9 aa, Homo Sapiens
RRTLDQRQA

SEQ ID NO: 572950 - protein, 9 aa, Homo Sapiens
VKPIIIGHH

SEQ ID NO: 572951 - protein, 9 aa, Homo Sapiens
VVVMGGKED

SEQ ID NO: 572952 - protein, 9 aa, Homo Sapiens
TVMIQAWPF

SEQ ID NO: 572953 - protein, 9 aa, Homo Sapiens
MIQAWPFTC

SEQ ID NO: 572954 - protein, 9 aa, Homo Sapiens
TLTVMIQAW

SEQ ID NO: 572955 - protein, 9 aa, Homo Sapiens
FQTLTVMIQ

SEQ ID NO: 572956 - protein, 9 aa, Homo Sapiens
QTLTVMIQA

SEQ ID NO: 572957 - protein, 9 aa, Homo Sapiens
VMIQAWPFT

SEQ ID NO: 572958 - protein, 9 aa, Homo Sapiens
LTVMIQAWP

SEQ ID NO: 572959 - protein, 9 aa, Homo Sapiens
HFQTLTVMI

SEQ ID NO: 572960 - protein, 9 aa, Homo Sapiens
IQAWPFTCL

SEQ ID NO: 572961 - protein, 9 aa, Homo Sapiens
KSLEKSELV

SEQ ID NO: 572962 - protein, 9 aa, Homo Sapiens
AERNGCIIS

SEQ ID NO: 572963 - protein, 9 aa, Homo Sapiens
IGHHAYGDQ

SEQ ID NO: 572964 - protein, 9 aa, Homo Sapiens
WVKPIIIGH

SEQ ID NO: 572965 - protein, 9 aa, Homo Sapiens
VMNVIHGDG

SEQ ID NO: 572966 - protein, 9 aa, Homo Sapiens
HPLELISGK

SEQ ID NO: 572967 - protein, 9 aa, Homo Sapiens
SLEKSELVQ

SEQ ID NO: 572968 - protein, 9 aa, Homo Sapiens
GCIISYTVV

SEQ ID NO: 572969 - protein, 9 aa, Homo Sapiens
RNGCIISYT

SEQ ID NO: 572970 - protein, 9 aa, Homo Sapiens
TVEWSARSE

SEQ ID NO: 572971 - protein, 9 aa, Homo Sapiens
EEESNRQRV

SEQ ID NO: 572972 - protein, 9 aa, Homo Sapiens
LNLHPPMSP

SEQ ID NO: 572973 - protein, 9 aa, Homo Sapiens
SSQMWHPLE

SEQ ID NO: 572974 - protein, 9 aa, Homo Sapiens
WHPLELISG

SEQ ID NO: 572975 - protein, 9 aa, Homo Sapiens
IIGHHAYGD

SEQ ID NO: 572976 - protein, 9 aa, Homo Sapiens
ERNGCIISY

SEQ ID NO: 572977 - protein, 9 aa, Homo Sapiens
SMLNLHPPM

SEQ ID NO: 572978 - protein, 9 aa, Homo Sapiens
IRSLVQRHI

SEQ ID NO: 572979 - protein, 9 aa, Homo Sapiens
PLTVEWSAR

SEQ ID NO: 572980 - protein, 9 aa, Homo Sapiens
PDWTSMLNL

SEQ ID NO: 572981 - protein, 9 aa, Homo Sapiens
RSLVQRHIK

SEQ ID NO: 572982 - protein, 9 aa, Homo Sapiens
RSYMKTVVL

SEQ ID NO: 572983 - protein, 9 aa, Homo Sapiens
LFPPTASTV

SEQ ID NO: 572984 - protein, 9 aa, Homo Sapiens
QRHIKVIQQ

SEQ ID NO: 572985 - protein, 9 aa, Homo Sapiens
QNLENKYLK

SEQ ID NO: 572986 - protein, 9 aa, Homo Sapiens
NQNLENKYL

SEQ ID NO: 572987 - protein, 9 aa, Homo Sapiens
GEPIELRRV

SEQ ID NO: 572988 - protein, 9 aa, Homo Sapiens
EASPRRMFA

SEQ ID NO: 572989 - protein, 9 aa, Homo Sapiens
ENKYLKDFE

SEQ ID NO: 572990 - protein, 9 aa, Homo Sapiens
YRSGIRSYM

SEQ ID NO: 572991 - protein, 9 aa, Homo Sapiens
EKSELVQLV

SEQ ID NO: 572992 - protein, 9 aa, Homo Sapiens
LTVEWSARS

SEQ ID NO: 572993 - protein, 9 aa, Homo Sapiens
LENKYLKDF

SEQ ID NO: 572994 - protein, 9 aa, Homo Sapiens
LAERNGCII

SEQ ID NO: 572995 - protein, 9 aa, Homo Sapiens
MLNLHPPMS

SEQ ID NO: 572996 - protein, 9 aa, Homo Sapiens
PIELRRVMN

SEQ ID NO: 572997 - protein, 9 aa, Homo Sapiens
VEASPRRMF

SEQ ID NO: 572998 - protein, 9 aa, Homo Sapiens
CIISYTVVF

SEQ ID NO: 572999 - protein, 9 aa, Homo Sapiens
ELRRVMNVI

SEQ ID NO: 573000 - protein, 9 aa, Homo Sapiens
MFANAHTYH

SEQ ID NO: 573001 - protein, 9 aa, Homo Sapiens
RVMNVIHGD

SEQ ID NO: 573002 - protein, 9 aa, Homo Sapiens
PPTASTVCT

SEQ ID NO: 573003 - protein, 9 aa, Homo Sapiens
WRTEEENLR

SEQ ID NO: 573004 - protein, 9 aa, Homo Sapiens
HHAYGDQYR

SEQ ID NO: 573005 - protein, 9 aa, Homo Sapiens
EGIRSLVQR

SEQ ID NO: 573006 - protein, 9 aa, Homo Sapiens
EWSARSESA

SEQ ID NO: 573007 - protein, 9 aa, Homo Sapiens
SSSQMWHPL

SEQ ID NO: 573008 - protein, 9 aa, Homo Sapiens
CPGRDWRTE

SEQ ID NO: 573009 - protein, 9 aa, Homo Sapiens
GIRSYMKTV

SEQ ID NO: 573010 - protein, 9 aa, Homo Sapiens
WSARSESAQ

SEQ ID NO: 573011 - protein, 9 aa, Homo Sapiens
ACPGRDWRT

SEQ ID NO: 573012 - protein, 9 aa, Homo Sapiens
ELVQLVAVT

SEQ ID NO: 573013 - protein, 9 aa, Homo Sapiens
RMFANAHTY

SEQ ID NO: 573014 - protein, 9 aa, Homo Sapiens
GPDWTSMLN

SEQ ID NO: 573015 - protein, 9 aa, Homo Sapiens
RYRSGIRSY

SEQ ID NO: 573016 - protein, 9 aa, Homo Sapiens
PVLAERNGC

SEQ ID NO: 573017 - protein, 9 aa, Homo Sapiens
PIIIGHHAY

SEQ ID NO: 573018 - protein, 9 aa, Homo Sapiens
NLENKYLKD

SEQ ID NO: 573019 - protein, 9 aa, Homo Sapiens
GIRSLVQRH

SEQ ID NO: 573020 - protein, 9 aa, Homo Sapiens
VGPDWTSML

SEQ ID NO: 573021 - protein, 9 aa, Homo Sapiens
EPIELRRVM

SEQ ID NO: 573022 - protein, 9 aa, Homo Sapiens
LVQRHIKVI

SEQ ID NO: 573023 - protein, 9 aa, Homo Sapiens
TIKNQNLEN

SEQ ID NO: 573024 - protein, 9 aa, Homo Sapiens
IIIGHHAYG

SEQ ID NO: 573025 - protein, 9 aa, Homo Sapiens
QRYRSGIRS

SEQ ID NO: 573026 - protein, 9 aa, Homo Sapiens
LEGIRSLVQ

SEQ ID NO: 573027 - protein, 9 aa, Homo Sapiens
RQRVFTGSW

SEQ ID NO: 573028 - protein, 9 aa, Homo Sapiens
SQMWHPLEL

SEQ ID NO: 573029 - protein, 9 aa, Homo Sapiens
TSMLNLHPP

SEQ ID NO: 573030 - protein, 9 aa, Homo Sapiens
KNQNLENKY

SEQ ID NO: 573031 - protein, 9 aa, Homo Sapiens
RRMFANAHT

SEQ ID NO: 573032 - protein, 9 aa, Homo Sapiens
ESNRQRVFT

SEQ ID NO: 573033 - protein, 9 aa, Homo Sapiens
DWTSMLNLH

SEQ ID NO: 573034 - protein, 9 aa, Homo Sapiens
KPIIIGHHA

SEQ ID NO: 573035 - protein, 9 aa, Homo Sapiens
EEEESNRQR

SEQ ID NO: 573036 - protein, 9 aa, Homo Sapiens
SGSSSQMWH

SEQ ID NO: 573037 - protein, 9 aa, Homo Sapiens
LPVLFPPTA

SEQ ID NO: 573038 - protein, 9 aa, Homo Sapiens
KSELVQLVA

SEQ ID NO: 573039 - protein, 9 aa, Homo Sapiens
NRQRVFTGS

SEQ ID NO: 573040 - protein, 9 aa, Homo Sapiens
PGRDWRTEE

SEQ ID NO: 573041 - protein, 9 aa, Homo Sapiens
NKEEEESNR

SEQ ID NO: 573042 - protein, 9 aa, Homo Sapiens
RRVMNVIHG

SEQ ID NO: 573043 - protein, 9 aa, Homo Sapiens
EESNRQRVF

SEQ ID NO: 573044 - protein, 9 aa, Homo Sapiens
CACPGRDWR

SEQ ID NO: 573045 - protein, 9 aa, Homo Sapiens
KEEEESNRQ

SEQ ID NO: 573046 - protein, 9 aa, Homo Sapiens
GSSSQMWHP

SEQ ID NO: 573047 - protein, 9 aa, Homo Sapiens
ASLPVLFPP

SEQ ID NO: 573048 - protein, 9 aa, Homo Sapiens
DWRTEEENL

SEQ ID NO: 573049 - protein, 9 aa, Homo Sapiens
NKYLKDFEI

SEQ ID NO: 573050 - protein, 9 aa, Homo Sapiens
SPRRMFANA

SEQ ID NO: 573051 - protein, 9 aa, Homo Sapiens
MVPPQRHPQ

SEQ ID NO: 573052 - protein, 9 aa, Homo Sapiens
MVEASPRRM

SEQ ID NO: 573053 - protein, 9 aa, Homo Sapiens
SLVQRHIKV

SEQ ID NO: 573054 - protein, 9 aa, Homo Sapiens
VLFPPTAST

SEQ ID NO: 573055 - protein, 9 aa, Homo Sapiens
VQRHIKVIQ

SEQ ID NO: 573056 - protein, 9 aa, Homo Sapiens
SELVQLVAV

SEQ ID NO: 573057 - protein, 9 aa, Homo Sapiens
ASPRRMFAN

SEQ ID NO: 573058 - protein, 9 aa, Homo Sapiens
LRRVMNVIH

SEQ ID NO: 573059 - protein, 9 aa, Homo Sapiens
MWHPLELIS

SEQ ID NO: 573060 - protein, 9 aa, Homo Sapiens
VEWSARSES

SEQ ID NO: 573061 - protein, 9 aa, Homo Sapiens
IRSYMKTVV

SEQ ID NO: 573062 - protein, 9 aa, Homo Sapiens
SNRQRVFTG

SEQ ID NO: 573063 - protein, 9 aa, Homo Sapiens
PASLPVLFP

SEQ ID NO: 573064 - protein, 9 aa, Homo Sapiens
FPPTASTVC

SEQ ID NO: 573065 - protein, 9 aa, Homo Sapiens
SPLTVEWSA

SEQ ID NO: 573066 - protein, 9 aa, Homo Sapiens
NGCIISYTV

SEQ ID NO: 573067 - protein, 9 aa, Homo Sapiens
SLPVLFPPT

SEQ ID NO: 573068 - protein, 9 aa, Homo Sapiens
LVQLVAVTQ

SEQ ID NO: 573069 - protein, 9 aa, Homo Sapiens
TSPLTVEWS

SEQ ID NO: 573070 - protein, 9 aa, Homo Sapiens
VCACPGRDW

SEQ ID NO: 573071 - protein, 9 aa, Homo Sapiens
QMWHPLELI

SEQ ID NO: 573072 - protein, 9 aa, Homo Sapiens
PRRMFANAH

SEQ ID NO: 573073 - protein, 9 aa, Homo Sapiens
WTSMLNLHP

SEQ ID NO: 573074 - protein, 9 aa, Homo Sapiens
PVLFPPTAS

SEQ ID NO: 573075 - protein, 9 aa, Homo Sapiens
RSGIRSYMK

SEQ ID NO: 573076 - protein, 9 aa, Homo Sapiens
VQLVAVTQK

SEQ ID NO: 573077 - protein, 9 aa, Homo Sapiens
IELRRVMNV

SEQ ID NO: 573078 - protein, 9 aa, Homo Sapiens
VLAERNGCI

SEQ ID NO: 573079 - protein, 9 aa, Homo Sapiens
SGIRSYMKT

SEQ ID NO: 573080 - protein, 9 aa, Homo Sapiens
GHHAYGDQY

SEQ ID NO: 573081 - protein, 9 aa, Homo Sapiens
SARSESAQS

SEQ ID NO: 573082 - protein, 9 aa, Homo Sapiens
GRDWRTEEE

SEQ ID NO: 573083 - protein, 9 aa, Homo Sapiens
IKNQNLENK

SEQ ID NO: 573084 - protein, 9 aa, Homo Sapiens
RDWRTEEEN

SEQ ID NO: 573085 - protein, 9 aa, Homo Sapiens
VKPIIIGHH

SEQ ID NO: 573086 - protein, 9 aa, Homo Sapiens
SYMKTVVLD

SEQ ID NO: 573087 - protein, 9 aa, Homo Sapiens
VPPQRHPQR

SEQ ID NO: 573088 - protein, 9 aa, Homo Sapiens
LEKSELVQL

SEQ ID NO: 573089 - protein, 9 aa, Homo Sapiens
VSLMGVYLL

SEQ ID NO: 573090 - protein, 9 aa, Homo Sapiens
HRHTGIHTD

SEQ ID NO: 573091 - protein, 9 aa, Homo Sapiens
DTHRNTQAH

SEQ ID NO: 573092 - protein, 9 aa, Homo Sapiens
AEELTLPEQ

SEQ ID NO: 573093 - protein, 9 aa, Homo Sapiens
LYYSDADGS

SEQ ID NO: 573094 - protein, 9 aa, Homo Sapiens
QILESHSWE

SEQ ID NO: 573095 - protein, 9 aa, Homo Sapiens
RHTHTQAYT

SEQ ID NO: 573096 - protein, 9 aa, Homo Sapiens
LLHTWERLH

SEQ ID NO: 573097 - protein, 9 aa, Homo Sapiens
GSPVQRIQM

SEQ ID NO: 573098 - protein, 9 aa, Homo Sapiens
THRHTGIHT

SEQ ID NO: 573099 - protein, 9 aa, Homo Sapiens
EYMVLASSS

SEQ ID NO: 573100 - protein, 9 aa, Homo Sapiens
VITRKMAAT

SEQ ID NO: 573101 - protein, 9 aa, Homo Sapiens
GKATPGYHM

SEQ ID NO: 573102 - protein, 9 aa, Homo Sapiens
VAYDAFPLA

SEQ ID NO: 573103 - protein, 9 aa, Homo Sapiens
TATGAHGVP

SEQ ID NO: 573104 - protein, 9 aa, Homo Sapiens
YKVIHFGNS

SEQ ID NO: 573105 - protein, 9 aa, Homo Sapiens
AHWLLHTWE

SEQ ID NO: 573106 - protein, 9 aa, Homo Sapiens
VIQRTHSKP

SEQ ID NO: 573107 - protein, 9 aa, Homo Sapiens
EVCVCACPG

SEQ ID NO: 573108 - protein, 9 aa, Homo Sapiens
LLFYVSLMG

SEQ ID NO: 573109 - protein, 9 aa, Homo Sapiens
GTHTVVVMG

SEQ ID NO: 573110 - protein, 9 aa, Homo Sapiens
LHQDLEALG

SEQ ID NO: 573111 - protein, 9 aa, Homo Sapiens
TGIHTDTHR

SEQ ID NO: 573112 - protein, 9 aa, Homo Sapiens
HTQAYTLTY

SEQ ID NO: 573113 - protein, 9 aa, Homo Sapiens
YGVLGGGCG

SEQ ID NO: 573114 - protein, 9 aa, Homo Sapiens
ADPCSKAAM

SEQ ID NO: 573115 - protein, 9 aa, Homo Sapiens
AVTSLSSLL

SEQ ID NO: 573116 - protein, 9 aa, Homo Sapiens
SSSVPLLQL

SEQ ID NO: 573117 - protein, 9 aa, Homo Sapiens
VMITSTLSI

SEQ ID NO: 573118 - protein, 9 aa, Homo Sapiens
GDYQKVLLY

SEQ ID NO: 573119 - protein, 9 aa, Homo Sapiens
LWKTFWRCN

SEQ ID NO: 573120 - protein, 9 aa, Homo Sapiens
RFTFQGHED

SEQ ID NO: 573121 - protein, 9 aa, Homo Sapiens
AYTLTYTGT

SEQ ID NO: 573122 - protein, 9 aa, Homo Sapiens
GEKAMAGAY

SEQ ID NO: 573123 - protein, 9 aa, Homo Sapiens
QTHIQAQTG

SEQ ID NO: 573124 - protein, 9 aa, Homo Sapiens
RECLGTHTV

SEQ ID NO: 573125 - protein, 9 aa, Homo Sapiens
RHTGIHTDT

SEQ ID NO: 573126 - protein, 9 aa, Homo Sapiens
KAMAGAYDA

SEQ ID NO: 573127 - protein, 9 aa, Homo Sapiens
PRDSESGCA

SEQ ID NO: 573128 - protein, 9 aa, Homo Sapiens
KHKKKCKSY

SEQ ID NO: 573129 - protein, 9 aa, Homo Sapiens
LEALGISDA

SEQ ID NO: 573130 - protein, 9 aa, Homo Sapiens
NNFQWYLDH

SEQ ID NO: 573131 - protein, 9 aa, Homo Sapiens
GDIATEFFQ

SEQ ID NO: 573132 - protein, 9 aa, Homo Sapiens
QAYTLTYTG

SEQ ID NO: 573133 - protein, 9 aa, Homo Sapiens
HRNTQAHTG

SEQ ID NO: 573134 - protein, 9 aa, Homo Sapiens
HTGIHTDTD

SEQ ID NO: 573135 - protein, 9 aa, Homo Sapiens
NNVIYLYRS

SEQ ID NO: 573136 - protein, 9 aa, Homo Sapiens
VLGGGCGCG

SEQ ID NO: 573137 - protein, 9 aa, Homo Sapiens
HRYTHRHTQ

SEQ ID NO: 573138 - protein, 9 aa, Homo Sapiens
AGGNSKGRR

SEQ ID NO: 573139 - protein, 9 aa, Homo Sapiens
TSLSSLLTF

SEQ ID NO: 573140 - protein, 9 aa, Homo Sapiens
YYSLPKSFK

SEQ ID NO: 573141 - protein, 9 aa, Homo Sapiens
THRHTHTHR

SEQ ID NO: 573142 - protein, 9 aa, Homo Sapiens
CNLSQPSEA

SEQ ID NO: 573143 - protein, 9 aa, Homo Sapiens
ALRKSLKCN

SEQ ID NO: 573144 - protein, 9 aa, Homo Sapiens
SIEPRCGSL

SEQ ID NO: 573145 - protein, 9 aa, Homo Sapiens
THSKPVLTG

SEQ ID NO: 573146 - protein, 9 aa, Homo Sapiens
AHGVPGAWE

SEQ ID NO: 573147 - protein, 9 aa, Homo Sapiens
YGCTTLPNG

SEQ ID NO: 573148 - protein, 9 aa, Homo Sapiens
SLKCNNFQW

SEQ ID NO: 573149 - protein, 9 aa, Homo Sapiens
KLNVFNNFI

SEQ ID NO: 573150 - protein, 9 aa, Homo Sapiens
NRLYPSVAY

SEQ ID NO: 573151 - protein, 9 aa, Homo Sapiens
MVLASSSVP

SEQ ID NO: 573152 - protein, 9 aa, Homo Sapiens
GTHRHTHTH

SEQ ID NO: 573153 - protein, 9 aa, Homo Sapiens
KTFWRCNLS

SEQ ID NO: 573154 - protein, 9 aa, Homo Sapiens
RYTHRHTQA

SEQ ID NO: 573155 - protein, 9 aa, Homo Sapiens
HTGIHTDTH

SEQ ID NO: 573156 - protein, 9 aa, Homo Sapiens
VFSIEPRCG

SEQ ID NO: 573157 - protein, 9 aa, Homo Sapiens
QAQTGTHRH

SEQ ID NO: 573158 - protein, 9 aa, Homo Sapiens
FCPSPRDSE

SEQ ID NO: 573159 - protein, 9 aa, Homo Sapiens
GGKATPGYH

SEQ ID NO: 573160 - protein, 9 aa, Homo Sapiens
VDAWISSKV

SEQ ID NO: 573161 - protein, 9 aa, Homo Sapiens
TAVTSLSSL

SEQ ID NO: 573162 - protein, 9 aa, Homo Sapiens
HTDTDTHSH

SEQ ID NO: 573163 - protein, 9 aa, Homo Sapiens
TQAYTQTHI

SEQ ID NO: 573164 - protein, 9 aa, Homo Sapiens
IYLMYHFAR

SEQ ID NO: 573165 - protein, 9 aa, Homo Sapiens
QLTSSELMV

SEQ ID NO: 573166 - protein, 9 aa, Homo Sapiens
ELGSPVQRI

SEQ ID NO: 573167 - protein, 9 aa, Homo Sapiens
SSELMVITR

SEQ ID NO: 573168 - protein, 9 aa, Homo Sapiens
APPQELGSP

SEQ ID NO: 573169 - protein, 9 aa, Homo Sapiens
HTHTHRYTH

SEQ ID NO: 573170 - protein, 9 aa, Homo Sapiens
LRKSLKCNN

SEQ ID NO: 573171 - protein, 9 aa, Homo Sapiens
RNSFEVCVC

SEQ ID NO: 573172 - protein, 9 aa, Homo Sapiens
VPVSLLLSV

SEQ ID NO: 573173 - protein, 9 aa, Homo Sapiens
FTFQGHEDP

SEQ ID NO: 573174 - protein, 9 aa, Homo Sapiens
RDSESGCAS

SEQ ID NO: 573175 - protein, 9 aa, Homo Sapiens
YTGTHRHTH

SEQ ID NO: 573176 - protein, 9 aa, Homo Sapiens
YSLRNKEAM

SEQ ID NO: 573177 - protein, 9 aa, Homo Sapiens
HTVVVMGGK

SEQ ID NO: 573178 - protein, 9 aa, Homo Sapiens
RTHAYTREC

SEQ ID NO: 573179 - protein, 9 aa, Homo Sapiens
FYVSLMGVY

SEQ ID NO: 573180 - protein, 9 aa, Homo Sapiens
LGSPVQRIQ

SEQ ID NO: 573181 - protein, 9 aa, Homo Sapiens
AMGALTQVI

SEQ ID NO: 573182 - protein, 9 aa, Homo Sapiens
QTGTHRHIH

SEQ ID NO: 573183 - protein, 9 aa, Homo Sapiens
KEAMGALTQ

SEQ ID NO: 573184 - protein, 9 aa, Homo Sapiens
EFFQKLSMA

SEQ ID NO: 573185 - protein, 9 aa, Homo Sapiens
GVPGAWEAV

SEQ ID NO: 573186 - protein, 9 aa, Homo Sapiens
LGRNSFEVC

SEQ ID NO: 573187 - protein, 9 aa, Homo Sapiens
GGRAAVGQE

SEQ ID NO: 573188 - protein, 9 aa, Homo Sapiens
KEDNGYLLE

SEQ ID NO: 573189 - protein, 9 aa, Homo Sapiens
SLRNKEAMG

SEQ ID NO: 573190 - protein, 9 aa, Homo Sapiens
TSVQLAEEL

SEQ ID NO: 573191 - protein, 9 aa, Homo Sapiens
SHSWELQEL

SEQ ID NO: 573192 - protein, 9 aa, Homo Sapiens
NATLKYKVI

SEQ ID NO: 573193 - protein, 9 aa, Homo Sapiens
VQLAEELTL

SEQ ID NO: 573194 - protein, 9 aa, Homo Sapiens
ATLKYKVIH

SEQ ID NO: 573195 - protein, 9 aa, Homo Sapiens
GIHTDTDTH

SEQ ID NO: 573196 - protein, 9 aa, Homo Sapiens
EERGHYAKL

SEQ ID NO: 573197 - protein, 9 aa, Homo Sapiens
GHYAKLIHN

SEQ ID NO: 573198 - protein, 9 aa, Homo Sapiens
FAEMKERGE

SEQ ID NO: 573199 - protein, 9 aa, Homo Sapiens
FQGHEDPPE

SEQ ID NO: 573200 - protein, 9 aa, Homo Sapiens
GTWEAPVYS

SEQ ID NO: 573201 - protein, 9 aa, Homo Sapiens
SKVTPKMLN

SEQ ID NO: 573202 - protein, 9 aa, Homo Sapiens
GEKKANLER

SEQ ID NO: 573203 - protein, 9 aa, Homo Sapiens
KFIYLMYHF

SEQ ID NO: 573204 - protein, 9 aa, Homo Sapiens
ESHSWELQE

SEQ ID NO: 573205 - protein, 9 aa, Homo Sapiens
LMEERGHYA

SEQ ID NO: 573206 - protein, 9 aa, Homo Sapiens
HWLLHTWER

SEQ ID NO: 573207 - protein, 9 aa, Homo Sapiens
ERGEKKANL

SEQ ID NO: 573208 - protein, 9 aa, Homo Sapiens
IQAQTGTHR

SEQ ID NO: 573209 - protein, 9 aa, Homo Sapiens
YSLPKSFKH

SEQ ID NO: 573210 - protein, 9 aa, Homo Sapiens
EKAMAGAYD

SEQ ID NO: 573211 - protein, 9 aa, Homo Sapiens
HSRTHAYTR

SEQ ID NO: 573212 - protein, 9 aa, Homo Sapiens
YVSLMGVYL

SEQ ID NO: 573213 - protein, 9 aa, Homo Sapiens
HYAKLIHNL

SEQ ID NO: 573214 - protein, 9 aa, Homo Sapiens
TFQGHEDPP

SEQ ID NO: 573215 - protein, 9 aa, Homo Sapiens
LESHSWELQ

SEQ ID NO: 573216 - protein, 9 aa, Homo Sapiens
LLHQDLEAL

SEQ ID NO: 573217 - protein, 9 aa, Homo Sapiens
TRECLGTHT

SEQ ID NO: 573218 - protein, 9 aa, Homo Sapiens
HTGMHRHTH

SEQ ID NO: 573219 - protein, 9 aa, Homo Sapiens
NKEAMGALT

SEQ ID NO: 573220 - protein, 9 aa, Homo Sapiens
SPGGPKFIY

SEQ ID NO: 573221 - protein, 9 aa, Homo Sapiens
YYSDADGSG

SEQ ID NO: 573222 - protein, 9 aa, Homo Sapiens
IGGKATPGY

SEQ ID NO: 573223 - protein, 9 aa, Homo Sapiens
KGDYQKVLL

SEQ ID NO: 573224 - protein, 9 aa, Homo Sapiens
TGTWEAPVY

SEQ ID NO: 573225 - protein, 9 aa, Homo Sapiens
THRYTHRHT

SEQ ID NO: 573226 - protein, 9 aa, Homo Sapiens
HSKPVLTGT

SEQ ID NO: 573227 - protein, 9 aa, Homo Sapiens
AQTGTHRHI

SEQ ID NO: 573228 - protein, 9 aa, Homo Sapiens
KVIHFGNSS

SEQ ID NO: 573229 - protein, 9 aa, Homo Sapiens
GMHRHTHTQ

SEQ ID NO: 573230 - protein, 9 aa, Homo Sapiens
ERGHYAKLI

SEQ ID NO: 573231 - protein, 9 aa, Homo Sapiens
GNSKGRRGS

SEQ ID NO: 573232 - protein, 9 aa, Homo Sapiens
KYKVIHFGN

SEQ ID NO: 573233 - protein, 9 aa, Homo Sapiens
TGTHRHTHT

SEQ ID NO: 573234 - protein, 9 aa, Homo Sapiens
PTSVQLAEE

SEQ ID NO: 573235 - protein, 9 aa, Homo Sapiens
PANRLYPSV

SEQ ID NO: 573236 - protein, 9 aa, Homo Sapiens
LVPVSLLLS

SEQ ID NO: 573237 - protein, 9 aa, Homo Sapiens
LASSSVPLL

SEQ ID NO: 573238 - protein, 9 aa, Homo Sapiens
VLSYYSLPK

SEQ ID NO: 573239 - protein, 9 aa, Homo Sapiens
YSDADGSGP

SEQ ID NO: 573240 - protein, 9 aa, Homo Sapiens
LRNKEAMGA

SEQ ID NO: 573241 - protein, 9 aa, Homo Sapiens
TDTHRNTQA

SEQ ID NO: 573242 - protein, 9 aa, Homo Sapiens
HHAYGDQYR

SEQ ID NO: 573243 - protein, 9 aa, Homo Sapiens
YTHRHTQAY

SEQ ID NO: 573244 - protein, 9 aa, Homo Sapiens
VLASSSVPL

SEQ ID NO: 573245 - protein, 9 aa, Homo Sapiens
TDTHSHRHT

SEQ ID NO: 573246 - protein, 9 aa, Homo Sapiens
HRHTGMHRH

SEQ ID NO: 573247 - protein, 9 aa, Homo Sapiens
FNNFIGLLQ

SEQ ID NO: 573248 - protein, 9 aa, Homo Sapiens
ELMEERGHY

SEQ ID NO: 573249 - protein, 9 aa, Homo Sapiens
EFAEMKERG

SEQ ID NO: 573250 - protein, 9 aa, Homo Sapiens
GGKEDNGYL

SEQ ID NO: 573251 - protein, 9 aa, Homo Sapiens
SKTRAGGNS

SEQ ID NO: 573252 - protein, 9 aa, Homo Sapiens
TRKHKKKCK

SEQ ID NO: 573253 - protein, 9 aa, Homo Sapiens
SGGGEKAMA

SEQ ID NO: 573254 - protein, 9 aa, Homo Sapiens
VLLFYVSLM

SEQ ID NO: 573255 - protein, 9 aa, Homo Sapiens
LGGGCGCGC

SEQ ID NO: 573256 - protein, 9 aa, Homo Sapiens
NGYLLEKKI

SEQ ID NO: 573257 - protein, 9 aa, Homo Sapiens
RHIHSRTHA

SEQ ID NO: 573258 - protein, 9 aa, Homo Sapiens
YTRECLGTH

SEQ ID NO: 573259 - protein, 9 aa, Homo Sapiens
DAWISSKVT

SEQ ID NO: 573260 - protein, 9 aa, Homo Sapiens
ESTRKHKKK

SEQ ID NO: 573261 - protein, 9 aa, Homo Sapiens
DTHSHRHTH

SEQ ID NO: 573262 - protein, 9 aa, Homo Sapiens
ITAVTSLSS

SEQ ID NO: 573263 - protein, 9 aa, Homo Sapiens
IIGGKATPG

SEQ ID NO: 573264 - protein, 9 aa, Homo Sapiens
TQAHTGIHT

SEQ ID NO: 573265 - protein, 9 aa, Homo Sapiens
LKEADPCSK

SEQ ID NO: 573266 - protein, 9 aa, Homo Sapiens
QGHEDPPEE

SEQ ID NO: 573267 - protein, 9 aa, Homo Sapiens
HTHTQAYTL

SEQ ID NO: 573268 - protein, 9 aa, Homo Sapiens
TVVVMGGKE

SEQ ID NO: 573269 - protein, 9 aa, Homo Sapiens
STRKHKKKC

SEQ ID NO: 573270 - protein, 9 aa, Homo Sapiens
RKHKKKCKS

SEQ ID NO: 573271 - protein, 9 aa, Homo Sapiens
RKSLKCNNF

SEQ ID NO: 573272 - protein, 9 aa, Homo Sapiens
KPIIIGHHA

SEQ ID NO: 573273 - protein, 9 aa, Homo Sapiens
DVIQRTHSK

SEQ ID NO: 573274 - protein, 9 aa, Homo Sapiens
YPSVAYDAF

SEQ ID NO: 573275 - protein, 9 aa, Homo Sapiens
GPGSGGGEK

SEQ ID NO: 573276 - protein, 9 aa, Homo Sapiens
GNPSGLYYS

SEQ ID NO: 573277 - protein, 9 aa, Homo Sapiens
NSSKTRAGG

SEQ ID NO: 573278 - protein, 9 aa, Homo Sapiens
SVAYDAFPL

SEQ ID NO: 573279 - protein, 9 aa, Homo Sapiens
SDADGSGPL

SEQ ID NO: 573280 - protein, 9 aa, Homo Sapiens
FFQKLSMAV

SEQ ID NO: 573281 - protein, 9 aa, Homo Sapiens
KERGEKKAN

SEQ ID NO: 573282 - protein, 9 aa, Homo Sapiens
RHTHTHRYT

SEQ ID NO: 573283 - protein, 9 aa, Homo Sapiens
THRNTQAHT

SEQ ID NO: 573284 - protein, 9 aa, Homo Sapiens
LNVFNNFIG

SEQ ID NO: 573285 - protein, 9 aa, Homo Sapiens
TQAYTLTYT

SEQ ID NO: 573286 - protein, 9 aa, Homo Sapiens
HSHRHTHTH

SEQ ID NO: 573287 - protein, 9 aa, Homo Sapiens
SLLHQDLEA

SEQ ID NO: 573288 - protein, 9 aa, Homo Sapiens
KVLLYLCGG

SEQ ID NO: 573289 - protein, 9 aa, Homo Sapiens
MEERGHYAK

SEQ ID NO: 573290 - protein, 9 aa, Homo Sapiens
THTQAYTLT

SEQ ID NO: 573291 - protein, 9 aa, Homo Sapiens
NTQAHTGIH

SEQ ID NO: 573292 - protein, 9 aa, Homo Sapiens
PSPRDSESG

SEQ ID NO: 573293 - protein, 9 aa, Homo Sapiens
SLSSLLTFS

SEQ ID NO: 573294 - protein, 9 aa, Homo Sapiens
ELMVITRKM

SEQ ID NO: 573295 - protein, 9 aa, Homo Sapiens
LPNGHREEG

SEQ ID NO: 573296 - protein, 9 aa, Homo Sapiens
FQKLNVFNN

SEQ ID NO: 573297 - protein, 9 aa, Homo Sapiens
CLGTHTVVV

SEQ ID NO: 573298 - protein, 9 aa, Homo Sapiens
DYQKVLLYL

SEQ ID NO: 573299 - protein, 9 aa, Homo Sapiens
GTHRHIHSR

SEQ ID NO: 573300 - protein, 9 aa, Homo Sapiens
TSSELMVIT

SEQ ID NO: 573301 - protein, 9 aa, Homo Sapiens
DPCSKAAMR

SEQ ID NO: 573302 - protein, 9 aa, Homo Sapiens
LHTWERLHK

SEQ ID NO: 573303 - protein, 9 aa, Homo Sapiens
SSVPLLQLE

SEQ ID NO: 573304 - protein, 9 aa, Homo Sapiens
TEVFSIEPR

SEQ ID NO: 573305 - protein, 9 aa, Homo Sapiens
YYVMITSTL

SEQ ID NO: 573306 - protein, 9 aa, Homo Sapiens
FFQKLNVFN

SEQ ID NO: 573307 - protein, 9 aa, Homo Sapiens
HTQAYTQTH

SEQ ID NO: 573308 - protein, 9 aa, Homo Sapiens
VTSLSSLLT

SEQ ID NO: 573309 - protein, 9 aa, Homo Sapiens
TWEAPVYSS

SEQ ID NO: 573310 - protein, 9 aa, Homo Sapiens
LKCNNFQWY

SEQ ID NO: 573311 - protein, 9 aa, Homo Sapiens
KATPGYHMA

SEQ ID NO: 573312 - protein, 9 aa, Homo Sapiens
LPNNVIYLY

SEQ ID NO: 573313 - protein, 9 aa, Homo Sapiens
RAGGNSKGR

SEQ ID NO: 573314 - protein, 9 aa, Homo Sapiens
FIYLMYHFA

SEQ ID NO: 573315 - protein, 9 aa, Homo Sapiens
RGHYAKLIH

SEQ ID NO: 573316 - protein, 9 aa, Homo Sapiens
TPGYHMAKM

SEQ ID NO: 573317 - protein, 9 aa, Homo Sapiens
RHTQAYTQT

SEQ ID NO: 573318 - protein, 9 aa, Homo Sapiens
GGGCGCGCG

SEQ ID NO: 573319 - protein, 9 aa, Homo Sapiens
RGEKKANLE

SEQ ID NO: 573320 - protein, 9 aa, Homo Sapiens
PSLLHQDLE

SEQ ID NO: 573321 - protein, 9 aa, Homo Sapiens
QTATGAHGV

SEQ ID NO: 573322 - protein, 9 aa, Homo Sapiens
PCSKAAMRR

SEQ ID NO: 573323 - protein, 9 aa, Homo Sapiens
LYPSVAYDA

SEQ ID NO: 573324 - protein, 9 aa, Homo Sapiens
SSKTRAGGN

SEQ ID NO: 573325 - protein, 9 aa, Homo Sapiens
GAIAHWLLH

SEQ ID NO: 573326 - protein, 9 aa, Homo Sapiens
ILESHSWEL

SEQ ID NO: 573327 - protein, 9 aa, Homo Sapiens
WVKPIIIGH

SEQ ID NO: 573328 - protein, 9 aa, Homo Sapiens
QELGSPVQR

SEQ ID NO: 573329 - protein, 9 aa, Homo Sapiens
TFWRCNLSQ

SEQ ID NO: 573330 - protein, 9 aa, Homo Sapiens
GAHGVPGAW

SEQ ID NO: 573331 - protein, 9 aa, Homo Sapiens
KVTPKMLNN

SEQ ID NO: 573332 - protein, 9 aa, Homo Sapiens
IAHWLLHTW

SEQ ID NO: 573333 - protein, 9 aa, Homo Sapiens
FSIEPRCGS

SEQ ID NO: 573334 - protein, 9 aa, Homo Sapiens
YQKVLLYLC

SEQ ID NO: 573335 - protein, 9 aa, Homo Sapiens
AGVYYVMIT

SEQ ID NO: 573336 - protein, 9 aa, Homo Sapiens
YMVLASSSV

SEQ ID NO: 573337 - protein, 9 aa, Homo Sapiens
HAYTRECLG

SEQ ID NO: 573338 - protein, 9 aa, Homo Sapiens
WISSKVTPK

SEQ ID NO: 573339 - protein, 9 aa, Homo Sapiens
CWLPNNVIY

SEQ ID NO: 573340 - protein, 9 aa, Homo Sapiens
THRHIHSRT

SEQ ID NO: 573341 - protein, 9 aa, Homo Sapiens
VYSSTSGLE

SEQ ID NO: 573342 - protein, 9 aa, Homo Sapiens
LRFTFQGHE

SEQ ID NO: 573343 - protein, 9 aa, Homo Sapiens
GYGCTTLPN

SEQ ID NO: 573344 - protein, 9 aa, Homo Sapiens
QAHTGIHTD

SEQ ID NO: 573345 - protein, 9 aa, Homo Sapiens
THTVVVMGG

SEQ ID NO: 573346 - protein, 9 aa, Homo Sapiens
EAPVYSSTS

SEQ ID NO: 573347 - protein, 9 aa, Homo Sapiens
LTVVLLFYV

SEQ ID NO: 573348 - protein, 9 aa, Homo Sapiens
LSYYSLPKS

SEQ ID NO: 573349 - protein, 9 aa, Homo Sapiens
ATGAHGVPG

SEQ ID NO: 573350 - protein, 9 aa, Homo Sapiens
LGTHTVVVM

SEQ ID NO: 573351 - protein, 9 aa, Homo Sapiens
DNGYLLEKK

SEQ ID NO: 573352 - protein, 9 aa, Homo Sapiens
THRHTQAYT

SEQ ID NO: 573353 - protein, 9 aa, Homo Sapiens
VYYVMITST

SEQ ID NO: 573354 - protein, 9 aa, Homo Sapiens
CFCPSPRDS

SEQ ID NO: 573355 - protein, 9 aa, Homo Sapiens
HTWERLHKG

SEQ ID NO: 573356 - protein, 9 aa, Homo Sapiens
TVIIGGKAT

SEQ ID NO: 573357 - protein, 9 aa, Homo Sapiens
VVLLFYVSL

SEQ ID NO: 573358 - protein, 9 aa, Homo Sapiens
EADPCSKAA

SEQ ID NO: 573359 - protein, 9 aa, Homo Sapiens
DTKGDYQKV

SEQ ID NO: 573360 - protein, 9 aa, Homo Sapiens
WEAPVYSST

SEQ ID NO: 573361 - protein, 9 aa, Homo Sapiens
HRHTQAYTQ

SEQ ID NO: 573362 - protein, 9 aa, Homo Sapiens
TAPGLRGRG

SEQ ID NO: 573363 - protein, 9 aa, Homo Sapiens
GCGCGCGYG

SEQ ID NO: 573364 - protein, 9 aa, Homo Sapiens
RLYPSVAYD

SEQ ID NO: 573365 - protein, 9 aa, Homo Sapiens
GPKFIYLMY

SEQ ID NO: 573366 - protein, 9 aa, Homo Sapiens
LQGLVPVSL

SEQ ID NO: 573367 - protein, 9 aa, Homo Sapiens
MGGKEDNGY

SEQ ID NO: 573368 - protein, 9 aa, Homo Sapiens
PNGHREEGK

SEQ ID NO: 573369 - protein, 9 aa, Homo Sapiens
GLRGRGGRA

SEQ ID NO: 573370 - protein, 9 aa, Homo Sapiens
KPTSVQLAE

SEQ ID NO: 573371 - protein, 9 aa, Homo Sapiens
YTQTHIQAQ

SEQ ID NO: 573372 - protein, 9 aa, Homo Sapiens
TLKYKVIHF

SEQ ID NO: 573373 - protein, 9 aa, Homo Sapiens
LTYTGTHRH

SEQ ID NO: 573374 - protein, 9 aa, Homo Sapiens
CSKAAMRRK

SEQ ID NO: 573375 - protein, 9 aa, Homo Sapiens
THTHRHTGI

SEQ ID NO: 573376 - protein, 9 aa, Homo Sapiens
TLPNGHREE

SEQ ID NO: 573377 - protein, 9 aa, Homo Sapiens
PHMLRFTFQ

SEQ ID NO: 573378 - protein, 9 aa, Homo Sapiens
MKERGEKKA

SEQ ID NO: 573379 - protein, 9 aa, Homo Sapiens
GIHTDTHRN

SEQ ID NO: 573380 - protein, 9 aa, Homo Sapiens
IIIGHHAYG

SEQ ID NO: 573381 - protein, 9 aa, Homo Sapiens
IHSRTHAYT

SEQ ID NO: 573382 - protein, 9 aa, Homo Sapiens
HTHTHRHTG

SEQ ID NO: 573383 - protein, 9 aa, Homo Sapiens
THTHRYTHR

SEQ ID NO: 573384 - protein, 9 aa, Homo Sapiens
VIIGGKATP

SEQ ID NO: 573385 - protein, 9 aa, Homo Sapiens
HTHRHTGIH

SEQ ID NO: 573386 - protein, 9 aa, Homo Sapiens
GGEKAMAGA

SEQ ID NO: 573387 - protein, 9 aa, Homo Sapiens
RHTHTHRHT

SEQ ID NO: 573388 - protein, 9 aa, Homo Sapiens
SELMVITRK

SEQ ID NO: 573389 - protein, 9 aa, Homo Sapiens
FAFCWLPNN

SEQ ID NO: 573390 - protein, 9 aa, Homo Sapiens
LPKSFKHTQ

SEQ ID NO: 573391 - protein, 9 aa, Homo Sapiens
AEMKERGEK

SEQ ID NO: 573392 - protein, 9 aa, Homo Sapiens
SYYSLPKSF

SEQ ID NO: 573393 - protein, 9 aa, Homo Sapiens
ISSKVTPKM

SEQ ID NO: 573394 - protein, 9 aa, Homo Sapiens
MLQGLVPVS

SEQ ID NO: 573395 - protein, 9 aa, Homo Sapiens
TAGVYYVMI

SEQ ID NO: 573396 - protein, 9 aa, Homo Sapiens
PGGPKFIYL

SEQ ID NO: 573397 - protein, 9 aa, Homo Sapiens
SLLTFSKFC

SEQ ID NO: 573398 - protein, 9 aa, Homo Sapiens
NGHREEGKY

SEQ ID NO: 573399 - protein, 9 aa, Homo Sapiens
LMVITRKMA

SEQ ID NO: 573400 - protein, 9 aa, Homo Sapiens
ASSSVPLLQ

SEQ ID NO: 573401 - protein, 9 aa, Homo Sapiens
IHTDTHRNT

SEQ ID NO: 573402 - protein, 9 aa, Homo Sapiens
NEYMVLASS

SEQ ID NO: 573403 - protein, 9 aa, Homo Sapiens
DLEALGISD

SEQ ID NO: 573404 - protein, 9 aa, Homo Sapiens
DTDTHSHRH

SEQ ID NO: 573405 - protein, 9 aa, Homo Sapiens
TLWKTFWRC

SEQ ID NO: 573406 - protein, 9 aa, Homo Sapiens
NNFIGLLQN

SEQ ID NO: 573407 - protein, 9 aa, Homo Sapiens
HTHRYTHRH

SEQ ID NO: 573408 - protein, 9 aa, Homo Sapiens
SRTHAYTRE

SEQ ID NO: 573409 - protein, 9 aa, Homo Sapiens
LTSSELMVI

SEQ ID NO: 573410 - protein, 9 aa, Homo Sapiens
QKVLLYLCG

SEQ ID NO: 573411 - protein, 9 aa, Homo Sapiens
MVITRKMAA

SEQ ID NO: 573412 - protein, 9 aa, Homo Sapiens
DIATEFFQK

SEQ ID NO: 573413 - protein, 9 aa, Homo Sapiens
TEFFQKLSM

SEQ ID NO: 573414 - protein, 9 aa, Homo Sapiens
WLPNNVIYL

SEQ ID NO: 573415 - protein, 9 aa, Homo Sapiens
RTHSKPVLT

SEQ ID NO: 573416 - protein, 9 aa, Homo Sapiens
GGCGCGCGY

SEQ ID NO: 573417 - protein, 9 aa, Homo Sapiens
TGIHTDTDT

SEQ ID NO: 573418 - protein, 9 aa, Homo Sapiens
LAEELTLPE

SEQ ID NO: 573419 - protein, 9 aa, Homo Sapiens
RNTQAHTGI

SEQ ID NO: 573420 - protein, 9 aa, Homo Sapiens
SPVQRIQMT

SEQ ID NO: 573421 - protein, 9 aa, Homo Sapiens
GGNSKGRRG

SEQ ID NO: 573422 - protein, 9 aa, Homo Sapiens
EELTLPEQT

SEQ ID NO: 573423 - protein, 9 aa, Homo Sapiens
RCNLSQPSE

SEQ ID NO: 573424 - protein, 9 aa, Homo Sapiens
KKKCKSYLK

SEQ ID NO: 573425 - protein, 9 aa, Homo Sapiens
NVFNNFIGL

SEQ ID NO: 573426 - protein, 9 aa, Homo Sapiens
NVIYLYRSY

SEQ ID NO: 573427 - protein, 9 aa, Homo Sapiens
YTLTYTGTH

SEQ ID NO: 573428 - protein, 9 aa, Homo Sapiens
PSGLYYSDA

SEQ ID NO: 573429 - protein, 9 aa, Homo Sapiens
KSFKHTQRP

SEQ ID NO: 573430 - protein, 9 aa, Homo Sapiens
MLRFTFQGH

SEQ ID NO: 573431 - protein, 9 aa, Homo Sapiens
TDTDTHSHR

SEQ ID NO: 573432 - protein, 9 aa, Homo Sapiens
VFNNFIGLL

SEQ ID NO: 573433 - protein, 9 aa, Homo Sapiens
EAMGALTQV

SEQ ID NO: 573434 - protein, 9 aa, Homo Sapiens
TGMHRHTHT

SEQ ID NO: 573435 - protein, 9 aa, Homo Sapiens
SNATLKYKV

SEQ ID NO: 573436 - protein, 9 aa, Homo Sapiens
AIAHWLLHT

SEQ ID NO: 573437 - protein, 9 aa, Homo Sapiens
IHTDTDTHS

SEQ ID NO: 573438 - protein, 9 aa, Homo Sapiens
YVMITSTLS

SEQ ID NO: 573439 - protein, 9 aa, Homo Sapiens
FWRCNLSQP

SEQ ID NO: 573440 - protein, 9 aa, Homo Sapiens
GRGGRAAVG

SEQ ID NO: 573441 - protein, 9 aa, Homo Sapiens
PGLRGRGGR

SEQ ID NO: 573442 - protein, 9 aa, Homo Sapiens
GLVPVSLLL

SEQ ID NO: 573443 - protein, 9 aa, Homo Sapiens
SFEVCVCAC

SEQ ID NO: 573444 - protein, 9 aa, Homo Sapiens
QRTHSKPVL

SEQ ID NO: 573445 - protein, 9 aa, Homo Sapiens
QKLSMAVNL

SEQ ID NO: 573446 - protein, 9 aa, Homo Sapiens
GYLLEKKIY

SEQ ID NO: 573447 - protein, 9 aa, Homo Sapiens
WRCNLSQPS

SEQ ID NO: 573448 - protein, 9 aa, Homo Sapiens
LTLKEADPC

SEQ ID NO: 573449 - protein, 9 aa, Homo Sapiens
HMLRFTFQG

SEQ ID NO: 573450 - protein, 9 aa, Homo Sapiens
VKPIIIGHH

SEQ ID NO: 573451 - protein, 9 aa, Homo Sapiens
VCVCACPGR

SEQ ID NO: 573452 - protein, 9 aa, Homo Sapiens
CPSPRDSES

SEQ ID NO: 573453 - protein, 9 aa, Homo Sapiens
PQELGSPVQ

SEQ ID NO: 573454 - protein, 9 aa, Homo Sapiens
GGGEKAMAG

SEQ ID NO: 573455 - protein, 9 aa, Homo Sapiens
GRNSFEVCV

SEQ ID NO: 573456 - protein, 9 aa, Homo Sapiens
VVMGGKEDN

SEQ ID NO: 573457 - protein, 9 aa, Homo Sapiens
IGHHAYGDQ

SEQ ID NO: 573458 - protein, 9 aa, Homo Sapiens
AFCWLPNNV

SEQ ID NO: 573459 - protein, 9 aa, Homo Sapiens
AHTGIHTDT

SEQ ID NO: 573460 - protein, 9 aa, Homo Sapiens
IYSLRNKEA

SEQ ID NO: 573461 - protein, 9 aa, Homo Sapiens
WLLHTWERL

SEQ ID NO: 573462 - protein, 9 aa, Homo Sapiens
WELQELERK

SEQ ID NO: 573463 - protein, 9 aa, Homo Sapiens
VIHFGNSSG

SEQ ID NO: 573464 - protein, 9 aa, Homo Sapiens
KSLKCNNFQ

SEQ ID NO: 573465 - protein, 9 aa, Homo Sapiens
AYTRECLGT

SEQ ID NO: 573466 - protein, 9 aa, Homo Sapiens
SHRHTHTHR

SEQ ID NO: 573467 - protein, 9 aa, Homo Sapiens
SVQLAEELT

SEQ ID NO: 573468 - protein, 9 aa, Homo Sapiens
QKLNVFNNF

SEQ ID NO: 573469 - protein, 9 aa, Homo Sapiens
EDNGYLLEK

SEQ ID NO: 573470 - protein, 9 aa, Homo Sapiens
HKKKCKSYL

SEQ ID NO: 573471 - protein, 9 aa, Homo Sapiens
IIGHHAYGD

SEQ ID NO: 573472 - protein, 9 aa, Homo Sapiens
HRHIHSRTH

SEQ ID NO: 573473 - protein, 9 aa, Homo Sapiens
RNKEAMGAL

SEQ ID NO: 573474 - protein, 9 aa, Homo Sapiens
RGRGGRAAV

SEQ ID NO: 573475 - protein, 9 aa, Homo Sapiens
AYTQTHIQA

SEQ ID NO: 573476 - protein, 9 aa, Homo Sapiens
ECLGTHTVV

SEQ ID NO: 573477 - protein, 9 aa, Homo Sapiens
WKTFWRCNL

SEQ ID NO: 573478 - protein, 9 aa, Homo Sapiens
TLKEADPCS

SEQ ID NO: 573479 - protein, 9 aa, Homo Sapiens
RESTRKHKK

SEQ ID NO: 573480 - protein, 9 aa, Homo Sapiens
YSSTSGLEQ

SEQ ID NO: 573481 - protein, 9 aa, Homo Sapiens
AWISSKVTP

SEQ ID NO: 573482 - protein, 9 aa, Homo Sapiens
APVYSSTSG

SEQ ID NO: 573483 - protein, 9 aa, Homo Sapiens
EMKERGEKK

SEQ ID NO: 573484 - protein, 9 aa, Homo Sapiens
CGCGCGYGH

SEQ ID NO: 573485 - protein, 9 aa, Homo Sapiens
SLPKSFKHT

SEQ ID NO: 573486 - protein, 9 aa, Homo Sapiens
YLMYHFARF

SEQ ID NO: 573487 - protein, 9 aa, Homo Sapiens
GGPKFIYLM

SEQ ID NO: 573488 - protein, 9 aa, Homo Sapiens
MHRHTHTQA

SEQ ID NO: 573489 - protein, 9 aa, Homo Sapiens
SPRDSESGC

SEQ ID NO: 573490 - protein, 9 aa, Homo Sapiens
KTRAGGNSK

SEQ ID NO: 573491 - protein, 9 aa, Homo Sapiens
FQKLSMAVN

SEQ ID NO: 573492 - protein, 9 aa, Homo Sapiens
FEVCVCACP

SEQ ID NO: 573493 - protein, 9 aa, Homo Sapiens
KELMEERGH

SEQ ID NO: 573494 - protein, 9 aa, Homo Sapiens
LFYVSLMGV

SEQ ID NO: 573495 - protein, 9 aa, Homo Sapiens
VDVIQRTHS

SEQ ID NO: 573496 - protein, 9 aa, Homo Sapiens
PGSGGGEKA

SEQ ID NO: 573497 - protein, 9 aa, Homo Sapiens
VMGGKEDNG

SEQ ID NO: 573498 - protein, 9 aa, Homo Sapiens
VPGAWEAVA

SEQ ID NO: 573499 - protein, 9 aa, Homo Sapiens
SGLYYSDAD

SEQ ID NO: 573500 - protein, 9 aa, Homo Sapiens
PNNVIYLYR

SEQ ID NO: 573501 - protein, 9 aa, Homo Sapiens
NRESTRKHK

SEQ ID NO: 573502 - protein, 9 aa, Homo Sapiens
TVVLLFYVS

SEQ ID NO: 573503 - protein, 9 aa, Homo Sapiens
EPRCGSLLG

SEQ ID NO: 573504 - protein, 9 aa, Homo Sapiens
ATPGYHMAK

SEQ ID NO: 573505 - protein, 9 aa, Homo Sapiens
APGLRGRGG

SEQ ID NO: 573506 - protein, 9 aa, Homo Sapiens
HIQAQTGTH

SEQ ID NO: 573507 - protein, 9 aa, Homo Sapiens
PIIIGHHAY

SEQ ID NO: 573508 - protein, 9 aa, Homo Sapiens
QDLEALGIS

SEQ ID NO: 573509 - protein, 9 aa, Homo Sapiens
VLLYLCGGD

SEQ ID NO: 573510 - protein, 9 aa, Homo Sapiens
IATEFFQKL

SEQ ID NO: 573511 - protein, 9 aa, Homo Sapiens
GVLGGGCGC

SEQ ID NO: 573512 - protein, 9 aa, Homo Sapiens
CVCACPGRD

SEQ ID NO: 573513 - protein, 9 aa, Homo Sapiens
LKYKVIHFG

SEQ ID NO: 573514 - protein, 9 aa, Homo Sapiens
QGLVPVSLL

SEQ ID NO: 573515 - protein, 9 aa, Homo Sapiens
HRHTHTQAY

SEQ ID NO: 573516 - protein, 9 aa, Homo Sapiens
RHTGMHRHT

SEQ ID NO: 573517 - protein, 9 aa, Homo Sapiens
ATEFFQKLS

SEQ ID NO: 573518 - protein, 9 aa, Homo Sapiens
QAYTQTHIQ

SEQ ID NO: 573519 - protein, 9 aa, Homo Sapiens
KCNNFQWYL

SEQ ID NO: 573520 - protein, 9 aa, Homo Sapiens
GLYYSDADG

SEQ ID NO: 573521 - protein, 9 aa, Homo Sapiens
HAPPQELGS

SEQ ID NO: 573522 - protein, 9 aa, Homo Sapiens
GCTTLPNGH

SEQ ID NO: 573523 - protein, 9 aa, Homo Sapiens
EALGISDAP

SEQ ID NO: 573524 - protein, 9 aa, Homo Sapiens
PSVAYDAFP

SEQ ID NO: 573525 - protein, 9 aa, Homo Sapiens
MITSTLSIF

SEQ ID NO: 573526 - protein, 9 aa, Homo Sapiens
IEPRCGSLL

SEQ ID NO: 573527 - protein, 9 aa, Homo Sapiens
TRAGGNSKG

SEQ ID NO: 573528 - protein, 9 aa, Homo Sapiens
ITSTLSIFQ

SEQ ID NO: 573529 - protein, 9 aa, Homo Sapiens
HQDLEALGI

SEQ ID NO: 573530 - protein, 9 aa, Homo Sapiens
RCGSLLGGT

SEQ ID NO: 573531 - protein, 9 aa, Homo Sapiens
ANRLYPSVA

SEQ ID NO: 573532 - protein, 9 aa, Homo Sapiens
THAYTRECL

SEQ ID NO: 573533 - protein, 9 aa, Homo Sapiens
DSESGCASS

SEQ ID NO: 573534 - protein, 9 aa, Homo Sapiens
PKFIYLMYH

SEQ ID NO: 573535 - protein, 9 aa, Homo Sapiens
HGVPGAWEA

SEQ ID NO: 573536 - protein, 9 aa, Homo Sapiens
GVYYVMITS

SEQ ID NO: 573537 - protein, 9 aa, Homo Sapiens
CNNFQWYLD

SEQ ID NO: 573538 - protein, 9 aa, Homo Sapiens
HSWELQELE

SEQ ID NO: 573539 - protein, 9 aa, Homo Sapiens
GSGGGEKAM

SEQ ID NO: 573540 - protein, 9 aa, Homo Sapiens
PKSFKHTQR

SEQ ID NO: 573541 - protein, 9 aa, Homo Sapiens
SSLLTFSKF

SEQ ID NO: 573542 - protein, 9 aa, Homo Sapiens
FCWLPNNVI

SEQ ID NO: 573543 - protein, 9 aa, Homo Sapiens
KEADPCSKA

SEQ ID NO: 573544 - protein, 9 aa, Homo Sapiens
TYTGTHRHT

SEQ ID NO: 573545 - protein, 9 aa, Homo Sapiens
SWELQELER

SEQ ID NO: 573546 - protein, 9 aa, Homo Sapiens
LRGRGGRAA

SEQ ID NO: 573547 - protein, 9 aa, Homo Sapiens
TLTYTGTHR

SEQ ID NO: 573548 - protein, 9 aa, Homo Sapiens
TQILESHSW

SEQ ID NO: 573549 - protein, 9 aa, Homo Sapiens
PRCGSLLGG

SEQ ID NO: 573550 - protein, 9 aa, Homo Sapiens
FVDAWISSK

SEQ ID NO: 573551 - protein, 9 aa, Homo Sapiens
HRHTHTHRY

SEQ ID NO: 573552 - protein, 9 aa, Homo Sapiens
TGAHGVPGA

SEQ ID NO: 573553 - protein, 9 aa, Homo Sapiens
SSKVTPKML

SEQ ID NO: 573554 - protein, 9 aa, Homo Sapiens
HRHTHTHRH

SEQ ID NO: 573555 - protein, 9 aa, Homo Sapiens
NPSGLYYSD

SEQ ID NO: 573556 - protein, 9 aa, Homo Sapiens
RGGRAAVGQ

SEQ ID NO: 573557 - protein, 9 aa, Homo Sapiens
THIQAQTGT

SEQ ID NO: 573558 - protein, 9 aa, Homo Sapiens
GYGVLGGGC

SEQ ID NO: 573559 - protein, 9 aa, Homo Sapiens
KVDVIQRTH

SEQ ID NO: 573560 - protein, 9 aa, Homo Sapiens
NSFEVCVCA

SEQ ID NO: 573561 - protein, 9 aa, Homo Sapiens
HIHSRTHAY

SEQ ID NO: 573562 - protein, 9 aa, Homo Sapiens
THSHRHTHT

SEQ ID NO: 573563 - protein, 9 aa, Homo Sapiens
IQRTHSKPV

SEQ ID NO: 573564 - protein, 9 aa, Homo Sapiens
SESGCASSP

SEQ ID NO: 573565 - protein, 9 aa, Homo Sapiens
TGTHRHIHS

SEQ ID NO: 573566 - protein, 9 aa, Homo Sapiens
CTTLPNGHR

SEQ ID NO: 573567 - protein, 9 aa, Homo Sapiens
LSSLLTFSK

SEQ ID NO: 573568 - protein, 9 aa, Homo Sapiens
TQTHIQAQT

SEQ ID NO: 573569 - protein, 9 aa, Homo Sapiens
PPQELGSPV

SEQ ID NO: 573570 - protein, 9 aa, Homo Sapiens
HTDTHRNTQ

SEQ ID NO: 573571 - protein, 9 aa, Homo Sapiens
PVYSSTSGL

SEQ ID NO: 573572 - protein, 9 aa, Homo Sapiens
GHHAYGDQY

SEQ ID NO: 573573 - protein, 9 aa, Homo Sapiens
GKEDNGYLL

SEQ ID NO: 573574 - protein, 9 aa, Homo Sapiens
EVFSIEPRC

SEQ ID NO: 573575 - protein, 9 aa, Homo Sapiens
TKGDYQKVL

SEQ ID NO: 573576 - protein, 9 aa, Homo Sapiens
QLAEELTLP

SEQ ID NO: 573577 - protein, 9 aa, Homo Sapiens
TTLPNGHRE

SEQ ID NO: 573578 - protein, 9 aa, Homo Sapiens
VVVMGGKED

SEQ ID NO: 573579 - protein, 9 aa, Homo Sapiens
QGIQDSFQK

SEQ ID NO: 573580 - protein, 9 aa, Homo Sapiens
VQETFAQGT

SEQ ID NO: 573581 - protein, 9 aa, Homo Sapiens
WRGVGPVSR

SEQ ID NO: 573582 - protein, 9 aa, Homo Sapiens
VVWDKISVN

SEQ ID NO: 573583 - protein, 9 aa, Homo Sapiens
RSARSVRSR

SEQ ID NO: 573584 - protein, 9 aa, Homo Sapiens
EEGNENEDS

SEQ ID NO: 573585 - protein, 9 aa, Homo Sapiens
KKEGFRSPG

SEQ ID NO: 573586 - protein, 9 aa, Homo Sapiens
NNANGIREE

SEQ ID NO: 573587 - protein, 9 aa, Homo Sapiens
VVKGSISFE

SEQ ID NO: 573588 - protein, 9 aa, Homo Sapiens
DEKPSWNQS

SEQ ID NO: 573589 - protein, 9 aa, Homo Sapiens
HLDQKYVLI

SEQ ID NO: 573590 - protein, 9 aa, Homo Sapiens
TEAHNRLPT

SEQ ID NO: 573591 - protein, 9 aa, Homo Sapiens
NRLPTCKGS

SEQ ID NO: 573592 - protein, 9 aa, Homo Sapiens
TRSARSVRS

SEQ ID NO: 573593 - protein, 9 aa, Homo Sapiens
CYHPTRVCL

SEQ ID NO: 573594 - protein, 9 aa, Homo Sapiens
RLVLYVVKG

SEQ ID NO: 573595 - protein, 9 aa, Homo Sapiens
GTEAHNRLP

SEQ ID NO: 573596 - protein, 9 aa, Homo Sapiens
AALGPRSVS

SEQ ID NO: 573597 - protein, 9 aa, Homo Sapiens
GMNWRPILT

SEQ ID NO: 573598 - protein, 9 aa, Homo Sapiens
AASKKTALP

SEQ ID NO: 573599 - protein, 9 aa, Homo Sapiens
ENEDSEAEV

SEQ ID NO: 573600 - protein, 9 aa, Homo Sapiens
NRLHRTPPL

SEQ ID NO: 573601 - protein, 9 aa, Homo Sapiens
FRFPRTRWQ

SEQ ID NO: 573602 - protein, 9 aa, Homo Sapiens
PRTRWQSAE

SEQ ID NO: 573603 - protein, 9 aa, Homo Sapiens
RVCLPGCLN

SEQ ID NO: 573604 - protein, 9 aa, Homo Sapiens
KISVNHRRT

SEQ ID NO: 573605 - protein, 9 aa, Homo Sapiens
VWDKISVNH

SEQ ID NO: 573606 - protein, 9 aa, Homo Sapiens
LTGCTTHCF

SEQ ID NO: 573607 - protein, 9 aa, Homo Sapiens
VPDLAPTLL

SEQ ID NO: 573608 - protein, 9 aa, Homo Sapiens
SSCMGGMNW

SEQ ID NO: 573609 - protein, 9 aa, Homo Sapiens
QSAYDGAEK

SEQ ID NO: 573610 - protein, 9 aa, Homo Sapiens
SLCLFHLIS

SEQ ID NO: 573611 - protein, 9 aa, Homo Sapiens
EGNENEDSE

SEQ ID NO: 573612 - protein, 9 aa, Homo Sapiens
LSRNASREE

SEQ ID NO: 573613 - protein, 9 aa, Homo Sapiens
EEGSSERPE

SEQ ID NO: 573614 - protein, 9 aa, Homo Sapiens
NGIREEEPK

SEQ ID NO: 573615 - protein, 9 aa, Homo Sapiens
VAINSIYSN

SEQ ID NO: 573616 - protein, 9 aa, Homo Sapiens
TAVQLYECQ

SEQ ID NO: 573617 - protein, 9 aa, Homo Sapiens
QAWVPDLAP

SEQ ID NO: 573618 - protein, 9 aa, Homo Sapiens
WDPFPASEL

SEQ ID NO: 573619 - protein, 9 aa, Homo Sapiens
EGFRSPGQP

SEQ ID NO: 573620 - protein, 9 aa, Homo Sapiens
KKTALPGSA

SEQ ID NO: 573621 - protein, 9 aa, Homo Sapiens
YRIHVASCQ

SEQ ID NO: 573622 - protein, 9 aa, Homo Sapiens
GFRSPGQPW

SEQ ID NO: 573623 - protein, 9 aa, Homo Sapiens
WVPDLAPTL

SEQ ID NO: 573624 - protein, 9 aa, Homo Sapiens
RSPGQPWQP

SEQ ID NO: 573625 - protein, 9 aa, Homo Sapiens
PSLEELISI

SEQ ID NO: 573626 - protein, 9 aa, Homo Sapiens
FPASELLPH

SEQ ID NO: 573627 - protein, 9 aa, Homo Sapiens
DVTNKLAGI

SEQ ID NO: 573628 - protein, 9 aa, Homo Sapiens
PSSPSGVKI

SEQ ID NO: 573629 - protein, 9 aa, Homo Sapiens
IGFCWTQYS

SEQ ID NO: 573630 - protein, 9 aa, Homo Sapiens
IFLAEKLPG

SEQ ID NO: 573631 - protein, 9 aa, Homo Sapiens
PSWNQSAPL

SEQ ID NO: 573632 - protein, 9 aa, Homo Sapiens
DVQETFAQG

SEQ ID NO: 573633 - protein, 9 aa, Homo Sapiens
SSFRFPRTR

SEQ ID NO: 573634 - protein, 9 aa, Homo Sapiens
GLRKKVTAV

SEQ ID NO: 573635 - protein, 9 aa, Homo Sapiens
RGVGPVSRN

SEQ ID NO: 573636 - protein, 9 aa, Homo Sapiens
IAQCGVLPN

SEQ ID NO: 573637 - protein, 9 aa, Homo Sapiens
FFKIIAAKA

SEQ ID NO: 573638 - protein, 9 aa, Homo Sapiens
RLHRTPPLF

SEQ ID NO: 573639 - protein, 9 aa, Homo Sapiens
HAGLYPCQS

SEQ ID NO: 573640 - protein, 9 aa, Homo Sapiens
VCYGADHDL

SEQ ID NO: 573641 - protein, 9 aa, Homo Sapiens
APRGVCYGA

SEQ ID NO: 573642 - protein, 9 aa, Homo Sapiens
MSQAWVPDL

SEQ ID NO: 573643 - protein, 9 aa, Homo Sapiens
HSHDTYGQA

SEQ ID NO: 573644 - protein, 9 aa, Homo Sapiens
GALAVHSHD

SEQ ID NO: 573645 - protein, 9 aa, Homo Sapiens
GGDVQETFA

SEQ ID NO: 573646 - protein, 9 aa, Homo Sapiens
SSERPECKS

SEQ ID NO: 573647 - protein, 9 aa, Homo Sapiens
DAPWDPFPA

SEQ ID NO: 573648 - protein, 9 aa, Homo Sapiens
QNPLLVWLF

SEQ ID NO: 573649 - protein, 9 aa, Homo Sapiens
LQDPTIARM

SEQ ID NO: 573650 - protein, 9 aa, Homo Sapiens
SLEELISIY

SEQ ID NO: 573651 - protein, 9 aa, Homo Sapiens
VKGSISFED

SEQ ID NO: 573652 - protein, 9 aa, Homo Sapiens
LGKVTIAQC

SEQ ID NO: 573653 - protein, 9 aa, Homo Sapiens
NIAWTNATN

SEQ ID NO: 573654 - protein, 9 aa, Homo Sapiens
QPRTEIPEG

SEQ ID NO: 573655 - protein, 9 aa, Homo Sapiens
SRNASREEE

SEQ ID NO: 573656 - protein, 9 aa, Homo Sapiens
SGKSQHAPA

SEQ ID NO: 573657 - protein, 9 aa, Homo Sapiens
RFPRTRWQS

SEQ ID NO: 573658 - protein, 9 aa, Homo Sapiens
SAKTCDSVQ

SEQ ID NO: 573659 - protein, 9 aa, Homo Sapiens
EIPAMLKLS

SEQ ID NO: 573660 - protein, 9 aa, Homo Sapiens
NPLLVWLFT

SEQ ID NO: 573661 - protein, 9 aa, Homo Sapiens
AVARMKEDR

SEQ ID NO: 573662 - protein, 9 aa, Homo Sapiens
TCDSVQCAF

SEQ ID NO: 573663 - protein, 9 aa, Homo Sapiens
PTIARMSIC

SEQ ID NO: 573664 - protein, 9 aa, Homo Sapiens
KIIAAKAVL

SEQ ID NO: 573665 - protein, 9 aa, Homo Sapiens
AKAASSSGQ

SEQ ID NO: 573666 - protein, 9 aa, Homo Sapiens
ETNTRSFNR

SEQ ID NO: 573667 - protein, 9 aa, Homo Sapiens
AWTNATNNM

SEQ ID NO: 573668 - protein, 9 aa, Homo Sapiens
LAVHSHDTY

SEQ ID NO: 573669 - protein, 9 aa, Homo Sapiens
SNQYQEEGS

SEQ ID NO: 573670 - protein, 9 aa, Homo Sapiens
MGATMVAIN

SEQ ID NO: 573671 - protein, 9 aa, Homo Sapiens
PSFFKIIAA

SEQ ID NO: 573672 - protein, 9 aa, Homo Sapiens
EEEGNENED

SEQ ID NO: 573673 - protein, 9 aa, Homo Sapiens
PGARVFSQL

SEQ ID NO: 573674 - protein, 9 aa, Homo Sapiens
DPFPASELL

SEQ ID NO: 573675 - protein, 9 aa, Homo Sapiens
AVIFLAEKL

SEQ ID NO: 573676 - protein, 9 aa, Homo Sapiens
DSTRSARSV

SEQ ID NO: 573677 - protein, 9 aa, Homo Sapiens
SFFKIIAAK

SEQ ID NO: 573678 - protein, 9 aa, Homo Sapiens
SSPSGVKII

SEQ ID NO: 573679 - protein, 9 aa, Homo Sapiens
KTCDSVQCA

SEQ ID NO: 573680 - protein, 9 aa, Homo Sapiens
RSVRSRVLE

SEQ ID NO: 573681 - protein, 9 aa, Homo Sapiens
SWNQSAPLS

SEQ ID NO: 573682 - protein, 9 aa, Homo Sapiens
FRSPGQPWQ

SEQ ID NO: 573683 - protein, 9 aa, Homo Sapiens
LGPRSVSLK

SEQ ID NO: 573684 - protein, 9 aa, Homo Sapiens
MGGMNWRPI

SEQ ID NO: 573685 - protein, 9 aa, Homo Sapiens
YLWRAREMP

SEQ ID NO: 573686 - protein, 9 aa, Homo Sapiens
GLTGCTTHC

SEQ ID NO: 573687 - protein, 9 aa, Homo Sapiens
VFSQLALDP

SEQ ID NO: 573688 - protein, 9 aa, Homo Sapiens
AQPRTEIPE

SEQ ID NO: 573689 - protein, 9 aa, Homo Sapiens
SGIPSLEEL

SEQ ID NO: 573690 - protein, 9 aa, Homo Sapiens
AFLSAKAAS

SEQ ID NO: 573691 - protein, 9 aa, Homo Sapiens
LHEVVEVYD

SEQ ID NO: 573692 - protein, 9 aa, Homo Sapiens
FQTSLHEVV

SEQ ID NO: 573693 - protein, 9 aa, Homo Sapiens
QTSLHEVVE

SEQ ID NO: 573694 - protein, 9 aa, Homo Sapiens
TMVAINSIY

SEQ ID NO: 573695 - protein, 9 aa, Homo Sapiens
REEEPKKKK

SEQ ID NO: 573696 - protein, 9 aa, Homo Sapiens
CGVLPNIQA

SEQ ID NO: 573697 - protein, 9 aa, Homo Sapiens
KEDRDGSCS

SEQ ID NO: 573698 - protein, 9 aa, Homo Sapiens
KLCQAVKFL

SEQ ID NO: 573699 - protein, 9 aa, Homo Sapiens
EQPDSWQPY

SEQ ID NO: 573700 - protein, 9 aa, Homo Sapiens
SVRSRVLEA

SEQ ID NO: 573701 - protein, 9 aa, Homo Sapiens
QHAPAEFRA

SEQ ID NO: 573702 - protein, 9 aa, Homo Sapiens
AAAQPRTEI

SEQ ID NO: 573703 - protein, 9 aa, Homo Sapiens
DPTIARMSI

SEQ ID NO: 573704 - protein, 9 aa, Homo Sapiens
AAPRGVCYG

SEQ ID NO: 573705 - protein, 9 aa, Homo Sapiens
MVAINSIYS

SEQ ID NO: 573706 - protein, 9 aa, Homo Sapiens
GKSQHAPAE

SEQ ID NO: 573707 - protein, 9 aa, Homo Sapiens
GAEKMAHQL

SEQ ID NO: 573708 - protein, 9 aa, Homo Sapiens
CLDGVSLSP

SEQ ID NO: 573709 - protein, 9 aa, Homo Sapiens
RTRWQSAED

SEQ ID NO: 573710 - protein, 9 aa, Homo Sapiens
RVANIAWTN

SEQ ID NO: 573711 - protein, 9 aa, Homo Sapiens
EAALGPRSV

SEQ ID NO: 573712 - protein, 9 aa, Homo Sapiens
KPVCNQVER

SEQ ID NO: 573713 - protein, 9 aa, Homo Sapiens
PLFPTPPPW

SEQ ID NO: 573714 - protein, 9 aa, Homo Sapiens
SARSVRSRV

SEQ ID NO: 573715 - protein, 9 aa, Homo Sapiens
YQHLDQKYV

SEQ ID NO: 573716 - protein, 9 aa, Homo Sapiens
AHAGLYPCQ

SEQ ID NO: 573717 - protein, 9 aa, Homo Sapiens
EETNTRSFN

SEQ ID NO: 573718 - protein, 9 aa, Homo Sapiens
APWDPFPAS

SEQ ID NO: 573719 - protein, 9 aa, Homo Sapiens
RSFNRMVRE

SEQ ID NO: 573720 - protein, 9 aa, Homo Sapiens
TFVVWDKIS

SEQ ID NO: 573721 - protein, 9 aa, Homo Sapiens
VLYVVKGSI

SEQ ID NO: 573722 - protein, 9 aa, Homo Sapiens
RQNPLLVWL

SEQ ID NO: 573723 - protein, 9 aa, Homo Sapiens
ARMKEDRDG

SEQ ID NO: 573724 - protein, 9 aa, Homo Sapiens
NQLATAKKM

SEQ ID NO: 573725 - protein, 9 aa, Homo Sapiens
SQHAPAEFR

SEQ ID NO: 573726 - protein, 9 aa, Homo Sapiens
LQKEEAALG

SEQ ID NO: 573727 - protein, 9 aa, Homo Sapiens
HRTPPLFPT

SEQ ID NO: 573728 - protein, 9 aa, Homo Sapiens
HCFEGCECD

SEQ ID NO: 573729 - protein, 9 aa, Homo Sapiens
QCGVLPNIQ

SEQ ID NO: 573730 - protein, 9 aa, Homo Sapiens
DKNQLATAK

SEQ ID NO: 573731 - protein, 9 aa, Homo Sapiens
DKISVNHRR

SEQ ID NO: 573732 - protein, 9 aa, Homo Sapiens
AEKLPGAQR

SEQ ID NO: 573733 - protein, 9 aa, Homo Sapiens
GPTSESSSS

SEQ ID NO: 573734 - protein, 9 aa, Homo Sapiens
NGWAWPRNA

SEQ ID NO: 573735 - protein, 9 aa, Homo Sapiens
NSGIPSLEE

SEQ ID NO: 573736 - protein, 9 aa, Homo Sapiens
QDSFQKMIL

SEQ ID NO: 573737 - protein, 9 aa, Homo Sapiens
SPSGVKIIE

SEQ ID NO: 573738 - protein, 9 aa, Homo Sapiens
QDPTIARMS

SEQ ID NO: 573739 - protein, 9 aa, Homo Sapiens
PPRLECNGA

SEQ ID NO: 573740 - protein, 9 aa, Homo Sapiens
IHVASCQDN

SEQ ID NO: 573741 - protein, 9 aa, Homo Sapiens
LPLTEYFLN

SEQ ID NO: 573742 - protein, 9 aa, Homo Sapiens
WRPILTIIT

SEQ ID NO: 573743 - protein, 9 aa, Homo Sapiens
QCLSNTLPL

SEQ ID NO: 573744 - protein, 9 aa, Homo Sapiens
QGAVARMKE

SEQ ID NO: 573745 - protein, 9 aa, Homo Sapiens
KDRQNPLLV

SEQ ID NO: 573746 - protein, 9 aa, Homo Sapiens
VTIAQCGVL

SEQ ID NO: 573747 - protein, 9 aa, Homo Sapiens
WESLCLFHL

SEQ ID NO: 573748 - protein, 9 aa, Homo Sapiens
DKDEKPSWN

SEQ ID NO: 573749 - protein, 9 aa, Homo Sapiens
YPGARVFSQ

SEQ ID NO: 573750 - protein, 9 aa, Homo Sapiens
HPTRVCLPG

SEQ ID NO: 573751 - protein, 9 aa, Homo Sapiens
LAEKLPGAQ

SEQ ID NO: 573752 - protein, 9 aa, Homo Sapiens
GCTTHCFEG

SEQ ID NO: 573753 - protein, 9 aa, Homo Sapiens
LHRTPPLFP

SEQ ID NO: 573754 - protein, 9 aa, Homo Sapiens
VTAVQLYEC

SEQ ID NO: 573755 - protein, 9 aa, Homo Sapiens
WDKISVNHR

SEQ ID NO: 573756 - protein, 9 aa, Homo Sapiens
GVSLSPPRL

SEQ ID NO: 573757 - protein, 9 aa, Homo Sapiens
VCNQVERHP

SEQ ID NO: 573758 - protein, 9 aa, Homo Sapiens
MAASKKTAL

SEQ ID NO: 573759 - protein, 9 aa, Homo Sapiens
HVASCQDNR

SEQ ID NO: 573760 - protein, 9 aa, Homo Sapiens
RGVCYGADH

SEQ ID NO: 573761 - protein, 9 aa, Homo Sapiens
QVERHPYFN

SEQ ID NO: 573762 - protein, 9 aa, Homo Sapiens
PAMLKLSCT

SEQ ID NO: 573763 - protein, 9 aa, Homo Sapiens
ETFAQGTRR

SEQ ID NO: 573764 - protein, 9 aa, Homo Sapiens
WPEQGIQDS

SEQ ID NO: 573765 - protein, 9 aa, Homo Sapiens
QYRIHVASC

SEQ ID NO: 573766 - protein, 9 aa, Homo Sapiens
EKLPGAQRC

SEQ ID NO: 573767 - protein, 9 aa, Homo Sapiens
ASDYQHLDQ

SEQ ID NO: 573768 - protein, 9 aa, Homo Sapiens
MKEDRDGSC

SEQ ID NO: 573769 - protein, 9 aa, Homo Sapiens
VASCQDNRR

SEQ ID NO: 573770 - protein, 9 aa, Homo Sapiens
NTLPLTEYF

SEQ ID NO: 573771 - protein, 9 aa, Homo Sapiens
SKLCQAVKF

SEQ ID NO: 573772 - protein, 9 aa, Homo Sapiens
VGPVSRNSG

SEQ ID NO: 573773 - protein, 9 aa, Homo Sapiens
GNENEDSEA

SEQ ID NO: 573774 - protein, 9 aa, Homo Sapiens
QGKFVQNGW

SEQ ID NO: 573775 - protein, 9 aa, Homo Sapiens
LPGSAVGKQ

SEQ ID NO: 573776 - protein, 9 aa, Homo Sapiens
GKQAAAQPR

SEQ ID NO: 573777 - protein, 9 aa, Homo Sapiens
LCLFHLISK

SEQ ID NO: 573778 - protein, 9 aa, Homo Sapiens
YDGAEKMAH

SEQ ID NO: 573779 - protein, 9 aa, Homo Sapiens
RTCYHPTRV

SEQ ID NO: 573780 - protein, 9 aa, Homo Sapiens
NRMVREAQL

SEQ ID NO: 573781 - protein, 9 aa, Homo Sapiens
PGQPWQPDK

SEQ ID NO: 573782 - protein, 9 aa, Homo Sapiens
ATKDRQNPL

SEQ ID NO: 573783 - protein, 9 aa, Homo Sapiens
NFTYPGARV

SEQ ID NO: 573784 - protein, 9 aa, Homo Sapiens
LCGTEAHNR

SEQ ID NO: 573785 - protein, 9 aa, Homo Sapiens
HFFCEIPAM

SEQ ID NO: 573786 - protein, 9 aa, Homo Sapiens
AKKMITSVL

SEQ ID NO: 573787 - protein, 9 aa, Homo Sapiens
SLSPPRLEC

SEQ ID NO: 573788 - protein, 9 aa, Homo Sapiens
TALPGSAVG

SEQ ID NO: 573789 - protein, 9 aa, Homo Sapiens
GPAHAGLYP

SEQ ID NO: 573790 - protein, 9 aa, Homo Sapiens
DTFVVWDKI

SEQ ID NO: 573791 - protein, 9 aa, Homo Sapiens
ASAKTCDSV

SEQ ID NO: 573792 - protein, 9 aa, Homo Sapiens
SFNRMVREA

SEQ ID NO: 573793 - protein, 9 aa, Homo Sapiens
WTNATNNMN

SEQ ID NO: 573794 - protein, 9 aa, Homo Sapiens
GIREEEPKK

SEQ ID NO: 573795 - protein, 9 aa, Homo Sapiens
EVVEVYDGP

SEQ ID NO: 573796 - protein, 9 aa, Homo Sapiens
FWPEQGIQD

SEQ ID NO: 573797 - protein, 9 aa, Homo Sapiens
GFCWTQYSP

SEQ ID NO: 573798 - protein, 9 aa, Homo Sapiens
RRYLWRARE

SEQ ID NO: 573799 - protein, 9 aa, Homo Sapiens
EAHNRLPTC

SEQ ID NO: 573800 - protein, 9 aa, Homo Sapiens
TLSRNASRE

SEQ ID NO: 573801 - protein, 9 aa, Homo Sapiens
DRQNPLLVW

SEQ ID NO: 573802 - protein, 9 aa, Homo Sapiens
DSEAEVDEN

SEQ ID NO: 573803 - protein, 9 aa, Homo Sapiens
ANGIREEEP

SEQ ID NO: 573804 - protein, 9 aa, Homo Sapiens
ADVPSSPSG

SEQ ID NO: 573805 - protein, 9 aa, Homo Sapiens
TKDRQNPLL

SEQ ID NO: 573806 - protein, 9 aa, Homo Sapiens
QEEGSSERP

SEQ ID NO: 573807 - protein, 9 aa, Homo Sapiens
TPPLFPTPP

SEQ ID NO: 573808 - protein, 9 aa, Homo Sapiens
KFVQNGWAW

SEQ ID NO: 573809 - protein, 9 aa, Homo Sapiens
KVTAVQLYE

SEQ ID NO: 573810 - protein, 9 aa, Homo Sapiens
DSWQPYGSS

SEQ ID NO: 573811 - protein, 9 aa, Homo Sapiens
TNKLAGIFH

SEQ ID NO: 573812 - protein, 9 aa, Homo Sapiens
PTRVCLPGC

SEQ ID NO: 573813 - protein, 9 aa, Homo Sapiens
RPDVTNKLA

SEQ ID NO: 573814 - protein, 9 aa, Homo Sapiens
HNRLPTCKG

SEQ ID NO: 573815 - protein, 9 aa, Homo Sapiens
ASCQDNRRH

SEQ ID NO: 573816 - protein, 9 aa, Homo Sapiens
MNWRPILTI

SEQ ID NO: 573817 - protein, 9 aa, Homo Sapiens
TSLHEVVEV

SEQ ID NO: 573818 - protein, 9 aa, Homo Sapiens
EGPTSESSS

SEQ ID NO: 573819 - protein, 9 aa, Homo Sapiens
QKEEAALGP

SEQ ID NO: 573820 - protein, 9 aa, Homo Sapiens
LSGLQDPTI

SEQ ID NO: 573821 - protein, 9 aa, Homo Sapiens
VFFQTSLHE

SEQ ID NO: 573822 - protein, 9 aa, Homo Sapiens
YQEEGSSER

SEQ ID NO: 573823 - protein, 9 aa, Homo Sapiens
WQPYGSSFY

SEQ ID NO: 573824 - protein, 9 aa, Homo Sapiens
SVDKDEKPS

SEQ ID NO: 573825 - protein, 9 aa, Homo Sapiens
TYPGARVFS

SEQ ID NO: 573826 - protein, 9 aa, Homo Sapiens
EEAALGPRS

SEQ ID NO: 573827 - protein, 9 aa, Homo Sapiens
WADAPWDPF

SEQ ID NO: 573828 - protein, 9 aa, Homo Sapiens
NNRTLQENI

SEQ ID NO: 573829 - protein, 9 aa, Homo Sapiens
MLKLSCTDT

SEQ ID NO: 573830 - protein, 9 aa, Homo Sapiens
ISVNHRRTH

SEQ ID NO: 573831 - protein, 9 aa, Homo Sapiens
PCQSGAAPG

SEQ ID NO: 573832 - protein, 9 aa, Homo Sapiens
ENSGIPSLE

SEQ ID NO: 573833 - protein, 9 aa, Homo Sapiens
NTNNANGIR

SEQ ID NO: 573834 - protein, 9 aa, Homo Sapiens
EQGIQDSFQ

SEQ ID NO: 573835 - protein, 9 aa, Homo Sapiens
GRRYLWRAR

SEQ ID NO: 573836 - protein, 9 aa, Homo Sapiens
EKPSWNQSA

SEQ ID NO: 573837 - protein, 9 aa, Homo Sapiens
KLPGAQRCQ

SEQ ID NO: 573838 - protein, 9 aa, Homo Sapiens
GWRGVGPVS

SEQ ID NO: 573839 - protein, 9 aa, Homo Sapiens
LQENILQVN

SEQ ID NO: 573840 - protein, 9 aa, Homo Sapiens
LLVWLFTGM

SEQ ID NO: 573841 - protein, 9 aa, Homo Sapiens
TLPLTEYFL

SEQ ID NO: 573842 - protein, 9 aa, Homo Sapiens
QAAAQPRTE

SEQ ID NO: 573843 - protein, 9 aa, Homo Sapiens
TNNANGIRE

SEQ ID NO: 573844 - protein, 9 aa, Homo Sapiens
LSQGRRYLW

SEQ ID NO: 573845 - protein, 9 aa, Homo Sapiens
WTQYSPNTQ

SEQ ID NO: 573846 - protein, 9 aa, Homo Sapiens
GARVFSQLA

SEQ ID NO: 573847 - protein, 9 aa, Homo Sapiens
PDVTNKLAG

SEQ ID NO: 573848 - protein, 9 aa, Homo Sapiens
ASKLCQAVK

SEQ ID NO: 573849 - protein, 9 aa, Homo Sapiens
RKKVTAVQL

SEQ ID NO: 573850 - protein, 9 aa, Homo Sapiens
EGSSERPEC

SEQ ID NO: 573851 - protein, 9 aa, Homo Sapiens
HMASKLCQA

SEQ ID NO: 573852 - protein, 9 aa, Homo Sapiens
WAWPRNADM

SEQ ID NO: 573853 - protein, 9 aa, Homo Sapiens
GVGGDVQET

SEQ ID NO: 573854 - protein, 9 aa, Homo Sapiens
VANIAWTNA

SEQ ID NO: 573855 - protein, 9 aa, Homo Sapiens
VHSHDTYGQ

SEQ ID NO: 573856 - protein, 9 aa, Homo Sapiens
GPSFFKIIA

SEQ ID NO: 573857 - protein, 9 aa, Homo Sapiens
VQLYECQLI

SEQ ID NO: 573858 - protein, 9 aa, Homo Sapiens
ARSVRSRVL

SEQ ID NO: 573859 - protein, 9 aa, Homo Sapiens
AIQCLSNTL

SEQ ID NO: 573860 - protein, 9 aa, Homo Sapiens
YVVKGSISF

SEQ ID NO: 573861 - protein, 9 aa, Homo Sapiens
AAQPRTEIP

SEQ ID NO: 573862 - protein, 9 aa, Homo Sapiens
NWRPILTII

SEQ ID NO: 573863 - protein, 9 aa, Homo Sapiens
FKIIAAKAV

SEQ ID NO: 573864 - protein, 9 aa, Homo Sapiens
KVTIAQCGV

SEQ ID NO: 573865 - protein, 9 aa, Homo Sapiens
HEVVEVYDG

SEQ ID NO: 573866 - protein, 9 aa, Homo Sapiens
FVQNGWAWP

SEQ ID NO: 573867 - protein, 9 aa, Homo Sapiens
PVSRNSGLY

SEQ ID NO: 573868 - protein, 9 aa, Homo Sapiens
SQGRRYLWR

SEQ ID NO: 573869 - protein, 9 aa, Homo Sapiens
GLYPCQSGA

SEQ ID NO: 573870 - protein, 9 aa, Homo Sapiens
IPSLEELIS

SEQ ID NO: 573871 - protein, 9 aa, Homo Sapiens
QHLDQKYVL

SEQ ID NO: 573872 - protein, 9 aa, Homo Sapiens
EDSEAEVDE

SEQ ID NO: 573873 - protein, 9 aa, Homo Sapiens
CQDNRRHRG

SEQ ID NO: 573874 - protein, 9 aa, Homo Sapiens
LEQPDSWQP

SEQ ID NO: 573875 - protein, 9 aa, Homo Sapiens
QENILQVNN

SEQ ID NO: 573876 - protein, 9 aa, Homo Sapiens
TAKKMITSV

SEQ ID NO: 573877 - protein, 9 aa, Homo Sapiens
RRTCYHPTR

SEQ ID NO: 573878 - protein, 9 aa, Homo Sapiens
CNQVERHPY

SEQ ID NO: 573879 - protein, 9 aa, Homo Sapiens
ADAPWDPFP

SEQ ID NO: 573880 - protein, 9 aa, Homo Sapiens
KPRPDVTNK

SEQ ID NO: 573881 - protein, 9 aa, Homo Sapiens
ALPGSAVGK

SEQ ID NO: 573882 - protein, 9 aa, Homo Sapiens
QETFAQGTR

SEQ ID NO: 573883 - protein, 9 aa, Homo Sapiens
TGCTTHCFE

SEQ ID NO: 573884 - protein, 9 aa, Homo Sapiens
GVCYGADHD

SEQ ID NO: 573885 - protein, 9 aa, Homo Sapiens
KEEAALGPR

SEQ ID NO: 573886 - protein, 9 aa, Homo Sapiens
FCEIPAMLK

SEQ ID NO: 573887 - protein, 9 aa, Homo Sapiens
LATAKKMIT

SEQ ID NO: 573888 - protein, 9 aa, Homo Sapiens
QNGWAWPRN

SEQ ID NO: 573889 - protein, 9 aa, Homo Sapiens
AQCGVLPNI

SEQ ID NO: 573890 - protein, 9 aa, Homo Sapiens
IAWTNATNN

SEQ ID NO: 573891 - protein, 9 aa, Homo Sapiens
FLSAKAASS

SEQ ID NO: 573892 - protein, 9 aa, Homo Sapiens
PRPDVTNKL

SEQ ID NO: 573893 - protein, 9 aa, Homo Sapiens
LLSQGRRYL

SEQ ID NO: 573894 - protein, 9 aa, Homo Sapiens
YHPTRVCLP

SEQ ID NO: 573895 - protein, 9 aa, Homo Sapiens
ANNRTLQEN

SEQ ID NO: 573896 - protein, 9 aa, Homo Sapiens
TRWQSAEDV

SEQ ID NO: 573897 - protein, 9 aa, Homo Sapiens
EASAKTCDS

SEQ ID NO: 573898 - protein, 9 aa, Homo Sapiens
FFCEIPAML

SEQ ID NO: 573899 - protein, 9 aa, Homo Sapiens
IQCLSNTLP

SEQ ID NO: 573900 - protein, 9 aa, Homo Sapiens
TCYHPTRVC

SEQ ID NO: 573901 - protein, 9 aa, Homo Sapiens
PLSSGKSQH

SEQ ID NO: 573902 - protein, 9 aa, Homo Sapiens
GSSERPECK

SEQ ID NO: 573903 - protein, 9 aa, Homo Sapiens
NANGIREEE

SEQ ID NO: 573904 - protein, 9 aa, Homo Sapiens
SGLTGCTTH

SEQ ID NO: 573905 - protein, 9 aa, Homo Sapiens
ERHPYFNRS

SEQ ID NO: 573906 - protein, 9 aa, Homo Sapiens
EKMAHQLKR

SEQ ID NO: 573907 - protein, 9 aa, Homo Sapiens
NENEDSEAE

SEQ ID NO: 573908 - protein, 9 aa, Homo Sapiens
RHPYFNRSK

SEQ ID NO: 573909 - protein, 9 aa, Homo Sapiens
GKVTIAQCG

SEQ ID NO: 573910 - protein, 9 aa, Homo Sapiens
VDKDEKPSW

SEQ ID NO: 573911 - protein, 9 aa, Homo Sapiens
TRSFNRMVR

SEQ ID NO: 573912 - protein, 9 aa, Homo Sapiens
RYLWRAREM

SEQ ID NO: 573913 - protein, 9 aa, Homo Sapiens
GGMNWRPIL

SEQ ID NO: 573914 - protein, 9 aa, Homo Sapiens
KNQLATAKK

SEQ ID NO: 573915 - protein, 9 aa, Homo Sapiens
TQGAVARMK

SEQ ID NO: 573916 - protein, 9 aa, Homo Sapiens
PKASDYQHL

SEQ ID NO: 573917 - protein, 9 aa, Homo Sapiens
KQAAAQPRT

SEQ ID NO: 573918 - protein, 9 aa, Homo Sapiens
SLSGLQDPT

SEQ ID NO: 573919 - protein, 9 aa, Homo Sapiens
SDYQHLDQK

SEQ ID NO: 573920 - protein, 9 aa, Homo Sapiens
NKLAGIFHA

SEQ ID NO: 573921 - protein, 9 aa, Homo Sapiens
SLHEVVEVY

SEQ ID NO: 573922 - protein, 9 aa, Homo Sapiens
SAKAASSSG

SEQ ID NO: 573923 - protein, 9 aa, Homo Sapiens
ARVFSQLAL

SEQ ID NO: 573924 - protein, 9 aa, Homo Sapiens
AVHSHDTYG

SEQ ID NO: 573925 - protein, 9 aa, Homo Sapiens
SWQPYGSSF

SEQ ID NO: 573926 - protein, 9 aa, Homo Sapiens
VRRVANIAW

SEQ ID NO: 573927 - protein, 9 aa, Homo Sapiens
SLLSQGRRY

SEQ ID NO: 573928 - protein, 9 aa, Homo Sapiens
IIAAKAVLK

SEQ ID NO: 573929 - protein, 9 aa, Homo Sapiens
QGTGTLSRN

SEQ ID NO: 573930 - protein, 9 aa, Homo Sapiens
FVVWDKISV

SEQ ID NO: 573931 - protein, 9 aa, Homo Sapiens
GIQDSFQKM

SEQ ID NO: 573932 - protein, 9 aa, Homo Sapiens
KPSWNQSAP

SEQ ID NO: 573933 - protein, 9 aa, Homo Sapiens
KDEKPSWNQ

SEQ ID NO: 573934 - protein, 9 aa, Homo Sapiens
GATMVAINS

SEQ ID NO: 573935 - protein, 9 aa, Homo Sapiens
AVQLYECQL

SEQ ID NO: 573936 - protein, 9 aa, Homo Sapiens
DGAEKMAHQ

SEQ ID NO: 573937 - protein, 9 aa, Homo Sapiens
AMLKLSCTD

SEQ ID NO: 573938 - protein, 9 aa, Homo Sapiens
SCLEQPDSW

SEQ ID NO: 573939 - protein, 9 aa, Homo Sapiens
TLQENILQV

SEQ ID NO: 573940 - protein, 9 aa, Homo Sapiens
RRVANIAWT

SEQ ID NO: 573941 - protein, 9 aa, Homo Sapiens
KNEYQPLLF

SEQ ID NO: 573942 - protein, 9 aa, Homo Sapiens
VARMKEDRD

SEQ ID NO: 573943 - protein, 9 aa, Homo Sapiens
AKTCDSVQC

SEQ ID NO: 573944 - protein, 9 aa, Homo Sapiens
LAAPRGVCY

SEQ ID NO: 573945 - protein, 9 aa, Homo Sapiens
SNTLPLTEY

SEQ ID NO: 573946 - protein, 9 aa, Homo Sapiens
NEDSEAEVD

SEQ ID NO: 573947 - protein, 9 aa, Homo Sapiens
RIHVASCQD

SEQ ID NO: 573948 - protein, 9 aa, Homo Sapiens
PSGVKIIEL

SEQ ID NO: 573949 - protein, 9 aa, Homo Sapiens
CTTHCFEGC

SEQ ID NO: 573950 - protein, 9 aa, Homo Sapiens
HQVHHMASK

SEQ ID NO: 573951 - protein, 9 aa, Homo Sapiens
DGVSLSPPR

SEQ ID NO: 573952 - protein, 9 aa, Homo Sapiens
TNTRSFNRM

SEQ ID NO: 573953 - protein, 9 aa, Homo Sapiens
FLAEKLPGA

SEQ ID NO: 573954 - protein, 9 aa, Homo Sapiens
IQDSFQKMI

SEQ ID NO: 573955 - protein, 9 aa, Homo Sapiens
RPKASDYQH

SEQ ID NO: 573956 - protein, 9 aa, Homo Sapiens
FNRMVREAQ

SEQ ID NO: 573957 - protein, 9 aa, Homo Sapiens
LSSGKSQHA

SEQ ID NO: 573958 - protein, 9 aa, Homo Sapiens
SHDTYGQAL

SEQ ID NO: 573959 - protein, 9 aa, Homo Sapiens
THCFEGCEC

SEQ ID NO: 573960 - protein, 9 aa, Homo Sapiens
CLFHLISKT

SEQ ID NO: 573961 - protein, 9 aa, Homo Sapiens
KASDYQHLD

SEQ ID NO: 573962 - protein, 9 aa, Homo Sapiens
QLATAKKMI

SEQ ID NO: 573963 - protein, 9 aa, Homo Sapiens
NRTLQENIL

SEQ ID NO: 573964 - protein, 9 aa, Homo Sapiens
GTLSRNASR

SEQ ID NO: 573965 - protein, 9 aa, Homo Sapiens
NEYQPLLFA

SEQ ID NO: 573966 - protein, 9 aa, Homo Sapiens
CLEQPDSWQ

SEQ ID NO: 573967 - protein, 9 aa, Homo Sapiens
IREEEPKKK

SEQ ID NO: 573968 - protein, 9 aa, Homo Sapiens
PDSWQPYGS

SEQ ID NO: 573969 - protein, 9 aa, Homo Sapiens
ANIAWTNAT

SEQ ID NO: 573970 - protein, 9 aa, Homo Sapiens
QKKEGFRSP

SEQ ID NO: 573971 - protein, 9 aa, Homo Sapiens
LYPCQSGAA

SEQ ID NO: 573972 - protein, 9 aa, Homo Sapiens
KEGFRSPGQ

SEQ ID NO: 573973 - protein, 9 aa, Homo Sapiens
LADVPSSPS

SEQ ID NO: 573974 - protein, 9 aa, Homo Sapiens
ESSSSGPGR

SEQ ID NO: 573975 - protein, 9 aa, Homo Sapiens
VERHPYFNR

SEQ ID NO: 573976 - protein, 9 aa, Homo Sapiens
ATEGPTSES

SEQ ID NO: 573977 - protein, 9 aa, Homo Sapiens
FTIGFCWTQ

SEQ ID NO: 573978 - protein, 9 aa, Homo Sapiens
VHHMASKLC

SEQ ID NO: 573979 - protein, 9 aa, Homo Sapiens
RMGATMVAI

SEQ ID NO: 573980 - protein, 9 aa, Homo Sapiens
PTSESSSSG

SEQ ID NO: 573981 - protein, 9 aa, Homo Sapiens
PRTEIPEGT

SEQ ID NO: 573982 - protein, 9 aa, Homo Sapiens
AWVPDLAPT

SEQ ID NO: 573983 - protein, 9 aa, Homo Sapiens
VTNKLAGIF

SEQ ID NO: 573984 - protein, 9 aa, Homo Sapiens
AHNRLPTCK

SEQ ID NO: 573985 - protein, 9 aa, Homo Sapiens
FPRTRWQSA

SEQ ID NO: 573986 - protein, 9 aa, Homo Sapiens
RTEIPEGTT

SEQ ID NO: 573987 - protein, 9 aa, Homo Sapiens
KKMITSVLE

SEQ ID NO: 573988 - protein, 9 aa, Homo Sapiens
PRGVCYGAD

SEQ ID NO: 573989 - protein, 9 aa, Homo Sapiens
GVGPVSRNS

SEQ ID NO: 573990 - protein, 9 aa, Homo Sapiens
CMGGMNWRP

SEQ ID NO: 573991 - protein, 9 aa, Homo Sapiens
SQAWVPDLA

SEQ ID NO: 573992 - protein, 9 aa, Homo Sapiens
QVHHMASKL

SEQ ID NO: 573993 - protein, 9 aa, Homo Sapiens
ASKKTALPG

SEQ ID NO: 573994 - protein, 9 aa, Homo Sapiens
TFAQGTRRN

SEQ ID NO: 573995 - protein, 9 aa, Homo Sapiens
GPRSVSLKD

SEQ ID NO: 573996 - protein, 9 aa, Homo Sapiens
LFTIGFCWT

SEQ ID NO: 573997 - protein, 9 aa, Homo Sapiens
GLQDPTIAR

SEQ ID NO: 573998 - protein, 9 aa, Homo Sapiens
PDLAPTLLF

SEQ ID NO: 573999 - protein, 9 aa, Homo Sapiens
KTALPGSAV

SEQ ID NO: 574000 - protein, 9 aa, Homo Sapiens
TIAQCGVLP

SEQ ID NO: 574001 - protein, 9 aa, Homo Sapiens
SCQDNRRHR

SEQ ID NO: 574002 - protein, 9 aa, Homo Sapiens
IAAKAVLKL

SEQ ID NO: 574003 - protein, 9 aa, Homo Sapiens
TIGFCWTQY

SEQ ID NO: 574004 - protein, 9 aa, Homo Sapiens
SAYDGAEKM

SEQ ID NO: 574005 - protein, 9 aa, Homo Sapiens
CLSNTLPLT

SEQ ID NO: 574006 - protein, 9 aa, Homo Sapiens
GPVSRNSGL

SEQ ID NO: 574007 - protein, 9 aa, Homo Sapiens
GWAWPRNAD

SEQ ID NO: 574008 - protein, 9 aa, Homo Sapiens
RTPPLFPTP

SEQ ID NO: 574009 - protein, 9 aa, Homo Sapiens
AYDGAEKMA

SEQ ID NO: 574010 - protein, 9 aa, Homo Sapiens
ATAKKMITS

SEQ ID NO: 574011 - protein, 9 aa, Homo Sapiens
PFPASELLP

SEQ ID NO: 574012 - protein, 9 aa, Homo Sapiens
VQNGWAWPR

SEQ ID NO: 574013 - protein, 9 aa, Homo Sapiens
NILQVNNLV

SEQ ID NO: 574014 - protein, 9 aa, Homo Sapiens
DYQHLDQKY

SEQ ID NO: 574015 - protein, 9 aa, Homo Sapiens
KKVTAVQLY

SEQ ID NO: 574016 - protein, 9 aa, Homo Sapiens
ALGPRSVSL

SEQ ID NO: 574017 - protein, 9 aa, Homo Sapiens
NASREEETR

SEQ ID NO: 574018 - protein, 9 aa, Homo Sapiens
QPDSWQPYG

SEQ ID NO: 574019 - protein, 9 aa, Homo Sapiens
LSAKAASSS

SEQ ID NO: 574020 - protein, 9 aa, Homo Sapiens
GKFVQNGWA

SEQ ID NO: 574021 - protein, 9 aa, Homo Sapiens
FYLAAPRGV

SEQ ID NO: 574022 - protein, 9 aa, Homo Sapiens
VGGDVQETF

SEQ ID NO: 574023 - protein, 9 aa, Homo Sapiens
TIARMSICS

SEQ ID NO: 574024 - protein, 9 aa, Homo Sapiens
SPPRLECNG

SEQ ID NO: 574025 - protein, 9 aa, Homo Sapiens
GRMGATMVA

SEQ ID NO: 574026 - protein, 9 aa, Homo Sapiens
DAVIFLAEK

SEQ ID NO: 574027 - protein, 9 aa, Homo Sapiens
TGTLSRNAS

SEQ ID NO: 574028 - protein, 9 aa, Homo Sapiens
DLAPTLLFS

SEQ ID NO: 574029 - protein, 9 aa, Homo Sapiens
SPGQPWQPD

SEQ ID NO: 574030 - protein, 9 aa, Homo Sapiens
PPGALAVHS

SEQ ID NO: 574031 - protein, 9 aa, Homo Sapiens
GTGTLSRNA

SEQ ID NO: 574032 - protein, 9 aa, Homo Sapiens
FTYPGARVF

SEQ ID NO: 574033 - protein, 9 aa, Homo Sapiens
LVLYVVKGS

SEQ ID NO: 574034 - protein, 9 aa, Homo Sapiens
RWQSAEDVH

SEQ ID NO: 574035 - protein, 9 aa, Homo Sapiens
NQVERHPYF

SEQ ID NO: 574036 - protein, 9 aa, Homo Sapiens
EFWPEQGIQ

SEQ ID NO: 574037 - protein, 9 aa, Homo Sapiens
LDGVSLSPP

SEQ ID NO: 574038 - protein, 9 aa, Homo Sapiens
AGRMGATMV

SEQ ID NO: 574039 - protein, 9 aa, Homo Sapiens
VPSSPSGVK

SEQ ID NO: 574040 - protein, 9 aa, Homo Sapiens
LSNTLPLTE

SEQ ID NO: 574041 - protein, 9 aa, Homo Sapiens
IPAMLKLSC

SEQ ID NO: 574042 - protein, 9 aa, Homo Sapiens
VSRNSGLYN

SEQ ID NO: 574043 - protein, 9 aa, Homo Sapiens
STRSARSVR

SEQ ID NO: 574044 - protein, 9 aa, Homo Sapiens
ALAVHSHDT

SEQ ID NO: 574045 - protein, 9 aa, Homo Sapiens
LYVVKGSIS

SEQ ID NO: 574046 - protein, 9 aa, Homo Sapiens
LEELISIYC

SEQ ID NO: 574047 - protein, 9 aa, Homo Sapiens
TSESSSSGP

SEQ ID NO: 574048 - protein, 9 aa, Homo Sapiens
DSVQCAFEE

SEQ ID NO: 574049 - protein, 9 aa, Homo Sapiens
QYQEEGSSE

SEQ ID NO: 574050 - protein, 9 aa, Homo Sapiens
SFRFPRTRW

SEQ ID NO: 574051 - protein, 9 aa, Homo Sapiens
ATMVAINSI

SEQ ID NO: 574052 - protein, 9 aa, Homo Sapiens
PAHAGLYPC

SEQ ID NO: 574053 - protein, 9 aa, Homo Sapiens
CWTQYSPNT

SEQ ID NO: 574054 - protein, 9 aa, Homo Sapiens
DVPSSPSGV

SEQ ID NO: 574055 - protein, 9 aa, Homo Sapiens
KSQHAPAEF

SEQ ID NO: 574056 - protein, 9 aa, Homo Sapiens
MASKLCQAV

SEQ ID NO: 574057 - protein, 9 aa, Homo Sapiens
ENILQVNNL

SEQ ID NO: 574058 - protein, 9 aa, Homo Sapiens
RTLQENILQ

SEQ ID NO: 574059 - protein, 9 aa, Homo Sapiens
AAKAVLKLQ

SEQ ID NO: 574060 - protein, 9 aa, Homo Sapiens
SENSGIPSL

SEQ ID NO: 574061 - protein, 9 aa, Homo Sapiens
SSGKSQHAP

SEQ ID NO: 574062 - protein, 9 aa, Homo Sapiens
SGVKIIELS

SEQ ID NO: 574063 - protein, 9 aa, Homo Sapiens
LRKKVTAVQ

SEQ ID NO: 574064 - protein, 9 aa, Homo Sapiens
TQYSPNTQQ

SEQ ID NO: 574065 - protein, 9 aa, Homo Sapiens
SVQCAFEEL

SEQ ID NO: 574066 - protein, 9 aa, Homo Sapiens
VRSRVLEAL

SEQ ID NO: 574067 - protein, 9 aa, Homo Sapiens
PVCNQVERH

SEQ ID NO: 574068 - protein, 9 aa, Homo Sapiens
TTHCFEGCE

SEQ ID NO: 574069 - protein, 9 aa, Homo Sapiens
PPLFPTPPP

SEQ ID NO: 574070 - protein, 9 aa, Homo Sapiens
PLLVWLFTG

SEQ ID NO: 574071 - protein, 9 aa, Homo Sapiens
RVFSQLALD

SEQ ID NO: 574072 - protein, 9 aa, Homo Sapiens
LFPTPPPWL

SEQ ID NO: 574073 - protein, 9 aa, Homo Sapiens
CDSVQCAFE

SEQ ID NO: 574074 - protein, 9 aa, Homo Sapiens
VIFLAEKLP

SEQ ID NO: 574075 - protein, 9 aa, Homo Sapiens
PGALAVHSH

SEQ ID NO: 574076 - protein, 9 aa, Homo Sapiens
LSPPRLECN

SEQ ID NO: 574077 - protein, 9 aa, Homo Sapiens
TRVCLPGCL

SEQ ID NO: 574078 - protein, 9 aa, Homo Sapiens
HAPAEFRAQ

SEQ ID NO: 574079 - protein, 9 aa, Homo Sapiens
TEGPTSESS

SEQ ID NO: 574080 - protein, 9 aa, Homo Sapiens
YPCQSGAAP

SEQ ID NO: 574081 - protein, 9 aa, Homo Sapiens
SKKTALPGS

SEQ ID NO: 574082 - protein, 9 aa, Homo Sapiens
RNASREEET

SEQ ID NO: 574083 - protein, 9 aa, Homo Sapiens
KAASSSGQM

SEQ ID NO: 574084 - protein, 9 aa, Homo Sapiens
PWDPFPASE

SEQ ID NO: 574085 - protein, 9 aa, Homo Sapiens
AEKMAHQLK

SEQ ID NO: 574086 - protein, 9 aa, Homo Sapiens
VSLSPPRLE

SEQ ID NO: 574087 - protein, 9 aa, Homo Sapiens
SESSSSGPG

SEQ ID NO: 574088 - protein, 9 aa, Homo Sapiens
CEIPAMLKL

SEQ ID NO: 574089 - protein, 9 aa, Homo Sapiens
CGWRGVGPV

SEQ ID NO: 574090 - protein, 9 aa, Homo Sapiens
KLAGIFHAD

SEQ ID NO: 574091 - protein, 9 aa, Homo Sapiens
SSSSGPGRL

SEQ ID NO: 574092 - protein, 9 aa, Homo Sapiens
FFQTSLHEV

SEQ ID NO: 574093 - protein, 9 aa, Homo Sapiens
HHMASKLCQ

SEQ ID NO: 574094 - protein, 9 aa, Homo Sapiens
ESLCLFHLI

SEQ ID NO: 574095 - protein, 9 aa, Homo Sapiens
YLAAPRGVC

SEQ ID NO: 574096 - protein, 9 aa, Homo Sapiens
SCMGGMNWR

SEQ ID NO: 574097 - protein, 9 aa, Homo Sapiens
SGLQDPTIA

SEQ ID NO: 574098 - protein, 9 aa, Homo Sapiens
NTRSFNRMV

SEQ ID NO: 574099 - protein, 9 aa, Homo Sapiens
LQSAYDGAE

SEQ ID NO: 574100 - protein, 9 aa, Homo Sapiens
FCWTQYSPN

SEQ ID NO: 574101 - protein, 9 aa, Homo Sapiens
RMKEDRDGS

SEQ ID NO: 574102 - protein, 9 aa, Homo Sapiens
GAVARMKED

SEQ ID NO: 574103 - protein, 9 aa, Homo Sapiens
TLCGTEAHN

SEQ ID NO: 574104 - protein, 9 aa, Homo Sapiens
GIPSLEELI

SEQ ID NO: 574105 - protein, 9 aa, Homo Sapiens
QGRRYLWRA

SEQ ID NO: 574106 - protein, 9 aa, Homo Sapiens
NQYQEEGSS

SEQ ID NO: 574107 - protein, 9 aa, Homo Sapiens
CGTEAHNRL

SEQ ID NO: 574108 - protein, 9 aa, Homo Sapiens
GDVQETFAQ

SEQ ID NO: 574109 - protein, 9 aa, Homo Sapiens
AGLYPCQSG

SEQ ID NO: 574110 - protein, 9 aa, Homo Sapiens
STGGILAAG

SEQ ID NO: 574111 - protein, 9 aa, Homo Sapiens
KITEAKLAA

SEQ ID NO: 574112 - protein, 9 aa, Homo Sapiens
QYTLNFSGD

SEQ ID NO: 574113 - protein, 9 aa, Homo Sapiens
KLRKKLFPS

SEQ ID NO: 574114 - protein, 9 aa, Homo Sapiens
SVDSEAIQK

SEQ ID NO: 574115 - protein, 9 aa, Homo Sapiens
GVHRPHCNV

SEQ ID NO: 574116 - protein, 9 aa, Homo Sapiens
FAPPVCTSS

SEQ ID NO: 574117 - protein, 9 aa, Homo Sapiens
RGLGPEEAH

SEQ ID NO: 574118 - protein, 9 aa, Homo Sapiens
LKCKGTGVC

SEQ ID NO: 574119 - protein, 9 aa, Homo Sapiens
FMFSSHNKK

SEQ ID NO: 574120 - protein, 9 aa, Homo Sapiens
LVCVFRIFK

SEQ ID NO: 574121 - protein, 9 aa, Homo Sapiens
QEILWAINH

SEQ ID NO: 574122 - protein, 9 aa, Homo Sapiens
HIIRNFCKD

SEQ ID NO: 574123 - protein, 9 aa, Homo Sapiens
TQRRSCDSG

SEQ ID NO: 574124 - protein, 9 aa, Homo Sapiens
SFAPPVCTS

SEQ ID NO: 574125 - protein, 9 aa, Homo Sapiens
GNCYNRWFE

SEQ ID NO: 574126 - protein, 9 aa, Homo Sapiens
GPQLAAQNG

SEQ ID NO: 574127 - protein, 9 aa, Homo Sapiens
KPGSCAPPR

SEQ ID NO: 574128 - protein, 9 aa, Homo Sapiens
PAALSSVPI

SEQ ID NO: 574129 - protein, 9 aa, Homo Sapiens
QNGHQPGQL

SEQ ID NO: 574130 - protein, 9 aa, Homo Sapiens
PLLKLTWTF

SEQ ID NO: 574131 - protein, 9 aa, Homo Sapiens
TCEKPYECY

SEQ ID NO: 574132 - protein, 9 aa, Homo Sapiens
EEQGDDQDR

SEQ ID NO: 574133 - protein, 9 aa, Homo Sapiens
MFETDDLVL

SEQ ID NO: 574134 - protein, 9 aa, Homo Sapiens
VCVFRIFKL

SEQ ID NO: 574135 - protein, 9 aa, Homo Sapiens
DLLGAQWGG

SEQ ID NO: 574136 - protein, 9 aa, Homo Sapiens
HLTGSISYA

SEQ ID NO: 574137 - protein, 9 aa, Homo Sapiens
FCEKPLLEK

SEQ ID NO: 574138 - protein, 9 aa, Homo Sapiens
CMRGLGPEE

SEQ ID NO: 574139 - protein, 9 aa, Homo Sapiens
LGPEEAHVI

SEQ ID NO: 574140 - protein, 9 aa, Homo Sapiens
FAQEFNLLD

SEQ ID NO: 574141 - protein, 9 aa, Homo Sapiens
MLQICVLHH

SEQ ID NO: 574142 - protein, 9 aa, Homo Sapiens
DDQDREKSK

SEQ ID NO: 574143 - protein, 9 aa, Homo Sapiens
RQLQLLLWT

SEQ ID NO: 574144 - protein, 9 aa, Homo Sapiens
LLDTDMPMS

SEQ ID NO: 574145 - protein, 9 aa, Homo Sapiens
YSRSYGHLL

SEQ ID NO: 574146 - protein, 9 aa, Homo Sapiens
DLPPKPGSC

SEQ ID NO: 574147 - protein, 9 aa, Homo Sapiens
FTTQRRSCD

SEQ ID NO: 574148 - protein, 9 aa, Homo Sapiens
TGYFFGLGM

SEQ ID NO: 574149 - protein, 9 aa, Homo Sapiens
SKLKEFCEK

SEQ ID NO: 574150 - protein, 9 aa, Homo Sapiens
KKKIMYLTT

SEQ ID NO: 574151 - protein, 9 aa, Homo Sapiens
GESLEVANS

SEQ ID NO: 574152 - protein, 9 aa, Homo Sapiens
CEVCLLRVM

SEQ ID NO: 574153 - protein, 9 aa, Homo Sapiens
FLGIIFFFT

SEQ ID NO: 574154 - protein, 9 aa, Homo Sapiens
SEAIQKAIR

SEQ ID NO: 574155 - protein, 9 aa, Homo Sapiens
VGLSQPHSS

SEQ ID NO: 574156 - protein, 9 aa, Homo Sapiens
CTECGRKML

SEQ ID NO: 574157 - protein, 9 aa, Homo Sapiens
LARQLQLLL

SEQ ID NO: 574158 - protein, 9 aa, Homo Sapiens
VAEQRSQKH

SEQ ID NO: 574159 - protein, 9 aa, Homo Sapiens
LSGSSTGGI

SEQ ID NO: 574160 - protein, 9 aa, Homo Sapiens
LGIIFFFTF

SEQ ID NO: 574161 - protein, 9 aa, Homo Sapiens
QPGQLVAEQ

SEQ ID NO: 574162 - protein, 9 aa, Homo Sapiens
KKSQLSLGG

SEQ ID NO: 574163 - protein, 9 aa, Homo Sapiens
QATPKAQDF

SEQ ID NO: 574164 - protein, 9 aa, Homo Sapiens
VSAASAGGS

SEQ ID NO: 574165 - protein, 9 aa, Homo Sapiens
AISTRLGFD

SEQ ID NO: 574166 - protein, 9 aa, Homo Sapiens
LELMDLLGA

SEQ ID NO: 574167 - protein, 9 aa, Homo Sapiens
SISSKLKEF

SEQ ID NO: 574168 - protein, 9 aa, Homo Sapiens
LQPHFEARF

SEQ ID NO: 574169 - protein, 9 aa, Homo Sapiens
SGSSTGGIL

SEQ ID NO: 574170 - protein, 9 aa, Homo Sapiens
DALSQLTKY

SEQ ID NO: 574171 - protein, 9 aa, Homo Sapiens
TVNGLERVS

SEQ ID NO: 574172 - protein, 9 aa, Homo Sapiens
WTSGSSKGE

SEQ ID NO: 574173 - protein, 9 aa, Homo Sapiens
LDLYSIIAE

SEQ ID NO: 574174 - protein, 9 aa, Homo Sapiens
SQTPESEHS

SEQ ID NO: 574175 - protein, 9 aa, Homo Sapiens
AEQRSQKHP

SEQ ID NO: 574176 - protein, 9 aa, Homo Sapiens
LSKEQVLRF

SEQ ID NO: 574177 - protein, 9 aa, Homo Sapiens
EEILPEEEE

SEQ ID NO: 574178 - protein, 9 aa, Homo Sapiens
IRLVCVFRI

SEQ ID NO: 574179 - protein, 9 aa, Homo Sapiens
HWEKLKQLA

SEQ ID NO: 574180 - protein, 9 aa, Homo Sapiens
PVSMPVVGT

SEQ ID NO: 574181 - protein, 9 aa, Homo Sapiens
LLKLTWTFN

SEQ ID NO: 574182 - protein, 9 aa, Homo Sapiens
AFCAEMGFP

SEQ ID NO: 574183 - protein, 9 aa, Homo Sapiens
GQPGSQVPD

SEQ ID NO: 574184 - protein, 9 aa, Homo Sapiens
TTVNGLERV

SEQ ID NO: 574185 - protein, 9 aa, Homo Sapiens
HVKLKTLTP

SEQ ID NO: 574186 - protein, 9 aa, Homo Sapiens
TETVLFRES

SEQ ID NO: 574187 - protein, 9 aa, Homo Sapiens
TITAPSLSG

SEQ ID NO: 574188 - protein, 9 aa, Homo Sapiens
PHFEARFLR

SEQ ID NO: 574189 - protein, 9 aa, Homo Sapiens
TGSISYANW

SEQ ID NO: 574190 - protein, 9 aa, Homo Sapiens
DPAGSWTCG

SEQ ID NO: 574191 - protein, 9 aa, Homo Sapiens
DPLLDTDMP

SEQ ID NO: 574192 - protein, 9 aa, Homo Sapiens
IFTCESKGK

SEQ ID NO: 574193 - protein, 9 aa, Homo Sapiens
SENLLSLCL

SEQ ID NO: 574194 - protein, 9 aa, Homo Sapiens
WFEKSFTLI

SEQ ID NO: 574195 - protein, 9 aa, Homo Sapiens
NNRSLDLYS

SEQ ID NO: 574196 - protein, 9 aa, Homo Sapiens
SYDIVLVQG

SEQ ID NO: 574197 - protein, 9 aa, Homo Sapiens
EQERFFEGK

SEQ ID NO: 574198 - protein, 9 aa, Homo Sapiens
HFLLASLLG

SEQ ID NO: 574199 - protein, 9 aa, Homo Sapiens
SIHNGEKPY

SEQ ID NO: 574200 - protein, 9 aa, Homo Sapiens
DTDMPMSEF

SEQ ID NO: 574201 - protein, 9 aa, Homo Sapiens
GQDPLAPPV

SEQ ID NO: 574202 - protein, 9 aa, Homo Sapiens
SSKLKEFCE

SEQ ID NO: 574203 - protein, 9 aa, Homo Sapiens
SDIIEIYTD

SEQ ID NO: 574204 - protein, 9 aa, Homo Sapiens
LIFTCESKG

SEQ ID NO: 574205 - protein, 9 aa, Homo Sapiens
PMSEFSDTL

SEQ ID NO: 574206 - protein, 9 aa, Homo Sapiens
KLAACQDQL

SEQ ID NO: 574207 - protein, 9 aa, Homo Sapiens
NDYRWRGPS

SEQ ID NO: 574208 - protein, 9 aa, Homo Sapiens
TSYKAFRAA

SEQ ID NO: 574209 - protein, 9 aa, Homo Sapiens
EILPEEEEI

SEQ ID NO: 574210 - protein, 9 aa, Homo Sapiens
AACQDQLQG

SEQ ID NO: 574211 - protein, 9 aa, Homo Sapiens
RKLLEYCKD

SEQ ID NO: 574212 - protein, 9 aa, Homo Sapiens
TSSSTETRS

SEQ ID NO: 574213 - protein, 9 aa, Homo Sapiens
PAEPGPGEV

SEQ ID NO: 574214 - protein, 9 aa, Homo Sapiens
KICKGPRKK

SEQ ID NO: 574215 - protein, 9 aa, Homo Sapiens
TPKAQDFHW

SEQ ID NO: 574216 - protein, 9 aa, Homo Sapiens
RPAEPGPGE

SEQ ID NO: 574217 - protein, 9 aa, Homo Sapiens
PGIFRGDKW

SEQ ID NO: 574218 - protein, 9 aa, Homo Sapiens
LDPAGSWTC

SEQ ID NO: 574219 - protein, 9 aa, Homo Sapiens
TDDLVLRKN

SEQ ID NO: 574220 - protein, 9 aa, Homo Sapiens
DSEAIQKAI

SEQ ID NO: 574221 - protein, 9 aa, Homo Sapiens
VKLKTLTPC

SEQ ID NO: 574222 - protein, 9 aa, Homo Sapiens
HYRLQPHFE

SEQ ID NO: 574223 - protein, 9 aa, Homo Sapiens
VIYRPHPAA

SEQ ID NO: 574224 - protein, 9 aa, Homo Sapiens
HFILFAQEF

SEQ ID NO: 574225 - protein, 9 aa, Homo Sapiens
YSIIAEVKA

SEQ ID NO: 574226 - protein, 9 aa, Homo Sapiens
VLPEEEEIL

SEQ ID NO: 574227 - protein, 9 aa, Homo Sapiens
LEYCKDLSL

SEQ ID NO: 574228 - protein, 9 aa, Homo Sapiens
SGATITAPS

SEQ ID NO: 574229 - protein, 9 aa, Homo Sapiens
EFGPAIDDG

SEQ ID NO: 574230 - protein, 9 aa, Homo Sapiens
DYRWRGPSP

SEQ ID NO: 574231 - protein, 9 aa, Homo Sapiens
LENCILKCK

SEQ ID NO: 574232 - protein, 9 aa, Homo Sapiens
QEVREKNQT

SEQ ID NO: 574233 - protein, 9 aa, Homo Sapiens
TYYKSIHNG

SEQ ID NO: 574234 - protein, 9 aa, Homo Sapiens
ELMDLLGAQ

SEQ ID NO: 574235 - protein, 9 aa, Homo Sapiens
LTGYFFGLG

SEQ ID NO: 574236 - protein, 9 aa, Homo Sapiens
NINTLGLGL

SEQ ID NO: 574237 - protein, 9 aa, Homo Sapiens
FFFTFFLQG

SEQ ID NO: 574238 - protein, 9 aa, Homo Sapiens
WSDIGPRAR

SEQ ID NO: 574239 - protein, 9 aa, Homo Sapiens
IEFGPAIDD

SEQ ID NO: 574240 - protein, 9 aa, Homo Sapiens
PQLAAQNGH

SEQ ID NO: 574241 - protein, 9 aa, Homo Sapiens
RSYGHLLSY

SEQ ID NO: 574242 - protein, 9 aa, Homo Sapiens
GEARGYWGQ

SEQ ID NO: 574243 - protein, 9 aa, Homo Sapiens
FRAARVTAR

SEQ ID NO: 574244 - protein, 9 aa, Homo Sapiens
FGPAIDDGN

SEQ ID NO: 574245 - protein, 9 aa, Homo Sapiens
RTSSPSRAT

SEQ ID NO: 574246 - protein, 9 aa, Homo Sapiens
LFCLAELTM

SEQ ID NO: 574247 - protein, 9 aa, Homo Sapiens
SVIYRPHPA

SEQ ID NO: 574248 - protein, 9 aa, Homo Sapiens
ARQLQLLLW

SEQ ID NO: 574249 - protein, 9 aa, Homo Sapiens
LFAQEFNLL

SEQ ID NO: 574250 - protein, 9 aa, Homo Sapiens
KAVTLFDDV

SEQ ID NO: 574251 - protein, 9 aa, Homo Sapiens
GYIQGMSDL

SEQ ID NO: 574252 - protein, 9 aa, Homo Sapiens
QDREKSKPA

SEQ ID NO: 574253 - protein, 9 aa, Homo Sapiens
DAAGHRPAE

SEQ ID NO: 574254 - protein, 9 aa, Homo Sapiens
QDPLAPPVD

SEQ ID NO: 574255 - protein, 9 aa, Homo Sapiens
LGYIQGMSD

SEQ ID NO: 574256 - protein, 9 aa, Homo Sapiens
LLILFCLAE

SEQ ID NO: 574257 - protein, 9 aa, Homo Sapiens
KGPRKKSQL

SEQ ID NO: 574258 - protein, 9 aa, Homo Sapiens
KKIMYLTTR

SEQ ID NO: 574259 - protein, 9 aa, Homo Sapiens
HSGATITAP

SEQ ID NO: 574260 - protein, 9 aa, Homo Sapiens
GRKMLQICV

SEQ ID NO: 574261 - protein, 9 aa, Homo Sapiens
CVFRIFKLS

SEQ ID NO: 574262 - protein, 9 aa, Homo Sapiens
TSGSSKGEP

SEQ ID NO: 574263 - protein, 9 aa, Homo Sapiens
KEQVLRFVM

SEQ ID NO: 574264 - protein, 9 aa, Homo Sapiens
EYCKDLSLL

SEQ ID NO: 574265 - protein, 9 aa, Homo Sapiens
DLYSIIAEV

SEQ ID NO: 574266 - protein, 9 aa, Homo Sapiens
CDSGTRMDS

SEQ ID NO: 574267 - protein, 9 aa, Homo Sapiens
SYHPGIFRG

SEQ ID NO: 574268 - protein, 9 aa, Homo Sapiens
LQLLLWTAC

SEQ ID NO: 574269 - protein, 9 aa, Homo Sapiens
EQGDDQDRE

SEQ ID NO: 574270 - protein, 9 aa, Homo Sapiens
SSKKKKKIM

SEQ ID NO: 574271 - protein, 9 aa, Homo Sapiens
QPHFEARFL

SEQ ID NO: 574272 - protein, 9 aa, Homo Sapiens
ITAPSLSGK

SEQ ID NO: 574273 - protein, 9 aa, Homo Sapiens
KGEPLQALT

SEQ ID NO: 574274 - protein, 9 aa, Homo Sapiens
YTLNFSGDS

SEQ ID NO: 574275 - protein, 9 aa, Homo Sapiens
TIVQQIAIL

SEQ ID NO: 574276 - protein, 9 aa, Homo Sapiens
TSSPSRATR

SEQ ID NO: 574277 - protein, 9 aa, Homo Sapiens
ITETVLFRE

SEQ ID NO: 574278 - protein, 9 aa, Homo Sapiens
RTANLRLPQ

SEQ ID NO: 574279 - protein, 9 aa, Homo Sapiens
ASYGYNINT

SEQ ID NO: 574280 - protein, 9 aa, Homo Sapiens
KKTSSSTET

SEQ ID NO: 574281 - protein, 9 aa, Homo Sapiens
AGSWTCGQP

SEQ ID NO: 574282 - protein, 9 aa, Homo Sapiens
ETDDLVLRK

SEQ ID NO: 574283 - protein, 9 aa, Homo Sapiens
HNGQDPLAP

SEQ ID NO: 574284 - protein, 9 aa, Homo Sapiens
LQICVLHHE

SEQ ID NO: 574285 - protein, 9 aa, Homo Sapiens
HSRDFHATE

SEQ ID NO: 574286 - protein, 9 aa, Homo Sapiens
KEKKAVTLF

SEQ ID NO: 574287 - protein, 9 aa, Homo Sapiens
PLQYTLNFS

SEQ ID NO: 574288 - protein, 9 aa, Homo Sapiens
QDLVEWLNV

SEQ ID NO: 574289 - protein, 9 aa, Homo Sapiens
RSKLRKKLF

SEQ ID NO: 574290 - protein, 9 aa, Homo Sapiens
LQEVREKNQ

SEQ ID NO: 574291 - protein, 9 aa, Homo Sapiens
SPGVHRPHC

SEQ ID NO: 574292 - protein, 9 aa, Homo Sapiens
GSWTCGQPG

SEQ ID NO: 574293 - protein, 9 aa, Homo Sapiens
YKAFRAARV

SEQ ID NO: 574294 - protein, 9 aa, Homo Sapiens
LKLTWTFNN

SEQ ID NO: 574295 - protein, 9 aa, Homo Sapiens
VDSEAIQKA

SEQ ID NO: 574296 - protein, 9 aa, Homo Sapiens
YRLQPHFEA

SEQ ID NO: 574297 - protein, 9 aa, Homo Sapiens
TLLILFCLA

SEQ ID NO: 574298 - protein, 9 aa, Homo Sapiens
ERVSLTVQC

SEQ ID NO: 574299 - protein, 9 aa, Homo Sapiens
SQKHPGCCT

SEQ ID NO: 574300 - protein, 9 aa, Homo Sapiens
ILFCLAELT

SEQ ID NO: 574301 - protein, 9 aa, Homo Sapiens
LGAISTRLG

SEQ ID NO: 574302 - protein, 9 aa, Homo Sapiens
QPGSQVPDL

SEQ ID NO: 574303 - protein, 9 aa, Homo Sapiens
LVGLSQPHS

SEQ ID NO: 574304 - protein, 9 aa, Homo Sapiens
IFFFTFFLQ

SEQ ID NO: 574305 - protein, 9 aa, Homo Sapiens
QARHTGITI

SEQ ID NO: 574306 - protein, 9 aa, Homo Sapiens
EFCEKPLLE

SEQ ID NO: 574307 - protein, 9 aa, Homo Sapiens
RSQKHPGCC

SEQ ID NO: 574308 - protein, 9 aa, Homo Sapiens
AKLAACQDQ

SEQ ID NO: 574309 - protein, 9 aa, Homo Sapiens
KHPGCCTAA

SEQ ID NO: 574310 - protein, 9 aa, Homo Sapiens
QTPESEHSR

SEQ ID NO: 574311 - protein, 9 aa, Homo Sapiens
AEMGFPHRG

SEQ ID NO: 574312 - protein, 9 aa, Homo Sapiens
YQGLSKEQV

SEQ ID NO: 574313 - protein, 9 aa, Homo Sapiens
YHPGIFRGD

SEQ ID NO: 574314 - protein, 9 aa, Homo Sapiens
PESEHSRDF

SEQ ID NO: 574315 - protein, 9 aa, Homo Sapiens
VEVEQERFF

SEQ ID NO: 574316 - protein, 9 aa, Homo Sapiens
QGLSKEQVL

SEQ ID NO: 574317 - protein, 9 aa, Homo Sapiens
GDWSDIGPR

SEQ ID NO: 574318 - protein, 9 aa, Homo Sapiens
LTGSISYAN

SEQ ID NO: 574319 - protein, 9 aa, Homo Sapiens
GIRGLKGQK

SEQ ID NO: 574320 - protein, 9 aa, Homo Sapiens
GSQTPESEH

SEQ ID NO: 574321 - protein, 9 aa, Homo Sapiens
KKLFPSTKK

SEQ ID NO: 574322 - protein, 9 aa, Homo Sapiens
SNISSGWSP

SEQ ID NO: 574323 - protein, 9 aa, Homo Sapiens
VLVQGESLE

SEQ ID NO: 574324 - protein, 9 aa, Homo Sapiens
ISSKKKKKI

SEQ ID NO: 574325 - protein, 9 aa, Homo Sapiens
RKMLQICVL

SEQ ID NO: 574326 - protein, 9 aa, Homo Sapiens
QGDDQDREK

SEQ ID NO: 574327 - protein, 9 aa, Homo Sapiens
NLYAGKCLL

SEQ ID NO: 574328 - protein, 9 aa, Homo Sapiens
LSYSRSYGH

SEQ ID NO: 574329 - protein, 9 aa, Homo Sapiens
PGQLVAEQR

SEQ ID NO: 574330 - protein, 9 aa, Homo Sapiens
HPGIFRGDK

SEQ ID NO: 574331 - protein, 9 aa, Homo Sapiens
DIIEIYTDQ

SEQ ID NO: 574332 - protein, 9 aa, Homo Sapiens
NKSSDIIEI

SEQ ID NO: 574333 - protein, 9 aa, Homo Sapiens
LDTDMPMSE

SEQ ID NO: 574334 - protein, 9 aa, Homo Sapiens
KSSDIIEIY

SEQ ID NO: 574335 - protein, 9 aa, Homo Sapiens
SPLSISAAN

SEQ ID NO: 574336 - protein, 9 aa, Homo Sapiens
MPLTLLILF

SEQ ID NO: 574337 - protein, 9 aa, Homo Sapiens
NVEVEQERF

SEQ ID NO: 574338 - protein, 9 aa, Homo Sapiens
MPMSEFSDT

SEQ ID NO: 574339 - protein, 9 aa, Homo Sapiens
EEEEILPEE

SEQ ID NO: 574340 - protein, 9 aa, Homo Sapiens
RLRGDWSDI

SEQ ID NO: 574341 - protein, 9 aa, Homo Sapiens
LQYTLNFSG

SEQ ID NO: 574342 - protein, 9 aa, Homo Sapiens
SDCSLFMFS

SEQ ID NO: 574343 - protein, 9 aa, Homo Sapiens
DIGPRARPE

SEQ ID NO: 574344 - protein, 9 aa, Homo Sapiens
TPESEHSRD

SEQ ID NO: 574345 - protein, 9 aa, Homo Sapiens
EQPYQGLSK

SEQ ID NO: 574346 - protein, 9 aa, Homo Sapiens
HPAALSSVP

SEQ ID NO: 574347 - protein, 9 aa, Homo Sapiens
EPLQALTRE

SEQ ID NO: 574348 - protein, 9 aa, Homo Sapiens
PDFSPSVDS

SEQ ID NO: 574349 - protein, 9 aa, Homo Sapiens
ILKCKGTGV

SEQ ID NO: 574350 - protein, 9 aa, Homo Sapiens
KKEKKAVTL

SEQ ID NO: 574351 - protein, 9 aa, Homo Sapiens
NGLERVSLT

SEQ ID NO: 574352 - protein, 9 aa, Homo Sapiens
SPSVDSEAI

SEQ ID NO: 574353 - protein, 9 aa, Homo Sapiens
VIMGSFAPP

SEQ ID NO: 574354 - protein, 9 aa, Homo Sapiens
FSSHNKKRP

SEQ ID NO: 574355 - protein, 9 aa, Homo Sapiens
AVTLFDDVT

SEQ ID NO: 574356 - protein, 9 aa, Homo Sapiens
YGYNINTLG

SEQ ID NO: 574357 - protein, 9 aa, Homo Sapiens
QHPVSMPVV

SEQ ID NO: 574358 - protein, 9 aa, Homo Sapiens
GQPLIFTCE

SEQ ID NO: 574359 - protein, 9 aa, Homo Sapiens
LKTLTPCGW

SEQ ID NO: 574360 - protein, 9 aa, Homo Sapiens
CGQPGSQVP

SEQ ID NO: 574361 - protein, 9 aa, Homo Sapiens
ICEVCLLRV

SEQ ID NO: 574362 - protein, 9 aa, Homo Sapiens
DSLGAISTR

SEQ ID NO: 574363 - protein, 9 aa, Homo Sapiens
LNDYRWRGP

SEQ ID NO: 574364 - protein, 9 aa, Homo Sapiens
VEHWEKLKQ

SEQ ID NO: 574365 - protein, 9 aa, Homo Sapiens
LFLGIIFFF

SEQ ID NO: 574366 - protein, 9 aa, Homo Sapiens
LRKKLFPST

SEQ ID NO: 574367 - protein, 9 aa, Homo Sapiens
LFDDVTVYL

SEQ ID NO: 574368 - protein, 9 aa, Homo Sapiens
GPEEAHVIR

SEQ ID NO: 574369 - protein, 9 aa, Homo Sapiens
LTLLILFCL

SEQ ID NO: 574370 - protein, 9 aa, Homo Sapiens
GYFFGLGMT

SEQ ID NO: 574371 - protein, 9 aa, Homo Sapiens
MDSLGAIST

SEQ ID NO: 574372 - protein, 9 aa, Homo Sapiens
GIFRGDKWS

SEQ ID NO: 574373 - protein, 9 aa, Homo Sapiens
KATGIPLLK

SEQ ID NO: 574374 - protein, 9 aa, Homo Sapiens
LNFSGDSQK

SEQ ID NO: 574375 - protein, 9 aa, Homo Sapiens
DPDHVKTLT

SEQ ID NO: 574376 - protein, 9 aa, Homo Sapiens
LCLDEYEET

SEQ ID NO: 574377 - protein, 9 aa, Homo Sapiens
LLGAQWGGM

SEQ ID NO: 574378 - protein, 9 aa, Homo Sapiens
HPVSMPVVG

SEQ ID NO: 574379 - protein, 9 aa, Homo Sapiens
VLMFETDDL

SEQ ID NO: 574380 - protein, 9 aa, Homo Sapiens
GLSKEQVLR

SEQ ID NO: 574381 - protein, 9 aa, Homo Sapiens
DHVKTLTPC

SEQ ID NO: 574382 - protein, 9 aa, Homo Sapiens
NSLELMDLL

SEQ ID NO: 574383 - protein, 9 aa, Homo Sapiens
MIEPQATPK

SEQ ID NO: 574384 - protein, 9 aa, Homo Sapiens
DEGLIEFGP

SEQ ID NO: 574385 - protein, 9 aa, Homo Sapiens
RVMAFDHYL

SEQ ID NO: 574386 - protein, 9 aa, Homo Sapiens
VEQERFFEG

SEQ ID NO: 574387 - protein, 9 aa, Homo Sapiens
SRATRDNPR

SEQ ID NO: 574388 - protein, 9 aa, Homo Sapiens
DHVKLKTLT

SEQ ID NO: 574389 - protein, 9 aa, Homo Sapiens
IYTDQDIPE

SEQ ID NO: 574390 - protein, 9 aa, Homo Sapiens
TANLRLPQR

SEQ ID NO: 574391 - protein, 9 aa, Homo Sapiens
QKHPGCCTA

SEQ ID NO: 574392 - protein, 9 aa, Homo Sapiens
NGQDPLAPP

SEQ ID NO: 574393 - protein, 9 aa, Homo Sapiens
PQEGQPLIF

SEQ ID NO: 574394 - protein, 9 aa, Homo Sapiens
GFPHRGYSI

SEQ ID NO: 574395 - protein, 9 aa, Homo Sapiens
LSLCLDEYE

SEQ ID NO: 574396 - protein, 9 aa, Homo Sapiens
IYRPHPAAL

SEQ ID NO: 574397 - protein, 9 aa, Homo Sapiens
SSTGGILAA

SEQ ID NO: 574398 - protein, 9 aa, Homo Sapiens
IHSGATITA

SEQ ID NO: 574399 - protein, 9 aa, Homo Sapiens
LFMFSSHNK

SEQ ID NO: 574400 - protein, 9 aa, Homo Sapiens
PYQGLSKEQ

SEQ ID NO: 574401 - protein, 9 aa, Homo Sapiens
FSPSVDSEA

SEQ ID NO: 574402 - protein, 9 aa, Homo Sapiens
CEKPYECYI

SEQ ID NO: 574403 - protein, 9 aa, Homo Sapiens
VCLLRVMAF

SEQ ID NO: 574404 - protein, 9 aa, Homo Sapiens
RAARVTARV

SEQ ID NO: 574405 - protein, 9 aa, Homo Sapiens
LTYYKSIHN

SEQ ID NO: 574406 - protein, 9 aa, Homo Sapiens
GKCLLIVME

SEQ ID NO: 574407 - protein, 9 aa, Homo Sapiens
CILKCKGTG

SEQ ID NO: 574408 - protein, 9 aa, Homo Sapiens
VNGLERVSL

SEQ ID NO: 574409 - protein, 9 aa, Homo Sapiens
ESEHSRDFH

SEQ ID NO: 574410 - protein, 9 aa, Homo Sapiens
SEHSRDFHA

SEQ ID NO: 574411 - protein, 9 aa, Homo Sapiens
AQEFNLLDP

SEQ ID NO: 574412 - protein, 9 aa, Homo Sapiens
TVLFRESTT

SEQ ID NO: 574413 - protein, 9 aa, Homo Sapiens
VHFILFAQE

SEQ ID NO: 574414 - protein, 9 aa, Homo Sapiens
KKKKKIMYL

SEQ ID NO: 574415 - protein, 9 aa, Homo Sapiens
CGRKMLQIC

SEQ ID NO: 574416 - protein, 9 aa, Homo Sapiens
YVHFILFAQ

SEQ ID NO: 574417 - protein, 9 aa, Homo Sapiens
TLASYGYNI

SEQ ID NO: 574418 - protein, 9 aa, Homo Sapiens
NCILKCKGT

SEQ ID NO: 574419 - protein, 9 aa, Homo Sapiens
GLGPEEAHV

SEQ ID NO: 574420 - protein, 9 aa, Homo Sapiens
YCKDLSLLD

SEQ ID NO: 574421 - protein, 9 aa, Homo Sapiens
EVLMFETDD

SEQ ID NO: 574422 - protein, 9 aa, Homo Sapiens
VYENLYAGK

SEQ ID NO: 574423 - protein, 9 aa, Homo Sapiens
HTGITIVQQ

SEQ ID NO: 574424 - protein, 9 aa, Homo Sapiens
VKTLTPCGW

SEQ ID NO: 574425 - protein, 9 aa, Homo Sapiens
AANSTQSPP

SEQ ID NO: 574426 - protein, 9 aa, Homo Sapiens
DLVEWLNVL

SEQ ID NO: 574427 - protein, 9 aa, Homo Sapiens
AAGHRPAEP

SEQ ID NO: 574428 - protein, 9 aa, Homo Sapiens
APPVCTSSP

SEQ ID NO: 574429 - protein, 9 aa, Homo Sapiens
TDMPMSEFS

SEQ ID NO: 574430 - protein, 9 aa, Homo Sapiens
FCAEMGFPH

SEQ ID NO: 574431 - protein, 9 aa, Homo Sapiens
LKGQKGEKG

SEQ ID NO: 574432 - protein, 9 aa, Homo Sapiens
NTSYKAFRA

SEQ ID NO: 574433 - protein, 9 aa, Homo Sapiens
VSENLLSLC

SEQ ID NO: 574434 - protein, 9 aa, Homo Sapiens
EHWEKLKQL

SEQ ID NO: 574435 - protein, 9 aa, Homo Sapiens
VTLFDDVTV

SEQ ID NO: 574436 - protein, 9 aa, Homo Sapiens
ILRVIRLVC

SEQ ID NO: 574437 - protein, 9 aa, Homo Sapiens
EKLKQLAKA

SEQ ID NO: 574438 - protein, 9 aa, Homo Sapiens
EDALSQLTK

SEQ ID NO: 574439 - protein, 9 aa, Homo Sapiens
YRWRGPSPN

SEQ ID NO: 574440 - protein, 9 aa, Homo Sapiens
GLKGQKGEK

SEQ ID NO: 574441 - protein, 9 aa, Homo Sapiens
DLGYIQGMS

SEQ ID NO: 574442 - protein, 9 aa, Homo Sapiens
SKLRKKLFP

SEQ ID NO: 574443 - protein, 9 aa, Homo Sapiens
GHQPGQLVA

SEQ ID NO: 574444 - protein, 9 aa, Homo Sapiens
ILWAINHII

SEQ ID NO: 574445 - protein, 9 aa, Homo Sapiens
FILFAQEFN

SEQ ID NO: 574446 - protein, 9 aa, Homo Sapiens
WSPLSPSAV

SEQ ID NO: 574447 - protein, 9 aa, Homo Sapiens
VVHYRLQPH

SEQ ID NO: 574448 - protein, 9 aa, Homo Sapiens
EPQATPKAQ

SEQ ID NO: 574449 - protein, 9 aa, Homo Sapiens
AVFDAVFNG

SEQ ID NO: 574450 - protein, 9 aa, Homo Sapiens
GGHEPLVGF

SEQ ID NO: 574451 - protein, 9 aa, Homo Sapiens
EKKAVTLFD

SEQ ID NO: 574452 - protein, 9 aa, Homo Sapiens
TSFLTGYFF

SEQ ID NO: 574453 - protein, 9 aa, Homo Sapiens
YRPHPAALS

SEQ ID NO: 574454 - protein, 9 aa, Homo Sapiens
PSVDSEAIQ

SEQ ID NO: 574455 - protein, 9 aa, Homo Sapiens
VLFRESTTV

SEQ ID NO: 574456 - protein, 9 aa, Homo Sapiens
EPLVGFLLR

SEQ ID NO: 574457 - protein, 9 aa, Homo Sapiens
INHIIRNFC

SEQ ID NO: 574458 - protein, 9 aa, Homo Sapiens
DNPRTSSPS

SEQ ID NO: 574459 - protein, 9 aa, Homo Sapiens
GSYHPGIFR

SEQ ID NO: 574460 - protein, 9 aa, Homo Sapiens
YAGKCLLIV

SEQ ID NO: 574461 - protein, 9 aa, Homo Sapiens
IGPRARPES

SEQ ID NO: 574462 - protein, 9 aa, Homo Sapiens
RVSLTVQCV

SEQ ID NO: 574463 - protein, 9 aa, Homo Sapiens
LIEFGPAID

SEQ ID NO: 574464 - protein, 9 aa, Homo Sapiens
LTPCGWHCV

SEQ ID NO: 574465 - protein, 9 aa, Homo Sapiens
SLFMFSSHN

SEQ ID NO: 574466 - protein, 9 aa, Homo Sapiens
LLEYCKDLS

SEQ ID NO: 574467 - protein, 9 aa, Homo Sapiens
ANLRLPQRP

SEQ ID NO: 574468 - protein, 9 aa, Homo Sapiens
GPRKKSQLS

SEQ ID NO: 574469 - protein, 9 aa, Homo Sapiens
LLVGLSQPH

SEQ ID NO: 574470 - protein, 9 aa, Homo Sapiens
CYNRWFEKS

SEQ ID NO: 574471 - protein, 9 aa, Homo Sapiens
HQPGQLVAE

SEQ ID NO: 574472 - protein, 9 aa, Homo Sapiens
RLQEVREKN

SEQ ID NO: 574473 - protein, 9 aa, Homo Sapiens
SSKGEPLQA

SEQ ID NO: 574474 - protein, 9 aa, Homo Sapiens
SGWSPLSPS

SEQ ID NO: 574475 - protein, 9 aa, Homo Sapiens
KTSSSTETR

SEQ ID NO: 574476 - protein, 9 aa, Homo Sapiens
ISSGWSPLS

SEQ ID NO: 574477 - protein, 9 aa, Homo Sapiens
RLQPHFEAR

SEQ ID NO: 574478 - protein, 9 aa, Homo Sapiens
RGDWSDIGP

SEQ ID NO: 574479 - protein, 9 aa, Homo Sapiens
CLDEYEETP

SEQ ID NO: 574480 - protein, 9 aa, Homo Sapiens
HFEARFLRF

SEQ ID NO: 574481 - protein, 9 aa, Homo Sapiens
KLLEYCKDL

SEQ ID NO: 574482 - protein, 9 aa, Homo Sapiens
LKQLAKARG

SEQ ID NO: 574483 - protein, 9 aa, Homo Sapiens
FFGLGMTLV

SEQ ID NO: 574484 - protein, 9 aa, Homo Sapiens
PLSISAANS

SEQ ID NO: 574485 - protein, 9 aa, Homo Sapiens
HCMRGLGPE

SEQ ID NO: 574486 - protein, 9 aa, Homo Sapiens
FPHRGYSIS

SEQ ID NO: 574487 - protein, 9 aa, Homo Sapiens
RPHCNVTCP

SEQ ID NO: 574488 - protein, 9 aa, Homo Sapiens
DDLVLRKNE

SEQ ID NO: 574489 - protein, 9 aa, Homo Sapiens
GIIFFFTFF

SEQ ID NO: 574490 - protein, 9 aa, Homo Sapiens
ICKGPRKKS

SEQ ID NO: 574491 - protein, 9 aa, Homo Sapiens
YANWAGSRS

SEQ ID NO: 574492 - protein, 9 aa, Homo Sapiens
GGRLDPAGS

SEQ ID NO: 574493 - protein, 9 aa, Homo Sapiens
AVFNGGMAT

SEQ ID NO: 574494 - protein, 9 aa, Homo Sapiens
LSQPHSSLR

SEQ ID NO: 574495 - protein, 9 aa, Homo Sapiens
ECGRKMLQI

SEQ ID NO: 574496 - protein, 9 aa, Homo Sapiens
ACQDQLQGY

SEQ ID NO: 574497 - protein, 9 aa, Homo Sapiens
LSQLTKYHS

SEQ ID NO: 574498 - protein, 9 aa, Homo Sapiens
LLRTANLRL

SEQ ID NO: 574499 - protein, 9 aa, Homo Sapiens
TQHQRIHTC

SEQ ID NO: 574500 - protein, 9 aa, Homo Sapiens
DFPLQYTLN

SEQ ID NO: 574501 - protein, 9 aa, Homo Sapiens
PKAQDFHWL

SEQ ID NO: 574502 - protein, 9 aa, Homo Sapiens
KLKTLTPCG

SEQ ID NO: 574503 - protein, 9 aa, Homo Sapiens
MGSFAPPVC

SEQ ID NO: 574504 - protein, 9 aa, Homo Sapiens
VGTYDLSGD

SEQ ID NO: 574505 - protein, 9 aa, Homo Sapiens
PVVGTYDLS

SEQ ID NO: 574506 - protein, 9 aa, Homo Sapiens
IMIEPQATP

SEQ ID NO: 574507 - protein, 9 aa, Homo Sapiens
RRKMKKTSS

SEQ ID NO: 574508 - protein, 9 aa, Homo Sapiens
ENLLSLCLD

SEQ ID NO: 574509 - protein, 9 aa, Homo Sapiens
VGSAVFDAV

SEQ ID NO: 574510 - protein, 9 aa, Homo Sapiens
EILWAINHI

SEQ ID NO: 574511 - protein, 9 aa, Homo Sapiens
PDHVKTLTP

SEQ ID NO: 574512 - protein, 9 aa, Homo Sapiens
KLKQLAKAR

SEQ ID NO: 574513 - protein, 9 aa, Homo Sapiens
LPEEEEILP

SEQ ID NO: 574514 - protein, 9 aa, Homo Sapiens
TECGRKMLQ

SEQ ID NO: 574515 - protein, 9 aa, Homo Sapiens
LRVMAFDHY

SEQ ID NO: 574516 - protein, 9 aa, Homo Sapiens
DGIRGLKGQ

SEQ ID NO: 574517 - protein, 9 aa, Homo Sapiens
NPRTSSPSR

SEQ ID NO: 574518 - protein, 9 aa, Homo Sapiens
ATGIPLLKL

SEQ ID NO: 574519 - protein, 9 aa, Homo Sapiens
DKLNDYRWR

SEQ ID NO: 574520 - protein, 9 aa, Homo Sapiens
FRESTTVMV

SEQ ID NO: 574521 - protein, 9 aa, Homo Sapiens
ARGYWGQES

SEQ ID NO: 574522 - protein, 9 aa, Homo Sapiens
FDAVFNGGM

SEQ ID NO: 574523 - protein, 9 aa, Homo Sapiens
RLPQRPCDA

SEQ ID NO: 574524 - protein, 9 aa, Homo Sapiens
SKEQVLRFV

SEQ ID NO: 574525 - protein, 9 aa, Homo Sapiens
AQNGHQPGQ

SEQ ID NO: 574526 - protein, 9 aa, Homo Sapiens
EHSRDFHAT

SEQ ID NO: 574527 - protein, 9 aa, Homo Sapiens
PRTSSPSRA

SEQ ID NO: 574528 - protein, 9 aa, Homo Sapiens
DSGTRMDSR

SEQ ID NO: 574529 - protein, 9 aa, Homo Sapiens
ASPLSISAA

SEQ ID NO: 574530 - protein, 9 aa, Homo Sapiens
GSFAPPVCT

SEQ ID NO: 574531 - protein, 9 aa, Homo Sapiens
GHEPLVGFL

SEQ ID NO: 574532 - protein, 9 aa, Homo Sapiens
EEEILPEEE

SEQ ID NO: 574533 - protein, 9 aa, Homo Sapiens
PAIDDGNYI

SEQ ID NO: 574534 - protein, 9 aa, Homo Sapiens
LPPKPGSCA

SEQ ID NO: 574535 - protein, 9 aa, Homo Sapiens
SDKLNDYRW

SEQ ID NO: 574536 - protein, 9 aa, Homo Sapiens
QLVAEQRSQ

SEQ ID NO: 574537 - protein, 9 aa, Homo Sapiens
PLTLLILFC

SEQ ID NO: 574538 - protein, 9 aa, Homo Sapiens
LRKLLEYCK

SEQ ID NO: 574539 - protein, 9 aa, Homo Sapiens
WEKLKQLAK

SEQ ID NO: 574540 - protein, 9 aa, Homo Sapiens
INTLGLGLS

SEQ ID NO: 574541 - protein, 9 aa, Homo Sapiens
TGITETVLF

SEQ ID NO: 574542 - protein, 9 aa, Homo Sapiens
RLDPAGSWT

SEQ ID NO: 574543 - protein, 9 aa, Homo Sapiens
EGVVSAASA

SEQ ID NO: 574544 - protein, 9 aa, Homo Sapiens
IMYLTTRNA

SEQ ID NO: 574545 - protein, 9 aa, Homo Sapiens
GEDAAGHRP

SEQ ID NO: 574546 - protein, 9 aa, Homo Sapiens
KEFCEKPLL

SEQ ID NO: 574547 - protein, 9 aa, Homo Sapiens
RGLKGQKGE

SEQ ID NO: 574548 - protein, 9 aa, Homo Sapiens
LRLPQRPCD

SEQ ID NO: 574549 - protein, 9 aa, Homo Sapiens
QLAAQNGHQ

SEQ ID NO: 574550 - protein, 9 aa, Homo Sapiens
SYANWAGSR

SEQ ID NO: 574551 - protein, 9 aa, Homo Sapiens
TFLLVGLSQ

SEQ ID NO: 574552 - protein, 9 aa, Homo Sapiens
MRGLGPEEA

SEQ ID NO: 574553 - protein, 9 aa, Homo Sapiens
FRLSGSSTG

SEQ ID NO: 574554 - protein, 9 aa, Homo Sapiens
GDDQDREKS

SEQ ID NO: 574555 - protein, 9 aa, Homo Sapiens
LLRVMAFDH

SEQ ID NO: 574556 - protein, 9 aa, Homo Sapiens
SAANSTQSP

SEQ ID NO: 574557 - protein, 9 aa, Homo Sapiens
GFLLRRGAS

SEQ ID NO: 574558 - protein, 9 aa, Homo Sapiens
LYAGKCLLI

SEQ ID NO: 574559 - protein, 9 aa, Homo Sapiens
VSLTVQCVY

SEQ ID NO: 574560 - protein, 9 aa, Homo Sapiens
FPSTKKGKS

SEQ ID NO: 574561 - protein, 9 aa, Homo Sapiens
DAVFNGGMA

SEQ ID NO: 574562 - protein, 9 aa, Homo Sapiens
YDIVLVQGE

SEQ ID NO: 574563 - protein, 9 aa, Homo Sapiens
NISSGWSPL

SEQ ID NO: 574564 - protein, 9 aa, Homo Sapiens
TGGILAAGV

SEQ ID NO: 574565 - protein, 9 aa, Homo Sapiens
MYAHFLLAS

SEQ ID NO: 574566 - protein, 9 aa, Homo Sapiens
SQLTKYHSA

SEQ ID NO: 574567 - protein, 9 aa, Homo Sapiens
QRRSCDSGT

SEQ ID NO: 574568 - protein, 9 aa, Homo Sapiens
NRWFEKSFT

SEQ ID NO: 574569 - protein, 9 aa, Homo Sapiens
LVGFLLRRG

SEQ ID NO: 574570 - protein, 9 aa, Homo Sapiens
SSSTETRSS

SEQ ID NO: 574571 - protein, 9 aa, Homo Sapiens
DNNRSLDLY

SEQ ID NO: 574572 - protein, 9 aa, Homo Sapiens
QERFFEGKN

SEQ ID NO: 574573 - protein, 9 aa, Homo Sapiens
LAAQNGHQP

SEQ ID NO: 574574 - protein, 9 aa, Homo Sapiens
QPLIFTCES

SEQ ID NO: 574575 - protein, 9 aa, Homo Sapiens
YENLYAGKC

SEQ ID NO: 574576 - protein, 9 aa, Homo Sapiens
LRTANLRLP

SEQ ID NO: 574577 - protein, 9 aa, Homo Sapiens
IEIYTDQDI

SEQ ID NO: 574578 - protein, 9 aa, Homo Sapiens
VIRLVCVFR

SEQ ID NO: 574579 - protein, 9 aa, Homo Sapiens
AALSSVPIQ

SEQ ID NO: 574580 - protein, 9 aa, Homo Sapiens
TNTSYKAFR

SEQ ID NO: 574581 - protein, 9 aa, Homo Sapiens
KTLTPCGWH

SEQ ID NO: 574582 - protein, 9 aa, Homo Sapiens
SPHNGQDPL

SEQ ID NO: 574583 - protein, 9 aa, Homo Sapiens
GAISTRLGF

SEQ ID NO: 574584 - protein, 9 aa, Homo Sapiens
LMFETDDLV

SEQ ID NO: 574585 - protein, 9 aa, Homo Sapiens
MAAEEGVVS

SEQ ID NO: 574586 - protein, 9 aa, Homo Sapiens
YIQGMSDLL

SEQ ID NO: 574587 - protein, 9 aa, Homo Sapiens
KGKEDALSQ

SEQ ID NO: 574588 - protein, 9 aa, Homo Sapiens
RVIRLVCVF

SEQ ID NO: 574589 - protein, 9 aa, Homo Sapiens
FCLAELTMA

SEQ ID NO: 574590 - protein, 9 aa, Homo Sapiens
RKKLFPSTK

SEQ ID NO: 574591 - protein, 9 aa, Homo Sapiens
FETDDLVLR

SEQ ID NO: 574592 - protein, 9 aa, Homo Sapiens
GITETVLFR

SEQ ID NO: 574593 - protein, 9 aa, Homo Sapiens
SISAANSTQ

SEQ ID NO: 574594 - protein, 9 aa, Homo Sapiens
KAFRAARVT

SEQ ID NO: 574595 - protein, 9 aa, Homo Sapiens
WTCGQPGSQ

SEQ ID NO: 574596 - protein, 9 aa, Homo Sapiens
GSAVFDAVF

SEQ ID NO: 574597 - protein, 9 aa, Homo Sapiens
VFDAVFNGG

SEQ ID NO: 574598 - protein, 9 aa, Homo Sapiens
AVLARQLQL

SEQ ID NO: 574599 - protein, 9 aa, Homo Sapiens
YFFGLGMTL

SEQ ID NO: 574600 - protein, 9 aa, Homo Sapiens
ISAANSTQS

SEQ ID NO: 574601 - protein, 9 aa, Homo Sapiens
PLLDTDMPM

SEQ ID NO: 574602 - protein, 9 aa, Homo Sapiens
SQPHSSLRE

SEQ ID NO: 574603 - protein, 9 aa, Homo Sapiens
KLFPSTKKG

SEQ ID NO: 574604 - protein, 9 aa, Homo Sapiens
CKATGIPLL

SEQ ID NO: 574605 - protein, 9 aa, Homo Sapiens
IEPQATPKA

SEQ ID NO: 574606 - protein, 9 aa, Homo Sapiens
VHYRLQPHF

SEQ ID NO: 574607 - protein, 9 aa, Homo Sapiens
TGIPLLKLT

SEQ ID NO: 574608 - protein, 9 aa, Homo Sapiens
KIMYLTTRN

SEQ ID NO: 574609 - protein, 9 aa, Homo Sapiens
MFSSHNKKR

SEQ ID NO: 574610 - protein, 9 aa, Homo Sapiens
MGFPHRGYS

SEQ ID NO: 574611 - protein, 9 aa, Homo Sapiens
LPQRPCDAA

SEQ ID NO: 574612 - protein, 9 aa, Homo Sapiens
QLQLLLWTA

SEQ ID NO: 574613 - protein, 9 aa, Homo Sapiens
QEGQPLIFT

SEQ ID NO: 574614 - protein, 9 aa, Homo Sapiens
RPHPAALSS

SEQ ID NO: 574615 - protein, 9 aa, Homo Sapiens
GWSPLSPSA

SEQ ID NO: 574616 - protein, 9 aa, Homo Sapiens
ENLYAGKCL

SEQ ID NO: 574617 - protein, 9 aa, Homo Sapiens
LASYGYNIN

SEQ ID NO: 574618 - protein, 9 aa, Homo Sapiens
EIYTDQDIP

SEQ ID NO: 574619 - protein, 9 aa, Homo Sapiens
NNVEVEQER

SEQ ID NO: 574620 - protein, 9 aa, Homo Sapiens
CLLRVMAFD

SEQ ID NO: 574621 - protein, 9 aa, Homo Sapiens
IRGLKGQKG

SEQ ID NO: 574622 - protein, 9 aa, Homo Sapiens
EMGFPHRGY

SEQ ID NO: 574623 - protein, 9 aa, Homo Sapiens
SYSRSYGHL

SEQ ID NO: 574624 - protein, 9 aa, Homo Sapiens
TPCGWHCVQ

SEQ ID NO: 574625 - protein, 9 aa, Homo Sapiens
LAFCAEMGF

SEQ ID NO: 574626 - protein, 9 aa, Homo Sapiens
LLSLCLDEY

SEQ ID NO: 574627 - protein, 9 aa, Homo Sapiens
CLCSPGVHR

SEQ ID NO: 574628 - protein, 9 aa, Homo Sapiens
FLLVGLSQP

SEQ ID NO: 574629 - protein, 9 aa, Homo Sapiens
ILPEEEEIP

SEQ ID NO: 574630 - protein, 9 aa, Homo Sapiens
VQGESLEVA

SEQ ID NO: 574631 - protein, 9 aa, Homo Sapiens
QLTKYHSAF

SEQ ID NO: 574632 - protein, 9 aa, Homo Sapiens
SPNLSYSRS

SEQ ID NO: 574633 - protein, 9 aa, Homo Sapiens
GLERVSLTV

SEQ ID NO: 574634 - protein, 9 aa, Homo Sapiens
EVCLLRVMA

SEQ ID NO: 574635 - protein, 9 aa, Homo Sapiens
DWSDIGPRA

SEQ ID NO: 574636 - protein, 9 aa, Homo Sapiens
SLDLYSIIA

SEQ ID NO: 574637 - protein, 9 aa, Homo Sapiens
LVQGESLEV

SEQ ID NO: 574638 - protein, 9 aa, Homo Sapiens
ARHTGITIV

SEQ ID NO: 574639 - protein, 9 aa, Homo Sapiens
AGGHEPLVG

SEQ ID NO: 574640 - protein, 9 aa, Homo Sapiens
GIHSGATIT

SEQ ID NO: 574641 - protein, 9 aa, Homo Sapiens
FPLQYTLNF

SEQ ID NO: 574642 - protein, 9 aa, Homo Sapiens
CSPGVHRPH

SEQ ID NO: 574643 - protein, 9 aa, Homo Sapiens
LERVSLTVQ

SEQ ID NO: 574644 - protein, 9 aa, Homo Sapiens
GYNINTLGL

SEQ ID NO: 574645 - protein, 9 aa, Homo Sapiens
LSISAANST

SEQ ID NO: 574646 - protein, 9 aa, Homo Sapiens
VFRLSGSST

SEQ ID NO: 574647 - protein, 9 aa, Homo Sapiens
SRSYGHLLS

SEQ ID NO: 574648 - protein, 9 aa, Homo Sapiens
SLGAISTRL

SEQ ID NO: 574649 - protein, 9 aa, Homo Sapiens
AEEGVVSAA

SEQ ID NO: 574650 - protein, 9 aa, Homo Sapiens
QEFNLLDPK

SEQ ID NO: 574651 - protein, 9 aa, Homo Sapiens
RKKSQLSLG

SEQ ID NO: 574652 - protein, 9 aa, Homo Sapiens
KEDALSQLT

SEQ ID NO: 574653 - protein, 9 aa, Homo Sapiens
SDIGPRARP

SEQ ID NO: 574654 - protein, 9 aa, Homo Sapiens
HRPAEPGPG

SEQ ID NO: 574655 - protein, 9 aa, Homo Sapiens
NLLSLCLDE

SEQ ID NO: 574656 - protein, 9 aa, Homo Sapiens
GQLVAEQRS

SEQ ID NO: 574657 - protein, 9 aa, Homo Sapiens
GSSTGGILA

SEQ ID NO: 574658 - protein, 9 aa, Homo Sapiens
GATITAPSL

SEQ ID NO: 574659 - protein, 9 aa, Homo Sapiens
LLLWTACKK

SEQ ID NO: 574660 - protein, 9 aa, Homo Sapiens
VLARQLQLL

SEQ ID NO: 574661 - protein, 9 aa, Homo Sapiens
LRGDWSDIG

SEQ ID NO: 574662 - protein, 9 aa, Homo Sapiens
ILFAQEFNL

SEQ ID NO: 574663 - protein, 9 aa, Homo Sapiens
SKGEPLQAL

SEQ ID NO: 574664 - protein, 9 aa, Homo Sapiens
REKSKPAGS

SEQ ID NO: 574665 - protein, 9 aa, Homo Sapiens
SCDSGTRMD

SEQ ID NO: 574666 - protein, 9 aa, Homo Sapiens
WLNVLNKAI

SEQ ID NO: 574667 - protein, 9 aa, Homo Sapiens
KGTGVCVLT

SEQ ID NO: 574668 - protein, 9 aa, Homo Sapiens
PQATPKAQD

SEQ ID NO: 574669 - protein, 9 aa, Homo Sapiens
YNRWFEKSF

SEQ ID NO: 574670 - protein, 9 aa, Homo Sapiens
PGSQVPDLQ

SEQ ID NO: 574671 - protein, 9 aa, Homo Sapiens
RWRGPSPNQ

SEQ ID NO: 574672 - protein, 9 aa, Homo Sapiens
LILFCLAEL

SEQ ID NO: 574673 - protein, 9 aa, Homo Sapiens
IFRGDKWSC

SEQ ID NO: 574674 - protein, 9 aa, Homo Sapiens
ISTRLGFDL

SEQ ID NO: 574675 - protein, 9 aa, Homo Sapiens
QLAKARGLK

SEQ ID NO: 574676 - protein, 9 aa, Homo Sapiens
RKMKKTSSS

SEQ ID NO: 574677 - protein, 9 aa, Homo Sapiens
VFNGGMATT

SEQ ID NO: 574678 - protein, 9 aa, Homo Sapiens
SYGHLLSYP

SEQ ID NO: 574679 - protein, 9 aa, Homo Sapiens
ENCILKCKG

SEQ ID NO: 574680 - protein, 9 aa, Homo Sapiens
QHQRIHTCE

SEQ ID NO: 574681 - protein, 9 aa, Homo Sapiens
ATPKAQDFH

SEQ ID NO: 574682 - protein, 9 aa, Homo Sapiens
ANWAGSRSL

SEQ ID NO: 574683 - protein, 9 aa, Homo Sapiens
DQDREKSKP

SEQ ID NO: 574684 - protein, 9 aa, Homo Sapiens
TGITIVQQI

SEQ ID NO: 574685 - protein, 9 aa, Homo Sapiens
PGVHRPHCN

SEQ ID NO: 574686 - protein, 9 aa, Homo Sapiens
LYSIIAEVK

SEQ ID NO: 574687 - protein, 9 aa, Homo Sapiens
MKKTSSSTE

SEQ ID NO: 574688 - protein, 9 aa, Homo Sapiens
CKGPRKKSQ

SEQ ID NO: 574689 - protein, 9 aa, Homo Sapiens
WGGRLDPAG

SEQ ID NO: 574690 - protein, 9 aa, Homo Sapiens
EQRSQKHPG

SEQ ID NO: 574691 - protein, 9 aa, Homo Sapiens
SSTETRSSS

SEQ ID NO: 574692 - protein, 9 aa, Homo Sapiens
TCGQPGSQV

SEQ ID NO: 574693 - protein, 9 aa, Homo Sapiens
LAACQDQLQ

SEQ ID NO: 574694 - protein, 9 aa, Homo Sapiens
PRKKSQLSL

SEQ ID NO: 574695 - protein, 9 aa, Homo Sapiens
LRVIRLVCV

SEQ ID NO: 574696 - protein, 9 aa, Homo Sapiens
YAHFLLASL

SEQ ID NO: 574697 - protein, 9 aa, Homo Sapiens
IMGSFAPPV

SEQ ID NO: 574698 - protein, 9 aa, Homo Sapiens
PNLSYSRSY

SEQ ID NO: 574699 - protein, 9 aa, Homo Sapiens
QGESLEVAN

SEQ ID NO: 574700 - protein, 9 aa, Homo Sapiens
KSIHNGEKP

SEQ ID NO: 574701 - protein, 9 aa, Homo Sapiens
RFFEGKNMA

SEQ ID NO: 574702 - protein, 9 aa, Homo Sapiens
PRSNISSGW

SEQ ID NO: 574703 - protein, 9 aa, Homo Sapiens
TTQRRSCDS

SEQ ID NO: 574704 - protein, 9 aa, Homo Sapiens
LFRESTTVM

SEQ ID NO: 574705 - protein, 9 aa, Homo Sapiens
ALSQLTKYH

SEQ ID NO: 574706 - protein, 9 aa, Homo Sapiens
AINHIIRNF

SEQ ID NO: 574707 - protein, 9 aa, Homo Sapiens
IIEIYTDQD

SEQ ID NO: 574708 - protein, 9 aa, Homo Sapiens
NCYNRWFEK

SEQ ID NO: 574709 - protein, 9 aa, Homo Sapiens
IFLFLGIIF

SEQ ID NO: 574710 - protein, 9 aa, Homo Sapiens
TLNFSGDSQ

SEQ ID NO: 574711 - protein, 9 aa, Homo Sapiens
ITSFLTGYF

SEQ ID NO: 574712 - protein, 9 aa, Homo Sapiens
SYKAFRAAR

SEQ ID NO: 574713 - protein, 9 aa, Homo Sapiens
VNSLELMDL

SEQ ID NO: 574714 - protein, 9 aa, Homo Sapiens
LHCMRGLGP

SEQ ID NO: 574715 - protein, 9 aa, Homo Sapiens
SLELMDLLG

SEQ ID NO: 574716 - protein, 9 aa, Homo Sapiens
LLHCMRGLG

SEQ ID NO: 574717 - protein, 9 aa, Homo Sapiens
WQARHTGIT

SEQ ID NO: 574718 - protein, 9 aa, Homo Sapiens
MYHFDLGYI

SEQ ID NO: 574719 - protein, 9 aa, Homo Sapiens
DMPMSEFSD

SEQ ID NO: 574720 - protein, 9 aa, Homo Sapiens
PHPAALSSV

SEQ ID NO: 574721 - protein, 9 aa, Homo Sapiens
GKEDALSQL

SEQ ID NO: 574722 - protein, 9 aa, Homo Sapiens
IIFFFTFFL

SEQ ID NO: 574723 - protein, 9 aa, Homo Sapiens
QQDLVEWLN

SEQ ID NO: 574724 - protein, 9 aa, Homo Sapiens
SCAPPRPPR

SEQ ID NO: 574725 - protein, 9 aa, Homo Sapiens
GQKGEKGED

SEQ ID NO: 574726 - protein, 9 aa, Homo Sapiens
RWFEKSFTL

SEQ ID NO: 574727 - protein, 9 aa, Homo Sapiens
VEWLNVLNK

SEQ ID NO: 574728 - protein, 9 aa, Homo Sapiens
ISSKLKEFC

SEQ ID NO: 574729 - protein, 9 aa, Homo Sapiens
LCSPGVHRP

SEQ ID NO: 574730 - protein, 9 aa, Homo Sapiens
NRSLDLYSI

SEQ ID NO: 574731 - protein, 9 aa, Homo Sapiens
KKAVTLFDD

SEQ ID NO: 574732 - protein, 9 aa, Homo Sapiens
PEEEEILPE

SEQ ID NO: 574733 - protein, 9 aa, Homo Sapiens
QPHSSLREL

SEQ ID NO: 574734 - protein, 9 aa, Homo Sapiens
FLFLGIIFF

SEQ ID NO: 574735 - protein, 9 aa, Homo Sapiens
VVGTYDLSG

SEQ ID NO: 574736 - protein, 9 aa, Homo Sapiens
VSMPVVGTY

SEQ ID NO: 574737 - protein, 9 aa, Homo Sapiens
GICEVCLLR

SEQ ID NO: 574738 - protein, 9 aa, Homo Sapiens
TLTPCGWHC

SEQ ID NO: 574739 - protein, 9 aa, Homo Sapiens
CAPPRPPRA

SEQ ID NO: 574740 - protein, 9 aa, Homo Sapiens
KMLQICVLH

SEQ ID NO: 574741 - protein, 9 aa, Homo Sapiens
AGHRPAEPG

SEQ ID NO: 574742 - protein, 9 aa, Homo Sapiens
DQQDLVEWL

SEQ ID NO: 574743 - protein, 9 aa, Homo Sapiens
PPVCTSSPK

SEQ ID NO: 574744 - protein, 9 aa, Homo Sapiens
CAEMGFPHR

SEQ ID NO: 574745 - protein, 9 aa, Homo Sapiens
SGSSKGEPL

SEQ ID NO: 574746 - protein, 9 aa, Homo Sapiens
IQGMSDLLS

SEQ ID NO: 574747 - protein, 9 aa, Homo Sapiens
GHRPAEPGP

SEQ ID NO: 574748 - protein, 9 aa, Homo Sapiens
GSSKGEPLQ

SEQ ID NO: 574749 - protein, 9 aa, Homo Sapiens
RHTGITIVQ

SEQ ID NO: 574750 - protein, 9 aa, Homo Sapiens
FTCESKGKP

SEQ ID NO: 574751 - protein, 9 aa, Homo Sapiens
SGIHSGATI

SEQ ID NO: 574752 - protein, 9 aa, Homo Sapiens
LVEWLNVLN

SEQ ID NO: 574753 - protein, 9 aa, Homo Sapiens
ASLRKLLEY

SEQ ID NO: 574754 - protein, 9 aa, Homo Sapiens
KKKKIMYLT

SEQ ID NO: 574755 - protein, 9 aa, Homo Sapiens
YNINTLGLG

SEQ ID NO: 574756 - protein, 9 aa, Homo Sapiens
EWLNVLNKA

SEQ ID NO: 574757 - protein, 9 aa, Homo Sapiens
EGLIEFGPA

SEQ ID NO: 574758 - protein, 9 aa, Homo Sapiens
ITIVQQIAI

SEQ ID NO: 574759 - protein, 9 aa, Homo Sapiens
AAEEGVVSA

SEQ ID NO: 574760 - protein, 9 aa, Homo Sapiens
EDAAGHRPA

SEQ ID NO: 574761 - protein, 9 aa, Homo Sapiens
FDLGYIQGM

SEQ ID NO: 574762 - protein, 9 aa, Homo Sapiens
EGQPLIFTC

SEQ ID NO: 574763 - protein, 9 aa, Homo Sapiens
DSDKLNDYR

SEQ ID NO: 574764 - protein, 9 aa, Homo Sapiens
NLRLPQRPC

SEQ ID NO: 574765 - protein, 9 aa, Homo Sapiens
NLSYSRSYG

SEQ ID NO: 574766 - protein, 9 aa, Homo Sapiens
ETVLFREST

SEQ ID NO: 574767 - protein, 9 aa, Homo Sapiens
PVIMGSFAP

SEQ ID NO: 574768 - protein, 9 aa, Homo Sapiens
HEPLVGFLL

SEQ ID NO: 574769 - protein, 9 aa, Homo Sapiens
ITEAKLAAC

SEQ ID NO: 574770 - protein, 9 aa, Homo Sapiens
GLSQPHSSL

SEQ ID NO: 574771 - protein, 9 aa, Homo Sapiens
RLSGSSTGG

SEQ ID NO: 574772 - protein, 9 aa, Homo Sapiens
MPVVGTYDL

SEQ ID NO: 574773 - protein, 9 aa, Homo Sapiens
QPYQGLSKE

SEQ ID NO: 574774 - protein, 9 aa, Homo Sapiens
MDLLGAQWG

SEQ ID NO: 574775 - protein, 9 aa, Homo Sapiens
VGFLLRRGA

SEQ ID NO: 574776 - protein, 9 aa, Homo Sapiens
GLIEFGPAI

SEQ ID NO: 574777 - protein, 9 aa, Homo Sapiens
IVLVQGESL

SEQ ID NO: 574778 - protein, 9 aa, Homo Sapiens
QKGEKGEDG

SEQ ID NO: 574779 - protein, 9 aa, Homo Sapiens
KSQLSLGGQ

SEQ ID NO: 574780 - protein, 9 aa, Homo Sapiens
HRPHCNVTC

SEQ ID NO: 574781 - protein, 9 aa, Homo Sapiens
YKSIHNGEK

SEQ ID NO: 574782 - protein, 9 aa, Homo Sapiens
RGYWGQESC

SEQ ID NO: 574783 - protein, 9 aa, Homo Sapiens
YYKSIHNGE

SEQ ID NO: 574784 - protein, 9 aa, Homo Sapiens
KQLAKARGL

SEQ ID NO: 574785 - protein, 9 aa, Homo Sapiens
EAKLAACQD

SEQ ID NO: 574786 - protein, 9 aa, Homo Sapiens
DREKSKPAG

SEQ ID NO: 574787 - protein, 9 aa, Homo Sapiens
GITIVQQIA

SEQ ID NO: 574788 - protein, 9 aa, Homo Sapiens
RRSCDSGTR

SEQ ID NO: 574789 - protein, 9 aa, Homo Sapiens
GPAIDDGNY

SEQ ID NO: 574790 - protein, 9 aa, Homo Sapiens
ERFFEGKNM

SEQ ID NO: 574791 - protein, 9 aa, Homo Sapiens
LNVLNKAIK

SEQ ID NO: 574792 - protein, 9 aa, Homo Sapiens
NHIIRNFCK

SEQ ID NO: 574793 - protein, 9 aa, Homo Sapiens
VVSAASAGG

SEQ ID NO: 574794 - protein, 9 aa, Homo Sapiens
EVEQERFFE

SEQ ID NO: 574795 - protein, 9 aa, Homo Sapiens
AFRAARVTA

SEQ ID NO: 574796 - protein, 9 aa, Homo Sapiens
SISYANWAG

SEQ ID NO: 574797 - protein, 9 aa, Homo Sapiens
KLNDYRWRG

SEQ ID NO: 574798 - protein, 9 aa, Homo Sapiens
SKKKKKIMY

SEQ ID NO: 574799 - protein, 9 aa, Homo Sapiens
TEAKLAACQ

SEQ ID NO: 574800 - protein, 9 aa, Homo Sapiens
PEVLMFETD

SEQ ID NO: 574801 - protein, 9 aa, Homo Sapiens
GEPLQALTR

SEQ ID NO: 574802 - protein, 9 aa, Homo Sapiens
SSDIIEIYT

SEQ ID NO: 574803 - protein, 9 aa, Homo Sapiens
SYGYNINTL

SEQ ID NO: 574804 - protein, 9 aa, Homo Sapiens
GIPLLKLTW

SEQ ID NO: 574805 - protein, 9 aa, Homo Sapiens
GVVSAASAG

SEQ ID NO: 574806 - protein, 9 aa, Homo Sapiens
LSSASTGDS

SEQ ID NO: 574807 - protein, 9 aa, Homo Sapiens
RSNISSGWS

SEQ ID NO: 574808 - protein, 9 aa, Homo Sapiens
ATITAPSLS

SEQ ID NO: 574809 - protein, 9 aa, Homo Sapiens
GRLDPAGSW

SEQ ID NO: 574810 - protein, 9 aa, Homo Sapiens
VHRPHCNVT

SEQ ID NO: 574811 - protein, 9 aa, Homo Sapiens
SASPLSISA

SEQ ID NO: 574812 - protein, 9 aa, Homo Sapiens
PAGSWTCGQ

SEQ ID NO: 574813 - protein, 9 aa, Homo Sapiens
PKPGSCAPP

SEQ ID NO: 574814 - protein, 9 aa, Homo Sapiens
QRSQKHPGC

SEQ ID NO: 574815 - protein, 9 aa, Homo Sapiens
SAVFDAVFN

SEQ ID NO: 574816 - protein, 9 aa, Homo Sapiens
KCKGTGVCV

SEQ ID NO: 574817 - protein, 9 aa, Homo Sapiens
RLVCVFRIF

SEQ ID NO: 574818 - protein, 9 aa, Homo Sapiens
KLKEFCEKP

SEQ ID NO: 574819 - protein, 9 aa, Homo Sapiens
GSISYANWA

SEQ ID NO: 574820 - protein, 9 aa, Homo Sapiens
YHFDLGYIQ

SEQ ID NO: 574821 - protein, 9 aa, Homo Sapiens
FLTGYFFGL

SEQ ID NO: 574822 - protein, 9 aa, Homo Sapiens
PHNGQDPLA

SEQ ID NO: 574823 - protein, 9 aa, Homo Sapiens
PLIFTCESK

SEQ ID NO: 574824 - protein, 9 aa, Homo Sapiens
FEKSFTLIS

SEQ ID NO: 574825 - protein, 9 aa, Homo Sapiens
KMKKTSSST

SEQ ID NO: 574826 - protein, 9 aa, Homo Sapiens
IPLLKLTWT

SEQ ID NO: 574827 - protein, 9 aa, Homo Sapiens
SSHNKKRPN

SEQ ID NO: 574828 - protein, 9 aa, Homo Sapiens
WAINHIIRN

SEQ ID NO: 574829 - protein, 9 aa, Homo Sapiens
TLFDDVTVY

SEQ ID NO: 574830 - protein, 9 aa, Homo Sapiens
LKEFCEKPL

SEQ ID NO: 574831 - protein, 9 aa, Homo Sapiens
DFSPSVDSE

SEQ ID NO: 574832 - protein, 9 aa, Homo Sapiens
LFPSTKKGK

SEQ ID NO: 574833 - protein, 9 aa, Homo Sapiens
SWTCGQPGS

SEQ ID NO: 574834 - protein, 9 aa, Homo Sapiens
EEGVVSAAS

SEQ ID NO: 574835 - protein, 9 aa, Homo Sapiens
AGKCLLIVM

SEQ ID NO: 574836 - protein, 9 aa, Homo Sapiens
AHFLLASLL

SEQ ID NO: 574837 - protein, 9 aa, Homo Sapiens
SSGWSPLSP

SEQ ID NO: 574838 - protein, 9 aa, Homo Sapiens
PPKPGSCAP

SEQ ID NO: 574839 - protein, 9 aa, Homo Sapiens
LVAEQRSQK

SEQ ID NO: 574840 - protein, 9 aa, Homo Sapiens
SLCLDEYEE

SEQ ID NO: 574841 - protein, 9 aa, Homo Sapiens
EARGYWGQE

SEQ ID NO: 574842 - protein, 9 aa, Homo Sapiens
NFSGDSQKL

SEQ ID NO: 574843 - protein, 9 aa, Homo Sapiens
SMPVVGTYD

SEQ ID NO: 574844 - protein, 9 aa, Homo Sapiens
CSLFMFSSH

SEQ ID NO: 574845 - protein, 9 aa, Homo Sapiens
RSCDSGTRM

SEQ ID NO: 574846 - protein, 9 aa, Homo Sapiens
LWAINHIIR

SEQ ID NO: 574847 - protein, 9 aa, Homo Sapiens
PGSCAPPRP

SEQ ID NO: 574848 - protein, 9 aa, Homo Sapiens
QLLLWTACK

SEQ ID NO: 574849 - protein, 9 aa, Homo Sapiens
SLRKLLEYC

SEQ ID NO: 574850 - protein, 9 aa, Homo Sapiens
GSCAPPRPP

SEQ ID NO: 574851 - protein, 9 aa, Homo Sapiens
HFDLGYIQG

SEQ ID NO: 574852 - protein, 9 aa, Homo Sapiens
DIVLVQGES

SEQ ID NO: 574853 - protein, 9 aa, Homo Sapiens
CKGTGVCVL

SEQ ID NO: 574854 - protein, 9 aa, Homo Sapiens
LMDLLGAQW

SEQ ID NO: 574855 - protein, 9 aa, Homo Sapiens
NGHQPGQLV

SEQ ID NO: 574856 - protein, 9 aa, Homo Sapiens
PLVGFLLRR

SEQ ID NO: 574857 - protein, 9 aa, Homo Sapiens
DCSLFMFSS

SEQ ID NO: 574858 - protein, 9 aa, Homo Sapiens
AAQNGHQPG

SEQ ID NO: 574859 - protein, 9 aa, Homo Sapiens
RSLDLYSII

SEQ ID NO: 574860 - protein, 9 aa, Homo Sapiens
HVKTLTPCG

SEQ ID NO: 574861 - protein, 9 aa, Homo Sapiens
EKSFTLISF

SEQ ID NO: 574862 - protein, 9 aa, Homo Sapiens
ISYANWAGS

SEQ ID NO: 574863 - protein, 9 aa, Homo Sapiens
SFLTGYFFG

SEQ ID NO: 574864 - protein, 9 aa, Homo Sapiens
NEVNQTKNV

SEQ ID NO: 574865 - protein, 9 aa, Homo Sapiens
PAVLQSPTH

SEQ ID NO: 574866 - protein, 9 aa, Homo Sapiens
LELIASENL

SEQ ID NO: 574867 - protein, 9 aa, Homo Sapiens
SSYLASPSL

SEQ ID NO: 574868 - protein, 9 aa, Homo Sapiens
AQAMESVKC

SEQ ID NO: 574869 - protein, 9 aa, Homo Sapiens
WSVLLNVEE

SEQ ID NO: 574870 - protein, 9 aa, Homo Sapiens
GNGYIAENE

SEQ ID NO: 574871 - protein, 9 aa, Homo Sapiens
LSMKCAIHV

SEQ ID NO: 574872 - protein, 9 aa, Homo Sapiens
SCIVKLTEK

SEQ ID NO: 574873 - protein, 9 aa, Homo Sapiens
TLTWTVPRG

SEQ ID NO: 574874 - protein, 9 aa, Homo Sapiens
TEIQATKEE

SEQ ID NO: 574875 - protein, 9 aa, Homo Sapiens
TSQLHHLSM

SEQ ID NO: 574876 - protein, 9 aa, Homo Sapiens
VSQELRGII

SEQ ID NO: 574877 - protein, 9 aa, Homo Sapiens
FEARNLREL

SEQ ID NO: 574878 - protein, 9 aa, Homo Sapiens
VLQSPTHPS

SEQ ID NO: 574879 - protein, 9 aa, Homo Sapiens
PIGWYTMAL

SEQ ID NO: 574880 - protein, 9 aa, Homo Sapiens
SDSQESDSE

SEQ ID NO: 574881 - protein, 9 aa, Homo Sapiens
CDLSCIVKL

SEQ ID NO: 574882 - protein, 9 aa, Homo Sapiens
QVRRGPESD

SEQ ID NO: 574883 - protein, 9 aa, Homo Sapiens
HLGSAGEQS

SEQ ID NO: 574884 - protein, 9 aa, Homo Sapiens
LCILSIMML

SEQ ID NO: 574885 - protein, 9 aa, Homo Sapiens
IGWYTMALQ

SEQ ID NO: 574886 - protein, 9 aa, Homo Sapiens
GKLKEGTYS

SEQ ID NO: 574887 - protein, 9 aa, Homo Sapiens
IQSCMGHLE

SEQ ID NO: 574888 - protein, 9 aa, Homo Sapiens
SGCRLLFLF

SEQ ID NO: 574889 - protein, 9 aa, Homo Sapiens
GLQGQAEFQ

SEQ ID NO: 574890 - protein, 9 aa, Homo Sapiens
DQRRSRSHD

SEQ ID NO: 574891 - protein, 9 aa, Homo Sapiens
RDQRRSRSH

SEQ ID NO: 574892 - protein, 9 aa, Homo Sapiens
SAGEQSRDG

SEQ ID NO: 574893 - protein, 9 aa, Homo Sapiens
NTEKGWEFH

SEQ ID NO: 574894 - protein, 9 aa, Homo Sapiens
VPRGPGSAH

SEQ ID NO: 574895 - protein, 9 aa, Homo Sapiens
YATWVSLAQ

SEQ ID NO: 574896 - protein, 9 aa, Homo Sapiens
QTKNVTRHA

SEQ ID NO: 574897 - protein, 9 aa, Homo Sapiens
YSTREEIQE

SEQ ID NO: 574898 - protein, 9 aa, Homo Sapiens
TPSPPTTTK

SEQ ID NO: 574899 - protein, 9 aa, Homo Sapiens
DYPYSLVSQ

SEQ ID NO: 574900 - protein, 9 aa, Homo Sapiens
DVAIDFCHE

SEQ ID NO: 574901 - protein, 9 aa, Homo Sapiens
RMTQYATWV

SEQ ID NO: 574902 - protein, 9 aa, Homo Sapiens
DGNGYIAEN

SEQ ID NO: 574903 - protein, 9 aa, Homo Sapiens
YAPELLFLC

SEQ ID NO: 574904 - protein, 9 aa, Homo Sapiens
EMSLENCAK

SEQ ID NO: 574905 - protein, 9 aa, Homo Sapiens
RNHLGSAGE

SEQ ID NO: 574906 - protein, 9 aa, Homo Sapiens
CRLLFLFLS

SEQ ID NO: 574907 - protein, 9 aa, Homo Sapiens
EASDYPAIS

SEQ ID NO: 574908 - protein, 9 aa, Homo Sapiens
TKNVTRHAE

SEQ ID NO: 574909 - protein, 9 aa, Homo Sapiens
SENLCSRAA

SEQ ID NO: 574910 - protein, 9 aa, Homo Sapiens
EVNCMQRAR

SEQ ID NO: 574911 - protein, 9 aa, Homo Sapiens
LFCSISLLT

SEQ ID NO: 574912 - protein, 9 aa, Homo Sapiens
WTVPRGPGS

SEQ ID NO: 574913 - protein, 9 aa, Homo Sapiens
SMKCAIHVL

SEQ ID NO: 574914 - protein, 9 aa, Homo Sapiens
LGSAGEQSR

SEQ ID NO: 574915 - protein, 9 aa, Homo Sapiens
THINFVVIG

SEQ ID NO: 574916 - protein, 9 aa, Homo Sapiens
PSPPTTTKT

SEQ ID NO: 574917 - protein, 9 aa, Homo Sapiens
RQDLLTIQP

SEQ ID NO: 574918 - protein, 9 aa, Homo Sapiens
GGQTALWSI

SEQ ID NO: 574919 - protein, 9 aa, Homo Sapiens
PKRRCRGAP

SEQ ID NO: 574920 - protein, 9 aa, Homo Sapiens
LLKSSDFAV

SEQ ID NO: 574921 - protein, 9 aa, Homo Sapiens
DFGKLKEGT

SEQ ID NO: 574922 - protein, 9 aa, Homo Sapiens
VSSAFENSC

SEQ ID NO: 574923 - protein, 9 aa, Homo Sapiens
EFEARNLRE

SEQ ID NO: 574924 - protein, 9 aa, Homo Sapiens
DSQESDSEY

SEQ ID NO: 574925 - protein, 9 aa, Homo Sapiens
QTEIQATKE

SEQ ID NO: 574926 - protein, 9 aa, Homo Sapiens
RERGEVNCM

SEQ ID NO: 574927 - protein, 9 aa, Homo Sapiens
RRCRGAPEG

SEQ ID NO: 574928 - protein, 9 aa, Homo Sapiens
TTTKTTPPP

SEQ ID NO: 574929 - protein, 9 aa, Homo Sapiens
LYPNPQERS

SEQ ID NO: 574930 - protein, 9 aa, Homo Sapiens
ADDSRWMKN

SEQ ID NO: 574931 - protein, 9 aa, Homo Sapiens
TCRTITPSE

SEQ ID NO: 574932 - protein, 9 aa, Homo Sapiens
LRELTVVQG

SEQ ID NO: 574933 - protein, 9 aa, Homo Sapiens
AMESVKCGG

SEQ ID NO: 574934 - protein, 9 aa, Homo Sapiens
LIASENLCS

SEQ ID NO: 574935 - protein, 9 aa, Homo Sapiens
RLLFLFLSP

SEQ ID NO: 574936 - protein, 9 aa, Homo Sapiens
SYSTREEIQ

SEQ ID NO: 574937 - protein, 9 aa, Homo Sapiens
LTEKRLRKA

SEQ ID NO: 574938 - protein, 9 aa, Homo Sapiens
KLKEGTYSC

SEQ ID NO: 574939 - protein, 9 aa, Homo Sapiens
AVLQSPTHP

SEQ ID NO: 574940 - protein, 9 aa, Homo Sapiens
KEKTHINFV

SEQ ID NO: 574941 - protein, 9 aa, Homo Sapiens
GAVLLKSSD

SEQ ID NO: 574942 - protein, 9 aa, Homo Sapiens
HLETADKQS

SEQ ID NO: 574943 - protein, 9 aa, Homo Sapiens
TQYATWVSL

SEQ ID NO: 574944 - protein, 9 aa, Homo Sapiens
NGYIAENEL

SEQ ID NO: 574945 - protein, 9 aa, Homo Sapiens
TIMSPAVLQ

SEQ ID NO: 574946 - protein, 9 aa, Homo Sapiens
EKTHINFVV

SEQ ID NO: 574947 - protein, 9 aa, Homo Sapiens
LVSQELRGI

SEQ ID NO: 574948 - protein, 9 aa, Homo Sapiens
NPQERSSFY

SEQ ID NO: 574949 - protein, 9 aa, Homo Sapiens
DYPAISELS

SEQ ID NO: 574950 - protein, 9 aa, Homo Sapiens
ASENLCSRA

SEQ ID NO: 574951 - protein, 9 aa, Homo Sapiens
MLGGAVLLK

SEQ ID NO: 574952 - protein, 9 aa, Homo Sapiens
QERSSFYSC

SEQ ID NO: 574953 - protein, 9 aa, Homo Sapiens
PGVSYSTRE

SEQ ID NO: 574954 - protein, 9 aa, Homo Sapiens
HMVMIRWNS

SEQ ID NO: 574955 - protein, 9 aa, Homo Sapiens
APIGWYTMA

SEQ ID NO: 574956 - protein, 9 aa, Homo Sapiens
VSYSTREEI

SEQ ID NO: 574957 - protein, 9 aa, Homo Sapiens
SEISDSQES

SEQ ID NO: 574958 - protein, 9 aa, Homo Sapiens
TEASDYPAI

SEQ ID NO: 574959 - protein, 9 aa, Homo Sapiens
KTTPPPTTT

SEQ ID NO: 574960 - protein, 9 aa, Homo Sapiens
LYEFEARNL

SEQ ID NO: 574961 - protein, 9 aa, Homo Sapiens
MMLPETKRK

SEQ ID NO: 574962 - protein, 9 aa, Homo Sapiens
QAQAMESVK

SEQ ID NO: 574963 - protein, 9 aa, Homo Sapiens
QAEFQILDN

SEQ ID NO: 574964 - protein, 9 aa, Homo Sapiens
ERGEVNCMQ

SEQ ID NO: 574965 - protein, 9 aa, Homo Sapiens
SPRMTQYAT

SEQ ID NO: 574966 - protein, 9 aa, Homo Sapiens
VELQQQSCF

SEQ ID NO: 574967 - protein, 9 aa, Homo Sapiens
PPTTTKTTP

SEQ ID NO: 574968 - protein, 9 aa, Homo Sapiens
STREEIQEV

SEQ ID NO: 574969 - protein, 9 aa, Homo Sapiens
DLHQRVHTR

SEQ ID NO: 574970 - protein, 9 aa, Homo Sapiens
LVGGQTALW

SEQ ID NO: 574971 - protein, 9 aa, Homo Sapiens
QRVSQVRRG

SEQ ID NO: 574972 - protein, 9 aa, Homo Sapiens
PMWSVLLNV

SEQ ID NO: 574973 - protein, 9 aa, Homo Sapiens
SHEQEMDKL

SEQ ID NO: 574974 - protein, 9 aa, Homo Sapiens
CRGAPEGGQ

SEQ ID NO: 574975 - protein, 9 aa, Homo Sapiens
RERPYNCKE

SEQ ID NO: 574976 - protein, 9 aa, Homo Sapiens
EWGPWEPCS

SEQ ID NO: 574977 - protein, 9 aa, Homo Sapiens
KNTEKGWEF

SEQ ID NO: 574978 - protein, 9 aa, Homo Sapiens
ELQQQSCFL

SEQ ID NO: 574979 - protein, 9 aa, Homo Sapiens
EIQSCMGHL

SEQ ID NO: 574980 - protein, 9 aa, Homo Sapiens
FYAPELLFL

SEQ ID NO: 574981 - protein, 9 aa, Homo Sapiens
VRRGPESDH

SEQ ID NO: 574982 - protein, 9 aa, Homo Sapiens
CAKAVKRSM

SEQ ID NO: 574983 - protein, 9 aa, Homo Sapiens
WLVGGQTAL

SEQ ID NO: 574984 - protein, 9 aa, Homo Sapiens
GQTALWSIL

SEQ ID NO: 574985 - protein, 9 aa, Homo Sapiens
QESDSEYEV

SEQ ID NO: 574986 - protein, 9 aa, Homo Sapiens
IASENLCSR

SEQ ID NO: 574987 - protein, 9 aa, Homo Sapiens
IPDFGKLKE

SEQ ID NO: 574988 - protein, 9 aa, Homo Sapiens
DPGVSYSTR

SEQ ID NO: 574989 - protein, 9 aa, Homo Sapiens
EVSSHEQEM

SEQ ID NO: 574990 - protein, 9 aa, Homo Sapiens
MKCAIHVLH

SEQ ID NO: 574991 - protein, 9 aa, Homo Sapiens
GSAGEQSRD

SEQ ID NO: 574992 - protein, 9 aa, Homo Sapiens
WGPWEPCSS

SEQ ID NO: 574993 - protein, 9 aa, Homo Sapiens
ILSIMMLPE

SEQ ID NO: 574994 - protein, 9 aa, Homo Sapiens
ISELSIEKP

SEQ ID NO: 574995 - protein, 9 aa, Homo Sapiens
LCLNCKKGR

SEQ ID NO: 574996 - protein, 9 aa, Homo Sapiens
QDGNGYIAE

SEQ ID NO: 574997 - protein, 9 aa, Homo Sapiens
NLRELTVVQ

SEQ ID NO: 574998 - protein, 9 aa, Homo Sapiens
LDSGLQGQA

SEQ ID NO: 574999 - protein, 9 aa, Homo Sapiens
KNVTRHAEM

SEQ ID NO: 575000 - protein, 9 aa, Homo Sapiens
HTRERPYNC

SEQ ID NO: 575001 - protein, 9 aa, Homo Sapiens
FVVIGHVDS

SEQ ID NO: 575002 - protein, 9 aa, Homo Sapiens
CTCRTITPS

SEQ ID NO: 575003 - protein, 9 aa, Homo Sapiens
TPSEESLCK

SEQ ID NO: 575004 - protein, 9 aa, Homo Sapiens
GHLSGCRLL

SEQ ID NO: 575005 - protein, 9 aa, Homo Sapiens
SRWMKNTEK

SEQ ID NO: 575006 - protein, 9 aa, Homo Sapiens
PRMTQYATW

SEQ ID NO: 575007 - protein, 9 aa, Homo Sapiens
DSGLQGQAE

SEQ ID NO: 575008 - protein, 9 aa, Homo Sapiens
TALWSILLM

SEQ ID NO: 575009 - protein, 9 aa, Homo Sapiens
SRNHLGSAG

SEQ ID NO: 575010 - protein, 9 aa, Homo Sapiens
LSQDFFSSY

SEQ ID NO: 575011 - protein, 9 aa, Homo Sapiens
NCMQRARKK

SEQ ID NO: 575012 - protein, 9 aa, Homo Sapiens
LLNVEEIKL

SEQ ID NO: 575013 - protein, 9 aa, Homo Sapiens
VMIRWNSGL

SEQ ID NO: 575014 - protein, 9 aa, Homo Sapiens
LIPDFGKLK

SEQ ID NO: 575015 - protein, 9 aa, Homo Sapiens
MTQYATWVS

SEQ ID NO: 575016 - protein, 9 aa, Homo Sapiens
CMQRARKKI

SEQ ID NO: 575017 - protein, 9 aa, Homo Sapiens
SYLASPSLP

SEQ ID NO: 575018 - protein, 9 aa, Homo Sapiens
EARNLRELT

SEQ ID NO: 575019 - protein, 9 aa, Homo Sapiens
SQLHHLSMK

SEQ ID NO: 575020 - protein, 9 aa, Homo Sapiens
ITPSEESLC

SEQ ID NO: 575021 - protein, 9 aa, Homo Sapiens
QGLCLNCKK

SEQ ID NO: 575022 - protein, 9 aa, Homo Sapiens
SIINLYFGS

SEQ ID NO: 575023 - protein, 9 aa, Homo Sapiens
FGKLKEGTY

SEQ ID NO: 575024 - protein, 9 aa, Homo Sapiens
QRQDLLTIQ

SEQ ID NO: 575025 - protein, 9 aa, Homo Sapiens
VNQTKNVTR

SEQ ID NO: 575026 - protein, 9 aa, Homo Sapiens
DFFSSYLAS

SEQ ID NO: 575027 - protein, 9 aa, Homo Sapiens
NCKKGRCNT

SEQ ID NO: 575028 - protein, 9 aa, Homo Sapiens
SAFENSCNI

SEQ ID NO: 575029 - protein, 9 aa, Homo Sapiens
LSIMMLPET

SEQ ID NO: 575030 - protein, 9 aa, Homo Sapiens
MSLENCAKA

SEQ ID NO: 575031 - protein, 9 aa, Homo Sapiens
RVSQVRRGP

SEQ ID NO: 575032 - protein, 9 aa, Homo Sapiens
FCSISLLTN

SEQ ID NO: 575033 - protein, 9 aa, Homo Sapiens
IQRLDTFSF

SEQ ID NO: 575034 - protein, 9 aa, Homo Sapiens
RWNSGLKPK

SEQ ID NO: 575035 - protein, 9 aa, Homo Sapiens
YLASPSLPL

SEQ ID NO: 575036 - protein, 9 aa, Homo Sapiens
SLGPSGLLA

SEQ ID NO: 575037 - protein, 9 aa, Homo Sapiens
VKLTEKRLR

SEQ ID NO: 575038 - protein, 9 aa, Homo Sapiens
FAPKRRCRG

SEQ ID NO: 575039 - protein, 9 aa, Homo Sapiens
SDPGVSYST

SEQ ID NO: 575040 - protein, 9 aa, Homo Sapiens
DSRWMKNTE

SEQ ID NO: 575041 - protein, 9 aa, Homo Sapiens
LLSLQRQDL

SEQ ID NO: 575042 - protein, 9 aa, Homo Sapiens
SVSSAFENS

SEQ ID NO: 575043 - protein, 9 aa, Homo Sapiens
AFENSCNIP

SEQ ID NO: 575044 - protein, 9 aa, Homo Sapiens
GSGDWVRHK

SEQ ID NO: 575045 - protein, 9 aa, Homo Sapiens
FSTNVTVRK

SEQ ID NO: 575046 - protein, 9 aa, Homo Sapiens
QDFFSSYLA

SEQ ID NO: 575047 - protein, 9 aa, Homo Sapiens
AGEQSRDGS

SEQ ID NO: 575048 - protein, 9 aa, Homo Sapiens
WNSGLKPKD

SEQ ID NO: 575049 - protein, 9 aa, Homo Sapiens
QCTCRTITP

SEQ ID NO: 575050 - protein, 9 aa, Homo Sapiens
SGLLAETPA

SEQ ID NO: 575051 - protein, 9 aa, Homo Sapiens
AVSATSIIN

SEQ ID NO: 575052 - protein, 9 aa, Homo Sapiens
LSCIVKLTE

SEQ ID NO: 575053 - protein, 9 aa, Homo Sapiens
SDVAIDFCH

SEQ ID NO: 575054 - protein, 9 aa, Homo Sapiens
ISLLTNFED

SEQ ID NO: 575055 - protein, 9 aa, Homo Sapiens
LGPSGLLAE

SEQ ID NO: 575056 - protein, 9 aa, Homo Sapiens
DLLTIQPGQ

SEQ ID NO: 575057 - protein, 9 aa, Homo Sapiens
SVKCGGVLS

SEQ ID NO: 575058 - protein, 9 aa, Homo Sapiens
LCSRAALEA

SEQ ID NO: 575059 - protein, 9 aa, Homo Sapiens
CIVKLTEKR

SEQ ID NO: 575060 - protein, 9 aa, Homo Sapiens
SRSRDQRRS

SEQ ID NO: 575061 - protein, 9 aa, Homo Sapiens
SFSTNVTVR

SEQ ID NO: 575062 - protein, 9 aa, Homo Sapiens
MSPAVLQSP

SEQ ID NO: 575063 - protein, 9 aa, Homo Sapiens
SPAVLQSPT

SEQ ID NO: 575064 - protein, 9 aa, Homo Sapiens
HSVSSAFEN

SEQ ID NO: 575065 - protein, 9 aa, Homo Sapiens
LQGQAEFQI

SEQ ID NO: 575066 - protein, 9 aa, Homo Sapiens
TVPRGPGSA

SEQ ID NO: 575067 - protein, 9 aa, Homo Sapiens
CSISLLTNF

SEQ ID NO: 575068 - protein, 9 aa, Homo Sapiens
QRLDTFSFS

SEQ ID NO: 575069 - protein, 9 aa, Homo Sapiens
PTTTKTTPP

SEQ ID NO: 575070 - protein, 9 aa, Homo Sapiens
IRWNSGLKP

SEQ ID NO: 575071 - protein, 9 aa, Homo Sapiens
YPAISELSI

SEQ ID NO: 575072 - protein, 9 aa, Homo Sapiens
GDWVRHKLC

SEQ ID NO: 575073 - protein, 9 aa, Homo Sapiens
VSQVRRGPE

SEQ ID NO: 575074 - protein, 9 aa, Homo Sapiens
SGLQGQAEF

SEQ ID NO: 575075 - protein, 9 aa, Homo Sapiens
LHHLSMKCA

SEQ ID NO: 575076 - protein, 9 aa, Homo Sapiens
PDFGKLKEG

SEQ ID NO: 575077 - protein, 9 aa, Homo Sapiens
SISLLTNFE

SEQ ID NO: 575078 - protein, 9 aa, Homo Sapiens
KRRCRGAPE

SEQ ID NO: 575079 - protein, 9 aa, Homo Sapiens
LKEGTYSCL

SEQ ID NO: 575080 - protein, 9 aa, Homo Sapiens
WVRHKLCMC

SEQ ID NO: 575081 - protein, 9 aa, Homo Sapiens
ELPKLFCSI

SEQ ID NO: 575082 - protein, 9 aa, Homo Sapiens
ENSCNIPSP

SEQ ID NO: 575083 - protein, 9 aa, Homo Sapiens
KEENTYPSF

SEQ ID NO: 575084 - protein, 9 aa, Homo Sapiens
VSSHEQEMD

SEQ ID NO: 575085 - protein, 9 aa, Homo Sapiens
HLSGCRLLF

SEQ ID NO: 575086 - protein, 9 aa, Homo Sapiens
SCMGHLETA

SEQ ID NO: 575087 - protein, 9 aa, Homo Sapiens
KLFCSISLL

SEQ ID NO: 575088 - protein, 9 aa, Homo Sapiens
NVEEIKLKN

SEQ ID NO: 575089 - protein, 9 aa, Homo Sapiens
YEFEARNLR

SEQ ID NO: 575090 - protein, 9 aa, Homo Sapiens
PSPRMTQYA

SEQ ID NO: 575091 - protein, 9 aa, Homo Sapiens
GWYTMALQI

SEQ ID NO: 575092 - protein, 9 aa, Homo Sapiens
TFSFSTNVT

SEQ ID NO: 575093 - protein, 9 aa, Homo Sapiens
HKLCMCADG

SEQ ID NO: 575094 - protein, 9 aa, Homo Sapiens
LQQQSCFLI

SEQ ID NO: 575095 - protein, 9 aa, Homo Sapiens
QGQAEFQIL

SEQ ID NO: 575096 - protein, 9 aa, Homo Sapiens
DWQRVSQVR

SEQ ID NO: 575097 - protein, 9 aa, Homo Sapiens
YSLGPSGLL

SEQ ID NO: 575098 - protein, 9 aa, Homo Sapiens
RCRGAPEGG

SEQ ID NO: 575099 - protein, 9 aa, Homo Sapiens
ARNLRELTV

SEQ ID NO: 575100 - protein, 9 aa, Homo Sapiens
ASDYPAISE

SEQ ID NO: 575101 - protein, 9 aa, Homo Sapiens
PKLFCSISL

SEQ ID NO: 575102 - protein, 9 aa, Homo Sapiens
TITPSEESL

SEQ ID NO: 575103 - protein, 9 aa, Homo Sapiens
DLSCIVKLT

SEQ ID NO: 575104 - protein, 9 aa, Homo Sapiens
GITLTWTVP

SEQ ID NO: 575105 - protein, 9 aa, Homo Sapiens
NLCSRAALE

SEQ ID NO: 575106 - protein, 9 aa, Homo Sapiens
HLSMKCAIH

SEQ ID NO: 575107 - protein, 9 aa, Homo Sapiens
ATSIINLYF

SEQ ID NO: 575108 - protein, 9 aa, Homo Sapiens
RRGPESDHS

SEQ ID NO: 575109 - protein, 9 aa, Homo Sapiens
RTITPSEES

SEQ ID NO: 575110 - protein, 9 aa, Homo Sapiens
DDSRWMKNT

SEQ ID NO: 575111 - protein, 9 aa, Homo Sapiens
LPSPRMTQY

SEQ ID NO: 575112 - protein, 9 aa, Homo Sapiens
VNCMQRARK

SEQ ID NO: 575113 - protein, 9 aa, Homo Sapiens
SVLLNVEEI

SEQ ID NO: 575114 - protein, 9 aa, Homo Sapiens
NHLGSAGEQ

SEQ ID NO: 575115 - protein, 9 aa, Homo Sapiens
LNVEEIKLK

SEQ ID NO: 575116 - protein, 9 aa, Homo Sapiens
QAMESVKCG

SEQ ID NO: 575117 - protein, 9 aa, Homo Sapiens
FCHEEWACL

SEQ ID NO: 575118 - protein, 9 aa, Homo Sapiens
IMSPAVLQS

SEQ ID NO: 575119 - protein, 9 aa, Homo Sapiens
SAVSATSII

SEQ ID NO: 575120 - protein, 9 aa, Homo Sapiens
VRHKLCMCA

SEQ ID NO: 575121 - protein, 9 aa, Homo Sapiens
KEEVSSHEQ

SEQ ID NO: 575122 - protein, 9 aa, Homo Sapiens
MLPETKRKL

SEQ ID NO: 575123 - protein, 9 aa, Homo Sapiens
RNLRELTVV

SEQ ID NO: 575124 - protein, 9 aa, Homo Sapiens
MSDPGVSYS

SEQ ID NO: 575125 - protein, 9 aa, Homo Sapiens
ESDSEYEVD

SEQ ID NO: 575126 - protein, 9 aa, Homo Sapiens
FFSSYLASP

SEQ ID NO: 575127 - protein, 9 aa, Homo Sapiens
VHTRERPYN

SEQ ID NO: 575128 - protein, 9 aa, Homo Sapiens
GHLETADKQ

SEQ ID NO: 575129 - protein, 9 aa, Homo Sapiens
LPKLFCSIS

SEQ ID NO: 575130 - protein, 9 aa, Homo Sapiens
EHSVSSAFE

SEQ ID NO: 575131 - protein, 9 aa, Homo Sapiens
IMMLPETKR

SEQ ID NO: 575132 - protein, 9 aa, Homo Sapiens
PSGLLAETP

SEQ ID NO: 575133 - protein, 9 aa, Homo Sapiens
QDLLTIQPG

SEQ ID NO: 575134 - protein, 9 aa, Homo Sapiens
FSQGLCLNC

SEQ ID NO: 575135 - protein, 9 aa, Homo Sapiens
NCAKAVKRS

SEQ ID NO: 575136 - protein, 9 aa, Homo Sapiens
FSFSTNVTV

SEQ ID NO: 575137 - protein, 9 aa, Homo Sapiens
PCSSCSRTC

SEQ ID NO: 575138 - protein, 9 aa, Homo Sapiens
YIAENELDA

SEQ ID NO: 575139 - protein, 9 aa, Homo Sapiens
PNPQERSSF

SEQ ID NO: 575140 - protein, 9 aa, Homo Sapiens
SQELRGIIR

SEQ ID NO: 575141 - protein, 9 aa, Homo Sapiens
CRTITPSEE

SEQ ID NO: 575142 - protein, 9 aa, Homo Sapiens
DWVRHKLCM

SEQ ID NO: 575143 - protein, 9 aa, Homo Sapiens
MKNTEKGWE

SEQ ID NO: 575144 - protein, 9 aa, Homo Sapiens
MVMIRWNSG

SEQ ID NO: 575145 - protein, 9 aa, Homo Sapiens
EVNQTKNVT

SEQ ID NO: 575146 - protein, 9 aa, Homo Sapiens
ADGLYPNPQ

SEQ ID NO: 575147 - protein, 9 aa, Homo Sapiens
LSLQRQDLL

SEQ ID NO: 575148 - protein, 9 aa, Homo Sapiens
IDFCHEEWA

SEQ ID NO: 575149 - protein, 9 aa, Homo Sapiens
VGGQTALWS

SEQ ID NO: 575150 - protein, 9 aa, Homo Sapiens
DFCHEEWAC

SEQ ID NO: 575151 - protein, 9 aa, Homo Sapiens
EQEMDKLKE

SEQ ID NO: 575152 - protein, 9 aa, Homo Sapiens
RGEVNCMQR

SEQ ID NO: 575153 - protein, 9 aa, Homo Sapiens
VTRHAEMVA

SEQ ID NO: 575154 - protein, 9 aa, Homo Sapiens
GVSYSTREE

SEQ ID NO: 575155 - protein, 9 aa, Homo Sapiens
VLLNVEEIK

SEQ ID NO: 575156 - protein, 9 aa, Homo Sapiens
NFVVIGHVD

SEQ ID NO: 575157 - protein, 9 aa, Homo Sapiens
SLQRQDLLT

SEQ ID NO: 575158 - protein, 9 aa, Homo Sapiens
ITLTWTVPR

SEQ ID NO: 575159 - protein, 9 aa, Homo Sapiens
HHLSMKCAI

SEQ ID NO: 575160 - protein, 9 aa, Homo Sapiens
SLVSQELRG

SEQ ID NO: 575161 - protein, 9 aa, Homo Sapiens
SAPIGWYTM

SEQ ID NO: 575162 - protein, 9 aa, Homo Sapiens
VLLKSSDFA

SEQ ID NO: 575163 - protein, 9 aa, Homo Sapiens
ESVKCGGVL

SEQ ID NO: 575164 - protein, 9 aa, Homo Sapiens
LGGAVLLKS

SEQ ID NO: 575165 - protein, 9 aa, Homo Sapiens
GLLAETPAE

SEQ ID NO: 575166 - protein, 9 aa, Homo Sapiens
DGLYPNPQE

SEQ ID NO: 575167 - protein, 9 aa, Homo Sapiens
QYATWVSLA

SEQ ID NO: 575168 - protein, 9 aa, Homo Sapiens
LQRQDLLTI

SEQ ID NO: 575169 - protein, 9 aa, Homo Sapiens
FSDVAIDFC

SEQ ID NO: 575170 - protein, 9 aa, Homo Sapiens
EISDSQESD

SEQ ID NO: 575171 - protein, 9 aa, Homo Sapiens
VEEIKLKNP

SEQ ID NO: 575172 - protein, 9 aa, Homo Sapiens
GGAVLLKSS

SEQ ID NO: 575173 - protein, 9 aa, Homo Sapiens
SLENCAKAV

SEQ ID NO: 575174 - protein, 9 aa, Homo Sapiens
RSRDQRRSR

SEQ ID NO: 575175 - protein, 9 aa, Homo Sapiens
QSCFLISHA

SEQ ID NO: 575176 - protein, 9 aa, Homo Sapiens
YEMSLENCA

SEQ ID NO: 575177 - protein, 9 aa, Homo Sapiens
WMKNTEKGW

SEQ ID NO: 575178 - protein, 9 aa, Homo Sapiens
GLCLNCKKG

SEQ ID NO: 575179 - protein, 9 aa, Homo Sapiens
PSEISDSQE

SEQ ID NO: 575180 - protein, 9 aa, Homo Sapiens
ENCAKAVKR

SEQ ID NO: 575181 - protein, 9 aa, Homo Sapiens
HLLSLQRQD

SEQ ID NO: 575182 - protein, 9 aa, Homo Sapiens
LLAETPAEV

SEQ ID NO: 575183 - protein, 9 aa, Homo Sapiens
PWEPCSSCS

SEQ ID NO: 575184 - protein, 9 aa, Homo Sapiens
FLISHAIEA

SEQ ID NO: 575185 - protein, 9 aa, Homo Sapiens
GEQSRDGSR

SEQ ID NO: 575186 - protein, 9 aa, Homo Sapiens
LKEEVSSHE

SEQ ID NO: 575187 - protein, 9 aa, Homo Sapiens
SSHEQEMDK

SEQ ID NO: 575188 - protein, 9 aa, Homo Sapiens
EEVSSHEQE

SEQ ID NO: 575189 - protein, 9 aa, Homo Sapiens
HEIQSCMGH

SEQ ID NO: 575190 - protein, 9 aa, Homo Sapiens
CILSIMMLP

SEQ ID NO: 575191 - protein, 9 aa, Homo Sapiens
APWLVGGQT

SEQ ID NO: 575192 - protein, 9 aa, Homo Sapiens
DTFSFSTNV

SEQ ID NO: 575193 - protein, 9 aa, Homo Sapiens
IAENELDAL

SEQ ID NO: 575194 - protein, 9 aa, Homo Sapiens
YSLVSQELR

SEQ ID NO: 575195 - protein, 9 aa, Homo Sapiens
SIMMLPETK

SEQ ID NO: 575196 - protein, 9 aa, Homo Sapiens
ISDSQESDS

SEQ ID NO: 575197 - protein, 9 aa, Homo Sapiens
SPASAPIGW

SEQ ID NO: 575198 - protein, 9 aa, Homo Sapiens
AIDFCHEEW

SEQ ID NO: 575199 - protein, 9 aa, Homo Sapiens
VMLGGAVLL

SEQ ID NO: 575200 - protein, 9 aa, Homo Sapiens
CMGHLETAD

SEQ ID NO: 575201 - protein, 9 aa, Homo Sapiens
SQDFFSSYL

SEQ ID NO: 575202 - protein, 9 aa, Homo Sapiens
AQTEIQATK

SEQ ID NO: 575203 - protein, 9 aa, Homo Sapiens
PWLVGGQTA

SEQ ID NO: 575204 - protein, 9 aa, Homo Sapiens
KLTEKRLRK

SEQ ID NO: 575205 - protein, 9 aa, Homo Sapiens
SQESDSEYE

SEQ ID NO: 575206 - protein, 9 aa, Homo Sapiens
RHKLCMCAD

SEQ ID NO: 575207 - protein, 9 aa, Homo Sapiens
SRDQRRSRS

SEQ ID NO: 575208 - protein, 9 aa, Homo Sapiens
MESVKCGGV

SEQ ID NO: 575209 - protein, 9 aa, Homo Sapiens
EYEMSLENC

SEQ ID NO: 575210 - protein, 9 aa, Homo Sapiens
LSGCRLLFL

SEQ ID NO: 575211 - protein, 9 aa, Homo Sapiens
WYTMALQIF

SEQ ID NO: 575212 - protein, 9 aa, Homo Sapiens
GPWEPCSSC

SEQ ID NO: 575213 - protein, 9 aa, Homo Sapiens
LDTFSFSTN

SEQ ID NO: 575214 - protein, 9 aa, Homo Sapiens
LQAQAMESV

SEQ ID NO: 575215 - protein, 9 aa, Homo Sapiens
RSRSRDQRR

SEQ ID NO: 575216 - protein, 9 aa, Homo Sapiens
FSSYLASPS

SEQ ID NO: 575217 - protein, 9 aa, Homo Sapiens
PYSLVSQEL

SEQ ID NO: 575218 - protein, 9 aa, Homo Sapiens
GEVNCMQRA

SEQ ID NO: 575219 - protein, 9 aa, Homo Sapiens
DQDGNGYIA

SEQ ID NO: 575220 - protein, 9 aa, Homo Sapiens
AVMLGGAVL

SEQ ID NO: 575221 - protein, 9 aa, Homo Sapiens
VAIDFCHEE

SEQ ID NO: 575222 - protein, 9 aa, Homo Sapiens
LTWTVPRGP

SEQ ID NO: 575223 - protein, 9 aa, Homo Sapiens
YPYSLVSQE

SEQ ID NO: 575224 - protein, 9 aa, Homo Sapiens
CLNCKKGRC

SEQ ID NO: 575225 - protein, 9 aa, Homo Sapiens
GYIAENELD

SEQ ID NO: 575226 - protein, 9 aa, Homo Sapiens
GKEKTHINF

SEQ ID NO: 575227 - protein, 9 aa, Homo Sapiens
TWTVPRGPG

SEQ ID NO: 575228 - protein, 9 aa, Homo Sapiens
QQSCFLISH

SEQ ID NO: 575229 - protein, 9 aa, Homo Sapiens
AVLLKSSDF

SEQ ID NO: 575230 - protein, 9 aa, Homo Sapiens
RRRSRSRDQ

SEQ ID NO: 575231 - protein, 9 aa, Homo Sapiens
ASAPIGWYT

SEQ ID NO: 575232 - protein, 9 aa, Homo Sapiens
GQAEFQILD

SEQ ID NO: 575233 - protein, 9 aa, Homo Sapiens
TKTTPPPTT

SEQ ID NO: 575234 - protein, 9 aa, Homo Sapiens
RRERGEVNC

SEQ ID NO: 575235 - protein, 9 aa, Homo Sapiens
PSEESLCKI

SEQ ID NO: 575236 - protein, 9 aa, Homo Sapiens
ESHMVMIRW

SEQ ID NO: 575237 - protein, 9 aa, Homo Sapiens
AENELDALL

SEQ ID NO: 575238 - protein, 9 aa, Homo Sapiens
AISELSIEK

SEQ ID NO: 575239 - protein, 9 aa, Homo Sapiens
MWSVLLNVE

SEQ ID NO: 575240 - protein, 9 aa, Homo Sapiens
SFSQGLCLN

SEQ ID NO: 575241 - protein, 9 aa, Homo Sapiens
IVKLTEKRL

SEQ ID NO: 575242 - protein, 9 aa, Homo Sapiens
HEQEMDKLK

SEQ ID NO: 575243 - protein, 9 aa, Homo Sapiens
MGHLETADK

SEQ ID NO: 575244 - protein, 9 aa, Homo Sapiens
HINFVVIGH

SEQ ID NO: 575245 - protein, 9 aa, Homo Sapiens
GLQAQAMES

SEQ ID NO: 575246 - protein, 9 aa, Homo Sapiens
SPPTTTKTT

SEQ ID NO: 575247 - protein, 9 aa, Homo Sapiens
CSSCSRTCG

SEQ ID NO: 575248 - protein, 9 aa, Homo Sapiens
SHMVMIRWN

SEQ ID NO: 575249 - protein, 9 aa, Homo Sapiens
ENLCSRAAL

SEQ ID NO: 575250 - protein, 9 aa, Homo Sapiens
GPSGLLAET

SEQ ID NO: 575251 - protein, 9 aa, Homo Sapiens
EPCSSCSRT

SEQ ID NO: 575252 - protein, 9 aa, Homo Sapiens
NQTKNVTRH

SEQ ID NO: 575253 - protein, 9 aa, Homo Sapiens
SATSIINLY

SEQ ID NO: 575254 - protein, 9 aa, Homo Sapiens
APKRRCRGA

SEQ ID NO: 575255 - protein, 9 aa, Homo Sapiens
SCFLISHAI

SEQ ID NO: 575256 - protein, 9 aa, Homo Sapiens
PAISELSIE

SEQ ID NO: 575257 - protein, 9 aa, Homo Sapiens
QELRGIIRG

SEQ ID NO: 575258 - protein, 9 aa, Homo Sapiens
LHQRVHTRE

SEQ ID NO: 575259 - protein, 9 aa, Homo Sapiens
MIRWNSGLK

SEQ ID NO: 575260 - protein, 9 aa, Homo Sapiens
ATKEENTYP

SEQ ID NO: 575261 - protein, 9 aa, Homo Sapiens
LLCILSIMM

SEQ ID NO: 575262 - protein, 9 aa, Homo Sapiens
KEGTYSCLA

SEQ ID NO: 575263 - protein, 9 aa, Homo Sapiens
GSAVSATSI

SEQ ID NO: 575264 - protein, 9 aa, Homo Sapiens
IQATKEENT

SEQ ID NO: 575265 - protein, 9 aa, Homo Sapiens
GEWGPWEPC

SEQ ID NO: 575266 - protein, 9 aa, Homo Sapiens
LNCKKGRCN

SEQ ID NO: 575267 - protein, 9 aa, Homo Sapiens
WEPCSSCSR

SEQ ID NO: 575268 - protein, 9 aa, Homo Sapiens
YPNPQERSS

SEQ ID NO: 575269 - protein, 9 aa, Homo Sapiens
QTALWSILL

SEQ ID NO: 575270 - protein, 9 aa, Homo Sapiens
ELIASENLC

SEQ ID NO: 575271 - protein, 9 aa, Homo Sapiens
QQQSCFLIS

SEQ ID NO: 575272 - protein, 9 aa, Homo Sapiens
RLDTFSFST

SEQ ID NO: 575273 - protein, 9 aa, Homo Sapiens
FENSCNIPS

SEQ ID NO: 575274 - protein, 9 aa, Homo Sapiens
KTHINFVVI

SEQ ID NO: 575275 - protein, 9 aa, Homo Sapiens
SQGLCLNCK

SEQ ID NO: 575276 - protein, 9 aa, Homo Sapiens
QRRSRSHDR

SEQ ID NO: 575277 - protein, 9 aa, Homo Sapiens
LENCAKAVK

SEQ ID NO: 575278 - protein, 9 aa, Homo Sapiens
NVTRHAEMV

SEQ ID NO: 575279 - protein, 9 aa, Homo Sapiens
TTKTTPPPT

SEQ ID NO: 575280 - protein, 9 aa, Homo Sapiens
EIQATKEEN

SEQ ID NO: 575281 - protein, 9 aa, Homo Sapiens
QLHHLSMKC

SEQ ID NO: 575282 - protein, 9 aa, Homo Sapiens
QGITLTWTV

SEQ ID NO: 575283 - protein, 9 aa, Homo Sapiens
PASAPIGWY

SEQ ID NO: 575284 - protein, 9 aa, Homo Sapiens
VSATSIINL

SEQ ID NO: 575285 - protein, 9 aa, Homo Sapiens
PQERSSFYS

SEQ ID NO: 575286 - protein, 9 aa, Homo Sapiens
QSCMGHLET

SEQ ID NO: 575287 - protein, 9 aa, Homo Sapiens
SQVRRGPES

SEQ ID NO: 575288 - protein, 9 aa, Homo Sapiens
TRERPYNCK

SEQ ID NO: 575289 - protein, 9 aa, Homo Sapiens
TSIINLYFG

SEQ ID NO: 575290 - protein, 9 aa, Homo Sapiens
SSAFENSCN

SEQ ID NO: 575291 - protein, 9 aa, Homo Sapiens
INFVVIGHV

SEQ ID NO: 575292 - protein, 9 aa, Homo Sapiens
CHEEWACLD

SEQ ID NO: 575293 - protein, 9 aa, Homo Sapiens
GLYPNPQER

SEQ ID NO: 575294 - protein, 9 aa, Homo Sapiens
WQRVSQVRR

SEQ ID NO: 575295 - protein, 9 aa, Homo Sapiens
RRSRSRDQR

SEQ ID NO: 575296 - protein, 9 aa, Homo Sapiens
QATKEENTY

SEQ ID NO: 575297 - protein, 9 aa, Homo Sapiens
SGDWVRHKL

SEQ ID NO: 575298 - protein, 9 aa, Homo Sapiens
LYSLGPSGL

SEQ ID NO: 575299 - protein, 9 aa, Homo Sapiens
RFAPKRRCR

SEQ ID NO: 575300 - protein, 9 aa, Homo Sapiens
IINLYFGSK

SEQ ID NO: 575301 - protein, 9 aa, Homo Sapiens
CFLISHAIE

SEQ ID NO: 575302 - protein, 9 aa, Homo Sapiens
SDYPAISEL

SEQ ID NO: 575303 - protein, 9 aa, Homo Sapiens
RWMKNTEKG

SEQ ID NO: 575304 - protein, 9 aa, Homo Sapiens
TKEENTYPS

SEQ ID NO: 575305 - protein, 9 aa, Homo Sapiens
CRFAPKRRC

SEQ ID NO: 575306 - protein, 9 aa, Homo Sapiens
GCRLLFLFL

SEQ ID NO: 575307 - protein, 9 aa, Homo Sapiens
LGSGDWVRH

SEQ ID NO: 575308 - protein, 9 aa, Homo Sapiens
TLVRSVWDS

SEQ ID NO: 575309 - protein, 9 aa, Homo Sapiens
KIGHTLHAH

SEQ ID NO: 575310 - protein, 9 aa, Homo Sapiens
LLPLPTAGR

SEQ ID NO: 575311 - protein, 9 aa, Homo Sapiens
SQESFAEGL

SEQ ID NO: 575312 - protein, 9 aa, Homo Sapiens
LRKLQLSGH

SEQ ID NO: 575313 - protein, 9 aa, Homo Sapiens
NQQKIRSLD

SEQ ID NO: 575314 - protein, 9 aa, Homo Sapiens
DGINFMGGG

SEQ ID NO: 575315 - protein, 9 aa, Homo Sapiens
GHTLHAHDP

SEQ ID NO: 575316 - protein, 9 aa, Homo Sapiens
EAAEREVRE

SEQ ID NO: 575317 - protein, 9 aa, Homo Sapiens
SESSRRVFL

SEQ ID NO: 575318 - protein, 9 aa, Homo Sapiens
YEETLRKLQ

SEQ ID NO: 575319 - protein, 9 aa, Homo Sapiens
LQDELLPCD

SEQ ID NO: 575320 - protein, 9 aa, Homo Sapiens
EKHEREKEI

SEQ ID NO: 575321 - protein, 9 aa, Homo Sapiens
RPNARCLVN

SEQ ID NO: 575322 - protein, 9 aa, Homo Sapiens
PRPAPCSPR

SEQ ID NO: 575323 - protein, 9 aa, Homo Sapiens
EDTLVRSVW

SEQ ID NO: 575324 - protein, 9 aa, Homo Sapiens
NITIEVNTL

SEQ ID NO: 575325 - protein, 9 aa, Homo Sapiens
KVRDALLDP

SEQ ID NO: 575326 - protein, 9 aa, Homo Sapiens
ETSSSFRER

SEQ ID NO: 575327 - protein, 9 aa, Homo Sapiens
SYISLNKSQ

SEQ ID NO: 575328 - protein, 9 aa, Homo Sapiens
QSCRITNPF

SEQ ID NO: 575329 - protein, 9 aa, Homo Sapiens
KAFSWKSCC

SEQ ID NO: 575330 - protein, 9 aa, Homo Sapiens
RITNPFSPC

SEQ ID NO: 575331 - protein, 9 aa, Homo Sapiens
ASTLSAPLE

SEQ ID NO: 575332 - protein, 9 aa, Homo Sapiens
HRGTAGGTA

SEQ ID NO: 575333 - protein, 9 aa, Homo Sapiens
EEQPRAGSQ

SEQ ID NO: 575334 - protein, 9 aa, Homo Sapiens
VGNSDPENK

SEQ ID NO: 575335 - protein, 9 aa, Homo Sapiens
QLASTLSAP

SEQ ID NO: 575336 - protein, 9 aa, Homo Sapiens
NFMGGGGES

SEQ ID NO: 575337 - protein, 9 aa, Homo Sapiens
YIHDYYVLN

SEQ ID NO: 575338 - protein, 9 aa, Homo Sapiens
RGRHRGTAG

SEQ ID NO: 575339 - protein, 9 aa, Homo Sapiens
LCSQESFAE

SEQ ID NO: 575340 - protein, 9 aa, Homo Sapiens
EREKEIKEF

SEQ ID NO: 575341 - protein, 9 aa, Homo Sapiens
MNFNVKKLA

SEQ ID NO: 575342 - protein, 9 aa, Homo Sapiens
EQEEEVAGG

SEQ ID NO: 575343 - protein, 9 aa, Homo Sapiens
GIIIGSFWL

SEQ ID NO: 575344 - protein, 9 aa, Homo Sapiens
QPRAGSQGS

SEQ ID NO: 575345 - protein, 9 aa, Homo Sapiens
SWKSCCINH

SEQ ID NO: 575346 - protein, 9 aa, Homo Sapiens
FGKELSEIG

SEQ ID NO: 575347 - protein, 9 aa, Homo Sapiens
LLPCDGISR

SEQ ID NO: 575348 - protein, 9 aa, Homo Sapiens
RVRLIVGKD

SEQ ID NO: 575349 - protein, 9 aa, Homo Sapiens
CTQFEETWA

SEQ ID NO: 575350 - protein, 9 aa, Homo Sapiens
VVETSSSFR

SEQ ID NO: 575351 - protein, 9 aa, Homo Sapiens
SILAGDVIA

SEQ ID NO: 575352 - protein, 9 aa, Homo Sapiens
TSCTQFEET

SEQ ID NO: 575353 - protein, 9 aa, Homo Sapiens
KANLSLSLS

SEQ ID NO: 575354 - protein, 9 aa, Homo Sapiens
NTLGWTSCT

SEQ ID NO: 575355 - protein, 9 aa, Homo Sapiens
QECLDEEEA

SEQ ID NO: 575356 - protein, 9 aa, Homo Sapiens
KGSQALFNC

SEQ ID NO: 575357 - protein, 9 aa, Homo Sapiens
GLALPPVPK

SEQ ID NO: 575358 - protein, 9 aa, Homo Sapiens
TNPFSPCPH

SEQ ID NO: 575359 - protein, 9 aa, Homo Sapiens
TCGIIIGSF

SEQ ID NO: 575360 - protein, 9 aa, Homo Sapiens
FGLTTQEPW

SEQ ID NO: 575361 - protein, 9 aa, Homo Sapiens
SYRGSRKRK

SEQ ID NO: 575362 - protein, 9 aa, Homo Sapiens
GSVGNSDPE

SEQ ID NO: 575363 - protein, 9 aa, Homo Sapiens
GSQGSGGNH

SEQ ID NO: 575364 - protein, 9 aa, Homo Sapiens
PLQDELLPC

SEQ ID NO: 575365 - protein, 9 aa, Homo Sapiens
TYEKHEREK

SEQ ID NO: 575366 - protein, 9 aa, Homo Sapiens
TDRQGQNSH

SEQ ID NO: 575367 - protein, 9 aa, Homo Sapiens
QSPVSQKHT

SEQ ID NO: 575368 - protein, 9 aa, Homo Sapiens
NFNVKKLAA

SEQ ID NO: 575369 - protein, 9 aa, Homo Sapiens
ECLDEEEAS

SEQ ID NO: 575370 - protein, 9 aa, Homo Sapiens
ETDVEDEFE

SEQ ID NO: 575371 - protein, 9 aa, Homo Sapiens
FQAVILEGH

SEQ ID NO: 575372 - protein, 9 aa, Homo Sapiens
PAKRVRLIV

SEQ ID NO: 575373 - protein, 9 aa, Homo Sapiens
DKEYSIEEV

SEQ ID NO: 575374 - protein, 9 aa, Homo Sapiens
HIICLVYKE

SEQ ID NO: 575375 - protein, 9 aa, Homo Sapiens
SRDSGLYAC

SEQ ID NO: 575376 - protein, 9 aa, Homo Sapiens
LVNVSSILA

SEQ ID NO: 575377 - protein, 9 aa, Homo Sapiens
EVNTLEVGK

SEQ ID NO: 575378 - protein, 9 aa, Homo Sapiens
LSEIGSDTT

SEQ ID NO: 575379 - protein, 9 aa, Homo Sapiens
RQRPRPPNS

SEQ ID NO: 575380 - protein, 9 aa, Homo Sapiens
EKKIVDNLN

SEQ ID NO: 575381 - protein, 9 aa, Homo Sapiens
GLTTQEPWI

SEQ ID NO: 575382 - protein, 9 aa, Homo Sapiens
ILLALMDGL

SEQ ID NO: 575383 - protein, 9 aa, Homo Sapiens
VNVSSILAG

SEQ ID NO: 575384 - protein, 9 aa, Homo Sapiens
ELLPCDGIS

SEQ ID NO: 575385 - protein, 9 aa, Homo Sapiens
IFGKELSEI

SEQ ID NO: 575386 - protein, 9 aa, Homo Sapiens
LRIKSGLGK

SEQ ID NO: 575387 - protein, 9 aa, Homo Sapiens
GFGLTTQEP

SEQ ID NO: 575388 - protein, 9 aa, Homo Sapiens
CCINHEKIH

SEQ ID NO: 575389 - protein, 9 aa, Homo Sapiens
TGGTTLAQI

SEQ ID NO: 575390 - protein, 9 aa, Homo Sapiens
EPLSLSSYI

SEQ ID NO: 575391 - protein, 9 aa, Homo Sapiens
QALFNCTVS

SEQ ID NO: 575392 - protein, 9 aa, Homo Sapiens
RHRSDPDQR

SEQ ID NO: 575393 - protein, 9 aa, Homo Sapiens
RYGEKVRDA

SEQ ID NO: 575394 - protein, 9 aa, Homo Sapiens
FYSTSKGYM

SEQ ID NO: 575395 - protein, 9 aa, Homo Sapiens
CLCSQESFA

SEQ ID NO: 575396 - protein, 9 aa, Homo Sapiens
RHHRLHTGD

SEQ ID NO: 575397 - protein, 9 aa, Homo Sapiens
VRLPGSQVF

SEQ ID NO: 575398 - protein, 9 aa, Homo Sapiens
TLSAPLENA

SEQ ID NO: 575399 - protein, 9 aa, Homo Sapiens
SHSTPRPAP

SEQ ID NO: 575400 - protein, 9 aa, Homo Sapiens
LPKVEETDV

SEQ ID NO: 575401 - protein, 9 aa, Homo Sapiens
QKMGCKKVL

SEQ ID NO: 575402 - protein, 9 aa, Homo Sapiens
TDYHKHSHG

SEQ ID NO: 575403 - protein, 9 aa, Homo Sapiens
QAAEKSCFS

SEQ ID NO: 575404 - protein, 9 aa, Homo Sapiens
LFGRGRHRG

SEQ ID NO: 575405 - protein, 9 aa, Homo Sapiens
VSDACAQKA

SEQ ID NO: 575406 - protein, 9 aa, Homo Sapiens
LSLPHLKLN

SEQ ID NO: 575407 - protein, 9 aa, Homo Sapiens
GRHRGTAGG

SEQ ID NO: 575408 - protein, 9 aa, Homo Sapiens
LRFRGLPEC

SEQ ID NO: 575409 - protein, 9 aa, Homo Sapiens
RFRGLPECM

SEQ ID NO: 575410 - protein, 9 aa, Homo Sapiens
EIGSDTTPL

SEQ ID NO: 575411 - protein, 9 aa, Homo Sapiens
KRWMPPFPT

SEQ ID NO: 575412 - protein, 9 aa, Homo Sapiens
GLSHSSPPG

SEQ ID NO: 575413 - protein, 9 aa, Homo Sapiens
YFCEPPSLL

SEQ ID NO: 575414 - protein, 9 aa, Homo Sapiens
RQLQECLDE

SEQ ID NO: 575415 - protein, 9 aa, Homo Sapiens
GKAIKHKDK

SEQ ID NO: 575416 - protein, 9 aa, Homo Sapiens
PSLLKLASI

SEQ ID NO: 575417 - protein, 9 aa, Homo Sapiens
IKSGLGKAI

SEQ ID NO: 575418 - protein, 9 aa, Homo Sapiens
CRITNPFSP

SEQ ID NO: 575419 - protein, 9 aa, Homo Sapiens
HSHGAAPCS

SEQ ID NO: 575420 - protein, 9 aa, Homo Sapiens
NLPPHIICL

SEQ ID NO: 575421 - protein, 9 aa, Homo Sapiens
KKIVDNLNK

SEQ ID NO: 575422 - protein, 9 aa, Homo Sapiens
DYHKHSHGA

SEQ ID NO: 575423 - protein, 9 aa, Homo Sapiens
PLRGASGPR

SEQ ID NO: 575424 - protein, 9 aa, Homo Sapiens
GQTDRQGQN

SEQ ID NO: 575425 - protein, 9 aa, Homo Sapiens
RGASGPRTG

SEQ ID NO: 575426 - protein, 9 aa, Homo Sapiens
RAGLSHSSP

SEQ ID NO: 575427 - protein, 9 aa, Homo Sapiens
DELLPCDGI

SEQ ID NO: 575428 - protein, 9 aa, Homo Sapiens
EREAAEREV

SEQ ID NO: 575429 - protein, 9 aa, Homo Sapiens
VAVDELSFN

SEQ ID NO: 575430 - protein, 9 aa, Homo Sapiens
SFNPGKQRF

SEQ ID NO: 575431 - protein, 9 aa, Homo Sapiens
LGKAIKHKD

SEQ ID NO: 575432 - protein, 9 aa, Homo Sapiens
RPRPPNSHS

SEQ ID NO: 575433 - protein, 9 aa, Homo Sapiens
RACYAMMLV

SEQ ID NO: 575434 - protein, 9 aa, Homo Sapiens
LYEQKQRGR

SEQ ID NO: 575435 - protein, 9 aa, Homo Sapiens
REKEIKEFE

SEQ ID NO: 575436 - protein, 9 aa, Homo Sapiens
ICLICGDCM

SEQ ID NO: 575437 - protein, 9 aa, Homo Sapiens
YSIEEVEAG

SEQ ID NO: 575438 - protein, 9 aa, Homo Sapiens
QRPRPPNSH

SEQ ID NO: 575439 - protein, 9 aa, Homo Sapiens
PSRTPSRRS

SEQ ID NO: 575440 - protein, 9 aa, Homo Sapiens
PLIGWVLRF

SEQ ID NO: 575441 - protein, 9 aa, Homo Sapiens
GHESYRGSR

SEQ ID NO: 575442 - protein, 9 aa, Homo Sapiens
EVDILVTVH

SEQ ID NO: 575443 - protein, 9 aa, Homo Sapiens
TTTSIVVQY

SEQ ID NO: 575444 - protein, 9 aa, Homo Sapiens
TLHAHDPVF

SEQ ID NO: 575445 - protein, 9 aa, Homo Sapiens
LTYEKHERE

SEQ ID NO: 575446 - protein, 9 aa, Homo Sapiens
HLKYIEGLS

SEQ ID NO: 575447 - protein, 9 aa, Homo Sapiens
LQECLDEEE

SEQ ID NO: 575448 - protein, 9 aa, Homo Sapiens
RGRAFTYST

SEQ ID NO: 575449 - protein, 9 aa, Homo Sapiens
RGLPECMGF

SEQ ID NO: 575450 - protein, 9 aa, Homo Sapiens
LRHRSDPDQ

SEQ ID NO: 575451 - protein, 9 aa, Homo Sapiens
EPSENNLES

SEQ ID NO: 575452 - protein, 9 aa, Homo Sapiens
EREVREKGH

SEQ ID NO: 575453 - protein, 9 aa, Homo Sapiens
VLSLMDAED

SEQ ID NO: 575454 - protein, 9 aa, Homo Sapiens
NLIRRRRVH

SEQ ID NO: 575455 - protein, 9 aa, Homo Sapiens
IIGSFWLGV

SEQ ID NO: 575456 - protein, 9 aa, Homo Sapiens
RHRGTAGGT

SEQ ID NO: 575457 - protein, 9 aa, Homo Sapiens
SRKRKRRSH

SEQ ID NO: 575458 - protein, 9 aa, Homo Sapiens
EQPRAGSQG

SEQ ID NO: 575459 - protein, 9 aa, Homo Sapiens
LAVLEDSAR

SEQ ID NO: 575460 - protein, 9 aa, Homo Sapiens
PAQRSPLRG

SEQ ID NO: 575461 - protein, 9 aa, Homo Sapiens
SIVSILLAL

SEQ ID NO: 575462 - protein, 9 aa, Homo Sapiens
EVREKGHLE

SEQ ID NO: 575463 - protein, 9 aa, Homo Sapiens
VDELSFNPG

SEQ ID NO: 575464 - protein, 9 aa, Homo Sapiens
LMYIHDYYV

SEQ ID NO: 575465 - protein, 9 aa, Homo Sapiens
RWMPPFPTC

SEQ ID NO: 575466 - protein, 9 aa, Homo Sapiens
IEEVEAGRI

SEQ ID NO: 575467 - protein, 9 aa, Homo Sapiens
LALCKASEV

SEQ ID NO: 575468 - protein, 9 aa, Homo Sapiens
PRSEVCGGG

SEQ ID NO: 575469 - protein, 9 aa, Homo Sapiens
PRPPNSHST

SEQ ID NO: 575470 - protein, 9 aa, Homo Sapiens
PPAKRVRLI

SEQ ID NO: 575471 - protein, 9 aa, Homo Sapiens
SILLALMDG

SEQ ID NO: 575472 - protein, 9 aa, Homo Sapiens
DACAQKANL

SEQ ID NO: 575473 - protein, 9 aa, Homo Sapiens
VTWLDGINF

SEQ ID NO: 575474 - protein, 9 aa, Homo Sapiens
SRRSSASVT

SEQ ID NO: 575475 - protein, 9 aa, Homo Sapiens
DVEDEFEQP

SEQ ID NO: 575476 - protein, 9 aa, Homo Sapiens
GLNDKKSEL

SEQ ID NO: 575477 - protein, 9 aa, Homo Sapiens
LAGDVIAAA

SEQ ID NO: 575478 - protein, 9 aa, Homo Sapiens
QRLLHSEAH

SEQ ID NO: 575479 - protein, 9 aa, Homo Sapiens
SDFGQHGTG

SEQ ID NO: 575480 - protein, 9 aa, Homo Sapiens
PTTTSIVVQ

SEQ ID NO: 575481 - protein, 9 aa, Homo Sapiens
RSDPDQRPR

SEQ ID NO: 575482 - protein, 9 aa, Homo Sapiens
VVNVTPVPA

SEQ ID NO: 575483 - protein, 9 aa, Homo Sapiens
FSPCPHLLP

SEQ ID NO: 575484 - protein, 9 aa, Homo Sapiens
DNLNKEYDT

SEQ ID NO: 575485 - protein, 9 aa, Homo Sapiens
KMGCKKVLA

SEQ ID NO: 575486 - protein, 9 aa, Homo Sapiens
RAGSQGSGG

SEQ ID NO: 575487 - protein, 9 aa, Homo Sapiens
KHTPFQISS

SEQ ID NO: 575488 - protein, 9 aa, Homo Sapiens
HESYRGSRK

SEQ ID NO: 575489 - protein, 9 aa, Homo Sapiens
WTSCTQFEE

SEQ ID NO: 575490 - protein, 9 aa, Homo Sapiens
ICLVYKEVT

SEQ ID NO: 575491 - protein, 9 aa, Homo Sapiens
RGPDGFGFS

SEQ ID NO: 575492 - protein, 9 aa, Homo Sapiens
EEGRAGLSH

SEQ ID NO: 575493 - protein, 9 aa, Homo Sapiens
LESENSAFQ

SEQ ID NO: 575494 - protein, 9 aa, Homo Sapiens
SDPDQRPRQ

SEQ ID NO: 575495 - protein, 9 aa, Homo Sapiens
QKHTPFQIS

SEQ ID NO: 575496 - protein, 9 aa, Homo Sapiens
FGRGRHRGT

SEQ ID NO: 575497 - protein, 9 aa, Homo Sapiens
CMDLEEPEK

SEQ ID NO: 575498 - protein, 9 aa, Homo Sapiens
RTGALVPRS

SEQ ID NO: 575499 - protein, 9 aa, Homo Sapiens
QESFAEGLH

SEQ ID NO: 575500 - protein, 9 aa, Homo Sapiens
VLEDSARDI

SEQ ID NO: 575501 - protein, 9 aa, Homo Sapiens
VCGGGLALP

SEQ ID NO: 575502 - protein, 9 aa, Homo Sapiens
ASGPRTGAL

SEQ ID NO: 575503 - protein, 9 aa, Homo Sapiens
SRTPSRRSS

SEQ ID NO: 575504 - protein, 9 aa, Homo Sapiens
IICLVYKEV

SEQ ID NO: 575505 - protein, 9 aa, Homo Sapiens
PRAGSQGSG

SEQ ID NO: 575506 - protein, 9 aa, Homo Sapiens
LSFNPGKQR

SEQ ID NO: 575507 - protein, 9 aa, Homo Sapiens
NNLESENSA

SEQ ID NO: 575508 - protein, 9 aa, Homo Sapiens
GRPLRHRSD

SEQ ID NO: 575509 - protein, 9 aa, Homo Sapiens
GLGKAIKHK

SEQ ID NO: 575510 - protein, 9 aa, Homo Sapiens
PTAGRVVVR

SEQ ID NO: 575511 - protein, 9 aa, Homo Sapiens
IIIGSFWLG

SEQ ID NO: 575512 - protein, 9 aa, Homo Sapiens
TPVSSTGGT

SEQ ID NO: 575513 - protein, 9 aa, Homo Sapiens
QRSPLRGAS

SEQ ID NO: 575514 - protein, 9 aa, Homo Sapiens
KEYSIEEVE

SEQ ID NO: 575515 - protein, 9 aa, Homo Sapiens
AQRSPLRGA

SEQ ID NO: 575516 - protein, 9 aa, Homo Sapiens
TLYEQKQRG

SEQ ID NO: 575517 - protein, 9 aa, Homo Sapiens
RRRRVHTEE

SEQ ID NO: 575518 - protein, 9 aa, Homo Sapiens
GGLALPPVP

SEQ ID NO: 575519 - protein, 9 aa, Homo Sapiens
WSSARNSAS

SEQ ID NO: 575520 - protein, 9 aa, Homo Sapiens
EPPSLLKLA

SEQ ID NO: 575521 - protein, 9 aa, Homo Sapiens
TSRDSGLYA

SEQ ID NO: 575522 - protein, 9 aa, Homo Sapiens
VKILNQQKI

SEQ ID NO: 575523 - protein, 9 aa, Homo Sapiens
VLAVHKVNI

SEQ ID NO: 575524 - protein, 9 aa, Homo Sapiens
YISLNKSQL

SEQ ID NO: 575525 - protein, 9 aa, Homo Sapiens
LIRRRRVHT

SEQ ID NO: 575526 - protein, 9 aa, Homo Sapiens
GDKSYKCEE

SEQ ID NO: 575527 - protein, 9 aa, Homo Sapiens
TQEWAGKKR

SEQ ID NO: 575528 - protein, 9 aa, Homo Sapiens
VEETDVEDE

SEQ ID NO: 575529 - protein, 9 aa, Homo Sapiens
GSQALFNCT

SEQ ID NO: 575530 - protein, 9 aa, Homo Sapiens
EDTQEWAGK

SEQ ID NO: 575531 - protein, 9 aa, Homo Sapiens
FGFSIVGGY

SEQ ID NO: 575532 - protein, 9 aa, Homo Sapiens
CLRNRYGEK

SEQ ID NO: 575533 - protein, 9 aa, Homo Sapiens
LSKGFGLTT

SEQ ID NO: 575534 - protein, 9 aa, Homo Sapiens
HSSIVSILL

SEQ ID NO: 575535 - protein, 9 aa, Homo Sapiens
WVLRFRGLP

SEQ ID NO: 575536 - protein, 9 aa, Homo Sapiens
KSNLIRRRR

SEQ ID NO: 575537 - protein, 9 aa, Homo Sapiens
QGRPLRHRS

SEQ ID NO: 575538 - protein, 9 aa, Homo Sapiens
LASTLSAPL

SEQ ID NO: 575539 - protein, 9 aa, Homo Sapiens
SSFRERKKK

SEQ ID NO: 575540 - protein, 9 aa, Homo Sapiens
VLMYIHDYY

SEQ ID NO: 575541 - protein, 9 aa, Homo Sapiens
PLPPAKRVR

SEQ ID NO: 575542 - protein, 9 aa, Homo Sapiens
TLERGPDGF

SEQ ID NO: 575543 - protein, 9 aa, Homo Sapiens
NIMNFNVKK

SEQ ID NO: 575544 - protein, 9 aa, Homo Sapiens
MNIMNFNVK

SEQ ID NO: 575545 - protein, 9 aa, Homo Sapiens
QEDTQEWAG

SEQ ID NO: 575546 - protein, 9 aa, Homo Sapiens
ETLRKLQLS

SEQ ID NO: 575547 - protein, 9 aa, Homo Sapiens
CKKVLAVHK

SEQ ID NO: 575548 - protein, 9 aa, Homo Sapiens
QRPRQRPRP

SEQ ID NO: 575549 - protein, 9 aa, Homo Sapiens
KHSHGAAPC

SEQ ID NO: 575550 - protein, 9 aa, Homo Sapiens
PFSPCPHLL

SEQ ID NO: 575551 - protein, 9 aa, Homo Sapiens
RKRKRRSHS

SEQ ID NO: 575552 - protein, 9 aa, Homo Sapiens
SCTQFEETW

SEQ ID NO: 575553 - protein, 9 aa, Homo Sapiens
NDCGKKFSQ

SEQ ID NO: 575554 - protein, 9 aa, Homo Sapiens
KVEETDVED

SEQ ID NO: 575555 - protein, 9 aa, Homo Sapiens
AKRVRLIVG

SEQ ID NO: 575556 - protein, 9 aa, Homo Sapiens
ALVPRSPEF

SEQ ID NO: 575557 - protein, 9 aa, Homo Sapiens
IGHTLHAHD

SEQ ID NO: 575558 - protein, 9 aa, Homo Sapiens
TTQEPWIQF

SEQ ID NO: 575559 - protein, 9 aa, Homo Sapiens
NSDPENKDP

SEQ ID NO: 575560 - protein, 9 aa, Homo Sapiens
FCEPPSLLK

SEQ ID NO: 575561 - protein, 9 aa, Homo Sapiens
NHYFCEPPS

SEQ ID NO: 575562 - protein, 9 aa, Homo Sapiens
SPLRGASGP

SEQ ID NO: 575563 - protein, 9 aa, Homo Sapiens
PHLKLNKET

SEQ ID NO: 575564 - protein, 9 aa, Homo Sapiens
LTDAVRLPG

SEQ ID NO: 575565 - protein, 9 aa, Homo Sapiens
YYHSLALCK

SEQ ID NO: 575566 - protein, 9 aa, Homo Sapiens
GPGGQAAEK

SEQ ID NO: 575567 - protein, 9 aa, Homo Sapiens
LGVGDQPGL

SEQ ID NO: 575568 - protein, 9 aa, Homo Sapiens
PSENNLESE

SEQ ID NO: 575569 - protein, 9 aa, Homo Sapiens
CSKIMAERP

SEQ ID NO: 575570 - protein, 9 aa, Homo Sapiens
TWLDGINFM

SEQ ID NO: 575571 - protein, 9 aa, Homo Sapiens
VTPVPADLL

SEQ ID NO: 575572 - protein, 9 aa, Homo Sapiens
QTDRQGQNS

SEQ ID NO: 575573 - protein, 9 aa, Homo Sapiens
GNSDPENKD

SEQ ID NO: 575574 - protein, 9 aa, Homo Sapiens
CGKKFSQKS

SEQ ID NO: 575575 - protein, 9 aa, Homo Sapiens
DTLVRSVWD

SEQ ID NO: 575576 - protein, 9 aa, Homo Sapiens
SAPLENAEL

SEQ ID NO: 575577 - protein, 9 aa, Homo Sapiens
TWPTTTSIV

SEQ ID NO: 575578 - protein, 9 aa, Homo Sapiens
LVLWLGGFV

SEQ ID NO: 575579 - protein, 9 aa, Homo Sapiens
PIAVLMYIH

SEQ ID NO: 575580 - protein, 9 aa, Homo Sapiens
MMLVLWLGG

SEQ ID NO: 575581 - protein, 9 aa, Homo Sapiens
GSGQSSDFG

SEQ ID NO: 575582 - protein, 9 aa, Homo Sapiens
EYSIEEVEA

SEQ ID NO: 575583 - protein, 9 aa, Homo Sapiens
KFQAVILEG

SEQ ID NO: 575584 - protein, 9 aa, Homo Sapiens
QPAPAQRSP

SEQ ID NO: 575585 - protein, 9 aa, Homo Sapiens
ARNSASAAE

SEQ ID NO: 575586 - protein, 9 aa, Homo Sapiens
SSRRVFLGR

SEQ ID NO: 575587 - protein, 9 aa, Homo Sapiens
VSQKHTPFQ

SEQ ID NO: 575588 - protein, 9 aa, Homo Sapiens
LDEEEASQE

SEQ ID NO: 575589 - protein, 9 aa, Homo Sapiens
ESILSLPHL

SEQ ID NO: 575590 - protein, 9 aa, Homo Sapiens
GGGLALPPV

SEQ ID NO: 575591 - protein, 9 aa, Homo Sapiens
VNVTPVPAD

SEQ ID NO: 575592 - protein, 9 aa, Homo Sapiens
KSINKIGHT

SEQ ID NO: 575593 - protein, 9 aa, Homo Sapiens
AALGSVGNS

SEQ ID NO: 575594 - protein, 9 aa, Homo Sapiens
PRTGALVPR

SEQ ID NO: 575595 - protein, 9 aa, Homo Sapiens
CDGISRPQM

SEQ ID NO: 575596 - protein, 9 aa, Homo Sapiens
WLDGINFMG

SEQ ID NO: 575597 - protein, 9 aa, Homo Sapiens
VEDEFEQPT

SEQ ID NO: 575598 - protein, 9 aa, Homo Sapiens
SRKSNLIRR

SEQ ID NO: 575599 - protein, 9 aa, Homo Sapiens
RSVWDSYAE

SEQ ID NO: 575600 - protein, 9 aa, Homo Sapiens
NKIGHTLHA

SEQ ID NO: 575601 - protein, 9 aa, Homo Sapiens
GKKRWMPPF

SEQ ID NO: 575602 - protein, 9 aa, Homo Sapiens
TGEKFQAVI

SEQ ID NO: 575603 - protein, 9 aa, Homo Sapiens
GQSSDFGQH

SEQ ID NO: 575604 - protein, 9 aa, Homo Sapiens
KEQEEEVAG

SEQ ID NO: 575605 - protein, 9 aa, Homo Sapiens
SEVCGGGLA

SEQ ID NO: 575606 - protein, 9 aa, Homo Sapiens
KMRQLQECL

SEQ ID NO: 575607 - protein, 9 aa, Homo Sapiens
EWAGKKRWM

SEQ ID NO: 575608 - protein, 9 aa, Homo Sapiens
SGQGRPLRH

SEQ ID NO: 575609 - protein, 9 aa, Homo Sapiens
LHSEAHLKY

SEQ ID NO: 575610 - protein, 9 aa, Homo Sapiens
LVPRSPEFH

SEQ ID NO: 575611 - protein, 9 aa, Homo Sapiens
LSSGQGRPL

SEQ ID NO: 575612 - protein, 9 aa, Homo Sapiens
FSWKSCCIN

SEQ ID NO: 575613 - protein, 9 aa, Homo Sapiens
SGPRTGALV

SEQ ID NO: 575614 - protein, 9 aa, Homo Sapiens
LPTAGRVVV

SEQ ID NO: 575615 - protein, 9 aa, Homo Sapiens
ASFYSTSKG

SEQ ID NO: 575616 - protein, 9 aa, Homo Sapiens
AVRLPGSQV

SEQ ID NO: 575617 - protein, 9 aa, Homo Sapiens
EKEIKEFER

SEQ ID NO: 575618 - protein, 9 aa, Homo Sapiens
PKVEETDVE

SEQ ID NO: 575619 - protein, 9 aa, Homo Sapiens
SFRERKKKE

SEQ ID NO: 575620 - protein, 9 aa, Homo Sapiens
KSGLGKAIK

SEQ ID NO: 575621 - protein, 9 aa, Homo Sapiens
TPVPADLLR

SEQ ID NO: 575622 - protein, 9 aa, Homo Sapiens
RTPSRRSSA

SEQ ID NO: 575623 - protein, 9 aa, Homo Sapiens
ELPQYEETL

SEQ ID NO: 575624 - protein, 9 aa, Homo Sapiens
LNQQKIRSL

SEQ ID NO: 575625 - protein, 9 aa, Homo Sapiens
STGGTTLAQ

SEQ ID NO: 575626 - protein, 9 aa, Homo Sapiens
GQAAEKSCF

SEQ ID NO: 575627 - protein, 9 aa, Homo Sapiens
AQKANLSLS

SEQ ID NO: 575628 - protein, 9 aa, Homo Sapiens
ELFGRGRHR

SEQ ID NO: 575629 - protein, 9 aa, Homo Sapiens
QVSDACAQK

SEQ ID NO: 575630 - protein, 9 aa, Homo Sapiens
HKHSHGAAP

SEQ ID NO: 575631 - protein, 9 aa, Homo Sapiens
ALSSGQGRP

SEQ ID NO: 575632 - protein, 9 aa, Homo Sapiens
VELASFYST

SEQ ID NO: 575633 - protein, 9 aa, Homo Sapiens
SGQSSDFGQ

SEQ ID NO: 575634 - protein, 9 aa, Homo Sapiens
INFMGGGGE

SEQ ID NO: 575635 - protein, 9 aa, Homo Sapiens
TDVEDEFEQ

SEQ ID NO: 575636 - protein, 9 aa, Homo Sapiens
TTSIVVQYV

SEQ ID NO: 575637 - protein, 9 aa, Homo Sapiens
EGEDTLVRS

SEQ ID NO: 575638 - protein, 9 aa, Homo Sapiens
SSILAGDVI

SEQ ID NO: 575639 - protein, 9 aa, Homo Sapiens
REVREKGHL

SEQ ID NO: 575640 - protein, 9 aa, Homo Sapiens
DCMDLEEPE

SEQ ID NO: 575641 - protein, 9 aa, Homo Sapiens
INITIEVNT

SEQ ID NO: 575642 - protein, 9 aa, Homo Sapiens
GASGPRTGA

SEQ ID NO: 575643 - protein, 9 aa, Homo Sapiens
SSSFRERKK

SEQ ID NO: 575644 - protein, 9 aa, Homo Sapiens
SINITIEVN

SEQ ID NO: 575645 - protein, 9 aa, Homo Sapiens
PPSLLKLAS

SEQ ID NO: 575646 - protein, 9 aa, Homo Sapiens
ITIEVNTLE

SEQ ID NO: 575647 - protein, 9 aa, Homo Sapiens
IKGATSRDS

SEQ ID NO: 575648 - protein, 9 aa, Homo Sapiens
TAGRVVVRR

SEQ ID NO: 575649 - protein, 9 aa, Homo Sapiens
SGLGKAIKH

SEQ ID NO: 575650 - protein, 9 aa, Homo Sapiens
LTITPVSST

SEQ ID NO: 575651 - protein, 9 aa, Homo Sapiens
SPVSQKHTP

SEQ ID NO: 575652 - protein, 9 aa, Homo Sapiens
RPRQRPRPP

SEQ ID NO: 575653 - protein, 9 aa, Homo Sapiens
RLHTGDKSY

SEQ ID NO: 575654 - protein, 9 aa, Homo Sapiens
PVSQKHTPF

SEQ ID NO: 575655 - protein, 9 aa, Homo Sapiens
NSHSTPRPA

SEQ ID NO: 575656 - protein, 9 aa, Homo Sapiens
PNSHSTPRP

SEQ ID NO: 575657 - protein, 9 aa, Homo Sapiens
LLTDAVRLP

SEQ ID NO: 575658 - protein, 9 aa, Homo Sapiens
SNVELASFY

SEQ ID NO: 575659 - protein, 9 aa, Homo Sapiens
GELFGRGRH

SEQ ID NO: 575660 - protein, 9 aa, Homo Sapiens
SQKHTPFQI

SEQ ID NO: 575661 - protein, 9 aa, Homo Sapiens
AEGLHCDRC

SEQ ID NO: 575662 - protein, 9 aa, Homo Sapiens
KVAVKILNQ

SEQ ID NO: 575663 - protein, 9 aa, Homo Sapiens
LRNRYGEKV

SEQ ID NO: 575664 - protein, 9 aa, Homo Sapiens
LPPAKRVRL

SEQ ID NO: 575665 - protein, 9 aa, Homo Sapiens
VFLGRLWRR

SEQ ID NO: 575666 - protein, 9 aa, Homo Sapiens
ELRIKSGLG

SEQ ID NO: 575667 - protein, 9 aa, Homo Sapiens
QIHSSIVSI

SEQ ID NO: 575668 - protein, 9 aa, Homo Sapiens
PPPGRDKEQ

SEQ ID NO: 575669 - protein, 9 aa, Homo Sapiens
GDQPGLNDK

SEQ ID NO: 575670 - protein, 9 aa, Homo Sapiens
STLSAPLEN

SEQ ID NO: 575671 - protein, 9 aa, Homo Sapiens
VLRFRGLPE

SEQ ID NO: 575672 - protein, 9 aa, Homo Sapiens
CSPRQPAPA

SEQ ID NO: 575673 - protein, 9 aa, Homo Sapiens
WPTTTSIVV

SEQ ID NO: 575674 - protein, 9 aa, Homo Sapiens
CYAMMLVLW

SEQ ID NO: 575675 - protein, 9 aa, Homo Sapiens
GSRKRKRRS

SEQ ID NO: 575676 - protein, 9 aa, Homo Sapiens
WKSCCINHE

SEQ ID NO: 575677 - protein, 9 aa, Homo Sapiens
YGEKVRDAL

SEQ ID NO: 575678 - protein, 9 aa, Homo Sapiens
RPAPCSPRQ

SEQ ID NO: 575679 - protein, 9 aa, Homo Sapiens
TSIVVQYVE

SEQ ID NO: 575680 - protein, 9 aa, Homo Sapiens
LPQYEETLR

SEQ ID NO: 575681 - protein, 9 aa, Homo Sapiens
PADLLRENT

SEQ ID NO: 575682 - protein, 9 aa, Homo Sapiens
SARNSASAA

SEQ ID NO: 575683 - protein, 9 aa, Homo Sapiens
DQRPRQRPR

SEQ ID NO: 575684 - protein, 9 aa, Homo Sapiens
LSAPLENAE

SEQ ID NO: 575685 - protein, 9 aa, Homo Sapiens
GLPECMGFD

SEQ ID NO: 575686 - protein, 9 aa, Homo Sapiens
CGIIIGSFW

SEQ ID NO: 575687 - protein, 9 aa, Homo Sapiens
ENNLESENS

SEQ ID NO: 575688 - protein, 9 aa, Homo Sapiens
PCSPRQPAP

SEQ ID NO: 575689 - protein, 9 aa, Homo Sapiens
YECNDCGKK

SEQ ID NO: 575690 - protein, 9 aa, Homo Sapiens
KKRWMPPFP

SEQ ID NO: 575691 - protein, 9 aa, Homo Sapiens
SHSSPPGSH

SEQ ID NO: 575692 - protein, 9 aa, Homo Sapiens
LGWTSCTQF

SEQ ID NO: 575693 - protein, 9 aa, Homo Sapiens
HTPFQISSA

SEQ ID NO: 575694 - protein, 9 aa, Homo Sapiens
CAQKANLSL

SEQ ID NO: 575695 - protein, 9 aa, Homo Sapiens
SDLLTDAVR

SEQ ID NO: 575696 - protein, 9 aa, Homo Sapiens
SEAHLKYIE

SEQ ID NO: 575697 - protein, 9 aa, Homo Sapiens
NRYGEKVRD

SEQ ID NO: 575698 - protein, 9 aa, Homo Sapiens
YSESSRRVF

SEQ ID NO: 575699 - protein, 9 aa, Homo Sapiens
PAPCSPRQP

SEQ ID NO: 575700 - protein, 9 aa, Homo Sapiens
RGSRKRKRR

SEQ ID NO: 575701 - protein, 9 aa, Homo Sapiens
KIMAERPNA

SEQ ID NO: 575702 - protein, 9 aa, Homo Sapiens
DAEDWQEGE

SEQ ID NO: 575703 - protein, 9 aa, Homo Sapiens
GKAFSWKSC

SEQ ID NO: 575704 - protein, 9 aa, Homo Sapiens
EDSARDIRE

SEQ ID NO: 575705 - protein, 9 aa, Homo Sapiens
RLPGSQVFL

SEQ ID NO: 575706 - protein, 9 aa, Homo Sapiens
AHLKYIEGL

SEQ ID NO: 575707 - protein, 9 aa, Homo Sapiens
SSARNSASA

SEQ ID NO: 575708 - protein, 9 aa, Homo Sapiens
FLLPLPTAG

SEQ ID NO: 575709 - protein, 9 aa, Homo Sapiens
IVVQYVEKM

SEQ ID NO: 575710 - protein, 9 aa, Homo Sapiens
DKSYKCEEC

SEQ ID NO: 575711 - protein, 9 aa, Homo Sapiens
LTCGIIIGS

SEQ ID NO: 575712 - protein, 9 aa, Homo Sapiens
LASFYSTSK

SEQ ID NO: 575713 - protein, 9 aa, Homo Sapiens
AERPNARCL

SEQ ID NO: 575714 - protein, 9 aa, Homo Sapiens
ETLYEQKQR

SEQ ID NO: 575715 - protein, 9 aa, Homo Sapiens
KVLAVHKVN

SEQ ID NO: 575716 - protein, 9 aa, Homo Sapiens
IEVNTLEVG

SEQ ID NO: 575717 - protein, 9 aa, Homo Sapiens
NVVETSSSF

SEQ ID NO: 575718 - protein, 9 aa, Homo Sapiens
VLWLGGFVH

SEQ ID NO: 575719 - protein, 9 aa, Homo Sapiens
VSSTGGTTL

SEQ ID NO: 575720 - protein, 9 aa, Homo Sapiens
LPHLKLNKE

SEQ ID NO: 575721 - protein, 9 aa, Homo Sapiens
SSIVSILLA

SEQ ID NO: 575722 - protein, 9 aa, Homo Sapiens
DAVRLPGSQ

SEQ ID NO: 575723 - protein, 9 aa, Homo Sapiens
YRGSRKRKR

SEQ ID NO: 575724 - protein, 9 aa, Homo Sapiens
FRERKKKEK

SEQ ID NO: 575725 - protein, 9 aa, Homo Sapiens
SIEEVEAGR

SEQ ID NO: 575726 - protein, 9 aa, Homo Sapiens
FLGRLWRRL

SEQ ID NO: 575727 - protein, 9 aa, Homo Sapiens
EKFQAVILE

SEQ ID NO: 575728 - protein, 9 aa, Homo Sapiens
PLQEDTQEW

SEQ ID NO: 575729 - protein, 9 aa, Homo Sapiens
PCDGISRPQ

SEQ ID NO: 575730 - protein, 9 aa, Homo Sapiens
RPLRHRSDP

SEQ ID NO: 575731 - protein, 9 aa, Homo Sapiens
PGRDKEQEE

SEQ ID NO: 575732 - protein, 9 aa, Homo Sapiens
SASAAEARS

SEQ ID NO: 575733 - protein, 9 aa, Homo Sapiens
LSHSSPPGS

SEQ ID NO: 575734 - protein, 9 aa, Homo Sapiens
LQIKGATSR

SEQ ID NO: 575735 - protein, 9 aa, Homo Sapiens
INKIGHTLH

SEQ ID NO: 575736 - protein, 9 aa, Homo Sapiens
NTLEVGKVE

SEQ ID NO: 575737 - protein, 9 aa, Homo Sapiens
EKVRDALLD

SEQ ID NO: 575738 - protein, 9 aa, Homo Sapiens
ELSEIGSDT

SEQ ID NO: 575739 - protein, 9 aa, Homo Sapiens
CLDEEEASQ

SEQ ID NO: 575740 - protein, 9 aa, Homo Sapiens
LNKEYDTLS

SEQ ID NO: 575741 - protein, 9 aa, Homo Sapiens
GWVLRFRGL

SEQ ID NO: 575742 - protein, 9 aa, Homo Sapiens
LQEDTQEWA

SEQ ID NO: 575743 - protein, 9 aa, Homo Sapiens
IRRRRVHTE

SEQ ID NO: 575744 - protein, 9 aa, Homo Sapiens
SFYSTSKGY

SEQ ID NO: 575745 - protein, 9 aa, Homo Sapiens
TDAVRLPGS

SEQ ID NO: 575746 - protein, 9 aa, Homo Sapiens
GINFMGGGG

SEQ ID NO: 575747 - protein, 9 aa, Homo Sapiens
ARDIREALH

SEQ ID NO: 575748 - protein, 9 aa, Homo Sapiens
SPRQPAPAQ

SEQ ID NO: 575749 - protein, 9 aa, Homo Sapiens
RNSASAAEA

SEQ ID NO: 575750 - protein, 9 aa, Homo Sapiens
SINKIGHTL

SEQ ID NO: 575751 - protein, 9 aa, Homo Sapiens
MFLLPLPTA

SEQ ID NO: 575752 - protein, 9 aa, Homo Sapiens
RRSSASVTP

SEQ ID NO: 575753 - protein, 9 aa, Homo Sapiens
SARDIREAL

SEQ ID NO: 575754 - protein, 9 aa, Homo Sapiens
GRAGLSHSS

SEQ ID NO: 575755 - protein, 9 aa, Homo Sapiens
RQPAPAQRS

SEQ ID NO: 575756 - protein, 9 aa, Homo Sapiens
GEKVRDALL

SEQ ID NO: 575757 - protein, 9 aa, Homo Sapiens
YEQKQRGRA

SEQ ID NO: 575758 - protein, 9 aa, Homo Sapiens
STPRPAPCS

SEQ ID NO: 575759 - protein, 9 aa, Homo Sapiens
CGGGLALPP

SEQ ID NO: 575760 - protein, 9 aa, Homo Sapiens
QEWAGKKRW

SEQ ID NO: 575761 - protein, 9 aa, Homo Sapiens
IHDYYVLNY

SEQ ID NO: 575762 - protein, 9 aa, Homo Sapiens
PSRRSSASV

SEQ ID NO: 575763 - protein, 9 aa, Homo Sapiens
GQGRPLRHR

SEQ ID NO: 575764 - protein, 9 aa, Homo Sapiens
AAEREVREK

SEQ ID NO: 575765 - protein, 9 aa, Homo Sapiens
PECMGFDRP

SEQ ID NO: 575766 - protein, 9 aa, Homo Sapiens
QQKIRSLDV

SEQ ID NO: 575767 - protein, 9 aa, Homo Sapiens
SRQLASTLS

SEQ ID NO: 575768 - protein, 9 aa, Homo Sapiens
RRVFLGRLW

SEQ ID NO: 575769 - protein, 9 aa, Homo Sapiens
SAALGSVGN

SEQ ID NO: 575770 - protein, 9 aa, Homo Sapiens
SLLKLASID

SEQ ID NO: 575771 - protein, 9 aa, Homo Sapiens
ESSRRVFLG

SEQ ID NO: 575772 - protein, 9 aa, Homo Sapiens
ILSLPHLKL

SEQ ID NO: 575773 - protein, 9 aa, Homo Sapiens
IPLPPAKRV

SEQ ID NO: 575774 - protein, 9 aa, Homo Sapiens
ESYRGSRKR

SEQ ID NO: 575775 - protein, 9 aa, Homo Sapiens
FRGLPECMG

SEQ ID NO: 575776 - protein, 9 aa, Homo Sapiens
VETSSSFRE

SEQ ID NO: 575777 - protein, 9 aa, Homo Sapiens
QYEETLRKL

SEQ ID NO: 575778 - protein, 9 aa, Homo Sapiens
IVSILLALM

SEQ ID NO: 575779 - protein, 9 aa, Homo Sapiens
VGDQPGLND

SEQ ID NO: 575780 - protein, 9 aa, Homo Sapiens
SIVVQYVEK

SEQ ID NO: 575781 - protein, 9 aa, Homo Sapiens
AICLICGDC

SEQ ID NO: 575782 - protein, 9 aa, Homo Sapiens
LEDSARDIR

SEQ ID NO: 575783 - protein, 9 aa, Homo Sapiens
LTTQEPWIQ

SEQ ID NO: 575784 - protein, 9 aa, Homo Sapiens
PGGQAAEKS

SEQ ID NO: 575785 - protein, 9 aa, Homo Sapiens
LMDAEDWQE

SEQ ID NO: 575786 - protein, 9 aa, Homo Sapiens
NLESENSAF

SEQ ID NO: 575787 - protein, 9 aa, Homo Sapiens
ALFNCTVSQ

SEQ ID NO: 575788 - protein, 9 aa, Homo Sapiens
ITPVSSTGG

SEQ ID NO: 575789 - protein, 9 aa, Homo Sapiens
SNLIRRRRV

SEQ ID NO: 575790 - protein, 9 aa, Homo Sapiens
YAMMLVLWL

SEQ ID NO: 575791 - protein, 9 aa, Homo Sapiens
EETLRKLQL

SEQ ID NO: 575792 - protein, 9 aa, Homo Sapiens
QRGRAFTYS

SEQ ID NO: 575793 - protein, 9 aa, Homo Sapiens
PHIICLVYK

SEQ ID NO: 575794 - protein, 9 aa, Homo Sapiens
PPNSHSTPR

SEQ ID NO: 575795 - protein, 9 aa, Homo Sapiens
QKANLSLSL

SEQ ID NO: 575796 - protein, 9 aa, Homo Sapiens
RNRYGEKVR

SEQ ID NO: 575797 - protein, 9 aa, Homo Sapiens
HSTPRPAPC

SEQ ID NO: 575798 - protein, 9 aa, Homo Sapiens
MDAEDWQEG

SEQ ID NO: 575799 - protein, 9 aa, Homo Sapiens
PRQRPRPPN

SEQ ID NO: 575800 - protein, 9 aa, Homo Sapiens
CLVYKEVTT

SEQ ID NO: 575801 - protein, 9 aa, Homo Sapiens
GWTSCTQFE

SEQ ID NO: 575802 - protein, 9 aa, Homo Sapiens
VNTLEVGKV

SEQ ID NO: 575803 - protein, 9 aa, Homo Sapiens
FNPGKQRFE

SEQ ID NO: 575804 - protein, 9 aa, Homo Sapiens
TGALVPRSP

SEQ ID NO: 575805 - protein, 9 aa, Homo Sapiens
PLPTAGRVV

SEQ ID NO: 575806 - protein, 9 aa, Homo Sapiens
GCKKVLAVH

SEQ ID NO: 575807 - protein, 9 aa, Homo Sapiens
CNDCGKKFS

SEQ ID NO: 575808 - protein, 9 aa, Homo Sapiens
ERPNARCLV

SEQ ID NO: 575809 - protein, 9 aa, Homo Sapiens
ERGPDGFGF

SEQ ID NO: 575810 - protein, 9 aa, Homo Sapiens
QEEEVAGGD

SEQ ID NO: 575811 - protein, 9 aa, Homo Sapiens
SSGQGRPLR

SEQ ID NO: 575812 - protein, 9 aa, Homo Sapiens
SQGSGGNHE

SEQ ID NO: 575813 - protein, 9 aa, Homo Sapiens
KGATSRDSG

SEQ ID NO: 575814 - protein, 9 aa, Homo Sapiens
LDGINFMGG

SEQ ID NO: 575815 - protein, 9 aa, Homo Sapiens
PLSLSSYIS

SEQ ID NO: 575816 - protein, 9 aa, Homo Sapiens
LHTGDKSYK

SEQ ID NO: 575817 - protein, 9 aa, Homo Sapiens
GSGSGQSSD

SEQ ID NO: 575818 - protein, 9 aa, Homo Sapiens
WAGKKRWMP

SEQ ID NO: 575819 - protein, 9 aa, Homo Sapiens
RSPLRGASG

SEQ ID NO: 575820 - protein, 9 aa, Homo Sapiens
EDWQEGEEI

SEQ ID NO: 575821 - protein, 9 aa, Homo Sapiens
PNARCLVNG

SEQ ID NO: 575822 - protein, 9 aa, Homo Sapiens
IVDNLNKEY

SEQ ID NO: 575823 - protein, 9 aa, Homo Sapiens
LSLMDAEDW

SEQ ID NO: 575824 - protein, 9 aa, Homo Sapiens
KRVRLIVGK

SEQ ID NO: 575825 - protein, 9 aa, Homo Sapiens
DVAVDELSF

SEQ ID NO: 575826 - protein, 9 aa, Homo Sapiens
VVQYVEKME

SEQ ID NO: 575827 - protein, 9 aa, Homo Sapiens
RRRVHTEER

SEQ ID NO: 575828 - protein, 9 aa, Homo Sapiens
APCSPRQPA

SEQ ID NO: 575829 - protein, 9 aa, Homo Sapiens
RSEVCGGGL

SEQ ID NO: 575830 - protein, 9 aa, Homo Sapiens
EGRAGLSHS

SEQ ID NO: 575831 - protein, 9 aa, Homo Sapiens
GKKFSQKSH

SEQ ID NO: 575832 - protein, 9 aa, Homo Sapiens
GATSRDSGL

SEQ ID NO: 575833 - protein, 9 aa, Homo Sapiens
GVGDQPGLN

SEQ ID NO: 575834 - protein, 9 aa, Homo Sapiens
LICGDCMDL

SEQ ID NO: 575835 - protein, 9 aa, Homo Sapiens
LPCDGISRP

SEQ ID NO: 575836 - protein, 9 aa, Homo Sapiens
PPGRDKEQE

SEQ ID NO: 575837 - protein, 9 aa, Homo Sapiens
PQYEETLRK

SEQ ID NO: 575838 - protein, 9 aa, Homo Sapiens
PDQRPRQRP

SEQ ID NO: 575839 - protein, 9 aa, Homo Sapiens
KGFGLTTQE

SEQ ID NO: 575840 - protein, 9 aa, Homo Sapiens
MLVLWLGGF

SEQ ID NO: 575841 - protein, 9 aa, Homo Sapiens
ILVTVHKTC

SEQ ID NO: 575842 - protein, 9 aa, Homo Sapiens
LFNCTVSQG

SEQ ID NO: 575843 - protein, 9 aa, Homo Sapiens
ESENSAFQQ

SEQ ID NO: 575844 - protein, 9 aa, Homo Sapiens
IMNFNVKKL

SEQ ID NO: 575845 - protein, 9 aa, Homo Sapiens
ECNDCGKKF

SEQ ID NO: 575846 - protein, 9 aa, Homo Sapiens
AMMLVLWLG

SEQ ID NO: 575847 - protein, 9 aa, Homo Sapiens
IGSFWLGVD

SEQ ID NO: 575848 - protein, 9 aa, Homo Sapiens
APAQRSPLR

SEQ ID NO: 575849 - protein, 9 aa, Homo Sapiens
GRDKEQEEE

SEQ ID NO: 575850 - protein, 9 aa, Homo Sapiens
NVELASFYS

SEQ ID NO: 575851 - protein, 9 aa, Homo Sapiens
KKFSQKSHL

SEQ ID NO: 575852 - protein, 9 aa, Homo Sapiens
GKELSEIGS

SEQ ID NO: 575853 - protein, 9 aa, Homo Sapiens
ADLLRENTE

SEQ ID NO: 575854 - protein, 9 aa, Homo Sapiens
RVFLGRLWR

SEQ ID NO: 575855 - protein, 9 aa, Homo Sapiens
SKGFGLTTQ

SEQ ID NO: 575856 - protein, 9 aa, Homo Sapiens
HRSDPDQRP

SEQ ID NO: 575857 - protein, 9 aa, Homo Sapiens
TPSRRSSAS

SEQ ID NO: 575858 - protein, 9 aa, Homo Sapiens
DELSFNPGK

SEQ ID NO: 575859 - protein, 9 aa, Homo Sapiens
IATDYHKHS

SEQ ID NO: 575860 - protein, 9 aa, Homo Sapiens
AVILEGHES

SEQ ID NO: 575861 - protein, 9 aa, Homo Sapiens
VLAVLEDSA

SEQ ID NO: 575862 - protein, 9 aa, Homo Sapiens
VDNLNKEYD

SEQ ID NO: 575863 - protein, 9 aa, Homo Sapiens
PPHIICLVY

SEQ ID NO: 575864 - protein, 9 aa, Homo Sapiens
SILSLPHLK

SEQ ID NO: 575865 - protein, 9 aa, Homo Sapiens
PVSSTGGTT

SEQ ID NO: 575866 - protein, 9 aa, Homo Sapiens
LQSPVSQKH

SEQ ID NO: 575867 - protein, 9 aa, Homo Sapiens
KEGEDTLVR

SEQ ID NO: 575868 - protein, 9 aa, Homo Sapiens
SSTGGTTLA

SEQ ID NO: 575869 - protein, 9 aa, Homo Sapiens
MGCKKVLAV

SEQ ID NO: 575870 - protein, 9 aa, Homo Sapiens
NWSSARNSA

SEQ ID NO: 575871 - protein, 9 aa, Homo Sapiens
QKQRGRAFT

SEQ ID NO: 575872 - protein, 9 aa, Homo Sapiens
IHSSIVSIL

SEQ ID NO: 575873 - protein, 9 aa, Homo Sapiens
HSSPPGSHS

SEQ ID NO: 575874 - protein, 9 aa, Homo Sapiens
HEREKEIKE

SEQ ID NO: 575875 - protein, 9 aa, Homo Sapiens
LSSYISLNK

SEQ ID NO: 575876 - protein, 9 aa, Homo Sapiens
ICGDCMDLE

SEQ ID NO: 575877 - protein, 9 aa, Homo Sapiens
NSASAAEAR

SEQ ID NO: 575878 - protein, 9 aa, Homo Sapiens
EVCGGGLAL

SEQ ID NO: 575879 - protein, 9 aa, Homo Sapiens
GPDGFGFSI

SEQ ID NO: 575880 - protein, 9 aa, Homo Sapiens
PDGFGFSIV

SEQ ID NO: 575881 - protein, 9 aa, Homo Sapiens
CEPSENNLE

SEQ ID NO: 575882 - protein, 9 aa, Homo Sapiens
GFGFSIVGG

SEQ ID NO: 575883 - protein, 9 aa, Homo Sapiens
PLRHRSDPD

SEQ ID NO: 575884 - protein, 9 aa, Homo Sapiens
DPDQRPRQR

SEQ ID NO: 575885 - protein, 9 aa, Homo Sapiens
GPSRTPSRR

SEQ ID NO: 575886 - protein, 9 aa, Homo Sapiens
NVSSILAGD

SEQ ID NO: 575887 - protein, 9 aa, Homo Sapiens
GGQAAEKSC

SEQ ID NO: 575888 - protein, 9 aa, Homo Sapiens
RQLASTLSA

SEQ ID NO: 575889 - protein, 9 aa, Homo Sapiens
VILEGHESY

SEQ ID NO: 575890 - protein, 9 aa, Homo Sapiens
AVLMYIHDY

SEQ ID NO: 575891 - protein, 9 aa, Homo Sapiens
LPECMGFDR

SEQ ID NO: 575892 - protein, 9 aa, Homo Sapiens
LIFGKELSE

SEQ ID NO: 575893 - protein, 9 aa, Homo Sapiens
SFWLGVDQE

SEQ ID NO: 575894 - protein, 9 aa, Homo Sapiens
FVTWLDGIN

SEQ ID NO: 575895 - protein, 9 aa, Homo Sapiens
PEPLSLSSY

SEQ ID NO: 575896 - protein, 9 aa, Homo Sapiens
QSSDFGQHG

SEQ ID NO: 575897 - protein, 9 aa, Homo Sapiens
KSCCINHEK

SEQ ID NO: 575898 - protein, 9 aa, Homo Sapiens
VREKGHLEP

SEQ ID NO: 575899 - protein, 9 aa, Homo Sapiens
NKEYDTLSK

SEQ ID NO: 575900 - protein, 9 aa, Homo Sapiens
SCCINHEKI

SEQ ID NO: 575901 - protein, 9 aa, Homo Sapiens
CGDCMDLEE

SEQ ID NO: 575902 - protein, 9 aa, Homo Sapiens
DTQEWAGKK

SEQ ID NO: 575903 - protein, 9 aa, Homo Sapiens
GEDTLVRSV

SEQ ID NO: 575904 - protein, 9 aa, Homo Sapiens
YLVNVSSIL

SEQ ID NO: 575905 - protein, 9 aa, Homo Sapiens
CKASEVFCW

SEQ ID NO: 575906 - protein, 9 aa, Homo Sapiens
SLSSYISLN

SEQ ID NO: 575907 - protein, 9 aa, Homo Sapiens
ELASFYSTS

SEQ ID NO: 575908 - protein, 9 aa, Homo Sapiens
DGFGFSIVG

SEQ ID NO: 575909 - protein, 9 aa, Homo Sapiens
SLPHLKLNK

SEQ ID NO: 575910 - protein, 9 aa, Homo Sapiens
ILEGHESYD

SEQ ID NO: 575911 - protein, 9 aa, Homo Sapiens
QDELLPCDG

SEQ ID NO: 575912 - protein, 9 aa, Homo Sapiens
LVRSVWDSY

SEQ ID NO: 575913 - protein, 9 aa, Homo Sapiens
SSDFGQHGT

SEQ ID NO: 575914 - protein, 9 aa, Homo Sapiens
SSYISLNKS

SEQ ID NO: 575915 - protein, 9 aa, Homo Sapiens
LRGASGPRT

SEQ ID NO: 575916 - protein, 9 aa, Homo Sapiens
TLRKLQLSG

SEQ ID NO: 575917 - protein, 9 aa, Homo Sapiens
HRLHTGDKS

SEQ ID NO: 575918 - protein, 9 aa, Homo Sapiens
AVLEDSARD

SEQ ID NO: 575919 - protein, 9 aa, Homo Sapiens
IMAERPNAR

SEQ ID NO: 575920 - protein, 9 aa, Homo Sapiens
AVKILNQQK

SEQ ID NO: 575921 - protein, 9 aa, Homo Sapiens
VLKGSQALF

SEQ ID NO: 575922 - protein, 9 aa, Homo Sapiens
LGSVGNSDP

SEQ ID NO: 575923 - protein, 9 aa, Homo Sapiens
AGKKRWMPP

SEQ ID NO: 575924 - protein, 9 aa, Homo Sapiens
KHEREKEIK

SEQ ID NO: 575925 - protein, 9 aa, Homo Sapiens
TITPVSSTG

SEQ ID NO: 575926 - protein, 9 aa, Homo Sapiens
YEKHEREKE

SEQ ID NO: 575927 - protein, 9 aa, Homo Sapiens
CEPPSLLKL

SEQ ID NO: 575928 - protein, 9 aa, Homo Sapiens
VSSILAGDV

SEQ ID NO: 575929 - protein, 9 aa, Homo Sapiens
GLSKGFGLT

SEQ ID NO: 575930 - protein, 9 aa, Homo Sapiens
ASAAEARSM

SEQ ID NO: 575931 - protein, 9 aa, Homo Sapiens
EQKQRGRAF

SEQ ID NO: 575932 - protein, 9 aa, Homo Sapiens
PGLNDKKSE

SEQ ID NO: 575933 - protein, 9 aa, Homo Sapiens
PVPADLLRE

SEQ ID NO: 575934 - protein, 9 aa, Homo Sapiens
RLLHSEAHL

SEQ ID NO: 575935 - protein, 9 aa, Homo Sapiens
EKSCFSYDI

SEQ ID NO: 575936 - protein, 9 aa, Homo Sapiens
GRGRHRGTA

SEQ ID NO: 575937 - protein, 9 aa, Homo Sapiens
ALGSVGNSD

SEQ ID NO: 575938 - protein, 9 aa, Homo Sapiens
ESFAEGLHC

SEQ ID NO: 575939 - protein, 9 aa, Homo Sapiens
ATSRDSGLY

SEQ ID NO: 575940 - protein, 9 aa, Homo Sapiens
EAHLKYIEG

SEQ ID NO: 575941 - protein, 9 aa, Homo Sapiens
QPGLNDKKS

SEQ ID NO: 575942 - protein, 9 aa, Homo Sapiens
NVTPVPADL

SEQ ID NO: 575943 - protein, 9 aa, Homo Sapiens
RKSNLIRRR

SEQ ID NO: 575944 - protein, 9 aa, Homo Sapiens
EEEQPRAGS

SEQ ID NO: 575945 - protein, 9 aa, Homo Sapiens
TIEVNTLEV

SEQ ID NO: 575946 - protein, 9 aa, Homo Sapiens
VAVKILNQQ

SEQ ID NO: 575947 - protein, 9 aa, Homo Sapiens
SLMDAEDWQ

SEQ ID NO: 575948 - protein, 9 aa, Homo Sapiens
GPRTGALVP

SEQ ID NO: 575949 - protein, 9 aa, Homo Sapiens
EETDVEDEF

SEQ ID NO: 575950 - protein, 9 aa, Homo Sapiens
ELSFNPGKQ

SEQ ID NO: 575951 - protein, 9 aa, Homo Sapiens
PRQPAPAQR

SEQ ID NO: 575952 - protein, 9 aa, Homo Sapiens
DLLTDAVRL

SEQ ID NO: 575953 - protein, 9 aa, Homo Sapiens
LPPHIICLV

SEQ ID NO: 575954 - protein, 9 aa, Homo Sapiens
GEKFQAVIL

SEQ ID NO: 575955 - protein, 9 aa, Homo Sapiens
AAEKSCFSY

SEQ ID NO: 575956 - protein, 9 aa, Homo Sapiens
SCRITNPFS

SEQ ID NO: 575957 - protein, 9 aa, Homo Sapiens
AGLSHSSPP

SEQ ID NO: 575958 - protein, 9 aa, Homo Sapiens
QLQECLDEE

SEQ ID NO: 575959 - protein, 9 aa, Homo Sapiens
LNDKKSELL

SEQ ID NO: 575960 - protein, 9 aa, Homo Sapiens
AEREVREKG

SEQ ID NO: 575961 - protein, 9 aa, Homo Sapiens
ENLPPHIIC

SEQ ID NO: 575962 - protein, 9 aa, Homo Sapiens
NLNKEYDTL

SEQ ID NO: 575963 - protein, 9 aa, Homo Sapiens
GDCMDLEEP

SEQ ID NO: 575964 - protein, 9 aa, Homo Sapiens
DIATDYHKH

SEQ ID NO: 575965 - protein, 9 aa, Homo Sapiens
LCKASEVFC

SEQ ID NO: 575966 - protein, 9 aa, Homo Sapiens
SEIGSDTTP

SEQ ID NO: 575967 - protein, 9 aa, Homo Sapiens
VEAGRIPNP

SEQ ID NO: 575968 - protein, 9 aa, Homo Sapiens
DFGQHGTGS

SEQ ID NO: 575969 - protein, 9 aa, Homo Sapiens
CLICGDCMD

SEQ ID NO: 575970 - protein, 9 aa, Homo Sapiens
ITNPFSPCP

SEQ ID NO: 575971 - protein, 9 aa, Homo Sapiens
ATDYHKHSH

SEQ ID NO: 575972 - protein, 9 aa, Homo Sapiens
GYYHSLALC

SEQ ID NO: 575973 - protein, 9 aa, Homo Sapiens
VSILLALMD

SEQ ID NO: 575974 - protein, 9 aa, Homo Sapiens
KILNQQKIR

SEQ ID NO: 575975 - protein, 9 aa, Homo Sapiens
QIKGATSRD

SEQ ID NO: 575976 - protein, 9 aa, Homo Sapiens
SDACAQKAN

SEQ ID NO: 575977 - protein, 9 aa, Homo Sapiens
YLQIKGATS

SEQ ID NO: 575978 - protein, 9 aa, Homo Sapiens
YHKHSHGAA

SEQ ID NO: 575979 - protein, 9 aa, Homo Sapiens
GSFWLGVDQ

SEQ ID NO: 575980 - protein, 9 aa, Homo Sapiens
SFAEGLHCD

SEQ ID NO: 575981 - protein, 9 aa, Homo Sapiens
RDKEQEEEV

SEQ ID NO: 575982 - protein, 9 aa, Homo Sapiens
LERGPDGFG

SEQ ID NO: 575983 - protein, 9 aa, Homo Sapiens
FAEGLHCDR

SEQ ID NO: 575984 - protein, 9 aa, Homo Sapiens
TGDKSYKCE

SEQ ID NO: 575985 - protein, 9 aa, Homo Sapiens
KVLSLMDAE

SEQ ID NO: 575986 - protein, 9 aa, Homo Sapiens
VPRSPEFHR

SEQ ID NO: 575987 - protein, 9 aa, Homo Sapiens
TPRPAPCSP

SEQ ID NO: 575988 - protein, 9 aa, Homo Sapiens
ACAQKANLS

SEQ ID NO: 575989 - protein, 9 aa, Homo Sapiens
RVLKGSQAL

SEQ ID NO: 575990 - protein, 9 aa, Homo Sapiens
RIKSGLGKA

SEQ ID NO: 575991 - protein, 9 aa, Homo Sapiens
IAVLMYIHD

SEQ ID NO: 575992 - protein, 9 aa, Homo Sapiens
QPIAVLMYI

SEQ ID NO: 575993 - protein, 9 aa, Homo Sapiens
SGSGQSSDF

SEQ ID NO: 575994 - protein, 9 aa, Homo Sapiens
PAPAQRSPL

SEQ ID NO: 575995 - protein, 9 aa, Homo Sapiens
AVDELSFNP

SEQ ID NO: 575996 - protein, 9 aa, Homo Sapiens
LAVHKVNIT

SEQ ID NO: 575997 - protein, 9 aa, Homo Sapiens
EVEAGRIPN

SEQ ID NO: 575998 - protein, 9 aa, Homo Sapiens
ALCKASEVF

SEQ ID NO: 575999 - protein, 9 aa, Homo Sapiens
DKEQEEEVA

SEQ ID NO: 576000 - protein, 9 aa, Homo Sapiens
YHSLALCKA

SEQ ID NO: 576001 - protein, 9 aa, Homo Sapiens
MYIHDYYVL

SEQ ID NO: 576002 - protein, 9 aa, Homo Sapiens
LIGWVLRFR

SEQ ID NO: 576003 - protein, 9 aa, Homo Sapiens
ILNQQKIRS

SEQ ID NO: 576004 - protein, 9 aa, Homo Sapiens
YSTSKGYMG

SEQ ID NO: 576005 - protein, 9 aa, Homo Sapiens
KQRGRAFTY

SEQ ID NO: 576006 - protein, 9 aa, Homo Sapiens
AEDWQEGEE

SEQ ID NO: 576007 - protein, 9 aa, Homo Sapiens
KKVLAVHKV

SEQ ID NO: 576008 - protein, 9 aa, Homo Sapiens
DILVTVHKT

SEQ ID NO: 576009 - protein, 9 aa, Homo Sapiens
KFSQKSHLS

SEQ ID NO: 576010 - protein, 9 aa, Homo Sapiens
SVGNSDPEN

SEQ ID NO: 576011 - protein, 9 aa, Homo Sapiens
LKGSQALFN

SEQ ID NO: 576012 - protein, 9 aa, Homo Sapiens
INTLGWTSC

SEQ ID NO: 576013 - protein, 9 aa, Homo Sapiens
AEKSCFSYD

SEQ ID NO: 576014 - protein, 9 aa, Homo Sapiens
KIVDNLNKE

SEQ ID NO: 576015 - protein, 9 aa, Homo Sapiens
TLGWTSCTQ

SEQ ID NO: 576016 - protein, 9 aa, Homo Sapiens
REAAEREVR

SEQ ID NO: 576017 - protein, 9 aa, Homo Sapiens
EEVEAGRIP

SEQ ID NO: 576018 - protein, 9 aa, Homo Sapiens
DSARDIREA

SEQ ID NO: 576019 - protein, 9 aa, Homo Sapiens
NPFSPCPHL

SEQ ID NO: 576020 - protein, 9 aa, Homo Sapiens
QAVILEGHE

SEQ ID NO: 576021 - protein, 9 aa, Homo Sapiens
HSEAHLKYI

SEQ ID NO: 576022 - protein, 9 aa, Homo Sapiens
KELSEIGSD

SEQ ID NO: 576023 - protein, 9 aa, Homo Sapiens
VPADLLREN

SEQ ID NO: 576024 - protein, 9 aa, Homo Sapiens
LLHSEAHLK

SEQ ID NO: 576025 - protein, 9 aa, Homo Sapiens
DCGKKFSQK

SEQ ID NO: 576026 - protein, 9 aa, Homo Sapiens
DQPGLNDKK

SEQ ID NO: 576027 - protein, 9 aa, Homo Sapiens
HTLHAHDPV

SEQ ID NO: 576028 - protein, 9 aa, Homo Sapiens
AGSQGSGGN

SEQ ID NO: 576029 - protein, 9 aa, Homo Sapiens
LSLSSYISL

SEQ ID NO: 576030 - protein, 9 aa, Homo Sapiens
ACYAMMLVL

SEQ ID NO: 576031 - protein, 9 aa, Homo Sapiens
IGWVLRFRG

SEQ ID NO: 576032 - protein, 9 aa, Homo Sapiens
RPPNSHSTP

SEQ ID NO: 576033 - protein, 9 aa, Homo Sapiens
VRSVWDSYA

SEQ ID NO: 576034 - protein, 9 aa, Homo Sapiens
SLALCKASE

SEQ ID NO: 576035 - protein, 9 aa, Homo Sapiens
MRQLQECLD

SEQ ID NO: 576036 - protein, 9 aa, Homo Sapiens
VRLIVGKDS

SEQ ID NO: 576037 - protein, 9 aa, Homo Sapiens
SQALFNCTV

SEQ ID NO: 576038 - protein, 9 aa, Homo Sapiens
VDILVTVHK

SEQ ID NO: 576039 - protein, 9 aa, Homo Sapiens
CSQESFAEG

SEQ ID NO: 576040 - protein, 9 aa, Homo Sapiens
SENNLESEN

SEQ ID NO: 576041 - protein, 9 aa, Homo Sapiens
HSLALCKAS

SEQ ID NO: 576042 - protein, 9 aa, Homo Sapiens
GALVPRSPE

SEQ ID NO: 576043 - protein, 9 aa, Homo Sapiens
HYFCEPPSL

SEQ ID NO: 576044 - protein, 9 aa, Homo Sapiens
KSCFSYDIL

SEQ ID NO: 576045 - protein, 9 aa, Homo Sapiens
SKIMAERPN

SEQ ID NO: 576046 - protein, 9 aa, Homo Sapiens
AFSWKSCCI

SEQ ID NO: 576047 - protein, 9 aa, Homo Sapiens
TSSSFRERK

SEQ ID NO: 576048 - protein, 9 aa, Homo Sapiens
LKLNKETID

SEQ ID NO: 576049 - protein, 9 aa, Homo Sapiens
MAERPNARC

SEQ ID NO: 576050 - protein, 9 aa, Homo Sapiens
HLKLNKETI

SEQ ID NO: 576051 - protein, 9 aa, Homo Sapiens
SRRVFLGRL

SEQ ID NO: 576052 - protein, 9 aa, Homo Sapiens
LPLPTAGRV

SEQ ID NO: 576053 - protein, 9 aa, Homo Sapiens
ILAGDVIAA

SEQ ID NO: 576054 - protein, 9 aa, Homo Sapiens
SEEERRPQP

SEQ ID NO: 576055 - protein, 9 aa, Homo Sapiens
GLWAGGQTI

SEQ ID NO: 576056 - protein, 9 aa, Homo Sapiens
QQKVLRAWR

SEQ ID NO: 576057 - protein, 9 aa, Homo Sapiens
HQERLGTCK

SEQ ID NO: 576058 - protein, 9 aa, Homo Sapiens
TKIKQRRSQ

SEQ ID NO: 576059 - protein, 9 aa, Homo Sapiens
WKQHCRSEE

SEQ ID NO: 576060 - protein, 9 aa, Homo Sapiens
SCIYCSKQL

SEQ ID NO: 576061 - protein, 9 aa, Homo Sapiens
VHIDSYAEE

SEQ ID NO: 576062 - protein, 9 aa, Homo Sapiens
VQRLLETRI

SEQ ID NO: 576063 - protein, 9 aa, Homo Sapiens
GLGTQQTRE

SEQ ID NO: 576064 - protein, 9 aa, Homo Sapiens
SHWRLSYKG

SEQ ID NO: 576065 - protein, 9 aa, Homo Sapiens
RMKLESLHQ

SEQ ID NO: 576066 - protein, 9 aa, Homo Sapiens
FGDPRTYYP

SEQ ID NO: 576067 - protein, 9 aa, Homo Sapiens
SFSLWCSPA

SEQ ID NO: 576068 - protein, 9 aa, Homo Sapiens
IQQKVLRAW

SEQ ID NO: 576069 - protein, 9 aa, Homo Sapiens
EELCQQHPR

SEQ ID NO: 576070 - protein, 9 aa, Homo Sapiens
ERSCREELC

SEQ ID NO: 576071 - protein, 9 aa, Homo Sapiens
WMPLHLFHE

SEQ ID NO: 576072 - protein, 9 aa, Homo Sapiens
HVCACPGRD

SEQ ID NO: 576073 - protein, 9 aa, Homo Sapiens
QKKTSNDGY

SEQ ID NO: 576074 - protein, 9 aa, Homo Sapiens
PEEPTCCAE

SEQ ID NO: 576075 - protein, 9 aa, Homo Sapiens
QGLPLMNQV

SEQ ID NO: 576076 - protein, 9 aa, Homo Sapiens
TGTFISASV

SEQ ID NO: 576077 - protein, 9 aa, Homo Sapiens
EPTCCAESF

SEQ ID NO: 576078 - protein, 9 aa, Homo Sapiens
VTYSCIYCS

SEQ ID NO: 576079 - protein, 9 aa, Homo Sapiens
LIRRSGDVS

SEQ ID NO: 576080 - protein, 9 aa, Homo Sapiens
NNNFITAIE

SEQ ID NO: 576081 - protein, 9 aa, Homo Sapiens
YYPDFKGPV

SEQ ID NO: 576082 - protein, 9 aa, Homo Sapiens
EPAAARGVF

SEQ ID NO: 576083 - protein, 9 aa, Homo Sapiens
AVKRRIVGN

SEQ ID NO: 576084 - protein, 9 aa, Homo Sapiens
TKMTLKQVS

SEQ ID NO: 576085 - protein, 9 aa, Homo Sapiens
PFRRLVREI

SEQ ID NO: 576086 - protein, 9 aa, Homo Sapiens
ENFGSSRLS

SEQ ID NO: 576087 - protein, 9 aa, Homo Sapiens
EVTDFNDNL

SEQ ID NO: 576088 - protein, 9 aa, Homo Sapiens
KSAFYVLEQ

SEQ ID NO: 576089 - protein, 9 aa, Homo Sapiens
IVNLDHHVI

SEQ ID NO: 576090 - protein, 9 aa, Homo Sapiens
STEKTDGTK

SEQ ID NO: 576091 - protein, 9 aa, Homo Sapiens
LPSERQEVD

SEQ ID NO: 576092 - protein, 9 aa, Homo Sapiens
LTDSCQPYK

SEQ ID NO: 576093 - protein, 9 aa, Homo Sapiens
LFHEVTDFN

SEQ ID NO: 576094 - protein, 9 aa, Homo Sapiens
SVLKASHRN

SEQ ID NO: 576095 - protein, 9 aa, Homo Sapiens
PSPEEPTCC

SEQ ID NO: 576096 - protein, 9 aa, Homo Sapiens
FDSYTNLEL

SEQ ID NO: 576097 - protein, 9 aa, Homo Sapiens
WRLSYKGQQ

SEQ ID NO: 576098 - protein, 9 aa, Homo Sapiens
GSSCVYCKT

SEQ ID NO: 576099 - protein, 9 aa, Homo Sapiens
YKGQQFGPR

SEQ ID NO: 576100 - protein, 9 aa, Homo Sapiens
AGNQSMIAF

SEQ ID NO: 576101 - protein, 9 aa, Homo Sapiens
RLIRQYGDH

SEQ ID NO: 576102 - protein, 9 aa, Homo Sapiens
QPFDTINKD

SEQ ID NO: 576103 - protein, 9 aa, Homo Sapiens
KIQQKVLRA

SEQ ID NO: 576104 - protein, 9 aa, Homo Sapiens
RRRGHNLYV

SEQ ID NO: 576105 - protein, 9 aa, Homo Sapiens
KQLKQYKDK

SEQ ID NO: 576106 - protein, 9 aa, Homo Sapiens
SELTKLDAQ

SEQ ID NO: 576107 - protein, 9 aa, Homo Sapiens
QLDVEHNLL

SEQ ID NO: 576108 - protein, 9 aa, Homo Sapiens
FISASVDEI

SEQ ID NO: 576109 - protein, 9 aa, Homo Sapiens
SVQRLLETR

SEQ ID NO: 576110 - protein, 9 aa, Homo Sapiens
QRVRRLIRQ

SEQ ID NO: 576111 - protein, 9 aa, Homo Sapiens
TDRQGQNSH

SEQ ID NO: 576112 - protein, 9 aa, Homo Sapiens
LGKHSGRKR

SEQ ID NO: 576113 - protein, 9 aa, Homo Sapiens
CHEPNKWQC

SEQ ID NO: 576114 - protein, 9 aa, Homo Sapiens
DEWTSRAHP

SEQ ID NO: 576115 - protein, 9 aa, Homo Sapiens
LKKQLKQYK

SEQ ID NO: 576116 - protein, 9 aa, Homo Sapiens
TLRCDVSGI

SEQ ID NO: 576117 - protein, 9 aa, Homo Sapiens
GTFISASVD

SEQ ID NO: 576118 - protein, 9 aa, Homo Sapiens
GGDIRVIAE

SEQ ID NO: 576119 - protein, 9 aa, Homo Sapiens
GRKRQWQST

SEQ ID NO: 576120 - protein, 9 aa, Homo Sapiens
ATTPPLPFH

SEQ ID NO: 576121 - protein, 9 aa, Homo Sapiens
ITPLKMLEK

SEQ ID NO: 576122 - protein, 9 aa, Homo Sapiens
AIRMQAHRQ

SEQ ID NO: 576123 - protein, 9 aa, Homo Sapiens
GSSFSLWCS

SEQ ID NO: 576124 - protein, 9 aa, Homo Sapiens
RLLETRIAV

SEQ ID NO: 576125 - protein, 9 aa, Homo Sapiens
LCQEYWNIT

SEQ ID NO: 576126 - protein, 9 aa, Homo Sapiens
TYLEKLNAQ

SEQ ID NO: 576127 - protein, 9 aa, Homo Sapiens
FTTDLQATK

SEQ ID NO: 576128 - protein, 9 aa, Homo Sapiens
TYSCIYCSK

SEQ ID NO: 576129 - protein, 9 aa, Homo Sapiens
PEPGSSCVY

SEQ ID NO: 576130 - protein, 9 aa, Homo Sapiens
YLEKLNAQV

SEQ ID NO: 576131 - protein, 9 aa, Homo Sapiens
RLLKKQLKQ

SEQ ID NO: 576132 - protein, 9 aa, Homo Sapiens
VNLDHHVIS

SEQ ID NO: 576133 - protein, 9 aa, Homo Sapiens
SLNKHLFLM

SEQ ID NO: 576134 - protein, 9 aa, Homo Sapiens
YLMDSKYID

SEQ ID NO: 576135 - protein, 9 aa, Homo Sapiens
YTNLELVAD

SEQ ID NO: 576136 - protein, 9 aa, Homo Sapiens
TEHRDRVML

SEQ ID NO: 576137 - protein, 9 aa, Homo Sapiens
TKLDAQRDK

SEQ ID NO: 576138 - protein, 9 aa, Homo Sapiens
RAHPGYGAG

SEQ ID NO: 576139 - protein, 9 aa, Homo Sapiens
LAGLGTQQT

SEQ ID NO: 576140 - protein, 9 aa, Homo Sapiens
QTIEGTWAG

SEQ ID NO: 576141 - protein, 9 aa, Homo Sapiens
STAVPKMIV

SEQ ID NO: 576142 - protein, 9 aa, Homo Sapiens
KECRRRGHN

SEQ ID NO: 576143 - protein, 9 aa, Homo Sapiens
IGGLFPGIP

SEQ ID NO: 576144 - protein, 9 aa, Homo Sapiens
VHNNCGIEV

SEQ ID NO: 576145 - protein, 9 aa, Homo Sapiens
ISNYPKIRV

SEQ ID NO: 576146 - protein, 9 aa, Homo Sapiens
SQTNFTLEQ

SEQ ID NO: 576147 - protein, 9 aa, Homo Sapiens
CYSFGIGPK

SEQ ID NO: 576148 - protein, 9 aa, Homo Sapiens
NNCGIEVYY

SEQ ID NO: 576149 - protein, 9 aa, Homo Sapiens
YSPAAKEVS

SEQ ID NO: 576150 - protein, 9 aa, Homo Sapiens
EVHIDSYAE

SEQ ID NO: 576151 - protein, 9 aa, Homo Sapiens
TTRHHDASR

SEQ ID NO: 576152 - protein, 9 aa, Homo Sapiens
SLLGSYQKK

SEQ ID NO: 576153 - protein, 9 aa, Homo Sapiens
VFNVFGDGL

SEQ ID NO: 576154 - protein, 9 aa, Homo Sapiens
GRWRKGRDL

SEQ ID NO: 576155 - protein, 9 aa, Homo Sapiens
GTKEKHKKE

SEQ ID NO: 576156 - protein, 9 aa, Homo Sapiens
HEVTDFNDN

SEQ ID NO: 576157 - protein, 9 aa, Homo Sapiens
NYNLTEQHS

SEQ ID NO: 576158 - protein, 9 aa, Homo Sapiens
DHHVISCAK

SEQ ID NO: 576159 - protein, 9 aa, Homo Sapiens
FEEVYVSSN

SEQ ID NO: 576160 - protein, 9 aa, Homo Sapiens
PLPFHLTAE

SEQ ID NO: 576161 - protein, 9 aa, Homo Sapiens
AGAANTISP

SEQ ID NO: 576162 - protein, 9 aa, Homo Sapiens
RPFLSQLKT

SEQ ID NO: 576163 - protein, 9 aa, Homo Sapiens
KNVGRYRET

SEQ ID NO: 576164 - protein, 9 aa, Homo Sapiens
REITPLKML

SEQ ID NO: 576165 - protein, 9 aa, Homo Sapiens
FNIVEEVAK

SEQ ID NO: 576166 - protein, 9 aa, Homo Sapiens
LKECRRRGH

SEQ ID NO: 576167 - protein, 9 aa, Homo Sapiens
ANTISPSQN

SEQ ID NO: 576168 - protein, 9 aa, Homo Sapiens
KHSGRKRQW

SEQ ID NO: 576169 - protein, 9 aa, Homo Sapiens
SYLMDSKYI

SEQ ID NO: 576170 - protein, 9 aa, Homo Sapiens
SHRNLVDRI

SEQ ID NO: 576171 - protein, 9 aa, Homo Sapiens
YSFGIGPKV

SEQ ID NO: 576172 - protein, 9 aa, Homo Sapiens
IDGTYFKIR

SEQ ID NO: 576173 - protein, 9 aa, Homo Sapiens
GGQTIEGTW

SEQ ID NO: 576174 - protein, 9 aa, Homo Sapiens
LVADYCENN

SEQ ID NO: 576175 - protein, 9 aa, Homo Sapiens
QMRMKLESL

SEQ ID NO: 576176 - protein, 9 aa, Homo Sapiens
ELPGSQDSR

SEQ ID NO: 576177 - protein, 9 aa, Homo Sapiens
IVFDVVAYE

SEQ ID NO: 576178 - protein, 9 aa, Homo Sapiens
KHQERLGTC

SEQ ID NO: 576179 - protein, 9 aa, Homo Sapiens
KLDAQRDKD

SEQ ID NO: 576180 - protein, 9 aa, Homo Sapiens
LEKLNAQVD

SEQ ID NO: 576181 - protein, 9 aa, Homo Sapiens
LRCDVSGIK

SEQ ID NO: 576182 - protein, 9 aa, Homo Sapiens
TCHEPNKWQ

SEQ ID NO: 576183 - protein, 9 aa, Homo Sapiens
RTWRPFLSQ

SEQ ID NO: 576184 - protein, 9 aa, Homo Sapiens
RRIVGNKNF

SEQ ID NO: 576185 - protein, 9 aa, Homo Sapiens
QRDKDRLTL

SEQ ID NO: 576186 - protein, 9 aa, Homo Sapiens
ELTKLDAQR

SEQ ID NO: 576187 - protein, 9 aa, Homo Sapiens
QTREPPAGP

SEQ ID NO: 576188 - protein, 9 aa, Homo Sapiens
NVTMAAKEV

SEQ ID NO: 576189 - protein, 9 aa, Homo Sapiens
VGGKPFKLF

SEQ ID NO: 576190 - protein, 9 aa, Homo Sapiens
VSRIITENG

SEQ ID NO: 576191 - protein, 9 aa, Homo Sapiens
LKQRLDKDG

SEQ ID NO: 576192 - protein, 9 aa, Homo Sapiens
SCQPYKSAF

SEQ ID NO: 576193 - protein, 9 aa, Homo Sapiens
QAHRQLHQE

SEQ ID NO: 576194 - protein, 9 aa, Homo Sapiens
PGHNRSFIA

SEQ ID NO: 576195 - protein, 9 aa, Homo Sapiens
KMTLKQVST

SEQ ID NO: 576196 - protein, 9 aa, Homo Sapiens
FTSTAVPKM

SEQ ID NO: 576197 - protein, 9 aa, Homo Sapiens
LDHHVISCA

SEQ ID NO: 576198 - protein, 9 aa, Homo Sapiens
LPLMNQVIS

SEQ ID NO: 576199 - protein, 9 aa, Homo Sapiens
EVHVCACPG

SEQ ID NO: 576200 - protein, 9 aa, Homo Sapiens
VQYFNIVEE

SEQ ID NO: 576201 - protein, 9 aa, Homo Sapiens
SRSTTRHHD

SEQ ID NO: 576202 - protein, 9 aa, Homo Sapiens
DWKIQQKVL

SEQ ID NO: 576203 - protein, 9 aa, Homo Sapiens
NQSMIAFTT

SEQ ID NO: 576204 - protein, 9 aa, Homo Sapiens
KEPVQYFNI

SEQ ID NO: 576205 - protein, 9 aa, Homo Sapiens
HNNCGIEVY

SEQ ID NO: 576206 - protein, 9 aa, Homo Sapiens
VGRWRKGRD

SEQ ID NO: 576207 - protein, 9 aa, Homo Sapiens
QTNFTLEQL

SEQ ID NO: 576208 - protein, 9 aa, Homo Sapiens
FRRLVREIA

SEQ ID NO: 576209 - protein, 9 aa, Homo Sapiens
TLSDWKIQQ

SEQ ID NO: 576210 - protein, 9 aa, Homo Sapiens
RTYYPDFKG

SEQ ID NO: 576211 - protein, 9 aa, Homo Sapiens
AWKQHCRSE

SEQ ID NO: 576212 - protein, 9 aa, Homo Sapiens
KRRIVGNKN

SEQ ID NO: 576213 - protein, 9 aa, Homo Sapiens
DSYTNLELV

SEQ ID NO: 576214 - protein, 9 aa, Homo Sapiens
LGRNSFEVH

SEQ ID NO: 576215 - protein, 9 aa, Homo Sapiens
TMAAKEVFL

SEQ ID NO: 576216 - protein, 9 aa, Homo Sapiens
MRMKLESLH

SEQ ID NO: 576217 - protein, 9 aa, Homo Sapiens
SWWHCNNCS

SEQ ID NO: 576218 - protein, 9 aa, Homo Sapiens
RWRKGRDLT

SEQ ID NO: 576219 - protein, 9 aa, Homo Sapiens
VELYTGEIS

SEQ ID NO: 576220 - protein, 9 aa, Homo Sapiens
RVELYTGEI

SEQ ID NO: 576221 - protein, 9 aa, Homo Sapiens
DRTWRPFLS

SEQ ID NO: 576222 - protein, 9 aa, Homo Sapiens
LPFRRLVRE

SEQ ID NO: 576223 - protein, 9 aa, Homo Sapiens
EVDVPAGET

SEQ ID NO: 576224 - protein, 9 aa, Homo Sapiens
VGRYRETAR

SEQ ID NO: 576225 - protein, 9 aa, Homo Sapiens
QHCRSEEGK

SEQ ID NO: 576226 - protein, 9 aa, Homo Sapiens
SSFSLWCSP

SEQ ID NO: 576227 - protein, 9 aa, Homo Sapiens
QRRSQTNFT

SEQ ID NO: 576228 - protein, 9 aa, Homo Sapiens
SDSDSNVVE

SEQ ID NO: 576229 - protein, 9 aa, Homo Sapiens
QLAMNSINY

SEQ ID NO: 576230 - protein, 9 aa, Homo Sapiens
ETRIAVYLM

SEQ ID NO: 576231 - protein, 9 aa, Homo Sapiens
YRETARSEI

SEQ ID NO: 576232 - protein, 9 aa, Homo Sapiens
ALMNNNFIT

SEQ ID NO: 576233 - protein, 9 aa, Homo Sapiens
DVGELFILI

SEQ ID NO: 576234 - protein, 9 aa, Homo Sapiens
FGNSCTLVV

SEQ ID NO: 576235 - protein, 9 aa, Homo Sapiens
LAMNSINYS

SEQ ID NO: 576236 - protein, 9 aa, Homo Sapiens
FSLLLCQEY

SEQ ID NO: 576237 - protein, 9 aa, Homo Sapiens
SMIAFTTDL

SEQ ID NO: 576238 - protein, 9 aa, Homo Sapiens
AKEVSRIIT

SEQ ID NO: 576239 - protein, 9 aa, Homo Sapiens
IWDVLCRDG

SEQ ID NO: 576240 - protein, 9 aa, Homo Sapiens
APVIGSKNW

SEQ ID NO: 576241 - protein, 9 aa, Homo Sapiens
FHEVTDFND

SEQ ID NO: 576242 - protein, 9 aa, Homo Sapiens
LNGFGNSCT

SEQ ID NO: 576243 - protein, 9 aa, Homo Sapiens
SDWKIQQKV

SEQ ID NO: 576244 - protein, 9 aa, Homo Sapiens
LCRDGEEFL

SEQ ID NO: 576245 - protein, 9 aa, Homo Sapiens
IKMYQPKKR

SEQ ID NO: 576246 - protein, 9 aa, Homo Sapiens
HLFHEVTDF

SEQ ID NO: 576247 - protein, 9 aa, Homo Sapiens
GCIVFDVVA

SEQ ID NO: 576248 - protein, 9 aa, Homo Sapiens
EHNLLKQRL

SEQ ID NO: 576249 - protein, 9 aa, Homo Sapiens
WDVLCRDGE

SEQ ID NO: 576250 - protein, 9 aa, Homo Sapiens
VDKIMMDLD

SEQ ID NO: 576251 - protein, 9 aa, Homo Sapiens
IVGGKPFKL

SEQ ID NO: 576252 - protein, 9 aa, Homo Sapiens
SSNLEQFAE

SEQ ID NO: 576253 - protein, 9 aa, Homo Sapiens
KQHCRSEEG

SEQ ID NO: 576254 - protein, 9 aa, Homo Sapiens
QFVLTYLEK

SEQ ID NO: 576255 - protein, 9 aa, Homo Sapiens
PAPVIGSKN

SEQ ID NO: 576256 - protein, 9 aa, Homo Sapiens
GSKNWLRLH

SEQ ID NO: 576257 - protein, 9 aa, Homo Sapiens
EQFAENTVQ

SEQ ID NO: 576258 - protein, 9 aa, Homo Sapiens
MNNNFITAI

SEQ ID NO: 576259 - protein, 9 aa, Homo Sapiens
KEKHKKEEE

SEQ ID NO: 576260 - protein, 9 aa, Homo Sapiens
WRPFLSQLK

SEQ ID NO: 576261 - protein, 9 aa, Homo Sapiens
CLKAWKQHC

SEQ ID NO: 576262 - protein, 9 aa, Homo Sapiens
GIPYRVEVA

SEQ ID NO: 576263 - protein, 9 aa, Homo Sapiens
KQYKDKLQA

SEQ ID NO: 576264 - protein, 9 aa, Homo Sapiens
RGMRFCIDV

SEQ ID NO: 576265 - protein, 9 aa, Homo Sapiens
RMQAHRQLH

SEQ ID NO: 576266 - protein, 9 aa, Homo Sapiens
HVISCAKTK

SEQ ID NO: 576267 - protein, 9 aa, Homo Sapiens
TIVNLDHHV

SEQ ID NO: 576268 - protein, 9 aa, Homo Sapiens
RRSQTNFTL

SEQ ID NO: 576269 - protein, 9 aa, Homo Sapiens
FGIGPKVCH

SEQ ID NO: 576270 - protein, 9 aa, Homo Sapiens
RWMFETQPF

SEQ ID NO: 576271 - protein, 9 aa, Homo Sapiens
DVPAGETSV

SEQ ID NO: 576272 - protein, 9 aa, Homo Sapiens
RYRETARSE

SEQ ID NO: 576273 - protein, 9 aa, Homo Sapiens
EHRDRVMLV

SEQ ID NO: 576274 - protein, 9 aa, Homo Sapiens
WTSRAHPGY

SEQ ID NO: 576275 - protein, 9 aa, Homo Sapiens
PLMNQVISW

SEQ ID NO: 576276 - protein, 9 aa, Homo Sapiens
RFCIDVFEE

SEQ ID NO: 576277 - protein, 9 aa, Homo Sapiens
WQCQEGWHG

SEQ ID NO: 576278 - protein, 9 aa, Homo Sapiens
AEAEKAKQK

SEQ ID NO: 576279 - protein, 9 aa, Homo Sapiens
ECRRRGHNL

SEQ ID NO: 576280 - protein, 9 aa, Homo Sapiens
IYLLPDSKK

SEQ ID NO: 576281 - protein, 9 aa, Homo Sapiens
DPSPEEPTC

SEQ ID NO: 576282 - protein, 9 aa, Homo Sapiens
QQTREPPAG

SEQ ID NO: 576283 - protein, 9 aa, Homo Sapiens
AATTPPLPF

SEQ ID NO: 576284 - protein, 9 aa, Homo Sapiens
KVCHRLVKG

SEQ ID NO: 576285 - protein, 9 aa, Homo Sapiens
SPAAKEVSR

SEQ ID NO: 576286 - protein, 9 aa, Homo Sapiens
ARGVFNVFG

SEQ ID NO: 576287 - protein, 9 aa, Homo Sapiens
IKQRRSQTN

SEQ ID NO: 576288 - protein, 9 aa, Homo Sapiens
ETGTFISAS

SEQ ID NO: 576289 - protein, 9 aa, Homo Sapiens
LPDLFEEED

SEQ ID NO: 576290 - protein, 9 aa, Homo Sapiens
DIGFTSTAV

SEQ ID NO: 576291 - protein, 9 aa, Homo Sapiens
CRIWDVLCR

SEQ ID NO: 576292 - protein, 9 aa, Homo Sapiens
GHNLYVVTE

SEQ ID NO: 576293 - protein, 9 aa, Homo Sapiens
LNYSIVGGK

SEQ ID NO: 576294 - protein, 9 aa, Homo Sapiens
LRAVKRRIV

SEQ ID NO: 576295 - protein, 9 aa, Homo Sapiens
GGLFPGIPY

SEQ ID NO: 576296 - protein, 9 aa, Homo Sapiens
ISVLKASHR

SEQ ID NO: 576297 - protein, 9 aa, Homo Sapiens
NSCTLVVSG

SEQ ID NO: 576298 - protein, 9 aa, Homo Sapiens
SLPAPVIGS

SEQ ID NO: 576299 - protein, 9 aa, Homo Sapiens
ENSDSDSNV

SEQ ID NO: 576300 - protein, 9 aa, Homo Sapiens
NLLKQRLDK

SEQ ID NO: 576301 - protein, 9 aa, Homo Sapiens
VIQRGMRFC

SEQ ID NO: 576302 - protein, 9 aa, Homo Sapiens
DREITPLKM

SEQ ID NO: 576303 - protein, 9 aa, Homo Sapiens
FLSQLKTPI

SEQ ID NO: 576304 - protein, 9 aa, Homo Sapiens
PMFISENFG

SEQ ID NO: 576305 - protein, 9 aa, Homo Sapiens
YQKKTSNDG

SEQ ID NO: 576306 - protein, 9 aa, Homo Sapiens
EQAIRMQAH

SEQ ID NO: 576307 - protein, 9 aa, Homo Sapiens
AMNSINYST

SEQ ID NO: 576308 - protein, 9 aa, Homo Sapiens
LLLCQEYWN

SEQ ID NO: 576309 - protein, 9 aa, Homo Sapiens
PVIGSKNWL

SEQ ID NO: 576310 - protein, 9 aa, Homo Sapiens
EDQMRMKLE

SEQ ID NO: 576311 - protein, 9 aa, Homo Sapiens
VPVDFEEVY

SEQ ID NO: 576312 - protein, 9 aa, Homo Sapiens
KQLAMNSIN

SEQ ID NO: 576313 - protein, 9 aa, Homo Sapiens
IEGTWAGDK

SEQ ID NO: 576314 - protein, 9 aa, Homo Sapiens
LFEEEDPWR

SEQ ID NO: 576315 - protein, 9 aa, Homo Sapiens
GTYFKIRAI

SEQ ID NO: 576316 - protein, 9 aa, Homo Sapiens
LVNVLPDLF

SEQ ID NO: 576317 - protein, 9 aa, Homo Sapiens
MQAHRQLHQ

SEQ ID NO: 576318 - protein, 9 aa, Homo Sapiens
LTKLDAQRD

SEQ ID NO: 576319 - protein, 9 aa, Homo Sapiens
QLKQYKDKL

SEQ ID NO: 576320 - protein, 9 aa, Homo Sapiens
QFAENTVQE

SEQ ID NO: 576321 - protein, 9 aa, Homo Sapiens
TYYPDFKGP

SEQ ID NO: 576322 - protein, 9 aa, Homo Sapiens
SNYPKIRVT

SEQ ID NO: 576323 - protein, 9 aa, Homo Sapiens
KDNKKHQER

SEQ ID NO: 576324 - protein, 9 aa, Homo Sapiens
GHNRSFIAE

SEQ ID NO: 576325 - protein, 9 aa, Homo Sapiens
STTRHHDAS

SEQ ID NO: 576326 - protein, 9 aa, Homo Sapiens
CIDVFEETR

SEQ ID NO: 576327 - protein, 9 aa, Homo Sapiens
DGCIVFDVV

SEQ ID NO: 576328 - protein, 9 aa, Homo Sapiens
PPLPFHLTA

SEQ ID NO: 576329 - protein, 9 aa, Homo Sapiens
NFITAIEMS

SEQ ID NO: 576330 - protein, 9 aa, Homo Sapiens
GKDNKKHQE

SEQ ID NO: 576331 - protein, 9 aa, Homo Sapiens
ASSNLEQFA

SEQ ID NO: 576332 - protein, 9 aa, Homo Sapiens
KLQRVRRLI

SEQ ID NO: 576333 - protein, 9 aa, Homo Sapiens
MFISENFGS

SEQ ID NO: 576334 - protein, 9 aa, Homo Sapiens
GTCHEPNKW

SEQ ID NO: 576335 - protein, 9 aa, Homo Sapiens
LTYLEKLNA

SEQ ID NO: 576336 - protein, 9 aa, Homo Sapiens
AQRDKDRLT

SEQ ID NO: 576337 - protein, 9 aa, Homo Sapiens
NGISNYPKI

SEQ ID NO: 576338 - protein, 9 aa, Homo Sapiens
TACLKAWKQ

SEQ ID NO: 576339 - protein, 9 aa, Homo Sapiens
RCLQKLSMN

SEQ ID NO: 576340 - protein, 9 aa, Homo Sapiens
AANTISPSQ

SEQ ID NO: 576341 - protein, 9 aa, Homo Sapiens
SYKGQQFGP

SEQ ID NO: 576342 - protein, 9 aa, Homo Sapiens
IEALMNNNF

SEQ ID NO: 576343 - protein, 9 aa, Homo Sapiens
DFGDPRTYY

SEQ ID NO: 576344 - protein, 9 aa, Homo Sapiens
LACRIWDVL

SEQ ID NO: 576345 - protein, 9 aa, Homo Sapiens
AAKEVFLVM

SEQ ID NO: 576346 - protein, 9 aa, Homo Sapiens
SDSNVVEKP

SEQ ID NO: 576347 - protein, 9 aa, Homo Sapiens
HIDSYAEER

SEQ ID NO: 576348 - protein, 9 aa, Homo Sapiens
TTLLNYNLT

SEQ ID NO: 576349 - protein, 9 aa, Homo Sapiens
LNYNLTEQH

SEQ ID NO: 576350 - protein, 9 aa, Homo Sapiens
FPMFISENF

SEQ ID NO: 576351 - protein, 9 aa, Homo Sapiens
PFLSQLKTP

SEQ ID NO: 576352 - protein, 9 aa, Homo Sapiens
RDRVMLVRG

SEQ ID NO: 576353 - protein, 9 aa, Homo Sapiens
KMLEKWAQL

SEQ ID NO: 576354 - protein, 9 aa, Homo Sapiens
LMAPVGRWR

SEQ ID NO: 576355 - protein, 9 aa, Homo Sapiens
PTCCAESFR

SEQ ID NO: 576356 - protein, 9 aa, Homo Sapiens
SLLLCQEYW

SEQ ID NO: 576357 - protein, 9 aa, Homo Sapiens
SENFGSSRL

SEQ ID NO: 576358 - protein, 9 aa, Homo Sapiens
IDSYAEERE

SEQ ID NO: 576359 - protein, 9 aa, Homo Sapiens
RSTTRHHDA

SEQ ID NO: 576360 - protein, 9 aa, Homo Sapiens
PYKSAFYVL

SEQ ID NO: 576361 - protein, 9 aa, Homo Sapiens
EKLQRVRRL

SEQ ID NO: 576362 - protein, 9 aa, Homo Sapiens
WWHCNNCSL

SEQ ID NO: 576363 - protein, 9 aa, Homo Sapiens
FEVHVCACP

SEQ ID NO: 576364 - protein, 9 aa, Homo Sapiens
EEKLQRVRR

SEQ ID NO: 576365 - protein, 9 aa, Homo Sapiens
ELFILIRRS

SEQ ID NO: 576366 - protein, 9 aa, Homo Sapiens
LGWGSSFSL

SEQ ID NO: 576367 - protein, 9 aa, Homo Sapiens
SKKKFQTKV

SEQ ID NO: 576368 - protein, 9 aa, Homo Sapiens
FVLTYLEKL

SEQ ID NO: 576369 - protein, 9 aa, Homo Sapiens
LLGSYQKKT

SEQ ID NO: 576370 - protein, 9 aa, Homo Sapiens
RASSNLEQF

SEQ ID NO: 576371 - protein, 9 aa, Homo Sapiens
LLCQEYWNI

SEQ ID NO: 576372 - protein, 9 aa, Homo Sapiens
FDVVAYEDN

SEQ ID NO: 576373 - protein, 9 aa, Homo Sapiens
FEEEDPWRS

SEQ ID NO: 576374 - protein, 9 aa, Homo Sapiens
KIKQRRSQT

SEQ ID NO: 576375 - protein, 9 aa, Homo Sapiens
FITAIEMSS

SEQ ID NO: 576376 - protein, 9 aa, Homo Sapiens
FKIRAIYDK

SEQ ID NO: 576377 - protein, 9 aa, Homo Sapiens
EEERRPQPV

SEQ ID NO: 576378 - protein, 9 aa, Homo Sapiens
VGELFILIR

SEQ ID NO: 576379 - protein, 9 aa, Homo Sapiens
MIAFTTDLQ

SEQ ID NO: 576380 - protein, 9 aa, Homo Sapiens
GRNSFEVHV

SEQ ID NO: 576381 - protein, 9 aa, Homo Sapiens
LLETRIAVY

SEQ ID NO: 576382 - protein, 9 aa, Homo Sapiens
SFGIGPKVC

SEQ ID NO: 576383 - protein, 9 aa, Homo Sapiens
CTLVVSGPL

SEQ ID NO: 576384 - protein, 9 aa, Homo Sapiens
NGFGNSCTL

SEQ ID NO: 576385 - protein, 9 aa, Homo Sapiens
TNLELVADY

SEQ ID NO: 576386 - protein, 9 aa, Homo Sapiens
RNYSRQLLQ

SEQ ID NO: 576387 - protein, 9 aa, Homo Sapiens
IITKMTLKQ

SEQ ID NO: 576388 - protein, 9 aa, Homo Sapiens
SPNGISNYP

SEQ ID NO: 576389 - protein, 9 aa, Homo Sapiens
WAGGQTIEG

SEQ ID NO: 576390 - protein, 9 aa, Homo Sapiens
WRKGRDLTW

SEQ ID NO: 576391 - protein, 9 aa, Homo Sapiens
PSERQEVDV

SEQ ID NO: 576392 - protein, 9 aa, Homo Sapiens
NYSTLLESE

SEQ ID NO: 576393 - protein, 9 aa, Homo Sapiens
ISPSQNKTA

SEQ ID NO: 576394 - protein, 9 aa, Homo Sapiens
GKHSGRKRQ

SEQ ID NO: 576395 - protein, 9 aa, Homo Sapiens
CDVSGIKGG

SEQ ID NO: 576396 - protein, 9 aa, Homo Sapiens
VLCRDGEEF

SEQ ID NO: 576397 - protein, 9 aa, Homo Sapiens
PAAARGVFN

SEQ ID NO: 576398 - protein, 9 aa, Homo Sapiens
GRYRETARS

SEQ ID NO: 576399 - protein, 9 aa, Homo Sapiens
ALRAVKRRI

SEQ ID NO: 576400 - protein, 9 aa, Homo Sapiens
IAFTTDLQA

SEQ ID NO: 576401 - protein, 9 aa, Homo Sapiens
MRFCIDVFE

SEQ ID NO: 576402 - protein, 9 aa, Homo Sapiens
SASVDEIQM

SEQ ID NO: 576403 - protein, 9 aa, Homo Sapiens
LDRTWRPFL

SEQ ID NO: 576404 - protein, 9 aa, Homo Sapiens
EPVQYFNIV

SEQ ID NO: 576405 - protein, 9 aa, Homo Sapiens
RETGTFISA

SEQ ID NO: 576406 - protein, 9 aa, Homo Sapiens
SYTNLELVA

SEQ ID NO: 576407 - protein, 9 aa, Homo Sapiens
QDSRVNLQG

SEQ ID NO: 576408 - protein, 9 aa, Homo Sapiens
RLNGFGNSC

SEQ ID NO: 576409 - protein, 9 aa, Homo Sapiens
SYAEEREDH

SEQ ID NO: 576410 - protein, 9 aa, Homo Sapiens
YSCIYCSKQ

SEQ ID NO: 576411 - protein, 9 aa, Homo Sapiens
ELRNYSRQL

SEQ ID NO: 576412 - protein, 9 aa, Homo Sapiens
PFDTINKDI

SEQ ID NO: 576413 - protein, 9 aa, Homo Sapiens
HNLYVVTEA

SEQ ID NO: 576414 - protein, 9 aa, Homo Sapiens
TAVPKMIVD

SEQ ID NO: 576415 - protein, 9 aa, Homo Sapiens
GKTTLLNYN

SEQ ID NO: 576416 - protein, 9 aa, Homo Sapiens
MDSKYIDPK

SEQ ID NO: 576417 - protein, 9 aa, Homo Sapiens
SSSDSEEER

SEQ ID NO: 576418 - protein, 9 aa, Homo Sapiens
VYYQTDMQS

SEQ ID NO: 576419 - protein, 9 aa, Homo Sapiens
AVDKIMMDL

SEQ ID NO: 576420 - protein, 9 aa, Homo Sapiens
QSMIAFTTD

SEQ ID NO: 576421 - protein, 9 aa, Homo Sapiens
KEKHPEPGS

SEQ ID NO: 576422 - protein, 9 aa, Homo Sapiens
NSFEVHVCA

SEQ ID NO: 576423 - protein, 9 aa, Homo Sapiens
SRIITENGD

SEQ ID NO: 576424 - protein, 9 aa, Homo Sapiens
DSNVVEKPY

SEQ ID NO: 576425 - protein, 9 aa, Homo Sapiens
RLSYKGQQF

SEQ ID NO: 576426 - protein, 9 aa, Homo Sapiens
IPYRVEVAA

SEQ ID NO: 576427 - protein, 9 aa, Homo Sapiens
ETINVTMAA

SEQ ID NO: 576428 - protein, 9 aa, Homo Sapiens
LSDWKIQQK

SEQ ID NO: 576429 - protein, 9 aa, Homo Sapiens
FPGIPYRVE

SEQ ID NO: 576430 - protein, 9 aa, Homo Sapiens
KKQLKQYKD

SEQ ID NO: 576431 - protein, 9 aa, Homo Sapiens
DVVAYEDNS

SEQ ID NO: 576432 - protein, 9 aa, Homo Sapiens
AVPKMIVDI

SEQ ID NO: 576433 - protein, 9 aa, Homo Sapiens
GELFILIRR

SEQ ID NO: 576434 - protein, 9 aa, Homo Sapiens
FCIDVFEET

SEQ ID NO: 576435 - protein, 9 aa, Homo Sapiens
ETQPFDTIN

SEQ ID NO: 576436 - protein, 9 aa, Homo Sapiens
RSQTNFTLE

SEQ ID NO: 576437 - protein, 9 aa, Homo Sapiens
LPFHLTAEE

SEQ ID NO: 576438 - protein, 9 aa, Homo Sapiens
KDALRAVKR

SEQ ID NO: 576439 - protein, 9 aa, Homo Sapiens
QSSSSDSEE

SEQ ID NO: 576440 - protein, 9 aa, Homo Sapiens
VVEKPYGRK

SEQ ID NO: 576441 - protein, 9 aa, Homo Sapiens
LFPGIPYRV

SEQ ID NO: 576442 - protein, 9 aa, Homo Sapiens
AFTTDLQAT

SEQ ID NO: 576443 - protein, 9 aa, Homo Sapiens
SCTLVVSGP

SEQ ID NO: 576444 - protein, 9 aa, Homo Sapiens
IEVYYQTDM

SEQ ID NO: 576445 - protein, 9 aa, Homo Sapiens
GQTDRQGQN

SEQ ID NO: 576446 - protein, 9 aa, Homo Sapiens
TLKQVSTWF

SEQ ID NO: 576447 - protein, 9 aa, Homo Sapiens
LDAQRDKDR

SEQ ID NO: 576448 - protein, 9 aa, Homo Sapiens
GLFPGIPYR

SEQ ID NO: 576449 - protein, 9 aa, Homo Sapiens
LETRIAVYL

SEQ ID NO: 576450 - protein, 9 aa, Homo Sapiens
EALMNNNFI

SEQ ID NO: 576451 - protein, 9 aa, Homo Sapiens
DSEEERRPQ

SEQ ID NO: 576452 - protein, 9 aa, Homo Sapiens
YPDFKGPVA

SEQ ID NO: 576453 - protein, 9 aa, Homo Sapiens
PFRVELYTG

SEQ ID NO: 576454 - protein, 9 aa, Homo Sapiens
PVGRWRKGR

SEQ ID NO: 576455 - protein, 9 aa, Homo Sapiens
RKLPFRRLV

SEQ ID NO: 576456 - protein, 9 aa, Homo Sapiens
MDLDQCRDG

SEQ ID NO: 576457 - protein, 9 aa, Homo Sapiens
WMFETQPFD

SEQ ID NO: 576458 - protein, 9 aa, Homo Sapiens
EKTDGTKEK

SEQ ID NO: 576459 - protein, 9 aa, Homo Sapiens
CQPYKSAFY

SEQ ID NO: 576460 - protein, 9 aa, Homo Sapiens
EGSWWHCNN

SEQ ID NO: 576461 - protein, 9 aa, Homo Sapiens
MFETQPFDT

SEQ ID NO: 576462 - protein, 9 aa, Homo Sapiens
ITKMTLKQV

SEQ ID NO: 576463 - protein, 9 aa, Homo Sapiens
FSLWCSPAP

SEQ ID NO: 576464 - protein, 9 aa, Homo Sapiens
MKLESLHQE

SEQ ID NO: 576465 - protein, 9 aa, Homo Sapiens
EDEWTSRAH

SEQ ID NO: 576466 - protein, 9 aa, Homo Sapiens
SPEEPTCCA

SEQ ID NO: 576467 - protein, 9 aa, Homo Sapiens
MSSYLMDSK

SEQ ID NO: 576468 - protein, 9 aa, Homo Sapiens
TARSEIQVL

SEQ ID NO: 576469 - protein, 9 aa, Homo Sapiens
PDIGFTSTA

SEQ ID NO: 576470 - protein, 9 aa, Homo Sapiens
TSRAHPGYG

SEQ ID NO: 576471 - protein, 9 aa, Homo Sapiens
GIEVYYQTD

SEQ ID NO: 576472 - protein, 9 aa, Homo Sapiens
RQNTLRCDV

SEQ ID NO: 576473 - protein, 9 aa, Homo Sapiens
CQEYWNITD

SEQ ID NO: 576474 - protein, 9 aa, Homo Sapiens
NKSPNGISN

SEQ ID NO: 576475 - protein, 9 aa, Homo Sapiens
GAANTISPS

SEQ ID NO: 576476 - protein, 9 aa, Homo Sapiens
NVGRYRETA

SEQ ID NO: 576477 - protein, 9 aa, Homo Sapiens
LPGSQDSRV

SEQ ID NO: 576478 - protein, 9 aa, Homo Sapiens
HPEPGSSCV

SEQ ID NO: 576479 - protein, 9 aa, Homo Sapiens
AEDQMRMKL

SEQ ID NO: 576480 - protein, 9 aa, Homo Sapiens
GFTSTAVPK

SEQ ID NO: 576481 - protein, 9 aa, Homo Sapiens
LLKKQLKQY

SEQ ID NO: 576482 - protein, 9 aa, Homo Sapiens
DAQRDKDRL

SEQ ID NO: 576483 - protein, 9 aa, Homo Sapiens
SSDERGISP

SEQ ID NO: 576484 - protein, 9 aa, Homo Sapiens
NTLRCDVSG

SEQ ID NO: 576485 - protein, 9 aa, Homo Sapiens
KMYQPKKRA

SEQ ID NO: 576486 - protein, 9 aa, Homo Sapiens
SFEVHVCAC

SEQ ID NO: 576487 - protein, 9 aa, Homo Sapiens
ERGISPAHK

SEQ ID NO: 576488 - protein, 9 aa, Homo Sapiens
DSDSNVVEK

SEQ ID NO: 576489 - protein, 9 aa, Homo Sapiens
SRVNLQGKD

SEQ ID NO: 576490 - protein, 9 aa, Homo Sapiens
RISVLKASH

SEQ ID NO: 576491 - protein, 9 aa, Homo Sapiens
APVGRWRKG

SEQ ID NO: 576492 - protein, 9 aa, Homo Sapiens
RAVKRRIVG

SEQ ID NO: 576493 - protein, 9 aa, Homo Sapiens
INVTMAAKE

SEQ ID NO: 576494 - protein, 9 aa, Homo Sapiens
RRLVREIAQ

SEQ ID NO: 576495 - protein, 9 aa, Homo Sapiens
KTDGTKEKH

SEQ ID NO: 576496 - protein, 9 aa, Homo Sapiens
SQDSRVNLQ

SEQ ID NO: 576497 - protein, 9 aa, Homo Sapiens
KQVSTWFAN

SEQ ID NO: 576498 - protein, 9 aa, Homo Sapiens
MSLNKHLFL

SEQ ID NO: 576499 - protein, 9 aa, Homo Sapiens
YSIVGGKPF

SEQ ID NO: 576500 - protein, 9 aa, Homo Sapiens
RRSRSTTRH

SEQ ID NO: 576501 - protein, 9 aa, Homo Sapiens
DSKYIDPKF

SEQ ID NO: 576502 - protein, 9 aa, Homo Sapiens
ELVADYCEN

SEQ ID NO: 576503 - protein, 9 aa, Homo Sapiens
LGSYQKKTS

SEQ ID NO: 576504 - protein, 9 aa, Homo Sapiens
NVVEKPYGR

SEQ ID NO: 576505 - protein, 9 aa, Homo Sapiens
PNKWQCQEG

SEQ ID NO: 576506 - protein, 9 aa, Homo Sapiens
NLTEQHSKR

SEQ ID NO: 576507 - protein, 9 aa, Homo Sapiens
DGTYFKIRA

SEQ ID NO: 576508 - protein, 9 aa, Homo Sapiens
DPRTYYPDF

SEQ ID NO: 576509 - protein, 9 aa, Homo Sapiens
RIWDVLCRD

SEQ ID NO: 576510 - protein, 9 aa, Homo Sapiens
TDGTKEKHK

SEQ ID NO: 576511 - protein, 9 aa, Homo Sapiens
SSYLMDSKY

SEQ ID NO: 576512 - protein, 9 aa, Homo Sapiens
KQRRSQTNF

SEQ ID NO: 576513 - protein, 9 aa, Homo Sapiens
VVAYEDNSL

SEQ ID NO: 576514 - protein, 9 aa, Homo Sapiens
TPLKMLEKW

SEQ ID NO: 576515 - protein, 9 aa, Homo Sapiens
FHLTAEETP

SEQ ID NO: 576516 - protein, 9 aa, Homo Sapiens
PYRVEVAAS

SEQ ID NO: 576517 - protein, 9 aa, Homo Sapiens
FLEVLTEHR

SEQ ID NO: 576518 - protein, 9 aa, Homo Sapiens
PLKMLEKWA

SEQ ID NO: 576519 - protein, 9 aa, Homo Sapiens
AARGVFNVF

SEQ ID NO: 576520 - protein, 9 aa, Homo Sapiens
GNQSMIAFT

SEQ ID NO: 576521 - protein, 9 aa, Homo Sapiens
REELCQQHP

SEQ ID NO: 576522 - protein, 9 aa, Homo Sapiens
QVGPGHNRS

SEQ ID NO: 576523 - protein, 9 aa, Homo Sapiens
PVQYFNIVE

SEQ ID NO: 576524 - protein, 9 aa, Homo Sapiens
GIGPKVCHR

SEQ ID NO: 576525 - protein, 9 aa, Homo Sapiens
TQQTREPPA

SEQ ID NO: 576526 - protein, 9 aa, Homo Sapiens
LKASHRNLV

SEQ ID NO: 576527 - protein, 9 aa, Homo Sapiens
DRSVQRLLE

SEQ ID NO: 576528 - protein, 9 aa, Homo Sapiens
NSINYSTLL

SEQ ID NO: 576529 - protein, 9 aa, Homo Sapiens
LPDSKKKFQ

SEQ ID NO: 576530 - protein, 9 aa, Homo Sapiens
DSRVNLQGK

SEQ ID NO: 576531 - protein, 9 aa, Homo Sapiens
VDFEEVYVS

SEQ ID NO: 576532 - protein, 9 aa, Homo Sapiens
KKHQERLGT

SEQ ID NO: 576533 - protein, 9 aa, Homo Sapiens
RGHNLYVVT

SEQ ID NO: 576534 - protein, 9 aa, Homo Sapiens
DLFEEEDPW

SEQ ID NO: 576535 - protein, 9 aa, Homo Sapiens
NLDHHVISC

SEQ ID NO: 576536 - protein, 9 aa, Homo Sapiens
TIEGTWAGD

SEQ ID NO: 576537 - protein, 9 aa, Homo Sapiens
TRRSRSTTR

SEQ ID NO: 576538 - protein, 9 aa, Homo Sapiens
CSKQLFSSL

SEQ ID NO: 576539 - protein, 9 aa, Homo Sapiens
LLNYNLTEQ

SEQ ID NO: 576540 - protein, 9 aa, Homo Sapiens
GSQDSRVNL

SEQ ID NO: 576541 - protein, 9 aa, Homo Sapiens
RRGHNLYVV

SEQ ID NO: 576542 - protein, 9 aa, Homo Sapiens
KYTQVGPGH

SEQ ID NO: 576543 - protein, 9 aa, Homo Sapiens
HHVISCAKT

SEQ ID NO: 576544 - protein, 9 aa, Homo Sapiens
NYPKIRVTV

SEQ ID NO: 576545 - protein, 9 aa, Homo Sapiens
KPFKLFEID

SEQ ID NO: 576546 - protein, 9 aa, Homo Sapiens
IVEEVAKAF

SEQ ID NO: 576547 - protein, 9 aa, Homo Sapiens
PAAKEVSRI

SEQ ID NO: 576548 - protein, 9 aa, Homo Sapiens
SKYIDPKFP

SEQ ID NO: 576549 - protein, 9 aa, Homo Sapiens
FAENTVQEE

SEQ ID NO: 576550 - protein, 9 aa, Homo Sapiens
LQRVRRLIR

SEQ ID NO: 576551 - protein, 9 aa, Homo Sapiens
VFDVVAYED

SEQ ID NO: 576552 - protein, 9 aa, Homo Sapiens
IRMQAHRQL

SEQ ID NO: 576553 - protein, 9 aa, Homo Sapiens
DNKKHQERL

SEQ ID NO: 576554 - protein, 9 aa, Homo Sapiens
YAEEREDHE

SEQ ID NO: 576555 - protein, 9 aa, Homo Sapiens
QTDRQGQNS

SEQ ID NO: 576556 - protein, 9 aa, Homo Sapiens
LLKQRLDKD

SEQ ID NO: 576557 - protein, 9 aa, Homo Sapiens
DGTKEKHKK

SEQ ID NO: 576558 - protein, 9 aa, Homo Sapiens
KAGAANTIS

SEQ ID NO: 576559 - protein, 9 aa, Homo Sapiens
IYCSKQLFS

SEQ ID NO: 576560 - protein, 9 aa, Homo Sapiens
PTRRSRSTT

SEQ ID NO: 576561 - protein, 9 aa, Homo Sapiens
VLKASHRNL

SEQ ID NO: 576562 - protein, 9 aa, Homo Sapiens
KLESLHQEF

SEQ ID NO: 576563 - protein, 9 aa, Homo Sapiens
VEHNLLKQR

SEQ ID NO: 576564 - protein, 9 aa, Homo Sapiens
EEVYVSSNA

SEQ ID NO: 576565 - protein, 9 aa, Homo Sapiens
YTSHWRLSY

SEQ ID NO: 576566 - protein, 9 aa, Homo Sapiens
GPKVCHRLV

SEQ ID NO: 576567 - protein, 9 aa, Homo Sapiens
NKWQCQEGW

SEQ ID NO: 576568 - protein, 9 aa, Homo Sapiens
QYFNIVEEV

SEQ ID NO: 576569 - protein, 9 aa, Homo Sapiens
QRLLETRIA

SEQ ID NO: 576570 - protein, 9 aa, Homo Sapiens
IGFTSTAVP

SEQ ID NO: 576571 - protein, 9 aa, Homo Sapiens
VNVLPDLFE

SEQ ID NO: 576572 - protein, 9 aa, Homo Sapiens
EEVHIDSYA

SEQ ID NO: 576573 - protein, 9 aa, Homo Sapiens
EITPLKMLE

SEQ ID NO: 576574 - protein, 9 aa, Homo Sapiens
KSPNGISNY

SEQ ID NO: 576575 - protein, 9 aa, Homo Sapiens
IRKLPFRRL

SEQ ID NO: 576576 - protein, 9 aa, Homo Sapiens
GEPAAARGV

SEQ ID NO: 576577 - protein, 9 aa, Homo Sapiens
MFIKMYQPK

SEQ ID NO: 576578 - protein, 9 aa, Homo Sapiens
EKHPEPGSS

SEQ ID NO: 576579 - protein, 9 aa, Homo Sapiens
NFGSSRLSS

SEQ ID NO: 576580 - protein, 9 aa, Homo Sapiens
GPGHNRSFI

SEQ ID NO: 576581 - protein, 9 aa, Homo Sapiens
SGRKRQWQS

SEQ ID NO: 576582 - protein, 9 aa, Homo Sapiens
RGISPAHKT

SEQ ID NO: 576583 - protein, 9 aa, Homo Sapiens
GKPFKLFEI

SEQ ID NO: 576584 - protein, 9 aa, Homo Sapiens
TPPLPFHLT

SEQ ID NO: 576585 - protein, 9 aa, Homo Sapiens
HPTRRSRST

SEQ ID NO: 576586 - protein, 9 aa, Homo Sapiens
IMMDLDQCR

SEQ ID NO: 576587 - protein, 9 aa, Homo Sapiens
SKAGAANTI

SEQ ID NO: 576588 - protein, 9 aa, Homo Sapiens
YKYTQVGPG

SEQ ID NO: 576589 - protein, 9 aa, Homo Sapiens
TQVGPGHNR

SEQ ID NO: 576590 - protein, 9 aa, Homo Sapiens
EVLTEHRDR

SEQ ID NO: 576591 - protein, 9 aa, Homo Sapiens
NNFITAIEM

SEQ ID NO: 576592 - protein, 9 aa, Homo Sapiens
FILIRRSGD

SEQ ID NO: 576593 - protein, 9 aa, Homo Sapiens
KTTLLNYNL

SEQ ID NO: 576594 - protein, 9 aa, Homo Sapiens
PDSKKKFQT

SEQ ID NO: 576595 - protein, 9 aa, Homo Sapiens
PDLFEEEDP

SEQ ID NO: 576596 - protein, 9 aa, Homo Sapiens
AGLGTQQTR

SEQ ID NO: 576597 - protein, 9 aa, Homo Sapiens
RSCREELCQ

SEQ ID NO: 576598 - protein, 9 aa, Homo Sapiens
PLAVDKIMM

SEQ ID NO: 576599 - protein, 9 aa, Homo Sapiens
VRRLIRQYG

SEQ ID NO: 576600 - protein, 9 aa, Homo Sapiens
PGSSCVYCK

SEQ ID NO: 576601 - protein, 9 aa, Homo Sapiens
SARFPFRVE

SEQ ID NO: 576602 - protein, 9 aa, Homo Sapiens
ELYTGEIST

SEQ ID NO: 576603 - protein, 9 aa, Homo Sapiens
DSCQPYKSA

SEQ ID NO: 576604 - protein, 9 aa, Homo Sapiens
ASHRNLVDR

SEQ ID NO: 576605 - protein, 9 aa, Homo Sapiens
YKSAFYVLE

SEQ ID NO: 576606 - protein, 9 aa, Homo Sapiens
WKIQQKVLR

SEQ ID NO: 576607 - protein, 9 aa, Homo Sapiens
VDVPAGETS

SEQ ID NO: 576608 - protein, 9 aa, Homo Sapiens
ILIRRSGDV

SEQ ID NO: 576609 - protein, 9 aa, Homo Sapiens
GMRFCIDVF

SEQ ID NO: 576610 - protein, 9 aa, Homo Sapiens
TTPPLPFHL

SEQ ID NO: 576611 - protein, 9 aa, Homo Sapiens
MYQPKKRAE

SEQ ID NO: 576612 - protein, 9 aa, Homo Sapiens
LFILIRRSG

SEQ ID NO: 576613 - protein, 9 aa, Homo Sapiens
EVYVSSNAD

SEQ ID NO: 576614 - protein, 9 aa, Homo Sapiens
VIGSKNWLR

SEQ ID NO: 576615 - protein, 9 aa, Homo Sapiens
RQWQSTLGH

SEQ ID NO: 576616 - protein, 9 aa, Homo Sapiens
LHLFHEVTD

SEQ ID NO: 576617 - protein, 9 aa, Homo Sapiens
MNQVISWAT

SEQ ID NO: 576618 - protein, 9 aa, Homo Sapiens
VTMAAKEVF

SEQ ID NO: 576619 - protein, 9 aa, Homo Sapiens
LDVEHNLLK

SEQ ID NO: 576620 - protein, 9 aa, Homo Sapiens
NKKHQERLG

SEQ ID NO: 576621 - protein, 9 aa, Homo Sapiens
GDIRVIAEA

SEQ ID NO: 576622 - protein, 9 aa, Homo Sapiens
TEKTDGTKE

SEQ ID NO: 576623 - protein, 9 aa, Homo Sapiens
MAPVGRWRK

SEQ ID NO: 576624 - protein, 9 aa, Homo Sapiens
YLLPDSKKK

SEQ ID NO: 576625 - protein, 9 aa, Homo Sapiens
AIITKMTLK

SEQ ID NO: 576626 - protein, 9 aa, Homo Sapiens
HEPNKWQCQ

SEQ ID NO: 576627 - protein, 9 aa, Homo Sapiens
LCQQHPRHS

SEQ ID NO: 576628 - protein, 9 aa, Homo Sapiens
QNTLRCDVS

SEQ ID NO: 576629 - protein, 9 aa, Homo Sapiens
LSYKGQQFG

SEQ ID NO: 576630 - protein, 9 aa, Homo Sapiens
AGGDIRVIA

SEQ ID NO: 576631 - protein, 9 aa, Homo Sapiens
SYQKKTSND

SEQ ID NO: 576632 - protein, 9 aa, Homo Sapiens
SEDEWTSRA

SEQ ID NO: 576633 - protein, 9 aa, Homo Sapiens
MSLLGSYQK

SEQ ID NO: 576634 - protein, 9 aa, Homo Sapiens
NVLPDLFEE

SEQ ID NO: 576635 - protein, 9 aa, Homo Sapiens
DKIMMDLDQ

SEQ ID NO: 576636 - protein, 9 aa, Homo Sapiens
HSGRKRQWQ

SEQ ID NO: 576637 - protein, 9 aa, Homo Sapiens
AGGQTIEGT

SEQ ID NO: 576638 - protein, 9 aa, Homo Sapiens
TREPPAGPP

SEQ ID NO: 576639 - protein, 9 aa, Homo Sapiens
WGSSFSLWC

SEQ ID NO: 576640 - protein, 9 aa, Homo Sapiens
HRNLVDRIT

SEQ ID NO: 576641 - protein, 9 aa, Homo Sapiens
KEVSRIITE

SEQ ID NO: 576642 - protein, 9 aa, Homo Sapiens
LEVLTEHRD

SEQ ID NO: 576643 - protein, 9 aa, Homo Sapiens
EWTSRAHPG

SEQ ID NO: 576644 - protein, 9 aa, Homo Sapiens
MMDLDQCRD

SEQ ID NO: 576645 - protein, 9 aa, Homo Sapiens
FRVELYTGE

SEQ ID NO: 576646 - protein, 9 aa, Homo Sapiens
EPGSSCVYC

SEQ ID NO: 576647 - protein, 9 aa, Homo Sapiens
DFEEVYVSS

SEQ ID NO: 576648 - protein, 9 aa, Homo Sapiens
EKLNAQVDV

SEQ ID NO: 576649 - protein, 9 aa, Homo Sapiens
RQEVDVPAG

SEQ ID NO: 576650 - protein, 9 aa, Homo Sapiens
DVSGIKGGT

SEQ ID NO: 576651 - protein, 9 aa, Homo Sapiens
PNGISNYPK

SEQ ID NO: 576652 - protein, 9 aa, Homo Sapiens
MLEKWAQLA

SEQ ID NO: 576653 - protein, 9 aa, Homo Sapiens
QEQAIRMQA

SEQ ID NO: 576654 - protein, 9 aa, Homo Sapiens
SLWCSPAPC

SEQ ID NO: 576655 - protein, 9 aa, Homo Sapiens
VHVCACPGR

SEQ ID NO: 576656 - protein, 9 aa, Homo Sapiens
MAAKEVFLV

SEQ ID NO: 576657 - protein, 9 aa, Homo Sapiens
TYFKIRAIY

SEQ ID NO: 576658 - protein, 9 aa, Homo Sapiens
DIRVIAEAE

SEQ ID NO: 576659 - protein, 9 aa, Homo Sapiens
QEVDVPAGE

SEQ ID NO: 576660 - protein, 9 aa, Homo Sapiens
NLELVADYC

SEQ ID NO: 576661 - protein, 9 aa, Homo Sapiens
QAIRMQAHR

SEQ ID NO: 576662 - protein, 9 aa, Homo Sapiens
ISASVDEIQ

SEQ ID NO: 576663 - protein, 9 aa, Homo Sapiens
GNSCTLVVS

SEQ ID NO: 576664 - protein, 9 aa, Homo Sapiens
CMFIKMYQP

SEQ ID NO: 576665 - protein, 9 aa, Homo Sapiens
TSHWRLSYK

SEQ ID NO: 576666 - protein, 9 aa, Homo Sapiens
DVLCRDGEE

SEQ ID NO: 576667 - protein, 9 aa, Homo Sapiens
KLNAQVDVT

SEQ ID NO: 576668 - protein, 9 aa, Homo Sapiens
FDTINKDIT

SEQ ID NO: 576669 - protein, 9 aa, Homo Sapiens
PLHLFHEVT

SEQ ID NO: 576670 - protein, 9 aa, Homo Sapiens
TDSCQPYKS

SEQ ID NO: 576671 - protein, 9 aa, Homo Sapiens
PFHLTAEET

SEQ ID NO: 576672 - protein, 9 aa, Homo Sapiens
KAWKQHCRS

SEQ ID NO: 576673 - protein, 9 aa, Homo Sapiens
CGIEVYYQT

SEQ ID NO: 576674 - protein, 9 aa, Homo Sapiens
AAKEVSRII

SEQ ID NO: 576675 - protein, 9 aa, Homo Sapiens
LTEHRDRVM

SEQ ID NO: 576676 - protein, 9 aa, Homo Sapiens
FPFRVELYT

SEQ ID NO: 576677 - protein, 9 aa, Homo Sapiens
LPAPVIGSK

SEQ ID NO: 576678 - protein, 9 aa, Homo Sapiens
DSYAEERED

SEQ ID NO: 576679 - protein, 9 aa, Homo Sapiens
ETARSEIQV

SEQ ID NO: 576680 - protein, 9 aa, Homo Sapiens
TFISASVDE

SEQ ID NO: 576681 - protein, 9 aa, Homo Sapiens
IRVIAEAEK

SEQ ID NO: 576682 - protein, 9 aa, Homo Sapiens
IGSKNWLRL

SEQ ID NO: 576683 - protein, 9 aa, Homo Sapiens
RRLIRQYGD

SEQ ID NO: 576684 - protein, 9 aa, Homo Sapiens
GFGNSCTLV

SEQ ID NO: 576685 - protein, 9 aa, Homo Sapiens
LKQYKDKLQ

SEQ ID NO: 576686 - protein, 9 aa, Homo Sapiens
PRTYYPDFK

SEQ ID NO: 576687 - protein, 9 aa, Homo Sapiens
NTISPSQNK

SEQ ID NO: 576688 - protein, 9 aa, Homo Sapiens
KIRAIYDKP

SEQ ID NO: 576689 - protein, 9 aa, Homo Sapiens
HRDRVMLVR

SEQ ID NO: 576690 - protein, 9 aa, Homo Sapiens
SNLEQFAEN

SEQ ID NO: 576691 - protein, 9 aa, Homo Sapiens
VLTEHRDRV

SEQ ID NO: 576692 - protein, 9 aa, Homo Sapiens
GLPLMNQVI

SEQ ID NO: 576693 - protein, 9 aa, Homo Sapiens
PVDFEEVYV

SEQ ID NO: 576694 - protein, 9 aa, Homo Sapiens
RNSFEVHVC

SEQ ID NO: 576695 - protein, 9 aa, Homo Sapiens
ACLKAWKQH

SEQ ID NO: 576696 - protein, 9 aa, Homo Sapiens
IGPKVCHRL

SEQ ID NO: 576697 - protein, 9 aa, Homo Sapiens
SEEVHIDSY

SEQ ID NO: 576698 - protein, 9 aa, Homo Sapiens
LIRKLPFRR

SEQ ID NO: 576699 - protein, 9 aa, Homo Sapiens
NCGIEVYYQ

SEQ ID NO: 576700 - protein, 9 aa, Homo Sapiens
IGCMFIKMY

SEQ ID NO: 576701 - protein, 9 aa, Homo Sapiens
VLPDLFEEE

SEQ ID NO: 576702 - protein, 9 aa, Homo Sapiens
YQPKKRAET

SEQ ID NO: 576703 - protein, 9 aa, Homo Sapiens
LMNNNFITA

SEQ ID NO: 576704 - protein, 9 aa, Homo Sapiens
EVSRIITEN

SEQ ID NO: 576705 - protein, 9 aa, Homo Sapiens
GQTIEGTWA

SEQ ID NO: 576706 - protein, 9 aa, Homo Sapiens
LWCSPAPCP

SEQ ID NO: 576707 - protein, 9 aa, Homo Sapiens
KHPEPGSSC

SEQ ID NO: 576708 - protein, 9 aa, Homo Sapiens
YCSKQLFSS

SEQ ID NO: 576709 - protein, 9 aa, Homo Sapiens
EEPTCCAES

SEQ ID NO: 576710 - protein, 9 aa, Homo Sapiens
ARLLKKQLK

SEQ ID NO: 576711 - protein, 9 aa, Homo Sapiens
YNLTEQHSK

SEQ ID NO: 576712 - protein, 9 aa, Homo Sapiens
GCMFIKMYQ

SEQ ID NO: 576713 - protein, 9 aa, Homo Sapiens
LKAWKQHCR

SEQ ID NO: 576714 - protein, 9 aa, Homo Sapiens
YVSSNADEE

SEQ ID NO: 576715 - protein, 9 aa, Homo Sapiens
TSTAVPKMI

SEQ ID NO: 576716 - protein, 9 aa, Homo Sapiens
TWRPFLSQL

SEQ ID NO: 576717 - protein, 9 aa, Homo Sapiens
LRCLQKLSM

SEQ ID NO: 576718 - protein, 9 aa, Homo Sapiens
DSKKKFQTK

SEQ ID NO: 576719 - protein, 9 aa, Homo Sapiens
RSVQRLLET

SEQ ID NO: 576720 - protein, 9 aa, Homo Sapiens
GSYQKKTSN

SEQ ID NO: 576721 - protein, 9 aa, Homo Sapiens
GVFNVFGDG

SEQ ID NO: 576722 - protein, 9 aa, Homo Sapiens
SKQLFSSLA

SEQ ID NO: 576723 - protein, 9 aa, Homo Sapiens
VKIYLLPDS

SEQ ID NO: 576724 - protein, 9 aa, Homo Sapiens
GTQQTREPP

SEQ ID NO: 576725 - protein, 9 aa, Homo Sapiens
RKRQWQSTL

SEQ ID NO: 576726 - protein, 9 aa, Homo Sapiens
KASHRNLVD

SEQ ID NO: 576727 - protein, 9 aa, Homo Sapiens
VKRRIVGNK

SEQ ID NO: 576728 - protein, 9 aa, Homo Sapiens
GGKPFKLFE

SEQ ID NO: 576729 - protein, 9 aa, Homo Sapiens
GDPRTYYPD

SEQ ID NO: 576730 - protein, 9 aa, Homo Sapiens
DQMRMKLES

SEQ ID NO: 576731 - protein, 9 aa, Homo Sapiens
QPYKSAFYV

SEQ ID NO: 576732 - protein, 9 aa, Homo Sapiens
CNNCSLKNA

SEQ ID NO: 576733 - protein, 9 aa, Homo Sapiens
LRNYSRQLL

SEQ ID NO: 576734 - protein, 9 aa, Homo Sapiens
SDSEEERRP

SEQ ID NO: 576735 - protein, 9 aa, Homo Sapiens
LWAGGQTIE

SEQ ID NO: 576736 - protein, 9 aa, Homo Sapiens
VGPGHNRSF

SEQ ID NO: 576737 - protein, 9 aa, Homo Sapiens
PGIPYRVEV

SEQ ID NO: 576738 - protein, 9 aa, Homo Sapiens
KLPFRRLVR

SEQ ID NO: 576739 - protein, 9 aa, Homo Sapiens
KIYLLPDSK

SEQ ID NO: 576740 - protein, 9 aa, Homo Sapiens
RVRRLIRQY

SEQ ID NO: 576741 - protein, 9 aa, Homo Sapiens
LSEDEWTSR

SEQ ID NO: 576742 - protein, 9 aa, Homo Sapiens
CREELCQQH

SEQ ID NO: 576743 - protein, 9 aa, Homo Sapiens
YWNITDFLL

SEQ ID NO: 576744 - protein, 9 aa, Homo Sapiens
MPLHLFHEV

SEQ ID NO: 576745 - protein, 9 aa, Homo Sapiens
CQQHPRHSR

SEQ ID NO: 576746 - protein, 9 aa, Homo Sapiens
LLIRKLPFR

SEQ ID NO: 576747 - protein, 9 aa, Homo Sapiens
LKQVSTWFA

SEQ ID NO: 576748 - protein, 9 aa, Homo Sapiens
IAEAEKAKQ

SEQ ID NO: 576749 - protein, 9 aa, Homo Sapiens
EVYYQTDMQ

SEQ ID NO: 576750 - protein, 9 aa, Homo Sapiens
DVEHNLLKQ

SEQ ID NO: 576751 - protein, 9 aa, Homo Sapiens
IQRGMRFCI

SEQ ID NO: 576752 - protein, 9 aa, Homo Sapiens
SRAHPGYGA

SEQ ID NO: 576753 - protein, 9 aa, Homo Sapiens
AHRQLHQEE

SEQ ID NO: 576754 - protein, 9 aa, Homo Sapiens
NYSIVGGKP

SEQ ID NO: 576755 - protein, 9 aa, Homo Sapiens
VYVSSNADE

SEQ ID NO: 576756 - protein, 9 aa, Homo Sapiens
KWQCQEGWH

SEQ ID NO: 576757 - protein, 9 aa, Homo Sapiens
QEYWNITDF

SEQ ID NO: 576758 - protein, 9 aa, Homo Sapiens
FIKMYQPKK

SEQ ID NO: 576759 - protein, 9 aa, Homo Sapiens
SSCVYCKTG

SEQ ID NO: 576760 - protein, 9 aa, Homo Sapiens
QKVLRAWRD

SEQ ID NO: 576761 - protein, 9 aa, Homo Sapiens
MNSINYSTL

SEQ ID NO: 576762 - protein, 9 aa, Homo Sapiens
RCDVSGIKG

SEQ ID NO: 576763 - protein, 9 aa, Homo Sapiens
NNCSLKNAS

SEQ ID NO: 576764 - protein, 9 aa, Homo Sapiens
RETARSEIQ

SEQ ID NO: 576765 - protein, 9 aa, Homo Sapiens
ISENFGSSR

SEQ ID NO: 576766 - protein, 9 aa, Homo Sapiens
LLPDSKKKF

SEQ ID NO: 576767 - protein, 9 aa, Homo Sapiens
WGKDNKKHQ

SEQ ID NO: 576768 - protein, 9 aa, Homo Sapiens
RKGRDLTWY

SEQ ID NO: 576769 - protein, 9 aa, Homo Sapiens
VAYEDNSLY

SEQ ID NO: 576770 - protein, 9 aa, Homo Sapiens
EYWNITDFL

SEQ ID NO: 576771 - protein, 9 aa, Homo Sapiens
ERQEVDVPA

SEQ ID NO: 576772 - protein, 9 aa, Homo Sapiens
YRETGTFIS

SEQ ID NO: 576773 - protein, 9 aa, Homo Sapiens
VISWATLAS

SEQ ID NO: 576774 - protein, 9 aa, Homo Sapiens
VIAEAEKAK

SEQ ID NO: 576775 - protein, 9 aa, Homo Sapiens
EERRPQPVR

SEQ ID NO: 576776 - protein, 9 aa, Homo Sapiens
NSDSDSNVV

SEQ ID NO: 576777 - protein, 9 aa, Homo Sapiens
ACRIWDVLC

SEQ ID NO: 576778 - protein, 9 aa, Homo Sapiens
PKVCHRLVK

SEQ ID NO: 576779 - protein, 9 aa, Homo Sapiens
LKMLEKWAQ

SEQ ID NO: 576780 - protein, 9 aa, Homo Sapiens
LELVADYCE

SEQ ID NO: 576781 - protein, 9 aa, Homo Sapiens
TISPSQNKT

SEQ ID NO: 576782 - protein, 9 aa, Homo Sapiens
TQPFDTINK

SEQ ID NO: 576783 - protein, 9 aa, Homo Sapiens
ELCQQHPRH

SEQ ID NO: 576784 - protein, 9 aa, Homo Sapiens
RSRSTTRHH

SEQ ID NO: 576785 - protein, 9 aa, Homo Sapiens
VLTYLEKLN

SEQ ID NO: 576786 - protein, 9 aa, Homo Sapiens
QRGMRFCID

SEQ ID NO: 576787 - protein, 9 aa, Homo Sapiens
YTQVGPGHN

SEQ ID NO: 576788 - protein, 9 aa, Homo Sapiens
RVIAEAEKA

SEQ ID NO: 576789 - protein, 9 aa, Homo Sapiens
SCREELCQQ

SEQ ID NO: 576790 - protein, 9 aa, Homo Sapiens
LAVDKIMMD

SEQ ID NO: 576791 - protein, 9 aa, Homo Sapiens
LKTEGPSKS

SEQ ID NO: 576792 - protein, 9 aa, Homo Sapiens
SNVVEKPYG

SEQ ID NO: 576793 - protein, 9 aa, Homo Sapiens
QERLGTCKV

SEQ ID NO: 576794 - protein, 9 aa, Homo Sapiens
CIYCSKQLF

SEQ ID NO: 576795 - protein, 9 aa, Homo Sapiens
CIVFDVVAY

SEQ ID NO: 576796 - protein, 9 aa, Homo Sapiens
TKEKHKKEE

SEQ ID NO: 576797 - protein, 9 aa, Homo Sapiens
DALRAVKRR

SEQ ID NO: 576798 - protein, 9 aa, Homo Sapiens
SINYSTLLE

SEQ ID NO: 576799 - protein, 9 aa, Homo Sapiens
KYIDPKFPP

SEQ ID NO: 576800 - protein, 9 aa, Homo Sapiens
HWRLSYKGQ

SEQ ID NO: 576801 - protein, 9 aa, Homo Sapiens
TINVTMAAK

SEQ ID NO: 576802 - protein, 9 aa, Homo Sapiens
NCSLKNAST

SEQ ID NO: 576803 - protein, 9 aa, Homo Sapiens
GSWWHCNNC

SEQ ID NO: 576804 - protein, 9 aa, Homo Sapiens
GWGSSFSLW

SEQ ID NO: 576805 - protein, 9 aa, Homo Sapiens
RGVFNVFGD

SEQ ID NO: 576806 - protein, 9 aa, Homo Sapiens
KLRCLQKLS

SEQ ID NO: 576807 - protein, 9 aa, Homo Sapiens
NIVEEVAKA

SEQ ID NO: 576808 - protein, 9 aa, Homo Sapiens
FISENFGSS

SEQ ID NO: 576809 - protein, 9 aa, Homo Sapiens
PGSQDSRVN

SEQ ID NO: 576810 - protein, 9 aa, Homo Sapiens
CRRRGHNLY

SEQ ID NO: 576811 - protein, 9 aa, Homo Sapiens
HNLLKQRLD

SEQ ID NO: 576812 - protein, 9 aa, Homo Sapiens
TCCAESFRV

SEQ ID NO: 576813 - protein, 9 aa, Homo Sapiens
KIMMDLDQC

SEQ ID NO: 576814 - protein, 9 aa, Homo Sapiens
GRQNTLRCD

SEQ ID NO: 576815 - protein, 9 aa, Homo Sapiens
HCNNCSLKN

SEQ ID NO: 576816 - protein, 9 aa, Homo Sapiens
LMDSKYIDP

SEQ ID NO: 576817 - protein, 9 aa, Homo Sapiens
AAARGVFNV

SEQ ID NO: 576818 - protein, 9 aa, Homo Sapiens
NLEQFAENT

SEQ ID NO: 576819 - protein, 9 aa, Homo Sapiens
ARFPFRVEL

SEQ ID NO: 576820 - protein, 9 aa, Homo Sapiens
CCAESFRVD

SEQ ID NO: 576821 - protein, 9 aa, Homo Sapiens
TLLNYNLTE

SEQ ID NO: 576822 - protein, 9 aa, Homo Sapiens
WHCNNCSLK

SEQ ID NO: 576823 - protein, 9 aa, Homo Sapiens
DERGISPAH

SEQ ID NO: 576824 - protein, 9 aa, Homo Sapiens
KRQWQSTLG

SEQ ID NO: 576825 - protein, 9 aa, Homo Sapiens
FETQPFDTI

SEQ ID NO: 576826 - protein, 9 aa, Homo Sapiens
SIVGGKPFK

SEQ ID NO: 576827 - protein, 9 aa, Homo Sapiens
MSSDERGIS

SEQ ID NO: 576828 - protein, 9 aa, Homo Sapiens
QVISWATLA

SEQ ID NO: 576829 - protein, 9 aa, Homo Sapiens
GELPGSQDS

SEQ ID NO: 576830 - protein, 9 aa, Homo Sapiens
GISNYPKIR

SEQ ID NO: 576831 - protein, 9 aa, Homo Sapiens
MTLKQVSTW

SEQ ID NO: 576832 - protein, 9 aa, Homo Sapiens
LEQFAENTV

SEQ ID NO: 576833 - protein, 9 aa, Homo Sapiens
YFNIVEEVA

SEQ ID NO: 576834 - protein, 9 aa, Homo Sapiens
LESLHQEFS

SEQ ID NO: 576835 - protein, 9 aa, Homo Sapiens
EDVGELFIL

SEQ ID NO: 576836 - protein, 9 aa, Homo Sapiens
MELRNYSRQ

SEQ ID NO: 576837 - protein, 9 aa, Homo Sapiens
SERQEVDVP

SEQ ID NO: 576838 - protein, 9 aa, Homo Sapiens
RFPFRVELY

SEQ ID NO: 576839 - protein, 9 aa, Homo Sapiens
LLDRTWRPF

SEQ ID NO: 576840 - protein, 9 aa, Homo Sapiens
ASLPAPVIG

SEQ ID NO: 576841 - protein, 9 aa, Homo Sapiens
NQVISWATL

SEQ ID NO: 576842 - protein, 9 aa, Homo Sapiens
LGTQQTREP

SEQ ID NO: 576843 - protein, 9 aa, Homo Sapiens
AKEVFLVMP

SEQ ID NO: 576844 - protein, 9 aa, Homo Sapiens
PTIVNLDHH

SEQ ID NO: 576845 - protein, 9 aa, Homo Sapiens
YFKIRAIYD

SEQ ID NO: 576846 - protein, 9 aa, Homo Sapiens
EPNKWQCQE

SEQ ID NO: 576847 - protein, 9 aa, Homo Sapiens
QEQEGGLGT

SEQ ID NO: 576848 - protein, 9 aa, Homo Sapiens
TFPMFISEN

SEQ ID NO: 576849 - protein, 9 aa, Homo Sapiens
SSDSEEERR

SEQ ID NO: 576850 - protein, 9 aa, Homo Sapiens
LMNQVISWA

SEQ ID NO: 576851 - protein, 9 aa, Homo Sapiens
INYSTLLES

SEQ ID NO: 576852 - protein, 9 aa, Homo Sapiens
SDERGISPA

SEQ ID NO: 576853 - protein, 9 aa, Homo Sapiens
EHKCPVGER

SEQ ID NO: 576854 - protein, 9 aa, Homo Sapiens
STAHTTPLH

SEQ ID NO: 576855 - protein, 9 aa, Homo Sapiens
PGRSRVLEQ

SEQ ID NO: 576856 - protein, 9 aa, Homo Sapiens
ALAFESSTG

SEQ ID NO: 576857 - protein, 9 aa, Homo Sapiens
TAFNKTRFQ

SEQ ID NO: 576858 - protein, 9 aa, Homo Sapiens
TVYENPHYQ

SEQ ID NO: 576859 - protein, 9 aa, Homo Sapiens
SAPDHALHG

SEQ ID NO: 576860 - protein, 9 aa, Homo Sapiens
ECEGLTERR

SEQ ID NO: 576861 - protein, 9 aa, Homo Sapiens
ELWAQHAML

SEQ ID NO: 576862 - protein, 9 aa, Homo Sapiens
YLGIEELTR

SEQ ID NO: 576863 - protein, 9 aa, Homo Sapiens
EYSTSVPLN

SEQ ID NO: 576864 - protein, 9 aa, Homo Sapiens
PDKEHRCIV

SEQ ID NO: 576865 - protein, 9 aa, Homo Sapiens
EHLKIHSRK

SEQ ID NO: 576866 - protein, 9 aa, Homo Sapiens
KWKGEGKFI

SEQ ID NO: 576867 - protein, 9 aa, Homo Sapiens
SSTGIFMGN

SEQ ID NO: 576868 - protein, 9 aa, Homo Sapiens
VYRECGRGF

SEQ ID NO: 576869 - protein, 9 aa, Homo Sapiens
DVTQVLPHA

SEQ ID NO: 576870 - protein, 9 aa, Homo Sapiens
SEYSTSVPL

SEQ ID NO: 576871 - protein, 9 aa, Homo Sapiens
RTRCLECEG

SEQ ID NO: 576872 - protein, 9 aa, Homo Sapiens
SKWKGEGKF

SEQ ID NO: 576873 - protein, 9 aa, Homo Sapiens
GFSNESVPD

SEQ ID NO: 576874 - protein, 9 aa, Homo Sapiens
TQQKDISES

SEQ ID NO: 576875 - protein, 9 aa, Homo Sapiens
DNFNPHLIV

SEQ ID NO: 576876 - protein, 9 aa, Homo Sapiens
FQKNELHSI

SEQ ID NO: 576877 - protein, 9 aa, Homo Sapiens
GFWFLMYPF

SEQ ID NO: 576878 - protein, 9 aa, Homo Sapiens
FTNSPTMMI

SEQ ID NO: 576879 - protein, 9 aa, Homo Sapiens
LEQPFPFQA

SEQ ID NO: 576880 - protein, 9 aa, Homo Sapiens
ILAFQKGFS

SEQ ID NO: 576881 - protein, 9 aa, Homo Sapiens
TWVCDQGKH

SEQ ID NO: 576882 - protein, 9 aa, Homo Sapiens
RIHSELWNR

SEQ ID NO: 576883 - protein, 9 aa, Homo Sapiens
LVLLRSVSS

SEQ ID NO: 576884 - protein, 9 aa, Homo Sapiens
VCDQGKHSD

SEQ ID NO: 576885 - protein, 9 aa, Homo Sapiens
EDSPRRSQV

SEQ ID NO: 576886 - protein, 9 aa, Homo Sapiens
PVQRSEIVK

SEQ ID NO: 576887 - protein, 9 aa, Homo Sapiens
EKLMDMKWM

SEQ ID NO: 576888 - protein, 9 aa, Homo Sapiens
RASGPAKDA

SEQ ID NO: 576889 - protein, 9 aa, Homo Sapiens
SSDKGVFSF

SEQ ID NO: 576890 - protein, 9 aa, Homo Sapiens
VSVGPCLTL

SEQ ID NO: 576891 - protein, 9 aa, Homo Sapiens
PRTTILKCI

SEQ ID NO: 576892 - protein, 9 aa, Homo Sapiens
NCAIELETN

SEQ ID NO: 576893 - protein, 9 aa, Homo Sapiens
KGEGKFILK

SEQ ID NO: 576894 - protein, 9 aa, Homo Sapiens
PGTSAPDHA

SEQ ID NO: 576895 - protein, 9 aa, Homo Sapiens
EVAATIMNL

SEQ ID NO: 576896 - protein, 9 aa, Homo Sapiens
LETNHRAES

SEQ ID NO: 576897 - protein, 9 aa, Homo Sapiens
GFVLTQAQG

SEQ ID NO: 576898 - protein, 9 aa, Homo Sapiens
KEKRREQAL

SEQ ID NO: 576899 - protein, 9 aa, Homo Sapiens
ASDYFKAKD

SEQ ID NO: 576900 - protein, 9 aa, Homo Sapiens
SDYFKAKDY

SEQ ID NO: 576901 - protein, 9 aa, Homo Sapiens
DPFLVLLRS

SEQ ID NO: 576902 - protein, 9 aa, Homo Sapiens
RVAGGAVCE

SEQ ID NO: 576903 - protein, 9 aa, Homo Sapiens
HDPGRSRVL

SEQ ID NO: 576904 - protein, 9 aa, Homo Sapiens
QGSFGGPTV

SEQ ID NO: 576905 - protein, 9 aa, Homo Sapiens
ERWEDSPRR

SEQ ID NO: 576906 - protein, 9 aa, Homo Sapiens
AKAKTRSKT

SEQ ID NO: 576907 - protein, 9 aa, Homo Sapiens
LSEHLKIHS

SEQ ID NO: 576908 - protein, 9 aa, Homo Sapiens
FARLEKKEK

SEQ ID NO: 576909 - protein, 9 aa, Homo Sapiens
VSWSYSQQR

SEQ ID NO: 576910 - protein, 9 aa, Homo Sapiens
SNSSYEWSL

SEQ ID NO: 576911 - protein, 9 aa, Homo Sapiens
CSSAVVSWS

SEQ ID NO: 576912 - protein, 9 aa, Homo Sapiens
FVPENNGPG

SEQ ID NO: 576913 - protein, 9 aa, Homo Sapiens
FNPHLIVFY

SEQ ID NO: 576914 - protein, 9 aa, Homo Sapiens
PSPGTSAPD

SEQ ID NO: 576915 - protein, 9 aa, Homo Sapiens
VTQVLPHAH

SEQ ID NO: 576916 - protein, 9 aa, Homo Sapiens
QGKLTSAQQ

SEQ ID NO: 576917 - protein, 9 aa, Homo Sapiens
VQRSEIVKV

SEQ ID NO: 576918 - protein, 9 aa, Homo Sapiens
DSNSSYEWS

SEQ ID NO: 576919 - protein, 9 aa, Homo Sapiens
HTSCASAGN

SEQ ID NO: 576920 - protein, 9 aa, Homo Sapiens
QKNELHSIF

SEQ ID NO: 576921 - protein, 9 aa, Homo Sapiens
WAQHAMLGH

SEQ ID NO: 576922 - protein, 9 aa, Homo Sapiens
PIDFKSNHR

SEQ ID NO: 576923 - protein, 9 aa, Homo Sapiens
QKIHKSEGR

SEQ ID NO: 576924 - protein, 9 aa, Homo Sapiens
NFKHVIGLS

SEQ ID NO: 576925 - protein, 9 aa, Homo Sapiens
ENGGRWAWS

SEQ ID NO: 576926 - protein, 9 aa, Homo Sapiens
QQENTSLSE

SEQ ID NO: 576927 - protein, 9 aa, Homo Sapiens
RKIRTSTSI

SEQ ID NO: 576928 - protein, 9 aa, Homo Sapiens
EATAFSGGR

SEQ ID NO: 576929 - protein, 9 aa, Homo Sapiens
REPMPPTLL

SEQ ID NO: 576930 - protein, 9 aa, Homo Sapiens
GAAVLRLRA

SEQ ID NO: 576931 - protein, 9 aa, Homo Sapiens
RAAKQLNFA

SEQ ID NO: 576932 - protein, 9 aa, Homo Sapiens
RSRVLEQPF

SEQ ID NO: 576933 - protein, 9 aa, Homo Sapiens
LKCIFTALP

SEQ ID NO: 576934 - protein, 9 aa, Homo Sapiens
IHSIVVQLQ

SEQ ID NO: 576935 - protein, 9 aa, Homo Sapiens
VFQKNELHS

SEQ ID NO: 576936 - protein, 9 aa, Homo Sapiens
AVFQKNELH

SEQ ID NO: 576937 - protein, 9 aa, Homo Sapiens
RSVPVLGSL

SEQ ID NO: 576938 - protein, 9 aa, Homo Sapiens
YGEEEVPRS

SEQ ID NO: 576939 - protein, 9 aa, Homo Sapiens
ARQLAGNSS

SEQ ID NO: 576940 - protein, 9 aa, Homo Sapiens
FAFTGRTPD

SEQ ID NO: 576941 - protein, 9 aa, Homo Sapiens
AFQKGFSNE

SEQ ID NO: 576942 - protein, 9 aa, Homo Sapiens
ELETNHRAE

SEQ ID NO: 576943 - protein, 9 aa, Homo Sapiens
ESSTGIFMG

SEQ ID NO: 576944 - protein, 9 aa, Homo Sapiens
LQGKLTSAQ

SEQ ID NO: 576945 - protein, 9 aa, Homo Sapiens
TYFVLCGSV

SEQ ID NO: 576946 - protein, 9 aa, Homo Sapiens
ILSDVTQVL

SEQ ID NO: 576947 - protein, 9 aa, Homo Sapiens
QPVYTTLTS

SEQ ID NO: 576948 - protein, 9 aa, Homo Sapiens
TGEKPYVYR

SEQ ID NO: 576949 - protein, 9 aa, Homo Sapiens
NSPTMMIMV

SEQ ID NO: 576950 - protein, 9 aa, Homo Sapiens
GPTVYENPH

SEQ ID NO: 576951 - protein, 9 aa, Homo Sapiens
FGREPMPPT

SEQ ID NO: 576952 - protein, 9 aa, Homo Sapiens
VPENNGPGA

SEQ ID NO: 576953 - protein, 9 aa, Homo Sapiens
APDHALHGK

SEQ ID NO: 576954 - protein, 9 aa, Homo Sapiens
CHLLGDRIC

SEQ ID NO: 576955 - protein, 9 aa, Homo Sapiens
LEKKEKRRE

SEQ ID NO: 576956 - protein, 9 aa, Homo Sapiens
MEVMKTRLP

SEQ ID NO: 576957 - protein, 9 aa, Homo Sapiens
LFVPENNGP

SEQ ID NO: 576958 - protein, 9 aa, Homo Sapiens
AGNYDIPSA

SEQ ID NO: 576959 - protein, 9 aa, Homo Sapiens
SISVLYGEE

SEQ ID NO: 576960 - protein, 9 aa, Homo Sapiens
FLSPVSSNT

SEQ ID NO: 576961 - protein, 9 aa, Homo Sapiens
SSYEWSLPS

SEQ ID NO: 576962 - protein, 9 aa, Homo Sapiens
SENTSASTT

SEQ ID NO: 576963 - protein, 9 aa, Homo Sapiens
LMDMKWMEK

SEQ ID NO: 576964 - protein, 9 aa, Homo Sapiens
YFVLCGSVL

SEQ ID NO: 576965 - protein, 9 aa, Homo Sapiens
EKMLLQKVE

SEQ ID NO: 576966 - protein, 9 aa, Homo Sapiens
SAVVSWSYS

SEQ ID NO: 576967 - protein, 9 aa, Homo Sapiens
CGKSFQKLS

SEQ ID NO: 576968 - protein, 9 aa, Homo Sapiens
ELPRASGPA

SEQ ID NO: 576969 - protein, 9 aa, Homo Sapiens
EGLTERRED

SEQ ID NO: 576970 - protein, 9 aa, Homo Sapiens
RVTWGSAQV

SEQ ID NO: 576971 - protein, 9 aa, Homo Sapiens
GIEELTREA

SEQ ID NO: 576972 - protein, 9 aa, Homo Sapiens
TVPEKSPDK

SEQ ID NO: 576973 - protein, 9 aa, Homo Sapiens
TASTADSEN

SEQ ID NO: 576974 - protein, 9 aa, Homo Sapiens
TSAPDHALH

SEQ ID NO: 576975 - protein, 9 aa, Homo Sapiens
SSAYNAYQA

SEQ ID NO: 576976 - protein, 9 aa, Homo Sapiens
IKVTSLCVE

SEQ ID NO: 576977 - protein, 9 aa, Homo Sapiens
AIFCHLLGD

SEQ ID NO: 576978 - protein, 9 aa, Homo Sapiens
WKGEGKFIL

SEQ ID NO: 576979 - protein, 9 aa, Homo Sapiens
VTTWVCDQG

SEQ ID NO: 576980 - protein, 9 aa, Homo Sapiens
LAVLEDSAR

SEQ ID NO: 576981 - protein, 9 aa, Homo Sapiens
QKLSHLTQH

SEQ ID NO: 576982 - protein, 9 aa, Homo Sapiens
SPTMMIMVG

SEQ ID NO: 576983 - protein, 9 aa, Homo Sapiens
TAHTTPLHV

SEQ ID NO: 576984 - protein, 9 aa, Homo Sapiens
EQSNSYWGE

SEQ ID NO: 576985 - protein, 9 aa, Homo Sapiens
QAAESCEVQ

SEQ ID NO: 576986 - protein, 9 aa, Homo Sapiens
TLLCSSAVV

SEQ ID NO: 576987 - protein, 9 aa, Homo Sapiens
VMKTRLPVG

SEQ ID NO: 576988 - protein, 9 aa, Homo Sapiens
QQQQQQVSA

SEQ ID NO: 576989 - protein, 9 aa, Homo Sapiens
ANEVAATIM

SEQ ID NO: 576990 - protein, 9 aa, Homo Sapiens
VLGNKFNHG

SEQ ID NO: 576991 - protein, 9 aa, Homo Sapiens
KTPIDFKSN

SEQ ID NO: 576992 - protein, 9 aa, Homo Sapiens
IAGFGREPM

SEQ ID NO: 576993 - protein, 9 aa, Homo Sapiens
KNELHSIFF

SEQ ID NO: 576994 - protein, 9 aa, Homo Sapiens
QQQQVSAHQ

SEQ ID NO: 576995 - protein, 9 aa, Homo Sapiens
MKTRLPVGK

SEQ ID NO: 576996 - protein, 9 aa, Homo Sapiens
KKNGNAIFC

SEQ ID NO: 576997 - protein, 9 aa, Homo Sapiens
NMSRKEKDE

SEQ ID NO: 576998 - protein, 9 aa, Homo Sapiens
QQQQQVSAH

SEQ ID NO: 576999 - protein, 9 aa, Homo Sapiens
PFLVLLRSV

SEQ ID NO: 577000 - protein, 9 aa, Homo Sapiens
TAFSGGRNN

SEQ ID NO: 577001 - protein, 9 aa, Homo Sapiens
HVIGLSCEL

SEQ ID NO: 577002 - protein, 9 aa, Homo Sapiens
EEREQQLRR

SEQ ID NO: 577003 - protein, 9 aa, Homo Sapiens
MWLLLKFRQ

SEQ ID NO: 577004 - protein, 9 aa, Homo Sapiens
SEHLKIHSR

SEQ ID NO: 577005 - protein, 9 aa, Homo Sapiens
IRSVPVLGS

SEQ ID NO: 577006 - protein, 9 aa, Homo Sapiens
RQLAVFQKN

SEQ ID NO: 577007 - protein, 9 aa, Homo Sapiens
TSTSIMEKD

SEQ ID NO: 577008 - protein, 9 aa, Homo Sapiens
YQAVYAVAH

SEQ ID NO: 577009 - protein, 9 aa, Homo Sapiens
AHTTPLHVT

SEQ ID NO: 577010 - protein, 9 aa, Homo Sapiens
AWSMPGWGP

SEQ ID NO: 577011 - protein, 9 aa, Homo Sapiens
FVLCGSVLS

SEQ ID NO: 577012 - protein, 9 aa, Homo Sapiens
VLEDSARDI

SEQ ID NO: 577013 - protein, 9 aa, Homo Sapiens
CAIELETNH

SEQ ID NO: 577014 - protein, 9 aa, Homo Sapiens
FLRKFSSDK

SEQ ID NO: 577015 - protein, 9 aa, Homo Sapiens
KTRSKTDAV

SEQ ID NO: 577016 - protein, 9 aa, Homo Sapiens
ANCSLELPR

SEQ ID NO: 577017 - protein, 9 aa, Homo Sapiens
QRVTTWVCD

SEQ ID NO: 577018 - protein, 9 aa, Homo Sapiens
SHNTYLTAR

SEQ ID NO: 577019 - protein, 9 aa, Homo Sapiens
LEDNYMYLG

SEQ ID NO: 577020 - protein, 9 aa, Homo Sapiens
HRQLAVFQK

SEQ ID NO: 577021 - protein, 9 aa, Homo Sapiens
RQLAGNSSV

SEQ ID NO: 577022 - protein, 9 aa, Homo Sapiens
LRSVSSSLS

SEQ ID NO: 577023 - protein, 9 aa, Homo Sapiens
LCVEANSCS

SEQ ID NO: 577024 - protein, 9 aa, Homo Sapiens
KPRHTSCAS

SEQ ID NO: 577025 - protein, 9 aa, Homo Sapiens
QVKINNDLN

SEQ ID NO: 577026 - protein, 9 aa, Homo Sapiens
PFPFQASGH

SEQ ID NO: 577027 - protein, 9 aa, Homo Sapiens
DNELWAQHA

SEQ ID NO: 577028 - protein, 9 aa, Homo Sapiens
LLYLFWLLV

SEQ ID NO: 577029 - protein, 9 aa, Homo Sapiens
KILAFQKGF

SEQ ID NO: 577030 - protein, 9 aa, Homo Sapiens
KTQASDYFK

SEQ ID NO: 577031 - protein, 9 aa, Homo Sapiens
TARQLAGNS

SEQ ID NO: 577032 - protein, 9 aa, Homo Sapiens
SSVSTAHTT

SEQ ID NO: 577033 - protein, 9 aa, Homo Sapiens
DTYSNIRVA

SEQ ID NO: 577034 - protein, 9 aa, Homo Sapiens
QSKWKGEGK

SEQ ID NO: 577035 - protein, 9 aa, Homo Sapiens
SNLRAGNYD

SEQ ID NO: 577036 - protein, 9 aa, Homo Sapiens
CPVGEREQL

SEQ ID NO: 577037 - protein, 9 aa, Homo Sapiens
SSSEYSTSV

SEQ ID NO: 577038 - protein, 9 aa, Homo Sapiens
LTQQKDISE

SEQ ID NO: 577039 - protein, 9 aa, Homo Sapiens
CASAGNDSK

SEQ ID NO: 577040 - protein, 9 aa, Homo Sapiens
WIAGFGREP

SEQ ID NO: 577041 - protein, 9 aa, Homo Sapiens
DNRNMSRKE

SEQ ID NO: 577042 - protein, 9 aa, Homo Sapiens
ELKTQASDY

SEQ ID NO: 577043 - protein, 9 aa, Homo Sapiens
ASGHGALLG

SEQ ID NO: 577044 - protein, 9 aa, Homo Sapiens
NNDLNYEFY

SEQ ID NO: 577045 - protein, 9 aa, Homo Sapiens
IFCHLLGDR

SEQ ID NO: 577046 - protein, 9 aa, Homo Sapiens
AYQAVYAVA

SEQ ID NO: 577047 - protein, 9 aa, Homo Sapiens
YRECGRGFS

SEQ ID NO: 577048 - protein, 9 aa, Homo Sapiens
AAKQLNFAF

SEQ ID NO: 577049 - protein, 9 aa, Homo Sapiens
AKQLNFAFT

SEQ ID NO: 577050 - protein, 9 aa, Homo Sapiens
VPVQRSEIV

SEQ ID NO: 577051 - protein, 9 aa, Homo Sapiens
FQVKINNDL

SEQ ID NO: 577052 - protein, 9 aa, Homo Sapiens
TPIDFKSNH

SEQ ID NO: 577053 - protein, 9 aa, Homo Sapiens
EKPYVYREC

SEQ ID NO: 577054 - protein, 9 aa, Homo Sapiens
HKCPVGERE

SEQ ID NO: 577055 - protein, 9 aa, Homo Sapiens
HSELWNRAP

SEQ ID NO: 577056 - protein, 9 aa, Homo Sapiens
SDVTQVLPH

SEQ ID NO: 577057 - protein, 9 aa, Homo Sapiens
RAGNYDIPS

SEQ ID NO: 577058 - protein, 9 aa, Homo Sapiens
STGIFMGNA

SEQ ID NO: 577059 - protein, 9 aa, Homo Sapiens
PEKSPDKEH

SEQ ID NO: 577060 - protein, 9 aa, Homo Sapiens
TSVPLNTPE

SEQ ID NO: 577061 - protein, 9 aa, Homo Sapiens
QQVSAHQEA

SEQ ID NO: 577062 - protein, 9 aa, Homo Sapiens
QFTNSPTMM

SEQ ID NO: 577063 - protein, 9 aa, Homo Sapiens
EEFWYLLML

SEQ ID NO: 577064 - protein, 9 aa, Homo Sapiens
RFQEVFDPP

SEQ ID NO: 577065 - protein, 9 aa, Homo Sapiens
VQKIKVTSL

SEQ ID NO: 577066 - protein, 9 aa, Homo Sapiens
DLHDHRQKY

SEQ ID NO: 577067 - protein, 9 aa, Homo Sapiens
EVMKTRLPV

SEQ ID NO: 577068 - protein, 9 aa, Homo Sapiens
LLCSSAVVS

SEQ ID NO: 577069 - protein, 9 aa, Homo Sapiens
MSSAYNAYQ

SEQ ID NO: 577070 - protein, 9 aa, Homo Sapiens
SLELPRASG

SEQ ID NO: 577071 - protein, 9 aa, Homo Sapiens
EQAAESCEV

SEQ ID NO: 577072 - protein, 9 aa, Homo Sapiens
EASAVEQAA

SEQ ID NO: 577073 - protein, 9 aa, Homo Sapiens
HCDYADTQS

SEQ ID NO: 577074 - protein, 9 aa, Homo Sapiens
LNFAFTGRT

SEQ ID NO: 577075 - protein, 9 aa, Homo Sapiens
VVQLQCINK

SEQ ID NO: 577076 - protein, 9 aa, Homo Sapiens
SSNTRDAGR

SEQ ID NO: 577077 - protein, 9 aa, Homo Sapiens
IVFYAMFTA

SEQ ID NO: 577078 - protein, 9 aa, Homo Sapiens
AKRQLQKIH

SEQ ID NO: 577079 - protein, 9 aa, Homo Sapiens
EVVQHDPGR

SEQ ID NO: 577080 - protein, 9 aa, Homo Sapiens
PYHFLRKFS

SEQ ID NO: 577081 - protein, 9 aa, Homo Sapiens
FFDEATAFS

SEQ ID NO: 577082 - protein, 9 aa, Homo Sapiens
SFGGPTVYE

SEQ ID NO: 577083 - protein, 9 aa, Homo Sapiens
ARWEPDTCT

SEQ ID NO: 577084 - protein, 9 aa, Homo Sapiens
VPEKSPDKE

SEQ ID NO: 577085 - protein, 9 aa, Homo Sapiens
RVTTWVCDQ

SEQ ID NO: 577086 - protein, 9 aa, Homo Sapiens
KRQLQKIHK

SEQ ID NO: 577087 - protein, 9 aa, Homo Sapiens
AGFGREPMP

SEQ ID NO: 577088 - protein, 9 aa, Homo Sapiens
YKTPIDFKS

SEQ ID NO: 577089 - protein, 9 aa, Homo Sapiens
ASANFKHVI

SEQ ID NO: 577090 - protein, 9 aa, Homo Sapiens
RCLECEGLT

SEQ ID NO: 577091 - protein, 9 aa, Homo Sapiens
PCKCKLCGK

SEQ ID NO: 577092 - protein, 9 aa, Homo Sapiens
FSNESVPDS

SEQ ID NO: 577093 - protein, 9 aa, Homo Sapiens
IHTGERPCK

SEQ ID NO: 577094 - protein, 9 aa, Homo Sapiens
QVLPHAHSA

SEQ ID NO: 577095 - protein, 9 aa, Homo Sapiens
LYKTPIDFK

SEQ ID NO: 577096 - protein, 9 aa, Homo Sapiens
LTQAQGGAI

SEQ ID NO: 577097 - protein, 9 aa, Homo Sapiens
RLPVGKTGQ

SEQ ID NO: 577098 - protein, 9 aa, Homo Sapiens
GSAQVFDLA

SEQ ID NO: 577099 - protein, 9 aa, Homo Sapiens
GEEEVPRSP

SEQ ID NO: 577100 - protein, 9 aa, Homo Sapiens
CKTAFNKTR

SEQ ID NO: 577101 - protein, 9 aa, Homo Sapiens
CYAYDSNSS

SEQ ID NO: 577102 - protein, 9 aa, Homo Sapiens
FNHGAEAIM

SEQ ID NO: 577103 - protein, 9 aa, Homo Sapiens
LSHLTQHKV

SEQ ID NO: 577104 - protein, 9 aa, Homo Sapiens
TIMNLTEFS

SEQ ID NO: 577105 - protein, 9 aa, Homo Sapiens
DYADTQSAS

SEQ ID NO: 577106 - protein, 9 aa, Homo Sapiens
KFNHGAEAI

SEQ ID NO: 577107 - protein, 9 aa, Homo Sapiens
PTMMIMVGL

SEQ ID NO: 577108 - protein, 9 aa, Homo Sapiens
GSFGGPTVY

SEQ ID NO: 577109 - protein, 9 aa, Homo Sapiens
QSPPGAAVL

SEQ ID NO: 577110 - protein, 9 aa, Homo Sapiens
KDISESNIA

SEQ ID NO: 577111 - protein, 9 aa, Homo Sapiens
GLTERREDF

SEQ ID NO: 577112 - protein, 9 aa, Homo Sapiens
IGLRCRTYF

SEQ ID NO: 577113 - protein, 9 aa, Homo Sapiens
IRDNELWAQ

SEQ ID NO: 577114 - protein, 9 aa, Homo Sapiens
DDSLLYKTP

SEQ ID NO: 577115 - protein, 9 aa, Homo Sapiens
VTWGSAQVF

SEQ ID NO: 577116 - protein, 9 aa, Homo Sapiens
FDMKWDQFY

SEQ ID NO: 577117 - protein, 9 aa, Homo Sapiens
SEADNRNMS

SEQ ID NO: 577118 - protein, 9 aa, Homo Sapiens
AEELKTQAS

SEQ ID NO: 577119 - protein, 9 aa, Homo Sapiens
LTARQLAGN

SEQ ID NO: 577120 - protein, 9 aa, Homo Sapiens
RSEIVKVIL

SEQ ID NO: 577121 - protein, 9 aa, Homo Sapiens
SANFKHVIG

SEQ ID NO: 577122 - protein, 9 aa, Homo Sapiens
SPVSSNTRD

SEQ ID NO: 577123 - protein, 9 aa, Homo Sapiens
VQDLHDHRQ

SEQ ID NO: 577124 - protein, 9 aa, Homo Sapiens
EDNYMYLGI

SEQ ID NO: 577125 - protein, 9 aa, Homo Sapiens
EPDTCTACV

SEQ ID NO: 577126 - protein, 9 aa, Homo Sapiens
AFARLEKKE

SEQ ID NO: 577127 - protein, 9 aa, Homo Sapiens
GQRVTTWVC

SEQ ID NO: 577128 - protein, 9 aa, Homo Sapiens
LKKPRTTIL

SEQ ID NO: 577129 - protein, 9 aa, Homo Sapiens
IEQSNSYWG

SEQ ID NO: 577130 - protein, 9 aa, Homo Sapiens
SPGTSAPDH

SEQ ID NO: 577131 - protein, 9 aa, Homo Sapiens
WLTVPEKSP

SEQ ID NO: 577132 - protein, 9 aa, Homo Sapiens
SSTSSPSTS

SEQ ID NO: 577133 - protein, 9 aa, Homo Sapiens
DQHLDCALD

SEQ ID NO: 577134 - protein, 9 aa, Homo Sapiens
LKIHSRKNL

SEQ ID NO: 577135 - protein, 9 aa, Homo Sapiens
PVGEREQLE

SEQ ID NO: 577136 - protein, 9 aa, Homo Sapiens
YADTQSASL

SEQ ID NO: 577137 - protein, 9 aa, Homo Sapiens
TYSNIRVAG

SEQ ID NO: 577138 - protein, 9 aa, Homo Sapiens
FDTYSNIRV

SEQ ID NO: 577139 - protein, 9 aa, Homo Sapiens
PHCDYADTQ

SEQ ID NO: 577140 - protein, 9 aa, Homo Sapiens
ISVLYGEEE

SEQ ID NO: 577141 - protein, 9 aa, Homo Sapiens
AFTGRTPDS

SEQ ID NO: 577142 - protein, 9 aa, Homo Sapiens
NEVAATIMN

SEQ ID NO: 577143 - protein, 9 aa, Homo Sapiens
TRSKTDAVA

SEQ ID NO: 577144 - protein, 9 aa, Homo Sapiens
SFQKLSHLT

SEQ ID NO: 577145 - protein, 9 aa, Homo Sapiens
GKSFQKLSH

SEQ ID NO: 577146 - protein, 9 aa, Homo Sapiens
TRLPVGKTG

SEQ ID NO: 577147 - protein, 9 aa, Homo Sapiens
RNMSRKEKD

SEQ ID NO: 577148 - protein, 9 aa, Homo Sapiens
SMPGWGPAC

SEQ ID NO: 577149 - protein, 9 aa, Homo Sapiens
SEEHKCPVG

SEQ ID NO: 577150 - protein, 9 aa, Homo Sapiens
VAASNLRAG

SEQ ID NO: 577151 - protein, 9 aa, Homo Sapiens
EGARWEPDT

SEQ ID NO: 577152 - protein, 9 aa, Homo Sapiens
EEEVPRSPF

SEQ ID NO: 577153 - protein, 9 aa, Homo Sapiens
QIFDMKWDQ

SEQ ID NO: 577154 - protein, 9 aa, Homo Sapiens
FVLTQAQGG

SEQ ID NO: 577155 - protein, 9 aa, Homo Sapiens
FKHVIGLSC

SEQ ID NO: 577156 - protein, 9 aa, Homo Sapiens
RTYFVLCGS

SEQ ID NO: 577157 - protein, 9 aa, Homo Sapiens
NYMYLGIEE

SEQ ID NO: 577158 - protein, 9 aa, Homo Sapiens
ISVRGFWFL

SEQ ID NO: 577159 - protein, 9 aa, Homo Sapiens
TRCLECEGL

SEQ ID NO: 577160 - protein, 9 aa, Homo Sapiens
FLVLLRSVS

SEQ ID NO: 577161 - protein, 9 aa, Homo Sapiens
LGIEELTRE

SEQ ID NO: 577162 - protein, 9 aa, Homo Sapiens
GFGREPMPP

SEQ ID NO: 577163 - protein, 9 aa, Homo Sapiens
QMWLLLKFR

SEQ ID NO: 577164 - protein, 9 aa, Homo Sapiens
AKTRSKTDA

SEQ ID NO: 577165 - protein, 9 aa, Homo Sapiens
NSYWGETLQ

SEQ ID NO: 577166 - protein, 9 aa, Homo Sapiens
DMKWMEKKA

SEQ ID NO: 577167 - protein, 9 aa, Homo Sapiens
AQGGAIICG

SEQ ID NO: 577168 - protein, 9 aa, Homo Sapiens
SLLYKTPID

SEQ ID NO: 577169 - protein, 9 aa, Homo Sapiens
VQHDPGRSR

SEQ ID NO: 577170 - protein, 9 aa, Homo Sapiens
NGGRWAWSM

SEQ ID NO: 577171 - protein, 9 aa, Homo Sapiens
LMLTIELPK

SEQ ID NO: 577172 - protein, 9 aa, Homo Sapiens
HALLYLFWL

SEQ ID NO: 577173 - protein, 9 aa, Homo Sapiens
EQPFPFQAS

SEQ ID NO: 577174 - protein, 9 aa, Homo Sapiens
KVTSLCVEA

SEQ ID NO: 577175 - protein, 9 aa, Homo Sapiens
MASANFKHV

SEQ ID NO: 577176 - protein, 9 aa, Homo Sapiens
KPYVYRECG

SEQ ID NO: 577177 - protein, 9 aa, Homo Sapiens
TADSENTSA

SEQ ID NO: 577178 - protein, 9 aa, Homo Sapiens
TQAQGGAII

SEQ ID NO: 577179 - protein, 9 aa, Homo Sapiens
ALLGSRGGP

SEQ ID NO: 577180 - protein, 9 aa, Homo Sapiens
IELETNHRA

SEQ ID NO: 577181 - protein, 9 aa, Homo Sapiens
SVLYGEEEV

SEQ ID NO: 577182 - protein, 9 aa, Homo Sapiens
PQQELFVPE

SEQ ID NO: 577183 - protein, 9 aa, Homo Sapiens
EVPATPATG

SEQ ID NO: 577184 - protein, 9 aa, Homo Sapiens
KAKTRSKTD

SEQ ID NO: 577185 - protein, 9 aa, Homo Sapiens
WEPDTCTAC

SEQ ID NO: 577186 - protein, 9 aa, Homo Sapiens
NIHLHALLY

SEQ ID NO: 577187 - protein, 9 aa, Homo Sapiens
RLEKKEKRR

SEQ ID NO: 577188 - protein, 9 aa, Homo Sapiens
FDEATAFSG

SEQ ID NO: 577189 - protein, 9 aa, Homo Sapiens
AQSKWKGEG

SEQ ID NO: 577190 - protein, 9 aa, Homo Sapiens
TSCASAGND

SEQ ID NO: 577191 - protein, 9 aa, Homo Sapiens
LQKVEKLNF

SEQ ID NO: 577192 - protein, 9 aa, Homo Sapiens
WNRAPSDVK

SEQ ID NO: 577193 - protein, 9 aa, Homo Sapiens
NTSASTTGS

SEQ ID NO: 577194 - protein, 9 aa, Homo Sapiens
VIGLSCELV

SEQ ID NO: 577195 - protein, 9 aa, Homo Sapiens
CDYADTQSA

SEQ ID NO: 577196 - protein, 9 aa, Homo Sapiens
HSIVVQLQC

SEQ ID NO: 577197 - protein, 9 aa, Homo Sapiens
VLLRSVSSS

SEQ ID NO: 577198 - protein, 9 aa, Homo Sapiens
SIVVQLQCI

SEQ ID NO: 577199 - protein, 9 aa, Homo Sapiens
VLYGEEEVP

SEQ ID NO: 577200 - protein, 9 aa, Homo Sapiens
YSNIRVAGG

SEQ ID NO: 577201 - protein, 9 aa, Homo Sapiens
KNGNAIFCH

SEQ ID NO: 577202 - protein, 9 aa, Homo Sapiens
PPGAAVLRL

SEQ ID NO: 577203 - protein, 9 aa, Homo Sapiens
HLTQQKDIS

SEQ ID NO: 577204 - protein, 9 aa, Homo Sapiens
DLNYEFYNS

SEQ ID NO: 577205 - protein, 9 aa, Homo Sapiens
HRVTWGSAQ

SEQ ID NO: 577206 - protein, 9 aa, Homo Sapiens
YAYDSNSSY

SEQ ID NO: 577207 - protein, 9 aa, Homo Sapiens
AQSPPGAAV

SEQ ID NO: 577208 - protein, 9 aa, Homo Sapiens
VEKLMDMKW

SEQ ID NO: 577209 - protein, 9 aa, Homo Sapiens
DHRQKYVII

SEQ ID NO: 577210 - protein, 9 aa, Homo Sapiens
YNAYQAVYA

SEQ ID NO: 577211 - protein, 9 aa, Homo Sapiens
DTCTACVCQ

SEQ ID NO: 577212 - protein, 9 aa, Homo Sapiens
SARDIREAL

SEQ ID NO: 577213 - protein, 9 aa, Homo Sapiens
IHKSEGRFH

SEQ ID NO: 577214 - protein, 9 aa, Homo Sapiens
TSSVSTAHT

SEQ ID NO: 577215 - protein, 9 aa, Homo Sapiens
IRVAGGAVC

SEQ ID NO: 577216 - protein, 9 aa, Homo Sapiens
SLTLREVSV

SEQ ID NO: 577217 - protein, 9 aa, Homo Sapiens
TWGSAQVFD

SEQ ID NO: 577218 - protein, 9 aa, Homo Sapiens
STSIMEKDL

SEQ ID NO: 577219 - protein, 9 aa, Homo Sapiens
FPFQASGHG

SEQ ID NO: 577220 - protein, 9 aa, Homo Sapiens
VVSWSYSQQ

SEQ ID NO: 577221 - protein, 9 aa, Homo Sapiens
KSFQKLSHL

SEQ ID NO: 577222 - protein, 9 aa, Homo Sapiens
NTYLTARQL

SEQ ID NO: 577223 - protein, 9 aa, Homo Sapiens
RRIHSELWN

SEQ ID NO: 577224 - protein, 9 aa, Homo Sapiens
TEKMLLQKV

SEQ ID NO: 577225 - protein, 9 aa, Homo Sapiens
HNTYLTARQ

SEQ ID NO: 577226 - protein, 9 aa, Homo Sapiens
RSFFDEATA

SEQ ID NO: 577227 - protein, 9 aa, Homo Sapiens
AEVPATPAT

SEQ ID NO: 577228 - protein, 9 aa, Homo Sapiens
IVVQLQCIN

SEQ ID NO: 577229 - protein, 9 aa, Homo Sapiens
SVPVLGSLL

SEQ ID NO: 577230 - protein, 9 aa, Homo Sapiens
QKGFSNESV

SEQ ID NO: 577231 - protein, 9 aa, Homo Sapiens
LIVFYAMFT

SEQ ID NO: 577232 - protein, 9 aa, Homo Sapiens
KKEKRREQA

SEQ ID NO: 577233 - protein, 9 aa, Homo Sapiens
AYNAYQAVY

SEQ ID NO: 577234 - protein, 9 aa, Homo Sapiens
PSTSSPSSS

SEQ ID NO: 577235 - protein, 9 aa, Homo Sapiens
VLTQAQGGA

SEQ ID NO: 577236 - protein, 9 aa, Homo Sapiens
CDGFVLTQA

SEQ ID NO: 577237 - protein, 9 aa, Homo Sapiens
REVSVGPCL

SEQ ID NO: 577238 - protein, 9 aa, Homo Sapiens
MLLQKVEKL

SEQ ID NO: 577239 - protein, 9 aa, Homo Sapiens
SRVLEQPFP

SEQ ID NO: 577240 - protein, 9 aa, Homo Sapiens
EDSARDIRE

SEQ ID NO: 577241 - protein, 9 aa, Homo Sapiens
RVLEQPFPF

SEQ ID NO: 577242 - protein, 9 aa, Homo Sapiens
VVVGFIRSV

SEQ ID NO: 577243 - protein, 9 aa, Homo Sapiens
VEQAAESCE

SEQ ID NO: 577244 - protein, 9 aa, Homo Sapiens
YHFLRKFSS

SEQ ID NO: 577245 - protein, 9 aa, Homo Sapiens
NIHSIVVQL

SEQ ID NO: 577246 - protein, 9 aa, Homo Sapiens
KCPVGEREQ

SEQ ID NO: 577247 - protein, 9 aa, Homo Sapiens
PYVYRECGR

SEQ ID NO: 577248 - protein, 9 aa, Homo Sapiens
EKSPDKEHR

SEQ ID NO: 577249 - protein, 9 aa, Homo Sapiens
QRSEIVKVI

SEQ ID NO: 577250 - protein, 9 aa, Homo Sapiens
SCASAGNDS

SEQ ID NO: 577251 - protein, 9 aa, Homo Sapiens
TQVLPHAHS

SEQ ID NO: 577252 - protein, 9 aa, Homo Sapiens
WVCDQGKHS

SEQ ID NO: 577253 - protein, 9 aa, Homo Sapiens
RILSDVTQV

SEQ ID NO: 577254 - protein, 9 aa, Homo Sapiens
QASDYFKAK

SEQ ID NO: 577255 - protein, 9 aa, Homo Sapiens
QAVYAVAHG

SEQ ID NO: 577256 - protein, 9 aa, Homo Sapiens
RDNELWAQH

SEQ ID NO: 577257 - protein, 9 aa, Homo Sapiens
TSLCVEANS

SEQ ID NO: 577258 - protein, 9 aa, Homo Sapiens
PVGKTGQYS

SEQ ID NO: 577259 - protein, 9 aa, Homo Sapiens
HLRKIRTST

SEQ ID NO: 577260 - protein, 9 aa, Homo Sapiens
LRKIRTSTS

SEQ ID NO: 577261 - protein, 9 aa, Homo Sapiens
NFNPHLIVF

SEQ ID NO: 577262 - protein, 9 aa, Homo Sapiens
LGNKFNHGA

SEQ ID NO: 577263 - protein, 9 aa, Homo Sapiens
MYLGIEELT

SEQ ID NO: 577264 - protein, 9 aa, Homo Sapiens
QAFARLEKK

SEQ ID NO: 577265 - protein, 9 aa, Homo Sapiens
QLAVFQKNE

SEQ ID NO: 577266 - protein, 9 aa, Homo Sapiens
SGSDNLSSS

SEQ ID NO: 577267 - protein, 9 aa, Homo Sapiens
HDHRQKYVI

SEQ ID NO: 577268 - protein, 9 aa, Homo Sapiens
NRNMSRKEK

SEQ ID NO: 577269 - protein, 9 aa, Homo Sapiens
RPCKCKLCG

SEQ ID NO: 577270 - protein, 9 aa, Homo Sapiens
SSSTSSPST

SEQ ID NO: 577271 - protein, 9 aa, Homo Sapiens
TGIFMGNAG

SEQ ID NO: 577272 - protein, 9 aa, Homo Sapiens
LTLREVSVG

SEQ ID NO: 577273 - protein, 9 aa, Homo Sapiens
QALAFESST

SEQ ID NO: 577274 - protein, 9 aa, Homo Sapiens
VFYAMFTAS

SEQ ID NO: 577275 - protein, 9 aa, Homo Sapiens
MDPFLVLLR

SEQ ID NO: 577276 - protein, 9 aa, Homo Sapiens
IHSELWNRA

SEQ ID NO: 577277 - protein, 9 aa, Homo Sapiens
ILKCIFTAL

SEQ ID NO: 577278 - protein, 9 aa, Homo Sapiens
LQCINKKVG

SEQ ID NO: 577279 - protein, 9 aa, Homo Sapiens
KTAFNKTRF

SEQ ID NO: 577280 - protein, 9 aa, Homo Sapiens
KKPRTTILK

SEQ ID NO: 577281 - protein, 9 aa, Homo Sapiens
NELWAQHAM

SEQ ID NO: 577282 - protein, 9 aa, Homo Sapiens
AATIMNLTE

SEQ ID NO: 577283 - protein, 9 aa, Homo Sapiens
QHVSGSDNL

SEQ ID NO: 577284 - protein, 9 aa, Homo Sapiens
LSPVSSNTR

SEQ ID NO: 577285 - protein, 9 aa, Homo Sapiens
ARDIREALH

SEQ ID NO: 577286 - protein, 9 aa, Homo Sapiens
DSPRRSQVL

SEQ ID NO: 577287 - protein, 9 aa, Homo Sapiens
FANEVAATI

SEQ ID NO: 577288 - protein, 9 aa, Homo Sapiens
HFLRKFSSD

SEQ ID NO: 577289 - protein, 9 aa, Homo Sapiens
NCSLELPRA

SEQ ID NO: 577290 - protein, 9 aa, Homo Sapiens
VPATPATGP

SEQ ID NO: 577291 - protein, 9 aa, Homo Sapiens
TYLTARQLA

SEQ ID NO: 577292 - protein, 9 aa, Homo Sapiens
GLRCRTYFV

SEQ ID NO: 577293 - protein, 9 aa, Homo Sapiens
DPGRSRVLE

SEQ ID NO: 577294 - protein, 9 aa, Homo Sapiens
PVYTTLTSP

SEQ ID NO: 577295 - protein, 9 aa, Homo Sapiens
KFSSDKGVF

SEQ ID NO: 577296 - protein, 9 aa, Homo Sapiens
FGGPTVYEN

SEQ ID NO: 577297 - protein, 9 aa, Homo Sapiens
ATAFSGGRN

SEQ ID NO: 577298 - protein, 9 aa, Homo Sapiens
EELKTQASD

SEQ ID NO: 577299 - protein, 9 aa, Homo Sapiens
KLMDMKWME

SEQ ID NO: 577300 - protein, 9 aa, Homo Sapiens
SPPGAAVLR

SEQ ID NO: 577301 - protein, 9 aa, Homo Sapiens
GEGKFILKL

SEQ ID NO: 577302 - protein, 9 aa, Homo Sapiens
GKLTSAQQE

SEQ ID NO: 577303 - protein, 9 aa, Homo Sapiens
PRASGPAKD

SEQ ID NO: 577304 - protein, 9 aa, Homo Sapiens
VGFIRSVPV

SEQ ID NO: 577305 - protein, 9 aa, Homo Sapiens
GREPMPPTL

SEQ ID NO: 577306 - protein, 9 aa, Homo Sapiens
ANFKHVIGL

SEQ ID NO: 577307 - protein, 9 aa, Homo Sapiens
SSVLGNKFN

SEQ ID NO: 577308 - protein, 9 aa, Homo Sapiens
AEEFWYLLM

SEQ ID NO: 577309 - protein, 9 aa, Homo Sapiens
TCTACVCQD

SEQ ID NO: 577310 - protein, 9 aa, Homo Sapiens
GEKPYVYRE

SEQ ID NO: 577311 - protein, 9 aa, Homo Sapiens
ISAQSPPGA

SEQ ID NO: 577312 - protein, 9 aa, Homo Sapiens
AIERWEDSP

SEQ ID NO: 577313 - protein, 9 aa, Homo Sapiens
PHLIVFYAM

SEQ ID NO: 577314 - protein, 9 aa, Homo Sapiens
TEASAVEQA

SEQ ID NO: 577315 - protein, 9 aa, Homo Sapiens
MKWDQFYSE

SEQ ID NO: 577316 - protein, 9 aa, Homo Sapiens
ERIRDNELW

SEQ ID NO: 577317 - protein, 9 aa, Homo Sapiens
SDNLSSSGQ

SEQ ID NO: 577318 - protein, 9 aa, Homo Sapiens
KVPVQRSEI

SEQ ID NO: 577319 - protein, 9 aa, Homo Sapiens
GTSAPDHAL

SEQ ID NO: 577320 - protein, 9 aa, Homo Sapiens
PVVVGFIRS

SEQ ID NO: 577321 - protein, 9 aa, Homo Sapiens
SVRGFWFLM

SEQ ID NO: 577322 - protein, 9 aa, Homo Sapiens
QSNSYWGET

SEQ ID NO: 577323 - protein, 9 aa, Homo Sapiens
ASNLRAGNY

SEQ ID NO: 577324 - protein, 9 aa, Homo Sapiens
LEDSARDIR

SEQ ID NO: 577325 - protein, 9 aa, Homo Sapiens
SHLRKIRTS

SEQ ID NO: 577326 - protein, 9 aa, Homo Sapiens
IERWEDSPR

SEQ ID NO: 577327 - protein, 9 aa, Homo Sapiens
QDLHDHRQK

SEQ ID NO: 577328 - protein, 9 aa, Homo Sapiens
SLCVEANSC

SEQ ID NO: 577329 - protein, 9 aa, Homo Sapiens
KPRTTILKC

SEQ ID NO: 577330 - protein, 9 aa, Homo Sapiens
FESSTGIFM

SEQ ID NO: 577331 - protein, 9 aa, Homo Sapiens
VCISVRGFW

SEQ ID NO: 577332 - protein, 9 aa, Homo Sapiens
PFQASGHGA

SEQ ID NO: 577333 - protein, 9 aa, Homo Sapiens
WEDSPRRSQ

SEQ ID NO: 577334 - protein, 9 aa, Homo Sapiens
NDLNYEFYN

SEQ ID NO: 577335 - protein, 9 aa, Homo Sapiens
RCRTYFVLC

SEQ ID NO: 577336 - protein, 9 aa, Homo Sapiens
VQLQCINKK

SEQ ID NO: 577337 - protein, 9 aa, Homo Sapiens
HLKIHSRKN

SEQ ID NO: 577338 - protein, 9 aa, Homo Sapiens
ASTADSENT

SEQ ID NO: 577339 - protein, 9 aa, Homo Sapiens
TRFQEVFDP

SEQ ID NO: 577340 - protein, 9 aa, Homo Sapiens
LRCRTYFVL

SEQ ID NO: 577341 - protein, 9 aa, Homo Sapiens
RTTILKCIF

SEQ ID NO: 577342 - protein, 9 aa, Homo Sapiens
KTRLPVGKT

SEQ ID NO: 577343 - protein, 9 aa, Homo Sapiens
LPRASGPAK

SEQ ID NO: 577344 - protein, 9 aa, Homo Sapiens
LCSSAVVSW

SEQ ID NO: 577345 - protein, 9 aa, Homo Sapiens
LLYKTPIDF

SEQ ID NO: 577346 - protein, 9 aa, Homo Sapiens
DHALHGKKN

SEQ ID NO: 577347 - protein, 9 aa, Homo Sapiens
DSENTSAST

SEQ ID NO: 577348 - protein, 9 aa, Homo Sapiens
KSPDKEHRC

SEQ ID NO: 577349 - protein, 9 aa, Homo Sapiens
GEREQLEET

SEQ ID NO: 577350 - protein, 9 aa, Homo Sapiens
TNSPTMMIM

SEQ ID NO: 577351 - protein, 9 aa, Homo Sapiens
VLPHAHSAC

SEQ ID NO: 577352 - protein, 9 aa, Homo Sapiens
GALLGSRGG

SEQ ID NO: 577353 - protein, 9 aa, Homo Sapiens
MIMVGLPAR

SEQ ID NO: 577354 - protein, 9 aa, Homo Sapiens
EGKFILKLK

SEQ ID NO: 577355 - protein, 9 aa, Homo Sapiens
MLTIELPKP

SEQ ID NO: 577356 - protein, 9 aa, Homo Sapiens
QLNFAFTGR

SEQ ID NO: 577357 - protein, 9 aa, Homo Sapiens
DGFVLTQAQ

SEQ ID NO: 577358 - protein, 9 aa, Homo Sapiens
QAEVPATPA

SEQ ID NO: 577359 - protein, 9 aa, Homo Sapiens
TLREVSVGP

SEQ ID NO: 577360 - protein, 9 aa, Homo Sapiens
PTVYENPHY

SEQ ID NO: 577361 - protein, 9 aa, Homo Sapiens
AIELETNHR

SEQ ID NO: 577362 - protein, 9 aa, Homo Sapiens
KIRTSTSIM

SEQ ID NO: 577363 - protein, 9 aa, Homo Sapiens
STSSPSTSS

SEQ ID NO: 577364 - protein, 9 aa, Homo Sapiens
WGSAQVFDL

SEQ ID NO: 577365 - protein, 9 aa, Homo Sapiens
QKIKVTSLC

SEQ ID NO: 577366 - protein, 9 aa, Homo Sapiens
SSAVVSWSY

SEQ ID NO: 577367 - protein, 9 aa, Homo Sapiens
SFLSPVSSN

SEQ ID NO: 577368 - protein, 9 aa, Homo Sapiens
SGHGALLGS

SEQ ID NO: 577369 - protein, 9 aa, Homo Sapiens
LLRSVSSSL

SEQ ID NO: 577370 - protein, 9 aa, Homo Sapiens
FQKLSHLTQ

SEQ ID NO: 577371 - protein, 9 aa, Homo Sapiens
GFIRSVPVL

SEQ ID NO: 577372 - protein, 9 aa, Homo Sapiens
RGFWFLMYP

SEQ ID NO: 577373 - protein, 9 aa, Homo Sapiens
VYENPHYQS

SEQ ID NO: 577374 - protein, 9 aa, Homo Sapiens
KLSEADNRN

SEQ ID NO: 577375 - protein, 9 aa, Homo Sapiens
GARWEPDTC

SEQ ID NO: 577376 - protein, 9 aa, Homo Sapiens
STADSENTS

SEQ ID NO: 577377 - protein, 9 aa, Homo Sapiens
GERPCKCKL

SEQ ID NO: 577378 - protein, 9 aa, Homo Sapiens
SSELSEHLK

SEQ ID NO: 577379 - protein, 9 aa, Homo Sapiens
LPVGKTGQY

SEQ ID NO: 577380 - protein, 9 aa, Homo Sapiens
IHLHALLYL

SEQ ID NO: 577381 - protein, 9 aa, Homo Sapiens
WFQIFDMKW

SEQ ID NO: 577382 - protein, 9 aa, Homo Sapiens
GNYDIPSAD

SEQ ID NO: 577383 - protein, 9 aa, Homo Sapiens
RQLQKIHKS

SEQ ID NO: 577384 - protein, 9 aa, Homo Sapiens
NFAFTGRTP

SEQ ID NO: 577385 - protein, 9 aa, Homo Sapiens
PATPATGPG

SEQ ID NO: 577386 - protein, 9 aa, Homo Sapiens
NKFNHGAEA

SEQ ID NO: 577387 - protein, 9 aa, Homo Sapiens
ENTSASTTG

SEQ ID NO: 577388 - protein, 9 aa, Homo Sapiens
SPDKEHRCI

SEQ ID NO: 577389 - protein, 9 aa, Homo Sapiens
NAIFCHLLG

SEQ ID NO: 577390 - protein, 9 aa, Homo Sapiens
DISESNIAY

SEQ ID NO: 577391 - protein, 9 aa, Homo Sapiens
RWEPDTCTA

SEQ ID NO: 577392 - protein, 9 aa, Homo Sapiens
VAQAEVPAT

SEQ ID NO: 577393 - protein, 9 aa, Homo Sapiens
SDQHLDCAL

SEQ ID NO: 577394 - protein, 9 aa, Homo Sapiens
RQKYVIILD

SEQ ID NO: 577395 - protein, 9 aa, Homo Sapiens
WLLLKFRQR

SEQ ID NO: 577396 - protein, 9 aa, Homo Sapiens
NAYQAVYAV

SEQ ID NO: 577397 - protein, 9 aa, Homo Sapiens
IFDMKWDQF

SEQ ID NO: 577398 - protein, 9 aa, Homo Sapiens
LLKFRQRRC

SEQ ID NO: 577399 - protein, 9 aa, Homo Sapiens
LKFRQRRCQ

SEQ ID NO: 577400 - protein, 9 aa, Homo Sapiens
LRKFSSDKG

SEQ ID NO: 577401 - protein, 9 aa, Homo Sapiens
WYLLMLTIE

SEQ ID NO: 577402 - protein, 9 aa, Homo Sapiens
ASAGNDSKP

SEQ ID NO: 577403 - protein, 9 aa, Homo Sapiens
LSSSGQHIS

SEQ ID NO: 577404 - protein, 9 aa, Homo Sapiens
TSSPSTSSP

SEQ ID NO: 577405 - protein, 9 aa, Homo Sapiens
ADSENTSAS

SEQ ID NO: 577406 - protein, 9 aa, Homo Sapiens
HLDCALDLM

SEQ ID NO: 577407 - protein, 9 aa, Homo Sapiens
SGQRVTTWV

SEQ ID NO: 577408 - protein, 9 aa, Homo Sapiens
AYDSNSSYE

SEQ ID NO: 577409 - protein, 9 aa, Homo Sapiens
HTGERPCKC

SEQ ID NO: 577410 - protein, 9 aa, Homo Sapiens
ELSEHLKIH

SEQ ID NO: 577411 - protein, 9 aa, Homo Sapiens
DMKWDQFYS

SEQ ID NO: 577412 - protein, 9 aa, Homo Sapiens
LNYEFYNST

SEQ ID NO: 577413 - protein, 9 aa, Homo Sapiens
DNLSSSGQH

SEQ ID NO: 577414 - protein, 9 aa, Homo Sapiens
AAESCEVQE

SEQ ID NO: 577415 - protein, 9 aa, Homo Sapiens
VLAVLEDSA

SEQ ID NO: 577416 - protein, 9 aa, Homo Sapiens
RREQEEREQ

SEQ ID NO: 577417 - protein, 9 aa, Homo Sapiens
SAVEQAAES

SEQ ID NO: 577418 - protein, 9 aa, Homo Sapiens
AFESSTGIF

SEQ ID NO: 577419 - protein, 9 aa, Homo Sapiens
RWEDSPRRS

SEQ ID NO: 577420 - protein, 9 aa, Homo Sapiens
LHALLYLFW

SEQ ID NO: 577421 - protein, 9 aa, Homo Sapiens
FQIFDMKWD

SEQ ID NO: 577422 - protein, 9 aa, Homo Sapiens
LREVSVGPC

SEQ ID NO: 577423 - protein, 9 aa, Homo Sapiens
NGNAIFCHL

SEQ ID NO: 577424 - protein, 9 aa, Homo Sapiens
IRTSTSIME

SEQ ID NO: 577425 - protein, 9 aa, Homo Sapiens
PDHALHGKK

SEQ ID NO: 577426 - protein, 9 aa, Homo Sapiens
SFFDEATAF

SEQ ID NO: 577427 - protein, 9 aa, Homo Sapiens
YRSFFDEAT

SEQ ID NO: 577428 - protein, 9 aa, Homo Sapiens
FVQDLHDHR

SEQ ID NO: 577429 - protein, 9 aa, Homo Sapiens
QLQKIHKSE

SEQ ID NO: 577430 - protein, 9 aa, Homo Sapiens
VRGFWFLMY

SEQ ID NO: 577431 - protein, 9 aa, Homo Sapiens
LTVPEKSPD

SEQ ID NO: 577432 - protein, 9 aa, Homo Sapiens
VTSLCVEAN

SEQ ID NO: 577433 - protein, 9 aa, Homo Sapiens
HGALLGSRG

SEQ ID NO: 577434 - protein, 9 aa, Homo Sapiens
NHGAEAIMP

SEQ ID NO: 577435 - protein, 9 aa, Homo Sapiens
ERPCKCKLC

SEQ ID NO: 577436 - protein, 9 aa, Homo Sapiens
YSISVLYGE

SEQ ID NO: 577437 - protein, 9 aa, Homo Sapiens
DNYMYLGIE

SEQ ID NO: 577438 - protein, 9 aa, Homo Sapiens
LFANEVAAT

SEQ ID NO: 577439 - protein, 9 aa, Homo Sapiens
EKKEKRREQ

SEQ ID NO: 577440 - protein, 9 aa, Homo Sapiens
ADTQSASLK

SEQ ID NO: 577441 - protein, 9 aa, Homo Sapiens
YSTSVPLNT

SEQ ID NO: 577442 - protein, 9 aa, Homo Sapiens
AASNLRAGN

SEQ ID NO: 577443 - protein, 9 aa, Homo Sapiens
PRHTSCASA

SEQ ID NO: 577444 - protein, 9 aa, Homo Sapiens
GNKFNHGAE

SEQ ID NO: 577445 - protein, 9 aa, Homo Sapiens
SEIVKVILR

SEQ ID NO: 577446 - protein, 9 aa, Homo Sapiens
YVYRECGRG

SEQ ID NO: 577447 - protein, 9 aa, Homo Sapiens
PGAAVLRLR

SEQ ID NO: 577448 - protein, 9 aa, Homo Sapiens
VLEQPFPFQ

SEQ ID NO: 577449 - protein, 9 aa, Homo Sapiens
VAGGAVCEQ

SEQ ID NO: 577450 - protein, 9 aa, Homo Sapiens
REQEEREQQ

SEQ ID NO: 577451 - protein, 9 aa, Homo Sapiens
HLIVFYAMF

SEQ ID NO: 577452 - protein, 9 aa, Homo Sapiens
SAQSPPGAA

SEQ ID NO: 577453 - protein, 9 aa, Homo Sapiens
YLTARQLAG

SEQ ID NO: 577454 - protein, 9 aa, Homo Sapiens
NHRVTWGSA

SEQ ID NO: 577455 - protein, 9 aa, Homo Sapiens
QQKDISESN

SEQ ID NO: 577456 - protein, 9 aa, Homo Sapiens
TTWVCDQGK

SEQ ID NO: 577457 - protein, 9 aa, Homo Sapiens
SPSTSSPSS

SEQ ID NO: 577458 - protein, 9 aa, Homo Sapiens
MDMKWMEKK

SEQ ID NO: 577459 - protein, 9 aa, Homo Sapiens
WSMPGWGPA

SEQ ID NO: 577460 - protein, 9 aa, Homo Sapiens
AFNKTRFQE

SEQ ID NO: 577461 - protein, 9 aa, Homo Sapiens
SRNCAIELE

SEQ ID NO: 577462 - protein, 9 aa, Homo Sapiens
PKPRHTSCA

SEQ ID NO: 577463 - protein, 9 aa, Homo Sapiens
SYEWSLPSD

SEQ ID NO: 577464 - protein, 9 aa, Homo Sapiens
NSSYEWSLP

SEQ ID NO: 577465 - protein, 9 aa, Homo Sapiens
HRQKYVIIL

SEQ ID NO: 577466 - protein, 9 aa, Homo Sapiens
EQEEREQQL

SEQ ID NO: 577467 - protein, 9 aa, Homo Sapiens
LAFESSTGI

SEQ ID NO: 577468 - protein, 9 aa, Homo Sapiens
FIRSVPVLG

SEQ ID NO: 577469 - protein, 9 aa, Homo Sapiens
SNIRVAGGA

SEQ ID NO: 577470 - protein, 9 aa, Homo Sapiens
RWAWSMPGW

SEQ ID NO: 577471 - protein, 9 aa, Homo Sapiens
RHTSCASAG

SEQ ID NO: 577472 - protein, 9 aa, Homo Sapiens
QAQGGAIIC

SEQ ID NO: 577473 - protein, 9 aa, Homo Sapiens
CLECEGLTE

SEQ ID NO: 577474 - protein, 9 aa, Homo Sapiens
RIRDNELWA

SEQ ID NO: 577475 - protein, 9 aa, Homo Sapiens
KAKAKTRSK

SEQ ID NO: 577476 - protein, 9 aa, Homo Sapiens
YNIHLHALL

SEQ ID NO: 577477 - protein, 9 aa, Homo Sapiens
PENNGPGAS

SEQ ID NO: 577478 - protein, 9 aa, Homo Sapiens
AQAEVPATP

SEQ ID NO: 577479 - protein, 9 aa, Homo Sapiens
SSPSTSSPS

SEQ ID NO: 577480 - protein, 9 aa, Homo Sapiens
LAFQKGFSN

SEQ ID NO: 577481 - protein, 9 aa, Homo Sapiens
LLLKFRQRR

SEQ ID NO: 577482 - protein, 9 aa, Homo Sapiens
SSEYSTSVP

SEQ ID NO: 577483 - protein, 9 aa, Homo Sapiens
QHLDCALDL

SEQ ID NO: 577484 - protein, 9 aa, Homo Sapiens
LRAGNYDIP

SEQ ID NO: 577485 - protein, 9 aa, Homo Sapiens
GHGALLGSR

SEQ ID NO: 577486 - protein, 9 aa, Homo Sapiens
TGERPCKCK

SEQ ID NO: 577487 - protein, 9 aa, Homo Sapiens
SPRRSQVLQ

SEQ ID NO: 577488 - protein, 9 aa, Homo Sapiens
FQKGFSNES

SEQ ID NO: 577489 - protein, 9 aa, Homo Sapiens
NTRDAGRRH

SEQ ID NO: 577490 - protein, 9 aa, Homo Sapiens
IVKVILREY

SEQ ID NO: 577491 - protein, 9 aa, Homo Sapiens
ASAVEQAAE

SEQ ID NO: 577492 - protein, 9 aa, Homo Sapiens
WAWSMPGWG

SEQ ID NO: 577493 - protein, 9 aa, Homo Sapiens
CPHCDYADT

SEQ ID NO: 577494 - protein, 9 aa, Homo Sapiens
QQQVSAHQE

SEQ ID NO: 577495 - protein, 9 aa, Homo Sapiens
RNCAIELET

SEQ ID NO: 577496 - protein, 9 aa, Homo Sapiens
ECGKSFQKL

SEQ ID NO: 577497 - protein, 9 aa, Homo Sapiens
SNSYWGETL

SEQ ID NO: 577498 - protein, 9 aa, Homo Sapiens
ELWNRAPSD

SEQ ID NO: 577499 - protein, 9 aa, Homo Sapiens
KQLNFAFTG

SEQ ID NO: 577500 - protein, 9 aa, Homo Sapiens
AVEQAAESC

SEQ ID NO: 577501 - protein, 9 aa, Homo Sapiens
CSLELPRAS

SEQ ID NO: 577502 - protein, 9 aa, Homo Sapiens
LQKIHKSEG

SEQ ID NO: 577503 - protein, 9 aa, Homo Sapiens
QEEREQQLR

SEQ ID NO: 577504 - protein, 9 aa, Homo Sapiens
SAQQENTSL

SEQ ID NO: 577505 - protein, 9 aa, Homo Sapiens
KHVIGLSCE

SEQ ID NO: 577506 - protein, 9 aa, Homo Sapiens
NWIAGFGRE

SEQ ID NO: 577507 - protein, 9 aa, Homo Sapiens
EVSVGPCLT

SEQ ID NO: 577508 - protein, 9 aa, Homo Sapiens
FSSDKGVFS

SEQ ID NO: 577509 - protein, 9 aa, Homo Sapiens
KINNDLNYE

SEQ ID NO: 577510 - protein, 9 aa, Homo Sapiens
MMIMVGLPA

SEQ ID NO: 577511 - protein, 9 aa, Homo Sapiens
ALLYLFWLL

SEQ ID NO: 577512 - protein, 9 aa, Homo Sapiens
KLSHLTQHK

SEQ ID NO: 577513 - protein, 9 aa, Homo Sapiens
ELFVPENNG

SEQ ID NO: 577514 - protein, 9 aa, Homo Sapiens
TPATGPGPH

SEQ ID NO: 577515 - protein, 9 aa, Homo Sapiens
HKSEGRFHV

SEQ ID NO: 577516 - protein, 9 aa, Homo Sapiens
LECEGLTER

SEQ ID NO: 577517 - protein, 9 aa, Homo Sapiens
RSKTDAVAE

SEQ ID NO: 577518 - protein, 9 aa, Homo Sapiens
QLQCINKKV

SEQ ID NO: 577519 - protein, 9 aa, Homo Sapiens
DSLLYKTPI

SEQ ID NO: 577520 - protein, 9 aa, Homo Sapiens
YDSNSSYEW

SEQ ID NO: 577521 - protein, 9 aa, Homo Sapiens
HVSGSDNLS

SEQ ID NO: 577522 - protein, 9 aa, Homo Sapiens
GRWAWSMPG

SEQ ID NO: 577523 - protein, 9 aa, Homo Sapiens
ENHLTQQKD

SEQ ID NO: 577524 - protein, 9 aa, Homo Sapiens
TILKCIFTA

SEQ ID NO: 577525 - protein, 9 aa, Homo Sapiens
CEGLTERRE

SEQ ID NO: 577526 - protein, 9 aa, Homo Sapiens
SELSEHLKI

SEQ ID NO: 577527 - protein, 9 aa, Homo Sapiens
KLTSAQQEN

SEQ ID NO: 577528 - protein, 9 aa, Homo Sapiens
AAVLRLRAH

SEQ ID NO: 577529 - protein, 9 aa, Homo Sapiens
QPQQELFVP

SEQ ID NO: 577530 - protein, 9 aa, Homo Sapiens
VGEREQLEE

SEQ ID NO: 577531 - protein, 9 aa, Homo Sapiens
MSDQHLDCA

SEQ ID NO: 577532 - protein, 9 aa, Homo Sapiens
SNTRDAGRR

SEQ ID NO: 577533 - protein, 9 aa, Homo Sapiens
DTQSASLKY

SEQ ID NO: 577534 - protein, 9 aa, Homo Sapiens
VAATIMNLT

SEQ ID NO: 577535 - protein, 9 aa, Homo Sapiens
RAKAKAKTR

SEQ ID NO: 577536 - protein, 9 aa, Homo Sapiens
FLVCISVRG

SEQ ID NO: 577537 - protein, 9 aa, Homo Sapiens
WMEKKAYMK

SEQ ID NO: 577538 - protein, 9 aa, Homo Sapiens
LYLFWLLVG

SEQ ID NO: 577539 - protein, 9 aa, Homo Sapiens
EREQQLRRE

SEQ ID NO: 577540 - protein, 9 aa, Homo Sapiens
FQASGHGAL

SEQ ID NO: 577541 - protein, 9 aa, Homo Sapiens
HTGEKPYVY

SEQ ID NO: 577542 - protein, 9 aa, Homo Sapiens
RKFSSDKGV

SEQ ID NO: 577543 - protein, 9 aa, Homo Sapiens
QQELFVPEN

SEQ ID NO: 577544 - protein, 9 aa, Homo Sapiens
SELWNRAPS

SEQ ID NO: 577545 - protein, 9 aa, Homo Sapiens
GRSRVLEQP

SEQ ID NO: 577546 - protein, 9 aa, Homo Sapiens
KIKVTSLCV

SEQ ID NO: 577547 - protein, 9 aa, Homo Sapiens
RIHTGERPC

SEQ ID NO: 577548 - protein, 9 aa, Homo Sapiens
AVVSWSYSQ

SEQ ID NO: 577549 - protein, 9 aa, Homo Sapiens
LWAQHAMLG

SEQ ID NO: 577550 - protein, 9 aa, Homo Sapiens
QSSELSEHL

SEQ ID NO: 577551 - protein, 9 aa, Homo Sapiens
FNKTRFQEV

SEQ ID NO: 577552 - protein, 9 aa, Homo Sapiens
LELPRASGP

SEQ ID NO: 577553 - protein, 9 aa, Homo Sapiens
GGPTVYENP

SEQ ID NO: 577554 - protein, 9 aa, Homo Sapiens
SVLGNKFNH

SEQ ID NO: 577555 - protein, 9 aa, Homo Sapiens
LKTQASDYF

SEQ ID NO: 577556 - protein, 9 aa, Homo Sapiens
KIHKSEGRF

SEQ ID NO: 577557 - protein, 9 aa, Homo Sapiens
INNDLNYEF

SEQ ID NO: 577558 - protein, 9 aa, Homo Sapiens
LAVFQKNEL

SEQ ID NO: 577559 - protein, 9 aa, Homo Sapiens
PVSSNTRDA

SEQ ID NO: 577560 - protein, 9 aa, Homo Sapiens
SVPLNTPEK

SEQ ID NO: 577561 - protein, 9 aa, Homo Sapiens
LSEADNRNM

SEQ ID NO: 577562 - protein, 9 aa, Homo Sapiens
VVGFIRSVP

SEQ ID NO: 577563 - protein, 9 aa, Homo Sapiens
HFGESTTGF

SEQ ID NO: 577564 - protein, 9 aa, Homo Sapiens
PTNHRVTWG

SEQ ID NO: 577565 - protein, 9 aa, Homo Sapiens
KMLLQKVEK

SEQ ID NO: 577566 - protein, 9 aa, Homo Sapiens
QPFPFQASG

SEQ ID NO: 577567 - protein, 9 aa, Homo Sapiens
ARLEKKEKR

SEQ ID NO: 577568 - protein, 9 aa, Homo Sapiens
ATPATGPGP

SEQ ID NO: 577569 - protein, 9 aa, Homo Sapiens
LTSAQQENT

SEQ ID NO: 577570 - protein, 9 aa, Homo Sapiens
KGFSNESVP

SEQ ID NO: 577571 - protein, 9 aa, Homo Sapiens
LSDVTQVLP

SEQ ID NO: 577572 - protein, 9 aa, Homo Sapiens
GGRWAWSMP

SEQ ID NO: 577573 - protein, 9 aa, Homo Sapiens
ATIMNLTEF

SEQ ID NO: 577574 - protein, 9 aa, Homo Sapiens
KCPHCDYAD

SEQ ID NO: 577575 - protein, 9 aa, Homo Sapiens
QKVEKLNFE

SEQ ID NO: 577576 - protein, 9 aa, Homo Sapiens
VSTAHTTPL

SEQ ID NO: 577577 - protein, 9 aa, Homo Sapiens
YMYLGIEEL

SEQ ID NO: 577578 - protein, 9 aa, Homo Sapiens
TNHRVTWGS

SEQ ID NO: 577579 - protein, 9 aa, Homo Sapiens
EEHKCPVGE

SEQ ID NO: 577580 - protein, 9 aa, Homo Sapiens
SAYNAYQAV

SEQ ID NO: 577581 - protein, 9 aa, Homo Sapiens
DEATAFSGG

SEQ ID NO: 577582 - protein, 9 aa, Homo Sapiens
FCHLLGDRI

SEQ ID NO: 577583 - protein, 9 aa, Homo Sapiens
GSDNLSSSG

SEQ ID NO: 577584 - protein, 9 aa, Homo Sapiens
LYGEEEVPR

SEQ ID NO: 577585 - protein, 9 aa, Homo Sapiens
QELFVPENN

SEQ ID NO: 577586 - protein, 9 aa, Homo Sapiens
NLRAGNYDI

SEQ ID NO: 577587 - protein, 9 aa, Homo Sapiens
ETNHRAESQ

SEQ ID NO: 577588 - protein, 9 aa, Homo Sapiens
MKWMEKKAY

SEQ ID NO: 577589 - protein, 9 aa, Homo Sapiens
LLQKVEKLN

SEQ ID NO: 577590 - protein, 9 aa, Homo Sapiens
VSGSDNLSS

SEQ ID NO: 577591 - protein, 9 aa, Homo Sapiens
NKTRFQEVF

SEQ ID NO: 577592 - protein, 9 aa, Homo Sapiens
EPMPPTLLG

SEQ ID NO: 577593 - protein, 9 aa, Homo Sapiens
NPHLIVFYA

SEQ ID NO: 577594 - protein, 9 aa, Homo Sapiens
CRTYFVLCG

SEQ ID NO: 577595 - protein, 9 aa, Homo Sapiens
GNAIFCHLL

SEQ ID NO: 577596 - protein, 9 aa, Homo Sapiens
KTRFQEVFD

SEQ ID NO: 577597 - protein, 9 aa, Homo Sapiens
NHLTQQKDI

SEQ ID NO: 577598 - protein, 9 aa, Homo Sapiens
TQASDYFKA

SEQ ID NO: 577599 - protein, 9 aa, Homo Sapiens
QKDISESNI

SEQ ID NO: 577600 - protein, 9 aa, Homo Sapiens
TTILKCIFT

SEQ ID NO: 577601 - protein, 9 aa, Homo Sapiens
NIRVAGGAV

SEQ ID NO: 577602 - protein, 9 aa, Homo Sapiens
QHDPGRSRV

SEQ ID NO: 577603 - protein, 9 aa, Homo Sapiens
EADNRNMSR

SEQ ID NO: 577604 - protein, 9 aa, Homo Sapiens
DSARDIREA

SEQ ID NO: 577605 - protein, 9 aa, Homo Sapiens
LHDHRQKYV

SEQ ID NO: 577606 - protein, 9 aa, Homo Sapiens
NLSSSGQHI

SEQ ID NO: 577607 - protein, 9 aa, Homo Sapiens
CISVRGFWF

SEQ ID NO: 577608 - protein, 9 aa, Homo Sapiens
SYWGETLQM

SEQ ID NO: 577609 - protein, 9 aa, Homo Sapiens
QASGHGALL

SEQ ID NO: 577610 - protein, 9 aa, Homo Sapiens
VKINNDLNY

SEQ ID NO: 577611 - protein, 9 aa, Homo Sapiens
CKCKLCGKG

SEQ ID NO: 577612 - protein, 9 aa, Homo Sapiens
EIVKVILRE

SEQ ID NO: 577613 - protein, 9 aa, Homo Sapiens
AQQENTSLS

SEQ ID NO: 577614 - protein, 9 aa, Homo Sapiens
SVSTAHTTP

SEQ ID NO: 577615 - protein, 9 aa, Homo Sapiens
VPLNTPEKG

SEQ ID NO: 577616 - protein, 9 aa, Homo Sapiens
RSVSSSLSS

SEQ ID NO: 577617 - protein, 9 aa, Homo Sapiens
HLHALLYLF

SEQ ID NO: 577618 - protein, 9 aa, Homo Sapiens
VEVVQHDPG

SEQ ID NO: 577619 - protein, 9 aa, Homo Sapiens
LVCISVRGF

SEQ ID NO: 577620 - protein, 9 aa, Homo Sapiens
YLLMLTIEL

SEQ ID NO: 577621 - protein, 9 aa, Homo Sapiens
QAQSKWKGE

SEQ ID NO: 577622 - protein, 9 aa, Homo Sapiens
ADNRNMSRK

SEQ ID NO: 577623 - protein, 9 aa, Homo Sapiens
TMMIMVGLP

SEQ ID NO: 577624 - protein, 9 aa, Homo Sapiens
PDTCTACVC

SEQ ID NO: 577625 - protein, 9 aa, Homo Sapiens
TSAQQENTS

SEQ ID NO: 577626 - protein, 9 aa, Homo Sapiens
KWMEKKAYM

SEQ ID NO: 577627 - protein, 9 aa, Homo Sapiens
KVEKLNFEN

SEQ ID NO: 577628 - protein, 9 aa, Homo Sapiens
FWYLLMLTI

SEQ ID NO: 577629 - protein, 9 aa, Homo Sapiens
STSVPLNTP

SEQ ID NO: 577630 - protein, 9 aa, Homo Sapiens
LLMLTIELP

SEQ ID NO: 577631 - protein, 9 aa, Homo Sapiens
RTSTSIMEK

SEQ ID NO: 577632 - protein, 9 aa, Homo Sapiens
AAIERWEDS

SEQ ID NO: 577633 - protein, 9 aa, Homo Sapiens
VVQHDPGRS

SEQ ID NO: 577634 - protein, 9 aa, Homo Sapiens
GRRIHSELW

SEQ ID NO: 577635 - protein, 9 aa, Homo Sapiens
LWNRAPSDV

SEQ ID NO: 577636 - protein, 9 aa, Homo Sapiens
VSSNTRDAG

SEQ ID NO: 577637 - protein, 9 aa, Homo Sapiens
LRREQEERE

SEQ ID NO: 577638 - protein, 9 aa, Homo Sapiens
AVLEDSARD

SEQ ID NO: 577639 - protein, 9 aa, Homo Sapiens
AKAKAKTRS

SEQ ID NO: 577640 - protein, 9 aa, Homo Sapiens
EFWYLLMLT

SEQ ID NO: 577641 - protein, 9 aa, Homo Sapiens
ELRRKPLEE

SEQ ID NO: 577642 - protein, 9 aa, Homo Sapiens
IETHKRIRT

SEQ ID NO: 577643 - protein, 9 aa, Homo Sapiens
QKTQASEDL

SEQ ID NO: 577644 - protein, 9 aa, Homo Sapiens
FFNLNRSSR

SEQ ID NO: 577645 - protein, 9 aa, Homo Sapiens
WALIAWEGP

SEQ ID NO: 577646 - protein, 9 aa, Homo Sapiens
LAYPLHFYE

SEQ ID NO: 577647 - protein, 9 aa, Homo Sapiens
FGQKSSLES

SEQ ID NO: 577648 - protein, 9 aa, Homo Sapiens
GNMLVGDPT

SEQ ID NO: 577649 - protein, 9 aa, Homo Sapiens
SFKCKCDSG

SEQ ID NO: 577650 - protein, 9 aa, Homo Sapiens
PEGAGFKRH

SEQ ID NO: 577651 - protein, 9 aa, Homo Sapiens
FGMAKKYRD

SEQ ID NO: 577652 - protein, 9 aa, Homo Sapiens
ESQLSLSFY

SEQ ID NO: 577653 - protein, 9 aa, Homo Sapiens
PAGPAWLTA

SEQ ID NO: 577654 - protein, 9 aa, Homo Sapiens
DAGAPRRGP

SEQ ID NO: 577655 - protein, 9 aa, Homo Sapiens
DFDSHYTLL

SEQ ID NO: 577656 - protein, 9 aa, Homo Sapiens
GDIPKSPAK

SEQ ID NO: 577657 - protein, 9 aa, Homo Sapiens
ELKDRQSRL

SEQ ID NO: 577658 - protein, 9 aa, Homo Sapiens
MKTKGEKVQ

SEQ ID NO: 577659 - protein, 9 aa, Homo Sapiens
ASQRMAWDV

SEQ ID NO: 577660 - protein, 9 aa, Homo Sapiens
VIPKRIPDI

SEQ ID NO: 577661 - protein, 9 aa, Homo Sapiens
QNLLSAVSN

SEQ ID NO: 577662 - protein, 9 aa, Homo Sapiens
NMLVGDPTH

SEQ ID NO: 577663 - protein, 9 aa, Homo Sapiens
DHHWKQLMK

SEQ ID NO: 577664 - protein, 9 aa, Homo Sapiens
TVSRPYYFI

SEQ ID NO: 577665 - protein, 9 aa, Homo Sapiens
GAGFKRHLP

SEQ ID NO: 577666 - protein, 9 aa, Homo Sapiens
NNVIPKRIP

SEQ ID NO: 577667 - protein, 9 aa, Homo Sapiens
SWREEALGL

SEQ ID NO: 577668 - protein, 9 aa, Homo Sapiens
SRPLGAAPR

SEQ ID NO: 577669 - protein, 9 aa, Homo Sapiens
DRFAASNCG

SEQ ID NO: 577670 - protein, 9 aa, Homo Sapiens
LRAQRAAGG

SEQ ID NO: 577671 - protein, 9 aa, Homo Sapiens
AFRSWREEA

SEQ ID NO: 577672 - protein, 9 aa, Homo Sapiens
AEAPSQGWS

SEQ ID NO: 577673 - protein, 9 aa, Homo Sapiens
GPHNAPCAK

SEQ ID NO: 577674 - protein, 9 aa, Homo Sapiens
RRSNVFGDK

SEQ ID NO: 577675 - protein, 9 aa, Homo Sapiens
NCGKERFVK

SEQ ID NO: 577676 - protein, 9 aa, Homo Sapiens
GAHQGPPGS

SEQ ID NO: 577677 - protein, 9 aa, Homo Sapiens
GMGSRCGGE

SEQ ID NO: 577678 - protein, 9 aa, Homo Sapiens
THVINLLRE

SEQ ID NO: 577679 - protein, 9 aa, Homo Sapiens
NIGDVRCYI

SEQ ID NO: 577680 - protein, 9 aa, Homo Sapiens
SQHCKSEEG

SEQ ID NO: 577681 - protein, 9 aa, Homo Sapiens
NDVHVCNEK

SEQ ID NO: 577682 - protein, 9 aa, Homo Sapiens
HTKLTPAST

SEQ ID NO: 577683 - protein, 9 aa, Homo Sapiens
YPYVQSCND

SEQ ID NO: 577684 - protein, 9 aa, Homo Sapiens
RSWILTASA

SEQ ID NO: 577685 - protein, 9 aa, Homo Sapiens
ALALILGTS

SEQ ID NO: 577686 - protein, 9 aa, Homo Sapiens
YSSLFPETE

SEQ ID NO: 577687 - protein, 9 aa, Homo Sapiens
HRSWTVSSP

SEQ ID NO: 577688 - protein, 9 aa, Homo Sapiens
CEAQLLQLY

SEQ ID NO: 577689 - protein, 9 aa, Homo Sapiens
NGPIFSSTP

SEQ ID NO: 577690 - protein, 9 aa, Homo Sapiens
SNSPGESEE

SEQ ID NO: 577691 - protein, 9 aa, Homo Sapiens
TDSPALNKM

SEQ ID NO: 577692 - protein, 9 aa, Homo Sapiens
LTAALEGYR

SEQ ID NO: 577693 - protein, 9 aa, Homo Sapiens
NRQGSIFFL

SEQ ID NO: 577694 - protein, 9 aa, Homo Sapiens
EFREIASHV

SEQ ID NO: 577695 - protein, 9 aa, Homo Sapiens
DVQLAIIKV

SEQ ID NO: 577696 - protein, 9 aa, Homo Sapiens
PWLGEPIYR

SEQ ID NO: 577697 - protein, 9 aa, Homo Sapiens
SSRRESKTR

SEQ ID NO: 577698 - protein, 9 aa, Homo Sapiens
YDTSNDIIV

SEQ ID NO: 577699 - protein, 9 aa, Homo Sapiens
GGARGPPVA

SEQ ID NO: 577700 - protein, 9 aa, Homo Sapiens
NFNPPLPMM

SEQ ID NO: 577701 - protein, 9 aa, Homo Sapiens
SRRQCSNSP

SEQ ID NO: 577702 - protein, 9 aa, Homo Sapiens
VLPCLDGYL

SEQ ID NO: 577703 - protein, 9 aa, Homo Sapiens
NLNRSSRRE

SEQ ID NO: 577704 - protein, 9 aa, Homo Sapiens
QGSNLVTEV

SEQ ID NO: 577705 - protein, 9 aa, Homo Sapiens
DVQNGHLEP

SEQ ID NO: 577706 - protein, 9 aa, Homo Sapiens
CNEKYKRWA

SEQ ID NO: 577707 - protein, 9 aa, Homo Sapiens
VQTTETQVF

SEQ ID NO: 577708 - protein, 9 aa, Homo Sapiens
AIRQQLAPS

SEQ ID NO: 577709 - protein, 9 aa, Homo Sapiens
LRACLQPPQ

SEQ ID NO: 577710 - protein, 9 aa, Homo Sapiens
GTSGGTSPS

SEQ ID NO: 577711 - protein, 9 aa, Homo Sapiens
LALLQFLED

SEQ ID NO: 577712 - protein, 9 aa, Homo Sapiens
SDSYSSLFP

SEQ ID NO: 577713 - protein, 9 aa, Homo Sapiens
PRGAGVGAH

SEQ ID NO: 577714 - protein, 9 aa, Homo Sapiens
TDVNDHKPE

SEQ ID NO: 577715 - protein, 9 aa, Homo Sapiens
LLPYGFKSL

SEQ ID NO: 577716 - protein, 9 aa, Homo Sapiens
TTHVINLLR

SEQ ID NO: 577717 - protein, 9 aa, Homo Sapiens
IEIWYDTSN

SEQ ID NO: 577718 - protein, 9 aa, Homo Sapiens
GQTHDEISR

SEQ ID NO: 577719 - protein, 9 aa, Homo Sapiens
CVPAPGAGT

SEQ ID NO: 577720 - protein, 9 aa, Homo Sapiens
LELKDRQSR

SEQ ID NO: 577721 - protein, 9 aa, Homo Sapiens
KGDDGIPGQ

SEQ ID NO: 577722 - protein, 9 aa, Homo Sapiens
PGVSMRLLE

SEQ ID NO: 577723 - protein, 9 aa, Homo Sapiens
LLQLYTEDG

SEQ ID NO: 577724 - protein, 9 aa, Homo Sapiens
VSMRLLESK

SEQ ID NO: 577725 - protein, 9 aa, Homo Sapiens
ALRAQRAAG

SEQ ID NO: 577726 - protein, 9 aa, Homo Sapiens
PDTLDSSGD

SEQ ID NO: 577727 - protein, 9 aa, Homo Sapiens
FDSHYTLLE

SEQ ID NO: 577728 - protein, 9 aa, Homo Sapiens
TVSSPAASS

SEQ ID NO: 577729 - protein, 9 aa, Homo Sapiens
LSGLLLLTA

SEQ ID NO: 577730 - protein, 9 aa, Homo Sapiens
PPTLGMKIN

SEQ ID NO: 577731 - protein, 9 aa, Homo Sapiens
TERIPVKGL

SEQ ID NO: 577732 - protein, 9 aa, Homo Sapiens
CPTAIVANT

SEQ ID NO: 577733 - protein, 9 aa, Homo Sapiens
VRVTDVNDH

SEQ ID NO: 577734 - protein, 9 aa, Homo Sapiens
YGSSSWLCL

SEQ ID NO: 577735 - protein, 9 aa, Homo Sapiens
DGIPGQPGP

SEQ ID NO: 577736 - protein, 9 aa, Homo Sapiens
KKRYLCLLE

SEQ ID NO: 577737 - protein, 9 aa, Homo Sapiens
HMDFDSHYT

SEQ ID NO: 577738 - protein, 9 aa, Homo Sapiens
AVDDLQFED

SEQ ID NO: 577739 - protein, 9 aa, Homo Sapiens
SDHYHHHVT

SEQ ID NO: 577740 - protein, 9 aa, Homo Sapiens
VIQVTAIDA

SEQ ID NO: 577741 - protein, 9 aa, Homo Sapiens
TCRAVASRA

SEQ ID NO: 577742 - protein, 9 aa, Homo Sapiens
PIVQLVQDE

SEQ ID NO: 577743 - protein, 9 aa, Homo Sapiens
QLAIIKVLG

SEQ ID NO: 577744 - protein, 9 aa, Homo Sapiens
LSSLGTRMG

SEQ ID NO: 577745 - protein, 9 aa, Homo Sapiens
IRTLTNSGL

SEQ ID NO: 577746 - protein, 9 aa, Homo Sapiens
GPSHAPFLS

SEQ ID NO: 577747 - protein, 9 aa, Homo Sapiens
WSHRTADAG

SEQ ID NO: 577748 - protein, 9 aa, Homo Sapiens
GHLEPNSDC

SEQ ID NO: 577749 - protein, 9 aa, Homo Sapiens
GMRSGGAFP

SEQ ID NO: 577750 - protein, 9 aa, Homo Sapiens
QLELQILCE

SEQ ID NO: 577751 - protein, 9 aa, Homo Sapiens
PPAHTCPRG

SEQ ID NO: 577752 - protein, 9 aa, Homo Sapiens
SDRFAASNC

SEQ ID NO: 577753 - protein, 9 aa, Homo Sapiens
WTVSSPAAS

SEQ ID NO: 577754 - protein, 9 aa, Homo Sapiens
QLKIYSIED

SEQ ID NO: 577755 - protein, 9 aa, Homo Sapiens
LTALALILG

SEQ ID NO: 577756 - protein, 9 aa, Homo Sapiens
RILFFDQSW

SEQ ID NO: 577757 - protein, 9 aa, Homo Sapiens
ISGRLMVIH

SEQ ID NO: 577758 - protein, 9 aa, Homo Sapiens
DFKPCVGSH

SEQ ID NO: 577759 - protein, 9 aa, Homo Sapiens
GLGDPVHLT

SEQ ID NO: 577760 - protein, 9 aa, Homo Sapiens
SLESHKRIH

SEQ ID NO: 577761 - protein, 9 aa, Homo Sapiens
RIPVKGLSR

SEQ ID NO: 577762 - protein, 9 aa, Homo Sapiens
SHRTADAGA

SEQ ID NO: 577763 - protein, 9 aa, Homo Sapiens
EMIAGDRQN

SEQ ID NO: 577764 - protein, 9 aa, Homo Sapiens
VRGLTALRA

SEQ ID NO: 577765 - protein, 9 aa, Homo Sapiens
TLRACLQPP

SEQ ID NO: 577766 - protein, 9 aa, Homo Sapiens
LQFEDFGNA

SEQ ID NO: 577767 - protein, 9 aa, Homo Sapiens
SAVSNMLQK

SEQ ID NO: 577768 - protein, 9 aa, Homo Sapiens
TAAIIAQRP

SEQ ID NO: 577769 - protein, 9 aa, Homo Sapiens
HCKSEEGLE

SEQ ID NO: 577770 - protein, 9 aa, Homo Sapiens
FTNVCDKPT

SEQ ID NO: 577771 - protein, 9 aa, Homo Sapiens
TRMGTLCYL

SEQ ID NO: 577772 - protein, 9 aa, Homo Sapiens
VSSPAASSA

SEQ ID NO: 577773 - protein, 9 aa, Homo Sapiens
WKTETGRFK

SEQ ID NO: 577774 - protein, 9 aa, Homo Sapiens
TIDHTKLTP

SEQ ID NO: 577775 - protein, 9 aa, Homo Sapiens
SLPQPLQGS

SEQ ID NO: 577776 - protein, 9 aa, Homo Sapiens
PPSGDLLNM

SEQ ID NO: 577777 - protein, 9 aa, Homo Sapiens
FRSWREEAL

SEQ ID NO: 577778 - protein, 9 aa, Homo Sapiens
LPQPLQGSP

SEQ ID NO: 577779 - protein, 9 aa, Homo Sapiens
YYFIEFDTF

SEQ ID NO: 577780 - protein, 9 aa, Homo Sapiens
FPETESVNP

SEQ ID NO: 577781 - protein, 9 aa, Homo Sapiens
SSLESHKRI

SEQ ID NO: 577782 - protein, 9 aa, Homo Sapiens
GKIEEHSVD

SEQ ID NO: 577783 - protein, 9 aa, Homo Sapiens
LSQTTGNSD

SEQ ID NO: 577784 - protein, 9 aa, Homo Sapiens
LYYGTIVGV

SEQ ID NO: 577785 - protein, 9 aa, Homo Sapiens
ALLQFLEDD

SEQ ID NO: 577786 - protein, 9 aa, Homo Sapiens
YSKPGVSMR

SEQ ID NO: 577787 - protein, 9 aa, Homo Sapiens
IRQQLAPSE

SEQ ID NO: 577788 - protein, 9 aa, Homo Sapiens
LPLWPLPNG

SEQ ID NO: 577789 - protein, 9 aa, Homo Sapiens
MKINFNPPL

SEQ ID NO: 577790 - protein, 9 aa, Homo Sapiens
SYPLAEKTS

SEQ ID NO: 577791 - protein, 9 aa, Homo Sapiens
KIRHSSCGR

SEQ ID NO: 577792 - protein, 9 aa, Homo Sapiens
CRAVASRAT

SEQ ID NO: 577793 - protein, 9 aa, Homo Sapiens
RRCIPDLAH

SEQ ID NO: 577794 - protein, 9 aa, Homo Sapiens
ICLGLGGKP

SEQ ID NO: 577795 - protein, 9 aa, Homo Sapiens
PAASSARRS

SEQ ID NO: 577796 - protein, 9 aa, Homo Sapiens
AEIEIWYDT

SEQ ID NO: 577797 - protein, 9 aa, Homo Sapiens
IGCGFSTGC

SEQ ID NO: 577798 - protein, 9 aa, Homo Sapiens
FEYPYVQSC

SEQ ID NO: 577799 - protein, 9 aa, Homo Sapiens
DPSLSDHGN

SEQ ID NO: 577800 - protein, 9 aa, Homo Sapiens
QHCKSEEGL

SEQ ID NO: 577801 - protein, 9 aa, Homo Sapiens
DLDLWPWLG

SEQ ID NO: 577802 - protein, 9 aa, Homo Sapiens
AIVANTVTT

SEQ ID NO: 577803 - protein, 9 aa, Homo Sapiens
PGSKRGPSH

SEQ ID NO: 577804 - protein, 9 aa, Homo Sapiens
VRSGCPAGP

SEQ ID NO: 577805 - protein, 9 aa, Homo Sapiens
KPSHLHKKN

SEQ ID NO: 577806 - protein, 9 aa, Homo Sapiens
EIASHVKVA

SEQ ID NO: 577807 - protein, 9 aa, Homo Sapiens
SSWLCLGNP

SEQ ID NO: 577808 - protein, 9 aa, Homo Sapiens
GQPGPKGIR

SEQ ID NO: 577809 - protein, 9 aa, Homo Sapiens
QRAAGGVGL

SEQ ID NO: 577810 - protein, 9 aa, Homo Sapiens
SLASFATTK

SEQ ID NO: 577811 - protein, 9 aa, Homo Sapiens
HVINLLREQ

SEQ ID NO: 577812 - protein, 9 aa, Homo Sapiens
NVFGDKLHI

SEQ ID NO: 577813 - protein, 9 aa, Homo Sapiens
RILESEKNE

SEQ ID NO: 577814 - protein, 9 aa, Homo Sapiens
NSDSSTASS

SEQ ID NO: 577815 - protein, 9 aa, Homo Sapiens
SCQPSCCET

SEQ ID NO: 577816 - protein, 9 aa, Homo Sapiens
KFYNESEDG

SEQ ID NO: 577817 - protein, 9 aa, Homo Sapiens
VQDEEEEAS

SEQ ID NO: 577818 - protein, 9 aa, Homo Sapiens
RREPGEVGG

SEQ ID NO: 577819 - protein, 9 aa, Homo Sapiens
ELTDLHGLS

SEQ ID NO: 577820 - protein, 9 aa, Homo Sapiens
LEPNSDCLC

SEQ ID NO: 577821 - protein, 9 aa, Homo Sapiens
EDFGNAATS

SEQ ID NO: 577822 - protein, 9 aa, Homo Sapiens
SQDLKLESP

SEQ ID NO: 577823 - protein, 9 aa, Homo Sapiens
TRRCIPDLA

SEQ ID NO: 577824 - protein, 9 aa, Homo Sapiens
PFDQNLSIN

SEQ ID NO: 577825 - protein, 9 aa, Homo Sapiens
KTQASEDLI

SEQ ID NO: 577826 - protein, 9 aa, Homo Sapiens
RPGYGERPL

SEQ ID NO: 577827 - protein, 9 aa, Homo Sapiens
LWAGMGSRC

SEQ ID NO: 577828 - protein, 9 aa, Homo Sapiens
PAKPIQPKL

SEQ ID NO: 577829 - protein, 9 aa, Homo Sapiens
AHLLLVQLE

SEQ ID NO: 577830 - protein, 9 aa, Homo Sapiens
LSPSSVNQN

SEQ ID NO: 577831 - protein, 9 aa, Homo Sapiens
LLTRGQTHD

SEQ ID NO: 577832 - protein, 9 aa, Homo Sapiens
TATQTRASQ

SEQ ID NO: 577833 - protein, 9 aa, Homo Sapiens
SNCGKERFV

SEQ ID NO: 577834 - protein, 9 aa, Homo Sapiens
HLLLVQLEH

SEQ ID NO: 577835 - protein, 9 aa, Homo Sapiens
GLVNSVASP

SEQ ID NO: 577836 - protein, 9 aa, Homo Sapiens
GDGLVNSVA

SEQ ID NO: 577837 - protein, 9 aa, Homo Sapiens
LGEPIYRNG

SEQ ID NO: 577838 - protein, 9 aa, Homo Sapiens
LREMIAGDR

SEQ ID NO: 577839 - protein, 9 aa, Homo Sapiens
VQNGHLEPN

SEQ ID NO: 577840 - protein, 9 aa, Homo Sapiens
DVHVCNEKY

SEQ ID NO: 577841 - protein, 9 aa, Homo Sapiens
AGQVGWLSG

SEQ ID NO: 577842 - protein, 9 aa, Homo Sapiens
RRKPLEEKR

SEQ ID NO: 577843 - protein, 9 aa, Homo Sapiens
HHWKQLMKR

SEQ ID NO: 577844 - protein, 9 aa, Homo Sapiens
CAICLGLGG

SEQ ID NO: 577845 - protein, 9 aa, Homo Sapiens
AAGGVGLGH

SEQ ID NO: 577846 - protein, 9 aa, Homo Sapiens
MAKKYRDNR

SEQ ID NO: 577847 - protein, 9 aa, Homo Sapiens
ACGDGSLSC

SEQ ID NO: 577848 - protein, 9 aa, Homo Sapiens
LAEIYEWMV

SEQ ID NO: 577849 - protein, 9 aa, Homo Sapiens
VTRRCIPDL

SEQ ID NO: 577850 - protein, 9 aa, Homo Sapiens
APDTLDSSG

SEQ ID NO: 577851 - protein, 9 aa, Homo Sapiens
YNESEDGDT

SEQ ID NO: 577852 - protein, 9 aa, Homo Sapiens
GPSASWALI

SEQ ID NO: 577853 - protein, 9 aa, Homo Sapiens
HLTVVLLYY

SEQ ID NO: 577854 - protein, 9 aa, Homo Sapiens
CLQPPQDPQ

SEQ ID NO: 577855 - protein, 9 aa, Homo Sapiens
SFFNFGHSK

SEQ ID NO: 577856 - protein, 9 aa, Homo Sapiens
AEIYEWMVR

SEQ ID NO: 577857 - protein, 9 aa, Homo Sapiens
LQNFINICR

SEQ ID NO: 577858 - protein, 9 aa, Homo Sapiens
GIPGQPGPK

SEQ ID NO: 577859 - protein, 9 aa, Homo Sapiens
KGVNIGDVR

SEQ ID NO: 577860 - protein, 9 aa, Homo Sapiens
PSHLHKKNL

SEQ ID NO: 577861 - protein, 9 aa, Homo Sapiens
IAWEGPSTS

SEQ ID NO: 577862 - protein, 9 aa, Homo Sapiens
ENGPIFSST

SEQ ID NO: 577863 - protein, 9 aa, Homo Sapiens
EHFQAFRSW

SEQ ID NO: 577864 - protein, 9 aa, Homo Sapiens
YRCPVGGPH

SEQ ID NO: 577865 - protein, 9 aa, Homo Sapiens
VMQPYYKDV

SEQ ID NO: 577866 - protein, 9 aa, Homo Sapiens
HLHKKNLDV

SEQ ID NO: 577867 - protein, 9 aa, Homo Sapiens
TNVCDKPTL

SEQ ID NO: 577868 - protein, 9 aa, Homo Sapiens
LGDPVHLTR

SEQ ID NO: 577869 - protein, 9 aa, Homo Sapiens
GLSRQDGKG

SEQ ID NO: 577870 - protein, 9 aa, Homo Sapiens
VNIGDVRCY

SEQ ID NO: 577871 - protein, 9 aa, Homo Sapiens
SNVFGDKLH

SEQ ID NO: 577872 - protein, 9 aa, Homo Sapiens
VKGLSRQDG

SEQ ID NO: 577873 - protein, 9 aa, Homo Sapiens
TKLTPASTP

SEQ ID NO: 577874 - protein, 9 aa, Homo Sapiens
SSSWLCLGN

SEQ ID NO: 577875 - protein, 9 aa, Homo Sapiens
LLNMYELFE

SEQ ID NO: 577876 - protein, 9 aa, Homo Sapiens
EIYEWMVRT

SEQ ID NO: 577877 - protein, 9 aa, Homo Sapiens
CACGDGSLS

SEQ ID NO: 577878 - protein, 9 aa, Homo Sapiens
FLEDDEIEM

SEQ ID NO: 577879 - protein, 9 aa, Homo Sapiens
SHLHKKNLD

SEQ ID NO: 577880 - protein, 9 aa, Homo Sapiens
TAAVDPSLS

SEQ ID NO: 577881 - protein, 9 aa, Homo Sapiens
VGLLRAALI

SEQ ID NO: 577882 - protein, 9 aa, Homo Sapiens
MDLKPYAIG

SEQ ID NO: 577883 - protein, 9 aa, Homo Sapiens
TQASEDLIP

SEQ ID NO: 577884 - protein, 9 aa, Homo Sapiens
HWQENGPIF

SEQ ID NO: 577885 - protein, 9 aa, Homo Sapiens
PLGVRSGCP

SEQ ID NO: 577886 - protein, 9 aa, Homo Sapiens
KGLSRQDGK

SEQ ID NO: 577887 - protein, 9 aa, Homo Sapiens
PSHAPFLSR

SEQ ID NO: 577888 - protein, 9 aa, Homo Sapiens
FPPPISPPY

SEQ ID NO: 577889 - protein, 9 aa, Homo Sapiens
ASWALIAWE

SEQ ID NO: 577890 - protein, 9 aa, Homo Sapiens
YMCEAENQF

SEQ ID NO: 577891 - protein, 9 aa, Homo Sapiens
DKKRYLCLL

SEQ ID NO: 577892 - protein, 9 aa, Homo Sapiens
KVVKIFKEV

SEQ ID NO: 577893 - protein, 9 aa, Homo Sapiens
SGCPAGPAW

SEQ ID NO: 577894 - protein, 9 aa, Homo Sapiens
YSIEDRTRV

SEQ ID NO: 577895 - protein, 9 aa, Homo Sapiens
LHKKNLDVT

SEQ ID NO: 577896 - protein, 9 aa, Homo Sapiens
TVVLLYYGT

SEQ ID NO: 577897 - protein, 9 aa, Homo Sapiens
KLAYPLHFY

SEQ ID NO: 577898 - protein, 9 aa, Homo Sapiens
SDKGTYMCE

SEQ ID NO: 577899 - protein, 9 aa, Homo Sapiens
GCLLQTPKL

SEQ ID NO: 577900 - protein, 9 aa, Homo Sapiens
SEALKDHHW

SEQ ID NO: 577901 - protein, 9 aa, Homo Sapiens
MEKAKSKTS

SEQ ID NO: 577902 - protein, 9 aa, Homo Sapiens
LAAEKQALE

SEQ ID NO: 577903 - protein, 9 aa, Homo Sapiens
AGFKRHLPK

SEQ ID NO: 577904 - protein, 9 aa, Homo Sapiens
QRILESEKN

SEQ ID NO: 577905 - protein, 9 aa, Homo Sapiens
EPTSRRQCS

SEQ ID NO: 577906 - protein, 9 aa, Homo Sapiens
GSSSWLCLG

SEQ ID NO: 577907 - protein, 9 aa, Homo Sapiens
TIGSFKCKC

SEQ ID NO: 577908 - protein, 9 aa, Homo Sapiens
ESEDGDTPD

SEQ ID NO: 577909 - protein, 9 aa, Homo Sapiens
DLKLESPTR

SEQ ID NO: 577910 - protein, 9 aa, Homo Sapiens
NEKYKRWAL

SEQ ID NO: 577911 - protein, 9 aa, Homo Sapiens
REPGEVGGA

SEQ ID NO: 577912 - protein, 9 aa, Homo Sapiens
EMDLKPYAI

SEQ ID NO: 577913 - protein, 9 aa, Homo Sapiens
SWILTASAM

SEQ ID NO: 577914 - protein, 9 aa, Homo Sapiens
CNNMFAKVV

SEQ ID NO: 577915 - protein, 9 aa, Homo Sapiens
LGVRSGCPA

SEQ ID NO: 577916 - protein, 9 aa, Homo Sapiens
VCAICLGLG

SEQ ID NO: 577917 - protein, 9 aa, Homo Sapiens
LFPETESVN

SEQ ID NO: 577918 - protein, 9 aa, Homo Sapiens
IGDVRCYIY

SEQ ID NO: 577919 - protein, 9 aa, Homo Sapiens
APLENRRTE

SEQ ID NO: 577920 - protein, 9 aa, Homo Sapiens
VINLLREQS

SEQ ID NO: 577921 - protein, 9 aa, Homo Sapiens
RMAWDVEAG

SEQ ID NO: 577922 - protein, 9 aa, Homo Sapiens
KEEELRRKP

SEQ ID NO: 577923 - protein, 9 aa, Homo Sapiens
ADAGAPRRG

SEQ ID NO: 577924 - protein, 9 aa, Homo Sapiens
RMGTLCYLG

SEQ ID NO: 577925 - protein, 9 aa, Homo Sapiens
SRCRAPLGV

SEQ ID NO: 577926 - protein, 9 aa, Homo Sapiens
ISPPYGPGR

SEQ ID NO: 577927 - protein, 9 aa, Homo Sapiens
FGHSKLQSL

SEQ ID NO: 577928 - protein, 9 aa, Homo Sapiens
TYMCEAENQ

SEQ ID NO: 577929 - protein, 9 aa, Homo Sapiens
RLAAEKQAL

SEQ ID NO: 577930 - protein, 9 aa, Homo Sapiens
NEVNNMLRQ

SEQ ID NO: 577931 - protein, 9 aa, Homo Sapiens
HSVDMETHV

SEQ ID NO: 577932 - protein, 9 aa, Homo Sapiens
EAFWLTGIC

SEQ ID NO: 577933 - protein, 9 aa, Homo Sapiens
RSAGSLSGA

SEQ ID NO: 577934 - protein, 9 aa, Homo Sapiens
SSVNQNFPA

SEQ ID NO: 577935 - protein, 9 aa, Homo Sapiens
SVTCTDSPA

SEQ ID NO: 577936 - protein, 9 aa, Homo Sapiens
LEFREIASH

SEQ ID NO: 577937 - protein, 9 aa, Homo Sapiens
SSCGRLLDD

SEQ ID NO: 577938 - protein, 9 aa, Homo Sapiens
FFNFGHSKL

SEQ ID NO: 577939 - protein, 9 aa, Homo Sapiens
QENGPIFSS

SEQ ID NO: 577940 - protein, 9 aa, Homo Sapiens
IPGQPGPKG

SEQ ID NO: 577941 - protein, 9 aa, Homo Sapiens
RKFYNESED

SEQ ID NO: 577942 - protein, 9 aa, Homo Sapiens
SQAQGQGSN

SEQ ID NO: 577943 - protein, 9 aa, Homo Sapiens
ASNCGKERF

SEQ ID NO: 577944 - protein, 9 aa, Homo Sapiens
ASSARRSWI

SEQ ID NO: 577945 - protein, 9 aa, Homo Sapiens
IDIDNCSVM

SEQ ID NO: 577946 - protein, 9 aa, Homo Sapiens
QLPPLSSLG

SEQ ID NO: 577947 - protein, 9 aa, Homo Sapiens
KQLELQILC

SEQ ID NO: 577948 - protein, 9 aa, Homo Sapiens
LCACGDGSL

SEQ ID NO: 577949 - protein, 9 aa, Homo Sapiens
TAKSVTCTD

SEQ ID NO: 577950 - protein, 9 aa, Homo Sapiens
MFQGMRSGG

SEQ ID NO: 577951 - protein, 9 aa, Homo Sapiens
EDALQNFIN

SEQ ID NO: 577952 - protein, 9 aa, Homo Sapiens
LKSEALKDH

SEQ ID NO: 577953 - protein, 9 aa, Homo Sapiens
KRHLPKVQM

SEQ ID NO: 577954 - protein, 9 aa, Homo Sapiens
AHHIISGRL

SEQ ID NO: 577955 - protein, 9 aa, Homo Sapiens
REIASHVKV

SEQ ID NO: 577956 - protein, 9 aa, Homo Sapiens
TSGGTSPSA

SEQ ID NO: 577957 - protein, 9 aa, Homo Sapiens
LLWKTETGR

SEQ ID NO: 577958 - protein, 9 aa, Homo Sapiens
CLLWKTETG

SEQ ID NO: 577959 - protein, 9 aa, Homo Sapiens
TGRGLDFVH

SEQ ID NO: 577960 - protein, 9 aa, Homo Sapiens
FREIASHVK

SEQ ID NO: 577961 - protein, 9 aa, Homo Sapiens
MVTHKSDSH

SEQ ID NO: 577962 - protein, 9 aa, Homo Sapiens
LALERTRVV

SEQ ID NO: 577963 - protein, 9 aa, Homo Sapiens
SEKNEMELK

SEQ ID NO: 577964 - protein, 9 aa, Homo Sapiens
SEVEETAAI

SEQ ID NO: 577965 - protein, 9 aa, Homo Sapiens
GPCLCACGD

SEQ ID NO: 577966 - protein, 9 aa, Homo Sapiens
EQHMDFDSH

SEQ ID NO: 577967 - protein, 9 aa, Homo Sapiens
LRQLQEAEK

SEQ ID NO: 577968 - protein, 9 aa, Homo Sapiens
PTNAMVTHK

SEQ ID NO: 577969 - protein, 9 aa, Homo Sapiens
LNETLESMT

SEQ ID NO: 577970 - protein, 9 aa, Homo Sapiens
NNMLRQLQE

SEQ ID NO: 577971 - protein, 9 aa, Homo Sapiens
TLAEIYEWM

SEQ ID NO: 577972 - protein, 9 aa, Homo Sapiens
PYYKDVLPC

SEQ ID NO: 577973 - protein, 9 aa, Homo Sapiens
GDGSLSCPV

SEQ ID NO: 577974 - protein, 9 aa, Homo Sapiens
WLGEPIYRN

SEQ ID NO: 577975 - protein, 9 aa, Homo Sapiens
LPTVSWHKD

SEQ ID NO: 577976 - protein, 9 aa, Homo Sapiens
SPSQAQGQG

SEQ ID NO: 577977 - protein, 9 aa, Homo Sapiens
LKPYAIGMP

SEQ ID NO: 577978 - protein, 9 aa, Homo Sapiens
AGSLSGAGL

SEQ ID NO: 577979 - protein, 9 aa, Homo Sapiens
LRLEDSLPQ

SEQ ID NO: 577980 - protein, 9 aa, Homo Sapiens
RASQRMAWD

SEQ ID NO: 577981 - protein, 9 aa, Homo Sapiens
DDGIPGQPG

SEQ ID NO: 577982 - protein, 9 aa, Homo Sapiens
WLCLGNPRA

SEQ ID NO: 577983 - protein, 9 aa, Homo Sapiens
EAQLLQLYT

SEQ ID NO: 577984 - protein, 9 aa, Homo Sapiens
DDPASDSTV

SEQ ID NO: 577985 - protein, 9 aa, Homo Sapiens
YQFKECGKA

SEQ ID NO: 577986 - protein, 9 aa, Homo Sapiens
TLGMKINFN

SEQ ID NO: 577987 - protein, 9 aa, Homo Sapiens
EHGRRSNVF

SEQ ID NO: 577988 - protein, 9 aa, Homo Sapiens
HGRRSNVFG

SEQ ID NO: 577989 - protein, 9 aa, Homo Sapiens
VNQNFPAST

SEQ ID NO: 577990 - protein, 9 aa, Homo Sapiens
LVGDPTHSR

SEQ ID NO: 577991 - protein, 9 aa, Homo Sapiens
ALKDHHWKQ

SEQ ID NO: 577992 - protein, 9 aa, Homo Sapiens
VAEDVVAGQ

SEQ ID NO: 577993 - protein, 9 aa, Homo Sapiens
GVGLGHRSW

SEQ ID NO: 577994 - protein, 9 aa, Homo Sapiens
ESEKNEMEL

SEQ ID NO: 577995 - protein, 9 aa, Homo Sapiens
SRIFKEARK

SEQ ID NO: 577996 - protein, 9 aa, Homo Sapiens
PGQPGPKGI

SEQ ID NO: 577997 - protein, 9 aa, Homo Sapiens
CEPIQAWEG

SEQ ID NO: 577998 - protein, 9 aa, Homo Sapiens
IFSSTPYRY

SEQ ID NO: 577999 - protein, 9 aa, Homo Sapiens
SLSCPVRGL

SEQ ID NO: 578000 - protein, 9 aa, Homo Sapiens
LCHPLCKST

SEQ ID NO: 578001 - protein, 9 aa, Homo Sapiens
CLGLGGKPA

SEQ ID NO: 578002 - protein, 9 aa, Homo Sapiens
PISPPYGPG

SEQ ID NO: 578003 - protein, 9 aa, Homo Sapiens
EKAKSKTSK

SEQ ID NO: 578004 - protein, 9 aa, Homo Sapiens
WLSGSTTVN

SEQ ID NO: 578005 - protein, 9 aa, Homo Sapiens
ASQGAVLLL

SEQ ID NO: 578006 - protein, 9 aa, Homo Sapiens
KFLYPTNAM

SEQ ID NO: 578007 - protein, 9 aa, Homo Sapiens
QTRASQRMA

SEQ ID NO: 578008 - protein, 9 aa, Homo Sapiens
YGMFQGMRS

SEQ ID NO: 578009 - protein, 9 aa, Homo Sapiens
AVTAAVDPS

SEQ ID NO: 578010 - protein, 9 aa, Homo Sapiens
VAGGLAIDI

SEQ ID NO: 578011 - protein, 9 aa, Homo Sapiens
PYVQSCNDV

SEQ ID NO: 578012 - protein, 9 aa, Homo Sapiens
VPPGERALV

SEQ ID NO: 578013 - protein, 9 aa, Homo Sapiens
SGLLLLTAA

SEQ ID NO: 578014 - protein, 9 aa, Homo Sapiens
PVHLTREEV

SEQ ID NO: 578015 - protein, 9 aa, Homo Sapiens
INICRNLWN

SEQ ID NO: 578016 - protein, 9 aa, Homo Sapiens
HMDKKRYLC

SEQ ID NO: 578017 - protein, 9 aa, Homo Sapiens
LPLRPGYGE

SEQ ID NO: 578018 - protein, 9 aa, Homo Sapiens
GFKRHLPKV

SEQ ID NO: 578019 - protein, 9 aa, Homo Sapiens
ILTASAMPV

SEQ ID NO: 578020 - protein, 9 aa, Homo Sapiens
LLLVQLEHS

SEQ ID NO: 578021 - protein, 9 aa, Homo Sapiens
RRGPCLCAC

SEQ ID NO: 578022 - protein, 9 aa, Homo Sapiens
AVGLLRAAL

SEQ ID NO: 578023 - protein, 9 aa, Homo Sapiens
TKMITDYLT

SEQ ID NO: 578024 - protein, 9 aa, Homo Sapiens
EFILEEDDP

SEQ ID NO: 578025 - protein, 9 aa, Homo Sapiens
LRPGYGERP

SEQ ID NO: 578026 - protein, 9 aa, Homo Sapiens
LLRAALILR

SEQ ID NO: 578027 - protein, 9 aa, Homo Sapiens
ASRGGQAPG

SEQ ID NO: 578028 - protein, 9 aa, Homo Sapiens
IWYDTSNDI

SEQ ID NO: 578029 - protein, 9 aa, Homo Sapiens
NMYELFEKA

SEQ ID NO: 578030 - protein, 9 aa, Homo Sapiens
GMFQGMRSG

SEQ ID NO: 578031 - protein, 9 aa, Homo Sapiens
NIQMEKAKS

SEQ ID NO: 578032 - protein, 9 aa, Homo Sapiens
GDLLAVGLL

SEQ ID NO: 578033 - protein, 9 aa, Homo Sapiens
VTDVNDHKP

SEQ ID NO: 578034 - protein, 9 aa, Homo Sapiens
PKRIPDIRR

SEQ ID NO: 578035 - protein, 9 aa, Homo Sapiens
PVPFRAVPL

SEQ ID NO: 578036 - protein, 9 aa, Homo Sapiens
QLASQGAVL

SEQ ID NO: 578037 - protein, 9 aa, Homo Sapiens
EKRLTLAEI

SEQ ID NO: 578038 - protein, 9 aa, Homo Sapiens
LEDSLPQPL

SEQ ID NO: 578039 - protein, 9 aa, Homo Sapiens
RSSRRESKT

SEQ ID NO: 578040 - protein, 9 aa, Homo Sapiens
VGGLGDPVH

SEQ ID NO: 578041 - protein, 9 aa, Homo Sapiens
KCDSGFALD

SEQ ID NO: 578042 - protein, 9 aa, Homo Sapiens
LKIRHSSCG

SEQ ID NO: 578043 - protein, 9 aa, Homo Sapiens
DHYHHHVTS

SEQ ID NO: 578044 - protein, 9 aa, Homo Sapiens
LKIYSIEDR

SEQ ID NO: 578045 - protein, 9 aa, Homo Sapiens
ETGRFKDVL

SEQ ID NO: 578046 - protein, 9 aa, Homo Sapiens
CETSSCQPS

SEQ ID NO: 578047 - protein, 9 aa, Homo Sapiens
FDQSWIQWS

SEQ ID NO: 578048 - protein, 9 aa, Homo Sapiens
EQRSQHCKS

SEQ ID NO: 578049 - protein, 9 aa, Homo Sapiens
LESEKNEME

SEQ ID NO: 578050 - protein, 9 aa, Homo Sapiens
DLSTSSYPL

SEQ ID NO: 578051 - protein, 9 aa, Homo Sapiens
AKSKTSKPP

SEQ ID NO: 578052 - protein, 9 aa, Homo Sapiens
GQVGWLSGS

SEQ ID NO: 578053 - protein, 9 aa, Homo Sapiens
IFFLTVVAV

SEQ ID NO: 578054 - protein, 9 aa, Homo Sapiens
LTPASTPEV

SEQ ID NO: 578055 - protein, 9 aa, Homo Sapiens
LLTFSTGRG

SEQ ID NO: 578056 - protein, 9 aa, Homo Sapiens
RSWREEALG

SEQ ID NO: 578057 - protein, 9 aa, Homo Sapiens
DVVAGQIIL

SEQ ID NO: 578058 - protein, 9 aa, Homo Sapiens
PLPTVSWHK

SEQ ID NO: 578059 - protein, 9 aa, Homo Sapiens
AGAASRGGQ

SEQ ID NO: 578060 - protein, 9 aa, Homo Sapiens
QGSIFFLTV

SEQ ID NO: 578061 - protein, 9 aa, Homo Sapiens
GGVGLGHRS

SEQ ID NO: 578062 - protein, 9 aa, Homo Sapiens
KQKTQASED

SEQ ID NO: 578063 - protein, 9 aa, Homo Sapiens
QQLAPSEYQ

SEQ ID NO: 578064 - protein, 9 aa, Homo Sapiens
VFGQKSSLE

SEQ ID NO: 578065 - protein, 9 aa, Homo Sapiens
GSLSCPVRG

SEQ ID NO: 578066 - protein, 9 aa, Homo Sapiens
FRAVPLPTV

SEQ ID NO: 578067 - protein, 9 aa, Homo Sapiens
LEAFWLTGI

SEQ ID NO: 578068 - protein, 9 aa, Homo Sapiens
IPKRIPDIR

SEQ ID NO: 578069 - protein, 9 aa, Homo Sapiens
PSQAQGQGS

SEQ ID NO: 578070 - protein, 9 aa, Homo Sapiens
THKRIRTGE

SEQ ID NO: 578071 - protein, 9 aa, Homo Sapiens
DGSLSCPVR

SEQ ID NO: 578072 - protein, 9 aa, Homo Sapiens
NAGEDEYEK

SEQ ID NO: 578073 - protein, 9 aa, Homo Sapiens
LFFDQSWIQ

SEQ ID NO: 578074 - protein, 9 aa, Homo Sapiens
RALVFPEGQ

SEQ ID NO: 578075 - protein, 9 aa, Homo Sapiens
VPLPTVSWH

SEQ ID NO: 578076 - protein, 9 aa, Homo Sapiens
SVNQNFPAS

SEQ ID NO: 578077 - protein, 9 aa, Homo Sapiens
GRGLDFVHH

SEQ ID NO: 578078 - protein, 9 aa, Homo Sapiens
GVNIGDVRC

SEQ ID NO: 578079 - protein, 9 aa, Homo Sapiens
GAGVGAHQG

SEQ ID NO: 578080 - protein, 9 aa, Homo Sapiens
DSHYTLLEL

SEQ ID NO: 578081 - protein, 9 aa, Homo Sapiens
GGLGDPVHL

SEQ ID NO: 578082 - protein, 9 aa, Homo Sapiens
RQCSNSPGE

SEQ ID NO: 578083 - protein, 9 aa, Homo Sapiens
EDFKPCVGS

SEQ ID NO: 578084 - protein, 9 aa, Homo Sapiens
IQMEKAKSK

SEQ ID NO: 578085 - protein, 9 aa, Homo Sapiens
GTLCYLGNR

SEQ ID NO: 578086 - protein, 9 aa, Homo Sapiens
RENCGQGVQ

SEQ ID NO: 578087 - protein, 9 aa, Homo Sapiens
KSESEVEET

SEQ ID NO: 578088 - protein, 9 aa, Homo Sapiens
QFTNVCDKP

SEQ ID NO: 578089 - protein, 9 aa, Homo Sapiens
RSGCPAGPA

SEQ ID NO: 578090 - protein, 9 aa, Homo Sapiens
LPGSKRGPS

SEQ ID NO: 578091 - protein, 9 aa, Homo Sapiens
GVRSGCPAG

SEQ ID NO: 578092 - protein, 9 aa, Homo Sapiens
QMEKAKSKT

SEQ ID NO: 578093 - protein, 9 aa, Homo Sapiens
DMAGQVGWL

SEQ ID NO: 578094 - protein, 9 aa, Homo Sapiens
SVDMETHVK

SEQ ID NO: 578095 - protein, 9 aa, Homo Sapiens
KPYAIGMPL

SEQ ID NO: 578096 - protein, 9 aa, Homo Sapiens
LENRRTESP

SEQ ID NO: 578097 - protein, 9 aa, Homo Sapiens
APGAGTSGG

SEQ ID NO: 578098 - protein, 9 aa, Homo Sapiens
KDMAGQVGW

SEQ ID NO: 578099 - protein, 9 aa, Homo Sapiens
IPMQLKIYS

SEQ ID NO: 578100 - protein, 9 aa, Homo Sapiens
FSTGCGSAV

SEQ ID NO: 578101 - protein, 9 aa, Homo Sapiens
RQQLAPSEY

SEQ ID NO: 578102 - protein, 9 aa, Homo Sapiens
STSSYPLAE

SEQ ID NO: 578103 - protein, 9 aa, Homo Sapiens
LIDFGMAKK

SEQ ID NO: 578104 - protein, 9 aa, Homo Sapiens
ALQNFINIC

SEQ ID NO: 578105 - protein, 9 aa, Homo Sapiens
FKECGKAFH

SEQ ID NO: 578106 - protein, 9 aa, Homo Sapiens
FATTKMITD

SEQ ID NO: 578107 - protein, 9 aa, Homo Sapiens
SKTSKPPQE

SEQ ID NO: 578108 - protein, 9 aa, Homo Sapiens
DFGMAKKYR

SEQ ID NO: 578109 - protein, 9 aa, Homo Sapiens
PLSSLGTRM

SEQ ID NO: 578110 - protein, 9 aa, Homo Sapiens
TAALEGYRC

SEQ ID NO: 578111 - protein, 9 aa, Homo Sapiens
PRRQRASES

SEQ ID NO: 578112 - protein, 9 aa, Homo Sapiens
LGHLRRMSW

SEQ ID NO: 578113 - protein, 9 aa, Homo Sapiens
SSAVVKLAY

SEQ ID NO: 578114 - protein, 9 aa, Homo Sapiens
LGLGGKPAF

SEQ ID NO: 578115 - protein, 9 aa, Homo Sapiens
DRQRILESE

SEQ ID NO: 578116 - protein, 9 aa, Homo Sapiens
WILTASAMP

SEQ ID NO: 578117 - protein, 9 aa, Homo Sapiens
LEMDLKPYA

SEQ ID NO: 578118 - protein, 9 aa, Homo Sapiens
SGKYENNSF

SEQ ID NO: 578119 - protein, 9 aa, Homo Sapiens
AGEDEYEKA

SEQ ID NO: 578120 - protein, 9 aa, Homo Sapiens
LERTRVVSV

SEQ ID NO: 578121 - protein, 9 aa, Homo Sapiens
PLGAAPRRS

SEQ ID NO: 578122 - protein, 9 aa, Homo Sapiens
IWVTVRVTD

SEQ ID NO: 578123 - protein, 9 aa, Homo Sapiens
WASDKGTYM

SEQ ID NO: 578124 - protein, 9 aa, Homo Sapiens
LDAVTAAVD

SEQ ID NO: 578125 - protein, 9 aa, Homo Sapiens
SFATTKMIT

SEQ ID NO: 578126 - protein, 9 aa, Homo Sapiens
PGYGERPLA

SEQ ID NO: 578127 - protein, 9 aa, Homo Sapiens
SDAGQLYVM

SEQ ID NO: 578128 - protein, 9 aa, Homo Sapiens
CDKPTLAEM

SEQ ID NO: 578129 - protein, 9 aa, Homo Sapiens
VEAGSRRGP

SEQ ID NO: 578130 - protein, 9 aa, Homo Sapiens
FGTCEAQLL

SEQ ID NO: 578131 - protein, 9 aa, Homo Sapiens
EDVVAGQII

SEQ ID NO: 578132 - protein, 9 aa, Homo Sapiens
MYELFEKAN

SEQ ID NO: 578133 - protein, 9 aa, Homo Sapiens
GEKVQTTET

SEQ ID NO: 578134 - protein, 9 aa, Homo Sapiens
LDLWPWLGE

SEQ ID NO: 578135 - protein, 9 aa, Homo Sapiens
IISGRLMVI

SEQ ID NO: 578136 - protein, 9 aa, Homo Sapiens
FFLTVVAVD

SEQ ID NO: 578137 - protein, 9 aa, Homo Sapiens
YGREDFKPC

SEQ ID NO: 578138 - protein, 9 aa, Homo Sapiens
KQISLAPDT

SEQ ID NO: 578139 - protein, 9 aa, Homo Sapiens
LVGEAIRQQ

SEQ ID NO: 578140 - protein, 9 aa, Homo Sapiens
NRRTESPCT

SEQ ID NO: 578141 - protein, 9 aa, Homo Sapiens
SPSSVNQNF

SEQ ID NO: 578142 - protein, 9 aa, Homo Sapiens
QLIRDFNNN

SEQ ID NO: 578143 - protein, 9 aa, Homo Sapiens
ELQNCPDPT

SEQ ID NO: 578144 - protein, 9 aa, Homo Sapiens
RRMSWIRIC

SEQ ID NO: 578145 - protein, 9 aa, Homo Sapiens
TRASQRMAW

SEQ ID NO: 578146 - protein, 9 aa, Homo Sapiens
LVVMFTECL

SEQ ID NO: 578147 - protein, 9 aa, Homo Sapiens
YEMEIRTLT

SEQ ID NO: 578148 - protein, 9 aa, Homo Sapiens
RTLTNSGLI

SEQ ID NO: 578149 - protein, 9 aa, Homo Sapiens
AGVGAHQGP

SEQ ID NO: 578150 - protein, 9 aa, Homo Sapiens
DLKPYAIGM

SEQ ID NO: 578151 - protein, 9 aa, Homo Sapiens
LGAAPRRST

SEQ ID NO: 578152 - protein, 9 aa, Homo Sapiens
KSSLESHKR

SEQ ID NO: 578153 - protein, 9 aa, Homo Sapiens
RGQTHDEIS

SEQ ID NO: 578154 - protein, 9 aa, Homo Sapiens
GVGAHQGPP

SEQ ID NO: 578155 - protein, 9 aa, Homo Sapiens
PYYFIEFDT

SEQ ID NO: 578156 - protein, 9 aa, Homo Sapiens
LGCLLQTPK

SEQ ID NO: 578157 - protein, 9 aa, Homo Sapiens
SQTTGNSDH

SEQ ID NO: 578158 - protein, 9 aa, Homo Sapiens
SCPVRGLTA

SEQ ID NO: 578159 - protein, 9 aa, Homo Sapiens
YKDVLPCLD

SEQ ID NO: 578160 - protein, 9 aa, Homo Sapiens
AIDIDNCSV

SEQ ID NO: 578161 - protein, 9 aa, Homo Sapiens
IDADDANYG

SEQ ID NO: 578162 - protein, 9 aa, Homo Sapiens
PQDPQMRLK

SEQ ID NO: 578163 - protein, 9 aa, Homo Sapiens
AICLGLGGK

SEQ ID NO: 578164 - protein, 9 aa, Homo Sapiens
THDEISRLS

SEQ ID NO: 578165 - protein, 9 aa, Homo Sapiens
SQRMAWDVE

SEQ ID NO: 578166 - protein, 9 aa, Homo Sapiens
KDHHWKQLM

SEQ ID NO: 578167 - protein, 9 aa, Homo Sapiens
LQKHNAGED

SEQ ID NO: 578168 - protein, 9 aa, Homo Sapiens
GLEFREIAS

SEQ ID NO: 578169 - protein, 9 aa, Homo Sapiens
SQNLLSAVS

SEQ ID NO: 578170 - protein, 9 aa, Homo Sapiens
LVFPEGQLA

SEQ ID NO: 578171 - protein, 9 aa, Homo Sapiens
EFTTHVINL

SEQ ID NO: 578172 - protein, 9 aa, Homo Sapiens
AQGQGSNLV

SEQ ID NO: 578173 - protein, 9 aa, Homo Sapiens
FAHHIISGR

SEQ ID NO: 578174 - protein, 9 aa, Homo Sapiens
TECLDVIFA

SEQ ID NO: 578175 - protein, 9 aa, Homo Sapiens
GWLSGSTTV

SEQ ID NO: 578176 - protein, 9 aa, Homo Sapiens
QCSNSPGES

SEQ ID NO: 578177 - protein, 9 aa, Homo Sapiens
GSIFFLTVV

SEQ ID NO: 578178 - protein, 9 aa, Homo Sapiens
SQLSLSFYT

SEQ ID NO: 578179 - protein, 9 aa, Homo Sapiens
EKQALEQVA

SEQ ID NO: 578180 - protein, 9 aa, Homo Sapiens
KPCVGSHVG

SEQ ID NO: 578181 - protein, 9 aa, Homo Sapiens
GTRMGTLCY

SEQ ID NO: 578182 - protein, 9 aa, Homo Sapiens
AGPAWLTAT

SEQ ID NO: 578183 - protein, 9 aa, Homo Sapiens
ATLREMIAG

SEQ ID NO: 578184 - protein, 9 aa, Homo Sapiens
YLCLLEIHK

SEQ ID NO: 578185 - protein, 9 aa, Homo Sapiens
LPFFGQGRP

SEQ ID NO: 578186 - protein, 9 aa, Homo Sapiens
RTADAGAPR

SEQ ID NO: 578187 - protein, 9 aa, Homo Sapiens
LRALPCAPA

SEQ ID NO: 578188 - protein, 9 aa, Homo Sapiens
SFSGFLVAT

SEQ ID NO: 578189 - protein, 9 aa, Homo Sapiens
CPVRGLTAL

SEQ ID NO: 578190 - protein, 9 aa, Homo Sapiens
FKPCVGSHV

SEQ ID NO: 578191 - protein, 9 aa, Homo Sapiens
AEKQALEQV

SEQ ID NO: 578192 - protein, 9 aa, Homo Sapiens
VGGARGPPV

SEQ ID NO: 578193 - protein, 9 aa, Homo Sapiens
EFGTCEAQL

SEQ ID NO: 578194 - protein, 9 aa, Homo Sapiens
VEETAAIIA

SEQ ID NO: 578195 - protein, 9 aa, Homo Sapiens
TRGQTHDEI

SEQ ID NO: 578196 - protein, 9 aa, Homo Sapiens
ESEVEETAA

SEQ ID NO: 578197 - protein, 9 aa, Homo Sapiens
LHGLSRIFK

SEQ ID NO: 578198 - protein, 9 aa, Homo Sapiens
GEVGGARGP

SEQ ID NO: 578199 - protein, 9 aa, Homo Sapiens
PSQDLKLES

SEQ ID NO: 578200 - protein, 9 aa, Homo Sapiens
GTYMCEAEN

SEQ ID NO: 578201 - protein, 9 aa, Homo Sapiens
WQENGPIFS

SEQ ID NO: 578202 - protein, 9 aa, Homo Sapiens
GDPVHLTRE

SEQ ID NO: 578203 - protein, 9 aa, Homo Sapiens
SSCQPSCCE

SEQ ID NO: 578204 - protein, 9 aa, Homo Sapiens
AEDVVAGQI

SEQ ID NO: 578205 - protein, 9 aa, Homo Sapiens
HLEPNSDCL

SEQ ID NO: 578206 - protein, 9 aa, Homo Sapiens
VYRCPVGGP

SEQ ID NO: 578207 - protein, 8 aa, Homo Sapiens
EEMKKTAI

SEQ ID NO: 578208 - protein, 9 aa, Homo Sapiens
QDEEEEASP

SEQ ID NO: 578209 - protein, 9 aa, Homo Sapiens
PFRAVPLPT

SEQ ID NO: 578210 - protein, 9 aa, Homo Sapiens
DHTKLTPAS

SEQ ID NO: 578211 - protein, 9 aa, Homo Sapiens
AEPSQDLKL

SEQ ID NO: 578212 - protein, 9 aa, Homo Sapiens
AGGLAIDID

SEQ ID NO: 578213 - protein, 9 aa, Homo Sapiens
SSTASSGAS

SEQ ID NO: 578214 - protein, 9 aa, Homo Sapiens
EVEETAAII

SEQ ID NO: 578215 - protein, 9 aa, Homo Sapiens
SGGAFPGGS

SEQ ID NO: 578216 - protein, 9 aa, Homo Sapiens
GQGSNLVTE

SEQ ID NO: 578217 - protein, 9 aa, Homo Sapiens
WDVEAGSRR

SEQ ID NO: 578218 - protein, 9 aa, Homo Sapiens
AWDVEAGSR

SEQ ID NO: 578219 - protein, 9 aa, Homo Sapiens
LKDHHWKQL

SEQ ID NO: 578220 - protein, 9 aa, Homo Sapiens
RCYIYDPVK

SEQ ID NO: 578221 - protein, 9 aa, Homo Sapiens
LQPPQDPQM

SEQ ID NO: 578222 - protein, 9 aa, Homo Sapiens
KCKCDSGFA

SEQ ID NO: 578223 - protein, 9 aa, Homo Sapiens
AVVHTILNE

SEQ ID NO: 578224 - protein, 9 aa, Homo Sapiens
SAGSLSGAG

SEQ ID NO: 578225 - protein, 9 aa, Homo Sapiens
AGQLYVMKV

SEQ ID NO: 578226 - protein, 9 aa, Homo Sapiens
DSYSSLFPE

SEQ ID NO: 578227 - protein, 9 aa, Homo Sapiens
GHRSWTVSS

SEQ ID NO: 578228 - protein, 9 aa, Homo Sapiens
HSSCGRLLD

SEQ ID NO: 578229 - protein, 9 aa, Homo Sapiens
CLLEIHKIM

SEQ ID NO: 578230 - protein, 9 aa, Homo Sapiens
RAEPSQDLK

SEQ ID NO: 578231 - protein, 9 aa, Homo Sapiens
MRENCGQGV

SEQ ID NO: 578232 - protein, 9 aa, Homo Sapiens
DSSTASSGA

SEQ ID NO: 578233 - protein, 9 aa, Homo Sapiens
MFTECLDVI

SEQ ID NO: 578234 - protein, 9 aa, Homo Sapiens
WAGMGSRCG

SEQ ID NO: 578235 - protein, 9 aa, Homo Sapiens
QPPQDPQMR

SEQ ID NO: 578236 - protein, 9 aa, Homo Sapiens
AQLLQLYTE

SEQ ID NO: 578237 - protein, 9 aa, Homo Sapiens
DPVHLTREE

SEQ ID NO: 578238 - protein, 9 aa, Homo Sapiens
SSTLLPYGF

SEQ ID NO: 578239 - protein, 9 aa, Homo Sapiens
RALPCAPAL

SEQ ID NO: 578240 - protein, 9 aa, Homo Sapiens
FAASNCGKE

SEQ ID NO: 578241 - protein, 9 aa, Homo Sapiens
ENCGQGVQT

SEQ ID NO: 578242 - protein, 9 aa, Homo Sapiens
SLSPSSVNQ

SEQ ID NO: 578243 - protein, 9 aa, Homo Sapiens
SFYTNAKFS

SEQ ID NO: 578244 - protein, 9 aa, Homo Sapiens
LAEKTSMHS

SEQ ID NO: 578245 - protein, 9 aa, Homo Sapiens
ADWLQKHNA

SEQ ID NO: 578246 - protein, 9 aa, Homo Sapiens
KQALEQVAE

SEQ ID NO: 578247 - protein, 9 aa, Homo Sapiens
VFHTLGCLL

SEQ ID NO: 578248 - protein, 9 aa, Homo Sapiens
NMFAKVVKI

SEQ ID NO: 578249 - protein, 9 aa, Homo Sapiens
FGDKLHIKG

SEQ ID NO: 578250 - protein, 9 aa, Homo Sapiens
SPAASSARR

SEQ ID NO: 578251 - protein, 9 aa, Homo Sapiens
RGAGVGAHQ

SEQ ID NO: 578252 - protein, 9 aa, Homo Sapiens
LVQLEHSEP

SEQ ID NO: 578253 - protein, 9 aa, Homo Sapiens
CTDSPALNK

SEQ ID NO: 578254 - protein, 9 aa, Homo Sapiens
LIAWEGPST

SEQ ID NO: 578255 - protein, 9 aa, Homo Sapiens
LKDRQSRLQ

SEQ ID NO: 578256 - protein, 9 aa, Homo Sapiens
KRIRTGEKP

SEQ ID NO: 578257 - protein, 9 aa, Homo Sapiens
QRASESRDL

SEQ ID NO: 578258 - protein, 9 aa, Homo Sapiens
LPPLSSLGT

SEQ ID NO: 578259 - protein, 9 aa, Homo Sapiens
VNNMLRQLQ

SEQ ID NO: 578260 - protein, 9 aa, Homo Sapiens
IPVKGLSRQ

SEQ ID NO: 578261 - protein, 9 aa, Homo Sapiens
LGHRSWTVS

SEQ ID NO: 578262 - protein, 9 aa, Homo Sapiens
CGFSTGCGS

SEQ ID NO: 578263 - protein, 9 aa, Homo Sapiens
SEQGDGLVN

SEQ ID NO: 578264 - protein, 9 aa, Homo Sapiens
ETHKRIRTG

SEQ ID NO: 578265 - protein, 9 aa, Homo Sapiens
DVEAGSRRG

SEQ ID NO: 578266 - protein, 9 aa, Homo Sapiens
LSTSSYPLA

SEQ ID NO: 578267 - protein, 9 aa, Homo Sapiens
TETGRFKDV

SEQ ID NO: 578268 - protein, 9 aa, Homo Sapiens
GGNMLVGDP

SEQ ID NO: 578269 - protein, 9 aa, Homo Sapiens
LDAEIEIWY

SEQ ID NO: 578270 - protein, 9 aa, Homo Sapiens
IAGDRQNHQ

SEQ ID NO: 578271 - protein, 9 aa, Homo Sapiens
AAVVHTILN

SEQ ID NO: 578272 - protein, 9 aa, Homo Sapiens
DAEDALQNF

SEQ ID NO: 578273 - protein, 9 aa, Homo Sapiens
MDFDSHYTL

SEQ ID NO: 578274 - protein, 9 aa, Homo Sapiens
IRTGEKPYR

SEQ ID NO: 578275 - protein, 9 aa, Homo Sapiens
GDDGIPGQP

SEQ ID NO: 578276 - protein, 9 aa, Homo Sapiens
PPGSQLPPL

SEQ ID NO: 578277 - protein, 9 aa, Homo Sapiens
GARGPPVAD

SEQ ID NO: 578278 - protein, 9 aa, Homo Sapiens
LLGHLRRMS

SEQ ID NO: 578279 - protein, 9 aa, Homo Sapiens
PGSQLPPLS

SEQ ID NO: 578280 - protein, 9 aa, Homo Sapiens
LSRQDGKGD

SEQ ID NO: 578281 - protein, 9 aa, Homo Sapiens
AMPVGRTGA

SEQ ID NO: 578282 - protein, 9 aa, Homo Sapiens
LLVCPTAIV

SEQ ID NO: 578283 - protein, 9 aa, Homo Sapiens
VKLAYPLHF

SEQ ID NO: 578284 - protein, 9 aa, Homo Sapiens
GNSDHYHHH

SEQ ID NO: 578285 - protein, 9 aa, Homo Sapiens
HFQAFRSWR

SEQ ID NO: 578286 - protein, 9 aa, Homo Sapiens
CPAGPAWLT

SEQ ID NO: 578287 - protein, 9 aa, Homo Sapiens
GAPRRGPRG

SEQ ID NO: 578288 - protein, 9 aa, Homo Sapiens
GAEAPSQGW

SEQ ID NO: 578289 - protein, 9 aa, Homo Sapiens
NRLRLQGMG

SEQ ID NO: 578290 - protein, 9 aa, Homo Sapiens
LAPDTLDSS

SEQ ID NO: 578291 - protein, 9 aa, Homo Sapiens
KFAHHIISG

SEQ ID NO: 578292 - protein, 9 aa, Homo Sapiens
GPRGAGVGA

SEQ ID NO: 578293 - protein, 9 aa, Homo Sapiens
VASRATLDS

SEQ ID NO: 578294 - protein, 9 aa, Homo Sapiens
FFRKFYNES

SEQ ID NO: 578295 - protein, 9 aa, Homo Sapiens
RSGKYENNS

SEQ ID NO: 578296 - protein, 9 aa, Homo Sapiens
QVGWLSGST

SEQ ID NO: 578297 - protein, 9 aa, Homo Sapiens
PLLGHLRRM

SEQ ID NO: 578298 - protein, 9 aa, Homo Sapiens
LKLESPTRS

SEQ ID NO: 578299 - protein, 9 aa, Homo Sapiens
RAVASRATL

SEQ ID NO: 578300 - protein, 9 aa, Homo Sapiens
GEMEELEAF

SEQ ID NO: 578301 - protein, 9 aa, Homo Sapiens
CPVGGPHNA

SEQ ID NO: 578302 - protein, 9 aa, Homo Sapiens
ELEAFWLTG

SEQ ID NO: 578303 - protein, 9 aa, Homo Sapiens
MEIRTLTNS

SEQ ID NO: 578304 - protein, 9 aa, Homo Sapiens
IPDLAHQWG

SEQ ID NO: 578305 - protein, 9 aa, Homo Sapiens
RTRVVSVQV

SEQ ID NO: 578306 - protein, 9 aa, Homo Sapiens
NESEDGDTP

SEQ ID NO: 578307 - protein, 9 aa, Homo Sapiens
LCEPIQAWE

SEQ ID NO: 578308 - protein, 9 aa, Homo Sapiens
KRLTLAEIY

SEQ ID NO: 578309 - protein, 9 aa, Homo Sapiens
AAEKQALEQ

SEQ ID NO: 578310 - protein, 9 aa, Homo Sapiens
DVAGGLAID

SEQ ID NO: 578311 - protein, 9 aa, Homo Sapiens
CIPDLAHQW

SEQ ID NO: 578312 - protein, 9 aa, Homo Sapiens
STLLPYGFK

SEQ ID NO: 578313 - protein, 9 aa, Homo Sapiens
DEEEEASPS

SEQ ID NO: 578314 - protein, 9 aa, Homo Sapiens
VTVRVTDVN

SEQ ID NO: 578315 - protein, 9 aa, Homo Sapiens
PLAEKTSMH

SEQ ID NO: 578316 - protein, 9 aa, Homo Sapiens
TRVVSVQVE

SEQ ID NO: 578317 - protein, 9 aa, Homo Sapiens
PTSRRQCSN

SEQ ID NO: 578318 - protein, 9 aa, Homo Sapiens
KAKSKTSKP

SEQ ID NO: 578319 - protein, 9 aa, Homo Sapiens
DDLQFEDFG

SEQ ID NO: 578320 - protein, 9 aa, Homo Sapiens
RLRLQGMGR

SEQ ID NO: 578321 - protein, 9 aa, Homo Sapiens
KINFNPPLP

SEQ ID NO: 578322 - protein, 9 aa, Homo Sapiens
GCLLWKTET

SEQ ID NO: 578323 - protein, 9 aa, Homo Sapiens
TSRRQCSNS

SEQ ID NO: 578324 - protein, 9 aa, Homo Sapiens
HLRRMSWIR

SEQ ID NO: 578325 - protein, 9 aa, Homo Sapiens
KYENNSFSQ

SEQ ID NO: 578326 - protein, 9 aa, Homo Sapiens
APSQGWSHR

SEQ ID NO: 578327 - protein, 9 aa, Homo Sapiens
ILFFDQSWI

SEQ ID NO: 578328 - protein, 9 aa, Homo Sapiens
AASNCGKER

SEQ ID NO: 578329 - protein, 9 aa, Homo Sapiens
ERIPVKGLS

SEQ ID NO: 578330 - protein, 9 aa, Homo Sapiens
RIPDIRRLS

SEQ ID NO: 578331 - protein, 9 aa, Homo Sapiens
VCNEKYKRW

SEQ ID NO: 578332 - protein, 9 aa, Homo Sapiens
VKQISLAPD

SEQ ID NO: 578333 - protein, 9 aa, Homo Sapiens
QLVQDEEEE

SEQ ID NO: 578334 - protein, 9 aa, Homo Sapiens
FNNNVQSMR

SEQ ID NO: 578335 - protein, 9 aa, Homo Sapiens
GAASRGGQA

SEQ ID NO: 578336 - protein, 9 aa, Homo Sapiens
GHLRRMSWI

SEQ ID NO: 578337 - protein, 9 aa, Homo Sapiens
SDLDLWPWL

SEQ ID NO: 578338 - protein, 9 aa, Homo Sapiens
AQFTNVCDK

SEQ ID NO: 578339 - protein, 9 aa, Homo Sapiens
AFEYPYVQS

SEQ ID NO: 578340 - protein, 9 aa, Homo Sapiens
TLGCLLQTP

SEQ ID NO: 578341 - protein, 9 aa, Homo Sapiens
TALALILGT

SEQ ID NO: 578342 - protein, 9 aa, Homo Sapiens
FHTLGCLLQ

SEQ ID NO: 578343 - protein, 9 aa, Homo Sapiens
AVVKLAYPL

SEQ ID NO: 578344 - protein, 9 aa, Homo Sapiens
EGDIPKSPA

SEQ ID NO: 578345 - protein, 9 aa, Homo Sapiens
ASESRDLCH

SEQ ID NO: 578346 - protein, 9 aa, Homo Sapiens
PHNAPCAKG

SEQ ID NO: 578347 - protein, 9 aa, Homo Sapiens
STGCGSAVK

SEQ ID NO: 578348 - protein, 9 aa, Homo Sapiens
ETSSCQPSC

SEQ ID NO: 578349 - protein, 9 aa, Homo Sapiens
EAIRQQLAP

SEQ ID NO: 578350 - protein, 9 aa, Homo Sapiens
ENRRTESPC

SEQ ID NO: 578351 - protein, 9 aa, Homo Sapiens
TLLPYGFKS

SEQ ID NO: 578352 - protein, 9 aa, Homo Sapiens
IEEHSVDME

SEQ ID NO: 578353 - protein, 9 aa, Homo Sapiens
SLLCHPLCK

SEQ ID NO: 578354 - protein, 9 aa, Homo Sapiens
ALLPFFGQG

SEQ ID NO: 578355 - protein, 9 aa, Homo Sapiens
LASQGAVLL

SEQ ID NO: 578356 - protein, 9 aa, Homo Sapiens
VDMETHVKT

SEQ ID NO: 578357 - protein, 9 aa, Homo Sapiens
FQGMRSGGA

SEQ ID NO: 578358 - protein, 9 aa, Homo Sapiens
YTIDHTKLT

SEQ ID NO: 578359 - protein, 9 aa, Homo Sapiens
QISLAPDTL

SEQ ID NO: 578360 - protein, 9 aa, Homo Sapiens
PLCKSTCCV

SEQ ID NO: 578361 - protein, 9 aa, Homo Sapiens
DSPALNKMF

SEQ ID NO: 578362 - protein, 9 aa, Homo Sapiens
PLPNGQMSR

SEQ ID NO: 578363 - protein, 9 aa, Homo Sapiens
LCKSTCCVP

SEQ ID NO: 578364 - protein, 9 aa, Homo Sapiens
STASSGAST

SEQ ID NO: 578365 - protein, 9 aa, Homo Sapiens
GSKRGPSHA

SEQ ID NO: 578366 - protein, 9 aa, Homo Sapiens
LLQFLEDDE

SEQ ID NO: 578367 - protein, 9 aa, Homo Sapiens
YLKIRHSSC

SEQ ID NO: 578368 - protein, 9 aa, Homo Sapiens
NNSFSQERT

SEQ ID NO: 578369 - protein, 9 aa, Homo Sapiens
EPGEVGGAR

SEQ ID NO: 578370 - protein, 9 aa, Homo Sapiens
HFVAEDVVA

SEQ ID NO: 578371 - protein, 9 aa, Homo Sapiens
QRMAWDVEA

SEQ ID NO: 578372 - protein, 9 aa, Homo Sapiens
LHWQENGPI

SEQ ID NO: 578373 - protein, 9 aa, Homo Sapiens
WPRYSKPGV

SEQ ID NO: 578374 - protein, 9 aa, Homo Sapiens
TILNETLES

SEQ ID NO: 578375 - protein, 9 aa, Homo Sapiens
LLVQLEHSE

SEQ ID NO: 578376 - protein, 9 aa, Homo Sapiens
QNCPDPTPF

SEQ ID NO: 578377 - protein, 9 aa, Homo Sapiens
DKPTLAEMG

SEQ ID NO: 578378 - protein, 9 aa, Homo Sapiens
HIISGRLMV

SEQ ID NO: 578379 - protein, 9 aa, Homo Sapiens
CGDGSLSCP

SEQ ID NO: 578380 - protein, 9 aa, Homo Sapiens
RASESRDLC

SEQ ID NO: 578381 - protein, 9 aa, Homo Sapiens
LRSAGSLSG

SEQ ID NO: 578382 - protein, 9 aa, Homo Sapiens
QKQKTQASE

SEQ ID NO: 578383 - protein, 9 aa, Homo Sapiens
GMKINFNPP

SEQ ID NO: 578384 - protein, 9 aa, Homo Sapiens
TFESQLSLS

SEQ ID NO: 578385 - protein, 9 aa, Homo Sapiens
AHQGPPGSQ

SEQ ID NO: 578386 - protein, 9 aa, Homo Sapiens
LCLLEIHKI

SEQ ID NO: 578387 - protein, 9 aa, Homo Sapiens
SWLCLGNPR

SEQ ID NO: 578388 - protein, 9 aa, Homo Sapiens
CGKIEEHSV

SEQ ID NO: 578389 - protein, 9 aa, Homo Sapiens
PDPTPFQNG

SEQ ID NO: 578390 - protein, 9 aa, Homo Sapiens
PRRSTRASR

SEQ ID NO: 578391 - protein, 9 aa, Homo Sapiens
LSINGKILS

SEQ ID NO: 578392 - protein, 9 aa, Homo Sapiens
TCTDSPALN

SEQ ID NO: 578393 - protein, 9 aa, Homo Sapiens
KHNAGEDEY

SEQ ID NO: 578394 - protein, 9 aa, Homo Sapiens
SCGRLLDDH

SEQ ID NO: 578395 - protein, 9 aa, Homo Sapiens
FAKVVKIFK

SEQ ID NO: 578396 - protein, 9 aa, Homo Sapiens
VQLASQGAV

SEQ ID NO: 578397 - protein, 9 aa, Homo Sapiens
EELRRKPLE

SEQ ID NO: 578398 - protein, 9 aa, Homo Sapiens
KRYLCLLEI

SEQ ID NO: 578399 - protein, 9 aa, Homo Sapiens
APRRSTRAS

SEQ ID NO: 578400 - protein, 9 aa, Homo Sapiens
LTATQTRAS

SEQ ID NO: 578401 - protein, 9 aa, Homo Sapiens
KDVLPCLDG

SEQ ID NO: 578402 - protein, 9 aa, Homo Sapiens
RRPRRQRAS

SEQ ID NO: 578403 - protein, 9 aa, Homo Sapiens
VTCTDSPAL

SEQ ID NO: 578404 - protein, 9 aa, Homo Sapiens
TSSYPLAEK

SEQ ID NO: 578405 - protein, 9 aa, Homo Sapiens
EQGDGLVNS

SEQ ID NO: 578406 - protein, 9 aa, Homo Sapiens
EDDEIEMLE

SEQ ID NO: 578407 - protein, 9 aa, Homo Sapiens
VLRSAGSLS

SEQ ID NO: 578408 - protein, 9 aa, Homo Sapiens
MPKPSHLHK

SEQ ID NO: 578409 - protein, 9 aa, Homo Sapiens
AAVDPSLSD

SEQ ID NO: 578410 - protein, 9 aa, Homo Sapiens
RQRASESRD

SEQ ID NO: 578411 - protein, 9 aa, Homo Sapiens
TLQGGNMLV

SEQ ID NO: 578412 - protein, 9 aa, Homo Sapiens
DPASDSTVE

SEQ ID NO: 578413 - protein, 9 aa, Homo Sapiens
PSSVNQNFP

SEQ ID NO: 578414 - protein, 9 aa, Homo Sapiens
QGPPGSQLP

SEQ ID NO: 578415 - protein, 9 aa, Homo Sapiens
EALKDHHWK

SEQ ID NO: 578416 - protein, 9 aa, Homo Sapiens
VGEAIRQQL

SEQ ID NO: 578417 - protein, 9 aa, Homo Sapiens
PLLVCPTAI

SEQ ID NO: 578418 - protein, 9 aa, Homo Sapiens
ERALVFPEG

SEQ ID NO: 578419 - protein, 9 aa, Homo Sapiens
ERTRVVSVQ

SEQ ID NO: 578420 - protein, 9 aa, Homo Sapiens
NAQFTNVCD

SEQ ID NO: 578421 - protein, 9 aa, Homo Sapiens
RFAASNCGK

SEQ ID NO: 578422 - protein, 9 aa, Homo Sapiens
TEFILEEDD

SEQ ID NO: 578423 - protein, 9 aa, Homo Sapiens
GEKPYQFKE

SEQ ID NO: 578424 - protein, 9 aa, Homo Sapiens
RACLQPPQD

SEQ ID NO: 578425 - protein, 9 aa, Homo Sapiens
RRAHLLLVQ

SEQ ID NO: 578426 - protein, 9 aa, Homo Sapiens
DALQNFINI

SEQ ID NO: 578427 - protein, 9 aa, Homo Sapiens
MQPYYKDVL

SEQ ID NO: 578428 - protein, 9 aa, Homo Sapiens
LELQILCEP

SEQ ID NO: 578429 - protein, 9 aa, Homo Sapiens
GPAWLTATQ

SEQ ID NO: 578430 - protein, 9 aa, Homo Sapiens
LSGAGLVPR

SEQ ID NO: 578431 - protein, 9 aa, Homo Sapiens
GSFKCKCDS

SEQ ID NO: 578432 - protein, 9 aa, Homo Sapiens
VGAHQGPPG

SEQ ID NO: 578433 - protein, 9 aa, Homo Sapiens
FDQNLSING

SEQ ID NO: 578434 - protein, 9 aa, Homo Sapiens
LTALRAQRA

SEQ ID NO: 578435 - protein, 9 aa, Homo Sapiens
WPWLGEPIY

SEQ ID NO: 578436 - protein, 9 aa, Homo Sapiens
MLVGDPTHS

SEQ ID NO: 578437 - protein, 9 aa, Homo Sapiens
LRRMSWIRI

SEQ ID NO: 578438 - protein, 9 aa, Homo Sapiens
GATYGSSSW

SEQ ID NO: 578439 - protein, 9 aa, Homo Sapiens
PPGERALVF

SEQ ID NO: 578440 - protein, 9 aa, Homo Sapiens
PKSPAKPIQ

SEQ ID NO: 578441 - protein, 9 aa, Homo Sapiens
VAFEYPYVQ

SEQ ID NO: 578442 - protein, 9 aa, Homo Sapiens
PSGDLLNMY

SEQ ID NO: 578443 - protein, 9 aa, Homo Sapiens
AYPLHFYEA

SEQ ID NO: 578444 - protein, 9 aa, Homo Sapiens
GGKPAFMGR

SEQ ID NO: 578445 - protein, 9 aa, Homo Sapiens
GNDVHVCNE

SEQ ID NO: 578446 - protein, 9 aa, Homo Sapiens
FRKFYNESE

SEQ ID NO: 578447 - protein, 9 aa, Homo Sapiens
AFWLTGICH

SEQ ID NO: 578448 - protein, 9 aa, Homo Sapiens
LQNCPDPTP

SEQ ID NO: 578449 - protein, 9 aa, Homo Sapiens
RRGPRGAGV

SEQ ID NO: 578450 - protein, 9 aa, Homo Sapiens
LGNRLRLQG

SEQ ID NO: 578451 - protein, 9 aa, Homo Sapiens
KLTPASTPE

SEQ ID NO: 578452 - protein, 9 aa, Homo Sapiens
EIWYDTSND

SEQ ID NO: 578453 - protein, 9 aa, Homo Sapiens
LTLAEIYEW

SEQ ID NO: 578454 - protein, 9 aa, Homo Sapiens
WVTVRVTDV

SEQ ID NO: 578455 - protein, 9 aa, Homo Sapiens
SIWVTVRVT

SEQ ID NO: 578456 - protein, 9 aa, Homo Sapiens
EMEIRTLTN

SEQ ID NO: 578457 - protein, 9 aa, Homo Sapiens
APRRGPRGA

SEQ ID NO: 578458 - protein, 9 aa, Homo Sapiens
LTASAMPVG

SEQ ID NO: 578459 - protein, 9 aa, Homo Sapiens
GPPGSQLPP

SEQ ID NO: 578460 - protein, 9 aa, Homo Sapiens
RDFNNNVQS

SEQ ID NO: 578461 - protein, 9 aa, Homo Sapiens
QNGHLEPNS

SEQ ID NO: 578462 - protein, 9 aa, Homo Sapiens
EPNSDCLCL

SEQ ID NO: 578463 - protein, 9 aa, Homo Sapiens
QFKECGKAF

SEQ ID NO: 578464 - protein, 9 aa, Homo Sapiens
LEDDEIEML

SEQ ID NO: 578465 - protein, 9 aa, Homo Sapiens
VVLLYYGTI

SEQ ID NO: 578466 - protein, 9 aa, Homo Sapiens
SPIVQLVQD

SEQ ID NO: 578467 - protein, 9 aa, Homo Sapiens
SIFFLTVVA

SEQ ID NO: 578468 - protein, 9 aa, Homo Sapiens
PLWPLPNGQ

SEQ ID NO: 578469 - protein, 9 aa, Homo Sapiens
LRRKPLEEK

SEQ ID NO: 578470 - protein, 9 aa, Homo Sapiens
PGVTRRCIP

SEQ ID NO: 578471 - protein, 9 aa, Homo Sapiens
KPYQFKECG

SEQ ID NO: 578472 - protein, 9 aa, Homo Sapiens
HLTCRAVAS

SEQ ID NO: 578473 - protein, 9 aa, Homo Sapiens
IVANTVTTV

SEQ ID NO: 578474 - protein, 9 aa, Homo Sapiens
PTLGMKINF

SEQ ID NO: 578475 - protein, 9 aa, Homo Sapiens
EETAAIIAQ

SEQ ID NO: 578476 - protein, 9 aa, Homo Sapiens
SWTVSSPAA

SEQ ID NO: 578477 - protein, 9 aa, Homo Sapiens
RHSSCGRLL

SEQ ID NO: 578478 - protein, 9 aa, Homo Sapiens
LGGKPAFMG

SEQ ID NO: 578479 - protein, 9 aa, Homo Sapiens
RLRLEDSLP

SEQ ID NO: 578480 - protein, 9 aa, Homo Sapiens
EHSVDMETH

SEQ ID NO: 578481 - protein, 9 aa, Homo Sapiens
SIEDRTRVP

SEQ ID NO: 578482 - protein, 9 aa, Homo Sapiens
VVKLAYPLH

SEQ ID NO: 578483 - protein, 9 aa, Homo Sapiens
ILNETLESM

SEQ ID NO: 578484 - protein, 9 aa, Homo Sapiens
GPGRFPPPI

SEQ ID NO: 578485 - protein, 9 aa, Homo Sapiens
AMNRQGSIF

SEQ ID NO: 578486 - protein, 9 aa, Homo Sapiens
NLLTRGQTH

SEQ ID NO: 578487 - protein, 9 aa, Homo Sapiens
SDSSTASSG

SEQ ID NO: 578488 - protein, 9 aa, Homo Sapiens
SDVQNGHLE

SEQ ID NO: 578489 - protein, 9 aa, Homo Sapiens
LTRGQTHDE

SEQ ID NO: 578490 - protein, 9 aa, Homo Sapiens
AGMGSRCGG

SEQ ID NO: 578491 - protein, 9 aa, Homo Sapiens
AGGVGLGHR

SEQ ID NO: 578492 - protein, 9 aa, Homo Sapiens
PAWLTATQT

SEQ ID NO: 578493 - protein, 9 aa, Homo Sapiens
CNEFTTHVI

SEQ ID NO: 578494 - protein, 9 aa, Homo Sapiens
SSARRSWIL

SEQ ID NO: 578495 - protein, 9 aa, Homo Sapiens
YYKDVLPCL

SEQ ID NO: 578496 - protein, 9 aa, Homo Sapiens
LAPLENRRT

SEQ ID NO: 578497 - protein, 9 aa, Homo Sapiens
PTVSRPYYF

SEQ ID NO: 578498 - protein, 9 aa, Homo Sapiens
QGAVLLLLR

SEQ ID NO: 578499 - protein, 9 aa, Homo Sapiens
QGMRSGGAF

SEQ ID NO: 578500 - protein, 9 aa, Homo Sapiens
TASSGASTA

SEQ ID NO: 578501 - protein, 9 aa, Homo Sapiens
CHPLCKSTC

SEQ ID NO: 578502 - protein, 9 aa, Homo Sapiens
SQGWSHRTA

SEQ ID NO: 578503 - protein, 9 aa, Homo Sapiens
GRTGAEAPS

SEQ ID NO: 578504 - protein, 9 aa, Homo Sapiens
SAAVVHTIL

SEQ ID NO: 578505 - protein, 9 aa, Homo Sapiens
PQPLQGSPT

SEQ ID NO: 578506 - protein, 9 aa, Homo Sapiens
ELELKDRQS

SEQ ID NO: 578507 - protein, 9 aa, Homo Sapiens
EAPSQGWSH

SEQ ID NO: 578508 - protein, 9 aa, Homo Sapiens
LAIIKVLGK

SEQ ID NO: 578509 - protein, 9 aa, Homo Sapiens
FEDFGNAAT

SEQ ID NO: 578510 - protein, 9 aa, Homo Sapiens
HQGPPGSQL

SEQ ID NO: 578511 - protein, 9 aa, Homo Sapiens
SLGTRMGTL

SEQ ID NO: 578512 - protein, 9 aa, Homo Sapiens
VDDLQFEDF

SEQ ID NO: 578513 - protein, 9 aa, Homo Sapiens
SQLPPLSSL

SEQ ID NO: 578514 - protein, 9 aa, Homo Sapiens
AGAPRRGPR

SEQ ID NO: 578515 - protein, 9 aa, Homo Sapiens
ALERTRVVS

SEQ ID NO: 578516 - protein, 9 aa, Homo Sapiens
SLRALPCAP

SEQ ID NO: 578517 - protein, 9 aa, Homo Sapiens
PCVGSHVGT

SEQ ID NO: 578518 - protein, 9 aa, Homo Sapiens
LLSAVSNML

SEQ ID NO: 578519 - protein, 9 aa, Homo Sapiens
TGAEAPSQG

SEQ ID NO: 578520 - protein, 9 aa, Homo Sapiens
TLCYLGNRL

SEQ ID NO: 578521 - protein, 9 aa, Homo Sapiens
SKRGPSHAP

SEQ ID NO: 578522 - protein, 9 aa, Homo Sapiens
ALVFPEGQL

SEQ ID NO: 578523 - protein, 9 aa, Homo Sapiens
FQAFRSWRE

SEQ ID NO: 578524 - protein, 9 aa, Homo Sapiens
TTGNSDHYH

SEQ ID NO: 578525 - protein, 9 aa, Homo Sapiens
LTFSTGRGL

SEQ ID NO: 578526 - protein, 9 aa, Homo Sapiens
RRSTRASRC

SEQ ID NO: 578527 - protein, 9 aa, Homo Sapiens
VHTILNETL

SEQ ID NO: 578528 - protein, 9 aa, Homo Sapiens
NGQMSREKQ

SEQ ID NO: 578529 - protein, 9 aa, Homo Sapiens
VHVCNEKYK

SEQ ID NO: 578530 - protein, 9 aa, Homo Sapiens
HYTLLELFA

SEQ ID NO: 578531 - protein, 9 aa, Homo Sapiens
DFNNNVQSM

SEQ ID NO: 578532 - protein, 9 aa, Homo Sapiens
RGVPACSHV

SEQ ID NO: 578533 - protein, 9 aa, Homo Sapiens
GERALVFPE

SEQ ID NO: 578534 - protein, 9 aa, Homo Sapiens
TGEKPYQFK

SEQ ID NO: 578535 - protein, 9 aa, Homo Sapiens
RSWTVSSPA

SEQ ID NO: 578536 - protein, 9 aa, Homo Sapiens
PVKGLSRQD

SEQ ID NO: 578537 - protein, 9 aa, Homo Sapiens
TGCGSAVKV

SEQ ID NO: 578538 - protein, 9 aa, Homo Sapiens
VVSVQVEMS

SEQ ID NO: 578539 - protein, 9 aa, Homo Sapiens
HTILNETLE

SEQ ID NO: 578540 - protein, 9 aa, Homo Sapiens
MEELEAFWL

SEQ ID NO: 578541 - protein, 9 aa, Homo Sapiens
EEELRRKPL

SEQ ID NO: 578542 - protein, 9 aa, Homo Sapiens
PDLAHQWGE

SEQ ID NO: 578543 - protein, 9 aa, Homo Sapiens
VPEGAGFKR

SEQ ID NO: 578544 - protein, 9 aa, Homo Sapiens
PPQDPQMRL

SEQ ID NO: 578545 - protein, 9 aa, Homo Sapiens
QLYVMKVLK

SEQ ID NO: 578546 - protein, 9 aa, Homo Sapiens
TGNSDHYHH

SEQ ID NO: 578547 - protein, 9 aa, Homo Sapiens
MDTYEMEIR

SEQ ID NO: 578548 - protein, 9 aa, Homo Sapiens
QKSSLESHK

SEQ ID NO: 578549 - protein, 9 aa, Homo Sapiens
LVQDEEEEA

SEQ ID NO: 578550 - protein, 9 aa, Homo Sapiens
CLDVIFAGG

SEQ ID NO: 578551 - protein, 9 aa, Homo Sapiens
VLLYYGTIV

SEQ ID NO: 578552 - protein, 9 aa, Homo Sapiens
YVMKVLKKA

SEQ ID NO: 578553 - protein, 9 aa, Homo Sapiens
VGDPTHSRS

SEQ ID NO: 578554 - protein, 9 aa, Homo Sapiens
NTIGSFKCK

SEQ ID NO: 578555 - protein, 9 aa, Homo Sapiens
CNNVIPKRI

SEQ ID NO: 578556 - protein, 9 aa, Homo Sapiens
SLSGAGLVP

SEQ ID NO: 578557 - protein, 9 aa, Homo Sapiens
FWLTGICHN

SEQ ID NO: 578558 - protein, 9 aa, Homo Sapiens
PGERALVFP

SEQ ID NO: 578559 - protein, 9 aa, Homo Sapiens
PPLSSLGTR

SEQ ID NO: 578560 - protein, 9 aa, Homo Sapiens
SGRLMVIHA

SEQ ID NO: 578561 - protein, 9 aa, Homo Sapiens
TTKMITDYL

SEQ ID NO: 578562 - protein, 9 aa, Homo Sapiens
EIRTLTNSG

SEQ ID NO: 578563 - protein, 9 aa, Homo Sapiens
ATTKMITDY

SEQ ID NO: 578564 - protein, 9 aa, Homo Sapiens
KDVQLAIIK

SEQ ID NO: 578565 - protein, 9 aa, Homo Sapiens
GKYENNSFS

SEQ ID NO: 578566 - protein, 9 aa, Homo Sapiens
PCLCACGDG

SEQ ID NO: 578567 - protein, 9 aa, Homo Sapiens
KVQTTETQV

SEQ ID NO: 578568 - protein, 9 aa, Homo Sapiens
LLPFFGQGR

SEQ ID NO: 578569 - protein, 9 aa, Homo Sapiens
RELELKDRQ

SEQ ID NO: 578570 - protein, 9 aa, Homo Sapiens
ARLAAEKQA

SEQ ID NO: 578571 - protein, 9 aa, Homo Sapiens
KSVTCTDSP

SEQ ID NO: 578572 - protein, 9 aa, Homo Sapiens
TIETHKRIR

SEQ ID NO: 578573 - protein, 9 aa, Homo Sapiens
VPTVSRPYY

SEQ ID NO: 578574 - protein, 9 aa, Homo Sapiens
QLLQLYTED

SEQ ID NO: 578575 - protein, 9 aa, Homo Sapiens
RFPPPISPP

SEQ ID NO: 578576 - protein, 9 aa, Homo Sapiens
QGWSHRTAD

SEQ ID NO: 578577 - protein, 9 aa, Homo Sapiens
LQGGNMLVG

SEQ ID NO: 578578 - protein, 9 aa, Homo Sapiens
FLYPTNAMV

SEQ ID NO: 578579 - protein, 9 aa, Homo Sapiens
MERAGAASR

SEQ ID NO: 578580 - protein, 9 aa, Homo Sapiens
SASWALIAW

SEQ ID NO: 578581 - protein, 9 aa, Homo Sapiens
GQKSSLESH

SEQ ID NO: 578582 - protein, 9 aa, Homo Sapiens
HRTADAGAP

SEQ ID NO: 578583 - protein, 9 aa, Homo Sapiens
VTAAVDPSL

SEQ ID NO: 578584 - protein, 9 aa, Homo Sapiens
ILCEPIQAW

SEQ ID NO: 578585 - protein, 9 aa, Homo Sapiens
FNFGHSKLQ

SEQ ID NO: 578586 - protein, 9 aa, Homo Sapiens
VPAPGAGTS

SEQ ID NO: 578587 - protein, 9 aa, Homo Sapiens
RKPLEEKRR

SEQ ID NO: 578588 - protein, 9 aa, Homo Sapiens
LQFLEDDEI

SEQ ID NO: 578589 - protein, 9 aa, Homo Sapiens
SHYTLLELF

SEQ ID NO: 578590 - protein, 9 aa, Homo Sapiens
QFEDFGNAA

SEQ ID NO: 578591 - protein, 9 aa, Homo Sapiens
IYVFHTLGC

SEQ ID NO: 578592 - protein, 9 aa, Homo Sapiens
YGFKSLPLQ

SEQ ID NO: 578593 - protein, 9 aa, Homo Sapiens
PMQLKIYSI

SEQ ID NO: 578594 - protein, 9 aa, Homo Sapiens
LTVVLLYYG

SEQ ID NO: 578595 - protein, 9 aa, Homo Sapiens
EEDDPASDS

SEQ ID NO: 578596 - protein, 9 aa, Homo Sapiens
VAGQIILQE

SEQ ID NO: 578597 - protein, 9 aa, Homo Sapiens
KTETGRFKD

SEQ ID NO: 578598 - protein, 9 aa, Homo Sapiens
ISFFNFGHS

SEQ ID NO: 578599 - protein, 9 aa, Homo Sapiens
DLLAVGLLR

SEQ ID NO: 578600 - protein, 9 aa, Homo Sapiens
LLPLRPGYG

SEQ ID NO: 578601 - protein, 9 aa, Homo Sapiens
PGAGTSGGT

SEQ ID NO: 578602 - protein, 9 aa, Homo Sapiens
NLLSAVSNM

SEQ ID NO: 578603 - protein, 9 aa, Homo Sapiens
LCYLGNRLR

SEQ ID NO: 578604 - protein, 9 aa, Homo Sapiens
KGTYMCEAE

SEQ ID NO: 578605 - protein, 9 aa, Homo Sapiens
ASRCRAPLG

SEQ ID NO: 578606 - protein, 9 aa, Homo Sapiens
ATYGSSSWL

SEQ ID NO: 578607 - protein, 9 aa, Homo Sapiens
EDSLPQPLQ

SEQ ID NO: 578608 - protein, 9 aa, Homo Sapiens
PGELWAGMG

SEQ ID NO: 578609 - protein, 9 aa, Homo Sapiens
TYEMEIRTL

SEQ ID NO: 578610 - protein, 9 aa, Homo Sapiens
TVRVTDVND

SEQ ID NO: 578611 - protein, 9 aa, Homo Sapiens
IQVTAIDAD

SEQ ID NO: 578612 - protein, 9 aa, Homo Sapiens
HCNNMFAKV

SEQ ID NO: 578613 - protein, 9 aa, Homo Sapiens
RGLTALRAQ

SEQ ID NO: 578614 - protein, 9 aa, Homo Sapiens
LYVMKVLKK

SEQ ID NO: 578615 - protein, 9 aa, Homo Sapiens
KDRQSRLQQ

SEQ ID NO: 578616 - protein, 9 aa, Homo Sapiens
RPRRQRASE

SEQ ID NO: 578617 - protein, 9 aa, Homo Sapiens
LWPLPNGQM

SEQ ID NO: 578618 - protein, 9 aa, Homo Sapiens
LWKTETGRF

SEQ ID NO: 578619 - protein, 9 aa, Homo Sapiens
GDVAGGLAI

SEQ ID NO: 578620 - protein, 9 aa, Homo Sapiens
RGLDFVHHS

SEQ ID NO: 578621 - protein, 9 aa, Homo Sapiens
VGWLSGSTT

SEQ ID NO: 578622 - protein, 9 aa, Homo Sapiens
IRHSSCGRL

SEQ ID NO: 578623 - protein, 9 aa, Homo Sapiens
ELVGEAIRQ

SEQ ID NO: 578624 - protein, 9 aa, Homo Sapiens
FKRHLPKVQ

SEQ ID NO: 578625 - protein, 9 aa, Homo Sapiens
TALRAQRAA

SEQ ID NO: 578626 - protein, 9 aa, Homo Sapiens
QRSQHCKSE

SEQ ID NO: 578627 - protein, 9 aa, Homo Sapiens
SAMPVGRTG

SEQ ID NO: 578628 - protein, 9 aa, Homo Sapiens
VGLGHRSWT

SEQ ID NO: 578629 - protein, 9 aa, Homo Sapiens
LASFATTKM

SEQ ID NO: 578630 - protein, 9 aa, Homo Sapiens
CLLQTPKLL

SEQ ID NO: 578631 - protein, 9 aa, Homo Sapiens
GQLYVMKVL

SEQ ID NO: 578632 - protein, 9 aa, Homo Sapiens
SAVVKLAYP

SEQ ID NO: 578633 - protein, 9 aa, Homo Sapiens
HTGEKPYQF

SEQ ID NO: 578634 - protein, 9 aa, Homo Sapiens
GVSMRLLES

SEQ ID NO: 578635 - protein, 9 aa, Homo Sapiens
RVVSVQVEM

SEQ ID NO: 578636 - protein, 9 aa, Homo Sapiens
HKRIRTGEK

SEQ ID NO: 578637 - protein, 9 aa, Homo Sapiens
EYPYVQSCN

SEQ ID NO: 578638 - protein, 9 aa, Homo Sapiens
IDHTKLTPA

SEQ ID NO: 578639 - protein, 9 aa, Homo Sapiens
DAVTAAVDP

SEQ ID NO: 578640 - protein, 9 aa, Homo Sapiens
QPYYKDVLP

SEQ ID NO: 578641 - protein, 9 aa, Homo Sapiens
GLSRIFKEA

SEQ ID NO: 578642 - protein, 9 aa, Homo Sapiens
AVLLLLRVL

SEQ ID NO: 578643 - protein, 9 aa, Homo Sapiens
LRAALILRV

SEQ ID NO: 578644 - protein, 9 aa, Homo Sapiens
KVFGQKSSL

SEQ ID NO: 578645 - protein, 9 aa, Homo Sapiens
LRLQGMGRA

SEQ ID NO: 578646 - protein, 9 aa, Homo Sapiens
HTCPRGVPA

SEQ ID NO: 578647 - protein, 9 aa, Homo Sapiens
SSEQGDGLV

SEQ ID NO: 578648 - protein, 9 aa, Homo Sapiens
VARLAAEKQ

SEQ ID NO: 578649 - protein, 9 aa, Homo Sapiens
WLQKHNAGE

SEQ ID NO: 578650 - protein, 9 aa, Homo Sapiens
VHLTREEVM

SEQ ID NO: 578651 - protein, 9 aa, Homo Sapiens
ERAGAASRG

SEQ ID NO: 578652 - protein, 9 aa, Homo Sapiens
MAGQVGWLS

SEQ ID NO: 578653 - protein, 9 aa, Homo Sapiens
AVASRATLD

SEQ ID NO: 578654 - protein, 9 aa, Homo Sapiens
MGTLCYLGN

SEQ ID NO: 578655 - protein, 9 aa, Homo Sapiens
PSQGWSHRT

SEQ ID NO: 578656 - protein, 9 aa, Homo Sapiens
LLCHPLCKS

SEQ ID NO: 578657 - protein, 9 aa, Homo Sapiens
GSRRGPCLC

SEQ ID NO: 578658 - protein, 9 aa, Homo Sapiens
HDEISRLSG

SEQ ID NO: 578659 - protein, 9 aa, Homo Sapiens
NVIPKRIPD

SEQ ID NO: 578660 - protein, 9 aa, Homo Sapiens
HPLCKSTCC

SEQ ID NO: 578661 - protein, 9 aa, Homo Sapiens
SQGAVLLLL

SEQ ID NO: 578662 - protein, 9 aa, Homo Sapiens
RLPGSKRGP

SEQ ID NO: 578663 - protein, 9 aa, Homo Sapiens
SYSSLFPET

SEQ ID NO: 578664 - protein, 9 aa, Homo Sapiens
EDDPASDST

SEQ ID NO: 578665 - protein, 9 aa, Homo Sapiens
PRYSKPGVS

SEQ ID NO: 578666 - protein, 9 aa, Homo Sapiens
GLTALALIL

SEQ ID NO: 578667 - protein, 9 aa, Homo Sapiens
ASEDLIPSH

SEQ ID NO: 578668 - protein, 9 aa, Homo Sapiens
NSFSQERTV

SEQ ID NO: 578669 - protein, 9 aa, Homo Sapiens
GAAPRRSTR

SEQ ID NO: 578670 - protein, 9 aa, Homo Sapiens
KIEEHSVDM

SEQ ID NO: 578671 - protein, 9 aa, Homo Sapiens
LSRIFKEAR

SEQ ID NO: 578672 - protein, 9 aa, Homo Sapiens
PYAIGMPLQ

SEQ ID NO: 578673 - protein, 9 aa, Homo Sapiens
RCIPDLAHQ

SEQ ID NO: 578674 - protein, 9 aa, Homo Sapiens
AVPLPTVSW

SEQ ID NO: 578675 - protein, 9 aa, Homo Sapiens
VFPEGQLAL

SEQ ID NO: 578676 - protein, 9 aa, Homo Sapiens
GGPHNAPCA

SEQ ID NO: 578677 - protein, 9 aa, Homo Sapiens
GSQLPPLSS

SEQ ID NO: 578678 - protein, 9 aa, Homo Sapiens
FESQLSLSF

SEQ ID NO: 578679 - protein, 9 aa, Homo Sapiens
KSEEGLEAR

SEQ ID NO: 578680 - protein, 9 aa, Homo Sapiens
GREDFKPCV

SEQ ID NO: 578681 - protein, 9 aa, Homo Sapiens
TFSTGRGLD

SEQ ID NO: 578682 - protein, 9 aa, Homo Sapiens
MALLPFFGQ

SEQ ID NO: 578683 - protein, 9 aa, Homo Sapiens
ILGTSLIYW

SEQ ID NO: 578684 - protein, 9 aa, Homo Sapiens
VVHTILNET

SEQ ID NO: 578685 - protein, 9 aa, Homo Sapiens
PVGRTGAEA

SEQ ID NO: 578686 - protein, 9 aa, Homo Sapiens
PLENRRTES

SEQ ID NO: 578687 - protein, 9 aa, Homo Sapiens
LGLEFREIA

SEQ ID NO: 578688 - protein, 9 aa, Homo Sapiens
DPTPFQNGY

SEQ ID NO: 578689 - protein, 9 aa, Homo Sapiens
HHSQNLLSA

SEQ ID NO: 578690 - protein, 9 aa, Homo Sapiens
RQRILESEK

SEQ ID NO: 578691 - protein, 9 aa, Homo Sapiens
QGGNMLVGD

SEQ ID NO: 578692 - protein, 9 aa, Homo Sapiens
GLGHRSWTV

SEQ ID NO: 578693 - protein, 9 aa, Homo Sapiens
AIDADDANY

SEQ ID NO: 578694 - protein, 9 aa, Homo Sapiens
RQLQEAEKE

SEQ ID NO: 578695 - protein, 9 aa, Homo Sapiens
EPSQDLKLE

SEQ ID NO: 578696 - protein, 9 aa, Homo Sapiens
CPPAHTCPR

SEQ ID NO: 578697 - protein, 9 aa, Homo Sapiens
ILESEKNEM

SEQ ID NO: 578698 - protein, 9 aa, Homo Sapiens
AMVTHKSDS

SEQ ID NO: 578699 - protein, 9 aa, Homo Sapiens
LILGTSLIY

SEQ ID NO: 578700 - protein, 9 aa, Homo Sapiens
GVTRRCIPD

SEQ ID NO: 578701 - protein, 9 aa, Homo Sapiens
PGRFPPPIS

SEQ ID NO: 578702 - protein, 9 aa, Homo Sapiens
NFGHSKLQS

SEQ ID NO: 578703 - protein, 9 aa, Homo Sapiens
EKVQTTETQ

SEQ ID NO: 578704 - protein, 9 aa, Homo Sapiens
QFLEDDEIE

SEQ ID NO: 578705 - protein, 9 aa, Homo Sapiens
EQLIRDFNN

SEQ ID NO: 578706 - protein, 9 aa, Homo Sapiens
SSDSYSSLF

SEQ ID NO: 578707 - protein, 9 aa, Homo Sapiens
PAPGAGTSG

SEQ ID NO: 578708 - protein, 9 aa, Homo Sapiens
INGKILSDD

SEQ ID NO: 578709 - protein, 9 aa, Homo Sapiens
DPVAFEYPY

SEQ ID NO: 578710 - protein, 9 aa, Homo Sapiens
TKGEKVQTT

SEQ ID NO: 578711 - protein, 9 aa, Homo Sapiens
AGSRRGPCL

SEQ ID NO: 578712 - protein, 9 aa, Homo Sapiens
RPLGAAPRR

SEQ ID NO: 578713 - protein, 9 aa, Homo Sapiens
HKKNLDVTK

SEQ ID NO: 578714 - protein, 9 aa, Homo Sapiens
LQILCEPIQ

SEQ ID NO: 578715 - protein, 9 aa, Homo Sapiens
KSLRALPCA

SEQ ID NO: 578716 - protein, 9 aa, Homo Sapiens
VTAIDADDA

SEQ ID NO: 578717 - protein, 9 aa, Homo Sapiens
PTPFQNGYM

SEQ ID NO: 578718 - protein, 9 aa, Homo Sapiens
NGKILSDDC

SEQ ID NO: 578719 - protein, 9 aa, Homo Sapiens
MFAKVVKIF

SEQ ID NO: 578720 - protein, 9 aa, Homo Sapiens
MIAGDRQNH

SEQ ID NO: 578721 - protein, 9 aa, Homo Sapiens
TRASRCRAP

SEQ ID NO: 578722 - protein, 9 aa, Homo Sapiens
GLTALRAQR

SEQ ID NO: 578723 - protein, 9 aa, Homo Sapiens
LGTRMGTLC

SEQ ID NO: 578724 - protein, 9 aa, Homo Sapiens
EMEELEAFW

SEQ ID NO: 578725 - protein, 9 aa, Homo Sapiens
KLFLIDFGM

SEQ ID NO: 578726 - protein, 9 aa, Homo Sapiens
DNEVNNMLR

SEQ ID NO: 578727 - protein, 9 aa, Homo Sapiens
IFARELELK

SEQ ID NO: 578728 - protein, 9 aa, Homo Sapiens
FLAPLENRR

SEQ ID NO: 578729 - protein, 9 aa, Homo Sapiens
VPFRAVPLP

SEQ ID NO: 578730 - protein, 9 aa, Homo Sapiens
SRRESKTRL

SEQ ID NO: 578731 - protein, 9 aa, Homo Sapiens
NMRENCGQG

SEQ ID NO: 578732 - protein, 9 aa, Homo Sapiens
IIKVLGKKG

SEQ ID NO: 578733 - protein, 9 aa, Homo Sapiens
EVNNMLRQL

SEQ ID NO: 578734 - protein, 9 aa, Homo Sapiens
SLSFYTNAK

SEQ ID NO: 578735 - protein, 9 aa, Homo Sapiens
MSLASFATT

SEQ ID NO: 578736 - protein, 9 aa, Homo Sapiens
EKPYQFKEC

SEQ ID NO: 578737 - protein, 9 aa, Homo Sapiens
NFINICRNL

SEQ ID NO: 578738 - protein, 9 aa, Homo Sapiens
ILEEDDPAS

SEQ ID NO: 578739 - protein, 9 aa, Homo Sapiens
RTESPCTFQ

SEQ ID NO: 578740 - protein, 9 aa, Homo Sapiens
RYLCLLEIH

SEQ ID NO: 578741 - protein, 9 aa, Homo Sapiens
DIPKSPAKP

SEQ ID NO: 578742 - protein, 9 aa, Homo Sapiens
NVCDKPTLA

SEQ ID NO: 578743 - protein, 9 aa, Homo Sapiens
LVNSVASPG

SEQ ID NO: 578744 - protein, 9 aa, Homo Sapiens
GWSHRTADA

SEQ ID NO: 578745 - protein, 9 aa, Homo Sapiens
TRILFFDQS

SEQ ID NO: 578746 - protein, 9 aa, Homo Sapiens
STRASRCRA

SEQ ID NO: 578747 - protein, 9 aa, Homo Sapiens
PLSGLLLLT

SEQ ID NO: 578748 - protein, 9 aa, Homo Sapiens
FLIDFGMAK

SEQ ID NO: 578749 - protein, 9 aa, Homo Sapiens
YGLTALALI

SEQ ID NO: 578750 - protein, 9 aa, Homo Sapiens
EMPKPSHLH

SEQ ID NO: 578751 - protein, 9 aa, Homo Sapiens
LLAVGLLRA

SEQ ID NO: 578752 - protein, 9 aa, Homo Sapiens
LALILGTSL

SEQ ID NO: 578753 - protein, 9 aa, Homo Sapiens
CSNSPGESE

SEQ ID NO: 578754 - protein, 9 aa, Homo Sapiens
KSEALKDHH

SEQ ID NO: 578755 - protein, 9 aa, Homo Sapiens
TADAGAPRR

SEQ ID NO: 578756 - protein, 9 aa, Homo Sapiens
AQKQKTQAS

SEQ ID NO: 578757 - protein, 9 aa, Homo Sapiens
NLGLEFREI

SEQ ID NO: 578758 - protein, 9 aa, Homo Sapiens
VSPSQAQGQ

SEQ ID NO: 578759 - protein, 9 aa, Homo Sapiens
YAIGMPLQE

SEQ ID NO: 578760 - protein, 9 aa, Homo Sapiens
TPLLGHLRR

SEQ ID NO: 578761 - protein, 9 aa, Homo Sapiens
PYQFKECGK

SEQ ID NO: 578762 - protein, 9 aa, Homo Sapiens
PYGFKSLPL

SEQ ID NO: 578763 - protein, 9 aa, Homo Sapiens
GPIFSSTPY

SEQ ID NO: 578764 - protein, 9 aa, Homo Sapiens
SGDLLNMYE

SEQ ID NO: 578765 - protein, 9 aa, Homo Sapiens
IGSFKCKCD

SEQ ID NO: 578766 - protein, 9 aa, Homo Sapiens
RLEDSLPQP

SEQ ID NO: 578767 - protein, 9 aa, Homo Sapiens
ADRQRILES

SEQ ID NO: 578768 - protein, 9 aa, Homo Sapiens
ALEQLIRDF

SEQ ID NO: 578769 - protein, 9 aa, Homo Sapiens
ATNSDSSTA

SEQ ID NO: 578770 - protein, 9 aa, Homo Sapiens
RAQRAAGGV

SEQ ID NO: 578771 - protein, 9 aa, Homo Sapiens
TNSDSSTAS

SEQ ID NO: 578772 - protein, 9 aa, Homo Sapiens
PPISPPYGP

SEQ ID NO: 578773 - protein, 9 aa, Homo Sapiens
PPPISPPYG

SEQ ID NO: 578774 - protein, 9 aa, Homo Sapiens
AASRGGQAP

SEQ ID NO: 578775 - protein, 9 aa, Homo Sapiens
LPNGQMSRE

SEQ ID NO: 578776 - protein, 9 aa, Homo Sapiens
VVAGQIILQ

SEQ ID NO: 578777 - protein, 9 aa, Homo Sapiens
CGSAVKVAK

SEQ ID NO: 578778 - protein, 9 aa, Homo Sapiens
VDPSLSDHG

SEQ ID NO: 578779 - protein, 9 aa, Homo Sapiens
VCPTAIVAN

SEQ ID NO: 578780 - protein, 9 aa, Homo Sapiens
DLWPWLGEP

SEQ ID NO: 578781 - protein, 9 aa, Homo Sapiens
TRSGKYENN

SEQ ID NO: 578782 - protein, 9 aa, Homo Sapiens
PTAIVANTV

SEQ ID NO: 578783 - protein, 9 aa, Homo Sapiens
GDRQNHQVK

SEQ ID NO: 578784 - protein, 9 aa, Homo Sapiens
MDKKRYLCL

SEQ ID NO: 578785 - protein, 9 aa, Homo Sapiens
DWLQKHNAG

SEQ ID NO: 578786 - protein, 9 aa, Homo Sapiens
AWLTATQTR

SEQ ID NO: 578787 - protein, 9 aa, Homo Sapiens
HVCNEKYKR

SEQ ID NO: 578788 - protein, 9 aa, Homo Sapiens
ENLGLEFRE

SEQ ID NO: 578789 - protein, 9 aa, Homo Sapiens
LSFYTNAKF

SEQ ID NO: 578790 - protein, 9 aa, Homo Sapiens
INFNPPLPM

SEQ ID NO: 578791 - protein, 9 aa, Homo Sapiens
RDPVAFEYP

SEQ ID NO: 578792 - protein, 9 aa, Homo Sapiens
SLAPDTLDS

SEQ ID NO: 578793 - protein, 9 aa, Homo Sapiens
YFIEFDTFI

SEQ ID NO: 578794 - protein, 9 aa, Homo Sapiens
VQLVQDEEE

SEQ ID NO: 578795 - protein, 9 aa, Homo Sapiens
GAGTSGGTS

SEQ ID NO: 578796 - protein, 9 aa, Homo Sapiens
CGQGVQTRK

SEQ ID NO: 578797 - protein, 9 aa, Homo Sapiens
KRIPDIRRL

SEQ ID NO: 578798 - protein, 9 aa, Homo Sapiens
MRSGGAFPG

SEQ ID NO: 578799 - protein, 9 aa, Homo Sapiens
KPLEEKRRK

SEQ ID NO: 578800 - protein, 9 aa, Homo Sapiens
RSQHCKSEE

SEQ ID NO: 578801 - protein, 9 aa, Homo Sapiens
GAVLLLLRV

SEQ ID NO: 578802 - protein, 9 aa, Homo Sapiens
RRSWILTAS

SEQ ID NO: 578803 - protein, 9 aa, Homo Sapiens
VMKVLKKAT

SEQ ID NO: 578804 - protein, 9 aa, Homo Sapiens
QAQGQGSNL

SEQ ID NO: 578805 - protein, 9 aa, Homo Sapiens
YENNSFSQE

SEQ ID NO: 578806 - protein, 9 aa, Homo Sapiens
CKSEEGLEA

SEQ ID NO: 578807 - protein, 9 aa, Homo Sapiens
SGAGLVPRE

SEQ ID NO: 578808 - protein, 9 aa, Homo Sapiens
LPYGFKSLP

SEQ ID NO: 578809 - protein, 9 aa, Homo Sapiens
SARRSWILT

SEQ ID NO: 578810 - protein, 9 aa, Homo Sapiens
SHLTVVLLY

SEQ ID NO: 578811 - protein, 9 aa, Homo Sapiens
GRFPPPISP

SEQ ID NO: 578812 - protein, 9 aa, Homo Sapiens
FILEEDDPA

SEQ ID NO: 578813 - protein, 9 aa, Homo Sapiens
CPRGVPACS

SEQ ID NO: 578814 - protein, 9 aa, Homo Sapiens
RSTRASRCR

SEQ ID NO: 578815 - protein, 9 aa, Homo Sapiens
SEEGLEARG

SEQ ID NO: 578816 - protein, 9 aa, Homo Sapiens
CRAPLGVRS

SEQ ID NO: 578817 - protein, 9 aa, Homo Sapiens
LDVIFAGGP

SEQ ID NO: 578818 - protein, 9 aa, Homo Sapiens
LEEDDPASD

SEQ ID NO: 578819 - protein, 9 aa, Homo Sapiens
LLYYGTIVG

SEQ ID NO: 578820 - protein, 9 aa, Homo Sapiens
FKSLPLQTS

SEQ ID NO: 578821 - protein, 9 aa, Homo Sapiens
ELWAGMGSR

SEQ ID NO: 578822 - protein, 9 aa, Homo Sapiens
CGKERFVKL

SEQ ID NO: 578823 - protein, 9 aa, Homo Sapiens
QHMDFDSHY

SEQ ID NO: 578824 - protein, 9 aa, Homo Sapiens
PVAFEYPYV

SEQ ID NO: 578825 - protein, 9 aa, Homo Sapiens
LLLLTAALE

SEQ ID NO: 578826 - protein, 9 aa, Homo Sapiens
AHTCPRGVP

SEQ ID NO: 578827 - protein, 9 aa, Homo Sapiens
PVRGLTALR

SEQ ID NO: 578828 - protein, 9 aa, Homo Sapiens
FVAEDVVAG

SEQ ID NO: 578829 - protein, 9 aa, Homo Sapiens
DLALLQFLE

SEQ ID NO: 578830 - protein, 9 aa, Homo Sapiens
HHIISGRLM

SEQ ID NO: 578831 - protein, 9 aa, Homo Sapiens
FTECLDVIF

SEQ ID NO: 578832 - protein, 9 aa, Homo Sapiens
QVTAIDADD

SEQ ID NO: 578833 - protein, 9 aa, Homo Sapiens
KRGPSHAPF

SEQ ID NO: 578834 - protein, 9 aa, Homo Sapiens
GSDAGQLYV

SEQ ID NO: 578835 - protein, 9 aa, Homo Sapiens
GLLPLRPGY

SEQ ID NO: 578836 - protein, 9 aa, Homo Sapiens
YVFHTLGCL

SEQ ID NO: 578837 - protein, 9 aa, Homo Sapiens
HSQNLLSAV

SEQ ID NO: 578838 - protein, 9 aa, Homo Sapiens
TPFQNGYMI

SEQ ID NO: 578839 - protein, 9 aa, Homo Sapiens
VHFVAEDVV

SEQ ID NO: 578840 - protein, 9 aa, Homo Sapiens
ETAAIIAQR

SEQ ID NO: 578841 - protein, 9 aa, Homo Sapiens
NEFTTHVIN

SEQ ID NO: 578842 - protein, 9 aa, Homo Sapiens
TCPRGVPAC

SEQ ID NO: 578843 - protein, 9 aa, Homo Sapiens
APLGVRSGC

SEQ ID NO: 578844 - protein, 9 aa, Homo Sapiens
NNMFAKVVK

SEQ ID NO: 578845 - protein, 9 aa, Homo Sapiens
AKVVKIFKE

SEQ ID NO: 578846 - protein, 9 aa, Homo Sapiens
NAISFFNFG

SEQ ID NO: 578847 - protein, 9 aa, Homo Sapiens
RRTESPCTF

SEQ ID NO: 578848 - protein, 9 aa, Homo Sapiens
AAPRRSTRA

SEQ ID NO: 578849 - protein, 9 aa, Homo Sapiens
NCGQGVQTR

SEQ ID NO: 578850 - protein, 9 aa, Homo Sapiens
ARRSWILTA

SEQ ID NO: 578851 - protein, 9 aa, Homo Sapiens
KTKGEKVQT

SEQ ID NO: 578852 - protein, 9 aa, Homo Sapiens
GQGVQTRKV

SEQ ID NO: 578853 - protein, 9 aa, Homo Sapiens
GGLAIDIDN

SEQ ID NO: 578854 - protein, 9 aa, Homo Sapiens
RHLTCRAVA

SEQ ID NO: 578855 - protein, 9 aa, Homo Sapiens
LAVGLLRAA

SEQ ID NO: 578856 - protein, 9 aa, Homo Sapiens
AQRAAGGVG

SEQ ID NO: 578857 - protein, 9 aa, Homo Sapiens
MLRQLQEAE

SEQ ID NO: 578858 - protein, 9 aa, Homo Sapiens
SINGKILSD

SEQ ID NO: 578859 - protein, 9 aa, Homo Sapiens
FKCKCDSGF

SEQ ID NO: 578860 - protein, 9 aa, Homo Sapiens
GYGERPLAW

SEQ ID NO: 578861 - protein, 9 aa, Homo Sapiens
ALILGTSLI

SEQ ID NO: 578862 - protein, 9 aa, Homo Sapiens
DKVFGQKSS

SEQ ID NO: 578863 - protein, 9 aa, Homo Sapiens
RRQRASESR

SEQ ID NO: 578864 - protein, 9 aa, Homo Sapiens
IDFGMAKKY

SEQ ID NO: 578865 - protein, 9 aa, Homo Sapiens
VSLLCHPLC

SEQ ID NO: 578866 - protein, 9 aa, Homo Sapiens
GRRSNVFGD

SEQ ID NO: 578867 - protein, 9 aa, Homo Sapiens
LVCPTAIVA

SEQ ID NO: 578868 - protein, 9 aa, Homo Sapiens
MPVGRTGAE

SEQ ID NO: 578869 - protein, 9 aa, Homo Sapiens
IRHLTCRAV

SEQ ID NO: 578870 - protein, 9 aa, Homo Sapiens
DQNLSINGK

SEQ ID NO: 578871 - protein, 9 aa, Homo Sapiens
NRSSRRESK

SEQ ID NO: 578872 - protein, 9 aa, Homo Sapiens
LAIDIDNCS

SEQ ID NO: 578873 - protein, 9 aa, Homo Sapiens
VRCYIYDPV

SEQ ID NO: 578874 - protein, 9 aa, Homo Sapiens
RHLPKVQMP

SEQ ID NO: 578875 - protein, 9 aa, Homo Sapiens
GMAKKYRDN

SEQ ID NO: 578876 - protein, 9 aa, Homo Sapiens
NKDVQLAII

SEQ ID NO: 578877 - protein, 9 aa, Homo Sapiens
FYNESEDGD

SEQ ID NO: 578878 - protein, 9 aa, Homo Sapiens
IYTIDHTKL

SEQ ID NO: 578879 - protein, 9 aa, Homo Sapiens
IKVLGKKGS

SEQ ID NO: 578880 - protein, 9 aa, Homo Sapiens
ACLQPPQDP

SEQ ID NO: 578881 - protein, 9 aa, Homo Sapiens
SLEMDLKPY

SEQ ID NO: 578882 - protein, 9 aa, Homo Sapiens
DKGTYMCEA

SEQ ID NO: 578883 - protein, 9 aa, Homo Sapiens
VQLEHSEPI

SEQ ID NO: 578884 - protein, 9 aa, Homo Sapiens
YPTNAMVTH

SEQ ID NO: 578885 - protein, 9 aa, Homo Sapiens
TCEAQLLQL

SEQ ID NO: 578886 - protein, 9 aa, Homo Sapiens
QAFRSWREE

SEQ ID NO: 578887 - protein, 9 aa, Homo Sapiens
MNRQGSIFF

SEQ ID NO: 578888 - protein, 9 aa, Homo Sapiens
FSGFLVATM

SEQ ID NO: 578889 - protein, 9 aa, Homo Sapiens
QKHNAGEDE

SEQ ID NO: 578890 - protein, 9 aa, Homo Sapiens
SESEVEETA

SEQ ID NO: 578891 - protein, 9 aa, Homo Sapiens
EAGSRRGPC

SEQ ID NO: 578892 - protein, 9 aa, Homo Sapiens
ASFATTKMI

SEQ ID NO: 578893 - protein, 9 aa, Homo Sapiens
TASAMPVGR

SEQ ID NO: 578894 - protein, 9 aa, Homo Sapiens
SSLFPETES

SEQ ID NO: 578895 - protein, 9 aa, Homo Sapiens
NGHLEPNSD

SEQ ID NO: 578896 - protein, 9 aa, Homo Sapiens
AIIKVLGKK

SEQ ID NO: 578897 - protein, 9 aa, Homo Sapiens
GNRLRLQGM

SEQ ID NO: 578898 - protein, 9 aa, Homo Sapiens
IYSIEDRTR

SEQ ID NO: 578899 - protein, 9 aa, Homo Sapiens
TAIVANTVT

SEQ ID NO: 578900 - protein, 9 aa, Homo Sapiens
WPLPNGQMS

SEQ ID NO: 578901 - protein, 9 aa, Homo Sapiens
TDLHGLSRI

SEQ ID NO: 578902 - protein, 9 aa, Homo Sapiens
QALEQVAEE

SEQ ID NO: 578903 - protein, 9 aa, Homo Sapiens
DTLDSSGDV

SEQ ID NO: 578904 - protein, 9 aa, Homo Sapiens
LHHSQNLLS

SEQ ID NO: 578905 - protein, 9 aa, Homo Sapiens
EEHSVDMET

SEQ ID NO: 578906 - protein, 9 aa, Homo Sapiens
GCGSAVKVA

SEQ ID NO: 578907 - protein, 9 aa, Homo Sapiens
GDLLNMYEL

SEQ ID NO: 578908 - protein, 9 aa, Homo Sapiens
EGAGFKRHL

SEQ ID NO: 578909 - protein, 9 aa, Homo Sapiens
QTTETQVFV

SEQ ID NO: 578910 - protein, 9 aa, Homo Sapiens
GCGFSTGCG

SEQ ID NO: 578911 - protein, 9 aa, Homo Sapiens
RGPSHAPFL

SEQ ID NO: 578912 - protein, 9 aa, Homo Sapiens
LLTAALEGY

SEQ ID NO: 578913 - protein, 9 aa, Homo Sapiens
FFDQSWIQW

SEQ ID NO: 578914 - protein, 9 aa, Homo Sapiens
LYPTNAMVT

SEQ ID NO: 578915 - protein, 9 aa, Homo Sapiens
VGRTGAEAP

SEQ ID NO: 578916 - protein, 9 aa, Homo Sapiens
HNAGEDEYE

SEQ ID NO: 578917 - protein, 9 aa, Homo Sapiens
FINICRNLW

SEQ ID NO: 578918 - protein, 9 aa, Homo Sapiens
SWALIAWEG

SEQ ID NO: 578919 - protein, 9 aa, Homo Sapiens
AKSVTCTDS

SEQ ID NO: 578920 - protein, 9 aa, Homo Sapiens
DVLPCLDGY

SEQ ID NO: 578921 - protein, 9 aa, Homo Sapiens
ASLSPSSVN

SEQ ID NO: 578922 - protein, 9 aa, Homo Sapiens
KPGVSMRLL

SEQ ID NO: 578923 - protein, 9 aa, Homo Sapiens
MGSRCGGEG

SEQ ID NO: 578924 - protein, 9 aa, Homo Sapiens
PAHTCPRGV

SEQ ID NO: 578925 - protein, 9 aa, Homo Sapiens
LGMKINFNP

SEQ ID NO: 578926 - protein, 9 aa, Homo Sapiens
WYDTSNDII

SEQ ID NO: 578927 - protein, 9 aa, Homo Sapiens
LSAVSNMLQ

SEQ ID NO: 578928 - protein, 9 aa, Homo Sapiens
AVDPSLSDH

SEQ ID NO: 578929 - protein, 9 aa, Homo Sapiens
SLFPETESV

SEQ ID NO: 578930 - protein, 9 aa, Homo Sapiens
AISFFNFGH

SEQ ID NO: 578931 - protein, 9 aa, Homo Sapiens
QLSLSFYTN

SEQ ID NO: 578932 - protein, 9 aa, Homo Sapiens
ISLAPDTLD

SEQ ID NO: 578933 - protein, 9 aa, Homo Sapiens
VVKIFKEVQ

SEQ ID NO: 578934 - protein, 9 aa, Homo Sapiens
INLLREQSR

SEQ ID NO: 578935 - protein, 9 aa, Homo Sapiens
CYLGNRLRL

SEQ ID NO: 578936 - protein, 9 aa, Homo Sapiens
AGTSGGTSP

SEQ ID NO: 578937 - protein, 9 aa, Homo Sapiens
QNLSINGKI

SEQ ID NO: 578938 - protein, 9 aa, Homo Sapiens
RTGEKPYRC

SEQ ID NO: 578939 - protein, 9 aa, Homo Sapiens
GCPAGPAWL

SEQ ID NO: 578940 - protein, 9 aa, Homo Sapiens
NSDHYHHHV

SEQ ID NO: 578941 - protein, 9 aa, Homo Sapiens
RSNVFGDKL

SEQ ID NO: 578942 - protein, 9 aa, Homo Sapiens
PNGQMSREK

SEQ ID NO: 578943 - protein, 9 aa, Homo Sapiens
EVGGARGPP

SEQ ID NO: 578944 - protein, 9 aa, Homo Sapiens
VCDKPTLAE

SEQ ID NO: 578945 - protein, 9 aa, Homo Sapiens
DSLPQPLQG

SEQ ID NO: 578946 - protein, 9 aa, Homo Sapiens
RGPCLCACG

SEQ ID NO: 578947 - protein, 9 aa, Homo Sapiens
DLLNMYELF

SEQ ID NO: 578948 - protein, 9 aa, Homo Sapiens
SSLGTRMGT

SEQ ID NO: 578949 - protein, 9 aa, Homo Sapiens
ITPLLGHLR

SEQ ID NO: 578950 - protein, 9 aa, Homo Sapiens
RAGAASRGG

SEQ ID NO: 578951 - protein, 9 aa, Homo Sapiens
SSYPLAEKT

SEQ ID NO: 578952 - protein, 9 aa, Homo Sapiens
WLTATQTRA

SEQ ID NO: 578953 - protein, 9 aa, Homo Sapiens
STGRGLDFV

SEQ ID NO: 578954 - protein, 9 aa, Homo Sapiens
GLAIDIDNC

SEQ ID NO: 578955 - protein, 9 aa, Homo Sapiens
PKPSHLHKK

SEQ ID NO: 578956 - protein, 9 aa, Homo Sapiens
VNSVASPGT

SEQ ID NO: 578957 - protein, 9 aa, Homo Sapiens
EIEIWYDTS

SEQ ID NO: 578958 - protein, 9 aa, Homo Sapiens
REMIAGDRQ

SEQ ID NO: 578959 - protein, 9 aa, Homo Sapiens
PSASWALIA

SEQ ID NO: 578960 - protein, 9 aa, Homo Sapiens
GELWAGMGS

SEQ ID NO: 578961 - protein, 9 aa, Homo Sapiens
VGGPHNAPC

SEQ ID NO: 578962 - protein, 9 aa, Homo Sapiens
CVGSHVGTG

SEQ ID NO: 578963 - protein, 9 aa, Homo Sapiens
RQGSIFFLT

SEQ ID NO: 578964 - protein, 9 aa, Homo Sapiens
KASLSPSSV

SEQ ID NO: 578965 - protein, 9 aa, Homo Sapiens
HTLGCLLQT

SEQ ID NO: 578966 - protein, 9 aa, Homo Sapiens
DLHGLSRIF

SEQ ID NO: 578967 - protein, 9 aa, Homo Sapiens
MAWDVEAGS

SEQ ID NO: 578968 - protein, 9 aa, Homo Sapiens
FNLNRSSRR

SEQ ID NO: 578969 - protein, 9 aa, Homo Sapiens
IVQLVQDEE

SEQ ID NO: 578970 - protein, 9 aa, Homo Sapiens
QPGPKGIRG

SEQ ID NO: 578971 - protein, 9 aa, Homo Sapiens
ASAMPVGRT

SEQ ID NO: 578972 - protein, 9 aa, Homo Sapiens
VCNNVIPKR

SEQ ID NO: 578973 - protein, 9 aa, Homo Sapiens
LIRDFNNNV

SEQ ID NO: 578974 - protein, 9 aa, Homo Sapiens
TQTRASQRM

SEQ ID NO: 578975 - protein, 9 aa, Homo Sapiens
DTYEMEIRT

SEQ ID NO: 578976 - protein, 9 aa, Homo Sapiens
HGLSRIFKE

SEQ ID NO: 578977 - protein, 9 aa, Homo Sapiens
FTTHVINLL

SEQ ID NO: 578978 - protein, 9 aa, Homo Sapiens
TLREMIAGD

SEQ ID NO: 578979 - protein, 9 aa, Homo Sapiens
ERRAHLLLV

SEQ ID NO: 578980 - protein, 9 aa, Homo Sapiens
DLQFEDFGN

SEQ ID NO: 578981 - protein, 9 aa, Homo Sapiens
RCRAPLGVR

SEQ ID NO: 578982 - protein, 9 aa, Homo Sapiens
QASEDLIPS

SEQ ID NO: 578983 - protein, 9 aa, Homo Sapiens
ELQILCEPI

SEQ ID NO: 578984 - protein, 9 aa, Homo Sapiens
ASDKGTYMC

SEQ ID NO: 578985 - protein, 9 aa, Homo Sapiens
VQLAIIKVL

SEQ ID NO: 578986 - protein, 9 aa, Homo Sapiens
SRRGPCLCA

SEQ ID NO: 578987 - protein, 9 aa, Homo Sapiens
NFFRKFYNE

SEQ ID NO: 578988 - protein, 9 aa, Homo Sapiens
KSPAKPIQP

SEQ ID NO: 578989 - protein, 9 aa, Homo Sapiens
PLRPGYGER

SEQ ID NO: 578990 - protein, 9 aa, Homo Sapiens
RVTDVNDHK

SEQ ID NO: 578991 - protein, 9 aa, Homo Sapiens
YLGNRLRLQ

SEQ ID NO: 578992 - protein, 9 aa, Homo Sapiens
ARELELKDR

SEQ ID NO: 578993 - protein, 9 aa, Homo Sapiens
SSPAASSAR

SEQ ID NO: 578994 - protein, 9 aa, Homo Sapiens
ASSGASTAT

SEQ ID NO: 578995 - protein, 9 aa, Homo Sapiens
GLGGKPAFM

SEQ ID NO: 578996 - protein, 9 aa, Homo Sapiens
NCPDPTPFQ

SEQ ID NO: 578997 - protein, 9 aa, Homo Sapiens
LFLIDFGMA

SEQ ID NO: 578998 - protein, 9 aa, Homo Sapiens
LEQLIRDFN

SEQ ID NO: 578999 - protein, 9 aa, Homo Sapiens
MQLKIYSIE

SEQ ID NO: 579000 - protein, 9 aa, Homo Sapiens
RAVPLPTVS

SEQ ID NO: 579001 - protein, 9 aa, Homo Sapiens
SKPGVSMRL

SEQ ID NO: 579002 - protein, 9 aa, Homo Sapiens
TYGSSSWLC

SEQ ID NO: 579003 - protein, 9 aa, Homo Sapiens
GLLRAALIL

SEQ ID NO: 579004 - protein, 9 aa, Homo Sapiens
CGRLLDDHD

SEQ ID NO: 579005 - protein, 9 aa, Homo Sapiens
RRQCSNSPG

SEQ ID NO: 579006 - protein, 9 aa, Homo Sapiens
PLEEKRRKE

SEQ ID NO: 579007 - protein, 9 aa, Homo Sapiens
RAPLGVRSG

SEQ ID NO: 579008 - protein, 9 aa, Homo Sapiens
KSKTSKPPQ

SEQ ID NO: 579009 - protein, 9 aa, Homo Sapiens
SRRPRRQRA

SEQ ID NO: 579010 - protein, 9 aa, Homo Sapiens
PRGVPACSH

SEQ ID NO: 579011 - protein, 9 aa, Homo Sapiens
RAHLLLVQL

SEQ ID NO: 579012 - protein, 9 aa, Homo Sapiens
ENNSFSQER

SEQ ID NO: 579013 - protein, 9 aa, Homo Sapiens
CKCDSGFAL

SEQ ID NO: 579014 - protein, 9 aa, Homo Sapiens
GTCEAQLLQ

SEQ ID NO: 579015 - protein, 9 aa, Homo Sapiens
ECLDVIFAG

SEQ ID NO: 579016 - protein, 9 aa, Homo Sapiens
QGQGSNLVT

SEQ ID NO: 579017 - protein, 9 aa, Homo Sapiens
AASSARRSW

SEQ ID NO: 579018 - protein, 9 aa, Homo Sapiens
RPYYFIEFD

SEQ ID NO: 579019 - protein, 9 aa, Homo Sapiens
QDLKLESPT

SEQ ID NO: 579020 - protein, 9 aa, Homo Sapiens
GFKSLPLQT

SEQ ID NO: 579021 - protein, 9 aa, Homo Sapiens
NMLRQLQEA

SEQ ID NO: 579022 - protein, 9 aa, Homo Sapiens
YYGTIVGVY

SEQ ID NO: 579023 - protein, 9 aa, Homo Sapiens
RASRCRAPL

SEQ ID NO: 579024 - protein, 9 aa, Homo Sapiens
QNFINICRN

SEQ ID NO: 579025 - protein, 9 aa, Homo Sapiens
QGVQTRKVR

SEQ ID NO: 579026 - protein, 9 aa, Homo Sapiens
SLPLWPLPN

SEQ ID NO: 579027 - protein, 9 aa, Homo Sapiens
KGEKVQTTE

SEQ ID NO: 579028 - protein, 9 aa, Homo Sapiens
FARELELKD

SEQ ID NO: 579029 - protein, 9 aa, Homo Sapiens
KLESPTRSL

SEQ ID NO: 579030 - protein, 9 aa, Homo Sapiens
GLDFVHHSG

SEQ ID NO: 579031 - protein, 9 aa, Homo Sapiens
VNMRENCGQ

SEQ ID NO: 579032 - protein, 9 aa, Homo Sapiens
LWPWLGEPI

SEQ ID NO: 579033 - protein, 9 aa, Homo Sapiens
VMFTECLDV

SEQ ID NO: 579034 - protein, 9 aa, Homo Sapiens
GSLSGAGLV

SEQ ID NO: 579035 - protein, 9 aa, Homo Sapiens
LNMYELFEK

SEQ ID NO: 579036 - protein, 9 aa, Homo Sapiens
QGDGLVNSV

SEQ ID NO: 579037 - protein, 9 aa, Homo Sapiens
GFSTGCGSA

SEQ ID NO: 579038 - protein, 9 aa, Homo Sapiens
FVQLASQGA

SEQ ID NO: 579039 - protein, 9 aa, Homo Sapiens
REDFKPCVG

SEQ ID NO: 579040 - protein, 9 aa, Homo Sapiens
RYSKPGVSM

SEQ ID NO: 579041 - protein, 9 aa, Homo Sapiens
LTCRAVASR

SEQ ID NO: 579042 - protein, 9 aa, Homo Sapiens
RCPVGGPHN

SEQ ID NO: 579043 - protein, 9 aa, Homo Sapiens
PRRGPRGAG

SEQ ID NO: 579044 - protein, 9 aa, Homo Sapiens
NAMVTHKSD

SEQ ID NO: 579045 - protein, 9 aa, Homo Sapiens
VSRPYYFIE

SEQ ID NO: 579046 - protein, 9 aa, Homo Sapiens
EELEAFWLT

SEQ ID NO: 579047 - protein, 9 aa, Homo Sapiens
AEDALQNFI

SEQ ID NO: 579048 - protein, 9 aa, Homo Sapiens
LNRSSRRES

SEQ ID NO: 579049 - protein, 9 aa, Homo Sapiens
TAIDADDAN

SEQ ID NO: 579050 - protein, 9 aa, Homo Sapiens
CLCACGDGS

SEQ ID NO: 579051 - protein, 9 aa, Homo Sapiens
QTHDEISRL

SEQ ID NO: 579052 - protein, 9 aa, Homo Sapiens
CPDPTPFQN

SEQ ID NO: 579053 - protein, 9 aa, Homo Sapiens
AGDRQNHQV

SEQ ID NO: 579054 - protein, 9 aa, Homo Sapiens
SRPYYFIEF

SEQ ID NO: 579055 - protein, 9 aa, Homo Sapiens
VFGDKLHIK

SEQ ID NO: 579056 - protein, 9 aa, Homo Sapiens
DAEIEIWYD

SEQ ID NO: 579057 - protein, 9 aa, Homo Sapiens
FSTGRGLDF

SEQ ID NO: 579058 - protein, 9 aa, Homo Sapiens
QTTGNSDHY

SEQ ID NO: 579059 - protein, 9 aa, Homo Sapiens
PEKRLTLAE

SEQ ID NO: 579060 - protein, 9 aa, Homo Sapiens
LSLSFYTNA

SEQ ID NO: 579061 - protein, 9 aa, Homo Sapiens
WREEALGLY

SEQ ID NO: 579062 - protein, 9 aa, Homo Sapiens
QKFAHHIIS

SEQ ID NO: 579063 - protein, 9 aa, Homo Sapiens
YGERPLAWL

SEQ ID NO: 579064 - protein, 9 aa, Homo Sapiens
RRESKTRLE

SEQ ID NO: 579065 - protein, 9 aa, Homo Sapiens
IRDFNNNVQ

SEQ ID NO: 579066 - protein, 9 aa, Homo Sapiens
PIFSSTPYR

SEQ ID NO: 579067 - protein, 9 aa, Homo Sapiens
RAAGGVGLG

SEQ ID NO: 579068 - protein, 9 aa, Homo Sapiens
GLLLLTAAL

SEQ ID NO: 579069 - protein, 9 aa, Homo Sapiens
DVRCYIYDP

SEQ ID NO: 579070 - protein, 9 aa, Homo Sapiens
RTGAEAPSQ

SEQ ID NO: 579071 - protein, 9 aa, Homo Sapiens
VVMFTECLD

SEQ ID NO: 579072 - protein, 9 aa, Homo Sapiens
GEAIRQQLA

SEQ ID NO: 579073 - protein, 9 aa, Homo Sapiens
LTDLHGLSR

SEQ ID NO: 579074 - protein, 9 aa, Homo Sapiens
IPKSPAKPI

SEQ ID NO: 579075 - protein, 9 aa, Homo Sapiens
DGLVNSVAS

SEQ ID NO: 579076 - protein, 9 aa, Homo Sapiens
MCEAENQFG

SEQ ID NO: 579077 - protein, 9 aa, Homo Sapiens
KDAEDALQN

SEQ ID NO: 579078 - protein, 9 aa, Homo Sapiens
SPAKPIQPK

SEQ ID NO: 579079 - protein, 9 aa, Homo Sapiens
ALIAWEGPS

SEQ ID NO: 579080 - protein, 9 aa, Homo Sapiens
YPLAEKTSM

SEQ ID NO: 579081 - protein, 9 aa, Homo Sapiens
QILCEPIQA

SEQ ID NO: 579082 - protein, 9 aa, Homo Sapiens
DFGNAATSL

SEQ ID NO: 579083 - protein, 9 aa, Homo Sapiens
GVGGLGDPV

SEQ ID NO: 579084 - protein, 9 aa, Homo Sapiens
DAGQLYVMK

SEQ ID NO: 579085 - protein, 9 aa, Homo Sapiens
EKYKRWALL

SEQ ID NO: 579086 - protein, 9 aa, Homo Sapiens
PVGGPHNAP

SEQ ID NO: 579087 - protein, 9 aa, Homo Sapiens
KIYSIEDRT

SEQ ID NO: 579088 - protein, 9 aa, Homo Sapiens
YPLHFYEAR

SEQ ID NO: 579089 - protein, 9 aa, Homo Sapiens
PGEVGGARG

SEQ ID NO: 579090 - protein, 9 aa, Homo Sapiens
GDVRCYIYD

SEQ ID NO: 579091 - protein, 9 aa, Homo Sapiens
LSCPVRGLT

SEQ ID NO: 579092 - protein, 9 aa, Homo Sapiens
RSGGAFPGG

SEQ ID NO: 579093 - protein, 9 aa, Homo Sapiens
RLTLAEIYE

SEQ ID NO: 579094 - protein, 9 aa, Homo Sapiens
ATQTRASQR

SEQ ID NO: 579095 - protein, 9 aa, Homo Sapiens
GSRCGGEGL

SEQ ID NO: 579096 - protein, 9 aa, Homo Sapiens
TNAMVTHKS

SEQ ID NO: 579097 - protein, 9 aa, Homo Sapiens
LLLTAALEG

SEQ ID NO: 579098 - protein, 9 aa, Homo Sapiens
SVSLLCHPL

SEQ ID NO: 579099 - protein, 9 aa, Homo Sapiens
DGCLLWKTE

SEQ ID NO: 579100 - protein, 9 aa, Homo Sapiens
QNAISFFNF

SEQ ID NO: 579101 - protein, 9 aa, Homo Sapiens
NLSINGKIL

SEQ ID NO: 579102 - protein, 9 aa, Homo Sapiens
KLALERTRV

SEQ ID NO: 579103 - protein, 9 aa, Homo Sapiens
RGPRGAGVG

SEQ ID NO: 579104 - protein, 9 aa, Homo Sapiens
THDLMLLRL

SEQ ID NO: 579105 - protein, 9 aa, Homo Sapiens
VLLVGTAVK

SEQ ID NO: 579106 - protein, 9 aa, Homo Sapiens
AIAIQSACR

SEQ ID NO: 579107 - protein, 9 aa, Homo Sapiens
QLVFYNAVA

SEQ ID NO: 579108 - protein, 9 aa, Homo Sapiens
LRANADRIR

SEQ ID NO: 579109 - protein, 9 aa, Homo Sapiens
SVQYASLSC

SEQ ID NO: 579110 - protein, 9 aa, Homo Sapiens
CFVEFLFHI

SEQ ID NO: 579111 - protein, 9 aa, Homo Sapiens
KLRESERIT

SEQ ID NO: 579112 - protein, 9 aa, Homo Sapiens
PWSPASCPW

SEQ ID NO: 579113 - protein, 9 aa, Homo Sapiens
AEGEAQEAE

SEQ ID NO: 579114 - protein, 9 aa, Homo Sapiens
CHSFLRAGF

SEQ ID NO: 579115 - protein, 9 aa, Homo Sapiens
KFPELAPSQ

SEQ ID NO: 579116 - protein, 9 aa, Homo Sapiens
CVAMPLRSG

SEQ ID NO: 579117 - protein, 9 aa, Homo Sapiens
TEEGPDVLS

SEQ ID NO: 579118 - protein, 9 aa, Homo Sapiens
SNNAETKYC

SEQ ID NO: 579119 - protein, 9 aa, Homo Sapiens
KEDEAEEES

SEQ ID NO: 579120 - protein, 9 aa, Homo Sapiens
QGEVQHQVA

SEQ ID NO: 579121 - protein, 9 aa, Homo Sapiens
SANARRSAS

SEQ ID NO: 579122 - protein, 9 aa, Homo Sapiens
QNSLELMMD

SEQ ID NO: 579123 - protein, 9 aa, Homo Sapiens
QIADLMEEN

SEQ ID NO: 579124 - protein, 9 aa, Homo Sapiens
NLKLCRPSF

SEQ ID NO: 579125 - protein, 9 aa, Homo Sapiens
VDSIISSSS

SEQ ID NO: 579126 - protein, 9 aa, Homo Sapiens
KLHANAWRV

SEQ ID NO: 579127 - protein, 9 aa, Homo Sapiens
SCTQEAAHD

SEQ ID NO: 579128 - protein, 9 aa, Homo Sapiens
FPRFKLDQK

SEQ ID NO: 579129 - protein, 9 aa, Homo Sapiens
QKRGLQVVP

SEQ ID NO: 579130 - protein, 9 aa, Homo Sapiens
FMSPMEQTN

SEQ ID NO: 579131 - protein, 9 aa, Homo Sapiens
PQGQLVFYN

SEQ ID NO: 579132 - protein, 9 aa, Homo Sapiens
RNVSANARR

SEQ ID NO: 579133 - protein, 9 aa, Homo Sapiens
SQSCSNKNP

SEQ ID NO: 579134 - protein, 9 aa, Homo Sapiens
RIMSVQNQE

SEQ ID NO: 579135 - protein, 9 aa, Homo Sapiens
EVFFPRFKL

SEQ ID NO: 579136 - protein, 9 aa, Homo Sapiens
PADILYKGT

SEQ ID NO: 579137 - protein, 9 aa, Homo Sapiens
NILASFEGK

SEQ ID NO: 579138 - protein, 9 aa, Homo Sapiens
ILQKEDEAE

SEQ ID NO: 579139 - protein, 9 aa, Homo Sapiens
PDVLSWLDR

SEQ ID NO: 579140 - protein, 9 aa, Homo Sapiens
KSVEMRHRK

SEQ ID NO: 579141 - protein, 9 aa, Homo Sapiens
KYLGLDPRK

SEQ ID NO: 579142 - protein, 9 aa, Homo Sapiens
DYTHDLMLL

SEQ ID NO: 579143 - protein, 9 aa, Homo Sapiens
MIEGTPKLH

SEQ ID NO: 579144 - protein, 9 aa, Homo Sapiens
ARIDPSEQV

SEQ ID NO: 579145 - protein, 9 aa, Homo Sapiens
KMELCARID

SEQ ID NO: 579146 - protein, 9 aa, Homo Sapiens
PMPGDQIKD

SEQ ID NO: 579147 - protein, 9 aa, Homo Sapiens
QQGTAWRRK

SEQ ID NO: 579148 - protein, 9 aa, Homo Sapiens
SRIMSVQNQ

SEQ ID NO: 579149 - protein, 9 aa, Homo Sapiens
LSWLDRQLI

SEQ ID NO: 579150 - protein, 9 aa, Homo Sapiens
QSCSNKNPD

SEQ ID NO: 579151 - protein, 9 aa, Homo Sapiens
KQIALALQH

SEQ ID NO: 579152 - protein, 9 aa, Homo Sapiens
KIQRRNKCH

SEQ ID NO: 579153 - protein, 9 aa, Homo Sapiens
PVEVNLKLC

SEQ ID NO: 579154 - protein, 9 aa, Homo Sapiens
EGEAQEAEG

SEQ ID NO: 579155 - protein, 9 aa, Homo Sapiens
TDKKADNSE

SEQ ID NO: 579156 - protein, 9 aa, Homo Sapiens
RSASASWSA

SEQ ID NO: 579157 - protein, 9 aa, Homo Sapiens
DSIISSSSS

SEQ ID NO: 579158 - protein, 9 aa, Homo Sapiens
ESSSSEYSS

SEQ ID NO: 579159 - protein, 9 aa, Homo Sapiens
ILNGTVEIR

SEQ ID NO: 579160 - protein, 9 aa, Homo Sapiens
CFGNLTYLN

SEQ ID NO: 579161 - protein, 9 aa, Homo Sapiens
EGPDVLSWL

SEQ ID NO: 579162 - protein, 9 aa, Homo Sapiens
DLQLRKALA

SEQ ID NO: 579163 - protein, 9 aa, Homo Sapiens
APTGGYLTT

SEQ ID NO: 579164 - protein, 9 aa, Homo Sapiens
WLFTKFPEL

SEQ ID NO: 579165 - protein, 9 aa, Homo Sapiens
KLCRPSFRD

SEQ ID NO: 579166 - protein, 9 aa, Homo Sapiens
TPKLHANAW

SEQ ID NO: 579167 - protein, 9 aa, Homo Sapiens
RHWLFTKFP

SEQ ID NO: 579168 - protein, 9 aa, Homo Sapiens
LRSVSAVYK

SEQ ID NO: 579169 - protein, 9 aa, Homo Sapiens
SVRLTASGR

SEQ ID NO: 579170 - protein, 9 aa, Homo Sapiens
YANNGSILQ

SEQ ID NO: 579171 - protein, 9 aa, Homo Sapiens
ITLTPQQVQ

SEQ ID NO: 579172 - protein, 9 aa, Homo Sapiens
LRESERITV

SEQ ID NO: 579173 - protein, 9 aa, Homo Sapiens
YGNPEVVRM

SEQ ID NO: 579174 - protein, 9 aa, Homo Sapiens
RESERITVE

SEQ ID NO: 579175 - protein, 9 aa, Homo Sapiens
LKLCRPSFR

SEQ ID NO: 579176 - protein, 9 aa, Homo Sapiens
FVFKQLDSL

SEQ ID NO: 579177 - protein, 9 aa, Homo Sapiens
NMEVFFPRF

SEQ ID NO: 579178 - protein, 9 aa, Homo Sapiens
INHQSNLKM

SEQ ID NO: 579179 - protein, 9 aa, Homo Sapiens
EEGPDVLSW

SEQ ID NO: 579180 - protein, 9 aa, Homo Sapiens
VEMRHRKVY

SEQ ID NO: 579181 - protein, 9 aa, Homo Sapiens
TPADILYKG

SEQ ID NO: 579182 - protein, 9 aa, Homo Sapiens
NNAETKYCV

SEQ ID NO: 579183 - protein, 9 aa, Homo Sapiens
LIDIRNDYV

SEQ ID NO: 579184 - protein, 9 aa, Homo Sapiens
ADILYKGTI

SEQ ID NO: 579185 - protein, 9 aa, Homo Sapiens
NPDGKQTRS

SEQ ID NO: 579186 - protein, 9 aa, Homo Sapiens
NKCHLMASV

SEQ ID NO: 579187 - protein, 9 aa, Homo Sapiens
SFEGKNRVW

SEQ ID NO: 579188 - protein, 9 aa, Homo Sapiens
TLTPQQVQE

SEQ ID NO: 579189 - protein, 9 aa, Homo Sapiens
EAELRANAD

SEQ ID NO: 579190 - protein, 9 aa, Homo Sapiens
PRFKLDQKY

SEQ ID NO: 579191 - protein, 9 aa, Homo Sapiens
RKQYNVDYK

SEQ ID NO: 579192 - protein, 9 aa, Homo Sapiens
VKHGVSHQI

SEQ ID NO: 579193 - protein, 9 aa, Homo Sapiens
FPMPGDQIK

SEQ ID NO: 579194 - protein, 9 aa, Homo Sapiens
RAGVLKQDL

SEQ ID NO: 579195 - protein, 9 aa, Homo Sapiens
ANARRSASK

SEQ ID NO: 579196 - protein, 9 aa, Homo Sapiens
LVLLVLHCF

SEQ ID NO: 579197 - protein, 9 aa, Homo Sapiens
WSASGSSGP

SEQ ID NO: 579198 - protein, 9 aa, Homo Sapiens
RRNKCHLMA

SEQ ID NO: 579199 - protein, 9 aa, Homo Sapiens
DRHWLFTKF

SEQ ID NO: 579200 - protein, 9 aa, Homo Sapiens
GPGRRSCWP

SEQ ID NO: 579201 - protein, 9 aa, Homo Sapiens
NVCLFYVGG

SEQ ID NO: 579202 - protein, 9 aa, Homo Sapiens
RAAYPLNLS

SEQ ID NO: 579203 - protein, 9 aa, Homo Sapiens
RRKQTAARA

SEQ ID NO: 579204 - protein, 9 aa, Homo Sapiens
NENMLLLTL

SEQ ID NO: 579205 - protein, 9 aa, Homo Sapiens
ELRRERDAS

SEQ ID NO: 579206 - protein, 9 aa, Homo Sapiens
KRGLQVVPL

SEQ ID NO: 579207 - protein, 9 aa, Homo Sapiens
LFYVLRSVV

SEQ ID NO: 579208 - protein, 9 aa, Homo Sapiens
PTGGYLTTG

SEQ ID NO: 579209 - protein, 9 aa, Homo Sapiens
SCSNKNPDG

SEQ ID NO: 579210 - protein, 9 aa, Homo Sapiens
CWPPRPWSP

SEQ ID NO: 579211 - protein, 9 aa, Homo Sapiens
ASFEGKNRV

SEQ ID NO: 579212 - protein, 9 aa, Homo Sapiens
SSGGSCGLG

SEQ ID NO: 579213 - protein, 9 aa, Homo Sapiens
TVYANNGSI

SEQ ID NO: 579214 - protein, 9 aa, Homo Sapiens
MGCVAMPLR

SEQ ID NO: 579215 - protein, 9 aa, Homo Sapiens
AHNPPVRLA

SEQ ID NO: 579216 - protein, 9 aa, Homo Sapiens
VFFPRFKLD

SEQ ID NO: 579217 - protein, 9 aa, Homo Sapiens
SFFSFYHPA

SEQ ID NO: 579218 - protein, 9 aa, Homo Sapiens
TGRKQYNVD

SEQ ID NO: 579219 - protein, 9 aa, Homo Sapiens
LVQGEVQHQ

SEQ ID NO: 579220 - protein, 9 aa, Homo Sapiens
SLFTRNCAY

SEQ ID NO: 579221 - protein, 9 aa, Homo Sapiens
HNPPVRLAP

SEQ ID NO: 579222 - protein, 9 aa, Homo Sapiens
AIQNQQNSL

SEQ ID NO: 579223 - protein, 9 aa, Homo Sapiens
VREFSFRVA

SEQ ID NO: 579224 - protein, 9 aa, Homo Sapiens
ARRSASKRR

SEQ ID NO: 579225 - protein, 9 aa, Homo Sapiens
YCVLKIDRT

SEQ ID NO: 579226 - protein, 9 aa, Homo Sapiens
HLMASVTSH

SEQ ID NO: 579227 - protein, 9 aa, Homo Sapiens
RITVETHTK

SEQ ID NO: 579228 - protein, 9 aa, Homo Sapiens
SVSVRLTAS

SEQ ID NO: 579229 - protein, 9 aa, Homo Sapiens
RSASKRRSV

SEQ ID NO: 579230 - protein, 9 aa, Homo Sapiens
LLVLHCFVE

SEQ ID NO: 579231 - protein, 9 aa, Homo Sapiens
LLHTCLPGD

SEQ ID NO: 579232 - protein, 9 aa, Homo Sapiens
FYVLRSVVF

SEQ ID NO: 579233 - protein, 9 aa, Homo Sapiens
QQNSLELMM

SEQ ID NO: 579234 - protein, 9 aa, Homo Sapiens
QLKAVLEKL

SEQ ID NO: 579235 - protein, 9 aa, Homo Sapiens
HPMGVFQKE

SEQ ID NO: 579236 - protein, 9 aa, Homo Sapiens
AGVLKQDLV

SEQ ID NO: 579237 - protein, 9 aa, Homo Sapiens
LLSVDSSIN

SEQ ID NO: 579238 - protein, 9 aa, Homo Sapiens
ILASFEGKN

SEQ ID NO: 579239 - protein, 9 aa, Homo Sapiens
QAFEAELRA

SEQ ID NO: 579240 - protein, 9 aa, Homo Sapiens
VSVRRSASA

SEQ ID NO: 579241 - protein, 9 aa, Homo Sapiens
RRERDASVS

SEQ ID NO: 579242 - protein, 9 aa, Homo Sapiens
RTEAGGQCH

SEQ ID NO: 579243 - protein, 9 aa, Homo Sapiens
GAAMAAGTA

SEQ ID NO: 579244 - protein, 9 aa, Homo Sapiens
PAEPHPMGV

SEQ ID NO: 579245 - protein, 9 aa, Homo Sapiens
SGMIEGTPK

SEQ ID NO: 579246 - protein, 9 aa, Homo Sapiens
NGTVEIRHP

SEQ ID NO: 579247 - protein, 9 aa, Homo Sapiens
DKKADNSEV

SEQ ID NO: 579248 - protein, 9 aa, Homo Sapiens
RHRKVYVEK

SEQ ID NO: 579249 - protein, 9 aa, Homo Sapiens
TKEGIDHSN

SEQ ID NO: 579250 - protein, 9 aa, Homo Sapiens
LTPQQVQEL

SEQ ID NO: 579251 - protein, 9 aa, Homo Sapiens
SIISSSSST

SEQ ID NO: 579252 - protein, 9 aa, Homo Sapiens
SERITVETH

SEQ ID NO: 579253 - protein, 9 aa, Homo Sapiens
SRFSSGGSC

SEQ ID NO: 579254 - protein, 9 aa, Homo Sapiens
EVFITDKKA

SEQ ID NO: 579255 - protein, 9 aa, Homo Sapiens
RKQTAARAF

SEQ ID NO: 579256 - protein, 9 aa, Homo Sapiens
GIPLETGRK

SEQ ID NO: 579257 - protein, 9 aa, Homo Sapiens
SILQGSSVA

SEQ ID NO: 579258 - protein, 9 aa, Homo Sapiens
FFPRFKLDQ

SEQ ID NO: 579259 - protein, 9 aa, Homo Sapiens
RGLQVVPLK

SEQ ID NO: 579260 - protein, 9 aa, Homo Sapiens
VLKQDLVRP

SEQ ID NO: 579261 - protein, 9 aa, Homo Sapiens
GAIAIQSAC

SEQ ID NO: 579262 - protein, 9 aa, Homo Sapiens
EPHPMGVFQ

SEQ ID NO: 579263 - protein, 9 aa, Homo Sapiens
AEALVGKTS

SEQ ID NO: 579264 - protein, 9 aa, Homo Sapiens
SQLKAVLEK

SEQ ID NO: 579265 - protein, 9 aa, Homo Sapiens
VSVRLTASG

SEQ ID NO: 579266 - protein, 9 aa, Homo Sapiens
VADTGASGC

SEQ ID NO: 579267 - protein, 9 aa, Homo Sapiens
RNDYVNWVQ

SEQ ID NO: 579268 - protein, 9 aa, Homo Sapiens
GNPEVVRMI

SEQ ID NO: 579269 - protein, 9 aa, Homo Sapiens
NISKYLGLD

SEQ ID NO: 579270 - protein, 9 aa, Homo Sapiens
LQLRKALAQ

SEQ ID NO: 579271 - protein, 9 aa, Homo Sapiens
EQTNTSEGW

SEQ ID NO: 579272 - protein, 9 aa, Homo Sapiens
QADEDYTHD

SEQ ID NO: 579273 - protein, 9 aa, Homo Sapiens
DILYKGTIT

SEQ ID NO: 579274 - protein, 9 aa, Homo Sapiens
AAYPLNLSF

SEQ ID NO: 579275 - protein, 9 aa, Homo Sapiens
LLTLLSQAR

SEQ ID NO: 579276 - protein, 9 aa, Homo Sapiens
NLRAAYPLN

SEQ ID NO: 579277 - protein, 9 aa, Homo Sapiens
RSVSAVYKR

SEQ ID NO: 579278 - protein, 9 aa, Homo Sapiens
NNKNVLLVG

SEQ ID NO: 579279 - protein, 9 aa, Homo Sapiens
ITDKKADNS

SEQ ID NO: 579280 - protein, 9 aa, Homo Sapiens
ETGRKQYNV

SEQ ID NO: 579281 - protein, 9 aa, Homo Sapiens
KAVLEKLSK

SEQ ID NO: 579282 - protein, 9 aa, Homo Sapiens
MEVFFPRFK

SEQ ID NO: 579283 - protein, 9 aa, Homo Sapiens
MRHRKVYVE

SEQ ID NO: 579284 - protein, 9 aa, Homo Sapiens
KRRSVSVRR

SEQ ID NO: 579285 - protein, 9 aa, Homo Sapiens
AGIMDQLSV

SEQ ID NO: 579286 - protein, 9 aa, Homo Sapiens
TDIVDYSLA

SEQ ID NO: 579287 - protein, 9 aa, Homo Sapiens
STKIQVIDI

SEQ ID NO: 579288 - protein, 9 aa, Homo Sapiens
IGVEAFCHS

SEQ ID NO: 579289 - protein, 9 aa, Homo Sapiens
ASKRRSVSV

SEQ ID NO: 579290 - protein, 9 aa, Homo Sapiens
YVGGPKMDT

SEQ ID NO: 579291 - protein, 9 aa, Homo Sapiens
VSRIMSVQN

SEQ ID NO: 579292 - protein, 9 aa, Homo Sapiens
FKWKPAEPH

SEQ ID NO: 579293 - protein, 9 aa, Homo Sapiens
EVRTEAGGQ

SEQ ID NO: 579294 - protein, 9 aa, Homo Sapiens
VPQGQLVFY

SEQ ID NO: 579295 - protein, 9 aa, Homo Sapiens
GLVLLVLHC

SEQ ID NO: 579296 - protein, 9 aa, Homo Sapiens
AMPLRSGAS

SEQ ID NO: 579297 - protein, 9 aa, Homo Sapiens
VSHQIWDFG

SEQ ID NO: 579298 - protein, 9 aa, Homo Sapiens
TASGRRNVS

SEQ ID NO: 579299 - protein, 9 aa, Homo Sapiens
QSFQDHKIK

SEQ ID NO: 579300 - protein, 9 aa, Homo Sapiens
VQAHNPPVR

SEQ ID NO: 579301 - protein, 9 aa, Homo Sapiens
QKEDEAEEE

SEQ ID NO: 579302 - protein, 9 aa, Homo Sapiens
REFSFRVAA

SEQ ID NO: 579303 - protein, 9 aa, Homo Sapiens
KMKHSTKIQ

SEQ ID NO: 579304 - protein, 9 aa, Homo Sapiens
SGRRNVSAN

SEQ ID NO: 579305 - protein, 9 aa, Homo Sapiens
AAPLLHTCL

SEQ ID NO: 579306 - protein, 9 aa, Homo Sapiens
IQRRNKCHL

SEQ ID NO: 579307 - protein, 9 aa, Homo Sapiens
ERITVETHT

SEQ ID NO: 579308 - protein, 9 aa, Homo Sapiens
SSSSEYSSS

SEQ ID NO: 579309 - protein, 9 aa, Homo Sapiens
TAPTGGYLT

SEQ ID NO: 579310 - protein, 9 aa, Homo Sapiens
NPCPAGIMD

SEQ ID NO: 579311 - protein, 9 aa, Homo Sapiens
GVEAFCHSF

SEQ ID NO: 579312 - protein, 9 aa, Homo Sapiens
VGNISKYLG

SEQ ID NO: 579313 - protein, 9 aa, Homo Sapiens
DIVDYSLAM

SEQ ID NO: 579314 - protein, 9 aa, Homo Sapiens
LMSPAPNDD

SEQ ID NO: 579315 - protein, 9 aa, Homo Sapiens
PLLHTCLPG

SEQ ID NO: 579316 - protein, 9 aa, Homo Sapiens
DIRNDYVNW

SEQ ID NO: 579317 - protein, 9 aa, Homo Sapiens
ISKYLGLDP

SEQ ID NO: 579318 - protein, 9 aa, Homo Sapiens
GGPKMDTTP

SEQ ID NO: 579319 - protein, 9 aa, Homo Sapiens
PLETGRKQY

SEQ ID NO: 579320 - protein, 9 aa, Homo Sapiens
SHQIWDFGD

SEQ ID NO: 579321 - protein, 9 aa, Homo Sapiens
SPASCPWPS

SEQ ID NO: 579322 - protein, 9 aa, Homo Sapiens
REILLSVDS

SEQ ID NO: 579323 - protein, 9 aa, Homo Sapiens
PLQDLQLRK

SEQ ID NO: 579324 - protein, 9 aa, Homo Sapiens
EVPQGQLVF

SEQ ID NO: 579325 - protein, 9 aa, Homo Sapiens
TQEAAHDSW

SEQ ID NO: 579326 - protein, 9 aa, Homo Sapiens
GNISKYLGL

SEQ ID NO: 579327 - protein, 9 aa, Homo Sapiens
QNENMLLLT

SEQ ID NO: 579328 - protein, 9 aa, Homo Sapiens
FHSVTDIVD

SEQ ID NO: 579329 - protein, 9 aa, Homo Sapiens
QDLVRPWGL

SEQ ID NO: 579330 - protein, 9 aa, Homo Sapiens
SASKRRSVS

SEQ ID NO: 579331 - protein, 9 aa, Homo Sapiens
YASLSCFGN

SEQ ID NO: 579332 - protein, 9 aa, Homo Sapiens
QFREILLSV

SEQ ID NO: 579333 - protein, 9 aa, Homo Sapiens
IRHPDGKVE

SEQ ID NO: 579334 - protein, 9 aa, Homo Sapiens
CARIDPSEQ

SEQ ID NO: 579335 - protein, 9 aa, Homo Sapiens
GENVREFSF

SEQ ID NO: 579336 - protein, 9 aa, Homo Sapiens
SELINHQSN

SEQ ID NO: 579337 - protein, 9 aa, Homo Sapiens
RRSASASWS

SEQ ID NO: 579338 - protein, 9 aa, Homo Sapiens
DLVRPWGLA

SEQ ID NO: 579339 - protein, 9 aa, Homo Sapiens
EVQHQVAAA

SEQ ID NO: 579340 - protein, 9 aa, Homo Sapiens
KILQKEDEA

SEQ ID NO: 579341 - protein, 9 aa, Homo Sapiens
GEAQEAEGE

SEQ ID NO: 579342 - protein, 9 aa, Homo Sapiens
PGRRSCWPP

SEQ ID NO: 579343 - protein, 9 aa, Homo Sapiens
DVVRDFVSR

SEQ ID NO: 579344 - protein, 9 aa, Homo Sapiens
AYSQLKAVL

SEQ ID NO: 579345 - protein, 9 aa, Homo Sapiens
YSQLKAVLE

SEQ ID NO: 579346 - protein, 9 aa, Homo Sapiens
VSAVYKRFP

SEQ ID NO: 579347 - protein, 9 aa, Homo Sapiens
IAIQSACRG

SEQ ID NO: 579348 - protein, 9 aa, Homo Sapiens
ILYKGTITR

SEQ ID NO: 579349 - protein, 9 aa, Homo Sapiens
AEPHPMGVF

SEQ ID NO: 579350 - protein, 9 aa, Homo Sapiens
CLPGDAAAS

SEQ ID NO: 579351 - protein, 9 aa, Homo Sapiens
TSQSSVDSI

SEQ ID NO: 579352 - protein, 9 aa, Homo Sapiens
RRSASKRRS

SEQ ID NO: 579353 - protein, 9 aa, Homo Sapiens
ASLSCFGNL

SEQ ID NO: 579354 - protein, 9 aa, Homo Sapiens
LNPCPAGIM

SEQ ID NO: 579355 - protein, 9 aa, Homo Sapiens
LAGFSGAKG

SEQ ID NO: 579356 - protein, 9 aa, Homo Sapiens
LMEENFRGD

SEQ ID NO: 579357 - protein, 9 aa, Homo Sapiens
LLVGTAVKD

SEQ ID NO: 579358 - protein, 9 aa, Homo Sapiens
PLSAQHAGV

SEQ ID NO: 579359 - protein, 9 aa, Homo Sapiens
VVRDFVSRI

SEQ ID NO: 579360 - protein, 9 aa, Homo Sapiens
RESSSSEYS

SEQ ID NO: 579361 - protein, 9 aa, Homo Sapiens
FSSGGSCGL

SEQ ID NO: 579362 - protein, 9 aa, Homo Sapiens
SVEMRHRKV

SEQ ID NO: 579363 - protein, 9 aa, Homo Sapiens
VLILRSVSA

SEQ ID NO: 579364 - protein, 9 aa, Homo Sapiens
LLLTLLSQA

SEQ ID NO: 579365 - protein, 9 aa, Homo Sapiens
TRQADEDYT

SEQ ID NO: 579366 - protein, 9 aa, Homo Sapiens
GVSHQIWDF

SEQ ID NO: 579367 - protein, 9 aa, Homo Sapiens
SFQDHKIKI

SEQ ID NO: 579368 - protein, 9 aa, Homo Sapiens
NNGSILQGS

SEQ ID NO: 579369 - protein, 9 aa, Homo Sapiens
SGGSCGLGG

SEQ ID NO: 579370 - protein, 9 aa, Homo Sapiens
PLRSGASPR

SEQ ID NO: 579371 - protein, 9 aa, Homo Sapiens
CLFYVGGPK

SEQ ID NO: 579372 - protein, 9 aa, Homo Sapiens
RFVFKQLDS

SEQ ID NO: 579373 - protein, 9 aa, Homo Sapiens
TCLPGDAAA

SEQ ID NO: 579374 - protein, 9 aa, Homo Sapiens
MKHSTKIQV

SEQ ID NO: 579375 - protein, 9 aa, Homo Sapiens
LDSSGDQQL

SEQ ID NO: 579376 - protein, 9 aa, Homo Sapiens
LTASGRRNV

SEQ ID NO: 579377 - protein, 9 aa, Homo Sapiens
KFPMPGDQI

SEQ ID NO: 579378 - protein, 9 aa, Homo Sapiens
LSNVLFYVL

SEQ ID NO: 579379 - protein, 9 aa, Homo Sapiens
FDVKHGVSH

SEQ ID NO: 579380 - protein, 9 aa, Homo Sapiens
EGKNRVWVI

SEQ ID NO: 579381 - protein, 9 aa, Homo Sapiens
SSGPGRRSC

SEQ ID NO: 579382 - protein, 9 aa, Homo Sapiens
CSNKNPDGK

SEQ ID NO: 579383 - protein, 9 aa, Homo Sapiens
VLLVLHCFV

SEQ ID NO: 579384 - protein, 9 aa, Homo Sapiens
QDHKIKISK

SEQ ID NO: 579385 - protein, 9 aa, Homo Sapiens
DKMKHSTKI

SEQ ID NO: 579386 - protein, 9 aa, Homo Sapiens
SCWPPRPWS

SEQ ID NO: 579387 - protein, 9 aa, Homo Sapiens
VRDFVSRIM

SEQ ID NO: 579388 - protein, 9 aa, Homo Sapiens
FCHSFLRAG

SEQ ID NO: 579389 - protein, 9 aa, Homo Sapiens
SSNNKNVLL

SEQ ID NO: 579390 - protein, 9 aa, Homo Sapiens
IEGTPKLHA

SEQ ID NO: 579391 - protein, 9 aa, Homo Sapiens
LHCFVEFLF

SEQ ID NO: 579392 - protein, 9 aa, Homo Sapiens
KEGIDHSNI

SEQ ID NO: 579393 - protein, 9 aa, Homo Sapiens
RDFVSRIMS

SEQ ID NO: 579394 - protein, 9 aa, Homo Sapiens
SASASWSAS

SEQ ID NO: 579395 - protein, 9 aa, Homo Sapiens
SCPWPSCMG

SEQ ID NO: 579396 - protein, 9 aa, Homo Sapiens
FQSFQDHKI

SEQ ID NO: 579397 - protein, 9 aa, Homo Sapiens
AFCHSFLRA

SEQ ID NO: 579398 - protein, 9 aa, Homo Sapiens
DEVPQGQLV

SEQ ID NO: 579399 - protein, 9 aa, Homo Sapiens
KWKPAEPHP

SEQ ID NO: 579400 - protein, 9 aa, Homo Sapiens
GPKMDTTPP

SEQ ID NO: 579401 - protein, 9 aa, Homo Sapiens
GFSGAKGDQ

SEQ ID NO: 579402 - protein, 9 aa, Homo Sapiens
QLFHSVTDI

SEQ ID NO: 579403 - protein, 9 aa, Homo Sapiens
EAFCHSFLR

SEQ ID NO: 579404 - protein, 9 aa, Homo Sapiens
LQHCHLLNI

SEQ ID NO: 579405 - protein, 9 aa, Homo Sapiens
LETGRKQYN

SEQ ID NO: 579406 - protein, 9 aa, Homo Sapiens
GSCGLGGGY

SEQ ID NO: 579407 - protein, 9 aa, Homo Sapiens
SFDVKHGVS

SEQ ID NO: 579408 - protein, 9 aa, Homo Sapiens
AQHAGVQAA

SEQ ID NO: 579409 - protein, 9 aa, Homo Sapiens
SNNKNVLLV

SEQ ID NO: 579410 - protein, 9 aa, Homo Sapiens
LFHSVTDIV

SEQ ID NO: 579411 - protein, 9 aa, Homo Sapiens
ASASWSASG

SEQ ID NO: 579412 - protein, 9 aa, Homo Sapiens
SASGSSGPG

SEQ ID NO: 579413 - protein, 9 aa, Homo Sapiens
NSLELMMDH

SEQ ID NO: 579414 - protein, 9 aa, Homo Sapiens
AMAAGTAEG

SEQ ID NO: 579415 - protein, 9 aa, Homo Sapiens
RNGSLFTRN

SEQ ID NO: 579416 - protein, 9 aa, Homo Sapiens
MAAPLLHTC

SEQ ID NO: 579417 - protein, 9 aa, Homo Sapiens
LLLYESPTT

SEQ ID NO: 579418 - protein, 9 aa, Homo Sapiens
FQDHKIKIS

SEQ ID NO: 579419 - protein, 9 aa, Homo Sapiens
YPLNLSFLL

SEQ ID NO: 579420 - protein, 9 aa, Homo Sapiens
RPLQDLQLR

SEQ ID NO: 579421 - protein, 9 aa, Homo Sapiens
EVADTGASG

SEQ ID NO: 579422 - protein, 9 aa, Homo Sapiens
RKKSVEMRH

SEQ ID NO: 579423 - protein, 9 aa, Homo Sapiens
MLLLTLLSQ

SEQ ID NO: 579424 - protein, 9 aa, Homo Sapiens
SKTAPTGGY

SEQ ID NO: 579425 - protein, 9 aa, Homo Sapiens
TKFPELAPS

SEQ ID NO: 579426 - protein, 9 aa, Homo Sapiens
YTHDLMLLR

SEQ ID NO: 579427 - protein, 9 aa, Homo Sapiens
VFYNAVAIP

SEQ ID NO: 579428 - protein, 9 aa, Homo Sapiens
RSGASPRSS

SEQ ID NO: 579429 - protein, 9 aa, Homo Sapiens
EGTPKLHAN

SEQ ID NO: 579430 - protein, 9 aa, Homo Sapiens
AGFSGAKGD

SEQ ID NO: 579431 - protein, 9 aa, Homo Sapiens
ERDASVSVR

SEQ ID NO: 579432 - protein, 9 aa, Homo Sapiens
LYESPTTGL

SEQ ID NO: 579433 - protein, 9 aa, Homo Sapiens
VTDIVDYSL

SEQ ID NO: 579434 - protein, 9 aa, Homo Sapiens
CHLMASVTS

SEQ ID NO: 579435 - protein, 9 aa, Homo Sapiens
TGGYLTTGS

SEQ ID NO: 579436 - protein, 9 aa, Homo Sapiens
RFSSGGSCG

SEQ ID NO: 579437 - protein, 9 aa, Homo Sapiens
RCSFFSFYH

SEQ ID NO: 579438 - protein, 9 aa, Homo Sapiens
ASCPWPSCM

SEQ ID NO: 579439 - protein, 9 aa, Homo Sapiens
DYVNWVQQQ

SEQ ID NO: 579440 - protein, 9 aa, Homo Sapiens
RRQFREILL

SEQ ID NO: 579441 - protein, 9 aa, Homo Sapiens
LSVDSSINQ

SEQ ID NO: 579442 - protein, 9 aa, Homo Sapiens
AFEAELRAN

SEQ ID NO: 579443 - protein, 9 aa, Homo Sapiens
GSILQGSSV

SEQ ID NO: 579444 - protein, 9 aa, Homo Sapiens
PHPMGVFQK

SEQ ID NO: 579445 - protein, 9 aa, Homo Sapiens
PWPSCMGCV

SEQ ID NO: 579446 - protein, 9 aa, Homo Sapiens
ELCARIDPS

SEQ ID NO: 579447 - protein, 9 aa, Homo Sapiens
MKYIIKFPM

SEQ ID NO: 579448 - protein, 9 aa, Homo Sapiens
RNKCHLMAS

SEQ ID NO: 579449 - protein, 9 aa, Homo Sapiens
TGENVREFS

SEQ ID NO: 579450 - protein, 9 aa, Homo Sapiens
ADEDYTHDL

SEQ ID NO: 579451 - protein, 9 aa, Homo Sapiens
GQLVFYNAV

SEQ ID NO: 579452 - protein, 9 aa, Homo Sapiens
GAYSQLKAV

SEQ ID NO: 579453 - protein, 9 aa, Homo Sapiens
KNPDGKQTR

SEQ ID NO: 579454 - protein, 9 aa, Homo Sapiens
YVLRSVVFF

SEQ ID NO: 579455 - protein, 9 aa, Homo Sapiens
IMDQLSVIP

SEQ ID NO: 579456 - protein, 9 aa, Homo Sapiens
RLSSCTQEA

SEQ ID NO: 579457 - protein, 9 aa, Homo Sapiens
SAEALVGKT

SEQ ID NO: 579458 - protein, 9 aa, Homo Sapiens
PPRPWSPAS

SEQ ID NO: 579459 - protein, 9 aa, Homo Sapiens
CPAGIMDQL

SEQ ID NO: 579460 - protein, 9 aa, Homo Sapiens
TKCIPLDSS

SEQ ID NO: 579461 - protein, 9 aa, Homo Sapiens
VLHCFVEFL

SEQ ID NO: 579462 - protein, 9 aa, Homo Sapiens
GSKKFWNKV

SEQ ID NO: 579463 - protein, 9 aa, Homo Sapiens
ILLSVDSSI

SEQ ID NO: 579464 - protein, 9 aa, Homo Sapiens
ASVSVRLTA

SEQ ID NO: 579465 - protein, 9 aa, Homo Sapiens
HRNGSLFTR

SEQ ID NO: 579466 - protein, 9 aa, Homo Sapiens
FEAELRANA

SEQ ID NO: 579467 - protein, 9 aa, Homo Sapiens
YIIKFPMPG

SEQ ID NO: 579468 - protein, 9 aa, Homo Sapiens
NYEQPTKEG

SEQ ID NO: 579469 - protein, 9 aa, Homo Sapiens
PHHQLPRES

SEQ ID NO: 579470 - protein, 9 aa, Homo Sapiens
SSELINHQS

SEQ ID NO: 579471 - protein, 9 aa, Homo Sapiens
GLQVVPLKY

SEQ ID NO: 579472 - protein, 9 aa, Homo Sapiens
NTSEGWIYG

SEQ ID NO: 579473 - protein, 9 aa, Homo Sapiens
IDPSEQVEG

SEQ ID NO: 579474 - protein, 9 aa, Homo Sapiens
SAVYKRFPS

SEQ ID NO: 579475 - protein, 9 aa, Homo Sapiens
TAEGVDVWS

SEQ ID NO: 579476 - protein, 9 aa, Homo Sapiens
DASVSVRLT

SEQ ID NO: 579477 - protein, 9 aa, Homo Sapiens
LQDLQLRKA

SEQ ID NO: 579478 - protein, 9 aa, Homo Sapiens
PPGLAGFSG

SEQ ID NO: 579479 - protein, 9 aa, Homo Sapiens
VQGEVQHQV

SEQ ID NO: 579480 - protein, 9 aa, Homo Sapiens
VKSTLLLYE

SEQ ID NO: 579481 - protein, 9 aa, Homo Sapiens
SSCTQEAAH

SEQ ID NO: 579482 - protein, 9 aa, Homo Sapiens
LGKTSERFV

SEQ ID NO: 579483 - protein, 9 aa, Homo Sapiens
KSTLLLYES

SEQ ID NO: 579484 - protein, 9 aa, Homo Sapiens
SGPGRRSCW

SEQ ID NO: 579485 - protein, 9 aa, Homo Sapiens
VNWVQQQAY

SEQ ID NO: 579486 - protein, 9 aa, Homo Sapiens
EDEAEEESL

SEQ ID NO: 579487 - protein, 9 aa, Homo Sapiens
PWANLRAAY

SEQ ID NO: 579488 - protein, 9 aa, Homo Sapiens
RQADEDYTH

SEQ ID NO: 579489 - protein, 9 aa, Homo Sapiens
VSANARRSA

SEQ ID NO: 579490 - protein, 9 aa, Homo Sapiens
SASWSASGS

SEQ ID NO: 579491 - protein, 9 aa, Homo Sapiens
EGIDHSNIG

SEQ ID NO: 579492 - protein, 9 aa, Homo Sapiens
QGTAWRRKQ

SEQ ID NO: 579493 - protein, 9 aa, Homo Sapiens
CIPLDSSGD

SEQ ID NO: 579494 - protein, 9 aa, Homo Sapiens
SPNILASFE

SEQ ID NO: 579495 - protein, 9 aa, Homo Sapiens
YRKKSVEMR

SEQ ID NO: 579496 - protein, 9 aa, Homo Sapiens
PEAEGEAQE

SEQ ID NO: 579497 - protein, 9 aa, Homo Sapiens
KCSSSELIN

SEQ ID NO: 579498 - protein, 9 aa, Homo Sapiens
AELRANADR

SEQ ID NO: 579499 - protein, 9 aa, Homo Sapiens
HQVAAAPDE

SEQ ID NO: 579500 - protein, 9 aa, Homo Sapiens
IVDYSLAMP

SEQ ID NO: 579501 - protein, 9 aa, Homo Sapiens
HKIKISKEE

SEQ ID NO: 579502 - protein, 9 aa, Homo Sapiens
FFSFYHPAH

SEQ ID NO: 579503 - protein, 9 aa, Homo Sapiens
KQTAARAFR

SEQ ID NO: 579504 - protein, 9 aa, Homo Sapiens
RIDPSEQVE

SEQ ID NO: 579505 - protein, 9 aa, Homo Sapiens
HAGVQAAPV

SEQ ID NO: 579506 - protein, 9 aa, Homo Sapiens
YEQPTKEGI

SEQ ID NO: 579507 - protein, 9 aa, Homo Sapiens
LQVVPLKYR

SEQ ID NO: 579508 - protein, 9 aa, Homo Sapiens
VQGLQKRGL

SEQ ID NO: 579509 - protein, 9 aa, Homo Sapiens
SFVGNISKY

SEQ ID NO: 579510 - protein, 9 aa, Homo Sapiens
ILRSVSAVY

SEQ ID NO: 579511 - protein, 9 aa, Homo Sapiens
VSKTAPTGG

SEQ ID NO: 579512 - protein, 9 aa, Homo Sapiens
PMEQTNTSE

SEQ ID NO: 579513 - protein, 9 aa, Homo Sapiens
LNGTVEIRH

SEQ ID NO: 579514 - protein, 9 aa, Homo Sapiens
PNILASFEG

SEQ ID NO: 579515 - protein, 9 aa, Homo Sapiens
SNKNPDGKQ

SEQ ID NO: 579516 - protein, 9 aa, Homo Sapiens
DHKIKISKE

SEQ ID NO: 579517 - protein, 9 aa, Homo Sapiens
WANLRAAYP

SEQ ID NO: 579518 - protein, 9 aa, Homo Sapiens
KLMSPAPND

SEQ ID NO: 579519 - protein, 9 aa, Homo Sapiens
QSACRGYDA

SEQ ID NO: 579520 - protein, 9 aa, Homo Sapiens
TVEIRHPDG

SEQ ID NO: 579521 - protein, 9 aa, Homo Sapiens
WPSCMGCVA

SEQ ID NO: 579522 - protein, 9 aa, Homo Sapiens
NHQSNLKMC

SEQ ID NO: 579523 - protein, 9 aa, Homo Sapiens
SKYLGLDPR

SEQ ID NO: 579524 - protein, 9 aa, Homo Sapiens
NQQNSLELM

SEQ ID NO: 579525 - protein, 9 aa, Homo Sapiens
IKISKEESK

SEQ ID NO: 579526 - protein, 9 aa, Homo Sapiens
LVGTAVKDL

SEQ ID NO: 579527 - protein, 9 aa, Homo Sapiens
EALVGKTSS

SEQ ID NO: 579528 - protein, 9 aa, Homo Sapiens
QVKRCSFFS

SEQ ID NO: 579529 - protein, 9 aa, Homo Sapiens
AIGVEAFCH

SEQ ID NO: 579530 - protein, 9 aa, Homo Sapiens
TAWRRKQTA

SEQ ID NO: 579531 - protein, 9 aa, Homo Sapiens
ELINHQSNL

SEQ ID NO: 579532 - protein, 9 aa, Homo Sapiens
HSFLRAGFL

SEQ ID NO: 579533 - protein, 9 aa, Homo Sapiens
DEDYTHDLM

SEQ ID NO: 579534 - protein, 9 aa, Homo Sapiens
EFSFRVAAL

SEQ ID NO: 579535 - protein, 9 aa, Homo Sapiens
PSCMGCVAM

SEQ ID NO: 579536 - protein, 9 aa, Homo Sapiens
LEVADTGAS

SEQ ID NO: 579537 - protein, 9 aa, Homo Sapiens
SYSAEALVG

SEQ ID NO: 579538 - protein, 9 aa, Homo Sapiens
KCIPLDSSG

SEQ ID NO: 579539 - protein, 9 aa, Homo Sapiens
KYIIKFPMP

SEQ ID NO: 579540 - protein, 9 aa, Homo Sapiens
LCARIDPSE

SEQ ID NO: 579541 - protein, 9 aa, Homo Sapiens
KAEGLEVAD

SEQ ID NO: 579542 - protein, 9 aa, Homo Sapiens
SGAKGDQGQ

SEQ ID NO: 579543 - protein, 9 aa, Homo Sapiens
KVLPHYLEL

SEQ ID NO: 579544 - protein, 9 aa, Homo Sapiens
LSSCTQEAA

SEQ ID NO: 579545 - protein, 9 aa, Homo Sapiens
QGAYSQLKA

SEQ ID NO: 579546 - protein, 9 aa, Homo Sapiens
ALVGKTSSN

SEQ ID NO: 579547 - protein, 9 aa, Homo Sapiens
HQLPRESSS

SEQ ID NO: 579548 - protein, 9 aa, Homo Sapiens
ADLMEENFR

SEQ ID NO: 579549 - protein, 9 aa, Homo Sapiens
TLLSQARKT

SEQ ID NO: 579550 - protein, 9 aa, Homo Sapiens
RPWSPASCP

SEQ ID NO: 579551 - protein, 9 aa, Homo Sapiens
HSVTDIVDY

SEQ ID NO: 579552 - protein, 9 aa, Homo Sapiens
QVAAAPDED

SEQ ID NO: 579553 - protein, 9 aa, Homo Sapiens
NEVRTEAGG

SEQ ID NO: 579554 - protein, 9 aa, Homo Sapiens
ITVETHTKV

SEQ ID NO: 579555 - protein, 9 aa, Homo Sapiens
PHKAEGLEV

SEQ ID NO: 579556 - protein, 9 aa, Homo Sapiens
ESPTTGLFP

SEQ ID NO: 579557 - protein, 9 aa, Homo Sapiens
LVGKTSSNS

SEQ ID NO: 579558 - protein, 9 aa, Homo Sapiens
LTLLSQARK

SEQ ID NO: 579559 - protein, 9 aa, Homo Sapiens
IQSACRGYD

SEQ ID NO: 579560 - protein, 9 aa, Homo Sapiens
IIKFPMPGD

SEQ ID NO: 579561 - protein, 9 aa, Homo Sapiens
TKQIALALQ

SEQ ID NO: 579562 - protein, 9 aa, Homo Sapiens
PRESSSSEY

SEQ ID NO: 579563 - protein, 9 aa, Homo Sapiens
EQVKLMSPA

SEQ ID NO: 579564 - protein, 9 aa, Homo Sapiens
WRRKQTAAR

SEQ ID NO: 579565 - protein, 9 aa, Homo Sapiens
QHQVAAAPD

SEQ ID NO: 579566 - protein, 9 aa, Homo Sapiens
LRKALAQRL

SEQ ID NO: 579567 - protein, 9 aa, Homo Sapiens
FSFRVAALT

SEQ ID NO: 579568 - protein, 9 aa, Homo Sapiens
VFITDKKAD

SEQ ID NO: 579569 - protein, 9 aa, Homo Sapiens
GCVAMPLRS

SEQ ID NO: 579570 - protein, 9 aa, Homo Sapiens
AVLEKLSKD

SEQ ID NO: 579571 - protein, 9 aa, Homo Sapiens
ENMLLLTLL

SEQ ID NO: 579572 - protein, 9 aa, Homo Sapiens
NGSILQGSS

SEQ ID NO: 579573 - protein, 9 aa, Homo Sapiens
RRNVSANAR

SEQ ID NO: 579574 - protein, 9 aa, Homo Sapiens
VGIPLETGR

SEQ ID NO: 579575 - protein, 9 aa, Homo Sapiens
KCHLMASVT

SEQ ID NO: 579576 - protein, 9 aa, Homo Sapiens
GTAWRRKQT

SEQ ID NO: 579577 - protein, 9 aa, Homo Sapiens
SWLDRQLIR

SEQ ID NO: 579578 - protein, 9 aa, Homo Sapiens
DEAEEESLM

SEQ ID NO: 579579 - protein, 9 aa, Homo Sapiens
SVRRSASAS

SEQ ID NO: 579580 - protein, 9 aa, Homo Sapiens
TEAGGQCHT

SEQ ID NO: 579581 - protein, 9 aa, Homo Sapiens
PTKEGIDHS

SEQ ID NO: 579582 - protein, 9 aa, Homo Sapiens
TRNCAYSKG

SEQ ID NO: 579583 - protein, 9 aa, Homo Sapiens
KKADNSEVF

SEQ ID NO: 579584 - protein, 9 aa, Homo Sapiens
LSAQHAGVQ

SEQ ID NO: 579585 - protein, 9 aa, Homo Sapiens
ESERITVET

SEQ ID NO: 579586 - protein, 9 aa, Homo Sapiens
NDYVNWVQQ

SEQ ID NO: 579587 - protein, 9 aa, Homo Sapiens
KPAEPHPMG

SEQ ID NO: 579588 - protein, 9 aa, Homo Sapiens
APLLHTCLP

SEQ ID NO: 579589 - protein, 9 aa, Homo Sapiens
SSVDSIISS

SEQ ID NO: 579590 - protein, 9 aa, Homo Sapiens
VAMPLRSGA

SEQ ID NO: 579591 - protein, 9 aa, Homo Sapiens
HHQLPRESS

SEQ ID NO: 579592 - protein, 9 aa, Homo Sapiens
IKFPMPGDQ

SEQ ID NO: 579593 - protein, 9 aa, Homo Sapiens
CTQEAAHDS

SEQ ID NO: 579594 - protein, 9 aa, Homo Sapiens
SACRGYDAR

SEQ ID NO: 579595 - protein, 9 aa, Homo Sapiens
PGLAGFSGA

SEQ ID NO: 579596 - protein, 9 aa, Homo Sapiens
YLGLDPRKL

SEQ ID NO: 579597 - protein, 9 aa, Homo Sapiens
RSVSVRRSA

SEQ ID NO: 579598 - protein, 9 aa, Homo Sapiens
WHRLSSCTQ

SEQ ID NO: 579599 - protein, 9 aa, Homo Sapiens
HTCLPGDAA

SEQ ID NO: 579600 - protein, 9 aa, Homo Sapiens
ASWSASGSS

SEQ ID NO: 579601 - protein, 9 aa, Homo Sapiens
LCRPSFRDD

SEQ ID NO: 579602 - protein, 9 aa, Homo Sapiens
EVNLKLCRP

SEQ ID NO: 579603 - protein, 9 aa, Homo Sapiens
HRLSSCTQE

SEQ ID NO: 579604 - protein, 9 aa, Homo Sapiens
FWNKVLPHY

SEQ ID NO: 579605 - protein, 9 aa, Homo Sapiens
EDKMKHSTK

SEQ ID NO: 579606 - protein, 9 aa, Homo Sapiens
KIKISKEES

SEQ ID NO: 579607 - protein, 9 aa, Homo Sapiens
KPEQVKLMS

SEQ ID NO: 579608 - protein, 9 aa, Homo Sapiens
NARRSASKR

SEQ ID NO: 579609 - protein, 9 aa, Homo Sapiens
RLTASGRRN

SEQ ID NO: 579610 - protein, 9 aa, Homo Sapiens
SSSELINHQ

SEQ ID NO: 579611 - protein, 9 aa, Homo Sapiens
QHAGVQAAP

SEQ ID NO: 579612 - protein, 9 aa, Homo Sapiens
LRSGASPRS

SEQ ID NO: 579613 - protein, 9 aa, Homo Sapiens
KNVLLVGTA

SEQ ID NO: 579614 - protein, 9 aa, Homo Sapiens
LGAAMAAGT

SEQ ID NO: 579615 - protein, 9 aa, Homo Sapiens
VYANNGSIL

SEQ ID NO: 579616 - protein, 9 aa, Homo Sapiens
GIMDQLSVI

SEQ ID NO: 579617 - protein, 9 aa, Homo Sapiens
VCLFYVGGP

SEQ ID NO: 579618 - protein, 9 aa, Homo Sapiens
QDLQLRKAL

SEQ ID NO: 579619 - protein, 9 aa, Homo Sapiens
AAMAAGTAE

SEQ ID NO: 579620 - protein, 9 aa, Homo Sapiens
VLSWLDRQL

SEQ ID NO: 579621 - protein, 9 aa, Homo Sapiens
PKLHANAWR

SEQ ID NO: 579622 - protein, 9 aa, Homo Sapiens
EASPLSAQH

SEQ ID NO: 579623 - protein, 9 aa, Homo Sapiens
SSYSAEALV

SEQ ID NO: 579624 - protein, 9 aa, Homo Sapiens
VKRCSFFSF

SEQ ID NO: 579625 - protein, 9 aa, Homo Sapiens
GEVQHQVAA

SEQ ID NO: 579626 - protein, 9 aa, Homo Sapiens
SERFVFKQL

SEQ ID NO: 579627 - protein, 9 aa, Homo Sapiens
IRNDYVNWV

SEQ ID NO: 579628 - protein, 9 aa, Homo Sapiens
GMIEGTPKL

SEQ ID NO: 579629 - protein, 9 aa, Homo Sapiens
GLEVADTGA

SEQ ID NO: 579630 - protein, 9 aa, Homo Sapiens
NKNPDGKQT

SEQ ID NO: 579631 - protein, 9 aa, Homo Sapiens
WPPRPWSPA

SEQ ID NO: 579632 - protein, 9 aa, Homo Sapiens
PAGIMDQLS

SEQ ID NO: 579633 - protein, 9 aa, Homo Sapiens
RKILQKEDE

SEQ ID NO: 579634 - protein, 9 aa, Homo Sapiens
VRKILQKED

SEQ ID NO: 579635 - protein, 9 aa, Homo Sapiens
ETKYCVLKI

SEQ ID NO: 579636 - protein, 9 aa, Homo Sapiens
ANNGSILQG

SEQ ID NO: 579637 - protein, 9 aa, Homo Sapiens
LQKEDEAEE

SEQ ID NO: 579638 - protein, 9 aa, Homo Sapiens
ELRANADRI

SEQ ID NO: 579639 - protein, 9 aa, Homo Sapiens
NAETKYCVL

SEQ ID NO: 579640 - protein, 9 aa, Homo Sapiens
NPPVRLAPV

SEQ ID NO: 579641 - protein, 9 aa, Homo Sapiens
SPAPNDDLA

SEQ ID NO: 579642 - protein, 9 aa, Homo Sapiens
VRLAPVTLS

SEQ ID NO: 579643 - protein, 9 aa, Homo Sapiens
KTSERFVFK

SEQ ID NO: 579644 - protein, 9 aa, Homo Sapiens
ALALQHCHL

SEQ ID NO: 579645 - protein, 9 aa, Homo Sapiens
TNTSEGWIY

SEQ ID NO: 579646 - protein, 9 aa, Homo Sapiens
LKAVLEKLS

SEQ ID NO: 579647 - protein, 9 aa, Homo Sapiens
SNVLFYVLR

SEQ ID NO: 579648 - protein, 9 aa, Homo Sapiens
LLSNVLFYV

SEQ ID NO: 579649 - protein, 9 aa, Homo Sapiens
SKRRSVSVR

SEQ ID NO: 579650 - protein, 9 aa, Homo Sapiens
EENFRGDAG

SEQ ID NO: 579651 - protein, 9 aa, Homo Sapiens
VRRSASASW

SEQ ID NO: 579652 - protein, 9 aa, Homo Sapiens
AWRRKQTAA

SEQ ID NO: 579653 - protein, 9 aa, Homo Sapiens
QPTKEGIDH

SEQ ID NO: 579654 - protein, 9 aa, Homo Sapiens
LKQDLVRPW

SEQ ID NO: 579655 - protein, 9 aa, Homo Sapiens
ILQGSSVAS

SEQ ID NO: 579656 - protein, 9 aa, Homo Sapiens
RKALAQRLL

SEQ ID NO: 579657 - protein, 9 aa, Homo Sapiens
SQSSVDSII

SEQ ID NO: 579658 - protein, 9 aa, Homo Sapiens
NFRGDAGLG

SEQ ID NO: 579659 - protein, 9 aa, Homo Sapiens
WKPAEPHPM

SEQ ID NO: 579660 - protein, 9 aa, Homo Sapiens
STLLLYESP

SEQ ID NO: 579661 - protein, 9 aa, Homo Sapiens
ENVREFSFR

SEQ ID NO: 579662 - protein, 9 aa, Homo Sapiens
CRPSFRDDI

SEQ ID NO: 579663 - protein, 9 aa, Homo Sapiens
FSGAKGDQG

SEQ ID NO: 579664 - protein, 9 aa, Homo Sapiens
QGLQKRGLQ

SEQ ID NO: 579665 - protein, 9 aa, Homo Sapiens
KMKYIIKFP

SEQ ID NO: 579666 - protein, 9 aa, Homo Sapiens
QGQLVFYNA

SEQ ID NO: 579667 - protein, 9 aa, Homo Sapiens
KRCSFFSFY

SEQ ID NO: 579668 - protein, 9 aa, Homo Sapiens
ITHGTPADI

SEQ ID NO: 579669 - protein, 9 aa, Homo Sapiens
GLAGFSGAK

SEQ ID NO: 579670 - protein, 9 aa, Homo Sapiens
NVLLVGTAV

SEQ ID NO: 579671 - protein, 9 aa, Homo Sapiens
MSPAPNDDL

SEQ ID NO: 579672 - protein, 9 aa, Homo Sapiens
DVLSWLDRQ

SEQ ID NO: 579673 - protein, 9 aa, Homo Sapiens
CSSSELINH

SEQ ID NO: 579674 - protein, 9 aa, Homo Sapiens
VNYEQPTKE

SEQ ID NO: 579675 - protein, 9 aa, Homo Sapiens
LFTRNCAYS

SEQ ID NO: 579676 - protein, 9 aa, Homo Sapiens
YESPTTGLF

SEQ ID NO: 579677 - protein, 9 aa, Homo Sapiens
EIRHPDGKV

SEQ ID NO: 579678 - protein, 9 aa, Homo Sapiens
CPWPSCMGC

SEQ ID NO: 579679 - protein, 9 aa, Homo Sapiens
FSFYHPAHC

SEQ ID NO: 579680 - protein, 9 aa, Homo Sapiens
SVSAVYKRF

SEQ ID NO: 579681 - protein, 9 aa, Homo Sapiens
ADNSEVFWN

SEQ ID NO: 579682 - protein, 9 aa, Homo Sapiens
QVKLMSPAP

SEQ ID NO: 579683 - protein, 9 aa, Homo Sapiens
HCFVEFLFH

SEQ ID NO: 579684 - protein, 9 aa, Homo Sapiens
PVRLAPVTL

SEQ ID NO: 579685 - protein, 9 aa, Homo Sapiens
EQPTKEGID

SEQ ID NO: 579686 - protein, 9 aa, Homo Sapiens
NKNVLLVGT

SEQ ID NO: 579687 - protein, 9 aa, Homo Sapiens
MELCARIDP

SEQ ID NO: 579688 - protein, 9 aa, Homo Sapiens
ACRGYDARR

SEQ ID NO: 579689 - protein, 9 aa, Homo Sapiens
QLPRESSSS

SEQ ID NO: 579690 - protein, 9 aa, Homo Sapiens
NKVLPHYLE

SEQ ID NO: 579691 - protein, 9 aa, Homo Sapiens
SGSKKFWNK

SEQ ID NO: 579692 - protein, 9 aa, Homo Sapiens
EILLSVDSS

SEQ ID NO: 579693 - protein, 9 aa, Homo Sapiens
MEQTNTSEG

SEQ ID NO: 579694 - protein, 9 aa, Homo Sapiens
WSPASCPWP

SEQ ID NO: 579695 - protein, 9 aa, Homo Sapiens
AGGQCHTEL

SEQ ID NO: 579696 - protein, 9 aa, Homo Sapiens
RNMEVFFPR

SEQ ID NO: 579697 - protein, 9 aa, Homo Sapiens
QNQQNSLEL

SEQ ID NO: 579698 - protein, 9 aa, Homo Sapiens
ALGITLTPQ

SEQ ID NO: 579699 - protein, 9 aa, Homo Sapiens
VQHQVAAAP

SEQ ID NO: 579700 - protein, 9 aa, Homo Sapiens
LILRSVSAV

SEQ ID NO: 579701 - protein, 9 aa, Homo Sapiens
TSERFVFKQ

SEQ ID NO: 579702 - protein, 9 aa, Homo Sapiens
PCPAGIMDQ

SEQ ID NO: 579703 - protein, 9 aa, Homo Sapiens
LALQHCHLL

SEQ ID NO: 579704 - protein, 9 aa, Homo Sapiens
GSLFTRNCA

SEQ ID NO: 579705 - protein, 9 aa, Homo Sapiens
GTPADILYK

SEQ ID NO: 579706 - protein, 9 aa, Homo Sapiens
DEELRRERD

SEQ ID NO: 579707 - protein, 9 aa, Homo Sapiens
YSAEALVGK

SEQ ID NO: 579708 - protein, 9 aa, Homo Sapiens
VEIRHPDGK

SEQ ID NO: 579709 - protein, 9 aa, Homo Sapiens
RRSVSVRRS

SEQ ID NO: 579710 - protein, 9 aa, Homo Sapiens
VEVNLKLCR

SEQ ID NO: 579711 - protein, 9 aa, Homo Sapiens
QYASLSCFG

SEQ ID NO: 579712 - protein, 9 aa, Homo Sapiens
ERFVFKQLD

SEQ ID NO: 579713 - protein, 9 aa, Homo Sapiens
AYPLNLSFL

SEQ ID NO: 579714 - protein, 9 aa, Homo Sapiens
GSSGPGRRS

SEQ ID NO: 579715 - protein, 9 aa, Homo Sapiens
PQQVQELGI

SEQ ID NO: 579716 - protein, 9 aa, Homo Sapiens
SPMEQTNTS

SEQ ID NO: 579717 - protein, 9 aa, Homo Sapiens
FYVGGPKMD

SEQ ID NO: 579718 - protein, 9 aa, Homo Sapiens
GKMELCARI

SEQ ID NO: 579719 - protein, 9 aa, Homo Sapiens
MPLRSGASP

SEQ ID NO: 579720 - protein, 9 aa, Homo Sapiens
LPRESSSSE

SEQ ID NO: 579721 - protein, 9 aa, Homo Sapiens
DLMEENFRG

SEQ ID NO: 579722 - protein, 9 aa, Homo Sapiens
SSRFSSGGS

SEQ ID NO: 579723 - protein, 9 aa, Homo Sapiens
AIQSACRGY

SEQ ID NO: 579724 - protein, 9 aa, Homo Sapiens
KTAPTGGYL

SEQ ID NO: 579725 - protein, 9 aa, Homo Sapiens
SVDSIISSS

SEQ ID NO: 579726 - protein, 9 aa, Homo Sapiens
SKLRESERI

SEQ ID NO: 579727 - protein, 9 aa, Homo Sapiens
QSSVDSIIS

SEQ ID NO: 579728 - protein, 9 aa, Homo Sapiens
HSTKIQVID

SEQ ID NO: 579729 - protein, 9 aa, Homo Sapiens
MAAGTAEGV

SEQ ID NO: 579730 - protein, 9 aa, Homo Sapiens
HGVSHQIWD

SEQ ID NO: 579731 - protein, 9 aa, Homo Sapiens
GVLKQDLVR

SEQ ID NO: 579732 - protein, 9 aa, Homo Sapiens
PEQVKLMSP

SEQ ID NO: 579733 - protein, 9 aa, Homo Sapiens
PDGKQTRSR

SEQ ID NO: 579734 - protein, 9 aa, Homo Sapiens
HKAEGLEVA

SEQ ID NO: 579735 - protein, 9 aa, Homo Sapiens
RFKLDQKYE

SEQ ID NO: 579736 - protein, 9 aa, Homo Sapiens
GPDVLSWLD

SEQ ID NO: 579737 - protein, 9 aa, Homo Sapiens
LQKRGLQVV

SEQ ID NO: 579738 - protein, 9 aa, Homo Sapiens
WNKVLPHYL

SEQ ID NO: 579739 - protein, 9 aa, Homo Sapiens
GGSCGLGGG

SEQ ID NO: 579740 - protein, 9 aa, Homo Sapiens
LLYESPTTG

SEQ ID NO: 579741 - protein, 9 aa, Homo Sapiens
SFRVAALTF

SEQ ID NO: 579742 - protein, 9 aa, Homo Sapiens
FEGKNRVWV

SEQ ID NO: 579743 - protein, 9 aa, Homo Sapiens
LHTCLPGDA

SEQ ID NO: 579744 - protein, 9 aa, Homo Sapiens
GTAEGVDVW

SEQ ID NO: 579745 - protein, 9 aa, Homo Sapiens
KDRHWLFTK

SEQ ID NO: 579746 - protein, 9 aa, Homo Sapiens
RQFREILLS

SEQ ID NO: 579747 - protein, 9 aa, Homo Sapiens
QLRKALAQR

SEQ ID NO: 579748 - protein, 9 aa, Homo Sapiens
AGTAEGVDV

SEQ ID NO: 579749 - protein, 9 aa, Homo Sapiens
NVSANARRS

SEQ ID NO: 579750 - protein, 9 aa, Homo Sapiens
FTRNCAYSK

SEQ ID NO: 579751 - protein, 9 aa, Homo Sapiens
SKKFWNKVL

SEQ ID NO: 579752 - protein, 9 aa, Homo Sapiens
NPEVVRMIH

SEQ ID NO: 579753 - protein, 9 aa, Homo Sapiens
PPVRLAPVT

SEQ ID NO: 579754 - protein, 9 aa, Homo Sapiens
ASGRRNVSA

SEQ ID NO: 579755 - protein, 9 aa, Homo Sapiens
SLSCFGNLT

SEQ ID NO: 579756 - protein, 9 aa, Homo Sapiens
SWSASGSSG

SEQ ID NO: 579757 - protein, 9 aa, Homo Sapiens
VHRNGSLFT

SEQ ID NO: 579758 - protein, 9 aa, Homo Sapiens
GTKCIPLDS

SEQ ID NO: 579759 - protein, 9 aa, Homo Sapiens
VLFYVLRSV

SEQ ID NO: 579760 - protein, 9 aa, Homo Sapiens
HGTPADILY

SEQ ID NO: 579761 - protein, 9 aa, Homo Sapiens
IQNQQNSLE

SEQ ID NO: 579762 - protein, 9 aa, Homo Sapiens
FITDKKADN

SEQ ID NO: 579763 - protein, 9 aa, Homo Sapiens
LINHQSNLK

SEQ ID NO: 579764 - protein, 9 aa, Homo Sapiens
FREILLSVD

SEQ ID NO: 579765 - protein, 9 aa, Homo Sapiens
KKSVEMRHR

SEQ ID NO: 579766 - protein, 9 aa, Homo Sapiens
QIALALQHC

SEQ ID NO: 579767 - protein, 9 aa, Homo Sapiens
GYLTTGSFM

SEQ ID NO: 579768 - protein, 9 aa, Homo Sapiens
VGKTSSNSE

SEQ ID NO: 579769 - protein, 9 aa, Homo Sapiens
AEGLEVADT

SEQ ID NO: 579770 - protein, 9 aa, Homo Sapiens
FLLSNVLFY

SEQ ID NO: 579771 - protein, 9 aa, Homo Sapiens
HWLFTKFPE

SEQ ID NO: 579772 - protein, 9 aa, Homo Sapiens
VNLKLCRPS

SEQ ID NO: 579773 - protein, 9 aa, Homo Sapiens
MEENFRGDA

SEQ ID NO: 579774 - protein, 9 aa, Homo Sapiens
IPLETGRKQ

SEQ ID NO: 579775 - protein, 9 aa, Homo Sapiens
QAHNPPVRL

SEQ ID NO: 579776 - protein, 9 aa, Homo Sapiens
QRRNKCHLM

SEQ ID NO: 579777 - protein, 9 aa, Homo Sapiens
RDASVSVRL

SEQ ID NO: 579778 - protein, 9 aa, Homo Sapiens
EDYTHDLML

SEQ ID NO: 579779 - protein, 9 aa, Homo Sapiens
SPLSAQHAG

SEQ ID NO: 579780 - protein, 9 aa, Homo Sapiens
SCGLGGGYG

SEQ ID NO: 579781 - protein, 9 aa, Homo Sapiens
FVGNISKYL

SEQ ID NO: 579782 - protein, 9 aa, Homo Sapiens
LVLHCFVEF

SEQ ID NO: 579783 - protein, 9 aa, Homo Sapiens
PASCPWPSC

SEQ ID NO: 579784 - protein, 9 aa, Homo Sapiens
EAGGQCHTE

SEQ ID NO: 579785 - protein, 9 aa, Homo Sapiens
NGSLFTRNC

SEQ ID NO: 579786 - protein, 9 aa, Homo Sapiens
RSCWPPRPW

SEQ ID NO: 579787 - protein, 9 aa, Homo Sapiens
GRKQYNVDY

SEQ ID NO: 579788 - protein, 9 aa, Homo Sapiens
DAIQNQQNS

SEQ ID NO: 579789 - protein, 9 aa, Homo Sapiens
KYCVLKIDR

SEQ ID NO: 579790 - protein, 9 aa, Homo Sapiens
QHCHLLNIA

SEQ ID NO: 579791 - protein, 9 aa, Homo Sapiens
MRLHQVLTG

SEQ ID NO: 579792 - protein, 9 aa, Homo Sapiens
LGTKCIPLD

SEQ ID NO: 579793 - protein, 9 aa, Homo Sapiens
GLQKRGLQV

SEQ ID NO: 579794 - protein, 9 aa, Homo Sapiens
TKYCVLKID

SEQ ID NO: 579795 - protein, 9 aa, Homo Sapiens
IDIRNDYVN

SEQ ID NO: 579796 - protein, 9 aa, Homo Sapiens
TPQQVQELG

SEQ ID NO: 579797 - protein, 9 aa, Homo Sapiens
EAEGEAQEA

SEQ ID NO: 579798 - protein, 9 aa, Homo Sapiens
CMGCVAMPL

SEQ ID NO: 579799 - protein, 9 aa, Homo Sapiens
CRGYDARRK

SEQ ID NO: 579800 - protein, 9 aa, Homo Sapiens
IADLMEENF

SEQ ID NO: 579801 - protein, 9 aa, Homo Sapiens
NMLLLTLLS

SEQ ID NO: 579802 - protein, 9 aa, Homo Sapiens
HWHRLSSCT

SEQ ID NO: 579803 - protein, 9 aa, Homo Sapiens
FVSRIMSVQ

SEQ ID NO: 579804 - protein, 9 aa, Homo Sapiens
EMRHRKVYV

SEQ ID NO: 579805 - protein, 9 aa, Homo Sapiens
MSPMEQTNT

SEQ ID NO: 579806 - protein, 9 aa, Homo Sapiens
SAQHAGVQA

SEQ ID NO: 579807 - protein, 9 aa, Homo Sapiens
ASGSSGPGR

SEQ ID NO: 579808 - protein, 9 aa, Homo Sapiens
RERDASVSV

SEQ ID NO: 579809 - protein, 9 aa, Homo Sapiens
FTKFPELAP

SEQ ID NO: 579810 - protein, 9 aa, Homo Sapiens
KFWNKVLPH

SEQ ID NO: 579811 - protein, 9 aa, Homo Sapiens
VFKQLDSLW

SEQ ID NO: 579812 - protein, 9 aa, Homo Sapiens
MDQLSVIPN

SEQ ID NO: 579813 - protein, 9 aa, Homo Sapiens
NVREFSFRV

SEQ ID NO: 579814 - protein, 9 aa, Homo Sapiens
EGLEVADTG

SEQ ID NO: 579815 - protein, 9 aa, Homo Sapiens
VRTEAGGQC

SEQ ID NO: 579816 - protein, 9 aa, Homo Sapiens
NVLFYVLRS

SEQ ID NO: 579817 - protein, 9 aa, Homo Sapiens
DVKHGVSHQ

SEQ ID NO: 579818 - protein, 9 aa, Homo Sapiens
GRRNVSANA

SEQ ID NO: 579819 - protein, 9 aa, Homo Sapiens
CVLKIDRTE

SEQ ID NO: 579820 - protein, 9 aa, Homo Sapiens
SGSSGPGRR

SEQ ID NO: 579821 - protein, 9 aa, Homo Sapiens
LRRERDASV

SEQ ID NO: 579822 - protein, 9 aa, Homo Sapiens
ALQHCHLLN

SEQ ID NO: 579823 - protein, 9 aa, Homo Sapiens
RHPDGKVEN

SEQ ID NO: 579824 - protein, 9 aa, Homo Sapiens
QQVQELGIP

SEQ ID NO: 579825 - protein, 9 aa, Homo Sapiens
IPLDSSGDQ

SEQ ID NO: 579826 - protein, 9 aa, Homo Sapiens
RANADRIRG

SEQ ID NO: 579827 - protein, 9 aa, Homo Sapiens
AETKYCVLK

SEQ ID NO: 579828 - protein, 9 aa, Homo Sapiens
VGGPKMDTT

SEQ ID NO: 579829 - protein, 9 aa, Homo Sapiens
KKFWNKVLP

SEQ ID NO: 579830 - protein, 9 aa, Homo Sapiens
SCFGNLTYL

SEQ ID NO: 579831 - protein, 9 aa, Homo Sapiens
GTPKLHANA

SEQ ID NO: 579832 - protein, 9 aa, Homo Sapiens
EAQEAEGEA

SEQ ID NO: 579833 - protein, 9 aa, Homo Sapiens
EELRRERDA

SEQ ID NO: 579834 - protein, 9 aa, Homo Sapiens
TLLLYESPT

SEQ ID NO: 579835 - protein, 9 aa, Homo Sapiens
LFYVGGPKM

SEQ ID NO: 579836 - protein, 9 aa, Homo Sapiens
SFYHPAHCL

SEQ ID NO: 579837 - protein, 9 aa, Homo Sapiens
RRSCWPPRP

SEQ ID NO: 579838 - protein, 9 aa, Homo Sapiens
GGYLTTGSF

SEQ ID NO: 579839 - protein, 9 aa, Homo Sapiens
KHSTKIQVI

SEQ ID NO: 579840 - protein, 9 aa, Homo Sapiens
SCMGCVAMP

SEQ ID NO: 579841 - protein, 9 aa, Homo Sapiens
IISSSSSTK

SEQ ID NO: 579842 - protein, 9 aa, Homo Sapiens
VKLMSPAPN

SEQ ID NO: 579843 - protein, 9 aa, Homo Sapiens
THGTPADIL

SEQ ID NO: 579844 - protein, 9 aa, Homo Sapiens
SVTDIVDYS

SEQ ID NO: 579845 - protein, 9 aa, Homo Sapiens
IALALQHCH

SEQ ID NO: 579846 - protein, 9 aa, Homo Sapiens
QEDKMKHST

SEQ ID NO: 579847 - protein, 9 aa, Homo Sapiens
KADNSEVFW

SEQ ID NO: 579848 - protein, 9 aa, Homo Sapiens
ENFRGDAGL

SEQ ID NO: 579849 - protein, 9 aa, Homo Sapiens
KQDLVRPWG

SEQ ID NO: 579850 - protein, 9 aa, Homo Sapiens
PLDSSGDQQ

SEQ ID NO: 579851 - protein, 9 aa, Homo Sapiens
CSFFSFYHP

SEQ ID NO: 579852 - protein, 9 aa, Homo Sapiens
LVRPWGLAP

SEQ ID NO: 579853 - protein, 9 aa, Homo Sapiens
KHGVSHQIW

SEQ ID NO: 579854 - protein, 9 aa, Homo Sapiens
SVSVRRSAS

SEQ ID NO: 579855 - protein, 9 aa, Homo Sapiens
PQEDKMKHS

SEQ ID NO: 579856 - protein, 9 aa, Homo Sapiens
PRPWSPASC

SEQ ID NO: 579857 - protein, 9 aa, Homo Sapiens
LASFEGKNR

SEQ ID NO: 579858 - protein, 9 aa, Homo Sapiens
GPPGLAGFS

SEQ ID NO: 579859 - protein, 9 aa, Homo Sapiens
AAGTAEGVD

SEQ ID NO: 579860 - protein, 9 aa, Homo Sapiens
VQYASLSCF

SEQ ID NO: 579861 - protein, 9 aa, Homo Sapiens
YVNWVQQQA

SEQ ID NO: 579862 - protein, 9 aa, Homo Sapiens
HQAFEAELR

SEQ ID NO: 579863 - protein, 9 aa, Homo Sapiens
SLELMMDHL

SEQ ID NO: 579864 - protein, 9 aa, Homo Sapiens
VRLTASGRR

SEQ ID NO: 579865 - protein, 9 aa, Homo Sapiens
LSCFGNLTY

SEQ ID NO: 579866 - protein, 9 aa, Homo Sapiens
IVQAHNPPV

SEQ ID NO: 579867 - protein, 9 aa, Homo Sapiens
LFTKFPELA

SEQ ID NO: 579868 - protein, 9 aa, Homo Sapiens
GITLTPQQV

SEQ ID NO: 579869 - protein, 9 aa, Homo Sapiens
ANLRAAYPL

SEQ ID NO: 579870 - protein, 9 aa, Homo Sapiens
LRAAYPLNL

SEQ ID NO: 579871 - protein, 9 aa, Homo Sapiens
QTNTSEGWI

SEQ ID NO: 579872 - protein, 9 aa, Homo Sapiens
LVFYNAVAI

SEQ ID NO: 579873 - protein, 9 aa, Homo Sapiens
VEAFCHSFL

SEQ ID NO: 579874 - protein, 9 aa, Homo Sapiens
DFVSRIMSV

SEQ ID NO: 579875 - protein, 9 aa, Homo Sapiens
RLHQVLTGA

SEQ ID NO: 579876 - protein, 9 aa, Homo Sapiens
GRRSCWPPR

SEQ ID NO: 579877 - protein, 9 aa, Homo Sapiens
GTVEIRHPD

SEQ ID NO: 579878 - protein, 9 aa, Homo Sapiens
GKTSERFVF

SEQ ID NO: 579879 - protein, 9 aa, Homo Sapiens
SLGTKCIPL

SEQ ID NO: 579880 - protein, 9 aa, Homo Sapiens
ASPLSAQHA

SEQ ID NO: 579881 - protein, 9 aa, Homo Sapiens
LNPNYEAEP

SEQ ID NO: 579882 - protein, 9 aa, Homo Sapiens
SCKAVTCCR

SEQ ID NO: 579883 - protein, 9 aa, Homo Sapiens
QHRSYMRFT

SEQ ID NO: 579884 - protein, 9 aa, Homo Sapiens
ISIPREHLP

SEQ ID NO: 579885 - protein, 9 aa, Homo Sapiens
SLPHELLST

SEQ ID NO: 579886 - protein, 9 aa, Homo Sapiens
ELLSTDNAL

SEQ ID NO: 579887 - protein, 9 aa, Homo Sapiens
CLLTNRSAC

SEQ ID NO: 579888 - protein, 9 aa, Homo Sapiens
TGACNNIDH

SEQ ID NO: 579889 - protein, 9 aa, Homo Sapiens
YLEKHITHK

SEQ ID NO: 579890 - protein, 9 aa, Homo Sapiens
GYTRQHLGA

SEQ ID NO: 579891 - protein, 9 aa, Homo Sapiens
KSRYHYFAR

SEQ ID NO: 579892 - protein, 9 aa, Homo Sapiens
QKTLHLETS

SEQ ID NO: 579893 - protein, 9 aa, Homo Sapiens
SHVSASSQW

SEQ ID NO: 579894 - protein, 9 aa, Homo Sapiens
APGKHLGYT

SEQ ID NO: 579895 - protein, 9 aa, Homo Sapiens
HPEAHSEEQ

SEQ ID NO: 579896 - protein, 9 aa, Homo Sapiens
RLQAQNIEQ

SEQ ID NO: 579897 - protein, 9 aa, Homo Sapiens
IFSLTTDCG

SEQ ID NO: 579898 - protein, 9 aa, Homo Sapiens
GAVGPISIP

SEQ ID NO: 579899 - protein, 9 aa, Homo Sapiens
DIGPSYRQG

SEQ ID NO: 579900 - protein, 9 aa, Homo Sapiens
LAVSAGIFS

SEQ ID NO: 579901 - protein, 9 aa, Homo Sapiens
VTLSSLELW

SEQ ID NO: 579902 - protein, 9 aa, Homo Sapiens
LGSEVLMRD

SEQ ID NO: 579903 - protein, 9 aa, Homo Sapiens
REQDIRMPK

SEQ ID NO: 579904 - protein, 9 aa, Homo Sapiens
NIDHPRWGA

SEQ ID NO: 579905 - protein, 9 aa, Homo Sapiens
GVTPKQYDT

SEQ ID NO: 579906 - protein, 9 aa, Homo Sapiens
QGKILNRKV

SEQ ID NO: 579907 - protein, 9 aa, Homo Sapiens
EVTDSEYFE

SEQ ID NO: 579908 - protein, 9 aa, Homo Sapiens
TESEDGEGE

SEQ ID NO: 579909 - protein, 9 aa, Homo Sapiens
PRHISPFWV

SEQ ID NO: 579910 - protein, 9 aa, Homo Sapiens
PREHLPACP

SEQ ID NO: 579911 - protein, 9 aa, Homo Sapiens
VLGETWEKA

SEQ ID NO: 579912 - protein, 9 aa, Homo Sapiens
TFPPDSLAH

SEQ ID NO: 579913 - protein, 9 aa, Homo Sapiens
QAEELPACL

SEQ ID NO: 579914 - protein, 9 aa, Homo Sapiens
IPAKVQTAL

SEQ ID NO: 579915 - protein, 9 aa, Homo Sapiens
ESEDGEGET

SEQ ID NO: 579916 - protein, 9 aa, Homo Sapiens
GELQQSGVV

SEQ ID NO: 579917 - protein, 9 aa, Homo Sapiens
HRSYMRFTE

SEQ ID NO: 579918 - protein, 9 aa, Homo Sapiens
YGGSKHNAL

SEQ ID NO: 579919 - protein, 9 aa, Homo Sapiens
MDEVTKPGN

SEQ ID NO: 579920 - protein, 9 aa, Homo Sapiens
AQNIEQRHI

SEQ ID NO: 579921 - protein, 9 aa, Homo Sapiens
FMVALGPVT

SEQ ID NO: 579922 - protein, 9 aa, Homo Sapiens
RHGVYVLGE

SEQ ID NO: 579923 - protein, 9 aa, Homo Sapiens
PSYRQGYAL

SEQ ID NO: 579924 - protein, 9 aa, Homo Sapiens
VAYFNKPDI

SEQ ID NO: 579925 - protein, 9 aa, Homo Sapiens
KAVTCCRVS

SEQ ID NO: 579926 - protein, 9 aa, Homo Sapiens
ARWVAYFNK

SEQ ID NO: 579927 - protein, 9 aa, Homo Sapiens
KENAQKKME

SEQ ID NO: 579928 - protein, 9 aa, Homo Sapiens
RVRAGFCFH

SEQ ID NO: 579929 - protein, 9 aa, Homo Sapiens
SASSQWQET

SEQ ID NO: 579930 - protein, 9 aa, Homo Sapiens
PLKLAGWQC

SEQ ID NO: 579931 - protein, 9 aa, Homo Sapiens
CDRYAAVCR

SEQ ID NO: 579932 - protein, 9 aa, Homo Sapiens
LWESEAGES

SEQ ID NO: 579933 - protein, 9 aa, Homo Sapiens
ATSYDLHRY

SEQ ID NO: 579934 - protein, 9 aa, Homo Sapiens
VAKTKLAIG

SEQ ID NO: 579935 - protein, 9 aa, Homo Sapiens
GACNNIDHP

SEQ ID NO: 579936 - protein, 9 aa, Homo Sapiens
SNKVVSHTS

SEQ ID NO: 579937 - protein, 9 aa, Homo Sapiens
LKDDHTFRP

SEQ ID NO: 579938 - protein, 9 aa, Homo Sapiens
AEDGPLVCQ

SEQ ID NO: 579939 - protein, 9 aa, Homo Sapiens
RWVAYFNKP

SEQ ID NO: 579940 - protein, 9 aa, Homo Sapiens
TVTLSSLEL

SEQ ID NO: 579941 - protein, 9 aa, Homo Sapiens
YPAKNSAEF

SEQ ID NO: 579942 - protein, 9 aa, Homo Sapiens
QAQNIEQRH

SEQ ID NO: 579943 - protein, 9 aa, Homo Sapiens
ALSCKAVTC

SEQ ID NO: 579944 - protein, 9 aa, Homo Sapiens
YTRQHLGAV

SEQ ID NO: 579945 - protein, 9 aa, Homo Sapiens
YMRFTEKED

SEQ ID NO: 579946 - protein, 9 aa, Homo Sapiens
ASLNPNYEA

SEQ ID NO: 579947 - protein, 9 aa, Homo Sapiens
VALGPVTTE

SEQ ID NO: 579948 - protein, 9 aa, Homo Sapiens
GPLVCQFEV

SEQ ID NO: 579949 - protein, 9 aa, Homo Sapiens
ANCILKADI

SEQ ID NO: 579950 - protein, 9 aa, Homo Sapiens
HLGYTRQHL

SEQ ID NO: 579951 - protein, 9 aa, Homo Sapiens
TRQHLGAVG

SEQ ID NO: 579952 - protein, 9 aa, Homo Sapiens
DTRMQLLAT

SEQ ID NO: 579953 - protein, 9 aa, Homo Sapiens
PVTTEHLEE

SEQ ID NO: 579954 - protein, 9 aa, Homo Sapiens
VKLPRHISP

SEQ ID NO: 579955 - protein, 9 aa, Homo Sapiens
SEDGEGETT

SEQ ID NO: 579956 - protein, 9 aa, Homo Sapiens
SKHNALLKW

SEQ ID NO: 579957 - protein, 9 aa, Homo Sapiens
VELSDGQPL

SEQ ID NO: 579958 - protein, 9 aa, Homo Sapiens
ISLTFPPDS

SEQ ID NO: 579959 - protein, 9 aa, Homo Sapiens
YHYFARTVP

SEQ ID NO: 579960 - protein, 9 aa, Homo Sapiens
SQWQETART

SEQ ID NO: 579961 - protein, 9 aa, Homo Sapiens
ETGEEENES

SEQ ID NO: 579962 - protein, 9 aa, Homo Sapiens
ACNNIDHPR

SEQ ID NO: 579963 - protein, 9 aa, Homo Sapiens
NRIFINNEW

SEQ ID NO: 579964 - protein, 9 aa, Homo Sapiens
GSEVLMRDL

SEQ ID NO: 579965 - protein, 9 aa, Homo Sapiens
KPEVTDSEY

SEQ ID NO: 579966 - protein, 9 aa, Homo Sapiens
ERDRKIMQS

SEQ ID NO: 579967 - protein, 9 aa, Homo Sapiens
CIPPMPGGL

SEQ ID NO: 579968 - protein, 9 aa, Homo Sapiens
PSLHRTQAE

SEQ ID NO: 579969 - protein, 9 aa, Homo Sapiens
VQKTLHLET

SEQ ID NO: 579970 - protein, 9 aa, Homo Sapiens
VVVGLLGDA

SEQ ID NO: 579971 - protein, 9 aa, Homo Sapiens
LKLAGWQCP

SEQ ID NO: 579972 - protein, 9 aa, Homo Sapiens
PKQYDTYFC

SEQ ID NO: 579973 - protein, 9 aa, Homo Sapiens
EAHSEEQQQ

SEQ ID NO: 579974 - protein, 9 aa, Homo Sapiens
KVQTALKEH

SEQ ID NO: 579975 - protein, 9 aa, Homo Sapiens
QPEVFCNRI

SEQ ID NO: 579976 - protein, 9 aa, Homo Sapiens
FRPLWVAPD

SEQ ID NO: 579977 - protein, 9 aa, Homo Sapiens
GTVTALFNV

SEQ ID NO: 579978 - protein, 9 aa, Homo Sapiens
DSHHQLWRV

SEQ ID NO: 579979 - protein, 9 aa, Homo Sapiens
EVFCNRIFI

SEQ ID NO: 579980 - protein, 9 aa, Homo Sapiens
NPNYEAEPS

SEQ ID NO: 579981 - protein, 9 aa, Homo Sapiens
KGLMDANCI

SEQ ID NO: 579982 - protein, 9 aa, Homo Sapiens
LGDAPGKHL

SEQ ID NO: 579983 - protein, 9 aa, Homo Sapiens
FLKSLRLVD

SEQ ID NO: 579984 - protein, 9 aa, Homo Sapiens
KNWKEERDR

SEQ ID NO: 579985 - protein, 9 aa, Homo Sapiens
HRGELQQSG

SEQ ID NO: 579986 - protein, 9 aa, Homo Sapiens
AFMVALGPV

SEQ ID NO: 579987 - protein, 9 aa, Homo Sapiens
SSGDTESED

SEQ ID NO: 579988 - protein, 9 aa, Homo Sapiens
TFRPLWVAP

SEQ ID NO: 579989 - protein, 9 aa, Homo Sapiens
PFWVFLKSL

SEQ ID NO: 579990 - protein, 9 aa, Homo Sapiens
RQRQNAGSS

SEQ ID NO: 579991 - protein, 9 aa, Homo Sapiens
KTLHLETSF

SEQ ID NO: 579992 - protein, 9 aa, Homo Sapiens
MDANCILKA

SEQ ID NO: 579993 - protein, 9 aa, Homo Sapiens
KCIPPMPGG

SEQ ID NO: 579994 - protein, 9 aa, Homo Sapiens
DAFQRSAGV

SEQ ID NO: 579995 - protein, 9 aa, Homo Sapiens
AVTCCRVSP

SEQ ID NO: 579996 - protein, 9 aa, Homo Sapiens
LGYTRQHLG

SEQ ID NO: 579997 - protein, 9 aa, Homo Sapiens
IRMPKKTGS

SEQ ID NO: 579998 - protein, 9 aa, Homo Sapiens
LHLETSFMG

SEQ ID NO: 579999 - protein, 9 aa, Homo Sapiens
AHCTVNGRE

SEQ ID NO: 580000 - protein, 9 aa, Homo Sapiens
GKILNRKVC

SEQ ID NO: 580001 - protein, 9 aa, Homo Sapiens
GEEENESQD

SEQ ID NO: 580002 - protein, 9 aa, Homo Sapiens
GPISIPREH

SEQ ID NO: 580003 - protein, 9 aa, Homo Sapiens
HPSHGVREK

SEQ ID NO: 580004 - protein, 9 aa, Homo Sapiens
LPSPQKCIP

SEQ ID NO: 580005 - protein, 9 aa, Homo Sapiens
NGQVTYSLL

SEQ ID NO: 580006 - protein, 9 aa, Homo Sapiens
SVIEVTKGH

SEQ ID NO: 580007 - protein, 9 aa, Homo Sapiens
DLSNSSLQN

SEQ ID NO: 580008 - protein, 9 aa, Homo Sapiens
IDAFQRSAG

SEQ ID NO: 580009 - protein, 9 aa, Homo Sapiens
SPFWVFLKS

SEQ ID NO: 580010 - protein, 9 aa, Homo Sapiens
DHRGELQQS

SEQ ID NO: 580011 - protein, 9 aa, Homo Sapiens
FLLAAMACD

SEQ ID NO: 580012 - protein, 9 aa, Homo Sapiens
VLAVSAGIF

SEQ ID NO: 580013 - protein, 9 aa, Homo Sapiens
SDREQDIRM

SEQ ID NO: 580014 - protein, 9 aa, Homo Sapiens
QARMRVHSW

SEQ ID NO: 580015 - protein, 9 aa, Homo Sapiens
ENESQDGEE

SEQ ID NO: 580016 - protein, 9 aa, Homo Sapiens
VCQFEVLGS

SEQ ID NO: 580017 - protein, 9 aa, Homo Sapiens
MPGVTPKQY

SEQ ID NO: 580018 - protein, 9 aa, Homo Sapiens
PHPASAAAA

SEQ ID NO: 580019 - protein, 9 aa, Homo Sapiens
RSACIPCFL

SEQ ID NO: 580020 - protein, 9 aa, Homo Sapiens
HITHKNGGA

SEQ ID NO: 580021 - protein, 9 aa, Homo Sapiens
KDDHTFRPL

SEQ ID NO: 580022 - protein, 9 aa, Homo Sapiens
GLGARFQQL

SEQ ID NO: 580023 - protein, 9 aa, Homo Sapiens
HLEVQIQTV

SEQ ID NO: 580024 - protein, 9 aa, Homo Sapiens
QRQNAGSSS

SEQ ID NO: 580025 - protein, 9 aa, Homo Sapiens
KPGNIVREL

SEQ ID NO: 580026 - protein, 9 aa, Homo Sapiens
NLLLQARMR

SEQ ID NO: 580027 - protein, 9 aa, Homo Sapiens
FCNRIFINN

SEQ ID NO: 580028 - protein, 9 aa, Homo Sapiens
LRLVDSHHQ

SEQ ID NO: 580029 - protein, 9 aa, Homo Sapiens
EQDHRGELQ

SEQ ID NO: 580030 - protein, 9 aa, Homo Sapiens
EWLGSNTTT

SEQ ID NO: 580031 - protein, 9 aa, Homo Sapiens
MQLLATSYD

SEQ ID NO: 580032 - protein, 9 aa, Homo Sapiens
LISLTFPPD

SEQ ID NO: 580033 - protein, 9 aa, Homo Sapiens
MRDLKCETP

SEQ ID NO: 580034 - protein, 9 aa, Homo Sapiens
TSYDLHRYF

SEQ ID NO: 580035 - protein, 9 aa, Homo Sapiens
SLRLVDSHH

SEQ ID NO: 580036 - protein, 9 aa, Homo Sapiens
VSEAGKSNY

SEQ ID NO: 580037 - protein, 9 aa, Homo Sapiens
LQQSGVVVG

SEQ ID NO: 580038 - protein, 9 aa, Homo Sapiens
DPTRSPYPS

SEQ ID NO: 580039 - protein, 9 aa, Homo Sapiens
FSDREQDIR

SEQ ID NO: 580040 - protein, 9 aa, Homo Sapiens
RDSGTNGQV

SEQ ID NO: 580041 - protein, 9 aa, Homo Sapiens
DLNEWLGSN

SEQ ID NO: 580042 - protein, 9 aa, Homo Sapiens
DTESEDGEG

SEQ ID NO: 580043 - protein, 9 aa, Homo Sapiens
RDLKCETPV

SEQ ID NO: 580044 - protein, 9 aa, Homo Sapiens
AMACDRYAA

SEQ ID NO: 580045 - protein, 9 aa, Homo Sapiens
VIPALWESE

SEQ ID NO: 580046 - protein, 9 aa, Homo Sapiens
ISTSKEQEV

SEQ ID NO: 580047 - protein, 9 aa, Homo Sapiens
GIFSLTTDC

SEQ ID NO: 580048 - protein, 9 aa, Homo Sapiens
ELDLSNSSL

SEQ ID NO: 580049 - protein, 9 aa, Homo Sapiens
PGVTPKQYD

SEQ ID NO: 580050 - protein, 9 aa, Homo Sapiens
GVYVLGETW

SEQ ID NO: 580051 - protein, 9 aa, Homo Sapiens
MKGLMDANC

SEQ ID NO: 580052 - protein, 9 aa, Homo Sapiens
RSYMRFTEK

SEQ ID NO: 580053 - protein, 9 aa, Homo Sapiens
FTEKEDESL

SEQ ID NO: 580054 - protein, 9 aa, Homo Sapiens
LSCKAVTCC

SEQ ID NO: 580055 - protein, 9 aa, Homo Sapiens
PGNIVRELK

SEQ ID NO: 580056 - protein, 9 aa, Homo Sapiens
NYEAEPSDP

SEQ ID NO: 580057 - protein, 9 aa, Homo Sapiens
ESQDGEEYK

SEQ ID NO: 580058 - protein, 9 aa, Homo Sapiens
QEVKYQASH

SEQ ID NO: 580059 - protein, 9 aa, Homo Sapiens
RMRVHSWAS

SEQ ID NO: 580060 - protein, 9 aa, Homo Sapiens
MVALGPVTT

SEQ ID NO: 580061 - protein, 9 aa, Homo Sapiens
EAEPSDPLG

SEQ ID NO: 580062 - protein, 9 aa, Homo Sapiens
ARFQQLLTP

SEQ ID NO: 580063 - protein, 9 aa, Homo Sapiens
VTKPGNIVR

SEQ ID NO: 580064 - protein, 9 aa, Homo Sapiens
KVVSHTSQP

SEQ ID NO: 580065 - protein, 9 aa, Homo Sapiens
RKEKENAQK

SEQ ID NO: 580066 - protein, 9 aa, Homo Sapiens
PGKHLGYTR

SEQ ID NO: 580067 - protein, 9 aa, Homo Sapiens
MGGFMDSGT

SEQ ID NO: 580068 - protein, 9 aa, Homo Sapiens
SSLQNFDYG

SEQ ID NO: 580069 - protein, 9 aa, Homo Sapiens
PACPGRTPT

SEQ ID NO: 580070 - protein, 9 aa, Homo Sapiens
GNLLLQARM

SEQ ID NO: 580071 - protein, 9 aa, Homo Sapiens
NRSACIPCF

SEQ ID NO: 580072 - protein, 9 aa, Homo Sapiens
RFVSEAGKS

SEQ ID NO: 580073 - protein, 9 aa, Homo Sapiens
EYGGSKHNA

SEQ ID NO: 580074 - protein, 9 aa, Homo Sapiens
EEENESQDG

SEQ ID NO: 580075 - protein, 9 aa, Homo Sapiens
ILVELSDGQ

SEQ ID NO: 580076 - protein, 9 aa, Homo Sapiens
DIAVTPLKL

SEQ ID NO: 580077 - protein, 9 aa, Homo Sapiens
GKHLGYTRQ

SEQ ID NO: 580078 - protein, 9 aa, Homo Sapiens
STDNALYFH

SEQ ID NO: 580079 - protein, 9 aa, Homo Sapiens
HTSPDIPAK

SEQ ID NO: 580080 - protein, 9 aa, Homo Sapiens
VYVLGETWE

SEQ ID NO: 580081 - protein, 9 aa, Homo Sapiens
RLGSEVLMR

SEQ ID NO: 580082 - protein, 9 aa, Homo Sapiens
KLPRHISPF

SEQ ID NO: 580083 - protein, 9 aa, Homo Sapiens
GRAGRVRAG

SEQ ID NO: 580084 - protein, 9 aa, Homo Sapiens
FVSEAGKSN

SEQ ID NO: 580085 - protein, 9 aa, Homo Sapiens
TQAEELPAC

SEQ ID NO: 580086 - protein, 9 aa, Homo Sapiens
ARGAHCTVN

SEQ ID NO: 580087 - protein, 9 aa, Homo Sapiens
FDARWVAYF

SEQ ID NO: 580088 - protein, 9 aa, Homo Sapiens
SDKSRYHYF

SEQ ID NO: 580089 - protein, 9 aa, Homo Sapiens
IEVTKGHLE

SEQ ID NO: 580090 - protein, 9 aa, Homo Sapiens
SGTNGQVTY

SEQ ID NO: 580091 - protein, 9 aa, Homo Sapiens
SLNPNYEAE

SEQ ID NO: 580092 - protein, 9 aa, Homo Sapiens
VTKGHLEVQ

SEQ ID NO: 580093 - protein, 9 aa, Homo Sapiens
EENESQDGE

SEQ ID NO: 580094 - protein, 9 aa, Homo Sapiens
KEQEVKYQA

SEQ ID NO: 580095 - protein, 9 aa, Homo Sapiens
TDSEYFEEA

SEQ ID NO: 580096 - protein, 9 aa, Homo Sapiens
KHNALLKWC

SEQ ID NO: 580097 - protein, 9 aa, Homo Sapiens
AIDAFQRSA

SEQ ID NO: 580098 - protein, 9 aa, Homo Sapiens
VNDERFVSE

SEQ ID NO: 580099 - protein, 9 aa, Homo Sapiens
GPVTTEHLE

SEQ ID NO: 580100 - protein, 9 aa, Homo Sapiens
KLAIGTSSM

SEQ ID NO: 580101 - protein, 9 aa, Homo Sapiens
TKLAIGTSS

SEQ ID NO: 580102 - protein, 9 aa, Homo Sapiens
PNYEAEPSD

SEQ ID NO: 580103 - protein, 9 aa, Homo Sapiens
LDLSNSSLQ

SEQ ID NO: 580104 - protein, 9 aa, Homo Sapiens
LSDKSRYHY

SEQ ID NO: 580105 - protein, 9 aa, Homo Sapiens
GDAAQHPEA

SEQ ID NO: 580106 - protein, 9 aa, Homo Sapiens
EDGPLVCQF

SEQ ID NO: 580107 - protein, 9 aa, Homo Sapiens
LLQARMRVH

SEQ ID NO: 580108 - protein, 9 aa, Homo Sapiens
SILISLTFP

SEQ ID NO: 580109 - protein, 9 aa, Homo Sapiens
SRYHYFART

SEQ ID NO: 580110 - protein, 9 aa, Homo Sapiens
WLGSNTTTF

SEQ ID NO: 580111 - protein, 9 aa, Homo Sapiens
LGAVGPISI

SEQ ID NO: 580112 - protein, 9 aa, Homo Sapiens
WVFLKSLRL

SEQ ID NO: 580113 - protein, 9 aa, Homo Sapiens
PALWESEAG

SEQ ID NO: 580114 - protein, 9 aa, Homo Sapiens
ACPGRTPTL

SEQ ID NO: 580115 - protein, 9 aa, Homo Sapiens
GYALFLRFE

SEQ ID NO: 580116 - protein, 9 aa, Homo Sapiens
TPLKLAGWQ

SEQ ID NO: 580117 - protein, 9 aa, Homo Sapiens
ACDRYAAVC

SEQ ID NO: 580118 - protein, 9 aa, Homo Sapiens
GDAPGKHLG

SEQ ID NO: 580119 - protein, 9 aa, Homo Sapiens
IPPMPGGLA

SEQ ID NO: 580120 - protein, 9 aa, Homo Sapiens
NNIDHPRWG

SEQ ID NO: 580121 - protein, 9 aa, Homo Sapiens
NHPSHGVRE

SEQ ID NO: 580122 - protein, 9 aa, Homo Sapiens
GARFQQLLT

SEQ ID NO: 580123 - protein, 9 aa, Homo Sapiens
LGETWEKAK

SEQ ID NO: 580124 - protein, 9 aa, Homo Sapiens
DHTFRPLWV

SEQ ID NO: 580125 - protein, 9 aa, Homo Sapiens
ENAQKKMET

SEQ ID NO: 580126 - protein, 9 aa, Homo Sapiens
QNAGSSSQQ

SEQ ID NO: 580127 - protein, 9 aa, Homo Sapiens
DANCILKAD

SEQ ID NO: 580128 - protein, 9 aa, Homo Sapiens
TMPVKLPRH

SEQ ID NO: 580129 - protein, 9 aa, Homo Sapiens
SAIDAFQRS

SEQ ID NO: 580130 - protein, 9 aa, Homo Sapiens
DAAQHPEAH

SEQ ID NO: 580131 - protein, 9 aa, Homo Sapiens
VTPKQYDTY

SEQ ID NO: 580132 - protein, 9 aa, Homo Sapiens
QKCIPPMPG

SEQ ID NO: 580133 - protein, 9 aa, Homo Sapiens
KLTVTLSSL

SEQ ID NO: 580134 - protein, 9 aa, Homo Sapiens
CNRIFINNE

SEQ ID NO: 580135 - protein, 9 aa, Homo Sapiens
SPQKCIPPM

SEQ ID NO: 580136 - protein, 9 aa, Homo Sapiens
LLTNRSACI

SEQ ID NO: 580137 - protein, 9 aa, Homo Sapiens
DDHTFRPLW

SEQ ID NO: 580138 - protein, 9 aa, Homo Sapiens
HGVYVLGET

SEQ ID NO: 580139 - protein, 9 aa, Homo Sapiens
VIEVTKGHL

SEQ ID NO: 580140 - protein, 9 aa, Homo Sapiens
ILKNWKEER

SEQ ID NO: 580141 - protein, 9 aa, Homo Sapiens
LSTDNALYF

SEQ ID NO: 580142 - protein, 9 aa, Homo Sapiens
NSSLQNFDY

SEQ ID NO: 580143 - protein, 9 aa, Homo Sapiens
QFKLTVTLS

SEQ ID NO: 580144 - protein, 9 aa, Homo Sapiens
FQQLLTPSR

SEQ ID NO: 580145 - protein, 9 aa, Homo Sapiens
CVAKTKLAI

SEQ ID NO: 580146 - protein, 9 aa, Homo Sapiens
GVVVGLLGD

SEQ ID NO: 580147 - protein, 9 aa, Homo Sapiens
SGDTESEDG

SEQ ID NO: 580148 - protein, 9 aa, Homo Sapiens
KEKENAQKK

SEQ ID NO: 580149 - protein, 9 aa, Homo Sapiens
DSEYFEEAA

SEQ ID NO: 580150 - protein, 9 aa, Homo Sapiens
RTPTLGSLP

SEQ ID NO: 580151 - protein, 9 aa, Homo Sapiens
EEFDARWVA

SEQ ID NO: 580152 - protein, 9 aa, Homo Sapiens
AIGTSSMIV

SEQ ID NO: 580153 - protein, 9 aa, Homo Sapiens
EEMKGLMDA

SEQ ID NO: 580154 - protein, 9 aa, Homo Sapiens
CIPCFLAGD

SEQ ID NO: 580155 - protein, 9 aa, Homo Sapiens
EQRHIVFLT

SEQ ID NO: 580156 - protein, 9 aa, Homo Sapiens
TRMQLLATS

SEQ ID NO: 580157 - protein, 9 aa, Homo Sapiens
TVTALFNVH

SEQ ID NO: 580158 - protein, 9 aa, Homo Sapiens
CPGRTPTLG

SEQ ID NO: 580159 - protein, 9 aa, Homo Sapiens
PGTVTALFN

SEQ ID NO: 580160 - protein, 9 aa, Homo Sapiens
GPSYRQGYA

SEQ ID NO: 580161 - protein, 9 aa, Homo Sapiens
RAGFCFHLC

SEQ ID NO: 580162 - protein, 9 aa, Homo Sapiens
DERFVSEAG

SEQ ID NO: 580163 - protein, 9 aa, Homo Sapiens
HTFRPLWVA

SEQ ID NO: 580164 - protein, 9 aa, Homo Sapiens
AAQHPEAHS

SEQ ID NO: 580165 - protein, 9 aa, Homo Sapiens
AVSAGIFSL

SEQ ID NO: 580166 - protein, 9 aa, Homo Sapiens
CLPSPQKCI

SEQ ID NO: 580167 - protein, 9 aa, Homo Sapiens
MACDRYAAV

SEQ ID NO: 580168 - protein, 9 aa, Homo Sapiens
PITGACNNI

SEQ ID NO: 580169 - protein, 9 aa, Homo Sapiens
REHLPACPG

SEQ ID NO: 580170 - protein, 9 aa, Homo Sapiens
LFTMPVKLP

SEQ ID NO: 580171 - protein, 9 aa, Homo Sapiens
GLLGDAPGK

SEQ ID NO: 580172 - protein, 9 aa, Homo Sapiens
AFQRSAGVL

SEQ ID NO: 580173 - protein, 9 aa, Homo Sapiens
WKEERDRKI

SEQ ID NO: 580174 - protein, 9 aa, Homo Sapiens
TALFNVHDS

SEQ ID NO: 580175 - protein, 9 aa, Homo Sapiens
EEQDHRGEL

SEQ ID NO: 580176 - protein, 9 aa, Homo Sapiens
SSPGTVTAL

SEQ ID NO: 580177 - protein, 9 aa, Homo Sapiens
EVLMRDLKC

SEQ ID NO: 580178 - protein, 9 aa, Homo Sapiens
ACIPCFLAG

SEQ ID NO: 580179 - protein, 9 aa, Homo Sapiens
EELPACLLS

SEQ ID NO: 580180 - protein, 9 aa, Homo Sapiens
WESEAGESR

SEQ ID NO: 580181 - protein, 9 aa, Homo Sapiens
PRKPEVTDS

SEQ ID NO: 580182 - protein, 9 aa, Homo Sapiens
PTRSPYPSQ

SEQ ID NO: 580183 - protein, 9 aa, Homo Sapiens
KQYDTYFCM

SEQ ID NO: 580184 - protein, 9 aa, Homo Sapiens
TCCRVSPLQ

SEQ ID NO: 580185 - protein, 9 aa, Homo Sapiens
MPVKLPRHI

SEQ ID NO: 580186 - protein, 9 aa, Homo Sapiens
GSKHNALLK

SEQ ID NO: 580187 - protein, 9 aa, Homo Sapiens
AHSEEQQQS

SEQ ID NO: 580188 - protein, 9 aa, Homo Sapiens
MLNYLEKHI

SEQ ID NO: 580189 - protein, 9 aa, Homo Sapiens
RMQLLATSY

SEQ ID NO: 580190 - protein, 9 aa, Homo Sapiens
AGSSSQQNN

SEQ ID NO: 580191 - protein, 9 aa, Homo Sapiens
CQPYPAKNS

SEQ ID NO: 580192 - protein, 9 aa, Homo Sapiens
SEYFEEAAN

SEQ ID NO: 580193 - protein, 9 aa, Homo Sapiens
NAQKKMETE

SEQ ID NO: 580194 - protein, 9 aa, Homo Sapiens
DKSRYHYFA

SEQ ID NO: 580195 - protein, 9 aa, Homo Sapiens
LTVTLSSLE

SEQ ID NO: 580196 - protein, 9 aa, Homo Sapiens
QQSGVVVGL

SEQ ID NO: 580197 - protein, 9 aa, Homo Sapiens
RSILISLTF

SEQ ID NO: 580198 - protein, 9 aa, Homo Sapiens
RGLGARFQQ

SEQ ID NO: 580199 - protein, 9 aa, Homo Sapiens
IAFMVALGP

SEQ ID NO: 580200 - protein, 9 aa, Homo Sapiens
EPCQPYPAK

SEQ ID NO: 580201 - protein, 9 aa, Homo Sapiens
LQAQNIEQR

SEQ ID NO: 580202 - protein, 9 aa, Homo Sapiens
PLVCQFEVL

SEQ ID NO: 580203 - protein, 9 aa, Homo Sapiens
EVKYQASHP

SEQ ID NO: 580204 - protein, 9 aa, Homo Sapiens
RRKEKENAQ

SEQ ID NO: 580205 - protein, 9 aa, Homo Sapiens
TRQRQNAGS

SEQ ID NO: 580206 - protein, 9 aa, Homo Sapiens
NYLEKHITH

SEQ ID NO: 580207 - protein, 9 aa, Homo Sapiens
EKEEEQDHR

SEQ ID NO: 580208 - protein, 9 aa, Homo Sapiens
VRAGFCFHL

SEQ ID NO: 580209 - protein, 9 aa, Homo Sapiens
GCILVELSD

SEQ ID NO: 580210 - protein, 9 aa, Homo Sapiens
SHGSNKVVS

SEQ ID NO: 580211 - protein, 9 aa, Homo Sapiens
LMDANCILK

SEQ ID NO: 580212 - protein, 9 aa, Homo Sapiens
HGVREKMST

SEQ ID NO: 580213 - protein, 9 aa, Homo Sapiens
SGVVVGLLG

SEQ ID NO: 580214 - protein, 8 aa, Homo Sapiens
GSRPRSPS

SEQ ID NO: 580215 - protein, 9 aa, Homo Sapiens
AKVQTALKE

SEQ ID NO: 580216 - protein, 9 aa, Homo Sapiens
HGSNKVVSH

SEQ ID NO: 580217 - protein, 9 aa, Homo Sapiens
KHITHKNGG

SEQ ID NO: 580218 - protein, 9 aa, Homo Sapiens
TDRDSGTNG

SEQ ID NO: 580219 - protein, 9 aa, Homo Sapiens
QWQETARTS

SEQ ID NO: 580220 - protein, 9 aa, Homo Sapiens
AVQPHPASA

SEQ ID NO: 580221 - protein, 9 aa, Homo Sapiens
EQEVKYQAS

SEQ ID NO: 580222 - protein, 9 aa, Homo Sapiens
VTCCRVSPL

SEQ ID NO: 580223 - protein, 9 aa, Homo Sapiens
SYMRFTEKE

SEQ ID NO: 580224 - protein, 9 aa, Homo Sapiens
VTPLKLAGW

SEQ ID NO: 580225 - protein, 9 aa, Homo Sapiens
GLMDANCIL

SEQ ID NO: 580226 - protein, 9 aa, Homo Sapiens
PARGAHCTV

SEQ ID NO: 580227 - protein, 9 aa, Homo Sapiens
RRGLGARFQ

SEQ ID NO: 580228 - protein, 9 aa, Homo Sapiens
QGYALFLRF

SEQ ID NO: 580229 - protein, 9 aa, Homo Sapiens
REYGGSKHN

SEQ ID NO: 580230 - protein, 9 aa, Homo Sapiens
RKVCCPICT

SEQ ID NO: 580231 - protein, 9 aa, Homo Sapiens
EVTKGHLEV

SEQ ID NO: 580232 - protein, 9 aa, Homo Sapiens
VFLLAAMAC

SEQ ID NO: 580233 - protein, 9 aa, Homo Sapiens
QRSAGVLNY

SEQ ID NO: 580234 - protein, 9 aa, Homo Sapiens
SPYPSQHLE

SEQ ID NO: 580235 - protein, 9 aa, Homo Sapiens
VGLLGDAPG

SEQ ID NO: 580236 - protein, 9 aa, Homo Sapiens
NESQDGEEY

SEQ ID NO: 580237 - protein, 9 aa, Homo Sapiens
QKKMETEAE

SEQ ID NO: 580238 - protein, 9 aa, Homo Sapiens
VDSHHQLWR

SEQ ID NO: 580239 - protein, 9 aa, Homo Sapiens
EERDRKIMQ

SEQ ID NO: 580240 - protein, 9 aa, Homo Sapiens
QSGVVVGLL

SEQ ID NO: 580241 - protein, 9 aa, Homo Sapiens
GSNKVVSHT

SEQ ID NO: 580242 - protein, 9 aa, Homo Sapiens
SSQWQETAR

SEQ ID NO: 580243 - protein, 9 aa, Homo Sapiens
GRTPTLGSL

SEQ ID NO: 580244 - protein, 9 aa, Homo Sapiens
PCQPYPAKN

SEQ ID NO: 580245 - protein, 9 aa, Homo Sapiens
DGEGETTVR

SEQ ID NO: 580246 - protein, 9 aa, Homo Sapiens
ITGACNNID

SEQ ID NO: 580247 - protein, 9 aa, Homo Sapiens
TSDPTRSPY

SEQ ID NO: 580248 - protein, 9 aa, Homo Sapiens
CQFEVLGSV

SEQ ID NO: 580249 - protein, 9 aa, Homo Sapiens
LKSLRLVDS

SEQ ID NO: 580250 - protein, 9 aa, Homo Sapiens
LHRTQAEEL

SEQ ID NO: 580251 - protein, 9 aa, Homo Sapiens
IAVTPLKLA

SEQ ID NO: 580252 - protein, 9 aa, Homo Sapiens
RRHGVYVLG

SEQ ID NO: 580253 - protein, 9 aa, Homo Sapiens
WSVGCILVE

SEQ ID NO: 580254 - protein, 9 aa, Homo Sapiens
LVLAVSAGI

SEQ ID NO: 580255 - protein, 9 aa, Homo Sapiens
GDTESEDGE

SEQ ID NO: 580256 - protein, 9 aa, Homo Sapiens
ITHKNGGAA

SEQ ID NO: 580257 - protein, 9 aa, Homo Sapiens
VLRPARGAH

SEQ ID NO: 580258 - protein, 9 aa, Homo Sapiens
QDIRMPKKT

SEQ ID NO: 580259 - protein, 9 aa, Homo Sapiens
LAGWQCPEC

SEQ ID NO: 580260 - protein, 9 aa, Homo Sapiens
HVSASSQWQ

SEQ ID NO: 580261 - protein, 9 aa, Homo Sapiens
RSPYPSQHL

SEQ ID NO: 580262 - protein, 9 aa, Homo Sapiens
AGRVRAGFC

SEQ ID NO: 580263 - protein, 9 aa, Homo Sapiens
AVTPLKLAG

SEQ ID NO: 580264 - protein, 9 aa, Homo Sapiens
FGEPCQPYP

SEQ ID NO: 580265 - protein, 9 aa, Homo Sapiens
PTLGSLPFS

SEQ ID NO: 580266 - protein, 9 aa, Homo Sapiens
ISTVQKTLH

SEQ ID NO: 580267 - protein, 9 aa, Homo Sapiens
LALSCKAVT

SEQ ID NO: 580268 - protein, 9 aa, Homo Sapiens
QQPEVFCNR

SEQ ID NO: 580269 - protein, 9 aa, Homo Sapiens
LTNRSACIP

SEQ ID NO: 580270 - protein, 9 aa, Homo Sapiens
AYFNKPDID

SEQ ID NO: 580271 - protein, 9 aa, Homo Sapiens
STVQKTLHL

SEQ ID NO: 580272 - protein, 9 aa, Homo Sapiens
RHISPFWVF

SEQ ID NO: 580273 - protein, 9 aa, Homo Sapiens
GHLEVQIQT

SEQ ID NO: 580274 - protein, 9 aa, Homo Sapiens
PSHGVREKM

SEQ ID NO: 580275 - protein, 9 aa, Homo Sapiens
RLVDSHHQL

SEQ ID NO: 580276 - protein, 9 aa, Homo Sapiens
FQRSAGVLN

SEQ ID NO: 580277 - protein, 9 aa, Homo Sapiens
LTFPPDSLA

SEQ ID NO: 580278 - protein, 9 aa, Homo Sapiens
RQGYALFLR

SEQ ID NO: 580279 - protein, 9 aa, Homo Sapiens
KSLRLVDSH

SEQ ID NO: 580280 - protein, 9 aa, Homo Sapiens
GSSSQQNNG

SEQ ID NO: 580281 - protein, 9 aa, Homo Sapiens
RGELQQSGV

SEQ ID NO: 580282 - protein, 9 aa, Homo Sapiens
SAGIFSLTT

SEQ ID NO: 580283 - protein, 9 aa, Homo Sapiens
TPKQYDTYF

SEQ ID NO: 580284 - protein, 9 aa, Homo Sapiens
ILNRKVCCP

SEQ ID NO: 580285 - protein, 9 aa, Homo Sapiens
ISPIAVQPH

SEQ ID NO: 580286 - protein, 9 aa, Homo Sapiens
LATSYDLHR

SEQ ID NO: 580287 - protein, 9 aa, Homo Sapiens
ARMRVHSWA

SEQ ID NO: 580288 - protein, 9 aa, Homo Sapiens
SYRQGYALF

SEQ ID NO: 580289 - protein, 9 aa, Homo Sapiens
SKEQEVKYQ

SEQ ID NO: 580290 - protein, 9 aa, Homo Sapiens
SLFTMPVKL

SEQ ID NO: 580291 - protein, 9 aa, Homo Sapiens
GEPCQPYPA

SEQ ID NO: 580292 - protein, 9 aa, Homo Sapiens
WVAYFNKPD

SEQ ID NO: 580293 - protein, 9 aa, Homo Sapiens
QLLATSYDL

SEQ ID NO: 580294 - protein, 9 aa, Homo Sapiens
RFQQLLTPS

SEQ ID NO: 580295 - protein, 9 aa, Homo Sapiens
HPASAAAAA

SEQ ID NO: 580296 - protein, 9 aa, Homo Sapiens
EFDARWVAY

SEQ ID NO: 580297 - protein, 9 aa, Homo Sapiens
VLMRDLKCE

SEQ ID NO: 580298 - protein, 9 aa, Homo Sapiens
AQKKMETEA

SEQ ID NO: 580299 - protein, 9 aa, Homo Sapiens
KVCCPICTE

SEQ ID NO: 580300 - protein, 9 aa, Homo Sapiens
SNSSLQNFD

SEQ ID NO: 580301 - protein, 9 aa, Homo Sapiens
AQHPEAHSE

SEQ ID NO: 580302 - protein, 9 aa, Homo Sapiens
PLKDDHTFR

SEQ ID NO: 580303 - protein, 9 aa, Homo Sapiens
LLLQARMRV

SEQ ID NO: 580304 - protein, 9 aa, Homo Sapiens
RSAGVLNYL

SEQ ID NO: 580305 - protein, 9 aa, Homo Sapiens
RFTEKEDES

SEQ ID NO: 580306 - protein, 9 aa, Homo Sapiens
YVLGETWEK

SEQ ID NO: 580307 - protein, 9 aa, Homo Sapiens
AEELPACLL

SEQ ID NO: 580308 - protein, 9 aa, Homo Sapiens
YEAEPSDPL

SEQ ID NO: 580309 - protein, 9 aa, Homo Sapiens
DEVTKPGNI

SEQ ID NO: 580310 - protein, 9 aa, Homo Sapiens
LVELSDGQP

SEQ ID NO: 580311 - protein, 9 aa, Homo Sapiens
EDGEGETTV

SEQ ID NO: 580312 - protein, 9 aa, Homo Sapiens
LPHELLSTD

SEQ ID NO: 580313 - protein, 9 aa, Homo Sapiens
DREQDIRMP

SEQ ID NO: 580314 - protein, 9 aa, Homo Sapiens
KLSDKSRYH

SEQ ID NO: 580315 - protein, 9 aa, Homo Sapiens
HNALLKWCQ

SEQ ID NO: 580316 - protein, 9 aa, Homo Sapiens
TLSSLELWS

SEQ ID NO: 580317 - protein, 9 aa, Homo Sapiens
EMKGLMDAN

SEQ ID NO: 580318 - protein, 9 aa, Homo Sapiens
QDHRGELQQ

SEQ ID NO: 580319 - protein, 9 aa, Homo Sapiens
EIDLNEWLG

SEQ ID NO: 580320 - protein, 9 aa, Homo Sapiens
VFLKSLRLV

SEQ ID NO: 580321 - protein, 9 aa, Homo Sapiens
AQHRSYMRF

SEQ ID NO: 580322 - protein, 9 aa, Homo Sapiens
SEAGESRGQ

SEQ ID NO: 580323 - protein, 9 aa, Homo Sapiens
SDPTRSPYP

SEQ ID NO: 580324 - protein, 9 aa, Homo Sapiens
TSKEQEVKY

SEQ ID NO: 580325 - protein, 9 aa, Homo Sapiens
SHGVREKMS

SEQ ID NO: 580326 - protein, 9 aa, Homo Sapiens
IAVQPHPAS

SEQ ID NO: 580327 - protein, 9 aa, Homo Sapiens
SLTFPPDSL

SEQ ID NO: 580328 - protein, 9 aa, Homo Sapiens
SVGCILVEL

SEQ ID NO: 580329 - protein, 9 aa, Homo Sapiens
GSNTTTFFH

SEQ ID NO: 580330 - protein, 9 aa, Homo Sapiens
PEAHSEEQQ

SEQ ID NO: 580331 - protein, 9 aa, Homo Sapiens
HYFARTVPP

SEQ ID NO: 580332 - protein, 9 aa, Homo Sapiens
LSNSSLQNF

SEQ ID NO: 580333 - protein, 9 aa, Homo Sapiens
RKPEVTDSE

SEQ ID NO: 580334 - protein, 9 aa, Homo Sapiens
PVKLPRHIS

SEQ ID NO: 580335 - protein, 9 aa, Homo Sapiens
VSASSQWQE

SEQ ID NO: 580336 - protein, 9 aa, Homo Sapiens
FTQFKLTVT

SEQ ID NO: 580337 - protein, 9 aa, Homo Sapiens
RIFINNEWH

SEQ ID NO: 580338 - protein, 9 aa, Homo Sapiens
FTMPVKLPR

SEQ ID NO: 580339 - protein, 9 aa, Homo Sapiens
KEERDRKIM

SEQ ID NO: 580340 - protein, 9 aa, Homo Sapiens
VSHTSQPQW

SEQ ID NO: 580341 - protein, 9 aa, Homo Sapiens
SLHRTQAEE

SEQ ID NO: 580342 - protein, 9 aa, Homo Sapiens
VGCILVELS

SEQ ID NO: 580343 - protein, 9 aa, Homo Sapiens
RAGRVRAGF

SEQ ID NO: 580344 - protein, 9 aa, Homo Sapiens
ALWESEAGE

SEQ ID NO: 580345 - protein, 9 aa, Homo Sapiens
QHPEAHSEE

SEQ ID NO: 580346 - protein, 9 aa, Homo Sapiens
IGTSSMIVP

SEQ ID NO: 580347 - protein, 9 aa, Homo Sapiens
SAGVLNYLK

SEQ ID NO: 580348 - protein, 9 aa, Homo Sapiens
LRPARGAHC

SEQ ID NO: 580349 - protein, 9 aa, Homo Sapiens
DSGTNGQVT

SEQ ID NO: 580350 - protein, 9 aa, Homo Sapiens
KILNRKVCC

SEQ ID NO: 580351 - protein, 9 aa, Homo Sapiens
RQNAGSSSQ

SEQ ID NO: 580352 - protein, 9 aa, Homo Sapiens
LNEWLGSNT

SEQ ID NO: 580353 - protein, 9 aa, Homo Sapiens
AREYGGSKH

SEQ ID NO: 580354 - protein, 9 aa, Homo Sapiens
GFGEPCQPY

SEQ ID NO: 580355 - protein, 9 aa, Homo Sapiens
FKLTVTLSS

SEQ ID NO: 580356 - protein, 9 aa, Homo Sapiens
KGRAGRVRA

SEQ ID NO: 580357 - protein, 9 aa, Homo Sapiens
ASSQWQETA

SEQ ID NO: 580358 - protein, 9 aa, Homo Sapiens
EAGKSNYQL

SEQ ID NO: 580359 - protein, 9 aa, Homo Sapiens
IEQRHIVFL

SEQ ID NO: 580360 - protein, 9 aa, Homo Sapiens
MPLKDDHTF

SEQ ID NO: 580361 - protein, 9 aa, Homo Sapiens
PDIPAKVQT

SEQ ID NO: 580362 - protein, 9 aa, Homo Sapiens
IGPSYRQGY

SEQ ID NO: 580363 - protein, 9 aa, Homo Sapiens
KEEEQDHRG

SEQ ID NO: 580364 - protein, 9 aa, Homo Sapiens
GGFMDSGTQ

SEQ ID NO: 580365 - protein, 9 aa, Homo Sapiens
PISIPREHL

SEQ ID NO: 580366 - protein, 9 aa, Homo Sapiens
ALGPVTTEH

SEQ ID NO: 580367 - protein, 9 aa, Homo Sapiens
MRFTEKEDE

SEQ ID NO: 580368 - protein, 9 aa, Homo Sapiens
LMRDLKCET

SEQ ID NO: 580369 - protein, 9 aa, Homo Sapiens
HISPFWVFL

SEQ ID NO: 580370 - protein, 9 aa, Homo Sapiens
VGPISIPRE

SEQ ID NO: 580371 - protein, 9 aa, Homo Sapiens
LMDEVTKPG

SEQ ID NO: 580372 - protein, 9 aa, Homo Sapiens
SHHQLWRVT

SEQ ID NO: 580373 - protein, 9 aa, Homo Sapiens
EKENAQKKM

SEQ ID NO: 580374 - protein, 9 aa, Homo Sapiens
PSPQKCIPP

SEQ ID NO: 580375 - protein, 9 aa, Homo Sapiens
YPSQHLEAP

SEQ ID NO: 580376 - protein, 9 aa, Homo Sapiens
YEKEEEQDH

SEQ ID NO: 580377 - protein, 9 aa, Homo Sapiens
AGIFSLTTD

SEQ ID NO: 580378 - protein, 9 aa, Homo Sapiens
VKYQASHPN

SEQ ID NO: 580379 - protein, 9 aa, Homo Sapiens
SINHPSHGV

SEQ ID NO: 580380 - protein, 9 aa, Homo Sapiens
VFCNRIFIN

SEQ ID NO: 580381 - protein, 9 aa, Homo Sapiens
LPACPGRTP

SEQ ID NO: 580382 - protein, 9 aa, Homo Sapiens
TSHGSNKVV

SEQ ID NO: 580383 - protein, 9 aa, Homo Sapiens
IPALWESEA

SEQ ID NO: 580384 - protein, 9 aa, Homo Sapiens
EKHITHKNG

SEQ ID NO: 580385 - protein, 9 aa, Homo Sapiens
RDRKIMQSQ

SEQ ID NO: 580386 - protein, 9 aa, Homo Sapiens
LGPVTTEHL

SEQ ID NO: 580387 - protein, 9 aa, Homo Sapiens
IRLQAQNIE

SEQ ID NO: 580388 - protein, 9 aa, Homo Sapiens
LQARMRVHS

SEQ ID NO: 580389 - protein, 9 aa, Homo Sapiens
SACIPCFLA

SEQ ID NO: 580390 - protein, 9 aa, Homo Sapiens
HELLSTDNA

SEQ ID NO: 580391 - protein, 9 aa, Homo Sapiens
TDNALYFHL

SEQ ID NO: 580392 - protein, 9 aa, Homo Sapiens
VSAGIFSLT

SEQ ID NO: 580393 - protein, 9 aa, Homo Sapiens
STSKEQEVK

SEQ ID NO: 580394 - protein, 9 aa, Homo Sapiens
PAKVQTALK

SEQ ID NO: 580395 - protein, 9 aa, Homo Sapiens
VCCPICTEK

SEQ ID NO: 580396 - protein, 9 aa, Homo Sapiens
DIPAKVQTA

SEQ ID NO: 580397 - protein, 9 aa, Homo Sapiens
ARSILISLT

SEQ ID NO: 580398 - protein, 9 aa, Homo Sapiens
NEWLGSNTT

SEQ ID NO: 580399 - protein, 9 aa, Homo Sapiens
PRRGLGARF

SEQ ID NO: 580400 - protein, 9 aa, Homo Sapiens
LNRKVCCPI

SEQ ID NO: 580401 - protein, 9 aa, Homo Sapiens
KAEDGPLVC

SEQ ID NO: 580402 - protein, 9 aa, Homo Sapiens
SEAGKSNYQ

SEQ ID NO: 580403 - protein, 9 aa, Homo Sapiens
VTALFNVHD

SEQ ID NO: 580404 - protein, 9 aa, Homo Sapiens
AEPSDPLGS

SEQ ID NO: 580405 - protein, 9 aa, Homo Sapiens
TGEEENESQ

SEQ ID NO: 580406 - protein, 9 aa, Homo Sapiens
NRKVCCPIC

SEQ ID NO: 580407 - protein, 9 aa, Homo Sapiens
RGAHCTVNG

SEQ ID NO: 580408 - protein, 9 aa, Homo Sapiens
SEVLMRDLK

SEQ ID NO: 580409 - protein, 9 aa, Homo Sapiens
NDERFVSEA

SEQ ID NO: 580410 - protein, 9 aa, Homo Sapiens
GRVRAGFCF

SEQ ID NO: 580411 - protein, 9 aa, Homo Sapiens
RTQAEELPA

SEQ ID NO: 580412 - protein, 9 aa, Homo Sapiens
RQHLGAVGP

SEQ ID NO: 580413 - protein, 9 aa, Homo Sapiens
VQPHPASAA

SEQ ID NO: 580414 - protein, 9 aa, Homo Sapiens
KHLGYTRQH

SEQ ID NO: 580415 - protein, 9 aa, Homo Sapiens
RMPKKTGSS

SEQ ID NO: 580416 - protein, 9 aa, Homo Sapiens
AGFCFHLCS

SEQ ID NO: 580417 - protein, 9 aa, Homo Sapiens
LEELDLSNS

SEQ ID NO: 580418 - protein, 9 aa, Homo Sapiens
HCTVNGREV

SEQ ID NO: 580419 - protein, 9 aa, Homo Sapiens
ESEAGESRG

SEQ ID NO: 580420 - protein, 9 aa, Homo Sapiens
ERFVSEAGK

SEQ ID NO: 580421 - protein, 9 aa, Homo Sapiens
ILISLTFPP

SEQ ID NO: 580422 - protein, 9 aa, Homo Sapiens
SSSPGTVTA

SEQ ID NO: 580423 - protein, 9 aa, Homo Sapiens
LPRHISPFW

SEQ ID NO: 580424 - protein, 9 aa, Homo Sapiens
NSHVSASSQ

SEQ ID NO: 580425 - protein, 9 aa, Homo Sapiens
QNIEQRHIV

SEQ ID NO: 580426 - protein, 9 aa, Homo Sapiens
EEEQDHRGE

SEQ ID NO: 580427 - protein, 9 aa, Homo Sapiens
DGPLVCQFE

SEQ ID NO: 580428 - protein, 9 aa, Homo Sapiens
YRQGYALFL

SEQ ID NO: 580429 - protein, 9 aa, Homo Sapiens
KLAGWQCPE

SEQ ID NO: 580430 - protein, 9 aa, Homo Sapiens
NKVVSHTSQ

SEQ ID NO: 580431 - protein, 9 aa, Homo Sapiens
DARWVAYFN

SEQ ID NO: 580432 - protein, 9 aa, Homo Sapiens
TPTLGSLPF

SEQ ID NO: 580433 - protein, 9 aa, Homo Sapiens
LLGDAPGKH

SEQ ID NO: 580434 - protein, 9 aa, Homo Sapiens
NWKEERDRK

SEQ ID NO: 580435 - protein, 9 aa, Homo Sapiens
LLAAMACDR

SEQ ID NO: 580436 - protein, 9 aa, Homo Sapiens
QHLGAVGPI

SEQ ID NO: 580437 - protein, 9 aa, Homo Sapiens
DIRMPKKTG

SEQ ID NO: 580438 - protein, 9 aa, Homo Sapiens
QPYPAKNSA

SEQ ID NO: 580439 - protein, 9 aa, Homo Sapiens
RYHYFARTV

SEQ ID NO: 580440 - protein, 9 aa, Homo Sapiens
PEVTDSEYF

SEQ ID NO: 580441 - protein, 9 aa, Homo Sapiens
INHPSHGVR

SEQ ID NO: 580442 - protein, 9 aa, Homo Sapiens
TSPDIPAKV

SEQ ID NO: 580443 - protein, 9 aa, Homo Sapiens
TRSPYPSQH

SEQ ID NO: 580444 - protein, 9 aa, Homo Sapiens
KLSINHPSH

SEQ ID NO: 580445 - protein, 9 aa, Homo Sapiens
CKAVTCCRV

SEQ ID NO: 580446 - protein, 9 aa, Homo Sapiens
PGRTPTLGS

SEQ ID NO: 580447 - protein, 9 aa, Homo Sapiens
TKPGNIVRE

SEQ ID NO: 580448 - protein, 9 aa, Homo Sapiens
SQDGEEYKK

SEQ ID NO: 580449 - protein, 9 aa, Homo Sapiens
DRDSGTNGQ

SEQ ID NO: 580450 - protein, 9 aa, Homo Sapiens
TVQKTLHLE

SEQ ID NO: 580451 - protein, 9 aa, Homo Sapiens
QPHPASAAA

SEQ ID NO: 580452 - protein, 9 aa, Homo Sapiens
GGSKHNALL

SEQ ID NO: 580453 - protein, 9 aa, Homo Sapiens
GAHCTVNGR

SEQ ID NO: 580454 - protein, 9 aa, Homo Sapiens
TLHLETSFM

SEQ ID NO: 580455 - protein, 9 aa, Homo Sapiens
SPDIPAKVQ

SEQ ID NO: 580456 - protein, 9 aa, Homo Sapiens
LVCQFEVLG

SEQ ID NO: 580457 - protein, 9 aa, Homo Sapiens
LLSTDNALY

SEQ ID NO: 580458 - protein, 9 aa, Homo Sapiens
VVGLLGDAP

SEQ ID NO: 580459 - protein, 9 aa, Homo Sapiens
PVIPALWES

SEQ ID NO: 580460 - protein, 9 aa, Homo Sapiens
TNRSACIPC

SEQ ID NO: 580461 - protein, 9 aa, Homo Sapiens
YDTYFCMSM

SEQ ID NO: 580462 - protein, 9 aa, Homo Sapiens
RPARGAHCT

SEQ ID NO: 580463 - protein, 9 aa, Homo Sapiens
ALMDEVTKP

SEQ ID NO: 580464 - protein, 9 aa, Homo Sapiens
IPREHLPAC

SEQ ID NO: 580465 - protein, 9 aa, Homo Sapiens
LVDSHHQLW

SEQ ID NO: 580466 - protein, 9 aa, Homo Sapiens
ISPFWVFLK

SEQ ID NO: 580467 - protein, 9 aa, Homo Sapiens
VTDSEYFEE

SEQ ID NO: 580468 - protein, 9 aa, Homo Sapiens
VRRHGVYVL

SEQ ID NO: 580469 - protein, 9 aa, Homo Sapiens
TQFKLTVTL

SEQ ID NO: 580470 - protein, 9 aa, Homo Sapiens
SPGTVTALF

SEQ ID NO: 580471 - protein, 9 aa, Homo Sapiens
NIEQRHIVF

SEQ ID NO: 580472 - protein, 9 aa, Homo Sapiens
VVSHTSQPQ

SEQ ID NO: 580473 - protein, 9 aa, Homo Sapiens
CILVELSDG

SEQ ID NO: 580474 - protein, 9 aa, Homo Sapiens
LLATSYDLH

SEQ ID NO: 580475 - protein, 9 aa, Homo Sapiens
HLETSFMGN

SEQ ID NO: 580476 - protein, 9 aa, Homo Sapiens
PQKCIPPMP

SEQ ID NO: 580477 - protein, 9 aa, Homo Sapiens
LGSNTTTFF

SEQ ID NO: 580478 - protein, 9 aa, Homo Sapiens
LKNWKEERD

SEQ ID NO: 580479 - protein, 9 aa, Homo Sapiens
CNNIDHPRW

SEQ ID NO: 580480 - protein, 9 aa, Homo Sapiens
AAMACDRYA

SEQ ID NO: 580481 - protein, 9 aa, Homo Sapiens
LSINHPSHG

SEQ ID NO: 580482 - protein, 9 aa, Homo Sapiens
KTRQRQNAG

SEQ ID NO: 580483 - protein, 9 aa, Homo Sapiens
ELQQSGVVV

SEQ ID NO: 580484 - protein, 9 aa, Homo Sapiens
PEVFCNRIF

SEQ ID NO: 580485 - protein, 9 aa, Homo Sapiens
HRTQAEELP

SEQ ID NO: 580486 - protein, 9 aa, Homo Sapiens
IDHPRWGAS

SEQ ID NO: 580487 - protein, 9 aa, Homo Sapiens
HLGAVGPIS

SEQ ID NO: 580488 - protein, 9 aa, Homo Sapiens
EQDIRMPKK

SEQ ID NO: 580489 - protein, 9 aa, Homo Sapiens
EHLPACPGR

SEQ ID NO: 580490 - protein, 9 aa, Homo Sapiens
AKTKLAIGT

SEQ ID NO: 580491 - protein, 9 aa, Homo Sapiens
EELDLSNSS

SEQ ID NO: 580492 - protein, 9 aa, Homo Sapiens
PYPSQHLEA

SEQ ID NO: 580493 - protein, 9 aa, Homo Sapiens
FWVFLKSLR

SEQ ID NO: 580494 - protein, 9 aa, Homo Sapiens
QYDTYFCMS

SEQ ID NO: 580495 - protein, 9 aa, Homo Sapiens
ESSSPGTVT

SEQ ID NO: 580496 - protein, 9 aa, Homo Sapiens
LNYLEKHIT

SEQ ID NO: 580497 - protein, 9 aa, Homo Sapiens
GQVTYSLLP

SEQ ID NO: 580498 - protein, 9 aa, Homo Sapiens
NAGSSSQQN

SEQ ID NO: 580499 - protein, 9 aa, Homo Sapiens
KGHLEVQIQ

SEQ ID NO: 580500 - protein, 9 aa, Homo Sapiens
SIPREHLPA

SEQ ID NO: 580501 - protein, 9 aa, Homo Sapiens
EVTKPGNIV

SEQ ID NO: 580502 - protein, 9 aa, Homo Sapiens
LAIGTSSMI

SEQ ID NO: 580503 - protein, 9 aa, Homo Sapiens
SPIAVQPHP

SEQ ID NO: 580504 - protein, 9 aa, Homo Sapiens
AVGPISIPR

SEQ ID NO: 580505 - protein, 9 aa, Homo Sapiens
MWSVGCILV

SEQ ID NO: 580506 - protein, 9 aa, Homo Sapiens
KTKLAIGTS

SEQ ID NO: 580507 - protein, 9 aa, Homo Sapiens
RGNLLLQAR

SEQ ID NO: 580508 - protein, 9 aa, Homo Sapiens
LEKHITHKN

SEQ ID NO: 580509 - protein, 9 aa, Homo Sapiens
PYPAKNSAE

SEQ ID NO: 580510 - protein, 9 aa, Homo Sapiens
LGARFQQLL

SEQ ID NO: 580511 - protein, 9 aa, Homo Sapiens
IDLNEWLGS

SEQ ID NO: 580512 - protein, 9 aa, Homo Sapiens
PIAVQPHPA

SEQ ID NO: 580513 - protein, 9 aa, Homo Sapiens
PHELLSTDN

SEQ ID NO: 580514 - protein, 9 aa, Homo Sapiens
TKGHLEVQI

SEQ ID NO: 580515 - protein, 9 aa, Homo Sapiens
HLPACPGRT

SEQ ID NO: 580516 - protein, 9 aa, Homo Sapiens
DAPGKHLGY

SEQ ID NO: 580517 - protein, 9 aa, Homo Sapiens
TVKEVQKAK

SEQ ID NO: 580518 - protein, 9 aa, Homo Sapiens
IPHVRMVAI

SEQ ID NO: 580519 - protein, 9 aa, Homo Sapiens
VLETNIQNY

SEQ ID NO: 580520 - protein, 9 aa, Homo Sapiens
CGSDVKTYK

SEQ ID NO: 580521 - protein, 9 aa, Homo Sapiens
AGGHPGRFQ

SEQ ID NO: 580522 - protein, 9 aa, Homo Sapiens
DHPRILQKI

SEQ ID NO: 580523 - protein, 9 aa, Homo Sapiens
ELIREVEPM

SEQ ID NO: 580524 - protein, 9 aa, Homo Sapiens
DKSLTKSNC

SEQ ID NO: 580525 - protein, 9 aa, Homo Sapiens
GFLTTFGPC

SEQ ID NO: 580526 - protein, 9 aa, Homo Sapiens
KSSSEAGAG

SEQ ID NO: 580527 - protein, 9 aa, Homo Sapiens
SPFGPLKVA

SEQ ID NO: 580528 - protein, 9 aa, Homo Sapiens
KVSMEPFLP

SEQ ID NO: 580529 - protein, 9 aa, Homo Sapiens
LCTPLSEEF

SEQ ID NO: 580530 - protein, 8 aa, Homo Sapiens
SEPAGDVR

SEQ ID NO: 580531 - protein, 9 aa, Homo Sapiens
GEVLMASTS

SEQ ID NO: 580532 - protein, 9 aa, Homo Sapiens
RVAAQRHSV

SEQ ID NO: 580533 - protein, 9 aa, Homo Sapiens
WPAEVCRPK

SEQ ID NO: 580534 - protein, 9 aa, Homo Sapiens
KLGQEKPTP

SEQ ID NO: 580535 - protein, 9 aa, Homo Sapiens
KDLIATRRD

SEQ ID NO: 580536 - protein, 9 aa, Homo Sapiens
TVLPALCEP

SEQ ID NO: 580537 - protein, 9 aa, Homo Sapiens
FHCSWGEYV

SEQ ID NO: 580538 - protein, 9 aa, Homo Sapiens
TCAVHGDLK

SEQ ID NO: 580539 - protein, 9 aa, Homo Sapiens
NLLRQQSLF

SEQ ID NO: 580540 - protein, 9 aa, Homo Sapiens
IQNYLSHFS

SEQ ID NO: 580541 - protein, 9 aa, Homo Sapiens
QKHLELMPS

SEQ ID NO: 580542 - protein, 9 aa, Homo Sapiens
PLEAADDAK

SEQ ID NO: 580543 - protein, 9 aa, Homo Sapiens
QYFQETVID

SEQ ID NO: 580544 - protein, 9 aa, Homo Sapiens
RALKSSSEA

SEQ ID NO: 580545 - protein, 9 aa, Homo Sapiens
TVLRQRLER

SEQ ID NO: 580546 - protein, 9 aa, Homo Sapiens
LATSVACVP

SEQ ID NO: 580547 - protein, 9 aa, Homo Sapiens
LMPSMTGMP

SEQ ID NO: 580548 - protein, 9 aa, Homo Sapiens
TPLTDLCYL

SEQ ID NO: 580549 - protein, 9 aa, Homo Sapiens
SDHLLTLSC

SEQ ID NO: 580550 - protein, 9 aa, Homo Sapiens
LDPEDRIPS

SEQ ID NO: 580551 - protein, 9 aa, Homo Sapiens
VKTYKNDCF

SEQ ID NO: 580552 - protein, 9 aa, Homo Sapiens
DVAEDDREL

SEQ ID NO: 580553 - protein, 9 aa, Homo Sapiens
IPIRTPQRM

SEQ ID NO: 580554 - protein, 9 aa, Homo Sapiens
LIATRRDLI

SEQ ID NO: 580555 - protein, 9 aa, Homo Sapiens
TTDKIPFSF

SEQ ID NO: 580556 - protein, 9 aa, Homo Sapiens
MPSASTASA

SEQ ID NO: 580557 - protein, 9 aa, Homo Sapiens
LCYLCLMGA

SEQ ID NO: 580558 - protein, 9 aa, Homo Sapiens
RRRSRLPCH

SEQ ID NO: 580559 - protein, 9 aa, Homo Sapiens
KSNCQSRLH

SEQ ID NO: 580560 - protein, 9 aa, Homo Sapiens
FAKNLLTCM

SEQ ID NO: 580561 - protein, 9 aa, Homo Sapiens
KEEVKNKIS

SEQ ID NO: 580562 - protein, 9 aa, Homo Sapiens
FGALKYTDD

SEQ ID NO: 580563 - protein, 9 aa, Homo Sapiens
LNAQNKNSS

SEQ ID NO: 580564 - protein, 9 aa, Homo Sapiens
DRAVVQSHY

SEQ ID NO: 580565 - protein, 9 aa, Homo Sapiens
IRRVAAQRH

SEQ ID NO: 580566 - protein, 9 aa, Homo Sapiens
SSPTSLDPR

SEQ ID NO: 580567 - protein, 9 aa, Homo Sapiens
TDLVRPEYT

SEQ ID NO: 580568 - protein, 9 aa, Homo Sapiens
IVQIILSCG

SEQ ID NO: 580569 - protein, 9 aa, Homo Sapiens
KKDLLDMLN

SEQ ID NO: 580570 - protein, 9 aa, Homo Sapiens
SGQLLIVVT

SEQ ID NO: 580571 - protein, 9 aa, Homo Sapiens
LLRQQSLFC

SEQ ID NO: 580572 - protein, 9 aa, Homo Sapiens
LFDRAVVQS

SEQ ID NO: 580573 - protein, 9 aa, Homo Sapiens
PSMTGMPSS

SEQ ID NO: 580574 - protein, 9 aa, Homo Sapiens
HRIVVLHHG

SEQ ID NO: 580575 - protein, 9 aa, Homo Sapiens
VSARRAGLT

SEQ ID NO: 580576 - protein, 9 aa, Homo Sapiens
CAVHGDLKP

SEQ ID NO: 580577 - protein, 9 aa, Homo Sapiens
EAYGKCKEI

SEQ ID NO: 580578 - protein, 9 aa, Homo Sapiens
FCRSWSRTH

SEQ ID NO: 580579 - protein, 9 aa, Homo Sapiens
EHEEKIREQ

SEQ ID NO: 580580 - protein, 9 aa, Homo Sapiens
GLKADAYRA

SEQ ID NO: 580581 - protein, 9 aa, Homo Sapiens
TSSCGRVPF

SEQ ID NO: 580582 - protein, 9 aa, Homo Sapiens
SDVKTYKND

SEQ ID NO: 580583 - protein, 9 aa, Homo Sapiens
LKSSSEAGA

SEQ ID NO: 580584 - protein, 9 aa, Homo Sapiens
QCTLFCGNS

SEQ ID NO: 580585 - protein, 9 aa, Homo Sapiens
RRDLIATQR

SEQ ID NO: 580586 - protein, 9 aa, Homo Sapiens
PLSEEFLDQ

SEQ ID NO: 580587 - protein, 9 aa, Homo Sapiens
SPLPSPITE

SEQ ID NO: 580588 - protein, 9 aa, Homo Sapiens
EEEATVNRQ

SEQ ID NO: 580589 - protein, 9 aa, Homo Sapiens
GEEDQVAQP

SEQ ID NO: 580590 - protein, 9 aa, Homo Sapiens
ITDLVRPEY

SEQ ID NO: 580591 - protein, 9 aa, Homo Sapiens
LKDYLTVLR

SEQ ID NO: 580592 - protein, 9 aa, Homo Sapiens
RSWSRTHSW

SEQ ID NO: 580593 - protein, 9 aa, Homo Sapiens
ETTVYISST

SEQ ID NO: 580594 - protein, 9 aa, Homo Sapiens
EDILEMVQI

SEQ ID NO: 580595 - protein, 9 aa, Homo Sapiens
AEVSKVAED

SEQ ID NO: 580596 - protein, 9 aa, Homo Sapiens
VRMVAIQVS

SEQ ID NO: 580597 - protein, 9 aa, Homo Sapiens
PQRMIAPVS

SEQ ID NO: 580598 - protein, 9 aa, Homo Sapiens
IAPVSARRA

SEQ ID NO: 580599 - protein, 9 aa, Homo Sapiens
CTLFCGNSR

SEQ ID NO: 580600 - protein, 9 aa, Homo Sapiens
EVLNAVPFL

SEQ ID NO: 580601 - protein, 9 aa, Homo Sapiens
TEDILEMVQ

SEQ ID NO: 580602 - protein, 9 aa, Homo Sapiens
RINNTWSGL

SEQ ID NO: 580603 - protein, 9 aa, Homo Sapiens
ILEMVQIPR

SEQ ID NO: 580604 - protein, 9 aa, Homo Sapiens
DYLTVLRQR

SEQ ID NO: 580605 - protein, 9 aa, Homo Sapiens
NYLSHFSLI

SEQ ID NO: 580606 - protein, 9 aa, Homo Sapiens
MEPFLPMDK

SEQ ID NO: 580607 - protein, 9 aa, Homo Sapiens
NIPHVRMVA

SEQ ID NO: 580608 - protein, 9 aa, Homo Sapiens
MDHLPLEAA

SEQ ID NO: 580609 - protein, 9 aa, Homo Sapiens
PSSVNQNFP

SEQ ID NO: 580610 - protein, 9 aa, Homo Sapiens
EAADDAKKV

SEQ ID NO: 580611 - protein, 9 aa, Homo Sapiens
LWACFYAIY

SEQ ID NO: 580612 - protein, 9 aa, Homo Sapiens
MLATSVACV

SEQ ID NO: 580613 - protein, 9 aa, Homo Sapiens
IEDDFSLKE

SEQ ID NO: 580614 - protein, 9 aa, Homo Sapiens
IVLNSPVTG

SEQ ID NO: 580615 - protein, 9 aa, Homo Sapiens
VVVEGSGRM

SEQ ID NO: 580616 - protein, 9 aa, Homo Sapiens
GGHPGRFQD

SEQ ID NO: 580617 - protein, 9 aa, Homo Sapiens
RDAFLEKTY

SEQ ID NO: 580618 - protein, 9 aa, Homo Sapiens
ARRAGLTKP

SEQ ID NO: 580619 - protein, 9 aa, Homo Sapiens
DTKTVKEVQ

SEQ ID NO: 580620 - protein, 9 aa, Homo Sapiens
VPVETTDKI

SEQ ID NO: 580621 - protein, 9 aa, Homo Sapiens
PCGCGLGEA

SEQ ID NO: 580622 - protein, 9 aa, Homo Sapiens
ALKYTDDPE

SEQ ID NO: 580623 - protein, 9 aa, Homo Sapiens
QQAEDHPRI

SEQ ID NO: 580624 - protein, 9 aa, Homo Sapiens
DLKPPIIWK

SEQ ID NO: 580625 - protein, 9 aa, Homo Sapiens
GNFHCSWGE

SEQ ID NO: 580626 - protein, 9 aa, Homo Sapiens
EVKNKISVM

SEQ ID NO: 580627 - protein, 9 aa, Homo Sapiens
SNCQSRLHD

SEQ ID NO: 580628 - protein, 9 aa, Homo Sapiens
TASARQHVV

SEQ ID NO: 580629 - protein, 9 aa, Homo Sapiens
EATVNRQQS

SEQ ID NO: 580630 - protein, 9 aa, Homo Sapiens
KDLLDMLNR

SEQ ID NO: 580631 - protein, 9 aa, Homo Sapiens
SLFCDVSIY

SEQ ID NO: 580632 - protein, 9 aa, Homo Sapiens
CPRGVPACS

SEQ ID NO: 580633 - protein, 9 aa, Homo Sapiens
REYKRIILE

SEQ ID NO: 580634 - protein, 9 aa, Homo Sapiens
GPAGTRSVR

SEQ ID NO: 580635 - protein, 9 aa, Homo Sapiens
LSVYAVTVL

SEQ ID NO: 580636 - protein, 9 aa, Homo Sapiens
FFMLISSMM

SEQ ID NO: 580637 - protein, 9 aa, Homo Sapiens
YLTVLRQRL

SEQ ID NO: 580638 - protein, 9 aa, Homo Sapiens
DNIIANEEP

SEQ ID NO: 580639 - protein, 9 aa, Homo Sapiens
AQRHSVLRQ

SEQ ID NO: 580640 - protein, 9 aa, Homo Sapiens
VFLTDQKRR

SEQ ID NO: 580641 - protein, 9 aa, Homo Sapiens
LTDLCYLCL

SEQ ID NO: 580642 - protein, 9 aa, Homo Sapiens
NSIQKHLEL

SEQ ID NO: 580643 - protein, 9 aa, Homo Sapiens
AEDHPRILQ

SEQ ID NO: 580644 - protein, 9 aa, Homo Sapiens
PFLPMDKLG

SEQ ID NO: 580645 - protein, 9 aa, Homo Sapiens
RRAGLTKPR

SEQ ID NO: 580646 - protein, 9 aa, Homo Sapiens
LPSPITEAS

SEQ ID NO: 580647 - protein, 9 aa, Homo Sapiens
TVNRQQSNE

SEQ ID NO: 580648 - protein, 9 aa, Homo Sapiens
CLLKGGYEG

SEQ ID NO: 580649 - protein, 9 aa, Homo Sapiens
IQKHLELMP

SEQ ID NO: 580650 - protein, 9 aa, Homo Sapiens
SPVTGKCTA

SEQ ID NO: 580651 - protein, 9 aa, Homo Sapiens
TKSNCQSRL

SEQ ID NO: 580652 - protein, 9 aa, Homo Sapiens
VPFLLHIPA

SEQ ID NO: 580653 - protein, 9 aa, Homo Sapiens
MVIKMVVSF

SEQ ID NO: 580654 - protein, 9 aa, Homo Sapiens
EDLKNKKDL

SEQ ID NO: 580655 - protein, 9 aa, Homo Sapiens
RIEDDFSLK

SEQ ID NO: 580656 - protein, 9 aa, Homo Sapiens
LFGLYGSLF

SEQ ID NO: 580657 - protein, 9 aa, Homo Sapiens
LVITPLTDL

SEQ ID NO: 580658 - protein, 9 aa, Homo Sapiens
GRMADVIAQ

SEQ ID NO: 580659 - protein, 9 aa, Homo Sapiens
VRPEYTNQC

SEQ ID NO: 580660 - protein, 9 aa, Homo Sapiens
MLCTPLSEE

SEQ ID NO: 580661 - protein, 9 aa, Homo Sapiens
KPTPWKESV

SEQ ID NO: 580662 - protein, 9 aa, Homo Sapiens
QRKRLSPVS

SEQ ID NO: 580663 - protein, 9 aa, Homo Sapiens
RCRRGEEDQ

SEQ ID NO: 580664 - protein, 9 aa, Homo Sapiens
ALRAFAARP

SEQ ID NO: 580665 - protein, 9 aa, Homo Sapiens
TDKIPFSFS

SEQ ID NO: 580666 - protein, 9 aa, Homo Sapiens
AVLSSVHPL

SEQ ID NO: 580667 - protein, 9 aa, Homo Sapiens
KVAEDSLEE

SEQ ID NO: 580668 - protein, 9 aa, Homo Sapiens
PPPPEVTDH

SEQ ID NO: 580669 - protein, 9 aa, Homo Sapiens
NISDRAHIV

SEQ ID NO: 580670 - protein, 9 aa, Homo Sapiens
EDHPRILQK

SEQ ID NO: 580671 - protein, 9 aa, Homo Sapiens
AVTVLPALC

SEQ ID NO: 580672 - protein, 9 aa, Homo Sapiens
GGPGLVGFQ

SEQ ID NO: 580673 - protein, 9 aa, Homo Sapiens
DDFSLKEQL

SEQ ID NO: 580674 - protein, 9 aa, Homo Sapiens
DPICGSDVK

SEQ ID NO: 580675 - protein, 9 aa, Homo Sapiens
SSSEAGAGL

SEQ ID NO: 580676 - protein, 9 aa, Homo Sapiens
GVWRLDSPL

SEQ ID NO: 580677 - protein, 9 aa, Homo Sapiens
LISSMMFLS

SEQ ID NO: 580678 - protein, 9 aa, Homo Sapiens
AHTCPRGVP

SEQ ID NO: 580679 - protein, 9 aa, Homo Sapiens
SVHPLFGLY

SEQ ID NO: 580680 - protein, 9 aa, Homo Sapiens
ERQNSSVRL

SEQ ID NO: 580681 - protein, 9 aa, Homo Sapiens
HVMNFLREQ

SEQ ID NO: 580682 - protein, 9 aa, Homo Sapiens
RRGEEDQVA

SEQ ID NO: 580683 - protein, 9 aa, Homo Sapiens
AASSSALTR

SEQ ID NO: 580684 - protein, 9 aa, Homo Sapiens
GTAHEMPKP

SEQ ID NO: 580685 - protein, 9 aa, Homo Sapiens
GFSSEYPEF

SEQ ID NO: 580686 - protein, 9 aa, Homo Sapiens
SVVTLKKEE

SEQ ID NO: 580687 - protein, 9 aa, Homo Sapiens
YTDDPEVLF

SEQ ID NO: 580688 - protein, 9 aa, Homo Sapiens
HQLALIIQL

SEQ ID NO: 580689 - protein, 9 aa, Homo Sapiens
DQVAQPWPE

SEQ ID NO: 580690 - protein, 9 aa, Homo Sapiens
SEAGAGLPR

SEQ ID NO: 580691 - protein, 9 aa, Homo Sapiens
AEEVMSLGR

SEQ ID NO: 580692 - protein, 9 aa, Homo Sapiens
ASTASARQH

SEQ ID NO: 580693 - protein, 9 aa, Homo Sapiens
EVSKVAEDS

SEQ ID NO: 580694 - protein, 9 aa, Homo Sapiens
ETNIQNYLS

SEQ ID NO: 580695 - protein, 9 aa, Homo Sapiens
RLVGWRAPA

SEQ ID NO: 580696 - protein, 9 aa, Homo Sapiens
LGQEKPTPW

SEQ ID NO: 580697 - protein, 9 aa, Homo Sapiens
RPKNVPPNI

SEQ ID NO: 580698 - protein, 9 aa, Homo Sapiens
SMEPFLPMD

SEQ ID NO: 580699 - protein, 9 aa, Homo Sapiens
RILQKIPIR

SEQ ID NO: 580700 - protein, 9 aa, Homo Sapiens
YFQETVIDT

SEQ ID NO: 580701 - protein, 9 aa, Homo Sapiens
LKYTDDPEV

SEQ ID NO: 580702 - protein, 9 aa, Homo Sapiens
RRKCAALDP

SEQ ID NO: 580703 - protein, 9 aa, Homo Sapiens
SPQEPPAAE

SEQ ID NO: 580704 - protein, 9 aa, Homo Sapiens
VLNSPVTGK

SEQ ID NO: 580705 - protein, 9 aa, Homo Sapiens
SRQIHNGKK

SEQ ID NO: 580706 - protein, 9 aa, Homo Sapiens
PVSARRAGL

SEQ ID NO: 580707 - protein, 9 aa, Homo Sapiens
IPAALGVNS

SEQ ID NO: 580708 - protein, 9 aa, Homo Sapiens
SFAGGHPGR

SEQ ID NO: 580709 - protein, 9 aa, Homo Sapiens
PRFRIEDDF

SEQ ID NO: 580710 - protein, 9 aa, Homo Sapiens
MTGMPSSLN

SEQ ID NO: 580711 - protein, 9 aa, Homo Sapiens
KMNLLRQQS

SEQ ID NO: 580712 - protein, 9 aa, Homo Sapiens
SALTRWCSS

SEQ ID NO: 580713 - protein, 9 aa, Homo Sapiens
AFPSAVGNP

SEQ ID NO: 580714 - protein, 9 aa, Homo Sapiens
LTKPRVQIL

SEQ ID NO: 580715 - protein, 9 aa, Homo Sapiens
RTPQRMIAP

SEQ ID NO: 580716 - protein, 9 aa, Homo Sapiens
EIVTGNPMV

SEQ ID NO: 580717 - protein, 9 aa, Homo Sapiens
PFLLHIPAL

SEQ ID NO: 580718 - protein, 9 aa, Homo Sapiens
VKEVQKAKN

SEQ ID NO: 580719 - protein, 9 aa, Homo Sapiens
NNTTEDILE

SEQ ID NO: 580720 - protein, 9 aa, Homo Sapiens
DGSDDGPAG

SEQ ID NO: 580721 - protein, 9 aa, Homo Sapiens
ATSVACVPT

SEQ ID NO: 580722 - protein, 9 aa, Homo Sapiens
CQSRLHDLL

SEQ ID NO: 580723 - protein, 9 aa, Homo Sapiens
INRNTDLER

SEQ ID NO: 580724 - protein, 9 aa, Homo Sapiens
RAVVQSHYI

SEQ ID NO: 580725 - protein, 9 aa, Homo Sapiens
EDDRELVDS

SEQ ID NO: 580726 - protein, 9 aa, Homo Sapiens
NCAPGAKDA

SEQ ID NO: 580727 - protein, 9 aa, Homo Sapiens
RVQILVPLM

SEQ ID NO: 580728 - protein, 9 aa, Homo Sapiens
TKTVKEVQK

SEQ ID NO: 580729 - protein, 9 aa, Homo Sapiens
LTCMPHDAI

SEQ ID NO: 580730 - protein, 9 aa, Homo Sapiens
SEQKTSGIL

SEQ ID NO: 580731 - protein, 9 aa, Homo Sapiens
QVSFLCKAC

SEQ ID NO: 580732 - protein, 9 aa, Homo Sapiens
LVRPEYTNQ

SEQ ID NO: 580733 - protein, 9 aa, Homo Sapiens
ILASLELLR

SEQ ID NO: 580734 - protein, 9 aa, Homo Sapiens
KEIGDDKVQ

SEQ ID NO: 580735 - protein, 9 aa, Homo Sapiens
CKVSMEPFL

SEQ ID NO: 580736 - protein, 9 aa, Homo Sapiens
EAGAGLPRC

SEQ ID NO: 580737 - protein, 9 aa, Homo Sapiens
RMIAPVSAR

SEQ ID NO: 580738 - protein, 9 aa, Homo Sapiens
DKEEVKNKI

SEQ ID NO: 580739 - protein, 9 aa, Homo Sapiens
LGNFHCSWG

SEQ ID NO: 580740 - protein, 9 aa, Homo Sapiens
QIILSCGHR

SEQ ID NO: 580741 - protein, 9 aa, Homo Sapiens
YSINRNTDL

SEQ ID NO: 580742 - protein, 9 aa, Homo Sapiens
HLTISSPTS

SEQ ID NO: 580743 - protein, 9 aa, Homo Sapiens
FSHPHNLAG

SEQ ID NO: 580744 - protein, 9 aa, Homo Sapiens
SWGEYVQAA

SEQ ID NO: 580745 - protein, 9 aa, Homo Sapiens
AEPTENRET

SEQ ID NO: 580746 - protein, 9 aa, Homo Sapiens
YFAEEVMSL

SEQ ID NO: 580747 - protein, 9 aa, Homo Sapiens
QKDLIATRR

SEQ ID NO: 580748 - protein, 9 aa, Homo Sapiens
SASTASARQ

SEQ ID NO: 580749 - protein, 9 aa, Homo Sapiens
QILVPLMMA

SEQ ID NO: 580750 - protein, 9 aa, Homo Sapiens
AADDAKKVK

SEQ ID NO: 580751 - protein, 9 aa, Homo Sapiens
KCAALDPED

SEQ ID NO: 580752 - protein, 9 aa, Homo Sapiens
MMFLSLSQG

SEQ ID NO: 580753 - protein, 9 aa, Homo Sapiens
KTSGILNKF

SEQ ID NO: 580754 - protein, 9 aa, Homo Sapiens
LDMLNREYK

SEQ ID NO: 580755 - protein, 9 aa, Homo Sapiens
MLISSMMFL

SEQ ID NO: 580756 - protein, 9 aa, Homo Sapiens
TRRDLIATQ

SEQ ID NO: 580757 - protein, 9 aa, Homo Sapiens
LLIVVTWLV

SEQ ID NO: 580758 - protein, 9 aa, Homo Sapiens
HCSWGEYVQ

SEQ ID NO: 580759 - protein, 9 aa, Homo Sapiens
NARALKSSS

SEQ ID NO: 580760 - protein, 9 aa, Homo Sapiens
ILQKIPIRT

SEQ ID NO: 580761 - protein, 9 aa, Homo Sapiens
SQATFLLSS

SEQ ID NO: 580762 - protein, 9 aa, Homo Sapiens
GLTKPRVQI

SEQ ID NO: 580763 - protein, 9 aa, Homo Sapiens
QKRRIFLPP

SEQ ID NO: 580764 - protein, 9 aa, Homo Sapiens
DHLLTLSCK

SEQ ID NO: 580765 - protein, 9 aa, Homo Sapiens
PIRTPQRMI

SEQ ID NO: 580766 - protein, 9 aa, Homo Sapiens
VVTLKKEES

SEQ ID NO: 580767 - protein, 9 aa, Homo Sapiens
NMCAFGGIL

SEQ ID NO: 580768 - protein, 9 aa, Homo Sapiens
SCKVSMEPF

SEQ ID NO: 580769 - protein, 9 aa, Homo Sapiens
ISSTLLLLP

SEQ ID NO: 580770 - protein, 9 aa, Homo Sapiens
TAHEMPKPS

SEQ ID NO: 580771 - protein, 9 aa, Homo Sapiens
NVPVETTDK

SEQ ID NO: 580772 - protein, 9 aa, Homo Sapiens
MLNREYKRI

SEQ ID NO: 580773 - protein, 9 aa, Homo Sapiens
VQSHYIHNL

SEQ ID NO: 580774 - protein, 9 aa, Homo Sapiens
RRCRRGEED

SEQ ID NO: 580775 - protein, 9 aa, Homo Sapiens
DEQMLNAQN

SEQ ID NO: 580776 - protein, 9 aa, Homo Sapiens
LQFCRSWSR

SEQ ID NO: 580777 - protein, 9 aa, Homo Sapiens
SLQFCRSWS

SEQ ID NO: 580778 - protein, 9 aa, Homo Sapiens
CGCGLGEAV

SEQ ID NO: 580779 - protein, 9 aa, Homo Sapiens
ETTDKIPFS

SEQ ID NO: 580780 - protein, 9 aa, Homo Sapiens
VYAVTVLPA

SEQ ID NO: 580781 - protein, 9 aa, Homo Sapiens
SIQKHLELM

SEQ ID NO: 580782 - protein, 9 aa, Homo Sapiens
KPPIIWKRN

SEQ ID NO: 580783 - protein, 9 aa, Homo Sapiens
LVPLMMAAL

SEQ ID NO: 580784 - protein, 9 aa, Homo Sapiens
YTIVLNSPV

SEQ ID NO: 580785 - protein, 9 aa, Homo Sapiens
NGPRSKIFD

SEQ ID NO: 580786 - protein, 9 aa, Homo Sapiens
SFCVAFPSA

SEQ ID NO: 580787 - protein, 9 aa, Homo Sapiens
LSPVSKEYQ

SEQ ID NO: 580788 - protein, 9 aa, Homo Sapiens
NSSVRLTWE

SEQ ID NO: 580789 - protein, 9 aa, Homo Sapiens
KPSPLMPSM

SEQ ID NO: 580790 - protein, 9 aa, Homo Sapiens
LKNKKDLLD

SEQ ID NO: 580791 - protein, 9 aa, Homo Sapiens
NFHCSWGEY

SEQ ID NO: 580792 - protein, 9 aa, Homo Sapiens
TSGICTGLK

SEQ ID NO: 580793 - protein, 9 aa, Homo Sapiens
EYTNQCTLF

SEQ ID NO: 580794 - protein, 9 aa, Homo Sapiens
LETNIQNYL

SEQ ID NO: 580795 - protein, 9 aa, Homo Sapiens
ADDAKKVKW

SEQ ID NO: 580796 - protein, 9 aa, Homo Sapiens
CCCLEEKVQ

SEQ ID NO: 580797 - protein, 9 aa, Homo Sapiens
LSGHCSNSA

SEQ ID NO: 580798 - protein, 9 aa, Homo Sapiens
PRILQKIPI

SEQ ID NO: 580799 - protein, 9 aa, Homo Sapiens
HEMPKPSPL

SEQ ID NO: 580800 - protein, 9 aa, Homo Sapiens
AKNLLTCMP

SEQ ID NO: 580801 - protein, 9 aa, Homo Sapiens
GMPSSLNCT

SEQ ID NO: 580802 - protein, 9 aa, Homo Sapiens
SKQELVITD

SEQ ID NO: 580803 - protein, 9 aa, Homo Sapiens
YTNQCTLFC

SEQ ID NO: 580804 - protein, 9 aa, Homo Sapiens
MLNAQNKNS

SEQ ID NO: 580805 - protein, 9 aa, Homo Sapiens
LNKFCSAKD

SEQ ID NO: 580806 - protein, 9 aa, Homo Sapiens
RKKRQMAAQ

SEQ ID NO: 580807 - protein, 9 aa, Homo Sapiens
KRRIFLPPP

SEQ ID NO: 580808 - protein, 9 aa, Homo Sapiens
QELVITDSY

SEQ ID NO: 580809 - protein, 9 aa, Homo Sapiens
RQQSLFCDV

SEQ ID NO: 580810 - protein, 9 aa, Homo Sapiens
VCYHKVKRK

SEQ ID NO: 580811 - protein, 9 aa, Homo Sapiens
DILEMVQIP

SEQ ID NO: 580812 - protein, 9 aa, Homo Sapiens
CGHRTSSFV

SEQ ID NO: 580813 - protein, 9 aa, Homo Sapiens
FDRAVVQSH

SEQ ID NO: 580814 - protein, 9 aa, Homo Sapiens
NLAGRRAMK

SEQ ID NO: 580815 - protein, 9 aa, Homo Sapiens
RLNISDRAH

SEQ ID NO: 580816 - protein, 9 aa, Homo Sapiens
PKPSPLMPS

SEQ ID NO: 580817 - protein, 9 aa, Homo Sapiens
YDPICGSDV

SEQ ID NO: 580818 - protein, 9 aa, Homo Sapiens
TGMPSSLNC

SEQ ID NO: 580819 - protein, 9 aa, Homo Sapiens
GGGVIVDNT

SEQ ID NO: 580820 - protein, 9 aa, Homo Sapiens
LSERQNSSV

SEQ ID NO: 580821 - protein, 9 aa, Homo Sapiens
QQSNEVTLT

SEQ ID NO: 580822 - protein, 9 aa, Homo Sapiens
MVDDGSDDG

SEQ ID NO: 580823 - protein, 9 aa, Homo Sapiens
NRCQLGLFG

SEQ ID NO: 580824 - protein, 9 aa, Homo Sapiens
IVVTWLVVE

SEQ ID NO: 580825 - protein, 9 aa, Homo Sapiens
VLWACFYAI

SEQ ID NO: 580826 - protein, 9 aa, Homo Sapiens
QEKKIREHE

SEQ ID NO: 580827 - protein, 9 aa, Homo Sapiens
TSVACVPTK

SEQ ID NO: 580828 - protein, 9 aa, Homo Sapiens
DLCYLCLMG

SEQ ID NO: 580829 - protein, 9 aa, Homo Sapiens
PGRFQDSKN

SEQ ID NO: 580830 - protein, 9 aa, Homo Sapiens
VQILVPLMM

SEQ ID NO: 580831 - protein, 9 aa, Homo Sapiens
RRSDHLLTL

SEQ ID NO: 580832 - protein, 9 aa, Homo Sapiens
TNIPHVRMV

SEQ ID NO: 580833 - protein, 9 aa, Homo Sapiens
PPAHTCPRG

SEQ ID NO: 580834 - protein, 9 aa, Homo Sapiens
ARIALLRET

SEQ ID NO: 580835 - protein, 9 aa, Homo Sapiens
HGDLKPPII

SEQ ID NO: 580836 - protein, 9 aa, Homo Sapiens
ALGVNSYSP

SEQ ID NO: 580837 - protein, 9 aa, Homo Sapiens
GLPRCLPPP

SEQ ID NO: 580838 - protein, 9 aa, Homo Sapiens
EVMSLGRNW

SEQ ID NO: 580839 - protein, 9 aa, Homo Sapiens
SRLPCHSDS

SEQ ID NO: 580840 - protein, 9 aa, Homo Sapiens
LHMLCTPLS

SEQ ID NO: 580841 - protein, 9 aa, Homo Sapiens
PQARKKKME

SEQ ID NO: 580842 - protein, 9 aa, Homo Sapiens
MDKLGQEKP

SEQ ID NO: 580843 - protein, 9 aa, Homo Sapiens
ALIIQLCGS

SEQ ID NO: 580844 - protein, 9 aa, Homo Sapiens
AGLTKPRVQ

SEQ ID NO: 580845 - protein, 9 aa, Homo Sapiens
DSPLPSPIT

SEQ ID NO: 580846 - protein, 9 aa, Homo Sapiens
PQQAEDHPR

SEQ ID NO: 580847 - protein, 9 aa, Homo Sapiens
PVYFAEEVM

SEQ ID NO: 580848 - protein, 9 aa, Homo Sapiens
CTMRRSDHL

SEQ ID NO: 580849 - protein, 9 aa, Homo Sapiens
PAEVCRPKN

SEQ ID NO: 580850 - protein, 9 aa, Homo Sapiens
KFAKNLLTC

SEQ ID NO: 580851 - protein, 9 aa, Homo Sapiens
SLDPRINNT

SEQ ID NO: 580852 - protein, 9 aa, Homo Sapiens
VAVAAAAAA

SEQ ID NO: 580853 - protein, 9 aa, Homo Sapiens
SERQNSSVR

SEQ ID NO: 580854 - protein, 9 aa, Homo Sapiens
EGWEKRLNI

SEQ ID NO: 580855 - protein, 9 aa, Homo Sapiens
ALDPEDRIP

SEQ ID NO: 580856 - protein, 9 aa, Homo Sapiens
QQSLFCDVS

SEQ ID NO: 580857 - protein, 9 aa, Homo Sapiens
EGFSSEYPE

SEQ ID NO: 580858 - protein, 9 aa, Homo Sapiens
IVVLHHGDL

SEQ ID NO: 580859 - protein, 9 aa, Homo Sapiens
AFLEKTYTK

SEQ ID NO: 580860 - protein, 9 aa, Homo Sapiens
KRLSPVSKE

SEQ ID NO: 580861 - protein, 9 aa, Homo Sapiens
LELMPSAST

SEQ ID NO: 580862 - protein, 9 aa, Homo Sapiens
ISSPTSLDP

SEQ ID NO: 580863 - protein, 9 aa, Homo Sapiens
LNSPVTGKC

SEQ ID NO: 580864 - protein, 9 aa, Homo Sapiens
PTSLDPRIN

SEQ ID NO: 580865 - protein, 9 aa, Homo Sapiens
VMLNGPRSK

SEQ ID NO: 580866 - protein, 9 aa, Homo Sapiens
PMDKLGQEK

SEQ ID NO: 580867 - protein, 9 aa, Homo Sapiens
VQPQARKKK

SEQ ID NO: 580868 - protein, 9 aa, Homo Sapiens
GRVPFAVYH

SEQ ID NO: 580869 - protein, 9 aa, Homo Sapiens
SWSRTHSWF

SEQ ID NO: 580870 - protein, 9 aa, Homo Sapiens
NLLTCMPHD

SEQ ID NO: 580871 - protein, 9 aa, Homo Sapiens
VHGDLKPPI

SEQ ID NO: 580872 - protein, 9 aa, Homo Sapiens
RFGALKYTD

SEQ ID NO: 580873 - protein, 9 aa, Homo Sapiens
SSCGRVPFA

SEQ ID NO: 580874 - protein, 9 aa, Homo Sapiens
KNKKDLLDM

SEQ ID NO: 580875 - protein, 9 aa, Homo Sapiens
RIALLRETN

SEQ ID NO: 580876 - protein, 9 aa, Homo Sapiens
PLKVAMELI

SEQ ID NO: 580877 - protein, 9 aa, Homo Sapiens
SFLQVSFLC

SEQ ID NO: 580878 - protein, 9 aa, Homo Sapiens
NREYKRIIL

SEQ ID NO: 580879 - protein, 9 aa, Homo Sapiens
HPLFGLYGS

SEQ ID NO: 580880 - protein, 9 aa, Homo Sapiens
LKVAMELIT

SEQ ID NO: 580881 - protein, 9 aa, Homo Sapiens
SRDAFLEKT

SEQ ID NO: 580882 - protein, 9 aa, Homo Sapiens
YLSHFSLIT

SEQ ID NO: 580883 - protein, 9 aa, Homo Sapiens
ATRRDLIAT

SEQ ID NO: 580884 - protein, 9 aa, Homo Sapiens
GYFGEVLMA

SEQ ID NO: 580885 - protein, 9 aa, Homo Sapiens
LVITDSYSG

SEQ ID NO: 580886 - protein, 9 aa, Homo Sapiens
CYHKVKRKI

SEQ ID NO: 580887 - protein, 9 aa, Homo Sapiens
PFGPLKVAM

SEQ ID NO: 580888 - protein, 9 aa, Homo Sapiens
VWRLDSPLP

SEQ ID NO: 580889 - protein, 9 aa, Homo Sapiens
VPFAVYHMH

SEQ ID NO: 580890 - protein, 9 aa, Homo Sapiens
RFQDSKNSD

SEQ ID NO: 580891 - protein, 9 aa, Homo Sapiens
HQYFQETVI

SEQ ID NO: 580892 - protein, 9 aa, Homo Sapiens
NTTEDILEM

SEQ ID NO: 580893 - protein, 9 aa, Homo Sapiens
ALKSSSEAG

SEQ ID NO: 580894 - protein, 9 aa, Homo Sapiens
KIPFSFSDR

SEQ ID NO: 580895 - protein, 9 aa, Homo Sapiens
HMLCTPLSE

SEQ ID NO: 580896 - protein, 9 aa, Homo Sapiens
WTAASSSAL

SEQ ID NO: 580897 - protein, 9 aa, Homo Sapiens
KRDRKQLRQ

SEQ ID NO: 580898 - protein, 9 aa, Homo Sapiens
PSPLMPSMT

SEQ ID NO: 580899 - protein, 9 aa, Homo Sapiens
NHRNPSNSR

SEQ ID NO: 580900 - protein, 9 aa, Homo Sapiens
FLRALSGHC

SEQ ID NO: 580901 - protein, 9 aa, Homo Sapiens
RYRGEPGGP

SEQ ID NO: 580902 - protein, 9 aa, Homo Sapiens
LIVNTDEVG

SEQ ID NO: 580903 - protein, 9 aa, Homo Sapiens
TPQRMIAPV

SEQ ID NO: 580904 - protein, 9 aa, Homo Sapiens
DLSVYAVTV

SEQ ID NO: 580905 - protein, 9 aa, Homo Sapiens
IVDNTESIL

SEQ ID NO: 580906 - protein, 9 aa, Homo Sapiens
LDSPLPSPI

SEQ ID NO: 580907 - protein, 9 aa, Homo Sapiens
PSSLNCTMR

SEQ ID NO: 580908 - protein, 9 aa, Homo Sapiens
AVVQSHYIH

SEQ ID NO: 580909 - protein, 9 aa, Homo Sapiens
QNSSVRLTW

SEQ ID NO: 580910 - protein, 9 aa, Homo Sapiens
EEDQVAQPW

SEQ ID NO: 580911 - protein, 9 aa, Homo Sapiens
LFFLGSSTA

SEQ ID NO: 580912 - protein, 9 aa, Homo Sapiens
PVSKEYQNV

SEQ ID NO: 580913 - protein, 9 aa, Homo Sapiens
LGLVQNMCA

SEQ ID NO: 580914 - protein, 9 aa, Homo Sapiens
FMLISSMMF

SEQ ID NO: 580915 - protein, 9 aa, Homo Sapiens
DLIATRRDL

SEQ ID NO: 580916 - protein, 9 aa, Homo Sapiens
VDDYLGFLT

SEQ ID NO: 580917 - protein, 9 aa, Homo Sapiens
RSRLPCHSD

SEQ ID NO: 580918 - protein, 9 aa, Homo Sapiens
VWKRDRKQL

SEQ ID NO: 580919 - protein, 9 aa, Homo Sapiens
YNLRNKDVK

SEQ ID NO: 580920 - protein, 9 aa, Homo Sapiens
CRRGEEDQV

SEQ ID NO: 580921 - protein, 9 aa, Homo Sapiens
EPDNLLFFL

SEQ ID NO: 580922 - protein, 9 aa, Homo Sapiens
ASQFHQYFQ

SEQ ID NO: 580923 - protein, 9 aa, Homo Sapiens
MMAALSCSR

SEQ ID NO: 580924 - protein, 9 aa, Homo Sapiens
SPSSVNQNF

SEQ ID NO: 580925 - protein, 9 aa, Homo Sapiens
QLLIVVTWL

SEQ ID NO: 580926 - protein, 9 aa, Homo Sapiens
GPLKVAMEL

SEQ ID NO: 580927 - protein, 9 aa, Homo Sapiens
AEDSLEECA

SEQ ID NO: 580928 - protein, 9 aa, Homo Sapiens
CAALDPEDR

SEQ ID NO: 580929 - protein, 9 aa, Homo Sapiens
SPLMPSMTG

SEQ ID NO: 580930 - protein, 9 aa, Homo Sapiens
VDEQMLNAQ

SEQ ID NO: 580931 - protein, 9 aa, Homo Sapiens
QSLFCDVSI

SEQ ID NO: 580932 - protein, 9 aa, Homo Sapiens
PFAVYHMHS

SEQ ID NO: 580933 - protein, 9 aa, Homo Sapiens
FLQVSFLCK

SEQ ID NO: 580934 - protein, 9 aa, Homo Sapiens
VETTDKIPF

SEQ ID NO: 580935 - protein, 9 aa, Homo Sapiens
EKPTPWKES

SEQ ID NO: 580936 - protein, 9 aa, Homo Sapiens
SQFHQYFQE

SEQ ID NO: 580937 - protein, 9 aa, Homo Sapiens
RWWPAEVCR

SEQ ID NO: 580938 - protein, 9 aa, Homo Sapiens
RQMAAQERK

SEQ ID NO: 580939 - protein, 9 aa, Homo Sapiens
LVFLTDQKR

SEQ ID NO: 580940 - protein, 9 aa, Homo Sapiens
CRSWSRTHS

SEQ ID NO: 580941 - protein, 9 aa, Homo Sapiens
SKVAEDSLE

SEQ ID NO: 580942 - protein, 9 aa, Homo Sapiens
LIYNLRNKD

SEQ ID NO: 580943 - protein, 9 aa, Homo Sapiens
GALKYTDDP

SEQ ID NO: 580944 - protein, 9 aa, Homo Sapiens
ESVVTLKKE

SEQ ID NO: 580945 - protein, 9 aa, Homo Sapiens
AQRKRLSPV

SEQ ID NO: 580946 - protein, 9 aa, Homo Sapiens
EVQKAKNVN

SEQ ID NO: 580947 - protein, 9 aa, Homo Sapiens
LSCGHRTSS

SEQ ID NO: 580948 - protein, 9 aa, Homo Sapiens
VLGLVQNMC

SEQ ID NO: 580949 - protein, 9 aa, Homo Sapiens
EPGGPGLVG

SEQ ID NO: 580950 - protein, 9 aa, Homo Sapiens
VITVNYRIG

SEQ ID NO: 580951 - protein, 9 aa, Homo Sapiens
RGVPACSHV

SEQ ID NO: 580952 - protein, 9 aa, Homo Sapiens
QSHYIHNLS

SEQ ID NO: 580953 - protein, 9 aa, Homo Sapiens
VLAVLWACF

SEQ ID NO: 580954 - protein, 9 aa, Homo Sapiens
CAFGGILVV

SEQ ID NO: 580955 - protein, 9 aa, Homo Sapiens
SPTSLDPRI

SEQ ID NO: 580956 - protein, 9 aa, Homo Sapiens
DDGSDDGPA

SEQ ID NO: 580957 - protein, 9 aa, Homo Sapiens
LMMAALSCS

SEQ ID NO: 580958 - protein, 9 aa, Homo Sapiens
KIPIRTPQR

SEQ ID NO: 580959 - protein, 9 aa, Homo Sapiens
SGICTGLKA

SEQ ID NO: 580960 - protein, 9 aa, Homo Sapiens
IGDDKVQLA

SEQ ID NO: 580961 - protein, 9 aa, Homo Sapiens
SDDGPAGTR

SEQ ID NO: 580962 - protein, 9 aa, Homo Sapiens
VCRPKNVPP

SEQ ID NO: 580963 - protein, 9 aa, Homo Sapiens
LICTALARI

SEQ ID NO: 580964 - protein, 9 aa, Homo Sapiens
FCVAFPSAV

SEQ ID NO: 580965 - protein, 9 aa, Homo Sapiens
GSSQATFLL

SEQ ID NO: 580966 - protein, 9 aa, Homo Sapiens
NNTWSGLLT

SEQ ID NO: 580967 - protein, 9 aa, Homo Sapiens
YLGFLTTFG

SEQ ID NO: 580968 - protein, 9 aa, Homo Sapiens
GWEKRLNIS

SEQ ID NO: 580969 - protein, 9 aa, Homo Sapiens
RPEYTNQCT

SEQ ID NO: 580970 - protein, 9 aa, Homo Sapiens
VAAAAAAAP

SEQ ID NO: 580971 - protein, 9 aa, Homo Sapiens
RQRLERYLS

SEQ ID NO: 580972 - protein, 9 aa, Homo Sapiens
ASLSPSSVN

SEQ ID NO: 580973 - protein, 9 aa, Homo Sapiens
NEEPGAFNN

SEQ ID NO: 580974 - protein, 9 aa, Homo Sapiens
PGGELIREV

SEQ ID NO: 580975 - protein, 9 aa, Homo Sapiens
AVHGDLKPP

SEQ ID NO: 580976 - protein, 9 aa, Homo Sapiens
KTVKEVQKA

SEQ ID NO: 580977 - protein, 9 aa, Homo Sapiens
KAEVSKVAE

SEQ ID NO: 580978 - protein, 9 aa, Homo Sapiens
LKPPIIWKR

SEQ ID NO: 580979 - protein, 9 aa, Homo Sapiens
LPLEAADDA

SEQ ID NO: 580980 - protein, 9 aa, Homo Sapiens
TPLSEEFLD

SEQ ID NO: 580981 - protein, 9 aa, Homo Sapiens
KVAMELITD

SEQ ID NO: 580982 - protein, 9 aa, Homo Sapiens
QMAAQERKV

SEQ ID NO: 580983 - protein, 9 aa, Homo Sapiens
QFCRSWSRT

SEQ ID NO: 580984 - protein, 9 aa, Homo Sapiens
LNISDRAHI

SEQ ID NO: 580985 - protein, 9 aa, Homo Sapiens
LPMDKLGQE

SEQ ID NO: 580986 - protein, 9 aa, Homo Sapiens
FAEEVMSLG

SEQ ID NO: 580987 - protein, 9 aa, Homo Sapiens
VMCAPGSSQ

SEQ ID NO: 580988 - protein, 9 aa, Homo Sapiens
ATVNRQQSN

SEQ ID NO: 580989 - protein, 9 aa, Homo Sapiens
FQETVIDTP

SEQ ID NO: 580990 - protein, 9 aa, Homo Sapiens
RKKKMEMRQ

SEQ ID NO: 580991 - protein, 9 aa, Homo Sapiens
CKEIGDDKV

SEQ ID NO: 580992 - protein, 9 aa, Homo Sapiens
RQNSSVRLT

SEQ ID NO: 580993 - protein, 9 aa, Homo Sapiens
WEKRLNISD

SEQ ID NO: 580994 - protein, 9 aa, Homo Sapiens
KHLELMPSA

SEQ ID NO: 580995 - protein, 9 aa, Homo Sapiens
VEGSGRMAD

SEQ ID NO: 580996 - protein, 9 aa, Homo Sapiens
TGLKADAYR

SEQ ID NO: 580997 - protein, 9 aa, Homo Sapiens
AKDAFKAIG

SEQ ID NO: 580998 - protein, 9 aa, Homo Sapiens
RAGLTKPRV

SEQ ID NO: 580999 - protein, 9 aa, Homo Sapiens
RRRKCAALD

SEQ ID NO: 581000 - protein, 9 aa, Homo Sapiens
EEVMSLGRN

SEQ ID NO: 581001 - protein, 9 aa, Homo Sapiens
TTFGPCYIN

SEQ ID NO: 581002 - protein, 9 aa, Homo Sapiens
PEVTDHPKK

SEQ ID NO: 581003 - protein, 9 aa, Homo Sapiens
GGYEGFSSE

SEQ ID NO: 581004 - protein, 9 aa, Homo Sapiens
TLKKEESFL

SEQ ID NO: 581005 - protein, 9 aa, Homo Sapiens
VGHRIVVLH

SEQ ID NO: 581006 - protein, 9 aa, Homo Sapiens
QARKKKMEM

SEQ ID NO: 581007 - protein, 9 aa, Homo Sapiens
KYTDDPEVL

SEQ ID NO: 581008 - protein, 9 aa, Homo Sapiens
TSLDPRINN

SEQ ID NO: 581009 - protein, 9 aa, Homo Sapiens
VAAQRHSVL

SEQ ID NO: 581010 - protein, 9 aa, Homo Sapiens
AYGKCKEIG

SEQ ID NO: 581011 - protein, 9 aa, Homo Sapiens
PEYTNQCTL

SEQ ID NO: 581012 - protein, 9 aa, Homo Sapiens
TSGILNKFC

SEQ ID NO: 581013 - protein, 9 aa, Homo Sapiens
QNYLSHFSL

SEQ ID NO: 581014 - protein, 9 aa, Homo Sapiens
NTDEVGRDC

SEQ ID NO: 581015 - protein, 9 aa, Homo Sapiens
PGGPGLVGF

SEQ ID NO: 581016 - protein, 9 aa, Homo Sapiens
EPFLPMDKL

SEQ ID NO: 581017 - protein, 9 aa, Homo Sapiens
KRLVGWRAP

SEQ ID NO: 581018 - protein, 9 aa, Homo Sapiens
QPQARKKKM

SEQ ID NO: 581019 - protein, 9 aa, Homo Sapiens
SSLNCTMRR

SEQ ID NO: 581020 - protein, 9 aa, Homo Sapiens
RGEPGGPGL

SEQ ID NO: 581021 - protein, 9 aa, Homo Sapiens
SFFMLISSM

SEQ ID NO: 581022 - protein, 9 aa, Homo Sapiens
LKKEESFLT

SEQ ID NO: 581023 - protein, 9 aa, Homo Sapiens
VSKVAEDSL

SEQ ID NO: 581024 - protein, 9 aa, Homo Sapiens
FLPMDKLGQ

SEQ ID NO: 581025 - protein, 9 aa, Homo Sapiens
IILSCGHRT

SEQ ID NO: 581026 - protein, 9 aa, Homo Sapiens
FAGGHPGRF

SEQ ID NO: 581027 - protein, 9 aa, Homo Sapiens
GQEKPTPWK

SEQ ID NO: 581028 - protein, 9 aa, Homo Sapiens
NFLREQSRT

SEQ ID NO: 581029 - protein, 9 aa, Homo Sapiens
GYEGFSSEY

SEQ ID NO: 581030 - protein, 9 aa, Homo Sapiens
CVAFPSAVG

SEQ ID NO: 581031 - protein, 9 aa, Homo Sapiens
MRRSDHLLT

SEQ ID NO: 581032 - protein, 9 aa, Homo Sapiens
CMPHDAIIL

SEQ ID NO: 581033 - protein, 9 aa, Homo Sapiens
DLVRPEYTN

SEQ ID NO: 581034 - protein, 9 aa, Homo Sapiens
CQMLATSVA

SEQ ID NO: 581035 - protein, 9 aa, Homo Sapiens
SVACVPTKC

SEQ ID NO: 581036 - protein, 9 aa, Homo Sapiens
DVKTYKNDC

SEQ ID NO: 581037 - protein, 9 aa, Homo Sapiens
SNSRQIHNG

SEQ ID NO: 581038 - protein, 9 aa, Homo Sapiens
RGEEDQVAQ

SEQ ID NO: 581039 - protein, 9 aa, Homo Sapiens
NRNTDLERY

SEQ ID NO: 581040 - protein, 9 aa, Homo Sapiens
SSQATFLLS

SEQ ID NO: 581041 - protein, 9 aa, Homo Sapiens
NQCTLFCGN

SEQ ID NO: 581042 - protein, 9 aa, Homo Sapiens
AAAAAAAPT

SEQ ID NO: 581043 - protein, 9 aa, Homo Sapiens
EDQVAQPWP

SEQ ID NO: 581044 - protein, 9 aa, Homo Sapiens
ICTALARIA

SEQ ID NO: 581045 - protein, 9 aa, Homo Sapiens
LSPSSVNQN

SEQ ID NO: 581046 - protein, 9 aa, Homo Sapiens
DFSLKEQLQ

SEQ ID NO: 581047 - protein, 9 aa, Homo Sapiens
LRQQSLFCD

SEQ ID NO: 581048 - protein, 9 aa, Homo Sapiens
GAKDAFKAI

SEQ ID NO: 581049 - protein, 9 aa, Homo Sapiens
VSFLCKACS

SEQ ID NO: 581050 - protein, 9 aa, Homo Sapiens
CKACSDFLI

SEQ ID NO: 581051 - protein, 9 aa, Homo Sapiens
ELMPSASTA

SEQ ID NO: 581052 - protein, 9 aa, Homo Sapiens
LIIQLCGSI

SEQ ID NO: 581053 - protein, 9 aa, Homo Sapiens
DAFLEKTYT

SEQ ID NO: 581054 - protein, 9 aa, Homo Sapiens
RQITDLVRP

SEQ ID NO: 581055 - protein, 9 aa, Homo Sapiens
QKIPIRTPQ

SEQ ID NO: 581056 - protein, 9 aa, Homo Sapiens
LNCTMRRSD

SEQ ID NO: 581057 - protein, 9 aa, Homo Sapiens
EYKRIILEF

SEQ ID NO: 581058 - protein, 9 aa, Homo Sapiens
VVEGSGRMA

SEQ ID NO: 581059 - protein, 9 aa, Homo Sapiens
LSEEFLDQN

SEQ ID NO: 581060 - protein, 9 aa, Homo Sapiens
PRVQILVPL

SEQ ID NO: 581061 - protein, 9 aa, Homo Sapiens
SINRNTDLE

SEQ ID NO: 581062 - protein, 9 aa, Homo Sapiens
TWTGYFGEV

SEQ ID NO: 581063 - protein, 9 aa, Homo Sapiens
HNLAGRRAM

SEQ ID NO: 581064 - protein, 9 aa, Homo Sapiens
FLGSSTASD

SEQ ID NO: 581065 - protein, 9 aa, Homo Sapiens
ASSSALTRW

SEQ ID NO: 581066 - protein, 9 aa, Homo Sapiens
KPRVQILVP

SEQ ID NO: 581067 - protein, 9 aa, Homo Sapiens
NPSNSRQIH

SEQ ID NO: 581068 - protein, 9 aa, Homo Sapiens
IATRRDLIA

SEQ ID NO: 581069 - protein, 9 aa, Homo Sapiens
PTCQMLATS

SEQ ID NO: 581070 - protein, 9 aa, Homo Sapiens
LDPRINNTW

SEQ ID NO: 581071 - protein, 9 aa, Homo Sapiens
ILVFLTDQK

SEQ ID NO: 581072 - protein, 9 aa, Homo Sapiens
LLTLSCKVS

SEQ ID NO: 581073 - protein, 9 aa, Homo Sapiens
ITSGICTGL

SEQ ID NO: 581074 - protein, 9 aa, Homo Sapiens
VNYRIGVLG

SEQ ID NO: 581075 - protein, 9 aa, Homo Sapiens
ENPSPQEPP

SEQ ID NO: 581076 - protein, 9 aa, Homo Sapiens
ICTGLKADA

SEQ ID NO: 581077 - protein, 9 aa, Homo Sapiens
APATWTAAS

SEQ ID NO: 581078 - protein, 9 aa, Homo Sapiens
RCQLGLFGR

SEQ ID NO: 581079 - protein, 9 aa, Homo Sapiens
VKNKISVMN

SEQ ID NO: 581080 - protein, 9 aa, Homo Sapiens
MCAPGSSQA

SEQ ID NO: 581081 - protein, 9 aa, Homo Sapiens
THVMNFLRE

SEQ ID NO: 581082 - protein, 9 aa, Homo Sapiens
ESFLTHLTI

SEQ ID NO: 581083 - protein, 9 aa, Homo Sapiens
LPCHSDSGS

SEQ ID NO: 581084 - protein, 9 aa, Homo Sapiens
QHQLALIIQ

SEQ ID NO: 581085 - protein, 9 aa, Homo Sapiens
LLTCMPHDA

SEQ ID NO: 581086 - protein, 9 aa, Homo Sapiens
VVHVMLNGP

SEQ ID NO: 581087 - protein, 9 aa, Homo Sapiens
VTVLPALCE

SEQ ID NO: 581088 - protein, 9 aa, Homo Sapiens
MPKPSPLMP

SEQ ID NO: 581089 - protein, 9 aa, Homo Sapiens
KVKRKILTT

SEQ ID NO: 581090 - protein, 9 aa, Homo Sapiens
VTWLVVEAP

SEQ ID NO: 581091 - protein, 9 aa, Homo Sapiens
VSKEYQNVH

SEQ ID NO: 581092 - protein, 9 aa, Homo Sapiens
LLKGGYEGF

SEQ ID NO: 581093 - protein, 9 aa, Homo Sapiens
YAVTVLPAL

SEQ ID NO: 581094 - protein, 9 aa, Homo Sapiens
EFTTHVMNF

SEQ ID NO: 581095 - protein, 9 aa, Homo Sapiens
GICTGLKAD

SEQ ID NO: 581096 - protein, 9 aa, Homo Sapiens
AGAGLPRCL

SEQ ID NO: 581097 - protein, 9 aa, Homo Sapiens
SAVGNPDLQ

SEQ ID NO: 581098 - protein, 9 aa, Homo Sapiens
QNMCAFGGI

SEQ ID NO: 581099 - protein, 9 aa, Homo Sapiens
LGEAVDGVR

SEQ ID NO: 581100 - protein, 9 aa, Homo Sapiens
PVTGKCTAA

SEQ ID NO: 581101 - protein, 9 aa, Homo Sapiens
SSVHPLFGL

SEQ ID NO: 581102 - protein, 9 aa, Homo Sapiens
IVTGNPMVI

SEQ ID NO: 581103 - protein, 9 aa, Homo Sapiens
RFLSNRCQL

SEQ ID NO: 581104 - protein, 9 aa, Homo Sapiens
STLLLLPIF

SEQ ID NO: 581105 - protein, 9 aa, Homo Sapiens
REHEEKIRE

SEQ ID NO: 581106 - protein, 9 aa, Homo Sapiens
GQLLIVVTW

SEQ ID NO: 581107 - protein, 9 aa, Homo Sapiens
FHQYFQETV

SEQ ID NO: 581108 - protein, 9 aa, Homo Sapiens
VNSYSPVPT

SEQ ID NO: 581109 - protein, 9 aa, Homo Sapiens
APGAKDAFK

SEQ ID NO: 581110 - protein, 9 aa, Homo Sapiens
TDDPEVLFY

SEQ ID NO: 581111 - protein, 9 aa, Homo Sapiens
HPKKPPPPE

SEQ ID NO: 581112 - protein, 9 aa, Homo Sapiens
KEESFLTHL

SEQ ID NO: 581113 - protein, 9 aa, Homo Sapiens
QEPDNLLFF

SEQ ID NO: 581114 - protein, 9 aa, Homo Sapiens
DHPKKPPPP

SEQ ID NO: 581115 - protein, 9 aa, Homo Sapiens
VTLKKEESF

SEQ ID NO: 581116 - protein, 9 aa, Homo Sapiens
VQNMCAFGG

SEQ ID NO: 581117 - protein, 9 aa, Homo Sapiens
HVRMVAIQV

SEQ ID NO: 581118 - protein, 9 aa, Homo Sapiens
EVDEQMLNA

SEQ ID NO: 581119 - protein, 9 aa, Homo Sapiens
ALSGHCSNS

SEQ ID NO: 581120 - protein, 9 aa, Homo Sapiens
GHPGRFQDS

SEQ ID NO: 581121 - protein, 9 aa, Homo Sapiens
RLPCHSDSG

SEQ ID NO: 581122 - protein, 9 aa, Homo Sapiens
VNTDEVGRD

SEQ ID NO: 581123 - protein, 9 aa, Homo Sapiens
AMELITDNK

SEQ ID NO: 581124 - protein, 9 aa, Homo Sapiens
PSSKQELVI

SEQ ID NO: 581125 - protein, 9 aa, Homo Sapiens
LTLSCKVSM

SEQ ID NO: 581126 - protein, 9 aa, Homo Sapiens
EESFLTHLT

SEQ ID NO: 581127 - protein, 9 aa, Homo Sapiens
VLSSVHPLF

SEQ ID NO: 581128 - protein, 9 aa, Homo Sapiens
PAHTCPRGV

SEQ ID NO: 581129 - protein, 9 aa, Homo Sapiens
LNREYKRII

SEQ ID NO: 581130 - protein, 9 aa, Homo Sapiens
MIAPVSARR

SEQ ID NO: 581131 - protein, 9 aa, Homo Sapiens
ELVITDSYS

SEQ ID NO: 581132 - protein, 9 aa, Homo Sapiens
SGILNKFCS

SEQ ID NO: 581133 - protein, 9 aa, Homo Sapiens
KEVQKAKNV

SEQ ID NO: 581134 - protein, 9 aa, Homo Sapiens
FLLHIPALA

SEQ ID NO: 581135 - protein, 9 aa, Homo Sapiens
KDKEEVKNK

SEQ ID NO: 581136 - protein, 9 aa, Homo Sapiens
VMNFLREQS

SEQ ID NO: 581137 - protein, 9 aa, Homo Sapiens
QRHSVLRQW

SEQ ID NO: 581138 - protein, 9 aa, Homo Sapiens
AGLPRCLPP

SEQ ID NO: 581139 - protein, 9 aa, Homo Sapiens
NIQNYLSHF

SEQ ID NO: 581140 - protein, 9 aa, Homo Sapiens
KRQMAAQER

SEQ ID NO: 581141 - protein, 9 aa, Homo Sapiens
VSEDDRNSL

SEQ ID NO: 581142 - protein, 9 aa, Homo Sapiens
GEPVYFAEE

SEQ ID NO: 581143 - protein, 9 aa, Homo Sapiens
EQEKKIREH

SEQ ID NO: 581144 - protein, 9 aa, Homo Sapiens
ICGSDVKTY

SEQ ID NO: 581145 - protein, 9 aa, Homo Sapiens
TKPRVQILV

SEQ ID NO: 581146 - protein, 9 aa, Homo Sapiens
WKRLVGWRA

SEQ ID NO: 581147 - protein, 9 aa, Homo Sapiens
EKTYTKLKL

SEQ ID NO: 581148 - protein, 9 aa, Homo Sapiens
FGEVLMAST

SEQ ID NO: 581149 - protein, 9 aa, Homo Sapiens
QASQFHQYF

SEQ ID NO: 581150 - protein, 9 aa, Homo Sapiens
KASLSPSSV

SEQ ID NO: 581151 - protein, 9 aa, Homo Sapiens
FFLGSSTAS

SEQ ID NO: 581152 - protein, 9 aa, Homo Sapiens
VYISSTLLL

SEQ ID NO: 581153 - protein, 9 aa, Homo Sapiens
EIGDDKVQL

SEQ ID NO: 581154 - protein, 9 aa, Homo Sapiens
VVQSHYIHN

SEQ ID NO: 581155 - protein, 9 aa, Homo Sapiens
PVETTDKIP

SEQ ID NO: 581156 - protein, 9 aa, Homo Sapiens
MADVIAQVA

SEQ ID NO: 581157 - protein, 9 aa, Homo Sapiens
MLNGPRSKI

SEQ ID NO: 581158 - protein, 9 aa, Homo Sapiens
GLGEAVDGV

SEQ ID NO: 581159 - protein, 9 aa, Homo Sapiens
AEDDRELVD

SEQ ID NO: 581160 - protein, 9 aa, Homo Sapiens
WRLDSPLPS

SEQ ID NO: 581161 - protein, 9 aa, Homo Sapiens
RALSGHCSN

SEQ ID NO: 581162 - protein, 9 aa, Homo Sapiens
CSWGEYVQA

SEQ ID NO: 581163 - protein, 9 aa, Homo Sapiens
GPRSKIFDK

SEQ ID NO: 581164 - protein, 9 aa, Homo Sapiens
YEGFSSEYP

SEQ ID NO: 581165 - protein, 9 aa, Homo Sapiens
YEDLKNKKD

SEQ ID NO: 581166 - protein, 9 aa, Homo Sapiens
TYTKLKLQV

SEQ ID NO: 581167 - protein, 9 aa, Homo Sapiens
EPCGCGLGE

SEQ ID NO: 581168 - protein, 9 aa, Homo Sapiens
PCHSDSGSD

SEQ ID NO: 581169 - protein, 9 aa, Homo Sapiens
ARALKSSSE

SEQ ID NO: 581170 - protein, 9 aa, Homo Sapiens
APVSARRAG

SEQ ID NO: 581171 - protein, 9 aa, Homo Sapiens
LVQNMCAFG

SEQ ID NO: 581172 - protein, 9 aa, Homo Sapiens
NKISVMNQL

SEQ ID NO: 581173 - protein, 9 aa, Homo Sapiens
YPNVCYHKV

SEQ ID NO: 581174 - protein, 9 aa, Homo Sapiens
CTPLSEEFL

SEQ ID NO: 581175 - protein, 9 aa, Homo Sapiens
SVYAVTVLP

SEQ ID NO: 581176 - protein, 9 aa, Homo Sapiens
ESALRAFAA

SEQ ID NO: 581177 - protein, 9 aa, Homo Sapiens
LTHLTISSP

SEQ ID NO: 581178 - protein, 9 aa, Homo Sapiens
LTISSPTSL

SEQ ID NO: 581179 - protein, 9 aa, Homo Sapiens
GFEGPGGEL

SEQ ID NO: 581180 - protein, 9 aa, Homo Sapiens
LMPSASTAS

SEQ ID NO: 581181 - protein, 9 aa, Homo Sapiens
GSDDGPAGT

SEQ ID NO: 581182 - protein, 9 aa, Homo Sapiens
PLPSPITEA

SEQ ID NO: 581183 - protein, 9 aa, Homo Sapiens
SEDDRNSLL

SEQ ID NO: 581184 - protein, 9 aa, Homo Sapiens
DRELVDSIC

SEQ ID NO: 581185 - protein, 9 aa, Homo Sapiens
TQKDLIATR

SEQ ID NO: 581186 - protein, 9 aa, Homo Sapiens
VGWRAPATW

SEQ ID NO: 581187 - protein, 9 aa, Homo Sapiens
GVNSYSPVP

SEQ ID NO: 581188 - protein, 9 aa, Homo Sapiens
ISSMMFLSL

SEQ ID NO: 581189 - protein, 9 aa, Homo Sapiens
LTDQKRRIF

SEQ ID NO: 581190 - protein, 9 aa, Homo Sapiens
SLSPSSVNQ

SEQ ID NO: 581191 - protein, 9 aa, Homo Sapiens
EMVQIPRQE

SEQ ID NO: 581192 - protein, 9 aa, Homo Sapiens
LTVLRQRLE

SEQ ID NO: 581193 - protein, 9 aa, Homo Sapiens
AALDPEDRI

SEQ ID NO: 581194 - protein, 9 aa, Homo Sapiens
IQLCGSITP

SEQ ID NO: 581195 - protein, 9 aa, Homo Sapiens
SHPHNLAGR

SEQ ID NO: 581196 - protein, 9 aa, Homo Sapiens
GAGLPRCLP

SEQ ID NO: 581197 - protein, 9 aa, Homo Sapiens
DRYRGEPGG

SEQ ID NO: 581198 - protein, 9 aa, Homo Sapiens
EDDFSLKEQ

SEQ ID NO: 581199 - protein, 9 aa, Homo Sapiens
MILASLELL

SEQ ID NO: 581200 - protein, 9 aa, Homo Sapiens
AAAAAAPTT

SEQ ID NO: 581201 - protein, 9 aa, Homo Sapiens
TALARIALL

SEQ ID NO: 581202 - protein, 9 aa, Homo Sapiens
EMPKPSPLM

SEQ ID NO: 581203 - protein, 9 aa, Homo Sapiens
KGGYEGFSS

SEQ ID NO: 581204 - protein, 9 aa, Homo Sapiens
ATWTAASSS

SEQ ID NO: 581205 - protein, 9 aa, Homo Sapiens
VYFAEEVMS

SEQ ID NO: 581206 - protein, 9 aa, Homo Sapiens
REVLNAVPF

SEQ ID NO: 581207 - protein, 9 aa, Homo Sapiens
TMRRSDHLL

SEQ ID NO: 581208 - protein, 9 aa, Homo Sapiens
QATFLLSSV

SEQ ID NO: 581209 - protein, 9 aa, Homo Sapiens
PLIYNLRNK

SEQ ID NO: 581210 - protein, 9 aa, Homo Sapiens
GHRIVVLHH

SEQ ID NO: 581211 - protein, 9 aa, Homo Sapiens
PLMPSMTGM

SEQ ID NO: 581212 - protein, 9 aa, Homo Sapiens
QLRQRPGHT

SEQ ID NO: 581213 - protein, 9 aa, Homo Sapiens
LSDNIIANE

SEQ ID NO: 581214 - protein, 9 aa, Homo Sapiens
VVTWLVVEA

SEQ ID NO: 581215 - protein, 9 aa, Homo Sapiens
QEPPAAESA

SEQ ID NO: 581216 - protein, 9 aa, Homo Sapiens
PSASTASAR

SEQ ID NO: 581217 - protein, 9 aa, Homo Sapiens
SSSALTRWC

SEQ ID NO: 581218 - protein, 9 aa, Homo Sapiens
NRQQSNEVT

SEQ ID NO: 581219 - protein, 9 aa, Homo Sapiens
QKAEVSKVA

SEQ ID NO: 581220 - protein, 9 aa, Homo Sapiens
AAQERKVTR

SEQ ID NO: 581221 - protein, 9 aa, Homo Sapiens
NSPVTGKCT

SEQ ID NO: 581222 - protein, 9 aa, Homo Sapiens
QPFLRALSG

SEQ ID NO: 581223 - protein, 9 aa, Homo Sapiens
NCQSRLHDL

SEQ ID NO: 581224 - protein, 9 aa, Homo Sapiens
TTVYISSTL

SEQ ID NO: 581225 - protein, 9 aa, Homo Sapiens
GLVQNMCAF

SEQ ID NO: 581226 - protein, 9 aa, Homo Sapiens
GRFQDSKNS

SEQ ID NO: 581227 - protein, 9 aa, Homo Sapiens
FSEVGHRIV

SEQ ID NO: 581228 - protein, 9 aa, Homo Sapiens
SEVGHRIVV

SEQ ID NO: 581229 - protein, 9 aa, Homo Sapiens
GGVIVDNTE

SEQ ID NO: 581230 - protein, 9 aa, Homo Sapiens
GSDVKTYKN

SEQ ID NO: 581231 - protein, 9 aa, Homo Sapiens
VLPALCEPG

SEQ ID NO: 581232 - protein, 9 aa, Homo Sapiens
DFSHPHNLA

SEQ ID NO: 581233 - protein, 9 aa, Homo Sapiens
ILSCGHRTS

SEQ ID NO: 581234 - protein, 9 aa, Homo Sapiens
LIVVTWLVV

SEQ ID NO: 581235 - protein, 9 aa, Homo Sapiens
KRQITDLVR

SEQ ID NO: 581236 - protein, 9 aa, Homo Sapiens
TDQKRRIFL

SEQ ID NO: 581237 - protein, 9 aa, Homo Sapiens
AQNKNSSYF

SEQ ID NO: 581238 - protein, 9 aa, Homo Sapiens
SVNQNFPAS

SEQ ID NO: 581239 - protein, 9 aa, Homo Sapiens
VHPLFGLYG

SEQ ID NO: 581240 - protein, 9 aa, Homo Sapiens
LGFLTTFGP

SEQ ID NO: 581241 - protein, 9 aa, Homo Sapiens
NCTMRRSDH

SEQ ID NO: 581242 - protein, 9 aa, Homo Sapiens
LSCKVSMEP

SEQ ID NO: 581243 - protein, 9 aa, Homo Sapiens
CIVLAVLWA

SEQ ID NO: 581244 - protein, 9 aa, Homo Sapiens
EIVQIILSC

SEQ ID NO: 581245 - protein, 9 aa, Homo Sapiens
GEAVDGVRF

SEQ ID NO: 581246 - protein, 9 aa, Homo Sapiens
TLLLLPIFL

SEQ ID NO: 581247 - protein, 9 aa, Homo Sapiens
RSDHLLTLS

SEQ ID NO: 581248 - protein, 9 aa, Homo Sapiens
AVTNIPHVR

SEQ ID NO: 581249 - protein, 9 aa, Homo Sapiens
DDGPAGTRS

SEQ ID NO: 581250 - protein, 9 aa, Homo Sapiens
TLSCKVSME

SEQ ID NO: 581251 - protein, 9 aa, Homo Sapiens
KDAFKAIGN

SEQ ID NO: 581252 - protein, 9 aa, Homo Sapiens
KRLNISDRA

SEQ ID NO: 581253 - protein, 9 aa, Homo Sapiens
PRINNTWSG

SEQ ID NO: 581254 - protein, 9 aa, Homo Sapiens
KKEESFLTH

SEQ ID NO: 581255 - protein, 9 aa, Homo Sapiens
DGPAGTRSV

SEQ ID NO: 581256 - protein, 9 aa, Homo Sapiens
HTCPRGVPA

SEQ ID NO: 581257 - protein, 9 aa, Homo Sapiens
LQVSFLCKA

SEQ ID NO: 581258 - protein, 9 aa, Homo Sapiens
EEVKNKISV

SEQ ID NO: 581259 - protein, 9 aa, Homo Sapiens
WACFYAIYV

SEQ ID NO: 581260 - protein, 9 aa, Homo Sapiens
QEKPTPWKE

SEQ ID NO: 581261 - protein, 9 aa, Homo Sapiens
CGRVPFAVY

SEQ ID NO: 581262 - protein, 9 aa, Homo Sapiens
KNCAPGAKD

SEQ ID NO: 581263 - protein, 9 aa, Homo Sapiens
SMTGMPSSL

SEQ ID NO: 581264 - protein, 9 aa, Homo Sapiens
EVGHRIVVL

SEQ ID NO: 581265 - protein, 9 aa, Homo Sapiens
NLGNFHCSW

SEQ ID NO: 581266 - protein, 9 aa, Homo Sapiens
GEPCGCGLG

SEQ ID NO: 581267 - protein, 9 aa, Homo Sapiens
VLNAVPFLL

SEQ ID NO: 581268 - protein, 9 aa, Homo Sapiens
ILNKFCSAK

SEQ ID NO: 581269 - protein, 9 aa, Homo Sapiens
AALGVNSYS

SEQ ID NO: 581270 - protein, 9 aa, Homo Sapiens
EVCRPKNVP

SEQ ID NO: 581271 - protein, 9 aa, Homo Sapiens
QMLATSVAC

SEQ ID NO: 581272 - protein, 9 aa, Homo Sapiens
PRSKIFDKN

SEQ ID NO: 581273 - protein, 9 aa, Homo Sapiens
NYRIGVLGF

SEQ ID NO: 581274 - protein, 9 aa, Homo Sapiens
HLLTLSCKV

SEQ ID NO: 581275 - protein, 9 aa, Homo Sapiens
VDDGSDDGP

SEQ ID NO: 581276 - protein, 9 aa, Homo Sapiens
PWKESVVTL

SEQ ID NO: 581277 - protein, 9 aa, Homo Sapiens
EVLMASTSY

SEQ ID NO: 581278 - protein, 9 aa, Homo Sapiens
EVTDHPKKP

SEQ ID NO: 581279 - protein, 9 aa, Homo Sapiens
GNPMVIKMV

SEQ ID NO: 581280 - protein, 9 aa, Homo Sapiens
CRPKNVPPN

SEQ ID NO: 581281 - protein, 9 aa, Homo Sapiens
ITPLTDLCY

SEQ ID NO: 581282 - protein, 9 aa, Homo Sapiens
SDFSHPHNL

SEQ ID NO: 581283 - protein, 9 aa, Homo Sapiens
YRIGVLGFL

SEQ ID NO: 581284 - protein, 9 aa, Homo Sapiens
MPRFRIEDD

SEQ ID NO: 581285 - protein, 9 aa, Homo Sapiens
VITPLTDLC

SEQ ID NO: 581286 - protein, 9 aa, Homo Sapiens
LGGRFLSNR

SEQ ID NO: 581287 - protein, 9 aa, Homo Sapiens
SARRAGLTK

SEQ ID NO: 581288 - protein, 9 aa, Homo Sapiens
VAEDSLEEC

SEQ ID NO: 581289 - protein, 9 aa, Homo Sapiens
RKQLRQRPG

SEQ ID NO: 581290 - protein, 9 aa, Homo Sapiens
FEGPGGELI

SEQ ID NO: 581291 - protein, 9 aa, Homo Sapiens
PRGVPACSH

SEQ ID NO: 581292 - protein, 9 aa, Homo Sapiens
GDLKPPIIW

SEQ ID NO: 581293 - protein, 9 aa, Homo Sapiens
PLMMAALSC

SEQ ID NO: 581294 - protein, 9 aa, Homo Sapiens
TDHPKKPPP

SEQ ID NO: 581295 - protein, 9 aa, Homo Sapiens
DYLGFLTTF

SEQ ID NO: 581296 - protein, 9 aa, Homo Sapiens
LEKTYTKLK

SEQ ID NO: 581297 - protein, 9 aa, Homo Sapiens
EQHQLALII

SEQ ID NO: 581298 - protein, 9 aa, Homo Sapiens
DDVAEDDRE

SEQ ID NO: 581299 - protein, 9 aa, Homo Sapiens
PVRYSINRN

SEQ ID NO: 581300 - protein, 9 aa, Homo Sapiens
KESVVTLKK

SEQ ID NO: 581301 - protein, 9 aa, Homo Sapiens
QMLNAQNKN

SEQ ID NO: 581302 - protein, 9 aa, Homo Sapiens
NPSPQEPPA

SEQ ID NO: 581303 - protein, 9 aa, Homo Sapiens
VRDTKTVKE

SEQ ID NO: 581304 - protein, 9 aa, Homo Sapiens
EEATVNRQQ

SEQ ID NO: 581305 - protein, 9 aa, Homo Sapiens
IGVLGFLST

SEQ ID NO: 581306 - protein, 9 aa, Homo Sapiens
TGNPMVIKM

SEQ ID NO: 581307 - protein, 9 aa, Homo Sapiens
EQKTSGILN

SEQ ID NO: 581308 - protein, 9 aa, Homo Sapiens
SCGHRTSSF

SEQ ID NO: 581309 - protein, 9 aa, Homo Sapiens
WGEYVQAAP

SEQ ID NO: 581310 - protein, 9 aa, Homo Sapiens
IVITVNYRI

SEQ ID NO: 581311 - protein, 9 aa, Homo Sapiens
EGGGVIVDN

SEQ ID NO: 581312 - protein, 9 aa, Homo Sapiens
GGELIREVE

SEQ ID NO: 581313 - protein, 9 aa, Homo Sapiens
IIANEEPGA

SEQ ID NO: 581314 - protein, 9 aa, Homo Sapiens
SGHCSNSAG

SEQ ID NO: 581315 - protein, 9 aa, Homo Sapiens
LRQRLERYL

SEQ ID NO: 581316 - protein, 9 aa, Homo Sapiens
SEGGGVIVD

SEQ ID NO: 581317 - protein, 9 aa, Homo Sapiens
RKCAALDPE

SEQ ID NO: 581318 - protein, 9 aa, Homo Sapiens
TISSPTSLD

SEQ ID NO: 581319 - protein, 9 aa, Homo Sapiens
NVCYHKVKR

SEQ ID NO: 581320 - protein, 9 aa, Homo Sapiens
RKRLSPVSK

SEQ ID NO: 581321 - protein, 9 aa, Homo Sapiens
SFLTHLTIS

SEQ ID NO: 581322 - protein, 9 aa, Homo Sapiens
TVNYRIGVL

SEQ ID NO: 581323 - protein, 9 aa, Homo Sapiens
SPVRYSINR

SEQ ID NO: 581324 - protein, 9 aa, Homo Sapiens
FLTTFGPCY

SEQ ID NO: 581325 - protein, 9 aa, Homo Sapiens
FLTDQKRRI

SEQ ID NO: 581326 - protein, 9 aa, Homo Sapiens
ALARIALLR

SEQ ID NO: 581327 - protein, 9 aa, Homo Sapiens
LLDMLNREY

SEQ ID NO: 581328 - protein, 9 aa, Homo Sapiens
GELIREVEP

SEQ ID NO: 581329 - protein, 9 aa, Homo Sapiens
GSGRMADVI

SEQ ID NO: 581330 - protein, 9 aa, Homo Sapiens
AEVCRPKNV

SEQ ID NO: 581331 - protein, 9 aa, Homo Sapiens
SSEAGAGLP

SEQ ID NO: 581332 - protein, 9 aa, Homo Sapiens
MNLLRQQSL

SEQ ID NO: 581333 - protein, 9 aa, Homo Sapiens
TGYFGEVLM

SEQ ID NO: 581334 - protein, 9 aa, Homo Sapiens
TDLCYLCLM

SEQ ID NO: 581335 - protein, 9 aa, Homo Sapiens
RMADVIAQV

SEQ ID NO: 581336 - protein, 9 aa, Homo Sapiens
WKESVVTLK

SEQ ID NO: 581337 - protein, 9 aa, Homo Sapiens
ARKKKMEMR

SEQ ID NO: 581338 - protein, 9 aa, Homo Sapiens
KIREHEEKI

SEQ ID NO: 581339 - protein, 9 aa, Homo Sapiens
IANEEPGAF

SEQ ID NO: 581340 - protein, 9 aa, Homo Sapiens
VSMEPFLPM

SEQ ID NO: 581341 - protein, 9 aa, Homo Sapiens
VIVDNTESI

SEQ ID NO: 581342 - protein, 9 aa, Homo Sapiens
QPSSKQELV

SEQ ID NO: 581343 - protein, 9 aa, Homo Sapiens
FLTHLTISS

SEQ ID NO: 581344 - protein, 9 aa, Homo Sapiens
LSNRCQLGL

SEQ ID NO: 581345 - protein, 9 aa, Homo Sapiens
RDTKTVKEV

SEQ ID NO: 581346 - protein, 9 aa, Homo Sapiens
NPMVIKMVV

SEQ ID NO: 581347 - protein, 9 aa, Homo Sapiens
SEEFLDQNV

SEQ ID NO: 581348 - protein, 9 aa, Homo Sapiens
NSRQIHNGK

SEQ ID NO: 581349 - protein, 9 aa, Homo Sapiens
VNRQQSNEV

SEQ ID NO: 581350 - protein, 9 aa, Homo Sapiens
TTHVMNFLR

SEQ ID NO: 581351 - protein, 9 aa, Homo Sapiens
FLEKTYTKL

SEQ ID NO: 581352 - protein, 9 aa, Homo Sapiens
LRALSGHCS

SEQ ID NO: 581353 - protein, 9 aa, Homo Sapiens
PTPWKESVV

SEQ ID NO: 581354 - protein, 9 aa, Homo Sapiens
VAEDDRELV

SEQ ID NO: 581355 - protein, 9 aa, Homo Sapiens
NAQNKNSSY

SEQ ID NO: 581356 - protein, 9 aa, Homo Sapiens
LKGGYEGFS

SEQ ID NO: 581357 - protein, 9 aa, Homo Sapiens
EEPGAFNNL

SEQ ID NO: 581358 - protein, 9 aa, Homo Sapiens
MAAQERKVT

SEQ ID NO: 581359 - protein, 9 aa, Homo Sapiens
DLLDMLNRE

SEQ ID NO: 581360 - protein, 9 aa, Homo Sapiens
RELVDSICE

SEQ ID NO: 581361 - protein, 9 aa, Homo Sapiens
LSSVHPLFG

SEQ ID NO: 581362 - protein, 9 aa, Homo Sapiens
TCQMLATSV

SEQ ID NO: 581363 - protein, 9 aa, Homo Sapiens
LSCSRSGQS

SEQ ID NO: 581364 - protein, 9 aa, Homo Sapiens
DMLNREYKR

SEQ ID NO: 581365 - protein, 9 aa, Homo Sapiens
VHVMLNGPR

SEQ ID NO: 581366 - protein, 9 aa, Homo Sapiens
EGSGRMADV

SEQ ID NO: 581367 - protein, 9 aa, Homo Sapiens
TNQCTLFCG

SEQ ID NO: 581368 - protein, 9 aa, Homo Sapiens
DRKQLRQRP

SEQ ID NO: 581369 - protein, 9 aa, Homo Sapiens
DNLLFFLGS

SEQ ID NO: 581370 - protein, 9 aa, Homo Sapiens
PLTDLCYLC

SEQ ID NO: 581371 - protein, 9 aa, Homo Sapiens
FLSNRCQLG

SEQ ID NO: 581372 - protein, 9 aa, Homo Sapiens
FSLQFCRSW

SEQ ID NO: 581373 - protein, 9 aa, Homo Sapiens
NSPVRYSIN

SEQ ID NO: 581374 - protein, 9 aa, Homo Sapiens
LEMVQIPRQ

SEQ ID NO: 581375 - protein, 9 aa, Homo Sapiens
ARRRKCAAL

SEQ ID NO: 581376 - protein, 9 aa, Homo Sapiens
DHLPLEAAD

SEQ ID NO: 581377 - protein, 9 aa, Homo Sapiens
AAQRHSVLR

SEQ ID NO: 581378 - protein, 9 aa, Homo Sapiens
EPPAAESAE

SEQ ID NO: 581379 - protein, 9 aa, Homo Sapiens
FGPLKVAME

SEQ ID NO: 581380 - protein, 9 aa, Homo Sapiens
PLFGLYGSL

SEQ ID NO: 581381 - protein, 9 aa, Homo Sapiens
DLFDRAVVQ

SEQ ID NO: 581382 - protein, 9 aa, Homo Sapiens
MAALSCSRS

SEQ ID NO: 581383 - protein, 9 aa, Homo Sapiens
KMEMRQLQR

SEQ ID NO: 581384 - protein, 9 aa, Homo Sapiens
TVYISSTLL

SEQ ID NO: 581385 - protein, 9 aa, Homo Sapiens
EKRLNISDR

SEQ ID NO: 581386 - protein, 9 aa, Homo Sapiens
NLLFFLGSS

SEQ ID NO: 581387 - protein, 9 aa, Homo Sapiens
SSVNQNFPA

SEQ ID NO: 581388 - protein, 9 aa, Homo Sapiens
CPPAHTCPR

SEQ ID NO: 581389 - protein, 9 aa, Homo Sapiens
VLRQRLERY

SEQ ID NO: 581390 - protein, 9 aa, Homo Sapiens
SCGRVPFAV

SEQ ID NO: 581391 - protein, 9 aa, Homo Sapiens
PAALGVNSY

SEQ ID NO: 581392 - protein, 9 aa, Homo Sapiens
NFSLQFCRS

SEQ ID NO: 581393 - protein, 9 aa, Homo Sapiens
VTGNPMVIK

SEQ ID NO: 581394 - protein, 9 aa, Homo Sapiens
VSDFSHPHN

SEQ ID NO: 581395 - protein, 9 aa, Homo Sapiens
NQPFLRALS

SEQ ID NO: 581396 - protein, 9 aa, Homo Sapiens
WKRDRKQLR

SEQ ID NO: 581397 - protein, 9 aa, Homo Sapiens
CAPGSSQAT

SEQ ID NO: 581398 - protein, 9 aa, Homo Sapiens
RFRIEDDFS

SEQ ID NO: 581399 - protein, 9 aa, Homo Sapiens
SNRCQLGLF

SEQ ID NO: 581400 - protein, 9 aa, Homo Sapiens
LGVNSYSPV

SEQ ID NO: 581401 - protein, 9 aa, Homo Sapiens
GCGLGEAVD

SEQ ID NO: 581402 - protein, 9 aa, Homo Sapiens
DKIPFSFSD

SEQ ID NO: 581403 - protein, 9 aa, Homo Sapiens
PPPEVTDHP

SEQ ID NO: 581404 - protein, 9 aa, Homo Sapiens
YFGEVLMAS

SEQ ID NO: 581405 - protein, 9 aa, Homo Sapiens
LLFFLGSST

SEQ ID NO: 581406 - protein, 9 aa, Homo Sapiens
HPHNLAGRR

SEQ ID NO: 581407 - protein, 9 aa, Homo Sapiens
HLPLEAADD

SEQ ID NO: 581408 - protein, 9 aa, Homo Sapiens
LNAVPFLLH

SEQ ID NO: 581409 - protein, 9 aa, Homo Sapiens
PHNLAGRRA

SEQ ID NO: 581410 - protein, 9 aa, Homo Sapiens
VTDHPKKPP

SEQ ID NO: 581411 - protein, 9 aa, Homo Sapiens
STASARQHV

SEQ ID NO: 581412 - protein, 9 aa, Homo Sapiens
PDNLLFFLG

SEQ ID NO: 581413 - protein, 9 aa, Homo Sapiens
VRYSINRNT

SEQ ID NO: 581414 - protein, 9 aa, Homo Sapiens
DEVGRDCLI

SEQ ID NO: 581415 - protein, 9 aa, Homo Sapiens
EVGRDCLIN

SEQ ID NO: 581416 - protein, 9 aa, Homo Sapiens
PSAVGNPDL

SEQ ID NO: 581417 - protein, 9 aa, Homo Sapiens
VGRDCLINA

SEQ ID NO: 581418 - protein, 9 aa, Homo Sapiens
SPVSKEYQN

SEQ ID NO: 581419 - protein, 9 aa, Homo Sapiens
MCAFGGILV

SEQ ID NO: 581420 - protein, 9 aa, Homo Sapiens
MPWRKQEQP

SEQ ID NO: 581421 - protein, 9 aa, Homo Sapiens
VTNIPHVRM

SEQ ID NO: 581422 - protein, 9 aa, Homo Sapiens
YHKVKRKIL

SEQ ID NO: 581423 - protein, 9 aa, Homo Sapiens
TPWKESVVT

SEQ ID NO: 581424 - protein, 9 aa, Homo Sapiens
RMVAIQVSW

SEQ ID NO: 581425 - protein, 9 aa, Homo Sapiens
GPGLVGFQG

SEQ ID NO: 581426 - protein, 9 aa, Homo Sapiens
PFLRALSGH

SEQ ID NO: 581427 - protein, 9 aa, Homo Sapiens
KQLRQRPGH

SEQ ID NO: 581428 - protein, 9 aa, Homo Sapiens
NKKDLLDML

SEQ ID NO: 581429 - protein, 9 aa, Homo Sapiens
CAPGAKDAF

SEQ ID NO: 581430 - protein, 9 aa, Homo Sapiens
DDRELVDSI

SEQ ID NO: 581431 - protein, 9 aa, Homo Sapiens
LQKIPIRTP

SEQ ID NO: 581432 - protein, 9 aa, Homo Sapiens
VDNTESILM

SEQ ID NO: 581433 - protein, 9 aa, Homo Sapiens
AVPFLLHIP

SEQ ID NO: 581434 - protein, 9 aa, Homo Sapiens
GPGGELIRE

SEQ ID NO: 581435 - protein, 9 aa, Homo Sapiens
ANEEPGAFN

SEQ ID NO: 581436 - protein, 9 aa, Homo Sapiens
VQIILSCGH

SEQ ID NO: 581437 - protein, 9 aa, Homo Sapiens
TTEDILEMV

SEQ ID NO: 581438 - protein, 9 aa, Homo Sapiens
WENPSPQEP

SEQ ID NO: 581439 - protein, 9 aa, Homo Sapiens
LARIALLRE

SEQ ID NO: 581440 - protein, 9 aa, Homo Sapiens
YISSTLLLL

SEQ ID NO: 581441 - protein, 9 aa, Homo Sapiens
QFHQYFQET

SEQ ID NO: 581442 - protein, 9 aa, Homo Sapiens
GRFLSNRCQ

SEQ ID NO: 581443 - protein, 9 aa, Homo Sapiens
EGPGGELIR

SEQ ID NO: 581444 - protein, 9 aa, Homo Sapiens
SFLCKACSD

SEQ ID NO: 581445 - protein, 9 aa, Homo Sapiens
SALRAFAAR

SEQ ID NO: 581446 - protein, 9 aa, Homo Sapiens
QERKVTRTI

SEQ ID NO: 581447 - protein, 9 aa, Homo Sapiens
MPSMTGMPS

SEQ ID NO: 581448 - protein, 9 aa, Homo Sapiens
TWLVVEAPG

SEQ ID NO: 581449 - protein, 9 aa, Homo Sapiens
PMVIKMVVS

SEQ ID NO: 581450 - protein, 9 aa, Homo Sapiens
WQPSSKQEL

SEQ ID NO: 581451 - protein, 9 aa, Homo Sapiens
RLDSPLPSP

SEQ ID NO: 581452 - protein, 9 aa, Homo Sapiens
HRNPSNSRQ

SEQ ID NO: 581453 - protein, 9 aa, Homo Sapiens
KKKMEMRQL

SEQ ID NO: 581454 - protein, 9 aa, Homo Sapiens
DPRINNTWS

SEQ ID NO: 581455 - protein, 9 aa, Homo Sapiens
HEEKIREQE

SEQ ID NO: 581456 - protein, 9 aa, Homo Sapiens
NFSEVGHRI

SEQ ID NO: 581457 - protein, 9 aa, Homo Sapiens
LRQRPGHTP

SEQ ID NO: 581458 - protein, 9 aa, Homo Sapiens
NCIVLAVLW

SEQ ID NO: 581459 - protein, 9 aa, Homo Sapiens
ITVNYRIGV

SEQ ID NO: 581460 - protein, 9 aa, Homo Sapiens
DQKRRIFLP

SEQ ID NO: 581461 - protein, 9 aa, Homo Sapiens
TWTAASSSA

SEQ ID NO: 581462 - protein, 9 aa, Homo Sapiens
FTTHVMNFL

SEQ ID NO: 581463 - protein, 9 aa, Homo Sapiens
SMMFLSLSQ

SEQ ID NO: 581464 - protein, 9 aa, Homo Sapiens
HLELMPSAS

SEQ ID NO: 581465 - protein, 9 aa, Homo Sapiens
VAMELITDN

SEQ ID NO: 581466 - protein, 9 aa, Homo Sapiens
WRKQEQPKR

SEQ ID NO: 581467 - protein, 9 aa, Homo Sapiens
RAPATWTAA

SEQ ID NO: 581468 - protein, 9 aa, Homo Sapiens
IIQLCGSIT

SEQ ID NO: 581469 - protein, 9 aa, Homo Sapiens
SSALTRWCS

SEQ ID NO: 581470 - protein, 9 aa, Homo Sapiens
KDYLTVLRQ

SEQ ID NO: 581471 - protein, 9 aa, Homo Sapiens
LKADAYRAQ

SEQ ID NO: 581472 - protein, 9 aa, Homo Sapiens
PGAKDAFKA

SEQ ID NO: 581473 - protein, 9 aa, Homo Sapiens
HPGRFQDSK

SEQ ID NO: 581474 - protein, 9 aa, Homo Sapiens
QKTSGILNK

SEQ ID NO: 581475 - protein, 9 aa, Homo Sapiens
LIREVEPML

SEQ ID NO: 581476 - protein, 9 aa, Homo Sapiens
KQELVITDS

SEQ ID NO: 581477 - protein, 9 aa, Homo Sapiens
NIIANEEPG

SEQ ID NO: 581478 - protein, 9 aa, Homo Sapiens
VTGKCTAAT

SEQ ID NO: 581479 - protein, 9 aa, Homo Sapiens
TCMPHDAII

SEQ ID NO: 581480 - protein, 9 aa, Homo Sapiens
QRMIAPVSA

SEQ ID NO: 581481 - protein, 9 aa, Homo Sapiens
DLKNKKDLL

SEQ ID NO: 581482 - protein, 9 aa, Homo Sapiens
PATWTAASS

SEQ ID NO: 581483 - protein, 9 aa, Homo Sapiens
IVLAVLWAC

SEQ ID NO: 581484 - protein, 9 aa, Homo Sapiens
PPEVTDHPK

SEQ ID NO: 581485 - protein, 9 aa, Homo Sapiens
EKKIREHEE

SEQ ID NO: 581486 - protein, 9 aa, Homo Sapiens
HSVLRQWAL

SEQ ID NO: 581487 - protein, 9 aa, Homo Sapiens
IYNLRNKDV

SEQ ID NO: 581488 - protein, 9 aa, Homo Sapiens
THLTISSPT

SEQ ID NO: 581489 - protein, 9 aa, Homo Sapiens
YGKCKEIGD

SEQ ID NO: 581490 - protein, 9 aa, Homo Sapiens
LCKACSDFL

SEQ ID NO: 581491 - protein, 9 aa, Homo Sapiens
LALIIQLCG

SEQ ID NO: 581492 - protein, 9 aa, Homo Sapiens
RYSINRNTD

SEQ ID NO: 581493 - protein, 9 aa, Homo Sapiens
SLTKSNCQS

SEQ ID NO: 581494 - protein, 9 aa, Homo Sapiens
PSPQEPPAA

SEQ ID NO: 581495 - protein, 9 aa, Homo Sapiens
LVGWRAPAT

SEQ ID NO: 581496 - protein, 9 aa, Homo Sapiens
AQERKVTRT

SEQ ID NO: 581497 - protein, 9 aa, Homo Sapiens
LAVLWACFY

SEQ ID NO: 581498 - protein, 9 aa, Homo Sapiens
PGSSQATFL

SEQ ID NO: 581499 - protein, 9 aa, Homo Sapiens
AALSCSRSG

SEQ ID NO: 581500 - protein, 9 aa, Homo Sapiens
DKLGQEKPT

SEQ ID NO: 581501 - protein, 9 aa, Homo Sapiens
HKVKRKILT

SEQ ID NO: 581502 - protein, 9 aa, Homo Sapiens
AVLWACFYA

SEQ ID NO: 581503 - protein, 9 aa, Homo Sapiens
RNPSNSRQI

SEQ ID NO: 581504 - protein, 9 aa, Homo Sapiens
TCPRGVPAC

SEQ ID NO: 581505 - protein, 9 aa, Homo Sapiens
ALSCSRSGQ

SEQ ID NO: 581506 - protein, 9 aa, Homo Sapiens
RIGVLGFLS

SEQ ID NO: 581507 - protein, 9 aa, Homo Sapiens
YRGEPGGPG

SEQ ID NO: 581508 - protein, 9 aa, Homo Sapiens
CHSDSGSDS

SEQ ID NO: 581509 - protein, 9 aa, Homo Sapiens
KISVMNQLD

SEQ ID NO: 581510 - protein, 9 aa, Homo Sapiens
PSNSRQIHN

SEQ ID NO: 581511 - protein, 9 aa, Homo Sapiens
VKRKILTTE

SEQ ID NO: 581512 - protein, 9 aa, Homo Sapiens
VAFPSAVGN

SEQ ID NO: 581513 - protein, 9 aa, Homo Sapiens
AHEMPKPSP

SEQ ID NO: 581514 - protein, 9 aa, Homo Sapiens
RDRKQLRQR

SEQ ID NO: 581515 - protein, 9 aa, Homo Sapiens
HVMLNGPRS

SEQ ID NO: 581516 - protein, 9 aa, Homo Sapiens
CGLGEAVDG

SEQ ID NO: 581517 - protein, 9 aa, Homo Sapiens
RRSRLPCHS

SEQ ID NO: 581518 - protein, 9 aa, Homo Sapiens
INNTWSGLL

SEQ ID NO: 581519 - protein, 9 aa, Homo Sapiens
SSTLLLLPI

SEQ ID NO: 581520 - protein, 9 aa, Homo Sapiens
RRRRSRLPC

SEQ ID NO: 581521 - protein, 9 aa, Homo Sapiens
KNLLTCMPH

SEQ ID NO: 581522 - protein, 9 aa, Homo Sapiens
PQEPPAAES

SEQ ID NO: 581523 - protein, 9 aa, Homo Sapiens
EQMLNAQNK

SEQ ID NO: 581524 - protein, 9 aa, Homo Sapiens
KKRQMAAQE

SEQ ID NO: 581525 - protein, 9 aa, Homo Sapiens
TAASSSALT

SEQ ID NO: 581526 - protein, 9 aa, Homo Sapiens
KNKISVMNQ

SEQ ID NO: 581527 - protein, 9 aa, Homo Sapiens
TIVLNSPVT

SEQ ID NO: 581528 - protein, 9 aa, Homo Sapiens
DDYLGFLTT

SEQ ID NO: 581529 - protein, 9 aa, Homo Sapiens
QEIVTGNPM

SEQ ID NO: 581530 - protein, 9 aa, Homo Sapiens
TSFCVAFPS

SEQ ID NO: 581531 - protein, 9 aa, Homo Sapiens
SWKRLVGWR

SEQ ID NO: 581532 - protein, 9 aa, Homo Sapiens
TNHRNPSNS

SEQ ID NO: 581533 - protein, 9 aa, Homo Sapiens
KSLTKSNCQ

SEQ ID NO: 581534 - protein, 9 aa, Homo Sapiens
LNGPRSKIF

SEQ ID NO: 581535 - protein, 9 aa, Homo Sapiens
SGRMADVIA

SEQ ID NO: 581536 - protein, 9 aa, Homo Sapiens
SSKQELVIT

SEQ ID NO: 581537 - protein, 9 aa, Homo Sapiens
PPAAESAEP

SEQ ID NO: 581538 - protein, 9 aa, Homo Sapiens
KCKEIGDDK

SEQ ID NO: 581539 - protein, 9 aa, Homo Sapiens
RVPFAVYHM

SEQ ID NO: 581540 - protein, 9 aa, Homo Sapiens
QLALIIQLC

SEQ ID NO: 581541 - protein, 9 aa, Homo Sapiens
WRAPATWTA

SEQ ID NO: 581542 - protein, 9 aa, Homo Sapiens
NSYSPVPTQ

SEQ ID NO: 581543 - protein, 9 aa, Homo Sapiens
DNTESILMS

SEQ ID NO: 581544 - protein, 9 aa, Homo Sapiens
SSWKRLVGW

SEQ ID NO: 581545 - protein, 9 aa, Homo Sapiens
KKIREHEEK

SEQ ID NO: 581546 - protein, 9 aa, Homo Sapiens
GVIVDNTES

SEQ ID NO: 581547 - protein, 9 aa, Homo Sapiens
LEAADDAKK

SEQ ID NO: 581548 - protein, 9 aa, Homo Sapiens
VNQNFPAST

SEQ ID NO: 581549 - protein, 9 aa, Homo Sapiens
DKNCAPGAK

SEQ ID NO: 581550 - protein, 9 aa, Homo Sapiens
KTYTKLKLQ

SEQ ID NO: 581551 - protein, 9 aa, Homo Sapiens
KKMEMRQLQ

SEQ ID NO: 581552 - protein, 9 aa, Homo Sapiens
SYSPVPTQP

SEQ ID NO: 581553 - protein, 9 aa, Homo Sapiens
TTWTGYFGE

SEQ ID NO: 581554 - protein, 9 aa, Homo Sapiens
IRTPQRMIA

SEQ ID NO: 581555 - protein, 9 aa, Homo Sapiens
CTGLKADAY

SEQ ID NO: 581556 - protein, 9 aa, Homo Sapiens
GWRAPATWT

SEQ ID NO: 581557 - protein, 9 aa, Homo Sapiens
IREHEEKIR

SEQ ID NO: 581558 - protein, 9 aa, Homo Sapiens
LEGWEKRLN

SEQ ID NO: 581559 - protein, 9 aa, Homo Sapiens
SSVRLTWEA

SEQ ID NO: 581560 - protein, 9 aa, Homo Sapiens
VRFGALKYT

SEQ ID NO: 581561 - protein, 9 aa, Homo Sapiens
FLREQSRTR

SEQ ID NO: 581562 - protein, 9 aa, Homo Sapiens
SDNIIANEE

SEQ ID NO: 581563 - protein, 9 aa, Homo Sapiens
IVNTDEVGR

SEQ ID NO: 581564 - protein, 9 aa, Homo Sapiens
PNVCYHKVK

SEQ ID NO: 581565 - protein, 9 aa, Homo Sapiens
TDEVGRDCL

SEQ ID NO: 581566 - protein, 9 aa, Homo Sapiens
CTALARIAL

SEQ ID NO: 581567 - protein, 9 aa, Homo Sapiens
LTTFGPCYI

SEQ ID NO: 581568 - protein, 9 aa, Homo Sapiens
SLNCTMRRS

SEQ ID NO: 581569 - protein, 9 aa, Homo Sapiens
GKCKEIGDD

SEQ ID NO: 581570 - protein, 9 aa, Homo Sapiens
QITDLVRPE

SEQ ID NO: 581571 - protein, 9 aa, Homo Sapiens
GILNKFCSA

SEQ ID NO: 581572 - protein, 9 aa, Homo Sapiens
VPLMMAALS

SEQ ID NO: 581573 - protein, 9 aa, Homo Sapiens
FPSAVGNPD

SEQ ID NO: 581574 - protein, 9 aa, Homo Sapiens
GGRFLSNRC

SEQ ID NO: 581575 - protein, 9 aa, Homo Sapiens
APGSSQATF

SEQ ID NO: 581576 - protein, 9 aa, Homo Sapiens
RQQSNEVTL

SEQ ID NO: 581577 - protein, 9 aa, Homo Sapiens
LTKSNCQSR

SEQ ID NO: 581578 - protein, 9 aa, Homo Sapiens
WWPAEVCRP

SEQ ID NO: 581579 - protein, 9 aa, Homo Sapiens
NLRNKDVKV

SEQ ID NO: 581580 - protein, 9 aa, Homo Sapiens
ITSSCGRVP

SEQ ID NO: 581581 - protein, 9 aa, Homo Sapiens
NLIVNTDEV

SEQ ID NO: 581582 - protein, 9 aa, Homo Sapiens
PHVRMVAIQ

SEQ ID NO: 581583 - protein, 9 aa, Homo Sapiens
MNFLREQSR

SEQ ID NO: 581584 - protein, 9 aa, Homo Sapiens
PWRKQEQPK

SEQ ID NO: 581585 - protein, 9 aa, Homo Sapiens
IALLRETNR

SEQ ID NO: 581586 - protein, 9 aa, Homo Sapiens
PICGSDVKT

SEQ ID NO: 581587 - protein, 9 aa, Homo Sapiens
FRIEDDFSL

SEQ ID NO: 581588 - protein, 9 aa, Homo Sapiens
SSMMFLSLS

SEQ ID NO: 581589 - protein, 9 aa, Homo Sapiens
EPVYFAEEV

SEQ ID NO: 581590 - protein, 9 aa, Homo Sapiens
RHSVLRQWA

SEQ ID NO: 581591 - protein, 9 aa, Homo Sapiens
QAEDHPRIL

SEQ ID NO: 581592 - protein, 9 aa, Homo Sapiens
RRVAAQRHS

SEQ ID NO: 581593 - protein, 9 aa, Homo Sapiens
NAVPFLLHI

SEQ ID NO: 581594 - protein, 9 aa, Homo Sapiens
MPSSLNCTM

SEQ ID NO: 581595 - protein, 9 aa, Homo Sapiens
ILVPLMMAA

SEQ ID NO: 581596 - protein, 9 aa, Homo Sapiens
RLSPVSKEY

SEQ ID NO: 581597 - protein, 9 aa, Homo Sapiens
GEPGGPGLV

SEQ ID NO: 581598 - protein, 9 aa, Homo Sapiens
LDDVAEDDR

SEQ ID NO: 581599 - protein, 9 aa, Homo Sapiens
HLSERQNSS

SEQ ID NO: 581600 - protein, 9 aa, Homo Sapiens
LHLSERQNS

SEQ ID NO: 581601 - protein, 9 aa, Homo Sapiens
FLCKACSDF

SEQ ID NO: 581602 - protein, 9 aa, Homo Sapiens
RIVVLHHGD

SEQ ID NO: 581603 - protein, 9 aa, Homo Sapiens
HPRILQKIP

SEQ ID NO: 581604 - protein, 9 aa, Homo Sapiens
TNIQNYLSH

SEQ ID NO: 581605 - protein, 9 aa, Homo Sapiens
WTGYFGEVL

SEQ ID NO: 581606 - protein, 9 aa, Homo Sapiens
PQQLSRSCL

SEQ ID NO: 581607 - protein, 9 aa, Homo Sapiens
DVGRVQMTA

SEQ ID NO: 581608 - protein, 9 aa, Homo Sapiens
IRGWKLFHN

SEQ ID NO: 581609 - protein, 9 aa, Homo Sapiens
ARLPVAARD

SEQ ID NO: 581610 - protein, 9 aa, Homo Sapiens
DMAQQRLVN

SEQ ID NO: 581611 - protein, 9 aa, Homo Sapiens
TQVKIWFQY

SEQ ID NO: 581612 - protein, 9 aa, Homo Sapiens
NLTSGEIVF

SEQ ID NO: 581613 - protein, 9 aa, Homo Sapiens
QNSPVNVNP

SEQ ID NO: 581614 - protein, 9 aa, Homo Sapiens
LDNLYQQKI

SEQ ID NO: 581615 - protein, 9 aa, Homo Sapiens
KKERELLHL

SEQ ID NO: 581616 - protein, 9 aa, Homo Sapiens
FWDCTICSI

SEQ ID NO: 581617 - protein, 9 aa, Homo Sapiens
LVLVGSPSR

SEQ ID NO: 581618 - protein, 9 aa, Homo Sapiens
YYSLYALYG

SEQ ID NO: 581619 - protein, 9 aa, Homo Sapiens
YTGSSGCCE

SEQ ID NO: 581620 - protein, 9 aa, Homo Sapiens
NHPNILPYR

SEQ ID NO: 581621 - protein, 9 aa, Homo Sapiens
DTCQHYVIS

SEQ ID NO: 581622 - protein, 9 aa, Homo Sapiens
KHILAKNYI

SEQ ID NO: 581623 - protein, 9 aa, Homo Sapiens
LVVDESVVR

SEQ ID NO: 581624 - protein, 9 aa, Homo Sapiens
QNLSDLCRW

SEQ ID NO: 581625 - protein, 9 aa, Homo Sapiens
QAPLVLCNG

SEQ ID NO: 581626 - protein, 9 aa, Homo Sapiens
EEWDFWDCT

SEQ ID NO: 581627 - protein, 9 aa, Homo Sapiens
DICAGNGIL

SEQ ID NO: 581628 - protein, 9 aa, Homo Sapiens
LLLPSQSSK

SEQ ID NO: 581629 - protein, 9 aa, Homo Sapiens
SPATAGLVP

SEQ ID NO: 581630 - protein, 9 aa, Homo Sapiens
CYTGSSGCC

SEQ ID NO: 581631 - protein, 9 aa, Homo Sapiens
IVYFRALVN

SEQ ID NO: 581632 - protein, 9 aa, Homo Sapiens
LTLLHLYKC

SEQ ID NO: 581633 - protein, 9 aa, Homo Sapiens
VGRVQMTAA

SEQ ID NO: 581634 - protein, 9 aa, Homo Sapiens
PLVLCNGEA

SEQ ID NO: 581635 - protein, 9 aa, Homo Sapiens
PDLLYGQPA

SEQ ID NO: 581636 - protein, 9 aa, Homo Sapiens
TVVIALFTE

SEQ ID NO: 581637 - protein, 9 aa, Homo Sapiens
PVAARDFIC

SEQ ID NO: 581638 - protein, 9 aa, Homo Sapiens
EQINSTGIL

SEQ ID NO: 581639 - protein, 9 aa, Homo Sapiens
GQSSVLGIH

SEQ ID NO: 581640 - protein, 9 aa, Homo Sapiens
TLLVDGFLN

SEQ ID NO: 581641 - protein, 9 aa, Homo Sapiens
SQAFHNVRI

SEQ ID NO: 581642 - protein, 9 aa, Homo Sapiens
AQGSPFCSI

SEQ ID NO: 581643 - protein, 9 aa, Homo Sapiens
LLHLLQTAH

SEQ ID NO: 581644 - protein, 9 aa, Homo Sapiens
QQLSRSCLT

SEQ ID NO: 581645 - protein, 9 aa, Homo Sapiens
IRATACHGS

SEQ ID NO: 581646 - protein, 9 aa, Homo Sapiens
KERELLHLL

SEQ ID NO: 581647 - protein, 9 aa, Homo Sapiens
GQHPPCWLE

SEQ ID NO: 581648 - protein, 9 aa, Homo Sapiens
VQKLDNLYQ

SEQ ID NO: 581649 - protein, 9 aa, Homo Sapiens
STGILSSQN

SEQ ID NO: 581650 - protein, 9 aa, Homo Sapiens
VSEPDTCQH

SEQ ID NO: 581651 - protein, 9 aa, Homo Sapiens
QTFEEWDFW

SEQ ID NO: 581652 - protein, 9 aa, Homo Sapiens
ESLILFHNP

SEQ ID NO: 581653 - protein, 9 aa, Homo Sapiens
HLLQTAHAD

SEQ ID NO: 581654 - protein, 9 aa, Homo Sapiens
FLVGAFCMP

SEQ ID NO: 581655 - protein, 9 aa, Homo Sapiens
GPSSGHALR

SEQ ID NO: 581656 - protein, 9 aa, Homo Sapiens
TGILSSQNF

SEQ ID NO: 581657 - protein, 9 aa, Homo Sapiens
LVEDKETGN

SEQ ID NO: 581658 - protein, 9 aa, Homo Sapiens
QRGYGARGC

SEQ ID NO: 581659 - protein, 9 aa, Homo Sapiens
CMPLYVPYV

SEQ ID NO: 581660 - protein, 9 aa, Homo Sapiens
DCAYRKRPR

SEQ ID NO: 581661 - protein, 9 aa, Homo Sapiens
EGWATLLVD

SEQ ID NO: 581662 - protein, 9 aa, Homo Sapiens
DFQIVYFRA

SEQ ID NO: 581663 - protein, 9 aa, Homo Sapiens
FCECQRSNK

SEQ ID NO: 581664 - protein, 9 aa, Homo Sapiens
CNGEAPDFS

SEQ ID NO: 581665 - protein, 9 aa, Homo Sapiens
SPVNVNPPP

SEQ ID NO: 581666 - protein, 9 aa, Homo Sapiens
PRGSTPKQS

SEQ ID NO: 581667 - protein, 9 aa, Homo Sapiens
PDTCQHYVI

SEQ ID NO: 581668 - protein, 9 aa, Homo Sapiens
DLCRWLQAQ

SEQ ID NO: 581669 - protein, 9 aa, Homo Sapiens
QGDDLKQTF

SEQ ID NO: 581670 - protein, 9 aa, Homo Sapiens
EEEMKLGEG

SEQ ID NO: 581671 - protein, 9 aa, Homo Sapiens
ETEVVLITN

SEQ ID NO: 581672 - protein, 9 aa, Homo Sapiens
ATLLVDGFL

SEQ ID NO: 581673 - protein, 9 aa, Homo Sapiens
CPYGTTGVN

SEQ ID NO: 581674 - protein, 9 aa, Homo Sapiens
VEEEEMKLG

SEQ ID NO: 581675 - protein, 9 aa, Homo Sapiens
WLCLGQHPP

SEQ ID NO: 581676 - protein, 9 aa, Homo Sapiens
LYGQPADYL

SEQ ID NO: 581677 - protein, 9 aa, Homo Sapiens
KWDICAGNG

SEQ ID NO: 581678 - protein, 9 aa, Homo Sapiens
NVRIIPPGS

SEQ ID NO: 581679 - protein, 9 aa, Homo Sapiens
RGWKLFHNY

SEQ ID NO: 581680 - protein, 9 aa, Homo Sapiens
YFTIAGHQA

SEQ ID NO: 581681 - protein, 9 aa, Homo Sapiens
ATLPAHPST

SEQ ID NO: 581682 - protein, 9 aa, Homo Sapiens
SDLCRWLQA

SEQ ID NO: 581683 - protein, 9 aa, Homo Sapiens
GEIVFLLEK

SEQ ID NO: 581684 - protein, 9 aa, Homo Sapiens
DPQTKPTSM

SEQ ID NO: 581685 - protein, 9 aa, Homo Sapiens
VLGIHARTH

SEQ ID NO: 581686 - protein, 9 aa, Homo Sapiens
VAQSWHMEN

SEQ ID NO: 581687 - protein, 9 aa, Homo Sapiens
TPERQEAAG

SEQ ID NO: 581688 - protein, 9 aa, Homo Sapiens
LHLLQTAHA

SEQ ID NO: 581689 - protein, 9 aa, Homo Sapiens
NSHGNVQAA

SEQ ID NO: 581690 - protein, 9 aa, Homo Sapiens
VIRTSGPSS

SEQ ID NO: 581691 - protein, 9 aa, Homo Sapiens
LEEDTIHKW

SEQ ID NO: 581692 - protein, 9 aa, Homo Sapiens
QRLVQNCLC

SEQ ID NO: 581693 - protein, 9 aa, Homo Sapiens
DEMPKRRLH

SEQ ID NO: 581694 - protein, 9 aa, Homo Sapiens
RFLVALISC

SEQ ID NO: 581695 - protein, 9 aa, Homo Sapiens
QDCAYRKRP

SEQ ID NO: 581696 - protein, 9 aa, Homo Sapiens
TFEEWDFWD

SEQ ID NO: 581697 - protein, 9 aa, Homo Sapiens
CSINIPEPV

SEQ ID NO: 581698 - protein, 9 aa, Homo Sapiens
LVQNCLCTL

SEQ ID NO: 581699 - protein, 9 aa, Homo Sapiens
TDMGTFFEL

SEQ ID NO: 581700 - protein, 9 aa, Homo Sapiens
VSELCKTIS

SEQ ID NO: 581701 - protein, 9 aa, Homo Sapiens
LLSFSETCY

SEQ ID NO: 581702 - protein, 9 aa, Homo Sapiens
SLILFHNPE

SEQ ID NO: 581703 - protein, 9 aa, Homo Sapiens
TLTAFTLKQ

SEQ ID NO: 581704 - protein, 9 aa, Homo Sapiens
LPVAARDFI

SEQ ID NO: 581705 - protein, 9 aa, Homo Sapiens
SRWNRKPDI

SEQ ID NO: 581706 - protein, 9 aa, Homo Sapiens
DDLKQTFEE

SEQ ID NO: 581707 - protein, 9 aa, Homo Sapiens
CGPCSEKRL

SEQ ID NO: 581708 - protein, 9 aa, Homo Sapiens
AQQRLVNEV

SEQ ID NO: 581709 - protein, 9 aa, Homo Sapiens
CRSRHRAGM

SEQ ID NO: 581710 - protein, 9 aa, Homo Sapiens
LGLKICGVL

SEQ ID NO: 581711 - protein, 9 aa, Homo Sapiens
WHMENHFWD

SEQ ID NO: 581712 - protein, 9 aa, Homo Sapiens
QVKIWFQYK

SEQ ID NO: 581713 - protein, 9 aa, Homo Sapiens
SEPDTCQHY

SEQ ID NO: 581714 - protein, 9 aa, Homo Sapiens
VSLPSNLEK

SEQ ID NO: 581715 - protein, 9 aa, Homo Sapiens
AGDTPERQE

SEQ ID NO: 581716 - protein, 9 aa, Homo Sapiens
LLLEQRTTS

SEQ ID NO: 581717 - protein, 9 aa, Homo Sapiens
WFMAQDCAY

SEQ ID NO: 581718 - protein, 9 aa, Homo Sapiens
YTILTHMLN

SEQ ID NO: 581719 - protein, 9 aa, Homo Sapiens
MKKMDPSTF

SEQ ID NO: 581720 - protein, 9 aa, Homo Sapiens
ARSGLNLNR

SEQ ID NO: 581721 - protein, 9 aa, Homo Sapiens
RGYGARGCE

SEQ ID NO: 581722 - protein, 9 aa, Homo Sapiens
DGDLESLIL

SEQ ID NO: 581723 - protein, 9 aa, Homo Sapiens
SLTSDETMC

SEQ ID NO: 581724 - protein, 9 aa, Homo Sapiens
VGGLLSHSL

SEQ ID NO: 581725 - protein, 9 aa, Homo Sapiens
IYASDVGRV

SEQ ID NO: 581726 - protein, 9 aa, Homo Sapiens
HTTDFYFTI

SEQ ID NO: 581727 - protein, 9 aa, Homo Sapiens
NSPVNVNPP

SEQ ID NO: 581728 - protein, 9 aa, Homo Sapiens
PHYKEYYCL

SEQ ID NO: 581729 - protein, 9 aa, Homo Sapiens
QHSWMAAGP

SEQ ID NO: 581730 - protein, 9 aa, Homo Sapiens
GWKLFHNYA

SEQ ID NO: 581731 - protein, 9 aa, Homo Sapiens
NPQHSWMAA

SEQ ID NO: 581732 - protein, 9 aa, Homo Sapiens
KLGEGLSSQ

SEQ ID NO: 581733 - protein, 9 aa, Homo Sapiens
QIVYFRALV

SEQ ID NO: 581734 - protein, 9 aa, Homo Sapiens
HMENHFWDG

SEQ ID NO: 581735 - protein, 9 aa, Homo Sapiens
CSLGEHVHA

SEQ ID NO: 581736 - protein, 9 aa, Homo Sapiens
RWKLPSLTS

SEQ ID NO: 581737 - protein, 9 aa, Homo Sapiens
LFFSLNTIR

SEQ ID NO: 581738 - protein, 9 aa, Homo Sapiens
PLVLVGSPS

SEQ ID NO: 581739 - protein, 9 aa, Homo Sapiens
IVSLPSNLE

SEQ ID NO: 581740 - protein, 9 aa, Homo Sapiens
MDPSTFAST

SEQ ID NO: 581741 - protein, 9 aa, Homo Sapiens
KGMPQQLSR

SEQ ID NO: 581742 - protein, 9 aa, Homo Sapiens
CLFIIPLEG

SEQ ID NO: 581743 - protein, 9 aa, Homo Sapiens
LNKYDSRIS

SEQ ID NO: 581744 - protein, 9 aa, Homo Sapiens
SHSLDYCFV

SEQ ID NO: 581745 - protein, 9 aa, Homo Sapiens
SEKRLLLPS

SEQ ID NO: 581746 - protein, 9 aa, Homo Sapiens
SMKHFSEAF

SEQ ID NO: 581747 - protein, 9 aa, Homo Sapiens
SGTPDCDPN

SEQ ID NO: 581748 - protein, 9 aa, Homo Sapiens
ANNSHGNVQ

SEQ ID NO: 581749 - protein, 9 aa, Homo Sapiens
YDSRISFLS

SEQ ID NO: 581750 - protein, 9 aa, Homo Sapiens
GEDPSRAVG

SEQ ID NO: 581751 - protein, 9 aa, Homo Sapiens
MYLFLSLLS

SEQ ID NO: 581752 - protein, 9 aa, Homo Sapiens
GQDYCTLTA

SEQ ID NO: 581753 - protein, 9 aa, Homo Sapiens
QILNKYDSR

SEQ ID NO: 581754 - protein, 9 aa, Homo Sapiens
DETDSPRQL

SEQ ID NO: 581755 - protein, 9 aa, Homo Sapiens
TTKRGEPHE

SEQ ID NO: 581756 - protein, 9 aa, Homo Sapiens
ELLHLLHAA

SEQ ID NO: 581757 - protein, 9 aa, Homo Sapiens
HVHASDSSD

SEQ ID NO: 581758 - protein, 9 aa, Homo Sapiens
WLETTFCEC

SEQ ID NO: 581759 - protein, 9 aa, Homo Sapiens
SFELTREPC

SEQ ID NO: 581760 - protein, 9 aa, Homo Sapiens
SCLTLFIRN

SEQ ID NO: 581761 - protein, 9 aa, Homo Sapiens
LGIHARTHL

SEQ ID NO: 581762 - protein, 9 aa, Homo Sapiens
FLETVHVYL

SEQ ID NO: 581763 - protein, 9 aa, Homo Sapiens
NNSHGNVQA

SEQ ID NO: 581764 - protein, 9 aa, Homo Sapiens
LESLILFHN

SEQ ID NO: 581765 - protein, 9 aa, Homo Sapiens
DRMCDPQTK

SEQ ID NO: 581766 - protein, 9 aa, Homo Sapiens
SIVSLPSNL

SEQ ID NO: 581767 - protein, 9 aa, Homo Sapiens
GNGILKALG

SEQ ID NO: 581768 - protein, 9 aa, Homo Sapiens
SLRGESPLA

SEQ ID NO: 581769 - protein, 9 aa, Homo Sapiens
VLITNVCLP

SEQ ID NO: 581770 - protein, 9 aa, Homo Sapiens
QPLHYSTIM

SEQ ID NO: 581771 - protein, 9 aa, Homo Sapiens
AATLPAHPS

SEQ ID NO: 581772 - protein, 9 aa, Homo Sapiens
SSGHALRIL

SEQ ID NO: 581773 - protein, 9 aa, Homo Sapiens
EEEEMKLGE

SEQ ID NO: 581774 - protein, 9 aa, Homo Sapiens
EPHELRNIF

SEQ ID NO: 581775 - protein, 9 aa, Homo Sapiens
PCWLETTFC

SEQ ID NO: 581776 - protein, 9 aa, Homo Sapiens
RRLHALANK

SEQ ID NO: 581777 - protein, 9 aa, Homo Sapiens
HDQLGPKIN

SEQ ID NO: 581778 - protein, 9 aa, Homo Sapiens
VQNCLCTLR

SEQ ID NO: 581779 - protein, 9 aa, Homo Sapiens
CLAVDALAE

SEQ ID NO: 581780 - protein, 9 aa, Homo Sapiens
RISFLSSVR

SEQ ID NO: 581781 - protein, 9 aa, Homo Sapiens
RKPDIQSLG

SEQ ID NO: 581782 - protein, 9 aa, Homo Sapiens
PGSQRSTKP

SEQ ID NO: 581783 - protein, 9 aa, Homo Sapiens
AVIRTSGPS

SEQ ID NO: 581784 - protein, 9 aa, Homo Sapiens
PFGALSIVS

SEQ ID NO: 581785 - protein, 9 aa, Homo Sapiens
KEYYCLAVD

SEQ ID NO: 581786 - protein, 9 aa, Homo Sapiens
NITNKTGFH

SEQ ID NO: 581787 - protein, 9 aa, Homo Sapiens
LVAENAESR

SEQ ID NO: 581788 - protein, 9 aa, Homo Sapiens
FYSITLFTY

SEQ ID NO: 581789 - protein, 9 aa, Homo Sapiens
LFTEFASNT

SEQ ID NO: 581790 - protein, 9 aa, Homo Sapiens
TGNGRALVH

SEQ ID NO: 581791 - protein, 9 aa, Homo Sapiens
KVQTTKRGE

SEQ ID NO: 581792 - protein, 9 aa, Homo Sapiens
QTTKRGEPH

SEQ ID NO: 581793 - protein, 9 aa, Homo Sapiens
LETVHVYLR

SEQ ID NO: 581794 - protein, 9 aa, Homo Sapiens
LEGCGFVSF

SEQ ID NO: 581795 - protein, 9 aa, Homo Sapiens
SCRSRHRAG

SEQ ID NO: 581796 - protein, 9 aa, Homo Sapiens
KCQLLLEQR

SEQ ID NO: 581797 - protein, 9 aa, Homo Sapiens
ERELLHLLH

SEQ ID NO: 581798 - protein, 9 aa, Homo Sapiens
FVLATEHNR

SEQ ID NO: 581799 - protein, 9 aa, Homo Sapiens
LVDGFLNAS

SEQ ID NO: 581800 - protein, 9 aa, Homo Sapiens
LGQHPPCWL

SEQ ID NO: 581801 - protein, 9 aa, Homo Sapiens
VLQRTNSLE

SEQ ID NO: 581802 - protein, 9 aa, Homo Sapiens
KLGLKICGV

SEQ ID NO: 581803 - protein, 9 aa, Homo Sapiens
GILKALGGH

SEQ ID NO: 581804 - protein, 9 aa, Homo Sapiens
LGSGDFQIV

SEQ ID NO: 581805 - protein, 9 aa, Homo Sapiens
INPQHSWMA

SEQ ID NO: 581806 - protein, 9 aa, Homo Sapiens
QLSRSCLTL

SEQ ID NO: 581807 - protein, 9 aa, Homo Sapiens
HNVRIIPPG

SEQ ID NO: 581808 - protein, 9 aa, Homo Sapiens
QSWHMENHF

SEQ ID NO: 581809 - protein, 9 aa, Homo Sapiens
NRIYHDQLG

SEQ ID NO: 581810 - protein, 9 aa, Homo Sapiens
GSPATAGLV

SEQ ID NO: 581811 - protein, 9 aa, Homo Sapiens
FQGDDLKQT

SEQ ID NO: 581812 - protein, 9 aa, Homo Sapiens
QVSTDEAEA

SEQ ID NO: 581813 - protein, 9 aa, Homo Sapiens
YCLAVDALA

SEQ ID NO: 581814 - protein, 9 aa, Homo Sapiens
FHYCSESWL

SEQ ID NO: 581815 - protein, 9 aa, Homo Sapiens
YSLYALYGQ

SEQ ID NO: 581816 - protein, 9 aa, Homo Sapiens
VVILFYSIT

SEQ ID NO: 581817 - protein, 9 aa, Homo Sapiens
ATACHGSAK

SEQ ID NO: 581818 - protein, 9 aa, Homo Sapiens
RNAGISLKK

SEQ ID NO: 581819 - protein, 9 aa, Homo Sapiens
ILNKYDSRI

SEQ ID NO: 581820 - protein, 9 aa, Homo Sapiens
YKEYYCLAV

SEQ ID NO: 581821 - protein, 9 aa, Homo Sapiens
FIIPLEGCG

SEQ ID NO: 581822 - protein, 9 aa, Homo Sapiens
FTIAGHQAM

SEQ ID NO: 581823 - protein, 9 aa, Homo Sapiens
LPVTFVGNL

SEQ ID NO: 581824 - protein, 9 aa, Homo Sapiens
SISRKGMPQ

SEQ ID NO: 581825 - protein, 9 aa, Homo Sapiens
LTGRHRGRR

SEQ ID NO: 581826 - protein, 9 aa, Homo Sapiens
LFIRNAGIS

SEQ ID NO: 581827 - protein, 9 aa, Homo Sapiens
LVALISCRS

SEQ ID NO: 581828 - protein, 9 aa, Homo Sapiens
GALSIVSLP

SEQ ID NO: 581829 - protein, 9 aa, Homo Sapiens
DLGSGDFQI

SEQ ID NO: 581830 - protein, 9 aa, Homo Sapiens
LCRWLQAQK

SEQ ID NO: 581831 - protein, 9 aa, Homo Sapiens
GGLLSHSLD

SEQ ID NO: 581832 - protein, 9 aa, Homo Sapiens
GAAAATLPA

SEQ ID NO: 581833 - protein, 9 aa, Homo Sapiens
GPEQQVSTD

SEQ ID NO: 581834 - protein, 9 aa, Homo Sapiens
HALANKGIF

SEQ ID NO: 581835 - protein, 9 aa, Homo Sapiens
WDFWDCTIC

SEQ ID NO: 581836 - protein, 9 aa, Homo Sapiens
KETGNGRAL

SEQ ID NO: 581837 - protein, 9 aa, Homo Sapiens
RATACHGSA

SEQ ID NO: 581838 - protein, 9 aa, Homo Sapiens
AAGPLLDIK

SEQ ID NO: 581839 - protein, 9 aa, Homo Sapiens
FHNVRIIPP

SEQ ID NO: 581840 - protein, 9 aa, Homo Sapiens
AALLLGEVL

SEQ ID NO: 581841 - protein, 9 aa, Homo Sapiens
VLLHLLQTA

SEQ ID NO: 581842 - protein, 9 aa, Homo Sapiens
EMKLGEGLS

SEQ ID NO: 581843 - protein, 9 aa, Homo Sapiens
IRNAGISLK

SEQ ID NO: 581844 - protein, 9 aa, Homo Sapiens
LLVVDESVV

SEQ ID NO: 581845 - protein, 9 aa, Homo Sapiens
MKLGEGLSS

SEQ ID NO: 581846 - protein, 9 aa, Homo Sapiens
TSGEIVFLL

SEQ ID NO: 581847 - protein, 9 aa, Homo Sapiens
GGGVAMGVY

SEQ ID NO: 581848 - protein, 9 aa, Homo Sapiens
LLLGEVLLV

SEQ ID NO: 581849 - protein, 9 aa, Homo Sapiens
VEDKETGNG

SEQ ID NO: 581850 - protein, 9 aa, Homo Sapiens
EIQLVAENA

SEQ ID NO: 581851 - protein, 9 aa, Homo Sapiens
RGESPLALL

SEQ ID NO: 581852 - protein, 9 aa, Homo Sapiens
LNLNRYSTS

SEQ ID NO: 581853 - protein, 9 aa, Homo Sapiens
QYKRSKFKK

SEQ ID NO: 581854 - protein, 9 aa, Homo Sapiens
MCDPQTKPT

SEQ ID NO: 581855 - protein, 9 aa, Homo Sapiens
GPCSEKRLL

SEQ ID NO: 581856 - protein, 9 aa, Homo Sapiens
LALFFSLNT

SEQ ID NO: 581857 - protein, 9 aa, Homo Sapiens
FASTGSVQW

SEQ ID NO: 581858 - protein, 9 aa, Homo Sapiens
CDQNLSDLC

SEQ ID NO: 581859 - protein, 9 aa, Homo Sapiens
GLVPGMSLS

SEQ ID NO: 581860 - protein, 9 aa, Homo Sapiens
CHANNSHGN

SEQ ID NO: 581861 - protein, 9 aa, Homo Sapiens
LCLGQHPPC

SEQ ID NO: 581862 - protein, 9 aa, Homo Sapiens
DPSRAVGHH

SEQ ID NO: 581863 - protein, 9 aa, Homo Sapiens
LCTLRNLSD

SEQ ID NO: 581864 - protein, 9 aa, Homo Sapiens
RMCDPQTKP

SEQ ID NO: 581865 - protein, 9 aa, Homo Sapiens
FEEWDFWDC

SEQ ID NO: 581866 - protein, 9 aa, Homo Sapiens
GSQRSTKPS

SEQ ID NO: 581867 - protein, 9 aa, Homo Sapiens
QTKPTSMQT

SEQ ID NO: 581868 - protein, 9 aa, Homo Sapiens
YGARGCETQ

SEQ ID NO: 581869 - protein, 9 aa, Homo Sapiens
YYCLAVDAL

SEQ ID NO: 581870 - protein, 9 aa, Homo Sapiens
IRERLLPVT

SEQ ID NO: 581871 - protein, 9 aa, Homo Sapiens
VKIWFQYKR

SEQ ID NO: 581872 - protein, 9 aa, Homo Sapiens
QLLLEQRTT

SEQ ID NO: 581873 - protein, 9 aa, Homo Sapiens
FELTREPCI

SEQ ID NO: 581874 - protein, 9 aa, Homo Sapiens
CARLPVAAR

SEQ ID NO: 581875 - protein, 9 aa, Homo Sapiens
KRPVLLHLL

SEQ ID NO: 581876 - protein, 9 aa, Homo Sapiens
IALFTEFAS

SEQ ID NO: 581877 - protein, 9 aa, Homo Sapiens
MLFNLFLQA

SEQ ID NO: 581878 - protein, 9 aa, Homo Sapiens
RRVVFLKQL

SEQ ID NO: 581879 - protein, 9 aa, Homo Sapiens
AFHNVRIIP

SEQ ID NO: 581880 - protein, 9 aa, Homo Sapiens
FNLFLQALF

SEQ ID NO: 581881 - protein, 9 aa, Homo Sapiens
LGPKINTSK

SEQ ID NO: 581882 - protein, 9 aa, Homo Sapiens
GPKINTSKK

SEQ ID NO: 581883 - protein, 9 aa, Homo Sapiens
LALLLGHLL

SEQ ID NO: 581884 - protein, 9 aa, Homo Sapiens
SPLALLLGH

SEQ ID NO: 581885 - protein, 9 aa, Homo Sapiens
EIVFLLEKI

SEQ ID NO: 581886 - protein, 9 aa, Homo Sapiens
RDMAQQRLV

SEQ ID NO: 581887 - protein, 9 aa, Homo Sapiens
TNVCLPPEM

SEQ ID NO: 581888 - protein, 9 aa, Homo Sapiens
TIHKWEVTV

SEQ ID NO: 581889 - protein, 9 aa, Homo Sapiens
DAPRASSLP

SEQ ID NO: 581890 - protein, 9 aa, Homo Sapiens
QLLLVLVKD

SEQ ID NO: 581891 - protein, 9 aa, Homo Sapiens
SRFCQSDGT

SEQ ID NO: 581892 - protein, 9 aa, Homo Sapiens
NSTGILSSQ

SEQ ID NO: 581893 - protein, 9 aa, Homo Sapiens
PPCWLETTF

SEQ ID NO: 581894 - protein, 9 aa, Homo Sapiens
LTHMLNPII

SEQ ID NO: 581895 - protein, 9 aa, Homo Sapiens
LSIVSLPSN

SEQ ID NO: 581896 - protein, 9 aa, Homo Sapiens
KLPSLTSDE

SEQ ID NO: 581897 - protein, 9 aa, Homo Sapiens
FIRNAGISL

SEQ ID NO: 581898 - protein, 9 aa, Homo Sapiens
VLLVVDESV

SEQ ID NO: 581899 - protein, 9 aa, Homo Sapiens
TNKTGFHYC

SEQ ID NO: 581900 - protein, 9 aa, Homo Sapiens
KNYISQVPV

SEQ ID NO: 581901 - protein, 9 aa, Homo Sapiens
STDEAEAQM

SEQ ID NO: 581902 - protein, 9 aa, Homo Sapiens
ESPLALLLG

SEQ ID NO: 581903 - protein, 9 aa, Homo Sapiens
RGEPHELRN

SEQ ID NO: 581904 - protein, 9 aa, Homo Sapiens
LLHLYKCMD

SEQ ID NO: 581905 - protein, 9 aa, Homo Sapiens
LVQRGYGAR

SEQ ID NO: 581906 - protein, 9 aa, Homo Sapiens
NVNPPPLSK

SEQ ID NO: 581907 - protein, 9 aa, Homo Sapiens
HLLHAAWDH

SEQ ID NO: 581908 - protein, 9 aa, Homo Sapiens
AEGQDYCTL

SEQ ID NO: 581909 - protein, 9 aa, Homo Sapiens
WDCTICSIS

SEQ ID NO: 581910 - protein, 9 aa, Homo Sapiens
SSVLGIHAR

SEQ ID NO: 581911 - protein, 9 aa, Homo Sapiens
LLLDCARLP

SEQ ID NO: 581912 - protein, 9 aa, Homo Sapiens
MAALLLGEV

SEQ ID NO: 581913 - protein, 9 aa, Homo Sapiens
PSSGHALRI

SEQ ID NO: 581914 - protein, 9 aa, Homo Sapiens
YLFLSLLSF

SEQ ID NO: 581915 - protein, 9 aa, Homo Sapiens
ILTHMLNPI

SEQ ID NO: 581916 - protein, 9 aa, Homo Sapiens
SNASGAAAA

SEQ ID NO: 581917 - protein, 9 aa, Homo Sapiens
LLGEVLLVA

SEQ ID NO: 581918 - protein, 9 aa, Homo Sapiens
TKPTDMGTF

SEQ ID NO: 581919 - protein, 9 aa, Homo Sapiens
GSGDFQIVY

SEQ ID NO: 581920 - protein, 9 aa, Homo Sapiens
QGMVLSSMK

SEQ ID NO: 581921 - protein, 9 aa, Homo Sapiens
CARSGLNLN

SEQ ID NO: 581922 - protein, 9 aa, Homo Sapiens
KLEQINSTG

SEQ ID NO: 581923 - protein, 9 aa, Homo Sapiens
PGVMYLTLL

SEQ ID NO: 581924 - protein, 9 aa, Homo Sapiens
TTFCECQRS

SEQ ID NO: 581925 - protein, 9 aa, Homo Sapiens
TCQHYVISL

SEQ ID NO: 581926 - protein, 9 aa, Homo Sapiens
RKGMPQQLS

SEQ ID NO: 581927 - protein, 9 aa, Homo Sapiens
RSGLNLNRY

SEQ ID NO: 581928 - protein, 9 aa, Homo Sapiens
SWMAAGPLL

SEQ ID NO: 581929 - protein, 9 aa, Homo Sapiens
SQRSTKPSC

SEQ ID NO: 581930 - protein, 9 aa, Homo Sapiens
YHDQLGPKI

SEQ ID NO: 581931 - protein, 9 aa, Homo Sapiens
LLLVLVKDH

SEQ ID NO: 581932 - protein, 9 aa, Homo Sapiens
GSTPKQSPS

SEQ ID NO: 581933 - protein, 9 aa, Homo Sapiens
VIALFTEFA

SEQ ID NO: 581934 - protein, 9 aa, Homo Sapiens
AMGVYNQDK

SEQ ID NO: 581935 - protein, 9 aa, Homo Sapiens
WMAAGPLLD

SEQ ID NO: 581936 - protein, 9 aa, Homo Sapiens
AFCMPLYVP

SEQ ID NO: 581937 - protein, 9 aa, Homo Sapiens
AVEEEEMKL

SEQ ID NO: 581938 - protein, 9 aa, Homo Sapiens
PKRRLHALA

SEQ ID NO: 581939 - protein, 9 aa, Homo Sapiens
SPSRFCQSD

SEQ ID NO: 581940 - protein, 9 aa, Homo Sapiens
GEIQLVAEN

SEQ ID NO: 581941 - protein, 9 aa, Homo Sapiens
GDTPERQEA

SEQ ID NO: 581942 - protein, 9 aa, Homo Sapiens
TPWNTLRQT

SEQ ID NO: 581943 - protein, 9 aa, Homo Sapiens
LAKNYISQV

SEQ ID NO: 581944 - protein, 9 aa, Homo Sapiens
EHNRTQCIK

SEQ ID NO: 581945 - protein, 9 aa, Homo Sapiens
VRIIPPGSG

SEQ ID NO: 581946 - protein, 9 aa, Homo Sapiens
FNHPNILPY

SEQ ID NO: 581947 - protein, 9 aa, Homo Sapiens
ITLFTYARP

SEQ ID NO: 581948 - protein, 9 aa, Homo Sapiens
DSRISFLSS

SEQ ID NO: 581949 - protein, 9 aa, Homo Sapiens
EYYCLAVDA

SEQ ID NO: 581950 - protein, 9 aa, Homo Sapiens
PGGPEQQVS

SEQ ID NO: 581951 - protein, 9 aa, Homo Sapiens
SWHMENHFW

SEQ ID NO: 581952 - protein, 9 aa, Homo Sapiens
ATEHNRTQC

SEQ ID NO: 581953 - protein, 9 aa, Homo Sapiens
QINSTGILS

SEQ ID NO: 581954 - protein, 9 aa, Homo Sapiens
PVLLHLLQT

SEQ ID NO: 581955 - protein, 9 aa, Homo Sapiens
RTSGPSSGH

SEQ ID NO: 581956 - protein, 9 aa, Homo Sapiens
LLPVTFVGN

SEQ ID NO: 581957 - protein, 9 aa, Homo Sapiens
PQTKPTSMQ

SEQ ID NO: 581958 - protein, 9 aa, Homo Sapiens
AQAQGSPFC

SEQ ID NO: 581959 - protein, 9 aa, Homo Sapiens
RTTSYAQLL

SEQ ID NO: 581960 - protein, 9 aa, Homo Sapiens
ILTGRHRGR

SEQ ID NO: 581961 - protein, 9 aa, Homo Sapiens
SHGNVQAAA

SEQ ID NO: 581962 - protein, 9 aa, Homo Sapiens
HMLNPIIYS

SEQ ID NO: 581963 - protein, 9 aa, Homo Sapiens
YCGKAFRRG

SEQ ID NO: 581964 - protein, 9 aa, Homo Sapiens
FYTILTHML

SEQ ID NO: 581965 - protein, 9 aa, Homo Sapiens
RELLHLLHA

SEQ ID NO: 581966 - protein, 9 aa, Homo Sapiens
LFYSITLFT

SEQ ID NO: 581967 - protein, 9 aa, Homo Sapiens
GAREKLFSS

SEQ ID NO: 581968 - protein, 9 aa, Homo Sapiens
CRCPYGTTG

SEQ ID NO: 581969 - protein, 9 aa, Homo Sapiens
ITNVCLPPE

SEQ ID NO: 581970 - protein, 9 aa, Homo Sapiens
NRTQCIKSS

SEQ ID NO: 581971 - protein, 9 aa, Homo Sapiens
NILPYRATF

SEQ ID NO: 581972 - protein, 9 aa, Homo Sapiens
WATLLVDGF

SEQ ID NO: 581973 - protein, 9 aa, Homo Sapiens
VLSSMKHFS

SEQ ID NO: 581974 - protein, 9 aa, Homo Sapiens
MVLSSMKHF

SEQ ID NO: 581975 - protein, 9 aa, Homo Sapiens
TGFHYCSES

SEQ ID NO: 581976 - protein, 9 aa, Homo Sapiens
RHRGRRVVF

SEQ ID NO: 581977 - protein, 9 aa, Homo Sapiens
GVYNQDKSI

SEQ ID NO: 581978 - protein, 9 aa, Homo Sapiens
RPDLLYGQP

SEQ ID NO: 581979 - protein, 9 aa, Homo Sapiens
NFKGFSGAR

SEQ ID NO: 581980 - protein, 9 aa, Homo Sapiens
KTGFHYCSE

SEQ ID NO: 581981 - protein, 9 aa, Homo Sapiens
LNPILNSGT

SEQ ID NO: 581982 - protein, 9 aa, Homo Sapiens
CLCTLRNLS

SEQ ID NO: 581983 - protein, 9 aa, Homo Sapiens
EHVHASDSS

SEQ ID NO: 581984 - protein, 9 aa, Homo Sapiens
QSSVLGIHA

SEQ ID NO: 581985 - protein, 9 aa, Homo Sapiens
MAAGPLLDI

SEQ ID NO: 581986 - protein, 9 aa, Homo Sapiens
KEEVQKLDN

SEQ ID NO: 581987 - protein, 9 aa, Homo Sapiens
NLQNSPVNV

SEQ ID NO: 581988 - protein, 9 aa, Homo Sapiens
TGEDPSRAV

SEQ ID NO: 581989 - protein, 9 aa, Homo Sapiens
LKQTFEEWD

SEQ ID NO: 581990 - protein, 9 aa, Homo Sapiens
PCSEKRLLL

SEQ ID NO: 581991 - protein, 9 aa, Homo Sapiens
HRGRRVVFL

SEQ ID NO: 581992 - protein, 9 aa, Homo Sapiens
LSSSTGEDP

SEQ ID NO: 581993 - protein, 9 aa, Homo Sapiens
CWLETTFCE

SEQ ID NO: 581994 - protein, 9 aa, Homo Sapiens
SPFCSINIP

SEQ ID NO: 581995 - protein, 9 aa, Homo Sapiens
IEVLLVVDE

SEQ ID NO: 581996 - protein, 9 aa, Homo Sapiens
EDAGEIQLV

SEQ ID NO: 581997 - protein, 9 aa, Homo Sapiens
VIRGWKLFH

SEQ ID NO: 581998 - protein, 9 aa, Homo Sapiens
IQSLGHRGR

SEQ ID NO: 581999 - protein, 9 aa, Homo Sapiens
EVLLVAQPQ

SEQ ID NO: 582000 - protein, 9 aa, Homo Sapiens
TFASTGSVQ

SEQ ID NO: 582001 - protein, 9 aa, Homo Sapiens
SLYALYGQR

SEQ ID NO: 582002 - protein, 9 aa, Homo Sapiens
QRTTSYAQL

SEQ ID NO: 582003 - protein, 9 aa, Homo Sapiens
GYGARGCET

SEQ ID NO: 582004 - protein, 9 aa, Homo Sapiens
RGSTPKQSP

SEQ ID NO: 582005 - protein, 9 aa, Homo Sapiens
LVGGLLSHS

SEQ ID NO: 582006 - protein, 9 aa, Homo Sapiens
PEQQVSTDE

SEQ ID NO: 582007 - protein, 9 aa, Homo Sapiens
EMPKRRLHA

SEQ ID NO: 582008 - protein, 9 aa, Homo Sapiens
PSRFCQSDG

SEQ ID NO: 582009 - protein, 9 aa, Homo Sapiens
GESPLALLL

SEQ ID NO: 582010 - protein, 9 aa, Homo Sapiens
PSLTSDETM

SEQ ID NO: 582011 - protein, 9 aa, Homo Sapiens
VQTTKRGEP

SEQ ID NO: 582012 - protein, 9 aa, Homo Sapiens
ALFFSLNTI

SEQ ID NO: 582013 - protein, 9 aa, Homo Sapiens
KRLLLPSQS

SEQ ID NO: 582014 - protein, 9 aa, Homo Sapiens
KIWFQYKRS

SEQ ID NO: 582015 - protein, 9 aa, Homo Sapiens
VVEGWATLL

SEQ ID NO: 582016 - protein, 9 aa, Homo Sapiens
RIYHDQLGP

SEQ ID NO: 582017 - protein, 9 aa, Homo Sapiens
NSGTPDCDP

SEQ ID NO: 582018 - protein, 9 aa, Homo Sapiens
CGVLQRTNS

SEQ ID NO: 582019 - protein, 9 aa, Homo Sapiens
VNVNPPPLS

SEQ ID NO: 582020 - protein, 9 aa, Homo Sapiens
KLVGGLLSH

SEQ ID NO: 582021 - protein, 9 aa, Homo Sapiens
VLNITNKTG

SEQ ID NO: 582022 - protein, 9 aa, Homo Sapiens
CDPQTKPTS

SEQ ID NO: 582023 - protein, 9 aa, Homo Sapiens
IGFQGDDLK

SEQ ID NO: 582024 - protein, 9 aa, Homo Sapiens
PWNTLRQTF

SEQ ID NO: 582025 - protein, 9 aa, Homo Sapiens
ASDVGRVQM

SEQ ID NO: 582026 - protein, 9 aa, Homo Sapiens
TGRHRGRRV

SEQ ID NO: 582027 - protein, 9 aa, Homo Sapiens
SKTCSLGEH

SEQ ID NO: 582028 - protein, 9 aa, Homo Sapiens
LTAFTLKQK

SEQ ID NO: 582029 - protein, 9 aa, Homo Sapiens
GWATLLVDG

SEQ ID NO: 582030 - protein, 9 aa, Homo Sapiens
CLTLFIRNA

SEQ ID NO: 582031 - protein, 9 aa, Homo Sapiens
LCRDMAQQR

SEQ ID NO: 582032 - protein, 9 aa, Homo Sapiens
ACARSGLNL

SEQ ID NO: 582033 - protein, 9 aa, Homo Sapiens
SSSTGEDPS

SEQ ID NO: 582034 - protein, 9 aa, Homo Sapiens
SSTGEDPSR

SEQ ID NO: 582035 - protein, 9 aa, Homo Sapiens
KIYASDVGR

SEQ ID NO: 582036 - protein, 9 aa, Homo Sapiens
PQHSWMAAG

SEQ ID NO: 582037 - protein, 9 aa, Homo Sapiens
VVDESVVRF

SEQ ID NO: 582038 - protein, 9 aa, Homo Sapiens
ELEPTPWNT

SEQ ID NO: 582039 - protein, 9 aa, Homo Sapiens
VSTDEAEAQ

SEQ ID NO: 582040 - protein, 9 aa, Homo Sapiens
SGEIVFLLE

SEQ ID NO: 582041 - protein, 9 aa, Homo Sapiens
TKRGEPHEL

SEQ ID NO: 582042 - protein, 9 aa, Homo Sapiens
LVPGMSLSA

SEQ ID NO: 582043 - protein, 9 aa, Homo Sapiens
VPGMSLSAG

SEQ ID NO: 582044 - protein, 9 aa, Homo Sapiens
NNELEPTPW

SEQ ID NO: 582045 - protein, 9 aa, Homo Sapiens
EQRTTSYAQ

SEQ ID NO: 582046 - protein, 9 aa, Homo Sapiens
VQRGYGARG

SEQ ID NO: 582047 - protein, 9 aa, Homo Sapiens
LGNRWKTFL

SEQ ID NO: 582048 - protein, 9 aa, Homo Sapiens
RSCLTLFIR

SEQ ID NO: 582049 - protein, 9 aa, Homo Sapiens
DLKIYASDV

SEQ ID NO: 582050 - protein, 9 aa, Homo Sapiens
LTLFIRNAG

SEQ ID NO: 582051 - protein, 9 aa, Homo Sapiens
FQYKRSKFK

SEQ ID NO: 582052 - protein, 9 aa, Homo Sapiens
LLYGQPADY

SEQ ID NO: 582053 - protein, 9 aa, Homo Sapiens
AKNYISQVP

SEQ ID NO: 582054 - protein, 9 aa, Homo Sapiens
DLLYGQPAD

SEQ ID NO: 582055 - protein, 9 aa, Homo Sapiens
YSITLFTYA

SEQ ID NO: 582056 - protein, 9 aa, Homo Sapiens
DYCTLTAFT

SEQ ID NO: 582057 - protein, 9 aa, Homo Sapiens
WFQYKRSKF

SEQ ID NO: 582058 - protein, 9 aa, Homo Sapiens
AAATLPAHP

SEQ ID NO: 582059 - protein, 9 aa, Homo Sapiens
EGQDYCTLT

SEQ ID NO: 582060 - protein, 9 aa, Homo Sapiens
PNILPYRAT

SEQ ID NO: 582061 - protein, 9 aa, Homo Sapiens
LEQINSTGI

SEQ ID NO: 582062 - protein, 9 aa, Homo Sapiens
EQQVSTDEA

SEQ ID NO: 582063 - protein, 9 aa, Homo Sapiens
AREKLFSSQ

SEQ ID NO: 582064 - protein, 9 aa, Homo Sapiens
EDTIHKWEV

SEQ ID NO: 582065 - protein, 9 aa, Homo Sapiens
LHLLHAAWD

SEQ ID NO: 582066 - protein, 9 aa, Homo Sapiens
WGSQAFHNV

SEQ ID NO: 582067 - protein, 9 aa, Homo Sapiens
NVSEPDTCQ

SEQ ID NO: 582068 - protein, 9 aa, Homo Sapiens
YQAPLVLCN

SEQ ID NO: 582069 - protein, 9 aa, Homo Sapiens
TSGPSSGHA

SEQ ID NO: 582070 - protein, 9 aa, Homo Sapiens
KLFNHPNIL

SEQ ID NO: 582071 - protein, 9 aa, Homo Sapiens
GIHARTHLP

SEQ ID NO: 582072 - protein, 9 aa, Homo Sapiens
STPKQSPSR

SEQ ID NO: 582073 - protein, 9 aa, Homo Sapiens
LLDCARLPV

SEQ ID NO: 582074 - protein, 9 aa, Homo Sapiens
YGTTGVNCE

SEQ ID NO: 582075 - protein, 9 aa, Homo Sapiens
DRYIAICQP

SEQ ID NO: 582076 - protein, 9 aa, Homo Sapiens
SLVQRGYGA

SEQ ID NO: 582077 - protein, 9 aa, Homo Sapiens
QQRLVNEVH

SEQ ID NO: 582078 - protein, 9 aa, Homo Sapiens
FGQSSVLGI

SEQ ID NO: 582079 - protein, 9 aa, Homo Sapiens
DFWDCTICS

SEQ ID NO: 582080 - protein, 9 aa, Homo Sapiens
ARGCETQKW

SEQ ID NO: 582081 - protein, 9 aa, Homo Sapiens
PAVAQSWHM

SEQ ID NO: 582082 - protein, 9 aa, Homo Sapiens
PATAGLVPG

SEQ ID NO: 582083 - protein, 9 aa, Homo Sapiens
NLYQQKIKE

SEQ ID NO: 582084 - protein, 9 aa, Homo Sapiens
KISFELTRE

SEQ ID NO: 582085 - protein, 9 aa, Homo Sapiens
KYLCRCPYG

SEQ ID NO: 582086 - protein, 9 aa, Homo Sapiens
ISRKGMPQQ

SEQ ID NO: 582087 - protein, 9 aa, Homo Sapiens
QRSTKPSCV

SEQ ID NO: 582088 - protein, 9 aa, Homo Sapiens
LCRCPYGTT

SEQ ID NO: 582089 - protein, 9 aa, Homo Sapiens
GMVLSSMKH

SEQ ID NO: 582090 - protein, 9 aa, Homo Sapiens
ASSLPRQAP

SEQ ID NO: 582091 - protein, 9 aa, Homo Sapiens
AGNGILKAL

SEQ ID NO: 582092 - protein, 9 aa, Homo Sapiens
FFSLNTIRF

SEQ ID NO: 582093 - protein, 9 aa, Homo Sapiens
SGAAAATLP

SEQ ID NO: 582094 - protein, 9 aa, Homo Sapiens
LVLCNGEAP

SEQ ID NO: 582095 - protein, 9 aa, Homo Sapiens
SAAGSRLAE

SEQ ID NO: 582096 - protein, 9 aa, Homo Sapiens
GAFCMPLYV

SEQ ID NO: 582097 - protein, 9 aa, Homo Sapiens
GGVAMGVYN

SEQ ID NO: 582098 - protein, 9 aa, Homo Sapiens
ISFELTREP

SEQ ID NO: 582099 - protein, 9 aa, Homo Sapiens
ACHGSAKKL

SEQ ID NO: 582100 - protein, 9 aa, Homo Sapiens
ILNSGTPDC

SEQ ID NO: 582101 - protein, 9 aa, Homo Sapiens
ILFYSITLF

SEQ ID NO: 582102 - protein, 9 aa, Homo Sapiens
DLESLILFH

SEQ ID NO: 582103 - protein, 9 aa, Homo Sapiens
LVGAFCMPL

SEQ ID NO: 582104 - protein, 9 aa, Homo Sapiens
KPTDMGTFF

SEQ ID NO: 582105 - protein, 9 aa, Homo Sapiens
RPVLLHLLQ

SEQ ID NO: 582106 - protein, 9 aa, Homo Sapiens
ESWLCLGQH

SEQ ID NO: 582107 - protein, 9 aa, Homo Sapiens
LPRQAPEPS

SEQ ID NO: 582108 - protein, 9 aa, Homo Sapiens
TDFYFTIAG

SEQ ID NO: 582109 - protein, 9 aa, Homo Sapiens
MAQQRLVNE

SEQ ID NO: 582110 - protein, 9 aa, Homo Sapiens
TEVVLITNV

SEQ ID NO: 582111 - protein, 9 aa, Homo Sapiens
ALLLGEVLL

SEQ ID NO: 582112 - protein, 9 aa, Homo Sapiens
TPKQSPSRL

SEQ ID NO: 582113 - protein, 9 aa, Homo Sapiens
ETDSPRQLL

SEQ ID NO: 582114 - protein, 9 aa, Homo Sapiens
QLVAENAES

SEQ ID NO: 582115 - protein, 9 aa, Homo Sapiens
SNRPDLLYG

SEQ ID NO: 582116 - protein, 9 aa, Homo Sapiens
PRASSLPRQ

SEQ ID NO: 582117 - protein, 9 aa, Homo Sapiens
LLHLLHAAW

SEQ ID NO: 582118 - protein, 9 aa, Homo Sapiens
VTFVGNLFM

SEQ ID NO: 582119 - protein, 9 aa, Homo Sapiens
FMAQDCAYR

SEQ ID NO: 582120 - protein, 9 aa, Homo Sapiens
ISQVPVLAS

SEQ ID NO: 582121 - protein, 9 aa, Homo Sapiens
SGLNLNRYS

SEQ ID NO: 582122 - protein, 9 aa, Homo Sapiens
NCLCTLRNL

SEQ ID NO: 582123 - protein, 9 aa, Homo Sapiens
ICAGNGILK

SEQ ID NO: 582124 - protein, 9 aa, Homo Sapiens
TCSLGEHVH

SEQ ID NO: 582125 - protein, 9 aa, Homo Sapiens
SLPSNLEKE

SEQ ID NO: 582126 - protein, 9 aa, Homo Sapiens
YCTLTAFTL

SEQ ID NO: 582127 - protein, 9 aa, Homo Sapiens
FCMPLYVPY

SEQ ID NO: 582128 - protein, 9 aa, Homo Sapiens
LNDRMCDPQ

SEQ ID NO: 582129 - protein, 9 aa, Homo Sapiens
LSLLSFSET

SEQ ID NO: 582130 - protein, 9 aa, Homo Sapiens
EPDTCQHYV

SEQ ID NO: 582131 - protein, 9 aa, Homo Sapiens
AATGPYYSL

SEQ ID NO: 582132 - protein, 9 aa, Homo Sapiens
LSHSLDYCF

SEQ ID NO: 582133 - protein, 9 aa, Homo Sapiens
ESVVRFHGK

SEQ ID NO: 582134 - protein, 9 aa, Homo Sapiens
MGTFFELYP

SEQ ID NO: 582135 - protein, 9 aa, Homo Sapiens
CTLRNLSDA

SEQ ID NO: 582136 - protein, 9 aa, Homo Sapiens
PFCSINIPE

SEQ ID NO: 582137 - protein, 9 aa, Homo Sapiens
WKTFLETVH

SEQ ID NO: 582138 - protein, 9 aa, Homo Sapiens
LVGSPSRFC

SEQ ID NO: 582139 - protein, 9 aa, Homo Sapiens
ERQEAAGTG

SEQ ID NO: 582140 - protein, 9 aa, Homo Sapiens
SVLGIHART

SEQ ID NO: 582141 - protein, 9 aa, Homo Sapiens
SSMKHFSEA

SEQ ID NO: 582142 - protein, 9 aa, Homo Sapiens
PDIQSLGHR

SEQ ID NO: 582143 - protein, 9 aa, Homo Sapiens
VILFYSITL

SEQ ID NO: 582144 - protein, 9 aa, Homo Sapiens
ETGNGRALV

SEQ ID NO: 582145 - protein, 9 aa, Homo Sapiens
QGSPFCSIN

SEQ ID NO: 582146 - protein, 9 aa, Homo Sapiens
ILPYRATFI

SEQ ID NO: 582147 - protein, 9 aa, Homo Sapiens
KMDPSTFAS

SEQ ID NO: 582148 - protein, 9 aa, Homo Sapiens
IRTSGPSSG

SEQ ID NO: 582149 - protein, 9 aa, Homo Sapiens
SRISFLSSV

SEQ ID NO: 582150 - protein, 9 aa, Homo Sapiens
TGPYYSLYA

SEQ ID NO: 582151 - protein, 9 aa, Homo Sapiens
AQDCAYRKR

SEQ ID NO: 582152 - protein, 9 aa, Homo Sapiens
MAQDCAYRK

SEQ ID NO: 582153 - protein, 9 aa, Homo Sapiens
LKICGVLQR

SEQ ID NO: 582154 - protein, 9 aa, Homo Sapiens
ALEEDTIHK

SEQ ID NO: 582155 - protein, 9 aa, Homo Sapiens
CRWLQAQKD

SEQ ID NO: 582156 - protein, 9 aa, Homo Sapiens
DMLFNLFLQ

SEQ ID NO: 582157 - protein, 9 aa, Homo Sapiens
NRKPDIQSL

SEQ ID NO: 582158 - protein, 9 aa, Homo Sapiens
IVFLLEKID

SEQ ID NO: 582159 - protein, 9 aa, Homo Sapiens
LILFHNPEY

SEQ ID NO: 582160 - protein, 9 aa, Homo Sapiens
KICGVLQRT

SEQ ID NO: 582161 - protein, 9 aa, Homo Sapiens
LPSLTSDET

SEQ ID NO: 582162 - protein, 9 aa, Homo Sapiens
EWDFWDCTI

SEQ ID NO: 582163 - protein, 9 aa, Homo Sapiens
QKKERELLH

SEQ ID NO: 582164 - protein, 9 aa, Homo Sapiens
ATAGLVPGM

SEQ ID NO: 582165 - protein, 9 aa, Homo Sapiens
ATGPYYSLY

SEQ ID NO: 582166 - protein, 9 aa, Homo Sapiens
IWFQYKRSK

SEQ ID NO: 582167 - protein, 9 aa, Homo Sapiens
VEGWATLLV

SEQ ID NO: 582168 - protein, 9 aa, Homo Sapiens
KGFSGAREK

SEQ ID NO: 582169 - protein, 9 aa, Homo Sapiens
RCPYGTTGV

SEQ ID NO: 582170 - protein, 9 aa, Homo Sapiens
TVVILFYSI

SEQ ID NO: 582171 - protein, 9 aa, Homo Sapiens
HNYALVIFE

SEQ ID NO: 582172 - protein, 9 aa, Homo Sapiens
QLGPKINTS

SEQ ID NO: 582173 - protein, 9 aa, Homo Sapiens
VVIALFTEF

SEQ ID NO: 582174 - protein, 9 aa, Homo Sapiens
RLLPVTFVG

SEQ ID NO: 582175 - protein, 9 aa, Homo Sapiens
LTREPCITP

SEQ ID NO: 582176 - protein, 9 aa, Homo Sapiens
HSWMAAGPL

SEQ ID NO: 582177 - protein, 9 aa, Homo Sapiens
DESVVRFHG

SEQ ID NO: 582178 - protein, 9 aa, Homo Sapiens
GFHYCSESW

SEQ ID NO: 582179 - protein, 9 aa, Homo Sapiens
GLNLNRYST

SEQ ID NO: 582180 - protein, 9 aa, Homo Sapiens
QEAAGTGKK

SEQ ID NO: 582181 - protein, 9 aa, Homo Sapiens
EVVLITNVC

SEQ ID NO: 582182 - protein, 9 aa, Homo Sapiens
LEANPTSAA

SEQ ID NO: 582183 - protein, 9 aa, Homo Sapiens
MYLTLLHLY

SEQ ID NO: 582184 - protein, 9 aa, Homo Sapiens
SWLCLGQHP

SEQ ID NO: 582185 - protein, 9 aa, Homo Sapiens
TILTHMLNP

SEQ ID NO: 582186 - protein, 9 aa, Homo Sapiens
GRHRGRRVV

SEQ ID NO: 582187 - protein, 9 aa, Homo Sapiens
LITVVIALF

SEQ ID NO: 582188 - protein, 9 aa, Homo Sapiens
KTFLETVHV

SEQ ID NO: 582189 - protein, 9 aa, Homo Sapiens
ELCRDMAQQ

SEQ ID NO: 582190 - protein, 9 aa, Homo Sapiens
NLSSSTGED

SEQ ID NO: 582191 - protein, 9 aa, Homo Sapiens
QQVSTDEAE

SEQ ID NO: 582192 - protein, 9 aa, Homo Sapiens
TICSISRKG

SEQ ID NO: 582193 - protein, 9 aa, Homo Sapiens
KLFHNYALV

SEQ ID NO: 582194 - protein, 9 aa, Homo Sapiens
IAICQPLHY

SEQ ID NO: 582195 - protein, 9 aa, Homo Sapiens
LNSGTPDCD

SEQ ID NO: 582196 - protein, 9 aa, Homo Sapiens
SSLPRQAPE

SEQ ID NO: 582197 - protein, 9 aa, Homo Sapiens
GDDLKQTFE

SEQ ID NO: 582198 - protein, 9 aa, Homo Sapiens
RWNRKPDIQ

SEQ ID NO: 582199 - protein, 9 aa, Homo Sapiens
GVMYLTLLH

SEQ ID NO: 582200 - protein, 9 aa, Homo Sapiens
TIAGHQAMH

SEQ ID NO: 582201 - protein, 9 aa, Homo Sapiens
LFHNYALVI

SEQ ID NO: 582202 - protein, 9 aa, Homo Sapiens
TPDCDPNLE

SEQ ID NO: 582203 - protein, 9 aa, Homo Sapiens
PVLNITNKT

SEQ ID NO: 582204 - protein, 9 aa, Homo Sapiens
VAMGVYNQD

SEQ ID NO: 582205 - protein, 9 aa, Homo Sapiens
LLITVVIAL

SEQ ID NO: 582206 - protein, 9 aa, Homo Sapiens
TFVLATEHN

SEQ ID NO: 582207 - protein, 9 aa, Homo Sapiens
YCSESWLCL

SEQ ID NO: 582208 - protein, 9 aa, Homo Sapiens
NTIRFFNRF

SEQ ID NO: 582209 - protein, 9 aa, Homo Sapiens
EPGVMYLTL

SEQ ID NO: 582210 - protein, 9 aa, Homo Sapiens
DQLGPKINT

SEQ ID NO: 582211 - protein, 9 aa, Homo Sapiens
LLVDGFLNA

SEQ ID NO: 582212 - protein, 9 aa, Homo Sapiens
QAQGSPFCS

SEQ ID NO: 582213 - protein, 9 aa, Homo Sapiens
EGGGVAMGV

SEQ ID NO: 582214 - protein, 9 aa, Homo Sapiens
TACHGSAKK

SEQ ID NO: 582215 - protein, 9 aa, Homo Sapiens
AAGSRLAEF

SEQ ID NO: 582216 - protein, 9 aa, Homo Sapiens
SLLSFSETC

SEQ ID NO: 582217 - protein, 9 aa, Homo Sapiens
FLVALISCR

SEQ ID NO: 582218 - protein, 9 aa, Homo Sapiens
HPNILPYRA

SEQ ID NO: 582219 - protein, 9 aa, Homo Sapiens
LITNVCLPP

SEQ ID NO: 582220 - protein, 9 aa, Homo Sapiens
STFASTGSV

SEQ ID NO: 582221 - protein, 9 aa, Homo Sapiens
NDRMCDPQT

SEQ ID NO: 582222 - protein, 9 aa, Homo Sapiens
SGPSSGHAL

SEQ ID NO: 582223 - protein, 9 aa, Homo Sapiens
GNGRALVHS

SEQ ID NO: 582224 - protein, 9 aa, Homo Sapiens
LETTFCECQ

SEQ ID NO: 582225 - protein, 9 aa, Homo Sapiens
TTDFYFTIA

SEQ ID NO: 582226 - protein, 9 aa, Homo Sapiens
LISCRSRHR

SEQ ID NO: 582227 - protein, 9 aa, Homo Sapiens
AGEIQLVAE

SEQ ID NO: 582228 - protein, 9 aa, Homo Sapiens
LCNGEAPDF

SEQ ID NO: 582229 - protein, 9 aa, Homo Sapiens
VYNQDKSIE

SEQ ID NO: 582230 - protein, 9 aa, Homo Sapiens
WPAVAQSWH

SEQ ID NO: 582231 - protein, 9 aa, Homo Sapiens
HYCSESWLC

SEQ ID NO: 582232 - protein, 9 aa, Homo Sapiens
RQLLLVLVK

SEQ ID NO: 582233 - protein, 9 aa, Homo Sapiens
ILAKNYISQ

SEQ ID NO: 582234 - protein, 9 aa, Homo Sapiens
GPYYSLYAL

SEQ ID NO: 582235 - protein, 9 aa, Homo Sapiens
QRLVNEVHE

SEQ ID NO: 582236 - protein, 9 aa, Homo Sapiens
HILAKNYIS

SEQ ID NO: 582237 - protein, 9 aa, Homo Sapiens
SLGEHVHAS

SEQ ID NO: 582238 - protein, 9 aa, Homo Sapiens
ICSISRKGM

SEQ ID NO: 582239 - protein, 9 aa, Homo Sapiens
LFNLFLQAL

SEQ ID NO: 582240 - protein, 9 aa, Homo Sapiens
RLPVAARDF

SEQ ID NO: 582241 - protein, 9 aa, Homo Sapiens
IQRPQNCYT

SEQ ID NO: 582242 - protein, 9 aa, Homo Sapiens
ADMLFNLFL

SEQ ID NO: 582243 - protein, 9 aa, Homo Sapiens
CLGQHPPCW

SEQ ID NO: 582244 - protein, 9 aa, Homo Sapiens
GLLSHSLDY

SEQ ID NO: 582245 - protein, 9 aa, Homo Sapiens
PYYSLYALY

SEQ ID NO: 582246 - protein, 9 aa, Homo Sapiens
VGSPSRFCQ

SEQ ID NO: 582247 - protein, 9 aa, Homo Sapiens
SDETMCKSV

SEQ ID NO: 582248 - protein, 9 aa, Homo Sapiens
AVFYTILTH

SEQ ID NO: 582249 - protein, 9 aa, Homo Sapiens
IADMLFNLF

SEQ ID NO: 582250 - protein, 9 aa, Homo Sapiens
KRGEPHELR

SEQ ID NO: 582251 - protein, 9 aa, Homo Sapiens
NELEPTPWN

SEQ ID NO: 582252 - protein, 9 aa, Homo Sapiens
GSPSRFCQS

SEQ ID NO: 582253 - protein, 9 aa, Homo Sapiens
MLFSMFPNE

SEQ ID NO: 582254 - protein, 9 aa, Homo Sapiens
ETTFCECQR

SEQ ID NO: 582255 - protein, 9 aa, Homo Sapiens
LTSGEIVFL

SEQ ID NO: 582256 - protein, 9 aa, Homo Sapiens
MVSELCKTI

SEQ ID NO: 582257 - protein, 9 aa, Homo Sapiens
PPHYKEYYC

SEQ ID NO: 582258 - protein, 9 aa, Homo Sapiens
EDKETGNGR

SEQ ID NO: 582259 - protein, 9 aa, Homo Sapiens
GEPHELRNI

SEQ ID NO: 582260 - protein, 9 aa, Homo Sapiens
HGNVQAAAN

SEQ ID NO: 582261 - protein, 9 aa, Homo Sapiens
NGILKALGG

SEQ ID NO: 582262 - protein, 9 aa, Homo Sapiens
ITKPTDMGT

SEQ ID NO: 582263 - protein, 9 aa, Homo Sapiens
ESNRPDLLY

SEQ ID NO: 582264 - protein, 9 aa, Homo Sapiens
WKLFHNYAL

SEQ ID NO: 582265 - protein, 9 aa, Homo Sapiens
CQHYVISLN

SEQ ID NO: 582266 - protein, 9 aa, Homo Sapiens
CTLTAFTLK

SEQ ID NO: 582267 - protein, 9 aa, Homo Sapiens
CSEKRLLLP

SEQ ID NO: 582268 - protein, 9 aa, Homo Sapiens
PDALEEDTI

SEQ ID NO: 582269 - protein, 9 aa, Homo Sapiens
GKISFELTR

SEQ ID NO: 582270 - protein, 9 aa, Homo Sapiens
WIQRPQNCY

SEQ ID NO: 582271 - protein, 9 aa, Homo Sapiens
GSPFCSINI

SEQ ID NO: 582272 - protein, 9 aa, Homo Sapiens
PLALLLGHL

SEQ ID NO: 582273 - protein, 9 aa, Homo Sapiens
FGALSIVSL

SEQ ID NO: 582274 - protein, 9 aa, Homo Sapiens
NKYDSRISF

SEQ ID NO: 582275 - protein, 9 aa, Homo Sapiens
CRDMAQQRL

SEQ ID NO: 582276 - protein, 9 aa, Homo Sapiens
GRRVVFLKQ

SEQ ID NO: 582277 - protein, 9 aa, Homo Sapiens
RGRRVVFLK

SEQ ID NO: 582278 - protein, 9 aa, Homo Sapiens
VLVGSPSRF

SEQ ID NO: 582279 - protein, 9 aa, Homo Sapiens
IPLEGCGFV

SEQ ID NO: 582280 - protein, 9 aa, Homo Sapiens
KYDSRISFL

SEQ ID NO: 582281 - protein, 9 aa, Homo Sapiens
LSSMKHFSE

SEQ ID NO: 582282 - protein, 9 aa, Homo Sapiens
QNCYTGSSG

SEQ ID NO: 582283 - protein, 9 aa, Homo Sapiens
APGSQRSTK

SEQ ID NO: 582284 - protein, 9 aa, Homo Sapiens
QAFHNVRII

SEQ ID NO: 582285 - protein, 9 aa, Homo Sapiens
DCARLPVAA

SEQ ID NO: 582286 - protein, 9 aa, Homo Sapiens
KKMDPSTFA

SEQ ID NO: 582287 - protein, 9 aa, Homo Sapiens
DALEEDTIH

SEQ ID NO: 582288 - protein, 9 aa, Homo Sapiens
CAGNGILKA

SEQ ID NO: 582289 - protein, 9 aa, Homo Sapiens
TIRFFNRFI

SEQ ID NO: 582290 - protein, 9 aa, Homo Sapiens
LYALYGQRL

SEQ ID NO: 582291 - protein, 9 aa, Homo Sapiens
DMGTFFELY

SEQ ID NO: 582292 - protein, 9 aa, Homo Sapiens
ALLLGHLLP

SEQ ID NO: 582293 - protein, 9 aa, Homo Sapiens
APRGSTPKQ

SEQ ID NO: 582294 - protein, 9 aa, Homo Sapiens
GNVQAAANI

SEQ ID NO: 582295 - protein, 9 aa, Homo Sapiens
CGKISFELT

SEQ ID NO: 582296 - protein, 9 aa, Homo Sapiens
NVQAAANII

SEQ ID NO: 582297 - protein, 9 aa, Homo Sapiens
YGQPADYLV

SEQ ID NO: 582298 - protein, 9 aa, Homo Sapiens
RLHALANKG

SEQ ID NO: 582299 - protein, 9 aa, Homo Sapiens
EPTPWNTLR

SEQ ID NO: 582300 - protein, 9 aa, Homo Sapiens
NCYTGSSGC

SEQ ID NO: 582301 - protein, 9 aa, Homo Sapiens
EEMKLGEGL

SEQ ID NO: 582302 - protein, 9 aa, Homo Sapiens
ITNKTGFHY

SEQ ID NO: 582303 - protein, 9 aa, Homo Sapiens
ISCRSRHRA

SEQ ID NO: 582304 - protein, 9 aa, Homo Sapiens
CSESWLCLG

SEQ ID NO: 582305 - protein, 9 aa, Homo Sapiens
KTCSLGEHV

SEQ ID NO: 582306 - protein, 9 aa, Homo Sapiens
TLLHLYKCM

SEQ ID NO: 582307 - protein, 9 aa, Homo Sapiens
GSQAFHNVR

SEQ ID NO: 582308 - protein, 9 aa, Homo Sapiens
CTICSISRK

SEQ ID NO: 582309 - protein, 9 aa, Homo Sapiens
DTPERQEAA

SEQ ID NO: 582310 - protein, 9 aa, Homo Sapiens
NLFLQALFL

SEQ ID NO: 582311 - protein, 9 aa, Homo Sapiens
RYIAICQPL

SEQ ID NO: 582312 - protein, 9 aa, Homo Sapiens
LLEQRTTSY

SEQ ID NO: 582313 - protein, 9 aa, Homo Sapiens
NRWKTFLET

SEQ ID NO: 582314 - protein, 9 aa, Homo Sapiens
SPRQLLLVL

SEQ ID NO: 582315 - protein, 9 aa, Homo Sapiens
DCTICSISR

SEQ ID NO: 582316 - protein, 9 aa, Homo Sapiens
LFLSLLSFS

SEQ ID NO: 582317 - protein, 9 aa, Homo Sapiens
SESWLCLGQ

SEQ ID NO: 582318 - protein, 9 aa, Homo Sapiens
KPDIQSLGH

SEQ ID NO: 582319 - protein, 9 aa, Homo Sapiens
YASDVGRVQ

SEQ ID NO: 582320 - protein, 9 aa, Homo Sapiens
TEHNRTQCI

SEQ ID NO: 582321 - protein, 9 aa, Homo Sapiens
DQNLSDLCR

SEQ ID NO: 582322 - protein, 9 aa, Homo Sapiens
AGSRLAEFG

SEQ ID NO: 582323 - protein, 9 aa, Homo Sapiens
PVTFVGNLF

SEQ ID NO: 582324 - protein, 9 aa, Homo Sapiens
GEHVHASDS

SEQ ID NO: 582325 - protein, 9 aa, Homo Sapiens
EDPSRAVGH

SEQ ID NO: 582326 - protein, 9 aa, Homo Sapiens
LSDLCRWLQ

SEQ ID NO: 582327 - protein, 9 aa, Homo Sapiens
WDICAGNGI

SEQ ID NO: 582328 - protein, 9 aa, Homo Sapiens
LFLQALFLI

SEQ ID NO: 582329 - protein, 9 aa, Homo Sapiens
KLDNLYQQK

SEQ ID NO: 582330 - protein, 9 aa, Homo Sapiens
SLPRQAPEP

SEQ ID NO: 582331 - protein, 9 aa, Homo Sapiens
LNTIRFFNR

SEQ ID NO: 582332 - protein, 9 aa, Homo Sapiens
DFYFTIAGH

SEQ ID NO: 582333 - protein, 9 aa, Homo Sapiens
DTIHKWEVT

SEQ ID NO: 582334 - protein, 9 aa, Homo Sapiens
LCLFIIPLE

SEQ ID NO: 582335 - protein, 9 aa, Homo Sapiens
RASSLPRQA

SEQ ID NO: 582336 - protein, 9 aa, Homo Sapiens
LFSMFPNEK

SEQ ID NO: 582337 - protein, 9 aa, Homo Sapiens
GFSGAREKL

SEQ ID NO: 582338 - protein, 9 aa, Homo Sapiens
RERLLPVTF

SEQ ID NO: 582339 - protein, 9 aa, Homo Sapiens
GDFQIVYFR

SEQ ID NO: 582340 - protein, 9 aa, Homo Sapiens
ITVVIALFT

SEQ ID NO: 582341 - protein, 9 aa, Homo Sapiens
STGEDPSRA

SEQ ID NO: 582342 - protein, 9 aa, Homo Sapiens
CSISRKGMP

SEQ ID NO: 582343 - protein, 9 aa, Homo Sapiens
TFCECQRSN

SEQ ID NO: 582344 - protein, 9 aa, Homo Sapiens
GILSSQNFT

SEQ ID NO: 582345 - protein, 9 aa, Homo Sapiens
ICGVLQRTN

SEQ ID NO: 582346 - protein, 9 aa, Homo Sapiens
EVLLVVDES

SEQ ID NO: 582347 - protein, 9 aa, Homo Sapiens
GLKICGVLQ

SEQ ID NO: 582348 - protein, 9 aa, Homo Sapiens
VFYTILTHM

SEQ ID NO: 582349 - protein, 9 aa, Homo Sapiens
EGCGFVSFR

SEQ ID NO: 582350 - protein, 9 aa, Homo Sapiens
WNTLRQTFE

SEQ ID NO: 582351 - protein, 9 aa, Homo Sapiens
TFFELYPLF

SEQ ID NO: 582352 - protein, 9 aa, Homo Sapiens
SRSCLTLFI

SEQ ID NO: 582353 - protein, 9 aa, Homo Sapiens
EWFMAQDCA

SEQ ID NO: 582354 - protein, 9 aa, Homo Sapiens
MPQQLSRSC

SEQ ID NO: 582355 - protein, 9 aa, Homo Sapiens
AAPRGSTPK

SEQ ID NO: 582356 - protein, 9 aa, Homo Sapiens
RAVEEEEMK

SEQ ID NO: 582357 - protein, 9 aa, Homo Sapiens
NLSDLCRWL

SEQ ID NO: 582358 - protein, 9 aa, Homo Sapiens
GFQGDDLKQ

SEQ ID NO: 582359 - protein, 9 aa, Homo Sapiens
RSTKPSCVP

SEQ ID NO: 582360 - protein, 9 aa, Homo Sapiens
GTFFELYPL

SEQ ID NO: 582361 - protein, 9 aa, Homo Sapiens
QDYCTLTAF

SEQ ID NO: 582362 - protein, 9 aa, Homo Sapiens
SLNTIRFFN

SEQ ID NO: 582363 - protein, 9 aa, Homo Sapiens
ELTREPCIT

SEQ ID NO: 582364 - protein, 9 aa, Homo Sapiens
KRRLHALAN

SEQ ID NO: 582365 - protein, 9 aa, Homo Sapiens
NPTSAAGSR

SEQ ID NO: 582366 - protein, 9 aa, Homo Sapiens
LEPTPWNTL

SEQ ID NO: 582367 - protein, 9 aa, Homo Sapiens
RLVQNCLCT

SEQ ID NO: 582368 - protein, 9 aa, Homo Sapiens
FLSLLSFSE

SEQ ID NO: 582369 - protein, 9 aa, Homo Sapiens
AQSWHMENH

SEQ ID NO: 582370 - protein, 9 aa, Homo Sapiens
NASGAAAAT

SEQ ID NO: 582371 - protein, 9 aa, Homo Sapiens
SACARSGLN

SEQ ID NO: 582372 - protein, 9 aa, Homo Sapiens
AGLVPGMSL

SEQ ID NO: 582373 - protein, 9 aa, Homo Sapiens
NRPDLLYGQ

SEQ ID NO: 582374 - protein, 9 aa, Homo Sapiens
DLKQTFEEW

SEQ ID NO: 582375 - protein, 9 aa, Homo Sapiens
DFLVGAFCM

SEQ ID NO: 582376 - protein, 9 aa, Homo Sapiens
DIQSLGHRG

SEQ ID NO: 582377 - protein, 9 aa, Homo Sapiens
TREPCITPS

SEQ ID NO: 582378 - protein, 9 aa, Homo Sapiens
LEQRTTSYA

SEQ ID NO: 582379 - protein, 9 aa, Homo Sapiens
PETEVVLIT

SEQ ID NO: 582380 - protein, 9 aa, Homo Sapiens
GEVLLVAQP

SEQ ID NO: 582381 - protein, 9 aa, Homo Sapiens
WKLPSLTSD

SEQ ID NO: 582382 - protein, 9 aa, Homo Sapiens
DPSTFASTG

SEQ ID NO: 582383 - protein, 9 aa, Homo Sapiens
SGAREKLFS

SEQ ID NO: 582384 - protein, 9 aa, Homo Sapiens
PSTFASTGS

SEQ ID NO: 582385 - protein, 9 aa, Homo Sapiens
MGVYNQDKS

SEQ ID NO: 582386 - protein, 9 aa, Homo Sapiens
NPILNSGTP

SEQ ID NO: 582387 - protein, 9 aa, Homo Sapiens
EVQKLDNLY

SEQ ID NO: 582388 - protein, 9 aa, Homo Sapiens
MKHFSEAFH

SEQ ID NO: 582389 - protein, 9 aa, Homo Sapiens
QHPPCWLET

SEQ ID NO: 582390 - protein, 9 aa, Homo Sapiens
HPPCWLETT

SEQ ID NO: 582391 - protein, 9 aa, Homo Sapiens
ALSIVSLPS

SEQ ID NO: 582392 - protein, 9 aa, Homo Sapiens
LKIYASDVG

SEQ ID NO: 582393 - protein, 9 aa, Homo Sapiens
LATEHNRTQ

SEQ ID NO: 582394 - protein, 9 aa, Homo Sapiens
KYCGKAFRR

SEQ ID NO: 582395 - protein, 9 aa, Homo Sapiens
LLSHSLDYC

SEQ ID NO: 582396 - protein, 9 aa, Homo Sapiens
PQNCYTGSS

SEQ ID NO: 582397 - protein, 9 aa, Homo Sapiens
IYHDQLGPK

SEQ ID NO: 582398 - protein, 9 aa, Homo Sapiens
AAGDTPERQ

SEQ ID NO: 582399 - protein, 9 aa, Homo Sapiens
VLCNGEAPD

SEQ ID NO: 582400 - protein, 9 aa, Homo Sapiens
LLQTAHADE

SEQ ID NO: 582401 - protein, 9 aa, Homo Sapiens
AYRKRPRMA

SEQ ID NO: 582402 - protein, 9 aa, Homo Sapiens
FSGAREKLF

SEQ ID NO: 582403 - protein, 9 aa, Homo Sapiens
GNRWKTFLE

SEQ ID NO: 582404 - protein, 9 aa, Homo Sapiens
VALISCRSR

SEQ ID NO: 582405 - protein, 9 aa, Homo Sapiens
FSLNTIRFF

SEQ ID NO: 582406 - protein, 9 aa, Homo Sapiens
LFNHPNILP

SEQ ID NO: 582407 - protein, 9 aa, Homo Sapiens
NGEAPDFSR

SEQ ID NO: 582408 - protein, 9 aa, Homo Sapiens
GDLESLILF

SEQ ID NO: 582409 - protein, 9 aa, Homo Sapiens
QNCLCTLRN

SEQ ID NO: 582410 - protein, 9 aa, Homo Sapiens
STKPSCVPP

SEQ ID NO: 582411 - protein, 9 aa, Homo Sapiens
TYAAPRGST

SEQ ID NO: 582412 - protein, 9 aa, Homo Sapiens
KQTFEEWDF

SEQ ID NO: 582413 - protein, 9 aa, Homo Sapiens
MPKRRLHAL

SEQ ID NO: 582414 - protein, 9 aa, Homo Sapiens
LFIIPLEGC

SEQ ID NO: 582415 - protein, 9 aa, Homo Sapiens
NGRALVHSM

SEQ ID NO: 582416 - protein, 9 aa, Homo Sapiens
DKETGNGRA

SEQ ID NO: 582417 - protein, 9 aa, Homo Sapiens
YISQVPVLA

SEQ ID NO: 582418 - protein, 9 aa, Homo Sapiens
EEVQKLDNL

SEQ ID NO: 582419 - protein, 9 aa, Homo Sapiens
PILNSGTPD

SEQ ID NO: 582420 - protein, 9 aa, Homo Sapiens
DAGEIQLVA

SEQ ID NO: 582421 - protein, 9 aa, Homo Sapiens
TFLETVHVY

SEQ ID NO: 582422 - protein, 9 aa, Homo Sapiens
FKGFSGARE

SEQ ID NO: 582423 - protein, 9 aa, Homo Sapiens
VFLLEKIDT

SEQ ID NO: 582424 - protein, 9 aa, Homo Sapiens
LDCARLPVA

SEQ ID NO: 582425 - protein, 9 aa, Homo Sapiens
LNITNKTGF

SEQ ID NO: 582426 - protein, 9 aa, Homo Sapiens
VGAFCMPLY

SEQ ID NO: 582427 - protein, 9 aa, Homo Sapiens
GGPEQQVST

SEQ ID NO: 582428 - protein, 9 aa, Homo Sapiens
SDVGRVQMT

SEQ ID NO: 582429 - protein, 9 aa, Homo Sapiens
CKYCGKAFR

SEQ ID NO: 582430 - protein, 9 aa, Homo Sapiens
RPQNCYTGS

SEQ ID NO: 582431 - protein, 9 aa, Homo Sapiens
PYGTTGVNC

SEQ ID NO: 582432 - protein, 9 aa, Homo Sapiens
HSLDYCFVL

SEQ ID NO: 582433 - protein, 9 aa, Homo Sapiens
KAPGSQRST

SEQ ID NO: 582434 - protein, 9 aa, Homo Sapiens
AAAATLPAH

SEQ ID NO: 582435 - protein, 9 aa, Homo Sapiens
VVLITNVCL

SEQ ID NO: 582436 - protein, 9 aa, Homo Sapiens
RDAPRASSL

SEQ ID NO: 582437 - protein, 9 aa, Homo Sapiens
RFGQSSVLG

SEQ ID NO: 582438 - protein, 9 aa, Homo Sapiens
KHTTDFYFT

SEQ ID NO: 582439 - protein, 9 aa, Homo Sapiens
ALISCRSRH

SEQ ID NO: 582440 - protein, 9 aa, Homo Sapiens
NKTGFHYCS

SEQ ID NO: 582441 - protein, 9 aa, Homo Sapiens
DSPRQLLLV

SEQ ID NO: 582442 - protein, 9 aa, Homo Sapiens
REKLFSSQC

SEQ ID NO: 582443 - protein, 9 aa, Homo Sapiens
LQNSPVNVN

SEQ ID NO: 582444 - protein, 9 aa, Homo Sapiens
ASGAAAATL

SEQ ID NO: 582445 - protein, 9 aa, Homo Sapiens
LGEHVHASD

SEQ ID NO: 582446 - protein, 9 aa, Homo Sapiens
HNRTQCIKS

SEQ ID NO: 582447 - protein, 9 aa, Homo Sapiens
KHFSEAFHQ

SEQ ID NO: 582448 - protein, 9 aa, Homo Sapiens
FQIVYFRAL

SEQ ID NO: 582449 - protein, 9 aa, Homo Sapiens
IIPLEGCGF

SEQ ID NO: 582450 - protein, 9 aa, Homo Sapiens
SGDFQIVYF

SEQ ID NO: 582451 - protein, 9 aa, Homo Sapiens
LRGESPLAL

SEQ ID NO: 582452 - protein, 9 aa, Homo Sapiens
EANPTSAAG

SEQ ID NO: 582453 - protein, 9 aa, Homo Sapiens
YAAPRGSTP

SEQ ID NO: 582454 - protein, 9 aa, Homo Sapiens
TPMYLFLSL

SEQ ID NO: 582455 - protein, 9 aa, Homo Sapiens
YIAICQPLH

SEQ ID NO: 582456 - protein, 9 aa, Homo Sapiens
DKYLCRCPY

SEQ ID NO: 582457 - protein, 9 aa, Homo Sapiens
TIRATACHG

SEQ ID NO: 582458 - protein, 9 aa, Homo Sapiens
NAGISLKKK

SEQ ID NO: 582459 - protein, 9 aa, Homo Sapiens
VMYLTLLHL

SEQ ID NO: 582460 - protein, 9 aa, Homo Sapiens
FLLEKIDTD

SEQ ID NO: 582461 - protein, 9 aa, Homo Sapiens
TSDETMCKS

SEQ ID NO: 582462 - protein, 9 aa, Homo Sapiens
WNRKPDIQS

SEQ ID NO: 582463 - protein, 9 aa, Homo Sapiens
ERLLPVTFV

SEQ ID NO: 582464 - protein, 9 aa, Homo Sapiens
PERQEAAGT

SEQ ID NO: 582465 - protein, 9 aa, Homo Sapiens
ANPTSAAGS

SEQ ID NO: 582466 - protein, 9 aa, Homo Sapiens
NYISQVPVL

SEQ ID NO: 582467 - protein, 9 aa, Homo Sapiens
APLVLCNGE

SEQ ID NO: 582468 - protein, 9 aa, Homo Sapiens
DNLYQQKIK

SEQ ID NO: 582469 - protein, 9 aa, Homo Sapiens
INSTGILSS

SEQ ID NO: 582470 - protein, 9 aa, Homo Sapiens
PVNVNPPPL

SEQ ID NO: 582471 - protein, 9 aa, Homo Sapiens
FCSINIPEP

SEQ ID NO: 582472 - protein, 9 aa, Homo Sapiens
QRPQNCYTG

SEQ ID NO: 582473 - protein, 9 aa, Homo Sapiens
TPDALEEDT

SEQ ID NO: 582474 - protein, 9 aa, Homo Sapiens
VDESVVRFH

SEQ ID NO: 582475 - protein, 9 aa, Homo Sapiens
APRASSLPR

SEQ ID NO: 582476 - protein, 9 aa, Homo Sapiens
PMYLFLSLL

SEQ ID NO: 582477 - protein, 9 aa, Homo Sapiens
LDGDLESLI

SEQ ID NO: 582478 - protein, 9 aa, Homo Sapiens
PTSAAGSRL

SEQ ID NO: 582479 - protein, 9 aa, Homo Sapiens
RLLLPSQSS

SEQ ID NO: 582480 - protein, 9 aa, Homo Sapiens
HYKEYYCLA

SEQ ID NO: 582481 - protein, 9 aa, Homo Sapiens
PLEGCGFVS

SEQ ID NO: 582482 - protein, 9 aa, Homo Sapiens
MPLYVPYVL

SEQ ID NO: 582483 - protein, 9 aa, Homo Sapiens
LHALANKGI

SEQ ID NO: 582484 - protein, 9 aa, Homo Sapiens
GARGCETQK

SEQ ID NO: 582485 - protein, 9 aa, Homo Sapiens
TSAAGSRLA

SEQ ID NO: 582486 - protein, 9 aa, Homo Sapiens
NLNRYSTSL

SEQ ID NO: 582487 - protein, 9 aa, Homo Sapiens
PTDMGTFFE

SEQ ID NO: 582488 - protein, 9 aa, Homo Sapiens
FLQALFLIQ

SEQ ID NO: 582489 - protein, 9 aa, Homo Sapiens
ALDGDLESL

SEQ ID NO: 582490 - protein, 9 aa, Homo Sapiens
TLFIRNAGI

SEQ ID NO: 582491 - protein, 9 aa, Homo Sapiens
GMPQQLSRS

SEQ ID NO: 582492 - protein, 9 aa, Homo Sapiens
LPYRATFIA

SEQ ID NO: 582493 - protein, 9 aa, Homo Sapiens
GVAMGVYNQ

SEQ ID NO: 582494 - protein, 9 aa, Homo Sapiens
EIGFQGDDL

SEQ ID NO: 582495 - protein, 9 aa, Homo Sapiens
VLATEHNRT

SEQ ID NO: 582496 - protein, 9 aa, Homo Sapiens
LTSDETMCK

SEQ ID NO: 582497 - protein, 9 aa, Homo Sapiens
YLCRCPYGT

SEQ ID NO: 582498 - protein, 9 aa, Homo Sapiens
AEDAGEIQL

SEQ ID NO: 582499 - protein, 9 aa, Homo Sapiens
YLTLLHLYK

SEQ ID NO: 582500 - protein, 9 aa, Homo Sapiens
YKRSKFKKL

SEQ ID NO: 582501 - protein, 9 aa, Homo Sapiens
SITLFTYAR

SEQ ID NO: 582502 - protein, 9 aa, Homo Sapiens
PRQLLLVLV

SEQ ID NO: 582503 - protein, 9 aa, Homo Sapiens
FNVSEPDTC

SEQ ID NO: 582504 - protein, 9 aa, Homo Sapiens
QKLDNLYQQ

SEQ ID NO: 582505 - protein, 9 aa, Homo Sapiens
GVLQRTNSL

SEQ ID NO: 582506 - protein, 9 aa, Homo Sapiens
PTPWNTLRQ

SEQ ID NO: 582507 - protein, 9 aa, Homo Sapiens
SKAPGSQRS

SEQ ID NO: 582508 - protein, 9 aa, Homo Sapiens
IQLVAENAE

SEQ ID NO: 582509 - protein, 9 aa, Homo Sapiens
RQEAAGTGK

SEQ ID NO: 582510 - protein, 9 aa, Homo Sapiens
HANNSHGNV

SEQ ID NO: 582511 - protein, 9 aa, Homo Sapiens
GTPDCDPNL

SEQ ID NO: 582512 - protein, 9 aa, Homo Sapiens
LSRSCLTLF

SEQ ID NO: 582513 - protein, 9 aa, Homo Sapiens
TAGLVPGMS

SEQ ID NO: 582514 - protein, 9 aa, Homo Sapiens
THMLNPIIY

SEQ ID NO: 582515 - protein, 9 aa, Homo Sapiens
IIRERLLPV

SEQ ID NO: 582516 - protein, 9 aa, Homo Sapiens
RWKTFLETV

SEQ ID NO: 582517 - protein, 9 aa, Homo Sapiens
VNPPPLSKM

SEQ ID NO: 582518 - protein, 9 aa, Homo Sapiens
FDRYIAICQ

SEQ ID NO: 582519 - protein, 9 aa, Homo Sapiens
CQLLLEQRT

SEQ ID NO: 582520 - protein, 9 aa, Homo Sapiens
AVAQSWHME

SEQ ID NO: 582521 - protein, 9 aa, Homo Sapiens
FYFTIAGHQ

SEQ ID NO: 582522 - protein, 9 aa, Homo Sapiens
LGEVLLVAQ

SEQ ID NO: 582523 - protein, 9 aa, Homo Sapiens
ALFTEFASN

SEQ ID NO: 582524 - protein, 9 aa, Homo Sapiens
CQPLHYSTI

SEQ ID NO: 582525 - protein, 9 aa, Homo Sapiens
EKRLLLPSQ

SEQ ID NO: 582526 - protein, 9 aa, Homo Sapiens
TDSPRQLLL

SEQ ID NO: 582527 - protein, 9 aa, Homo Sapiens
FHNYALVIF

SEQ ID NO: 582528 - protein, 9 aa, Homo Sapiens
SRKGMPQQL

SEQ ID NO: 582529 - protein, 9 aa, Homo Sapiens
CAYRKRPRM

SEQ ID NO: 582530 - protein, 9 aa, Homo Sapiens
EEDTIHKWE

SEQ ID NO: 582531 - protein, 9 aa, Homo Sapiens
SSAPGSGNP

SEQ ID NO: 582532 - protein, 9 aa, Homo Sapiens
NDLLDCLLE

SEQ ID NO: 582533 - protein, 9 aa, Homo Sapiens
RWKQLSFPQ

SEQ ID NO: 582534 - protein, 9 aa, Homo Sapiens
LPWLPLLKN

SEQ ID NO: 582535 - protein, 9 aa, Homo Sapiens
QWDSPAPVT

SEQ ID NO: 582536 - protein, 9 aa, Homo Sapiens
SSDEDKHKI

SEQ ID NO: 582537 - protein, 9 aa, Homo Sapiens
QLEWTLETL

SEQ ID NO: 582538 - protein, 9 aa, Homo Sapiens
AGVVLNSRT

SEQ ID NO: 582539 - protein, 9 aa, Homo Sapiens
LGALLNKEP

SEQ ID NO: 582540 - protein, 9 aa, Homo Sapiens
LYLGVSRHK

SEQ ID NO: 582541 - protein, 9 aa, Homo Sapiens
VLIFASFLG

SEQ ID NO: 582542 - protein, 9 aa, Homo Sapiens
GGDISKPLT

SEQ ID NO: 582543 - protein, 9 aa, Homo Sapiens
LSFPQQEAQ

SEQ ID NO: 582544 - protein, 9 aa, Homo Sapiens
FSKSIEIPS

SEQ ID NO: 582545 - protein, 9 aa, Homo Sapiens
GCIKNDIQF

SEQ ID NO: 582546 - protein, 9 aa, Homo Sapiens
KEFKTHLGI

SEQ ID NO: 582547 - protein, 9 aa, Homo Sapiens
WIPEGQRAR

SEQ ID NO: 582548 - protein, 9 aa, Homo Sapiens
EEMLWGSIM

SEQ ID NO: 582549 - protein, 9 aa, Homo Sapiens
VLARRRLNT

SEQ ID NO: 582550 - protein, 9 aa, Homo Sapiens
ESLRCYYWA

SEQ ID NO: 582551 - protein, 9 aa, Homo Sapiens
AAGDGPTQS

SEQ ID NO: 582552 - protein, 9 aa, Homo Sapiens
VMFLFPVTV

SEQ ID NO: 582553 - protein, 9 aa, Homo Sapiens
NLNQYAIFL

SEQ ID NO: 582554 - protein, 9 aa, Homo Sapiens
FKTHLGIFL

SEQ ID NO: 582555 - protein, 9 aa, Homo Sapiens
KIVVFNTSG

SEQ ID NO: 582556 - protein, 9 aa, Homo Sapiens
AIQGDLNDA

SEQ ID NO: 582557 - protein, 9 aa, Homo Sapiens
RDLGEENFK

SEQ ID NO: 582558 - protein, 8 aa, Homo Sapiens
MDVSGVGF

SEQ ID NO: 582559 - protein, 9 aa, Homo Sapiens
ETLLEQLNE

SEQ ID NO: 582560 - protein, 9 aa, Homo Sapiens
SQQKRSRGK

SEQ ID NO: 582561 - protein, 9 aa, Homo Sapiens
DIQFSLFTT

SEQ ID NO: 582562 - protein, 9 aa, Homo Sapiens
FIQKGTLIV

SEQ ID NO: 582563 - protein, 9 aa, Homo Sapiens
YGRLGDGIG

SEQ ID NO: 582564 - protein, 9 aa, Homo Sapiens
KPTGRWLGR

SEQ ID NO: 582565 - protein, 9 aa, Homo Sapiens
PQLVTGRCS

SEQ ID NO: 582566 - protein, 9 aa, Homo Sapiens
FASFLGFTE

SEQ ID NO: 582567 - protein, 9 aa, Homo Sapiens
QDSLVILTV

SEQ ID NO: 582568 - protein, 9 aa, Homo Sapiens
CLWTLRKLS

SEQ ID NO: 582569 - protein, 9 aa, Homo Sapiens
HTPVYVFLS

SEQ ID NO: 582570 - protein, 9 aa, Homo Sapiens
AGTINDLLD

SEQ ID NO: 582571 - protein, 9 aa, Homo Sapiens
LTPPTLPRC

SEQ ID NO: 582572 - protein, 9 aa, Homo Sapiens
LKNASLSLE

SEQ ID NO: 582573 - protein, 9 aa, Homo Sapiens
KVFMERNYE

SEQ ID NO: 582574 - protein, 9 aa, Homo Sapiens
WKNKGLWIP

SEQ ID NO: 582575 - protein, 9 aa, Homo Sapiens
NLLAERTSR

SEQ ID NO: 582576 - protein, 9 aa, Homo Sapiens
SLHRPMNFF

SEQ ID NO: 582577 - protein, 9 aa, Homo Sapiens
MKLPHLLNS

SEQ ID NO: 582578 - protein, 9 aa, Homo Sapiens
GQGPACRAQ

SEQ ID NO: 582579 - protein, 9 aa, Homo Sapiens
TENAQKVGH

SEQ ID NO: 582580 - protein, 9 aa, Homo Sapiens
EALGALLNK

SEQ ID NO: 582581 - protein, 9 aa, Homo Sapiens
ATREEDSCF

SEQ ID NO: 582582 - protein, 9 aa, Homo Sapiens
GYGRLGDGI

SEQ ID NO: 582583 - protein, 9 aa, Homo Sapiens
QKGTLIVHQ

SEQ ID NO: 582584 - protein, 9 aa, Homo Sapiens
ATSMDVQQE

SEQ ID NO: 582585 - protein, 9 aa, Homo Sapiens
FMYGCLISP

SEQ ID NO: 582586 - protein, 9 aa, Homo Sapiens
ENAQKVGHF

SEQ ID NO: 582587 - protein, 9 aa, Homo Sapiens
AGARSLELG

SEQ ID NO: 582588 - protein, 9 aa, Homo Sapiens
SSSDSGRLH

SEQ ID NO: 582589 - protein, 9 aa, Homo Sapiens
KPGIPGLPS

SEQ ID NO: 582590 - protein, 9 aa, Homo Sapiens
TSEGSDRKK

SEQ ID NO: 582591 - protein, 9 aa, Homo Sapiens
KVGHFDKEI

SEQ ID NO: 582592 - protein, 9 aa, Homo Sapiens
VTGIHSCSI

SEQ ID NO: 582593 - protein, 9 aa, Homo Sapiens
QMHKSAIKD

SEQ ID NO: 582594 - protein, 9 aa, Homo Sapiens
ASFLRAQEW

SEQ ID NO: 582595 - protein, 9 aa, Homo Sapiens
GDISKPLTD

SEQ ID NO: 582596 - protein, 9 aa, Homo Sapiens
SQGAEVSLR

SEQ ID NO: 582597 - protein, 9 aa, Homo Sapiens
PRWCTWPLP

SEQ ID NO: 582598 - protein, 9 aa, Homo Sapiens
SCSINETCF

SEQ ID NO: 582599 - protein, 9 aa, Homo Sapiens
SPAVATKSR

SEQ ID NO: 582600 - protein, 9 aa, Homo Sapiens
RSPVGPGCP

SEQ ID NO: 582601 - protein, 9 aa, Homo Sapiens
KELSENIND

SEQ ID NO: 582602 - protein, 9 aa, Homo Sapiens
PTGRWLGRS

SEQ ID NO: 582603 - protein, 9 aa, Homo Sapiens
LHRPMNFFL

SEQ ID NO: 582604 - protein, 9 aa, Homo Sapiens
RTEEEMLWG

SEQ ID NO: 582605 - protein, 9 aa, Homo Sapiens
DEDKHKIAD

SEQ ID NO: 582606 - protein, 9 aa, Homo Sapiens
SLKGPGDQW

SEQ ID NO: 582607 - protein, 9 aa, Homo Sapiens
PRPRWCTWP

SEQ ID NO: 582608 - protein, 9 aa, Homo Sapiens
KNKGLWIPE

SEQ ID NO: 582609 - protein, 9 aa, Homo Sapiens
KSRRFAAAR

SEQ ID NO: 582610 - protein, 9 aa, Homo Sapiens
RLGDGIGYV

SEQ ID NO: 582611 - protein, 9 aa, Homo Sapiens
RPGIVRGMY

SEQ ID NO: 582612 - protein, 9 aa, Homo Sapiens
MYGCLISPN

SEQ ID NO: 582613 - protein, 9 aa, Homo Sapiens
SLSLESTKS

SEQ ID NO: 582614 - protein, 9 aa, Homo Sapiens
DSSREVNTT

SEQ ID NO: 582615 - protein, 9 aa, Homo Sapiens
LENLPWLPL

SEQ ID NO: 582616 - protein, 9 aa, Homo Sapiens
WKQLSFPQQ

SEQ ID NO: 582617 - protein, 9 aa, Homo Sapiens
VPSTAPVCG

SEQ ID NO: 582618 - protein, 9 aa, Homo Sapiens
SHPEWVKVY

SEQ ID NO: 582619 - protein, 9 aa, Homo Sapiens
PPMRRLGMI

SEQ ID NO: 582620 - protein, 9 aa, Homo Sapiens
LDSRLHTPV

SEQ ID NO: 582621 - protein, 9 aa, Homo Sapiens
VILTVMATL

SEQ ID NO: 582622 - protein, 9 aa, Homo Sapiens
AWSYNNSTE

SEQ ID NO: 582623 - protein, 9 aa, Homo Sapiens
EPLPRPRWC

SEQ ID NO: 582624 - protein, 9 aa, Homo Sapiens
ALQHIESPS

SEQ ID NO: 582625 - protein, 9 aa, Homo Sapiens
PGAVATSLL

SEQ ID NO: 582626 - protein, 9 aa, Homo Sapiens
PSLHRPMNF

SEQ ID NO: 582627 - protein, 9 aa, Homo Sapiens
GDGPTQSAV

SEQ ID NO: 582628 - protein, 9 aa, Homo Sapiens
IRYTSVERL

SEQ ID NO: 582629 - protein, 9 aa, Homo Sapiens
PVYVFLSHL

SEQ ID NO: 582630 - protein, 9 aa, Homo Sapiens
WTLETLLEQ

SEQ ID NO: 582631 - protein, 9 aa, Homo Sapiens
TSLLRRPRR

SEQ ID NO: 582632 - protein, 9 aa, Homo Sapiens
GGDTDMTGY

SEQ ID NO: 582633 - protein, 9 aa, Homo Sapiens
LSTNYPHNY

SEQ ID NO: 582634 - protein, 9 aa, Homo Sapiens
LETLLEQLN

SEQ ID NO: 582635 - protein, 9 aa, Homo Sapiens
LMTSSALDT

SEQ ID NO: 582636 - protein, 9 aa, Homo Sapiens
ASLSLESTK

SEQ ID NO: 582637 - protein, 9 aa, Homo Sapiens
VSPVFTQSR

SEQ ID NO: 582638 - protein, 9 aa, Homo Sapiens
DLHIMKLPH

SEQ ID NO: 582639 - protein, 9 aa, Homo Sapiens
TKASVVTDD

SEQ ID NO: 582640 - protein, 9 aa, Homo Sapiens
PGIPGLPSR

SEQ ID NO: 582641 - protein, 9 aa, Homo Sapiens
ACRAQVPRK

SEQ ID NO: 582642 - protein, 9 aa, Homo Sapiens
PVRGPVTGL

SEQ ID NO: 582643 - protein, 9 aa, Homo Sapiens
QIRYTSVER

SEQ ID NO: 582644 - protein, 9 aa, Homo Sapiens
KGPGDQWSA

SEQ ID NO: 582645 - protein, 9 aa, Homo Sapiens
KKPKALQHI

SEQ ID NO: 582646 - protein, 9 aa, Homo Sapiens
PCWKSLTNS

SEQ ID NO: 582647 - protein, 9 aa, Homo Sapiens
RLNTGEKSY

SEQ ID NO: 582648 - protein, 9 aa, Homo Sapiens
RLDSSLPPM

SEQ ID NO: 582649 - protein, 9 aa, Homo Sapiens
AQVPRKPPP

SEQ ID NO: 582650 - protein, 9 aa, Homo Sapiens
FSLFTTSPL

SEQ ID NO: 582651 - protein, 9 aa, Homo Sapiens
LFPVTVGSL

SEQ ID NO: 582652 - protein, 9 aa, Homo Sapiens
QFAAVLARR

SEQ ID NO: 582653 - protein, 9 aa, Homo Sapiens
SRHKPINRR

SEQ ID NO: 582654 - protein, 9 aa, Homo Sapiens
QVYEAIQGD

SEQ ID NO: 582655 - protein, 9 aa, Homo Sapiens
DSFVVERQP

SEQ ID NO: 582656 - protein, 9 aa, Homo Sapiens
EYAYRHGIA

SEQ ID NO: 582657 - protein, 9 aa, Homo Sapiens
LAYDSSREV

SEQ ID NO: 582658 - protein, 9 aa, Homo Sapiens
AEGGQKLED

SEQ ID NO: 582659 - protein, 9 aa, Homo Sapiens
PENKDSDKV

SEQ ID NO: 582660 - protein, 9 aa, Homo Sapiens
NRTENAQKV

SEQ ID NO: 582661 - protein, 9 aa, Homo Sapiens
GYVAYVAKD

SEQ ID NO: 582662 - protein, 9 aa, Homo Sapiens
SSALDTSQV

SEQ ID NO: 582663 - protein, 9 aa, Homo Sapiens
RPMNFFLGH

SEQ ID NO: 582664 - protein, 9 aa, Homo Sapiens
WVKVYGPGV

SEQ ID NO: 582665 - protein, 9 aa, Homo Sapiens
VAGGDISKP

SEQ ID NO: 582666 - protein, 9 aa, Homo Sapiens
AVATSLLRR

SEQ ID NO: 582667 - protein, 9 aa, Homo Sapiens
SRAGGVGEA

SEQ ID NO: 582668 - protein, 9 aa, Homo Sapiens
FPQQEAQKI

SEQ ID NO: 582669 - protein, 9 aa, Homo Sapiens
RSIREIILP

SEQ ID NO: 582670 - protein, 9 aa, Homo Sapiens
AASSRRRSA

SEQ ID NO: 582671 - protein, 9 aa, Homo Sapiens
IESPSETNK

SEQ ID NO: 582672 - protein, 9 aa, Homo Sapiens
LVQQWPQMH

SEQ ID NO: 582673 - protein, 9 aa, Homo Sapiens
TGIHSCSIN

SEQ ID NO: 582674 - protein, 9 aa, Homo Sapiens
KGTLIVHQR

SEQ ID NO: 582675 - protein, 9 aa, Homo Sapiens
TVMATLKIR

SEQ ID NO: 582676 - protein, 9 aa, Homo Sapiens
KLADLPTVE

SEQ ID NO: 582677 - protein, 9 aa, Homo Sapiens
LKPKVPASA

SEQ ID NO: 582678 - protein, 9 aa, Homo Sapiens
VNLEEDKLP

SEQ ID NO: 582679 - protein, 9 aa, Homo Sapiens
LRRPRRTTS

SEQ ID NO: 582680 - protein, 9 aa, Homo Sapiens
VCKETIGWR

SEQ ID NO: 582681 - protein, 9 aa, Homo Sapiens
IVVFNTSGG

SEQ ID NO: 582682 - protein, 9 aa, Homo Sapiens
LWIPEGQRA

SEQ ID NO: 582683 - protein, 9 aa, Homo Sapiens
YNNSTEAMT

SEQ ID NO: 582684 - protein, 9 aa, Homo Sapiens
SDEDKHKIA

SEQ ID NO: 582685 - protein, 9 aa, Homo Sapiens
APSLHRPMN

SEQ ID NO: 582686 - protein, 9 aa, Homo Sapiens
CRRMCRAIG

SEQ ID NO: 582687 - protein, 9 aa, Homo Sapiens
GRLVDTTGI

SEQ ID NO: 582688 - protein, 9 aa, Homo Sapiens
RVSIQAVNL

SEQ ID NO: 582689 - protein, 9 aa, Homo Sapiens
EMLWGSIMR

SEQ ID NO: 582690 - protein, 9 aa, Homo Sapiens
GFIQKGTLI

SEQ ID NO: 582691 - protein, 9 aa, Homo Sapiens
SAQDTCIGS

SEQ ID NO: 582692 - protein, 9 aa, Homo Sapiens
ALDTSQVKD

SEQ ID NO: 582693 - protein, 9 aa, Homo Sapiens
IQAVNLEED

SEQ ID NO: 582694 - protein, 9 aa, Homo Sapiens
LVTGRCSTR

SEQ ID NO: 582695 - protein, 9 aa, Homo Sapiens
KGLWIPEGQ

SEQ ID NO: 582696 - protein, 9 aa, Homo Sapiens
VPIPGLIPG

SEQ ID NO: 582697 - protein, 9 aa, Homo Sapiens
TPTSQQKRS

SEQ ID NO: 582698 - protein, 9 aa, Homo Sapiens
FLGFTEIEA

SEQ ID NO: 582699 - protein, 9 aa, Homo Sapiens
AVCKETIGW

SEQ ID NO: 582700 - protein, 9 aa, Homo Sapiens
PQLEWTLET

SEQ ID NO: 582701 - protein, 9 aa, Homo Sapiens
GAGTINDLL

SEQ ID NO: 582702 - protein, 9 aa, Homo Sapiens
LRKLSDAAT

SEQ ID NO: 582703 - protein, 9 aa, Homo Sapiens
GITKAKTGG

SEQ ID NO: 582704 - protein, 9 aa, Homo Sapiens
DKPKKVLSG

SEQ ID NO: 582705 - protein, 9 aa, Homo Sapiens
MFLFPVTVG

SEQ ID NO: 582706 - protein, 9 aa, Homo Sapiens
FLRAQEWAA

SEQ ID NO: 582707 - protein, 9 aa, Homo Sapiens
NLPWLPLLK

SEQ ID NO: 582708 - protein, 9 aa, Homo Sapiens
HCSSSDSGR

SEQ ID NO: 582709 - protein, 9 aa, Homo Sapiens
AVNLEEDKL

SEQ ID NO: 582710 - protein, 9 aa, Homo Sapiens
STNYPHNYT

SEQ ID NO: 582711 - protein, 9 aa, Homo Sapiens
GLTPPTLPR

SEQ ID NO: 582712 - protein, 9 aa, Homo Sapiens
LPSRAGGVG

SEQ ID NO: 582713 - protein, 9 aa, Homo Sapiens
RAQEWAAES

SEQ ID NO: 582714 - protein, 9 aa, Homo Sapiens
MREMRAGGC

SEQ ID NO: 582715 - protein, 9 aa, Homo Sapiens
GSHPEWVKV

SEQ ID NO: 582716 - protein, 9 aa, Homo Sapiens
VLSTNYPHN

SEQ ID NO: 582717 - protein, 9 aa, Homo Sapiens
RHKPINRRV

SEQ ID NO: 582718 - protein, 9 aa, Homo Sapiens
FAAVLARRR

SEQ ID NO: 582719 - protein, 9 aa, Homo Sapiens
NDVTLMKEE

SEQ ID NO: 582720 - protein, 9 aa, Homo Sapiens
DISKPLTDQ

SEQ ID NO: 582721 - protein, 9 aa, Homo Sapiens
LLLKFSKSI

SEQ ID NO: 582722 - protein, 9 aa, Homo Sapiens
GPGCPLKPT

SEQ ID NO: 582723 - protein, 9 aa, Homo Sapiens
GVEERSHKL

SEQ ID NO: 582724 - protein, 9 aa, Homo Sapiens
LGYGRLGDG

SEQ ID NO: 582725 - protein, 9 aa, Homo Sapiens
SPIPSVHPV

SEQ ID NO: 582726 - protein, 9 aa, Homo Sapiens
TGLKAALLK

SEQ ID NO: 582727 - protein, 9 aa, Homo Sapiens
GHILKSAQD

SEQ ID NO: 582728 - protein, 9 aa, Homo Sapiens
QWSASAASS

SEQ ID NO: 582729 - protein, 9 aa, Homo Sapiens
YLNTKIADE

SEQ ID NO: 582730 - protein, 9 aa, Homo Sapiens
KQLSFPQQE

SEQ ID NO: 582731 - protein, 9 aa, Homo Sapiens
ILVRDAKRS

SEQ ID NO: 582732 - protein, 9 aa, Homo Sapiens
LSLESTKSP

SEQ ID NO: 582733 - protein, 9 aa, Homo Sapiens
EKENVRTVL

SEQ ID NO: 582734 - protein, 9 aa, Homo Sapiens
MSRSGWKVG

SEQ ID NO: 582735 - protein, 9 aa, Homo Sapiens
TGRCSTRAF

SEQ ID NO: 582736 - protein, 9 aa, Homo Sapiens
SLMTSSALD

SEQ ID NO: 582737 - protein, 9 aa, Homo Sapiens
LADLPTVEA

SEQ ID NO: 582738 - protein, 9 aa, Homo Sapiens
ERTSRSSPV

SEQ ID NO: 582739 - protein, 9 aa, Homo Sapiens
RARQGVEER

SEQ ID NO: 582740 - protein, 9 aa, Homo Sapiens
GPPEPCPRV

SEQ ID NO: 582741 - protein, 9 aa, Homo Sapiens
AVLARRRLN

SEQ ID NO: 582742 - protein, 9 aa, Homo Sapiens
ASSAPGSGN

SEQ ID NO: 582743 - protein, 9 aa, Homo Sapiens
PACRAQVPR

SEQ ID NO: 582744 - protein, 9 aa, Homo Sapiens
SRSSPVRGP

SEQ ID NO: 582745 - protein, 9 aa, Homo Sapiens
VSPIPSVHP

SEQ ID NO: 582746 - protein, 9 aa, Homo Sapiens
PPPELHLAQ

SEQ ID NO: 582747 - protein, 9 aa, Homo Sapiens
KETIGWRKD

SEQ ID NO: 582748 - protein, 9 aa, Homo Sapiens
VMATLKIRN

SEQ ID NO: 582749 - protein, 9 aa, Homo Sapiens
HSCSINETC

SEQ ID NO: 582750 - protein, 9 aa, Homo Sapiens
VVKFSIRLV

SEQ ID NO: 582751 - protein, 9 aa, Homo Sapiens
LMSRSGWKV

SEQ ID NO: 582752 - protein, 9 aa, Homo Sapiens
KIFDEDNIL

SEQ ID NO: 582753 - protein, 9 aa, Homo Sapiens
GIPGLPSRA

SEQ ID NO: 582754 - protein, 9 aa, Homo Sapiens
IQFSLFTTS

SEQ ID NO: 582755 - protein, 9 aa, Homo Sapiens
TSRSSPVRG

SEQ ID NO: 582756 - protein, 9 aa, Homo Sapiens
TPPTLPRCV

SEQ ID NO: 582757 - protein, 9 aa, Homo Sapiens
KSECIQLHL

SEQ ID NO: 582758 - protein, 9 aa, Homo Sapiens
QGKIFDEDN

SEQ ID NO: 582759 - protein, 9 aa, Homo Sapiens
PAPVTYQKC

SEQ ID NO: 582760 - protein, 9 aa, Homo Sapiens
GLIPGPISG

SEQ ID NO: 582761 - protein, 9 aa, Homo Sapiens
PANVGITKA

SEQ ID NO: 582762 - protein, 9 aa, Homo Sapiens
HRLNTGEKS

SEQ ID NO: 582763 - protein, 9 aa, Homo Sapiens
ATSLLRRPR

SEQ ID NO: 582764 - protein, 9 aa, Homo Sapiens
DSSDEDKHK

SEQ ID NO: 582765 - protein, 9 aa, Homo Sapiens
KLSDAATKQ

SEQ ID NO: 582766 - protein, 9 aa, Homo Sapiens
DSLVILTVM

SEQ ID NO: 582767 - protein, 9 aa, Homo Sapiens
LTVMATLKI

SEQ ID NO: 582768 - protein, 9 aa, Homo Sapiens
PGLPSRAGG

SEQ ID NO: 582769 - protein, 9 aa, Homo Sapiens
MTSSALDTS

SEQ ID NO: 582770 - protein, 9 aa, Homo Sapiens
KNASLSLES

SEQ ID NO: 582771 - protein, 9 aa, Homo Sapiens
PTLPRCVST

SEQ ID NO: 582772 - protein, 9 aa, Homo Sapiens
SLELGEALA

SEQ ID NO: 582773 - protein, 9 aa, Homo Sapiens
RVGESTTHR

SEQ ID NO: 582774 - protein, 9 aa, Homo Sapiens
FKDSFVVER

SEQ ID NO: 582775 - protein, 9 aa, Homo Sapiens
EDKHKIADE

SEQ ID NO: 582776 - protein, 9 aa, Homo Sapiens
RESQGAEVS

SEQ ID NO: 582777 - protein, 9 aa, Homo Sapiens
RPRRTTSAS

SEQ ID NO: 582778 - protein, 9 aa, Homo Sapiens
GDTDMTGYV

SEQ ID NO: 582779 - protein, 9 aa, Homo Sapiens
DSPAPVTYQ

SEQ ID NO: 582780 - protein, 9 aa, Homo Sapiens
PSRAGGVGE

SEQ ID NO: 582781 - protein, 9 aa, Homo Sapiens
AYRHGIAEA

SEQ ID NO: 582782 - protein, 9 aa, Homo Sapiens
GSSGPCWKS

SEQ ID NO: 582783 - protein, 9 aa, Homo Sapiens
LVRDAKRSI

SEQ ID NO: 582784 - protein, 9 aa, Homo Sapiens
CAYDPEASS

SEQ ID NO: 582785 - protein, 9 aa, Homo Sapiens
ENINDVTLM

SEQ ID NO: 582786 - protein, 9 aa, Homo Sapiens
GIVRGMYLN

SEQ ID NO: 582787 - protein, 9 aa, Homo Sapiens
DPALWAALS

SEQ ID NO: 582788 - protein, 9 aa, Homo Sapiens
LLKRSPVGP

SEQ ID NO: 582789 - protein, 9 aa, Homo Sapiens
SFKERVAEG

SEQ ID NO: 582790 - protein, 9 aa, Homo Sapiens
HGIAEAVGL

SEQ ID NO: 582791 - protein, 9 aa, Homo Sapiens
SPAPVTYQK

SEQ ID NO: 582792 - protein, 9 aa, Homo Sapiens
NNSTEAMTY

SEQ ID NO: 582793 - protein, 9 aa, Homo Sapiens
PRKPPPGRR

SEQ ID NO: 582794 - protein, 9 aa, Homo Sapiens
PSSEEEDGD

SEQ ID NO: 582795 - protein, 9 aa, Homo Sapiens
PELHLAQVF

SEQ ID NO: 582796 - protein, 9 aa, Homo Sapiens
CKAFKHSST

SEQ ID NO: 582797 - protein, 9 aa, Homo Sapiens
AQDTCIGSE

SEQ ID NO: 582798 - protein, 9 aa, Homo Sapiens
LRTVTLSTK

SEQ ID NO: 582799 - protein, 9 aa, Homo Sapiens
EFSQTGNKS

SEQ ID NO: 582800 - protein, 9 aa, Homo Sapiens
SSPVRGPVT

SEQ ID NO: 582801 - protein, 9 aa, Homo Sapiens
GSLKLADLP

SEQ ID NO: 582802 - protein, 9 aa, Homo Sapiens
PAVATKSRR

SEQ ID NO: 582803 - protein, 9 aa, Homo Sapiens
SAPSVSPIP

SEQ ID NO: 582804 - protein, 9 aa, Homo Sapiens
VRGMYLNTK

SEQ ID NO: 582805 - protein, 9 aa, Homo Sapiens
VTGRCSTRA

SEQ ID NO: 582806 - protein, 9 aa, Homo Sapiens
NAQKVGHFD

SEQ ID NO: 582807 - protein, 9 aa, Homo Sapiens
MRAGGCCHA

SEQ ID NO: 582808 - protein, 9 aa, Homo Sapiens
KPKVPASAT

SEQ ID NO: 582809 - protein, 9 aa, Homo Sapiens
IQKGTLIVH

SEQ ID NO: 582810 - protein, 9 aa, Homo Sapiens
TAASSRRRS

SEQ ID NO: 582811 - protein, 9 aa, Homo Sapiens
PVCGKKHRP

SEQ ID NO: 582812 - protein, 9 aa, Homo Sapiens
SLLRRPRRT

SEQ ID NO: 582813 - protein, 9 aa, Homo Sapiens
TAPVCGKKH

SEQ ID NO: 582814 - protein, 9 aa, Homo Sapiens
GLKAALLKR

SEQ ID NO: 582815 - protein, 9 aa, Homo Sapiens
YKCEECCKA

SEQ ID NO: 582816 - protein, 9 aa, Homo Sapiens
CSTRAFHRK

SEQ ID NO: 582817 - protein, 9 aa, Homo Sapiens
RCSTRAFHR

SEQ ID NO: 582818 - protein, 9 aa, Homo Sapiens
GPGAVATSL

SEQ ID NO: 582819 - protein, 9 aa, Homo Sapiens
LWGSIMRVL

SEQ ID NO: 582820 - protein, 9 aa, Homo Sapiens
RKPPPGRRA

SEQ ID NO: 582821 - protein, 9 aa, Homo Sapiens
VLQIRYTSV

SEQ ID NO: 582822 - protein, 9 aa, Homo Sapiens
FRDLGEENF

SEQ ID NO: 582823 - protein, 9 aa, Homo Sapiens
VQQWPQMHK

SEQ ID NO: 582824 - protein, 9 aa, Homo Sapiens
TVIPRKVVV

SEQ ID NO: 582825 - protein, 9 aa, Homo Sapiens
IRQFAAVLA

SEQ ID NO: 582826 - protein, 9 aa, Homo Sapiens
AFAQVYEAI

SEQ ID NO: 582827 - protein, 9 aa, Homo Sapiens
ASPRTPLEN

SEQ ID NO: 582828 - protein, 9 aa, Homo Sapiens
QGVEERSHK

SEQ ID NO: 582829 - protein, 9 aa, Homo Sapiens
GESTTHREG

SEQ ID NO: 582830 - protein, 9 aa, Homo Sapiens
TKSRRFAAA

SEQ ID NO: 582831 - protein, 9 aa, Homo Sapiens
LWKNKGLWI

SEQ ID NO: 582832 - protein, 9 aa, Homo Sapiens
CGKKHRPPG

SEQ ID NO: 582833 - protein, 9 aa, Homo Sapiens
SDRKKHPYY

SEQ ID NO: 582834 - protein, 9 aa, Homo Sapiens
EEEMLWGSI

SEQ ID NO: 582835 - protein, 9 aa, Homo Sapiens
NVGITKAKT

SEQ ID NO: 582836 - protein, 9 aa, Homo Sapiens
GDQWSASAA

SEQ ID NO: 582837 - protein, 9 aa, Homo Sapiens
RTVLRTVTL

SEQ ID NO: 582838 - protein, 9 aa, Homo Sapiens
PRRTTSASQ

SEQ ID NO: 582839 - protein, 9 aa, Homo Sapiens
TLPRCVSTM

SEQ ID NO: 582840 - protein, 9 aa, Homo Sapiens
IMKLPHLLN

SEQ ID NO: 582841 - protein, 9 aa, Homo Sapiens
DECVTGIHS

SEQ ID NO: 582842 - protein, 9 aa, Homo Sapiens
LIPGPISGP

SEQ ID NO: 582843 - protein, 9 aa, Homo Sapiens
QEALGALLN

SEQ ID NO: 582844 - protein, 9 aa, Homo Sapiens
HHRLNTGEK

SEQ ID NO: 582845 - protein, 9 aa, Homo Sapiens
TVAGGDISK

SEQ ID NO: 582846 - protein, 9 aa, Homo Sapiens
TVLRTVTLS

SEQ ID NO: 582847 - protein, 9 aa, Homo Sapiens
HLAQVFGRP

SEQ ID NO: 582848 - protein, 9 aa, Homo Sapiens
ATEFSQTGN

SEQ ID NO: 582849 - protein, 9 aa, Homo Sapiens
ECVTGIHSC

SEQ ID NO: 582850 - protein, 9 aa, Homo Sapiens
LSAPSVSPI

SEQ ID NO: 582851 - protein, 9 aa, Homo Sapiens
LFVMFLFPV

SEQ ID NO: 582852 - protein, 9 aa, Homo Sapiens
AHRFRDLGE

SEQ ID NO: 582853 - protein, 9 aa, Homo Sapiens
CPLKPTGRW

SEQ ID NO: 582854 - protein, 9 aa, Homo Sapiens
YDSSREVNT

SEQ ID NO: 582855 - protein, 9 aa, Homo Sapiens
KRTTTAASS

SEQ ID NO: 582856 - protein, 9 aa, Homo Sapiens
TVLAISHPD

SEQ ID NO: 582857 - protein, 9 aa, Homo Sapiens
SSRRRSASA

SEQ ID NO: 582858 - protein, 9 aa, Homo Sapiens
NINDVTLMK

SEQ ID NO: 582859 - protein, 9 aa, Homo Sapiens
QWPQMHKSA

SEQ ID NO: 582860 - protein, 9 aa, Homo Sapiens
LLKFSKSIE

SEQ ID NO: 582861 - protein, 9 aa, Homo Sapiens
QAVNLEEDK

SEQ ID NO: 582862 - protein, 9 aa, Homo Sapiens
RLSTPKLLI

SEQ ID NO: 582863 - protein, 9 aa, Homo Sapiens
RILVRDAKR

SEQ ID NO: 582864 - protein, 9 aa, Homo Sapiens
ATKSRRFAA

SEQ ID NO: 582865 - protein, 9 aa, Homo Sapiens
MTGYVAYVA

SEQ ID NO: 582866 - protein, 9 aa, Homo Sapiens
LVLAYDSSR

SEQ ID NO: 582867 - protein, 9 aa, Homo Sapiens
FKERVAEGG

SEQ ID NO: 582868 - protein, 9 aa, Homo Sapiens
HSSSNKIVV

SEQ ID NO: 582869 - protein, 9 aa, Homo Sapiens
GPTQSAVDP

SEQ ID NO: 582870 - protein, 9 aa, Homo Sapiens
PGCPLKPTG

SEQ ID NO: 582871 - protein, 9 aa, Homo Sapiens
SLYLGVSRH

SEQ ID NO: 582872 - protein, 9 aa, Homo Sapiens
DQWSASAAS

SEQ ID NO: 582873 - protein, 9 aa, Homo Sapiens
MHKSAIKDA

SEQ ID NO: 582874 - protein, 9 aa, Homo Sapiens
ANEYAYRHG

SEQ ID NO: 582875 - protein, 9 aa, Homo Sapiens
VSRHKPINR

SEQ ID NO: 582876 - protein, 9 aa, Homo Sapiens
KLTVAGGDI

SEQ ID NO: 582877 - protein, 9 aa, Homo Sapiens
AERTSRSSP

SEQ ID NO: 582878 - protein, 9 aa, Homo Sapiens
SEVAHRFRD

SEQ ID NO: 582879 - protein, 9 aa, Homo Sapiens
PPEPCPRVE

SEQ ID NO: 582880 - protein, 9 aa, Homo Sapiens
EDLLVRSFY

SEQ ID NO: 582881 - protein, 9 aa, Homo Sapiens
TRTALRPPQ

SEQ ID NO: 582882 - protein, 9 aa, Homo Sapiens
NLFKDSFVV

SEQ ID NO: 582883 - protein, 9 aa, Homo Sapiens
PRTPLENLP

SEQ ID NO: 582884 - protein, 9 aa, Homo Sapiens
LSVSADPYV

SEQ ID NO: 582885 - protein, 9 aa, Homo Sapiens
NCLWTLRKL

SEQ ID NO: 582886 - protein, 9 aa, Homo Sapiens
DSYLEPFTH

SEQ ID NO: 582887 - protein, 9 aa, Homo Sapiens
TQSAVDPAL

SEQ ID NO: 582888 - protein, 9 aa, Homo Sapiens
VYVFLSHLA

SEQ ID NO: 582889 - protein, 9 aa, Homo Sapiens
GSIMRVLSK

SEQ ID NO: 582890 - protein, 9 aa, Homo Sapiens
TLRKLSDAA

SEQ ID NO: 582891 - protein, 9 aa, Homo Sapiens
NTGEKSYKC

SEQ ID NO: 582892 - protein, 9 aa, Homo Sapiens
KSEVAHRFR

SEQ ID NO: 582893 - protein, 9 aa, Homo Sapiens
EGGQKLEDS

SEQ ID NO: 582894 - protein, 9 aa, Homo Sapiens
NVRTVLRTV

SEQ ID NO: 582895 - protein, 9 aa, Homo Sapiens
ERAKEFKTH

SEQ ID NO: 582896 - protein, 9 aa, Homo Sapiens
VFMERNYEF

SEQ ID NO: 582897 - protein, 9 aa, Homo Sapiens
VTYQKCLSS

SEQ ID NO: 582898 - protein, 9 aa, Homo Sapiens
ATATEFSQT

SEQ ID NO: 582899 - protein, 9 aa, Homo Sapiens
ASQGASPRT

SEQ ID NO: 582900 - protein, 9 aa, Homo Sapiens
LEKFKLVNT

SEQ ID NO: 582901 - protein, 9 aa, Homo Sapiens
GCLISPNNR

SEQ ID NO: 582902 - protein, 9 aa, Homo Sapiens
LKLADLPTV

SEQ ID NO: 582903 - protein, 9 aa, Homo Sapiens
GRSATSTGS

SEQ ID NO: 582904 - protein, 9 aa, Homo Sapiens
TIGWRKDAL

SEQ ID NO: 582905 - protein, 9 aa, Homo Sapiens
MRADDVVYI

SEQ ID NO: 582906 - protein, 9 aa, Homo Sapiens
LARHHRLNT

SEQ ID NO: 582907 - protein, 9 aa, Homo Sapiens
DAGSSGPCW

SEQ ID NO: 582908 - protein, 9 aa, Homo Sapiens
ARQGVEERS

SEQ ID NO: 582909 - protein, 9 aa, Homo Sapiens
YDGEGNESL

SEQ ID NO: 582910 - protein, 9 aa, Homo Sapiens
LTVAGGDIS

SEQ ID NO: 582911 - protein, 9 aa, Homo Sapiens
YLWETIVLF

SEQ ID NO: 582912 - protein, 9 aa, Homo Sapiens
AGLGYGRLG

SEQ ID NO: 582913 - protein, 9 aa, Homo Sapiens
SECIQLHLN

SEQ ID NO: 582914 - protein, 9 aa, Homo Sapiens
RKKHPYYYS

SEQ ID NO: 582915 - protein, 9 aa, Homo Sapiens
PISVPIPGL

SEQ ID NO: 582916 - protein, 9 aa, Homo Sapiens
SYNNSTEAM

SEQ ID NO: 582917 - protein, 9 aa, Homo Sapiens
ERVAEGGQK

SEQ ID NO: 582918 - protein, 9 aa, Homo Sapiens
GVVLNSRTA

SEQ ID NO: 582919 - protein, 9 aa, Homo Sapiens
EEEDGDAVA

SEQ ID NO: 582920 - protein, 9 aa, Homo Sapiens
DLLDCLLED

SEQ ID NO: 582921 - protein, 9 aa, Homo Sapiens
LDTSQVKDK

SEQ ID NO: 582922 - protein, 9 aa, Homo Sapiens
GPACRAQVP

SEQ ID NO: 582923 - protein, 9 aa, Homo Sapiens
EVPSTAPVC

SEQ ID NO: 582924 - protein, 9 aa, Homo Sapiens
SGMRESQGA

SEQ ID NO: 582925 - protein, 9 aa, Homo Sapiens
IFDEDNILN

SEQ ID NO: 582926 - protein, 9 aa, Homo Sapiens
IYTAAFLLC

SEQ ID NO: 582927 - protein, 9 aa, Homo Sapiens
LDSSLPPMR

SEQ ID NO: 582928 - protein, 9 aa, Homo Sapiens
LHLAQVFGR

SEQ ID NO: 582929 - protein, 9 aa, Homo Sapiens
LPAISKATS

SEQ ID NO: 582930 - protein, 9 aa, Homo Sapiens
LIGDLWNLQ

SEQ ID NO: 582931 - protein, 9 aa, Homo Sapiens
CVTGIHSCS

SEQ ID NO: 582932 - protein, 9 aa, Homo Sapiens
SPVGPGCPL

SEQ ID NO: 582933 - protein, 9 aa, Homo Sapiens
TRVGESTTH

SEQ ID NO: 582934 - protein, 9 aa, Homo Sapiens
QIVDLHIMK

SEQ ID NO: 582935 - protein, 9 aa, Homo Sapiens
TTTAASSRR

SEQ ID NO: 582936 - protein, 9 aa, Homo Sapiens
CEDLLVRSF

SEQ ID NO: 582937 - protein, 9 aa, Homo Sapiens
KCEECCKAF

SEQ ID NO: 582938 - protein, 9 aa, Homo Sapiens
LGRSATSTG

SEQ ID NO: 582939 - protein, 9 aa, Homo Sapiens
MAGARSLEL

SEQ ID NO: 582940 - protein, 9 aa, Homo Sapiens
NDIQFSLFT

SEQ ID NO: 582941 - protein, 9 aa, Homo Sapiens
LQAAVCKET

SEQ ID NO: 582942 - protein, 9 aa, Homo Sapiens
LLRRPRRTT

SEQ ID NO: 582943 - protein, 9 aa, Homo Sapiens
ERARQGVEE

SEQ ID NO: 582944 - protein, 9 aa, Homo Sapiens
TPLENLPWL

SEQ ID NO: 582945 - protein, 9 aa, Homo Sapiens
SGAWSYNNS

SEQ ID NO: 582946 - protein, 9 aa, Homo Sapiens
VLNSRTAAE

SEQ ID NO: 582947 - protein, 9 aa, Homo Sapiens
DDSSDEDKH

SEQ ID NO: 582948 - protein, 9 aa, Homo Sapiens
DAKRSIREI

SEQ ID NO: 582949 - protein, 9 aa, Homo Sapiens
GIYTAAFLL

SEQ ID NO: 582950 - protein, 9 aa, Homo Sapiens
VDLHIMKLP

SEQ ID NO: 582951 - protein, 9 aa, Homo Sapiens
EGSHPEWVK

SEQ ID NO: 582952 - protein, 9 aa, Homo Sapiens
VPRKPPPGR

SEQ ID NO: 582953 - protein, 9 aa, Homo Sapiens
DLLVRSFYL

SEQ ID NO: 582954 - protein, 9 aa, Homo Sapiens
IKNDIQFSL

SEQ ID NO: 582955 - protein, 9 aa, Homo Sapiens
HRPMNFFLG

SEQ ID NO: 582956 - protein, 9 aa, Homo Sapiens
LVDTTGIYT

SEQ ID NO: 582957 - protein, 9 aa, Homo Sapiens
SSGPCWKSL

SEQ ID NO: 582958 - protein, 9 aa, Homo Sapiens
IVDLHIMKL

SEQ ID NO: 582959 - protein, 9 aa, Homo Sapiens
LQIRYTSVE

SEQ ID NO: 582960 - protein, 9 aa, Homo Sapiens
ASSRRRSAS

SEQ ID NO: 582961 - protein, 9 aa, Homo Sapiens
YAYRHGIAE

SEQ ID NO: 582962 - protein, 9 aa, Homo Sapiens
KAALLKRSP

SEQ ID NO: 582963 - protein, 9 aa, Homo Sapiens
SVSPIPSVH

SEQ ID NO: 582964 - protein, 9 aa, Homo Sapiens
RPRWCTWPL

SEQ ID NO: 582965 - protein, 9 aa, Homo Sapiens
KVLQIRYTS

SEQ ID NO: 582966 - protein, 9 aa, Homo Sapiens
WTLRKLSDA

SEQ ID NO: 582967 - protein, 9 aa, Homo Sapiens
EFKTHLGIF

SEQ ID NO: 582968 - protein, 9 aa, Homo Sapiens
VTSEGSDRK

SEQ ID NO: 582969 - protein, 9 aa, Homo Sapiens
LEWTLETLL

SEQ ID NO: 582970 - protein, 9 aa, Homo Sapiens
GLGYGRLGD

SEQ ID NO: 582971 - protein, 9 aa, Homo Sapiens
VAEGGQKLE

SEQ ID NO: 582972 - protein, 9 aa, Homo Sapiens
MLWGSIMRV

SEQ ID NO: 582973 - protein, 9 aa, Homo Sapiens
ADDVVYIKG

SEQ ID NO: 582974 - protein, 9 aa, Homo Sapiens
DKVSPVFTQ

SEQ ID NO: 582975 - protein, 9 aa, Homo Sapiens
FSKSKSECI

SEQ ID NO: 582976 - protein, 9 aa, Homo Sapiens
LKNLLAERT

SEQ ID NO: 582977 - protein, 9 aa, Homo Sapiens
GVVLSTNYP

SEQ ID NO: 582978 - protein, 9 aa, Homo Sapiens
ENLPWLPLL

SEQ ID NO: 582979 - protein, 9 aa, Homo Sapiens
PGLIPGPIS

SEQ ID NO: 582980 - protein, 9 aa, Homo Sapiens
LARRRLNTR

SEQ ID NO: 582981 - protein, 9 aa, Homo Sapiens
LWTLRKLSD

SEQ ID NO: 582982 - protein, 9 aa, Homo Sapiens
SKSKSECIQ

SEQ ID NO: 582983 - protein, 9 aa, Homo Sapiens
KLLIGDLWN

SEQ ID NO: 582984 - protein, 9 aa, Homo Sapiens
KTGHILKSA

SEQ ID NO: 582985 - protein, 9 aa, Homo Sapiens
TINDLLDCL

SEQ ID NO: 582986 - protein, 9 aa, Homo Sapiens
HIMKLPHLL

SEQ ID NO: 582987 - protein, 9 aa, Homo Sapiens
LHIMKLPHL

SEQ ID NO: 582988 - protein, 9 aa, Homo Sapiens
RAQVPRKPP

SEQ ID NO: 582989 - protein, 9 aa, Homo Sapiens
VVFNTSGGS

SEQ ID NO: 582990 - protein, 9 aa, Homo Sapiens
YEAIQGDLN

SEQ ID NO: 582991 - protein, 9 aa, Homo Sapiens
SLPPMRRLG

SEQ ID NO: 582992 - protein, 9 aa, Homo Sapiens
SPLMSRSGW

SEQ ID NO: 582993 - protein, 9 aa, Homo Sapiens
VRTVLRTVT

SEQ ID NO: 582994 - protein, 9 aa, Homo Sapiens
CGPPPELHL

SEQ ID NO: 582995 - protein, 9 aa, Homo Sapiens
PQLVLAYDS

SEQ ID NO: 582996 - protein, 9 aa, Homo Sapiens
KSAQDTCIG

SEQ ID NO: 582997 - protein, 9 aa, Homo Sapiens
ISKATSMDV

SEQ ID NO: 582998 - protein, 9 aa, Homo Sapiens
RTTTAASSR

SEQ ID NO: 582999 - protein, 9 aa, Homo Sapiens
RVAEGGQKL

SEQ ID NO: 583000 - protein, 9 aa, Homo Sapiens
GRWLGRSAT

SEQ ID NO: 583001 - protein, 9 aa, Homo Sapiens
PPTLPRCVS

SEQ ID NO: 583002 - protein, 9 aa, Homo Sapiens
YLGVSRHKP

SEQ ID NO: 583003 - protein, 9 aa, Homo Sapiens
HVGKVFMER

SEQ ID NO: 583004 - protein, 9 aa, Homo Sapiens
GGQKLEDSY

SEQ ID NO: 583005 - protein, 9 aa, Homo Sapiens
RADDVVYIK

SEQ ID NO: 583006 - protein, 9 aa, Homo Sapiens
PMRRLGMIV

SEQ ID NO: 583007 - protein, 9 aa, Homo Sapiens
SFLGFTEIE

SEQ ID NO: 583008 - protein, 9 aa, Homo Sapiens
RSRGKSYGR

SEQ ID NO: 583009 - protein, 9 aa, Homo Sapiens
AYDSSREVN

SEQ ID NO: 583010 - protein, 9 aa, Homo Sapiens
IYNLFKDSF

SEQ ID NO: 583011 - protein, 9 aa, Homo Sapiens
DALCRRMCR

SEQ ID NO: 583012 - protein, 9 aa, Homo Sapiens
NTRTALRPP

SEQ ID NO: 583013 - protein, 9 aa, Homo Sapiens
LLAERTSRS

SEQ ID NO: 583014 - protein, 9 aa, Homo Sapiens
FPVTVGSLI

SEQ ID NO: 583015 - protein, 9 aa, Homo Sapiens
NKIVVFNTS

SEQ ID NO: 583016 - protein, 9 aa, Homo Sapiens
AVDPALWAA

SEQ ID NO: 583017 - protein, 9 aa, Homo Sapiens
RYTSVERLL

SEQ ID NO: 583018 - protein, 9 aa, Homo Sapiens
SLVILTVMA

SEQ ID NO: 583019 - protein, 9 aa, Homo Sapiens
PKALQHIES

SEQ ID NO: 583020 - protein, 9 aa, Homo Sapiens
TLETLLEQL

SEQ ID NO: 583021 - protein, 9 aa, Homo Sapiens
APVTYQKCL

SEQ ID NO: 583022 - protein, 9 aa, Homo Sapiens
SEGVVLSTN

SEQ ID NO: 583023 - protein, 9 aa, Homo Sapiens
NASLSLEST

SEQ ID NO: 583024 - protein, 9 aa, Homo Sapiens
LGVSRHKPI

SEQ ID NO: 583025 - protein, 9 aa, Homo Sapiens
MYLNTKIAD

SEQ ID NO: 583026 - protein, 9 aa, Homo Sapiens
SGWKVGDSS

SEQ ID NO: 583027 - protein, 9 aa, Homo Sapiens
LRAQEWAAE

SEQ ID NO: 583028 - protein, 9 aa, Homo Sapiens
CRAQVPRKP

SEQ ID NO: 583029 - protein, 9 aa, Homo Sapiens
WCEDLLVRS

SEQ ID NO: 583030 - protein, 9 aa, Homo Sapiens
VDPALWAAL

SEQ ID NO: 583031 - protein, 9 aa, Homo Sapiens
PPELHLAQV

SEQ ID NO: 583032 - protein, 9 aa, Homo Sapiens
GNLNQYAIF

SEQ ID NO: 583033 - protein, 9 aa, Homo Sapiens
CIKNDIQFS

SEQ ID NO: 583034 - protein, 9 aa, Homo Sapiens
DRKKHPYYY

SEQ ID NO: 583035 - protein, 9 aa, Homo Sapiens
EGSDRKKHP

SEQ ID NO: 583036 - protein, 9 aa, Homo Sapiens
VGPGCPLKP

SEQ ID NO: 583037 - protein, 9 aa, Homo Sapiens
VYDGEGNES

SEQ ID NO: 583038 - protein, 9 aa, Homo Sapiens
AKIDSYLEP

SEQ ID NO: 583039 - protein, 9 aa, Homo Sapiens
PRSPAVATK

SEQ ID NO: 583040 - protein, 9 aa, Homo Sapiens
IFLCRTEQG

SEQ ID NO: 583041 - protein, 9 aa, Homo Sapiens
LLCGMREMR

SEQ ID NO: 583042 - protein, 9 aa, Homo Sapiens
GARSLELGE

SEQ ID NO: 583043 - protein, 9 aa, Homo Sapiens
LLNKEPQKM

SEQ ID NO: 583044 - protein, 9 aa, Homo Sapiens
THREGAESA

SEQ ID NO: 583045 - protein, 9 aa, Homo Sapiens
ELSENINDV

SEQ ID NO: 583046 - protein, 9 aa, Homo Sapiens
PKVPASATR

SEQ ID NO: 583047 - protein, 9 aa, Homo Sapiens
ETIGWRKDA

SEQ ID NO: 583048 - protein, 9 aa, Homo Sapiens
IAGVVLNSR

SEQ ID NO: 583049 - protein, 9 aa, Homo Sapiens
PEWVKVYGP

SEQ ID NO: 583050 - protein, 9 aa, Homo Sapiens
GWKVGDSSG

SEQ ID NO: 583051 - protein, 9 aa, Homo Sapiens
YQGKIFDED

SEQ ID NO: 583052 - protein, 9 aa, Homo Sapiens
TPKLLIGDL

SEQ ID NO: 583053 - protein, 9 aa, Homo Sapiens
ASATREEDS

SEQ ID NO: 583054 - protein, 9 aa, Homo Sapiens
GCPLKPTGR

SEQ ID NO: 583055 - protein, 9 aa, Homo Sapiens
VATKSRRFA

SEQ ID NO: 583056 - protein, 9 aa, Homo Sapiens
PAISKATSM

SEQ ID NO: 583057 - protein, 9 aa, Homo Sapiens
RSLELGEAL

SEQ ID NO: 583058 - protein, 9 aa, Homo Sapiens
WDSPAPVTY

SEQ ID NO: 583059 - protein, 9 aa, Homo Sapiens
KERVAEGGQ

SEQ ID NO: 583060 - protein, 9 aa, Homo Sapiens
PIPGLIPGP

SEQ ID NO: 583061 - protein, 9 aa, Homo Sapiens
CLISPNNRN

SEQ ID NO: 583062 - protein, 9 aa, Homo Sapiens
IPEGQRARI

SEQ ID NO: 583063 - protein, 9 aa, Homo Sapiens
DTDMTGYVA

SEQ ID NO: 583064 - protein, 9 aa, Homo Sapiens
ALLCGMREM

SEQ ID NO: 583065 - protein, 9 aa, Homo Sapiens
AVTSEGSDR

SEQ ID NO: 583066 - protein, 9 aa, Homo Sapiens
AAGLGYGRL

SEQ ID NO: 583067 - protein, 9 aa, Homo Sapiens
SFLRAQEWA

SEQ ID NO: 583068 - protein, 9 aa, Homo Sapiens
KGFIQKGTL

SEQ ID NO: 583069 - protein, 9 aa, Homo Sapiens
LPLLKNLLA

SEQ ID NO: 583070 - protein, 9 aa, Homo Sapiens
RGPGAVATS

SEQ ID NO: 583071 - protein, 9 aa, Homo Sapiens
TSQQKRSRG

SEQ ID NO: 583072 - protein, 9 aa, Homo Sapiens
QGPACRAQV

SEQ ID NO: 583073 - protein, 9 aa, Homo Sapiens
PEASSAPGS

SEQ ID NO: 583074 - protein, 9 aa, Homo Sapiens
LKRSPVGPG

SEQ ID NO: 583075 - protein, 9 aa, Homo Sapiens
ALGALLNKE

SEQ ID NO: 583076 - protein, 9 aa, Homo Sapiens
DGEGNESLR

SEQ ID NO: 583077 - protein, 9 aa, Homo Sapiens
KRSRGKSYG

SEQ ID NO: 583078 - protein, 9 aa, Homo Sapiens
SIEIPSSVQ

SEQ ID NO: 583079 - protein, 9 aa, Homo Sapiens
VGAGTINDL

SEQ ID NO: 583080 - protein, 9 aa, Homo Sapiens
TEEEMLWGS

SEQ ID NO: 583081 - protein, 9 aa, Homo Sapiens
ILKSAQDTC

SEQ ID NO: 583082 - protein, 9 aa, Homo Sapiens
FLIYNLFKD

SEQ ID NO: 583083 - protein, 9 aa, Homo Sapiens
SSSNKIVVF

SEQ ID NO: 583084 - protein, 9 aa, Homo Sapiens
TQGQSGPPE

SEQ ID NO: 583085 - protein, 9 aa, Homo Sapiens
KVSPVFTQS

SEQ ID NO: 583086 - protein, 9 aa, Homo Sapiens
IPGLPSRAG

SEQ ID NO: 583087 - protein, 9 aa, Homo Sapiens
SATREEDSC

SEQ ID NO: 583088 - protein, 9 aa, Homo Sapiens
LNTGEKSYK

SEQ ID NO: 583089 - protein, 9 aa, Homo Sapiens
MGDTVLAIS

SEQ ID NO: 583090 - protein, 9 aa, Homo Sapiens
WPQMHKSAI

SEQ ID NO: 583091 - protein, 9 aa, Homo Sapiens
MNFFLGHLS

SEQ ID NO: 583092 - protein, 9 aa, Homo Sapiens
KASVVTDDG

SEQ ID NO: 583093 - protein, 9 aa, Homo Sapiens
RSSPVRGPV

SEQ ID NO: 583094 - protein, 9 aa, Homo Sapiens
SKSECIQLH

SEQ ID NO: 583095 - protein, 9 aa, Homo Sapiens
PTQSAVDPA

SEQ ID NO: 583096 - protein, 9 aa, Homo Sapiens
SSREVNTTE

SEQ ID NO: 583097 - protein, 9 aa, Homo Sapiens
ECIQLHLNL

SEQ ID NO: 583098 - protein, 9 aa, Homo Sapiens
TGIYTAAFL

SEQ ID NO: 583099 - protein, 9 aa, Homo Sapiens
SAVDPALWA

SEQ ID NO: 583100 - protein, 9 aa, Homo Sapiens
LNSRTAAEA

SEQ ID NO: 583101 - protein, 9 aa, Homo Sapiens
RQFAAVLAR

SEQ ID NO: 583102 - protein, 9 aa, Homo Sapiens
EECCKAFKH

SEQ ID NO: 583103 - protein, 9 aa, Homo Sapiens
LISPNNRNQ

SEQ ID NO: 583104 - protein, 9 aa, Homo Sapiens
QLVTGRCST

SEQ ID NO: 583105 - protein, 9 aa, Homo Sapiens
GKEPANVGI

SEQ ID NO: 583106 - protein, 9 aa, Homo Sapiens
SSEEEDGDA

SEQ ID NO: 583107 - protein, 9 aa, Homo Sapiens
SRSGWKVGD

SEQ ID NO: 583108 - protein, 9 aa, Homo Sapiens
SENINDVTL

SEQ ID NO: 583109 - protein, 9 aa, Homo Sapiens
SVGAGTIND

SEQ ID NO: 583110 - protein, 9 aa, Homo Sapiens
AQKVGHFDK

SEQ ID NO: 583111 - protein, 9 aa, Homo Sapiens
VCGKKHRPP

SEQ ID NO: 583112 - protein, 9 aa, Homo Sapiens
FDEDNILNE

SEQ ID NO: 583113 - protein, 9 aa, Homo Sapiens
LSENINDVT

SEQ ID NO: 583114 - protein, 9 aa, Homo Sapiens
PLPRPRWCT

SEQ ID NO: 583115 - protein, 9 aa, Homo Sapiens
SERARQGVE

SEQ ID NO: 583116 - protein, 9 aa, Homo Sapiens
PLENLPWLP

SEQ ID NO: 583117 - protein, 9 aa, Homo Sapiens
ARSLELGEA

SEQ ID NO: 583118 - protein, 9 aa, Homo Sapiens
GLSVSADPY

SEQ ID NO: 583119 - protein, 9 aa, Homo Sapiens
PGRRARGPG

SEQ ID NO: 583120 - protein, 9 aa, Homo Sapiens
LLVRSFYLK

SEQ ID NO: 583121 - protein, 9 aa, Homo Sapiens
FVMFLFPVT

SEQ ID NO: 583122 - protein, 9 aa, Homo Sapiens
KFKLVNTRT

SEQ ID NO: 583123 - protein, 9 aa, Homo Sapiens
LDGLTPPTL

SEQ ID NO: 583124 - protein, 9 aa, Homo Sapiens
AAVCKETIG

SEQ ID NO: 583125 - protein, 9 aa, Homo Sapiens
EGSLKLADL

SEQ ID NO: 583126 - protein, 9 aa, Homo Sapiens
GRLGDGIGY

SEQ ID NO: 583127 - protein, 9 aa, Homo Sapiens
HILKSAQDT

SEQ ID NO: 583128 - protein, 9 aa, Homo Sapiens
RTENAQKVG

SEQ ID NO: 583129 - protein, 9 aa, Homo Sapiens
PPLSAPSVS

SEQ ID NO: 583130 - protein, 9 aa, Homo Sapiens
KEPANVGIT

SEQ ID NO: 583131 - protein, 9 aa, Homo Sapiens
ADLPTVEAP

SEQ ID NO: 583132 - protein, 9 aa, Homo Sapiens
TPVYVFLSH

SEQ ID NO: 583133 - protein, 9 aa, Homo Sapiens
RKLSDAATK

SEQ ID NO: 583134 - protein, 9 aa, Homo Sapiens
ISVPIPGLI

SEQ ID NO: 583135 - protein, 9 aa, Homo Sapiens
CSSSDSGRL

SEQ ID NO: 583136 - protein, 9 aa, Homo Sapiens
ARHHRLNTG

SEQ ID NO: 583137 - protein, 9 aa, Homo Sapiens
VNTRTALRP

SEQ ID NO: 583138 - protein, 9 aa, Homo Sapiens
RAVRCCTKA

SEQ ID NO: 583139 - protein, 9 aa, Homo Sapiens
TTHREGAES

SEQ ID NO: 583140 - protein, 9 aa, Homo Sapiens
VGESTTHRE

SEQ ID NO: 583141 - protein, 9 aa, Homo Sapiens
SFPQQEAQK

SEQ ID NO: 583142 - protein, 9 aa, Homo Sapiens
RRPRRTTSA

SEQ ID NO: 583143 - protein, 9 aa, Homo Sapiens
VGKVFMERN

SEQ ID NO: 583144 - protein, 9 aa, Homo Sapiens
HKSAIKDAE

SEQ ID NO: 583145 - protein, 9 aa, Homo Sapiens
YAIFLCRTE

SEQ ID NO: 583146 - protein, 9 aa, Homo Sapiens
VSADPYVQD

SEQ ID NO: 583147 - protein, 9 aa, Homo Sapiens
AVATKSRRF

SEQ ID NO: 583148 - protein, 9 aa, Homo Sapiens
ALLKRSPVG

SEQ ID NO: 583149 - protein, 9 aa, Homo Sapiens
RRTTSASQG

SEQ ID NO: 583150 - protein, 9 aa, Homo Sapiens
SALDTSQVK

SEQ ID NO: 583151 - protein, 9 aa, Homo Sapiens
TSMDVQQET

SEQ ID NO: 583152 - protein, 9 aa, Homo Sapiens
NEYAYRHGI

SEQ ID NO: 583153 - protein, 9 aa, Homo Sapiens
CHCSSSDSG

SEQ ID NO: 583154 - protein, 9 aa, Homo Sapiens
DSSLPPMRR

SEQ ID NO: 583155 - protein, 9 aa, Homo Sapiens
MERNYEFLA

SEQ ID NO: 583156 - protein, 9 aa, Homo Sapiens
PSVSPIPSV

SEQ ID NO: 583157 - protein, 9 aa, Homo Sapiens
GRCSTRAFH

SEQ ID NO: 583158 - protein, 9 aa, Homo Sapiens
VTGLKAALL

SEQ ID NO: 583159 - protein, 9 aa, Homo Sapiens
LIFASFLGF

SEQ ID NO: 583160 - protein, 9 aa, Homo Sapiens
RSATSTGSV

SEQ ID NO: 583161 - protein, 9 aa, Homo Sapiens
EDNILNELN

SEQ ID NO: 583162 - protein, 9 aa, Homo Sapiens
LIYNLFKDS

SEQ ID NO: 583163 - protein, 9 aa, Homo Sapiens
GIHSCSINE

SEQ ID NO: 583164 - protein, 9 aa, Homo Sapiens
REMRAGGCC

SEQ ID NO: 583165 - protein, 9 aa, Homo Sapiens
RDAKRSIRE

SEQ ID NO: 583166 - protein, 9 aa, Homo Sapiens
GLPAISKAT

SEQ ID NO: 583167 - protein, 9 aa, Homo Sapiens
FLLLKFSKS

SEQ ID NO: 583168 - protein, 9 aa, Homo Sapiens
RARGPGAVA

SEQ ID NO: 583169 - protein, 9 aa, Homo Sapiens
GPGDQWSAS

SEQ ID NO: 583170 - protein, 9 aa, Homo Sapiens
SASQGASPR

SEQ ID NO: 583171 - protein, 9 aa, Homo Sapiens
PGDQWSASA

SEQ ID NO: 583172 - protein, 9 aa, Homo Sapiens
EMRAGGCCH

SEQ ID NO: 583173 - protein, 9 aa, Homo Sapiens
VVLSTNYPH

SEQ ID NO: 583174 - protein, 9 aa, Homo Sapiens
RSGWKVGDS

SEQ ID NO: 583175 - protein, 9 aa, Homo Sapiens
GSDRKKHPY

SEQ ID NO: 583176 - protein, 9 aa, Homo Sapiens
DVLIFASFL

SEQ ID NO: 583177 - protein, 9 aa, Homo Sapiens
KKNLKNASL

SEQ ID NO: 583178 - protein, 9 aa, Homo Sapiens
GPVTGLKAA

SEQ ID NO: 583179 - protein, 9 aa, Homo Sapiens
ANVGITKAK

SEQ ID NO: 583180 - protein, 9 aa, Homo Sapiens
QQWPQMHKS

SEQ ID NO: 583181 - protein, 9 aa, Homo Sapiens
QVPRKPPPG

SEQ ID NO: 583182 - protein, 9 aa, Homo Sapiens
SYLEPFTHS

SEQ ID NO: 583183 - protein, 9 aa, Homo Sapiens
LVNTRTALR

SEQ ID NO: 583184 - protein, 9 aa, Homo Sapiens
RKVVVKFSI

SEQ ID NO: 583185 - protein, 9 aa, Homo Sapiens
LKGPGDQWS

SEQ ID NO: 583186 - protein, 9 aa, Homo Sapiens
YRHGIAEAV

SEQ ID NO: 583187 - protein, 9 aa, Homo Sapiens
AKRSIREII

SEQ ID NO: 583188 - protein, 9 aa, Homo Sapiens
DGPTQSAVD

SEQ ID NO: 583189 - protein, 9 aa, Homo Sapiens
IPGLIPGPI

SEQ ID NO: 583190 - protein, 9 aa, Homo Sapiens
NQYAIFLCR

SEQ ID NO: 583191 - protein, 9 aa, Homo Sapiens
EPCPRVELG

SEQ ID NO: 583192 - protein, 9 aa, Homo Sapiens
SPRTPLENL

SEQ ID NO: 583193 - protein, 9 aa, Homo Sapiens
SPQLEWTLE

SEQ ID NO: 583194 - protein, 9 aa, Homo Sapiens
KSIEIPSSV

SEQ ID NO: 583195 - protein, 9 aa, Homo Sapiens
SEEEDGDAV

SEQ ID NO: 583196 - protein, 9 aa, Homo Sapiens
TTGIYTAAF

SEQ ID NO: 583197 - protein, 9 aa, Homo Sapiens
PPGRRARGP

SEQ ID NO: 583198 - protein, 9 aa, Homo Sapiens
NSRTAAEAD

SEQ ID NO: 583199 - protein, 9 aa, Homo Sapiens
LPPMRRLGM

SEQ ID NO: 583200 - protein, 9 aa, Homo Sapiens
EWFMRADDV

SEQ ID NO: 583201 - protein, 9 aa, Homo Sapiens
VVYIKGDKL

SEQ ID NO: 583202 - protein, 9 aa, Homo Sapiens
RTPTSQQKR

SEQ ID NO: 583203 - protein, 9 aa, Homo Sapiens
PSTAPVCGK

SEQ ID NO: 583204 - protein, 9 aa, Homo Sapiens
AYDPEASSA

SEQ ID NO: 583205 - protein, 9 aa, Homo Sapiens
IHSCSINET

SEQ ID NO: 583206 - protein, 9 aa, Homo Sapiens
GEGSHPEWV

SEQ ID NO: 583207 - protein, 9 aa, Homo Sapiens
KSKSECIQL

SEQ ID NO: 583208 - protein, 9 aa, Homo Sapiens
TNYPHNYTA

SEQ ID NO: 583209 - protein, 9 aa, Homo Sapiens
CIQLHLNLE

SEQ ID NO: 583210 - protein, 9 aa, Homo Sapiens
LFKDSFVVE

SEQ ID NO: 583211 - protein, 9 aa, Homo Sapiens
TATEFSQTG

SEQ ID NO: 583212 - protein, 9 aa, Homo Sapiens
DDVVYIKGD

SEQ ID NO: 583213 - protein, 9 aa, Homo Sapiens
SQGASPRTP

SEQ ID NO: 583214 - protein, 9 aa, Homo Sapiens
IQLHLNLEK

SEQ ID NO: 583215 - protein, 9 aa, Homo Sapiens
MDKPKKVLS

SEQ ID NO: 583216 - protein, 9 aa, Homo Sapiens
SIQAVNLEE

SEQ ID NO: 583217 - protein, 9 aa, Homo Sapiens
SEHIWCEDL

SEQ ID NO: 583218 - protein, 9 aa, Homo Sapiens
ERNYEFLAY

SEQ ID NO: 583219 - protein, 9 aa, Homo Sapiens
AISKATSMD

SEQ ID NO: 583220 - protein, 9 aa, Homo Sapiens
RFRDLGEEN

SEQ ID NO: 583221 - protein, 9 aa, Homo Sapiens
PEPCPRVEL

SEQ ID NO: 583222 - protein, 9 aa, Homo Sapiens
SVPIPGLIP

SEQ ID NO: 583223 - protein, 9 aa, Homo Sapiens
KLVNTRTAL

SEQ ID NO: 583224 - protein, 9 aa, Homo Sapiens
TTAASSRRR

SEQ ID NO: 583225 - protein, 9 aa, Homo Sapiens
PVTYQKCLS

SEQ ID NO: 583226 - protein, 9 aa, Homo Sapiens
NKEPQKMIE

SEQ ID NO: 583227 - protein, 9 aa, Homo Sapiens
LNKEPQKMI

SEQ ID NO: 583228 - protein, 9 aa, Homo Sapiens
KIDSYLEPF

SEQ ID NO: 583229 - protein, 9 aa, Homo Sapiens
AEVSLRTIS

SEQ ID NO: 583230 - protein, 9 aa, Homo Sapiens
ENKDSDKVS

SEQ ID NO: 583231 - protein, 9 aa, Homo Sapiens
SSLPPMRRL

SEQ ID NO: 583232 - protein, 9 aa, Homo Sapiens
RLHTPVYVF

SEQ ID NO: 583233 - protein, 9 aa, Homo Sapiens
ALCRRMCRA

SEQ ID NO: 583234 - protein, 9 aa, Homo Sapiens
PGIVRGMYL

SEQ ID NO: 583235 - protein, 9 aa, Homo Sapiens
HKIADEGHP

SEQ ID NO: 583236 - protein, 9 aa, Homo Sapiens
FQRWKQLSF

SEQ ID NO: 583237 - protein, 9 aa, Homo Sapiens
STRAFHRKS

SEQ ID NO: 583238 - protein, 9 aa, Homo Sapiens
QGDALCRRM

SEQ ID NO: 583239 - protein, 9 aa, Homo Sapiens
EGVVLSTNY

SEQ ID NO: 583240 - protein, 9 aa, Homo Sapiens
CKETIGWRK

SEQ ID NO: 583241 - protein, 9 aa, Homo Sapiens
TGHILKSAQ

SEQ ID NO: 583242 - protein, 9 aa, Homo Sapiens
WSYNNSTEA

SEQ ID NO: 583243 - protein, 9 aa, Homo Sapiens
ETIVLFSLA

SEQ ID NO: 583244 - protein, 9 aa, Homo Sapiens
LAERTSRSS

SEQ ID NO: 583245 - protein, 9 aa, Homo Sapiens
DTVLAISHP

SEQ ID NO: 583246 - protein, 9 aa, Homo Sapiens
DGLTPPTLP

SEQ ID NO: 583247 - protein, 9 aa, Homo Sapiens
RGPVTGLKA

SEQ ID NO: 583248 - protein, 9 aa, Homo Sapiens
TELATATEF

SEQ ID NO: 583249 - protein, 9 aa, Homo Sapiens
GQSGPPEPC

SEQ ID NO: 583250 - protein, 9 aa, Homo Sapiens
KDSDKVSPV

SEQ ID NO: 583251 - protein, 9 aa, Homo Sapiens
SSLKGPGDQ

SEQ ID NO: 583252 - protein, 9 aa, Homo Sapiens
VIPRKVVVK

SEQ ID NO: 583253 - protein, 9 aa, Homo Sapiens
SATSTGSVG

SEQ ID NO: 583254 - protein, 9 aa, Homo Sapiens
GDAGSSGPC

SEQ ID NO: 583255 - protein, 9 aa, Homo Sapiens
PWLPLLKNL

SEQ ID NO: 583256 - protein, 9 aa, Homo Sapiens
GLPSRAGGV

SEQ ID NO: 583257 - protein, 9 aa, Homo Sapiens
EHIWCEDLL

SEQ ID NO: 583258 - protein, 9 aa, Homo Sapiens
LKPTGRWLG

SEQ ID NO: 583259 - protein, 9 aa, Homo Sapiens
SLARHHRLN

SEQ ID NO: 583260 - protein, 9 aa, Homo Sapiens
YNLFKDSFV

SEQ ID NO: 583261 - protein, 9 aa, Homo Sapiens
VAHRFRDLG

SEQ ID NO: 583262 - protein, 9 aa, Homo Sapiens
LAISHPDSI

SEQ ID NO: 583263 - protein, 9 aa, Homo Sapiens
ELHLAQVFG

SEQ ID NO: 583264 - protein, 9 aa, Homo Sapiens
RRMCRAIGE

SEQ ID NO: 583265 - protein, 9 aa, Homo Sapiens
CTKASVVTD

SEQ ID NO: 583266 - protein, 9 aa, Homo Sapiens
GMRESQGAE

SEQ ID NO: 583267 - protein, 9 aa, Homo Sapiens
YFMYGCLIS

SEQ ID NO: 583268 - protein, 9 aa, Homo Sapiens
GAVATSLLR

SEQ ID NO: 583269 - protein, 9 aa, Homo Sapiens
WLPLLKNLL

SEQ ID NO: 583270 - protein, 9 aa, Homo Sapiens
VPASATREE

SEQ ID NO: 583271 - protein, 9 aa, Homo Sapiens
DMTGYVAYV

SEQ ID NO: 583272 - protein, 9 aa, Homo Sapiens
GDTVLAISH

SEQ ID NO: 583273 - protein, 9 aa, Homo Sapiens
RGMYLNTKI

SEQ ID NO: 583274 - protein, 9 aa, Homo Sapiens
KNDIQFSLF

SEQ ID NO: 583275 - protein, 9 aa, Homo Sapiens
KTHLGIFLH

SEQ ID NO: 583276 - protein, 9 aa, Homo Sapiens
ITKAKTGGA

SEQ ID NO: 583277 - protein, 9 aa, Homo Sapiens
THSSSNKIV

SEQ ID NO: 583278 - protein, 9 aa, Homo Sapiens
SEGSDRKKH

SEQ ID NO: 583279 - protein, 9 aa, Homo Sapiens
SKATSMDVQ

SEQ ID NO: 583280 - protein, 9 aa, Homo Sapiens
PRVSIQAVN

SEQ ID NO: 583281 - protein, 9 aa, Homo Sapiens
VVVKFSIRL

SEQ ID NO: 583282 - protein, 9 aa, Homo Sapiens
DTTGIYTAA

SEQ ID NO: 583283 - protein, 9 aa, Homo Sapiens
PASATREED

SEQ ID NO: 583284 - protein, 9 aa, Homo Sapiens
HIESPSETN

SEQ ID NO: 583285 - protein, 9 aa, Homo Sapiens
TQIVDLHIM

SEQ ID NO: 583286 - protein, 9 aa, Homo Sapiens
HLGIFLHKS

SEQ ID NO: 583287 - protein, 9 aa, Homo Sapiens
FLCRTEQGT

SEQ ID NO: 583288 - protein, 9 aa, Homo Sapiens
FAQVYEAIQ

SEQ ID NO: 583289 - protein, 9 aa, Homo Sapiens
PKLLIGDLW

SEQ ID NO: 583290 - protein, 9 aa, Homo Sapiens
LHTPVYVFL

SEQ ID NO: 583291 - protein, 9 aa, Homo Sapiens
GASPRTPLE

SEQ ID NO: 583292 - protein, 9 aa, Homo Sapiens
DEDNILNEL

SEQ ID NO: 583293 - protein, 9 aa, Homo Sapiens
YVQDWIFTV

SEQ ID NO: 583294 - protein, 9 aa, Homo Sapiens
SGGDTDMTG

SEQ ID NO: 583295 - protein, 9 aa, Homo Sapiens
VDTTGIYTA

SEQ ID NO: 583296 - protein, 9 aa, Homo Sapiens
IFASFLGFT

SEQ ID NO: 583297 - protein, 9 aa, Homo Sapiens
IVLFSLAAS

SEQ ID NO: 583298 - protein, 9 aa, Homo Sapiens
SNKIVVFNT

SEQ ID NO: 583299 - protein, 9 aa, Homo Sapiens
PANEYAYRH

SEQ ID NO: 583300 - protein, 9 aa, Homo Sapiens
GMYLNTKIA

SEQ ID NO: 583301 - protein, 9 aa, Homo Sapiens
QKVGHFDKE

SEQ ID NO: 583302 - protein, 9 aa, Homo Sapiens
WLGRSATST

SEQ ID NO: 583303 - protein, 9 aa, Homo Sapiens
KPKALQHIE

SEQ ID NO: 583304 - protein, 9 aa, Homo Sapiens
GDALCRRMC

SEQ ID NO: 583305 - protein, 9 aa, Homo Sapiens
YDPEASSAP

SEQ ID NO: 583306 - protein, 9 aa, Homo Sapiens
LLIGDLWNL

SEQ ID NO: 583307 - protein, 9 aa, Homo Sapiens
SHPDSITTI

SEQ ID NO: 583308 - protein, 9 aa, Homo Sapiens
LPRPRWCTW

SEQ ID NO: 583309 - protein, 9 aa, Homo Sapiens
RLDGLTPPT

SEQ ID NO: 583310 - protein, 9 aa, Homo Sapiens
PLSAPSVSP

SEQ ID NO: 583311 - protein, 9 aa, Homo Sapiens
CKVLQIRYT

SEQ ID NO: 583312 - protein, 9 aa, Homo Sapiens
WETIVLFSL

SEQ ID NO: 583313 - protein, 9 aa, Homo Sapiens
VRDAKRSIR

SEQ ID NO: 583314 - protein, 9 aa, Homo Sapiens
AIFLCRTEQ

SEQ ID NO: 583315 - protein, 9 aa, Homo Sapiens
ILTVMATLK

SEQ ID NO: 583316 - protein, 9 aa, Homo Sapiens
SPNNRNQGV

SEQ ID NO: 583317 - protein, 9 aa, Homo Sapiens
WKVGDSSGT

SEQ ID NO: 583318 - protein, 9 aa, Homo Sapiens
LATATEFSQ

SEQ ID NO: 583319 - protein, 9 aa, Homo Sapiens
QSGPPEPCP

SEQ ID NO: 583320 - protein, 9 aa, Homo Sapiens
CEECCKAFK

SEQ ID NO: 583321 - protein, 9 aa, Homo Sapiens
WGSIMRVLS

SEQ ID NO: 583322 - protein, 9 aa, Homo Sapiens
PLLKNLLAE

SEQ ID NO: 583323 - protein, 9 aa, Homo Sapiens
TSSALDTSQ

SEQ ID NO: 583324 - protein, 9 aa, Homo Sapiens
NKGLWIPEG

SEQ ID NO: 583325 - protein, 9 aa, Homo Sapiens
PRKVVVKFS

SEQ ID NO: 583326 - protein, 9 aa, Homo Sapiens
LAAGLGYGR

SEQ ID NO: 583327 - protein, 9 aa, Homo Sapiens
LEPFTHSAP

SEQ ID NO: 583328 - protein, 9 aa, Homo Sapiens
APRVSIQAV

SEQ ID NO: 583329 - protein, 9 aa, Homo Sapiens
YGCLISPNN

SEQ ID NO: 583330 - protein, 9 aa, Homo Sapiens
AGGDISKPL

SEQ ID NO: 583331 - protein, 9 aa, Homo Sapiens
PTSQQKRSR

SEQ ID NO: 583332 - protein, 9 aa, Homo Sapiens
LCRRMCRAI

SEQ ID NO: 583333 - protein, 9 aa, Homo Sapiens
GALLNKEPQ

SEQ ID NO: 583334 - protein, 9 aa, Homo Sapiens
ARGPGAVAT

SEQ ID NO: 583335 - protein, 9 aa, Homo Sapiens
AGDGPTQSA

SEQ ID NO: 583336 - protein, 9 aa, Homo Sapiens
AISHPDSIT

SEQ ID NO: 583337 - protein, 9 aa, Homo Sapiens
LTRVGESTT

SEQ ID NO: 583338 - protein, 9 aa, Homo Sapiens
RRARGPGAV

SEQ ID NO: 583339 - protein, 9 aa, Homo Sapiens
RMCRAIGES

SEQ ID NO: 583340 - protein, 9 aa, Homo Sapiens
VLAISHPDS

SEQ ID NO: 583341 - protein, 9 aa, Homo Sapiens
RTTSASQGA

SEQ ID NO: 583342 - protein, 9 aa, Homo Sapiens
QFSLFTTSP

SEQ ID NO: 583343 - protein, 9 aa, Homo Sapiens
KALQHIESP

SEQ ID NO: 583344 - protein, 9 aa, Homo Sapiens
GKLTVAGGD

SEQ ID NO: 583345 - protein, 9 aa, Homo Sapiens
NLKNASLSL

SEQ ID NO: 583346 - protein, 9 aa, Homo Sapiens
RHGIAEAVG

SEQ ID NO: 583347 - protein, 9 aa, Homo Sapiens
LWETIVLFS

SEQ ID NO: 583348 - protein, 9 aa, Homo Sapiens
QGASPRTPL

SEQ ID NO: 583349 - protein, 9 aa, Homo Sapiens
EEDGDAVAH

SEQ ID NO: 583350 - protein, 9 aa, Homo Sapiens
CCTKASVVT

SEQ ID NO: 583351 - protein, 9 aa, Homo Sapiens
DVTLMKEEL

SEQ ID NO: 583352 - protein, 9 aa, Homo Sapiens
SLKLADLPT

SEQ ID NO: 583353 - protein, 9 aa, Homo Sapiens
TIVLFSLAA

SEQ ID NO: 583354 - protein, 9 aa, Homo Sapiens
QNCLWTLRK

SEQ ID NO: 583355 - protein, 9 aa, Homo Sapiens
TSASQGASP

SEQ ID NO: 583356 - protein, 9 aa, Homo Sapiens
MRESQGAEV

SEQ ID NO: 583357 - protein, 9 aa, Homo Sapiens
RTPLENLPW

SEQ ID NO: 583358 - protein, 9 aa, Homo Sapiens
TSVERLLER

SEQ ID NO: 583359 - protein, 9 aa, Homo Sapiens
ADPYVQDWI

SEQ ID NO: 583360 - protein, 9 aa, Homo Sapiens
KFSKSIEIP

SEQ ID NO: 583361 - protein, 9 aa, Homo Sapiens
FEPLPRPRW

SEQ ID NO: 583362 - protein, 9 aa, Homo Sapiens
GKVFMERNY

SEQ ID NO: 583363 - protein, 9 aa, Homo Sapiens
VCAYDPEAS

SEQ ID NO: 583364 - protein, 9 aa, Homo Sapiens
ESQGAEVSL

SEQ ID NO: 583365 - protein, 9 aa, Homo Sapiens
IVRGMYLNT

SEQ ID NO: 583366 - protein, 9 aa, Homo Sapiens
DSDKVSPVF

SEQ ID NO: 583367 - protein, 9 aa, Homo Sapiens
LCGMREMRA

SEQ ID NO: 583368 - protein, 9 aa, Homo Sapiens
HPEWVKVYG

SEQ ID NO: 583369 - protein, 9 aa, Homo Sapiens
DSLMTSSAL

SEQ ID NO: 583370 - protein, 9 aa, Homo Sapiens
NKDSDKVSP

SEQ ID NO: 583371 - protein, 9 aa, Homo Sapiens
WFMRADDVV

SEQ ID NO: 583372 - protein, 9 aa, Homo Sapiens
FKLVNTRTA

SEQ ID NO: 583373 - protein, 9 aa, Homo Sapiens
LLKNLLAER

SEQ ID NO: 583374 - protein, 9 aa, Homo Sapiens
TGRWLGRSA

SEQ ID NO: 583375 - protein, 9 aa, Homo Sapiens
FLFPVTVGS

SEQ ID NO: 583376 - protein, 9 aa, Homo Sapiens
GAWSYNNST

SEQ ID NO: 583377 - protein, 9 aa, Homo Sapiens
INDLLDCLL

SEQ ID NO: 583378 - protein, 9 aa, Homo Sapiens
QKRSRGKSY

SEQ ID NO: 583379 - protein, 9 aa, Homo Sapiens
GVSRHKPIN

SEQ ID NO: 583380 - protein, 9 aa, Homo Sapiens
VRGPVTGLK

SEQ ID NO: 583381 - protein, 9 aa, Homo Sapiens
EVAHRFRDL

SEQ ID NO: 583382 - protein, 9 aa, Homo Sapiens
GTINDLLDC

SEQ ID NO: 583383 - protein, 9 aa, Homo Sapiens
DPYVQDWIF

SEQ ID NO: 583384 - protein, 9 aa, Homo Sapiens
KNLKNASLS

SEQ ID NO: 583385 - protein, 9 aa, Homo Sapiens
IWCEDLLVR

SEQ ID NO: 583386 - protein, 9 aa, Homo Sapiens
TEFSQTGNK

SEQ ID NO: 583387 - protein, 9 aa, Homo Sapiens
KENVRTVLR

SEQ ID NO: 583388 - protein, 9 aa, Homo Sapiens
ARRRLNTRW

SEQ ID NO: 583389 - protein, 9 aa, Homo Sapiens
ESGAWSYNN

SEQ ID NO: 583390 - protein, 9 aa, Homo Sapiens
KATSMDVQQ

SEQ ID NO: 583391 - protein, 9 aa, Homo Sapiens
SVSADPYVQ

SEQ ID NO: 583392 - protein, 9 aa, Homo Sapiens
VDVLIFASF

SEQ ID NO: 583393 - protein, 9 aa, Homo Sapiens
EPANVGITK

SEQ ID NO: 583394 - protein, 9 aa, Homo Sapiens
KPKKVLSGQ

SEQ ID NO: 583395 - protein, 9 aa, Homo Sapiens
ENVRTVLRT

SEQ ID NO: 583396 - protein, 9 aa, Homo Sapiens
PVTVGSLIL

SEQ ID NO: 583397 - protein, 9 aa, Homo Sapiens
LQWDSPAPV

SEQ ID NO: 583398 - protein, 9 aa, Homo Sapiens
RCCTKASVV

SEQ ID NO: 583399 - protein, 9 aa, Homo Sapiens
KHKIADEGH

SEQ ID NO: 583400 - protein, 9 aa, Homo Sapiens
IDSYLEPFT

SEQ ID NO: 583401 - protein, 9 aa, Homo Sapiens
VLFSLAASK

SEQ ID NO: 583402 - protein, 9 aa, Homo Sapiens
APVCGKKHR

SEQ ID NO: 583403 - protein, 9 aa, Homo Sapiens
SGPPEPCPR

SEQ ID NO: 583404 - protein, 9 aa, Homo Sapiens
ILFVMFLFP

SEQ ID NO: 583405 - protein, 9 aa, Homo Sapiens
CCKAFKHSS

SEQ ID NO: 583406 - protein, 9 aa, Homo Sapiens
EWTLETLLE

SEQ ID NO: 583407 - protein, 9 aa, Homo Sapiens
GPPPELHLA

SEQ ID NO: 583408 - protein, 9 aa, Homo Sapiens
VLRTVTLST

SEQ ID NO: 583409 - protein, 9 aa, Homo Sapiens
DKHKIADEG

SEQ ID NO: 583410 - protein, 9 aa, Homo Sapiens
VSIQAVNLE

SEQ ID NO: 583411 - protein, 9 aa, Homo Sapiens
VGHFDKEIV

SEQ ID NO: 583412 - protein, 9 aa, Homo Sapiens
HIWCEDLLV

SEQ ID NO: 583413 - protein, 9 aa, Homo Sapiens
ELATATEFS

SEQ ID NO: 583414 - protein, 9 aa, Homo Sapiens
TTELATATE

SEQ ID NO: 583415 - protein, 9 aa, Homo Sapiens
STPKLLIGD

SEQ ID NO: 583416 - protein, 9 aa, Homo Sapiens
SPVRGPVTG

SEQ ID NO: 583417 - protein, 9 aa, Homo Sapiens
LVILTVMAT

SEQ ID NO: 583418 - protein, 9 aa, Homo Sapiens
SQGDALCRR

SEQ ID NO: 583419 - protein, 9 aa, Homo Sapiens
LKFSKSIEI

SEQ ID NO: 583420 - protein, 9 aa, Homo Sapiens
SADPYVQDW

SEQ ID NO: 583421 - protein, 9 aa, Homo Sapiens
SSNKIVVFN

SEQ ID NO: 583422 - protein, 9 aa, Homo Sapiens
RSPAVATKS

SEQ ID NO: 583423 - protein, 9 aa, Homo Sapiens
KSLYLGVSR

SEQ ID NO: 583424 - protein, 9 aa, Homo Sapiens
YTSVERLLE

SEQ ID NO: 583425 - protein, 9 aa, Homo Sapiens
ERAVRCCTK

SEQ ID NO: 583426 - protein, 9 aa, Homo Sapiens
STAPVCGKK

SEQ ID NO: 583427 - protein, 9 aa, Homo Sapiens
WCTWPLPRP

SEQ ID NO: 583428 - protein, 9 aa, Homo Sapiens
VEERSHKLQ

SEQ ID NO: 583429 - protein, 9 aa, Homo Sapiens
EKFKLVNTR

SEQ ID NO: 583430 - protein, 9 aa, Homo Sapiens
ISPNNRNQG

SEQ ID NO: 583431 - protein, 9 aa, Homo Sapiens
EWVKVYGPG

SEQ ID NO: 583432 - protein, 9 aa, Homo Sapiens
SGPCWKSLT

SEQ ID NO: 583433 - protein, 9 aa, Homo Sapiens
SKSIEIPSS

SEQ ID NO: 583434 - protein, 9 aa, Homo Sapiens
GPCWKSLTN

SEQ ID NO: 583435 - protein, 9 aa, Homo Sapiens
SRLHTPVYV

SEQ ID NO: 583436 - protein, 9 aa, Homo Sapiens
VKFSIRLVP

SEQ ID NO: 583437 - protein, 9 aa, Homo Sapiens
YLEPFTHSA

SEQ ID NO: 583438 - protein, 9 aa, Homo Sapiens
THLGIFLHK

SEQ ID NO: 583439 - protein, 9 aa, Homo Sapiens
FMERNYEFL

SEQ ID NO: 583440 - protein, 9 aa, Homo Sapiens
GNESLRCYY

SEQ ID NO: 583441 - protein, 9 aa, Homo Sapiens
MRRLGMIVA

SEQ ID NO: 583442 - protein, 9 aa, Homo Sapiens
GLWIPEGQR

SEQ ID NO: 583443 - protein, 9 aa, Homo Sapiens
LAIAGVVLN

SEQ ID NO: 583444 - protein, 9 aa, Homo Sapiens
IPRKVVVKF

SEQ ID NO: 583445 - protein, 9 aa, Homo Sapiens
EASSAPGSG

SEQ ID NO: 583446 - protein, 9 aa, Homo Sapiens
QLVLAYDSS

SEQ ID NO: 583447 - protein, 9 aa, Homo Sapiens
LYLWETIVL

SEQ ID NO: 583448 - protein, 9 aa, Homo Sapiens
SDKVSPVFT

SEQ ID NO: 583449 - protein, 9 aa, Homo Sapiens
HSERARQGV

SEQ ID NO: 583450 - protein, 9 aa, Homo Sapiens
QQKRSRGKS

SEQ ID NO: 583451 - protein, 9 aa, Homo Sapiens
PVTGLKAAL

SEQ ID NO: 583452 - protein, 9 aa, Homo Sapiens
PQMHKSAIK

SEQ ID NO: 583453 - protein, 9 aa, Homo Sapiens
CGMREMRAG

SEQ ID NO: 583454 - protein, 9 aa, Homo Sapiens
ASFLGFTEI

SEQ ID NO: 583455 - protein, 9 aa, Homo Sapiens
LKSAQDTCI

SEQ ID NO: 583456 - protein, 9 aa, Homo Sapiens
PVGPGCPLK

SEQ ID NO: 583457 - protein, 9 aa, Homo Sapiens
AKEFKTHLG

SEQ ID NO: 583458 - protein, 9 aa, Homo Sapiens
PMNFFLGHL

SEQ ID NO: 583459 - protein, 9 aa, Homo Sapiens
EAIQGDLND

SEQ ID NO: 583460 - protein, 9 aa, Homo Sapiens
TGYVAYVAK

SEQ ID NO: 583461 - protein, 9 aa, Homo Sapiens
KAKIDSYLE

SEQ ID NO: 583462 - protein, 9 aa, Homo Sapiens
KVPASATRE

SEQ ID NO: 583463 - protein, 9 aa, Homo Sapiens
AVRCCTKAS

SEQ ID NO: 583464 - protein, 9 aa, Homo Sapiens
APSVSPIPS

SEQ ID NO: 583465 - protein, 9 aa, Homo Sapiens
QGQSGPPEP

SEQ ID NO: 583466 - protein, 9 aa, Homo Sapiens
GAEVSLRTI

SEQ ID NO: 583467 - protein, 9 aa, Homo Sapiens
TTSASQGAS

SEQ ID NO: 583468 - protein, 9 aa, Homo Sapiens
PLKPTGRWL

SEQ ID NO: 583469 - protein, 9 aa, Homo Sapiens
PLMSRSGWK

SEQ ID NO: 583470 - protein, 9 aa, Homo Sapiens
VVLNSRTAA

SEQ ID NO: 583471 - protein, 9 aa, Homo Sapiens
AGSSGPCWK

SEQ ID NO: 583472 - protein, 9 aa, Homo Sapiens
EEGSLKLAD

SEQ ID NO: 583473 - protein, 9 aa, Homo Sapiens
GRRARGPGA

SEQ ID NO: 583474 - protein, 9 aa, Homo Sapiens
LFSLAASKE

SEQ ID NO: 583475 - protein, 9 aa, Homo Sapiens
ESTTHREGA

SEQ ID NO: 583476 - protein, 9 aa, Homo Sapiens
FMRADDVVY

SEQ ID NO: 583477 - protein, 9 aa, Homo Sapiens
SCGPPPELH

SEQ ID NO: 583478 - protein, 9 aa, Homo Sapiens
QGAEVSLRT

SEQ ID NO: 583479 - protein, 9 aa, Homo Sapiens
NFFLGHLSF

SEQ ID NO: 583480 - protein, 9 aa, Homo Sapiens
ECCKAFKHS

SEQ ID NO: 583481 - protein, 9 aa, Homo Sapiens
RWCTWPLPR

SEQ ID NO: 583482 - protein, 9 aa, Homo Sapiens
KRSPVGPGC

SEQ ID NO: 583483 - protein, 9 aa, Homo Sapiens
ISHPDSITT

SEQ ID NO: 583484 - protein, 9 aa, Homo Sapiens
LNQYAIFLC

SEQ ID NO: 583485 - protein, 9 aa, Homo Sapiens
RKAKIDSYL

SEQ ID NO: 583486 - protein, 9 aa, Homo Sapiens
VYEAIQGDL

SEQ ID NO: 583487 - protein, 9 aa, Homo Sapiens
INDVTLMKE

SEQ ID NO: 583488 - protein, 9 aa, Homo Sapiens
QHIESPSET

SEQ ID NO: 583489 - protein, 9 aa, Homo Sapiens
RLVDTTGIY

SEQ ID NO: 583490 - protein, 9 aa, Homo Sapiens
RWLGRSATS

SEQ ID NO: 583491 - protein, 9 aa, Homo Sapiens
KRSIREIIL

SEQ ID NO: 583492 - protein, 9 aa, Homo Sapiens
QRWKQLSFP

SEQ ID NO: 583493 - protein, 9 aa, Homo Sapiens
AQVYEAIQG

SEQ ID NO: 583494 - protein, 9 aa, Homo Sapiens
KVVVKFSIR

SEQ ID NO: 583495 - protein, 9 aa, Homo Sapiens
RTSRSSPVR

SEQ ID NO: 583496 - protein, 9 aa, Homo Sapiens
RHHRLNTGE

SEQ ID NO: 583497 - protein, 9 aa, Homo Sapiens
NSTEAMTYD

SEQ ID NO: 583498 - protein, 9 aa, Homo Sapiens
PYVQDWIFT

SEQ ID NO: 583499 - protein, 9 aa, Homo Sapiens
AIAGVVLNS

SEQ ID NO: 583500 - protein, 9 aa, Homo Sapiens
LQHIESPSE

SEQ ID NO: 583501 - protein, 9 aa, Homo Sapiens
QSAVDPALW

SEQ ID NO: 583502 - protein, 9 aa, Homo Sapiens
EGNESLRCY

SEQ ID NO: 583503 - protein, 9 aa, Homo Sapiens
EEEGSLKLA

SEQ ID NO: 583504 - protein, 9 aa, Homo Sapiens
DPEASSAPG

SEQ ID NO: 583505 - protein, 9 aa, Homo Sapiens
STTHREGAE

SEQ ID NO: 583506 - protein, 9 aa, Homo Sapiens
VGEGSHPEW

SEQ ID NO: 583507 - protein, 9 aa, Homo Sapiens
RAKEFKTHL

SEQ ID NO: 583508 - protein, 9 aa, Homo Sapiens
ALLNKEPQK

SEQ ID NO: 583509 - protein, 9 aa, Homo Sapiens
TDMTGYVAY

SEQ ID NO: 583510 - protein, 9 aa, Homo Sapiens
AAVLARRRL

SEQ ID NO: 583511 - protein, 9 aa, Homo Sapiens
VGITKAKTG

SEQ ID NO: 583512 - protein, 9 aa, Homo Sapiens
SRRRSASAT

SEQ ID NO: 583513 - protein, 9 aa, Homo Sapiens
PPPGRRARG

SEQ ID NO: 583514 - protein, 9 aa, Homo Sapiens
HRFRDLGEE

SEQ ID NO: 583515 - protein, 9 aa, Homo Sapiens
VATSLLRRP

SEQ ID NO: 583516 - protein, 9 aa, Homo Sapiens
VRCCTKASV

SEQ ID NO: 583517 - protein, 9 aa, Homo Sapiens
IQGDLNDAK

SEQ ID NO: 583518 - protein, 9 aa, Homo Sapiens
IGDLWNLQA

SEQ ID NO: 583519 - protein, 9 aa, Homo Sapiens
VLAYDSSRE

SEQ ID NO: 583520 - protein, 9 aa, Homo Sapiens
RQGVEERSH

SEQ ID NO: 583521 - protein, 9 aa, Homo Sapiens
CWKSLTNSR

SEQ ID NO: 583522 - protein, 9 aa, Homo Sapiens
LKAALLKRS

SEQ ID NO: 583523 - protein, 9 aa, Homo Sapiens
GMREMRAGG

SEQ ID NO: 583524 - protein, 9 aa, Homo Sapiens
GSEGVVLST

SEQ ID NO: 583525 - protein, 9 aa, Homo Sapiens
GEGNESLRC

SEQ ID NO: 583526 - protein, 9 aa, Homo Sapiens
QYAIFLCRT

SEQ ID NO: 583527 - protein, 9 aa, Homo Sapiens
QLSFPQQEA

SEQ ID NO: 583528 - protein, 9 aa, Homo Sapiens
GKIFDEDNI

SEQ ID NO: 583529 - protein, 9 aa, Homo Sapiens
AALLKRSPV

SEQ ID NO: 583530 - protein, 9 aa, Homo Sapiens
KNLLAERTS

SEQ ID NO: 583531 - protein, 9 aa, Homo Sapiens
PKKVLSGQD

SEQ ID NO: 583532 - protein, 9 aa, Homo Sapiens
GTLIVHQRI

SEQ ID NO: 583533 - protein, 9 aa, Homo Sapiens
GKGFIQKGT

SEQ ID NO: 583534 - protein, 9 aa, Homo Sapiens
LSTPKLLIG

SEQ ID NO: 583535 - protein, 9 aa, Homo Sapiens
SHVGKVFME

SEQ ID NO: 583536 - protein, 9 aa, Homo Sapiens
SLRCYYWAV

SEQ ID NO: 583537 - protein, 9 aa, Homo Sapiens
DVVYIKGDK

SEQ ID NO: 583538 - protein, 9 aa, Homo Sapiens
KPPPGRRAR

SEQ ID NO: 583539 - protein, 9 aa, Homo Sapiens
KDSFVVERQ

SEQ ID NO: 583540 - protein, 9 aa, Homo Sapiens
DNILNELND

SEQ ID NO: 583541 - protein, 9 aa, Homo Sapiens
QAAVCKETI

SEQ ID NO: 583542 - protein, 9 aa, Homo Sapiens
NESLRCYYW

SEQ ID NO: 583543 - protein, 9 aa, Homo Sapiens
RYGLSTCLG

SEQ ID NO: 583544 - protein, 9 aa, Homo Sapiens
MTEEVEDKL

SEQ ID NO: 583545 - protein, 9 aa, Homo Sapiens
LESLRKQVE

SEQ ID NO: 583546 - protein, 9 aa, Homo Sapiens
AVALGDVGH

SEQ ID NO: 583547 - protein, 9 aa, Homo Sapiens
DMRLVEELE

SEQ ID NO: 583548 - protein, 9 aa, Homo Sapiens
WLHLGERAY

SEQ ID NO: 583549 - protein, 9 aa, Homo Sapiens
RRKFDNSSS

SEQ ID NO: 583550 - protein, 9 aa, Homo Sapiens
APTPAVAAA

SEQ ID NO: 583551 - protein, 9 aa, Homo Sapiens
FGSKFGVQM

SEQ ID NO: 583552 - protein, 9 aa, Homo Sapiens
LQSPLLAER

SEQ ID NO: 583553 - protein, 9 aa, Homo Sapiens
SDDDKTVKK

SEQ ID NO: 583554 - protein, 9 aa, Homo Sapiens
TTLFTSNPA

SEQ ID NO: 583555 - protein, 9 aa, Homo Sapiens
FHPSEAMCR

SEQ ID NO: 583556 - protein, 9 aa, Homo Sapiens
SQGMTEEVE

SEQ ID NO: 583557 - protein, 9 aa, Homo Sapiens
SSSLDPEPD

SEQ ID NO: 583558 - protein, 9 aa, Homo Sapiens
CLQEAVSEA

SEQ ID NO: 583559 - protein, 9 aa, Homo Sapiens
KSFTYKPEV

SEQ ID NO: 583560 - protein, 9 aa, Homo Sapiens
YMASEVVNR

SEQ ID NO: 583561 - protein, 9 aa, Homo Sapiens
HSLPATRAV

SEQ ID NO: 583562 - protein, 9 aa, Homo Sapiens
SPAADAPTP

SEQ ID NO: 583563 - protein, 9 aa, Homo Sapiens
LDLTHVLLR

SEQ ID NO: 583564 - protein, 9 aa, Homo Sapiens
RPRATDGHR

SEQ ID NO: 583565 - protein, 9 aa, Homo Sapiens
GGDNLDLTH

SEQ ID NO: 583566 - protein, 9 aa, Homo Sapiens
SCLMPTLLG

SEQ ID NO: 583567 - protein, 9 aa, Homo Sapiens
LFVFVLRCL

SEQ ID NO: 583568 - protein, 9 aa, Homo Sapiens
GGSLLSPSA

SEQ ID NO: 583569 - protein, 9 aa, Homo Sapiens
PALGSPSEG

SEQ ID NO: 583570 - protein, 9 aa, Homo Sapiens
VPHGKSQRE

SEQ ID NO: 583571 - protein, 9 aa, Homo Sapiens
QSPLLAERV

SEQ ID NO: 583572 - protein, 9 aa, Homo Sapiens
TVKKIAMRE

SEQ ID NO: 583573 - protein, 9 aa, Homo Sapiens
SHLCANGST

SEQ ID NO: 583574 - protein, 9 aa, Homo Sapiens
GGPVTVTDT

SEQ ID NO: 583575 - protein, 9 aa, Homo Sapiens
RALGSTSLP

SEQ ID NO: 583576 - protein, 9 aa, Homo Sapiens
TYKPEVFFQ

SEQ ID NO: 583577 - protein, 9 aa, Homo Sapiens
TTSQVRPKH

SEQ ID NO: 583578 - protein, 9 aa, Homo Sapiens
QDQDSQRGH

SEQ ID NO: 583579 - protein, 9 aa, Homo Sapiens
CAKIDEKTA

SEQ ID NO: 583580 - protein, 9 aa, Homo Sapiens
TEEVEDKLL

SEQ ID NO: 583581 - protein, 9 aa, Homo Sapiens
VSHIVKNHN

SEQ ID NO: 583582 - protein, 9 aa, Homo Sapiens
SLQSPLLAE

SEQ ID NO: 583583 - protein, 9 aa, Homo Sapiens
TKEPAPDPS

SEQ ID NO: 583584 - protein, 9 aa, Homo Sapiens
LCANGSTCT

SEQ ID NO: 583585 - protein, 9 aa, Homo Sapiens
CLHTLVEHS

SEQ ID NO: 583586 - protein, 9 aa, Homo Sapiens
VFRLFGCFA

SEQ ID NO: 583587 - protein, 9 aa, Homo Sapiens
GLEDLFYEY

SEQ ID NO: 583588 - protein, 9 aa, Homo Sapiens
RPKHITSLE

SEQ ID NO: 583589 - protein, 9 aa, Homo Sapiens
SVCYDSSLK

SEQ ID NO: 583590 - protein, 9 aa, Homo Sapiens
EFWEENFCC

SEQ ID NO: 583591 - protein, 9 aa, Homo Sapiens
DLTHVLLRK

SEQ ID NO: 583592 - protein, 9 aa, Homo Sapiens
TSESMLWKA

SEQ ID NO: 583593 - protein, 9 aa, Homo Sapiens
PAADAPTPA

SEQ ID NO: 583594 - protein, 9 aa, Homo Sapiens
LCLHTLVEH

SEQ ID NO: 583595 - protein, 9 aa, Homo Sapiens
LEDLFYEYG

SEQ ID NO: 583596 - protein, 9 aa, Homo Sapiens
ELALPNHHP

SEQ ID NO: 583597 - protein, 9 aa, Homo Sapiens
DAPTPAVAA

SEQ ID NO: 583598 - protein, 9 aa, Homo Sapiens
TLCLHTLVE

SEQ ID NO: 583599 - protein, 9 aa, Homo Sapiens
SASYVYILS

SEQ ID NO: 583600 - protein, 9 aa, Homo Sapiens
AAVAAASLL

SEQ ID NO: 583601 - protein, 9 aa, Homo Sapiens
EHQWLHLGE

SEQ ID NO: 583602 - protein, 9 aa, Homo Sapiens
GGASPSLSV

SEQ ID NO: 583603 - protein, 9 aa, Homo Sapiens
IHVEKNRHY

SEQ ID NO: 583604 - protein, 9 aa, Homo Sapiens
PASTLCLHT

SEQ ID NO: 583605 - protein, 9 aa, Homo Sapiens
HIVELLLQQ

SEQ ID NO: 583606 - protein, 9 aa, Homo Sapiens
QERPLFEKK

SEQ ID NO: 583607 - protein, 9 aa, Homo Sapiens
GGRPRATDG

SEQ ID NO: 583608 - protein, 9 aa, Homo Sapiens
VSQALVQKH

SEQ ID NO: 583609 - protein, 9 aa, Homo Sapiens
NLLEHQWLH

SEQ ID NO: 583610 - protein, 9 aa, Homo Sapiens
TSAVDDTTL

SEQ ID NO: 583611 - protein, 9 aa, Homo Sapiens
ESSCLMPTL

SEQ ID NO: 583612 - protein, 9 aa, Homo Sapiens
ENFCCKLGS

SEQ ID NO: 583613 - protein, 9 aa, Homo Sapiens
GTAFFPTRS

SEQ ID NO: 583614 - protein, 9 aa, Homo Sapiens
VAVEEVNEE

SEQ ID NO: 583615 - protein, 9 aa, Homo Sapiens
GARSEDAGE

SEQ ID NO: 583616 - protein, 9 aa, Homo Sapiens
PVTVTDTNL

SEQ ID NO: 583617 - protein, 9 aa, Homo Sapiens
DTTLFTSNP

SEQ ID NO: 583618 - protein, 9 aa, Homo Sapiens
EGSTSSSLD

SEQ ID NO: 583619 - protein, 9 aa, Homo Sapiens
TLTAFTLKQ

SEQ ID NO: 583620 - protein, 9 aa, Homo Sapiens
SLSVQSFSR

SEQ ID NO: 583621 - protein, 9 aa, Homo Sapiens
TASSRASTA

SEQ ID NO: 583622 - protein, 9 aa, Homo Sapiens
IVVFRLFGC

SEQ ID NO: 583623 - protein, 9 aa, Homo Sapiens
RPSCCLTTC

SEQ ID NO: 583624 - protein, 9 aa, Homo Sapiens
HVLLRKFRD

SEQ ID NO: 583625 - protein, 9 aa, Homo Sapiens
GATGTAFFP

SEQ ID NO: 583626 - protein, 9 aa, Homo Sapiens
VVILVLVVV

SEQ ID NO: 583627 - protein, 9 aa, Homo Sapiens
KVLEETKEP

SEQ ID NO: 583628 - protein, 9 aa, Homo Sapiens
QDSQRGHSY

SEQ ID NO: 583629 - protein, 9 aa, Homo Sapiens
TSGWGSIEP

SEQ ID NO: 583630 - protein, 9 aa, Homo Sapiens
IFERESRHG

SEQ ID NO: 583631 - protein, 9 aa, Homo Sapiens
LAVVILVLV

SEQ ID NO: 583632 - protein, 9 aa, Homo Sapiens
LESDDDKTV

SEQ ID NO: 583633 - protein, 9 aa, Homo Sapiens
ASEVVNRRG

SEQ ID NO: 583634 - protein, 9 aa, Homo Sapiens
CTLTAFTLK

SEQ ID NO: 583635 - protein, 9 aa, Homo Sapiens
AVSEALLMA

SEQ ID NO: 583636 - protein, 9 aa, Homo Sapiens
LAQHSVELA

SEQ ID NO: 583637 - protein, 9 aa, Homo Sapiens
DSVRGFGSK

SEQ ID NO: 583638 - protein, 9 aa, Homo Sapiens
SGIHSLPAT

SEQ ID NO: 583639 - protein, 9 aa, Homo Sapiens
LLLQQQFLE

SEQ ID NO: 583640 - protein, 9 aa, Homo Sapiens
LLEHQWLHL

SEQ ID NO: 583641 - protein, 9 aa, Homo Sapiens
QVRPKHITS

SEQ ID NO: 583642 - protein, 9 aa, Homo Sapiens
EYAYRHGIA

SEQ ID NO: 583643 - protein, 9 aa, Homo Sapiens
RSNLLEHQW

SEQ ID NO: 583644 - protein, 9 aa, Homo Sapiens
CLSHLCANG

SEQ ID NO: 583645 - protein, 9 aa, Homo Sapiens
VQGARSEDA

SEQ ID NO: 583646 - protein, 9 aa, Homo Sapiens
EVKQFFQIT

SEQ ID NO: 583647 - protein, 9 aa, Homo Sapiens
MASEVVNRR

SEQ ID NO: 583648 - protein, 9 aa, Homo Sapiens
LMLSAHRVI

SEQ ID NO: 583649 - protein, 9 aa, Homo Sapiens
RKFDNSSSL

SEQ ID NO: 583650 - protein, 9 aa, Homo Sapiens
IGGAVTFVL

SEQ ID NO: 583651 - protein, 9 aa, Homo Sapiens
MLSAHRVIG

SEQ ID NO: 583652 - protein, 9 aa, Homo Sapiens
YGLEDLFYE

SEQ ID NO: 583653 - protein, 9 aa, Homo Sapiens
QEAVSEALL

SEQ ID NO: 583654 - protein, 9 aa, Homo Sapiens
NAVALGDVG

SEQ ID NO: 583655 - protein, 9 aa, Homo Sapiens
TDTNLVLGR

SEQ ID NO: 583656 - protein, 9 aa, Homo Sapiens
LTHVLLRKF

SEQ ID NO: 583657 - protein, 9 aa, Homo Sapiens
QFVSQALVQ

SEQ ID NO: 583658 - protein, 9 aa, Homo Sapiens
RPALGSPSE

SEQ ID NO: 583659 - protein, 9 aa, Homo Sapiens
DKTVKKIAM

SEQ ID NO: 583660 - protein, 9 aa, Homo Sapiens
GPVTVTDTN

SEQ ID NO: 583661 - protein, 9 aa, Homo Sapiens
VNEEGKFVR

SEQ ID NO: 583662 - protein, 9 aa, Homo Sapiens
ASSRASTAT

SEQ ID NO: 583663 - protein, 9 aa, Homo Sapiens
LDARQAQGV

SEQ ID NO: 583664 - protein, 9 aa, Homo Sapiens
CGTVEYMAS

SEQ ID NO: 583665 - protein, 9 aa, Homo Sapiens
GQDYCTLTA

SEQ ID NO: 583666 - protein, 9 aa, Homo Sapiens
WEELYKSRP

SEQ ID NO: 583667 - protein, 9 aa, Homo Sapiens
QFFQITCEN

SEQ ID NO: 583668 - protein, 9 aa, Homo Sapiens
HRRKFDNSS

SEQ ID NO: 583669 - protein, 9 aa, Homo Sapiens
HLCANGSTC

SEQ ID NO: 583670 - protein, 9 aa, Homo Sapiens
QQDMRLVEE

SEQ ID NO: 583671 - protein, 9 aa, Homo Sapiens
LNAVALGDV

SEQ ID NO: 583672 - protein, 9 aa, Homo Sapiens
RLSADKFEV

SEQ ID NO: 583673 - protein, 9 aa, Homo Sapiens
VRGFGSKFG

SEQ ID NO: 583674 - protein, 9 aa, Homo Sapiens
LEHQWLHLG

SEQ ID NO: 583675 - protein, 9 aa, Homo Sapiens
IFQDKELNV

SEQ ID NO: 583676 - protein, 9 aa, Homo Sapiens
FELSCWGGG

SEQ ID NO: 583677 - protein, 9 aa, Homo Sapiens
KATAAVAAA

SEQ ID NO: 583678 - protein, 9 aa, Homo Sapiens
RLFGCFATC

SEQ ID NO: 583679 - protein, 9 aa, Homo Sapiens
ISSGGSLLS

SEQ ID NO: 583680 - protein, 9 aa, Homo Sapiens
DWLGGRPRA

SEQ ID NO: 583681 - protein, 9 aa, Homo Sapiens
ENSELPEDG

SEQ ID NO: 583682 - protein, 9 aa, Homo Sapiens
RQAQGVALS

SEQ ID NO: 583683 - protein, 9 aa, Homo Sapiens
TTCYTSGWG

SEQ ID NO: 583684 - protein, 9 aa, Homo Sapiens
GRPRATDGH

SEQ ID NO: 583685 - protein, 9 aa, Homo Sapiens
SEVVNRRGH

SEQ ID NO: 583686 - protein, 9 aa, Homo Sapiens
IFLVHFDPN

SEQ ID NO: 583687 - protein, 9 aa, Homo Sapiens
SPLLAERVP

SEQ ID NO: 583688 - protein, 9 aa, Homo Sapiens
PFCESSCLM

SEQ ID NO: 583689 - protein, 9 aa, Homo Sapiens
QVEHVTEPA

SEQ ID NO: 583690 - protein, 9 aa, Homo Sapiens
LHTLVEHSG

SEQ ID NO: 583691 - protein, 9 aa, Homo Sapiens
ARSEDAGEY

SEQ ID NO: 583692 - protein, 9 aa, Homo Sapiens
RGFGSKFGV

SEQ ID NO: 583693 - protein, 9 aa, Homo Sapiens
IVEVKQFFQ

SEQ ID NO: 583694 - protein, 9 aa, Homo Sapiens
GLDARQAQG

SEQ ID NO: 583695 - protein, 9 aa, Homo Sapiens
VALGDVGHY

SEQ ID NO: 583696 - protein, 9 aa, Homo Sapiens
VYILSTILK

SEQ ID NO: 583697 - protein, 9 aa, Homo Sapiens
EKAAEDSCA

SEQ ID NO: 583698 - protein, 9 aa, Homo Sapiens
APANGRDNK

SEQ ID NO: 583699 - protein, 9 aa, Homo Sapiens
EKNRHYYVN

SEQ ID NO: 583700 - protein, 9 aa, Homo Sapiens
LEERQTILE

SEQ ID NO: 583701 - protein, 9 aa, Homo Sapiens
VDSVRGFGS

SEQ ID NO: 583702 - protein, 9 aa, Homo Sapiens
APFELSCWG

SEQ ID NO: 583703 - protein, 9 aa, Homo Sapiens
VSEALLMAD

SEQ ID NO: 583704 - protein, 9 aa, Homo Sapiens
VTDTNLVLG

SEQ ID NO: 583705 - protein, 9 aa, Homo Sapiens
VTVTDTNLV

SEQ ID NO: 583706 - protein, 9 aa, Homo Sapiens
SPGATGTAF

SEQ ID NO: 583707 - protein, 9 aa, Homo Sapiens
LYKSRPGDD

SEQ ID NO: 583708 - protein, 9 aa, Homo Sapiens
QRGHSYLRD

SEQ ID NO: 583709 - protein, 9 aa, Homo Sapiens
TGTTIVVFR

SEQ ID NO: 583710 - protein, 9 aa, Homo Sapiens
RPLFEKKRG

SEQ ID NO: 583711 - protein, 9 aa, Homo Sapiens
RQTILEAAR

SEQ ID NO: 583712 - protein, 9 aa, Homo Sapiens
PKKRKFESG

SEQ ID NO: 583713 - protein, 9 aa, Homo Sapiens
PRALGSTSL

SEQ ID NO: 583714 - protein, 9 aa, Homo Sapiens
EENFCCKLG

SEQ ID NO: 583715 - protein, 9 aa, Homo Sapiens
FVLRCLELK

SEQ ID NO: 583716 - protein, 9 aa, Homo Sapiens
PLRYGLSTC

SEQ ID NO: 583717 - protein, 9 aa, Homo Sapiens
YKPEVFFQC

SEQ ID NO: 583718 - protein, 9 aa, Homo Sapiens
QFYKAYHFW

SEQ ID NO: 583719 - protein, 9 aa, Homo Sapiens
CCLTTCCRT

SEQ ID NO: 583720 - protein, 9 aa, Homo Sapiens
LESQPHSSA

SEQ ID NO: 583721 - protein, 9 aa, Homo Sapiens
MEAERRPAL

SEQ ID NO: 583722 - protein, 9 aa, Homo Sapiens
LVLVVVKCV

SEQ ID NO: 583723 - protein, 9 aa, Homo Sapiens
KNRHYYVNR

SEQ ID NO: 583724 - protein, 9 aa, Homo Sapiens
VKQFFQITC

SEQ ID NO: 583725 - protein, 9 aa, Homo Sapiens
LVEELERSL

SEQ ID NO: 583726 - protein, 9 aa, Homo Sapiens
STSLPHFRR

SEQ ID NO: 583727 - protein, 9 aa, Homo Sapiens
SPSLSVQSF

SEQ ID NO: 583728 - protein, 9 aa, Homo Sapiens
NLDLTHVLL

SEQ ID NO: 583729 - protein, 9 aa, Homo Sapiens
GFGSKFGVQ

SEQ ID NO: 583730 - protein, 9 aa, Homo Sapiens
EKQQDMRLV

SEQ ID NO: 583731 - protein, 9 aa, Homo Sapiens
QIQNLSVCY

SEQ ID NO: 583732 - protein, 9 aa, Homo Sapiens
LEAARQCGD

SEQ ID NO: 583733 - protein, 9 aa, Homo Sapiens
VGAICSGIH

SEQ ID NO: 583734 - protein, 9 aa, Homo Sapiens
TSQVRPKHI

SEQ ID NO: 583735 - protein, 9 aa, Homo Sapiens
EWEELYKSR

SEQ ID NO: 583736 - protein, 9 aa, Homo Sapiens
SAPANGRDN

SEQ ID NO: 583737 - protein, 9 aa, Homo Sapiens
AGGASPSLS

SEQ ID NO: 583738 - protein, 9 aa, Homo Sapiens
YEWLVSHIV

SEQ ID NO: 583739 - protein, 9 aa, Homo Sapiens
WTDACLSHL

SEQ ID NO: 583740 - protein, 9 aa, Homo Sapiens
GKSFTYKPE

SEQ ID NO: 583741 - protein, 9 aa, Homo Sapiens
GHIVELLLQ

SEQ ID NO: 583742 - protein, 9 aa, Homo Sapiens
SLDPEPDTE

SEQ ID NO: 583743 - protein, 9 aa, Homo Sapiens
LGDVGHYTC

SEQ ID NO: 583744 - protein, 9 aa, Homo Sapiens
DVGHYTCRY

SEQ ID NO: 583745 - protein, 9 aa, Homo Sapiens
QDKELNVVS

SEQ ID NO: 583746 - protein, 9 aa, Homo Sapiens
RRGSVLQSI

SEQ ID NO: 583747 - protein, 9 aa, Homo Sapiens
SSLDPEPDT

SEQ ID NO: 583748 - protein, 9 aa, Homo Sapiens
SRPFQTTVP

SEQ ID NO: 583749 - protein, 9 aa, Homo Sapiens
VTAVIYARR

SEQ ID NO: 583750 - protein, 9 aa, Homo Sapiens
ELLLQQQFL

SEQ ID NO: 583751 - protein, 9 aa, Homo Sapiens
PKHITSLEV

SEQ ID NO: 583752 - protein, 9 aa, Homo Sapiens
AVVILVLVV

SEQ ID NO: 583753 - protein, 9 aa, Homo Sapiens
GRVAVEEVN

SEQ ID NO: 583754 - protein, 9 aa, Homo Sapiens
SLQFFVEPS

SEQ ID NO: 583755 - protein, 9 aa, Homo Sapiens
PFELSCWGG

SEQ ID NO: 583756 - protein, 9 aa, Homo Sapiens
QAQGVALSS

SEQ ID NO: 583757 - protein, 9 aa, Homo Sapiens
LSQGMTEEV

SEQ ID NO: 583758 - protein, 9 aa, Homo Sapiens
ICSGIHSLP

SEQ ID NO: 583759 - protein, 9 aa, Homo Sapiens
SVELALPNH

SEQ ID NO: 583760 - protein, 9 aa, Homo Sapiens
AEGQDYCTL

SEQ ID NO: 583761 - protein, 9 aa, Homo Sapiens
EDLFYEYGV

SEQ ID NO: 583762 - protein, 9 aa, Homo Sapiens
KEASLQFFV

SEQ ID NO: 583763 - protein, 9 aa, Homo Sapiens
FESGGGGEG

SEQ ID NO: 583764 - protein, 9 aa, Homo Sapiens
FFVEPSEAT

SEQ ID NO: 583765 - protein, 9 aa, Homo Sapiens
ANEYAYRHG

SEQ ID NO: 583766 - protein, 9 aa, Homo Sapiens
GPLQERPLF

SEQ ID NO: 583767 - protein, 9 aa, Homo Sapiens
DHRRMLTPA

SEQ ID NO: 583768 - protein, 9 aa, Homo Sapiens
SLPHFRRAS

SEQ ID NO: 583769 - protein, 9 aa, Homo Sapiens
AVEEVNEEG

SEQ ID NO: 583770 - protein, 9 aa, Homo Sapiens
PERLSADKF

SEQ ID NO: 583771 - protein, 9 aa, Homo Sapiens
KEPAPDPSA

SEQ ID NO: 583772 - protein, 9 aa, Homo Sapiens
SAHRVIGPE

SEQ ID NO: 583773 - protein, 9 aa, Homo Sapiens
KTTSQVRPK

SEQ ID NO: 583774 - protein, 9 aa, Homo Sapiens
SLLSPSAVS

SEQ ID NO: 583775 - protein, 9 aa, Homo Sapiens
DSQRGHSYL

SEQ ID NO: 583776 - protein, 9 aa, Homo Sapiens
GTRVLSLVQ

SEQ ID NO: 583777 - protein, 9 aa, Homo Sapiens
VEDKLLALK

SEQ ID NO: 583778 - protein, 9 aa, Homo Sapiens
RLVEELERS

SEQ ID NO: 583779 - protein, 9 aa, Homo Sapiens
PSLSVQSFS

SEQ ID NO: 583780 - protein, 9 aa, Homo Sapiens
APASTLCLH

SEQ ID NO: 583781 - protein, 9 aa, Homo Sapiens
FQTTVPHGK

SEQ ID NO: 583782 - protein, 9 aa, Homo Sapiens
RSEDAGEYL

SEQ ID NO: 583783 - protein, 9 aa, Homo Sapiens
DSCAKIDEK

SEQ ID NO: 583784 - protein, 9 aa, Homo Sapiens
ACALESQPH

SEQ ID NO: 583785 - protein, 9 aa, Homo Sapiens
DKATAAVAA

SEQ ID NO: 583786 - protein, 9 aa, Homo Sapiens
GGAVTFVLV

SEQ ID NO: 583787 - protein, 9 aa, Homo Sapiens
SSCLMPTLL

SEQ ID NO: 583788 - protein, 9 aa, Homo Sapiens
AVIYARRGS

SEQ ID NO: 583789 - protein, 9 aa, Homo Sapiens
NSSSLMLEW

SEQ ID NO: 583790 - protein, 9 aa, Homo Sapiens
QSVSQATNW

SEQ ID NO: 583791 - protein, 9 aa, Homo Sapiens
QLTDLVPNM

SEQ ID NO: 583792 - protein, 9 aa, Homo Sapiens
ALLPENDTS

SEQ ID NO: 583793 - protein, 9 aa, Homo Sapiens
MSQPKKRKF

SEQ ID NO: 583794 - protein, 9 aa, Homo Sapiens
FVFVLRCLE

SEQ ID NO: 583795 - protein, 9 aa, Homo Sapiens
KSRPGDDYE

SEQ ID NO: 583796 - protein, 9 aa, Homo Sapiens
LSAGDHRRM

SEQ ID NO: 583797 - protein, 9 aa, Homo Sapiens
SVQSFSRGS

SEQ ID NO: 583798 - protein, 9 aa, Homo Sapiens
CSGIHSLPA

SEQ ID NO: 583799 - protein, 9 aa, Homo Sapiens
GSPAADAPT

SEQ ID NO: 583800 - protein, 9 aa, Homo Sapiens
AAPFELSCW

SEQ ID NO: 583801 - protein, 9 aa, Homo Sapiens
VVFRLFGCF

SEQ ID NO: 583802 - protein, 9 aa, Homo Sapiens
KELNVVSGE

SEQ ID NO: 583803 - protein, 9 aa, Homo Sapiens
NVVSGEATA

SEQ ID NO: 583804 - protein, 9 aa, Homo Sapiens
IYARRGSVL

SEQ ID NO: 583805 - protein, 9 aa, Homo Sapiens
QPKKRKFES

SEQ ID NO: 583806 - protein, 9 aa, Homo Sapiens
ACLSHLCAN

SEQ ID NO: 583807 - protein, 9 aa, Homo Sapiens
LTDLVPNME

SEQ ID NO: 583808 - protein, 9 aa, Homo Sapiens
FDNSSSLML

SEQ ID NO: 583809 - protein, 9 aa, Homo Sapiens
QNLSVCYDS

SEQ ID NO: 583810 - protein, 9 aa, Homo Sapiens
TSLPHFRRA

SEQ ID NO: 583811 - protein, 9 aa, Homo Sapiens
WEENFCCKL

SEQ ID NO: 583812 - protein, 9 aa, Homo Sapiens
AGDHRRMLT

SEQ ID NO: 583813 - protein, 9 aa, Homo Sapiens
LVVVKCVRR

SEQ ID NO: 583814 - protein, 9 aa, Homo Sapiens
FLVHFDPNL

SEQ ID NO: 583815 - protein, 9 aa, Homo Sapiens
ESSTASSRA

SEQ ID NO: 583816 - protein, 9 aa, Homo Sapiens
RVAVEEVNE

SEQ ID NO: 583817 - protein, 9 aa, Homo Sapiens
HYYVNRQAQ

SEQ ID NO: 583818 - protein, 9 aa, Homo Sapiens
KPVYRNPLR

SEQ ID NO: 583819 - protein, 9 aa, Homo Sapiens
LGSTSLPHF

SEQ ID NO: 583820 - protein, 9 aa, Homo Sapiens
EKTNSFHPS

SEQ ID NO: 583821 - protein, 9 aa, Homo Sapiens
QTILEAARQ

SEQ ID NO: 583822 - protein, 9 aa, Homo Sapiens
YPISQNPER

SEQ ID NO: 583823 - protein, 9 aa, Homo Sapiens
KEKQQDMRL

SEQ ID NO: 583824 - protein, 9 aa, Homo Sapiens
HIVKNHNEN

SEQ ID NO: 583825 - protein, 9 aa, Homo Sapiens
NMEYAVTVQ

SEQ ID NO: 583826 - protein, 9 aa, Homo Sapiens
LQFFVEPSE

SEQ ID NO: 583827 - protein, 9 aa, Homo Sapiens
PVYRNPLRY

SEQ ID NO: 583828 - protein, 9 aa, Homo Sapiens
YCTLTAFTL

SEQ ID NO: 583829 - protein, 9 aa, Homo Sapiens
IVELLLQQQ

SEQ ID NO: 583830 - protein, 9 aa, Homo Sapiens
VIYARRGSV

SEQ ID NO: 583831 - protein, 9 aa, Homo Sapiens
AEDSCAKID

SEQ ID NO: 583832 - protein, 9 aa, Homo Sapiens
NRHYYVNRQ

SEQ ID NO: 583833 - protein, 9 aa, Homo Sapiens
IKVLEETKE

SEQ ID NO: 583834 - protein, 9 aa, Homo Sapiens
YAYRHGIAE

SEQ ID NO: 583835 - protein, 9 aa, Homo Sapiens
EWLVSHIVK

SEQ ID NO: 583836 - protein, 9 aa, Homo Sapiens
AYRHGIAEA

SEQ ID NO: 583837 - protein, 9 aa, Homo Sapiens
QTTVPHGKS

SEQ ID NO: 583838 - protein, 9 aa, Homo Sapiens
PTPAVAAAE

SEQ ID NO: 583839 - protein, 9 aa, Homo Sapiens
LSWQSVSQA

SEQ ID NO: 583840 - protein, 9 aa, Homo Sapiens
TVPHGKSQR

SEQ ID NO: 583841 - protein, 9 aa, Homo Sapiens
ELNVVSGEA

SEQ ID NO: 583842 - protein, 9 aa, Homo Sapiens
GDVGHYTCR

SEQ ID NO: 583843 - protein, 9 aa, Homo Sapiens
NPERLSADK

SEQ ID NO: 583844 - protein, 9 aa, Homo Sapiens
EYIFERESR

SEQ ID NO: 583845 - protein, 9 aa, Homo Sapiens
NQSEACALE

SEQ ID NO: 583846 - protein, 9 aa, Homo Sapiens
LTAFTLKQK

SEQ ID NO: 583847 - protein, 9 aa, Homo Sapiens
AEFWEENFC

SEQ ID NO: 583848 - protein, 9 aa, Homo Sapiens
DTSESMLWK

SEQ ID NO: 583849 - protein, 9 aa, Homo Sapiens
DNSSSLMLE

SEQ ID NO: 583850 - protein, 9 aa, Homo Sapiens
LLSAGDHRR

SEQ ID NO: 583851 - protein, 9 aa, Homo Sapiens
VEVKQFFQI

SEQ ID NO: 583852 - protein, 9 aa, Homo Sapiens
DPEPDTEKA

SEQ ID NO: 583853 - protein, 9 aa, Homo Sapiens
KTNSFHPSE

SEQ ID NO: 583854 - protein, 9 aa, Homo Sapiens
LSHLCANGS

SEQ ID NO: 583855 - protein, 9 aa, Homo Sapiens
VILVLVVVK

SEQ ID NO: 583856 - protein, 9 aa, Homo Sapiens
GAICSGIHS

SEQ ID NO: 583857 - protein, 9 aa, Homo Sapiens
PGATGTAFF

SEQ ID NO: 583858 - protein, 9 aa, Homo Sapiens
EVNEEGKFV

SEQ ID NO: 583859 - protein, 9 aa, Homo Sapiens
WQSVSQATN

SEQ ID NO: 583860 - protein, 9 aa, Homo Sapiens
MGYFVDQCE

SEQ ID NO: 583861 - protein, 9 aa, Homo Sapiens
VGHYTCRYR

SEQ ID NO: 583862 - protein, 9 aa, Homo Sapiens
EPTTLSWQS

SEQ ID NO: 583863 - protein, 9 aa, Homo Sapiens
CLMPTLLGA

SEQ ID NO: 583864 - protein, 9 aa, Homo Sapiens
LGTTCYTSG

SEQ ID NO: 583865 - protein, 9 aa, Homo Sapiens
AVDDTTLFT

SEQ ID NO: 583866 - protein, 9 aa, Homo Sapiens
VDQCEVGTN

SEQ ID NO: 583867 - protein, 9 aa, Homo Sapiens
SLRKQVEHV

SEQ ID NO: 583868 - protein, 9 aa, Homo Sapiens
WLGGRPRAT

SEQ ID NO: 583869 - protein, 9 aa, Homo Sapiens
KRKFESGGG

SEQ ID NO: 583870 - protein, 9 aa, Homo Sapiens
RKQVEHVTE

SEQ ID NO: 583871 - protein, 9 aa, Homo Sapiens
EGQDYCTLT

SEQ ID NO: 583872 - protein, 9 aa, Homo Sapiens
ISQNPERLS

SEQ ID NO: 583873 - protein, 9 aa, Homo Sapiens
ERQTILEAA

SEQ ID NO: 583874 - protein, 9 aa, Homo Sapiens
DACLSHLCA

SEQ ID NO: 583875 - protein, 9 aa, Homo Sapiens
SCCLTTCCR

SEQ ID NO: 583876 - protein, 9 aa, Homo Sapiens
TTIVVFRLF

SEQ ID NO: 583877 - protein, 9 aa, Homo Sapiens
IHSLPATRA

SEQ ID NO: 583878 - protein, 9 aa, Homo Sapiens
PGPLQERPL

SEQ ID NO: 583879 - protein, 9 aa, Homo Sapiens
KTVKKIAMR

SEQ ID NO: 583880 - protein, 9 aa, Homo Sapiens
SEAMCRDKE

SEQ ID NO: 583881 - protein, 9 aa, Homo Sapiens
SQPKKRKFE

SEQ ID NO: 583882 - protein, 9 aa, Homo Sapiens
KKRKFESGG

SEQ ID NO: 583883 - protein, 9 aa, Homo Sapiens
RNPLRYGLS

SEQ ID NO: 583884 - protein, 9 aa, Homo Sapiens
ARQAQGVAL

SEQ ID NO: 583885 - protein, 9 aa, Homo Sapiens
NPLRYGLST

SEQ ID NO: 583886 - protein, 9 aa, Homo Sapiens
ALVQKHKEG

SEQ ID NO: 583887 - protein, 9 aa, Homo Sapiens
FQDKELNVV

SEQ ID NO: 583888 - protein, 9 aa, Homo Sapiens
VCYDSSLKP

SEQ ID NO: 583889 - protein, 9 aa, Homo Sapiens
DNKQFPPIL

SEQ ID NO: 583890 - protein, 9 aa, Homo Sapiens
PISQNPERL

SEQ ID NO: 583891 - protein, 9 aa, Homo Sapiens
TPAVAAAEV

SEQ ID NO: 583892 - protein, 9 aa, Homo Sapiens
CESSCLMPT

SEQ ID NO: 583893 - protein, 9 aa, Homo Sapiens
SYVYILSTI

SEQ ID NO: 583894 - protein, 9 aa, Homo Sapiens
SKIVEVKQF

SEQ ID NO: 583895 - protein, 9 aa, Homo Sapiens
HSVELALPN

SEQ ID NO: 583896 - protein, 9 aa, Homo Sapiens
AICSGIHSL

SEQ ID NO: 583897 - protein, 9 aa, Homo Sapiens
TTLSWQSVS

SEQ ID NO: 583898 - protein, 9 aa, Homo Sapiens
PLFEKKRGA

SEQ ID NO: 583899 - protein, 9 aa, Homo Sapiens
AVTFVLVVL

SEQ ID NO: 583900 - protein, 9 aa, Homo Sapiens
LSLVQFYKA

SEQ ID NO: 583901 - protein, 9 aa, Homo Sapiens
FERESRHGK

SEQ ID NO: 583902 - protein, 9 aa, Homo Sapiens
RVQGARSED

SEQ ID NO: 583903 - protein, 9 aa, Homo Sapiens
FCESSCLMP

SEQ ID NO: 583904 - protein, 9 aa, Homo Sapiens
EVEDKLLAL

SEQ ID NO: 583905 - protein, 9 aa, Homo Sapiens
SEDAGEYLC

SEQ ID NO: 583906 - protein, 9 aa, Homo Sapiens
EELYKSRPG

SEQ ID NO: 583907 - protein, 9 aa, Homo Sapiens
LFYEYGVDL

SEQ ID NO: 583908 - protein, 9 aa, Homo Sapiens
GSKFGVQMD

SEQ ID NO: 583909 - protein, 9 aa, Homo Sapiens
ALGSPSEGL

SEQ ID NO: 583910 - protein, 9 aa, Homo Sapiens
TTVPHGKSQ

SEQ ID NO: 583911 - protein, 9 aa, Homo Sapiens
YIFERESRH

SEQ ID NO: 583912 - protein, 9 aa, Homo Sapiens
CCKLGSHGK

SEQ ID NO: 583913 - protein, 9 aa, Homo Sapiens
KPEVFFQCK

SEQ ID NO: 583914 - protein, 9 aa, Homo Sapiens
KIVEVKQFF

SEQ ID NO: 583915 - protein, 9 aa, Homo Sapiens
VYRNPLRYG

SEQ ID NO: 583916 - protein, 9 aa, Homo Sapiens
VEKNRHYYV

SEQ ID NO: 583917 - protein, 9 aa, Homo Sapiens
ALESLRKQV

SEQ ID NO: 583918 - protein, 9 aa, Homo Sapiens
ALESQPHSS

SEQ ID NO: 583919 - protein, 9 aa, Homo Sapiens
GLIGGAVTF

SEQ ID NO: 583920 - protein, 9 aa, Homo Sapiens
PANGRDNKQ

SEQ ID NO: 583921 - protein, 9 aa, Homo Sapiens
LGGRPRATD

SEQ ID NO: 583922 - protein, 9 aa, Homo Sapiens
TSSSLDPEP

SEQ ID NO: 583923 - protein, 9 aa, Homo Sapiens
ATAAVAAAS

SEQ ID NO: 583924 - protein, 9 aa, Homo Sapiens
KQFFQITCE

SEQ ID NO: 583925 - protein, 9 aa, Homo Sapiens
LNVVSGEAT

SEQ ID NO: 583926 - protein, 9 aa, Homo Sapiens
YVYILSTIL

SEQ ID NO: 583927 - protein, 9 aa, Homo Sapiens
ISASYVYIL

SEQ ID NO: 583928 - protein, 9 aa, Homo Sapiens
KQFVSQALV

SEQ ID NO: 583929 - protein, 9 aa, Homo Sapiens
CLELKCGKK

SEQ ID NO: 583930 - protein, 9 aa, Homo Sapiens
HGHIVELLL

SEQ ID NO: 583931 - protein, 9 aa, Homo Sapiens
NEYAYRHGI

SEQ ID NO: 583932 - protein, 9 aa, Homo Sapiens
LQQQFLEIF

SEQ ID NO: 583933 - protein, 9 aa, Homo Sapiens
ADAPTPAVA

SEQ ID NO: 583934 - protein, 9 aa, Homo Sapiens
AQHSVELAL

SEQ ID NO: 583935 - protein, 9 aa, Homo Sapiens
KFESGGGGE

SEQ ID NO: 583936 - protein, 9 aa, Homo Sapiens
RRPALGSPS

SEQ ID NO: 583937 - protein, 9 aa, Homo Sapiens
FWEENFCCK

SEQ ID NO: 583938 - protein, 9 aa, Homo Sapiens
AQGVALSSG

SEQ ID NO: 583939 - protein, 9 aa, Homo Sapiens
GTVEYMASE

SEQ ID NO: 583940 - protein, 9 aa, Homo Sapiens
ASTLCLHTL

SEQ ID NO: 583941 - protein, 9 aa, Homo Sapiens
TAVIYARRG

SEQ ID NO: 583942 - protein, 9 aa, Homo Sapiens
RCLELKCGK

SEQ ID NO: 583943 - protein, 9 aa, Homo Sapiens
VDDTTLFTS

SEQ ID NO: 583944 - protein, 9 aa, Homo Sapiens
NSESSTASS

SEQ ID NO: 583945 - protein, 9 aa, Homo Sapiens
HQWLHLGER

SEQ ID NO: 583946 - protein, 9 aa, Homo Sapiens
TDLVPNMEY

SEQ ID NO: 583947 - protein, 9 aa, Homo Sapiens
TDACLSHLC

SEQ ID NO: 583948 - protein, 9 aa, Homo Sapiens
GTTCYTSGW

SEQ ID NO: 583949 - protein, 9 aa, Homo Sapiens
LMPTLLGAI

SEQ ID NO: 583950 - protein, 9 aa, Homo Sapiens
LQEAVSEAL

SEQ ID NO: 583951 - protein, 9 aa, Homo Sapiens
TISASYVYI

SEQ ID NO: 583952 - protein, 9 aa, Homo Sapiens
VLRCLELKC

SEQ ID NO: 583953 - protein, 9 aa, Homo Sapiens
ALGTTCYTS

SEQ ID NO: 583954 - protein, 9 aa, Homo Sapiens
QGVALSSGT

SEQ ID NO: 583955 - protein, 9 aa, Homo Sapiens
SEACALESQ

SEQ ID NO: 583956 - protein, 9 aa, Homo Sapiens
EYGVDLQLW

SEQ ID NO: 583957 - protein, 9 aa, Homo Sapiens
LLLSAGDHR

SEQ ID NO: 583958 - protein, 9 aa, Homo Sapiens
DLFYEYGVD

SEQ ID NO: 583959 - protein, 9 aa, Homo Sapiens
AADAPTPAV

SEQ ID NO: 583960 - protein, 9 aa, Homo Sapiens
SGGSLLSPS

SEQ ID NO: 583961 - protein, 9 aa, Homo Sapiens
FCCKLGSHG

SEQ ID NO: 583962 - protein, 9 aa, Homo Sapiens
LSVQSFSRG

SEQ ID NO: 583963 - protein, 9 aa, Homo Sapiens
PVMGYFVDQ

SEQ ID NO: 583964 - protein, 9 aa, Homo Sapiens
IQIQNLSVC

SEQ ID NO: 583965 - protein, 9 aa, Homo Sapiens
ASYVYILST

SEQ ID NO: 583966 - protein, 9 aa, Homo Sapiens
VPNMEYAVT

SEQ ID NO: 583967 - protein, 9 aa, Homo Sapiens
EEVNEEGKF

SEQ ID NO: 583968 - protein, 9 aa, Homo Sapiens
LDPEPDTEK

SEQ ID NO: 583969 - protein, 9 aa, Homo Sapiens
VEHVTEPAP

SEQ ID NO: 583970 - protein, 9 aa, Homo Sapiens
TAAVAAASL

SEQ ID NO: 583971 - protein, 9 aa, Homo Sapiens
QHSVELALP

SEQ ID NO: 583972 - protein, 9 aa, Homo Sapiens
TNLVLGRLL

SEQ ID NO: 583973 - protein, 9 aa, Homo Sapiens
QGARSEDAG

SEQ ID NO: 583974 - protein, 9 aa, Homo Sapiens
MEYAVTVQA

SEQ ID NO: 583975 - protein, 9 aa, Homo Sapiens
ITISASYVY

SEQ ID NO: 583976 - protein, 9 aa, Homo Sapiens
RDWLGGRPR

SEQ ID NO: 583977 - protein, 9 aa, Homo Sapiens
DDDKTVKKI

SEQ ID NO: 583978 - protein, 9 aa, Homo Sapiens
RVIGPEPTG

SEQ ID NO: 583979 - protein, 9 aa, Homo Sapiens
YKSRPGDDY

SEQ ID NO: 583980 - protein, 9 aa, Homo Sapiens
QALVQKHKE

SEQ ID NO: 583981 - protein, 9 aa, Homo Sapiens
DCLQEAVSE

SEQ ID NO: 583982 - protein, 9 aa, Homo Sapiens
GHSYLRDNV

SEQ ID NO: 583983 - protein, 9 aa, Homo Sapiens
QNPERLSAD

SEQ ID NO: 583984 - protein, 9 aa, Homo Sapiens
VFVLRCLEL

SEQ ID NO: 583985 - protein, 9 aa, Homo Sapiens
ESRHGKRVQ

SEQ ID NO: 583986 - protein, 9 aa, Homo Sapiens
YTSGWGSIE

SEQ ID NO: 583987 - protein, 9 aa, Homo Sapiens
VLEETKEPA

SEQ ID NO: 583988 - protein, 9 aa, Homo Sapiens
GRDNKQFPP

SEQ ID NO: 583989 - protein, 9 aa, Homo Sapiens
EDSCAKIDE

SEQ ID NO: 583990 - protein, 9 aa, Homo Sapiens
IEKAAEDSC

SEQ ID NO: 583991 - protein, 9 aa, Homo Sapiens
DDTTLFTSN

SEQ ID NO: 583992 - protein, 9 aa, Homo Sapiens
LLPENDTSE

SEQ ID NO: 583993 - protein, 9 aa, Homo Sapiens
ALPNHHPFH

SEQ ID NO: 583994 - protein, 9 aa, Homo Sapiens
GTTIVVFRL

SEQ ID NO: 583995 - protein, 9 aa, Homo Sapiens
YYVNRQAQE

SEQ ID NO: 583996 - protein, 9 aa, Homo Sapiens
KKEASLQFF

SEQ ID NO: 583997 - protein, 9 aa, Homo Sapiens
EACALESQP

SEQ ID NO: 583998 - protein, 9 aa, Homo Sapiens
ANGRDNKQF

SEQ ID NO: 583999 - protein, 9 aa, Homo Sapiens
AERRPALGS

SEQ ID NO: 584000 - protein, 9 aa, Homo Sapiens
EETKEPAPD

SEQ ID NO: 584001 - protein, 9 aa, Homo Sapiens
SCCRPSCCL

SEQ ID NO: 584002 - protein, 9 aa, Homo Sapiens
TVTDTNLVL

SEQ ID NO: 584003 - protein, 9 aa, Homo Sapiens
NDTSESMLW

SEQ ID NO: 584004 - protein, 9 aa, Homo Sapiens
VELALPNHH

SEQ ID NO: 584005 - protein, 9 aa, Homo Sapiens
TRVLSLVQF

SEQ ID NO: 584006 - protein, 9 aa, Homo Sapiens
PSEAMCRDK

SEQ ID NO: 584007 - protein, 9 aa, Homo Sapiens
YRHGIAEAV

SEQ ID NO: 584008 - protein, 9 aa, Homo Sapiens
NGFMIFLVH

SEQ ID NO: 584009 - protein, 9 aa, Homo Sapiens
AVAAASLLA

SEQ ID NO: 584010 - protein, 9 aa, Homo Sapiens
SLEERQTIL

SEQ ID NO: 584011 - protein, 9 aa, Homo Sapiens
VAAASLLAN

SEQ ID NO: 584012 - protein, 9 aa, Homo Sapiens
SHIVKNHNE

SEQ ID NO: 584013 - protein, 9 aa, Homo Sapiens
LVQFYKAYH

SEQ ID NO: 584014 - protein, 9 aa, Homo Sapiens
WLVSHIVKN

SEQ ID NO: 584015 - protein, 9 aa, Homo Sapiens
VEEVNEEGK

SEQ ID NO: 584016 - protein, 9 aa, Homo Sapiens
LFTSNPAFS

SEQ ID NO: 584017 - protein, 9 aa, Homo Sapiens
PLLAERVPR

SEQ ID NO: 584018 - protein, 9 aa, Homo Sapiens
SAGDHRRML

SEQ ID NO: 584019 - protein, 9 aa, Homo Sapiens
SVSKKKKKP

SEQ ID NO: 584020 - protein, 9 aa, Homo Sapiens
SFHPSEAMC

SEQ ID NO: 584021 - protein, 9 aa, Homo Sapiens
ESLRKQVEH

SEQ ID NO: 584022 - protein, 9 aa, Homo Sapiens
SWQSVSQAT

SEQ ID NO: 584023 - protein, 9 aa, Homo Sapiens
AGLIGGAVT

SEQ ID NO: 584024 - protein, 9 aa, Homo Sapiens
CRPSCCLTT

SEQ ID NO: 584025 - protein, 9 aa, Homo Sapiens
ASPSLSVQS

SEQ ID NO: 584026 - protein, 9 aa, Homo Sapiens
ASLQFFVEP

SEQ ID NO: 584027 - protein, 9 aa, Homo Sapiens
ALGSTSLPH

SEQ ID NO: 584028 - protein, 9 aa, Homo Sapiens
VMGYFVDQC

SEQ ID NO: 584029 - protein, 9 aa, Homo Sapiens
YEYGVDLQL

SEQ ID NO: 584030 - protein, 9 aa, Homo Sapiens
VTFVLVVLL

SEQ ID NO: 584031 - protein, 9 aa, Homo Sapiens
NFCCKLGSH

SEQ ID NO: 584032 - protein, 9 aa, Homo Sapiens
TAFFPTRSA

SEQ ID NO: 584033 - protein, 9 aa, Homo Sapiens
ERLSADKFE

SEQ ID NO: 584034 - protein, 9 aa, Homo Sapiens
DNLDLTHVL

SEQ ID NO: 584035 - protein, 9 aa, Homo Sapiens
DTNLVLGRL

SEQ ID NO: 584036 - protein, 9 aa, Homo Sapiens
GVALSSGTK

SEQ ID NO: 584037 - protein, 9 aa, Homo Sapiens
RKFESGGGG

SEQ ID NO: 584038 - protein, 9 aa, Homo Sapiens
ILEAARQCG

SEQ ID NO: 584039 - protein, 9 aa, Homo Sapiens
KAAEDSCAK

SEQ ID NO: 584040 - protein, 9 aa, Homo Sapiens
AGEYIFERE

SEQ ID NO: 584041 - protein, 9 aa, Homo Sapiens
SRPGDDYED

SEQ ID NO: 584042 - protein, 9 aa, Homo Sapiens
CYDSSLKPV

SEQ ID NO: 584043 - protein, 9 aa, Homo Sapiens
PALGTTCYT

SEQ ID NO: 584044 - protein, 9 aa, Homo Sapiens
NSFHPSEAM

SEQ ID NO: 584045 - protein, 9 aa, Homo Sapiens
SLVQFYKAY

SEQ ID NO: 584046 - protein, 9 aa, Homo Sapiens
SVRGFGSKF

SEQ ID NO: 584047 - protein, 9 aa, Homo Sapiens
PANEYAYRH

SEQ ID NO: 584048 - protein, 9 aa, Homo Sapiens
STASSRAST

SEQ ID NO: 584049 - protein, 9 aa, Homo Sapiens
PEVFFQCKS

SEQ ID NO: 584050 - protein, 9 aa, Homo Sapiens
RDNKQFPPI

SEQ ID NO: 584051 - protein, 9 aa, Homo Sapiens
AHRVIGPEP

SEQ ID NO: 584052 - protein, 9 aa, Homo Sapiens
KQQDMRLVE

SEQ ID NO: 584053 - protein, 9 aa, Homo Sapiens
YILSTILKI

SEQ ID NO: 584054 - protein, 9 aa, Homo Sapiens
ENDTSESML

SEQ ID NO: 584055 - protein, 9 aa, Homo Sapiens
RHYYVNRQA

SEQ ID NO: 584056 - protein, 9 aa, Homo Sapiens
QWLHLGERA

SEQ ID NO: 584057 - protein, 9 aa, Homo Sapiens
FRLFGCFAT

SEQ ID NO: 584058 - protein, 9 aa, Homo Sapiens
PTTLSWQSV

SEQ ID NO: 584059 - protein, 9 aa, Homo Sapiens
RPFQTTVPH

SEQ ID NO: 584060 - protein, 9 aa, Homo Sapiens
NKQFPPILV

SEQ ID NO: 584061 - protein, 9 aa, Homo Sapiens
SFTYKPEVF

SEQ ID NO: 584062 - protein, 9 aa, Homo Sapiens
SESMLWKAT

SEQ ID NO: 584063 - protein, 9 aa, Homo Sapiens
GNGFMIFLV

SEQ ID NO: 584064 - protein, 9 aa, Homo Sapiens
GSTSLPHFR

SEQ ID NO: 584065 - protein, 9 aa, Homo Sapiens
ELYKSRPGD

SEQ ID NO: 584066 - protein, 9 aa, Homo Sapiens
EDAGEYLCD

SEQ ID NO: 584067 - protein, 9 aa, Homo Sapiens
DKYEWLVSH

SEQ ID NO: 584068 - protein, 9 aa, Homo Sapiens
RESRHGKRV

SEQ ID NO: 584069 - protein, 9 aa, Homo Sapiens
AFFPTRSAT

SEQ ID NO: 584070 - protein, 9 aa, Homo Sapiens
MRLVEELER

SEQ ID NO: 584071 - protein, 9 aa, Homo Sapiens
NISSGGSLL

SEQ ID NO: 584072 - protein, 9 aa, Homo Sapiens
LPFCESSCL

SEQ ID NO: 584073 - protein, 9 aa, Homo Sapiens
TSKIVEVKQ

SEQ ID NO: 584074 - protein, 9 aa, Homo Sapiens
NLSVCYDSS

SEQ ID NO: 584075 - protein, 9 aa, Homo Sapiens
LELKCGKKR

SEQ ID NO: 584076 - protein, 9 aa, Homo Sapiens
RVLSLVQFY

SEQ ID NO: 584077 - protein, 9 aa, Homo Sapiens
DLVPNMEYA

SEQ ID NO: 584078 - protein, 9 aa, Homo Sapiens
SNLLEHQWL

SEQ ID NO: 584079 - protein, 9 aa, Homo Sapiens
ILVLVVVKC

SEQ ID NO: 584080 - protein, 9 aa, Homo Sapiens
LLQQQFLEI

SEQ ID NO: 584081 - protein, 9 aa, Homo Sapiens
LTTCCRTTC

SEQ ID NO: 584082 - protein, 9 aa, Homo Sapiens
RHGIAEAVG

SEQ ID NO: 584083 - protein, 9 aa, Homo Sapiens
EEVEDKLLA

SEQ ID NO: 584084 - protein, 9 aa, Homo Sapiens
CCRPSCCLT

SEQ ID NO: 584085 - protein, 9 aa, Homo Sapiens
QCEVGTNNW

SEQ ID NO: 584086 - protein, 9 aa, Homo Sapiens
LVHFDPNLH

SEQ ID NO: 584087 - protein, 9 aa, Homo Sapiens
SSTASSRAS

SEQ ID NO: 584088 - protein, 9 aa, Homo Sapiens
PNMEYAVTV

SEQ ID NO: 584089 - protein, 9 aa, Homo Sapiens
LRKQVEHVT

SEQ ID NO: 584090 - protein, 9 aa, Homo Sapiens
TIVVFRLFG

SEQ ID NO: 584091 - protein, 9 aa, Homo Sapiens
TPLMLSAHR

SEQ ID NO: 584092 - protein, 9 aa, Homo Sapiens
GPGPLQERP

SEQ ID NO: 584093 - protein, 9 aa, Homo Sapiens
SADKATAAV

SEQ ID NO: 584094 - protein, 9 aa, Homo Sapiens
FTYKPEVFF

SEQ ID NO: 584095 - protein, 9 aa, Homo Sapiens
FVSQALVQK

SEQ ID NO: 584096 - protein, 9 aa, Homo Sapiens
FFPTRSATS

SEQ ID NO: 584097 - protein, 9 aa, Homo Sapiens
GLLLSAGDH

SEQ ID NO: 584098 - protein, 9 aa, Homo Sapiens
SCAKIDEKT

SEQ ID NO: 584099 - protein, 9 aa, Homo Sapiens
ERESRHGKR

SEQ ID NO: 584100 - protein, 9 aa, Homo Sapiens
KFDNSSSLM

SEQ ID NO: 584101 - protein, 9 aa, Homo Sapiens
QGMTEEVED

SEQ ID NO: 584102 - protein, 9 aa, Homo Sapiens
TFVLVVLLS

SEQ ID NO: 584103 - protein, 9 aa, Homo Sapiens
LRCLELKCG

SEQ ID NO: 584104 - protein, 9 aa, Homo Sapiens
RRDWLGGRP

SEQ ID NO: 584105 - protein, 9 aa, Homo Sapiens
LPHFRRASV

SEQ ID NO: 584106 - protein, 9 aa, Homo Sapiens
SQVRPKHIT

SEQ ID NO: 584107 - protein, 9 aa, Homo Sapiens
DQDSQRGHS

SEQ ID NO: 584108 - protein, 9 aa, Homo Sapiens
GRRDWLGGR

SEQ ID NO: 584109 - protein, 9 aa, Homo Sapiens
PENDTSESM

SEQ ID NO: 584110 - protein, 9 aa, Homo Sapiens
VSKKKKKPG

SEQ ID NO: 584111 - protein, 9 aa, Homo Sapiens
MIFLVHFDP

SEQ ID NO: 584112 - protein, 9 aa, Homo Sapiens
VQFYKAYHF

SEQ ID NO: 584113 - protein, 9 aa, Homo Sapiens
QFFVEPSEA

SEQ ID NO: 584114 - protein, 9 aa, Homo Sapiens
LRYGLSTCL

SEQ ID NO: 584115 - protein, 9 aa, Homo Sapiens
SGKSFTYKP

SEQ ID NO: 584116 - protein, 9 aa, Homo Sapiens
PLMLSAHRV

SEQ ID NO: 584117 - protein, 9 aa, Homo Sapiens
THVLLRKFR

SEQ ID NO: 584118 - protein, 9 aa, Homo Sapiens
ATNSESSTA

SEQ ID NO: 584119 - protein, 9 aa, Homo Sapiens
RGHSYLRDN

SEQ ID NO: 584120 - protein, 9 aa, Homo Sapiens
PFQTTVPHG

SEQ ID NO: 584121 - protein, 9 aa, Homo Sapiens
IQNLSVCYD

SEQ ID NO: 584122 - protein, 9 aa, Homo Sapiens
TGTAFFPTR

SEQ ID NO: 584123 - protein, 9 aa, Homo Sapiens
LALPNHHPF

SEQ ID NO: 584124 - protein, 9 aa, Homo Sapiens
LGSPSEGLF

SEQ ID NO: 584125 - protein, 9 aa, Homo Sapiens
HGIAEAVGL

SEQ ID NO: 584126 - protein, 9 aa, Homo Sapiens
ESDDDKTVK

SEQ ID NO: 584127 - protein, 9 aa, Homo Sapiens
HTLVEHSGR

SEQ ID NO: 584128 - protein, 9 aa, Homo Sapiens
NGRDNKQFP

SEQ ID NO: 584129 - protein, 9 aa, Homo Sapiens
LQERPLFEK

SEQ ID NO: 584130 - protein, 9 aa, Homo Sapiens
LRVQGARSE

SEQ ID NO: 584131 - protein, 9 aa, Homo Sapiens
SAVDDTTLF

SEQ ID NO: 584132 - protein, 9 aa, Homo Sapiens
DARQAQGVA

SEQ ID NO: 584133 - protein, 9 aa, Homo Sapiens
TCYTSGWGS

SEQ ID NO: 584134 - protein, 9 aa, Homo Sapiens
SQNPERLSA

SEQ ID NO: 584135 - protein, 9 aa, Homo Sapiens
STLCLHTLV

SEQ ID NO: 584136 - protein, 9 aa, Homo Sapiens
LVPNMEYAV

SEQ ID NO: 584137 - protein, 9 aa, Homo Sapiens
GSTSSSLDP

SEQ ID NO: 584138 - protein, 9 aa, Homo Sapiens
SSGGSLLSP

SEQ ID NO: 584139 - protein, 9 aa, Homo Sapiens
SQALVQKHK

SEQ ID NO: 584140 - protein, 9 aa, Homo Sapiens
LLSPSAVSH

SEQ ID NO: 584141 - protein, 9 aa, Homo Sapiens
VHFDPNLHT

SEQ ID NO: 584142 - protein, 9 aa, Homo Sapiens
CALESQPHS

SEQ ID NO: 584143 - protein, 9 aa, Homo Sapiens
FVEPSEATN

SEQ ID NO: 584144 - protein, 9 aa, Homo Sapiens
LEETKEPAP

SEQ ID NO: 584145 - protein, 9 aa, Homo Sapiens
DKELNVVSG

SEQ ID NO: 584146 - protein, 9 aa, Homo Sapiens
GIHSLPATR

SEQ ID NO: 584147 - protein, 9 aa, Homo Sapiens
VLSLVQFYK

SEQ ID NO: 584148 - protein, 9 aa, Homo Sapiens
SESSTASSR

SEQ ID NO: 584149 - protein, 9 aa, Homo Sapiens
CLTTCCRTT

SEQ ID NO: 584150 - protein, 9 aa, Homo Sapiens
ERPLFEKKR

SEQ ID NO: 584151 - protein, 9 aa, Homo Sapiens
DQCEVGTNN

SEQ ID NO: 584152 - protein, 9 aa, Homo Sapiens
HPSEAMCRD

SEQ ID NO: 584153 - protein, 9 aa, Homo Sapiens
HRVIGPEPT

SEQ ID NO: 584154 - protein, 9 aa, Homo Sapiens
CYTSGWGSI

SEQ ID NO: 584155 - protein, 9 aa, Homo Sapiens
VVVKCVRRK

SEQ ID NO: 584156 - protein, 9 aa, Homo Sapiens
DYCTLTAFT

SEQ ID NO: 584157 - protein, 9 aa, Homo Sapiens
LKQFVSQAL

SEQ ID NO: 584158 - protein, 9 aa, Homo Sapiens
TNSESSTAS

SEQ ID NO: 584159 - protein, 9 aa, Homo Sapiens
GASPSLSVQ

SEQ ID NO: 584160 - protein, 9 aa, Homo Sapiens
LPENDTSES

SEQ ID NO: 584161 - protein, 9 aa, Homo Sapiens
FVDQCEVGT

SEQ ID NO: 584162 - protein, 9 aa, Homo Sapiens
YARRGSVLQ

SEQ ID NO: 584163 - protein, 9 aa, Homo Sapiens
TILEAARQC

SEQ ID NO: 584164 - protein, 9 aa, Homo Sapiens
KQVEHVTEP

SEQ ID NO: 584165 - protein, 9 aa, Homo Sapiens
VELLLQQQF

SEQ ID NO: 584166 - protein, 9 aa, Homo Sapiens
GFMIFLVHF

SEQ ID NO: 584167 - protein, 9 aa, Homo Sapiens
DDKTVKKIA

SEQ ID NO: 584168 - protein, 9 aa, Homo Sapiens
QHRRKFDNS

SEQ ID NO: 584169 - protein, 9 aa, Homo Sapiens
SKFGVQMDR

SEQ ID NO: 584170 - protein, 9 aa, Homo Sapiens
EPAPDPSAQ

SEQ ID NO: 584171 - protein, 9 aa, Homo Sapiens
LVSHIVKNH

SEQ ID NO: 584172 - protein, 9 aa, Homo Sapiens
YRNPLRYGL

SEQ ID NO: 584173 - protein, 9 aa, Homo Sapiens
RGSVLQSIE

SEQ ID NO: 584174 - protein, 9 aa, Homo Sapiens
GAVTFVLVV

SEQ ID NO: 584175 - protein, 9 aa, Homo Sapiens
TVEYMASEV

SEQ ID NO: 584176 - protein, 9 aa, Homo Sapiens
LSVCYDSSL

SEQ ID NO: 584177 - protein, 9 aa, Homo Sapiens
ATGTAFFPT

SEQ ID NO: 584178 - protein, 9 aa, Homo Sapiens
GSLLSPSAV

SEQ ID NO: 584179 - protein, 9 aa, Homo Sapiens
QSEACALES

SEQ ID NO: 584180 - protein, 9 aa, Homo Sapiens
HVEKNRHYY

SEQ ID NO: 584181 - protein, 9 aa, Homo Sapiens
EAERRPALG

SEQ ID NO: 584182 - protein, 9 aa, Homo Sapiens
FYEYGVDLQ

SEQ ID NO: 584183 - protein, 9 aa, Homo Sapiens
QDMRLVEEL

SEQ ID NO: 584184 - protein, 9 aa, Homo Sapiens
VEYMASEVV

SEQ ID NO: 584185 - protein, 9 aa, Homo Sapiens
SQRGHSYLR

SEQ ID NO: 584186 - protein, 9 aa, Homo Sapiens
ERRPALGSP

SEQ ID NO: 584187 - protein, 9 aa, Homo Sapiens
SNISSGGSL

SEQ ID NO: 584188 - protein, 9 aa, Homo Sapiens
ETKEPAPDP

SEQ ID NO: 584189 - protein, 9 aa, Homo Sapiens
GMTEEVEDK

SEQ ID NO: 584190 - protein, 9 aa, Homo Sapiens
YFVDQCEVG

SEQ ID NO: 584191 - protein, 9 aa, Homo Sapiens
LNQSEACAL

SEQ ID NO: 584192 - protein, 9 aa, Homo Sapiens
LSAHRVIGP

SEQ ID NO: 584193 - protein, 9 aa, Homo Sapiens
RPGDDYEDP

SEQ ID NO: 584194 - protein, 9 aa, Homo Sapiens
VLVVVKCVR

SEQ ID NO: 584195 - protein, 9 aa, Homo Sapiens
MAAPFELSC

SEQ ID NO: 584196 - protein, 9 aa, Homo Sapiens
AAEDSCAKI

SEQ ID NO: 584197 - protein, 9 aa, Homo Sapiens
TNSFHPSEA

SEQ ID NO: 584198 - protein, 9 aa, Homo Sapiens
QDYCTLTAF

SEQ ID NO: 584199 - protein, 9 aa, Homo Sapiens
SSSLMLEWK

SEQ ID NO: 584200 - protein, 9 aa, Homo Sapiens
GYFVDQCEV

SEQ ID NO: 584201 - protein, 9 aa, Homo Sapiens
KYEWLVSHI

SEQ ID NO: 584202 - protein, 9 aa, Homo Sapiens
KHITSLEVI

SEQ ID NO: 584203 - protein, 9 aa, Homo Sapiens
ALGDVGHYT

SEQ ID NO: 584204 - protein, 9 aa, Homo Sapiens
LIGGAVTFV

SEQ ID NO: 584205 - protein, 9 aa, Homo Sapiens
PLQERPLFE

SEQ ID NO: 584206 - protein, 9 aa, Homo Sapiens
NEEGKFVRL

SEQ ID NO: 584207 - protein, 9 aa, Homo Sapiens
TLFTSNPAF

SEQ ID NO: 584208 - protein, 9 aa, Homo Sapiens
ADKATAAVA

SEQ ID NO: 584209 - protein, 9 aa, Homo Sapiens
EAVSEALLM

SEQ ID NO: 584210 - protein, 9 aa, Homo Sapiens
VRPKHITSL

SEQ ID NO: 584211 - protein, 9 aa, Homo Sapiens
HSYLRDNVL

SEQ ID NO: 584212 - protein, 9 aa, Homo Sapiens
PSCCLTTCC

SEQ ID NO: 584213 - protein, 9 aa, Homo Sapiens
FLESDDDKT

SEQ ID NO: 584214 - protein, 9 aa, Homo Sapiens
VVSGEATAQ

SEQ ID NO: 584215 - protein, 9 aa, Homo Sapiens
TLSWQSVSQ

SEQ ID NO: 584216 - protein, 9 aa, Homo Sapiens
RLKQFVSQA

SEQ ID NO: 584217 - protein, 9 aa, Homo Sapiens
NSELPEDGR

SEQ ID NO: 584218 - protein, 9 aa, Homo Sapiens
PSRPFQTTV

SEQ ID NO: 584219 - protein, 9 aa, Homo Sapiens
FMIFLVHFD

SEQ ID NO: 584220 - protein, 9 aa, Homo Sapiens
SEPTTLSWQ

SEQ ID NO: 584221 - protein, 9 aa, Homo Sapiens
GDHRRMLTP

SEQ ID NO: 584222 - protein, 9 aa, Homo Sapiens
GDNLDLTHV

SEQ ID NO: 584223 - protein, 9 aa, Homo Sapiens
EASLQFFVE

SEQ ID NO: 584224 - protein, 9 aa, Homo Sapiens
ARRGSVLQS

SEQ ID NO: 584225 - protein, 9 aa, Homo Sapiens
EYMASEVVN

SEQ ID NO: 584226 - protein, 9 aa, Homo Sapiens
GEYIFERES

SEQ ID NO: 584227 - protein, 9 aa, Homo Sapiens
AWTEGLGWC

SEQ ID NO: 584228 - protein, 9 aa, Homo Sapiens
IALCVKIRS

SEQ ID NO: 584229 - protein, 9 aa, Homo Sapiens
KSDICDPNP

SEQ ID NO: 584230 - protein, 9 aa, Homo Sapiens
PPATDFKYA

SEQ ID NO: 584231 - protein, 9 aa, Homo Sapiens
DRNKLSIEE

SEQ ID NO: 584232 - protein, 9 aa, Homo Sapiens
LRGGAVERP

SEQ ID NO: 584233 - protein, 9 aa, Homo Sapiens
FLLAMAAFC

SEQ ID NO: 584234 - protein, 9 aa, Homo Sapiens
RFPKPELEV

SEQ ID NO: 584235 - protein, 9 aa, Homo Sapiens
DLTLREKRT

SEQ ID NO: 584236 - protein, 9 aa, Homo Sapiens
YDCQQCGNA

SEQ ID NO: 584237 - protein, 9 aa, Homo Sapiens
ESCLDLTLR

SEQ ID NO: 584238 - protein, 9 aa, Homo Sapiens
QCGNAFIRS

SEQ ID NO: 584239 - protein, 9 aa, Homo Sapiens
FQRPTVYYV

SEQ ID NO: 584240 - protein, 9 aa, Homo Sapiens
TVYYVMSGP

SEQ ID NO: 584241 - protein, 9 aa, Homo Sapiens
CVKIRSYEE

SEQ ID NO: 584242 - protein, 9 aa, Homo Sapiens
GYEFCHNRN

SEQ ID NO: 584243 - protein, 9 aa, Homo Sapiens
GPWGRCTRD

SEQ ID NO: 584244 - protein, 9 aa, Homo Sapiens
YWFLCAAVN

SEQ ID NO: 584245 - protein, 9 aa, Homo Sapiens
DLIDILYLG

SEQ ID NO: 584246 - protein, 9 aa, Homo Sapiens
GLICVKDSY

SEQ ID NO: 584247 - protein, 9 aa, Homo Sapiens
SHFPGTRTI

SEQ ID NO: 584248 - protein, 9 aa, Homo Sapiens
GLGWCNAGW

SEQ ID NO: 584249 - protein, 9 aa, Homo Sapiens
ALQNYLTED

SEQ ID NO: 584250 - protein, 9 aa, Homo Sapiens
DNTYQAAIG

SEQ ID NO: 584251 - protein, 9 aa, Homo Sapiens
FNPPATDFK

SEQ ID NO: 584252 - protein, 9 aa, Homo Sapiens
RAAKGFLLA

SEQ ID NO: 584253 - protein, 9 aa, Homo Sapiens
RLLVSSNSR

SEQ ID NO: 584254 - protein, 9 aa, Homo Sapiens
QQHSGGARS

SEQ ID NO: 584255 - protein, 9 aa, Homo Sapiens
AAIGIDFLS

SEQ ID NO: 584256 - protein, 9 aa, Homo Sapiens
NVRTVQSDD

SEQ ID NO: 584257 - protein, 9 aa, Homo Sapiens
SRTSGLFIH

SEQ ID NO: 584258 - protein, 9 aa, Homo Sapiens
VHHLGDREK

SEQ ID NO: 584259 - protein, 9 aa, Homo Sapiens
PPQRLIRVE

SEQ ID NO: 584260 - protein, 9 aa, Homo Sapiens
HSDRLLELN

SEQ ID NO: 584261 - protein, 9 aa, Homo Sapiens
FSEDEHLLR

SEQ ID NO: 584262 - protein, 9 aa, Homo Sapiens
DFQVCTEIL

SEQ ID NO: 584263 - protein, 9 aa, Homo Sapiens
ECGKSFSRT

SEQ ID NO: 584264 - protein, 9 aa, Homo Sapiens
NWTEECGNL

SEQ ID NO: 584265 - protein, 9 aa, Homo Sapiens
TEKNCSQIQ

SEQ ID NO: 584266 - protein, 9 aa, Homo Sapiens
EFSLSKEDR

SEQ ID NO: 584267 - protein, 9 aa, Homo Sapiens
LQESLTSHC

SEQ ID NO: 584268 - protein, 9 aa, Homo Sapiens
SEHVQVEEK

SEQ ID NO: 584269 - protein, 9 aa, Homo Sapiens
GKTYSGYWF

SEQ ID NO: 584270 - protein, 9 aa, Homo Sapiens
TEECGNLWW

SEQ ID NO: 584271 - protein, 9 aa, Homo Sapiens
LSIEERRKL

SEQ ID NO: 584272 - protein, 9 aa, Homo Sapiens
RHVIYIHTK

SEQ ID NO: 584273 - protein, 9 aa, Homo Sapiens
GLAPPQRLI

SEQ ID NO: 584274 - protein, 9 aa, Homo Sapiens
FSLSKEDRM

SEQ ID NO: 584275 - protein, 9 aa, Homo Sapiens
RKMQVLESS

SEQ ID NO: 584276 - protein, 9 aa, Homo Sapiens
FLLYEECLS

SEQ ID NO: 584277 - protein, 9 aa, Homo Sapiens
AESLAGSKA

SEQ ID NO: 584278 - protein, 9 aa, Homo Sapiens
TRDCGPGGV

SEQ ID NO: 584279 - protein, 9 aa, Homo Sapiens
ILYLGVSRE

SEQ ID NO: 584280 - protein, 9 aa, Homo Sapiens
RNVLTIFSA

SEQ ID NO: 584281 - protein, 9 aa, Homo Sapiens
HLTEAIFSE

SEQ ID NO: 584282 - protein, 9 aa, Homo Sapiens
MLPGNCQTQ

SEQ ID NO: 584283 - protein, 9 aa, Homo Sapiens
CLDLTLREK

SEQ ID NO: 584284 - protein, 9 aa, Homo Sapiens
TDITFRHTR

SEQ ID NO: 584285 - protein, 9 aa, Homo Sapiens
GFQRPTVYY

SEQ ID NO: 584286 - protein, 9 aa, Homo Sapiens
LAPPQRLIR

SEQ ID NO: 584287 - protein, 9 aa, Homo Sapiens
NDVLKVTFL

SEQ ID NO: 584288 - protein, 9 aa, Homo Sapiens
ARIIALCVK

SEQ ID NO: 584289 - protein, 9 aa, Homo Sapiens
LKYGRSLNC

SEQ ID NO: 584290 - protein, 9 aa, Homo Sapiens
KTTDEPREP

SEQ ID NO: 584291 - protein, 9 aa, Homo Sapiens
NESDFQVCT

SEQ ID NO: 584292 - protein, 9 aa, Homo Sapiens
ICFLRWAGN

SEQ ID NO: 584293 - protein, 9 aa, Homo Sapiens
SDGLAPPQR

SEQ ID NO: 584294 - protein, 9 aa, Homo Sapiens
CSQIQDLHK

SEQ ID NO: 584295 - protein, 9 aa, Homo Sapiens
WSWGEERRV

SEQ ID NO: 584296 - protein, 9 aa, Homo Sapiens
REKRTAILQ

SEQ ID NO: 584297 - protein, 9 aa, Homo Sapiens
IRADELQES

SEQ ID NO: 584298 - protein, 9 aa, Homo Sapiens
TVAGVQVSG

SEQ ID NO: 584299 - protein, 9 aa, Homo Sapiens
AHCNLRLLV

SEQ ID NO: 584300 - protein, 9 aa, Homo Sapiens
ARLGLGHSY

SEQ ID NO: 584301 - protein, 9 aa, Homo Sapiens
QKCVISEHV

SEQ ID NO: 584302 - protein, 9 aa, Homo Sapiens
EFCHNRNVL

SEQ ID NO: 584303 - protein, 9 aa, Homo Sapiens
WYLNVRTVQ

SEQ ID NO: 584304 - protein, 9 aa, Homo Sapiens
DENTFSNDV

SEQ ID NO: 584305 - protein, 9 aa, Homo Sapiens
YSGYWFLCA

SEQ ID NO: 584306 - protein, 9 aa, Homo Sapiens
KARAARTVL

SEQ ID NO: 584307 - protein, 9 aa, Homo Sapiens
DELQESLTS

SEQ ID NO: 584308 - protein, 9 aa, Homo Sapiens
QNWTEECGN

SEQ ID NO: 584309 - protein, 9 aa, Homo Sapiens
LRLLVSSNS

SEQ ID NO: 584310 - protein, 9 aa, Homo Sapiens
REKVRCVAS

SEQ ID NO: 584311 - protein, 9 aa, Homo Sapiens
DVLKVTFLI

SEQ ID NO: 584312 - protein, 9 aa, Homo Sapiens
TTDEPREPG

SEQ ID NO: 584313 - protein, 9 aa, Homo Sapiens
TEDLKAMDK

SEQ ID NO: 584314 - protein, 9 aa, Homo Sapiens
ESLTSHCVV

SEQ ID NO: 584315 - protein, 9 aa, Homo Sapiens
HKPSGSPSW

SEQ ID NO: 584316 - protein, 9 aa, Homo Sapiens
NPPATDFKY

SEQ ID NO: 584317 - protein, 9 aa, Homo Sapiens
WELPDKLHL

SEQ ID NO: 584318 - protein, 9 aa, Homo Sapiens
LLQQKVMAQ

SEQ ID NO: 584319 - protein, 9 aa, Homo Sapiens
RLIRVEGNL

SEQ ID NO: 584320 - protein, 9 aa, Homo Sapiens
IIALCVKIR

SEQ ID NO: 584321 - protein, 9 aa, Homo Sapiens
VCTEILNTY

SEQ ID NO: 584322 - protein, 9 aa, Homo Sapiens
LEARIIALC

SEQ ID NO: 584323 - protein, 9 aa, Homo Sapiens
KYGRSLNCL

SEQ ID NO: 584324 - protein, 9 aa, Homo Sapiens
MTRGSMVGQ

SEQ ID NO: 584325 - protein, 9 aa, Homo Sapiens
EDSQEYRYI

SEQ ID NO: 584326 - protein, 9 aa, Homo Sapiens
VISEHVQVE

SEQ ID NO: 584327 - protein, 9 aa, Homo Sapiens
RLGLGHSYS

SEQ ID NO: 584328 - protein, 9 aa, Homo Sapiens
DEPREPGKY

SEQ ID NO: 584329 - protein, 9 aa, Homo Sapiens
EKTTDEPRE

SEQ ID NO: 584330 - protein, 9 aa, Homo Sapiens
VQVEEKCGG

SEQ ID NO: 584331 - protein, 9 aa, Homo Sapiens
NCQTQDVEV

SEQ ID NO: 584332 - protein, 9 aa, Homo Sapiens
APPQRLIRV

SEQ ID NO: 584333 - protein, 9 aa, Homo Sapiens
AKGFLLAMA

SEQ ID NO: 584334 - protein, 9 aa, Homo Sapiens
LGNHCSLLQ

SEQ ID NO: 584335 - protein, 9 aa, Homo Sapiens
LQQKVMAQQ

SEQ ID NO: 584336 - protein, 9 aa, Homo Sapiens
FQVCTEILN

SEQ ID NO: 584337 - protein, 9 aa, Homo Sapiens
GYCPNMMRV

SEQ ID NO: 584338 - protein, 9 aa, Homo Sapiens
EGLGWCNAG

SEQ ID NO: 584339 - protein, 9 aa, Homo Sapiens
EELDLRRKM

SEQ ID NO: 584340 - protein, 9 aa, Homo Sapiens
GSMVGQFQE

SEQ ID NO: 584341 - protein, 9 aa, Homo Sapiens
KMQVLESSL

SEQ ID NO: 584342 - protein, 9 aa, Homo Sapiens
FLDAIHLTE

SEQ ID NO: 584343 - protein, 9 aa, Homo Sapiens
LFLDAIHLT

SEQ ID NO: 584344 - protein, 9 aa, Homo Sapiens
QEYRYICFL

SEQ ID NO: 584345 - protein, 9 aa, Homo Sapiens
YLGVSREVF

SEQ ID NO: 584346 - protein, 9 aa, Homo Sapiens
STDITFRHT

SEQ ID NO: 584347 - protein, 9 aa, Homo Sapiens
DMDLIDILY

SEQ ID NO: 584348 - protein, 9 aa, Homo Sapiens
PDVSWYLNV

SEQ ID NO: 584349 - protein, 9 aa, Homo Sapiens
IGLVHHLGD

SEQ ID NO: 584350 - protein, 9 aa, Homo Sapiens
SGYWFLCAA

SEQ ID NO: 584351 - protein, 9 aa, Homo Sapiens
DEHLLRGGA

SEQ ID NO: 584352 - protein, 9 aa, Homo Sapiens
KYGLICVKD

SEQ ID NO: 584353 - protein, 9 aa, Homo Sapiens
ITFRHTRKN

SEQ ID NO: 584354 - protein, 9 aa, Homo Sapiens
IPAEVFKQI

SEQ ID NO: 584355 - protein, 9 aa, Homo Sapiens
LSACKARLG

SEQ ID NO: 584356 - protein, 9 aa, Homo Sapiens
ICAGYCPNM

SEQ ID NO: 584357 - protein, 9 aa, Homo Sapiens
RCTRDCGPG

SEQ ID NO: 584358 - protein, 9 aa, Homo Sapiens
LNVRTVQSD

SEQ ID NO: 584359 - protein, 9 aa, Homo Sapiens
DFKYAQNNT

SEQ ID NO: 584360 - protein, 9 aa, Homo Sapiens
LTEDLKAMD

SEQ ID NO: 584361 - protein, 9 aa, Homo Sapiens
PSIVMLPGN

SEQ ID NO: 584362 - protein, 9 aa, Homo Sapiens
MDLIDILYL

SEQ ID NO: 584363 - protein, 9 aa, Homo Sapiens
PWVGNLISQ

SEQ ID NO: 584364 - protein, 9 aa, Homo Sapiens
GLVHHLGDR

SEQ ID NO: 584365 - protein, 9 aa, Homo Sapiens
EHVQVEEKC

SEQ ID NO: 584366 - protein, 9 aa, Homo Sapiens
TEILNTYLT

SEQ ID NO: 584367 - protein, 9 aa, Homo Sapiens
IEAPGWVRM

SEQ ID NO: 584368 - protein, 9 aa, Homo Sapiens
FLCAAVNRA

SEQ ID NO: 584369 - protein, 9 aa, Homo Sapiens
HVIYIHTKD

SEQ ID NO: 584370 - protein, 9 aa, Homo Sapiens
LVFLLYEEC

SEQ ID NO: 584371 - protein, 9 aa, Homo Sapiens
IVMLPGNCQ

SEQ ID NO: 584372 - protein, 9 aa, Homo Sapiens
TLREKRTAI

SEQ ID NO: 584373 - protein, 9 aa, Homo Sapiens
TRGSMVGQF

SEQ ID NO: 584374 - protein, 9 aa, Homo Sapiens
YGRSLNCLQ

SEQ ID NO: 584375 - protein, 9 aa, Homo Sapiens
KTYSGYWFL

SEQ ID NO: 584376 - protein, 9 aa, Homo Sapiens
SLSKEDRMP

SEQ ID NO: 584377 - protein, 9 aa, Homo Sapiens
LPDKLHLKA

SEQ ID NO: 584378 - protein, 9 aa, Homo Sapiens
ISEHVQVEE

SEQ ID NO: 584379 - protein, 9 aa, Homo Sapiens
YLTEDLKAM

SEQ ID NO: 584380 - protein, 9 aa, Homo Sapiens
WFLCAAVNR

SEQ ID NO: 584381 - protein, 9 aa, Homo Sapiens
TWELPDKLH

SEQ ID NO: 584382 - protein, 9 aa, Homo Sapiens
PSPWVGNLI

SEQ ID NO: 584383 - protein, 9 aa, Homo Sapiens
TEGKIPAEV

SEQ ID NO: 584384 - protein, 9 aa, Homo Sapiens
KDRNKLSIE

SEQ ID NO: 584385 - protein, 9 aa, Homo Sapiens
SACKARLGL

SEQ ID NO: 584386 - protein, 9 aa, Homo Sapiens
VSGVTHIWA

SEQ ID NO: 584387 - protein, 9 aa, Homo Sapiens
AAESLAGSK

SEQ ID NO: 584388 - protein, 9 aa, Homo Sapiens
QVCTEILNT

SEQ ID NO: 584389 - protein, 9 aa, Homo Sapiens
LNSLVFLLY

SEQ ID NO: 584390 - protein, 9 aa, Homo Sapiens
AQHKPSGSP

SEQ ID NO: 584391 - protein, 9 aa, Homo Sapiens
TEGLGWCNA

SEQ ID NO: 584392 - protein, 9 aa, Homo Sapiens
CSLLQQKVM

SEQ ID NO: 584393 - protein, 9 aa, Homo Sapiens
DLNSLVFLL

SEQ ID NO: 584394 - protein, 9 aa, Homo Sapiens
GNAFIRSSF

SEQ ID NO: 584395 - protein, 9 aa, Homo Sapiens
LCVKIRSYE

SEQ ID NO: 584396 - protein, 9 aa, Homo Sapiens
ESDFQVCTE

SEQ ID NO: 584397 - protein, 9 aa, Homo Sapiens
YGLICVKDS

SEQ ID NO: 584398 - protein, 9 aa, Homo Sapiens
SQIQDLHKK

SEQ ID NO: 584399 - protein, 9 aa, Homo Sapiens
TSQPSPWVG

SEQ ID NO: 584400 - protein, 9 aa, Homo Sapiens
TICAGYCPN

SEQ ID NO: 584401 - protein, 9 aa, Homo Sapiens
DLSACKARL

SEQ ID NO: 584402 - protein, 9 aa, Homo Sapiens
GGARSLAGP

SEQ ID NO: 584403 - protein, 9 aa, Homo Sapiens
DAIHLTEAI

SEQ ID NO: 584404 - protein, 9 aa, Homo Sapiens
MQVLESSLE

SEQ ID NO: 584405 - protein, 9 aa, Homo Sapiens
RLLELNVPY

SEQ ID NO: 584406 - protein, 9 aa, Homo Sapiens
TFSNDVLKV

SEQ ID NO: 584407 - protein, 9 aa, Homo Sapiens
AGREKVRCV

SEQ ID NO: 584408 - protein, 9 aa, Homo Sapiens
SIVMLPGNC

SEQ ID NO: 584409 - protein, 9 aa, Homo Sapiens
SFSRTSGLF

SEQ ID NO: 584410 - protein, 9 aa, Homo Sapiens
GNHCSLLQQ

SEQ ID NO: 584411 - protein, 9 aa, Homo Sapiens
QRPTVYYVM

SEQ ID NO: 584412 - protein, 9 aa, Homo Sapiens
GSKARAART

SEQ ID NO: 584413 - protein, 9 aa, Homo Sapiens
NTYQAAIGI

SEQ ID NO: 584414 - protein, 9 aa, Homo Sapiens
AGPWGRCTR

SEQ ID NO: 584415 - protein, 9 aa, Homo Sapiens
PIEAPGWVR

SEQ ID NO: 584416 - protein, 9 aa, Homo Sapiens
LTFSLRPLG

SEQ ID NO: 584417 - protein, 9 aa, Homo Sapiens
LGCGICNKR

SEQ ID NO: 584418 - protein, 9 aa, Homo Sapiens
CLGNHCSLL

SEQ ID NO: 584419 - protein, 9 aa, Homo Sapiens
VYYVMSGPA

SEQ ID NO: 584420 - protein, 9 aa, Homo Sapiens
NAFIRSSFL

SEQ ID NO: 584421 - protein, 9 aa, Homo Sapiens
IEERRKLFE

SEQ ID NO: 584422 - protein, 9 aa, Homo Sapiens
HKATSKSSE

SEQ ID NO: 584423 - protein, 9 aa, Homo Sapiens
QHKPSGSPS

SEQ ID NO: 584424 - protein, 9 aa, Homo Sapiens
MLTFSLRPL

SEQ ID NO: 584425 - protein, 9 aa, Homo Sapiens
LIDILYLGV

SEQ ID NO: 584426 - protein, 9 aa, Homo Sapiens
SDYICHSHF

SEQ ID NO: 584427 - protein, 9 aa, Homo Sapiens
GWCNAGWLL

SEQ ID NO: 584428 - protein, 9 aa, Homo Sapiens
SCLDLTLRE

SEQ ID NO: 584429 - protein, 9 aa, Homo Sapiens
LQNWTEECG

SEQ ID NO: 584430 - protein, 9 aa, Homo Sapiens
NTFSNDVLK

SEQ ID NO: 584431 - protein, 9 aa, Homo Sapiens
ELPDKLHLK

SEQ ID NO: 584432 - protein, 9 aa, Homo Sapiens
ERRVSQGTT

SEQ ID NO: 584433 - protein, 9 aa, Homo Sapiens
TFRHTRKNS

SEQ ID NO: 584434 - protein, 9 aa, Homo Sapiens
GFLLAMAAF

SEQ ID NO: 584435 - protein, 9 aa, Homo Sapiens
LTEKNCSQI

SEQ ID NO: 584436 - protein, 9 aa, Homo Sapiens
ELDLRRKMQ

SEQ ID NO: 584437 - protein, 9 aa, Homo Sapiens
QFQEAAFAL

SEQ ID NO: 584438 - protein, 9 aa, Homo Sapiens
QVDAHKATS

SEQ ID NO: 584439 - protein, 9 aa, Homo Sapiens
GSPSWRRQG

SEQ ID NO: 584440 - protein, 9 aa, Homo Sapiens
CKARLGLGH

SEQ ID NO: 584441 - protein, 9 aa, Homo Sapiens
SLVFLLYEE

SEQ ID NO: 584442 - protein, 9 aa, Homo Sapiens
CLKYGRSLN

SEQ ID NO: 584443 - protein, 9 aa, Homo Sapiens
NSLVFLLYE

SEQ ID NO: 584444 - protein, 9 aa, Homo Sapiens
YQAWTEGLG

SEQ ID NO: 584445 - protein, 9 aa, Homo Sapiens
KIALFGAGS

SEQ ID NO: 584446 - protein, 9 aa, Homo Sapiens
VGQFQEAAF

SEQ ID NO: 584447 - protein, 9 aa, Homo Sapiens
LEVQFTPLQ

SEQ ID NO: 584448 - protein, 9 aa, Homo Sapiens
PYDCQQCGN

SEQ ID NO: 584449 - protein, 9 aa, Homo Sapiens
IHLTEAIFS

SEQ ID NO: 584450 - protein, 9 aa, Homo Sapiens
KNILVVDLG

SEQ ID NO: 584451 - protein, 9 aa, Homo Sapiens
FGKSDICDP

SEQ ID NO: 584452 - protein, 9 aa, Homo Sapiens
QRLIRVEGN

SEQ ID NO: 584453 - protein, 9 aa, Homo Sapiens
DYICHSHFP

SEQ ID NO: 584454 - protein, 9 aa, Homo Sapiens
SIEERRKLF

SEQ ID NO: 584455 - protein, 9 aa, Homo Sapiens
VSWYLNVRT

SEQ ID NO: 584456 - protein, 9 aa, Homo Sapiens
PKPELEVQF

SEQ ID NO: 584457 - protein, 9 aa, Homo Sapiens
KCVISEHVQ

SEQ ID NO: 584458 - protein, 9 aa, Homo Sapiens
VRTVQSDDL

SEQ ID NO: 584459 - protein, 9 aa, Homo Sapiens
CNLRLLVSS

SEQ ID NO: 584460 - protein, 9 aa, Homo Sapiens
SPSWRRQGH

SEQ ID NO: 584461 - protein, 9 aa, Homo Sapiens
RPTVYYVMS

SEQ ID NO: 584462 - protein, 9 aa, Homo Sapiens
KSFSRTSGL

SEQ ID NO: 584463 - protein, 9 aa, Homo Sapiens
GRSLNCLQR

SEQ ID NO: 584464 - protein, 9 aa, Homo Sapiens
PAETGGRQD

SEQ ID NO: 584465 - protein, 9 aa, Homo Sapiens
TDFKYAQNN

SEQ ID NO: 584466 - protein, 9 aa, Homo Sapiens
HCSLLQQKV

SEQ ID NO: 584467 - protein, 9 aa, Homo Sapiens
WVGNLISQI

SEQ ID NO: 584468 - protein, 9 aa, Homo Sapiens
ARSLAGPSG

SEQ ID NO: 584469 - protein, 9 aa, Homo Sapiens
NRNVLTIFS

SEQ ID NO: 584470 - protein, 9 aa, Homo Sapiens
QPSPWVGNL

SEQ ID NO: 584471 - protein, 9 aa, Homo Sapiens
SLTSHCVVT

SEQ ID NO: 584472 - protein, 9 aa, Homo Sapiens
ADELQESLT

SEQ ID NO: 584473 - protein, 9 aa, Homo Sapiens
PQRLIRVEG

SEQ ID NO: 584474 - protein, 9 aa, Homo Sapiens
DKLHLKAGV

SEQ ID NO: 584475 - protein, 9 aa, Homo Sapiens
KIPAEVFKQ

SEQ ID NO: 584476 - protein, 9 aa, Homo Sapiens
GYWFLCAAV

SEQ ID NO: 584477 - protein, 9 aa, Homo Sapiens
AGSASISCA

SEQ ID NO: 584478 - protein, 9 aa, Homo Sapiens
RRVSQGTTF

SEQ ID NO: 584479 - protein, 9 aa, Homo Sapiens
WEPPAETGG

SEQ ID NO: 584480 - protein, 9 aa, Homo Sapiens
LREKRTAIL

SEQ ID NO: 584481 - protein, 9 aa, Homo Sapiens
RPLGCGICN

SEQ ID NO: 584482 - protein, 9 aa, Homo Sapiens
VQVSGVTHI

SEQ ID NO: 584483 - protein, 9 aa, Homo Sapiens
KEDRMPVPE

SEQ ID NO: 584484 - protein, 9 aa, Homo Sapiens
KGFLLAMAA

SEQ ID NO: 584485 - protein, 9 aa, Homo Sapiens
NMMRVLQAV

SEQ ID NO: 584486 - protein, 9 aa, Homo Sapiens
LLRGGAVER

SEQ ID NO: 584487 - protein, 9 aa, Homo Sapiens
SNDVLKVTF

SEQ ID NO: 584488 - protein, 9 aa, Homo Sapiens
CTRDCGPGG

SEQ ID NO: 584489 - protein, 9 aa, Homo Sapiens
KPKVTKYGL

SEQ ID NO: 584490 - protein, 9 aa, Homo Sapiens
PAEVFKQIS

SEQ ID NO: 584491 - protein, 9 aa, Homo Sapiens
EERRVSQGT

SEQ ID NO: 584492 - protein, 9 aa, Homo Sapiens
TYSGYWFLC

SEQ ID NO: 584493 - protein, 9 aa, Homo Sapiens
LVHHLGDRE

SEQ ID NO: 584494 - protein, 9 aa, Homo Sapiens
DVSWYLNVR

SEQ ID NO: 584495 - protein, 9 aa, Homo Sapiens
TSKSSETLA

SEQ ID NO: 584496 - protein, 9 aa, Homo Sapiens
LDLTLREKR

SEQ ID NO: 584497 - protein, 9 aa, Homo Sapiens
CMCLPIEAP

SEQ ID NO: 584498 - protein, 9 aa, Homo Sapiens
RADELQESL

SEQ ID NO: 584499 - protein, 9 aa, Homo Sapiens
HLLRGGAVE

SEQ ID NO: 584500 - protein, 9 aa, Homo Sapiens
GEKNILVVD

SEQ ID NO: 584501 - protein, 9 aa, Homo Sapiens
SDICDPNPC

SEQ ID NO: 584502 - protein, 9 aa, Homo Sapiens
LGVPQFGKS

SEQ ID NO: 584503 - protein, 9 aa, Homo Sapiens
IKDRNKLSI

SEQ ID NO: 584504 - protein, 9 aa, Homo Sapiens
ATSKSSETL

SEQ ID NO: 584505 - protein, 9 aa, Homo Sapiens
KLHLKAGVQ

SEQ ID NO: 584506 - protein, 9 aa, Homo Sapiens
PNMMRVLQA

SEQ ID NO: 584507 - protein, 9 aa, Homo Sapiens
LLAMAAFCF

SEQ ID NO: 584508 - protein, 9 aa, Homo Sapiens
FNGFQRPTV

SEQ ID NO: 584509 - protein, 9 aa, Homo Sapiens
QAWTEGLGW

SEQ ID NO: 584510 - protein, 9 aa, Homo Sapiens
GVPQFGKSD

SEQ ID NO: 584511 - protein, 9 aa, Homo Sapiens
QESLTSHCV

SEQ ID NO: 584512 - protein, 9 aa, Homo Sapiens
AGSKARAAR

SEQ ID NO: 584513 - protein, 9 aa, Homo Sapiens
LCGLPFGIY

SEQ ID NO: 584514 - protein, 9 aa, Homo Sapiens
PATDFKYAQ

SEQ ID NO: 584515 - protein, 9 aa, Homo Sapiens
LGWCNAGWL

SEQ ID NO: 584516 - protein, 9 aa, Homo Sapiens
PPAETGGRQ

SEQ ID NO: 584517 - protein, 9 aa, Homo Sapiens
GREKVRCVA

SEQ ID NO: 584518 - protein, 9 aa, Homo Sapiens
KVTKYGLIC

SEQ ID NO: 584519 - protein, 9 aa, Homo Sapiens
VLLFLLCGL

SEQ ID NO: 584520 - protein, 9 aa, Homo Sapiens
SGGARSLAG

SEQ ID NO: 584521 - protein, 9 aa, Homo Sapiens
AIGIDFLSK

SEQ ID NO: 584522 - protein, 9 aa, Homo Sapiens
CFFAGREKV

SEQ ID NO: 584523 - protein, 9 aa, Homo Sapiens
ICHSHFPGT

SEQ ID NO: 584524 - protein, 9 aa, Homo Sapiens
ITWELPDKL

SEQ ID NO: 584525 - protein, 9 aa, Homo Sapiens
GAGSASISC

SEQ ID NO: 584526 - protein, 9 aa, Homo Sapiens
HTRKNSVPV

SEQ ID NO: 584527 - protein, 9 aa, Homo Sapiens
YLNVRTVQS

SEQ ID NO: 584528 - protein, 9 aa, Homo Sapiens
SLNCLQRHL

SEQ ID NO: 584529 - protein, 9 aa, Homo Sapiens
VSSNSRASA

SEQ ID NO: 584530 - protein, 9 aa, Homo Sapiens
RIIALCVKI

SEQ ID NO: 584531 - protein, 9 aa, Homo Sapiens
PRAAKGFLL

SEQ ID NO: 584532 - protein, 9 aa, Homo Sapiens
SFDNTYQAA

SEQ ID NO: 584533 - protein, 9 aa, Homo Sapiens
SEDEHLLRG

SEQ ID NO: 584534 - protein, 9 aa, Homo Sapiens
NLRLLVSSN

SEQ ID NO: 584535 - protein, 9 aa, Homo Sapiens
DLRRKMQVL

SEQ ID NO: 584536 - protein, 9 aa, Homo Sapiens
CPNMMRVLQ

SEQ ID NO: 584537 - protein, 9 aa, Homo Sapiens
QVSGVTHIW

SEQ ID NO: 584538 - protein, 9 aa, Homo Sapiens
DAHKATSKS

SEQ ID NO: 584539 - protein, 9 aa, Homo Sapiens
MVGQFQEAA

SEQ ID NO: 584540 - protein, 9 aa, Homo Sapiens
REPGKYPCG

SEQ ID NO: 584541 - protein, 9 aa, Homo Sapiens
SLRWEPPAE

SEQ ID NO: 584542 - protein, 9 aa, Homo Sapiens
SLLQQKVMA

SEQ ID NO: 584543 - protein, 9 aa, Homo Sapiens
APGWVRMLA

SEQ ID NO: 584544 - protein, 9 aa, Homo Sapiens
SDLNSLVFL

SEQ ID NO: 584545 - protein, 9 aa, Homo Sapiens
GNLWWDAFT

SEQ ID NO: 584546 - protein, 9 aa, Homo Sapiens
PQFGKSDIC

SEQ ID NO: 584547 - protein, 9 aa, Homo Sapiens
DILYLGVSR

SEQ ID NO: 584548 - protein, 9 aa, Homo Sapiens
DITFRHTRK

SEQ ID NO: 584549 - protein, 9 aa, Homo Sapiens
SDFQVCTEI

SEQ ID NO: 584550 - protein, 9 aa, Homo Sapiens
ETGGRQDVR

SEQ ID NO: 584551 - protein, 9 aa, Homo Sapiens
EPREPGKYP

SEQ ID NO: 584552 - protein, 9 aa, Homo Sapiens
NCSQIQDLH

SEQ ID NO: 584553 - protein, 9 aa, Homo Sapiens
KYAQNNTWT

SEQ ID NO: 584554 - protein, 9 aa, Homo Sapiens
FFAGREKVR

SEQ ID NO: 584555 - protein, 9 aa, Homo Sapiens
LTVLLFLLC

SEQ ID NO: 584556 - protein, 9 aa, Homo Sapiens
PTVYYVMSG

SEQ ID NO: 584557 - protein, 9 aa, Homo Sapiens
NCLQRHLTK

SEQ ID NO: 584558 - protein, 9 aa, Homo Sapiens
FSRTSGLFI

SEQ ID NO: 584559 - protein, 9 aa, Homo Sapiens
EDEHLLRGG

SEQ ID NO: 584560 - protein, 9 aa, Homo Sapiens
TSGLFIHQK

SEQ ID NO: 584561 - protein, 9 aa, Homo Sapiens
ENTFSNDVL

SEQ ID NO: 584562 - protein, 9 aa, Homo Sapiens
GAQHKPSGS

SEQ ID NO: 584563 - protein, 9 aa, Homo Sapiens
VIGLVHHLG

SEQ ID NO: 584564 - protein, 9 aa, Homo Sapiens
NKLSIEERR

SEQ ID NO: 584565 - protein, 9 aa, Homo Sapiens
LRRKMQVLE

SEQ ID NO: 584566 - protein, 9 aa, Homo Sapiens
RGSMVGQFQ

SEQ ID NO: 584567 - protein, 9 aa, Homo Sapiens
LQNYLTEDL

SEQ ID NO: 584568 - protein, 9 aa, Homo Sapiens
KLSIEERRK

SEQ ID NO: 584569 - protein, 9 aa, Homo Sapiens
HSDYICHSH

SEQ ID NO: 584570 - protein, 9 aa, Homo Sapiens
VFLLYEECL

SEQ ID NO: 584571 - protein, 9 aa, Homo Sapiens
LAGSKARAA

SEQ ID NO: 584572 - protein, 9 aa, Homo Sapiens
KVRCVASEY

SEQ ID NO: 584573 - protein, 9 aa, Homo Sapiens
QIQDLHKKI

SEQ ID NO: 584574 - protein, 9 aa, Homo Sapiens
QHSGGARSL

SEQ ID NO: 584575 - protein, 9 aa, Homo Sapiens
CAGYCPNMM

SEQ ID NO: 584576 - protein, 9 aa, Homo Sapiens
FSNDVLKVT

SEQ ID NO: 584577 - protein, 9 aa, Homo Sapiens
LHLKAGVQA

SEQ ID NO: 584578 - protein, 9 aa, Homo Sapiens
LLFLLCGLP

SEQ ID NO: 584579 - protein, 9 aa, Homo Sapiens
WTEECGNLW

SEQ ID NO: 584580 - protein, 9 aa, Homo Sapiens
SDRLLELNV

SEQ ID NO: 584581 - protein, 9 aa, Homo Sapiens
WGEERRVSQ

SEQ ID NO: 584582 - protein, 9 aa, Homo Sapiens
PKVTKYGLI

SEQ ID NO: 584583 - protein, 9 aa, Homo Sapiens
EYRYICFLR

SEQ ID NO: 584584 - protein, 9 aa, Homo Sapiens
MCLPIEAPG

SEQ ID NO: 584585 - protein, 9 aa, Homo Sapiens
NGFQRPTVY

SEQ ID NO: 584586 - protein, 9 aa, Homo Sapiens
CHNRNVLTI

SEQ ID NO: 584587 - protein, 9 aa, Homo Sapiens
PDKLHLKAG

SEQ ID NO: 584588 - protein, 9 aa, Homo Sapiens
ELQESLTSH

SEQ ID NO: 584589 - protein, 9 aa, Homo Sapiens
SKARAARTV

SEQ ID NO: 584590 - protein, 9 aa, Homo Sapiens
AKPKVTKYG

SEQ ID NO: 584591 - protein, 9 aa, Homo Sapiens
ATDFKYAQN

SEQ ID NO: 584592 - protein, 9 aa, Homo Sapiens
QQQHSGGAR

SEQ ID NO: 584593 - protein, 9 aa, Homo Sapiens
VVDLGGGTF

SEQ ID NO: 584594 - protein, 9 aa, Homo Sapiens
ECGNLWWDA

SEQ ID NO: 584595 - protein, 9 aa, Homo Sapiens
DRMPVPELY

SEQ ID NO: 584596 - protein, 9 aa, Homo Sapiens
VQFTPLQPN

SEQ ID NO: 584597 - protein, 9 aa, Homo Sapiens
VMLPGNCQT

SEQ ID NO: 584598 - protein, 9 aa, Homo Sapiens
GKSFSRTSG

SEQ ID NO: 584599 - protein, 9 aa, Homo Sapiens
TFSLRPLGC

SEQ ID NO: 584600 - protein, 9 aa, Homo Sapiens
IALFGAGSA

SEQ ID NO: 584601 - protein, 9 aa, Homo Sapiens
HNRNVLTIF

SEQ ID NO: 584602 - protein, 9 aa, Homo Sapiens
TVLLFLLCG

SEQ ID NO: 584603 - protein, 9 aa, Homo Sapiens
AGYCPNMMR

SEQ ID NO: 584604 - protein, 9 aa, Homo Sapiens
PSTDITFRH

SEQ ID NO: 584605 - protein, 9 aa, Homo Sapiens
RRKMQVLES

SEQ ID NO: 584606 - protein, 9 aa, Homo Sapiens
SQEYRYICF

SEQ ID NO: 584607 - protein, 9 aa, Homo Sapiens
SFSEDEHLL

SEQ ID NO: 584608 - protein, 9 aa, Homo Sapiens
SASISCASF

SEQ ID NO: 584609 - protein, 9 aa, Homo Sapiens
GEERRVSQG

SEQ ID NO: 584610 - protein, 9 aa, Homo Sapiens
SGFKRHVIY

SEQ ID NO: 584611 - protein, 9 aa, Homo Sapiens
LNCLQRHLT

SEQ ID NO: 584612 - protein, 9 aa, Homo Sapiens
LFGAGSASI

SEQ ID NO: 584613 - protein, 9 aa, Homo Sapiens
GFKRHVIYI

SEQ ID NO: 584614 - protein, 9 aa, Homo Sapiens
HCNLRLLVS

SEQ ID NO: 584615 - protein, 9 aa, Homo Sapiens
SLRPLGCGI

SEQ ID NO: 584616 - protein, 9 aa, Homo Sapiens
AAKGFLLAM

SEQ ID NO: 584617 - protein, 9 aa, Homo Sapiens
QNYLTEDLK

SEQ ID NO: 584618 - protein, 9 aa, Homo Sapiens
FKRHVIYIH

SEQ ID NO: 584619 - protein, 9 aa, Homo Sapiens
CTEILNTYL

SEQ ID NO: 584620 - protein, 9 aa, Homo Sapiens
DGLAPPQRL

SEQ ID NO: 584621 - protein, 9 aa, Homo Sapiens
ALCVKIRSY

SEQ ID NO: 584622 - protein, 9 aa, Homo Sapiens
FGAGSASIS

SEQ ID NO: 584623 - protein, 9 aa, Homo Sapiens
KPSGSPSWR

SEQ ID NO: 584624 - protein, 9 aa, Homo Sapiens
CGNLWWDAF

SEQ ID NO: 584625 - protein, 9 aa, Homo Sapiens
KRHVIYIHT

SEQ ID NO: 584626 - protein, 9 aa, Homo Sapiens
PREPGKYPC

SEQ ID NO: 584627 - protein, 9 aa, Homo Sapiens
CVISEHVQV

SEQ ID NO: 584628 - protein, 9 aa, Homo Sapiens
CLPIEAPGW

SEQ ID NO: 584629 - protein, 9 aa, Homo Sapiens
ESLAGSKAR

SEQ ID NO: 584630 - protein, 9 aa, Homo Sapiens
REKTTDEPR

SEQ ID NO: 584631 - protein, 9 aa, Homo Sapiens
AHKATSKSS

SEQ ID NO: 584632 - protein, 9 aa, Homo Sapiens
RYICFLRWA

SEQ ID NO: 584633 - protein, 9 aa, Homo Sapiens
DPRAAKGFL

SEQ ID NO: 584634 - protein, 9 aa, Homo Sapiens
EGEKNILVV

SEQ ID NO: 584635 - protein, 9 aa, Homo Sapiens
YIHTKDYPH

SEQ ID NO: 584636 - protein, 9 aa, Homo Sapiens
LVVDLGGGT

SEQ ID NO: 584637 - protein, 9 aa, Homo Sapiens
KPELEVQFT

SEQ ID NO: 584638 - protein, 9 aa, Homo Sapiens
EKVRCVASE

SEQ ID NO: 584639 - protein, 9 aa, Homo Sapiens
SGSPSWRRQ

SEQ ID NO: 584640 - protein, 9 aa, Homo Sapiens
WTEGLGWCN

SEQ ID NO: 584641 - protein, 9 aa, Homo Sapiens
PSGVIGLVH

SEQ ID NO: 584642 - protein, 9 aa, Homo Sapiens
IDILYLGVS

SEQ ID NO: 584643 - protein, 9 aa, Homo Sapiens
AIHLTEAIF

SEQ ID NO: 584644 - protein, 9 aa, Homo Sapiens
EVQFTPLQP

SEQ ID NO: 584645 - protein, 9 aa, Homo Sapiens
EPPAETGGR

SEQ ID NO: 584646 - protein, 9 aa, Homo Sapiens
LTEAIFSED

SEQ ID NO: 584647 - protein, 9 aa, Homo Sapiens
HTVAGVQVS

SEQ ID NO: 584648 - protein, 9 aa, Homo Sapiens
RSLNCLQRH

SEQ ID NO: 584649 - protein, 9 aa, Homo Sapiens
ACKARLGLG

SEQ ID NO: 584650 - protein, 9 aa, Homo Sapiens
RWEPPAETG

SEQ ID NO: 584651 - protein, 9 aa, Homo Sapiens
SWSWGEERR

SEQ ID NO: 584652 - protein, 9 aa, Homo Sapiens
RHTRKNSVP

SEQ ID NO: 584653 - protein, 9 aa, Homo Sapiens
YICHSHFPG

SEQ ID NO: 584654 - protein, 9 aa, Homo Sapiens
EDRMPVPEL

SEQ ID NO: 584655 - protein, 9 aa, Homo Sapiens
KATSKSSET

SEQ ID NO: 584656 - protein, 9 aa, Homo Sapiens
FPKPELEVQ

SEQ ID NO: 584657 - protein, 9 aa, Homo Sapiens
YICFLRWAG

SEQ ID NO: 584658 - protein, 9 aa, Homo Sapiens
LDLRRKMQV

SEQ ID NO: 584659 - protein, 9 aa, Homo Sapiens
DLKAMDKMY

SEQ ID NO: 584660 - protein, 9 aa, Homo Sapiens
VDLGGGTFD

SEQ ID NO: 584661 - protein, 9 aa, Homo Sapiens
PGNCQTQDV

SEQ ID NO: 584662 - protein, 9 aa, Homo Sapiens
FRHTRKNSV

SEQ ID NO: 584663 - protein, 9 aa, Homo Sapiens
LTLREKRTA

SEQ ID NO: 584664 - protein, 9 aa, Homo Sapiens
PGWVRMLAV

SEQ ID NO: 584665 - protein, 9 aa, Homo Sapiens
CGNAFIRSS

SEQ ID NO: 584666 - protein, 9 aa, Homo Sapiens
SKEDRMPVP

SEQ ID NO: 584667 - protein, 9 aa, Homo Sapiens
TYQAAIGID

SEQ ID NO: 584668 - protein, 9 aa, Homo Sapiens
YEFCHNRNV

SEQ ID NO: 584669 - protein, 9 aa, Homo Sapiens
SMVGQFQEA

SEQ ID NO: 584670 - protein, 9 aa, Homo Sapiens
IQDLHKKII

SEQ ID NO: 584671 - protein, 9 aa, Homo Sapiens
EECGNLWWD

SEQ ID NO: 584672 - protein, 9 aa, Homo Sapiens
QQCGNAFIR

SEQ ID NO: 584673 - protein, 9 aa, Homo Sapiens
GVIGLVHHL

SEQ ID NO: 584674 - protein, 9 aa, Homo Sapiens
HSHFPGTRT

SEQ ID NO: 584675 - protein, 9 aa, Homo Sapiens
RNKLSIEER

SEQ ID NO: 584676 - protein, 9 aa, Homo Sapiens
LRPLGCGIC

SEQ ID NO: 584677 - protein, 9 aa, Homo Sapiens
EAPGWVRML

SEQ ID NO: 584678 - protein, 9 aa, Homo Sapiens
TDEPREPGK

SEQ ID NO: 584679 - protein, 9 aa, Homo Sapiens
LPIEAPGWV

SEQ ID NO: 584680 - protein, 9 aa, Homo Sapiens
LPGNCQTQD

SEQ ID NO: 584681 - protein, 9 aa, Homo Sapiens
IYIHTKDYP

SEQ ID NO: 584682 - protein, 9 aa, Homo Sapiens
LVSSNSRAS

SEQ ID NO: 584683 - protein, 9 aa, Homo Sapiens
ALFGAGSAS

SEQ ID NO: 584684 - protein, 9 aa, Homo Sapiens
GKSDICDPN

SEQ ID NO: 584685 - protein, 9 aa, Homo Sapiens
EHLLRGGAV

SEQ ID NO: 584686 - protein, 9 aa, Homo Sapiens
SKSSETLAL

SEQ ID NO: 584687 - protein, 9 aa, Homo Sapiens
CGKSFSRTS

SEQ ID NO: 584688 - protein, 9 aa, Homo Sapiens
EKNCSQIQD

SEQ ID NO: 584689 - protein, 9 aa, Homo Sapiens
GKIPAEVFK

SEQ ID NO: 584690 - protein, 9 aa, Homo Sapiens
SPWVGNLIS

SEQ ID NO: 584691 - protein, 9 aa, Homo Sapiens
LDAIHLTEA

SEQ ID NO: 584692 - protein, 9 aa, Homo Sapiens
QFGKSDICD

SEQ ID NO: 584693 - protein, 9 aa, Homo Sapiens
DSQEYRYIC

SEQ ID NO: 584694 - protein, 9 aa, Homo Sapiens
HCTSQPSPW

SEQ ID NO: 584695 - protein, 9 aa, Homo Sapiens
HHLGDREKR

SEQ ID NO: 584696 - protein, 9 aa, Homo Sapiens
PLGCGICNK

SEQ ID NO: 584697 - protein, 9 aa, Homo Sapiens
QAAIGIDFL

SEQ ID NO: 584698 - protein, 9 aa, Homo Sapiens
CTSQPSPWV

SEQ ID NO: 584699 - protein, 9 aa, Homo Sapiens
YRYICFLRW

SEQ ID NO: 584700 - protein, 9 aa, Homo Sapiens
RMPVPELYN

SEQ ID NO: 584701 - protein, 9 aa, Homo Sapiens
YQAAIGIDF

SEQ ID NO: 584702 - protein, 9 aa, Homo Sapiens
SWYLNVRTV

SEQ ID NO: 584703 - protein, 9 aa, Homo Sapiens
GARSLAGPS

SEQ ID NO: 584704 - protein, 9 aa, Homo Sapiens
KNCSQIQDL

SEQ ID NO: 584705 - protein, 9 aa, Homo Sapiens
SLAGSKARA

SEQ ID NO: 584706 - protein, 9 aa, Homo Sapiens
EDLKAMDKM

SEQ ID NO: 584707 - protein, 9 aa, Homo Sapiens
LFLLCGLPF

SEQ ID NO: 584708 - protein, 9 aa, Homo Sapiens
ISWSWGEER

SEQ ID NO: 584709 - protein, 9 aa, Homo Sapiens
LSKEDRMPV

SEQ ID NO: 584710 - protein, 9 aa, Homo Sapiens
NHSDYICHS

SEQ ID NO: 584711 - protein, 9 aa, Homo Sapiens
HVQVEEKCG

SEQ ID NO: 584712 - protein, 9 aa, Homo Sapiens
FAGREKVRC

SEQ ID NO: 584713 - protein, 9 aa, Homo Sapiens
SGVIGLVHH

SEQ ID NO: 584714 - protein, 9 aa, Homo Sapiens
GNCQTQDVE

SEQ ID NO: 584715 - protein, 9 aa, Homo Sapiens
EARIIALCV

SEQ ID NO: 584716 - protein, 9 aa, Homo Sapiens
LYLGVSREV

SEQ ID NO: 584717 - protein, 9 aa, Homo Sapiens
VDAHKATSK

SEQ ID NO: 584718 - protein, 9 aa, Homo Sapiens
LLVSSNSRA

SEQ ID NO: 584719 - protein, 9 aa, Homo Sapiens
SQPSPWVGN

SEQ ID NO: 584720 - protein, 9 aa, Homo Sapiens
RTSGLFIHQ

SEQ ID NO: 584721 - protein, 9 aa, Homo Sapiens
ELEVQFTPL

SEQ ID NO: 584722 - protein, 9 aa, Homo Sapiens
LLTVLLFLL

SEQ ID NO: 584723 - protein, 9 aa, Homo Sapiens
EGKIPAEVF

SEQ ID NO: 584724 - protein, 9 aa, Homo Sapiens
VRCVASEYF

SEQ ID NO: 584725 - protein, 9 aa, Homo Sapiens
YCPNMMRVL

SEQ ID NO: 584726 - protein, 9 aa, Homo Sapiens
SGVTHIWAV

SEQ ID NO: 584727 - protein, 9 aa, Homo Sapiens
ILVVDLGGG

SEQ ID NO: 584728 - protein, 9 aa, Homo Sapiens
NYLTEDLKA

SEQ ID NO: 584729 - protein, 9 aa, Homo Sapiens
VTKYGLICV

SEQ ID NO: 584730 - protein, 9 aa, Homo Sapiens
FDNTYQAAI

SEQ ID NO: 584731 - protein, 9 aa, Homo Sapiens
GRCTRDCGP

SEQ ID NO: 584732 - protein, 9 aa, Homo Sapiens
VIYIHTKDY

SEQ ID NO: 584733 - protein, 9 aa, Homo Sapiens
NVLTIFSAS

SEQ ID NO: 584734 - protein, 9 aa, Homo Sapiens
FSLRPLGCG

SEQ ID NO: 584735 - protein, 9 aa, Homo Sapiens
GQFQEAAFA

SEQ ID NO: 584736 - protein, 9 aa, Homo Sapiens
NHCSLLQQK

SEQ ID NO: 584737 - protein, 9 aa, Homo Sapiens
VPQFGKSDI

SEQ ID NO: 584738 - protein, 9 aa, Homo Sapiens
FKYAQNNTW

SEQ ID NO: 584739 - protein, 9 aa, Homo Sapiens
CQQCGNAFI

SEQ ID NO: 584740 - protein, 9 aa, Homo Sapiens
DCQQCGNAF

SEQ ID NO: 584741 - protein, 9 aa, Homo Sapiens
CHSHFPGTR

SEQ ID NO: 584742 - protein, 9 aa, Homo Sapiens
PSGSPSWRR

SEQ ID NO: 584743 - protein, 9 aa, Homo Sapiens
WGRCTRDCG

SEQ ID NO: 584744 - protein, 9 aa, Homo Sapiens
VLKVTFLIT

SEQ ID NO: 584745 - protein, 9 aa, Homo Sapiens
GSASISCAS

SEQ ID NO: 584746 - protein, 9 aa, Homo Sapiens
RDCGPGGVQ

SEQ ID NO: 584747 - protein, 9 aa, Homo Sapiens
PWGRCTRDC

SEQ ID NO: 584748 - protein, 9 aa, Homo Sapiens
DRLLELNVP

SEQ ID NO: 584749 - protein, 9 aa, Homo Sapiens
HSGGARSLA

SEQ ID NO: 584750 - protein, 9 aa, Homo Sapiens
EKNILVVDL

SEQ ID NO: 584751 - protein, 9 aa, Homo Sapiens
TKYGLICVK

SEQ ID NO: 584752 - protein, 9 aa, Homo Sapiens
RSLAGPSGG

SEQ ID NO: 584753 - protein, 9 aa, Homo Sapiens
QLFLDAIHL

SEQ ID NO: 584754 - protein, 9 aa, Homo Sapiens
NILVVDLGG

SEQ ID NO: 584755 - protein, 9 aa, Homo Sapiens
SWGEERRVS

SEQ ID NO: 584756 - protein, 9 aa, Homo Sapiens
FCHNRNVLT

SEQ ID NO: 584757 - protein, 9 aa, Homo Sapiens
KARLGLGHS

SEQ ID NO: 584758 - protein, 9 aa, Homo Sapiens
PELEVQFTP

SEQ ID NO: 584759 - protein, 9 aa, Homo Sapiens
AETGGRQDV

SEQ ID NO: 584760 - protein, 9 aa, Homo Sapiens
TDLSACKAR

SEQ ID NO: 584761 - protein, 9 aa, Homo Sapiens
LRWEPPAET

SEQ ID NO: 584762 - protein, 9 aa, Homo Sapiens
SSMIYHQQQ

SEQ ID NO: 584763 - protein, 9 aa, Homo Sapiens
ANNINCITE

SEQ ID NO: 584764 - protein, 9 aa, Homo Sapiens
SNSRGPCDS

SEQ ID NO: 584765 - protein, 9 aa, Homo Sapiens
GHRSFSGIK

SEQ ID NO: 584766 - protein, 9 aa, Homo Sapiens
VMSTDRYLA

SEQ ID NO: 584767 - protein, 9 aa, Homo Sapiens
YTEALAQKD

SEQ ID NO: 584768 - protein, 9 aa, Homo Sapiens
PIAILPVSV

SEQ ID NO: 584769 - protein, 9 aa, Homo Sapiens
RGRAMAIYK

SEQ ID NO: 584770 - protein, 9 aa, Homo Sapiens
LGPGDLRTF

SEQ ID NO: 584771 - protein, 9 aa, Homo Sapiens
TESGKTDEA

SEQ ID NO: 584772 - protein, 9 aa, Homo Sapiens
QNSSKHGAL

SEQ ID NO: 584773 - protein, 9 aa, Homo Sapiens
QVRAQNSSG

SEQ ID NO: 584774 - protein, 9 aa, Homo Sapiens
KSLLSVEDM

SEQ ID NO: 584775 - protein, 9 aa, Homo Sapiens
HPELPSAKA

SEQ ID NO: 584776 - protein, 9 aa, Homo Sapiens
LTKHKIIYT

SEQ ID NO: 584777 - protein, 9 aa, Homo Sapiens
LTGILYSYA

SEQ ID NO: 584778 - protein, 9 aa, Homo Sapiens
SRPSYPRGV

SEQ ID NO: 584779 - protein, 9 aa, Homo Sapiens
RGPCDSNQP

SEQ ID NO: 584780 - protein, 9 aa, Homo Sapiens
LLKWNPRNY

SEQ ID NO: 584781 - protein, 9 aa, Homo Sapiens
SKHGALSSG

SEQ ID NO: 584782 - protein, 9 aa, Homo Sapiens
NGYFETIVS

SEQ ID NO: 584783 - protein, 9 aa, Homo Sapiens
GRPIAILPV

SEQ ID NO: 584784 - protein, 9 aa, Homo Sapiens
PTRSFPFLL

SEQ ID NO: 584785 - protein, 9 aa, Homo Sapiens
KIGAAIPTS

SEQ ID NO: 584786 - protein, 9 aa, Homo Sapiens
YMIHIIEKW

SEQ ID NO: 584787 - protein, 9 aa, Homo Sapiens
MKIGAAIPT

SEQ ID NO: 584788 - protein, 9 aa, Homo Sapiens
GKAQQLLQD

SEQ ID NO: 584789 - protein, 9 aa, Homo Sapiens
MDDLVKSLL

SEQ ID NO: 584790 - protein, 9 aa, Homo Sapiens
LEKHPELPS

SEQ ID NO: 584791 - protein, 9 aa, Homo Sapiens
IFLLKWNPR

SEQ ID NO: 584792 - protein, 9 aa, Homo Sapiens
KDGSPFFPE

SEQ ID NO: 584793 - protein, 9 aa, Homo Sapiens
ITHQITVQQ

SEQ ID NO: 584794 - protein, 9 aa, Homo Sapiens
DFYKHQIEE

SEQ ID NO: 584795 - protein, 9 aa, Homo Sapiens
ADAQENRPD

SEQ ID NO: 584796 - protein, 9 aa, Homo Sapiens
CKYEEKVSS

SEQ ID NO: 584797 - protein, 9 aa, Homo Sapiens
GDDRAKEDM

SEQ ID NO: 584798 - protein, 9 aa, Homo Sapiens
NLLGTMESE

SEQ ID NO: 584799 - protein, 9 aa, Homo Sapiens
VKSLLSVED

SEQ ID NO: 584800 - protein, 9 aa, Homo Sapiens
ALSSGFRLE

SEQ ID NO: 584801 - protein, 9 aa, Homo Sapiens
GPQGVQGVK

SEQ ID NO: 584802 - protein, 9 aa, Homo Sapiens
RPSYPRGVF

SEQ ID NO: 584803 - protein, 9 aa, Homo Sapiens
LVERLDSEE

SEQ ID NO: 584804 - protein, 9 aa, Homo Sapiens
QGVQGVKGE

SEQ ID NO: 584805 - protein, 9 aa, Homo Sapiens
PEEMAQVRA

SEQ ID NO: 584806 - protein, 9 aa, Homo Sapiens
VSDVGLERF

SEQ ID NO: 584807 - protein, 9 aa, Homo Sapiens
TGILYSYAK

SEQ ID NO: 584808 - protein, 9 aa, Homo Sapiens
DSNVGHNLP

SEQ ID NO: 584809 - protein, 9 aa, Homo Sapiens
TLCLVVAVA

SEQ ID NO: 584810 - protein, 9 aa, Homo Sapiens
VWIFHIRNK

SEQ ID NO: 584811 - protein, 9 aa, Homo Sapiens
TRSFPFLLL

SEQ ID NO: 584812 - protein, 9 aa, Homo Sapiens
GTRGRAMAI

SEQ ID NO: 584813 - protein, 9 aa, Homo Sapiens
VMGSYDGEI

SEQ ID NO: 584814 - protein, 9 aa, Homo Sapiens
EVCDSNVGH

SEQ ID NO: 584815 - protein, 9 aa, Homo Sapiens
LLGTMESES

SEQ ID NO: 584816 - protein, 9 aa, Homo Sapiens
VFAMSGLRW

SEQ ID NO: 584817 - protein, 9 aa, Homo Sapiens
YAKIVSSIR

SEQ ID NO: 584818 - protein, 9 aa, Homo Sapiens
TLTKHKIIY

SEQ ID NO: 584819 - protein, 9 aa, Homo Sapiens
KLRRQSGFL

SEQ ID NO: 584820 - protein, 9 aa, Homo Sapiens
VTYSSMIYH

SEQ ID NO: 584821 - protein, 9 aa, Homo Sapiens
TAQKTIVYL

SEQ ID NO: 584822 - protein, 9 aa, Homo Sapiens
VWMDDLVKS

SEQ ID NO: 584823 - protein, 9 aa, Homo Sapiens
DLVKSLLSV

SEQ ID NO: 584824 - protein, 9 aa, Homo Sapiens
KAMSRPVLY

SEQ ID NO: 584825 - protein, 9 aa, Homo Sapiens
AVWIFHIRN

SEQ ID NO: 584826 - protein, 9 aa, Homo Sapiens
ILKNQLPGL

SEQ ID NO: 584827 - protein, 9 aa, Homo Sapiens
VLYSNWLSK

SEQ ID NO: 584828 - protein, 9 aa, Homo Sapiens
LSSGFRLEE

SEQ ID NO: 584829 - protein, 9 aa, Homo Sapiens
GESTTSCIS

SEQ ID NO: 584830 - protein, 9 aa, Homo Sapiens
EKHPELPSA

SEQ ID NO: 584831 - protein, 9 aa, Homo Sapiens
IDGTYFKIR

SEQ ID NO: 584832 - protein, 9 aa, Homo Sapiens
FLPPQTLVM

SEQ ID NO: 584833 - protein, 9 aa, Homo Sapiens
AQKTIVYLG

SEQ ID NO: 584834 - protein, 9 aa, Homo Sapiens
CLVATDFYK

SEQ ID NO: 584835 - protein, 9 aa, Homo Sapiens
IALSRTPVL

SEQ ID NO: 584836 - protein, 9 aa, Homo Sapiens
VGLERFLLA

SEQ ID NO: 584837 - protein, 9 aa, Homo Sapiens
KRAGENRSP

SEQ ID NO: 584838 - protein, 9 aa, Homo Sapiens
IYHQQQSGR

SEQ ID NO: 584839 - protein, 9 aa, Homo Sapiens
RHSNASPQA

SEQ ID NO: 584840 - protein, 9 aa, Homo Sapiens
AKIVSSIRA

SEQ ID NO: 584841 - protein, 9 aa, Homo Sapiens
AVMSTDRYL

SEQ ID NO: 584842 - protein, 9 aa, Homo Sapiens
QPVFAMSGL

SEQ ID NO: 584843 - protein, 9 aa, Homo Sapiens
SETANGYFE

SEQ ID NO: 584844 - protein, 9 aa, Homo Sapiens
VKPTESGKT

SEQ ID NO: 584845 - protein, 9 aa, Homo Sapiens
NSRGPCDSN

SEQ ID NO: 584846 - protein, 9 aa, Homo Sapiens
LPPQTLVMG

SEQ ID NO: 584847 - protein, 9 aa, Homo Sapiens
TGQVGKELY

SEQ ID NO: 584848 - protein, 9 aa, Homo Sapiens
LTLCLVVAV

SEQ ID NO: 584849 - protein, 9 aa, Homo Sapiens
LSRPSYPRG

SEQ ID NO: 584850 - protein, 9 aa, Homo Sapiens
GTAWLEWWH

SEQ ID NO: 584851 - protein, 9 aa, Homo Sapiens
TCSNSRGPC

SEQ ID NO: 584852 - protein, 9 aa, Homo Sapiens
MSPKDGSPF

SEQ ID NO: 584853 - protein, 9 aa, Homo Sapiens
THVSLLPPP

SEQ ID NO: 584854 - protein, 9 aa, Homo Sapiens
AITCSNSRG

SEQ ID NO: 584855 - protein, 9 aa, Homo Sapiens
AMSRPVLYS

SEQ ID NO: 584856 - protein, 9 aa, Homo Sapiens
RTPTLVSLL

SEQ ID NO: 584857 - protein, 9 aa, Homo Sapiens
HSNASPQAG

SEQ ID NO: 584858 - protein, 9 aa, Homo Sapiens
HVSGPIFLL

SEQ ID NO: 584859 - protein, 9 aa, Homo Sapiens
HAASLAPCD

SEQ ID NO: 584860 - protein, 9 aa, Homo Sapiens
WIFHIRNKT

SEQ ID NO: 584861 - protein, 9 aa, Homo Sapiens
LPVSVAASI

SEQ ID NO: 584862 - protein, 9 aa, Homo Sapiens
SNASPQAGE

SEQ ID NO: 584863 - protein, 9 aa, Homo Sapiens
TENIEVITH

SEQ ID NO: 584864 - protein, 9 aa, Homo Sapiens
ELWTAQKTI

SEQ ID NO: 584865 - protein, 9 aa, Homo Sapiens
TSCISPGST

SEQ ID NO: 584866 - protein, 9 aa, Homo Sapiens
CSLCCSFKV

SEQ ID NO: 584867 - protein, 9 aa, Homo Sapiens
ENIEVITHQ

SEQ ID NO: 584868 - protein, 9 aa, Homo Sapiens
QYTEALAQK

SEQ ID NO: 584869 - protein, 9 aa, Homo Sapiens
TANGYFETI

SEQ ID NO: 584870 - protein, 9 aa, Homo Sapiens
HGKAQQLLQ

SEQ ID NO: 584871 - protein, 9 aa, Homo Sapiens
EFADAQENR

SEQ ID NO: 584872 - protein, 9 aa, Homo Sapiens
NSFCSLCCS

SEQ ID NO: 584873 - protein, 9 aa, Homo Sapiens
GMSPKDGSP

SEQ ID NO: 584874 - protein, 9 aa, Homo Sapiens
LCCSFKVPK

SEQ ID NO: 584875 - protein, 9 aa, Homo Sapiens
STDRYLAIC

SEQ ID NO: 584876 - protein, 9 aa, Homo Sapiens
NTIFSSATL

SEQ ID NO: 584877 - protein, 9 aa, Homo Sapiens
PELPSAKAV

SEQ ID NO: 584878 - protein, 9 aa, Homo Sapiens
LRYLPTRSF

SEQ ID NO: 584879 - protein, 9 aa, Homo Sapiens
REHREKERQ

SEQ ID NO: 584880 - protein, 9 aa, Homo Sapiens
GIEVNLLGT

SEQ ID NO: 584881 - protein, 9 aa, Homo Sapiens
KLHGKAQQL

SEQ ID NO: 584882 - protein, 9 aa, Homo Sapiens
GPIFLLKWN

SEQ ID NO: 584883 - protein, 9 aa, Homo Sapiens
PSYPRGVFL

SEQ ID NO: 584884 - protein, 9 aa, Homo Sapiens
REKAMSRPV

SEQ ID NO: 584885 - protein, 9 aa, Homo Sapiens
NVGHNLPTI

SEQ ID NO: 584886 - protein, 9 aa, Homo Sapiens
ITCSNSRGP

SEQ ID NO: 584887 - protein, 9 aa, Homo Sapiens
RPVLYSNWL

SEQ ID NO: 584888 - protein, 9 aa, Homo Sapiens
AKEDMDEAI

SEQ ID NO: 584889 - protein, 9 aa, Homo Sapiens
LPPPASMMW

SEQ ID NO: 584890 - protein, 9 aa, Homo Sapiens
KEDMDEAIE

SEQ ID NO: 584891 - protein, 9 aa, Homo Sapiens
KSELWTAQK

SEQ ID NO: 584892 - protein, 9 aa, Homo Sapiens
LYSETANGY

SEQ ID NO: 584893 - protein, 9 aa, Homo Sapiens
GDPRHSNAS

SEQ ID NO: 584894 - protein, 9 aa, Homo Sapiens
SPEEMAQVR

SEQ ID NO: 584895 - protein, 9 aa, Homo Sapiens
YEEKVSSEH

SEQ ID NO: 584896 - protein, 9 aa, Homo Sapiens
KELYICIWD

SEQ ID NO: 584897 - protein, 9 aa, Homo Sapiens
EMAQVRAQN

SEQ ID NO: 584898 - protein, 9 aa, Homo Sapiens
LHGKAQQLL

SEQ ID NO: 584899 - protein, 9 aa, Homo Sapiens
SDVGLERFL

SEQ ID NO: 584900 - protein, 9 aa, Homo Sapiens
LKNQLPGLL

SEQ ID NO: 584901 - protein, 9 aa, Homo Sapiens
KEQPVFAMS

SEQ ID NO: 584902 - protein, 9 aa, Homo Sapiens
ANGYFETIV

SEQ ID NO: 584903 - protein, 9 aa, Homo Sapiens
IEVNLLGTM

SEQ ID NO: 584904 - protein, 9 aa, Homo Sapiens
LSAIALSRT

SEQ ID NO: 584905 - protein, 9 aa, Homo Sapiens
LLLAVMSTD

SEQ ID NO: 584906 - protein, 9 aa, Homo Sapiens
FYKHQIEEE

SEQ ID NO: 584907 - protein, 9 aa, Homo Sapiens
TLVMGSYDG

SEQ ID NO: 584908 - protein, 9 aa, Homo Sapiens
AGGHAASLA

SEQ ID NO: 584909 - protein, 9 aa, Homo Sapiens
LYICIWDSY

SEQ ID NO: 584910 - protein, 9 aa, Homo Sapiens
AWLEWWHVQ

SEQ ID NO: 584911 - protein, 9 aa, Homo Sapiens
AQVRAQNSS

SEQ ID NO: 584912 - protein, 9 aa, Homo Sapiens
EQPVFAMSG

SEQ ID NO: 584913 - protein, 9 aa, Homo Sapiens
SREFADAQE

SEQ ID NO: 584914 - protein, 9 aa, Homo Sapiens
FREGMSPKD

SEQ ID NO: 584915 - protein, 9 aa, Homo Sapiens
PCKYEEKVS

SEQ ID NO: 584916 - protein, 9 aa, Homo Sapiens
KDRKLHGKA

SEQ ID NO: 584917 - protein, 9 aa, Homo Sapiens
ELVERLDSE

SEQ ID NO: 584918 - protein, 9 aa, Homo Sapiens
SLLSVEDMN

SEQ ID NO: 584919 - protein, 9 aa, Homo Sapiens
SGKTDEATA

SEQ ID NO: 584920 - protein, 9 aa, Homo Sapiens
INCITEGIN

SEQ ID NO: 584921 - protein, 9 aa, Homo Sapiens
GSLEKHPEL

SEQ ID NO: 584922 - protein, 9 aa, Homo Sapiens
ELPSAKAVT

SEQ ID NO: 584923 - protein, 9 aa, Homo Sapiens
SPKDGSPFF

SEQ ID NO: 584924 - protein, 9 aa, Homo Sapiens
VPTEDYMIH

SEQ ID NO: 584925 - protein, 9 aa, Homo Sapiens
PQGVQGVKG

SEQ ID NO: 584926 - protein, 9 aa, Homo Sapiens
VGKELYICI

SEQ ID NO: 584927 - protein, 9 aa, Homo Sapiens
STPPPGTRG

SEQ ID NO: 584928 - protein, 9 aa, Homo Sapiens
PSSDSFLGP

SEQ ID NO: 584929 - protein, 9 aa, Homo Sapiens
GRGESTTSC

SEQ ID NO: 584930 - protein, 9 aa, Homo Sapiens
ELSSMKIGA

SEQ ID NO: 584931 - protein, 9 aa, Homo Sapiens
YSETANGYF

SEQ ID NO: 584932 - protein, 9 aa, Homo Sapiens
SMKIGAAIP

SEQ ID NO: 584933 - protein, 9 aa, Homo Sapiens
ELYICIWDS

SEQ ID NO: 584934 - protein, 9 aa, Homo Sapiens
KTDEATAKT

SEQ ID NO: 584935 - protein, 9 aa, Homo Sapiens
SDSFLGPGD

SEQ ID NO: 584936 - protein, 9 aa, Homo Sapiens
GALSSGFRL

SEQ ID NO: 584937 - protein, 9 aa, Homo Sapiens
SRPVLYSNW

SEQ ID NO: 584938 - protein, 9 aa, Homo Sapiens
KHGALSSGF

SEQ ID NO: 584939 - protein, 9 aa, Homo Sapiens
LPQRTPTLV

SEQ ID NO: 584940 - protein, 9 aa, Homo Sapiens
RSPGDPRHS

SEQ ID NO: 584941 - protein, 9 aa, Homo Sapiens
PLVSDVGLE

SEQ ID NO: 584942 - protein, 9 aa, Homo Sapiens
GVFLTWAVS

SEQ ID NO: 584943 - protein, 9 aa, Homo Sapiens
PPGTRGRAM

SEQ ID NO: 584944 - protein, 9 aa, Homo Sapiens
RKLHGKAQQ

SEQ ID NO: 584945 - protein, 9 aa, Homo Sapiens
SSATLPRPG

SEQ ID NO: 584946 - protein, 9 aa, Homo Sapiens
GKELYICIW

SEQ ID NO: 584947 - protein, 9 aa, Homo Sapiens
NEWLQDILK

SEQ ID NO: 584948 - protein, 9 aa, Homo Sapiens
GTMESESWG

SEQ ID NO: 584949 - protein, 9 aa, Homo Sapiens
VATDFYKHQ

SEQ ID NO: 584950 - protein, 9 aa, Homo Sapiens
DLDLTLCLV

SEQ ID NO: 584951 - protein, 9 aa, Homo Sapiens
LAGGHAASL

SEQ ID NO: 584952 - protein, 9 aa, Homo Sapiens
LSPEEMAQV

SEQ ID NO: 584953 - protein, 9 aa, Homo Sapiens
PTEDYMIHI

SEQ ID NO: 584954 - protein, 9 aa, Homo Sapiens
WHVQPTLDL

SEQ ID NO: 584955 - protein, 9 aa, Homo Sapiens
RPIAILPVS

SEQ ID NO: 584956 - protein, 9 aa, Homo Sapiens
SFCSLCCSF

SEQ ID NO: 584957 - protein, 9 aa, Homo Sapiens
AIALSRTPV

SEQ ID NO: 584958 - protein, 9 aa, Homo Sapiens
VLEKGSFMN

SEQ ID NO: 584959 - protein, 9 aa, Homo Sapiens
IEVLEKGSF

SEQ ID NO: 584960 - protein, 9 aa, Homo Sapiens
QDILKNQLP

SEQ ID NO: 584961 - protein, 9 aa, Homo Sapiens
NASPQAGEK

SEQ ID NO: 584962 - protein, 9 aa, Homo Sapiens
WTAQKTIVY

SEQ ID NO: 584963 - protein, 9 aa, Homo Sapiens
IEVITHQIT

SEQ ID NO: 584964 - protein, 9 aa, Homo Sapiens
SPEGEGHRS

SEQ ID NO: 584965 - protein, 9 aa, Homo Sapiens
PATLPQRTP

SEQ ID NO: 584966 - protein, 9 aa, Homo Sapiens
CLVVAVAAV

SEQ ID NO: 584967 - protein, 9 aa, Homo Sapiens
ETANGYFET

SEQ ID NO: 584968 - protein, 9 aa, Homo Sapiens
CINANNINC

SEQ ID NO: 584969 - protein, 9 aa, Homo Sapiens
SKDRKLHGK

SEQ ID NO: 584970 - protein, 9 aa, Homo Sapiens
NGLAVWIFH

SEQ ID NO: 584971 - protein, 9 aa, Homo Sapiens
LLAGGHAAS

SEQ ID NO: 584972 - protein, 9 aa, Homo Sapiens
SSKHGALSS

SEQ ID NO: 584973 - protein, 9 aa, Homo Sapiens
SKPCKYEEK

SEQ ID NO: 584974 - protein, 9 aa, Homo Sapiens
LDLTLCLVV

SEQ ID NO: 584975 - protein, 9 aa, Homo Sapiens
FKIRAIYDK

SEQ ID NO: 584976 - protein, 9 aa, Homo Sapiens
PLYSETANG

SEQ ID NO: 584977 - protein, 9 aa, Homo Sapiens
EHREKERQV

SEQ ID NO: 584978 - protein, 9 aa, Homo Sapiens
HREKERQVS

SEQ ID NO: 584979 - protein, 9 aa, Homo Sapiens
ESTTSCISP

SEQ ID NO: 584980 - protein, 9 aa, Homo Sapiens
EDLDLTLCL

SEQ ID NO: 584981 - protein, 9 aa, Homo Sapiens
LSKPCKYEE

SEQ ID NO: 584982 - protein, 9 aa, Homo Sapiens
EVTENIEVI

SEQ ID NO: 584983 - protein, 9 aa, Homo Sapiens
LSSMKIGAA

SEQ ID NO: 584984 - protein, 9 aa, Homo Sapiens
KGSFMNLTR

SEQ ID NO: 584985 - protein, 9 aa, Homo Sapiens
ESGKTDEAT

SEQ ID NO: 584986 - protein, 9 aa, Homo Sapiens
APLVSDVGL

SEQ ID NO: 584987 - protein, 9 aa, Homo Sapiens
RLDSEEEKL

SEQ ID NO: 584988 - protein, 9 aa, Homo Sapiens
KEVCDSNVG

SEQ ID NO: 584989 - protein, 9 aa, Homo Sapiens
GKTDEATAK

SEQ ID NO: 584990 - protein, 9 aa, Homo Sapiens
EEMAQVRAQ

SEQ ID NO: 584991 - protein, 9 aa, Homo Sapiens
LKEVCDSNV

SEQ ID NO: 584992 - protein, 9 aa, Homo Sapiens
ASLAPCDEP

SEQ ID NO: 584993 - protein, 9 aa, Homo Sapiens
GLSPEEMAQ

SEQ ID NO: 584994 - protein, 9 aa, Homo Sapiens
STTSCISPG

SEQ ID NO: 584995 - protein, 9 aa, Homo Sapiens
TDEATAKTQ

SEQ ID NO: 584996 - protein, 9 aa, Homo Sapiens
GILYSYAKI

SEQ ID NO: 584997 - protein, 9 aa, Homo Sapiens
QVGKELYIC

SEQ ID NO: 584998 - protein, 9 aa, Homo Sapiens
TEDYMIHII

SEQ ID NO: 584999 - protein, 9 aa, Homo Sapiens
DLTLCLVVA

SEQ ID NO: 585000 - protein, 9 aa, Homo Sapiens
PRGVFLTWA

SEQ ID NO: 585001 - protein, 9 aa, Homo Sapiens
GAAIPTSRA

SEQ ID NO: 585002 - protein, 9 aa, Homo Sapiens
EVITHQITV

SEQ ID NO: 585003 - protein, 9 aa, Homo Sapiens
DDLVKSLLS

SEQ ID NO: 585004 - protein, 9 aa, Homo Sapiens
PEDLDLTLC

SEQ ID NO: 585005 - protein, 9 aa, Homo Sapiens
INANNINCI

SEQ ID NO: 585006 - protein, 9 aa, Homo Sapiens
NNRIEVLEK

SEQ ID NO: 585007 - protein, 9 aa, Homo Sapiens
PQTLVMGSY

SEQ ID NO: 585008 - protein, 9 aa, Homo Sapiens
IFHIRNKTS

SEQ ID NO: 585009 - protein, 9 aa, Homo Sapiens
SSRTSSTCR

SEQ ID NO: 585010 - protein, 9 aa, Homo Sapiens
TEALAQKDK

SEQ ID NO: 585011 - protein, 9 aa, Homo Sapiens
MSRPVLYSN

SEQ ID NO: 585012 - protein, 9 aa, Homo Sapiens
VERLDSEEE

SEQ ID NO: 585013 - protein, 9 aa, Homo Sapiens
SNVGHNLPT

SEQ ID NO: 585014 - protein, 9 aa, Homo Sapiens
CDSNVGHNL

SEQ ID NO: 585015 - protein, 9 aa, Homo Sapiens
TTSCISPGS

SEQ ID NO: 585016 - protein, 9 aa, Homo Sapiens
IVPATLPQR

SEQ ID NO: 585017 - protein, 9 aa, Homo Sapiens
KHPELPSAK

SEQ ID NO: 585018 - protein, 9 aa, Homo Sapiens
KAPLVSDVG

SEQ ID NO: 585019 - protein, 9 aa, Homo Sapiens
DRKLHGKAQ

SEQ ID NO: 585020 - protein, 9 aa, Homo Sapiens
MIYHQQQSG

SEQ ID NO: 585021 - protein, 9 aa, Homo Sapiens
GLERFLLAP

SEQ ID NO: 585022 - protein, 9 aa, Homo Sapiens
VPATLPQRT

SEQ ID NO: 585023 - protein, 9 aa, Homo Sapiens
REFADAQEN

SEQ ID NO: 585024 - protein, 9 aa, Homo Sapiens
LVATDFYKH

SEQ ID NO: 585025 - protein, 9 aa, Homo Sapiens
EDYMIHIIE

SEQ ID NO: 585026 - protein, 9 aa, Homo Sapiens
VNLLGTMES

SEQ ID NO: 585027 - protein, 9 aa, Homo Sapiens
LVKSLLSVE

SEQ ID NO: 585028 - protein, 9 aa, Homo Sapiens
LPTRSFPFL

SEQ ID NO: 585029 - protein, 9 aa, Homo Sapiens
PQRTPTLVS

SEQ ID NO: 585030 - protein, 9 aa, Homo Sapiens
SFLGPGDLR

SEQ ID NO: 585031 - protein, 9 aa, Homo Sapiens
ENRSPGDPR

SEQ ID NO: 585032 - protein, 9 aa, Homo Sapiens
EKGSFMNLT

SEQ ID NO: 585033 - protein, 9 aa, Homo Sapiens
LVSDVGLER

SEQ ID NO: 585034 - protein, 9 aa, Homo Sapiens
NCGNSFCSL

SEQ ID NO: 585035 - protein, 9 aa, Homo Sapiens
DSEEEKLAD

SEQ ID NO: 585036 - protein, 9 aa, Homo Sapiens
TDFYKHQIE

SEQ ID NO: 585037 - protein, 9 aa, Homo Sapiens
MSGLRWGSF

SEQ ID NO: 585038 - protein, 9 aa, Homo Sapiens
RLRYLPTRS

SEQ ID NO: 585039 - protein, 9 aa, Homo Sapiens
GENRSPGDP

SEQ ID NO: 585040 - protein, 9 aa, Homo Sapiens
PVLYSNWLS

SEQ ID NO: 585041 - protein, 9 aa, Homo Sapiens
TALSAIALS

SEQ ID NO: 585042 - protein, 9 aa, Homo Sapiens
PGDLRTFGQ

SEQ ID NO: 585043 - protein, 9 aa, Homo Sapiens
LLPPPASMM

SEQ ID NO: 585044 - protein, 9 aa, Homo Sapiens
GEGHRSFSG

SEQ ID NO: 585045 - protein, 9 aa, Homo Sapiens
KTIVYLGDY

SEQ ID NO: 585046 - protein, 9 aa, Homo Sapiens
RRLRYLPTR

SEQ ID NO: 585047 - protein, 9 aa, Homo Sapiens
DGTYFKIRA

SEQ ID NO: 585048 - protein, 9 aa, Homo Sapiens
AQENRPDAR

SEQ ID NO: 585049 - protein, 9 aa, Homo Sapiens
AMSGLRWGS

SEQ ID NO: 585050 - protein, 9 aa, Homo Sapiens
VSVAASITA

SEQ ID NO: 585051 - protein, 9 aa, Homo Sapiens
GPGDLRTFG

SEQ ID NO: 585052 - protein, 9 aa, Homo Sapiens
PLLAGGHAA

SEQ ID NO: 585053 - protein, 9 aa, Homo Sapiens
AASLAPCDE

SEQ ID NO: 585054 - protein, 9 aa, Homo Sapiens
QTLVMGSYD

SEQ ID NO: 585055 - protein, 9 aa, Homo Sapiens
PTESGKTDE

SEQ ID NO: 585056 - protein, 9 aa, Homo Sapiens
EGMSPKDGS

SEQ ID NO: 585057 - protein, 9 aa, Homo Sapiens
NINCITEGI

SEQ ID NO: 585058 - protein, 9 aa, Homo Sapiens
FLLLAVMST

SEQ ID NO: 585059 - protein, 9 aa, Homo Sapiens
YSSMIYHQQ

SEQ ID NO: 585060 - protein, 9 aa, Homo Sapiens
LGTMESESW

SEQ ID NO: 585061 - protein, 9 aa, Homo Sapiens
MKEREHREK

SEQ ID NO: 585062 - protein, 9 aa, Homo Sapiens
TAWLEWWHV

SEQ ID NO: 585063 - protein, 9 aa, Homo Sapiens
EELVERLDS

SEQ ID NO: 585064 - protein, 9 aa, Homo Sapiens
AILPVSVAA

SEQ ID NO: 585065 - protein, 9 aa, Homo Sapiens
EGEGHRSFS

SEQ ID NO: 585066 - protein, 9 aa, Homo Sapiens
DVGLERFLL

SEQ ID NO: 585067 - protein, 9 aa, Homo Sapiens
VKGEQGPPG

SEQ ID NO: 585068 - protein, 9 aa, Homo Sapiens
KHQIEEELD

SEQ ID NO: 585069 - protein, 9 aa, Homo Sapiens
FAMSGLRWG

SEQ ID NO: 585070 - protein, 9 aa, Homo Sapiens
VLSKPCKYE

SEQ ID NO: 585071 - protein, 9 aa, Homo Sapiens
SSMKIGAAI

SEQ ID NO: 585072 - protein, 9 aa, Homo Sapiens
LPSAKAVTA

SEQ ID NO: 585073 - protein, 9 aa, Homo Sapiens
LYSYAKIVS

SEQ ID NO: 585074 - protein, 9 aa, Homo Sapiens
DDRAKEDMD

SEQ ID NO: 585075 - protein, 9 aa, Homo Sapiens
HRSFSGIKG

SEQ ID NO: 585076 - protein, 9 aa, Homo Sapiens
IAILPVSVA

SEQ ID NO: 585077 - protein, 9 aa, Homo Sapiens
IFSSATLPR

SEQ ID NO: 585078 - protein, 9 aa, Homo Sapiens
EREHREKER

SEQ ID NO: 585079 - protein, 9 aa, Homo Sapiens
ASGDDRAKE

SEQ ID NO: 585080 - protein, 9 aa, Homo Sapiens
ATDFYKHQI

SEQ ID NO: 585081 - protein, 9 aa, Homo Sapiens
ALSRTPVLM

SEQ ID NO: 585082 - protein, 9 aa, Homo Sapiens
EKAMSRPVL

SEQ ID NO: 585083 - protein, 9 aa, Homo Sapiens
RGVFLTWAV

SEQ ID NO: 585084 - protein, 9 aa, Homo Sapiens
VASGDDRAK

SEQ ID NO: 585085 - protein, 9 aa, Homo Sapiens
GQVGKELYI

SEQ ID NO: 585086 - protein, 9 aa, Homo Sapiens
EVLEKGSFM

SEQ ID NO: 585087 - protein, 9 aa, Homo Sapiens
RAGENRSPG

SEQ ID NO: 585088 - protein, 9 aa, Homo Sapiens
RIEVLEKGS

SEQ ID NO: 585089 - protein, 9 aa, Homo Sapiens
SLEKHPELP

SEQ ID NO: 585090 - protein, 9 aa, Homo Sapiens
ILYSYAKIV

SEQ ID NO: 585091 - protein, 9 aa, Homo Sapiens
DILKNQLPG

SEQ ID NO: 585092 - protein, 9 aa, Homo Sapiens
GGHAASLAP

SEQ ID NO: 585093 - protein, 9 aa, Homo Sapiens
SATLPRPGD

SEQ ID NO: 585094 - protein, 9 aa, Homo Sapiens
VITHQITVQ

SEQ ID NO: 585095 - protein, 9 aa, Homo Sapiens
YSYAKIVSS

SEQ ID NO: 585096 - protein, 9 aa, Homo Sapiens
TENTIFSSA

SEQ ID NO: 585097 - protein, 9 aa, Homo Sapiens
RVPTEDYMI

SEQ ID NO: 585098 - protein, 9 aa, Homo Sapiens
LQDILKNQL

SEQ ID NO: 585099 - protein, 9 aa, Homo Sapiens
REGMSPKDG

SEQ ID NO: 585100 - protein, 9 aa, Homo Sapiens
DYMIHIIEK

SEQ ID NO: 585101 - protein, 9 aa, Homo Sapiens
KHKIIYTGE

SEQ ID NO: 585102 - protein, 9 aa, Homo Sapiens
PGTHVSLLP

SEQ ID NO: 585103 - protein, 9 aa, Homo Sapiens
VSGPIFLLK

SEQ ID NO: 585104 - protein, 9 aa, Homo Sapiens
SYPRGVFLT

SEQ ID NO: 585105 - protein, 9 aa, Homo Sapiens
TYSSMIYHQ

SEQ ID NO: 585106 - protein, 9 aa, Homo Sapiens
VSLLPPPAS

SEQ ID NO: 585107 - protein, 9 aa, Homo Sapiens
EGHRSFSGI

SEQ ID NO: 585108 - protein, 9 aa, Homo Sapiens
LTALSAIAL

SEQ ID NO: 585109 - protein, 9 aa, Homo Sapiens
MGSYDGEIV

SEQ ID NO: 585110 - protein, 9 aa, Homo Sapiens
WLQDILKNQ

SEQ ID NO: 585111 - protein, 9 aa, Homo Sapiens
ILPVSVAAS

SEQ ID NO: 585112 - protein, 9 aa, Homo Sapiens
RYLPTRSFP

SEQ ID NO: 585113 - protein, 9 aa, Homo Sapiens
SPGDPRHSN

SEQ ID NO: 585114 - protein, 9 aa, Homo Sapiens
APLYSETAN

SEQ ID NO: 585115 - protein, 9 aa, Homo Sapiens
TPPPGTRGR

SEQ ID NO: 585116 - protein, 9 aa, Homo Sapiens
YKHQIEEEL

SEQ ID NO: 585117 - protein, 9 aa, Homo Sapiens
ATGQVGKEL

SEQ ID NO: 585118 - protein, 9 aa, Homo Sapiens
KAQQLLQDS

SEQ ID NO: 585119 - protein, 9 aa, Homo Sapiens
FSSATLPRP

SEQ ID NO: 585120 - protein, 9 aa, Homo Sapiens
LAVWIFHIR

SEQ ID NO: 585121 - protein, 9 aa, Homo Sapiens
YLPTRSFPF

SEQ ID NO: 585122 - protein, 9 aa, Homo Sapiens
NIEVITHQI

SEQ ID NO: 585123 - protein, 9 aa, Homo Sapiens
NRIEVLEKG

SEQ ID NO: 585124 - protein, 9 aa, Homo Sapiens
QHSPEGEGH

SEQ ID NO: 585125 - protein, 9 aa, Homo Sapiens
ATLPRPGDP

SEQ ID NO: 585126 - protein, 9 aa, Homo Sapiens
NANNINCIT

SEQ ID NO: 585127 - protein, 9 aa, Homo Sapiens
LCLVVAVAA

SEQ ID NO: 585128 - protein, 9 aa, Homo Sapiens
DGSPFFPEH

SEQ ID NO: 585129 - protein, 9 aa, Homo Sapiens
CSNSRGPCD

SEQ ID NO: 585130 - protein, 9 aa, Homo Sapiens
YPRGVFLTW

SEQ ID NO: 585131 - protein, 9 aa, Homo Sapiens
LLKEVCDSN

SEQ ID NO: 585132 - protein, 9 aa, Homo Sapiens
HSPEGEGHR

SEQ ID NO: 585133 - protein, 9 aa, Homo Sapiens
SYAKIVSSI

SEQ ID NO: 585134 - protein, 9 aa, Homo Sapiens
QGVKGEQGP

SEQ ID NO: 585135 - protein, 9 aa, Homo Sapiens
LEKGSFMNL

SEQ ID NO: 585136 - protein, 9 aa, Homo Sapiens
PGTRGRAMA

SEQ ID NO: 585137 - protein, 9 aa, Homo Sapiens
TMESESWGH

SEQ ID NO: 585138 - protein, 9 aa, Homo Sapiens
QRTPTLVSL

SEQ ID NO: 585139 - protein, 9 aa, Homo Sapiens
LEWWHVQPT

SEQ ID NO: 585140 - protein, 9 aa, Homo Sapiens
QKTIVYLGD

SEQ ID NO: 585141 - protein, 9 aa, Homo Sapiens
CISPGSTEI

SEQ ID NO: 585142 - protein, 9 aa, Homo Sapiens
LVMGSYDGE

SEQ ID NO: 585143 - protein, 9 aa, Homo Sapiens
LSRTPVLMN

SEQ ID NO: 585144 - protein, 9 aa, Homo Sapiens
DPRHSNASP

SEQ ID NO: 585145 - protein, 9 aa, Homo Sapiens
NRSPGDPRH

SEQ ID NO: 585146 - protein, 9 aa, Homo Sapiens
PKDGSPFFP

SEQ ID NO: 585147 - protein, 9 aa, Homo Sapiens
KEREHREKE

SEQ ID NO: 585148 - protein, 9 aa, Homo Sapiens
KPTESGKTD

SEQ ID NO: 585149 - protein, 9 aa, Homo Sapiens
FLGPGDLRT

SEQ ID NO: 585150 - protein, 9 aa, Homo Sapiens
SGDDRAKED

SEQ ID NO: 585151 - protein, 9 aa, Homo Sapiens
HVSLLPPPA

SEQ ID NO: 585152 - protein, 9 aa, Homo Sapiens
MSTDRYLAI

SEQ ID NO: 585153 - protein, 9 aa, Homo Sapiens
TYFKIRAIY

SEQ ID NO: 585154 - protein, 9 aa, Homo Sapiens
SAIALSRTP

SEQ ID NO: 585155 - protein, 9 aa, Homo Sapiens
FCSLCCSFK

SEQ ID NO: 585156 - protein, 9 aa, Homo Sapiens
TRGRAMAIY

SEQ ID NO: 585157 - protein, 9 aa, Homo Sapiens
SGLRWGSFR

SEQ ID NO: 585158 - protein, 9 aa, Homo Sapiens
GLAVWIFHI

SEQ ID NO: 585159 - protein, 9 aa, Homo Sapiens
TLPQRTPTL

SEQ ID NO: 585160 - protein, 9 aa, Homo Sapiens
HQQQSGRGW

SEQ ID NO: 585161 - protein, 9 aa, Homo Sapiens
MAQVRAQNS

SEQ ID NO: 585162 - protein, 9 aa, Homo Sapiens
RAKEDMDEA

SEQ ID NO: 585163 - protein, 9 aa, Homo Sapiens
PGPQGVQGV

SEQ ID NO: 585164 - protein, 9 aa, Homo Sapiens
PVSVAASIT

SEQ ID NO: 585165 - protein, 9 aa, Homo Sapiens
ENTIFSSAT

SEQ ID NO: 585166 - protein, 9 aa, Homo Sapiens
PRHSNASPQ

SEQ ID NO: 585167 - protein, 9 aa, Homo Sapiens
ALSAIALSR

SEQ ID NO: 585168 - protein, 9 aa, Homo Sapiens
CGNSFCSLC

SEQ ID NO: 585169 - protein, 9 aa, Homo Sapiens
ATLPQRTPT

SEQ ID NO: 585170 - protein, 9 aa, Homo Sapiens
GVQGVKGEQ

SEQ ID NO: 585171 - protein, 9 aa, Homo Sapiens
SMIYHQQQS

SEQ ID NO: 585172 - protein, 9 aa, Homo Sapiens
KIRAIYDKP

SEQ ID NO: 585173 - protein, 9 aa, Homo Sapiens
LLAVMSTDR

SEQ ID NO: 585174 - protein, 9 aa, Homo Sapiens
GRAMAIYKQ

SEQ ID NO: 585175 - protein, 9 aa, Homo Sapiens
PPPGTRGRA

SEQ ID NO: 585176 - protein, 9 aa, Homo Sapiens
KYEEKVSSE

SEQ ID NO: 585177 - protein, 9 aa, Homo Sapiens
NCITEGINE

SEQ ID NO: 585178 - protein, 9 aa, Homo Sapiens
LSMKEREHR

SEQ ID NO: 585179 - protein, 9 aa, Homo Sapiens
GHAASLAPC

SEQ ID NO: 585180 - protein, 9 aa, Homo Sapiens
EVNLLGTME

SEQ ID NO: 585181 - protein, 9 aa, Homo Sapiens
FADAQENRP

SEQ ID NO: 585182 - protein, 9 aa, Homo Sapiens
SLCCSFKVP

SEQ ID NO: 585183 - protein, 9 aa, Homo Sapiens
HGALSSGFR

SEQ ID NO: 585184 - protein, 9 aa, Homo Sapiens
TIFSSATLP

SEQ ID NO: 585185 - protein, 9 aa, Homo Sapiens
GTHVSLLPP

SEQ ID NO: 585186 - protein, 9 aa, Homo Sapiens
IGAAIPTSR

SEQ ID NO: 585187 - protein, 9 aa, Homo Sapiens
VHVSGPIFL

SEQ ID NO: 585188 - protein, 9 aa, Homo Sapiens
PGDPRHSNA

SEQ ID NO: 585189 - protein, 9 aa, Homo Sapiens
VSREFADAQ

SEQ ID NO: 585190 - protein, 9 aa, Homo Sapiens
SGPIFLLKW

SEQ ID NO: 585191 - protein, 9 aa, Homo Sapiens
AGENRSPGD

SEQ ID NO: 585192 - protein, 9 aa, Homo Sapiens
PEGEGHRSF

SEQ ID NO: 585193 - protein, 9 aa, Homo Sapiens
MELSSMKIG

SEQ ID NO: 585194 - protein, 9 aa, Homo Sapiens
RSFPFLLLL

SEQ ID NO: 585195 - protein, 9 aa, Homo Sapiens
FLLKWNPRN

SEQ ID NO: 585196 - protein, 9 aa, Homo Sapiens
VTENIEVIT

SEQ ID NO: 585197 - protein, 9 aa, Homo Sapiens
WWHVQPTLD

SEQ ID NO: 585198 - protein, 9 aa, Homo Sapiens
PIFLLKWNP

SEQ ID NO: 585199 - protein, 9 aa, Homo Sapiens
EWWHVQPTL

SEQ ID NO: 585200 - protein, 9 aa, Homo Sapiens
TDRYLAICH

SEQ ID NO: 585201 - protein, 9 aa, Homo Sapiens
DRAKEDMDE

SEQ ID NO: 585202 - protein, 9 aa, Homo Sapiens
SMKEREHRE

SEQ ID NO: 585203 - protein, 9 aa, Homo Sapiens
CITEGINEA

SEQ ID NO: 585204 - protein, 9 aa, Homo Sapiens
SELWTAQKT

SEQ ID NO: 585205 - protein, 9 aa, Homo Sapiens
LAVMSTDRY

SEQ ID NO: 585206 - protein, 9 aa, Homo Sapiens
GNSFCSLCC

SEQ ID NO: 585207 - protein, 9 aa, Homo Sapiens
SLLPPPASM

SEQ ID NO: 585208 - protein, 9 aa, Homo Sapiens
SSDSFLGPG

SEQ ID NO: 585209 - protein, 9 aa, Homo Sapiens
ASPQAGEKE

SEQ ID NO: 585210 - protein, 9 aa, Homo Sapiens
EWLQDILKN

SEQ ID NO: 585211 - protein, 9 aa, Homo Sapiens
VCDSNVGHN

SEQ ID NO: 585212 - protein, 9 aa, Homo Sapiens
GGTAWLEWW

SEQ ID NO: 585213 - protein, 9 aa, Homo Sapiens
VQGVKGEQG

SEQ ID NO: 585214 - protein, 9 aa, Homo Sapiens
WLEWWHVQP

SEQ ID NO: 585215 - protein, 9 aa, Homo Sapiens
RGESTTSCI

SEQ ID NO: 585216 - protein, 9 aa, Homo Sapiens
NSSKHGALS

SEQ ID NO: 585217 - protein, 9 aa, Homo Sapiens
GTYFKIRAI

SEQ ID NO: 585218 - protein, 9 aa, Homo Sapiens
SCISPGSTE

SEQ ID NO: 585219 - protein, 9 aa, Homo Sapiens
PPQTLVMGS

SEQ ID NO: 585220 - protein, 9 aa, Homo Sapiens
ERLDSEEEK

SEQ ID NO: 585221 - protein, 9 aa, Homo Sapiens
KPCKYEEKV

SEQ ID NO: 585222 - protein, 9 aa, Homo Sapiens
LWTAQKTIV

SEQ ID NO: 585223 - protein, 9 aa, Homo Sapiens
SRGPCDSNQ

SEQ ID NO: 585224 - protein, 9 aa, Homo Sapiens
CAITCSNSR

SEQ ID NO: 585225 - protein, 9 aa, Homo Sapiens
NNINCITEG

SEQ ID NO: 585226 - protein, 9 aa, Homo Sapiens
LNEWLQDIL

SEQ ID NO: 585227 - protein, 9 aa, Homo Sapiens
PVFAMSGLR

SEQ ID NO: 585228 - protein, 9 aa, Homo Sapiens
TKHKIIYTG

SEQ ID NO: 585229 - protein, 9 aa, Homo Sapiens
LDSEEEKLA

SEQ ID NO: 585230 - protein, 9 aa, Homo Sapiens
WMDDLVKSL

SEQ ID NO: 585231 - protein, 9 aa, Homo Sapiens
DAQENRPDA

SEQ ID NO: 585232 - protein, 9 aa, Homo Sapiens
REKERQVSE

SEQ ID NO: 585233 - protein, 9 aa, Homo Sapiens
LVLSKPCKY

SEQ ID NO: 585234 - protein, 9 aa, Homo Sapiens
DSFLGPGDL

SEQ ID NO: 585235 - protein, 9 aa, Homo Sapiens
QENRPDARS

SEQ ID NO: 585236 - protein, 9 aa, Homo Sapiens
YHQQQSGRG

SEQ ID NO: 585237 - protein, 9 aa, Homo Sapiens
EEELVERLD

SEQ ID NO: 585238 - protein, 9 aa, Homo Sapiens
YFKIRAIYD

SEQ ID NO: 585239 - protein, 9 aa, Homo Sapiens
GVKGEQGPP

SEQ ID NO: 585240 - protein, 9 aa, Homo Sapiens
WPGTHVSLL

SEQ ID NO: 585241 - protein, 9 aa, Homo Sapiens
ESCLIQDEI

SEQ ID NO: 585242 - protein, 9 aa, Homo Sapiens
KGCIPEGKE

SEQ ID NO: 585243 - protein, 9 aa, Homo Sapiens
KLSEAQRVE

SEQ ID NO: 585244 - protein, 9 aa, Homo Sapiens
QPPPPQDLL

SEQ ID NO: 585245 - protein, 9 aa, Homo Sapiens
MEYFSRFGT

SEQ ID NO: 585246 - protein, 9 aa, Homo Sapiens
LSTSFIRAV

SEQ ID NO: 585247 - protein, 9 aa, Homo Sapiens
KLSLPESLK

SEQ ID NO: 585248 - protein, 9 aa, Homo Sapiens
SVLGRRHET

SEQ ID NO: 585249 - protein, 9 aa, Homo Sapiens
GCVPLLEES

SEQ ID NO: 585250 - protein, 9 aa, Homo Sapiens
WWWRHRAQA

SEQ ID NO: 585251 - protein, 9 aa, Homo Sapiens
ISPLVVAKG

SEQ ID NO: 585252 - protein, 9 aa, Homo Sapiens
SWSPGWWWR

SEQ ID NO: 585253 - protein, 9 aa, Homo Sapiens
RRGLRARRN

SEQ ID NO: 585254 - protein, 9 aa, Homo Sapiens
GKEAITIVQ

SEQ ID NO: 585255 - protein, 9 aa, Homo Sapiens
IMKLSLPES

SEQ ID NO: 585256 - protein, 9 aa, Homo Sapiens
RRQPPNGGR

SEQ ID NO: 585257 - protein, 9 aa, Homo Sapiens
SSDLEDKRS

SEQ ID NO: 585258 - protein, 9 aa, Homo Sapiens
PRQCVPYGV

SEQ ID NO: 585259 - protein, 9 aa, Homo Sapiens
DILKTPDGG

SEQ ID NO: 585260 - protein, 9 aa, Homo Sapiens
SLSATQPCS

SEQ ID NO: 585261 - protein, 9 aa, Homo Sapiens
ILDIRRRER

SEQ ID NO: 585262 - protein, 9 aa, Homo Sapiens
KETSPESCL

SEQ ID NO: 585263 - protein, 9 aa, Homo Sapiens
LLEESETRK

SEQ ID NO: 585264 - protein, 9 aa, Homo Sapiens
HPRQCVPYG

SEQ ID NO: 585265 - protein, 9 aa, Homo Sapiens
CSPRPTALH

SEQ ID NO: 585266 - protein, 9 aa, Homo Sapiens
KKETSPESC

SEQ ID NO: 585267 - protein, 9 aa, Homo Sapiens
VPYGVLVWA

SEQ ID NO: 585268 - protein, 9 aa, Homo Sapiens
KEAITIVQH

SEQ ID NO: 585269 - protein, 9 aa, Homo Sapiens
IPEGKEAIT

SEQ ID NO: 585270 - protein, 9 aa, Homo Sapiens
DLLGRRRWL

SEQ ID NO: 585271 - protein, 9 aa, Homo Sapiens
LLGRRRWLS

SEQ ID NO: 585272 - protein, 9 aa, Homo Sapiens
SDLEDKRSE

SEQ ID NO: 585273 - protein, 9 aa, Homo Sapiens
CKMEYFSRF

SEQ ID NO: 585274 - protein, 9 aa, Homo Sapiens
LEDKRSEDS

SEQ ID NO: 585275 - protein, 9 aa, Homo Sapiens
KEEKLSEAQ

SEQ ID NO: 585276 - protein, 9 aa, Homo Sapiens
TISPLVVAK

SEQ ID NO: 585277 - protein, 9 aa, Homo Sapiens
QDLPTLSFG

SEQ ID NO: 585278 - protein, 9 aa, Homo Sapiens
HTALLQERR

SEQ ID NO: 585279 - protein, 9 aa, Homo Sapiens
VLHPELTVD

SEQ ID NO: 585280 - protein, 9 aa, Homo Sapiens
PSLSATQPC

SEQ ID NO: 585281 - protein, 9 aa, Homo Sapiens
EEGIFANLC

SEQ ID NO: 585282 - protein, 9 aa, Homo Sapiens
EIFCKMEYF

SEQ ID NO: 585283 - protein, 9 aa, Homo Sapiens
LCNLSEINL

SEQ ID NO: 585284 - protein, 9 aa, Homo Sapiens
ALHASSVGP

SEQ ID NO: 585285 - protein, 9 aa, Homo Sapiens
CVPYGVLVW

SEQ ID NO: 585286 - protein, 9 aa, Homo Sapiens
LKTPDGGQL

SEQ ID NO: 585287 - protein, 9 aa, Homo Sapiens
VKNIMVVVS

SEQ ID NO: 585288 - protein, 9 aa, Homo Sapiens
PTSCTVDFV

SEQ ID NO: 585289 - protein, 9 aa, Homo Sapiens
CVLHPELTV

SEQ ID NO: 585290 - protein, 9 aa, Homo Sapiens
EESETRKNN

SEQ ID NO: 585291 - protein, 9 aa, Homo Sapiens
MNECEINNG

SEQ ID NO: 585292 - protein, 9 aa, Homo Sapiens
CNLSEINLS

SEQ ID NO: 585293 - protein, 9 aa, Homo Sapiens
FISHPRQCV

SEQ ID NO: 585294 - protein, 9 aa, Homo Sapiens
PDSAEWQNL

SEQ ID NO: 585295 - protein, 9 aa, Homo Sapiens
SVLPHRWPS

SEQ ID NO: 585296 - protein, 9 aa, Homo Sapiens
QSDILKTPD

SEQ ID NO: 585297 - protein, 9 aa, Homo Sapiens
LHASSVGPG

SEQ ID NO: 585298 - protein, 9 aa, Homo Sapiens
LREKIMKLS

SEQ ID NO: 585299 - protein, 9 aa, Homo Sapiens
KPEKISVLG

SEQ ID NO: 585300 - protein, 9 aa, Homo Sapiens
ATQPCSPRP

SEQ ID NO: 585301 - protein, 9 aa, Homo Sapiens
PAQKRVYRS

SEQ ID NO: 585302 - protein, 9 aa, Homo Sapiens
LPHRWPSAW

SEQ ID NO: 585303 - protein, 9 aa, Homo Sapiens
RVPSGHASS

SEQ ID NO: 585304 - protein, 9 aa, Homo Sapiens
DKRSEDSVR

SEQ ID NO: 585305 - protein, 9 aa, Homo Sapiens
VDFVNIEVW

SEQ ID NO: 585306 - protein, 9 aa, Homo Sapiens
LPTLSFGKI

SEQ ID NO: 585307 - protein, 9 aa, Homo Sapiens
CTVDFVNIE

SEQ ID NO: 585308 - protein, 9 aa, Homo Sapiens
KKSVIQVTK

SEQ ID NO: 585309 - protein, 9 aa, Homo Sapiens
SPLVVAKGG

SEQ ID NO: 585310 - protein, 9 aa, Homo Sapiens
LYQSDILKT

SEQ ID NO: 585311 - protein, 9 aa, Homo Sapiens
LQDLPTLSF

SEQ ID NO: 585312 - protein, 9 aa, Homo Sapiens
QDLLGRRRW

SEQ ID NO: 585313 - protein, 9 aa, Homo Sapiens
SDILKTPDG

SEQ ID NO: 585314 - protein, 9 aa, Homo Sapiens
PHRWPSAWH

SEQ ID NO: 585315 - protein, 9 aa, Homo Sapiens
QKPEKISVL

SEQ ID NO: 585316 - protein, 9 aa, Homo Sapiens
SAPDSAEWQ

SEQ ID NO: 585317 - protein, 9 aa, Homo Sapiens
EGKEAITIV

SEQ ID NO: 585318 - protein, 9 aa, Homo Sapiens
HRWPSAWHL

SEQ ID NO: 585319 - protein, 9 aa, Homo Sapiens
TVDFVNIEV

SEQ ID NO: 585320 - protein, 9 aa, Homo Sapiens
PPPPQDLLG

SEQ ID NO: 585321 - protein, 9 aa, Homo Sapiens
GLRARRNNS

SEQ ID NO: 585322 - protein, 9 aa, Homo Sapiens
LSATQPCSP

SEQ ID NO: 585323 - protein, 9 aa, Homo Sapiens
LEESETRKN

SEQ ID NO: 585324 - protein, 9 aa, Homo Sapiens
SKEEKLSEA

SEQ ID NO: 585325 - protein, 9 aa, Homo Sapiens
TILDIRRRE

SEQ ID NO: 585326 - protein, 9 aa, Homo Sapiens
TSCTVDFVN

SEQ ID NO: 585327 - protein, 9 aa, Homo Sapiens
VKKSVIQVT

SEQ ID NO: 585328 - protein, 9 aa, Homo Sapiens
GHASSVLPH

SEQ ID NO: 585329 - protein, 9 aa, Homo Sapiens
GRVPSGHAS

SEQ ID NO: 585330 - protein, 9 aa, Homo Sapiens
KIMKLSLPE

SEQ ID NO: 585331 - protein, 9 aa, Homo Sapiens
GCIPEGKEA

SEQ ID NO: 585332 - protein, 9 aa, Homo Sapiens
IGRDRRGLR

SEQ ID NO: 585333 - protein, 9 aa, Homo Sapiens
RQCVPYGVL

SEQ ID NO: 585334 - protein, 9 aa, Homo Sapiens
SATQPCSPR

SEQ ID NO: 585335 - protein, 9 aa, Homo Sapiens
KTPDGGQLL

SEQ ID NO: 585336 - protein, 9 aa, Homo Sapiens
LSLPESLKA

SEQ ID NO: 585337 - protein, 9 aa, Homo Sapiens
APDSAEWQN

SEQ ID NO: 585338 - protein, 9 aa, Homo Sapiens
SVGPGRVPS

SEQ ID NO: 585339 - protein, 9 aa, Homo Sapiens
EKLSEAQRV

SEQ ID NO: 585340 - protein, 9 aa, Homo Sapiens
LSRASCSSW

SEQ ID NO: 585341 - protein, 9 aa, Homo Sapiens
AKGGTAWLE

SEQ ID NO: 585342 - protein, 9 aa, Homo Sapiens
KEIFCKMEY

SEQ ID NO: 585343 - protein, 9 aa, Homo Sapiens
KSFTNTILD

SEQ ID NO: 585344 - protein, 9 aa, Homo Sapiens
YLQDLPTLS

SEQ ID NO: 585345 - protein, 9 aa, Homo Sapiens
ISVLGRRHE

SEQ ID NO: 585346 - protein, 9 aa, Homo Sapiens
PEGKEAITI

SEQ ID NO: 585347 - protein, 9 aa, Homo Sapiens
LDTHGCYSG

SEQ ID NO: 585348 - protein, 9 aa, Homo Sapiens
AQPPPPQDL

SEQ ID NO: 585349 - protein, 9 aa, Homo Sapiens
AGLHTALLQ

SEQ ID NO: 585350 - protein, 9 aa, Homo Sapiens
EEKLSEAQR

SEQ ID NO: 585351 - protein, 9 aa, Homo Sapiens
PGWWWRHRA

SEQ ID NO: 585352 - protein, 9 aa, Homo Sapiens
SCTVDFVNI

SEQ ID NO: 585353 - protein, 9 aa, Homo Sapiens
THGCYSGPC

SEQ ID NO: 585354 - protein, 9 aa, Homo Sapiens
ETSPESCLI

SEQ ID NO: 585355 - protein, 9 aa, Homo Sapiens
EGIFANLCN

SEQ ID NO: 585356 - protein, 9 aa, Homo Sapiens
NVKNIMVVV

SEQ ID NO: 585357 - protein, 9 aa, Homo Sapiens
RASCSSWSP

SEQ ID NO: 585358 - protein, 9 aa, Homo Sapiens
RDRRGLRAR

SEQ ID NO: 585359 - protein, 9 aa, Homo Sapiens
AVESIKHFI

SEQ ID NO: 585360 - protein, 9 aa, Homo Sapiens
YGCVPLLEE

SEQ ID NO: 585361 - protein, 9 aa, Homo Sapiens
REKIMKLSL

SEQ ID NO: 585362 - protein, 9 aa, Homo Sapiens
ASCSSWSPG

SEQ ID NO: 585363 - protein, 9 aa, Homo Sapiens
ALPSLSATQ

SEQ ID NO: 585364 - protein, 9 aa, Homo Sapiens
GRDRRGLRA

SEQ ID NO: 585365 - protein, 9 aa, Homo Sapiens
HASSVLPHR

SEQ ID NO: 585366 - protein, 9 aa, Homo Sapiens
QPVKKSVIQ

SEQ ID NO: 585367 - protein, 9 aa, Homo Sapiens
NPAQKRVYR

SEQ ID NO: 585368 - protein, 9 aa, Homo Sapiens
VIQVTKSVD

SEQ ID NO: 585369 - protein, 9 aa, Homo Sapiens
SGHASSVLP

SEQ ID NO: 585370 - protein, 9 aa, Homo Sapiens
IMVVVSRWY

SEQ ID NO: 585371 - protein, 9 aa, Homo Sapiens
QARRQPPNG

SEQ ID NO: 585372 - protein, 9 aa, Homo Sapiens
PSAWHLSRA

SEQ ID NO: 585373 - protein, 9 aa, Homo Sapiens
CYCMTFISH

SEQ ID NO: 585374 - protein, 9 aa, Homo Sapiens
NIMVVVSRW

SEQ ID NO: 585375 - protein, 9 aa, Homo Sapiens
CLIQDEIAV

SEQ ID NO: 585376 - protein, 9 aa, Homo Sapiens
SSVLPHRWP

SEQ ID NO: 585377 - protein, 9 aa, Homo Sapiens
SSAPDSAEW

SEQ ID NO: 585378 - protein, 9 aa, Homo Sapiens
LSEAQRVEA

SEQ ID NO: 585379 - protein, 9 aa, Homo Sapiens
FSKEEKLSE

SEQ ID NO: 585380 - protein, 9 aa, Homo Sapiens
SRASCSSWS

SEQ ID NO: 585381 - protein, 9 aa, Homo Sapiens
EKISVLGRR

SEQ ID NO: 585382 - protein, 9 aa, Homo Sapiens
CIPEGKEAI

SEQ ID NO: 585383 - protein, 9 aa, Homo Sapiens
RWPSAWHLS

SEQ ID NO: 585384 - protein, 9 aa, Homo Sapiens
TFISHPRQC

SEQ ID NO: 585385 - protein, 9 aa, Homo Sapiens
GPGRVPSGH

SEQ ID NO: 585386 - protein, 9 aa, Homo Sapiens
PLLEESETR

SEQ ID NO: 585387 - protein, 9 aa, Homo Sapiens
SPESCLIQD

SEQ ID NO: 585388 - protein, 9 aa, Homo Sapiens
VLYQSDILK

SEQ ID NO: 585389 - protein, 9 aa, Homo Sapiens
GQPVKKSVI

SEQ ID NO: 585390 - protein, 9 aa, Homo Sapiens
LDIRRRERK

SEQ ID NO: 585391 - protein, 9 aa, Homo Sapiens
HGCYSGPCP

SEQ ID NO: 585392 - protein, 9 aa, Homo Sapiens
MKLSLPESL

SEQ ID NO: 585393 - protein, 9 aa, Homo Sapiens
CMTFISHPR

SEQ ID NO: 585394 - protein, 9 aa, Homo Sapiens
IFCKMEYFS

SEQ ID NO: 585395 - protein, 9 aa, Homo Sapiens
GWWWRHRAQ

SEQ ID NO: 585396 - protein, 9 aa, Homo Sapiens
AFSKEEKLS

SEQ ID NO: 585397 - protein, 9 aa, Homo Sapiens
PLVVAKGGT

SEQ ID NO: 585398 - protein, 9 aa, Homo Sapiens
FTNTILDIR

SEQ ID NO: 585399 - protein, 9 aa, Homo Sapiens
FCKMEYFSR

SEQ ID NO: 585400 - protein, 9 aa, Homo Sapiens
VPSGHASSV

SEQ ID NO: 585401 - protein, 9 aa, Homo Sapiens
KISVLGRRH

SEQ ID NO: 585402 - protein, 9 aa, Homo Sapiens
VYRSMMLEN

SEQ ID NO: 585403 - protein, 9 aa, Homo Sapiens
VLPHRWPSA

SEQ ID NO: 585404 - protein, 9 aa, Homo Sapiens
PTLSFGKIP

SEQ ID NO: 585405 - protein, 9 aa, Homo Sapiens
SAEWQNLPV

SEQ ID NO: 585406 - protein, 9 aa, Homo Sapiens
DLEDKRSED

SEQ ID NO: 585407 - protein, 9 aa, Homo Sapiens
THGCVLHPE

SEQ ID NO: 585408 - protein, 9 aa, Homo Sapiens
QCVPYGVLV

SEQ ID NO: 585409 - protein, 9 aa, Homo Sapiens
MDAYTHGCV

SEQ ID NO: 585410 - protein, 9 aa, Homo Sapiens
KSVIQVTKS

SEQ ID NO: 585411 - protein, 9 aa, Homo Sapiens
AQKRVYRSM

SEQ ID NO: 585412 - protein, 9 aa, Homo Sapiens
NTILDIRRR

SEQ ID NO: 585413 - protein, 9 aa, Homo Sapiens
WMNPAQKRV

SEQ ID NO: 585414 - protein, 9 aa, Homo Sapiens
ALLQERRIG

SEQ ID NO: 585415 - protein, 9 aa, Homo Sapiens
SLPESLKAY

SEQ ID NO: 585416 - protein, 9 aa, Homo Sapiens
EKSFTNTIL

SEQ ID NO: 585417 - protein, 9 aa, Homo Sapiens
HRAQARRQP

SEQ ID NO: 585418 - protein, 9 aa, Homo Sapiens
DRRGLRARR

SEQ ID NO: 585419 - protein, 9 aa, Homo Sapiens
LVVAKGGTA

SEQ ID NO: 585420 - protein, 9 aa, Homo Sapiens
RPTALHASS

SEQ ID NO: 585421 - protein, 9 aa, Homo Sapiens
LRARRNNSG

SEQ ID NO: 585422 - protein, 9 aa, Homo Sapiens
HLSRASCSS

SEQ ID NO: 585423 - protein, 9 aa, Homo Sapiens
CEDMNECEI

SEQ ID NO: 585424 - protein, 9 aa, Homo Sapiens
DAYTHGCVL

SEQ ID NO: 585425 - protein, 9 aa, Homo Sapiens
DSAEWQNLP

SEQ ID NO: 585426 - protein, 9 aa, Homo Sapiens
SLSTSFIRA

SEQ ID NO: 585427 - protein, 9 aa, Homo Sapiens
IRAVESIKH

SEQ ID NO: 585428 - protein, 9 aa, Homo Sapiens
ASSVGPGRV

SEQ ID NO: 585429 - protein, 9 aa, Homo Sapiens
LHTALLQER

SEQ ID NO: 585430 - protein, 9 aa, Homo Sapiens
PTALHASSV

SEQ ID NO: 585431 - protein, 9 aa, Homo Sapiens
WSPGWWWRH

SEQ ID NO: 585432 - protein, 9 aa, Homo Sapiens
EDMNECEIN

SEQ ID NO: 585433 - protein, 9 aa, Homo Sapiens
PSGHASSVL

SEQ ID NO: 585434 - protein, 9 aa, Homo Sapiens
HLDTHGCYS

SEQ ID NO: 585435 - protein, 9 aa, Homo Sapiens
KSSDLEDKR

SEQ ID NO: 585436 - protein, 9 aa, Homo Sapiens
RGLRARRNN

SEQ ID NO: 585437 - protein, 9 aa, Homo Sapiens
MTFISHPRQ

SEQ ID NO: 585438 - protein, 9 aa, Homo Sapiens
LGRRHETGV

SEQ ID NO: 585439 - protein, 9 aa, Homo Sapiens
PQDLLGRRR

SEQ ID NO: 585440 - protein, 9 aa, Homo Sapiens
GYICEDMNE

SEQ ID NO: 585441 - protein, 9 aa, Homo Sapiens
DMNECEINN

SEQ ID NO: 585442 - protein, 9 aa, Homo Sapiens
TALLQERRI

SEQ ID NO: 585443 - protein, 9 aa, Homo Sapiens
SCLIQDEIA

SEQ ID NO: 585444 - protein, 9 aa, Homo Sapiens
PGRVPSGHA

SEQ ID NO: 585445 - protein, 9 aa, Homo Sapiens
SHPRQCVPY

SEQ ID NO: 585446 - protein, 9 aa, Homo Sapiens
RQPPNGGRW

SEQ ID NO: 585447 - protein, 9 aa, Homo Sapiens
EWQNLPVNP

SEQ ID NO: 585448 - protein, 9 aa, Homo Sapiens
KNIMVVVSR

SEQ ID NO: 585449 - protein, 9 aa, Homo Sapiens
ANLCNLSEI

SEQ ID NO: 585450 - protein, 9 aa, Homo Sapiens
SPGWWWRHR

SEQ ID NO: 585451 - protein, 9 aa, Homo Sapiens
AQARRQPPN

SEQ ID NO: 585452 - protein, 9 aa, Homo Sapiens
ISHPRQCVP

SEQ ID NO: 585453 - protein, 9 aa, Homo Sapiens
YTHGCVLHP

SEQ ID NO: 585454 - protein, 9 aa, Homo Sapiens
PYGVLVWAL

SEQ ID NO: 585455 - protein, 9 aa, Homo Sapiens
GLHTALLQE

SEQ ID NO: 585456 - protein, 9 aa, Homo Sapiens
PEAGLHTAL

SEQ ID NO: 585457 - protein, 9 aa, Homo Sapiens
TNTILDIRR

SEQ ID NO: 585458 - protein, 9 aa, Homo Sapiens
GKSSDLEDK

SEQ ID NO: 585459 - protein, 9 aa, Homo Sapiens
ILKTPDGGQ

SEQ ID NO: 585460 - protein, 9 aa, Homo Sapiens
ASSVLPHRW

SEQ ID NO: 585461 - protein, 9 aa, Homo Sapiens
PESCLIQDE

SEQ ID NO: 585462 - protein, 9 aa, Homo Sapiens
TALHASSVG

SEQ ID NO: 585463 - protein, 9 aa, Homo Sapiens
ICEDMNECE

SEQ ID NO: 585464 - protein, 9 aa, Homo Sapiens
WQNLPVNPP

SEQ ID NO: 585465 - protein, 9 aa, Homo Sapiens
DFVNIEVWV

SEQ ID NO: 585466 - protein, 9 aa, Homo Sapiens
EILNVKNIM

SEQ ID NO: 585467 - protein, 9 aa, Homo Sapiens
STFLHLDTH

SEQ ID NO: 585468 - protein, 9 aa, Homo Sapiens
SSVGPGRVP

SEQ ID NO: 585469 - protein, 9 aa, Homo Sapiens
WRHRAQARR

SEQ ID NO: 585470 - protein, 9 aa, Homo Sapiens
WPSAWHLSR

SEQ ID NO: 585471 - protein, 9 aa, Homo Sapiens
AYTHGCVLH

SEQ ID NO: 585472 - protein, 9 aa, Homo Sapiens
GVLVWALPS

SEQ ID NO: 585473 - protein, 9 aa, Homo Sapiens
EDKRSEDSV

SEQ ID NO: 585474 - protein, 9 aa, Homo Sapiens
AWHLSRASC

SEQ ID NO: 585475 - protein, 9 aa, Homo Sapiens
VLGRRHETG

SEQ ID NO: 585476 - protein, 9 aa, Homo Sapiens
CSSWSPGWW

SEQ ID NO: 585477 - protein, 9 aa, Homo Sapiens
PRPTALHAS

SEQ ID NO: 585478 - protein, 9 aa, Homo Sapiens
NLCNLSEIN

SEQ ID NO: 585479 - protein, 9 aa, Homo Sapiens
QPCSPRPTA

SEQ ID NO: 585480 - protein, 9 aa, Homo Sapiens
HGCVLHPEL

SEQ ID NO: 585481 - protein, 9 aa, Homo Sapiens
YQSDILKTP

SEQ ID NO: 585482 - protein, 9 aa, Homo Sapiens
YCMTFISHP

SEQ ID NO: 585483 - protein, 9 aa, Homo Sapiens
PPPQDLLGR

SEQ ID NO: 585484 - protein, 9 aa, Homo Sapiens
MEILNVKNI

SEQ ID NO: 585485 - protein, 9 aa, Homo Sapiens
KMEYFSRFG

SEQ ID NO: 585486 - protein, 9 aa, Homo Sapiens
TSPESCLIQ

SEQ ID NO: 585487 - protein, 9 aa, Homo Sapiens
LVWALPSLS

SEQ ID NO: 585488 - protein, 9 aa, Homo Sapiens
VVAKGGTAW

SEQ ID NO: 585489 - protein, 9 aa, Homo Sapiens
NGYICEDMN

SEQ ID NO: 585490 - protein, 9 aa, Homo Sapiens
YAFSKEEKL

SEQ ID NO: 585491 - protein, 9 aa, Homo Sapiens
TKGCIPEGK

SEQ ID NO: 585492 - protein, 9 aa, Homo Sapiens
FLHLDTHGC

SEQ ID NO: 585493 - protein, 9 aa, Homo Sapiens
VWALPSLSA

SEQ ID NO: 585494 - protein, 9 aa, Homo Sapiens
WHLSRASCS

SEQ ID NO: 585495 - protein, 9 aa, Homo Sapiens
LLQERRIGG

SEQ ID NO: 585496 - protein, 9 aa, Homo Sapiens
TLSFGKIPS

SEQ ID NO: 585497 - protein, 9 aa, Homo Sapiens
TQPCSPRPT

SEQ ID NO: 585498 - protein, 9 aa, Homo Sapiens
IQVTKSVDF

SEQ ID NO: 585499 - protein, 9 aa, Homo Sapiens
ESETRKNNL

SEQ ID NO: 585500 - protein, 9 aa, Homo Sapiens
SCSSWSPGW

SEQ ID NO: 585501 - protein, 9 aa, Homo Sapiens
RVYRSMMLE

SEQ ID NO: 585502 - protein, 9 aa, Homo Sapiens
LPSLSATQP

SEQ ID NO: 585503 - protein, 9 aa, Homo Sapiens
FANLCNLSE

SEQ ID NO: 585504 - protein, 9 aa, Homo Sapiens
MNPAQKRVY

SEQ ID NO: 585505 - protein, 9 aa, Homo Sapiens
TPTSCTVDF

SEQ ID NO: 585506 - protein, 9 aa, Homo Sapiens
EAGLHTALL

SEQ ID NO: 585507 - protein, 9 aa, Homo Sapiens
KRSEDSVRP

SEQ ID NO: 585508 - protein, 9 aa, Homo Sapiens
PEKISVLGR

SEQ ID NO: 585509 - protein, 9 aa, Homo Sapiens
VLVWALPSL

SEQ ID NO: 585510 - protein, 9 aa, Homo Sapiens
VGPGRVPSG

SEQ ID NO: 585511 - protein, 9 aa, Homo Sapiens
HASSVGPGR

SEQ ID NO: 585512 - protein, 9 aa, Homo Sapiens
AEWQNLPVN

SEQ ID NO: 585513 - protein, 9 aa, Homo Sapiens
VAKGGTAWL

SEQ ID NO: 585514 - protein, 9 aa, Homo Sapiens
SFTNTILDI

SEQ ID NO: 585515 - protein, 9 aa, Homo Sapiens
IFANLCNLS

SEQ ID NO: 585516 - protein, 9 aa, Homo Sapiens
LHLDTHGCY

SEQ ID NO: 585517 - protein, 9 aa, Homo Sapiens
EKIMKLSLP

SEQ ID NO: 585518 - protein, 9 aa, Homo Sapiens
DLPTLSFGK

SEQ ID NO: 585519 - protein, 9 aa, Homo Sapiens
CVPLLEESE

SEQ ID NO: 585520 - protein, 9 aa, Homo Sapiens
EYFSRFGTK

SEQ ID NO: 585521 - protein, 9 aa, Homo Sapiens
YGVLVWALP

SEQ ID NO: 585522 - protein, 9 aa, Homo Sapiens
GIFANLCNL

SEQ ID NO: 585523 - protein, 9 aa, Homo Sapiens
TSFIRAVES

SEQ ID NO: 585524 - protein, 9 aa, Homo Sapiens
LNVKNIMVV

SEQ ID NO: 585525 - protein, 9 aa, Homo Sapiens
ILNVKNIMV

SEQ ID NO: 585526 - protein, 9 aa, Homo Sapiens
PCSPRPTAL

SEQ ID NO: 585527 - protein, 9 aa, Homo Sapiens
GCVLHPELT

SEQ ID NO: 585528 - protein, 9 aa, Homo Sapiens
YICEDMNEC

SEQ ID NO: 585529 - protein, 9 aa, Homo Sapiens
ARRQPPNGG

SEQ ID NO: 585530 - protein, 9 aa, Homo Sapiens
RAQARRQPP

SEQ ID NO: 585531 - protein, 9 aa, Homo Sapiens
KRVYRSMML

SEQ ID NO: 585532 - protein, 9 aa, Homo Sapiens
WALPSLSAT

SEQ ID NO: 585533 - protein, 9 aa, Homo Sapiens
KGGTAWLEW

SEQ ID NO: 585534 - protein, 9 aa, Homo Sapiens
SSWSPGWWW

SEQ ID NO: 585535 - protein, 9 aa, Homo Sapiens
TFLHLDTHG

SEQ ID NO: 585536 - protein, 9 aa, Homo Sapiens
LCYCMTFIS

SEQ ID NO: 585537 - protein, 9 aa, Homo Sapiens
DTHGCYSGP

SEQ ID NO: 585538 - protein, 9 aa, Homo Sapiens
GNGYICEDM

SEQ ID NO: 585539 - protein, 9 aa, Homo Sapiens
AIGRDRRGL

SEQ ID NO: 585540 - protein, 9 aa, Homo Sapiens
PPQDLLGRR

SEQ ID NO: 585541 - protein, 9 aa, Homo Sapiens
LSFGKIPSQ

SEQ ID NO: 585542 - protein, 9 aa, Homo Sapiens
STSFIRAVE

SEQ ID NO: 585543 - protein, 9 aa, Homo Sapiens
RYLQDLPTL

SEQ ID NO: 585544 - protein, 9 aa, Homo Sapiens
RAVESIKHF

SEQ ID NO: 585545 - protein, 9 aa, Homo Sapiens
PVKKSVIQV

SEQ ID NO: 585546 - protein, 9 aa, Homo Sapiens
QKRVYRSMM

SEQ ID NO: 585547 - protein, 9 aa, Homo Sapiens
SVIQVTKSV

SEQ ID NO: 585548 - protein, 9 aa, Homo Sapiens
RHRAQARRQ

SEQ ID NO: 585549 - protein, 9 aa, Homo Sapiens
SPRPTALHA

SEQ ID NO: 585550 - protein, 9 aa, Homo Sapiens
WWRHRAQAR

SEQ ID NO: 585551 - protein, 9 aa, Homo Sapiens
SFIRAVESI

SEQ ID NO: 585552 - protein, 9 aa, Homo Sapiens
FIRAVESIK

SEQ ID NO: 585553 - protein, 9 aa, Homo Sapiens
VPLLEESET

SEQ ID NO: 585554 - protein, 9 aa, Homo Sapiens
NKEIFCKME

SEQ ID NO: 585555 - protein, 9 aa, Homo Sapiens
SAWHLSRAS

SEQ ID NO: 585556 - protein, 9 aa, Homo Sapiens
PRSGLYLQQ

SEQ ID NO: 585557 - protein, 9 aa, Homo Sapiens
DCWDRTAQL

SEQ ID NO: 585558 - protein, 9 aa, Homo Sapiens
GSPRTSENH

SEQ ID NO: 585559 - protein, 9 aa, Homo Sapiens
AKDLALLYF

SEQ ID NO: 585560 - protein, 9 aa, Homo Sapiens
FTCGETEKP

SEQ ID NO: 585561 - protein, 9 aa, Homo Sapiens
GKLRETRGA

SEQ ID NO: 585562 - protein, 9 aa, Homo Sapiens
KFDSLYYVD

SEQ ID NO: 585563 - protein, 9 aa, Homo Sapiens
ENSSQSGRL

SEQ ID NO: 585564 - protein, 9 aa, Homo Sapiens
NAKPLYLHR

SEQ ID NO: 585565 - protein, 9 aa, Homo Sapiens
IHCALEIVK

SEQ ID NO: 585566 - protein, 9 aa, Homo Sapiens
QSLYIDSFD

SEQ ID NO: 585567 - protein, 9 aa, Homo Sapiens
QAEGPCLMR

SEQ ID NO: 585568 - protein, 9 aa, Homo Sapiens
GDVSGSKRR

SEQ ID NO: 585569 - protein, 9 aa, Homo Sapiens
CLKRLRIGS

SEQ ID NO: 585570 - protein, 9 aa, Homo Sapiens
KRLRIGSYF

SEQ ID NO: 585571 - protein, 9 aa, Homo Sapiens
LSLFLELSA

SEQ ID NO: 585572 - protein, 9 aa, Homo Sapiens
VTRLLILAH

SEQ ID NO: 585573 - protein, 9 aa, Homo Sapiens
FERLSTGSV

SEQ ID NO: 585574 - protein, 9 aa, Homo Sapiens
KFVILANAS

SEQ ID NO: 585575 - protein, 9 aa, Homo Sapiens
NNKSLRSLE

SEQ ID NO: 585576 - protein, 9 aa, Homo Sapiens
GYSLFVYIP

SEQ ID NO: 585577 - protein, 9 aa, Homo Sapiens
ILKKVKDSW

SEQ ID NO: 585578 - protein, 9 aa, Homo Sapiens
MEAIHLDKT

SEQ ID NO: 585579 - protein, 9 aa, Homo Sapiens
FPGSPRTSE

SEQ ID NO: 585580 - protein, 9 aa, Homo Sapiens
DAAYYSYQS

SEQ ID NO: 585581 - protein, 9 aa, Homo Sapiens
TRGGTRRHS

SEQ ID NO: 585582 - protein, 9 aa, Homo Sapiens
IVNRFKEDS

SEQ ID NO: 585583 - protein, 9 aa, Homo Sapiens
IHLDKTLRK

SEQ ID NO: 585584 - protein, 9 aa, Homo Sapiens
GKLTEGMQV

SEQ ID NO: 585585 - protein, 9 aa, Homo Sapiens
DFVRFFPAF

SEQ ID NO: 585586 - protein, 9 aa, Homo Sapiens
NPRSGLYLQ

SEQ ID NO: 585587 - protein, 9 aa, Homo Sapiens
MFFLAISIV

SEQ ID NO: 585588 - protein, 9 aa, Homo Sapiens
GRLPETPEH

SEQ ID NO: 585589 - protein, 9 aa, Homo Sapiens
QHCRAPPHL

SEQ ID NO: 585590 - protein, 9 aa, Homo Sapiens
CQPSNVEDP

SEQ ID NO: 585591 - protein, 9 aa, Homo Sapiens
RVLGSKLQH

SEQ ID NO: 585592 - protein, 9 aa, Homo Sapiens
FQEGKQQYL

SEQ ID NO: 585593 - protein, 9 aa, Homo Sapiens
LEIVKVMKE

SEQ ID NO: 585594 - protein, 9 aa, Homo Sapiens
VMEAPFQAP

SEQ ID NO: 585595 - protein, 9 aa, Homo Sapiens
VTAVLLFCL

SEQ ID NO: 585596 - protein, 9 aa, Homo Sapiens
HCALEIVKV

SEQ ID NO: 585597 - protein, 9 aa, Homo Sapiens
HMQMEAIHL

SEQ ID NO: 585598 - protein, 9 aa, Homo Sapiens
VTYSLLEKE

SEQ ID NO: 585599 - protein, 9 aa, Homo Sapiens
VSVSSDLWG

SEQ ID NO: 585600 - protein, 9 aa, Homo Sapiens
WIDTKKPFS

SEQ ID NO: 585601 - protein, 9 aa, Homo Sapiens
APDLWIDTK

SEQ ID NO: 585602 - protein, 9 aa, Homo Sapiens
NSATPDCDP

SEQ ID NO: 585603 - protein, 9 aa, Homo Sapiens
ILAHMIDVM

SEQ ID NO: 585604 - protein, 9 aa, Homo Sapiens
DADPSVHDS

SEQ ID NO: 585605 - protein, 9 aa, Homo Sapiens
GQSPLILCY

SEQ ID NO: 585606 - protein, 9 aa, Homo Sapiens
LNSATPDCD

SEQ ID NO: 585607 - protein, 9 aa, Homo Sapiens
GKFVILANA

SEQ ID NO: 585608 - protein, 9 aa, Homo Sapiens
VVRGYYLSL

SEQ ID NO: 585609 - protein, 9 aa, Homo Sapiens
QSPRSPPGK

SEQ ID NO: 585610 - protein, 9 aa, Homo Sapiens
RPLETENNK

SEQ ID NO: 585611 - protein, 9 aa, Homo Sapiens
QEEREQQLR

SEQ ID NO: 585612 - protein, 9 aa, Homo Sapiens
LTEGMQVLE

SEQ ID NO: 585613 - protein, 9 aa, Homo Sapiens
QKRSGAINS

SEQ ID NO: 585614 - protein, 9 aa, Homo Sapiens
VHLVTKVDT

SEQ ID NO: 585615 - protein, 9 aa, Homo Sapiens
GLQEGYGVE

SEQ ID NO: 585616 - protein, 9 aa, Homo Sapiens
VERVPQFRT

SEQ ID NO: 585617 - protein, 9 aa, Homo Sapiens
VKVMKEEMK

SEQ ID NO: 585618 - protein, 9 aa, Homo Sapiens
PEGKVDSPK

SEQ ID NO: 585619 - protein, 9 aa, Homo Sapiens
AESGWRSTL

SEQ ID NO: 585620 - protein, 9 aa, Homo Sapiens
IDGINVTEK

SEQ ID NO: 585621 - protein, 9 aa, Homo Sapiens
YVDRIPENA

SEQ ID NO: 585622 - protein, 9 aa, Homo Sapiens
VYIPTAILW

SEQ ID NO: 585623 - protein, 9 aa, Homo Sapiens
AAYYSYQSR

SEQ ID NO: 585624 - protein, 9 aa, Homo Sapiens
TPSEQRISV

SEQ ID NO: 585625 - protein, 9 aa, Homo Sapiens
VPPPWAPGR

SEQ ID NO: 585626 - protein, 9 aa, Homo Sapiens
CLMREVAQL

SEQ ID NO: 585627 - protein, 9 aa, Homo Sapiens
LAHMIDVMC

SEQ ID NO: 585628 - protein, 9 aa, Homo Sapiens
EGRYQETPV

SEQ ID NO: 585629 - protein, 9 aa, Homo Sapiens
SIVGTDFSM

SEQ ID NO: 585630 - protein, 9 aa, Homo Sapiens
IITTKAKVD

SEQ ID NO: 585631 - protein, 9 aa, Homo Sapiens
LAKDLALLY

SEQ ID NO: 585632 - protein, 9 aa, Homo Sapiens
EAPFQAPGR

SEQ ID NO: 585633 - protein, 9 aa, Homo Sapiens
DEMDADPSV

SEQ ID NO: 585634 - protein, 9 aa, Homo Sapiens
LAPILNSAT

SEQ ID NO: 585635 - protein, 9 aa, Homo Sapiens
RNGRCIILT

SEQ ID NO: 585636 - protein, 9 aa, Homo Sapiens
TMFRYQVHQ

SEQ ID NO: 585637 - protein, 9 aa, Homo Sapiens
RLLAEGHAD

SEQ ID NO: 585638 - protein, 9 aa, Homo Sapiens
RYGRIEYVH

SEQ ID NO: 585639 - protein, 9 aa, Homo Sapiens
SGPLRTLTC

SEQ ID NO: 585640 - protein, 9 aa, Homo Sapiens
VHNKKNTPL

SEQ ID NO: 585641 - protein, 9 aa, Homo Sapiens
ISVERVPQF

SEQ ID NO: 585642 - protein, 9 aa, Homo Sapiens
CARYLLLSK

SEQ ID NO: 585643 - protein, 9 aa, Homo Sapiens
QTGKLTEGM

SEQ ID NO: 585644 - protein, 9 aa, Homo Sapiens
GPLRTLTCL

SEQ ID NO: 585645 - protein, 9 aa, Homo Sapiens
RGALREKTL

SEQ ID NO: 585646 - protein, 9 aa, Homo Sapiens
PILNSATPD

SEQ ID NO: 585647 - protein, 9 aa, Homo Sapiens
LSGANPRSG

SEQ ID NO: 585648 - protein, 9 aa, Homo Sapiens
SLLEKEIQG

SEQ ID NO: 585649 - protein, 9 aa, Homo Sapiens
NVEDPFGEE

SEQ ID NO: 585650 - protein, 9 aa, Homo Sapiens
CFRAESEYT

SEQ ID NO: 585651 - protein, 9 aa, Homo Sapiens
ILNSATPDC

SEQ ID NO: 585652 - protein, 9 aa, Homo Sapiens
SADFVRFFP

SEQ ID NO: 585653 - protein, 9 aa, Homo Sapiens
RWCSPTSLE

SEQ ID NO: 585654 - protein, 9 aa, Homo Sapiens
AEVILGNII

SEQ ID NO: 585655 - protein, 9 aa, Homo Sapiens
LLLSKQPSQ

SEQ ID NO: 585656 - protein, 9 aa, Homo Sapiens
WCSPTSLEG

SEQ ID NO: 585657 - protein, 9 aa, Homo Sapiens
FQAPGRTIT

SEQ ID NO: 585658 - protein, 9 aa, Homo Sapiens
PYLKKKDEF

SEQ ID NO: 585659 - protein, 9 aa, Homo Sapiens
QVQVTVLLV

SEQ ID NO: 585660 - protein, 9 aa, Homo Sapiens
ILYILDGSG

SEQ ID NO: 585661 - protein, 9 aa, Homo Sapiens
VAAAADYAG

SEQ ID NO: 585662 - protein, 9 aa, Homo Sapiens
CPTCTRGGT

SEQ ID NO: 585663 - protein, 9 aa, Homo Sapiens
RQSPINIIT

SEQ ID NO: 585664 - protein, 9 aa, Homo Sapiens
ITSPPRYGR

SEQ ID NO: 585665 - protein, 9 aa, Homo Sapiens
YGRIEYVHY

SEQ ID NO: 585666 - protein, 9 aa, Homo Sapiens
ALEIVKVMK

SEQ ID NO: 585667 - protein, 9 aa, Homo Sapiens
GDFVRLRRN

SEQ ID NO: 585668 - protein, 9 aa, Homo Sapiens
LQQHCRAPP

SEQ ID NO: 585669 - protein, 9 aa, Homo Sapiens
IPLGIFNHS

SEQ ID NO: 585670 - protein, 9 aa, Homo Sapiens
KKEKPLPRR

SEQ ID NO: 585671 - protein, 9 aa, Homo Sapiens
CSDCWDRTA

SEQ ID NO: 585672 - protein, 9 aa, Homo Sapiens
LKKVKDSWK

SEQ ID NO: 585673 - protein, 9 aa, Homo Sapiens
SSGPLRTLT

SEQ ID NO: 585674 - protein, 9 aa, Homo Sapiens
PTPVSVSSD

SEQ ID NO: 585675 - protein, 9 aa, Homo Sapiens
RTLTCLHVP

SEQ ID NO: 585676 - protein, 9 aa, Homo Sapiens
EKLKAKLDS

SEQ ID NO: 585677 - protein, 9 aa, Homo Sapiens
EVPGVFSRS

SEQ ID NO: 585678 - protein, 9 aa, Homo Sapiens
PPRYGRIEY

SEQ ID NO: 585679 - protein, 9 aa, Homo Sapiens
DKSQSPRSP

SEQ ID NO: 585680 - protein, 9 aa, Homo Sapiens
TFNSDFIPL

SEQ ID NO: 585681 - protein, 9 aa, Homo Sapiens
SFGHPACRL

SEQ ID NO: 585682 - protein, 9 aa, Homo Sapiens
QEPEGKVDS

SEQ ID NO: 585683 - protein, 9 aa, Homo Sapiens
RLLILAHMI

SEQ ID NO: 585684 - protein, 9 aa, Homo Sapiens
VTILEMRSV

SEQ ID NO: 585685 - protein, 9 aa, Homo Sapiens
ETKRNQEPE

SEQ ID NO: 585686 - protein, 9 aa, Homo Sapiens
QTFNSDFIP

SEQ ID NO: 585687 - protein, 9 aa, Homo Sapiens
SSQSGRLPE

SEQ ID NO: 585688 - protein, 9 aa, Homo Sapiens
THMQMEAIH

SEQ ID NO: 585689 - protein, 9 aa, Homo Sapiens
ETRGALREK

SEQ ID NO: 585690 - protein, 9 aa, Homo Sapiens
CCPTCTRGG

SEQ ID NO: 585691 - protein, 9 aa, Homo Sapiens
ESGWRSTLR

SEQ ID NO: 585692 - protein, 9 aa, Homo Sapiens
RNRHSAAPE

SEQ ID NO: 585693 - protein, 9 aa, Homo Sapiens
SHVYCFRAE

SEQ ID NO: 585694 - protein, 9 aa, Homo Sapiens
HGFAKFLIF

SEQ ID NO: 585695 - protein, 9 aa, Homo Sapiens
EVTYSLLEK

SEQ ID NO: 585696 - protein, 9 aa, Homo Sapiens
FYLKQWLSY

SEQ ID NO: 585697 - protein, 9 aa, Homo Sapiens
QQHCRAPPH

SEQ ID NO: 585698 - protein, 9 aa, Homo Sapiens
RSTLRRRGP

SEQ ID NO: 585699 - protein, 9 aa, Homo Sapiens
LENDPYCRH

SEQ ID NO: 585700 - protein, 9 aa, Homo Sapiens
TGRQLHTSP

SEQ ID NO: 585701 - protein, 9 aa, Homo Sapiens
ELLWHGFAK

SEQ ID NO: 585702 - protein, 9 aa, Homo Sapiens
VVPKKPEEK

SEQ ID NO: 585703 - protein, 9 aa, Homo Sapiens
QDNVHLVTK

SEQ ID NO: 585704 - protein, 9 aa, Homo Sapiens
AGTQDTRWC

SEQ ID NO: 585705 - protein, 9 aa, Homo Sapiens
VSSDLWGDF

SEQ ID NO: 585706 - protein, 9 aa, Homo Sapiens
YYSQSLYID

SEQ ID NO: 585707 - protein, 9 aa, Homo Sapiens
TYSLLEKEI

SEQ ID NO: 585708 - protein, 9 aa, Homo Sapiens
RLRRNEIFP

SEQ ID NO: 585709 - protein, 9 aa, Homo Sapiens
FGKFVILAN

SEQ ID NO: 585710 - protein, 9 aa, Homo Sapiens
QTGRQLHTS

SEQ ID NO: 585711 - protein, 9 aa, Homo Sapiens
SVTRNGRCI

SEQ ID NO: 585712 - protein, 9 aa, Homo Sapiens
VVTILEMRS

SEQ ID NO: 585713 - protein, 9 aa, Homo Sapiens
KSQSPRSPP

SEQ ID NO: 585714 - protein, 9 aa, Homo Sapiens
KRSGAINSK

SEQ ID NO: 585715 - protein, 9 aa, Homo Sapiens
RQKRSGAIN

SEQ ID NO: 585716 - protein, 9 aa, Homo Sapiens
LWHGFAKFL

SEQ ID NO: 585717 - protein, 9 aa, Homo Sapiens
DEILYILDG

SEQ ID NO: 585718 - protein, 9 aa, Homo Sapiens
GYLQHLQKV

SEQ ID NO: 585719 - protein, 9 aa, Homo Sapiens
ERLSTGSVQ

SEQ ID NO: 585720 - protein, 9 aa, Homo Sapiens
LEELNDRYR

SEQ ID NO: 585721 - protein, 9 aa, Homo Sapiens
SDCWDRTAQ

SEQ ID NO: 585722 - protein, 9 aa, Homo Sapiens
SVHDSFEQA

SEQ ID NO: 585723 - protein, 9 aa, Homo Sapiens
IQFIRQKRS

SEQ ID NO: 585724 - protein, 9 aa, Homo Sapiens
LPRRNIHSG

SEQ ID NO: 585725 - protein, 9 aa, Homo Sapiens
ETREPNNTL

SEQ ID NO: 585726 - protein, 9 aa, Homo Sapiens
NSFAAGCVV

SEQ ID NO: 585727 - protein, 9 aa, Homo Sapiens
LTCLHVPGT

SEQ ID NO: 585728 - protein, 9 aa, Homo Sapiens
PAKVPVVPK

SEQ ID NO: 585729 - protein, 9 aa, Homo Sapiens
NPSNDKWDG

SEQ ID NO: 585730 - protein, 9 aa, Homo Sapiens
RLVSRSRNS

SEQ ID NO: 585731 - protein, 9 aa, Homo Sapiens
PNILIDKVK

SEQ ID NO: 585732 - protein, 9 aa, Homo Sapiens
LQAAVEHVE

SEQ ID NO: 585733 - protein, 9 aa, Homo Sapiens
IFFGKFVIL

SEQ ID NO: 585734 - protein, 9 aa, Homo Sapiens
HTDGYLQHL

SEQ ID NO: 585735 - protein, 9 aa, Homo Sapiens
EFQEGKQQY

SEQ ID NO: 585736 - protein, 9 aa, Homo Sapiens
LSKQPSQAQ

SEQ ID NO: 585737 - protein, 9 aa, Homo Sapiens
RCIILTAVL

SEQ ID NO: 585738 - protein, 9 aa, Homo Sapiens
AQAVAAAAD

SEQ ID NO: 585739 - protein, 9 aa, Homo Sapiens
KSMITAGFA

SEQ ID NO: 585740 - protein, 9 aa, Homo Sapiens
LAISIVGTD

SEQ ID NO: 585741 - protein, 9 aa, Homo Sapiens
LAQRLQAAV

SEQ ID NO: 585742 - protein, 9 aa, Homo Sapiens
DFQKGDFFK

SEQ ID NO: 585743 - protein, 9 aa, Homo Sapiens
HLDDEILYI

SEQ ID NO: 585744 - protein, 9 aa, Homo Sapiens
HLHLDDEIL

SEQ ID NO: 585745 - protein, 9 aa, Homo Sapiens
EEREQQLRR

SEQ ID NO: 585746 - protein, 9 aa, Homo Sapiens
SPPRYGRIE

SEQ ID NO: 585747 - protein, 9 aa, Homo Sapiens
RYQETPVYL

SEQ ID NO: 585748 - protein, 9 aa, Homo Sapiens
TWSNGLQEG

SEQ ID NO: 585749 - protein, 9 aa, Homo Sapiens
YCFRAESEY

SEQ ID NO: 585750 - protein, 9 aa, Homo Sapiens
EGHADPDAE

SEQ ID NO: 585751 - protein, 9 aa, Homo Sapiens
NLETREPNN

SEQ ID NO: 585752 - protein, 9 aa, Homo Sapiens
KAKLDSDTV

SEQ ID NO: 585753 - protein, 9 aa, Homo Sapiens
FIPKRPIPA

SEQ ID NO: 585754 - protein, 9 aa, Homo Sapiens
TPDCDPDTI

SEQ ID NO: 585755 - protein, 9 aa, Homo Sapiens
VLPLNTDKA

SEQ ID NO: 585756 - protein, 9 aa, Homo Sapiens
TDKADTGKN

SEQ ID NO: 585757 - protein, 9 aa, Homo Sapiens
TSPPRYGRI

SEQ ID NO: 585758 - protein, 9 aa, Homo Sapiens
GANPRSGLY

SEQ ID NO: 585759 - protein, 9 aa, Homo Sapiens
RSRAWQDNV

SEQ ID NO: 585760 - protein, 9 aa, Homo Sapiens
FIPLGIFNH

SEQ ID NO: 585761 - protein, 9 aa, Homo Sapiens
QGDKSQSPR

SEQ ID NO: 585762 - protein, 9 aa, Homo Sapiens
YYSYQSRYH

SEQ ID NO: 585763 - protein, 9 aa, Homo Sapiens
EEVPGVFSR

SEQ ID NO: 585764 - protein, 9 aa, Homo Sapiens
ALLYFEIFD

SEQ ID NO: 585765 - protein, 9 aa, Homo Sapiens
LKQWLSYNI

SEQ ID NO: 585766 - protein, 9 aa, Homo Sapiens
VMRKVSFLR

SEQ ID NO: 585767 - protein, 9 aa, Homo Sapiens
LSYNISIWD

SEQ ID NO: 585768 - protein, 9 aa, Homo Sapiens
METKRNQEP

SEQ ID NO: 585769 - protein, 9 aa, Homo Sapiens
DDDDHDDDD

SEQ ID NO: 585770 - protein, 9 aa, Homo Sapiens
TENNKSLRS

SEQ ID NO: 585771 - protein, 9 aa, Homo Sapiens
AFIVVTILE

SEQ ID NO: 585772 - protein, 9 aa, Homo Sapiens
CYLKMHELA

SEQ ID NO: 585773 - protein, 9 aa, Homo Sapiens
SVSSDLWGD

SEQ ID NO: 585774 - protein, 9 aa, Homo Sapiens
CSMMSAPTC

SEQ ID NO: 585775 - protein, 9 aa, Homo Sapiens
TQDTRWCSP

SEQ ID NO: 585776 - protein, 9 aa, Homo Sapiens
SVVVHCSDC

SEQ ID NO: 585777 - protein, 9 aa, Homo Sapiens
HVYCFRAES

SEQ ID NO: 585778 - protein, 9 aa, Homo Sapiens
WHGFAKFLI

SEQ ID NO: 585779 - protein, 9 aa, Homo Sapiens
RHSAAPEDH

SEQ ID NO: 585780 - protein, 9 aa, Homo Sapiens
YSYQSRYHF

SEQ ID NO: 585781 - protein, 9 aa, Homo Sapiens
LDTMFRYQV

SEQ ID NO: 585782 - protein, 9 aa, Homo Sapiens
IHTLILYKN

SEQ ID NO: 585783 - protein, 9 aa, Homo Sapiens
IALQQHCRA

SEQ ID NO: 585784 - protein, 9 aa, Homo Sapiens
MRKVSFLRR

SEQ ID NO: 585785 - protein, 9 aa, Homo Sapiens
LPLNTDKAD

SEQ ID NO: 585786 - protein, 9 aa, Homo Sapiens
VRPLETENN

SEQ ID NO: 585787 - protein, 9 aa, Homo Sapiens
DPSVHDSFE

SEQ ID NO: 585788 - protein, 9 aa, Homo Sapiens
RFKEDSSLE

SEQ ID NO: 585789 - protein, 9 aa, Homo Sapiens
RRNEIFPAD

SEQ ID NO: 585790 - protein, 9 aa, Homo Sapiens
LDWIVNRFK

SEQ ID NO: 585791 - protein, 9 aa, Homo Sapiens
TLRRRGPGT

SEQ ID NO: 585792 - protein, 9 aa, Homo Sapiens
QEGYGVETY

SEQ ID NO: 585793 - protein, 9 aa, Homo Sapiens
GHADPDAEL

SEQ ID NO: 585794 - protein, 9 aa, Homo Sapiens
QVTVLLVDN

SEQ ID NO: 585795 - protein, 9 aa, Homo Sapiens
DHDDDDEDD

SEQ ID NO: 585796 - protein, 9 aa, Homo Sapiens
LEKEIQGLP

SEQ ID NO: 585797 - protein, 9 aa, Homo Sapiens
QIALQQHCR

SEQ ID NO: 585798 - protein, 9 aa, Homo Sapiens
FKSHVYCFR

SEQ ID NO: 585799 - protein, 9 aa, Homo Sapiens
AGRVGVVEI

SEQ ID NO: 585800 - protein, 9 aa, Homo Sapiens
ESAQPLPTF

SEQ ID NO: 585801 - protein, 9 aa, Homo Sapiens
TFHTDGYLQ

SEQ ID NO: 585802 - protein, 9 aa, Homo Sapiens
RKESAQPLP

SEQ ID NO: 585803 - protein, 9 aa, Homo Sapiens
GNLETREPN

SEQ ID NO: 585804 - protein, 9 aa, Homo Sapiens
WIVNRFKED

SEQ ID NO: 585805 - protein, 9 aa, Homo Sapiens
CVTAVLLFC

SEQ ID NO: 585806 - protein, 9 aa, Homo Sapiens
AEGYLDIDG

SEQ ID NO: 585807 - protein, 9 aa, Homo Sapiens
LNDRYRLDC

SEQ ID NO: 585808 - protein, 9 aa, Homo Sapiens
AGFAPVVIE

SEQ ID NO: 585809 - protein, 9 aa, Homo Sapiens
AVLLFCLCK

SEQ ID NO: 585810 - protein, 9 aa, Homo Sapiens
TAGRVGVVE

SEQ ID NO: 585811 - protein, 9 aa, Homo Sapiens
ALDFQPSKQ

SEQ ID NO: 585812 - protein, 9 aa, Homo Sapiens
IVVTILEMR

SEQ ID NO: 585813 - protein, 9 aa, Homo Sapiens
GALREKTLA

SEQ ID NO: 585814 - protein, 9 aa, Homo Sapiens
QPSKQSIGS

SEQ ID NO: 585815 - protein, 9 aa, Homo Sapiens
ELTKNAQRV

SEQ ID NO: 585816 - protein, 9 aa, Homo Sapiens
QWLSYNISI

SEQ ID NO: 585817 - protein, 9 aa, Homo Sapiens
EILYILDGS

SEQ ID NO: 585818 - protein, 9 aa, Homo Sapiens
SRYHFCEKC

SEQ ID NO: 585819 - protein, 9 aa, Homo Sapiens
PRYGRIEYV

SEQ ID NO: 585820 - protein, 9 aa, Homo Sapiens
TKRNQEPEG

SEQ ID NO: 585821 - protein, 9 aa, Homo Sapiens
AAPDLWIDT

SEQ ID NO: 585822 - protein, 9 aa, Homo Sapiens
SPDAEDYFE

SEQ ID NO: 585823 - protein, 9 aa, Homo Sapiens
VERALRAAH

SEQ ID NO: 585824 - protein, 9 aa, Homo Sapiens
SQSPRSPPG

SEQ ID NO: 585825 - protein, 9 aa, Homo Sapiens
QCYFEGRYQ

SEQ ID NO: 585826 - protein, 9 aa, Homo Sapiens
HTLILYKNQ

SEQ ID NO: 585827 - protein, 9 aa, Homo Sapiens
SPRTSENHP

SEQ ID NO: 585828 - protein, 9 aa, Homo Sapiens
SVERVPQFR

SEQ ID NO: 585829 - protein, 9 aa, Homo Sapiens
GFAKFLIFL

SEQ ID NO: 585830 - protein, 9 aa, Homo Sapiens
TQCYFEGRY

SEQ ID NO: 585831 - protein, 9 aa, Homo Sapiens
FIVVTILEM

SEQ ID NO: 585832 - protein, 9 aa, Homo Sapiens
DRIPENAPG

SEQ ID NO: 585833 - protein, 9 aa, Homo Sapiens
SEQRISVER

SEQ ID NO: 585834 - protein, 9 aa, Homo Sapiens
DFQTGRQLH

SEQ ID NO: 585835 - protein, 9 aa, Homo Sapiens
GRKESAQPL

SEQ ID NO: 585836 - protein, 9 aa, Homo Sapiens
DAEDYFEHS

SEQ ID NO: 585837 - protein, 9 aa, Homo Sapiens
DDSADFVRF

SEQ ID NO: 585838 - protein, 9 aa, Homo Sapiens
LDSDTVKSS

SEQ ID NO: 585839 - protein, 9 aa, Homo Sapiens
EAILKKVKD

SEQ ID NO: 585840 - protein, 9 aa, Homo Sapiens
IVGTDFSMI

SEQ ID NO: 585841 - protein, 9 aa, Homo Sapiens
FQKGDFFKD

SEQ ID NO: 585842 - protein, 9 aa, Homo Sapiens
NGCESPDAE

SEQ ID NO: 585843 - protein, 9 aa, Homo Sapiens
DSDTVKSSA

SEQ ID NO: 585844 - protein, 9 aa, Homo Sapiens
RAPPHLAAT

SEQ ID NO: 585845 - protein, 9 aa, Homo Sapiens
TKNAQRVLG

SEQ ID NO: 585846 - protein, 9 aa, Homo Sapiens
MCSMMSAPT

SEQ ID NO: 585847 - protein, 9 aa, Homo Sapiens
FAESGWRST

SEQ ID NO: 585848 - protein, 9 aa, Homo Sapiens
IFTCGETEK

SEQ ID NO: 585849 - protein, 9 aa, Homo Sapiens
PLPRRNIHS

SEQ ID NO: 585850 - protein, 9 aa, Homo Sapiens
PVDLSPRCS

SEQ ID NO: 585851 - protein, 9 aa, Homo Sapiens
AHLPRYQYL

SEQ ID NO: 585852 - protein, 9 aa, Homo Sapiens
QFIRQKRSG

SEQ ID NO: 585853 - protein, 9 aa, Homo Sapiens
VYGYSLFVY

SEQ ID NO: 585854 - protein, 9 aa, Homo Sapiens
DLIFTCGET

SEQ ID NO: 585855 - protein, 9 aa, Homo Sapiens
GIHCALEIV

SEQ ID NO: 585856 - protein, 9 aa, Homo Sapiens
RSVMEAPFQ

SEQ ID NO: 585857 - protein, 9 aa, Homo Sapiens
RSGLYLQQM

SEQ ID NO: 585858 - protein, 9 aa, Homo Sapiens
VDLSPRCSL

SEQ ID NO: 585859 - protein, 9 aa, Homo Sapiens
VRLRRNEIF

SEQ ID NO: 585860 - protein, 9 aa, Homo Sapiens
ANPRSGLYL

SEQ ID NO: 585861 - protein, 9 aa, Homo Sapiens
KKDEFQEGK

SEQ ID NO: 585862 - protein, 9 aa, Homo Sapiens
LYIDSFDEE

SEQ ID NO: 585863 - protein, 9 aa, Homo Sapiens
AVVVHAALY

SEQ ID NO: 585864 - protein, 9 aa, Homo Sapiens
PPAKVPVVP

SEQ ID NO: 585865 - protein, 9 aa, Homo Sapiens
GYYLSLFLE

SEQ ID NO: 585866 - protein, 9 aa, Homo Sapiens
LETREPNNT

SEQ ID NO: 585867 - protein, 9 aa, Homo Sapiens
AGCVVNGGD

SEQ ID NO: 585868 - protein, 9 aa, Homo Sapiens
AADYAGLKV

SEQ ID NO: 585869 - protein, 9 aa, Homo Sapiens
DGRVTAFQG

SEQ ID NO: 585870 - protein, 9 aa, Homo Sapiens
KKKDEFQEG

SEQ ID NO: 585871 - protein, 9 aa, Homo Sapiens
TNSFAAGCV

SEQ ID NO: 585872 - protein, 9 aa, Homo Sapiens
TRGALREKT

SEQ ID NO: 585873 - protein, 9 aa, Homo Sapiens
RQKLDTMFR

SEQ ID NO: 585874 - protein, 9 aa, Homo Sapiens
AKLDSDTVK

SEQ ID NO: 585875 - protein, 9 aa, Homo Sapiens
AIDAVHNKK

SEQ ID NO: 585876 - protein, 9 aa, Homo Sapiens
EGYLDIDGI

SEQ ID NO: 585877 - protein, 9 aa, Homo Sapiens
PSEQRISVE

SEQ ID NO: 585878 - protein, 9 aa, Homo Sapiens
AQRLQAAVE

SEQ ID NO: 585879 - protein, 9 aa, Homo Sapiens
IALVDGRVT

SEQ ID NO: 585880 - protein, 9 aa, Homo Sapiens
AAADYAGLK

SEQ ID NO: 585881 - protein, 9 aa, Homo Sapiens
SNGLQEGYG

SEQ ID NO: 585882 - protein, 9 aa, Homo Sapiens
RAWQDNVHL

SEQ ID NO: 585883 - protein, 9 aa, Homo Sapiens
SDTVKSSAL

SEQ ID NO: 585884 - protein, 9 aa, Homo Sapiens
FGHPACRLV

SEQ ID NO: 585885 - protein, 9 aa, Homo Sapiens
CVYGYSLFV

SEQ ID NO: 585886 - protein, 9 aa, Homo Sapiens
VGAEGYLDI

SEQ ID NO: 585887 - protein, 9 aa, Homo Sapiens
SDYYSQSLY

SEQ ID NO: 585888 - protein, 9 aa, Homo Sapiens
LLVDNVGPK

SEQ ID NO: 585889 - protein, 9 aa, Homo Sapiens
SQSGRLPET

SEQ ID NO: 585890 - protein, 9 aa, Homo Sapiens
SFPGSPRTS

SEQ ID NO: 585891 - protein, 9 aa, Homo Sapiens
EMATFHTDG

SEQ ID NO: 585892 - protein, 9 aa, Homo Sapiens
ACARYLLLS

SEQ ID NO: 585893 - protein, 9 aa, Homo Sapiens
SAEQTGKLT

SEQ ID NO: 585894 - protein, 9 aa, Homo Sapiens
DDDDDDDDH

SEQ ID NO: 585895 - protein, 9 aa, Homo Sapiens
LEMRSVSGR

SEQ ID NO: 585896 - protein, 9 aa, Homo Sapiens
CISSGQHYW

SEQ ID NO: 585897 - protein, 9 aa, Homo Sapiens
RCSLTVKDL

SEQ ID NO: 585898 - protein, 9 aa, Homo Sapiens
NDPYCRHVI

SEQ ID NO: 585899 - protein, 9 aa, Homo Sapiens
VDRIPENAP

SEQ ID NO: 585900 - protein, 9 aa, Homo Sapiens
PMFERLSTG

SEQ ID NO: 585901 - protein, 9 aa, Homo Sapiens
QRLLAEGHA

SEQ ID NO: 585902 - protein, 9 aa, Homo Sapiens
VHAALYDSD

SEQ ID NO: 585903 - protein, 9 aa, Homo Sapiens
TLTCLHVPG

SEQ ID NO: 585904 - protein, 9 aa, Homo Sapiens
SFLRRKDVL

SEQ ID NO: 585905 - protein, 9 aa, Homo Sapiens
NSDFIPLGI

SEQ ID NO: 585906 - protein, 9 aa, Homo Sapiens
RVTAFQGDK

SEQ ID NO: 585907 - protein, 9 aa, Homo Sapiens
ATFHTDGYL

SEQ ID NO: 585908 - protein, 9 aa, Homo Sapiens
CWDRTAQLT

SEQ ID NO: 585909 - protein, 9 aa, Homo Sapiens
AAVEHVEAV

SEQ ID NO: 585910 - protein, 9 aa, Homo Sapiens
TAGFAPVVI

SEQ ID NO: 585911 - protein, 9 aa, Homo Sapiens
EKEIQGLPV

SEQ ID NO: 585912 - protein, 9 aa, Homo Sapiens
AISIVGTDF

SEQ ID NO: 585913 - protein, 9 aa, Homo Sapiens
HDDDDEDDE

SEQ ID NO: 585914 - protein, 9 aa, Homo Sapiens
LVDGRVTAF

SEQ ID NO: 585915 - protein, 9 aa, Homo Sapiens
QDTRWCSPT

SEQ ID NO: 585916 - protein, 9 aa, Homo Sapiens
LLYFEIFDS

SEQ ID NO: 585917 - protein, 9 aa, Homo Sapiens
NSCNRVPNI

SEQ ID NO: 585918 - protein, 9 aa, Homo Sapiens
ALYDSDFFT

SEQ ID NO: 585919 - protein, 9 aa, Homo Sapiens
APILNSATP

SEQ ID NO: 585920 - protein, 9 aa, Homo Sapiens
EEQIDFQKG

SEQ ID NO: 585921 - protein, 9 aa, Homo Sapiens
TDGYLQHLQ

SEQ ID NO: 585922 - protein, 9 aa, Homo Sapiens
RVPNILIDK

SEQ ID NO: 585923 - protein, 9 aa, Homo Sapiens
FLRRKDVLG

SEQ ID NO: 585924 - protein, 9 aa, Homo Sapiens
YSQSLYIDS

SEQ ID NO: 585925 - protein, 9 aa, Homo Sapiens
VVHCSDCWD

SEQ ID NO: 585926 - protein, 9 aa, Homo Sapiens
ACRLVSRSR

SEQ ID NO: 585927 - protein, 9 aa, Homo Sapiens
FICLKRLRI

SEQ ID NO: 585928 - protein, 9 aa, Homo Sapiens
CIILTAVLA

SEQ ID NO: 585929 - protein, 9 aa, Homo Sapiens
PLILCYLKM

SEQ ID NO: 585930 - protein, 9 aa, Homo Sapiens
NDKWDGDVS

SEQ ID NO: 585931 - protein, 9 aa, Homo Sapiens
YYSGTKFHR

SEQ ID NO: 585932 - protein, 9 aa, Homo Sapiens
IPKRPIPAI

SEQ ID NO: 585933 - protein, 9 aa, Homo Sapiens
LTKNAQRVL

SEQ ID NO: 585934 - protein, 9 aa, Homo Sapiens
ISIVGTDFS

SEQ ID NO: 585935 - protein, 9 aa, Homo Sapiens
AAHLPRYQY

SEQ ID NO: 585936 - protein, 9 aa, Homo Sapiens
EQTGKLTEG

SEQ ID NO: 585937 - protein, 9 aa, Homo Sapiens
PIPAIKDVI

SEQ ID NO: 585938 - protein, 9 aa, Homo Sapiens
LEAILKKVK

SEQ ID NO: 585939 - protein, 9 aa, Homo Sapiens
ERAAIDAVH

SEQ ID NO: 585940 - protein, 9 aa, Homo Sapiens
ILGADLIFT

SEQ ID NO: 585941 - protein, 9 aa, Homo Sapiens
GRCIILTAV

SEQ ID NO: 585942 - protein, 9 aa, Homo Sapiens
VDGRVTAFQ

SEQ ID NO: 585943 - protein, 9 aa, Homo Sapiens
KPLPRRNIH

SEQ ID NO: 585944 - protein, 9 aa, Homo Sapiens
KVSFLRRKD

SEQ ID NO: 585945 - protein, 9 aa, Homo Sapiens
RNEIFPADI

SEQ ID NO: 585946 - protein, 9 aa, Homo Sapiens
RRVPPPWAP

SEQ ID NO: 585947 - protein, 9 aa, Homo Sapiens
RLSTGSVQE

SEQ ID NO: 585948 - protein, 9 aa, Homo Sapiens
QSRYHFCEK

SEQ ID NO: 585949 - protein, 9 aa, Homo Sapiens
FNSDFIPLG

SEQ ID NO: 585950 - protein, 9 aa, Homo Sapiens
GSVQEQLPY

SEQ ID NO: 585951 - protein, 9 aa, Homo Sapiens
VVVHCSDCW

SEQ ID NO: 585952 - protein, 9 aa, Homo Sapiens
GTWSNGLQE

SEQ ID NO: 585953 - protein, 9 aa, Homo Sapiens
ITTKAKVDK

SEQ ID NO: 585954 - protein, 9 aa, Homo Sapiens
EGYGVETYG

SEQ ID NO: 585955 - protein, 9 aa, Homo Sapiens
PCLMREVAQ

SEQ ID NO: 585956 - protein, 9 aa, Homo Sapiens
NVHLVTKVD

SEQ ID NO: 585957 - protein, 9 aa, Homo Sapiens
GGQSPLILC

SEQ ID NO: 585958 - protein, 9 aa, Homo Sapiens
LDFQPSKQS

SEQ ID NO: 585959 - protein, 9 aa, Homo Sapiens
AEDYFEHSP

SEQ ID NO: 585960 - protein, 9 aa, Homo Sapiens
LNTDKADTG

SEQ ID NO: 585961 - protein, 9 aa, Homo Sapiens
DFIPLGIFN

SEQ ID NO: 585962 - protein, 9 aa, Homo Sapiens
KDLALLYFE

SEQ ID NO: 585963 - protein, 9 aa, Homo Sapiens
NAQRVLGSK

SEQ ID NO: 585964 - protein, 9 aa, Homo Sapiens
YLLLSKQPS

SEQ ID NO: 585965 - protein, 9 aa, Homo Sapiens
QSGRLPETP

SEQ ID NO: 585966 - protein, 9 aa, Homo Sapiens
APVVIENVL

SEQ ID NO: 585967 - protein, 9 aa, Homo Sapiens
QRISVERVP

SEQ ID NO: 585968 - protein, 9 aa, Homo Sapiens
LFLELSAGL

SEQ ID NO: 585969 - protein, 9 aa, Homo Sapiens
CYFEGRYQE

SEQ ID NO: 585970 - protein, 9 aa, Homo Sapiens
PLNTDKADT

SEQ ID NO: 585971 - protein, 9 aa, Homo Sapiens
DLALLYFEI

SEQ ID NO: 585972 - protein, 9 aa, Homo Sapiens
ILYKNQIIK

SEQ ID NO: 585973 - protein, 9 aa, Homo Sapiens
PDAEDYFEH

SEQ ID NO: 585974 - protein, 9 aa, Homo Sapiens
LILAHMIDV

SEQ ID NO: 585975 - protein, 9 aa, Homo Sapiens
YKNQIIKLE

SEQ ID NO: 585976 - protein, 9 aa, Homo Sapiens
VTAFQGDKL

SEQ ID NO: 585977 - protein, 9 aa, Homo Sapiens
SGRLPETPE

SEQ ID NO: 585978 - protein, 9 aa, Homo Sapiens
KESAQPLPT

SEQ ID NO: 585979 - protein, 9 aa, Homo Sapiens
LGSFPGSPR

SEQ ID NO: 585980 - protein, 9 aa, Homo Sapiens
AAAADYAGL

SEQ ID NO: 585981 - protein, 9 aa, Homo Sapiens
LSTGSVQEQ

SEQ ID NO: 585982 - protein, 9 aa, Homo Sapiens
GYYSGTKFH

SEQ ID NO: 585983 - protein, 9 aa, Homo Sapiens
GFAPVVIEN

SEQ ID NO: 585984 - protein, 9 aa, Homo Sapiens
DDHDDDDED

SEQ ID NO: 585985 - protein, 9 aa, Homo Sapiens
CALEIVKVM

SEQ ID NO: 585986 - protein, 9 aa, Homo Sapiens
EAIHLDKTL

SEQ ID NO: 585987 - protein, 9 aa, Homo Sapiens
APPAKVPVV

SEQ ID NO: 585988 - protein, 9 aa, Homo Sapiens
LCYLKMHEL

SEQ ID NO: 585989 - protein, 9 aa, Homo Sapiens
CRAPPHLAA

SEQ ID NO: 585990 - protein, 9 aa, Homo Sapiens
DYYSQSLYI

SEQ ID NO: 585991 - protein, 9 aa, Homo Sapiens
ADYAGLKVA

SEQ ID NO: 585992 - protein, 9 aa, Homo Sapiens
VEDPFGEEF

SEQ ID NO: 585993 - protein, 9 aa, Homo Sapiens
NKSLRSLEE

SEQ ID NO: 585994 - protein, 9 aa, Homo Sapiens
LGADLIFTC

SEQ ID NO: 585995 - protein, 9 aa, Homo Sapiens
RVPPPWAPG

SEQ ID NO: 585996 - protein, 9 aa, Homo Sapiens
VPVVPKKPE

SEQ ID NO: 585997 - protein, 9 aa, Homo Sapiens
ATPDCDPDT

SEQ ID NO: 585998 - protein, 9 aa, Homo Sapiens
DKWDGDVSG

SEQ ID NO: 585999 - protein, 9 aa, Homo Sapiens
GDKSQSPRS

SEQ ID NO: 586000 - protein, 9 aa, Homo Sapiens
GRIEYVHYP

SEQ ID NO: 586001 - protein, 9 aa, Homo Sapiens
QCISSGQHY

SEQ ID NO: 586002 - protein, 9 aa, Homo Sapiens
PLRTLTCLH

SEQ ID NO: 586003 - protein, 9 aa, Homo Sapiens
DDEILYILD

SEQ ID NO: 586004 - protein, 9 aa, Homo Sapiens
VRFFPAFVW

SEQ ID NO: 586005 - protein, 9 aa, Homo Sapiens
LSPRCSLTV

SEQ ID NO: 586006 - protein, 9 aa, Homo Sapiens
EKPLPRRNI

SEQ ID NO: 586007 - protein, 9 aa, Homo Sapiens
NKLEELNDR

SEQ ID NO: 586008 - protein, 9 aa, Homo Sapiens
FVYIPTAIL

SEQ ID NO: 586009 - protein, 9 aa, Homo Sapiens
SLFLELSAG

SEQ ID NO: 586010 - protein, 9 aa, Homo Sapiens
AQRVLGSKL

SEQ ID NO: 586011 - protein, 9 aa, Homo Sapiens
KALENDPYC

SEQ ID NO: 586012 - protein, 9 aa, Homo Sapiens
RPIPAIKDV

SEQ ID NO: 586013 - protein, 9 aa, Homo Sapiens
KLEELNDRY

SEQ ID NO: 586014 - protein, 9 aa, Homo Sapiens
MFRYQVHQG

SEQ ID NO: 586015 - protein, 9 aa, Homo Sapiens
DAVHNKKNT

SEQ ID NO: 586016 - protein, 9 aa, Homo Sapiens
RRNIHSGFW

SEQ ID NO: 586017 - protein, 9 aa, Homo Sapiens
KWDGDVSGS

SEQ ID NO: 586018 - protein, 9 aa, Homo Sapiens
DDDHDDDDE

SEQ ID NO: 586019 - protein, 9 aa, Homo Sapiens
DIHTLILYK

SEQ ID NO: 586020 - protein, 9 aa, Homo Sapiens
LRETRGALR

SEQ ID NO: 586021 - protein, 9 aa, Homo Sapiens
LRRKDVLGD

SEQ ID NO: 586022 - protein, 9 aa, Homo Sapiens
YSLLEKEIQ

SEQ ID NO: 586023 - protein, 9 aa, Homo Sapiens
GAEGYLDID

SEQ ID NO: 586024 - protein, 9 aa, Homo Sapiens
YLKQWLSYN

SEQ ID NO: 586025 - protein, 9 aa, Homo Sapiens
TAVLLFCLC

SEQ ID NO: 586026 - protein, 9 aa, Homo Sapiens
DLWIDTKKP

SEQ ID NO: 586027 - protein, 9 aa, Homo Sapiens
VGDFVRLRR

SEQ ID NO: 586028 - protein, 9 aa, Homo Sapiens
RISVERVPQ

SEQ ID NO: 586029 - protein, 9 aa, Homo Sapiens
RSSGPLRTL

SEQ ID NO: 586030 - protein, 9 aa, Homo Sapiens
VPGVFSRSV

SEQ ID NO: 586031 - protein, 9 aa, Homo Sapiens
LARRGYYSG

SEQ ID NO: 586032 - protein, 9 aa, Homo Sapiens
PFQAPGRTI

SEQ ID NO: 586033 - protein, 9 aa, Homo Sapiens
HTSPLYDRL

SEQ ID NO: 586034 - protein, 9 aa, Homo Sapiens
DPYCRHVIP

SEQ ID NO: 586035 - protein, 9 aa, Homo Sapiens
TCTRGGTRR

SEQ ID NO: 586036 - protein, 9 aa, Homo Sapiens
NRHSAAPED

SEQ ID NO: 586037 - protein, 9 aa, Homo Sapiens
QSPLILCYL

SEQ ID NO: 586038 - protein, 9 aa, Homo Sapiens
RTSENHPDT

SEQ ID NO: 586039 - protein, 9 aa, Homo Sapiens
RALRAAHLP

SEQ ID NO: 586040 - protein, 9 aa, Homo Sapiens
QSPINIITT

SEQ ID NO: 586041 - protein, 9 aa, Homo Sapiens
VHCSDCWDR

SEQ ID NO: 586042 - protein, 9 aa, Homo Sapiens
LILAATAGR

SEQ ID NO: 586043 - protein, 9 aa, Homo Sapiens
YLSLFLELS

SEQ ID NO: 586044 - protein, 9 aa, Homo Sapiens
GSFPGSPRT

SEQ ID NO: 586045 - protein, 9 aa, Homo Sapiens
TILEMRSVS

SEQ ID NO: 586046 - protein, 9 aa, Homo Sapiens
QSIGSVTSG

SEQ ID NO: 586047 - protein, 9 aa, Homo Sapiens
NGLQEGYGV

SEQ ID NO: 586048 - protein, 9 aa, Homo Sapiens
NQEPEGKVD

SEQ ID NO: 586049 - protein, 9 aa, Homo Sapiens
NRFKEDSSL

SEQ ID NO: 586050 - protein, 9 aa, Homo Sapiens
ARRGYYSGT

SEQ ID NO: 586051 - protein, 9 aa, Homo Sapiens
NILIDKVKD

SEQ ID NO: 586052 - protein, 9 aa, Homo Sapiens
RKVSFLRRK

SEQ ID NO: 586053 - protein, 9 aa, Homo Sapiens
LENSSQSGR

SEQ ID NO: 586054 - protein, 9 aa, Homo Sapiens
WQDNVHLVT

SEQ ID NO: 586055 - protein, 9 aa, Homo Sapiens
YDSDFFTSY

SEQ ID NO: 586056 - protein, 9 aa, Homo Sapiens
LREEVPGVF

SEQ ID NO: 586057 - protein, 9 aa, Homo Sapiens
SKQSIGSVT

SEQ ID NO: 586058 - protein, 9 aa, Homo Sapiens
GKAEVILGN

SEQ ID NO: 586059 - protein, 9 aa, Homo Sapiens
VSFLRRKDV

SEQ ID NO: 586060 - protein, 9 aa, Homo Sapiens
AEGHADPDA

SEQ ID NO: 586061 - protein, 9 aa, Homo Sapiens
VRGYYLSLF

SEQ ID NO: 586062 - protein, 9 aa, Homo Sapiens
SAAPEDHCR

SEQ ID NO: 586063 - protein, 9 aa, Homo Sapiens
SQSLYIDSF

SEQ ID NO: 586064 - protein, 9 aa, Homo Sapiens
TRWCSPTSL

SEQ ID NO: 586065 - protein, 9 aa, Homo Sapiens
RSGAINSKQ

SEQ ID NO: 586066 - protein, 9 aa, Homo Sapiens
NTDKADTGK

SEQ ID NO: 586067 - protein, 9 aa, Homo Sapiens
VDDSADFVR

SEQ ID NO: 586068 - protein, 9 aa, Homo Sapiens
LRAAHLPRY

SEQ ID NO: 586069 - protein, 9 aa, Homo Sapiens
EEEQIDFQK

SEQ ID NO: 586070 - protein, 9 aa, Homo Sapiens
TRNGRCIIL

SEQ ID NO: 586071 - protein, 9 aa, Homo Sapiens
VNRFKEDSS

SEQ ID NO: 586072 - protein, 9 aa, Homo Sapiens
LHTSPLYDR

SEQ ID NO: 586073 - protein, 9 aa, Homo Sapiens
SPINIITTK

SEQ ID NO: 586074 - protein, 9 aa, Homo Sapiens
ITAGFAPVV

SEQ ID NO: 586075 - protein, 9 aa, Homo Sapiens
GADLIFTCG

SEQ ID NO: 586076 - protein, 9 aa, Homo Sapiens
IPAIKDVIG

SEQ ID NO: 586077 - protein, 9 aa, Homo Sapiens
YQSRYHFCE

SEQ ID NO: 586078 - protein, 9 aa, Homo Sapiens
AKVPVVPKK

SEQ ID NO: 586079 - protein, 9 aa, Homo Sapiens
LRTLTCLHV

SEQ ID NO: 586080 - protein, 9 aa, Homo Sapiens
ESPDAEDYF

SEQ ID NO: 586081 - protein, 9 aa, Homo Sapiens
APFQAPGRT

SEQ ID NO: 586082 - protein, 9 aa, Homo Sapiens
AVAAAADYA

SEQ ID NO: 586083 - protein, 9 aa, Homo Sapiens
AEGPCLMRE

SEQ ID NO: 586084 - protein, 9 aa, Homo Sapiens
VVVHAALYD

SEQ ID NO: 586085 - protein, 9 aa, Homo Sapiens
IVKVMKEEM

SEQ ID NO: 586086 - protein, 9 aa, Homo Sapiens
CSPTSLEGE

SEQ ID NO: 586087 - protein, 9 aa, Homo Sapiens
LKKKDEFQE

SEQ ID NO: 586088 - protein, 9 aa, Homo Sapiens
SYQSRYHFC

SEQ ID NO: 586089 - protein, 9 aa, Homo Sapiens
KFLIFLLPL

SEQ ID NO: 586090 - protein, 9 aa, Homo Sapiens
PACRLVSRS

SEQ ID NO: 586091 - protein, 9 aa, Homo Sapiens
ISSGQHYWE

SEQ ID NO: 586092 - protein, 9 aa, Homo Sapiens
ECRRVPPPW

SEQ ID NO: 586093 - protein, 9 aa, Homo Sapiens
PSNVEDPFG

SEQ ID NO: 586094 - protein, 9 aa, Homo Sapiens
QLDWIVNRF

SEQ ID NO: 586095 - protein, 9 aa, Homo Sapiens
TCGETEKPE

SEQ ID NO: 586096 - protein, 9 aa, Homo Sapiens
SCCPTCTRG

SEQ ID NO: 586097 - protein, 9 aa, Homo Sapiens
PGSPRTSEN

SEQ ID NO: 586098 - protein, 9 aa, Homo Sapiens
HTNSFAAGC

SEQ ID NO: 586099 - protein, 9 aa, Homo Sapiens
SFICLKRLR

SEQ ID NO: 586100 - protein, 9 aa, Homo Sapiens
SPLILCYLK

SEQ ID NO: 586101 - protein, 9 aa, Homo Sapiens
INKLEELND

SEQ ID NO: 586102 - protein, 9 aa, Homo Sapiens
LLWHGFAKF

SEQ ID NO: 586103 - protein, 9 aa, Homo Sapiens
KEIQGLPVT

SEQ ID NO: 586104 - protein, 9 aa, Homo Sapiens
VILGNIIKK

SEQ ID NO: 586105 - protein, 9 aa, Homo Sapiens
PVSVSSDLW

SEQ ID NO: 586106 - protein, 9 aa, Homo Sapiens
EPEGKVDSP

SEQ ID NO: 586107 - protein, 9 aa, Homo Sapiens
VTVLLVDNV

SEQ ID NO: 586108 - protein, 9 aa, Homo Sapiens
AAIDAVHNK

SEQ ID NO: 586109 - protein, 9 aa, Homo Sapiens
MEAPFQAPG

SEQ ID NO: 586110 - protein, 9 aa, Homo Sapiens
SLYIDSFDE

SEQ ID NO: 586111 - protein, 9 aa, Homo Sapiens
PSNDKWDGD

SEQ ID NO: 586112 - protein, 9 aa, Homo Sapiens
DFVRLRRNE

SEQ ID NO: 586113 - protein, 9 aa, Homo Sapiens
AYYSYQSRY

SEQ ID NO: 586114 - protein, 9 aa, Homo Sapiens
AILKKVKDS

SEQ ID NO: 586115 - protein, 9 aa, Homo Sapiens
AATAGRVGV

SEQ ID NO: 586116 - protein, 9 aa, Homo Sapiens
PDLWIDTKK

SEQ ID NO: 586117 - protein, 9 aa, Homo Sapiens
IIFFGKFVI

SEQ ID NO: 586118 - protein, 9 aa, Homo Sapiens
ARYLLLSKQ

SEQ ID NO: 586119 - protein, 9 aa, Homo Sapiens
INIITTKAK

SEQ ID NO: 586120 - protein, 9 aa, Homo Sapiens
KQWLSYNIS

SEQ ID NO: 586121 - protein, 9 aa, Homo Sapiens
HFKSHVYCF

SEQ ID NO: 586122 - protein, 9 aa, Homo Sapiens
FEGRYQETP

SEQ ID NO: 586123 - protein, 9 aa, Homo Sapiens
STGSVQEQL

SEQ ID NO: 586124 - protein, 9 aa, Homo Sapiens
VPNILIDKV

SEQ ID NO: 586125 - protein, 9 aa, Homo Sapiens
MMSAPTCLA

SEQ ID NO: 586126 - protein, 9 aa, Homo Sapiens
HLDKTLRKE

SEQ ID NO: 586127 - protein, 9 aa, Homo Sapiens
PHTNSFAAG

SEQ ID NO: 586128 - protein, 9 aa, Homo Sapiens
KSHVYCFRA

SEQ ID NO: 586129 - protein, 9 aa, Homo Sapiens
QNSCNRVPN

SEQ ID NO: 586130 - protein, 9 aa, Homo Sapiens
SGLYLQQMP

SEQ ID NO: 586131 - protein, 9 aa, Homo Sapiens
LYILDGSGY

SEQ ID NO: 586132 - protein, 9 aa, Homo Sapiens
MQMEAIHLD

SEQ ID NO: 586133 - protein, 9 aa, Homo Sapiens
CESPDAEDY

SEQ ID NO: 586134 - protein, 9 aa, Homo Sapiens
FVRFFPAFV

SEQ ID NO: 586135 - protein, 9 aa, Homo Sapiens
GGTRRHSWR

SEQ ID NO: 586136 - protein, 9 aa, Homo Sapiens
VLLVDNVGP

SEQ ID NO: 586137 - protein, 9 aa, Homo Sapiens
DDDDDDDHD

SEQ ID NO: 586138 - protein, 9 aa, Homo Sapiens
YVLPLNTDK

SEQ ID NO: 586139 - protein, 9 aa, Homo Sapiens
PQGDKSQSP

SEQ ID NO: 586140 - protein, 9 aa, Homo Sapiens
KGKLRETRG

SEQ ID NO: 586141 - protein, 9 aa, Homo Sapiens
GWRSTLRRR

SEQ ID NO: 586142 - protein, 9 aa, Homo Sapiens
HADPDAELQ

SEQ ID NO: 586143 - protein, 9 aa, Homo Sapiens
RYVLPLNTD

SEQ ID NO: 586144 - protein, 9 aa, Homo Sapiens
VLSGANPRS

SEQ ID NO: 586145 - protein, 9 aa, Homo Sapiens
ALVDGRVTA

SEQ ID NO: 586146 - protein, 9 aa, Homo Sapiens
LWIDTKKPF

SEQ ID NO: 586147 - protein, 9 aa, Homo Sapiens
RQLHTSPLY

SEQ ID NO: 586148 - protein, 9 aa, Homo Sapiens
LAEGHADPD

SEQ ID NO: 586149 - protein, 9 aa, Homo Sapiens
MREVAQLRA

SEQ ID NO: 586150 - protein, 9 aa, Homo Sapiens
DRYRLDCNL

SEQ ID NO: 586151 - protein, 9 aa, Homo Sapiens
YCRHVIPMN

SEQ ID NO: 586152 - protein, 9 aa, Homo Sapiens
EQRISVERV

SEQ ID NO: 586153 - protein, 9 aa, Homo Sapiens
YLDIDGINV

SEQ ID NO: 586154 - protein, 9 aa, Homo Sapiens
REEVPGVFS

SEQ ID NO: 586155 - protein, 9 aa, Homo Sapiens
KKVKDSWKT

SEQ ID NO: 586156 - protein, 9 aa, Homo Sapiens
LILCYLKMH

SEQ ID NO: 586157 - protein, 9 aa, Homo Sapiens
ALRAAHLPR

SEQ ID NO: 586158 - protein, 9 aa, Homo Sapiens
SLTVKDLLL

SEQ ID NO: 586159 - protein, 9 aa, Homo Sapiens
AIKDVIGKA

SEQ ID NO: 586160 - protein, 9 aa, Homo Sapiens
SPRCSLTVK

SEQ ID NO: 586161 - protein, 9 aa, Homo Sapiens
ELARRGYYS

SEQ ID NO: 586162 - protein, 9 aa, Homo Sapiens
QRLQAAVEH

SEQ ID NO: 586163 - protein, 9 aa, Homo Sapiens
FRYQVHQGV

SEQ ID NO: 586164 - protein, 9 aa, Homo Sapiens
IVIIFFGKF

SEQ ID NO: 586165 - protein, 9 aa, Homo Sapiens
PRRNIHSGF

SEQ ID NO: 586166 - protein, 9 aa, Homo Sapiens
EGPCLMREV

SEQ ID NO: 586167 - protein, 9 aa, Homo Sapiens
SQCISSGQH

SEQ ID NO: 586168 - protein, 9 aa, Homo Sapiens
SNVEDPFGE

SEQ ID NO: 586169 - protein, 9 aa, Homo Sapiens
LFVYIPTAI

SEQ ID NO: 586170 - protein, 9 aa, Homo Sapiens
LALLYFEIF

SEQ ID NO: 586171 - protein, 9 aa, Homo Sapiens
QIDFQKGDF

SEQ ID NO: 586172 - protein, 9 aa, Homo Sapiens
SCNRVPNIL

SEQ ID NO: 586173 - protein, 9 aa, Homo Sapiens
SDFIPLGIF

SEQ ID NO: 586174 - protein, 9 aa, Homo Sapiens
CRLVSRSRN

SEQ ID NO: 586175 - protein, 9 aa, Homo Sapiens
LYDSDFFTS

SEQ ID NO: 586176 - protein, 9 aa, Homo Sapiens
PAIKDVIGK

SEQ ID NO: 586177 - protein, 9 aa, Homo Sapiens
RGYYLSLFL

SEQ ID NO: 586178 - protein, 9 aa, Homo Sapiens
YFEGRYQET

SEQ ID NO: 586179 - protein, 9 aa, Homo Sapiens
ADIHTLILY

SEQ ID NO: 586180 - protein, 9 aa, Homo Sapiens
FVRLRRNEI

SEQ ID NO: 586181 - protein, 9 aa, Homo Sapiens
DNVHLVTKV

SEQ ID NO: 586182 - protein, 9 aa, Homo Sapiens
YGYSLFVYI

SEQ ID NO: 586183 - protein, 9 aa, Homo Sapiens
SLFVYIPTA

SEQ ID NO: 586184 - protein, 9 aa, Homo Sapiens
TVLLVDNVG

SEQ ID NO: 586185 - protein, 9 aa, Homo Sapiens
ADFVRFFPA

SEQ ID NO: 586186 - protein, 9 aa, Homo Sapiens
PYCRHVIPM

SEQ ID NO: 586187 - protein, 9 aa, Homo Sapiens
MITAGFAPV

SEQ ID NO: 586188 - protein, 9 aa, Homo Sapiens
LAATAGRVG

SEQ ID NO: 586189 - protein, 9 aa, Homo Sapiens
VEHVEAVNA

SEQ ID NO: 586190 - protein, 9 aa, Homo Sapiens
FIRQKRSGA

SEQ ID NO: 586191 - protein, 9 aa, Homo Sapiens
FQTGRQLHT

SEQ ID NO: 586192 - protein, 9 aa, Homo Sapiens
QPSNVEDPF

SEQ ID NO: 586193 - protein, 9 aa, Homo Sapiens
QMEAIHLDK

SEQ ID NO: 586194 - protein, 9 aa, Homo Sapiens
FFLAISIVG

SEQ ID NO: 586195 - protein, 9 aa, Homo Sapiens
VIIFFGKFV

SEQ ID NO: 586196 - protein, 9 aa, Homo Sapiens
VKDSWKTTE

SEQ ID NO: 586197 - protein, 9 aa, Homo Sapiens
AKPLYLHRK

SEQ ID NO: 586198 - protein, 9 aa, Homo Sapiens
SCVTAVLLF

SEQ ID NO: 586199 - protein, 9 aa, Homo Sapiens
RREQEEREQ

SEQ ID NO: 586200 - protein, 9 aa, Homo Sapiens
RLPETPEHS

SEQ ID NO: 586201 - protein, 9 aa, Homo Sapiens
DSFGHPACR

SEQ ID NO: 586202 - protein, 9 aa, Homo Sapiens
FKSCVTAVL

SEQ ID NO: 586203 - protein, 9 aa, Homo Sapiens
SATPDCDPD

SEQ ID NO: 586204 - protein, 9 aa, Homo Sapiens
IDFQKGDFF

SEQ ID NO: 586205 - protein, 9 aa, Homo Sapiens
PRTSENHPD

SEQ ID NO: 586206 - protein, 9 aa, Homo Sapiens
VIALVDGRV

SEQ ID NO: 586207 - protein, 9 aa, Homo Sapiens
TKKPFSLKA

SEQ ID NO: 586208 - protein, 9 aa, Homo Sapiens
ENDPYCRHV

SEQ ID NO: 586209 - protein, 9 aa, Homo Sapiens
GRVTAFQGD

SEQ ID NO: 586210 - protein, 9 aa, Homo Sapiens
KLKAKLDSD

SEQ ID NO: 586211 - protein, 9 aa, Homo Sapiens
DSLYYVDRI

SEQ ID NO: 586212 - protein, 9 aa, Homo Sapiens
PWAPGRCEN

SEQ ID NO: 586213 - protein, 9 aa, Homo Sapiens
PLGIFNHSP

SEQ ID NO: 586214 - protein, 9 aa, Homo Sapiens
GYLDIDGIN

SEQ ID NO: 586215 - protein, 9 aa, Homo Sapiens
LHFKSHVYC

SEQ ID NO: 586216 - protein, 9 aa, Homo Sapiens
DWIVNRFKE

SEQ ID NO: 586217 - protein, 9 aa, Homo Sapiens
KGDFFKDPL

SEQ ID NO: 586218 - protein, 9 aa, Homo Sapiens
FQPSKQSIG

SEQ ID NO: 586219 - protein, 9 aa, Homo Sapiens
HNKKNTPLH

SEQ ID NO: 586220 - protein, 9 aa, Homo Sapiens
RETRGALRE

SEQ ID NO: 586221 - protein, 9 aa, Homo Sapiens
LFFKSCVTA

SEQ ID NO: 586222 - protein, 9 aa, Homo Sapiens
KLDTMFRYQ

SEQ ID NO: 586223 - protein, 9 aa, Homo Sapiens
NDRYRLDCN

SEQ ID NO: 586224 - protein, 9 aa, Homo Sapiens
IRQKRSGAI

SEQ ID NO: 586225 - protein, 9 aa, Homo Sapiens
GPCLMREVA

SEQ ID NO: 586226 - protein, 9 aa, Homo Sapiens
AAGCVVNGG

SEQ ID NO: 586227 - protein, 9 aa, Homo Sapiens
RRYVLPLNT

SEQ ID NO: 586228 - protein, 9 aa, Homo Sapiens
HAALYDSDF

SEQ ID NO: 586229 - protein, 9 aa, Homo Sapiens
GTQDTRWCS

SEQ ID NO: 586230 - protein, 9 aa, Homo Sapiens
YYVDRIPEN

SEQ ID NO: 586231 - protein, 9 aa, Homo Sapiens
LRCQPSNVE

SEQ ID NO: 586232 - protein, 9 aa, Homo Sapiens
DYAGLKVAR

SEQ ID NO: 586233 - protein, 9 aa, Homo Sapiens
SGTKFHRII

SEQ ID NO: 586234 - protein, 9 aa, Homo Sapiens
REQEEREQQ

SEQ ID NO: 586235 - protein, 9 aa, Homo Sapiens
KDSWKTTEF

SEQ ID NO: 586236 - protein, 9 aa, Homo Sapiens
LDIDGINVT

SEQ ID NO: 586237 - protein, 9 aa, Homo Sapiens
RVGVVEILL

SEQ ID NO: 586238 - protein, 9 aa, Homo Sapiens
LRRNEIFPA

SEQ ID NO: 586239 - protein, 9 aa, Homo Sapiens
LQEGYGVET

SEQ ID NO: 586240 - protein, 9 aa, Homo Sapiens
YSGTKFHRI

SEQ ID NO: 586241 - protein, 9 aa, Homo Sapiens
DTMFRYQVH

SEQ ID NO: 586242 - protein, 9 aa, Homo Sapiens
HCRAPPHLA

SEQ ID NO: 586243 - protein, 9 aa, Homo Sapiens
IDAVHNKKN

SEQ ID NO: 586244 - protein, 9 aa, Homo Sapiens
YYLSLFLEL

SEQ ID NO: 586245 - protein, 9 aa, Homo Sapiens
AIHLDKTLR

SEQ ID NO: 586246 - protein, 9 aa, Homo Sapiens
EQEEREQQL

SEQ ID NO: 586247 - protein, 9 aa, Homo Sapiens
FFGKFVILA

SEQ ID NO: 586248 - protein, 9 aa, Homo Sapiens
ICLKRLRIG

SEQ ID NO: 586249 - protein, 9 aa, Homo Sapiens
SGANPRSGL

SEQ ID NO: 586250 - protein, 9 aa, Homo Sapiens
SGNAKPLYL

SEQ ID NO: 586251 - protein, 9 aa, Homo Sapiens
ADLIFTCGE

SEQ ID NO: 586252 - protein, 9 aa, Homo Sapiens
RRKDVLGDS

SEQ ID NO: 586253 - protein, 9 aa, Homo Sapiens
LLAEGHADP

SEQ ID NO: 586254 - protein, 9 aa, Homo Sapiens
RAAIDAVHN

SEQ ID NO: 586255 - protein, 9 aa, Homo Sapiens
RCQPSNVED

SEQ ID NO: 586256 - protein, 9 aa, Homo Sapiens
PSKQSIGSV

SEQ ID NO: 586257 - protein, 9 aa, Homo Sapiens
ETENNKSLR

SEQ ID NO: 586258 - protein, 9 aa, Homo Sapiens
ELNDRYRLD

SEQ ID NO: 586259 - protein, 9 aa, Homo Sapiens
CRRVPPPWA

SEQ ID NO: 586260 - protein, 9 aa, Homo Sapiens
PKRPIPAIK

SEQ ID NO: 586261 - protein, 9 aa, Homo Sapiens
KVKDSWKTT

SEQ ID NO: 586262 - protein, 9 aa, Homo Sapiens
EDYFEHSPL

SEQ ID NO: 586263 - protein, 9 aa, Homo Sapiens
SNDKWDGDV

SEQ ID NO: 586264 - protein, 9 aa, Homo Sapiens
GRYQETPVY

SEQ ID NO: 586265 - protein, 9 aa, Homo Sapiens
YSLFVYIPT

SEQ ID NO: 586266 - protein, 9 aa, Homo Sapiens
TGKLTEGMQ

SEQ ID NO: 586267 - protein, 9 aa, Homo Sapiens
SGAINSKQL

SEQ ID NO: 586268 - protein, 9 aa, Homo Sapiens
SHRNRHSAA

SEQ ID NO: 586269 - protein, 9 aa, Homo Sapiens
DGYLQHLQK

SEQ ID NO: 586270 - protein, 9 aa, Homo Sapiens
MATFHTDGY

SEQ ID NO: 586271 - protein, 9 aa, Homo Sapiens
YLKKKDEFQ

SEQ ID NO: 586272 - protein, 9 aa, Homo Sapiens
WAPGRCENS

SEQ ID NO: 586273 - protein, 9 aa, Homo Sapiens
NIITTKAKV

SEQ ID NO: 586274 - protein, 9 aa, Homo Sapiens
QLHTSPLYD

SEQ ID NO: 586275 - protein, 9 aa, Homo Sapiens
TPVSVSSDL

SEQ ID NO: 586276 - protein, 9 aa, Homo Sapiens
RAAHLPRYQ

SEQ ID NO: 586277 - protein, 9 aa, Homo Sapiens
LDDEILYIL

SEQ ID NO: 586278 - protein, 9 aa, Homo Sapiens
LVDNVGPKV

SEQ ID NO: 586279 - protein, 9 aa, Homo Sapiens
PPQGDKSQS

SEQ ID NO: 586280 - protein, 9 aa, Homo Sapiens
DGDVSGSKR

SEQ ID NO: 586281 - protein, 9 aa, Homo Sapiens
WDGDVSGSK

SEQ ID NO: 586282 - protein, 9 aa, Homo Sapiens
TRLLILAHM

SEQ ID NO: 586283 - protein, 9 aa, Homo Sapiens
LILYKNQII

SEQ ID NO: 586284 - protein, 9 aa, Homo Sapiens
IDTKKPFSL

SEQ ID NO: 586285 - protein, 9 aa, Homo Sapiens
FAPVVIENV

SEQ ID NO: 586286 - protein, 9 aa, Homo Sapiens
RNQEPEGKV

SEQ ID NO: 586287 - protein, 9 aa, Homo Sapiens
TEGMQVLEW

SEQ ID NO: 586288 - protein, 9 aa, Homo Sapiens
AFYLKQWLS

SEQ ID NO: 586289 - protein, 9 aa, Homo Sapiens
RRQKLDTMF

SEQ ID NO: 586290 - protein, 9 aa, Homo Sapiens
LHLDDEILY

SEQ ID NO: 586291 - protein, 9 aa, Homo Sapiens
AHMIDVMCL

SEQ ID NO: 586292 - protein, 9 aa, Homo Sapiens
DFQPSKQSI

SEQ ID NO: 586293 - protein, 9 aa, Homo Sapiens
LLILAHMID

SEQ ID NO: 586294 - protein, 9 aa, Homo Sapiens
GSQCISSGQ

SEQ ID NO: 586295 - protein, 9 aa, Homo Sapiens
FDSLYYVDR

SEQ ID NO: 586296 - protein, 9 aa, Homo Sapiens
RRGYYSGTK

SEQ ID NO: 586297 - protein, 9 aa, Homo Sapiens
CPHTNSFAA

SEQ ID NO: 586298 - protein, 9 aa, Homo Sapiens
CSLTVKDLL

SEQ ID NO: 586299 - protein, 9 aa, Homo Sapiens
MTQCYFEGR

SEQ ID NO: 586300 - protein, 9 aa, Homo Sapiens
MDADPSVHD

SEQ ID NO: 586301 - protein, 9 aa, Homo Sapiens
SLYYVDRIP

SEQ ID NO: 586302 - protein, 9 aa, Homo Sapiens
NRVPNILID

SEQ ID NO: 586303 - protein, 9 aa, Homo Sapiens
KDEFQEGKQ

SEQ ID NO: 586304 - protein, 9 aa, Homo Sapiens
HSAAPEDHC

SEQ ID NO: 586305 - protein, 9 aa, Homo Sapiens
RFFPAFVWT

SEQ ID NO: 586306 - protein, 9 aa, Homo Sapiens
GHPACRLVS

SEQ ID NO: 586307 - protein, 9 aa, Homo Sapiens
PPPQGDKSQ

SEQ ID NO: 586308 - protein, 9 aa, Homo Sapiens
SMMSAPTCL

SEQ ID NO: 586309 - protein, 9 aa, Homo Sapiens
NSSQSGRLP

SEQ ID NO: 586310 - protein, 9 aa, Homo Sapiens
DACARYLLL

SEQ ID NO: 586311 - protein, 9 aa, Homo Sapiens
DTKKPFSLK

SEQ ID NO: 586312 - protein, 9 aa, Homo Sapiens
QAPGRTITV

SEQ ID NO: 586313 - protein, 9 aa, Homo Sapiens
WSNGLQEGY

SEQ ID NO: 586314 - protein, 9 aa, Homo Sapiens
KLTEGMQVL

SEQ ID NO: 586315 - protein, 9 aa, Homo Sapiens
EAPPAKVPV

SEQ ID NO: 586316 - protein, 9 aa, Homo Sapiens
RNIHSGFWI

SEQ ID NO: 586317 - protein, 9 aa, Homo Sapiens
EIVIIFFGK

SEQ ID NO: 586318 - protein, 9 aa, Homo Sapiens
WRSTLRRRG

SEQ ID NO: 586319 - protein, 9 aa, Homo Sapiens
APEDHCRRS

SEQ ID NO: 586320 - protein, 9 aa, Homo Sapiens
KRPIPAIKD

SEQ ID NO: 586321 - protein, 9 aa, Homo Sapiens
ALQQHCRAP

SEQ ID NO: 586322 - protein, 9 aa, Homo Sapiens
LLSKQPSQA

SEQ ID NO: 586323 - protein, 9 aa, Homo Sapiens
EREQQLRRE

SEQ ID NO: 586324 - protein, 9 aa, Homo Sapiens
HRNRHSAAP

SEQ ID NO: 586325 - protein, 9 aa, Homo Sapiens
WLSYNISIW

SEQ ID NO: 586326 - protein, 9 aa, Homo Sapiens
KEKPLPRRN

SEQ ID NO: 586327 - protein, 9 aa, Homo Sapiens
PRCSLTVKD

SEQ ID NO: 586328 - protein, 9 aa, Homo Sapiens
EELNDRYRL

SEQ ID NO: 586329 - protein, 9 aa, Homo Sapiens
KLRETRGAL

SEQ ID NO: 586330 - protein, 9 aa, Homo Sapiens
FAKFLIFLL

SEQ ID NO: 586331 - protein, 9 aa, Homo Sapiens
STLRRRGPG

SEQ ID NO: 586332 - protein, 9 aa, Homo Sapiens
VHDSFEQAP

SEQ ID NO: 586333 - protein, 9 aa, Homo Sapiens
DMFFLAISI

SEQ ID NO: 586334 - protein, 9 aa, Homo Sapiens
VTRNGRCII

SEQ ID NO: 586335 - protein, 9 aa, Homo Sapiens
TGSVQEQLP

SEQ ID NO: 586336 - protein, 9 aa, Homo Sapiens
AAPEDHCRR

SEQ ID NO: 586337 - protein, 9 aa, Homo Sapiens
DQLDWIVNR

SEQ ID NO: 586338 - protein, 9 aa, Homo Sapiens
LMREVAQLR

SEQ ID NO: 586339 - protein, 9 aa, Homo Sapiens
KVPVVPKKP

SEQ ID NO: 586340 - protein, 9 aa, Homo Sapiens
APTPVSVSS

SEQ ID NO: 586341 - protein, 9 aa, Homo Sapiens
ENNKSLRSL

SEQ ID NO: 586342 - protein, 9 aa, Homo Sapiens
SFAAGCVVN

SEQ ID NO: 586343 - protein, 9 aa, Homo Sapiens
QKLDTMFRY

SEQ ID NO: 586344 - protein, 9 aa, Homo Sapiens
QAAVEHVEA

SEQ ID NO: 586345 - protein, 9 aa, Homo Sapiens
KLDSDTVKS

SEQ ID NO: 586346 - protein, 9 aa, Homo Sapiens
SMITAGFAP

SEQ ID NO: 586347 - protein, 9 aa, Homo Sapiens
HLPRYQYLR

SEQ ID NO: 586348 - protein, 9 aa, Homo Sapiens
EMDADPSVH

SEQ ID NO: 586349 - protein, 9 aa, Homo Sapiens
DLSPRCSLT

SEQ ID NO: 586350 - protein, 9 aa, Homo Sapiens
PTCTRGGTR

SEQ ID NO: 586351 - protein, 9 aa, Homo Sapiens
ILGNIIKKK

SEQ ID NO: 586352 - protein, 9 aa, Homo Sapiens
DDDDDHDDD

SEQ ID NO: 586353 - protein, 9 aa, Homo Sapiens
SDLWGDFST

SEQ ID NO: 586354 - protein, 9 aa, Homo Sapiens
ILEMRSVSG

SEQ ID NO: 586355 - protein, 9 aa, Homo Sapiens
HPACRLVSR

SEQ ID NO: 586356 - protein, 9 aa, Homo Sapiens
LLEKEIQGL

SEQ ID NO: 586357 - protein, 9 aa, Homo Sapiens
TLILYKNQI

SEQ ID NO: 586358 - protein, 9 aa, Homo Sapiens
AVHNKKNTP

SEQ ID NO: 586359 - protein, 9 aa, Homo Sapiens
FLAISIVGT

SEQ ID NO: 586360 - protein, 9 aa, Homo Sapiens
KSCVTAVLL

SEQ ID NO: 586361 - protein, 9 aa, Homo Sapiens
VLGSKLQHI

SEQ ID NO: 586362 - protein, 9 aa, Homo Sapiens
VVHAALYDS

SEQ ID NO: 586363 - protein, 9 aa, Homo Sapiens
SSDLWGDFS

SEQ ID NO: 586364 - protein, 9 aa, Homo Sapiens
RGYYSGTKF

SEQ ID NO: 586365 - protein, 9 aa, Homo Sapiens
KQSIGSVTS

SEQ ID NO: 586366 - protein, 9 aa, Homo Sapiens
GRQLHTSPL

SEQ ID NO: 586367 - protein, 9 aa, Homo Sapiens
NKALENDPY

SEQ ID NO: 586368 - protein, 9 aa, Homo Sapiens
VYCFRAESE

SEQ ID NO: 586369 - protein, 9 aa, Homo Sapiens
PINIITTKA

SEQ ID NO: 586370 - protein, 9 aa, Homo Sapiens
GNAKPLYLH

SEQ ID NO: 586371 - protein, 9 aa, Homo Sapiens
SGWRSTLRR

SEQ ID NO: 586372 - protein, 9 aa, Homo Sapiens
PPWAPGRCE

SEQ ID NO: 586373 - protein, 9 aa, Homo Sapiens
ATAGRVGVV

SEQ ID NO: 586374 - protein, 9 aa, Homo Sapiens
SRAWQDNVH

SEQ ID NO: 586375 - protein, 9 aa, Homo Sapiens
CQAEGPCLM

SEQ ID NO: 586376 - protein, 9 aa, Homo Sapiens
AVEHVEAVN

SEQ ID NO: 586377 - protein, 9 aa, Homo Sapiens
AALYDSDFF

SEQ ID NO: 586378 - protein, 9 aa, Homo Sapiens
SVMEAPFQA

SEQ ID NO: 586379 - protein, 9 aa, Homo Sapiens
QLAKDLALL

SEQ ID NO: 586380 - protein, 9 aa, Homo Sapiens
FAAGCVVNG

SEQ ID NO: 586381 - protein, 9 aa, Homo Sapiens
LKRLRIGSY

SEQ ID NO: 586382 - protein, 9 aa, Homo Sapiens
DEFQEGKQQ

SEQ ID NO: 586383 - protein, 9 aa, Homo Sapiens
RGGTRRHSW

SEQ ID NO: 586384 - protein, 9 aa, Homo Sapiens
GCESPDAED

SEQ ID NO: 586385 - protein, 9 aa, Homo Sapiens
FFKSCVTAV

SEQ ID NO: 586386 - protein, 9 aa, Homo Sapiens
VQVQVTVLL

SEQ ID NO: 586387 - protein, 9 aa, Homo Sapiens
GRVGVVEIL

SEQ ID NO: 586388 - protein, 9 aa, Homo Sapiens
DSADFVRFF

SEQ ID NO: 586389 - protein, 9 aa, Homo Sapiens
DTRWCSPTS

SEQ ID NO: 586390 - protein, 9 aa, Homo Sapiens
EVILGNIIK

SEQ ID NO: 586391 - protein, 9 aa, Homo Sapiens
PSVHDSFEQ

SEQ ID NO: 586392 - protein, 9 aa, Homo Sapiens
RYLLLSKQP

SEQ ID NO: 586393 - protein, 9 aa, Homo Sapiens
CTRGGTRRH

SEQ ID NO: 586394 - protein, 9 aa, Homo Sapiens
PPPWAPGRC

SEQ ID NO: 586395 - protein, 9 aa, Homo Sapiens
LKAKLDSDT

SEQ ID NO: 586396 - protein, 9 aa, Homo Sapiens
LETENNKSL

SEQ ID NO: 586397 - protein, 9 aa, Homo Sapiens
GAFYLKQWL

SEQ ID NO: 586398 - protein, 9 aa, Homo Sapiens
LQLAKDLAL

SEQ ID NO: 586399 - protein, 9 aa, Homo Sapiens
ERALRAAHL

SEQ ID NO: 586400 - protein, 9 aa, Homo Sapiens
NGRCIILTA

SEQ ID NO: 586401 - protein, 9 aa, Homo Sapiens
AKFLIFLLP

SEQ ID NO: 586402 - protein, 9 aa, Homo Sapiens
EQIDFQKGD

SEQ ID NO: 586403 - protein, 9 aa, Homo Sapiens
AWQDNVHLV

SEQ ID NO: 586404 - protein, 9 aa, Homo Sapiens
DIDGINVTE

SEQ ID NO: 586405 - protein, 9 aa, Homo Sapiens
QAVAAAADY

SEQ ID NO: 586406 - protein, 9 aa, Homo Sapiens
FHTDGYLQH

SEQ ID NO: 586407 - protein, 9 aa, Homo Sapiens
HMIDVMCLL

SEQ ID NO: 586408 - protein, 9 aa, Homo Sapiens
ADPSVHDSF

SEQ ID NO: 586409 - protein, 9 aa, Homo Sapiens
MFERLSTGS

SEQ ID NO: 586410 - protein, 9 aa, Homo Sapiens
QRVLGSKLQ

SEQ ID NO: 586411 - protein, 9 aa, Homo Sapiens
ADPDAELQR

SEQ ID NO: 586412 - protein, 9 aa, Homo Sapiens
VQVTVLLVD

SEQ ID NO: 586413 - protein, 9 aa, Homo Sapiens
KSVTRNGRC

SEQ ID NO: 586414 - protein, 9 aa, Homo Sapiens
RIEYVHYPG

SEQ ID NO: 586415 - protein, 9 aa, Homo Sapiens
LYKNQIIKL

SEQ ID NO: 586416 - protein, 9 aa, Homo Sapiens
ILCYLKMHE

SEQ ID NO: 586417 - protein, 9 aa, Homo Sapiens
GLRCQPSNV

SEQ ID NO: 586418 - protein, 9 aa, Homo Sapiens
CNRVPNILI

SEQ ID NO: 586419 - protein, 9 aa, Homo Sapiens
LYYVDRIPE

SEQ ID NO: 586420 - protein, 9 aa, Homo Sapiens
LIFTCGETE

SEQ ID NO: 586421 - protein, 9 aa, Homo Sapiens
QKGDFFKDP

SEQ ID NO: 586422 - protein, 9 aa, Homo Sapiens
PLETENNKS

SEQ ID NO: 586423 - protein, 9 aa, Homo Sapiens
ALENDPYCR

SEQ ID NO: 586424 - protein, 9 aa, Homo Sapiens
ILAATAGRV

SEQ ID NO: 586425 - protein, 9 aa, Homo Sapiens
EMRSVSGRR

SEQ ID NO: 586426 - protein, 9 aa, Homo Sapiens
RLQAAVEHV

SEQ ID NO: 586427 - protein, 9 aa, Homo Sapiens
KAEVILGNI

SEQ ID NO: 586428 - protein, 9 aa, Homo Sapiens
NSDYYSQSL

SEQ ID NO: 586429 - protein, 9 aa, Homo Sapiens
LRREQEERE

SEQ ID NO: 586430 - protein, 9 aa, Homo Sapiens
KRNQEPEGK

SEQ ID NO: 586431 - protein, 9 aa, Homo Sapiens
PVVPKKPEE

SEQ ID NO: 586432 - protein, 9 aa, Homo Sapiens
KNAQRVLGS

SEQ ID NO: 586433 - protein, 9 aa, Homo Sapiens
EIVKVMKEE

SEQ ID NO: 586434 - protein, 9 aa, Homo Sapiens
HCSDCWDRT

SEQ ID NO: 586435 - protein, 9 aa, Homo Sapiens
GSSGTQGHM

SEQ ID NO: 586436 - protein, 9 aa, Homo Sapiens
EDDMEISNK

SEQ ID NO: 586437 - protein, 9 aa, Homo Sapiens
VLLSLPMVM

SEQ ID NO: 586438 - protein, 9 aa, Homo Sapiens
KQYIEKRAA

SEQ ID NO: 586439 - protein, 9 aa, Homo Sapiens
LQPSTSTEQ

SEQ ID NO: 586440 - protein, 9 aa, Homo Sapiens
LEEPACLVN

SEQ ID NO: 586441 - protein, 9 aa, Homo Sapiens
IIHLTVVIY

SEQ ID NO: 586442 - protein, 9 aa, Homo Sapiens
FWVGSIVGA

SEQ ID NO: 586443 - protein, 9 aa, Homo Sapiens
KYDGNIDCL

SEQ ID NO: 586444 - protein, 9 aa, Homo Sapiens
TIVSYSLPI

SEQ ID NO: 586445 - protein, 9 aa, Homo Sapiens
GQLLPVVLP

SEQ ID NO: 586446 - protein, 9 aa, Homo Sapiens
ASACHHTRI

SEQ ID NO: 586447 - protein, 9 aa, Homo Sapiens
VPSCGSAPQ

SEQ ID NO: 586448 - protein, 9 aa, Homo Sapiens
RQQPVNCLN

SEQ ID NO: 586449 - protein, 9 aa, Homo Sapiens
KFKTMQSHG

SEQ ID NO: 586450 - protein, 9 aa, Homo Sapiens
ISTATLLSS

SEQ ID NO: 586451 - protein, 9 aa, Homo Sapiens
QEEALMILK

SEQ ID NO: 586452 - protein, 9 aa, Homo Sapiens
VPVGLAWSG

SEQ ID NO: 586453 - protein, 9 aa, Homo Sapiens
VRSPTEATC

SEQ ID NO: 586454 - protein, 9 aa, Homo Sapiens
APQRGSTEP

SEQ ID NO: 586455 - protein, 9 aa, Homo Sapiens
EDVEAIQKL

SEQ ID NO: 586456 - protein, 9 aa, Homo Sapiens
RCAQLHETQ

SEQ ID NO: 586457 - protein, 9 aa, Homo Sapiens
FKTMQSHGI

SEQ ID NO: 586458 - protein, 9 aa, Homo Sapiens
HLTVVIYVL

SEQ ID NO: 586459 - protein, 9 aa, Homo Sapiens
TLLSNNIDH

SEQ ID NO: 586460 - protein, 9 aa, Homo Sapiens
GTQGHMGPQ

SEQ ID NO: 586461 - protein, 9 aa, Homo Sapiens
QVAGTASAC

SEQ ID NO: 586462 - protein, 9 aa, Homo Sapiens
SNKIKTQWT

SEQ ID NO: 586463 - protein, 9 aa, Homo Sapiens
LSLPMVMAG

SEQ ID NO: 586464 - protein, 9 aa, Homo Sapiens
AFQVAGTAS

SEQ ID NO: 586465 - protein, 9 aa, Homo Sapiens
KISKFLLED

SEQ ID NO: 586466 - protein, 9 aa, Homo Sapiens
GSRGPEGPR

SEQ ID NO: 586467 - protein, 9 aa, Homo Sapiens
CCPMCPSSV

SEQ ID NO: 586468 - protein, 9 aa, Homo Sapiens
EESEVAQTS

SEQ ID NO: 586469 - protein, 9 aa, Homo Sapiens
DEPFGEGHQ

SEQ ID NO: 586470 - protein, 9 aa, Homo Sapiens
WQAFKNEAT

SEQ ID NO: 586471 - protein, 9 aa, Homo Sapiens
LALDLKVIH

SEQ ID NO: 586472 - protein, 9 aa, Homo Sapiens
NNPSCMLGS

SEQ ID NO: 586473 - protein, 9 aa, Homo Sapiens
EDNIQLKPD

SEQ ID NO: 586474 - protein, 9 aa, Homo Sapiens
NKIKTQWTS

SEQ ID NO: 586475 - protein, 9 aa, Homo Sapiens
NPCTSMAND

SEQ ID NO: 586476 - protein, 9 aa, Homo Sapiens
TKPQSTFGK

SEQ ID NO: 586477 - protein, 9 aa, Homo Sapiens
VSLTSGHTI

SEQ ID NO: 586478 - protein, 9 aa, Homo Sapiens
FMKRPDPQE

SEQ ID NO: 586479 - protein, 9 aa, Homo Sapiens
GSIDRHDQR

SEQ ID NO: 586480 - protein, 9 aa, Homo Sapiens
YSCIKLFPS

SEQ ID NO: 586481 - protein, 9 aa, Homo Sapiens
DRQQPVNCL

SEQ ID NO: 586482 - protein, 9 aa, Homo Sapiens
AGVRSPTEA

SEQ ID NO: 586483 - protein, 9 aa, Homo Sapiens
PTEATCKVV

SEQ ID NO: 586484 - protein, 9 aa, Homo Sapiens
RGSTEPFRP

SEQ ID NO: 586485 - protein, 9 aa, Homo Sapiens
SQALSQQSE

SEQ ID NO: 586486 - protein, 9 aa, Homo Sapiens
MNRLQRVKK

SEQ ID NO: 586487 - protein, 9 aa, Homo Sapiens
PDPQEEALM

SEQ ID NO: 586488 - protein, 9 aa, Homo Sapiens
STEPFRPVP

SEQ ID NO: 586489 - protein, 9 aa, Homo Sapiens
AGKEEYSAM

SEQ ID NO: 586490 - protein, 9 aa, Homo Sapiens
LQRVKKQQI

SEQ ID NO: 586491 - protein, 9 aa, Homo Sapiens
FNVGTTALW

SEQ ID NO: 586492 - protein, 9 aa, Homo Sapiens
RVKKQQIEN

SEQ ID NO: 586493 - protein, 9 aa, Homo Sapiens
FASLALVFS

SEQ ID NO: 586494 - protein, 9 aa, Homo Sapiens
KPLWKSATA

SEQ ID NO: 586495 - protein, 9 aa, Homo Sapiens
SFASLALVF

SEQ ID NO: 586496 - protein, 9 aa, Homo Sapiens
RPVPPTVSW

SEQ ID NO: 586497 - protein, 9 aa, Homo Sapiens
DVEAIQKLQ

SEQ ID NO: 586498 - protein, 9 aa, Homo Sapiens
RILVVKLLS

SEQ ID NO: 586499 - protein, 9 aa, Homo Sapiens
SVSRLERRE

SEQ ID NO: 586500 - protein, 9 aa, Homo Sapiens
VKPLWKSAT

SEQ ID NO: 586501 - protein, 9 aa, Homo Sapiens
EPFRPVPPT

SEQ ID NO: 586502 - protein, 9 aa, Homo Sapiens
VHPNKIQSL

SEQ ID NO: 586503 - protein, 9 aa, Homo Sapiens
IKLKLQGQL

SEQ ID NO: 586504 - protein, 9 aa, Homo Sapiens
DVRPPLGRC

SEQ ID NO: 586505 - protein, 9 aa, Homo Sapiens
NEATEIIPE

SEQ ID NO: 586506 - protein, 9 aa, Homo Sapiens
HQRRQEEKQ

SEQ ID NO: 586507 - protein, 9 aa, Homo Sapiens
KRRVYRRKI

SEQ ID NO: 586508 - protein, 9 aa, Homo Sapiens
RSPTEATCK

SEQ ID NO: 586509 - protein, 9 aa, Homo Sapiens
KEEYSAMRD

SEQ ID NO: 586510 - protein, 9 aa, Homo Sapiens
NLEEPACLV

SEQ ID NO: 586511 - protein, 9 aa, Homo Sapiens
KHIILQKDL

SEQ ID NO: 586512 - protein, 9 aa, Homo Sapiens
RRVYRRKIS

SEQ ID NO: 586513 - protein, 9 aa, Homo Sapiens
GIRRHVQEL

SEQ ID NO: 586514 - protein, 9 aa, Homo Sapiens
FVLKCCPMC

SEQ ID NO: 586515 - protein, 9 aa, Homo Sapiens
TGSIDRHDQ

SEQ ID NO: 586516 - protein, 9 aa, Homo Sapiens
SVKPLWKSA

SEQ ID NO: 586517 - protein, 9 aa, Homo Sapiens
HPNKIQSLQ

SEQ ID NO: 586518 - protein, 9 aa, Homo Sapiens
EAIQKLQDV

SEQ ID NO: 586519 - protein, 9 aa, Homo Sapiens
QPSTSTEQP

SEQ ID NO: 586520 - protein, 9 aa, Homo Sapiens
PFPSVKPLW

SEQ ID NO: 586521 - protein, 9 aa, Homo Sapiens
QLCEDNIQL

SEQ ID NO: 586522 - protein, 9 aa, Homo Sapiens
QVSRGPGFN

SEQ ID NO: 586523 - protein, 9 aa, Homo Sapiens
VPPTVSWSF

SEQ ID NO: 586524 - protein, 9 aa, Homo Sapiens
PVGLAWSGS

SEQ ID NO: 586525 - protein, 9 aa, Homo Sapiens
EAIFDSSKH

SEQ ID NO: 586526 - protein, 9 aa, Homo Sapiens
QSEVIVRQL

SEQ ID NO: 586527 - protein, 9 aa, Homo Sapiens
RPPLGRCLV

SEQ ID NO: 586528 - protein, 9 aa, Homo Sapiens
SIKHCTLLS

SEQ ID NO: 586529 - protein, 9 aa, Homo Sapiens
RLNELQEEH

SEQ ID NO: 586530 - protein, 9 aa, Homo Sapiens
VVLLSLPMV

SEQ ID NO: 586531 - protein, 9 aa, Homo Sapiens
AAVAIIHLT

SEQ ID NO: 586532 - protein, 9 aa, Homo Sapiens
LKLAGWQCP

SEQ ID NO: 586533 - protein, 9 aa, Homo Sapiens
MANDLVCEK

SEQ ID NO: 586534 - protein, 9 aa, Homo Sapiens
LLSLPMVMA

SEQ ID NO: 586535 - protein, 9 aa, Homo Sapiens
KELTGSIDR

SEQ ID NO: 586536 - protein, 9 aa, Homo Sapiens
TSMANDLVC

SEQ ID NO: 586537 - protein, 9 aa, Homo Sapiens
EISNKIKTQ

SEQ ID NO: 586538 - protein, 9 aa, Homo Sapiens
MREMRAGGC

SEQ ID NO: 586539 - protein, 9 aa, Homo Sapiens
NPSCMLGSS

SEQ ID NO: 586540 - protein, 9 aa, Homo Sapiens
DIRLSDFQT

SEQ ID NO: 586541 - protein, 9 aa, Homo Sapiens
IMTSLKSAN

SEQ ID NO: 586542 - protein, 9 aa, Homo Sapiens
LKCCPMCPS

SEQ ID NO: 586543 - protein, 9 aa, Homo Sapiens
QYIEKRAAD

SEQ ID NO: 586544 - protein, 9 aa, Homo Sapiens
VNSEKPSGK

SEQ ID NO: 586545 - protein, 9 aa, Homo Sapiens
IRRHVQELH

SEQ ID NO: 586546 - protein, 9 aa, Homo Sapiens
MCPSSVPSC

SEQ ID NO: 586547 - protein, 9 aa, Homo Sapiens
LLSDSANAN

SEQ ID NO: 586548 - protein, 9 aa, Homo Sapiens
SSKHIILQK

SEQ ID NO: 586549 - protein, 9 aa, Homo Sapiens
SGHTIIRTP

SEQ ID NO: 586550 - protein, 9 aa, Homo Sapiens
NRLQRVKKQ

SEQ ID NO: 586551 - protein, 9 aa, Homo Sapiens
ASLALVFSF

SEQ ID NO: 586552 - protein, 9 aa, Homo Sapiens
SYHPGIFRG

SEQ ID NO: 586553 - protein, 9 aa, Homo Sapiens
RNNPSCMLG

SEQ ID NO: 586554 - protein, 9 aa, Homo Sapiens
GVRSPTEAT

SEQ ID NO: 586555 - protein, 9 aa, Homo Sapiens
IRLSDFQTF

SEQ ID NO: 586556 - protein, 9 aa, Homo Sapiens
GEESEVAQT

SEQ ID NO: 586557 - protein, 9 aa, Homo Sapiens
KSIKHCTLL

SEQ ID NO: 586558 - protein, 9 aa, Homo Sapiens
QALSQQSEV

SEQ ID NO: 586559 - protein, 9 aa, Homo Sapiens
SIVGAVLAA

SEQ ID NO: 586560 - protein, 9 aa, Homo Sapiens
MTKPQSTFG

SEQ ID NO: 586561 - protein, 9 aa, Homo Sapiens
TIIRTPMGD

SEQ ID NO: 586562 - protein, 9 aa, Homo Sapiens
ELQEEHQRR

SEQ ID NO: 586563 - protein, 9 aa, Homo Sapiens
KRPDPQEEA

SEQ ID NO: 586564 - protein, 9 aa, Homo Sapiens
SDFQTFKPS

SEQ ID NO: 586565 - protein, 9 aa, Homo Sapiens
KTMPSASVH

SEQ ID NO: 586566 - protein, 9 aa, Homo Sapiens
ESLKYDGNI

SEQ ID NO: 586567 - protein, 9 aa, Homo Sapiens
PQRGSTEPF

SEQ ID NO: 586568 - protein, 9 aa, Homo Sapiens
VFWVGSIVG

SEQ ID NO: 586569 - protein, 9 aa, Homo Sapiens
PPTVSWSFA

SEQ ID NO: 586570 - protein, 9 aa, Homo Sapiens
DWDYENSSA

SEQ ID NO: 586571 - protein, 9 aa, Homo Sapiens
GRCLVGGQE

SEQ ID NO: 586572 - protein, 9 aa, Homo Sapiens
PEGPRGKPG

SEQ ID NO: 586573 - protein, 9 aa, Homo Sapiens
AQLHETQRE

SEQ ID NO: 586574 - protein, 9 aa, Homo Sapiens
SRGPGFNVG

SEQ ID NO: 586575 - protein, 9 aa, Homo Sapiens
LTIVSYSLP

SEQ ID NO: 586576 - protein, 9 aa, Homo Sapiens
PCKSELRIL

SEQ ID NO: 586577 - protein, 9 aa, Homo Sapiens
HPGIFRGDK

SEQ ID NO: 586578 - protein, 9 aa, Homo Sapiens
MPSASVHPN

SEQ ID NO: 586579 - protein, 9 aa, Homo Sapiens
MRAGGCCHA

SEQ ID NO: 586580 - protein, 9 aa, Homo Sapiens
YVLQGVPLG

SEQ ID NO: 586581 - protein, 9 aa, Homo Sapiens
IKELTGSID

SEQ ID NO: 586582 - protein, 9 aa, Homo Sapiens
VGVTHIHTV

SEQ ID NO: 586583 - protein, 9 aa, Homo Sapiens
LAWSGSPGG

SEQ ID NO: 586584 - protein, 9 aa, Homo Sapiens
VSRGPGFNV

SEQ ID NO: 586585 - protein, 9 aa, Homo Sapiens
QGQLLPVVL

SEQ ID NO: 586586 - protein, 9 aa, Homo Sapiens
VASGCFVLK

SEQ ID NO: 586587 - protein, 9 aa, Homo Sapiens
RVLEKEVSH

SEQ ID NO: 586588 - protein, 9 aa, Homo Sapiens
VAIIHLTVV

SEQ ID NO: 586589 - protein, 9 aa, Homo Sapiens
RKISKFLLE

SEQ ID NO: 586590 - protein, 9 aa, Homo Sapiens
QLHETQREN

SEQ ID NO: 586591 - protein, 9 aa, Homo Sapiens
RWDVDDWDY

SEQ ID NO: 586592 - protein, 9 aa, Homo Sapiens
ALSNDRYRA

SEQ ID NO: 586593 - protein, 9 aa, Homo Sapiens
VTPLKLAGW

SEQ ID NO: 586594 - protein, 9 aa, Homo Sapiens
PLSQLNPRG

SEQ ID NO: 586595 - protein, 9 aa, Homo Sapiens
MELSALEKT

SEQ ID NO: 586596 - protein, 9 aa, Homo Sapiens
VQVGVTHIH

SEQ ID NO: 586597 - protein, 9 aa, Homo Sapiens
EGPRGKPGE

SEQ ID NO: 586598 - protein, 9 aa, Homo Sapiens
MEISNKIKT

SEQ ID NO: 586599 - protein, 9 aa, Homo Sapiens
NFLTIVSYS

SEQ ID NO: 586600 - protein, 9 aa, Homo Sapiens
ILVVKLLSI

SEQ ID NO: 586601 - protein, 8 aa, Homo Sapiens
ISKGGSEA

SEQ ID NO: 586602 - protein, 9 aa, Homo Sapiens
PASTHMTPS

SEQ ID NO: 586603 - protein, 9 aa, Homo Sapiens
FDSSKHIIL

SEQ ID NO: 586604 - protein, 9 aa, Homo Sapiens
ASVHPNKIQ

SEQ ID NO: 586605 - protein, 9 aa, Homo Sapiens
IKHCTLLSN

SEQ ID NO: 586606 - protein, 9 aa, Homo Sapiens
SAAVAIIHL

SEQ ID NO: 586607 - protein, 9 aa, Homo Sapiens
LKYDGNIDC

SEQ ID NO: 586608 - protein, 9 aa, Homo Sapiens
GIFRGDKWS

SEQ ID NO: 586609 - protein, 9 aa, Homo Sapiens
LSDSANANC

SEQ ID NO: 586610 - protein, 9 aa, Homo Sapiens
SVIYSCIKL

SEQ ID NO: 586611 - protein, 9 aa, Homo Sapiens
TEATCKVVF

SEQ ID NO: 586612 - protein, 9 aa, Homo Sapiens
RIYEMELSA

SEQ ID NO: 586613 - protein, 9 aa, Homo Sapiens
MKRPDPQEE

SEQ ID NO: 586614 - protein, 9 aa, Homo Sapiens
EIMTSLKSA

SEQ ID NO: 586615 - protein, 9 aa, Homo Sapiens
PVPPTVSWS

SEQ ID NO: 586616 - protein, 9 aa, Homo Sapiens
ALSQQSEVI

SEQ ID NO: 586617 - protein, 9 aa, Homo Sapiens
EEHQRRQEE

SEQ ID NO: 586618 - protein, 9 aa, Homo Sapiens
CSVSRLERR

SEQ ID NO: 586619 - protein, 9 aa, Homo Sapiens
QAFKNEATE

SEQ ID NO: 586620 - protein, 9 aa, Homo Sapiens
STHMTPSPP

SEQ ID NO: 586621 - protein, 9 aa, Homo Sapiens
LSLCALSND

SEQ ID NO: 586622 - protein, 9 aa, Homo Sapiens
QGSSGTQGH

SEQ ID NO: 586623 - protein, 9 aa, Homo Sapiens
CIKLFPSPL

SEQ ID NO: 586624 - protein, 9 aa, Homo Sapiens
SANANCITW

SEQ ID NO: 586625 - protein, 9 aa, Homo Sapiens
DMEISNKIK

SEQ ID NO: 586626 - protein, 9 aa, Homo Sapiens
LCALSNDRY

SEQ ID NO: 586627 - protein, 9 aa, Homo Sapiens
YMNLSQAFS

SEQ ID NO: 586628 - protein, 9 aa, Homo Sapiens
PQGSSGTQG

SEQ ID NO: 586629 - protein, 9 aa, Homo Sapiens
EVAQTSCGL

SEQ ID NO: 586630 - protein, 9 aa, Homo Sapiens
PLWKSATAR

SEQ ID NO: 586631 - protein, 9 aa, Homo Sapiens
LVNSEKPSG

SEQ ID NO: 586632 - protein, 9 aa, Homo Sapiens
MQSHGILLH

SEQ ID NO: 586633 - protein, 9 aa, Homo Sapiens
SWSFASLAL

SEQ ID NO: 586634 - protein, 9 aa, Homo Sapiens
SNDRYRAVA

SEQ ID NO: 586635 - protein, 9 aa, Homo Sapiens
EIKELTGSI

SEQ ID NO: 586636 - protein, 9 aa, Homo Sapiens
LTSGHTIIR

SEQ ID NO: 586637 - protein, 9 aa, Homo Sapiens
WDVDDWDYE

SEQ ID NO: 586638 - protein, 9 aa, Homo Sapiens
ISAAVAIIH

SEQ ID NO: 586639 - protein, 9 aa, Homo Sapiens
THMTPSPPS

SEQ ID NO: 586640 - protein, 9 aa, Homo Sapiens
VYEPPPPVF

SEQ ID NO: 586641 - protein, 9 aa, Homo Sapiens
PLGRCLVGG

SEQ ID NO: 586642 - protein, 9 aa, Homo Sapiens
KSANGQIES

SEQ ID NO: 586643 - protein, 9 aa, Homo Sapiens
NCITWEGTN

SEQ ID NO: 586644 - protein, 9 aa, Homo Sapiens
VLQGVPLGL

SEQ ID NO: 586645 - protein, 9 aa, Homo Sapiens
FKNEATEII

SEQ ID NO: 586646 - protein, 9 aa, Homo Sapiens
ELTGSIDRH

SEQ ID NO: 586647 - protein, 9 aa, Homo Sapiens
RDLALDLKV

SEQ ID NO: 586648 - protein, 9 aa, Homo Sapiens
SQGTPWLFL

SEQ ID NO: 586649 - protein, 9 aa, Homo Sapiens
LSQQSEVIV

SEQ ID NO: 586650 - protein, 9 aa, Homo Sapiens
FLYVLQGVP

SEQ ID NO: 586651 - protein, 9 aa, Homo Sapiens
SKHIILQKD

SEQ ID NO: 586652 - protein, 9 aa, Homo Sapiens
VLKCCPMCP

SEQ ID NO: 586653 - protein, 9 aa, Homo Sapiens
GYPKLYLDE

SEQ ID NO: 586654 - protein, 9 aa, Homo Sapiens
LYVLQGVPL

SEQ ID NO: 586655 - protein, 9 aa, Homo Sapiens
GTPWLFLTS

SEQ ID NO: 586656 - protein, 9 aa, Homo Sapiens
TPLKLAGWQ

SEQ ID NO: 586657 - protein, 9 aa, Homo Sapiens
ATCKVVFEN

SEQ ID NO: 586658 - protein, 9 aa, Homo Sapiens
SSRCCSVSR

SEQ ID NO: 586659 - protein, 9 aa, Homo Sapiens
VKKQQIENG

SEQ ID NO: 586660 - protein, 9 aa, Homo Sapiens
QGWQAFKNE

SEQ ID NO: 586661 - protein, 9 aa, Homo Sapiens
CIPVVYEPP

SEQ ID NO: 586662 - protein, 9 aa, Homo Sapiens
SQLNPRGLR

SEQ ID NO: 586663 - protein, 9 aa, Homo Sapiens
CFVLKCCPM

SEQ ID NO: 586664 - protein, 9 aa, Homo Sapiens
SGTQGHMGP

SEQ ID NO: 586665 - protein, 9 aa, Homo Sapiens
GSTEPFRPV

SEQ ID NO: 586666 - protein, 9 aa, Homo Sapiens
PQEEALMIL

SEQ ID NO: 586667 - protein, 9 aa, Homo Sapiens
YENSSARLF

SEQ ID NO: 586668 - protein, 9 aa, Homo Sapiens
SCMLGSSNR

SEQ ID NO: 586669 - protein, 9 aa, Homo Sapiens
SGIRRHVQE

SEQ ID NO: 586670 - protein, 9 aa, Homo Sapiens
SDSANANCI

SEQ ID NO: 586671 - protein, 9 aa, Homo Sapiens
YRRKISKFL

SEQ ID NO: 586672 - protein, 9 aa, Homo Sapiens
AWSGSPGGP

SEQ ID NO: 586673 - protein, 9 aa, Homo Sapiens
DILDTAGKE

SEQ ID NO: 586674 - protein, 9 aa, Homo Sapiens
NANCITWEG

SEQ ID NO: 586675 - protein, 9 aa, Homo Sapiens
IDRHDQRHA

SEQ ID NO: 586676 - protein, 9 aa, Homo Sapiens
RGPEGPRGK

SEQ ID NO: 586677 - protein, 9 aa, Homo Sapiens
IYEMELSAL

SEQ ID NO: 586678 - protein, 9 aa, Homo Sapiens
GWQAFKNEA

SEQ ID NO: 586679 - protein, 9 aa, Homo Sapiens
CPMCPSSVP

SEQ ID NO: 586680 - protein, 9 aa, Homo Sapiens
CHDRQQPVN

SEQ ID NO: 586681 - protein, 9 aa, Homo Sapiens
TASACHHTR

SEQ ID NO: 586682 - protein, 9 aa, Homo Sapiens
LWKSATARN

SEQ ID NO: 586683 - protein, 9 aa, Homo Sapiens
VGSIVGAVL

SEQ ID NO: 586684 - protein, 9 aa, Homo Sapiens
VAGTASACH

SEQ ID NO: 586685 - protein, 9 aa, Homo Sapiens
STATLLSSM

SEQ ID NO: 586686 - protein, 9 aa, Homo Sapiens
KLYLDEPFG

SEQ ID NO: 586687 - protein, 9 aa, Homo Sapiens
HTIIRTPMG

SEQ ID NO: 586688 - protein, 9 aa, Homo Sapiens
SASVHPNKI

SEQ ID NO: 586689 - protein, 9 aa, Homo Sapiens
APQCHDRQQ

SEQ ID NO: 586690 - protein, 9 aa, Homo Sapiens
YIQQLCEDN

SEQ ID NO: 586691 - protein, 9 aa, Homo Sapiens
LSQLNPRGL

SEQ ID NO: 586692 - protein, 9 aa, Homo Sapiens
SRCCSVSRL

SEQ ID NO: 586693 - protein, 9 aa, Homo Sapiens
ILDTAGKEE

SEQ ID NO: 586694 - protein, 9 aa, Homo Sapiens
SEVIVRQLQ

SEQ ID NO: 586695 - protein, 9 aa, Homo Sapiens
SVVLLSLPM

SEQ ID NO: 586696 - protein, 9 aa, Homo Sapiens
VEAIQKLQD

SEQ ID NO: 586697 - protein, 9 aa, Homo Sapiens
GVQVGVTHI

SEQ ID NO: 586698 - protein, 9 aa, Homo Sapiens
GSYHPGIFR

SEQ ID NO: 586699 - protein, 9 aa, Homo Sapiens
LSNDRYRAV

SEQ ID NO: 586700 - protein, 9 aa, Homo Sapiens
NTVKVFMTK

SEQ ID NO: 586701 - protein, 9 aa, Homo Sapiens
LTGEESEVA

SEQ ID NO: 586702 - protein, 9 aa, Homo Sapiens
SGCFVLKCC

SEQ ID NO: 586703 - protein, 9 aa, Homo Sapiens
VAGVQVGVT

SEQ ID NO: 586704 - protein, 9 aa, Homo Sapiens
KLKLQGQLL

SEQ ID NO: 586705 - protein, 9 aa, Homo Sapiens
RCLVGGQEE

SEQ ID NO: 586706 - protein, 9 aa, Homo Sapiens
VKVFMTKPQ

SEQ ID NO: 586707 - protein, 9 aa, Homo Sapiens
ANCITWEGT

SEQ ID NO: 586708 - protein, 9 aa, Homo Sapiens
AVAGVQVGV

SEQ ID NO: 586709 - protein, 9 aa, Homo Sapiens
LLPVVLPPI

SEQ ID NO: 586710 - protein, 9 aa, Homo Sapiens
SLVSGIRRH

SEQ ID NO: 586711 - protein, 9 aa, Homo Sapiens
TPWLFLTSA

SEQ ID NO: 586712 - protein, 9 aa, Homo Sapiens
HWVFWVGSI

SEQ ID NO: 586713 - protein, 9 aa, Homo Sapiens
LQGVPLGLA

SEQ ID NO: 586714 - protein, 9 aa, Homo Sapiens
FPSVKPLWK

SEQ ID NO: 586715 - protein, 9 aa, Homo Sapiens
YEMELSALE

SEQ ID NO: 586716 - protein, 9 aa, Homo Sapiens
QQSEVIVRQ

SEQ ID NO: 586717 - protein, 9 aa, Homo Sapiens
CGMREMRAG

SEQ ID NO: 586718 - protein, 9 aa, Homo Sapiens
CGSAPQRGS

SEQ ID NO: 586719 - protein, 9 aa, Homo Sapiens
GPQGSSGTQ

SEQ ID NO: 586720 - protein, 9 aa, Homo Sapiens
GHTIIRTPM

SEQ ID NO: 586721 - protein, 9 aa, Homo Sapiens
TVPVGLAWS

SEQ ID NO: 586722 - protein, 9 aa, Homo Sapiens
SVHPNKIQS

SEQ ID NO: 586723 - protein, 9 aa, Homo Sapiens
PKLYLDEPF

SEQ ID NO: 586724 - protein, 9 aa, Homo Sapiens
LPMVMAGSG

SEQ ID NO: 586725 - protein, 9 aa, Homo Sapiens
VRPPLGRCL

SEQ ID NO: 586726 - protein, 9 aa, Homo Sapiens
CEDNIQLKP

SEQ ID NO: 586727 - protein, 9 aa, Homo Sapiens
GKEEYSAMR

SEQ ID NO: 586728 - protein, 9 aa, Homo Sapiens
LLCGMREMR

SEQ ID NO: 586729 - protein, 9 aa, Homo Sapiens
LDEPFGEGH

SEQ ID NO: 586730 - protein, 9 aa, Homo Sapiens
QEEHQRRQE

SEQ ID NO: 586731 - protein, 9 aa, Homo Sapiens
SDIRLSDFQ

SEQ ID NO: 586732 - protein, 9 aa, Homo Sapiens
PLKLAGWQC

SEQ ID NO: 586733 - protein, 9 aa, Homo Sapiens
HMTPSPPST

SEQ ID NO: 586734 - protein, 9 aa, Homo Sapiens
AIIHLTVVI

SEQ ID NO: 586735 - protein, 9 aa, Homo Sapiens
VDDWDYENS

SEQ ID NO: 586736 - protein, 9 aa, Homo Sapiens
PVVYEPPPP

SEQ ID NO: 586737 - protein, 9 aa, Homo Sapiens
NEDDMEISN

SEQ ID NO: 586738 - protein, 9 aa, Homo Sapiens
LSSMLCIVR

SEQ ID NO: 586739 - protein, 9 aa, Homo Sapiens
TCLPESLKY

SEQ ID NO: 586740 - protein, 9 aa, Homo Sapiens
VYRRKISKF

SEQ ID NO: 586741 - protein, 9 aa, Homo Sapiens
ALLCGMREM

SEQ ID NO: 586742 - protein, 9 aa, Homo Sapiens
LNPRGLRSC

SEQ ID NO: 586743 - protein, 9 aa, Homo Sapiens
EPFGEGHQE

SEQ ID NO: 586744 - protein, 9 aa, Homo Sapiens
QGSCIPVVY

SEQ ID NO: 586745 - protein, 9 aa, Homo Sapiens
IEDVEAIQK

SEQ ID NO: 586746 - protein, 9 aa, Homo Sapiens
QLLPVVLPP

SEQ ID NO: 586747 - protein, 9 aa, Homo Sapiens
KHCTLLSNN

SEQ ID NO: 586748 - protein, 9 aa, Homo Sapiens
TVSWSFASL

SEQ ID NO: 586749 - protein, 9 aa, Homo Sapiens
DFQTFKPSG

SEQ ID NO: 586750 - protein, 9 aa, Homo Sapiens
IHLTVVIYV

SEQ ID NO: 586751 - protein, 9 aa, Homo Sapiens
LSALEKTKK

SEQ ID NO: 586752 - protein, 9 aa, Homo Sapiens
LAPLLRDLA

SEQ ID NO: 586753 - protein, 9 aa, Homo Sapiens
TGEESEVAQ

SEQ ID NO: 586754 - protein, 9 aa, Homo Sapiens
ASTHMTPSP

SEQ ID NO: 586755 - protein, 9 aa, Homo Sapiens
VLSLCALSN

SEQ ID NO: 586756 - protein, 9 aa, Homo Sapiens
SCIPVVYEP

SEQ ID NO: 586757 - protein, 9 aa, Homo Sapiens
VPLGLAGSI

SEQ ID NO: 586758 - protein, 9 aa, Homo Sapiens
ASGCFVLKC

SEQ ID NO: 586759 - protein, 9 aa, Homo Sapiens
GSQALSQQS

SEQ ID NO: 586760 - protein, 9 aa, Homo Sapiens
VSVIYSCIK

SEQ ID NO: 586761 - protein, 9 aa, Homo Sapiens
QVGVTHIHT

SEQ ID NO: 586762 - protein, 9 aa, Homo Sapiens
FELQVYRAY

SEQ ID NO: 586763 - protein, 9 aa, Homo Sapiens
SLCALSNDR

SEQ ID NO: 586764 - protein, 9 aa, Homo Sapiens
MGNSSQGTP

SEQ ID NO: 586765 - protein, 9 aa, Homo Sapiens
FQVAGTASA

SEQ ID NO: 586766 - protein, 9 aa, Homo Sapiens
SRLERREIH

SEQ ID NO: 586767 - protein, 9 aa, Homo Sapiens
LVSGIRRHV

SEQ ID NO: 586768 - protein, 9 aa, Homo Sapiens
HMGNSSQGT

SEQ ID NO: 586769 - protein, 9 aa, Homo Sapiens
WSGSPGGPA

SEQ ID NO: 586770 - protein, 9 aa, Homo Sapiens
VFMTKPQST

SEQ ID NO: 586771 - protein, 9 aa, Homo Sapiens
YDGNIDCLD

SEQ ID NO: 586772 - protein, 9 aa, Homo Sapiens
AFKNEATEI

SEQ ID NO: 586773 - protein, 9 aa, Homo Sapiens
SHSPTTSSI

SEQ ID NO: 586774 - protein, 9 aa, Homo Sapiens
DDWDYENSS

SEQ ID NO: 586775 - protein, 9 aa, Homo Sapiens
PGPQGSSGT

SEQ ID NO: 586776 - protein, 9 aa, Homo Sapiens
APLLRDLAL

SEQ ID NO: 586777 - protein, 9 aa, Homo Sapiens
FMTKPQSTF

SEQ ID NO: 586778 - protein, 9 aa, Homo Sapiens
GSIVGAVLA

SEQ ID NO: 586779 - protein, 9 aa, Homo Sapiens
RERCAQLHE

SEQ ID NO: 586780 - protein, 9 aa, Homo Sapiens
DDMEISNKI

SEQ ID NO: 586781 - protein, 9 aa, Homo Sapiens
TSLKSANGQ

SEQ ID NO: 586782 - protein, 9 aa, Homo Sapiens
HGILLHREG

SEQ ID NO: 586783 - protein, 9 aa, Homo Sapiens
RLQRVKKQQ

SEQ ID NO: 586784 - protein, 9 aa, Homo Sapiens
SELRILVVK

SEQ ID NO: 586785 - protein, 9 aa, Homo Sapiens
ELRILVVKL

SEQ ID NO: 586786 - protein, 9 aa, Homo Sapiens
LQGQLLPVV

SEQ ID NO: 586787 - protein, 9 aa, Homo Sapiens
VAQTSCGLL

SEQ ID NO: 586788 - protein, 9 aa, Homo Sapiens
IAVTPLKLA

SEQ ID NO: 586789 - protein, 9 aa, Homo Sapiens
KRAADLYNI

SEQ ID NO: 586790 - protein, 9 aa, Homo Sapiens
LSDFQTFKP

SEQ ID NO: 586791 - protein, 9 aa, Homo Sapiens
LKFKTMQSH

SEQ ID NO: 586792 - protein, 9 aa, Homo Sapiens
LAGWQCPEC

SEQ ID NO: 586793 - protein, 9 aa, Homo Sapiens
EVSHSPTTS

SEQ ID NO: 586794 - protein, 9 aa, Homo Sapiens
ELTGEESEV

SEQ ID NO: 586795 - protein, 9 aa, Homo Sapiens
HIILQKDLV

SEQ ID NO: 586796 - protein, 9 aa, Homo Sapiens
YLDEPFGEG

SEQ ID NO: 586797 - protein, 9 aa, Homo Sapiens
AVTPLKLAG

SEQ ID NO: 586798 - protein, 9 aa, Homo Sapiens
ARERCAQLH

SEQ ID NO: 586799 - protein, 9 aa, Homo Sapiens
ISNKIKTQW

SEQ ID NO: 586800 - protein, 9 aa, Homo Sapiens
FLTIVSYSL

SEQ ID NO: 586801 - protein, 9 aa, Homo Sapiens
MTPSPPSTA

SEQ ID NO: 586802 - protein, 9 aa, Homo Sapiens
TSGHTIIRT

SEQ ID NO: 586803 - protein, 9 aa, Homo Sapiens
CPSSVPSCG

SEQ ID NO: 586804 - protein, 9 aa, Homo Sapiens
CAQLHETQR

SEQ ID NO: 586805 - protein, 9 aa, Homo Sapiens
DNIQLKPDV

SEQ ID NO: 586806 - protein, 9 aa, Homo Sapiens
ESLVSGIRR

SEQ ID NO: 586807 - protein, 9 aa, Homo Sapiens
REMRAGGCC

SEQ ID NO: 586808 - protein, 9 aa, Homo Sapiens
IFDSSKHII

SEQ ID NO: 586809 - protein, 9 aa, Homo Sapiens
FQTFKPSGA

SEQ ID NO: 586810 - protein, 9 aa, Homo Sapiens
PFRPVPPTV

SEQ ID NO: 586811 - protein, 9 aa, Homo Sapiens
LPESLKYDG

SEQ ID NO: 586812 - protein, 9 aa, Homo Sapiens
LKLQGQLLP

SEQ ID NO: 586813 - protein, 9 aa, Homo Sapiens
EMRAGGCCH

SEQ ID NO: 586814 - protein, 9 aa, Homo Sapiens
MTYLHPTQF

SEQ ID NO: 586815 - protein, 9 aa, Homo Sapiens
RRHVQELHR

SEQ ID NO: 586816 - protein, 9 aa, Homo Sapiens
ACLVNSEKP

SEQ ID NO: 586817 - protein, 9 aa, Homo Sapiens
VPLSQLNPR

SEQ ID NO: 586818 - protein, 9 aa, Homo Sapiens
VVYEPPPPV

SEQ ID NO: 586819 - protein, 9 aa, Homo Sapiens
MHIEDVEAI

SEQ ID NO: 586820 - protein, 9 aa, Homo Sapiens
PRGKPGEDG

SEQ ID NO: 586821 - protein, 9 aa, Homo Sapiens
LMTYLHPTQ

SEQ ID NO: 586822 - protein, 9 aa, Homo Sapiens
IEKRAADLY

SEQ ID NO: 586823 - protein, 9 aa, Homo Sapiens
GCFVLKCCP

SEQ ID NO: 586824 - protein, 9 aa, Homo Sapiens
DLALDLKVI

SEQ ID NO: 586825 - protein, 9 aa, Homo Sapiens
MTSLKSANG

SEQ ID NO: 586826 - protein, 9 aa, Homo Sapiens
NIQLKPDVV

SEQ ID NO: 586827 - protein, 9 aa, Homo Sapiens
GPEGPRGKP

SEQ ID NO: 586828 - protein, 9 aa, Homo Sapiens
KDNFLTIVS

SEQ ID NO: 586829 - protein, 9 aa, Homo Sapiens
LGSSNRLDE

SEQ ID NO: 586830 - protein, 9 aa, Homo Sapiens
GPGFNVGTT

SEQ ID NO: 586831 - protein, 9 aa, Homo Sapiens
ATLLSSMLC

SEQ ID NO: 586832 - protein, 9 aa, Homo Sapiens
LLSNNIDHL

SEQ ID NO: 586833 - protein, 9 aa, Homo Sapiens
TATLLSSML

SEQ ID NO: 586834 - protein, 9 aa, Homo Sapiens
QSHGILLHR

SEQ ID NO: 586835 - protein, 9 aa, Homo Sapiens
KVFMTKPQS

SEQ ID NO: 586836 - protein, 9 aa, Homo Sapiens
KPQSTFGKI

SEQ ID NO: 586837 - protein, 9 aa, Homo Sapiens
ANANCITWE

SEQ ID NO: 586838 - protein, 9 aa, Homo Sapiens
SGSPGGPAW

SEQ ID NO: 586839 - protein, 9 aa, Homo Sapiens
PPCKSELRI

SEQ ID NO: 586840 - protein, 9 aa, Homo Sapiens
SACHHTRIV

SEQ ID NO: 586841 - protein, 9 aa, Homo Sapiens
WSFASLALV

SEQ ID NO: 586842 - protein, 9 aa, Homo Sapiens
LLRDLALDL

SEQ ID NO: 586843 - protein, 9 aa, Homo Sapiens
SVPSCGSAP

SEQ ID NO: 586844 - protein, 9 aa, Homo Sapiens
TLLSSMLCI

SEQ ID NO: 586845 - protein, 9 aa, Homo Sapiens
IYSCIKLFP

SEQ ID NO: 586846 - protein, 9 aa, Homo Sapiens
EEPACLVNS

SEQ ID NO: 586847 - protein, 9 aa, Homo Sapiens
RQVSRGPGF

SEQ ID NO: 586848 - protein, 9 aa, Homo Sapiens
PSCMLGSSN

SEQ ID NO: 586849 - protein, 9 aa, Homo Sapiens
AMNRLQRVK

SEQ ID NO: 586850 - protein, 9 aa, Homo Sapiens
LFLYVLQGV

SEQ ID NO: 586851 - protein, 9 aa, Homo Sapiens
AGVQVGVTH

SEQ ID NO: 586852 - protein, 9 aa, Homo Sapiens
AHWVFWVGS

SEQ ID NO: 586853 - protein, 9 aa, Homo Sapiens
ANDLVCEKP

SEQ ID NO: 586854 - protein, 9 aa, Homo Sapiens
EAARERCAQ

SEQ ID NO: 586855 - protein, 9 aa, Homo Sapiens
EMELSALEK

SEQ ID NO: 586856 - protein, 9 aa, Homo Sapiens
RAYMNLSQA

SEQ ID NO: 586857 - protein, 9 aa, Homo Sapiens
HDRQQPVNC

SEQ ID NO: 586858 - protein, 9 aa, Homo Sapiens
ELQVYRAYM

SEQ ID NO: 586859 - protein, 9 aa, Homo Sapiens
WKSATARNL

SEQ ID NO: 586860 - protein, 9 aa, Homo Sapiens
NELQEEHQR

SEQ ID NO: 586861 - protein, 9 aa, Homo Sapiens
RGKPGEDGE

SEQ ID NO: 586862 - protein, 9 aa, Homo Sapiens
SEVAQTSCG

SEQ ID NO: 586863 - protein, 9 aa, Homo Sapiens
AIFDSSKHI

SEQ ID NO: 586864 - protein, 9 aa, Homo Sapiens
PSVKPLWKS

SEQ ID NO: 586865 - protein, 9 aa, Homo Sapiens
LSVVLLSLP

SEQ ID NO: 586866 - protein, 9 aa, Homo Sapiens
TQGHMGPQG

SEQ ID NO: 586867 - protein, 9 aa, Homo Sapiens
ERCAQLHET

SEQ ID NO: 586868 - protein, 9 aa, Homo Sapiens
VIYSCIKLF

SEQ ID NO: 586869 - protein, 9 aa, Homo Sapiens
PPLGRCLVG

SEQ ID NO: 586870 - protein, 9 aa, Homo Sapiens
PSSVPSCGS

SEQ ID NO: 586871 - protein, 9 aa, Homo Sapiens
SPTEATCKV

SEQ ID NO: 586872 - protein, 9 aa, Homo Sapiens
IFRGDKWSC

SEQ ID NO: 586873 - protein, 9 aa, Homo Sapiens
FMKDNFLTI

SEQ ID NO: 586874 - protein, 9 aa, Homo Sapiens
SLTSGHTII

SEQ ID NO: 586875 - protein, 9 aa, Homo Sapiens
VLEKEVSHS

SEQ ID NO: 586876 - protein, 9 aa, Homo Sapiens
ASDIRLSDF

SEQ ID NO: 586877 - protein, 9 aa, Homo Sapiens
QQLCEDNIQ

SEQ ID NO: 586878 - protein, 9 aa, Homo Sapiens
EKRAADLYN

SEQ ID NO: 586879 - protein, 9 aa, Homo Sapiens
IPVVYEPPP

SEQ ID NO: 586880 - protein, 9 aa, Homo Sapiens
AARERCAQL

SEQ ID NO: 586881 - protein, 9 aa, Homo Sapiens
TVKVFMTKP

SEQ ID NO: 586882 - protein, 9 aa, Homo Sapiens
VSWSFASLA

SEQ ID NO: 586883 - protein, 9 aa, Homo Sapiens
SHGILLHRE

SEQ ID NO: 586884 - protein, 9 aa, Homo Sapiens
NKSIKHCTL

SEQ ID NO: 586885 - protein, 9 aa, Homo Sapiens
DVDDWDYEN

SEQ ID NO: 586886 - protein, 9 aa, Homo Sapiens
ANGQIESLI

SEQ ID NO: 586887 - protein, 9 aa, Homo Sapiens
SCGSAPQRG

SEQ ID NO: 586888 - protein, 9 aa, Homo Sapiens
PAVPLSQLN

SEQ ID NO: 586889 - protein, 9 aa, Homo Sapiens
ESEVAQTSC

SEQ ID NO: 586890 - protein, 9 aa, Homo Sapiens
LNELQEEHQ

SEQ ID NO: 586891 - protein, 9 aa, Homo Sapiens
PQCHDRQQP

SEQ ID NO: 586892 - protein, 9 aa, Homo Sapiens
DPQEEALMI

SEQ ID NO: 586893 - protein, 9 aa, Homo Sapiens
IQQLCEDNI

SEQ ID NO: 586894 - protein, 9 aa, Homo Sapiens
SLPMVMAGS

SEQ ID NO: 586895 - protein, 9 aa, Homo Sapiens
TEPFRPVPP

SEQ ID NO: 586896 - protein, 9 aa, Homo Sapiens
FVSVIYSCI

SEQ ID NO: 586897 - protein, 9 aa, Homo Sapiens
GVPLGLAGS

SEQ ID NO: 586898 - protein, 9 aa, Homo Sapiens
SANGQIESL

SEQ ID NO: 586899 - protein, 9 aa, Homo Sapiens
ELSALEKTK

SEQ ID NO: 586900 - protein, 9 aa, Homo Sapiens
KNEATEIIP

SEQ ID NO: 586901 - protein, 9 aa, Homo Sapiens
SLALVFSFT

SEQ ID NO: 586902 - protein, 9 aa, Homo Sapiens
YHPGIFRGD

SEQ ID NO: 586903 - protein, 9 aa, Homo Sapiens
QAMNRLQRV

SEQ ID NO: 586904 - protein, 9 aa, Homo Sapiens
QLNPRGLRS

SEQ ID NO: 586905 - protein, 9 aa, Homo Sapiens
PLLRDLALD

SEQ ID NO: 586906 - protein, 9 aa, Homo Sapiens
MKDNFLTIV

SEQ ID NO: 586907 - protein, 9 aa, Homo Sapiens
SLKYDGNID

SEQ ID NO: 586908 - protein, 9 aa, Homo Sapiens
DNFLTIVSY

SEQ ID NO: 586909 - protein, 9 aa, Homo Sapiens
VYRAYMNLS

SEQ ID NO: 586910 - protein, 9 aa, Homo Sapiens
GLAWSGSPG

SEQ ID NO: 586911 - protein, 9 aa, Homo Sapiens
SSGTQGHMG

SEQ ID NO: 586912 - protein, 9 aa, Homo Sapiens
PESLKYDGN

SEQ ID NO: 586913 - protein, 9 aa, Homo Sapiens
QGVPLGLAG

SEQ ID NO: 586914 - protein, 9 aa, Homo Sapiens
GSCIPVVYE

SEQ ID NO: 586915 - protein, 9 aa, Homo Sapiens
GFNVGTTAL

SEQ ID NO: 586916 - protein, 9 aa, Homo Sapiens
YPKLYLDEP

SEQ ID NO: 586917 - protein, 9 aa, Homo Sapiens
RVYRRKISK

SEQ ID NO: 586918 - protein, 9 aa, Homo Sapiens
PMCPSSVPS

SEQ ID NO: 586919 - protein, 9 aa, Homo Sapiens
ITAPQCHDR

SEQ ID NO: 586920 - protein, 9 aa, Homo Sapiens
SIDRHDQRH

SEQ ID NO: 586921 - protein, 9 aa, Homo Sapiens
GNSSQGTPW

SEQ ID NO: 586922 - protein, 9 aa, Homo Sapiens
CKSELRILV

SEQ ID NO: 586923 - protein, 9 aa, Homo Sapiens
LEKEVSHSP

SEQ ID NO: 586924 - protein, 9 aa, Homo Sapiens
VSHSPTTSS

SEQ ID NO: 586925 - protein, 9 aa, Homo Sapiens
AIQKLQDVL

SEQ ID NO: 586926 - protein, 9 aa, Homo Sapiens
GSAPQRGST

SEQ ID NO: 586927 - protein, 9 aa, Homo Sapiens
VFMKRPDPQ

SEQ ID NO: 586928 - protein, 9 aa, Homo Sapiens
NDLVCEKPV

SEQ ID NO: 586929 - protein, 9 aa, Homo Sapiens
LQEEHQRRQ

SEQ ID NO: 586930 - protein, 9 aa, Homo Sapiens
IVSYSLPIV

SEQ ID NO: 586931 - protein, 9 aa, Homo Sapiens
KCCPMCPSS

SEQ ID NO: 586932 - protein, 9 aa, Homo Sapiens
KLQGQLLPV

SEQ ID NO: 586933 - protein, 9 aa, Homo Sapiens
ISKFLLEDA

SEQ ID NO: 586934 - protein, 9 aa, Homo Sapiens
HIEDVEAIQ

SEQ ID NO: 586935 - protein, 9 aa, Homo Sapiens
SLKSANGQI

SEQ ID NO: 586936 - protein, 9 aa, Homo Sapiens
CLVNSEKPS

SEQ ID NO: 586937 - protein, 9 aa, Homo Sapiens
LCGMREMRA

SEQ ID NO: 586938 - protein, 9 aa, Homo Sapiens
DSANANCIT

SEQ ID NO: 586939 - protein, 9 aa, Homo Sapiens
EATCKVVFE

SEQ ID NO: 586940 - protein, 9 aa, Homo Sapiens
FRPVPPTVS

SEQ ID NO: 586941 - protein, 9 aa, Homo Sapiens
PGIFRGDKW

SEQ ID NO: 586942 - protein, 9 aa, Homo Sapiens
DIAVTPLKL

SEQ ID NO: 586943 - protein, 9 aa, Homo Sapiens
GPRGKPGED

SEQ ID NO: 586944 - protein, 9 aa, Homo Sapiens
WVFWVGSIV

SEQ ID NO: 586945 - protein, 9 aa, Homo Sapiens
NSSQGTPWL

SEQ ID NO: 586946 - protein, 9 aa, Homo Sapiens
PGFNVGTTA

SEQ ID NO: 586947 - protein, 9 aa, Homo Sapiens
WVGSIVGAV

SEQ ID NO: 586948 - protein, 9 aa, Homo Sapiens
KLAGWQCPE

SEQ ID NO: 586949 - protein, 9 aa, Homo Sapiens
AESLVSGIR

SEQ ID NO: 586950 - protein, 9 aa, Homo Sapiens
MLGSSNRLD

SEQ ID NO: 586951 - protein, 9 aa, Homo Sapiens
QRGSTEPFR

SEQ ID NO: 586952 - protein, 9 aa, Homo Sapiens
SMLCIVRAP

SEQ ID NO: 586953 - protein, 9 aa, Homo Sapiens
NPRGLRSCA

SEQ ID NO: 586954 - protein, 9 aa, Homo Sapiens
TMPSASVHP

SEQ ID NO: 586955 - protein, 9 aa, Homo Sapiens
SAPQRGSTE

SEQ ID NO: 586956 - protein, 9 aa, Homo Sapiens
HCTLLSNNI

SEQ ID NO: 586957 - protein, 9 aa, Homo Sapiens
VSGIRRHVQ

SEQ ID NO: 586958 - protein, 9 aa, Homo Sapiens
PSASVHPNK

SEQ ID NO: 586959 - protein, 9 aa, Homo Sapiens
RCCSVSRLE

SEQ ID NO: 586960 - protein, 9 aa, Homo Sapiens
TAGKEEYSA

SEQ ID NO: 586961 - protein, 9 aa, Homo Sapiens
ASSRCCSVS

SEQ ID NO: 586962 - protein, 9 aa, Homo Sapiens
RRKISKFLL

SEQ ID NO: 586963 - protein, 9 aa, Homo Sapiens
AYMNLSQAF

SEQ ID NO: 586964 - protein, 9 aa, Homo Sapiens
HPASTHMTP

SEQ ID NO: 586965 - protein, 9 aa, Homo Sapiens
CCSVSRLER

SEQ ID NO: 586966 - protein, 9 aa, Homo Sapiens
EHQRRQEEK

SEQ ID NO: 586967 - protein, 9 aa, Homo Sapiens
DTAGKEEYS

SEQ ID NO: 586968 - protein, 9 aa, Homo Sapiens
LYLDEPFGE

SEQ ID NO: 586969 - protein, 9 aa, Homo Sapiens
YIEKRAADL

SEQ ID NO: 586970 - protein, 9 aa, Homo Sapiens
EPACLVNSE

SEQ ID NO: 586971 - protein, 9 aa, Homo Sapiens
SRGPEGPRG

SEQ ID NO: 586972 - protein, 9 aa, Homo Sapiens
RPDPQEEAL

SEQ ID NO: 586973 - protein, 9 aa, Homo Sapiens
LRDLALDLK

SEQ ID NO: 586974 - protein, 9 aa, Homo Sapiens
QVYRAYMNL

SEQ ID NO: 586975 - protein, 9 aa, Homo Sapiens
TMQSHGILL

SEQ ID NO: 586976 - protein, 9 aa, Homo Sapiens
AVPLSQLNP

SEQ ID NO: 586977 - protein, 9 aa, Homo Sapiens
LQVYRAYMN

SEQ ID NO: 586978 - protein, 9 aa, Homo Sapiens
KEVSHSPTT

SEQ ID NO: 586979 - protein, 9 aa, Homo Sapiens
CLVGGQEEA

SEQ ID NO: 586980 - protein, 9 aa, Homo Sapiens
CTSMANDLV

SEQ ID NO: 586981 - protein, 9 aa, Homo Sapiens
SMANDLVCE

SEQ ID NO: 586982 - protein, 9 aa, Homo Sapiens
SSMLCIVRA

SEQ ID NO: 586983 - protein, 9 aa, Homo Sapiens
IQKLQDVLH

SEQ ID NO: 586984 - protein, 9 aa, Homo Sapiens
TQRIYEMEL

SEQ ID NO: 586985 - protein, 9 aa, Homo Sapiens
DYENSSARL

SEQ ID NO: 586986 - protein, 9 aa, Homo Sapiens
NDRYRAVAS

SEQ ID NO: 586987 - protein, 9 aa, Homo Sapiens
PCTSMANDL

SEQ ID NO: 586988 - protein, 9 aa, Homo Sapiens
SCIKLFPSP

SEQ ID NO: 586989 - protein, 9 aa, Homo Sapiens
KTMQSHGIL

SEQ ID NO: 586990 - protein, 9 aa, Homo Sapiens
QGTPWLFLT

SEQ ID NO: 586991 - protein, 9 aa, Homo Sapiens
YEPPPPVFE

SEQ ID NO: 586992 - protein, 9 aa, Homo Sapiens
CTLLSNNID

SEQ ID NO: 586993 - protein, 9 aa, Homo Sapiens
RLSDFQTFK

SEQ ID NO: 586994 - protein, 9 aa, Homo Sapiens
THPASTHMT

SEQ ID NO: 586995 - protein, 9 aa, Homo Sapiens
QCHDRQQPV

SEQ ID NO: 586996 - protein, 9 aa, Homo Sapiens
CALSNDRYR

SEQ ID NO: 586997 - protein, 9 aa, Homo Sapiens
DLVCEKPVV

SEQ ID NO: 586998 - protein, 9 aa, Homo Sapiens
WDYENSSAR

SEQ ID NO: 586999 - protein, 9 aa, Homo Sapiens
PTVSWSFAS

SEQ ID NO: 587000 - protein, 9 aa, Homo Sapiens
VLAPLLRDL

SEQ ID NO: 587001 - protein, 9 aa, Homo Sapiens
EVSLTSGHT

SEQ ID NO: 587002 - protein, 9 aa, Homo Sapiens
PSCGSAPQR

SEQ ID NO: 587003 - protein, 9 aa, Homo Sapiens
CMLGSSNRL

SEQ ID NO: 587004 - protein, 9 aa, Homo Sapiens
RAADLYNIK

SEQ ID NO: 587005 - protein, 9 aa, Homo Sapiens
LLSSMLCIV

SEQ ID NO: 587006 - protein, 9 aa, Homo Sapiens
LTGSIDRHD

SEQ ID NO: 587007 - protein, 9 aa, Homo Sapiens
VSRLERREI

SEQ ID NO: 587008 - protein, 9 aa, Homo Sapiens
QRVKKQQIE

SEQ ID NO: 587009 - protein, 9 aa, Homo Sapiens
LGRCLVGGQ

SEQ ID NO: 587010 - protein, 9 aa, Homo Sapiens
CLPESLKYD

SEQ ID NO: 587011 - protein, 9 aa, Homo Sapiens
LKSANGQIE

SEQ ID NO: 587012 - protein, 9 aa, Homo Sapiens
AGTASACHH

SEQ ID NO: 587013 - protein, 9 aa, Homo Sapiens
LCEDNIQLK

SEQ ID NO: 587014 - protein, 9 aa, Homo Sapiens
HSPTTSSIT

SEQ ID NO: 587015 - protein, 9 aa, Homo Sapiens
SSQGTPWLF

SEQ ID NO: 587016 - protein, 9 aa, Homo Sapiens
VGLAWSGSP

SEQ ID NO: 587017 - protein, 9 aa, Homo Sapiens
RGPGFNVGT

SEQ ID NO: 587018 - protein, 9 aa, Homo Sapiens
TAPQCHDRQ

SEQ ID NO: 587019 - protein, 9 aa, Homo Sapiens
YRAYMNLSQ

SEQ ID NO: 587020 - protein, 9 aa, Homo Sapiens
LDILDTAGK

SEQ ID NO: 587021 - protein, 9 aa, Homo Sapiens
IKLFPSPLQ

SEQ ID NO: 587022 - protein, 9 aa, Homo Sapiens
EKEVSHSPT

SEQ ID NO: 587023 - protein, 9 aa, Homo Sapiens
ELQPSTSTE

SEQ ID NO: 587024 - protein, 9 aa, Homo Sapiens
PACLVNSEK

SEQ ID NO: 587025 - protein, 9 aa, Homo Sapiens
KSELRILVV

SEQ ID NO: 587026 - protein, 9 aa, Homo Sapiens
GSSNRLDEE

SEQ ID NO: 587027 - protein, 9 aa, Homo Sapiens
LDTAGKEEY

SEQ ID NO: 587028 - protein, 9 aa, Homo Sapiens
EATEIIPEL

SEQ ID NO: 587029 - protein, 9 aa, Homo Sapiens
SQQSEVIVR

SEQ ID NO: 587030 - protein, 9 aa, Homo Sapiens
GMREMRAGG

SEQ ID NO: 587031 - protein, 9 aa, Homo Sapiens
LKQYIEKRA

SEQ ID NO: 587032 - protein, 9 aa, Homo Sapiens
LRILVVKLL

SEQ ID NO: 587033 - protein, 9 aa, Homo Sapiens
PMVMAGSGN

SEQ ID NO: 587034 - protein, 9 aa, Homo Sapiens
QTHPASTHM

SEQ ID NO: 587035 - protein, 9 aa, Homo Sapiens
QRIYEMELS

SEQ ID NO: 587036 - protein, 9 aa, Homo Sapiens
GTASACHHT

SEQ ID NO: 587037 - protein, 9 aa, Homo Sapiens
AVAIIHLTV

SEQ ID NO: 587038 - protein, 9 aa, Homo Sapiens
SSVPSCGSA

SEQ ID NO: 587039 - protein, 9 aa, Homo Sapiens
DSSKHIILQ

SEQ ID NO: 587040 - protein, 9 aa, Homo Sapiens
KLKQYIEKR

SEQ ID NO: 587041 - protein, 9 aa, Homo Sapiens
HFGNMKLKQ

SEQ ID NO: 587042 - protein, 9 aa, Homo Sapiens
RGDRYLEED

SEQ ID NO: 587043 - protein, 9 aa, Homo Sapiens
SGFKATSAE

SEQ ID NO: 587044 - protein, 9 aa, Homo Sapiens
QMIKPSLIS

SEQ ID NO: 587045 - protein, 9 aa, Homo Sapiens
NHTGFICGC

SEQ ID NO: 587046 - protein, 9 aa, Homo Sapiens
GDRYLEEDN

SEQ ID NO: 587047 - protein, 9 aa, Homo Sapiens
ASGPASQER

SEQ ID NO: 587048 - protein, 9 aa, Homo Sapiens
EMPQTGFSA

SEQ ID NO: 587049 - protein, 9 aa, Homo Sapiens
SEKPSGFKA

SEQ ID NO: 587050 - protein, 9 aa, Homo Sapiens
VPDYQLKEF

SEQ ID NO: 587051 - protein, 9 aa, Homo Sapiens
ECGKAVTYR

SEQ ID NO: 587052 - protein, 9 aa, Homo Sapiens
PGESDSPWT

SEQ ID NO: 587053 - protein, 9 aa, Homo Sapiens
STEDSMRDD

SEQ ID NO: 587054 - protein, 9 aa, Homo Sapiens
SKDIMKNKV

SEQ ID NO: 587055 - protein, 9 aa, Homo Sapiens
IRQDMIIDK

SEQ ID NO: 587056 - protein, 9 aa, Homo Sapiens
CWKSQLMHQ

SEQ ID NO: 587057 - protein, 9 aa, Homo Sapiens
MWSPEEQGR

SEQ ID NO: 587058 - protein, 9 aa, Homo Sapiens
TVGGQMIKP

SEQ ID NO: 587059 - protein, 9 aa, Homo Sapiens
SGPASQERE

SEQ ID NO: 587060 - protein, 9 aa, Homo Sapiens
AFCWKSQLM

SEQ ID NO: 587061 - protein, 9 aa, Homo Sapiens
GQEEYSAMM

SEQ ID NO: 587062 - protein, 9 aa, Homo Sapiens
QSTEDSMRD

SEQ ID NO: 587063 - protein, 9 aa, Homo Sapiens
TSLLVDTVE

SEQ ID NO: 587064 - protein, 9 aa, Homo Sapiens
FKATSAEKD

SEQ ID NO: 587065 - protein, 9 aa, Homo Sapiens
WLPVNVTEG

SEQ ID NO: 587066 - protein, 9 aa, Homo Sapiens
INRLDLLIV

SEQ ID NO: 587067 - protein, 9 aa, Homo Sapiens
IDHTSLLVD

SEQ ID NO: 587068 - protein, 9 aa, Homo Sapiens
IMHFGNMKL

SEQ ID NO: 587069 - protein, 9 aa, Homo Sapiens
YSAMMDQYM

SEQ ID NO: 587070 - protein, 9 aa, Homo Sapiens
EQSTEDSMR

SEQ ID NO: 587071 - protein, 9 aa, Homo Sapiens
NMKLKQKPR

SEQ ID NO: 587072 - protein, 9 aa, Homo Sapiens
TSSKDIMKN

SEQ ID NO: 587073 - protein, 9 aa, Homo Sapiens
GNMKLKQKP

SEQ ID NO: 587074 - protein, 9 aa, Homo Sapiens
GPASQEREG

SEQ ID NO: 587075 - protein, 9 aa, Homo Sapiens
RPPSPPLSR

SEQ ID NO: 587076 - protein, 9 aa, Homo Sapiens
GIPGMAPPP

SEQ ID NO: 587077 - protein, 9 aa, Homo Sapiens
EVPDYQLKE

SEQ ID NO: 587078 - protein, 9 aa, Homo Sapiens
SQRPDDKCK

SEQ ID NO: 587079 - protein, 9 aa, Homo Sapiens
KAVTYRSEL

SEQ ID NO: 587080 - protein, 9 aa, Homo Sapiens
MKNKVDFRA

SEQ ID NO: 587081 - protein, 9 aa, Homo Sapiens
EDNVVQNFE

SEQ ID NO: 587082 - protein, 9 aa, Homo Sapiens
SPPLSRWER

SEQ ID NO: 587083 - protein, 9 aa, Homo Sapiens
DYQLKEFRE

SEQ ID NO: 587084 - protein, 9 aa, Homo Sapiens
SRCCRRAGC

SEQ ID NO: 587085 - protein, 9 aa, Homo Sapiens
FEMEMPQTG

SEQ ID NO: 587086 - protein, 9 aa, Homo Sapiens
FFSPEPGES

SEQ ID NO: 587087 - protein, 9 aa, Homo Sapiens
ICGCSLERS

SEQ ID NO: 587088 - protein, 9 aa, Homo Sapiens
RLDLLIVPT

SEQ ID NO: 587089 - protein, 9 aa, Homo Sapiens
MKLKQKPRE

SEQ ID NO: 587090 - protein, 9 aa, Homo Sapiens
KVISYYSCL

SEQ ID NO: 587091 - protein, 9 aa, Homo Sapiens
RAGCCYTHS

SEQ ID NO: 587092 - protein, 9 aa, Homo Sapiens
VISYYSCLA

SEQ ID NO: 587093 - protein, 9 aa, Homo Sapiens
MMDQYMRTG

SEQ ID NO: 587094 - protein, 9 aa, Homo Sapiens
QISEDNVVQ

SEQ ID NO: 587095 - protein, 9 aa, Homo Sapiens
KCKDSSPHC

SEQ ID NO: 587096 - protein, 9 aa, Homo Sapiens
GKGFQQKGN

SEQ ID NO: 587097 - protein, 9 aa, Homo Sapiens
TEVPDYQLK

SEQ ID NO: 587098 - protein, 9 aa, Homo Sapiens
IPGMAPPPA

SEQ ID NO: 587099 - protein, 9 aa, Homo Sapiens
QEEYSAMMD

SEQ ID NO: 587100 - protein, 9 aa, Homo Sapiens
ISYYSCLAR

SEQ ID NO: 587101 - protein, 9 aa, Homo Sapiens
QQKGNYKNH

SEQ ID NO: 587102 - protein, 9 aa, Homo Sapiens
VTYRSELII

SEQ ID NO: 587103 - protein, 9 aa, Homo Sapiens
RCCRRAGCC

SEQ ID NO: 587104 - protein, 9 aa, Homo Sapiens
RDDTKPKPK

SEQ ID NO: 587105 - protein, 9 aa, Homo Sapiens
PEEQGRTNL

SEQ ID NO: 587106 - protein, 9 aa, Homo Sapiens
QGIPGMAPP

SEQ ID NO: 587107 - protein, 9 aa, Homo Sapiens
ASFEMEMPQ

SEQ ID NO: 587108 - protein, 9 aa, Homo Sapiens
MIKPSLISW

SEQ ID NO: 587109 - protein, 9 aa, Homo Sapiens
PQHKVRGDR

SEQ ID NO: 587110 - protein, 9 aa, Homo Sapiens
LKQKPREEQ

SEQ ID NO: 587111 - protein, 9 aa, Homo Sapiens
GLKQSLTPS

SEQ ID NO: 587112 - protein, 9 aa, Homo Sapiens
VTEGGARQE

SEQ ID NO: 587113 - protein, 9 aa, Homo Sapiens
SSKDIMKNK

SEQ ID NO: 587114 - protein, 9 aa, Homo Sapiens
KVRGDRYLE

SEQ ID NO: 587115 - protein, 9 aa, Homo Sapiens
PEPGESDSP

SEQ ID NO: 587116 - protein, 9 aa, Homo Sapiens
SDSPWTGSG

SEQ ID NO: 587117 - protein, 9 aa, Homo Sapiens
TEDSMRDDT

SEQ ID NO: 587118 - protein, 9 aa, Homo Sapiens
VNVTEGGAR

SEQ ID NO: 587119 - protein, 9 aa, Homo Sapiens
CGKGFQQKG

SEQ ID NO: 587120 - protein, 9 aa, Homo Sapiens
KLKQKPREE

SEQ ID NO: 587121 - protein, 9 aa, Homo Sapiens
VQNFEKTLE

SEQ ID NO: 587122 - protein, 9 aa, Homo Sapiens
SLLVDTVEK

SEQ ID NO: 587123 - protein, 9 aa, Homo Sapiens
GFICGCSLE

SEQ ID NO: 587124 - protein, 9 aa, Homo Sapiens
LVAQGIPGS

SEQ ID NO: 587125 - protein, 9 aa, Homo Sapiens
REALGRQSL

SEQ ID NO: 587126 - protein, 9 aa, Homo Sapiens
MDQYMRTGE

SEQ ID NO: 587127 - protein, 9 aa, Homo Sapiens
LGRQSLESY

SEQ ID NO: 587128 - protein, 9 aa, Homo Sapiens
RWERVSRLM

SEQ ID NO: 587129 - protein, 9 aa, Homo Sapiens
DHTSLLVDT

SEQ ID NO: 587130 - protein, 9 aa, Homo Sapiens
CGKVISYYS

SEQ ID NO: 587131 - protein, 9 aa, Homo Sapiens
GFKATSAEK

SEQ ID NO: 587132 - protein, 9 aa, Homo Sapiens
LVAQGIPGM

SEQ ID NO: 587133 - protein, 9 aa, Homo Sapiens
STDFECDKL

SEQ ID NO: 587134 - protein, 9 aa, Homo Sapiens
PSGFKATSA

SEQ ID NO: 587135 - protein, 9 aa, Homo Sapiens
PVLVAQGIP

SEQ ID NO: 587136 - protein, 9 aa, Homo Sapiens
WKSQLMHQR

SEQ ID NO: 587137 - protein, 9 aa, Homo Sapiens
QGRTNLQVP

SEQ ID NO: 587138 - protein, 9 aa, Homo Sapiens
SPEEQGRTN

SEQ ID NO: 587139 - protein, 9 aa, Homo Sapiens
VSTDFECDK

SEQ ID NO: 587140 - protein, 9 aa, Homo Sapiens
VGGQMIKPS

SEQ ID NO: 587141 - protein, 9 aa, Homo Sapiens
ETVSTDFEC

SEQ ID NO: 587142 - protein, 9 aa, Homo Sapiens
SLNHTGFIC

SEQ ID NO: 587143 - protein, 9 aa, Homo Sapiens
VRGDRYLEE

SEQ ID NO: 587144 - protein, 9 aa, Homo Sapiens
DFECDKLYF

SEQ ID NO: 587145 - protein, 9 aa, Homo Sapiens
LLVDTVEKI

SEQ ID NO: 587146 - protein, 9 aa, Homo Sapiens
GRQSLESYL

SEQ ID NO: 587147 - protein, 9 aa, Homo Sapiens
CGKAVTYRS

SEQ ID NO: 587148 - protein, 9 aa, Homo Sapiens
ATVGGQMIK

SEQ ID NO: 587149 - protein, 9 aa, Homo Sapiens
VDTVEKIAW

SEQ ID NO: 587150 - protein, 9 aa, Homo Sapiens
FSPEPGESD

SEQ ID NO: 587151 - protein, 9 aa, Homo Sapiens
GPGPHSLNH

SEQ ID NO: 587152 - protein, 9 aa, Homo Sapiens
GCSLERSLC

SEQ ID NO: 587153 - protein, 9 aa, Homo Sapiens
PCSQRPDDK

SEQ ID NO: 587154 - protein, 9 aa, Homo Sapiens
SRWERVSRL

SEQ ID NO: 587155 - protein, 9 aa, Homo Sapiens
NVTEGGARQ

SEQ ID NO: 587156 - protein, 9 aa, Homo Sapiens
ESDSPWTGS

SEQ ID NO: 587157 - protein, 9 aa, Homo Sapiens
KSQLMHQRT

SEQ ID NO: 587158 - protein, 9 aa, Homo Sapiens
KQSLTPSPA

SEQ ID NO: 587159 - protein, 9 aa, Homo Sapiens
AQGIPGMAP

SEQ ID NO: 587160 - protein, 9 aa, Homo Sapiens
SPEPGESDS

SEQ ID NO: 587161 - protein, 9 aa, Homo Sapiens
NECGKVISY

SEQ ID NO: 587162 - protein, 9 aa, Homo Sapiens
ICTECGKAV

SEQ ID NO: 587163 - protein, 9 aa, Homo Sapiens
PVNVTEGGA

SEQ ID NO: 587164 - protein, 9 aa, Homo Sapiens
GTSSKDIMK

SEQ ID NO: 587165 - protein, 9 aa, Homo Sapiens
SFEMEMPQT

SEQ ID NO: 587166 - protein, 9 aa, Homo Sapiens
SQLMHQRTH

SEQ ID NO: 587167 - protein, 9 aa, Homo Sapiens
DRYLEEDNS

SEQ ID NO: 587168 - protein, 9 aa, Homo Sapiens
SMRDDTKPK

SEQ ID NO: 587169 - protein, 9 aa, Homo Sapiens
CGCSLERSL

SEQ ID NO: 587170 - protein, 9 aa, Homo Sapiens
DGTSSKDIM

SEQ ID NO: 587171 - protein, 9 aa, Homo Sapiens
PQTGFSAHY

SEQ ID NO: 587172 - protein, 9 aa, Homo Sapiens
VSSEKPSGF

SEQ ID NO: 587173 - protein, 9 aa, Homo Sapiens
MASGPASQE

SEQ ID NO: 587174 - protein, 9 aa, Homo Sapiens
SSEKPSGFK

SEQ ID NO: 587175 - protein, 9 aa, Homo Sapiens
DLPIRQDMI

SEQ ID NO: 587176 - protein, 9 aa, Homo Sapiens
CCRRAGCCY

SEQ ID NO: 587177 - protein, 9 aa, Homo Sapiens
LSRWERVSR

SEQ ID NO: 587178 - protein, 9 aa, Homo Sapiens
AQGIPGSPG

SEQ ID NO: 587179 - protein, 9 aa, Homo Sapiens
GRIDLPIRQ

SEQ ID NO: 587180 - protein, 9 aa, Homo Sapiens
IPGSPGGLG

SEQ ID NO: 587181 - protein, 9 aa, Homo Sapiens
VLVAQGIPG

SEQ ID NO: 587182 - protein, 9 aa, Homo Sapiens
NLATVGGQM

SEQ ID NO: 587183 - protein, 9 aa, Homo Sapiens
SLTPSPAGP

SEQ ID NO: 587184 - protein, 9 aa, Homo Sapiens
YQLKEFREV

SEQ ID NO: 587185 - protein, 9 aa, Homo Sapiens
GIDHTSLLV

SEQ ID NO: 587186 - protein, 9 aa, Homo Sapiens
NVVQNFEKT

SEQ ID NO: 587187 - protein, 9 aa, Homo Sapiens
AVTYRSELI

SEQ ID NO: 587188 - protein, 9 aa, Homo Sapiens
QHKVRGDRY

SEQ ID NO: 587189 - protein, 9 aa, Homo Sapiens
DKCKDSSPH

SEQ ID NO: 587190 - protein, 9 aa, Homo Sapiens
RPQHKVRGD

SEQ ID NO: 587191 - protein, 9 aa, Homo Sapiens
PIRQDMIID

SEQ ID NO: 587192 - protein, 9 aa, Homo Sapiens
EDSMRDDTK

SEQ ID NO: 587193 - protein, 9 aa, Homo Sapiens
ARREALGRQ

SEQ ID NO: 587194 - protein, 9 aa, Homo Sapiens
IDLPIRQDM

SEQ ID NO: 587195 - protein, 9 aa, Homo Sapiens
EQGRTNLQV

SEQ ID NO: 587196 - protein, 9 aa, Homo Sapiens
EEQGRTNLQ

SEQ ID NO: 587197 - protein, 9 aa, Homo Sapiens
AMMDQYMRT

SEQ ID NO: 587198 - protein, 9 aa, Homo Sapiens
GRTNLQVPS

SEQ ID NO: 587199 - protein, 9 aa, Homo Sapiens
EEYSAMMDQ

SEQ ID NO: 587200 - protein, 9 aa, Homo Sapiens
PPLSRWERV

SEQ ID NO: 587201 - protein, 9 aa, Homo Sapiens
QSLTPSPAG

SEQ ID NO: 587202 - protein, 9 aa, Homo Sapiens
RQDMIIDKL

SEQ ID NO: 587203 - protein, 9 aa, Homo Sapiens
GQMIKPSLI

SEQ ID NO: 587204 - protein, 9 aa, Homo Sapiens
WSPEEQGRT

SEQ ID NO: 587205 - protein, 9 aa, Homo Sapiens
QCNECGKVI

SEQ ID NO: 587206 - protein, 9 aa, Homo Sapiens
VAQGIPGSP

SEQ ID NO: 587207 - protein, 9 aa, Homo Sapiens
LTPSPAGPG

SEQ ID NO: 587208 - protein, 9 aa, Homo Sapiens
GESDSPWTG

SEQ ID NO: 587209 - protein, 9 aa, Homo Sapiens
PAGPGPHSL

SEQ ID NO: 587210 - protein, 9 aa, Homo Sapiens
ALGRQSLES

SEQ ID NO: 587211 - protein, 9 aa, Homo Sapiens
PETVSTDFE

SEQ ID NO: 587212 - protein, 9 aa, Homo Sapiens
TVSTDFECD

SEQ ID NO: 587213 - protein, 9 aa, Homo Sapiens
PDYQLKEFR

SEQ ID NO: 587214 - protein, 9 aa, Homo Sapiens
LNHTGFICG

SEQ ID NO: 587215 - protein, 9 aa, Homo Sapiens
GKVISYYSC

SEQ ID NO: 587216 - protein, 9 aa, Homo Sapiens
FGNMKLKQK

SEQ ID NO: 587217 - protein, 9 aa, Homo Sapiens
AIRTEVPDY

SEQ ID NO: 587218 - protein, 9 aa, Homo Sapiens
QLMHQRTHV

SEQ ID NO: 587219 - protein, 9 aa, Homo Sapiens
TGFICGCSL

SEQ ID NO: 587220 - protein, 9 aa, Homo Sapiens
ECGKVISYY

SEQ ID NO: 587221 - protein, 9 aa, Homo Sapiens
FICGCSLER

SEQ ID NO: 587222 - protein, 9 aa, Homo Sapiens
FCWKSQLMH

SEQ ID NO: 587223 - protein, 9 aa, Homo Sapiens
PDDKCKDSS

SEQ ID NO: 587224 - protein, 9 aa, Homo Sapiens
TECGKAVTY

SEQ ID NO: 587225 - protein, 9 aa, Homo Sapiens
SMWSPEEQG

SEQ ID NO: 587226 - protein, 9 aa, Homo Sapiens
SPAGPGPHS

SEQ ID NO: 587227 - protein, 9 aa, Homo Sapiens
LPVNVTEGG

SEQ ID NO: 587228 - protein, 9 aa, Homo Sapiens
HKVRGDRYL

SEQ ID NO: 587229 - protein, 9 aa, Homo Sapiens
AASFEMEMP

SEQ ID NO: 587230 - protein, 9 aa, Homo Sapiens
PASQEREGL

SEQ ID NO: 587231 - protein, 9 aa, Homo Sapiens
RRAGCCYTH

SEQ ID NO: 587232 - protein, 9 aa, Homo Sapiens
IMKNKVDFR

SEQ ID NO: 587233 - protein, 9 aa, Homo Sapiens
MEMPQTGFS

SEQ ID NO: 587234 - protein, 9 aa, Homo Sapiens
PPSPPLSRW

SEQ ID NO: 587235 - protein, 9 aa, Homo Sapiens
LATVGGQMI

SEQ ID NO: 587236 - protein, 9 aa, Homo Sapiens
DDKCKDSSP

SEQ ID NO: 587237 - protein, 9 aa, Homo Sapiens
PSPPLSRWE

SEQ ID NO: 587238 - protein, 9 aa, Homo Sapiens
DIMKNKVDF

SEQ ID NO: 587239 - protein, 9 aa, Homo Sapiens
RPDDKCKDS

SEQ ID NO: 587240 - protein, 9 aa, Homo Sapiens
DSMRDDTKP

SEQ ID NO: 587241 - protein, 9 aa, Homo Sapiens
GIPGSPGGL

SEQ ID NO: 587242 - protein, 9 aa, Homo Sapiens
EALGRQSLE

SEQ ID NO: 587243 - protein, 9 aa, Homo Sapiens
HSLNHTGFI

SEQ ID NO: 587244 - protein, 9 aa, Homo Sapiens
FCGKGFQQK

SEQ ID NO: 587245 - protein, 9 aa, Homo Sapiens
MPQTGFSAH

SEQ ID NO: 587246 - protein, 9 aa, Homo Sapiens
EFCGKGFQQ

SEQ ID NO: 587247 - protein, 9 aa, Homo Sapiens
GKAVTYRSE

SEQ ID NO: 587248 - protein, 9 aa, Homo Sapiens
EGGARQEQR

SEQ ID NO: 587249 - protein, 9 aa, Homo Sapiens
QRPDDKCKD

SEQ ID NO: 587250 - protein, 9 aa, Homo Sapiens
RREALGRQS

SEQ ID NO: 587251 - protein, 9 aa, Homo Sapiens
RIDLPIRQD

SEQ ID NO: 587252 - protein, 9 aa, Homo Sapiens
PTKDSQHVL

SEQ ID NO: 587253 - protein, 9 aa, Homo Sapiens
QPVLVAQGI

SEQ ID NO: 587254 - protein, 9 aa, Homo Sapiens
EMEMPQTGF

SEQ ID NO: 587255 - protein, 9 aa, Homo Sapiens
AGPGPHSLN

SEQ ID NO: 587256 - protein, 9 aa, Homo Sapiens
KPSGFKATS

SEQ ID NO: 587257 - protein, 9 aa, Homo Sapiens
CRRAGCCYT

SEQ ID NO: 587258 - protein, 9 aa, Homo Sapiens
EKPSGFKAT

SEQ ID NO: 587259 - protein, 9 aa, Homo Sapiens
PWLPVNVTE

SEQ ID NO: 587260 - protein, 9 aa, Homo Sapiens
AGCCYTHSC

SEQ ID NO: 587261 - protein, 9 aa, Homo Sapiens
PGPHSLNHT

SEQ ID NO: 587262 - protein, 9 aa, Homo Sapiens
ISEDNVVQN

SEQ ID NO: 587263 - protein, 9 aa, Homo Sapiens
SEDNVVQNF

SEQ ID NO: 587264 - protein, 9 aa, Homo Sapiens
QARREALGR

SEQ ID NO: 587265 - protein, 9 aa, Homo Sapiens
LVDTVEKIA

SEQ ID NO: 587266 - protein, 9 aa, Homo Sapiens
LQISEDNVV

SEQ ID NO: 587267 - protein, 9 aa, Homo Sapiens
FECDKLYFE

SEQ ID NO: 587268 - protein, 9 aa, Homo Sapiens
FQQKGNYKN

SEQ ID NO: 587269 - protein, 9 aa, Homo Sapiens
LPIRQDMII

SEQ ID NO: 587270 - protein, 9 aa, Homo Sapiens
KGFQQKGNY

SEQ ID NO: 587271 - protein, 9 aa, Homo Sapiens
TDFECDKLY

SEQ ID NO: 587272 - protein, 9 aa, Homo Sapiens
GGQMIKPSL

SEQ ID NO: 587273 - protein, 9 aa, Homo Sapiens
LKQSLTPSP

SEQ ID NO: 587274 - protein, 9 aa, Homo Sapiens
MHFGNMKLK

SEQ ID NO: 587275 - protein, 9 aa, Homo Sapiens
SAMMDQYMR

SEQ ID NO: 587276 - protein, 9 aa, Homo Sapiens
IRTEVPDYQ

SEQ ID NO: 587277 - protein, 9 aa, Homo Sapiens
CEFCGKGFQ

SEQ ID NO: 587278 - protein, 9 aa, Homo Sapiens
GCCYTHSCC

SEQ ID NO: 587279 - protein, 9 aa, Homo Sapiens
CTECGKAVT

SEQ ID NO: 587280 - protein, 9 aa, Homo Sapiens
TPSPAGPGP

SEQ ID NO: 587281 - protein, 9 aa, Homo Sapiens
HTSLLVDTV

SEQ ID NO: 587282 - protein, 9 aa, Homo Sapiens
PSPAGPGPH

SEQ ID NO: 587283 - protein, 9 aa, Homo Sapiens
ASQEREGLL

SEQ ID NO: 587284 - protein, 9 aa, Homo Sapiens
KGRIDLPIR

SEQ ID NO: 587285 - protein, 9 aa, Homo Sapiens
LQARREALG

SEQ ID NO: 587286 - protein, 9 aa, Homo Sapiens
CSQRPDDKC

SEQ ID NO: 587287 - protein, 9 aa, Homo Sapiens
PHSLNHTGF

SEQ ID NO: 587288 - protein, 9 aa, Homo Sapiens
TEGGARQEQ

SEQ ID NO: 587289 - protein, 9 aa, Homo Sapiens
EPGESDSPW

SEQ ID NO: 587290 - protein, 9 aa, Homo Sapiens
RTEVPDYQL

SEQ ID NO: 587291 - protein, 9 aa, Homo Sapiens
CNECGKVIS

SEQ ID NO: 587292 - protein, 9 aa, Homo Sapiens
KDIMKNKVD

SEQ ID NO: 587293 - protein, 9 aa, Homo Sapiens
GFQQKGNYK

SEQ ID NO: 587294 - protein, 9 aa, Homo Sapiens
VVQNFEKTL

SEQ ID NO: 587295 - protein, 9 aa, Homo Sapiens
HTGFICGCS

SEQ ID NO: 587296 - protein, 9 aa, Homo Sapiens
NRLDLLIVP

SEQ ID NO: 587297 - protein, 9 aa, Homo Sapiens
PLSRWERVS

SEQ ID NO: 587298 - protein, 9 aa, Homo Sapiens
LMHQRTHVD

SEQ ID NO: 587299 - protein, 9 aa, Homo Sapiens
EYSAMMDQY

SEQ ID NO: 587300 - protein, 9 aa, Homo Sapiens
VAQGIPGMA

SEQ ID NO: 587301 - protein, 9 aa, Homo Sapiens
DNVVQNFEK

SEQ ID NO: 587302 - protein, 9 aa, Homo Sapiens
GPHSLNHTG

SEQ ID NO: 587303 - protein, 9 aa, Homo Sapiens
MRDDTKPKP

SEQ ID NO: 587304 - protein, 9 aa, Homo Sapiens
QGIPGSPGG

SEQ ID NO: 587305 - protein, 9 aa, Homo Sapiens
SADPGRDPL

SEQ ID NO: 587306 - protein, 9 aa, Homo Sapiens
RLPKHDRGK

SEQ ID NO: 587307 - protein, 9 aa, Homo Sapiens
QKPEPMDVL

SEQ ID NO: 587308 - protein, 9 aa, Homo Sapiens
GIVKAASGF

SEQ ID NO: 587309 - protein, 9 aa, Homo Sapiens
AAGQDLQQA

SEQ ID NO: 587310 - protein, 9 aa, Homo Sapiens
VLVPTEGWN

SEQ ID NO: 587311 - protein, 9 aa, Homo Sapiens
DKARRLKHQ

SEQ ID NO: 587312 - protein, 9 aa, Homo Sapiens
KRTNWKVAI

SEQ ID NO: 587313 - protein, 9 aa, Homo Sapiens
ESSSSHVAK

SEQ ID NO: 587314 - protein, 9 aa, Homo Sapiens
EGWNKLLNW

SEQ ID NO: 587315 - protein, 9 aa, Homo Sapiens
ISGERLPKH

SEQ ID NO: 587316 - protein, 9 aa, Homo Sapiens
NSQKGACST

SEQ ID NO: 587317 - protein, 9 aa, Homo Sapiens
LIRTRTSYF

SEQ ID NO: 587318 - protein, 9 aa, Homo Sapiens
QVVNVLNSM

SEQ ID NO: 587319 - protein, 9 aa, Homo Sapiens
KGSLTILRI

SEQ ID NO: 587320 - protein, 9 aa, Homo Sapiens
LCLLSGVAA

SEQ ID NO: 587321 - protein, 9 aa, Homo Sapiens
PTEGWNKLL

SEQ ID NO: 587322 - protein, 9 aa, Homo Sapiens
AAVVSNGLG

SEQ ID NO: 587323 - protein, 9 aa, Homo Sapiens
EIIKQLKID

SEQ ID NO: 587324 - protein, 9 aa, Homo Sapiens
GERLPKHDR

SEQ ID NO: 587325 - protein, 9 aa, Homo Sapiens
QQDSEAIIS

SEQ ID NO: 587326 - protein, 9 aa, Homo Sapiens
FLSTVRGAT

SEQ ID NO: 587327 - protein, 9 aa, Homo Sapiens
RNKTFVVQG

SEQ ID NO: 587328 - protein, 9 aa, Homo Sapiens
WSVVGAQLI

SEQ ID NO: 587329 - protein, 9 aa, Homo Sapiens
VPTEGWNKL

SEQ ID NO: 587330 - protein, 9 aa, Homo Sapiens
AVGLLRAAL

SEQ ID NO: 587331 - protein, 9 aa, Homo Sapiens
QLLQEDFLN

SEQ ID NO: 587332 - protein, 9 aa, Homo Sapiens
DGLPTPRCS

SEQ ID NO: 587333 - protein, 9 aa, Homo Sapiens
RAGGCSPGP

SEQ ID NO: 587334 - protein, 9 aa, Homo Sapiens
PPSFVQKPE

SEQ ID NO: 587335 - protein, 9 aa, Homo Sapiens
QGCSPGSLG

SEQ ID NO: 587336 - protein, 9 aa, Homo Sapiens
EITPRILVW

SEQ ID NO: 587337 - protein, 9 aa, Homo Sapiens
EAWDMNEKK

SEQ ID NO: 587338 - protein, 9 aa, Homo Sapiens
LLRAALILR

SEQ ID NO: 587339 - protein, 9 aa, Homo Sapiens
AIMSSLFDM

SEQ ID NO: 587340 - protein, 9 aa, Homo Sapiens
ILDQPYRLN

SEQ ID NO: 587341 - protein, 9 aa, Homo Sapiens
PLLIRTRTS

SEQ ID NO: 587342 - protein, 9 aa, Homo Sapiens
KAPSTQKKF

SEQ ID NO: 587343 - protein, 9 aa, Homo Sapiens
ETTGERTDV

SEQ ID NO: 587344 - protein, 9 aa, Homo Sapiens
ESREFEFEA

SEQ ID NO: 587345 - protein, 9 aa, Homo Sapiens
YYPSEDMAV

SEQ ID NO: 587346 - protein, 9 aa, Homo Sapiens
QGGSSAGHP

SEQ ID NO: 587347 - protein, 9 aa, Homo Sapiens
QDLQQADHT

SEQ ID NO: 587348 - protein, 9 aa, Homo Sapiens
FHEALNGFH

SEQ ID NO: 587349 - protein, 9 aa, Homo Sapiens
CPCDKYNEQ

SEQ ID NO: 587350 - protein, 9 aa, Homo Sapiens
QQWVGAALR

SEQ ID NO: 587351 - protein, 9 aa, Homo Sapiens
SYPLLIRTR

SEQ ID NO: 587352 - protein, 9 aa, Homo Sapiens
SFEPPETPG

SEQ ID NO: 587353 - protein, 9 aa, Homo Sapiens
HGWQHSLLS

SEQ ID NO: 587354 - protein, 9 aa, Homo Sapiens
TTGERTDVI

SEQ ID NO: 587355 - protein, 9 aa, Homo Sapiens
KSCTKRDIK

SEQ ID NO: 587356 - protein, 9 aa, Homo Sapiens
PVSADPGRD

SEQ ID NO: 587357 - protein, 9 aa, Homo Sapiens
PTCPGGTGH

SEQ ID NO: 587358 - protein, 9 aa, Homo Sapiens
TLTYWDENV

SEQ ID NO: 587359 - protein, 9 aa, Homo Sapiens
ECRILGKVE

SEQ ID NO: 587360 - protein, 9 aa, Homo Sapiens
RILDQPYRL

SEQ ID NO: 587361 - protein, 9 aa, Homo Sapiens
KTNSQKGAC

SEQ ID NO: 587362 - protein, 9 aa, Homo Sapiens
DQGGSSAGH

SEQ ID NO: 587363 - protein, 9 aa, Homo Sapiens
TQRLGARAG

SEQ ID NO: 587364 - protein, 9 aa, Homo Sapiens
TGHHCNKLF

SEQ ID NO: 587365 - protein, 9 aa, Homo Sapiens
IIKQLKIDL

SEQ ID NO: 587366 - protein, 9 aa, Homo Sapiens
KGGIVKAAS

SEQ ID NO: 587367 - protein, 9 aa, Homo Sapiens
VTAKGSLTI

SEQ ID NO: 587368 - protein, 9 aa, Homo Sapiens
ETLPVSADP

SEQ ID NO: 587369 - protein, 9 aa, Homo Sapiens
GSLGQGEPP

SEQ ID NO: 587370 - protein, 9 aa, Homo Sapiens
MLQERGFPE

SEQ ID NO: 587371 - protein, 9 aa, Homo Sapiens
VYSKLCKEA

SEQ ID NO: 587372 - protein, 9 aa, Homo Sapiens
SPGPALGQL

SEQ ID NO: 587373 - protein, 9 aa, Homo Sapiens
EPPTCPGGT

SEQ ID NO: 587374 - protein, 9 aa, Homo Sapiens
SQKGACSTW

SEQ ID NO: 587375 - protein, 9 aa, Homo Sapiens
WDMNEKKQA

SEQ ID NO: 587376 - protein, 9 aa, Homo Sapiens
QERGFPELL

SEQ ID NO: 587377 - protein, 9 aa, Homo Sapiens
GGSSAGHPA

SEQ ID NO: 587378 - protein, 9 aa, Homo Sapiens
TMENYSMEA

SEQ ID NO: 587379 - protein, 9 aa, Homo Sapiens
TVLWYSVVH

SEQ ID NO: 587380 - protein, 9 aa, Homo Sapiens
NSLDWNAEY

SEQ ID NO: 587381 - protein, 9 aa, Homo Sapiens
GCGSALAAP

SEQ ID NO: 587382 - protein, 9 aa, Homo Sapiens
PGVKDSTIG

SEQ ID NO: 587383 - protein, 9 aa, Homo Sapiens
NYSMEAQFV

SEQ ID NO: 587384 - protein, 9 aa, Homo Sapiens
RDANTYKIC

SEQ ID NO: 587385 - protein, 9 aa, Homo Sapiens
LLWQATPAQ

SEQ ID NO: 587386 - protein, 9 aa, Homo Sapiens
QCVSFSGVK

SEQ ID NO: 587387 - protein, 9 aa, Homo Sapiens
KSGSFLMPE

SEQ ID NO: 587388 - protein, 9 aa, Homo Sapiens
RDVTAKGSL

SEQ ID NO: 587389 - protein, 9 aa, Homo Sapiens
CSPGPALGQ

SEQ ID NO: 587390 - protein, 9 aa, Homo Sapiens
SIAFADMLL

SEQ ID NO: 587391 - protein, 9 aa, Homo Sapiens
GSDHVMLNS

SEQ ID NO: 587392 - protein, 9 aa, Homo Sapiens
DPDVLLYYP

SEQ ID NO: 587393 - protein, 9 aa, Homo Sapiens
ERLPKHDRG

SEQ ID NO: 587394 - protein, 9 aa, Homo Sapiens
CRKELARRV

SEQ ID NO: 587395 - protein, 9 aa, Homo Sapiens
VAVLEETTG

SEQ ID NO: 587396 - protein, 9 aa, Homo Sapiens
MENYSMEAQ

SEQ ID NO: 587397 - protein, 9 aa, Homo Sapiens
GDDIFLMAQ

SEQ ID NO: 587398 - protein, 9 aa, Homo Sapiens
PRADRAALQ

SEQ ID NO: 587399 - protein, 9 aa, Homo Sapiens
LRAALILRV

SEQ ID NO: 587400 - protein, 9 aa, Homo Sapiens
LLLTVLWYS

SEQ ID NO: 587401 - protein, 9 aa, Homo Sapiens
KRLQCVSFS

SEQ ID NO: 587402 - protein, 9 aa, Homo Sapiens
AMPGLAPTV

SEQ ID NO: 587403 - protein, 9 aa, Homo Sapiens
RTSYFFGGC

SEQ ID NO: 587404 - protein, 9 aa, Homo Sapiens
SLALPAEVT

SEQ ID NO: 587405 - protein, 9 aa, Homo Sapiens
FPCTVRWFH

SEQ ID NO: 587406 - protein, 9 aa, Homo Sapiens
GHRLLWQAT

SEQ ID NO: 587407 - protein, 9 aa, Homo Sapiens
QDKETLPDL

SEQ ID NO: 587408 - protein, 9 aa, Homo Sapiens
EKSCTKRDI

SEQ ID NO: 587409 - protein, 9 aa, Homo Sapiens
SHVAKGETL

SEQ ID NO: 587410 - protein, 9 aa, Homo Sapiens
SFQGLQNLS

SEQ ID NO: 587411 - protein, 9 aa, Homo Sapiens
IFLMAQALE

SEQ ID NO: 587412 - protein, 9 aa, Homo Sapiens
NVPNVPYNK

SEQ ID NO: 587413 - protein, 9 aa, Homo Sapiens
FLMAQALEK

SEQ ID NO: 587414 - protein, 9 aa, Homo Sapiens
DSYAASLSK

SEQ ID NO: 587415 - protein, 9 aa, Homo Sapiens
DYLQLQKVL

SEQ ID NO: 587416 - protein, 9 aa, Homo Sapiens
CNESREFEF

SEQ ID NO: 587417 - protein, 9 aa, Homo Sapiens
ISAAYVQGK

SEQ ID NO: 587418 - protein, 9 aa, Homo Sapiens
PPETPGVKD

SEQ ID NO: 587419 - protein, 9 aa, Homo Sapiens
VSLALPAEV

SEQ ID NO: 587420 - protein, 9 aa, Homo Sapiens
TNSQKGACS

SEQ ID NO: 587421 - protein, 9 aa, Homo Sapiens
GDKAPSTQK

SEQ ID NO: 587422 - protein, 9 aa, Homo Sapiens
EDFLNVADL

SEQ ID NO: 587423 - protein, 9 aa, Homo Sapiens
LGARAGGCS

SEQ ID NO: 587424 - protein, 9 aa, Homo Sapiens
QQAEEIEKD

SEQ ID NO: 587425 - protein, 9 aa, Homo Sapiens
GLYTCNESR

SEQ ID NO: 587426 - protein, 9 aa, Homo Sapiens
WKVAIDERS

SEQ ID NO: 587427 - protein, 9 aa, Homo Sapiens
LMGTGHHCN

SEQ ID NO: 587428 - protein, 9 aa, Homo Sapiens
WYSVVHTSA

SEQ ID NO: 587429 - protein, 9 aa, Homo Sapiens
NDRDQGGSS

SEQ ID NO: 587430 - protein, 9 aa, Homo Sapiens
GTWKHVRRY

SEQ ID NO: 587431 - protein, 9 aa, Homo Sapiens
LETLPVSAD

SEQ ID NO: 587432 - protein, 9 aa, Homo Sapiens
QWVGAALRL

SEQ ID NO: 587433 - protein, 9 aa, Homo Sapiens
YSKLCKEAE

SEQ ID NO: 587434 - protein, 9 aa, Homo Sapiens
SGELLNMAV

SEQ ID NO: 587435 - protein, 9 aa, Homo Sapiens
ESRKMYDDA

SEQ ID NO: 587436 - protein, 9 aa, Homo Sapiens
VGLTDGLPT

SEQ ID NO: 587437 - protein, 9 aa, Homo Sapiens
ILLASIAFA

SEQ ID NO: 587438 - protein, 9 aa, Homo Sapiens
WLPKKPMRQ

SEQ ID NO: 587439 - protein, 9 aa, Homo Sapiens
PRPQDHDTD

SEQ ID NO: 587440 - protein, 9 aa, Homo Sapiens
RAAQDCRKE

SEQ ID NO: 587441 - protein, 9 aa, Homo Sapiens
APRDASFGQ

SEQ ID NO: 587442 - protein, 9 aa, Homo Sapiens
SSKTTTSVP

SEQ ID NO: 587443 - protein, 9 aa, Homo Sapiens
VLEETTGER

SEQ ID NO: 587444 - protein, 9 aa, Homo Sapiens
AGQDLQQAD

SEQ ID NO: 587445 - protein, 9 aa, Homo Sapiens
DCRKELARR

SEQ ID NO: 587446 - protein, 9 aa, Homo Sapiens
IRKANPGSG

SEQ ID NO: 587447 - protein, 9 aa, Homo Sapiens
GLQILTYAL

SEQ ID NO: 587448 - protein, 9 aa, Homo Sapiens
GTGHHCNKL

SEQ ID NO: 587449 - protein, 9 aa, Homo Sapiens
ANPGSGFVY

SEQ ID NO: 587450 - protein, 9 aa, Homo Sapiens
QHILPQRRC

SEQ ID NO: 587451 - protein, 9 aa, Homo Sapiens
FGQHELGSN

SEQ ID NO: 587452 - protein, 9 aa, Homo Sapiens
VQSTYLLIA

SEQ ID NO: 587453 - protein, 9 aa, Homo Sapiens
PGGTGHRLL

SEQ ID NO: 587454 - protein, 9 aa, Homo Sapiens
WGPTPRADR

SEQ ID NO: 587455 - protein, 9 aa, Homo Sapiens
FVRNLGLKH

SEQ ID NO: 587456 - protein, 9 aa, Homo Sapiens
GHHCNKLFL

SEQ ID NO: 587457 - protein, 9 aa, Homo Sapiens
RPQDHDTDL

SEQ ID NO: 587458 - protein, 9 aa, Homo Sapiens
SSAGHPASR

SEQ ID NO: 587459 - protein, 9 aa, Homo Sapiens
RLKHQQAEE

SEQ ID NO: 587460 - protein, 9 aa, Homo Sapiens
THVFPTHDF

SEQ ID NO: 587461 - protein, 9 aa, Homo Sapiens
GGLSLWSVV

SEQ ID NO: 587462 - protein, 9 aa, Homo Sapiens
NGVAIMSSL

SEQ ID NO: 587463 - protein, 9 aa, Homo Sapiens
WESEFGQHE

SEQ ID NO: 587464 - protein, 9 aa, Homo Sapiens
LWYSVVHTS

SEQ ID NO: 587465 - protein, 9 aa, Homo Sapiens
CSHWGPAMP

SEQ ID NO: 587466 - protein, 9 aa, Homo Sapiens
FVQKPEPMD

SEQ ID NO: 587467 - protein, 9 aa, Homo Sapiens
VDRLMLQYL

SEQ ID NO: 587468 - protein, 9 aa, Homo Sapiens
PEVSPANGF

SEQ ID NO: 587469 - protein, 9 aa, Homo Sapiens
KLITRSVSG

SEQ ID NO: 587470 - protein, 9 aa, Homo Sapiens
LKHLEQQEK

SEQ ID NO: 587471 - protein, 9 aa, Homo Sapiens
IDLALEANS

SEQ ID NO: 587472 - protein, 9 aa, Homo Sapiens
LQEMYKASQ

SEQ ID NO: 587473 - protein, 9 aa, Homo Sapiens
YLIQQDSEA

SEQ ID NO: 587474 - protein, 9 aa, Homo Sapiens
AAQDCRKEL

SEQ ID NO: 587475 - protein, 9 aa, Homo Sapiens
PFHEALNGF

SEQ ID NO: 587476 - protein, 9 aa, Homo Sapiens
LSLWSVVGA

SEQ ID NO: 587477 - protein, 9 aa, Homo Sapiens
QGLQNLSKI

SEQ ID NO: 587478 - protein, 9 aa, Homo Sapiens
PEPMDVLTG

SEQ ID NO: 587479 - protein, 9 aa, Homo Sapiens
VSPANGFNR

SEQ ID NO: 587480 - protein, 9 aa, Homo Sapiens
YECRILGKV

SEQ ID NO: 587481 - protein, 9 aa, Homo Sapiens
ENYSMEAQF

SEQ ID NO: 587482 - protein, 9 aa, Homo Sapiens
SLLSPILSC

SEQ ID NO: 587483 - protein, 9 aa, Homo Sapiens
VAKGETLDL

SEQ ID NO: 587484 - protein, 9 aa, Homo Sapiens
KSSKTTTSV

SEQ ID NO: 587485 - protein, 9 aa, Homo Sapiens
KSSSRLTYI

SEQ ID NO: 587486 - protein, 9 aa, Homo Sapiens
AIKQQWVGA

SEQ ID NO: 587487 - protein, 9 aa, Homo Sapiens
RWMVLEAIS

SEQ ID NO: 587488 - protein, 9 aa, Homo Sapiens
AKGSLTILR

SEQ ID NO: 587489 - protein, 9 aa, Homo Sapiens
YVLVPTEGW

SEQ ID NO: 587490 - protein, 9 aa, Homo Sapiens
QGEPPTCPG

SEQ ID NO: 587491 - protein, 9 aa, Homo Sapiens
NFLMGTGHH

SEQ ID NO: 587492 - protein, 9 aa, Homo Sapiens
FYSHFPCTV

SEQ ID NO: 587493 - protein, 9 aa, Homo Sapiens
MVAGIIDLA

SEQ ID NO: 587494 - protein, 9 aa, Homo Sapiens
GSQAAVVSN

SEQ ID NO: 587495 - protein, 9 aa, Homo Sapiens
ALAAPRDAS

SEQ ID NO: 587496 - protein, 9 aa, Homo Sapiens
IIDLALEAN

SEQ ID NO: 587497 - protein, 9 aa, Homo Sapiens
TLPVSADPG

SEQ ID NO: 587498 - protein, 9 aa, Homo Sapiens
LITRSVSGS

SEQ ID NO: 587499 - protein, 9 aa, Homo Sapiens
AGGCSPGPA

SEQ ID NO: 587500 - protein, 9 aa, Homo Sapiens
YCPCDKYNE

SEQ ID NO: 587501 - protein, 9 aa, Homo Sapiens
IERILEAWD

SEQ ID NO: 587502 - protein, 9 aa, Homo Sapiens
ITPRILVWR

SEQ ID NO: 587503 - protein, 9 aa, Homo Sapiens
QDSEAIIST

SEQ ID NO: 587504 - protein, 9 aa, Homo Sapiens
SAAYVQGKS

SEQ ID NO: 587505 - protein, 9 aa, Homo Sapiens
SAVAKLITR

SEQ ID NO: 587506 - protein, 9 aa, Homo Sapiens
CLLSGVAAA

SEQ ID NO: 587507 - protein, 9 aa, Homo Sapiens
VPFHEALNG

SEQ ID NO: 587508 - protein, 9 aa, Homo Sapiens
LTQRLGARA

SEQ ID NO: 587509 - protein, 9 aa, Homo Sapiens
DMNEKKQAE

SEQ ID NO: 587510 - protein, 9 aa, Homo Sapiens
VKSSKTTTS

SEQ ID NO: 587511 - protein, 9 aa, Homo Sapiens
TQKKFALSP

SEQ ID NO: 587512 - protein, 9 aa, Homo Sapiens
AMYAEEKGT

SEQ ID NO: 587513 - protein, 9 aa, Homo Sapiens
AVLEETTGE

SEQ ID NO: 587514 - protein, 9 aa, Homo Sapiens
CELLWLKRL

SEQ ID NO: 587515 - protein, 9 aa, Homo Sapiens
ACEPIQVVN

SEQ ID NO: 587516 - protein, 9 aa, Homo Sapiens
LAVGLLRAA

SEQ ID NO: 587517 - protein, 9 aa, Homo Sapiens
QKGACSTWM

SEQ ID NO: 587518 - protein, 9 aa, Homo Sapiens
LAPTVLPNL

SEQ ID NO: 587519 - protein, 9 aa, Homo Sapiens
VFPTHDFPT

SEQ ID NO: 587520 - protein, 9 aa, Homo Sapiens
SIRIVRLVR

SEQ ID NO: 587521 - protein, 9 aa, Homo Sapiens
CFPEKSCTK

SEQ ID NO: 587522 - protein, 9 aa, Homo Sapiens
DGSEYLIQQ

SEQ ID NO: 587523 - protein, 9 aa, Homo Sapiens
SLFDMPCDE

SEQ ID NO: 587524 - protein, 9 aa, Homo Sapiens
ENVPNVPYN

SEQ ID NO: 587525 - protein, 9 aa, Homo Sapiens
QHELGSNDI

SEQ ID NO: 587526 - protein, 9 aa, Homo Sapiens
LNQLLQEDF

SEQ ID NO: 587527 - protein, 9 aa, Homo Sapiens
VQGKSSAEM

SEQ ID NO: 587528 - protein, 9 aa, Homo Sapiens
LSRVYSKLC

SEQ ID NO: 587529 - protein, 9 aa, Homo Sapiens
YWDENVPNV

SEQ ID NO: 587530 - protein, 9 aa, Homo Sapiens
AINILLASI

SEQ ID NO: 587531 - protein, 9 aa, Homo Sapiens
RRLKHQQAE

SEQ ID NO: 587532 - protein, 9 aa, Homo Sapiens
GLPTPRCSH

SEQ ID NO: 587533 - protein, 9 aa, Homo Sapiens
LTDGLPTPR

SEQ ID NO: 587534 - protein, 9 aa, Homo Sapiens
YSHFPCTVR

SEQ ID NO: 587535 - protein, 9 aa, Homo Sapiens
PGLAPTVLP

SEQ ID NO: 587536 - protein, 9 aa, Homo Sapiens
LQCVSFSGV

SEQ ID NO: 587537 - protein, 9 aa, Homo Sapiens
WGPAMPGLA

SEQ ID NO: 587538 - protein, 9 aa, Homo Sapiens
TNWKVAIDE

SEQ ID NO: 587539 - protein, 9 aa, Homo Sapiens
VGAALRLHA

SEQ ID NO: 587540 - protein, 9 aa, Homo Sapiens
SALAAPRDA

SEQ ID NO: 587541 - protein, 9 aa, Homo Sapiens
FHESRVDRL

SEQ ID NO: 587542 - protein, 9 aa, Homo Sapiens
WLKRLSRED

SEQ ID NO: 587543 - protein, 9 aa, Homo Sapiens
DFLNVADLT

SEQ ID NO: 587544 - protein, 9 aa, Homo Sapiens
VAGIIDLAL

SEQ ID NO: 587545 - protein, 9 aa, Homo Sapiens
RLGARAGGC

SEQ ID NO: 587546 - protein, 9 aa, Homo Sapiens
IRDANTYKI

SEQ ID NO: 587547 - protein, 9 aa, Homo Sapiens
AGIIDLALE

SEQ ID NO: 587548 - protein, 9 aa, Homo Sapiens
HLYRLEMEF

SEQ ID NO: 587549 - protein, 9 aa, Homo Sapiens
GTGHRLLWQ

SEQ ID NO: 587550 - protein, 9 aa, Homo Sapiens
HEALNGFHP

SEQ ID NO: 587551 - protein, 9 aa, Homo Sapiens
LTVLWYSVV

SEQ ID NO: 587552 - protein, 9 aa, Homo Sapiens
DNFLMGTGH

SEQ ID NO: 587553 - protein, 9 aa, Homo Sapiens
HESRKMYDD

SEQ ID NO: 587554 - protein, 9 aa, Homo Sapiens
IVKAASGFN

SEQ ID NO: 587555 - protein, 9 aa, Homo Sapiens
NILLASIAF

SEQ ID NO: 587556 - protein, 9 aa, Homo Sapiens
LIRKSGSFL

SEQ ID NO: 587557 - protein, 9 aa, Homo Sapiens
KGACSTWMK

SEQ ID NO: 587558 - protein, 9 aa, Homo Sapiens
CPGGTGHRL

SEQ ID NO: 587559 - protein, 9 aa, Homo Sapiens
SRVDRLMLQ

SEQ ID NO: 587560 - protein, 9 aa, Homo Sapiens
ALGQLCLLS

SEQ ID NO: 587561 - protein, 9 aa, Homo Sapiens
VVGAQLICT

SEQ ID NO: 587562 - protein, 9 aa, Homo Sapiens
DKAPSTQKK

SEQ ID NO: 587563 - protein, 9 aa, Homo Sapiens
GACSTWMKA

SEQ ID NO: 587564 - protein, 9 aa, Homo Sapiens
NISAAYVQG

SEQ ID NO: 587565 - protein, 9 aa, Homo Sapiens
MYAEEKGTP

SEQ ID NO: 587566 - protein, 9 aa, Homo Sapiens
DKYNEQPVG

SEQ ID NO: 587567 - protein, 9 aa, Homo Sapiens
SGERLPKHD

SEQ ID NO: 587568 - protein, 9 aa, Homo Sapiens
RILVWRQTL

SEQ ID NO: 587569 - protein, 9 aa, Homo Sapiens
RIVRLVRDK

SEQ ID NO: 587570 - protein, 9 aa, Homo Sapiens
DVTAKGSLT

SEQ ID NO: 587571 - protein, 9 aa, Homo Sapiens
AVATKIRDA

SEQ ID NO: 587572 - protein, 9 aa, Homo Sapiens
HWGPAMPGL

SEQ ID NO: 587573 - protein, 9 aa, Homo Sapiens
AIRGSSSQG

SEQ ID NO: 587574 - protein, 9 aa, Homo Sapiens
TWKHVRRYG

SEQ ID NO: 587575 - protein, 9 aa, Homo Sapiens
SCFPEKSCT

SEQ ID NO: 587576 - protein, 9 aa, Homo Sapiens
GNISAAYVQ

SEQ ID NO: 587577 - protein, 9 aa, Homo Sapiens
FLMGTGHHC

SEQ ID NO: 587578 - protein, 9 aa, Homo Sapiens
YIGVSLALP

SEQ ID NO: 587579 - protein, 9 aa, Homo Sapiens
ILLGFSDYL

SEQ ID NO: 587580 - protein, 9 aa, Homo Sapiens
RGFPELLVK

SEQ ID NO: 587581 - protein, 9 aa, Homo Sapiens
PYIQHAMYA

SEQ ID NO: 587582 - protein, 9 aa, Homo Sapiens
GDLLAVGLL

SEQ ID NO: 587583 - protein, 9 aa, Homo Sapiens
FKDLSIRIV

SEQ ID NO: 587584 - protein, 9 aa, Homo Sapiens
GQGEPPTCP

SEQ ID NO: 587585 - protein, 9 aa, Homo Sapiens
GGIVKAASG

SEQ ID NO: 587586 - protein, 9 aa, Homo Sapiens
HTQHILPQR

SEQ ID NO: 587587 - protein, 9 aa, Homo Sapiens
DVLLYYPSE

SEQ ID NO: 587588 - protein, 9 aa, Homo Sapiens
RDQGGSSAG

SEQ ID NO: 587589 - protein, 9 aa, Homo Sapiens
HSSGLQILT

SEQ ID NO: 587590 - protein, 9 aa, Homo Sapiens
AAEDAAGQD

SEQ ID NO: 587591 - protein, 9 aa, Homo Sapiens
PPTCPGGTG

SEQ ID NO: 587592 - protein, 9 aa, Homo Sapiens
HDRGKMRFH

SEQ ID NO: 587593 - protein, 9 aa, Homo Sapiens
KHVRRYGGI

SEQ ID NO: 587594 - protein, 9 aa, Homo Sapiens
VLLYYPSED

SEQ ID NO: 587595 - protein, 9 aa, Homo Sapiens
VPNVPYNKT

SEQ ID NO: 587596 - protein, 9 aa, Homo Sapiens
QAAVVSNGL

SEQ ID NO: 587597 - protein, 9 aa, Homo Sapiens
LQNLSKINL

SEQ ID NO: 587598 - protein, 9 aa, Homo Sapiens
GFRNKTFVV

SEQ ID NO: 587599 - protein, 9 aa, Homo Sapiens
MEAQFVLDG

SEQ ID NO: 587600 - protein, 9 aa, Homo Sapiens
GLQNLSKIN

SEQ ID NO: 587601 - protein, 9 aa, Homo Sapiens
AAPRDASFG

SEQ ID NO: 587602 - protein, 9 aa, Homo Sapiens
DAAGQDLQQ

SEQ ID NO: 587603 - protein, 9 aa, Homo Sapiens
DGDINGNFT

SEQ ID NO: 587604 - protein, 9 aa, Homo Sapiens
GPALGQLCL

SEQ ID NO: 587605 - protein, 9 aa, Homo Sapiens
LEAWDMNEK

SEQ ID NO: 587606 - protein, 9 aa, Homo Sapiens
LSIRIVRLV

SEQ ID NO: 587607 - protein, 9 aa, Homo Sapiens
IKQLKIDLK

SEQ ID NO: 587608 - protein, 9 aa, Homo Sapiens
QGKSSAEMI

SEQ ID NO: 587609 - protein, 9 aa, Homo Sapiens
QLCLLSGVA

SEQ ID NO: 587610 - protein, 9 aa, Homo Sapiens
LGFSDYLQL

SEQ ID NO: 587611 - protein, 9 aa, Homo Sapiens
NQLLQEDFL

SEQ ID NO: 587612 - protein, 9 aa, Homo Sapiens
DRAALQLKL

SEQ ID NO: 587613 - protein, 9 aa, Homo Sapiens
TGHRLLWQA

SEQ ID NO: 587614 - protein, 9 aa, Homo Sapiens
HLIRKSSSR

SEQ ID NO: 587615 - protein, 9 aa, Homo Sapiens
LRSLQQPVQ

SEQ ID NO: 587616 - protein, 9 aa, Homo Sapiens
MLNSLDWNA

SEQ ID NO: 587617 - protein, 9 aa, Homo Sapiens
LLQEDFLNV

SEQ ID NO: 587618 - protein, 9 aa, Homo Sapiens
SGDKAPSTQ

SEQ ID NO: 587619 - protein, 9 aa, Homo Sapiens
AFLSTVRGA

SEQ ID NO: 587620 - protein, 9 aa, Homo Sapiens
KYNEQPVGN

SEQ ID NO: 587621 - protein, 9 aa, Homo Sapiens
LVPTEGWNK

SEQ ID NO: 587622 - protein, 9 aa, Homo Sapiens
ARAAQDCRK

SEQ ID NO: 587623 - protein, 9 aa, Homo Sapiens
RNLGLKHLM

SEQ ID NO: 587624 - protein, 9 aa, Homo Sapiens
SSRLTYIAE

SEQ ID NO: 587625 - protein, 9 aa, Homo Sapiens
SPANGFNRL

SEQ ID NO: 587626 - protein, 9 aa, Homo Sapiens
AVVSNGLGA

SEQ ID NO: 587627 - protein, 9 aa, Homo Sapiens
TAEHLYRLE

SEQ ID NO: 587628 - protein, 9 aa, Homo Sapiens
YIQHAMYAE

SEQ ID NO: 587629 - protein, 9 aa, Homo Sapiens
LSKINLNHN

SEQ ID NO: 587630 - protein, 9 aa, Homo Sapiens
IQHAMYAEE

SEQ ID NO: 587631 - protein, 9 aa, Homo Sapiens
NCELLWLKR

SEQ ID NO: 587632 - protein, 9 aa, Homo Sapiens
AFGTWKHVR

SEQ ID NO: 587633 - protein, 9 aa, Homo Sapiens
RKELARRVA

SEQ ID NO: 587634 - protein, 9 aa, Homo Sapiens
HVMLNSLDW

SEQ ID NO: 587635 - protein, 9 aa, Homo Sapiens
SHFPCTVRW

SEQ ID NO: 587636 - protein, 9 aa, Homo Sapiens
RRCTWVNPL

SEQ ID NO: 587637 - protein, 9 aa, Homo Sapiens
KRLSREDDL

SEQ ID NO: 587638 - protein, 9 aa, Homo Sapiens
SPGSLGQGE

SEQ ID NO: 587639 - protein, 9 aa, Homo Sapiens
FTPRPQDHD

SEQ ID NO: 587640 - protein, 9 aa, Homo Sapiens
KIRDANTYK

SEQ ID NO: 587641 - protein, 9 aa, Homo Sapiens
EHLYRLEME

SEQ ID NO: 587642 - protein, 9 aa, Homo Sapiens
ETVLPMYEC

SEQ ID NO: 587643 - protein, 9 aa, Homo Sapiens
HVRRYGGIY

SEQ ID NO: 587644 - protein, 9 aa, Homo Sapiens
WMVLEAISL

SEQ ID NO: 587645 - protein, 9 aa, Homo Sapiens
MGTGHHCNK

SEQ ID NO: 587646 - protein, 9 aa, Homo Sapiens
RTSFTAEHL

SEQ ID NO: 587647 - protein, 9 aa, Homo Sapiens
KKPMRQDKE

SEQ ID NO: 587648 - protein, 9 aa, Homo Sapiens
NLQKVKSSK

SEQ ID NO: 587649 - protein, 9 aa, Homo Sapiens
LIRKSSSRL

SEQ ID NO: 587650 - protein, 9 aa, Homo Sapiens
QFVRNLGLK

SEQ ID NO: 587651 - protein, 9 aa, Homo Sapiens
RLNLQVTSV

SEQ ID NO: 587652 - protein, 9 aa, Homo Sapiens
MYKASQKEM

SEQ ID NO: 587653 - protein, 9 aa, Homo Sapiens
PGSQAAVVS

SEQ ID NO: 587654 - protein, 9 aa, Homo Sapiens
ERILEAWDM

SEQ ID NO: 587655 - protein, 9 aa, Homo Sapiens
VRNLGLKHL

SEQ ID NO: 587656 - protein, 9 aa, Homo Sapiens
YAEEKGTPI

SEQ ID NO: 587657 - protein, 9 aa, Homo Sapiens
NGFNRLPTP

SEQ ID NO: 587658 - protein, 9 aa, Homo Sapiens
PRDASFGQG

SEQ ID NO: 587659 - protein, 9 aa, Homo Sapiens
CKEAEKIKK

SEQ ID NO: 587660 - protein, 9 aa, Homo Sapiens
ATKIRDANT

SEQ ID NO: 587661 - protein, 9 aa, Homo Sapiens
SFVQKPEPM

SEQ ID NO: 587662 - protein, 9 aa, Homo Sapiens
ELQEMYKAS

SEQ ID NO: 587663 - protein, 9 aa, Homo Sapiens
CRILGKVER

SEQ ID NO: 587664 - protein, 9 aa, Homo Sapiens
GCSPGSLGQ

SEQ ID NO: 587665 - protein, 9 aa, Homo Sapiens
PANGFNRLP

SEQ ID NO: 587666 - protein, 9 aa, Homo Sapiens
SRVYSKLCK

SEQ ID NO: 587667 - protein, 9 aa, Homo Sapiens
ALLTAPNPD

SEQ ID NO: 587668 - protein, 9 aa, Homo Sapiens
SYEITPRIL

SEQ ID NO: 587669 - protein, 9 aa, Homo Sapiens
PGDDIFLMA

SEQ ID NO: 587670 - protein, 9 aa, Homo Sapiens
LTYWDENVP

SEQ ID NO: 587671 - protein, 9 aa, Homo Sapiens
CEPIQVVNV

SEQ ID NO: 587672 - protein, 9 aa, Homo Sapiens
DAKAIRGSS

SEQ ID NO: 587673 - protein, 9 aa, Homo Sapiens
CQEKRLQCV

SEQ ID NO: 587674 - protein, 9 aa, Homo Sapiens
GMLQERGFP

SEQ ID NO: 587675 - protein, 9 aa, Homo Sapiens
CTKRDIKPN

SEQ ID NO: 587676 - protein, 9 aa, Homo Sapiens
SFTAEHLYR

SEQ ID NO: 587677 - protein, 9 aa, Homo Sapiens
LDQPYRLNL

SEQ ID NO: 587678 - protein, 9 aa, Homo Sapiens
PTPRCSHWG

SEQ ID NO: 587679 - protein, 9 aa, Homo Sapiens
SGMLQERGF

SEQ ID NO: 587680 - protein, 9 aa, Homo Sapiens
PTHDFPTRD

SEQ ID NO: 587681 - protein, 9 aa, Homo Sapiens
LPQRRCTWV

SEQ ID NO: 587682 - protein, 9 aa, Homo Sapiens
GQDLQQADH

SEQ ID NO: 587683 - protein, 9 aa, Homo Sapiens
QRRCTWVNP

SEQ ID NO: 587684 - protein, 9 aa, Homo Sapiens
TPGFRNKTF

SEQ ID NO: 587685 - protein, 9 aa, Homo Sapiens
QALLTAPNP

SEQ ID NO: 587686 - protein, 9 aa, Homo Sapiens
LIQQDSEAI

SEQ ID NO: 587687 - protein, 9 aa, Homo Sapiens
IKQQWVGAA

SEQ ID NO: 587688 - protein, 9 aa, Homo Sapiens
RSLQQPVQS

SEQ ID NO: 587689 - protein, 9 aa, Homo Sapiens
LVWRQTLER

SEQ ID NO: 587690 - protein, 9 aa, Homo Sapiens
LLSIQALLT

SEQ ID NO: 587691 - protein, 9 aa, Homo Sapiens
PKKPMRQDK

SEQ ID NO: 587692 - protein, 9 aa, Homo Sapiens
SGLQILTYA

SEQ ID NO: 587693 - protein, 9 aa, Homo Sapiens
TDGLPTPRC

SEQ ID NO: 587694 - protein, 9 aa, Homo Sapiens
ASQGCSPGS

SEQ ID NO: 587695 - protein, 9 aa, Homo Sapiens
LPTPRCSHW

SEQ ID NO: 587696 - protein, 9 aa, Homo Sapiens
QPVQSTYLL

SEQ ID NO: 587697 - protein, 9 aa, Homo Sapiens
PWESEFGQH

SEQ ID NO: 587698 - protein, 9 aa, Homo Sapiens
LNMAVIDSA

SEQ ID NO: 587699 - protein, 9 aa, Homo Sapiens
KLCKEAEKI

SEQ ID NO: 587700 - protein, 9 aa, Homo Sapiens
AQDCRKELA

SEQ ID NO: 587701 - protein, 9 aa, Homo Sapiens
NEQPVGNWS

SEQ ID NO: 587702 - protein, 9 aa, Homo Sapiens
SKINLNHNP

SEQ ID NO: 587703 - protein, 9 aa, Homo Sapiens
ERGFPELLV

SEQ ID NO: 587704 - protein, 9 aa, Homo Sapiens
GGTGHRLLW

SEQ ID NO: 587705 - protein, 9 aa, Homo Sapiens
HELGSNDIQ

SEQ ID NO: 587706 - protein, 9 aa, Homo Sapiens
PTHVFPTHD

SEQ ID NO: 587707 - protein, 9 aa, Homo Sapiens
SDYLQLQKV

SEQ ID NO: 587708 - protein, 9 aa, Homo Sapiens
YLQLQKVLF

SEQ ID NO: 587709 - protein, 9 aa, Homo Sapiens
FPELLVKRV

SEQ ID NO: 587710 - protein, 9 aa, Homo Sapiens
FLTQRLGAR

SEQ ID NO: 587711 - protein, 9 aa, Homo Sapiens
SSLFDMPCD

SEQ ID NO: 587712 - protein, 9 aa, Homo Sapiens
PDVLLYYPS

SEQ ID NO: 587713 - protein, 9 aa, Homo Sapiens
KELARRVAD

SEQ ID NO: 587714 - protein, 9 aa, Homo Sapiens
RCSHWGPAM

SEQ ID NO: 587715 - protein, 9 aa, Homo Sapiens
FQGLQNLSK

SEQ ID NO: 587716 - protein, 9 aa, Homo Sapiens
ILVWRQTLE

SEQ ID NO: 587717 - protein, 9 aa, Homo Sapiens
LLSGVAAAS

SEQ ID NO: 587718 - protein, 9 aa, Homo Sapiens
GWNKLLNWY

SEQ ID NO: 587719 - protein, 9 aa, Homo Sapiens
MAVRISKKR

SEQ ID NO: 587720 - protein, 9 aa, Homo Sapiens
LLGFSDYLQ

SEQ ID NO: 587721 - protein, 9 aa, Homo Sapiens
EMYKASQKE

SEQ ID NO: 587722 - protein, 9 aa, Homo Sapiens
LAAPRDASF

SEQ ID NO: 587723 - protein, 9 aa, Homo Sapiens
LLTVLWYSV

SEQ ID NO: 587724 - protein, 9 aa, Homo Sapiens
SFLMPELKL

SEQ ID NO: 587725 - protein, 9 aa, Homo Sapiens
LGQGEPPTC

SEQ ID NO: 587726 - protein, 9 aa, Homo Sapiens
EYLIQQDSE

SEQ ID NO: 587727 - protein, 9 aa, Homo Sapiens
NPGSGFVYV

SEQ ID NO: 587728 - protein, 9 aa, Homo Sapiens
TPRILVWRQ

SEQ ID NO: 587729 - protein, 9 aa, Homo Sapiens
SRILDQPYR

SEQ ID NO: 587730 - protein, 9 aa, Homo Sapiens
EQPVGNWSD

SEQ ID NO: 587731 - protein, 9 aa, Homo Sapiens
SRKMYDDAI

SEQ ID NO: 587732 - protein, 9 aa, Homo Sapiens
INILLASIA

SEQ ID NO: 587733 - protein, 9 aa, Homo Sapiens
HVAKGETLD

SEQ ID NO: 587734 - protein, 9 aa, Homo Sapiens
RLLWQATPA

SEQ ID NO: 587735 - protein, 9 aa, Homo Sapiens
VLPMYECRI

SEQ ID NO: 587736 - protein, 9 aa, Homo Sapiens
FPTHDFPTR

SEQ ID NO: 587737 - protein, 9 aa, Homo Sapiens
IRKSSSRLT

SEQ ID NO: 587738 - protein, 9 aa, Homo Sapiens
ALPAEVTSS

SEQ ID NO: 587739 - protein, 9 aa, Homo Sapiens
SEYLIQQDS

SEQ ID NO: 587740 - protein, 9 aa, Homo Sapiens
KAIRGSSSQ

SEQ ID NO: 587741 - protein, 9 aa, Homo Sapiens
GLSLWSVVG

SEQ ID NO: 587742 - protein, 9 aa, Homo Sapiens
IQALLTAPN

SEQ ID NO: 587743 - protein, 9 aa, Homo Sapiens
YNKPGDDIF

SEQ ID NO: 587744 - protein, 9 aa, Homo Sapiens
AKLITRSVS

SEQ ID NO: 587745 - protein, 9 aa, Homo Sapiens
VDPDVLLYY

SEQ ID NO: 587746 - protein, 9 aa, Homo Sapiens
VLEAISLLY

SEQ ID NO: 587747 - protein, 9 aa, Homo Sapiens
IRKSGSFLM

SEQ ID NO: 587748 - protein, 9 aa, Homo Sapiens
IDERSAESS

SEQ ID NO: 587749 - protein, 9 aa, Homo Sapiens
TACEPIQVV

SEQ ID NO: 587750 - protein, 9 aa, Homo Sapiens
AASQGCSPG

SEQ ID NO: 587751 - protein, 9 aa, Homo Sapiens
ATKGGIVKA

SEQ ID NO: 587752 - protein, 9 aa, Homo Sapiens
IQVVNVLNS

SEQ ID NO: 587753 - protein, 9 aa, Homo Sapiens
WQATPAQRE

SEQ ID NO: 587754 - protein, 9 aa, Homo Sapiens
ANGFNRLPT

SEQ ID NO: 587755 - protein, 9 aa, Homo Sapiens
SMEAQFVLD

SEQ ID NO: 587756 - protein, 9 aa, Homo Sapiens
INLQKVKSS

SEQ ID NO: 587757 - protein, 9 aa, Homo Sapiens
VTPGSQAAV

SEQ ID NO: 587758 - protein, 9 aa, Homo Sapiens
GGCSPGPAL

SEQ ID NO: 587759 - protein, 9 aa, Homo Sapiens
GEPPTCPGG

SEQ ID NO: 587760 - protein, 9 aa, Homo Sapiens
TDHESRKMY

SEQ ID NO: 587761 - protein, 9 aa, Homo Sapiens
TPGSQAAVV

SEQ ID NO: 587762 - protein, 9 aa, Homo Sapiens
VRRYGGIYA

SEQ ID NO: 587763 - protein, 9 aa, Homo Sapiens
PAMPGLAPT

SEQ ID NO: 587764 - protein, 9 aa, Homo Sapiens
DLALEANSQ

SEQ ID NO: 587765 - protein, 9 aa, Homo Sapiens
VSFSGVKER

SEQ ID NO: 587766 - protein, 9 aa, Homo Sapiens
YVQGKSSAE

SEQ ID NO: 587767 - protein, 9 aa, Homo Sapiens
PGFRNKTFV

SEQ ID NO: 587768 - protein, 9 aa, Homo Sapiens
GSFLMPELK

SEQ ID NO: 587769 - protein, 9 aa, Homo Sapiens
EPPETPGVK

SEQ ID NO: 587770 - protein, 9 aa, Homo Sapiens
VLWYSVVHT

SEQ ID NO: 587771 - protein, 9 aa, Homo Sapiens
DRLMLQYLT

SEQ ID NO: 587772 - protein, 9 aa, Homo Sapiens
SSQGPLTES

SEQ ID NO: 587773 - protein, 9 aa, Homo Sapiens
IQQDSEAII

SEQ ID NO: 587774 - protein, 9 aa, Homo Sapiens
AVRISKKRK

SEQ ID NO: 587775 - protein, 9 aa, Homo Sapiens
GFPELLVKR

SEQ ID NO: 587776 - protein, 9 aa, Homo Sapiens
QKKFALSPQ

SEQ ID NO: 587777 - protein, 9 aa, Homo Sapiens
ETPGVKDST

SEQ ID NO: 587778 - protein, 9 aa, Homo Sapiens
KNGVAIMSS

SEQ ID NO: 587779 - protein, 9 aa, Homo Sapiens
GPAMPGLAP

SEQ ID NO: 587780 - protein, 9 aa, Homo Sapiens
SSSRLTYIA

SEQ ID NO: 587781 - protein, 9 aa, Homo Sapiens
APMVAGIID

SEQ ID NO: 587782 - protein, 9 aa, Homo Sapiens
PKHDRGKMR

SEQ ID NO: 587783 - protein, 9 aa, Homo Sapiens
KDLSIRIVR

SEQ ID NO: 587784 - protein, 9 aa, Homo Sapiens
IRTRTSYFF

SEQ ID NO: 587785 - protein, 9 aa, Homo Sapiens
HHCNKLFLI

SEQ ID NO: 587786 - protein, 9 aa, Homo Sapiens
PMYECRILG

SEQ ID NO: 587787 - protein, 9 aa, Homo Sapiens
KTDHESRKM

SEQ ID NO: 587788 - protein, 9 aa, Homo Sapiens
PVQSTYLLI

SEQ ID NO: 587789 - protein, 9 aa, Homo Sapiens
DLLAVGLLR

SEQ ID NO: 587790 - protein, 9 aa, Homo Sapiens
SHWGPAMPG

SEQ ID NO: 587791 - protein, 9 aa, Homo Sapiens
RLMLQYLTV

SEQ ID NO: 587792 - protein, 9 aa, Homo Sapiens
PIQVVNVLN

SEQ ID NO: 587793 - protein, 9 aa, Homo Sapiens
GMTPGFRNK

SEQ ID NO: 587794 - protein, 9 aa, Homo Sapiens
FSVPFHEAL

SEQ ID NO: 587795 - protein, 9 aa, Homo Sapiens
SGFVYVVDT

SEQ ID NO: 587796 - protein, 9 aa, Homo Sapiens
HVFPTHDFP

SEQ ID NO: 587797 - protein, 9 aa, Homo Sapiens
PGSGFVYVV

SEQ ID NO: 587798 - protein, 9 aa, Homo Sapiens
YSVVHTSAL

SEQ ID NO: 587799 - protein, 9 aa, Homo Sapiens
SRLTYIAEW

SEQ ID NO: 587800 - protein, 9 aa, Homo Sapiens
RQDKETLPD

SEQ ID NO: 587801 - protein, 9 aa, Homo Sapiens
GWGPTPRAD

SEQ ID NO: 587802 - protein, 9 aa, Homo Sapiens
SVVGAQLIC

SEQ ID NO: 587803 - protein, 9 aa, Homo Sapiens
ILPQRRCTW

SEQ ID NO: 587804 - protein, 9 aa, Homo Sapiens
NMAVIDSAQ

SEQ ID NO: 587805 - protein, 9 aa, Homo Sapiens
LASIAFADM

SEQ ID NO: 587806 - protein, 9 aa, Homo Sapiens
KANPGSGFV

SEQ ID NO: 587807 - protein, 9 aa, Homo Sapiens
PALGQLCLL

SEQ ID NO: 587808 - protein, 9 aa, Homo Sapiens
YRLNLQVTS

SEQ ID NO: 587809 - protein, 9 aa, Homo Sapiens
VAKLITRSV

SEQ ID NO: 587810 - protein, 9 aa, Homo Sapiens
PEKSCTKRD

SEQ ID NO: 587811 - protein, 9 aa, Homo Sapiens
LAFGTWKHV

SEQ ID NO: 587812 - protein, 9 aa, Homo Sapiens
EPIQVVNVL

SEQ ID NO: 587813 - protein, 9 aa, Homo Sapiens
IGVSLALPA

SEQ ID NO: 587814 - protein, 9 aa, Homo Sapiens
DRWMVLEAI

SEQ ID NO: 587815 - protein, 9 aa, Homo Sapiens
GELLNMAVI

SEQ ID NO: 587816 - protein, 9 aa, Homo Sapiens
SRLTELQEM

SEQ ID NO: 587817 - protein, 9 aa, Homo Sapiens
RSGELLNMA

SEQ ID NO: 587818 - protein, 9 aa, Homo Sapiens
DLQQADHTW

SEQ ID NO: 587819 - protein, 9 aa, Homo Sapiens
VGAQLICTL

SEQ ID NO: 587820 - protein, 9 aa, Homo Sapiens
LTELQEMYK

SEQ ID NO: 587821 - protein, 9 aa, Homo Sapiens
VRISKKRKF

SEQ ID NO: 587822 - protein, 9 aa, Homo Sapiens
IVRLVRDKD

SEQ ID NO: 587823 - protein, 9 aa, Homo Sapiens
YTCNESREF

SEQ ID NO: 587824 - protein, 9 aa, Homo Sapiens
SGSDHVMLN

SEQ ID NO: 587825 - protein, 9 aa, Homo Sapiens
LKHLMDIFE

SEQ ID NO: 587826 - protein, 9 aa, Homo Sapiens
KVKSSKTTT

SEQ ID NO: 587827 - protein, 9 aa, Homo Sapiens
LNSLDWNAE

SEQ ID NO: 587828 - protein, 9 aa, Homo Sapiens
DDIFLMAQA

SEQ ID NO: 587829 - protein, 9 aa, Homo Sapiens
KGETLDLNC

SEQ ID NO: 587830 - protein, 9 aa, Homo Sapiens
LEQQEKQPE

SEQ ID NO: 587831 - protein, 9 aa, Homo Sapiens
FPEKSCTKR

SEQ ID NO: 587832 - protein, 9 aa, Homo Sapiens
GLAPTVLPN

SEQ ID NO: 587833 - protein, 9 aa, Homo Sapiens
ARAGGCSPG

SEQ ID NO: 587834 - protein, 9 aa, Homo Sapiens
HFPCTVRWF

SEQ ID NO: 587835 - protein, 9 aa, Homo Sapiens
LPVSADPGR

SEQ ID NO: 587836 - protein, 9 aa, Homo Sapiens
PCTVRWFHR

SEQ ID NO: 587837 - protein, 9 aa, Homo Sapiens
SIQALLTAP

SEQ ID NO: 587838 - protein, 9 aa, Homo Sapiens
GCSPGPALG

SEQ ID NO: 587839 - protein, 9 aa, Homo Sapiens
TCNESREFE

SEQ ID NO: 587840 - protein, 9 aa, Homo Sapiens
TRTSYFFGG

SEQ ID NO: 587841 - protein, 9 aa, Homo Sapiens
PTFYSHFPC

SEQ ID NO: 587842 - protein, 9 aa, Homo Sapiens
LLWLKRLSR

SEQ ID NO: 587843 - protein, 9 aa, Homo Sapiens
KHLEQQEKQ

SEQ ID NO: 587844 - protein, 9 aa, Homo Sapiens
IMSSLFDMP

SEQ ID NO: 587845 - protein, 9 aa, Homo Sapiens
AVDPDVLLY

SEQ ID NO: 587846 - protein, 9 aa, Homo Sapiens
LKRLSREDD

SEQ ID NO: 587847 - protein, 9 aa, Homo Sapiens
SGVAAASQG

SEQ ID NO: 587848 - protein, 9 aa, Homo Sapiens
KHQQAEEIE

SEQ ID NO: 587849 - protein, 9 aa, Homo Sapiens
NGNFTINPY

SEQ ID NO: 587850 - protein, 9 aa, Homo Sapiens
SQAAVVSNG

SEQ ID NO: 587851 - protein, 9 aa, Homo Sapiens
CSPGSLGQG

SEQ ID NO: 587852 - protein, 9 aa, Homo Sapiens
EFGQHELGS

SEQ ID NO: 587853 - protein, 9 aa, Homo Sapiens
FGTWKHVRR

SEQ ID NO: 587854 - protein, 9 aa, Homo Sapiens
QRLGARAGG

SEQ ID NO: 587855 - protein, 9 aa, Homo Sapiens
LPMYECRIL

SEQ ID NO: 587856 - protein, 9 aa, Homo Sapiens
SGLYTCNES

SEQ ID NO: 587857 - protein, 9 aa, Homo Sapiens
TAPNPDDPL

SEQ ID NO: 587858 - protein, 9 aa, Homo Sapiens
SSSHVAKGE

SEQ ID NO: 587859 - protein, 9 aa, Homo Sapiens
EVSPANGFN

SEQ ID NO: 587860 - protein, 9 aa, Homo Sapiens
ELLWLKRLS

SEQ ID NO: 587861 - protein, 9 aa, Homo Sapiens
LKIDLKKAQ

SEQ ID NO: 587862 - protein, 9 aa, Homo Sapiens
MSDKTDHES

SEQ ID NO: 587863 - protein, 9 aa, Homo Sapiens
MAFLSTVRG

SEQ ID NO: 587864 - protein, 9 aa, Homo Sapiens
NLGLKHLMD

SEQ ID NO: 587865 - protein, 9 aa, Homo Sapiens
SCTKRDIKP

SEQ ID NO: 587866 - protein, 9 aa, Homo Sapiens
CTACEPIQV

SEQ ID NO: 587867 - protein, 9 aa, Homo Sapiens
GWQHSLLSP

SEQ ID NO: 587868 - protein, 9 aa, Homo Sapiens
SEFGQHELG

SEQ ID NO: 587869 - protein, 9 aa, Homo Sapiens
QLKIDLKKA

SEQ ID NO: 587870 - protein, 9 aa, Homo Sapiens
NFTINPYSG

SEQ ID NO: 587871 - protein, 9 aa, Homo Sapiens
WEFSVPFHE

SEQ ID NO: 587872 - protein, 9 aa, Homo Sapiens
GSEYLIQQD

SEQ ID NO: 587873 - protein, 9 aa, Homo Sapiens
SSSQGPLTE

SEQ ID NO: 587874 - protein, 9 aa, Homo Sapiens
RADRAALQL

SEQ ID NO: 587875 - protein, 9 aa, Homo Sapiens
LSKAIEAEA

SEQ ID NO: 587876 - protein, 9 aa, Homo Sapiens
SGSFLMPEL

SEQ ID NO: 587877 - protein, 9 aa, Homo Sapiens
TGERTDVIQ

SEQ ID NO: 587878 - protein, 9 aa, Homo Sapiens
ESRVDRLML

SEQ ID NO: 587879 - protein, 9 aa, Homo Sapiens
RFLTQRLGA

SEQ ID NO: 587880 - protein, 9 aa, Homo Sapiens
LCKEAEKIK

SEQ ID NO: 587881 - protein, 9 aa, Homo Sapiens
RVDRLMLQY

SEQ ID NO: 587882 - protein, 9 aa, Homo Sapiens
WDENVPNVP

SEQ ID NO: 587883 - protein, 9 aa, Homo Sapiens
MRQDKETLP

SEQ ID NO: 587884 - protein, 9 aa, Homo Sapiens
CTVRWFHRL

SEQ ID NO: 587885 - protein, 9 aa, Homo Sapiens
TRTSFTAEH

SEQ ID NO: 587886 - protein, 9 aa, Homo Sapiens
SYAASLSKA

SEQ ID NO: 587887 - protein, 9 aa, Homo Sapiens
MTPGFRNKT

SEQ ID NO: 587888 - protein, 9 aa, Homo Sapiens
LEAISLLYN

SEQ ID NO: 587889 - protein, 9 aa, Homo Sapiens
RVYSKLCKE

SEQ ID NO: 587890 - protein, 9 aa, Homo Sapiens
TPRPQDHDT

SEQ ID NO: 587891 - protein, 9 aa, Homo Sapiens
NWKVAIDER

SEQ ID NO: 587892 - protein, 9 aa, Homo Sapiens
QQPVQSTYL

SEQ ID NO: 587893 - protein, 9 aa, Homo Sapiens
EALNGFHPA

SEQ ID NO: 587894 - protein, 9 aa, Homo Sapiens
GLLRAALIL

SEQ ID NO: 587895 - protein, 9 aa, Homo Sapiens
INGNFTINP

SEQ ID NO: 587896 - protein, 9 aa, Homo Sapiens
LWQATPAQR

SEQ ID NO: 587897 - protein, 9 aa, Homo Sapiens
DENVPNVPY

SEQ ID NO: 587898 - protein, 9 aa, Homo Sapiens
WQHSLLSPI

SEQ ID NO: 587899 - protein, 9 aa, Homo Sapiens
TSFTAEHLY

SEQ ID NO: 587900 - protein, 9 aa, Homo Sapiens
SKAIEAEAK

SEQ ID NO: 587901 - protein, 9 aa, Homo Sapiens
LNDRDQGGS

SEQ ID NO: 587902 - protein, 9 aa, Homo Sapiens
EKRLQCVSF

SEQ ID NO: 587903 - protein, 9 aa, Homo Sapiens
AKGETLDLN

SEQ ID NO: 587904 - protein, 9 aa, Homo Sapiens
GNFTINPYS

SEQ ID NO: 587905 - protein, 9 aa, Homo Sapiens
VVSNGLGAQ

SEQ ID NO: 587906 - protein, 9 aa, Homo Sapiens
AKAIRGSSS

SEQ ID NO: 587907 - protein, 9 aa, Homo Sapiens
RLTYIAEWK

SEQ ID NO: 587908 - protein, 9 aa, Homo Sapiens
KLETLPVSA

SEQ ID NO: 587909 - protein, 9 aa, Homo Sapiens
LYTCNESRE

SEQ ID NO: 587910 - protein, 9 aa, Homo Sapiens
CGSALAAPR

SEQ ID NO: 587911 - protein, 9 aa, Homo Sapiens
YPLLIRTRT

SEQ ID NO: 587912 - protein, 9 aa, Homo Sapiens
GVAIMSSLF

SEQ ID NO: 587913 - protein, 9 aa, Homo Sapiens
SVPFHEALN

SEQ ID NO: 587914 - protein, 9 aa, Homo Sapiens
LYYPSEDMA

SEQ ID NO: 587915 - protein, 9 aa, Homo Sapiens
PSFVQKPEP

SEQ ID NO: 587916 - protein, 9 aa, Homo Sapiens
TEGWNKLLN

SEQ ID NO: 587917 - protein, 9 aa, Homo Sapiens
ESEFGQHEL

SEQ ID NO: 587918 - protein, 9 aa, Homo Sapiens
QILTYALKR

SEQ ID NO: 587919 - protein, 9 aa, Homo Sapiens
DLKKAQESQ

SEQ ID NO: 587920 - protein, 9 aa, Homo Sapiens
LQERGFPEL

SEQ ID NO: 587921 - protein, 9 aa, Homo Sapiens
PGSLGQGEP

SEQ ID NO: 587922 - protein, 9 aa, Homo Sapiens
DIFLMAQAL

SEQ ID NO: 587923 - protein, 9 aa, Homo Sapiens
VVNVLNSMY

SEQ ID NO: 587924 - protein, 9 aa, Homo Sapiens
ILEAWDMNE

SEQ ID NO: 587925 - protein, 9 aa, Homo Sapiens
EPMDVLTGT

SEQ ID NO: 587926 - protein, 9 aa, Homo Sapiens
WKHVRRYGG

SEQ ID NO: 587927 - protein, 9 aa, Homo Sapiens
EFSVPFHEA

SEQ ID NO: 587928 - protein, 9 aa, Homo Sapiens
RLTELQEMY

SEQ ID NO: 587929 - protein, 9 aa, Homo Sapiens
DHVMLNSLD

SEQ ID NO: 587930 - protein, 9 aa, Homo Sapiens
AAYVQGKSS

SEQ ID NO: 587931 - protein, 9 aa, Homo Sapiens
LSPILSCVA

SEQ ID NO: 587932 - protein, 9 aa, Homo Sapiens
FTAEHLYRL

SEQ ID NO: 587933 - protein, 9 aa, Homo Sapiens
PYRLNLQVT

SEQ ID NO: 587934 - protein, 9 aa, Homo Sapiens
HESRVDRLM

SEQ ID NO: 587935 - protein, 9 aa, Homo Sapiens
GFSDYLQLQ

SEQ ID NO: 587936 - protein, 9 aa, Homo Sapiens
YSMEAQFVL

SEQ ID NO: 587937 - protein, 9 aa, Homo Sapiens
QHAMYAEEK

SEQ ID NO: 587938 - protein, 9 aa, Homo Sapiens
RKSSSRLTY

SEQ ID NO: 587939 - protein, 9 aa, Homo Sapiens
SLSKAIEAE

SEQ ID NO: 587940 - protein, 9 aa, Homo Sapiens
DSGLYTCNE

SEQ ID NO: 587941 - protein, 9 aa, Homo Sapiens
ACSTWMKAI

SEQ ID NO: 587942 - protein, 9 aa, Homo Sapiens
IDLKKAQES

SEQ ID NO: 587943 - protein, 9 aa, Homo Sapiens
SSGLQILTY

SEQ ID NO: 587944 - protein, 9 aa, Homo Sapiens
RKANPGSGF

SEQ ID NO: 587945 - protein, 9 aa, Homo Sapiens
VSADPGRDP

SEQ ID NO: 587946 - protein, 9 aa, Homo Sapiens
HILPQRRCT

SEQ ID NO: 587947 - protein, 9 aa, Homo Sapiens
AYVQGKSSA

SEQ ID NO: 587948 - protein, 9 aa, Homo Sapiens
YEITPRILV

SEQ ID NO: 587949 - protein, 9 aa, Homo Sapiens
EETTGERTD

SEQ ID NO: 587950 - protein, 9 aa, Homo Sapiens
CDKYNEQPV

SEQ ID NO: 587951 - protein, 9 aa, Homo Sapiens
GSLTILRIL

SEQ ID NO: 587952 - protein, 9 aa, Homo Sapiens
MATKGGIVK

SEQ ID NO: 587953 - protein, 9 aa, Homo Sapiens
GSGFVYVVD

SEQ ID NO: 587954 - protein, 9 aa, Homo Sapiens
PRCSHWGPA

SEQ ID NO: 587955 - protein, 9 aa, Homo Sapiens
SLWSVVGAQ

SEQ ID NO: 587956 - protein, 9 aa, Homo Sapiens
VAIMSSLFD

SEQ ID NO: 587957 - protein, 9 aa, Homo Sapiens
KDGDINGNF

SEQ ID NO: 587958 - protein, 9 aa, Homo Sapiens
GDINGNFTI

SEQ ID NO: 587959 - protein, 9 aa, Homo Sapiens
ASIAFADML

SEQ ID NO: 587960 - protein, 9 aa, Homo Sapiens
LQKVKSSKT

SEQ ID NO: 587961 - protein, 9 aa, Homo Sapiens
PCDKYNEQP

SEQ ID NO: 587962 - protein, 9 aa, Homo Sapiens
KHLMDIFER

SEQ ID NO: 587963 - protein, 9 aa, Homo Sapiens
VGLLRAALI

SEQ ID NO: 587964 - protein, 9 aa, Homo Sapiens
FSDYLQLQK

SEQ ID NO: 587965 - protein, 9 aa, Homo Sapiens
LPAEVTSSV

SEQ ID NO: 587966 - protein, 9 aa, Homo Sapiens
PTPRADRAA

SEQ ID NO: 587967 - protein, 9 aa, Homo Sapiens
SDKTDHESR

SEQ ID NO: 587968 - protein, 9 aa, Homo Sapiens
AEDAAGQDL

SEQ ID NO: 587969 - protein, 9 aa, Homo Sapiens
PMVAGIIDL

SEQ ID NO: 587970 - protein, 9 aa, Homo Sapiens
EAISLLYNQ

SEQ ID NO: 587971 - protein, 9 aa, Homo Sapiens
RTRTSYFFG

SEQ ID NO: 587972 - protein, 9 aa, Homo Sapiens
GPTPRADRA

SEQ ID NO: 587973 - protein, 9 aa, Homo Sapiens
MVLEAISLL

SEQ ID NO: 587974 - protein, 9 aa, Homo Sapiens
RGSSSQGPL

SEQ ID NO: 587975 - protein, 9 aa, Homo Sapiens
TQHILPQRR

SEQ ID NO: 587976 - protein, 9 aa, Homo Sapiens
RCDRWMVLE

SEQ ID NO: 587977 - protein, 9 aa, Homo Sapiens
LGQLCLLSG

SEQ ID NO: 587978 - protein, 9 aa, Homo Sapiens
DKTDHESRK

SEQ ID NO: 587979 - protein, 9 aa, Homo Sapiens
SVVHTSALV

SEQ ID NO: 587980 - protein, 9 aa, Homo Sapiens
LYIGVSLAL

SEQ ID NO: 587981 - protein, 9 aa, Homo Sapiens
NKTFVVQGF

SEQ ID NO: 587982 - protein, 9 aa, Homo Sapiens
PQRRCTWVN

SEQ ID NO: 587983 - protein, 9 aa, Homo Sapiens
TKIRDANTY

SEQ ID NO: 587984 - protein, 9 aa, Homo Sapiens
TPGVKDSTI

SEQ ID NO: 587985 - protein, 9 aa, Homo Sapiens
SLGQGEPPT

SEQ ID NO: 587986 - protein, 9 aa, Homo Sapiens
LGLKHLMDI

SEQ ID NO: 587987 - protein, 9 aa, Homo Sapiens
PETPGVKDS

SEQ ID NO: 587988 - protein, 9 aa, Homo Sapiens
MYECRILGK

SEQ ID NO: 587989 - protein, 9 aa, Homo Sapiens
ASLSKAIEA

SEQ ID NO: 587990 - protein, 9 aa, Homo Sapiens
PRILVWRQT

SEQ ID NO: 587991 - protein, 9 aa, Homo Sapiens
AIDERSAES

SEQ ID NO: 587992 - protein, 9 aa, Homo Sapiens
ILTYALKRS

SEQ ID NO: 587993 - protein, 9 aa, Homo Sapiens
MSSLFDMPC

SEQ ID NO: 587994 - protein, 9 aa, Homo Sapiens
TVGLTDGLP

SEQ ID NO: 587995 - protein, 9 aa, Homo Sapiens
MAVIDSAQL

SEQ ID NO: 587996 - protein, 9 aa, Homo Sapiens
CNCELLWLK

SEQ ID NO: 587997 - protein, 9 aa, Homo Sapiens
GIIDLALEA

SEQ ID NO: 587998 - protein, 9 aa, Homo Sapiens
DHESRKMYD

SEQ ID NO: 587999 - protein, 9 aa, Homo Sapiens
QKVKSSKTT

SEQ ID NO: 588000 - protein, 9 aa, Homo Sapiens
LSAVAKLIT

SEQ ID NO: 588001 - protein, 9 aa, Homo Sapiens
HLEQQEKQP

SEQ ID NO: 588002 - protein, 9 aa, Homo Sapiens
ELLNMAVID

SEQ ID NO: 588003 - protein, 9 aa, Homo Sapiens
ITRSVSGSL

SEQ ID NO: 588004 - protein, 9 aa, Homo Sapiens
PMRQDKETL

SEQ ID NO: 588005 - protein, 9 aa, Homo Sapiens
GSSAGHPAS

SEQ ID NO: 588006 - protein, 9 aa, Homo Sapiens
GLTDGLPTP

SEQ ID NO: 588007 - protein, 9 aa, Homo Sapiens
LLIRTRTSY

SEQ ID NO: 588008 - protein, 9 aa, Homo Sapiens
DANTYKICT

SEQ ID NO: 588009 - protein, 9 aa, Homo Sapiens
MPGLAPTVL

SEQ ID NO: 588010 - protein, 9 aa, Homo Sapiens
VKDGDINGN

SEQ ID NO: 588011 - protein, 9 aa, Homo Sapiens
KQLKIDLKK

SEQ ID NO: 588012 - protein, 9 aa, Homo Sapiens
LQEDFLNVA

SEQ ID NO: 588013 - protein, 9 aa, Homo Sapiens
LALPAEVTS

SEQ ID NO: 588014 - protein, 9 aa, Homo Sapiens
FLMPELKLS

SEQ ID NO: 588015 - protein, 9 aa, Homo Sapiens
RILEAWDMN

SEQ ID NO: 588016 - protein, 9 aa, Homo Sapiens
LRAIKQQWV

SEQ ID NO: 588017 - protein, 9 aa, Homo Sapiens
VMLNSLDWN

SEQ ID NO: 588018 - protein, 9 aa, Homo Sapiens
VAIDERSAE

SEQ ID NO: 588019 - protein, 9 aa, Homo Sapiens
KPMRQDKET

SEQ ID NO: 588020 - protein, 9 aa, Homo Sapiens
GARAGGCSP

SEQ ID NO: 588021 - protein, 9 aa, Homo Sapiens
FRNKTFVVQ

SEQ ID NO: 588022 - protein, 9 aa, Homo Sapiens
IAFADMLLA

SEQ ID NO: 588023 - protein, 9 aa, Homo Sapiens
HRLLWQATP

SEQ ID NO: 588024 - protein, 9 aa, Homo Sapiens
GVKDSTIGG

SEQ ID NO: 588025 - protein, 9 aa, Homo Sapiens
TYWDENVPN

SEQ ID NO: 588026 - protein, 9 aa, Homo Sapiens
SDHVMLNSL

SEQ ID NO: 588027 - protein, 9 aa, Homo Sapiens
QDCRKELAR

SEQ ID NO: 588028 - protein, 9 aa, Homo Sapiens
LWLKRLSRE

SEQ ID NO: 588029 - protein, 9 aa, Homo Sapiens
GQLCLLSGV

SEQ ID NO: 588030 - protein, 9 aa, Homo Sapiens
AAASQGCSP

SEQ ID NO: 588031 - protein, 9 aa, Homo Sapiens
KARRLKHQQ

SEQ ID NO: 588032 - protein, 9 aa, Homo Sapiens
CDRWMVLEA

SEQ ID NO: 588033 - protein, 9 aa, Homo Sapiens
GLKHLMDIF

SEQ ID NO: 588034 - protein, 9 aa, Homo Sapiens
LLASIAFAD

SEQ ID NO: 588035 - protein, 9 aa, Homo Sapiens
APSTQKKFA

SEQ ID NO: 588036 - protein, 9 aa, Homo Sapiens
RISKKRKFV

SEQ ID NO: 588037 - protein, 9 aa, Homo Sapiens
SLTILRILS

SEQ ID NO: 588038 - protein, 9 aa, Homo Sapiens
KVAIDERSA

SEQ ID NO: 588039 - protein, 9 aa, Homo Sapiens
KQQWVGAAL

SEQ ID NO: 588040 - protein, 9 aa, Homo Sapiens
GVSLALPAE

SEQ ID NO: 588041 - protein, 9 aa, Homo Sapiens
LKHQQAEEI

SEQ ID NO: 588042 - protein, 9 aa, Homo Sapiens
MAMATKGGI

SEQ ID NO: 588043 - protein, 9 aa, Homo Sapiens
EINLQKVKS

SEQ ID NO: 588044 - protein, 9 aa, Homo Sapiens
SQGCSPGSL

SEQ ID NO: 588045 - protein, 9 aa, Homo Sapiens
AKLETLPVS

SEQ ID NO: 588046 - protein, 9 aa, Homo Sapiens
PGPALGQLC

SEQ ID NO: 588047 - protein, 9 aa, Homo Sapiens
QEMYKASQK

SEQ ID NO: 588048 - protein, 9 aa, Homo Sapiens
ARHSSGLQI

SEQ ID NO: 588049 - protein, 9 aa, Homo Sapiens
LWSVVGAQL

SEQ ID NO: 588050 - protein, 9 aa, Homo Sapiens
HSLLSPILS

SEQ ID NO: 588051 - protein, 9 aa, Homo Sapiens
TRSVSGSLP

SEQ ID NO: 588052 - protein, 9 aa, Homo Sapiens
GSALAAPRD

SEQ ID NO: 588053 - protein, 9 aa, Homo Sapiens
DQPYRLNLQ

SEQ ID NO: 588054 - protein, 9 aa, Homo Sapiens
TFYSHFPCT

SEQ ID NO: 588055 - protein, 9 aa, Homo Sapiens
QNLSKINLN

SEQ ID NO: 588056 - protein, 9 aa, Homo Sapiens
YAASLSKAI

SEQ ID NO: 588057 - protein, 9 aa, Homo Sapiens
IFKDLSIRI

SEQ ID NO: 588058 - protein, 9 aa, Homo Sapiens
QPYRLNLQV

SEQ ID NO: 588059 - protein, 9 aa, Homo Sapiens
VSCFPEKSC

SEQ ID NO: 588060 - protein, 9 aa, Homo Sapiens
FNRLPTPSP

SEQ ID NO: 588061 - protein, 9 aa, Homo Sapiens
LMPELKLSI

SEQ ID NO: 588062 - protein, 9 aa, Homo Sapiens
LLYYPSEDM

SEQ ID NO: 588063 - protein, 9 aa, Homo Sapiens
TKGGIVKAA

SEQ ID NO: 588064 - protein, 9 aa, Homo Sapiens
KIDLKKAQE

SEQ ID NO: 588065 - protein, 9 aa, Homo Sapiens
KHDRGKMRF

SEQ ID NO: 588066 - protein, 9 aa, Homo Sapiens
SLQQPVQST

SEQ ID NO: 588067 - protein, 9 aa, Homo Sapiens
ADRAALQLK

SEQ ID NO: 588068 - protein, 9 aa, Homo Sapiens
KPGDDIFLM

SEQ ID NO: 588069 - protein, 9 aa, Homo Sapiens
IRGSSSQGP

SEQ ID NO: 588070 - protein, 9 aa, Homo Sapiens
TPRCSHWGP

SEQ ID NO: 588071 - protein, 9 aa, Homo Sapiens
LLNMAVIDS

SEQ ID NO: 588072 - protein, 9 aa, Homo Sapiens
EQQEKQPEL

SEQ ID NO: 588073 - protein, 9 aa, Homo Sapiens
TCPGGTGHR

SEQ ID NO: 588074 - protein, 9 aa, Homo Sapiens
GQHELGSND

SEQ ID NO: 588075 - protein, 9 aa, Homo Sapiens
SPILSCVAV

SEQ ID NO: 588076 - protein, 9 aa, Homo Sapiens
QEKRLQCVS

SEQ ID NO: 588077 - protein, 9 aa, Homo Sapiens
VATKIRDAN

SEQ ID NO: 588078 - protein, 9 aa, Homo Sapiens
ARRLKHQQA

SEQ ID NO: 588079 - protein, 9 aa, Homo Sapiens
DRDQGGSSA

SEQ ID NO: 588080 - protein, 9 aa, Homo Sapiens
HQQAEEIEK

SEQ ID NO: 588081 - protein, 9 aa, Homo Sapiens
GERTDVIQG

SEQ ID NO: 588082 - protein, 9 aa, Homo Sapiens
ANTYKICTW

SEQ ID NO: 588083 - protein, 9 aa, Homo Sapiens
GPALLWAGH

SEQ ID NO: 588084 - protein, 9 aa, Homo Sapiens
AWDMNEKKQ

SEQ ID NO: 588085 - protein, 9 aa, Homo Sapiens
TPRADRAAL

SEQ ID NO: 588086 - protein, 9 aa, Homo Sapiens
GFVYVVDTR

SEQ ID NO: 588087 - protein, 9 aa, Homo Sapiens
CVSFSGVKE

SEQ ID NO: 588088 - protein, 9 aa, Homo Sapiens
RLQCVSFSG

SEQ ID NO: 588089 - protein, 9 aa, Homo Sapiens
QEDFLNVAD

SEQ ID NO: 588090 - protein, 9 aa, Homo Sapiens
LDSYAASLS

SEQ ID NO: 588091 - protein, 9 aa, Homo Sapiens
MTMENYSME

SEQ ID NO: 588092 - protein, 9 aa, Homo Sapiens
PTVLPNLSS

SEQ ID NO: 588093 - protein, 9 aa, Homo Sapiens
GFNRLPTPS

SEQ ID NO: 588094 - protein, 9 aa, Homo Sapiens
LSIQALLTA

SEQ ID NO: 588095 - protein, 9 aa, Homo Sapiens
FPTHVFPTH

SEQ ID NO: 588096 - protein, 9 aa, Homo Sapiens
AASLSKAIE

SEQ ID NO: 588097 - protein, 9 aa, Homo Sapiens
LTAPNPDDP

SEQ ID NO: 588098 - protein, 9 aa, Homo Sapiens
AEEKGTPIF

SEQ ID NO: 588099 - protein, 9 aa, Homo Sapiens
DINGNFTIN

SEQ ID NO: 588100 - protein, 9 aa, Homo Sapiens
LMLQYLTVN

SEQ ID NO: 588101 - protein, 9 aa, Homo Sapiens
CSTWMKAIV

SEQ ID NO: 588102 - protein, 9 aa, Homo Sapiens
LQILTYALK

SEQ ID NO: 588103 - protein, 9 aa, Homo Sapiens
APTVLPNLS

SEQ ID NO: 588104 - protein, 9 aa, Homo Sapiens
LLTAPNPDD

SEQ ID NO: 588105 - protein, 9 aa, Homo Sapiens
GVAAASQGC

SEQ ID NO: 588106 - protein, 9 aa, Homo Sapiens
TELQEMYKA

SEQ ID NO: 588107 - protein, 9 aa, Homo Sapiens
EDAAGQDLQ

SEQ ID NO: 588108 - protein, 9 aa, Homo Sapiens
DLSIRIVRL

SEQ ID NO: 588109 - protein, 9 aa, Homo Sapiens
SKLCKEAEK

SEQ ID NO: 588110 - protein, 9 aa, Homo Sapiens
VAAASQGCS

SEQ ID NO: 588111 - protein, 9 aa, Homo Sapiens
LQLQKVLFV

SEQ ID NO: 588112 - protein, 9 aa, Homo Sapiens
GSSSQGPLT

SEQ ID NO: 588113 - protein, 9 aa, Homo Sapiens
YNEQPVGNW

SEQ ID NO: 588114 - protein, 9 aa, Homo Sapiens
QHSLLSPIL

SEQ ID NO: 588115 - protein, 9 aa, Homo Sapiens
AMATKGGIV

SEQ ID NO: 588116 - protein, 9 aa, Homo Sapiens
HAMYAEEKG

SEQ ID NO: 588117 - protein, 9 aa, Homo Sapiens
PLRSLQQPV

SEQ ID NO: 588118 - protein, 9 aa, Homo Sapiens
IRIVRLVRD

SEQ ID NO: 588119 - protein, 9 aa, Homo Sapiens
DYVLVPTEG

SEQ ID NO: 588120 - protein, 9 aa, Homo Sapiens
LLAVGLLRA

SEQ ID NO: 588121 - protein, 9 aa, Homo Sapiens
RTNWKVAID

SEQ ID NO: 588122 - protein, 9 aa, Homo Sapiens
TAKGSLTIL

SEQ ID NO: 588123 - protein, 9 aa, Homo Sapiens
LEETTGERT

SEQ ID NO: 588124 - protein, 9 aa, Homo Sapiens
LLSPILSCV

SEQ ID NO: 588125 - protein, 9 aa, Homo Sapiens
SSSSHVAKG

SEQ ID NO: 588126 - protein, 9 aa, Homo Sapiens
FEPPETPGV

SEQ ID NO: 588127 - protein, 9 aa, Homo Sapiens
RKSGSFLMP

SEQ ID NO: 588128 - protein, 9 aa, Homo Sapiens
KPEPMDVLT

SEQ ID NO: 588129 - protein, 9 aa, Homo Sapiens
AVAKLITRS

SEQ ID NO: 588130 - protein, 9 aa, Homo Sapiens
LSGVAAASQ

SEQ ID NO: 588131 - protein, 9 aa, Homo Sapiens
WVGAALRLH

SEQ ID NO: 588132 - protein, 9 aa, Homo Sapiens
PSTQKKFAL

SEQ ID NO: 588133 - protein, 9 aa, Homo Sapiens
LGMTPGFRN

SEQ ID NO: 588134 - protein, 9 aa, Homo Sapiens
NESREFEFE

SEQ ID NO: 588135 - protein, 9 aa, Homo Sapiens
LQQPVQSTY

SEQ ID NO: 588136 - protein, 9 aa, Homo Sapiens
EAQFVLDGL

SEQ ID NO: 588137 - protein, 9 aa, Homo Sapiens
RHSSGLQIL

SEQ ID NO: 588138 - protein, 9 aa, Homo Sapiens
SSHVAKGET

SEQ ID NO: 588139 - protein, 9 aa, Homo Sapiens
LPKKPMRQD

SEQ ID NO: 588140 - protein, 9 aa, Homo Sapiens
NLSKINLNH

SEQ ID NO: 588141 - protein, 9 aa, Homo Sapiens
RAIKQQWVG

SEQ ID NO: 588142 - protein, 9 aa, Homo Sapiens
STQKKFALS

SEQ ID NO: 588143 - protein, 9 aa, Homo Sapiens
AEHLYRLEM

SEQ ID NO: 588144 - protein, 9 aa, Homo Sapiens
VQKPEPMDV

SEQ ID NO: 588145 - protein, 9 aa, Homo Sapiens
NKPGDDIFL

SEQ ID NO: 588146 - protein, 9 aa, Homo Sapiens
FLNVADLTS

SEQ ID NO: 588147 - protein, 9 aa, Homo Sapiens
LPKHDRGKM

SEQ ID NO: 588148 - protein, 9 aa, Homo Sapiens
TVLPMYECR

SEQ ID NO: 588149 - protein, 9 aa, Homo Sapiens
VQPLVTMKQ

SEQ ID NO: 588150 - protein, 9 aa, Homo Sapiens
AIEVYKKTV

SEQ ID NO: 588151 - protein, 9 aa, Homo Sapiens
THCFNHSLC

SEQ ID NO: 588152 - protein, 9 aa, Homo Sapiens
RREEGYTCV

SEQ ID NO: 588153 - protein, 9 aa, Homo Sapiens
EAIEEMCHE

SEQ ID NO: 588154 - protein, 9 aa, Homo Sapiens
MLKSGRPLK

SEQ ID NO: 588155 - protein, 9 aa, Homo Sapiens
NSSHELSLH

SEQ ID NO: 588156 - protein, 9 aa, Homo Sapiens
SRDQKNCQF

SEQ ID NO: 588157 - protein, 9 aa, Homo Sapiens
REKVCASLE

SEQ ID NO: 588158 - protein, 9 aa, Homo Sapiens
IYPILFLGF

SEQ ID NO: 588159 - protein, 9 aa, Homo Sapiens
SSEPGLFVV

SEQ ID NO: 588160 - protein, 9 aa, Homo Sapiens
GAPSRGTLT

SEQ ID NO: 588161 - protein, 9 aa, Homo Sapiens
VCASLEAYC

SEQ ID NO: 588162 - protein, 9 aa, Homo Sapiens
SAVCVHQLP

SEQ ID NO: 588163 - protein, 9 aa, Homo Sapiens
GDTAFIILC

SEQ ID NO: 588164 - protein, 9 aa, Homo Sapiens
CKRPLIFIH

SEQ ID NO: 588165 - protein, 9 aa, Homo Sapiens
PRAMLKSGR

SEQ ID NO: 588166 - protein, 9 aa, Homo Sapiens
DFPVHGIEP

SEQ ID NO: 588167 - protein, 9 aa, Homo Sapiens
IPRQIPGQS

SEQ ID NO: 588168 - protein, 9 aa, Homo Sapiens
QASQPEEMI

SEQ ID NO: 588169 - protein, 9 aa, Homo Sapiens
FSWQSVLLS

SEQ ID NO: 588170 - protein, 9 aa, Homo Sapiens
PGMFLFEVV

SEQ ID NO: 588171 - protein, 9 aa, Homo Sapiens
AKEQEWDHI

SEQ ID NO: 588172 - protein, 9 aa, Homo Sapiens
SEQDGGSML

SEQ ID NO: 588173 - protein, 9 aa, Homo Sapiens
RSVPIWEQA

SEQ ID NO: 588174 - protein, 9 aa, Homo Sapiens
TGNITGMSF

SEQ ID NO: 588175 - protein, 9 aa, Homo Sapiens
RWGGGRLGG

SEQ ID NO: 588176 - protein, 9 aa, Homo Sapiens
FADDVALVS

SEQ ID NO: 588177 - protein, 9 aa, Homo Sapiens
VNSTRRVGK

SEQ ID NO: 588178 - protein, 9 aa, Homo Sapiens
PGSAVCVHQ

SEQ ID NO: 588179 - protein, 9 aa, Homo Sapiens
IWEQAPWCE

SEQ ID NO: 588180 - protein, 9 aa, Homo Sapiens
WEQAPWCET

SEQ ID NO: 588181 - protein, 9 aa, Homo Sapiens
CVLTSGIFE

SEQ ID NO: 588182 - protein, 9 aa, Homo Sapiens
KENLDDMGY

SEQ ID NO: 588183 - protein, 9 aa, Homo Sapiens
GGACARREE

SEQ ID NO: 588184 - protein, 9 aa, Homo Sapiens
SKLLANVVY

SEQ ID NO: 588185 - protein, 9 aa, Homo Sapiens
QAPWCETIV

SEQ ID NO: 588186 - protein, 9 aa, Homo Sapiens
GVRAPGGPG

SEQ ID NO: 588187 - protein, 9 aa, Homo Sapiens
KKRTPQEDE

SEQ ID NO: 588188 - protein, 9 aa, Homo Sapiens
GKKLIRVEE

SEQ ID NO: 588189 - protein, 9 aa, Homo Sapiens
LLKPLWQPF

SEQ ID NO: 588190 - protein, 9 aa, Homo Sapiens
PFTHMEYGL

SEQ ID NO: 588191 - protein, 9 aa, Homo Sapiens
CLKIGRDAL

SEQ ID NO: 588192 - protein, 9 aa, Homo Sapiens
IPQQAQELG

SEQ ID NO: 588193 - protein, 9 aa, Homo Sapiens
AARWGGGRL

SEQ ID NO: 588194 - protein, 9 aa, Homo Sapiens
SRAEEYEVL

SEQ ID NO: 588195 - protein, 9 aa, Homo Sapiens
EWDGVGPIP

SEQ ID NO: 588196 - protein, 9 aa, Homo Sapiens
AGSGGVRAP

SEQ ID NO: 588197 - protein, 9 aa, Homo Sapiens
CSSFLGLSQ

SEQ ID NO: 588198 - protein, 9 aa, Homo Sapiens
IDKPLASGV

SEQ ID NO: 588199 - protein, 9 aa, Homo Sapiens
LWQPFTHME

SEQ ID NO: 588200 - protein, 9 aa, Homo Sapiens
RVGKKLIRV

SEQ ID NO: 588201 - protein, 9 aa, Homo Sapiens
LSLHHRVHT

SEQ ID NO: 588202 - protein, 9 aa, Homo Sapiens
GSMLQRAAV

SEQ ID NO: 588203 - protein, 9 aa, Homo Sapiens
VPIWEQAPW

SEQ ID NO: 588204 - protein, 9 aa, Homo Sapiens
MFLFEVVPG

SEQ ID NO: 588205 - protein, 9 aa, Homo Sapiens
WQPFTHMEY

SEQ ID NO: 588206 - protein, 9 aa, Homo Sapiens
KNCQFLGNT

SEQ ID NO: 588207 - protein, 9 aa, Homo Sapiens
NPGMFLFEV

SEQ ID NO: 588208 - protein, 9 aa, Homo Sapiens
PVEIERMQI

SEQ ID NO: 588209 - protein, 9 aa, Homo Sapiens
QRVLLFADD

SEQ ID NO: 588210 - protein, 9 aa, Homo Sapiens
CQFLGNTES

SEQ ID NO: 588211 - protein, 9 aa, Homo Sapiens
MEAIEEMCH

SEQ ID NO: 588212 - protein, 9 aa, Homo Sapiens
FLGLSQNLL

SEQ ID NO: 588213 - protein, 9 aa, Homo Sapiens
EDEWDGVGP

SEQ ID NO: 588214 - protein, 9 aa, Homo Sapiens
DGGSMLQRA

SEQ ID NO: 588215 - protein, 9 aa, Homo Sapiens
GGSMLQRAA

SEQ ID NO: 588216 - protein, 9 aa, Homo Sapiens
KLLANVVYQ

SEQ ID NO: 588217 - protein, 9 aa, Homo Sapiens
MKQLLWVSG

SEQ ID NO: 588218 - protein, 9 aa, Homo Sapiens
LQASPEGLD

SEQ ID NO: 588219 - protein, 9 aa, Homo Sapiens
RRVGKKLIR

SEQ ID NO: 588220 - protein, 9 aa, Homo Sapiens
KQCLKIGRD

SEQ ID NO: 588221 - protein, 9 aa, Homo Sapiens
PILFLGFVY

SEQ ID NO: 588222 - protein, 9 aa, Homo Sapiens
QPFTHMEYG

SEQ ID NO: 588223 - protein, 9 aa, Homo Sapiens
QSVLLSHQR

SEQ ID NO: 588224 - protein, 9 aa, Homo Sapiens
EWDHIQTID

SEQ ID NO: 588225 - protein, 9 aa, Homo Sapiens
GGVRAPGGP

SEQ ID NO: 588226 - protein, 9 aa, Homo Sapiens
GNITGMSFS

SEQ ID NO: 588227 - protein, 9 aa, Homo Sapiens
VAADAKQCL

SEQ ID NO: 588228 - protein, 9 aa, Homo Sapiens
KSSEPGLFV

SEQ ID NO: 588229 - protein, 9 aa, Homo Sapiens
LCKRPLIFI

SEQ ID NO: 588230 - protein, 9 aa, Homo Sapiens
KRRGRRSAN

SEQ ID NO: 588231 - protein, 9 aa, Homo Sapiens
SWQSVLLSH

SEQ ID NO: 588232 - protein, 9 aa, Homo Sapiens
LKIGRDALR

SEQ ID NO: 588233 - protein, 9 aa, Homo Sapiens
EQAPWCETI

SEQ ID NO: 588234 - protein, 9 aa, Homo Sapiens
ENPGMFLFE

SEQ ID NO: 588235 - protein, 9 aa, Homo Sapiens
MLQRAAVSR

SEQ ID NO: 588236 - protein, 9 aa, Homo Sapiens
FSDFPVHGI

SEQ ID NO: 588237 - protein, 9 aa, Homo Sapiens
LVQPLVTMK

SEQ ID NO: 588238 - protein, 9 aa, Homo Sapiens
NIFFPFLNI

SEQ ID NO: 588239 - protein, 9 aa, Homo Sapiens
DQDLLRCCV

SEQ ID NO: 588240 - protein, 9 aa, Homo Sapiens
LANVVYQYK

SEQ ID NO: 588241 - protein, 9 aa, Homo Sapiens
TKVLKPLSV

SEQ ID NO: 588242 - protein, 9 aa, Homo Sapiens
GEGWLLGPR

SEQ ID NO: 588243 - protein, 9 aa, Homo Sapiens
KRTPQEDEW

SEQ ID NO: 588244 - protein, 9 aa, Homo Sapiens
GGPGSAVCV

SEQ ID NO: 588245 - protein, 9 aa, Homo Sapiens
SSHELSLHH

SEQ ID NO: 588246 - protein, 9 aa, Homo Sapiens
VEALREKVC

SEQ ID NO: 588247 - protein, 9 aa, Homo Sapiens
RAPGGPGSA

SEQ ID NO: 588248 - protein, 9 aa, Homo Sapiens
WEGIDKPLA

SEQ ID NO: 588249 - protein, 9 aa, Homo Sapiens
QEDEWDGVG

SEQ ID NO: 588250 - protein, 9 aa, Homo Sapiens
LGLSQNLLL

SEQ ID NO: 588251 - protein, 9 aa, Homo Sapiens
LREKVCASL

SEQ ID NO: 588252 - protein, 9 aa, Homo Sapiens
RTPQEDEWD

SEQ ID NO: 588253 - protein, 9 aa, Homo Sapiens
GMFLFEVVP

SEQ ID NO: 588254 - protein, 9 aa, Homo Sapiens
PEVAKEQEW

SEQ ID NO: 588255 - protein, 9 aa, Homo Sapiens
NQIPRQIPG

SEQ ID NO: 588256 - protein, 9 aa, Homo Sapiens
DMETIYPIL

SEQ ID NO: 588257 - protein, 9 aa, Homo Sapiens
GIPLIPQQA

SEQ ID NO: 588258 - protein, 9 aa, Homo Sapiens
CARREEGYT

SEQ ID NO: 588259 - protein, 9 aa, Homo Sapiens
LPRAMLKSG

SEQ ID NO: 588260 - protein, 9 aa, Homo Sapiens
ENLDDMGYI

SEQ ID NO: 588261 - protein, 9 aa, Homo Sapiens
QDGGSMLQR

SEQ ID NO: 588262 - protein, 9 aa, Homo Sapiens
EQEWDHIQT

SEQ ID NO: 588263 - protein, 9 aa, Homo Sapiens
VQASQPEEM

SEQ ID NO: 588264 - protein, 9 aa, Homo Sapiens
FDKENLDDM

SEQ ID NO: 588265 - protein, 9 aa, Homo Sapiens
CPFCGNIFF

SEQ ID NO: 588266 - protein, 9 aa, Homo Sapiens
LVTMKQLLW

SEQ ID NO: 588267 - protein, 9 aa, Homo Sapiens
KELMEAIEE

SEQ ID NO: 588268 - protein, 9 aa, Homo Sapiens
VTGNITGMS

SEQ ID NO: 588269 - protein, 9 aa, Homo Sapiens
GQSFYTKPL

SEQ ID NO: 588270 - protein, 9 aa, Homo Sapiens
KVCASLEAY

SEQ ID NO: 588271 - protein, 9 aa, Homo Sapiens
KCSLDWLLL

SEQ ID NO: 588272 - protein, 9 aa, Homo Sapiens
NVDQATRVA

SEQ ID NO: 588273 - protein, 9 aa, Homo Sapiens
NSTRRVGKK

SEQ ID NO: 588274 - protein, 9 aa, Homo Sapiens
NITGMSFSI

SEQ ID NO: 588275 - protein, 9 aa, Homo Sapiens
CFNHSLCNF

SEQ ID NO: 588276 - protein, 9 aa, Homo Sapiens
TRRVGKKLI

SEQ ID NO: 588277 - protein, 9 aa, Homo Sapiens
EPGLFVVGL

SEQ ID NO: 588278 - protein, 9 aa, Homo Sapiens
LLRCCVLTS

SEQ ID NO: 588279 - protein, 9 aa, Homo Sapiens
RKRRGRRSA

SEQ ID NO: 588280 - protein, 9 aa, Homo Sapiens
QDLLRCCVL

SEQ ID NO: 588281 - protein, 9 aa, Homo Sapiens
DLLRCCVLT

SEQ ID NO: 588282 - protein, 9 aa, Homo Sapiens
CNEENPGMF

SEQ ID NO: 588283 - protein, 9 aa, Homo Sapiens
LRLIKSPVE

SEQ ID NO: 588284 - protein, 9 aa, Homo Sapiens
VCVHQLPPG

SEQ ID NO: 588285 - protein, 9 aa, Homo Sapiens
FPVHGIEPM

SEQ ID NO: 588286 - protein, 9 aa, Homo Sapiens
ILHRTGHVS

SEQ ID NO: 588287 - protein, 9 aa, Homo Sapiens
EGLDSTQPH

SEQ ID NO: 588288 - protein, 9 aa, Homo Sapiens
SPGAPSRGT

SEQ ID NO: 588289 - protein, 9 aa, Homo Sapiens
CVTGNITGM

SEQ ID NO: 588290 - protein, 9 aa, Homo Sapiens
YKKTVEFSP

SEQ ID NO: 588291 - protein, 9 aa, Homo Sapiens
RRSANNTPE

SEQ ID NO: 588292 - protein, 9 aa, Homo Sapiens
ALSAAARWG

SEQ ID NO: 588293 - protein, 9 aa, Homo Sapiens
QIPRQIPGQ

SEQ ID NO: 588294 - protein, 9 aa, Homo Sapiens
LLAGSGGVR

SEQ ID NO: 588295 - protein, 9 aa, Homo Sapiens
MSFSILWDP

SEQ ID NO: 588296 - protein, 9 aa, Homo Sapiens
PFCGNIFFP

SEQ ID NO: 588297 - protein, 9 aa, Homo Sapiens
DKPLASGVT

SEQ ID NO: 588298 - protein, 9 aa, Homo Sapiens
ETKVLKPLS

SEQ ID NO: 588299 - protein, 9 aa, Homo Sapiens
NTESYQFGK

SEQ ID NO: 588300 - protein, 9 aa, Homo Sapiens
LLLAGSGGV

SEQ ID NO: 588301 - protein, 9 aa, Homo Sapiens
KKTVEFSPE

SEQ ID NO: 588302 - protein, 9 aa, Homo Sapiens
RLIKSPVEI

SEQ ID NO: 588303 - protein, 9 aa, Homo Sapiens
DQKNCQFLG

SEQ ID NO: 588304 - protein, 9 aa, Homo Sapiens
QFLGNTESY

SEQ ID NO: 588305 - protein, 9 aa, Homo Sapiens
METIYPILF

SEQ ID NO: 588306 - protein, 9 aa, Homo Sapiens
GNIFFPFLN

SEQ ID NO: 588307 - protein, 9 aa, Homo Sapiens
KPLSVIMGV

SEQ ID NO: 588308 - protein, 9 aa, Homo Sapiens
KQLLWVSGR

SEQ ID NO: 588309 - protein, 9 aa, Homo Sapiens
TCKELMEAI

SEQ ID NO: 588310 - protein, 9 aa, Homo Sapiens
QKNCQFLGN

SEQ ID NO: 588311 - protein, 9 aa, Homo Sapiens
STRRVGKKL

SEQ ID NO: 588312 - protein, 9 aa, Homo Sapiens
FNSSHELSL

SEQ ID NO: 588313 - protein, 9 aa, Homo Sapiens
PQEDEWDGV

SEQ ID NO: 588314 - protein, 9 aa, Homo Sapiens
PLVTMKQLL

SEQ ID NO: 588315 - protein, 9 aa, Homo Sapiens
ANVVYQYKG

SEQ ID NO: 588316 - protein, 9 aa, Homo Sapiens
PGGPGSAVC

SEQ ID NO: 588317 - protein, 9 aa, Homo Sapiens
SEPGLFVVG

SEQ ID NO: 588318 - protein, 9 aa, Homo Sapiens
ELMEAIEEM

SEQ ID NO: 588319 - protein, 9 aa, Homo Sapiens
AAARWGGGR

SEQ ID NO: 588320 - protein, 9 aa, Homo Sapiens
ELSLHHRVH

SEQ ID NO: 588321 - protein, 9 aa, Homo Sapiens
SSFLGLSQN

SEQ ID NO: 588322 - protein, 9 aa, Homo Sapiens
HELVTTHCF

SEQ ID NO: 588323 - protein, 9 aa, Homo Sapiens
DVEESHKCS

SEQ ID NO: 588324 - protein, 9 aa, Homo Sapiens
ADAKQCLKI

SEQ ID NO: 588325 - protein, 9 aa, Homo Sapiens
TIYPILFLG

SEQ ID NO: 588326 - protein, 9 aa, Homo Sapiens
ARREEGYTC

SEQ ID NO: 588327 - protein, 9 aa, Homo Sapiens
RAEEYEVLY

SEQ ID NO: 588328 - protein, 9 aa, Homo Sapiens
TGMSFSILW

SEQ ID NO: 588329 - protein, 9 aa, Homo Sapiens
ELVTTHCFN

SEQ ID NO: 588330 - protein, 9 aa, Homo Sapiens
PSRGTLTLD

SEQ ID NO: 588331 - protein, 9 aa, Homo Sapiens
LSSSRDQKN

SEQ ID NO: 588332 - protein, 9 aa, Homo Sapiens
KTVEFSPEN

SEQ ID NO: 588333 - protein, 9 aa, Homo Sapiens
LVTTHCFNH

SEQ ID NO: 588334 - protein, 9 aa, Homo Sapiens
LIPQQAQEL

SEQ ID NO: 588335 - protein, 9 aa, Homo Sapiens
HGIEPMNNA

SEQ ID NO: 588336 - protein, 9 aa, Homo Sapiens
ALREKVCAS

SEQ ID NO: 588337 - protein, 9 aa, Homo Sapiens
RLRLIKSPV

SEQ ID NO: 588338 - protein, 9 aa, Homo Sapiens
VGKKLIRVE

SEQ ID NO: 588339 - protein, 9 aa, Homo Sapiens
ARWGGGRLG

SEQ ID NO: 588340 - protein, 9 aa, Homo Sapiens
AGGAGEGWL

SEQ ID NO: 588341 - protein, 9 aa, Homo Sapiens
RDTLVADNV

SEQ ID NO: 588342 - protein, 9 aa, Homo Sapiens
HELSLHHRV

SEQ ID NO: 588343 - protein, 9 aa, Homo Sapiens
GSGGVRAPG

SEQ ID NO: 588344 - protein, 9 aa, Homo Sapiens
FLGNTESYQ

SEQ ID NO: 588345 - protein, 9 aa, Homo Sapiens
ETIYPILFL

SEQ ID NO: 588346 - protein, 9 aa, Homo Sapiens
RGRRSANNT

SEQ ID NO: 588347 - protein, 9 aa, Homo Sapiens
KETKVLKPL

SEQ ID NO: 588348 - protein, 9 aa, Homo Sapiens
QCLKIGRDA

SEQ ID NO: 588349 - protein, 9 aa, Homo Sapiens
ESHKCSLDW

SEQ ID NO: 588350 - protein, 9 aa, Homo Sapiens
QPEEMIIKW

SEQ ID NO: 588351 - protein, 9 aa, Homo Sapiens
TQTGSPGAP

SEQ ID NO: 588352 - protein, 9 aa, Homo Sapiens
GLPRAMLKS

SEQ ID NO: 588353 - protein, 9 aa, Homo Sapiens
LIKSPVEIE

SEQ ID NO: 588354 - protein, 9 aa, Homo Sapiens
VYKKTVEFS

SEQ ID NO: 588355 - protein, 9 aa, Homo Sapiens
YWEGIDKPL

SEQ ID NO: 588356 - protein, 9 aa, Homo Sapiens
TLVADNVDQ

SEQ ID NO: 588357 - protein, 9 aa, Homo Sapiens
PGQSFYTKP

SEQ ID NO: 588358 - protein, 9 aa, Homo Sapiens
VADNVDQAT

SEQ ID NO: 588359 - protein, 9 aa, Homo Sapiens
AIEEMCHEE

SEQ ID NO: 588360 - protein, 9 aa, Homo Sapiens
EKVCASLEA

SEQ ID NO: 588361 - protein, 9 aa, Homo Sapiens
VEESHKCSL

SEQ ID NO: 588362 - protein, 9 aa, Homo Sapiens
NCQFLGNTE

SEQ ID NO: 588363 - protein, 9 aa, Homo Sapiens
LVADNVDQA

SEQ ID NO: 588364 - protein, 9 aa, Homo Sapiens
SVPIWEQAP

SEQ ID NO: 588365 - protein, 9 aa, Homo Sapiens
ASKLLANVV

SEQ ID NO: 588366 - protein, 9 aa, Homo Sapiens
MFDKENLDD

SEQ ID NO: 588367 - protein, 9 aa, Homo Sapiens
QIPGQSFYT

SEQ ID NO: 588368 - protein, 9 aa, Homo Sapiens
IRVQASQPE

SEQ ID NO: 588369 - protein, 9 aa, Homo Sapiens
VDQATRVAY

SEQ ID NO: 588370 - protein, 9 aa, Homo Sapiens
SPEGLDSTQ

SEQ ID NO: 588371 - protein, 9 aa, Homo Sapiens
DTCKELMEA

SEQ ID NO: 588372 - protein, 9 aa, Homo Sapiens
GAGEGWLLG

SEQ ID NO: 588373 - protein, 9 aa, Homo Sapiens
RSANNTPEN

SEQ ID NO: 588374 - protein, 9 aa, Homo Sapiens
PQGLQASPE

SEQ ID NO: 588375 - protein, 9 aa, Homo Sapiens
SAAARWGGG

SEQ ID NO: 588376 - protein, 9 aa, Homo Sapiens
DKENLDDMG

SEQ ID NO: 588377 - protein, 9 aa, Homo Sapiens
DTLVADNVD

SEQ ID NO: 588378 - protein, 9 aa, Homo Sapiens
YWLCSSFLG

SEQ ID NO: 588379 - protein, 9 aa, Homo Sapiens
IILCKRPLI

SEQ ID NO: 588380 - protein, 9 aa, Homo Sapiens
EALREKVCA

SEQ ID NO: 588381 - protein, 9 aa, Homo Sapiens
LRCCVLTSG

SEQ ID NO: 588382 - protein, 9 aa, Homo Sapiens
IPLIPQQAQ

SEQ ID NO: 588383 - protein, 9 aa, Homo Sapiens
GSAVCVHQL

SEQ ID NO: 588384 - protein, 9 aa, Homo Sapiens
PGLPRAMLK

SEQ ID NO: 588385 - protein, 9 aa, Homo Sapiens
SDFPVHGIE

SEQ ID NO: 588386 - protein, 9 aa, Homo Sapiens
ADNVDQATR

SEQ ID NO: 588387 - protein, 9 aa, Homo Sapiens
LKPLWQPFT

SEQ ID NO: 588388 - protein, 9 aa, Homo Sapiens
GMSFSILWD

SEQ ID NO: 588389 - protein, 9 aa, Homo Sapiens
RRKRRGRRS

SEQ ID NO: 588390 - protein, 9 aa, Homo Sapiens
LHRTGHVSE

SEQ ID NO: 588391 - protein, 9 aa, Homo Sapiens
VVYQYKGMG

SEQ ID NO: 588392 - protein, 9 aa, Homo Sapiens
ASPEGLDST

SEQ ID NO: 588393 - protein, 9 aa, Homo Sapiens
DTAFIILCK

SEQ ID NO: 588394 - protein, 9 aa, Homo Sapiens
VLLSHQRTH

SEQ ID NO: 588395 - protein, 9 aa, Homo Sapiens
SHKCSLDWL

SEQ ID NO: 588396 - protein, 9 aa, Homo Sapiens
PVHGIEPMN

SEQ ID NO: 588397 - protein, 9 aa, Homo Sapiens
IPGQSFYTK

SEQ ID NO: 588398 - protein, 9 aa, Homo Sapiens
TPQEDEWDG

SEQ ID NO: 588399 - protein, 9 aa, Homo Sapiens
RVLLFADDV

SEQ ID NO: 588400 - protein, 9 aa, Homo Sapiens
EEYEVLYTI

SEQ ID NO: 588401 - protein, 9 aa, Homo Sapiens
HKCSLDWLL

SEQ ID NO: 588402 - protein, 9 aa, Homo Sapiens
DNVDQATRV

SEQ ID NO: 588403 - protein, 9 aa, Homo Sapiens
AADAKQCLK

SEQ ID NO: 588404 - protein, 9 aa, Homo Sapiens
KAIEVYKKT

SEQ ID NO: 588405 - protein, 9 aa, Homo Sapiens
ALIMFDKEN

SEQ ID NO: 588406 - protein, 9 aa, Homo Sapiens
GRQRVLLFA

SEQ ID NO: 588407 - protein, 9 aa, Homo Sapiens
ALLKPLWQP

SEQ ID NO: 588408 - protein, 9 aa, Homo Sapiens
APSRGTLTL

SEQ ID NO: 588409 - protein, 9 aa, Homo Sapiens
CVHQLPPGQ

SEQ ID NO: 588410 - protein, 9 aa, Homo Sapiens
DEWDGVGPI

SEQ ID NO: 588411 - protein, 9 aa, Homo Sapiens
QTGSPGAPS

SEQ ID NO: 588412 - protein, 9 aa, Homo Sapiens
FCGNIFFPF

SEQ ID NO: 588413 - protein, 9 aa, Homo Sapiens
ALGIPLIPQ

SEQ ID NO: 588414 - protein, 9 aa, Homo Sapiens
GGAGEGWLL

SEQ ID NO: 588415 - protein, 9 aa, Homo Sapiens
LPGLPRAML

SEQ ID NO: 588416 - protein, 9 aa, Homo Sapiens
QPLVTMKQL

SEQ ID NO: 588417 - protein, 9 aa, Homo Sapiens
LMEAIEEMC

SEQ ID NO: 588418 - protein, 9 aa, Homo Sapiens
CKELMEAIE

SEQ ID NO: 588419 - protein, 9 aa, Homo Sapiens
LLANVVYQY

SEQ ID NO: 588420 - protein, 9 aa, Homo Sapiens
SDQDLLRCC

SEQ ID NO: 588421 - protein, 9 aa, Homo Sapiens
RRGRRSANN

SEQ ID NO: 588422 - protein, 9 aa, Homo Sapiens
TGSPGAPSR

SEQ ID NO: 588423 - protein, 9 aa, Homo Sapiens
PGLFVVGLH

SEQ ID NO: 588424 - protein, 9 aa, Homo Sapiens
FIILCKRPL

SEQ ID NO: 588425 - protein, 9 aa, Homo Sapiens
KVLKPLSVI

SEQ ID NO: 588426 - protein, 9 aa, Homo Sapiens
TTHCFNHSL

SEQ ID NO: 588427 - protein, 9 aa, Homo Sapiens
VSEQDGGSM

SEQ ID NO: 588428 - protein, 9 aa, Homo Sapiens
CASLEAYCK

SEQ ID NO: 588429 - protein, 9 aa, Homo Sapiens
EALIMFDKE

SEQ ID NO: 588430 - protein, 9 aa, Homo Sapiens
NVVYQYKGM

SEQ ID NO: 588431 - protein, 9 aa, Homo Sapiens
PIWEQAPWC

SEQ ID NO: 588432 - protein, 9 aa, Homo Sapiens
SLHHRVHTG

SEQ ID NO: 588433 - protein, 9 aa, Homo Sapiens
SSRDQKNCQ

SEQ ID NO: 588434 - protein, 9 aa, Homo Sapiens
GRRSANNTP

SEQ ID NO: 588435 - protein, 9 aa, Homo Sapiens
PLWQPFTHM

SEQ ID NO: 588436 - protein, 9 aa, Homo Sapiens
AGEGWLLGP

SEQ ID NO: 588437 - protein, 9 aa, Homo Sapiens
LKPLSVIMG

SEQ ID NO: 588438 - protein, 9 aa, Homo Sapiens
LIMFDKENL

SEQ ID NO: 588439 - protein, 9 aa, Homo Sapiens
AVCVHQLPP

SEQ ID NO: 588440 - protein, 9 aa, Homo Sapiens
IKSPVEIER

SEQ ID NO: 588441 - protein, 9 aa, Homo Sapiens
VLKPLSVIM

SEQ ID NO: 588442 - protein, 9 aa, Homo Sapiens
RCCVLTSGI

SEQ ID NO: 588443 - protein, 9 aa, Homo Sapiens
EEGYTCVCR

SEQ ID NO: 588444 - protein, 9 aa, Homo Sapiens
EGYTCVCRP

SEQ ID NO: 588445 - protein, 9 aa, Homo Sapiens
VTMKQLLWV

SEQ ID NO: 588446 - protein, 9 aa, Homo Sapiens
SSSRDQKNC

SEQ ID NO: 588447 - protein, 9 aa, Homo Sapiens
AFIILCKRP

SEQ ID NO: 588448 - protein, 9 aa, Homo Sapiens
LKSGRPLKS

SEQ ID NO: 588449 - protein, 9 aa, Homo Sapiens
ACARREEGY

SEQ ID NO: 588450 - protein, 9 aa, Homo Sapiens
PEEMIIKWE

SEQ ID NO: 588451 - protein, 9 aa, Homo Sapiens
IFFPFLNIE

SEQ ID NO: 588452 - protein, 9 aa, Homo Sapiens
MPSRAEEYE

SEQ ID NO: 588453 - protein, 9 aa, Homo Sapiens
EESHKCSLD

SEQ ID NO: 588454 - protein, 9 aa, Homo Sapiens
LYWLCSSFL

SEQ ID NO: 588455 - protein, 9 aa, Homo Sapiens
HRTGHVSES

SEQ ID NO: 588456 - protein, 9 aa, Homo Sapiens
PLSVIMGVF

SEQ ID NO: 588457 - protein, 9 aa, Homo Sapiens
EGIDKPLAS

SEQ ID NO: 588458 - protein, 9 aa, Homo Sapiens
SGGVRAPGG

SEQ ID NO: 588459 - protein, 9 aa, Homo Sapiens
PRQIPGQSF

SEQ ID NO: 588460 - protein, 9 aa, Homo Sapiens
SFLGLSQNL

SEQ ID NO: 588461 - protein, 9 aa, Homo Sapiens
ASQPEEMII

SEQ ID NO: 588462 - protein, 9 aa, Homo Sapiens
GNTESYQFG

SEQ ID NO: 588463 - protein, 9 aa, Homo Sapiens
QLPPGQLHV

SEQ ID NO: 588464 - protein, 9 aa, Homo Sapiens
GLQASPEGL

SEQ ID NO: 588465 - protein, 9 aa, Homo Sapiens
RQRVLLFAD

SEQ ID NO: 588466 - protein, 9 aa, Homo Sapiens
REEGYTCVC

SEQ ID NO: 588467 - protein, 9 aa, Homo Sapiens
ILFLGFVYS

SEQ ID NO: 588468 - protein, 9 aa, Homo Sapiens
GACARREEG

SEQ ID NO: 588469 - protein, 9 aa, Homo Sapiens
EQDGGSMLQ

SEQ ID NO: 588470 - protein, 9 aa, Homo Sapiens
SPVEIERMQ

SEQ ID NO: 588471 - protein, 9 aa, Homo Sapiens
SVLLSHQRT

SEQ ID NO: 588472 - protein, 9 aa, Homo Sapiens
NDMETIYPI

SEQ ID NO: 588473 - protein, 9 aa, Homo Sapiens
WGGGRLGGF

SEQ ID NO: 588474 - protein, 9 aa, Homo Sapiens
CGNIFFPFL

SEQ ID NO: 588475 - protein, 9 aa, Homo Sapiens
AKQCLKIGR

SEQ ID NO: 588476 - protein, 9 aa, Homo Sapiens
SHELSLHHR

SEQ ID NO: 588477 - protein, 9 aa, Homo Sapiens
VLLFADDVA

SEQ ID NO: 588478 - protein, 9 aa, Homo Sapiens
LPEVAKEQE

SEQ ID NO: 588479 - protein, 9 aa, Homo Sapiens
LGNTESYQF

SEQ ID NO: 588480 - protein, 9 aa, Homo Sapiens
PEGLDSTQP

SEQ ID NO: 588481 - protein, 9 aa, Homo Sapiens
LGIPLIPQQ

SEQ ID NO: 588482 - protein, 9 aa, Homo Sapiens
FFPFLNIEI

SEQ ID NO: 588483 - protein, 9 aa, Homo Sapiens
FDVEESHKC

SEQ ID NO: 588484 - protein, 9 aa, Homo Sapiens
NEENPGMFL

SEQ ID NO: 588485 - protein, 9 aa, Homo Sapiens
FVVGLHTGE

SEQ ID NO: 588486 - protein, 9 aa, Homo Sapiens
RQIPGQSFY

SEQ ID NO: 588487 - protein, 9 aa, Homo Sapiens
CCVLTSGIF

SEQ ID NO: 588488 - protein, 9 aa, Homo Sapiens
AMLKSGRPL

SEQ ID NO: 588489 - protein, 9 aa, Homo Sapiens
PRRKRRGRR

SEQ ID NO: 588490 - protein, 9 aa, Homo Sapiens
FINAGGAGE

SEQ ID NO: 588491 - protein, 9 aa, Homo Sapiens
LAGSGGVRA

SEQ ID NO: 588492 - protein, 9 aa, Homo Sapiens
GIEPMNNAT

SEQ ID NO: 588493 - protein, 9 aa, Homo Sapiens
VRAPGGPGS

SEQ ID NO: 588494 - protein, 9 aa, Homo Sapiens
KEQEWDHIQ

SEQ ID NO: 588495 - protein, 9 aa, Homo Sapiens
PGAPSRGTL

SEQ ID NO: 588496 - protein, 9 aa, Homo Sapiens
INAGGAGEG

SEQ ID NO: 588497 - protein, 9 aa, Homo Sapiens
VYWEGIDKP

SEQ ID NO: 588498 - protein, 9 aa, Homo Sapiens
ITGMSFSIL

SEQ ID NO: 588499 - protein, 9 aa, Homo Sapiens
ILCKRPLIF

SEQ ID NO: 588500 - protein, 9 aa, Homo Sapiens
EENPGMFLF

SEQ ID NO: 588501 - protein, 9 aa, Homo Sapiens
HQLPPGQLH

SEQ ID NO: 588502 - protein, 9 aa, Homo Sapiens
KSPVEIERM

SEQ ID NO: 588503 - protein, 9 aa, Homo Sapiens
IMFDKENLD

SEQ ID NO: 588504 - protein, 9 aa, Homo Sapiens
EYEVLYTIG

SEQ ID NO: 588505 - protein, 9 aa, Homo Sapiens
LFVVGLHTG

SEQ ID NO: 588506 - protein, 9 aa, Homo Sapiens
RVQASQPEE

SEQ ID NO: 588507 - protein, 9 aa, Homo Sapiens
RDQKNCQFL

SEQ ID NO: 588508 - protein, 9 aa, Homo Sapiens
LSAAARWGG

SEQ ID NO: 588509 - protein, 9 aa, Homo Sapiens
IEVYKKTVE

SEQ ID NO: 588510 - protein, 9 aa, Homo Sapiens
VHGIEPMNN

SEQ ID NO: 588511 - protein, 9 aa, Homo Sapiens
KPLASGVTI

SEQ ID NO: 588512 - protein, 9 aa, Homo Sapiens
YPILFLGFV

SEQ ID NO: 588513 - protein, 9 aa, Homo Sapiens
TAFIILCKR

SEQ ID NO: 588514 - protein, 9 aa, Homo Sapiens
DAKQCLKIG

SEQ ID NO: 588515 - protein, 9 aa, Homo Sapiens
IRSVPIWEQ

SEQ ID NO: 588516 - protein, 9 aa, Homo Sapiens
WQSVLLSHQ

SEQ ID NO: 588517 - protein, 9 aa, Homo Sapiens
QGLQASPEG

SEQ ID NO: 588518 - protein, 9 aa, Homo Sapiens
TVEFSPENT

SEQ ID NO: 588519 - protein, 9 aa, Homo Sapiens
EVYKKTVEF

SEQ ID NO: 588520 - protein, 9 aa, Homo Sapiens
IEPMNNATK

SEQ ID NO: 588521 - protein, 9 aa, Homo Sapiens
SQPEEMIIK

SEQ ID NO: 588522 - protein, 9 aa, Homo Sapiens
SMLQRAAVS

SEQ ID NO: 588523 - protein, 9 aa, Homo Sapiens
RAMLKSGRP

SEQ ID NO: 588524 - protein, 9 aa, Homo Sapiens
EEMIIKWEP

SEQ ID NO: 588525 - protein, 9 aa, Homo Sapiens
HCFNHSLCN

SEQ ID NO: 588526 - protein, 9 aa, Homo Sapiens
NFDVEESHK

SEQ ID NO: 588527 - protein, 9 aa, Homo Sapiens
LALSAAARW

SEQ ID NO: 588528 - protein, 9 aa, Homo Sapiens
EVAKEQEWD

SEQ ID NO: 588529 - protein, 9 aa, Homo Sapiens
LFADDVALV

SEQ ID NO: 588530 - protein, 9 aa, Homo Sapiens
APGGPGSAV

SEQ ID NO: 588531 - protein, 9 aa, Homo Sapiens
LLFADDVAL

SEQ ID NO: 588532 - protein, 9 aa, Homo Sapiens
VEIERMQIA

SEQ ID NO: 588533 - protein, 9 aa, Homo Sapiens
LVNSTRRVG

SEQ ID NO: 588534 - protein, 9 aa, Homo Sapiens
AASKLLANV

SEQ ID NO: 588535 - protein, 9 aa, Homo Sapiens
VVGLHTGEV

SEQ ID NO: 588536 - protein, 9 aa, Homo Sapiens
AEEYEVLYT

SEQ ID NO: 588537 - protein, 9 aa, Homo Sapiens
NAGGAGEGW

SEQ ID NO: 588538 - protein, 9 aa, Homo Sapiens
ADDVALVSK

SEQ ID NO: 588539 - protein, 9 aa, Homo Sapiens
FPFLNIEIR

SEQ ID NO: 588540 - protein, 9 aa, Homo Sapiens
GIDKPLASG

SEQ ID NO: 588541 - protein, 9 aa, Homo Sapiens
QEWDHIQTI

SEQ ID NO: 588542 - protein, 9 aa, Homo Sapiens
GPGSAVCVH

SEQ ID NO: 588543 - protein, 9 aa, Homo Sapiens
VAKEQEWDH

SEQ ID NO: 588544 - protein, 9 aa, Homo Sapiens
GLFVVGLHT

SEQ ID NO: 588545 - protein, 9 aa, Homo Sapiens
VHQLPPGQL

SEQ ID NO: 588546 - protein, 9 aa, Homo Sapiens
DFINAGGAG

SEQ ID NO: 588547 - protein, 9 aa, Homo Sapiens
GVYWEGIDK

SEQ ID NO: 588548 - protein, 9 aa, Homo Sapiens
KPLWQPFTH

SEQ ID NO: 588549 - protein, 9 aa, Homo Sapiens
PLIPQQAQE

SEQ ID NO: 588550 - protein, 9 aa, Homo Sapiens
TMKQLLWVS

SEQ ID NO: 588551 - protein, 9 aa, Homo Sapiens
KKETKVLKP

SEQ ID NO: 588552 - protein, 9 aa, Homo Sapiens
VTTHCFNHS

SEQ ID NO: 588553 - protein, 9 aa, Homo Sapiens
WLCSSFLGL

SEQ ID NO: 588554 - protein, 9 aa, Homo Sapiens
GSPGAPSRG

SEQ ID NO: 588555 - protein, 9 aa, Homo Sapiens
LCSSFLGLS

SEQ ID NO: 588556 - protein, 9 aa, Homo Sapiens
QASPEGLDS

SEQ ID NO: 588557 - protein, 9 aa, Homo Sapiens
PCNEENPGM

SEQ ID NO: 588558 - protein, 9 aa, Homo Sapiens
PSRAEEYEV

SEQ ID NO: 588559 - protein, 9 aa, Homo Sapiens
GNSQVHMSR

SEQ ID NO: 588560 - protein, 9 aa, Homo Sapiens
VTGNSQVHM

SEQ ID NO: 588561 - protein, 9 aa, Homo Sapiens
YAIFVEDIM

SEQ ID NO: 588562 - protein, 9 aa, Homo Sapiens
PFFSPLTFF

SEQ ID NO: 588563 - protein, 9 aa, Homo Sapiens
ILLGKFSLP

SEQ ID NO: 588564 - protein, 9 aa, Homo Sapiens
LKNTIPFPL

SEQ ID NO: 588565 - protein, 9 aa, Homo Sapiens
YTYEILLWT

SEQ ID NO: 588566 - protein, 9 aa, Homo Sapiens
ALRPVFMKS

SEQ ID NO: 588567 - protein, 9 aa, Homo Sapiens
PMEHPIPQS

SEQ ID NO: 588568 - protein, 9 aa, Homo Sapiens
MTPTVFSSH

SEQ ID NO: 588569 - protein, 9 aa, Homo Sapiens
SMAYFTGPC

SEQ ID NO: 588570 - protein, 9 aa, Homo Sapiens
FSPLTFFQG

SEQ ID NO: 588571 - protein, 9 aa, Homo Sapiens
EKVQLTKVP

SEQ ID NO: 588572 - protein, 9 aa, Homo Sapiens
LIPGLAGKT

SEQ ID NO: 588573 - protein, 9 aa, Homo Sapiens
YPQNPKRRE

SEQ ID NO: 588574 - protein, 9 aa, Homo Sapiens
LSKYAIFVE

SEQ ID NO: 588575 - protein, 9 aa, Homo Sapiens
DYEVQHQLL

SEQ ID NO: 588576 - protein, 9 aa, Homo Sapiens
IFPQSPGFK

SEQ ID NO: 588577 - protein, 9 aa, Homo Sapiens
YTFCFISFP

SEQ ID NO: 588578 - protein, 9 aa, Homo Sapiens
SPMEHPIPQ

SEQ ID NO: 588579 - protein, 9 aa, Homo Sapiens
AFFNWNFLS

SEQ ID NO: 588580 - protein, 9 aa, Homo Sapiens
IGKCLWYPT

SEQ ID NO: 588581 - protein, 9 aa, Homo Sapiens
NTSFSKSNA

SEQ ID NO: 588582 - protein, 9 aa, Homo Sapiens
FPKWFMINP

SEQ ID NO: 588583 - protein, 9 aa, Homo Sapiens
QGMLMLCGL

SEQ ID NO: 588584 - protein, 9 aa, Homo Sapiens
FMINPAISL

SEQ ID NO: 588585 - protein, 9 aa, Homo Sapiens
CIRDVPGNE

SEQ ID NO: 588586 - protein, 9 aa, Homo Sapiens
YIHTHTFYV

SEQ ID NO: 588587 - protein, 9 aa, Homo Sapiens
LHNLDLMIR

SEQ ID NO: 588588 - protein, 9 aa, Homo Sapiens
TPTHARIII

SEQ ID NO: 588589 - protein, 9 aa, Homo Sapiens
RKLDHYIGY

SEQ ID NO: 588590 - protein, 9 aa, Homo Sapiens
ETKPEDCIR

SEQ ID NO: 588591 - protein, 9 aa, Homo Sapiens
VLYFSCNPM

SEQ ID NO: 588592 - protein, 9 aa, Homo Sapiens
WLGMKSDAG

SEQ ID NO: 588593 - protein, 9 aa, Homo Sapiens
RMEEEKVQL

SEQ ID NO: 588594 - protein, 9 aa, Homo Sapiens
IQCLIFTFM

SEQ ID NO: 588595 - protein, 9 aa, Homo Sapiens
FFQGMLMLC

SEQ ID NO: 588596 - protein, 9 aa, Homo Sapiens
ETSWCATLQ

SEQ ID NO: 588597 - protein, 9 aa, Homo Sapiens
YERFVTGEN

SEQ ID NO: 588598 - protein, 9 aa, Homo Sapiens
QLTKVPEVS

SEQ ID NO: 588599 - protein, 9 aa, Homo Sapiens
NCSFFSEII

SEQ ID NO: 588600 - protein, 9 aa, Homo Sapiens
FRTVLYYYK

SEQ ID NO: 588601 - protein, 9 aa, Homo Sapiens
GQYSMAYFT

SEQ ID NO: 588602 - protein, 9 aa, Homo Sapiens
TYEILLWTT

SEQ ID NO: 588603 - protein, 9 aa, Homo Sapiens
RWMMISPYV

SEQ ID NO: 588604 - protein, 9 aa, Homo Sapiens
PSGTPDHST

SEQ ID NO: 588605 - protein, 9 aa, Homo Sapiens
VFSSHHTAG

SEQ ID NO: 588606 - protein, 9 aa, Homo Sapiens
QEGVGEPQS

SEQ ID NO: 588607 - protein, 9 aa, Homo Sapiens
DGVTRPDYE

SEQ ID NO: 588608 - protein, 9 aa, Homo Sapiens
KARYERFVT

SEQ ID NO: 588609 - protein, 9 aa, Homo Sapiens
APAREPVIS

SEQ ID NO: 588610 - protein, 9 aa, Homo Sapiens
SCNPMQFAT

SEQ ID NO: 588611 - protein, 9 aa, Homo Sapiens
RIIIRHMAA

SEQ ID NO: 588612 - protein, 9 aa, Homo Sapiens
GCVENMDAS

SEQ ID NO: 588613 - protein, 9 aa, Homo Sapiens
FPLHSAYHS

SEQ ID NO: 588614 - protein, 9 aa, Homo Sapiens
YGNLLEEDL

SEQ ID NO: 588615 - protein, 9 aa, Homo Sapiens
WILLLQRSH

SEQ ID NO: 588616 - protein, 9 aa, Homo Sapiens
NFETSWCAT

SEQ ID NO: 588617 - protein, 9 aa, Homo Sapiens
YVSTHTSTG

SEQ ID NO: 588618 - protein, 9 aa, Homo Sapiens
LCGLINFRF

SEQ ID NO: 588619 - protein, 9 aa, Homo Sapiens
GQPGSQVPD

SEQ ID NO: 588620 - protein, 9 aa, Homo Sapiens
PGLAGKTKL

SEQ ID NO: 588621 - protein, 9 aa, Homo Sapiens
LHSAYHSVG

SEQ ID NO: 588622 - protein, 9 aa, Homo Sapiens
WYPTRAWSA

SEQ ID NO: 588623 - protein, 9 aa, Homo Sapiens
SDFLYPQNP

SEQ ID NO: 588624 - protein, 9 aa, Homo Sapiens
DPAGSWTCG

SEQ ID NO: 588625 - protein, 9 aa, Homo Sapiens
SVGDVVLYF

SEQ ID NO: 588626 - protein, 9 aa, Homo Sapiens
FETSWCATL

SEQ ID NO: 588627 - protein, 9 aa, Homo Sapiens
RTVLYYYKT

SEQ ID NO: 588628 - protein, 9 aa, Homo Sapiens
AICELKNTI

SEQ ID NO: 588629 - protein, 9 aa, Homo Sapiens
EESGWCSGL

SEQ ID NO: 588630 - protein, 9 aa, Homo Sapiens
PEDPSNCSF

SEQ ID NO: 588631 - protein, 9 aa, Homo Sapiens
MNGDILLFG

SEQ ID NO: 588632 - protein, 9 aa, Homo Sapiens
SQRVCHIFP

SEQ ID NO: 588633 - protein, 9 aa, Homo Sapiens
GKCLWYPTR

SEQ ID NO: 588634 - protein, 9 aa, Homo Sapiens
YYYKTGIIN

SEQ ID NO: 588635 - protein, 9 aa, Homo Sapiens
IVLNTDITF

SEQ ID NO: 588636 - protein, 9 aa, Homo Sapiens
NKIFGFPRC

SEQ ID NO: 588637 - protein, 9 aa, Homo Sapiens
RFIGLKCLE

SEQ ID NO: 588638 - protein, 9 aa, Homo Sapiens
MQFATIKWL

SEQ ID NO: 588639 - protein, 9 aa, Homo Sapiens
QIQCLIFTF

SEQ ID NO: 588640 - protein, 9 aa, Homo Sapiens
ACFSTMPFF

SEQ ID NO: 588641 - protein, 9 aa, Homo Sapiens
IYIYTHIYI

SEQ ID NO: 588642 - protein, 9 aa, Homo Sapiens
REESGWCSG

SEQ ID NO: 588643 - protein, 9 aa, Homo Sapiens
DLMTVCARH

SEQ ID NO: 588644 - protein, 9 aa, Homo Sapiens
NTDITFATD

SEQ ID NO: 588645 - protein, 9 aa, Homo Sapiens
LDPAGSWTC

SEQ ID NO: 588646 - protein, 9 aa, Homo Sapiens
PGSAPSPLC

SEQ ID NO: 588647 - protein, 9 aa, Homo Sapiens
CSFAGILEN

SEQ ID NO: 588648 - protein, 9 aa, Homo Sapiens
GPEVPPNPP

SEQ ID NO: 588649 - protein, 9 aa, Homo Sapiens
GYGAAVLVL

SEQ ID NO: 588650 - protein, 9 aa, Homo Sapiens
ILLWTTSRV

SEQ ID NO: 588651 - protein, 9 aa, Homo Sapiens
HPKFPTGGK

SEQ ID NO: 588652 - protein, 9 aa, Homo Sapiens
VSTHTSTGE

SEQ ID NO: 588653 - protein, 9 aa, Homo Sapiens
IRDVPGNEH

SEQ ID NO: 588654 - protein, 9 aa, Homo Sapiens
MNFETSWCA

SEQ ID NO: 588655 - protein, 9 aa, Homo Sapiens
SSPMEHPIP

SEQ ID NO: 588656 - protein, 9 aa, Homo Sapiens
GDILILLGK

SEQ ID NO: 588657 - protein, 9 aa, Homo Sapiens
TIKWLGMKS

SEQ ID NO: 588658 - protein, 9 aa, Homo Sapiens
KDGVTRPDY

SEQ ID NO: 588659 - protein, 9 aa, Homo Sapiens
HSTSSPALL

SEQ ID NO: 588660 - protein, 9 aa, Homo Sapiens
CSFFSEIIS

SEQ ID NO: 588661 - protein, 9 aa, Homo Sapiens
CFSTMPFFS

SEQ ID NO: 588662 - protein, 9 aa, Homo Sapiens
NYFPKWFMI

SEQ ID NO: 588663 - protein, 9 aa, Homo Sapiens
APSPLCLLH

SEQ ID NO: 588664 - protein, 9 aa, Homo Sapiens
ISLFNKIFG

SEQ ID NO: 588665 - protein, 9 aa, Homo Sapiens
TGGKMSQYL

SEQ ID NO: 588666 - protein, 9 aa, Homo Sapiens
IYLLKVSKA

SEQ ID NO: 588667 - protein, 9 aa, Homo Sapiens
RAIYLLKVS

SEQ ID NO: 588668 - protein, 9 aa, Homo Sapiens
TLGIIIGAF

SEQ ID NO: 588669 - protein, 9 aa, Homo Sapiens
FQGMLMLCG

SEQ ID NO: 588670 - protein, 9 aa, Homo Sapiens
NGDILLFGT

SEQ ID NO: 588671 - protein, 9 aa, Homo Sapiens
DDLIVTPVA

SEQ ID NO: 588672 - protein, 9 aa, Homo Sapiens
TFCLNACNI

SEQ ID NO: 588673 - protein, 9 aa, Homo Sapiens
CELKNTIPF

SEQ ID NO: 588674 - protein, 9 aa, Homo Sapiens
CSGLRVGFT

SEQ ID NO: 588675 - protein, 9 aa, Homo Sapiens
WCSGLRVGF

SEQ ID NO: 588676 - protein, 9 aa, Homo Sapiens
SSHHTAGGM

SEQ ID NO: 588677 - protein, 9 aa, Homo Sapiens
AIFVEDIMV

SEQ ID NO: 588678 - protein, 9 aa, Homo Sapiens
YEILLWTTS

SEQ ID NO: 588679 - protein, 9 aa, Homo Sapiens
FPQSPGFKW

SEQ ID NO: 588680 - protein, 9 aa, Homo Sapiens
ISDTLSTMT

SEQ ID NO: 588681 - protein, 9 aa, Homo Sapiens
LSIAICELK

SEQ ID NO: 588682 - protein, 9 aa, Homo Sapiens
FSQRVCHIF

SEQ ID NO: 588683 - protein, 9 aa, Homo Sapiens
GLINFRFSQ

SEQ ID NO: 588684 - protein, 9 aa, Homo Sapiens
TYTYEILLW

SEQ ID NO: 588685 - protein, 9 aa, Homo Sapiens
ISPYVDPRL

SEQ ID NO: 588686 - protein, 9 aa, Homo Sapiens
MEEEKVQLT

SEQ ID NO: 588687 - protein, 9 aa, Homo Sapiens
GWCSGLRVG

SEQ ID NO: 588688 - protein, 9 aa, Homo Sapiens
ISCSRYYPA

SEQ ID NO: 588689 - protein, 9 aa, Homo Sapiens
PTGGKMSQY

SEQ ID NO: 588690 - protein, 9 aa, Homo Sapiens
TMPFFSPLT

SEQ ID NO: 588691 - protein, 9 aa, Homo Sapiens
SFSKSNAHK

SEQ ID NO: 588692 - protein, 9 aa, Homo Sapiens
EFEMENFTS

SEQ ID NO: 588693 - protein, 9 aa, Homo Sapiens
LYFSCNPMQ

SEQ ID NO: 588694 - protein, 9 aa, Homo Sapiens
DCIRDVPGN

SEQ ID NO: 588695 - protein, 9 aa, Homo Sapiens
VWVTGNSQV

SEQ ID NO: 588696 - protein, 9 aa, Homo Sapiens
SKFPIDHFL

SEQ ID NO: 588697 - protein, 9 aa, Homo Sapiens
AGSWTCGQP

SEQ ID NO: 588698 - protein, 9 aa, Homo Sapiens
LLGKFSLPC

SEQ ID NO: 588699 - protein, 9 aa, Homo Sapiens
TVLYYYKTG

SEQ ID NO: 588700 - protein, 9 aa, Homo Sapiens
FFNWNFLST

SEQ ID NO: 588701 - protein, 9 aa, Homo Sapiens
LEILQLEFE

SEQ ID NO: 588702 - protein, 9 aa, Homo Sapiens
LSDISDTLS

SEQ ID NO: 588703 - protein, 9 aa, Homo Sapiens
GSWTCGQPG

SEQ ID NO: 588704 - protein, 9 aa, Homo Sapiens
ILCLSIAIC

SEQ ID NO: 588705 - protein, 9 aa, Homo Sapiens
YPTRAWSAW

SEQ ID NO: 588706 - protein, 9 aa, Homo Sapiens
RNVTLQCDT

SEQ ID NO: 588707 - protein, 9 aa, Homo Sapiens
TGNSQVHMS

SEQ ID NO: 588708 - protein, 9 aa, Homo Sapiens
TFCFISFPE

SEQ ID NO: 588709 - protein, 9 aa, Homo Sapiens
LNTDITFAT

SEQ ID NO: 588710 - protein, 9 aa, Homo Sapiens
YEVQHQLLP

SEQ ID NO: 588711 - protein, 9 aa, Homo Sapiens
QPGSQVPDL

SEQ ID NO: 588712 - protein, 9 aa, Homo Sapiens
RVCSFAGIL

SEQ ID NO: 588713 - protein, 9 aa, Homo Sapiens
MKSQQLSYC

SEQ ID NO: 588714 - protein, 9 aa, Homo Sapiens
ERFVTGENP

SEQ ID NO: 588715 - protein, 9 aa, Homo Sapiens
EGVGEPQSP

SEQ ID NO: 588716 - protein, 9 aa, Homo Sapiens
GSAAEMYGS

SEQ ID NO: 588717 - protein, 9 aa, Homo Sapiens
DILILLGKF

SEQ ID NO: 588718 - protein, 9 aa, Homo Sapiens
STMTQSGPS

SEQ ID NO: 588719 - protein, 9 aa, Homo Sapiens
QCLIFTFMD

SEQ ID NO: 588720 - protein, 9 aa, Homo Sapiens
NFRFSQRVC

SEQ ID NO: 588721 - protein, 9 aa, Homo Sapiens
YIGYGAAVL

SEQ ID NO: 588722 - protein, 9 aa, Homo Sapiens
EDPSNCSFF

SEQ ID NO: 588723 - protein, 9 aa, Homo Sapiens
ATTLGIIIG

SEQ ID NO: 588724 - protein, 9 aa, Homo Sapiens
PAISLFNKI

SEQ ID NO: 588725 - protein, 9 aa, Homo Sapiens
KCTPRVCSF

SEQ ID NO: 588726 - protein, 9 aa, Homo Sapiens
SKAGQNKPA

SEQ ID NO: 588727 - protein, 9 aa, Homo Sapiens
HDYNTSFSK

SEQ ID NO: 588728 - protein, 9 aa, Homo Sapiens
EEPEDPSNC

SEQ ID NO: 588729 - protein, 9 aa, Homo Sapiens
LIVTPVAQV

SEQ ID NO: 588730 - protein, 9 aa, Homo Sapiens
CLWYPTRAW

SEQ ID NO: 588731 - protein, 9 aa, Homo Sapiens
FNWNFLSTL

SEQ ID NO: 588732 - protein, 9 aa, Homo Sapiens
FKWILLLQR

SEQ ID NO: 588733 - protein, 9 aa, Homo Sapiens
GVKGSAAEM

SEQ ID NO: 588734 - protein, 9 aa, Homo Sapiens
IKWLGMKSD

SEQ ID NO: 588735 - protein, 9 aa, Homo Sapiens
IIIRHMAAP

SEQ ID NO: 588736 - protein, 9 aa, Homo Sapiens
LCLSIAICE

SEQ ID NO: 588737 - protein, 9 aa, Homo Sapiens
FMKSQQLSY

SEQ ID NO: 588738 - protein, 9 aa, Homo Sapiens
REPVISSEE

SEQ ID NO: 588739 - protein, 9 aa, Homo Sapiens
RVIVLNTDI

SEQ ID NO: 588740 - protein, 9 aa, Homo Sapiens
DHSTSSPAL

SEQ ID NO: 588741 - protein, 9 aa, Homo Sapiens
PRVCSFAGI

SEQ ID NO: 588742 - protein, 9 aa, Homo Sapiens
PAGTHAKRR

SEQ ID NO: 588743 - protein, 9 aa, Homo Sapiens
IGAFTVCWL

SEQ ID NO: 588744 - protein, 9 aa, Homo Sapiens
KFPTGGKMS

SEQ ID NO: 588745 - protein, 9 aa, Homo Sapiens
PEDCIRDVP

SEQ ID NO: 588746 - protein, 9 aa, Homo Sapiens
SPLTFFQGM

SEQ ID NO: 588747 - protein, 9 aa, Homo Sapiens
GMLMLCGLI

SEQ ID NO: 588748 - protein, 9 aa, Homo Sapiens
VGKTSLMDQ

SEQ ID NO: 588749 - protein, 9 aa, Homo Sapiens
CLLHPGVAA

SEQ ID NO: 588750 - protein, 9 aa, Homo Sapiens
DYNTSFSKS

SEQ ID NO: 588751 - protein, 9 aa, Homo Sapiens
SNCSFFSEI

SEQ ID NO: 588752 - protein, 9 aa, Homo Sapiens
AATTLGIII

SEQ ID NO: 588753 - protein, 9 aa, Homo Sapiens
ETGEFYVST

SEQ ID NO: 588754 - protein, 9 aa, Homo Sapiens
IGCVENMDA

SEQ ID NO: 588755 - protein, 9 aa, Homo Sapiens
ALLIPGLAG

SEQ ID NO: 588756 - protein, 9 aa, Homo Sapiens
LLIPGLAGK

SEQ ID NO: 588757 - protein, 9 aa, Homo Sapiens
IRIASAGVA

SEQ ID NO: 588758 - protein, 9 aa, Homo Sapiens
NQLSKYAIF

SEQ ID NO: 588759 - protein, 9 aa, Homo Sapiens
IKSWIFFFS

SEQ ID NO: 588760 - protein, 9 aa, Homo Sapiens
EFYVSTHTS

SEQ ID NO: 588761 - protein, 9 aa, Homo Sapiens
FSKSNAHKA

SEQ ID NO: 588762 - protein, 9 aa, Homo Sapiens
AYHSVGDVV

SEQ ID NO: 588763 - protein, 9 aa, Homo Sapiens
SKSNAHKAE

SEQ ID NO: 588764 - protein, 9 aa, Homo Sapiens
LGIIIGAFT

SEQ ID NO: 588765 - protein, 9 aa, Homo Sapiens
CGQPGSQVP

SEQ ID NO: 588766 - protein, 9 aa, Homo Sapiens
SCSRYYPAG

SEQ ID NO: 588767 - protein, 9 aa, Homo Sapiens
KFPIDHFLP

SEQ ID NO: 588768 - protein, 9 aa, Homo Sapiens
HIFPQSPGF

SEQ ID NO: 588769 - protein, 9 aa, Homo Sapiens
IIGAFTVCW

SEQ ID NO: 588770 - protein, 9 aa, Homo Sapiens
CLIFTFMDW

SEQ ID NO: 588771 - protein, 9 aa, Homo Sapiens
PQSPGFKWI

SEQ ID NO: 588772 - protein, 9 aa, Homo Sapiens
YFSCNPMQF

SEQ ID NO: 588773 - protein, 9 aa, Homo Sapiens
SHSFLRHCQ

SEQ ID NO: 588774 - protein, 9 aa, Homo Sapiens
GAPAREPVI

SEQ ID NO: 588775 - protein, 9 aa, Homo Sapiens
HNLDLMIRI

SEQ ID NO: 588776 - protein, 9 aa, Homo Sapiens
NSQVHMSRH

SEQ ID NO: 588777 - protein, 9 aa, Homo Sapiens
TYGNLLEED

SEQ ID NO: 588778 - protein, 9 aa, Homo Sapiens
SLDIGKCLW

SEQ ID NO: 588779 - protein, 9 aa, Homo Sapiens
ELTYGNLLE

SEQ ID NO: 588780 - protein, 9 aa, Homo Sapiens
LYYYKTGII

SEQ ID NO: 588781 - protein, 9 aa, Homo Sapiens
NFLSTLNAG

SEQ ID NO: 588782 - protein, 9 aa, Homo Sapiens
LITYTFCFI

SEQ ID NO: 588783 - protein, 9 aa, Homo Sapiens
KGSAAEMYG

SEQ ID NO: 588784 - protein, 9 aa, Homo Sapiens
YLLKVSKAG

SEQ ID NO: 588785 - protein, 9 aa, Homo Sapiens
VNALLIPGL

SEQ ID NO: 588786 - protein, 9 aa, Homo Sapiens
TSLMDQYVN

SEQ ID NO: 588787 - protein, 9 aa, Homo Sapiens
VTPVAQVLA

SEQ ID NO: 588788 - protein, 9 aa, Homo Sapiens
HILCLSIAI

SEQ ID NO: 588789 - protein, 9 aa, Homo Sapiens
LMIRIASAG

SEQ ID NO: 588790 - protein, 9 aa, Homo Sapiens
STMPFFSPL

SEQ ID NO: 588791 - protein, 9 aa, Homo Sapiens
FGFPRCACF

SEQ ID NO: 588792 - protein, 9 aa, Homo Sapiens
ICELKNTIP

SEQ ID NO: 588793 - protein, 9 aa, Homo Sapiens
HQEGVGEPQ

SEQ ID NO: 588794 - protein, 9 aa, Homo Sapiens
FVTGENPFE

SEQ ID NO: 588795 - protein, 9 aa, Homo Sapiens
FISFPEPEL

SEQ ID NO: 588796 - protein, 9 aa, Homo Sapiens
FLRHCQFSQ

SEQ ID NO: 588797 - protein, 9 aa, Homo Sapiens
HPIPQSAPL

SEQ ID NO: 588798 - protein, 9 aa, Homo Sapiens
IMRTYTYEI

SEQ ID NO: 588799 - protein, 9 aa, Homo Sapiens
LCLLHPGVA

SEQ ID NO: 588800 - protein, 9 aa, Homo Sapiens
SLMDQYVNK

SEQ ID NO: 588801 - protein, 9 aa, Homo Sapiens
FSTMPFFSP

SEQ ID NO: 588802 - protein, 9 aa, Homo Sapiens
DFLYPQNPK

SEQ ID NO: 588803 - protein, 9 aa, Homo Sapiens
MISPYVDPR

SEQ ID NO: 588804 - protein, 9 aa, Homo Sapiens
QRSHSFLRH

SEQ ID NO: 588805 - protein, 9 aa, Homo Sapiens
KDTHPKFPT

SEQ ID NO: 588806 - protein, 9 aa, Homo Sapiens
RCACFSTMP

SEQ ID NO: 588807 - protein, 9 aa, Homo Sapiens
KSLDIGKCL

SEQ ID NO: 588808 - protein, 9 aa, Homo Sapiens
GKTSLMDQY

SEQ ID NO: 588809 - protein, 9 aa, Homo Sapiens
MRTYTYEIL

SEQ ID NO: 588810 - protein, 9 aa, Homo Sapiens
DLMIRIASA

SEQ ID NO: 588811 - protein, 9 aa, Homo Sapiens
TKPEDCIRD

SEQ ID NO: 588812 - protein, 9 aa, Homo Sapiens
PLTFFQGML

SEQ ID NO: 588813 - protein, 9 aa, Homo Sapiens
TTLGIIIGA

SEQ ID NO: 588814 - protein, 9 aa, Homo Sapiens
INPAISLFN

SEQ ID NO: 588815 - protein, 9 aa, Homo Sapiens
VKGSAAEMY

SEQ ID NO: 588816 - protein, 9 aa, Homo Sapiens
PTRAWSAWP

SEQ ID NO: 588817 - protein, 9 aa, Homo Sapiens
PTVFSSHHT

SEQ ID NO: 588818 - protein, 9 aa, Homo Sapiens
LDIGKCLWY

SEQ ID NO: 588819 - protein, 9 aa, Homo Sapiens
PKWFMINPA

SEQ ID NO: 588820 - protein, 9 aa, Homo Sapiens
ILLLQRSHS

SEQ ID NO: 588821 - protein, 9 aa, Homo Sapiens
LAGKTKLEK

SEQ ID NO: 588822 - protein, 9 aa, Homo Sapiens
PVFMKSQQL

SEQ ID NO: 588823 - protein, 9 aa, Homo Sapiens
GIIIGAFTV

SEQ ID NO: 588824 - protein, 9 aa, Homo Sapiens
HIYIHTHTF

SEQ ID NO: 588825 - protein, 9 aa, Homo Sapiens
FSQVHILCL

SEQ ID NO: 588826 - protein, 9 aa, Homo Sapiens
INFRFSQRV

SEQ ID NO: 588827 - protein, 9 aa, Homo Sapiens
GSIGCVENM

SEQ ID NO: 588828 - protein, 9 aa, Homo Sapiens
LLRLPALRF

SEQ ID NO: 588829 - protein, 9 aa, Homo Sapiens
DTHPKFPTG

SEQ ID NO: 588830 - protein, 9 aa, Homo Sapiens
RFSQRVCHI

SEQ ID NO: 588831 - protein, 9 aa, Homo Sapiens
NAGVKGSAA

SEQ ID NO: 588832 - protein, 9 aa, Homo Sapiens
RDVPGNEHA

SEQ ID NO: 588833 - protein, 9 aa, Homo Sapiens
LEFEMENFT

SEQ ID NO: 588834 - protein, 9 aa, Homo Sapiens
GNAGVKGSA

SEQ ID NO: 588835 - protein, 9 aa, Homo Sapiens
YSMAYFTGP

SEQ ID NO: 588836 - protein, 9 aa, Homo Sapiens
ALRFIGLKC

SEQ ID NO: 588837 - protein, 9 aa, Homo Sapiens
ILQLEFEME

SEQ ID NO: 588838 - protein, 9 aa, Homo Sapiens
VPPNPPGSH

SEQ ID NO: 588839 - protein, 9 aa, Homo Sapiens
IYTHIYIHT

SEQ ID NO: 588840 - protein, 9 aa, Homo Sapiens
DEEEEEDQG

SEQ ID NO: 588841 - protein, 9 aa, Homo Sapiens
RTSSPMEHP

SEQ ID NO: 588842 - protein, 9 aa, Homo Sapiens
AREPVISSE

SEQ ID NO: 588843 - protein, 9 aa, Homo Sapiens
CVENMDASS

SEQ ID NO: 588844 - protein, 9 aa, Homo Sapiens
TVCARHWLR

SEQ ID NO: 588845 - protein, 9 aa, Homo Sapiens
FPRCACFST

SEQ ID NO: 588846 - protein, 9 aa, Homo Sapiens
QGAPAREPV

SEQ ID NO: 588847 - protein, 9 aa, Homo Sapiens
CQFSQVHIL

SEQ ID NO: 588848 - protein, 9 aa, Homo Sapiens
TPVAQVLAS

SEQ ID NO: 588849 - protein, 9 aa, Homo Sapiens
EEEKVQLTK

SEQ ID NO: 588850 - protein, 9 aa, Homo Sapiens
LMDQYVNKK

SEQ ID NO: 588851 - protein, 9 aa, Homo Sapiens
TSSPALLLS

SEQ ID NO: 588852 - protein, 9 aa, Homo Sapiens
LQLEFEMEN

SEQ ID NO: 588853 - protein, 9 aa, Homo Sapiens
ATIKWLGMK

SEQ ID NO: 588854 - protein, 9 aa, Homo Sapiens
DPRWMMISP

SEQ ID NO: 588855 - protein, 9 aa, Homo Sapiens
CCWNYFPKW

SEQ ID NO: 588856 - protein, 9 aa, Homo Sapiens
SIGCVENMD

SEQ ID NO: 588857 - protein, 9 aa, Homo Sapiens
YTHIYIHTH

SEQ ID NO: 588858 - protein, 9 aa, Homo Sapiens
QLSKYAIFV

SEQ ID NO: 588859 - protein, 9 aa, Homo Sapiens
MPFFSPLTF

SEQ ID NO: 588860 - protein, 9 aa, Homo Sapiens
FPIDHFLPQ

SEQ ID NO: 588861 - protein, 9 aa, Homo Sapiens
RPDYEVQHQ

SEQ ID NO: 588862 - protein, 9 aa, Homo Sapiens
LDHYIGYGA

SEQ ID NO: 588863 - protein, 9 aa, Homo Sapiens
FTPPHDLMT

SEQ ID NO: 588864 - protein, 9 aa, Homo Sapiens
NLERVIVLN

SEQ ID NO: 588865 - protein, 9 aa, Homo Sapiens
RYERFVTGE

SEQ ID NO: 588866 - protein, 9 aa, Homo Sapiens
KPEDCIRDV

SEQ ID NO: 588867 - protein, 9 aa, Homo Sapiens
ELKNTIPFP

SEQ ID NO: 588868 - protein, 9 aa, Homo Sapiens
FCLNACNIT

SEQ ID NO: 588869 - protein, 9 aa, Homo Sapiens
DHYIGYGAA

SEQ ID NO: 588870 - protein, 9 aa, Homo Sapiens
KTSLMDQYV

SEQ ID NO: 588871 - protein, 9 aa, Homo Sapiens
QETGEFYVS

SEQ ID NO: 588872 - protein, 9 aa, Homo Sapiens
CGLINFRFS

SEQ ID NO: 588873 - protein, 9 aa, Homo Sapiens
RLPALRFIG

SEQ ID NO: 588874 - protein, 9 aa, Homo Sapiens
SPVVASGRN

SEQ ID NO: 588875 - protein, 9 aa, Homo Sapiens
SLFNKIFGF

SEQ ID NO: 588876 - protein, 9 aa, Homo Sapiens
DISDTLSTM

SEQ ID NO: 588877 - protein, 9 aa, Homo Sapiens
VTGENPFEI

SEQ ID NO: 588878 - protein, 9 aa, Homo Sapiens
GRNVTLQCD

SEQ ID NO: 588879 - protein, 9 aa, Homo Sapiens
IIRHMAAPL

SEQ ID NO: 588880 - protein, 9 aa, Homo Sapiens
TFFQGMLML

SEQ ID NO: 588881 - protein, 9 aa, Homo Sapiens
SGTPDHSTS

SEQ ID NO: 588882 - protein, 9 aa, Homo Sapiens
THPKFPTGG

SEQ ID NO: 588883 - protein, 9 aa, Homo Sapiens
RHCQFSQVH

SEQ ID NO: 588884 - protein, 9 aa, Homo Sapiens
YYPAGTHAK

SEQ ID NO: 588885 - protein, 9 aa, Homo Sapiens
NALLIPGLA

SEQ ID NO: 588886 - protein, 9 aa, Homo Sapiens
FSSHHTAGG

SEQ ID NO: 588887 - protein, 9 aa, Homo Sapiens
SDISDTLST

SEQ ID NO: 588888 - protein, 9 aa, Homo Sapiens
LINFRFSQR

SEQ ID NO: 588889 - protein, 9 aa, Homo Sapiens
AGTHAKRRF

SEQ ID NO: 588890 - protein, 9 aa, Homo Sapiens
VVASGRNVT

SEQ ID NO: 588891 - protein, 9 aa, Homo Sapiens
HSVGDVVLY

SEQ ID NO: 588892 - protein, 9 aa, Homo Sapiens
FIGLKCLEH

SEQ ID NO: 588893 - protein, 9 aa, Homo Sapiens
VFRTVLYYY

SEQ ID NO: 588894 - protein, 9 aa, Homo Sapiens
IPGLAGKTK

SEQ ID NO: 588895 - protein, 9 aa, Homo Sapiens
QFATIKWLG

SEQ ID NO: 588896 - protein, 9 aa, Homo Sapiens
LHQEGVGEP

SEQ ID NO: 588897 - protein, 9 aa, Homo Sapiens
QVHILCLSI

SEQ ID NO: 588898 - protein, 9 aa, Homo Sapiens
EHPIPQSAP

SEQ ID NO: 588899 - protein, 9 aa, Homo Sapiens
LFNKIFGFP

SEQ ID NO: 588900 - protein, 9 aa, Homo Sapiens
VENMDASSY

SEQ ID NO: 588901 - protein, 9 aa, Homo Sapiens
DPSNCSFFS

SEQ ID NO: 588902 - protein, 9 aa, Homo Sapiens
AGVKGSAAE

SEQ ID NO: 588903 - protein, 9 aa, Homo Sapiens
SFLRHCQFS

SEQ ID NO: 588904 - protein, 9 aa, Homo Sapiens
SRTSSPMEH

SEQ ID NO: 588905 - protein, 9 aa, Homo Sapiens
FDPRWMMIS

SEQ ID NO: 588906 - protein, 9 aa, Homo Sapiens
PEVPPNPPG

SEQ ID NO: 588907 - protein, 9 aa, Homo Sapiens
VCSFAGILE

SEQ ID NO: 588908 - protein, 9 aa, Homo Sapiens
DIGKCLWYP

SEQ ID NO: 588909 - protein, 9 aa, Homo Sapiens
YIYTHIYIH

SEQ ID NO: 588910 - protein, 9 aa, Homo Sapiens
RYYPAGTHA

SEQ ID NO: 588911 - protein, 9 aa, Homo Sapiens
HHTAGGMTP

SEQ ID NO: 588912 - protein, 9 aa, Homo Sapiens
CWNYFPKWF

SEQ ID NO: 588913 - protein, 9 aa, Homo Sapiens
PSPLCLLHP

SEQ ID NO: 588914 - protein, 9 aa, Homo Sapiens
GVGKTSLMD

SEQ ID NO: 588915 - protein, 9 aa, Homo Sapiens
FPTGGKMSQ

SEQ ID NO: 588916 - protein, 9 aa, Homo Sapiens
AISLFNKIF

SEQ ID NO: 588917 - protein, 9 aa, Homo Sapiens
EILLWTTSR

SEQ ID NO: 588918 - protein, 9 aa, Homo Sapiens
IQETGEFYV

SEQ ID NO: 588919 - protein, 9 aa, Homo Sapiens
FNKIFGFPR

SEQ ID NO: 588920 - protein, 9 aa, Homo Sapiens
NPAISLFNK

SEQ ID NO: 588921 - protein, 9 aa, Homo Sapiens
YHSVGDVVL

SEQ ID NO: 588922 - protein, 9 aa, Homo Sapiens
VISSEEQKQ

SEQ ID NO: 588923 - protein, 9 aa, Homo Sapiens
SRYYPAGTH

SEQ ID NO: 588924 - protein, 9 aa, Homo Sapiens
PVVASGRNV

SEQ ID NO: 588925 - protein, 9 aa, Homo Sapiens
LRLPALRFI

SEQ ID NO: 588926 - protein, 9 aa, Homo Sapiens
RLDPAGSWT

SEQ ID NO: 588927 - protein, 9 aa, Homo Sapiens
VCHIFPQSP

SEQ ID NO: 588928 - protein, 9 aa, Homo Sapiens
RTYTYEILL

SEQ ID NO: 588929 - protein, 9 aa, Homo Sapiens
PDHSTSSPA

SEQ ID NO: 588930 - protein, 9 aa, Homo Sapiens
VTRPDYEVQ

SEQ ID NO: 588931 - protein, 9 aa, Homo Sapiens
KVSKAGQNK

SEQ ID NO: 588932 - protein, 9 aa, Homo Sapiens
TSFSKSNAH

SEQ ID NO: 588933 - protein, 9 aa, Homo Sapiens
LNACNITFD

SEQ ID NO: 588934 - protein, 9 aa, Homo Sapiens
NLDLMIRIA

SEQ ID NO: 588935 - protein, 9 aa, Homo Sapiens
FYVSTHTST

SEQ ID NO: 588936 - protein, 9 aa, Homo Sapiens
CNITFDACL

SEQ ID NO: 588937 - protein, 9 aa, Homo Sapiens
LTYGNLLEE

SEQ ID NO: 588938 - protein, 9 aa, Homo Sapiens
GVGEPQSPR

SEQ ID NO: 588939 - protein, 9 aa, Homo Sapiens
LTKVPEVSK

SEQ ID NO: 588940 - protein, 9 aa, Homo Sapiens
RTFCLNACN

SEQ ID NO: 588941 - protein, 9 aa, Homo Sapiens
CFISFPEPE

SEQ ID NO: 588942 - protein, 9 aa, Homo Sapiens
PGDILILLG

SEQ ID NO: 588943 - protein, 9 aa, Homo Sapiens
LTFFQGMLM

SEQ ID NO: 588944 - protein, 9 aa, Homo Sapiens
STSSPALLL

SEQ ID NO: 588945 - protein, 9 aa, Homo Sapiens
IVTPVAQVL

SEQ ID NO: 588946 - protein, 9 aa, Homo Sapiens
PQNPKRREE

SEQ ID NO: 588947 - protein, 9 aa, Homo Sapiens
NTIPFPLHS

SEQ ID NO: 588948 - protein, 9 aa, Homo Sapiens
VGEPQSPRN

SEQ ID NO: 588949 - protein, 9 aa, Homo Sapiens
GPLEILQLE

SEQ ID NO: 588950 - protein, 9 aa, Homo Sapiens
PSNCSFFSE

SEQ ID NO: 588951 - protein, 9 aa, Homo Sapiens
TPPHDLMTV

SEQ ID NO: 588952 - protein, 9 aa, Homo Sapiens
ITYTFCFIS

SEQ ID NO: 588953 - protein, 9 aa, Homo Sapiens
RIASAGVAV

SEQ ID NO: 588954 - protein, 9 aa, Homo Sapiens
SLGQYSMAY

SEQ ID NO: 588955 - protein, 9 aa, Homo Sapiens
LLQRSHSFL

SEQ ID NO: 588956 - protein, 9 aa, Homo Sapiens
LGKFSLPCD

SEQ ID NO: 588957 - protein, 9 aa, Homo Sapiens
TSSPMEHPI

SEQ ID NO: 588958 - protein, 9 aa, Homo Sapiens
LIFTFMDWI

SEQ ID NO: 588959 - protein, 9 aa, Homo Sapiens
WNYFPKWFM

SEQ ID NO: 588960 - protein, 9 aa, Homo Sapiens
TIKSWIFFF

SEQ ID NO: 588961 - protein, 9 aa, Homo Sapiens
PKFPTGGKM

SEQ ID NO: 588962 - protein, 9 aa, Homo Sapiens
NPPGSHSAF

SEQ ID NO: 588963 - protein, 9 aa, Homo Sapiens
ILILLGKFS

SEQ ID NO: 588964 - protein, 9 aa, Homo Sapiens
KLDHYIGYG

SEQ ID NO: 588965 - protein, 9 aa, Homo Sapiens
LLLQRSHSF

SEQ ID NO: 588966 - protein, 9 aa, Homo Sapiens
CGPEVPPNP

SEQ ID NO: 588967 - protein, 9 aa, Homo Sapiens
MLMLCGLIN

SEQ ID NO: 588968 - protein, 9 aa, Homo Sapiens
SWIFFFSVQ

SEQ ID NO: 588969 - protein, 9 aa, Homo Sapiens
MREAYNDSS

SEQ ID NO: 588970 - protein, 9 aa, Homo Sapiens
PPNPPGSHS

SEQ ID NO: 588971 - protein, 9 aa, Homo Sapiens
WNQLSKYAI

SEQ ID NO: 588972 - protein, 9 aa, Homo Sapiens
FCFISFPEP

SEQ ID NO: 588973 - protein, 9 aa, Homo Sapiens
IPFPLHSAY

SEQ ID NO: 588974 - protein, 9 aa, Homo Sapiens
DVVLYFSCN

SEQ ID NO: 588975 - protein, 9 aa, Homo Sapiens
QRVCHIFPQ

SEQ ID NO: 588976 - protein, 9 aa, Homo Sapiens
FLPQQLPSP

SEQ ID NO: 588977 - protein, 9 aa, Homo Sapiens
MTVCARHWL

SEQ ID NO: 588978 - protein, 9 aa, Homo Sapiens
VAQVLASLR

SEQ ID NO: 588979 - protein, 9 aa, Homo Sapiens
YFTGPCPLE

SEQ ID NO: 588980 - protein, 9 aa, Homo Sapiens
TRGSGGGQM

SEQ ID NO: 588981 - protein, 9 aa, Homo Sapiens
MDQYVNKKF

SEQ ID NO: 588982 - protein, 9 aa, Homo Sapiens
CACFSTMPF

SEQ ID NO: 588983 - protein, 9 aa, Homo Sapiens
VQLTKVPEV

SEQ ID NO: 588984 - protein, 9 aa, Homo Sapiens
WNFLSTLNA

SEQ ID NO: 588985 - protein, 9 aa, Homo Sapiens
KIFGFPRCA

SEQ ID NO: 588986 - protein, 9 aa, Homo Sapiens
SPGFKWILL

SEQ ID NO: 588987 - protein, 9 aa, Homo Sapiens
LREESGWCS

SEQ ID NO: 588988 - protein, 9 aa, Homo Sapiens
GGQMREAYN

SEQ ID NO: 588989 - protein, 9 aa, Homo Sapiens
RGNAGVKGS

SEQ ID NO: 588990 - protein, 9 aa, Homo Sapiens
TSWCATLQY

SEQ ID NO: 588991 - protein, 9 aa, Homo Sapiens
MINPAISLF

SEQ ID NO: 588992 - protein, 9 aa, Homo Sapiens
LELTYGNLL

SEQ ID NO: 588993 - protein, 9 aa, Homo Sapiens
RALRPVFMK

SEQ ID NO: 588994 - protein, 9 aa, Homo Sapiens
GQMREAYND

SEQ ID NO: 588995 - protein, 9 aa, Homo Sapiens
PAFFNWNFL

SEQ ID NO: 588996 - protein, 9 aa, Homo Sapiens
QFSQVHILC

SEQ ID NO: 588997 - protein, 9 aa, Homo Sapiens
KVQLTKVPE

SEQ ID NO: 588998 - protein, 9 aa, Homo Sapiens
DLIVTPVAQ

SEQ ID NO: 588999 - protein, 9 aa, Homo Sapiens
LRHCQFSQV

SEQ ID NO: 589000 - protein, 9 aa, Homo Sapiens
TIPFPLHSA

SEQ ID NO: 589001 - protein, 9 aa, Homo Sapiens
LKVSKAGQN

SEQ ID NO: 589002 - protein, 9 aa, Homo Sapiens
GDVVLYFSC

SEQ ID NO: 589003 - protein, 9 aa, Homo Sapiens
SIAICELKN

SEQ ID NO: 589004 - protein, 9 aa, Homo Sapiens
NPAFFNWNF

SEQ ID NO: 589005 - protein, 9 aa, Homo Sapiens
GFKWILLLQ

SEQ ID NO: 589006 - protein, 9 aa, Homo Sapiens
WMMISPYVD

SEQ ID NO: 589007 - protein, 9 aa, Homo Sapiens
FSCNPMQFA

SEQ ID NO: 589008 - protein, 9 aa, Homo Sapiens
KWILLLQRS

SEQ ID NO: 589009 - protein, 9 aa, Homo Sapiens
ACNITFDAC

SEQ ID NO: 589010 - protein, 9 aa, Homo Sapiens
SGRNVTLQC

SEQ ID NO: 589011 - protein, 9 aa, Homo Sapiens
PSPVVASGR

SEQ ID NO: 589012 - protein, 9 aa, Homo Sapiens
GDDLIVTPV

SEQ ID NO: 589013 - protein, 9 aa, Homo Sapiens
LYPQNPKRR

SEQ ID NO: 589014 - protein, 9 aa, Homo Sapiens
FATIKWLGM

SEQ ID NO: 589015 - protein, 9 aa, Homo Sapiens
TRPDYEVQH

SEQ ID NO: 589016 - protein, 9 aa, Homo Sapiens
GSGGGQMRE

SEQ ID NO: 589017 - protein, 9 aa, Homo Sapiens
SPYVDPRLL

SEQ ID NO: 589018 - protein, 9 aa, Homo Sapiens
TGPVWVTGN

SEQ ID NO: 589019 - protein, 9 aa, Homo Sapiens
RVCHIFPQS

SEQ ID NO: 589020 - protein, 9 aa, Homo Sapiens
LILLGKFSL

SEQ ID NO: 589021 - protein, 9 aa, Homo Sapiens
SHHTAGGMT

SEQ ID NO: 589022 - protein, 9 aa, Homo Sapiens
TGEFYVSTH

SEQ ID NO: 589023 - protein, 9 aa, Homo Sapiens
ARYERFVTG

SEQ ID NO: 589024 - protein, 9 aa, Homo Sapiens
PRWMMISPY

SEQ ID NO: 589025 - protein, 9 aa, Homo Sapiens
GPVWVTGNS

SEQ ID NO: 589026 - protein, 9 aa, Homo Sapiens
IFGFPRCAC

SEQ ID NO: 589027 - protein, 9 aa, Homo Sapiens
GFPRCACFS

SEQ ID NO: 589028 - protein, 9 aa, Homo Sapiens
PVISSEEQK

SEQ ID NO: 589029 - protein, 9 aa, Homo Sapiens
PLEILQLEF

SEQ ID NO: 589030 - protein, 9 aa, Homo Sapiens
KCLWYPTRA

SEQ ID NO: 589031 - protein, 9 aa, Homo Sapiens
NWNFLSTLN

SEQ ID NO: 589032 - protein, 9 aa, Homo Sapiens
YFPKWFMIN

SEQ ID NO: 589033 - protein, 9 aa, Homo Sapiens
PGSQVPDLQ

SEQ ID NO: 589034 - protein, 9 aa, Homo Sapiens
LRPVFMKSQ

SEQ ID NO: 589035 - protein, 9 aa, Homo Sapiens
QLEFEMENF

SEQ ID NO: 589036 - protein, 9 aa, Homo Sapiens
HDLMTVCAR

SEQ ID NO: 589037 - protein, 9 aa, Homo Sapiens
GGGQMREAY

SEQ ID NO: 589038 - protein, 9 aa, Homo Sapiens
NRGNAGVKG

SEQ ID NO: 589039 - protein, 9 aa, Homo Sapiens
CSRYYPAGT

SEQ ID NO: 589040 - protein, 9 aa, Homo Sapiens
DHFLPQQLP

SEQ ID NO: 589041 - protein, 9 aa, Homo Sapiens
LERVIVLNT

SEQ ID NO: 589042 - protein, 9 aa, Homo Sapiens
WFMINPAIS

SEQ ID NO: 589043 - protein, 9 aa, Homo Sapiens
RGSGGGQMR

SEQ ID NO: 589044 - protein, 9 aa, Homo Sapiens
LLKVSKAGQ

SEQ ID NO: 589045 - protein, 9 aa, Homo Sapiens
MDASSYPPP

SEQ ID NO: 589046 - protein, 9 aa, Homo Sapiens
WCATLQYCP

SEQ ID NO: 589047 - protein, 9 aa, Homo Sapiens
LMLCGLINF

SEQ ID NO: 589048 - protein, 9 aa, Homo Sapiens
EDCIRDVPG

SEQ ID NO: 589049 - protein, 9 aa, Homo Sapiens
LQRSHSFLR

SEQ ID NO: 589050 - protein, 9 aa, Homo Sapiens
NSLHQEGVG

SEQ ID NO: 589051 - protein, 9 aa, Homo Sapiens
NACNITFDA

SEQ ID NO: 589052 - protein, 9 aa, Homo Sapiens
EEEEEDQGP

SEQ ID NO: 589053 - protein, 9 aa, Homo Sapiens
ARIIIRHMA

SEQ ID NO: 589054 - protein, 9 aa, Homo Sapiens
SGWCSGLRV

SEQ ID NO: 589055 - protein, 9 aa, Homo Sapiens
TCGQPGSQV

SEQ ID NO: 589056 - protein, 9 aa, Homo Sapiens
ESGWCSGLR

SEQ ID NO: 589057 - protein, 9 aa, Homo Sapiens
DSKFPIDHF

SEQ ID NO: 589058 - protein, 9 aa, Homo Sapiens
YPAGTHAKR

SEQ ID NO: 589059 - protein, 9 aa, Homo Sapiens
CTPRVCSFA

SEQ ID NO: 589060 - protein, 9 aa, Homo Sapiens
GCGPEVPPN

SEQ ID NO: 589061 - protein, 9 aa, Homo Sapiens
VLYYYKTGI

SEQ ID NO: 589062 - protein, 9 aa, Homo Sapiens
PAREPVISS

SEQ ID NO: 589063 - protein, 9 aa, Homo Sapiens
ARKLDHYIG

SEQ ID NO: 589064 - protein, 9 aa, Homo Sapiens
HYIGYGAAV

SEQ ID NO: 589065 - protein, 9 aa, Homo Sapiens
RFVTGENPF

SEQ ID NO: 589066 - protein, 9 aa, Homo Sapiens
TVFSSHHTA

SEQ ID NO: 589067 - protein, 9 aa, Homo Sapiens
PPHDLMTVC

SEQ ID NO: 589068 - protein, 9 aa, Homo Sapiens
ATVFRTVLY

SEQ ID NO: 589069 - protein, 9 aa, Homo Sapiens
LPALRFIGL

SEQ ID NO: 589070 - protein, 9 aa, Homo Sapiens
IYIHTHTFY

SEQ ID NO: 589071 - protein, 9 aa, Homo Sapiens
PRCACFSTM

SEQ ID NO: 589072 - protein, 9 aa, Homo Sapiens
PLHSAYHSV

SEQ ID NO: 589073 - protein, 9 aa, Homo Sapiens
HCQFSQVHI

SEQ ID NO: 589074 - protein, 9 aa, Homo Sapiens
EVPPNPPGS

SEQ ID NO: 589075 - protein, 9 aa, Homo Sapiens
VLNTDITFA

SEQ ID NO: 589076 - protein, 9 aa, Homo Sapiens
GSAPSPLCL

SEQ ID NO: 589077 - protein, 9 aa, Homo Sapiens
SFAGILENG

SEQ ID NO: 589078 - protein, 9 aa, Homo Sapiens
MAYFTGPCP

SEQ ID NO: 589079 - protein, 9 aa, Homo Sapiens
SQVHILCLS

SEQ ID NO: 589080 - protein, 9 aa, Homo Sapiens
ASGRNVTLQ

SEQ ID NO: 589081 - protein, 9 aa, Homo Sapiens
AYFTGPCPL

SEQ ID NO: 589082 - protein, 9 aa, Homo Sapiens
PALRFIGLK

SEQ ID NO: 589083 - protein, 9 aa, Homo Sapiens
EILQLEFEM

SEQ ID NO: 589084 - protein, 9 aa, Homo Sapiens
PVWVTGNSQ

SEQ ID NO: 589085 - protein, 9 aa, Homo Sapiens
SKYAIFVED

SEQ ID NO: 589086 - protein, 9 aa, Homo Sapiens
WTCGQPGSQ

SEQ ID NO: 589087 - protein, 9 aa, Homo Sapiens
FRFSQRVCH

SEQ ID NO: 589088 - protein, 9 aa, Homo Sapiens
YNTSFSKSN

SEQ ID NO: 589089 - protein, 9 aa, Homo Sapiens
TVFRTVLYY

SEQ ID NO: 589090 - protein, 9 aa, Homo Sapiens
QYSMAYFTG

SEQ ID NO: 589091 - protein, 9 aa, Homo Sapiens
CLNACNITF

SEQ ID NO: 589092 - protein, 9 aa, Homo Sapiens
VIVLNTDIT

SEQ ID NO: 589093 - protein, 9 aa, Homo Sapiens
SWCATLQYC

SEQ ID NO: 589094 - protein, 9 aa, Homo Sapiens
SDTLSTMTQ

SEQ ID NO: 589095 - protein, 9 aa, Homo Sapiens
DTLSTMTQS

SEQ ID NO: 589096 - protein, 9 aa, Homo Sapiens
MIRIASAGV

SEQ ID NO: 589097 - protein, 9 aa, Homo Sapiens
VVLYFSCNP

SEQ ID NO: 589098 - protein, 9 aa, Homo Sapiens
VHILCLSIA

SEQ ID NO: 589099 - protein, 9 aa, Homo Sapiens
IAICELKNT

SEQ ID NO: 589100 - protein, 9 aa, Homo Sapiens
NLELTYGNL

SEQ ID NO: 589101 - protein, 9 aa, Homo Sapiens
WGGRLDPAG

SEQ ID NO: 589102 - protein, 9 aa, Homo Sapiens
IHTHTFYVS

SEQ ID NO: 589103 - protein, 9 aa, Homo Sapiens
KSNAHKAEK

SEQ ID NO: 589104 - protein, 9 aa, Homo Sapiens
ERVIVLNTD

SEQ ID NO: 589105 - protein, 9 aa, Homo Sapiens
IDHFLPQQL

SEQ ID NO: 589106 - protein, 9 aa, Homo Sapiens
MMISPYVDP

SEQ ID NO: 589107 - protein, 9 aa, Homo Sapiens
IGYGAAVLV

SEQ ID NO: 589108 - protein, 9 aa, Homo Sapiens
LGQYSMAYF

SEQ ID NO: 589109 - protein, 9 aa, Homo Sapiens
TPTVFSSHH

SEQ ID NO: 589110 - protein, 9 aa, Homo Sapiens
SGGGQMREA

SEQ ID NO: 589111 - protein, 9 aa, Homo Sapiens
TGENPFEIQ

SEQ ID NO: 589112 - protein, 9 aa, Homo Sapiens
RPVFMKSQQ

SEQ ID NO: 589113 - protein, 9 aa, Homo Sapiens
CNPMQFATI

SEQ ID NO: 589114 - protein, 9 aa, Homo Sapiens
SGLRVGFTR

SEQ ID NO: 589115 - protein, 9 aa, Homo Sapiens
AQSDFLYPQ

SEQ ID NO: 589116 - protein, 9 aa, Homo Sapiens
AIYLLKVSK

SEQ ID NO: 589117 - protein, 9 aa, Homo Sapiens
CLSIAICEL

SEQ ID NO: 589118 - protein, 9 aa, Homo Sapiens
TLSTMTQSG

SEQ ID NO: 589119 - protein, 9 aa, Homo Sapiens
GGRLDPAGS

SEQ ID NO: 589120 - protein, 9 aa, Homo Sapiens
PDYEVQHQL

SEQ ID NO: 589121 - protein, 9 aa, Homo Sapiens
NPMQFATIK

SEQ ID NO: 589122 - protein, 9 aa, Homo Sapiens
HSFLRHCQF

SEQ ID NO: 589123 - protein, 9 aa, Homo Sapiens
QNPKRREEV

SEQ ID NO: 589124 - protein, 9 aa, Homo Sapiens
LKCTPRVCS

SEQ ID NO: 589125 - protein, 9 aa, Homo Sapiens
FFSPLTFFQ

SEQ ID NO: 589126 - protein, 9 aa, Homo Sapiens
LDLMIRIAS

SEQ ID NO: 589127 - protein, 9 aa, Homo Sapiens
MEHPIPQSA

SEQ ID NO: 589128 - protein, 9 aa, Homo Sapiens
KSWIFFFSV

SEQ ID NO: 589129 - protein, 9 aa, Homo Sapiens
ENMDASSYP

SEQ ID NO: 589130 - protein, 9 aa, Homo Sapiens
KWLGMKSDA

SEQ ID NO: 589131 - protein, 9 aa, Homo Sapiens
PTHARIIIR

SEQ ID NO: 589132 - protein, 9 aa, Homo Sapiens
VFMKSQQLS

SEQ ID NO: 589133 - protein, 9 aa, Homo Sapiens
GEPQSPRNL

SEQ ID NO: 589134 - protein, 9 aa, Homo Sapiens
QSDFLYPQN

SEQ ID NO: 589135 - protein, 9 aa, Homo Sapiens
RSHSFLRHC

SEQ ID NO: 589136 - protein, 9 aa, Homo Sapiens
HFLPQQLPS

SEQ ID NO: 589137 - protein, 9 aa, Homo Sapiens
TYTFCFISF

SEQ ID NO: 589138 - protein, 9 aa, Homo Sapiens
LRFIGLKCL

SEQ ID NO: 589139 - protein, 9 aa, Homo Sapiens
VPGDILILL

SEQ ID NO: 589140 - protein, 9 aa, Homo Sapiens
PHDLMTVCA

SEQ ID NO: 589141 - protein, 9 aa, Homo Sapiens
PVAQVLASL

SEQ ID NO: 589142 - protein, 9 aa, Homo Sapiens
PFPLHSAYH

SEQ ID NO: 589143 - protein, 9 aa, Homo Sapiens
TPRVCSFAG

SEQ ID NO: 589144 - protein, 9 aa, Homo Sapiens
EPEDPSNCS

SEQ ID NO: 589145 - protein, 9 aa, Homo Sapiens
TPDHSTSSP

SEQ ID NO: 589146 - protein, 9 aa, Homo Sapiens
GRLDPAGSW

SEQ ID NO: 589147 - protein, 9 aa, Homo Sapiens
QSPGFKWIL

SEQ ID NO: 589148 - protein, 9 aa, Homo Sapiens
IRHMAAPLI

SEQ ID NO: 589149 - protein, 9 aa, Homo Sapiens
GEFYVSTHT

SEQ ID NO: 589150 - protein, 9 aa, Homo Sapiens
PAGSWTCGQ

SEQ ID NO: 589151 - protein, 9 aa, Homo Sapiens
FLYPQNPKR

SEQ ID NO: 589152 - protein, 9 aa, Homo Sapiens
PMQFATIKW

SEQ ID NO: 589153 - protein, 9 aa, Homo Sapiens
PNPPGSHSA

SEQ ID NO: 589154 - protein, 9 aa, Homo Sapiens
VGDVVLYFS

SEQ ID NO: 589155 - protein, 9 aa, Homo Sapiens
VASGRNVTL

SEQ ID NO: 589156 - protein, 9 aa, Homo Sapiens
KNTIPFPLH

SEQ ID NO: 589157 - protein, 9 aa, Homo Sapiens
ENLELTYGN

SEQ ID NO: 589158 - protein, 9 aa, Homo Sapiens
THARIIIRH

SEQ ID NO: 589159 - protein, 9 aa, Homo Sapiens
PIDHFLPQQ

SEQ ID NO: 589160 - protein, 9 aa, Homo Sapiens
PLCLLHPGV

SEQ ID NO: 589161 - protein, 9 aa, Homo Sapiens
VSKAGQNKP

SEQ ID NO: 589162 - protein, 9 aa, Homo Sapiens
KYAIFVEDI

SEQ ID NO: 589163 - protein, 9 aa, Homo Sapiens
SWTCGQPGS

SEQ ID NO: 589164 - protein, 9 aa, Homo Sapiens
GVTRPDYEV

SEQ ID NO: 589165 - protein, 9 aa, Homo Sapiens
WVTGNSQVH

SEQ ID NO: 589166 - protein, 9 aa, Homo Sapiens
LRTFCLNAC

SEQ ID NO: 589167 - protein, 9 aa, Homo Sapiens
LSTMTQSGP

SEQ ID NO: 589168 - protein, 9 aa, Homo Sapiens
MLCGLINFR

SEQ ID NO: 589169 - protein, 9 aa, Homo Sapiens
SAYHSVGDV

SEQ ID NO: 589170 - protein, 9 aa, Homo Sapiens
HSAYHSVGD

SEQ ID NO: 589171 - protein, 9 aa, Homo Sapiens
THIYIHTHT

SEQ ID NO: 589172 - protein, 9 aa, Homo Sapiens
KWFMINPAI

SEQ ID NO: 589173 - protein, 9 aa, Homo Sapiens
SPLCLLHPG

SEQ ID NO: 589174 - protein, 9 aa, Homo Sapiens
CHIFPQSPG

SEQ ID NO: 589175 - protein, 9 aa, Homo Sapiens
EPVISSEEQ

SEQ ID NO: 589176 - protein, 9 aa, Homo Sapiens
ISFPEPELY

SEQ ID NO: 589177 - protein, 9 aa, Homo Sapiens
SAPSPLCLL

SEQ ID NO: 589178 - protein, 9 aa, Homo Sapiens
GWNQLSKYA

SEQ ID NO: 589179 - protein, 9 aa, Homo Sapiens
QMREAYNDS

SEQ ID NO: 589180 - protein, 9 aa, Homo Sapiens
IIIGAFTVC

SEQ ID NO: 589181 - protein, 9 aa, Homo Sapiens
HARIIIRHM

SEQ ID NO: 589182 - protein, 9 aa, Homo Sapiens
LMTVCARHW

SEQ ID NO: 589183 - protein, 9 aa, Homo Sapiens
PGFKWILLL

SEQ ID NO: 589184 - protein, 9 aa, Homo Sapiens
NMDASSYPP

SEQ ID NO: 589185 - protein, 9 aa, Homo Sapiens
SLHQEGVGE

SEQ ID NO: 589186 - protein, 9 aa, Homo Sapiens
GTPDHSTSS

SEQ ID NO: 589187 - protein, 9 aa, Homo Sapiens
LWYPTRAWS

SEQ ID NO: 589188 - protein, 9 aa, Homo Sapiens
QRALRPVFM

SEQ ID NO: 589189 - protein, 9 aa, Homo Sapiens
GLAGKTKLE

SEQ ID NO: 589190 - protein, 9 aa, Homo Sapiens
EEKVQLTKV

SEQ ID NO: 589191 - protein, 9 aa, Homo Sapiens
DQYVNKKFS

SEQ ID NO: 589192 - protein, 9 aa, Homo Sapiens
ENPAFFNWN

SEQ ID NO: 589193 - protein, 9 aa, Homo Sapiens
KRNRRSHQE

SEQ ID NO: 589194 - protein, 9 aa, Homo Sapiens
AWLFWMWYN

SEQ ID NO: 589195 - protein, 9 aa, Homo Sapiens
MALQADRLA

SEQ ID NO: 589196 - protein, 9 aa, Homo Sapiens
SSYWSPCQT

SEQ ID NO: 589197 - protein, 9 aa, Homo Sapiens
KYLIPPTAL

SEQ ID NO: 589198 - protein, 9 aa, Homo Sapiens
RERLAMALQ

SEQ ID NO: 589199 - protein, 9 aa, Homo Sapiens
GFGCDEPDI

SEQ ID NO: 589200 - protein, 9 aa, Homo Sapiens
GKCGPVHFP

SEQ ID NO: 589201 - protein, 9 aa, Homo Sapiens
MILQHWPNA

SEQ ID NO: 589202 - protein, 9 aa, Homo Sapiens
ETQRSYEEA

SEQ ID NO: 589203 - protein, 9 aa, Homo Sapiens
AETQRSYEE

SEQ ID NO: 589204 - protein, 9 aa, Homo Sapiens
CQTHRQSGN

SEQ ID NO: 589205 - protein, 9 aa, Homo Sapiens
VSLSLSLYH

SEQ ID NO: 589206 - protein, 9 aa, Homo Sapiens
AWLQTSSYW

SEQ ID NO: 589207 - protein, 9 aa, Homo Sapiens
IPPTALARK

SEQ ID NO: 589208 - protein, 9 aa, Homo Sapiens
YLIPPTALA

SEQ ID NO: 589209 - protein, 9 aa, Homo Sapiens
LYQPPEMIL

SEQ ID NO: 589210 - protein, 9 aa, Homo Sapiens
TALARKRNR

SEQ ID NO: 589211 - protein, 9 aa, Homo Sapiens
SVVAETQRS

SEQ ID NO: 589212 - protein, 9 aa, Homo Sapiens
NKLYQPPEM

SEQ ID NO: 589213 - protein, 9 aa, Homo Sapiens
RNRRSHQEA

SEQ ID NO: 589214 - protein, 9 aa, Homo Sapiens
KRVNQDPIK

SEQ ID NO: 589215 - protein, 9 aa, Homo Sapiens
KAESAWLFW

SEQ ID NO: 589216 - protein, 9 aa, Homo Sapiens
NLCFGKCGP

SEQ ID NO: 589217 - protein, 9 aa, Homo Sapiens
AEQDDFYEV

SEQ ID NO: 589218 - protein, 9 aa, Homo Sapiens
LYNLGFGCD

SEQ ID NO: 589219 - protein, 9 aa, Homo Sapiens
FDCDSEGRL

SEQ ID NO: 589220 - protein, 9 aa, Homo Sapiens
KRWKRVNQD

SEQ ID NO: 589221 - protein, 9 aa, Homo Sapiens
KSWSGARAE

SEQ ID NO: 589222 - protein, 9 aa, Homo Sapiens
YGLMKIGEP

SEQ ID NO: 589223 - protein, 9 aa, Homo Sapiens
ARERLAMAL

SEQ ID NO: 589224 - protein, 9 aa, Homo Sapiens
LCFGKCGPV

SEQ ID NO: 589225 - protein, 9 aa, Homo Sapiens
YNLGFGCDE

SEQ ID NO: 589226 - protein, 9 aa, Homo Sapiens
VKYLIPPTA

SEQ ID NO: 589227 - protein, 9 aa, Homo Sapiens
SAWLFWMWY

SEQ ID NO: 589228 - protein, 9 aa, Homo Sapiens
TQRSYEEAL

SEQ ID NO: 589229 - protein, 9 aa, Homo Sapiens
ETSVKSWSG

SEQ ID NO: 589230 - protein, 9 aa, Homo Sapiens
QSGNRSCLP

SEQ ID NO: 589231 - protein, 9 aa, Homo Sapiens
WLQTSSYWS

SEQ ID NO: 589232 - protein, 9 aa, Homo Sapiens
FWMWYNFDH

SEQ ID NO: 589233 - protein, 9 aa, Homo Sapiens
LQTSSYWSP

SEQ ID NO: 589234 - protein, 9 aa, Homo Sapiens
DCDSEGRLT

SEQ ID NO: 589235 - protein, 9 aa, Homo Sapiens
ERLAMALQA

SEQ ID NO: 589236 - protein, 9 aa, Homo Sapiens
RVNQDPIKA

SEQ ID NO: 589237 - protein, 9 aa, Homo Sapiens
PLSQGPSLS

SEQ ID NO: 589238 - protein, 9 aa, Homo Sapiens
GCDEPDIAS

SEQ ID NO: 589239 - protein, 9 aa, Homo Sapiens
AAAEQDDFY

SEQ ID NO: 589240 - protein, 9 aa, Homo Sapiens
QFVKYLIPP

SEQ ID NO: 589241 - protein, 9 aa, Homo Sapiens
SGARAENVV

SEQ ID NO: 589242 - protein, 9 aa, Homo Sapiens
WKRVNQDPI

SEQ ID NO: 589243 - protein, 9 aa, Homo Sapiens
PEMILQHWP

SEQ ID NO: 589244 - protein, 9 aa, Homo Sapiens
APQELGAAA

SEQ ID NO: 589245 - protein, 9 aa, Homo Sapiens
QEQLRRLKW

SEQ ID NO: 589246 - protein, 9 aa, Homo Sapiens
SQFVKYLIP

SEQ ID NO: 589247 - protein, 9 aa, Homo Sapiens
KENEENQNS

SEQ ID NO: 589248 - protein, 9 aa, Homo Sapiens
QTHRQSGNR

SEQ ID NO: 589249 - protein, 9 aa, Homo Sapiens
PVPQKIEAP

SEQ ID NO: 589250 - protein, 9 aa, Homo Sapiens
LARKRNRRS

SEQ ID NO: 589251 - protein, 9 aa, Homo Sapiens
GPVHFPGAA

SEQ ID NO: 589252 - protein, 9 aa, Homo Sapiens
LSLSLYHTH

SEQ ID NO: 589253 - protein, 9 aa, Homo Sapiens
LPRSSRNSS

SEQ ID NO: 589254 - protein, 9 aa, Homo Sapiens
SQGPSLSPT

SEQ ID NO: 589255 - protein, 9 aa, Homo Sapiens
QEAWLQTSS

SEQ ID NO: 589256 - protein, 9 aa, Homo Sapiens
SLLFVALPR

SEQ ID NO: 589257 - protein, 9 aa, Homo Sapiens
LYHTHTHTH

SEQ ID NO: 589258 - protein, 9 aa, Homo Sapiens
RSYEEALLQ

SEQ ID NO: 589259 - protein, 9 aa, Homo Sapiens
ESAWLFWMW

SEQ ID NO: 589260 - protein, 9 aa, Homo Sapiens
WTTFFDCDS

SEQ ID NO: 589261 - protein, 9 aa, Homo Sapiens
KCGPVHFPG

SEQ ID NO: 589262 - protein, 9 aa, Homo Sapiens
LLFVALPRS

SEQ ID NO: 589263 - protein, 9 aa, Homo Sapiens
QDPIKAMTL

SEQ ID NO: 589264 - protein, 9 aa, Homo Sapiens
IEAPCFQNE

SEQ ID NO: 589265 - protein, 9 aa, Homo Sapiens
GHRGQCYPT

SEQ ID NO: 589266 - protein, 9 aa, Homo Sapiens
PPTALARKR

SEQ ID NO: 589267 - protein, 9 aa, Homo Sapiens
LGFGCDEPD

SEQ ID NO: 589268 - protein, 9 aa, Homo Sapiens
EMILQHWPN

SEQ ID NO: 589269 - protein, 9 aa, Homo Sapiens
SYEEALLQK

SEQ ID NO: 589270 - protein, 9 aa, Homo Sapiens
FTAHRHATI

SEQ ID NO: 589271 - protein, 9 aa, Homo Sapiens
EAWLQTSSY

SEQ ID NO: 589272 - protein, 9 aa, Homo Sapiens
FFDCDSEGR

SEQ ID NO: 589273 - protein, 9 aa, Homo Sapiens
LRRLKWNQE

SEQ ID NO: 589274 - protein, 9 aa, Homo Sapiens
YHTHTHTHT

SEQ ID NO: 589275 - protein, 9 aa, Homo Sapiens
PCFQNEKVT

SEQ ID NO: 589276 - protein, 9 aa, Homo Sapiens
YRCGHRGQC

SEQ ID NO: 589277 - protein, 9 aa, Homo Sapiens
NSYGERLQL

SEQ ID NO: 589278 - protein, 9 aa, Homo Sapiens
YWSPCQTHR

SEQ ID NO: 589279 - protein, 9 aa, Homo Sapiens
WSGARAENV

SEQ ID NO: 589280 - protein, 9 aa, Homo Sapiens
TSFTAHRHA

SEQ ID NO: 589281 - protein, 9 aa, Homo Sapiens
SHQEAWLQT

SEQ ID NO: 589282 - protein, 9 aa, Homo Sapiens
RRLKWNQEK

SEQ ID NO: 589283 - protein, 9 aa, Homo Sapiens
AAEQDDFYE

SEQ ID NO: 589284 - protein, 9 aa, Homo Sapiens
AYRCGHRGQ

SEQ ID NO: 589285 - protein, 9 aa, Homo Sapiens
PQKIEAPCF

SEQ ID NO: 589286 - protein, 9 aa, Homo Sapiens
RCGHRGQCY

SEQ ID NO: 589287 - protein, 9 aa, Homo Sapiens
RSSRNSSLR

SEQ ID NO: 589288 - protein, 9 aa, Homo Sapiens
HRHATITHL

SEQ ID NO: 589289 - protein, 9 aa, Homo Sapiens
HRGQCYPTS

SEQ ID NO: 589290 - protein, 9 aa, Homo Sapiens
THRQSGNRS

SEQ ID NO: 589291 - protein, 9 aa, Homo Sapiens
CGPVHFPGA

SEQ ID NO: 589292 - protein, 9 aa, Homo Sapiens
LSQGPSLSP

SEQ ID NO: 589293 - protein, 9 aa, Homo Sapiens
RSHQEAWLQ

SEQ ID NO: 589294 - protein, 9 aa, Homo Sapiens
DYGLMKIGE

SEQ ID NO: 589295 - protein, 9 aa, Homo Sapiens
SLSLYHTHT

SEQ ID NO: 589296 - protein, 9 aa, Homo Sapiens
VALPRSSRN

SEQ ID NO: 589297 - protein, 9 aa, Homo Sapiens
SSRNSSLRR

SEQ ID NO: 589298 - protein, 9 aa, Homo Sapiens
VNQDPIKAM

SEQ ID NO: 589299 - protein, 9 aa, Homo Sapiens
MKIGEPSTP

SEQ ID NO: 589300 - protein, 9 aa, Homo Sapiens
TAHRHATIT

SEQ ID NO: 589301 - protein, 9 aa, Homo Sapiens
VPQKIEAPC

SEQ ID NO: 589302 - protein, 9 aa, Homo Sapiens
NQNSYGERL

SEQ ID NO: 589303 - protein, 9 aa, Homo Sapiens
QPPEMILQH

SEQ ID NO: 589304 - protein, 9 aa, Homo Sapiens
FGKCGPVHF

SEQ ID NO: 589305 - protein, 9 aa, Homo Sapiens
QRSYEEALL

SEQ ID NO: 589306 - protein, 9 aa, Homo Sapiens
LMKIGEPST

SEQ ID NO: 589307 - protein, 9 aa, Homo Sapiens
TGWTTFFDC

SEQ ID NO: 589308 - protein, 9 aa, Homo Sapiens
GEPSTPYHS

SEQ ID NO: 589309 - protein, 9 aa, Homo Sapiens
YKENEENQN

SEQ ID NO: 589310 - protein, 9 aa, Homo Sapiens
NRRSHQEAW

SEQ ID NO: 589311 - protein, 9 aa, Homo Sapiens
WMWYNFDHN

SEQ ID NO: 589312 - protein, 9 aa, Homo Sapiens
ALARKRNRR

SEQ ID NO: 589313 - protein, 9 aa, Homo Sapiens
CDSEGRLTN

SEQ ID NO: 589314 - protein, 9 aa, Homo Sapiens
LFVALPRSS

SEQ ID NO: 589315 - protein, 9 aa, Homo Sapiens
KSTPLSQGP

SEQ ID NO: 589316 - protein, 9 aa, Homo Sapiens
CFGKCGPVH

SEQ ID NO: 589317 - protein, 9 aa, Homo Sapiens
IGEPSTPYH

SEQ ID NO: 589318 - protein, 9 aa, Homo Sapiens
KIEAPCFQN

SEQ ID NO: 589319 - protein, 9 aa, Homo Sapiens
PVHFPGAAQ

SEQ ID NO: 589320 - protein, 9 aa, Homo Sapiens
TSVKSWSGA

SEQ ID NO: 589321 - protein, 9 aa, Homo Sapiens
NQDPIKAMT

SEQ ID NO: 589322 - protein, 9 aa, Homo Sapiens
TFFDCDSEG

SEQ ID NO: 589323 - protein, 9 aa, Homo Sapiens
ENQNSYGER

SEQ ID NO: 589324 - protein, 9 aa, Homo Sapiens
EENQNSYGE

SEQ ID NO: 589325 - protein, 9 aa, Homo Sapiens
WAYRCGHRG

SEQ ID NO: 589326 - protein, 9 aa, Homo Sapiens
SPCQTHRQS

SEQ ID NO: 589327 - protein, 9 aa, Homo Sapiens
PQELGAAAE

SEQ ID NO: 589328 - protein, 9 aa, Homo Sapiens
EQLRRLKWN

SEQ ID NO: 589329 - protein, 9 aa, Homo Sapiens
ENEENQNSY

SEQ ID NO: 589330 - protein, 9 aa, Homo Sapiens
EAPCFQNEK

SEQ ID NO: 589331 - protein, 9 aa, Homo Sapiens
QGPSLSPTK

SEQ ID NO: 589332 - protein, 9 aa, Homo Sapiens
QNSYGERLQ

SEQ ID NO: 589333 - protein, 9 aa, Homo Sapiens
RWKRVNQDP

SEQ ID NO: 589334 - protein, 9 aa, Homo Sapiens
FSLLFVALP

SEQ ID NO: 589335 - protein, 9 aa, Homo Sapiens
APCFQNEKV

SEQ ID NO: 589336 - protein, 9 aa, Homo Sapiens
FVALPRSSR

SEQ ID NO: 589337 - protein, 9 aa, Homo Sapiens
RHATITHLL

SEQ ID NO: 589338 - protein, 9 aa, Homo Sapiens
WSPCQTHRQ

SEQ ID NO: 589339 - protein, 9 aa, Homo Sapiens
VKSWSGARA

SEQ ID NO: 589340 - protein, 9 aa, Homo Sapiens
PPEMILQHW

SEQ ID NO: 589341 - protein, 9 aa, Homo Sapiens
KWNQEKEKL

SEQ ID NO: 589342 - protein, 9 aa, Homo Sapiens
NLGFGCDEP

SEQ ID NO: 589343 - protein, 9 aa, Homo Sapiens
TKSTPLSQG

SEQ ID NO: 589344 - protein, 9 aa, Homo Sapiens
DETSVKSWS

SEQ ID NO: 589345 - protein, 9 aa, Homo Sapiens
TTFFDCDSE

SEQ ID NO: 589346 - protein, 9 aa, Homo Sapiens
HRQSGNRSC

SEQ ID NO: 589347 - protein, 9 aa, Homo Sapiens
WNQEKEKLK

SEQ ID NO: 589348 - protein, 9 aa, Homo Sapiens
AHRHATITH

SEQ ID NO: 589349 - protein, 9 aa, Homo Sapiens
VAETQRSYE

SEQ ID NO: 589350 - protein, 9 aa, Homo Sapiens
GTSFTAHRH

SEQ ID NO: 589351 - protein, 9 aa, Homo Sapiens
PCQTHRQSG

SEQ ID NO: 589352 - protein, 9 aa, Homo Sapiens
SWSGARAEN

SEQ ID NO: 589353 - protein, 9 aa, Homo Sapiens
TSSYWSPCQ

SEQ ID NO: 589354 - protein, 9 aa, Homo Sapiens
SFTAHRHAT

SEQ ID NO: 589355 - protein, 9 aa, Homo Sapiens
KDYGLMKIG

SEQ ID NO: 589356 - protein, 9 aa, Homo Sapiens
RQSGNRSCL

SEQ ID NO: 589357 - protein, 9 aa, Homo Sapiens
FGCDEPDIA

SEQ ID NO: 589358 - protein, 9 aa, Homo Sapiens
SKRWKRVNQ

SEQ ID NO: 589359 - protein, 9 aa, Homo Sapiens
RGQCYPTSW

SEQ ID NO: 589360 - protein, 9 aa, Homo Sapiens
LFWMWYNFD

SEQ ID NO: 589361 - protein, 9 aa, Homo Sapiens
ELGAAAEQD

SEQ ID NO: 589362 - protein, 9 aa, Homo Sapiens
HQEAWLQTS

SEQ ID NO: 589363 - protein, 9 aa, Homo Sapiens
CDEPDIASK

SEQ ID NO: 589364 - protein, 9 aa, Homo Sapiens
PRSSRNSSL

SEQ ID NO: 589365 - protein, 9 aa, Homo Sapiens
PTALARKRN

SEQ ID NO: 589366 - protein, 9 aa, Homo Sapiens
YQPPEMILQ

SEQ ID NO: 589367 - protein, 9 aa, Homo Sapiens
SLSLSLYHT

SEQ ID NO: 589368 - protein, 9 aa, Homo Sapiens
VVAETQRSY

SEQ ID NO: 589369 - protein, 9 aa, Homo Sapiens
ILYNLGFGC

SEQ ID NO: 589370 - protein, 9 aa, Homo Sapiens
SLYHTHTHT

SEQ ID NO: 589371 - protein, 9 aa, Homo Sapiens
STPLSQGPS

SEQ ID NO: 589372 - protein, 9 aa, Homo Sapiens
HATITHLLY

SEQ ID NO: 589373 - protein, 9 aa, Homo Sapiens
SYWSPCQTH

SEQ ID NO: 589374 - protein, 9 aa, Homo Sapiens
RRSHQEAWL

SEQ ID NO: 589375 - protein, 9 aa, Homo Sapiens
GNRSCLPSH

SEQ ID NO: 589376 - protein, 9 aa, Homo Sapiens
QTSSYWSPC

SEQ ID NO: 589377 - protein, 9 aa, Homo Sapiens
SVKSWSGAR

SEQ ID NO: 589378 - protein, 9 aa, Homo Sapiens
CGHRGQCYP

SEQ ID NO: 589379 - protein, 9 aa, Homo Sapiens
KIGEPSTPY

SEQ ID NO: 589380 - protein, 9 aa, Homo Sapiens
RKRNRRSHQ

SEQ ID NO: 589381 - protein, 9 aa, Homo Sapiens
GPSLSPTKQ

SEQ ID NO: 589382 - protein, 9 aa, Homo Sapiens
LIPPTALAR

SEQ ID NO: 589383 - protein, 9 aa, Homo Sapiens
KARERLAMA

SEQ ID NO: 589384 - protein, 9 aa, Homo Sapiens
IFSLLFVAL

SEQ ID NO: 589385 - protein, 9 aa, Homo Sapiens
LKWNQEKEK

SEQ ID NO: 589386 - protein, 9 aa, Homo Sapiens
AMALQADRL

SEQ ID NO: 589387 - protein, 9 aa, Homo Sapiens
SGNRSCLPS

SEQ ID NO: 589388 - protein, 9 aa, Homo Sapiens
NEENQNSYG

SEQ ID NO: 589389 - protein, 9 aa, Homo Sapiens
LAMALQADR

SEQ ID NO: 589390 - protein, 9 aa, Homo Sapiens
GQCYPTSWQ

SEQ ID NO: 589391 - protein, 9 aa, Homo Sapiens
KKARERLAM

SEQ ID NO: 589392 - protein, 9 aa, Homo Sapiens
TPLSQGPSL

SEQ ID NO: 589393 - protein, 9 aa, Homo Sapiens
QLRRLKWNQ

SEQ ID NO: 589394 - protein, 9 aa, Homo Sapiens
RLKWNQEKE

SEQ ID NO: 589395 - protein, 9 aa, Homo Sapiens
GAAAEQDDF

SEQ ID NO: 589396 - protein, 9 aa, Homo Sapiens
FVKYLIPPT

SEQ ID NO: 589397 - protein, 9 aa, Homo Sapiens
GLMKIGEPS

SEQ ID NO: 589398 - protein, 9 aa, Homo Sapiens
LGAAAEQDD

SEQ ID NO: 589399 - protein, 9 aa, Homo Sapiens
LSLYHTHTH

SEQ ID NO: 589400 - protein, 9 aa, Homo Sapiens
ARKRNRRSH

SEQ ID NO: 589401 - protein, 9 aa, Homo Sapiens
ALPRSSRNS

SEQ ID NO: 589402 - protein, 9 aa, Homo Sapiens
RLAMALQAD

SEQ ID NO: 589403 - protein, 9 aa, Homo Sapiens
GWTTFFDCD

SEQ ID NO: 589404 - protein, 9 aa, Homo Sapiens
QKIEAPCFQ

SEQ ID NO: 589405 - protein, 9 aa, Homo Sapiens
WLFWMWYNF

SEQ ID NO: 589406 - protein, 9 aa, Homo Sapiens
AESAWLFWM

SEQ ID NO: 589407 - protein, 9 aa, Homo Sapiens
KLYQPPEMI

SEQ ID NO: 589408 - protein, 9 aa, Homo Sapiens
QELGAAAEQ

SEQ ID NO: 589409 - protein, 9 aa, Homo Sapiens
KSGDACNLE

SEQ ID NO: 589410 - protein, 9 aa, Homo Sapiens
MQQLDLEAD

SEQ ID NO: 589411 - protein, 9 aa, Homo Sapiens
QVPGAECLP

SEQ ID NO: 589412 - protein, 9 aa, Homo Sapiens
ASYAQQCLS

SEQ ID NO: 589413 - protein, 9 aa, Homo Sapiens
PQGRDSSIH

SEQ ID NO: 589414 - protein, 9 aa, Homo Sapiens
NYLDKYEPC

SEQ ID NO: 589415 - protein, 9 aa, Homo Sapiens
LSLGRIKTF

SEQ ID NO: 589416 - protein, 9 aa, Homo Sapiens
FRHSVVVPC

SEQ ID NO: 589417 - protein, 9 aa, Homo Sapiens
ITKKVQSQV

SEQ ID NO: 589418 - protein, 9 aa, Homo Sapiens
ITICIIINS

SEQ ID NO: 589419 - protein, 9 aa, Homo Sapiens
GPIAAGTCD

SEQ ID NO: 589420 - protein, 9 aa, Homo Sapiens
NERAALLPR

SEQ ID NO: 589421 - protein, 9 aa, Homo Sapiens
AGTVAWQAK

SEQ ID NO: 589422 - protein, 9 aa, Homo Sapiens
LVRHTSQVT

SEQ ID NO: 589423 - protein, 9 aa, Homo Sapiens
TAGKSSFTV

SEQ ID NO: 589424 - protein, 9 aa, Homo Sapiens
EQEEEEERR

SEQ ID NO: 589425 - protein, 9 aa, Homo Sapiens
TSQVTQLVS

SEQ ID NO: 589426 - protein, 9 aa, Homo Sapiens
ECEFSNLPE

SEQ ID NO: 589427 - protein, 9 aa, Homo Sapiens
VRHTSQVTQ

SEQ ID NO: 589428 - protein, 9 aa, Homo Sapiens
NPYPKSYTL

SEQ ID NO: 589429 - protein, 9 aa, Homo Sapiens
ELLQVDPRL

SEQ ID NO: 589430 - protein, 9 aa, Homo Sapiens
YKAAQKADA

SEQ ID NO: 589431 - protein, 9 aa, Homo Sapiens
LDEDSITKP

SEQ ID NO: 589432 - protein, 9 aa, Homo Sapiens
IPFLVSSVE

SEQ ID NO: 589433 - protein, 9 aa, Homo Sapiens
MIHPGLVCC

SEQ ID NO: 589434 - protein, 9 aa, Homo Sapiens
LQCQLEFTK

SEQ ID NO: 589435 - protein, 9 aa, Homo Sapiens
CREVEQWFA

SEQ ID NO: 589436 - protein, 9 aa, Homo Sapiens
RCVSNSREY

SEQ ID NO: 589437 - protein, 9 aa, Homo Sapiens
CTSVSPFYL

SEQ ID NO: 589438 - protein, 9 aa, Homo Sapiens
GMAENTCHK

SEQ ID NO: 589439 - protein, 9 aa, Homo Sapiens
QAPVERNYH

SEQ ID NO: 589440 - protein, 9 aa, Homo Sapiens
MFGREFCYS

SEQ ID NO: 589441 - protein, 9 aa, Homo Sapiens
NTAGKSSFT

SEQ ID NO: 589442 - protein, 9 aa, Homo Sapiens
WLSPEEDLI

SEQ ID NO: 589443 - protein, 9 aa, Homo Sapiens
MTAYWTNFA

SEQ ID NO: 589444 - protein, 9 aa, Homo Sapiens
AELSYEERN

SEQ ID NO: 589445 - protein, 9 aa, Homo Sapiens
SPFYLGAEL

SEQ ID NO: 589446 - protein, 9 aa, Homo Sapiens
MKQEEEANK

SEQ ID NO: 589447 - protein, 9 aa, Homo Sapiens
GSSPHLQRT

SEQ ID NO: 589448 - protein, 9 aa, Homo Sapiens
SSSVSPHRG

SEQ ID NO: 589449 - protein, 9 aa, Homo Sapiens
GNLCRSNQQ

SEQ ID NO: 589450 - protein, 9 aa, Homo Sapiens
LSLGVLAVL

SEQ ID NO: 589451 - protein, 9 aa, Homo Sapiens
GKPYVCPEC

SEQ ID NO: 589452 - protein, 9 aa, Homo Sapiens
HMAGAAAVM

SEQ ID NO: 589453 - protein, 9 aa, Homo Sapiens
FLCTSVSPF

SEQ ID NO: 589454 - protein, 9 aa, Homo Sapiens
HQLIISSAL

SEQ ID NO: 589455 - protein, 9 aa, Homo Sapiens
LKKQEKEVK

SEQ ID NO: 589456 - protein, 9 aa, Homo Sapiens
KKGEALFPG

SEQ ID NO: 589457 - protein, 9 aa, Homo Sapiens
LQLFFSGVV

SEQ ID NO: 589458 - protein, 9 aa, Homo Sapiens
RHDGYRSHG

SEQ ID NO: 589459 - protein, 9 aa, Homo Sapiens
PYPKSYTLV

SEQ ID NO: 589460 - protein, 9 aa, Homo Sapiens
LLQSDEREA

SEQ ID NO: 589461 - protein, 9 aa, Homo Sapiens
DICDVDCHG

SEQ ID NO: 589462 - protein, 9 aa, Homo Sapiens
VQRDYVFYL

SEQ ID NO: 589463 - protein, 9 aa, Homo Sapiens
INHHSSCNG

SEQ ID NO: 589464 - protein, 9 aa, Homo Sapiens
EYILLAFMA

SEQ ID NO: 589465 - protein, 9 aa, Homo Sapiens
LEDNEEKMS

SEQ ID NO: 589466 - protein, 9 aa, Homo Sapiens
VETNCREVE

SEQ ID NO: 589467 - protein, 9 aa, Homo Sapiens
VSNSREYCS

SEQ ID NO: 589468 - protein, 9 aa, Homo Sapiens
VFSMLIMCT

SEQ ID NO: 589469 - protein, 9 aa, Homo Sapiens
SDLSKPIGA

SEQ ID NO: 589470 - protein, 9 aa, Homo Sapiens
SNTELYVIF

SEQ ID NO: 589471 - protein, 9 aa, Homo Sapiens
LMKTMGNVA

SEQ ID NO: 589472 - protein, 9 aa, Homo Sapiens
SSFRHDGYR

SEQ ID NO: 589473 - protein, 9 aa, Homo Sapiens
FGHGAEDSA

SEQ ID NO: 589474 - protein, 9 aa, Homo Sapiens
GHGAEDSAG

SEQ ID NO: 589475 - protein, 9 aa, Homo Sapiens
GKKKGPNAY

SEQ ID NO: 589476 - protein, 9 aa, Homo Sapiens
QYVNQRNTR

SEQ ID NO: 589477 - protein, 9 aa, Homo Sapiens
PCQRLENAV

SEQ ID NO: 589478 - protein, 9 aa, Homo Sapiens
GKGMAENTC

SEQ ID NO: 589479 - protein, 9 aa, Homo Sapiens
PEDSIKVIG

SEQ ID NO: 589480 - protein, 9 aa, Homo Sapiens
GNFSDLSKP

SEQ ID NO: 589481 - protein, 9 aa, Homo Sapiens
DILFAFTMR

SEQ ID NO: 589482 - protein, 9 aa, Homo Sapiens
LPRGLDIKL

SEQ ID NO: 589483 - protein, 9 aa, Homo Sapiens
QSEHSSEHV

SEQ ID NO: 589484 - protein, 9 aa, Homo Sapiens
SERFDTHGC

SEQ ID NO: 589485 - protein, 9 aa, Homo Sapiens
GSQIEFEQQ

SEQ ID NO: 589486 - protein, 9 aa, Homo Sapiens
DDFDPASTM

SEQ ID NO: 589487 - protein, 9 aa, Homo Sapiens
PEPYSEQVL

SEQ ID NO: 589488 - protein, 9 aa, Homo Sapiens
QGCSAKSKN

SEQ ID NO: 589489 - protein, 9 aa, Homo Sapiens
RRNPIYPLI

SEQ ID NO: 589490 - protein, 9 aa, Homo Sapiens
GGINAAFSW

SEQ ID NO: 589491 - protein, 9 aa, Homo Sapiens
LRTLLLYLS

SEQ ID NO: 589492 - protein, 9 aa, Homo Sapiens
DIKLEELGD

SEQ ID NO: 589493 - protein, 9 aa, Homo Sapiens
GLRPFPGLD

SEQ ID NO: 589494 - protein, 9 aa, Homo Sapiens
FLVSSVEDF

SEQ ID NO: 589495 - protein, 9 aa, Homo Sapiens
KQEEEANKL

SEQ ID NO: 589496 - protein, 9 aa, Homo Sapiens
CECGKFFME

SEQ ID NO: 589497 - protein, 9 aa, Homo Sapiens
DLEALLQSD

SEQ ID NO: 589498 - protein, 9 aa, Homo Sapiens
NTELYVIFT

SEQ ID NO: 589499 - protein, 9 aa, Homo Sapiens
DEGRRMTDV

SEQ ID NO: 589500 - protein, 9 aa, Homo Sapiens
RLPVRKKVL

SEQ ID NO: 589501 - protein, 9 aa, Homo Sapiens
SNLPENECC

SEQ ID NO: 589502 - protein, 9 aa, Homo Sapiens
FDPASTMSK

SEQ ID NO: 589503 - protein, 9 aa, Homo Sapiens
GGKPYVCPE

SEQ ID NO: 589504 - protein, 9 aa, Homo Sapiens
YSQELPGAI

SEQ ID NO: 589505 - protein, 9 aa, Homo Sapiens
CRSNQQLQV

SEQ ID NO: 589506 - protein, 9 aa, Homo Sapiens
TNVGDQRST

SEQ ID NO: 589507 - protein, 9 aa, Homo Sapiens
YGYLAQHYV

SEQ ID NO: 589508 - protein, 9 aa, Homo Sapiens
WKAHHLQCH

SEQ ID NO: 589509 - protein, 9 aa, Homo Sapiens
WLKATPHFL

SEQ ID NO: 589510 - protein, 9 aa, Homo Sapiens
TVIPLLPSY

SEQ ID NO: 589511 - protein, 9 aa, Homo Sapiens
QSVEPFTKQ

SEQ ID NO: 589512 - protein, 9 aa, Homo Sapiens
MLICDIDGD

SEQ ID NO: 589513 - protein, 9 aa, Homo Sapiens
LSQGPDSTE

SEQ ID NO: 589514 - protein, 9 aa, Homo Sapiens
ISYRIPLGG

SEQ ID NO: 589515 - protein, 9 aa, Homo Sapiens
YDRLYEEYA

SEQ ID NO: 589516 - protein, 9 aa, Homo Sapiens
KSIKSVVPV

SEQ ID NO: 589517 - protein, 9 aa, Homo Sapiens
LKATPHFLV

SEQ ID NO: 589518 - protein, 9 aa, Homo Sapiens
ANTKVMLIC

SEQ ID NO: 589519 - protein, 9 aa, Homo Sapiens
CDCDLRGKS

SEQ ID NO: 589520 - protein, 9 aa, Homo Sapiens
ATNVGDQRS

SEQ ID NO: 589521 - protein, 9 aa, Homo Sapiens
IPPFLDDIP

SEQ ID NO: 589522 - protein, 9 aa, Homo Sapiens
KAMTAYWTN

SEQ ID NO: 589523 - protein, 9 aa, Homo Sapiens
CYTHPCSLR

SEQ ID NO: 589524 - protein, 9 aa, Homo Sapiens
SSGSRVCGN

SEQ ID NO: 589525 - protein, 9 aa, Homo Sapiens
ERFDTHGCR

SEQ ID NO: 589526 - protein, 9 aa, Homo Sapiens
GKDFLKSEK

SEQ ID NO: 589527 - protein, 9 aa, Homo Sapiens
DLLHWKAHH

SEQ ID NO: 589528 - protein, 9 aa, Homo Sapiens
VASCASAPA

SEQ ID NO: 589529 - protein, 9 aa, Homo Sapiens
VAWQAKSSS

SEQ ID NO: 589530 - protein, 9 aa, Homo Sapiens
AILHHQTLY

SEQ ID NO: 589531 - protein, 9 aa, Homo Sapiens
HSSCNGTWS

SEQ ID NO: 589532 - protein, 9 aa, Homo Sapiens
NTCHKSYRP

SEQ ID NO: 589533 - protein, 9 aa, Homo Sapiens
WYHRLPVRK

SEQ ID NO: 589534 - protein, 9 aa, Homo Sapiens
LSVGPLRFQ

SEQ ID NO: 589535 - protein, 9 aa, Homo Sapiens
KPKSPACEP

SEQ ID NO: 589536 - protein, 9 aa, Homo Sapiens
PSEINANYL

SEQ ID NO: 589537 - protein, 9 aa, Homo Sapiens
AENTCHKSY

SEQ ID NO: 589538 - protein, 9 aa, Homo Sapiens
QRYVINHHS

SEQ ID NO: 589539 - protein, 9 aa, Homo Sapiens
EMLLITSNP

SEQ ID NO: 589540 - protein, 9 aa, Homo Sapiens
LCWPESGEC

SEQ ID NO: 589541 - protein, 9 aa, Homo Sapiens
ITSNPYDYA

SEQ ID NO: 589542 - protein, 9 aa, Homo Sapiens
IPLGGLFTY

SEQ ID NO: 589543 - protein, 9 aa, Homo Sapiens
VHRWPSAQV

SEQ ID NO: 589544 - protein, 9 aa, Homo Sapiens
QTPAQELHR

SEQ ID NO: 589545 - protein, 9 aa, Homo Sapiens
CDLRGKSGD

SEQ ID NO: 589546 - protein, 9 aa, Homo Sapiens
CRQAPVERN

SEQ ID NO: 589547 - protein, 9 aa, Homo Sapiens
INAAFSWAH

SEQ ID NO: 589548 - protein, 9 aa, Homo Sapiens
FFRRSLRRA

SEQ ID NO: 589549 - protein, 9 aa, Homo Sapiens
KDVFEKRRK

SEQ ID NO: 589550 - protein, 9 aa, Homo Sapiens
YLAQHYVCM

SEQ ID NO: 589551 - protein, 9 aa, Homo Sapiens
TPPTGERRF

SEQ ID NO: 589552 - protein, 9 aa, Homo Sapiens
GISARHILV

SEQ ID NO: 589553 - protein, 9 aa, Homo Sapiens
HPNCTFDYL

SEQ ID NO: 589554 - protein, 9 aa, Homo Sapiens
FDTHGCRFI

SEQ ID NO: 589555 - protein, 9 aa, Homo Sapiens
YLGVPYATP

SEQ ID NO: 589556 - protein, 9 aa, Homo Sapiens
FYEEQIKTK

SEQ ID NO: 589557 - protein, 9 aa, Homo Sapiens
FELVKMDFD

SEQ ID NO: 589558 - protein, 9 aa, Homo Sapiens
VFKAGTVAW

SEQ ID NO: 589559 - protein, 9 aa, Homo Sapiens
ELAILHHQT

SEQ ID NO: 589560 - protein, 9 aa, Homo Sapiens
SCVVRYFVA

SEQ ID NO: 589561 - protein, 9 aa, Homo Sapiens
PGNFSDLSK

SEQ ID NO: 589562 - protein, 9 aa, Homo Sapiens
EMKPLLRSA

SEQ ID NO: 589563 - protein, 9 aa, Homo Sapiens
ENNTPSSAE

SEQ ID NO: 589564 - protein, 9 aa, Homo Sapiens
ACLNERAAL

SEQ ID NO: 589565 - protein, 9 aa, Homo Sapiens
MKTMGNVAT

SEQ ID NO: 589566 - protein, 9 aa, Homo Sapiens
LSSVSTGHT

SEQ ID NO: 589567 - protein, 9 aa, Homo Sapiens
SYRIPLGGL

SEQ ID NO: 589568 - protein, 9 aa, Homo Sapiens
DKCYTHPCS

SEQ ID NO: 589569 - protein, 9 aa, Homo Sapiens
DIAFETREI

SEQ ID NO: 589570 - protein, 9 aa, Homo Sapiens
CRLQSCIAF

SEQ ID NO: 589571 - protein, 9 aa, Homo Sapiens
GQVPGAECL

SEQ ID NO: 589572 - protein, 9 aa, Homo Sapiens
SLSLGRIKT

SEQ ID NO: 589573 - protein, 9 aa, Homo Sapiens
HPCSLRKHM

SEQ ID NO: 589574 - protein, 9 aa, Homo Sapiens
HQGIQRRFT

SEQ ID NO: 589575 - protein, 9 aa, Homo Sapiens
SSVSPHRGN

SEQ ID NO: 589576 - protein, 9 aa, Homo Sapiens
TLAFAGLVI

SEQ ID NO: 589577 - protein, 9 aa, Homo Sapiens
LDVQELSLG

SEQ ID NO: 589578 - protein, 9 aa, Homo Sapiens
KYWVIKGNI

SEQ ID NO: 589579 - protein, 9 aa, Homo Sapiens
NAAFSWAHN

SEQ ID NO: 589580 - protein, 9 aa, Homo Sapiens
RVGKEKAQA

SEQ ID NO: 589581 - protein, 9 aa, Homo Sapiens
KAAQKADAQ

SEQ ID NO: 589582 - protein, 9 aa, Homo Sapiens
GLKYWVIKG

SEQ ID NO: 589583 - protein, 9 aa, Homo Sapiens
PGAECLPPT

SEQ ID NO: 589584 - protein, 9 aa, Homo Sapiens
SVEDFKDHI

SEQ ID NO: 589585 - protein, 9 aa, Homo Sapiens
NTTSFPFSP

SEQ ID NO: 589586 - protein, 9 aa, Homo Sapiens
KHKLRYRKE

SEQ ID NO: 589587 - protein, 9 aa, Homo Sapiens
ALVETNCRE

SEQ ID NO: 589588 - protein, 9 aa, Homo Sapiens
EDSKSIKSV

SEQ ID NO: 589589 - protein, 9 aa, Homo Sapiens
GAECLPPTR

SEQ ID NO: 589590 - protein, 9 aa, Homo Sapiens
DSTEEKQLS

SEQ ID NO: 589591 - protein, 9 aa, Homo Sapiens
KGRPSRPAN

SEQ ID NO: 589592 - protein, 9 aa, Homo Sapiens
LDPSEINAN

SEQ ID NO: 589593 - protein, 9 aa, Homo Sapiens
PACEPSEPE

SEQ ID NO: 589594 - protein, 9 aa, Homo Sapiens
VCRQAPVER

SEQ ID NO: 589595 - protein, 9 aa, Homo Sapiens
DRLLQQHLA

SEQ ID NO: 589596 - protein, 9 aa, Homo Sapiens
PSAQLGEEV

SEQ ID NO: 589597 - protein, 9 aa, Homo Sapiens
ANYLDKYEP

SEQ ID NO: 589598 - protein, 9 aa, Homo Sapiens
GLVASCASA

SEQ ID NO: 589599 - protein, 9 aa, Homo Sapiens
KSPACEPSE

SEQ ID NO: 589600 - protein, 9 aa, Homo Sapiens
KFWLYFSQV

SEQ ID NO: 589601 - protein, 9 aa, Homo Sapiens
IRAFAERVG

SEQ ID NO: 589602 - protein, 9 aa, Homo Sapiens
SCPYSQELP

SEQ ID NO: 589603 - protein, 9 aa, Homo Sapiens
EVRSNSLGH

SEQ ID NO: 589604 - protein, 9 aa, Homo Sapiens
SPNTGDLQY

SEQ ID NO: 589605 - protein, 9 aa, Homo Sapiens
PSRPANKQS

SEQ ID NO: 589606 - protein, 9 aa, Homo Sapiens
SAQVRQTWS

SEQ ID NO: 589607 - protein, 9 aa, Homo Sapiens
CVHRWPSAQ

SEQ ID NO: 589608 - protein, 9 aa, Homo Sapiens
ALIVSGLSC

SEQ ID NO: 589609 - protein, 9 aa, Homo Sapiens
VFLYYEAGD

SEQ ID NO: 589610 - protein, 9 aa, Homo Sapiens
YATPPTGER

SEQ ID NO: 589611 - protein, 9 aa, Homo Sapiens
KDFLKSEKL

SEQ ID NO: 589612 - protein, 9 aa, Homo Sapiens
GKSFKQSSN

SEQ ID NO: 589613 - protein, 9 aa, Homo Sapiens
FTKQQLNNM

SEQ ID NO: 589614 - protein, 9 aa, Homo Sapiens
TNARQSKGE

SEQ ID NO: 589615 - protein, 9 aa, Homo Sapiens
LEADEETLE

SEQ ID NO: 589616 - protein, 9 aa, Homo Sapiens
VESNNRVNQ

SEQ ID NO: 589617 - protein, 9 aa, Homo Sapiens
QLDLEADEE

SEQ ID NO: 589618 - protein, 9 aa, Homo Sapiens
IIINSVFLA

SEQ ID NO: 589619 - protein, 9 aa, Homo Sapiens
VLWDWLRNS

SEQ ID NO: 589620 - protein, 9 aa, Homo Sapiens
TMSKYDSLD

SEQ ID NO: 589621 - protein, 9 aa, Homo Sapiens
ATSTCTEVR

SEQ ID NO: 589622 - protein, 9 aa, Homo Sapiens
RNQGYQLIR

SEQ ID NO: 589623 - protein, 9 aa, Homo Sapiens
PEKAKSPGR

SEQ ID NO: 589624 - protein, 9 aa, Homo Sapiens
ASCPYSQEL

SEQ ID NO: 589625 - protein, 9 aa, Homo Sapiens
DKVDGFFRR

SEQ ID NO: 589626 - protein, 9 aa, Homo Sapiens
LCRSNQQLQ

SEQ ID NO: 589627 - protein, 9 aa, Homo Sapiens
VSNTELYVI

SEQ ID NO: 589628 - protein, 9 aa, Homo Sapiens
QRIHTGGKP

SEQ ID NO: 589629 - protein, 9 aa, Homo Sapiens
AKSKNLLAW

SEQ ID NO: 589630 - protein, 9 aa, Homo Sapiens
VRGTFDIYV

SEQ ID NO: 589631 - protein, 9 aa, Homo Sapiens
QRTTHHRSS

SEQ ID NO: 589632 - protein, 9 aa, Homo Sapiens
CTFDYLAVY

SEQ ID NO: 589633 - protein, 9 aa, Homo Sapiens
SIPGLRPFP

SEQ ID NO: 589634 - protein, 9 aa, Homo Sapiens
GNMRAASPP

SEQ ID NO: 589635 - protein, 9 aa, Homo Sapiens
TDQTPAQEL

SEQ ID NO: 589636 - protein, 9 aa, Homo Sapiens
GINAAFSWA

SEQ ID NO: 589637 - protein, 9 aa, Homo Sapiens
SNPYDYAFV

SEQ ID NO: 589638 - protein, 9 aa, Homo Sapiens
LVETNCREV

SEQ ID NO: 589639 - protein, 9 aa, Homo Sapiens
GAELSYEER

SEQ ID NO: 589640 - protein, 9 aa, Homo Sapiens
EGGHVNVAF

SEQ ID NO: 589641 - protein, 9 aa, Homo Sapiens
ITKPVHSSI

SEQ ID NO: 589642 - protein, 9 aa, Homo Sapiens
VGLLRAALI

SEQ ID NO: 589643 - protein, 9 aa, Homo Sapiens
DSITKPVHS

SEQ ID NO: 589644 - protein, 9 aa, Homo Sapiens
YFYEEQIKT

SEQ ID NO: 589645 - protein, 9 aa, Homo Sapiens
QVRQTWSVL

SEQ ID NO: 589646 - protein, 9 aa, Homo Sapiens
QDVQAIWYF

SEQ ID NO: 589647 - protein, 9 aa, Homo Sapiens
PQIPAERDG

SEQ ID NO: 589648 - protein, 9 aa, Homo Sapiens
QIKEQEEEE

SEQ ID NO: 589649 - protein, 9 aa, Homo Sapiens
KHKKKGRPS

SEQ ID NO: 589650 - protein, 9 aa, Homo Sapiens
SPGRGKVTA

SEQ ID NO: 589651 - protein, 9 aa, Homo Sapiens
LVSSVEDFK

SEQ ID NO: 589652 - protein, 9 aa, Homo Sapiens
LALIVSGLS

SEQ ID NO: 589653 - protein, 9 aa, Homo Sapiens
HILVAVKCM

SEQ ID NO: 589654 - protein, 9 aa, Homo Sapiens
INSVFLAME

SEQ ID NO: 589655 - protein, 9 aa, Homo Sapiens
CVVRYFVAL

SEQ ID NO: 589656 - protein, 9 aa, Homo Sapiens
PHCLLLPAH

SEQ ID NO: 589657 - protein, 9 aa, Homo Sapiens
VSPFYLGAE

SEQ ID NO: 589658 - protein, 9 aa, Homo Sapiens
ARQSKGEEE

SEQ ID NO: 589659 - protein, 9 aa, Homo Sapiens
LAFMAFDRY

SEQ ID NO: 589660 - protein, 9 aa, Homo Sapiens
EEANKLTRQ

SEQ ID NO: 589661 - protein, 9 aa, Homo Sapiens
LYEEYARTS

SEQ ID NO: 589662 - protein, 9 aa, Homo Sapiens
QNFKLMWNI

SEQ ID NO: 589663 - protein, 9 aa, Homo Sapiens
VPGAECLPP

SEQ ID NO: 589664 - protein, 9 aa, Homo Sapiens
IMHLLYNFC

SEQ ID NO: 589665 - protein, 9 aa, Homo Sapiens
SECFSSLSL

SEQ ID NO: 589666 - protein, 9 aa, Homo Sapiens
IPLQLFFSG

SEQ ID NO: 589667 - protein, 9 aa, Homo Sapiens
SLPPGGINA

SEQ ID NO: 589668 - protein, 9 aa, Homo Sapiens
GNVATFCML

SEQ ID NO: 589669 - protein, 9 aa, Homo Sapiens
HQGTYRCIA

SEQ ID NO: 589670 - protein, 9 aa, Homo Sapiens
SVIADRFVS

SEQ ID NO: 589671 - protein, 9 aa, Homo Sapiens
IYPLIDKKK

SEQ ID NO: 589672 - protein, 9 aa, Homo Sapiens
RSPNTGDLQ

SEQ ID NO: 589673 - protein, 9 aa, Homo Sapiens
TLPGNFSDL

SEQ ID NO: 589674 - protein, 9 aa, Homo Sapiens
EALLQSDER

SEQ ID NO: 589675 - protein, 9 aa, Homo Sapiens
LLYNFCHSC

SEQ ID NO: 589676 - protein, 9 aa, Homo Sapiens
GEPSKLKRS

SEQ ID NO: 589677 - protein, 9 aa, Homo Sapiens
EVMIHPGLV

SEQ ID NO: 589678 - protein, 9 aa, Homo Sapiens
LQYVNQRNT

SEQ ID NO: 589679 - protein, 9 aa, Homo Sapiens
CLPPTRGLL

SEQ ID NO: 589680 - protein, 9 aa, Homo Sapiens
TQIQSVEPF

SEQ ID NO: 589681 - protein, 9 aa, Homo Sapiens
YARTSQEIQ

SEQ ID NO: 589682 - protein, 9 aa, Homo Sapiens
LRPFPGLDQ

SEQ ID NO: 589683 - protein, 9 aa, Homo Sapiens
WKVRRSAAK

SEQ ID NO: 589684 - protein, 9 aa, Homo Sapiens
VEGGHVNVA

SEQ ID NO: 589685 - protein, 9 aa, Homo Sapiens
DISAATPEK

SEQ ID NO: 589686 - protein, 9 aa, Homo Sapiens
PFLDDIPEE

SEQ ID NO: 589687 - protein, 9 aa, Homo Sapiens
GHVFFLSND

SEQ ID NO: 589688 - protein, 9 aa, Homo Sapiens
SVLDISAAT

SEQ ID NO: 589689 - protein, 9 aa, Homo Sapiens
GDNFYVIVR

SEQ ID NO: 589690 - protein, 9 aa, Homo Sapiens
DGYRSHGPL

SEQ ID NO: 589691 - protein, 9 aa, Homo Sapiens
LELAILHHQ

SEQ ID NO: 589692 - protein, 9 aa, Homo Sapiens
RRFTVTIIH

SEQ ID NO: 589693 - protein, 9 aa, Homo Sapiens
KKQEKEVKD

SEQ ID NO: 589694 - protein, 9 aa, Homo Sapiens
KDKFWLYFS

SEQ ID NO: 589695 - protein, 9 aa, Homo Sapiens
IQSVEPFTK

SEQ ID NO: 589696 - protein, 9 aa, Homo Sapiens
AFQNLIDYF

SEQ ID NO: 589697 - protein, 9 aa, Homo Sapiens
QTNARQSKG

SEQ ID NO: 589698 - protein, 9 aa, Homo Sapiens
NLDEDSITK

SEQ ID NO: 589699 - protein, 9 aa, Homo Sapiens
SMETALVTP

SEQ ID NO: 589700 - protein, 9 aa, Homo Sapiens
PPGGINAAF

SEQ ID NO: 589701 - protein, 9 aa, Homo Sapiens
ILGPIIRAL

SEQ ID NO: 589702 - protein, 9 aa, Homo Sapiens
KKVQSQVLT

SEQ ID NO: 589703 - protein, 9 aa, Homo Sapiens
PKDLPDILD

SEQ ID NO: 589704 - protein, 9 aa, Homo Sapiens
AGKSSFTVI

SEQ ID NO: 589705 - protein, 9 aa, Homo Sapiens
VTCELCWPE

SEQ ID NO: 589706 - protein, 9 aa, Homo Sapiens
SVFLAMEHH

SEQ ID NO: 589707 - protein, 9 aa, Homo Sapiens
HKKKGRPSR

SEQ ID NO: 589708 - protein, 9 aa, Homo Sapiens
SCASAPAPG

SEQ ID NO: 589709 - protein, 9 aa, Homo Sapiens
SALQGLVAS

SEQ ID NO: 589710 - protein, 9 aa, Homo Sapiens
GHVNVAFSQ

SEQ ID NO: 589711 - protein, 9 aa, Homo Sapiens
NPIYPLIDK

SEQ ID NO: 589712 - protein, 9 aa, Homo Sapiens
YYEAGDVSF

SEQ ID NO: 589713 - protein, 9 aa, Homo Sapiens
HLKGNNPYP

SEQ ID NO: 589714 - protein, 9 aa, Homo Sapiens
CQLEFTKKT

SEQ ID NO: 589715 - protein, 9 aa, Homo Sapiens
PGGINAAFS

SEQ ID NO: 589716 - protein, 9 aa, Homo Sapiens
PSAQVRQTW

SEQ ID NO: 589717 - protein, 9 aa, Homo Sapiens
SWKVRRSAA

SEQ ID NO: 589718 - protein, 9 aa, Homo Sapiens
VLVVTRTKH

SEQ ID NO: 589719 - protein, 9 aa, Homo Sapiens
ISAATPEKQ

SEQ ID NO: 589720 - protein, 9 aa, Homo Sapiens
WQGCSAKSK

SEQ ID NO: 589721 - protein, 9 aa, Homo Sapiens
GCSAKSKNL

SEQ ID NO: 589722 - protein, 9 aa, Homo Sapiens
TQNFKLMWN

SEQ ID NO: 589723 - protein, 9 aa, Homo Sapiens
DIPPFLDDI

SEQ ID NO: 589724 - protein, 9 aa, Homo Sapiens
LVIIIIKPK

SEQ ID NO: 589725 - protein, 9 aa, Homo Sapiens
QHQGTYRCI

SEQ ID NO: 589726 - protein, 9 aa, Homo Sapiens
GLRTDFDLN

SEQ ID NO: 589727 - protein, 9 aa, Homo Sapiens
AREQTDQTP

SEQ ID NO: 589728 - protein, 9 aa, Homo Sapiens
ILLAFMAFD

SEQ ID NO: 589729 - protein, 9 aa, Homo Sapiens
ELVKLGHVF

SEQ ID NO: 589730 - protein, 9 aa, Homo Sapiens
AAGTCDHFT

SEQ ID NO: 589731 - protein, 9 aa, Homo Sapiens
IGFASCVVR

SEQ ID NO: 589732 - protein, 9 aa, Homo Sapiens
EALVETNCR

SEQ ID NO: 589733 - protein, 9 aa, Homo Sapiens
FSNLPENEC

SEQ ID NO: 589734 - protein, 9 aa, Homo Sapiens
MKLFFEMKP

SEQ ID NO: 589735 - protein, 9 aa, Homo Sapiens
VMFLLCAVK

SEQ ID NO: 589736 - protein, 9 aa, Homo Sapiens
ARHILVAVK

SEQ ID NO: 589737 - protein, 9 aa, Homo Sapiens
AVTQGGWRS

SEQ ID NO: 589738 - protein, 9 aa, Homo Sapiens
TREIIFRNM

SEQ ID NO: 589739 - protein, 9 aa, Homo Sapiens
RDLLHWKAH

SEQ ID NO: 589740 - protein, 9 aa, Homo Sapiens
HTGGKPYVC

SEQ ID NO: 589741 - protein, 9 aa, Homo Sapiens
TRTKHMRTP

SEQ ID NO: 589742 - protein, 9 aa, Homo Sapiens
QAIWYFGSA

SEQ ID NO: 589743 - protein, 9 aa, Homo Sapiens
KPYKCGLCG

SEQ ID NO: 589744 - protein, 9 aa, Homo Sapiens
ILHHQTLYE

SEQ ID NO: 589745 - protein, 9 aa, Homo Sapiens
TICIIINSV

SEQ ID NO: 589746 - protein, 9 aa, Homo Sapiens
ANPHAEGQL

SEQ ID NO: 589747 - protein, 9 aa, Homo Sapiens
EANKLTRQW

SEQ ID NO: 589748 - protein, 9 aa, Homo Sapiens
SSAEPTENR

SEQ ID NO: 589749 - protein, 9 aa, Homo Sapiens
RTDFDLNVI

SEQ ID NO: 589750 - protein, 9 aa, Homo Sapiens
LERKLYGYL

SEQ ID NO: 589751 - protein, 9 aa, Homo Sapiens
GPEAHKGPP

SEQ ID NO: 589752 - protein, 9 aa, Homo Sapiens
AIWYFGSAQ

SEQ ID NO: 589753 - protein, 9 aa, Homo Sapiens
RQHQGTYRC

SEQ ID NO: 589754 - protein, 9 aa, Homo Sapiens
FFEMKPLLR

SEQ ID NO: 589755 - protein, 9 aa, Homo Sapiens
SYWASELVL

SEQ ID NO: 589756 - protein, 9 aa, Homo Sapiens
TCTEVRSNS

SEQ ID NO: 589757 - protein, 9 aa, Homo Sapiens
AAQTSLTIS

SEQ ID NO: 589758 - protein, 9 aa, Homo Sapiens
GNNPYPKSY

SEQ ID NO: 589759 - protein, 9 aa, Homo Sapiens
SITKPVHSS

SEQ ID NO: 589760 - protein, 9 aa, Homo Sapiens
CQRLENAVK

SEQ ID NO: 589761 - protein, 9 aa, Homo Sapiens
PHFLVIFQW

SEQ ID NO: 589762 - protein, 9 aa, Homo Sapiens
RSNSLGHLV

SEQ ID NO: 589763 - protein, 9 aa, Homo Sapiens
TKKVQSQVL

SEQ ID NO: 589764 - protein, 9 aa, Homo Sapiens
NENNTPSSA

SEQ ID NO: 589765 - protein, 9 aa, Homo Sapiens
QIQSVEPFT

SEQ ID NO: 589766 - protein, 9 aa, Homo Sapiens
AQVRQTWSV

SEQ ID NO: 589767 - protein, 9 aa, Homo Sapiens
TAYRSPNTG

SEQ ID NO: 589768 - protein, 9 aa, Homo Sapiens
LIVSGLSCV

SEQ ID NO: 589769 - protein, 9 aa, Homo Sapiens
CLLLPAHTL

SEQ ID NO: 589770 - protein, 9 aa, Homo Sapiens
PYATPPTGE

SEQ ID NO: 589771 - protein, 9 aa, Homo Sapiens
CHKSYRPLC

SEQ ID NO: 589772 - protein, 9 aa, Homo Sapiens
LCTSVSPFY

SEQ ID NO: 589773 - protein, 9 aa, Homo Sapiens
FDLNVISLK

SEQ ID NO: 589774 - protein, 9 aa, Homo Sapiens
KKKGPNAYS

SEQ ID NO: 589775 - protein, 9 aa, Homo Sapiens
THWYHRLPV

SEQ ID NO: 589776 - protein, 9 aa, Homo Sapiens
RMKQEEEAN

SEQ ID NO: 589777 - protein, 9 aa, Homo Sapiens
EERNTTSFP

SEQ ID NO: 589778 - protein, 9 aa, Homo Sapiens
PAERDGEPS

SEQ ID NO: 589779 - protein, 9 aa, Homo Sapiens
WHCPQASPG

SEQ ID NO: 589780 - protein, 9 aa, Homo Sapiens
FPFELVKMD

SEQ ID NO: 589781 - protein, 9 aa, Homo Sapiens
KILVHSVFS

SEQ ID NO: 589782 - protein, 9 aa, Homo Sapiens
QLGEEVLRQ

SEQ ID NO: 589783 - protein, 9 aa, Homo Sapiens
DLVTVIPLL

SEQ ID NO: 589784 - protein, 9 aa, Homo Sapiens
SQGPDSTEE

SEQ ID NO: 589785 - protein, 9 aa, Homo Sapiens
LLDLTSYIA

SEQ ID NO: 589786 - protein, 9 aa, Homo Sapiens
VKLGHVFFL

SEQ ID NO: 589787 - protein, 9 aa, Homo Sapiens
TEVRSNSLG

SEQ ID NO: 589788 - protein, 9 aa, Homo Sapiens
RQKCPPSWY

SEQ ID NO: 589789 - protein, 9 aa, Homo Sapiens
TEQGAELSY

SEQ ID NO: 589790 - protein, 9 aa, Homo Sapiens
DILDKQNQM

SEQ ID NO: 589791 - protein, 9 aa, Homo Sapiens
EKRRKKPTH

SEQ ID NO: 589792 - protein, 9 aa, Homo Sapiens
FITLQNVSA

SEQ ID NO: 589793 - protein, 9 aa, Homo Sapiens
REYCSMIIE

SEQ ID NO: 589794 - protein, 9 aa, Homo Sapiens
NQRNTRDLL

SEQ ID NO: 589795 - protein, 9 aa, Homo Sapiens
LKQIKEQEE

SEQ ID NO: 589796 - protein, 9 aa, Homo Sapiens
LVIFQWHQL

SEQ ID NO: 589797 - protein, 9 aa, Homo Sapiens
RWSDLPKDK

SEQ ID NO: 589798 - protein, 9 aa, Homo Sapiens
SPEDLEALL

SEQ ID NO: 589799 - protein, 9 aa, Homo Sapiens
QVTQLVSQD

SEQ ID NO: 589800 - protein, 9 aa, Homo Sapiens
GDLQYVNQR

SEQ ID NO: 589801 - protein, 9 aa, Homo Sapiens
IKEQEEEEE

SEQ ID NO: 589802 - protein, 9 aa, Homo Sapiens
NCTFDYLAV

SEQ ID NO: 589803 - protein, 9 aa, Homo Sapiens
RTLLLYLSQ

SEQ ID NO: 589804 - protein, 9 aa, Homo Sapiens
KILRTLLLY

SEQ ID NO: 589805 - protein, 9 aa, Homo Sapiens
AVGLLRAAL

SEQ ID NO: 589806 - protein, 9 aa, Homo Sapiens
VNQRNTRDL

SEQ ID NO: 589807 - protein, 9 aa, Homo Sapiens
FPGLDQMSF

SEQ ID NO: 589808 - protein, 9 aa, Homo Sapiens
CDFITLQNV

SEQ ID NO: 589809 - protein, 9 aa, Homo Sapiens
LLRAALILR

SEQ ID NO: 589810 - protein, 9 aa, Homo Sapiens
DHLKQIKEQ

SEQ ID NO: 589811 - protein, 9 aa, Homo Sapiens
GYLAQHYVC

SEQ ID NO: 589812 - protein, 9 aa, Homo Sapiens
ALHQDVQAI

SEQ ID NO: 589813 - protein, 9 aa, Homo Sapiens
MDFDEKDLR

SEQ ID NO: 589814 - protein, 9 aa, Homo Sapiens
DPASTMSKY

SEQ ID NO: 589815 - protein, 9 aa, Homo Sapiens
PNDIPPFLD

SEQ ID NO: 589816 - protein, 9 aa, Homo Sapiens
GSPCQRLEN

SEQ ID NO: 589817 - protein, 9 aa, Homo Sapiens
GDLLAVGLL

SEQ ID NO: 589818 - protein, 9 aa, Homo Sapiens
PIYPLIDKK

SEQ ID NO: 589819 - protein, 9 aa, Homo Sapiens
PGMLMLTED

SEQ ID NO: 589820 - protein, 9 aa, Homo Sapiens
LDIAFETRE

SEQ ID NO: 589821 - protein, 9 aa, Homo Sapiens
KVTSDHINL

SEQ ID NO: 589822 - protein, 9 aa, Homo Sapiens
EEERNTTSF

SEQ ID NO: 589823 - protein, 9 aa, Homo Sapiens
RCQYCRLQS

SEQ ID NO: 589824 - protein, 9 aa, Homo Sapiens
LVHSVFSML

SEQ ID NO: 589825 - protein, 9 aa, Homo Sapiens
QGPDSTEEK

SEQ ID NO: 589826 - protein, 9 aa, Homo Sapiens
LIFVTDTAK

SEQ ID NO: 589827 - protein, 9 aa, Homo Sapiens
VYSVTCELC

SEQ ID NO: 589828 - protein, 9 aa, Homo Sapiens
DALVRHTSQ

SEQ ID NO: 589829 - protein, 9 aa, Homo Sapiens
VINHHSSCN

SEQ ID NO: 589830 - protein, 9 aa, Homo Sapiens
DLNVISLKE

SEQ ID NO: 589831 - protein, 9 aa, Homo Sapiens
NRLEQLTLE

SEQ ID NO: 589832 - protein, 9 aa, Homo Sapiens
KCYTHPCSL

SEQ ID NO: 589833 - protein, 9 aa, Homo Sapiens
SIKILVHSV

SEQ ID NO: 589834 - protein, 9 aa, Homo Sapiens
TLEDNEEKM

SEQ ID NO: 589835 - protein, 9 aa, Homo Sapiens
SSLSLGRIK

SEQ ID NO: 589836 - protein, 9 aa, Homo Sapiens
VKMDFDEKD

SEQ ID NO: 589837 - protein, 9 aa, Homo Sapiens
NSREYCSMI

SEQ ID NO: 589838 - protein, 9 aa, Homo Sapiens
LNRLEQLTL

SEQ ID NO: 589839 - protein, 9 aa, Homo Sapiens
QGIQRRFTV

SEQ ID NO: 589840 - protein, 9 aa, Homo Sapiens
AQLGEEVLR

SEQ ID NO: 589841 - protein, 9 aa, Homo Sapiens
YDICDVDCH

SEQ ID NO: 589842 - protein, 9 aa, Homo Sapiens
NTPSSAEPT

SEQ ID NO: 589843 - protein, 9 aa, Homo Sapiens
VLAQQQQHK

SEQ ID NO: 589844 - protein, 9 aa, Homo Sapiens
SEQVLWDWL

SEQ ID NO: 589845 - protein, 9 aa, Homo Sapiens
HWHCPQASP

SEQ ID NO: 589846 - protein, 9 aa, Homo Sapiens
VIGNMRAAS

SEQ ID NO: 589847 - protein, 9 aa, Homo Sapiens
LSPEEDLIF

SEQ ID NO: 589848 - protein, 9 aa, Homo Sapiens
SYEERNLLS

SEQ ID NO: 589849 - protein, 9 aa, Homo Sapiens
AKTLAFAGL

SEQ ID NO: 589850 - protein, 9 aa, Homo Sapiens
GAAAVMFLL

SEQ ID NO: 589851 - protein, 9 aa, Homo Sapiens
EPYSEQVLW

SEQ ID NO: 589852 - protein, 9 aa, Homo Sapiens
PVERNYHIF

SEQ ID NO: 589853 - protein, 9 aa, Homo Sapiens
FQAFLVIYL

SEQ ID NO: 589854 - protein, 9 aa, Homo Sapiens
QGLVASCAS

SEQ ID NO: 589855 - protein, 9 aa, Homo Sapiens
DTHGCRFIV

SEQ ID NO: 589856 - protein, 9 aa, Homo Sapiens
DGFLCTSVS

SEQ ID NO: 589857 - protein, 9 aa, Homo Sapiens
CTEVRSNSL

SEQ ID NO: 589858 - protein, 9 aa, Homo Sapiens
VDGFFRRSL

SEQ ID NO: 589859 - protein, 9 aa, Homo Sapiens
PLDIAFETR

SEQ ID NO: 589860 - protein, 9 aa, Homo Sapiens
PQCDFITLQ

SEQ ID NO: 589861 - protein, 9 aa, Homo Sapiens
LNERAALLP

SEQ ID NO: 589862 - protein, 9 aa, Homo Sapiens
LYVIFTCLG

SEQ ID NO: 589863 - protein, 9 aa, Homo Sapiens
SLTISAFQA

SEQ ID NO: 589864 - protein, 9 aa, Homo Sapiens
GRRNPIYPL

SEQ ID NO: 589865 - protein, 9 aa, Homo Sapiens
RSSSVSPHR

SEQ ID NO: 589866 - protein, 9 aa, Homo Sapiens
TPEPYSEQV

SEQ ID NO: 589867 - protein, 9 aa, Homo Sapiens
KVRRSAAKC

SEQ ID NO: 589868 - protein, 9 aa, Homo Sapiens
LVKLGHVFF

SEQ ID NO: 589869 - protein, 9 aa, Homo Sapiens
KEVKDFRKK

SEQ ID NO: 589870 - protein, 9 aa, Homo Sapiens
AGLKYWVIK

SEQ ID NO: 589871 - protein, 9 aa, Homo Sapiens
GTVAWQAKS

SEQ ID NO: 589872 - protein, 9 aa, Homo Sapiens
PNSSVSGDI

SEQ ID NO: 589873 - protein, 9 aa, Homo Sapiens
VAAQTSLTI

SEQ ID NO: 589874 - protein, 9 aa, Homo Sapiens
ILREDASHQ

SEQ ID NO: 589875 - protein, 9 aa, Homo Sapiens
SGLSCVLCK

SEQ ID NO: 589876 - protein, 9 aa, Homo Sapiens
GLCGKLFTS

SEQ ID NO: 589877 - protein, 9 aa, Homo Sapiens
SPCQRLENA

SEQ ID NO: 589878 - protein, 9 aa, Homo Sapiens
GGHVNVAFS

SEQ ID NO: 589879 - protein, 9 aa, Homo Sapiens
VRSNSLGHL

SEQ ID NO: 589880 - protein, 9 aa, Homo Sapiens
SWYKFSNIF

SEQ ID NO: 589881 - protein, 9 aa, Homo Sapiens
EFCYSMETA

SEQ ID NO: 589882 - protein, 9 aa, Homo Sapiens
VKMDFKELL

SEQ ID NO: 589883 - protein, 9 aa, Homo Sapiens
SVEPFTKQQ

SEQ ID NO: 589884 - protein, 9 aa, Homo Sapiens
IEFEQQERL

SEQ ID NO: 589885 - protein, 9 aa, Homo Sapiens
KEQEEEEER

SEQ ID NO: 589886 - protein, 9 aa, Homo Sapiens
LQGLVASCA

SEQ ID NO: 589887 - protein, 9 aa, Homo Sapiens
KCPPSWYKF

SEQ ID NO: 589888 - protein, 9 aa, Homo Sapiens
QLQVMLTMH

SEQ ID NO: 589889 - protein, 9 aa, Homo Sapiens
YSMETALVT

SEQ ID NO: 589890 - protein, 9 aa, Homo Sapiens
ASLQDNEGA

SEQ ID NO: 589891 - protein, 9 aa, Homo Sapiens
EKMSRLSKV

SEQ ID NO: 589892 - protein, 9 aa, Homo Sapiens
ASKHKLRYR

SEQ ID NO: 589893 - protein, 9 aa, Homo Sapiens
LVLDRGHLD

SEQ ID NO: 589894 - protein, 9 aa, Homo Sapiens
CTEYILLAF

SEQ ID NO: 589895 - protein, 9 aa, Homo Sapiens
DFDEKDLRR

SEQ ID NO: 589896 - protein, 9 aa, Homo Sapiens
AQQCLSLWG

SEQ ID NO: 589897 - protein, 9 aa, Homo Sapiens
DLIFVTDTA

SEQ ID NO: 589898 - protein, 9 aa, Homo Sapiens
CQWSEVMIH

SEQ ID NO: 589899 - protein, 9 aa, Homo Sapiens
SIAGMAIPL

SEQ ID NO: 589900 - protein, 9 aa, Homo Sapiens
VRYFVALYY

SEQ ID NO: 589901 - protein, 9 aa, Homo Sapiens
VTRTKHMRT

SEQ ID NO: 589902 - protein, 9 aa, Homo Sapiens
LRGKSGDAC

SEQ ID NO: 589903 - protein, 9 aa, Homo Sapiens
KTMGNVATF

SEQ ID NO: 589904 - protein, 9 aa, Homo Sapiens
RKLYGYLAQ

SEQ ID NO: 589905 - protein, 9 aa, Homo Sapiens
RGLDIKLEE

SEQ ID NO: 589906 - protein, 9 aa, Homo Sapiens
TCELCWPES

SEQ ID NO: 589907 - protein, 9 aa, Homo Sapiens
ELMQQLDLE

SEQ ID NO: 589908 - protein, 9 aa, Homo Sapiens
HSVVVPCEP

SEQ ID NO: 589909 - protein, 9 aa, Homo Sapiens
YCKNDLWVV

SEQ ID NO: 589910 - protein, 9 aa, Homo Sapiens
FKELLQVDP

SEQ ID NO: 589911 - protein, 9 aa, Homo Sapiens
PKGSKEVQR

SEQ ID NO: 589912 - protein, 9 aa, Homo Sapiens
HVIEQTNAR

SEQ ID NO: 589913 - protein, 9 aa, Homo Sapiens
RIPLGGLFT

SEQ ID NO: 589914 - protein, 9 aa, Homo Sapiens
FSLYLVLDR

SEQ ID NO: 589915 - protein, 9 aa, Homo Sapiens
MGNVATFCM

SEQ ID NO: 589916 - protein, 9 aa, Homo Sapiens
LYLSQYDCV

SEQ ID NO: 589917 - protein, 9 aa, Homo Sapiens
LGALDVQEL

SEQ ID NO: 589918 - protein, 9 aa, Homo Sapiens
CGLCGKLFT

SEQ ID NO: 589919 - protein, 9 aa, Homo Sapiens
RLLQQHLAK

SEQ ID NO: 589920 - protein, 9 aa, Homo Sapiens
RVTPGMLML

SEQ ID NO: 589921 - protein, 9 aa, Homo Sapiens
SVVPVYLKR

SEQ ID NO: 589922 - protein, 9 aa, Homo Sapiens
MTQNFKLMW

SEQ ID NO: 589923 - protein, 9 aa, Homo Sapiens
HVNVAFSQS

SEQ ID NO: 589924 - protein, 9 aa, Homo Sapiens
SSVEDFKDH

SEQ ID NO: 589925 - protein, 9 aa, Homo Sapiens
RSEGERMVV

SEQ ID NO: 589926 - protein, 9 aa, Homo Sapiens
KLMWNILLF

SEQ ID NO: 589927 - protein, 9 aa, Homo Sapiens
GPIIRALVR

SEQ ID NO: 589928 - protein, 9 aa, Homo Sapiens
CVRTAVTQG

SEQ ID NO: 589929 - protein, 9 aa, Homo Sapiens
LAQHYVCMK

SEQ ID NO: 589930 - protein, 9 aa, Homo Sapiens
MLMLTEDFF

SEQ ID NO: 589931 - protein, 9 aa, Homo Sapiens
SYGCCECGK

SEQ ID NO: 589932 - protein, 9 aa, Homo Sapiens
TTHHRSSSV

SEQ ID NO: 589933 - protein, 9 aa, Homo Sapiens
PSWYKFSNI

SEQ ID NO: 589934 - protein, 9 aa, Homo Sapiens
TQSEHSSEH

SEQ ID NO: 589935 - protein, 9 aa, Homo Sapiens
IQSNRRHYR

SEQ ID NO: 589936 - protein, 9 aa, Homo Sapiens
QSCIAFGMK

SEQ ID NO: 589937 - protein, 9 aa, Homo Sapiens
LIEMLLITS

SEQ ID NO: 589938 - protein, 9 aa, Homo Sapiens
FKYLQCQLE

SEQ ID NO: 589939 - protein, 9 aa, Homo Sapiens
QQHLAKLEE

SEQ ID NO: 589940 - protein, 9 aa, Homo Sapiens
ANKLTRQWS

SEQ ID NO: 589941 - protein, 9 aa, Homo Sapiens
AFMAFDRYV

SEQ ID NO: 589942 - protein, 9 aa, Homo Sapiens
RSSAYCKND

SEQ ID NO: 589943 - protein, 9 aa, Homo Sapiens
WSEVMIHPG

SEQ ID NO: 589944 - protein, 9 aa, Homo Sapiens
LPGNFSDLS

SEQ ID NO: 589945 - protein, 9 aa, Homo Sapiens
RYFVALYYN

SEQ ID NO: 589946 - protein, 9 aa, Homo Sapiens
ECGKSFKQS

SEQ ID NO: 589947 - protein, 9 aa, Homo Sapiens
VVSSGSRVC

SEQ ID NO: 589948 - protein, 9 aa, Homo Sapiens
KERSSAYCK

SEQ ID NO: 589949 - protein, 9 aa, Homo Sapiens
SKSEGSPCQ

SEQ ID NO: 589950 - protein, 9 aa, Homo Sapiens
HDHVGHGRS

SEQ ID NO: 589951 - protein, 9 aa, Homo Sapiens
CKNDLWVVS

SEQ ID NO: 589952 - protein, 9 aa, Homo Sapiens
TSIPGLRPF

SEQ ID NO: 589953 - protein, 9 aa, Homo Sapiens
GASKHKLRY

SEQ ID NO: 589954 - protein, 9 aa, Homo Sapiens
NQGYQLIRS

SEQ ID NO: 589955 - protein, 9 aa, Homo Sapiens
KDLPDILDK

SEQ ID NO: 589956 - protein, 9 aa, Homo Sapiens
GACVRTAVT

SEQ ID NO: 589957 - protein, 9 aa, Homo Sapiens
GVVSSGSRV

SEQ ID NO: 589958 - protein, 9 aa, Homo Sapiens
SFTVIAEEL

SEQ ID NO: 589959 - protein, 9 aa, Homo Sapiens
GVIPQGRDS

SEQ ID NO: 589960 - protein, 9 aa, Homo Sapiens
VSPEDLEAL

SEQ ID NO: 589961 - protein, 9 aa, Homo Sapiens
VLEGVVSSG

SEQ ID NO: 589962 - protein, 9 aa, Homo Sapiens
VNVAFSQSN

SEQ ID NO: 589963 - protein, 9 aa, Homo Sapiens
ELPGAIGLD

SEQ ID NO: 589964 - protein, 9 aa, Homo Sapiens
REFCYSMET

SEQ ID NO: 589965 - protein, 9 aa, Homo Sapiens
LVGSSPHLQ

SEQ ID NO: 589966 - protein, 9 aa, Homo Sapiens
AYRSPNTGD

SEQ ID NO: 589967 - protein, 9 aa, Homo Sapiens
ESNNRVNQT

SEQ ID NO: 589968 - protein, 9 aa, Homo Sapiens
SVFSMLIMC

SEQ ID NO: 589969 - protein, 9 aa, Homo Sapiens
NFCHSCDAG

SEQ ID NO: 589970 - protein, 9 aa, Homo Sapiens
ELCWPESGE

SEQ ID NO: 589971 - protein, 9 aa, Homo Sapiens
SFRHDGYRS

SEQ ID NO: 589972 - protein, 9 aa, Homo Sapiens
KVQSQVLTQ

SEQ ID NO: 589973 - protein, 9 aa, Homo Sapiens
CYSMETALV

SEQ ID NO: 589974 - protein, 9 aa, Homo Sapiens
GMAIPLQLF

SEQ ID NO: 589975 - protein, 9 aa, Homo Sapiens
LNVISLKEE

SEQ ID NO: 589976 - protein, 9 aa, Homo Sapiens
LDISAATPE

SEQ ID NO: 589977 - protein, 9 aa, Homo Sapiens
QELSLGVLA

SEQ ID NO: 589978 - protein, 9 aa, Homo Sapiens
LVVLMKTMG

SEQ ID NO: 589979 - protein, 9 aa, Homo Sapiens
KSEGSPCQR

SEQ ID NO: 589980 - protein, 9 aa, Homo Sapiens
QHLAKLEEA

SEQ ID NO: 589981 - protein, 9 aa, Homo Sapiens
QIPAERDGE

SEQ ID NO: 589982 - protein, 9 aa, Homo Sapiens
AYCKNDLWV

SEQ ID NO: 589983 - protein, 9 aa, Homo Sapiens
YEALVETNC

SEQ ID NO: 589984 - protein, 9 aa, Homo Sapiens
TISAFQAES

SEQ ID NO: 589985 - protein, 9 aa, Homo Sapiens
LVVTRTKHM

SEQ ID NO: 589986 - protein, 9 aa, Homo Sapiens
SQVTQLVSQ

SEQ ID NO: 589987 - protein, 9 aa, Homo Sapiens
FSDLSKPIG

SEQ ID NO: 589988 - protein, 9 aa, Homo Sapiens
PPSWYKFSN

SEQ ID NO: 589989 - protein, 9 aa, Homo Sapiens
LPKDKFWLY

SEQ ID NO: 589990 - protein, 8 aa, Homo Sapiens
EAVVLPWQ

SEQ ID NO: 589991 - protein, 9 aa, Homo Sapiens
ERSSAYCKN

SEQ ID NO: 589992 - protein, 9 aa, Homo Sapiens
ASCASAPAP

SEQ ID NO: 589993 - protein, 9 aa, Homo Sapiens
LVLAQQQQH

SEQ ID NO: 589994 - protein, 9 aa, Homo Sapiens
FQNLIDYFY

SEQ ID NO: 589995 - protein, 9 aa, Homo Sapiens
SKHKLRYRK

SEQ ID NO: 589996 - protein, 9 aa, Homo Sapiens
LYYEAGDVS

SEQ ID NO: 589997 - protein, 9 aa, Homo Sapiens
NVAFSQSNP

SEQ ID NO: 589998 - protein, 9 aa, Homo Sapiens
SRVCRQAPV

SEQ ID NO: 589999 - protein, 9 aa, Homo Sapiens
FETREIIFR

SEQ ID NO: 590000 - protein, 9 aa, Homo Sapiens
KNSKVTQSE

SEQ ID NO: 590001 - protein, 9 aa, Homo Sapiens
DLRGKSGDA

SEQ ID NO: 590002 - protein, 9 aa, Homo Sapiens
PASTMSKYD

SEQ ID NO: 590003 - protein, 9 aa, Homo Sapiens
ILFAFTMRV

SEQ ID NO: 590004 - protein, 9 aa, Homo Sapiens
SDLVTVIPL

SEQ ID NO: 590005 - protein, 9 aa, Homo Sapiens
FYDICDVDC

SEQ ID NO: 590006 - protein, 9 aa, Homo Sapiens
TLLLYLSQY

SEQ ID NO: 590007 - protein, 9 aa, Homo Sapiens
WPSAQVRQT

SEQ ID NO: 590008 - protein, 9 aa, Homo Sapiens
HKLRYRKEV

SEQ ID NO: 590009 - protein, 9 aa, Homo Sapiens
LLYLSQYDC

SEQ ID NO: 590010 - protein, 9 aa, Homo Sapiens
RNTRDLLHW

SEQ ID NO: 590011 - protein, 9 aa, Homo Sapiens
KGSQIEFEQ

SEQ ID NO: 590012 - protein, 9 aa, Homo Sapiens
TNTHWYHRL

SEQ ID NO: 590013 - protein, 9 aa, Homo Sapiens
AHDHVGHGR

SEQ ID NO: 590014 - protein, 9 aa, Homo Sapiens
GHFYDICDV

SEQ ID NO: 590015 - protein, 9 aa, Homo Sapiens
CASYAQQCL

SEQ ID NO: 590016 - protein, 9 aa, Homo Sapiens
LHQDVQAIW

SEQ ID NO: 590017 - protein, 9 aa, Homo Sapiens
ELYVIFTCL

SEQ ID NO: 590018 - protein, 9 aa, Homo Sapiens
PKSPACEPS

SEQ ID NO: 590019 - protein, 9 aa, Homo Sapiens
RFTGVIPQG

SEQ ID NO: 590020 - protein, 9 aa, Homo Sapiens
PNCTFDYLA

SEQ ID NO: 590021 - protein, 9 aa, Homo Sapiens
LKILRTLLL

SEQ ID NO: 590022 - protein, 9 aa, Homo Sapiens
KLFFEMKPL

SEQ ID NO: 590023 - protein, 9 aa, Homo Sapiens
LSVLDISAA

SEQ ID NO: 590024 - protein, 9 aa, Homo Sapiens
CEPPEVGSD

SEQ ID NO: 590025 - protein, 9 aa, Homo Sapiens
KMDFDEKDL

SEQ ID NO: 590026 - protein, 9 aa, Homo Sapiens
LSYEERNLL

SEQ ID NO: 590027 - protein, 9 aa, Homo Sapiens
SGLGRITES

SEQ ID NO: 590028 - protein, 9 aa, Homo Sapiens
PEAHKGPPA

SEQ ID NO: 590029 - protein, 9 aa, Homo Sapiens
FKAGTVAWQ

SEQ ID NO: 590030 - protein, 9 aa, Homo Sapiens
VIADRFVSS

SEQ ID NO: 590031 - protein, 9 aa, Homo Sapiens
KVMLICDID

SEQ ID NO: 590032 - protein, 9 aa, Homo Sapiens
AALLPRNTA

SEQ ID NO: 590033 - protein, 9 aa, Homo Sapiens
SWMKLFFEM

SEQ ID NO: 590034 - protein, 9 aa, Homo Sapiens
GYQLIRSMI

SEQ ID NO: 590035 - protein, 9 aa, Homo Sapiens
KLSVGPLRF

SEQ ID NO: 590036 - protein, 9 aa, Homo Sapiens
KMDFKELLQ

SEQ ID NO: 590037 - protein, 9 aa, Homo Sapiens
LGRITESTS

SEQ ID NO: 590038 - protein, 9 aa, Homo Sapiens
TFDYLAVYD

SEQ ID NO: 590039 - protein, 9 aa, Homo Sapiens
NLIDYFYEE

SEQ ID NO: 590040 - protein, 9 aa, Homo Sapiens
NRRHYRDKH

SEQ ID NO: 590041 - protein, 9 aa, Homo Sapiens
PLLPSYCSS

SEQ ID NO: 590042 - protein, 9 aa, Homo Sapiens
SEGSPCQRL

SEQ ID NO: 590043 - protein, 9 aa, Homo Sapiens
ALVRHTSQV

SEQ ID NO: 590044 - protein, 9 aa, Homo Sapiens
YSEQVLWDW

SEQ ID NO: 590045 - protein, 9 aa, Homo Sapiens
LPKGSKEVQ

SEQ ID NO: 590046 - protein, 9 aa, Homo Sapiens
CDVDCHGSC

SEQ ID NO: 590047 - protein, 9 aa, Homo Sapiens
RWPSAQVRQ

SEQ ID NO: 590048 - protein, 9 aa, Homo Sapiens
VERNYHIFY

SEQ ID NO: 590049 - protein, 9 aa, Homo Sapiens
YVNQRNTRD

SEQ ID NO: 590050 - protein, 9 aa, Homo Sapiens
RYRKEVEIT

SEQ ID NO: 590051 - protein, 9 aa, Homo Sapiens
QRCPQCDFI

SEQ ID NO: 590052 - protein, 9 aa, Homo Sapiens
AITKKVQSQ

SEQ ID NO: 590053 - protein, 9 aa, Homo Sapiens
TELYVIFTC

SEQ ID NO: 590054 - protein, 9 aa, Homo Sapiens
ACVRTAVTQ

SEQ ID NO: 590055 - protein, 9 aa, Homo Sapiens
DSKSIKSVV

SEQ ID NO: 590056 - protein, 9 aa, Homo Sapiens
KQEKEVKDF

SEQ ID NO: 590057 - protein, 9 aa, Homo Sapiens
LLLYLSQYD

SEQ ID NO: 590058 - protein, 9 aa, Homo Sapiens
VSKAMTAYW

SEQ ID NO: 590059 - protein, 9 aa, Homo Sapiens
QKCPPSWYK

SEQ ID NO: 590060 - protein, 9 aa, Homo Sapiens
QGYQLIRSM

SEQ ID NO: 590061 - protein, 9 aa, Homo Sapiens
CDIDGDGCR

SEQ ID NO: 590062 - protein, 9 aa, Homo Sapiens
SQELPGAIG

SEQ ID NO: 590063 - protein, 9 aa, Homo Sapiens
VVVPCEPPE

SEQ ID NO: 590064 - protein, 9 aa, Homo Sapiens
TGDLQYVNQ

SEQ ID NO: 590065 - protein, 9 aa, Homo Sapiens
LPNDIPPFL

SEQ ID NO: 590066 - protein, 9 aa, Homo Sapiens
IPGLRPFPG

SEQ ID NO: 590067 - protein, 9 aa, Homo Sapiens
FTGVIPQGR

SEQ ID NO: 590068 - protein, 9 aa, Homo Sapiens
ILVAVKCML

SEQ ID NO: 590069 - protein, 9 aa, Homo Sapiens
NLSVLDISA

SEQ ID NO: 590070 - protein, 9 aa, Homo Sapiens
YAQQCLSLW

SEQ ID NO: 590071 - protein, 9 aa, Homo Sapiens
NPHAEGQLQ

SEQ ID NO: 590072 - protein, 9 aa, Homo Sapiens
QQLQVMLTM

SEQ ID NO: 590073 - protein, 9 aa, Homo Sapiens
EDNEEKMSR

SEQ ID NO: 590074 - protein, 9 aa, Homo Sapiens
DPSEINANY

SEQ ID NO: 590075 - protein, 9 aa, Homo Sapiens
FCHSCDAGA

SEQ ID NO: 590076 - protein, 9 aa, Homo Sapiens
AVESNNRVN

SEQ ID NO: 590077 - protein, 9 aa, Homo Sapiens
HRWPSAQVR

SEQ ID NO: 590078 - protein, 9 aa, Homo Sapiens
LQCHWHCPQ

SEQ ID NO: 590079 - protein, 9 aa, Homo Sapiens
YNFCHSCDA

SEQ ID NO: 590080 - protein, 9 aa, Homo Sapiens
DVECEFSNL

SEQ ID NO: 590081 - protein, 9 aa, Homo Sapiens
RVLALIVSG

SEQ ID NO: 590082 - protein, 9 aa, Homo Sapiens
ERVGKEKAQ

SEQ ID NO: 590083 - protein, 9 aa, Homo Sapiens
INLYKVKPN

SEQ ID NO: 590084 - protein, 9 aa, Homo Sapiens
NDIPPFLDD

SEQ ID NO: 590085 - protein, 9 aa, Homo Sapiens
MSKYDSLDF

SEQ ID NO: 590086 - protein, 9 aa, Homo Sapiens
CIIINSVFL

SEQ ID NO: 590087 - protein, 9 aa, Homo Sapiens
DTSERFDTH

SEQ ID NO: 590088 - protein, 9 aa, Homo Sapiens
SRQKCPPSW

SEQ ID NO: 590089 - protein, 9 aa, Homo Sapiens
FTVIAEELS

SEQ ID NO: 590090 - protein, 9 aa, Homo Sapiens
IELVKLGHV

SEQ ID NO: 590091 - protein, 9 aa, Homo Sapiens
TPGMLMLTE

SEQ ID NO: 590092 - protein, 9 aa, Homo Sapiens
GYIQSNRRH

SEQ ID NO: 590093 - protein, 9 aa, Homo Sapiens
PARCVSNSR

SEQ ID NO: 590094 - protein, 9 aa, Homo Sapiens
AAQKADAQD

SEQ ID NO: 590095 - protein, 9 aa, Homo Sapiens
AMTAYWTNF

SEQ ID NO: 590096 - protein, 9 aa, Homo Sapiens
CDKCYTHPC

SEQ ID NO: 590097 - protein, 9 aa, Homo Sapiens
GFLCTSVSP

SEQ ID NO: 590098 - protein, 9 aa, Homo Sapiens
TDFDLNVIS

SEQ ID NO: 590099 - protein, 9 aa, Homo Sapiens
ERAALLPRN

SEQ ID NO: 590100 - protein, 9 aa, Homo Sapiens
ADRFVSSFS

SEQ ID NO: 590101 - protein, 9 aa, Homo Sapiens
RAALLPRNT

SEQ ID NO: 590102 - protein, 9 aa, Homo Sapiens
PLGGLFTYV

SEQ ID NO: 590103 - protein, 9 aa, Homo Sapiens
TPNSSVSGD

SEQ ID NO: 590104 - protein, 9 aa, Homo Sapiens
VIPLLPSYC

SEQ ID NO: 590105 - protein, 9 aa, Homo Sapiens
YPLIDKKKQ

SEQ ID NO: 590106 - protein, 9 aa, Homo Sapiens
TNCREVEQW

SEQ ID NO: 590107 - protein, 9 aa, Homo Sapiens
RQAPVERNY

SEQ ID NO: 590108 - protein, 9 aa, Homo Sapiens
NFSDLSKPI

SEQ ID NO: 590109 - protein, 9 aa, Homo Sapiens
TGGKPYVCP

SEQ ID NO: 590110 - protein, 9 aa, Homo Sapiens
YVIFTCLGE

SEQ ID NO: 590111 - protein, 9 aa, Homo Sapiens
WMKLFFEMK

SEQ ID NO: 590112 - protein, 9 aa, Homo Sapiens
EQVLWDWLR

SEQ ID NO: 590113 - protein, 9 aa, Homo Sapiens
ENTCHKSYR

SEQ ID NO: 590114 - protein, 9 aa, Homo Sapiens
VIEQTNARQ

SEQ ID NO: 590115 - protein, 9 aa, Homo Sapiens
RSHGPLLPL

SEQ ID NO: 590116 - protein, 9 aa, Homo Sapiens
SPEKAKSPG

SEQ ID NO: 590117 - protein, 9 aa, Homo Sapiens
HQDVQAIWY

SEQ ID NO: 590118 - protein, 9 aa, Homo Sapiens
DFLKSEKLS

SEQ ID NO: 590119 - protein, 9 aa, Homo Sapiens
GEEERNTTS

SEQ ID NO: 590120 - protein, 9 aa, Homo Sapiens
AIPLQLFFS

SEQ ID NO: 590121 - protein, 9 aa, Homo Sapiens
HTQEPSAQL

SEQ ID NO: 590122 - protein, 9 aa, Homo Sapiens
CELCWPESG

SEQ ID NO: 590123 - protein, 9 aa, Homo Sapiens
FQGDRNYWN

SEQ ID NO: 590124 - protein, 9 aa, Homo Sapiens
FHHFGKDFL

SEQ ID NO: 590125 - protein, 9 aa, Homo Sapiens
QNLIDYFYE

SEQ ID NO: 590126 - protein, 9 aa, Homo Sapiens
VLALIVSGL

SEQ ID NO: 590127 - protein, 9 aa, Homo Sapiens
TTRFTGVIP

SEQ ID NO: 590128 - protein, 9 aa, Homo Sapiens
KCGLCGKLF

SEQ ID NO: 590129 - protein, 9 aa, Homo Sapiens
NTGDLQYVN

SEQ ID NO: 590130 - protein, 9 aa, Homo Sapiens
DSIKVIGNM

SEQ ID NO: 590131 - protein, 9 aa, Homo Sapiens
PTNTHWYHR

SEQ ID NO: 590132 - protein, 9 aa, Homo Sapiens
IEMLLITSN

SEQ ID NO: 590133 - protein, 9 aa, Homo Sapiens
RRSAAKCIA

SEQ ID NO: 590134 - protein, 9 aa, Homo Sapiens
APVERNYHI

SEQ ID NO: 590135 - protein, 9 aa, Homo Sapiens
AKSPGRGKV

SEQ ID NO: 590136 - protein, 9 aa, Homo Sapiens
DVDCHGSCS

SEQ ID NO: 590137 - protein, 9 aa, Homo Sapiens
PYSEQVLWD

SEQ ID NO: 590138 - protein, 9 aa, Homo Sapiens
GNTAGKSSF

SEQ ID NO: 590139 - protein, 9 aa, Homo Sapiens
VAFSQSNPP

SEQ ID NO: 590140 - protein, 9 aa, Homo Sapiens
GFFRRSLRR

SEQ ID NO: 590141 - protein, 9 aa, Homo Sapiens
DVQELSLGV

SEQ ID NO: 590142 - protein, 9 aa, Homo Sapiens
VVIFSLYLV

SEQ ID NO: 590143 - protein, 9 aa, Homo Sapiens
NVISLKEEG

SEQ ID NO: 590144 - protein, 9 aa, Homo Sapiens
NANYLDKYE

SEQ ID NO: 590145 - protein, 9 aa, Homo Sapiens
GLVIIIIKP

SEQ ID NO: 590146 - protein, 9 aa, Homo Sapiens
HDGYRSHGP

SEQ ID NO: 590147 - protein, 9 aa, Homo Sapiens
QEEEEERRK

SEQ ID NO: 590148 - protein, 9 aa, Homo Sapiens
AERDGEPSK

SEQ ID NO: 590149 - protein, 9 aa, Homo Sapiens
KEVQRDYVF

SEQ ID NO: 590150 - protein, 9 aa, Homo Sapiens
VRTAVTQGG

SEQ ID NO: 590151 - protein, 9 aa, Homo Sapiens
YFLKDEGRR

SEQ ID NO: 590152 - protein, 9 aa, Homo Sapiens
AGMAIPLQL

SEQ ID NO: 590153 - protein, 9 aa, Homo Sapiens
NARQSKGEE

SEQ ID NO: 590154 - protein, 9 aa, Homo Sapiens
LLPAHTLQG

SEQ ID NO: 590155 - protein, 9 aa, Homo Sapiens
DYFYEEQIK

SEQ ID NO: 590156 - protein, 9 aa, Homo Sapiens
VMIHPGLVC

SEQ ID NO: 590157 - protein, 9 aa, Homo Sapiens
VIPQGRDSS

SEQ ID NO: 590158 - protein, 9 aa, Homo Sapiens
RPSRPANKQ

SEQ ID NO: 590159 - protein, 9 aa, Homo Sapiens
QDLELAILH

SEQ ID NO: 590160 - protein, 9 aa, Homo Sapiens
SPEEDLIFV

SEQ ID NO: 590161 - protein, 9 aa, Homo Sapiens
TSNPYDYAF

SEQ ID NO: 590162 - protein, 9 aa, Homo Sapiens
ERNTTSFPF

SEQ ID NO: 590163 - protein, 9 aa, Homo Sapiens
VMLICDIDG

SEQ ID NO: 590164 - protein, 9 aa, Homo Sapiens
SYAQQCLSL

SEQ ID NO: 590165 - protein, 9 aa, Homo Sapiens
KGKPKSPAC

SEQ ID NO: 590166 - protein, 9 aa, Homo Sapiens
LGPIIRALV

SEQ ID NO: 590167 - protein, 9 aa, Homo Sapiens
CSLRKHMKV

SEQ ID NO: 590168 - protein, 9 aa, Homo Sapiens
KAKSPGRGK

SEQ ID NO: 590169 - protein, 9 aa, Homo Sapiens
VSGDILFPV

SEQ ID NO: 590170 - protein, 9 aa, Homo Sapiens
VHQRIHTGG

SEQ ID NO: 590171 - protein, 9 aa, Homo Sapiens
KAHHLQCHW

SEQ ID NO: 590172 - protein, 9 aa, Homo Sapiens
EGVVSSGSR

SEQ ID NO: 590173 - protein, 9 aa, Homo Sapiens
ETREIIFRN

SEQ ID NO: 590174 - protein, 9 aa, Homo Sapiens
NLYKVKPNP

SEQ ID NO: 590175 - protein, 9 aa, Homo Sapiens
LCGKLFTSK

SEQ ID NO: 590176 - protein, 9 aa, Homo Sapiens
RSYGCCECG

SEQ ID NO: 590177 - protein, 9 aa, Homo Sapiens
NTKVMLICD

SEQ ID NO: 590178 - protein, 9 aa, Homo Sapiens
VVPCEPPEV

SEQ ID NO: 590179 - protein, 9 aa, Homo Sapiens
SEVMIHPGL

SEQ ID NO: 590180 - protein, 9 aa, Homo Sapiens
NIMVVLVVT

SEQ ID NO: 590181 - protein, 9 aa, Homo Sapiens
LSLWGPGAQ

SEQ ID NO: 590182 - protein, 9 aa, Homo Sapiens
QCQLEFTKK

SEQ ID NO: 590183 - protein, 9 aa, Homo Sapiens
NEEKMSRLS

SEQ ID NO: 590184 - protein, 9 aa, Homo Sapiens
SIKDVFEKR

SEQ ID NO: 590185 - protein, 9 aa, Homo Sapiens
GGVLEGVVS

SEQ ID NO: 590186 - protein, 9 aa, Homo Sapiens
IRALVRDTL

SEQ ID NO: 590187 - protein, 9 aa, Homo Sapiens
PFLVSSVED

SEQ ID NO: 590188 - protein, 9 aa, Homo Sapiens
RFTVTIIHE

SEQ ID NO: 590189 - protein, 9 aa, Homo Sapiens
GRQHQGTYR

SEQ ID NO: 590190 - protein, 9 aa, Homo Sapiens
QTSLTISAF

SEQ ID NO: 590191 - protein, 9 aa, Homo Sapiens
KDRLLQQHL

SEQ ID NO: 590192 - protein, 9 aa, Homo Sapiens
KAGTVAWQA

SEQ ID NO: 590193 - protein, 9 aa, Homo Sapiens
IAGMAIPLQ

SEQ ID NO: 590194 - protein, 9 aa, Homo Sapiens
IPLFQAFLV

SEQ ID NO: 590195 - protein, 9 aa, Homo Sapiens
PNTGDLQYV

SEQ ID NO: 590196 - protein, 9 aa, Homo Sapiens
AGAAAVMFL

SEQ ID NO: 590197 - protein, 9 aa, Homo Sapiens
FAERVGKEK

SEQ ID NO: 590198 - protein, 9 aa, Homo Sapiens
AFTMRVLGE

SEQ ID NO: 590199 - protein, 9 aa, Homo Sapiens
LAILHHQTL

SEQ ID NO: 590200 - protein, 9 aa, Homo Sapiens
RKHKKKGRP

SEQ ID NO: 590201 - protein, 9 aa, Homo Sapiens
EVKDFRKKF

SEQ ID NO: 590202 - protein, 9 aa, Homo Sapiens
ISARHILVA

SEQ ID NO: 590203 - protein, 9 aa, Homo Sapiens
IAFETREII

SEQ ID NO: 590204 - protein, 9 aa, Homo Sapiens
GRITESTSQ

SEQ ID NO: 590205 - protein, 9 aa, Homo Sapiens
LVTVIPLLP

SEQ ID NO: 590206 - protein, 9 aa, Homo Sapiens
KSFKQSSNL

SEQ ID NO: 590207 - protein, 9 aa, Homo Sapiens
SNQQLQVML

SEQ ID NO: 590208 - protein, 9 aa, Homo Sapiens
VHSVFSMLI

SEQ ID NO: 590209 - protein, 9 aa, Homo Sapiens
PAQELHRSQ

SEQ ID NO: 590210 - protein, 9 aa, Homo Sapiens
PKDKFWLYF

SEQ ID NO: 590211 - protein, 9 aa, Homo Sapiens
QRNTRDLLH

SEQ ID NO: 590212 - protein, 9 aa, Homo Sapiens
KATPHFLVI

SEQ ID NO: 590213 - protein, 9 aa, Homo Sapiens
ANENNTPSS

SEQ ID NO: 590214 - protein, 9 aa, Homo Sapiens
GVPYATPPT

SEQ ID NO: 590215 - protein, 9 aa, Homo Sapiens
NQQLQVMLT

SEQ ID NO: 590216 - protein, 9 aa, Homo Sapiens
DEDSITKPV

SEQ ID NO: 590217 - protein, 9 aa, Homo Sapiens
KDEGRRMTD

SEQ ID NO: 590218 - protein, 9 aa, Homo Sapiens
PFELVKMDF

SEQ ID NO: 590219 - protein, 9 aa, Homo Sapiens
KMSRLSKVA

SEQ ID NO: 590220 - protein, 9 aa, Homo Sapiens
LPGAIGLDG

SEQ ID NO: 590221 - protein, 9 aa, Homo Sapiens
REIIFRNMN

SEQ ID NO: 590222 - protein, 9 aa, Homo Sapiens
FRRSLRRAR

SEQ ID NO: 590223 - protein, 9 aa, Homo Sapiens
DRFVSSFSR

SEQ ID NO: 590224 - protein, 9 aa, Homo Sapiens
VLDISAATP

SEQ ID NO: 590225 - protein, 9 aa, Homo Sapiens
DGFFRRSLR

SEQ ID NO: 590226 - protein, 9 aa, Homo Sapiens
CQYCRLQSC

SEQ ID NO: 590227 - protein, 9 aa, Homo Sapiens
MAGAAAVMF

SEQ ID NO: 590228 - protein, 9 aa, Homo Sapiens
HHLQCHWHC

SEQ ID NO: 590229 - protein, 9 aa, Homo Sapiens
ALVRDTLKI

SEQ ID NO: 590230 - protein, 9 aa, Homo Sapiens
NTHWYHRLP

SEQ ID NO: 590231 - protein, 9 aa, Homo Sapiens
AFSGLNRLE

SEQ ID NO: 590232 - protein, 9 aa, Homo Sapiens
YILLAFMAF

SEQ ID NO: 590233 - protein, 9 aa, Homo Sapiens
IEQTNARQS

SEQ ID NO: 590234 - protein, 9 aa, Homo Sapiens
NSSVSGDIL

SEQ ID NO: 590235 - protein, 9 aa, Homo Sapiens
FAFTMRVLG

SEQ ID NO: 590236 - protein, 9 aa, Homo Sapiens
QELPGAIGL

SEQ ID NO: 590237 - protein, 9 aa, Homo Sapiens
KSSFTVIAE

SEQ ID NO: 590238 - protein, 9 aa, Homo Sapiens
NHHSSCNGT

SEQ ID NO: 590239 - protein, 9 aa, Homo Sapiens
VTQGGWRSL

SEQ ID NO: 590240 - protein, 9 aa, Homo Sapiens
TRDLLHWKA

SEQ ID NO: 590241 - protein, 9 aa, Homo Sapiens
QYCRLQSCI

SEQ ID NO: 590242 - protein, 9 aa, Homo Sapiens
SLGRIKTFS

SEQ ID NO: 590243 - protein, 9 aa, Homo Sapiens
FSGLNRLEQ

SEQ ID NO: 590244 - protein, 9 aa, Homo Sapiens
GQRCPQCDF

SEQ ID NO: 590245 - protein, 9 aa, Homo Sapiens
SELVLAQQQ

SEQ ID NO: 590246 - protein, 9 aa, Homo Sapiens
LEHHPNCTF

SEQ ID NO: 590247 - protein, 9 aa, Homo Sapiens
CRVGVFLYY

SEQ ID NO: 590248 - protein, 9 aa, Homo Sapiens
EAHKGPPAP

SEQ ID NO: 590249 - protein, 9 aa, Homo Sapiens
HLQCHWHCP

SEQ ID NO: 590250 - protein, 9 aa, Homo Sapiens
IPLLPSYCS

SEQ ID NO: 590251 - protein, 9 aa, Homo Sapiens
REDASHQLI

SEQ ID NO: 590252 - protein, 9 aa, Homo Sapiens
LYKVKPNPP

SEQ ID NO: 590253 - protein, 9 aa, Homo Sapiens
MKGSQIEFE

SEQ ID NO: 590254 - protein, 9 aa, Homo Sapiens
KGPIAAGTC

SEQ ID NO: 590255 - protein, 9 aa, Homo Sapiens
GRPSRPANK

SEQ ID NO: 590256 - protein, 9 aa, Homo Sapiens
HHSSCNGTW

SEQ ID NO: 590257 - protein, 9 aa, Homo Sapiens
KVIGNMRAA

SEQ ID NO: 590258 - protein, 9 aa, Homo Sapiens
GVFLYYEAG

SEQ ID NO: 590259 - protein, 9 aa, Homo Sapiens
CHWHCPQAS

SEQ ID NO: 590260 - protein, 9 aa, Homo Sapiens
MQDLELAIL

SEQ ID NO: 590261 - protein, 9 aa, Homo Sapiens
RDGEPSKLK

SEQ ID NO: 590262 - protein, 9 aa, Homo Sapiens
IQRRFTVTI

SEQ ID NO: 590263 - protein, 9 aa, Homo Sapiens
TCHKSYRPL

SEQ ID NO: 590264 - protein, 9 aa, Homo Sapiens
IRSMIGYIE

SEQ ID NO: 590265 - protein, 9 aa, Homo Sapiens
MRVLGESGE

SEQ ID NO: 590266 - protein, 9 aa, Homo Sapiens
QEPSAQLGE

SEQ ID NO: 590267 - protein, 9 aa, Homo Sapiens
AATPEKQMC

SEQ ID NO: 590268 - protein, 9 aa, Homo Sapiens
YKCGLCGKL

SEQ ID NO: 590269 - protein, 9 aa, Homo Sapiens
YEEYARTSQ

SEQ ID NO: 590270 - protein, 9 aa, Homo Sapiens
GEKPYKCGL

SEQ ID NO: 590271 - protein, 9 aa, Homo Sapiens
VSSVEDFKD

SEQ ID NO: 590272 - protein, 9 aa, Homo Sapiens
SNRRHYRDK

SEQ ID NO: 590273 - protein, 9 aa, Homo Sapiens
ELSLGVLAV

SEQ ID NO: 590274 - protein, 8 aa, Homo Sapiens
VWCLGLAV

SEQ ID NO: 590275 - protein, 9 aa, Homo Sapiens
RLYEEYART

SEQ ID NO: 590276 - protein, 9 aa, Homo Sapiens
FGREFCYSM

SEQ ID NO: 590277 - protein, 9 aa, Homo Sapiens
LCRVGVFLY

SEQ ID NO: 590278 - protein, 9 aa, Homo Sapiens
LLPKGSKEV

SEQ ID NO: 590279 - protein, 9 aa, Homo Sapiens
NQTPKKMNN

SEQ ID NO: 590280 - protein, 9 aa, Homo Sapiens
WKIPLFQAF

SEQ ID NO: 590281 - protein, 9 aa, Homo Sapiens
DQASVIADR

SEQ ID NO: 590282 - protein, 9 aa, Homo Sapiens
EGSPCQRLE

SEQ ID NO: 590283 - protein, 9 aa, Homo Sapiens
YLQCQLEFT

SEQ ID NO: 590284 - protein, 9 aa, Homo Sapiens
LLAFMAFDR

SEQ ID NO: 590285 - protein, 9 aa, Homo Sapiens
AFETREIIF

SEQ ID NO: 590286 - protein, 9 aa, Homo Sapiens
GEISYRIPL

SEQ ID NO: 590287 - protein, 9 aa, Homo Sapiens
YRSPNTGDL

SEQ ID NO: 590288 - protein, 9 aa, Homo Sapiens
KRSYGCCEC

SEQ ID NO: 590289 - protein, 9 aa, Homo Sapiens
LPAHTLQGE

SEQ ID NO: 590290 - protein, 9 aa, Homo Sapiens
KYKAAQKAD

SEQ ID NO: 590291 - protein, 9 aa, Homo Sapiens
RNPIYPLID

SEQ ID NO: 590292 - protein, 9 aa, Homo Sapiens
ASTMSKYDS

SEQ ID NO: 590293 - protein, 9 aa, Homo Sapiens
VAHVVANPH

SEQ ID NO: 590294 - protein, 9 aa, Homo Sapiens
SSGYIQSNR

SEQ ID NO: 590295 - protein, 9 aa, Homo Sapiens
KGMAENTCH

SEQ ID NO: 590296 - protein, 9 aa, Homo Sapiens
FSYWASELV

SEQ ID NO: 590297 - protein, 9 aa, Homo Sapiens
GREFCYSME

SEQ ID NO: 590298 - protein, 9 aa, Homo Sapiens
ATPHFLVIF

SEQ ID NO: 590299 - protein, 9 aa, Homo Sapiens
HWYHRLPVR

SEQ ID NO: 590300 - protein, 9 aa, Homo Sapiens
NCREVEQWF

SEQ ID NO: 590301 - protein, 9 aa, Homo Sapiens
EHHPNCTFD

SEQ ID NO: 590302 - protein, 9 aa, Homo Sapiens
KGSKEVQRD

SEQ ID NO: 590303 - protein, 9 aa, Homo Sapiens
LPDILDKQN

SEQ ID NO: 590304 - protein, 9 aa, Homo Sapiens
GRSEGERMV

SEQ ID NO: 590305 - protein, 9 aa, Homo Sapiens
LCQWSEVMI

SEQ ID NO: 590306 - protein, 9 aa, Homo Sapiens
HDTSERFDT

SEQ ID NO: 590307 - protein, 9 aa, Homo Sapiens
KELLQVDPR

SEQ ID NO: 590308 - protein, 9 aa, Homo Sapiens
DGEPSKLKR

SEQ ID NO: 590309 - protein, 9 aa, Homo Sapiens
FEMKPLLRS

SEQ ID NO: 590310 - protein, 9 aa, Homo Sapiens
TAVTQGGWR

SEQ ID NO: 590311 - protein, 9 aa, Homo Sapiens
PEEDLIFVT

SEQ ID NO: 590312 - protein, 9 aa, Homo Sapiens
TAYWTNFAK

SEQ ID NO: 590313 - protein, 9 aa, Homo Sapiens
TEYILLAFM

SEQ ID NO: 590314 - protein, 9 aa, Homo Sapiens
SDLPKDKFW

SEQ ID NO: 590315 - protein, 9 aa, Homo Sapiens
SAATPEKQM

SEQ ID NO: 590316 - protein, 9 aa, Homo Sapiens
DMSWKVRRS

SEQ ID NO: 590317 - protein, 9 aa, Homo Sapiens
PEASLQDNE

SEQ ID NO: 590318 - protein, 9 aa, Homo Sapiens
IADRFVSSF

SEQ ID NO: 590319 - protein, 9 aa, Homo Sapiens
CVSNSREYC

SEQ ID NO: 590320 - protein, 9 aa, Homo Sapiens
ETNCREVEQ

SEQ ID NO: 590321 - protein, 9 aa, Homo Sapiens
NKLTRQWSL

SEQ ID NO: 590322 - protein, 9 aa, Homo Sapiens
GPDSTEEKQ

SEQ ID NO: 590323 - protein, 9 aa, Homo Sapiens
EDLEALLQS

SEQ ID NO: 590324 - protein, 9 aa, Homo Sapiens
MLLITSNPY

SEQ ID NO: 590325 - protein, 9 aa, Homo Sapiens
PHAEGQLQW

SEQ ID NO: 590326 - protein, 9 aa, Homo Sapiens
PLIDKKKQF

SEQ ID NO: 590327 - protein, 9 aa, Homo Sapiens
QWKIPLFQA

SEQ ID NO: 590328 - protein, 9 aa, Homo Sapiens
AHVVANPHA

SEQ ID NO: 590329 - protein, 9 aa, Homo Sapiens
YGCCECGKF

SEQ ID NO: 590330 - protein, 9 aa, Homo Sapiens
AAAVMFLLC

SEQ ID NO: 590331 - protein, 9 aa, Homo Sapiens
AGTCDHFTK

SEQ ID NO: 590332 - protein, 9 aa, Homo Sapiens
LMLTEDFFA

SEQ ID NO: 590333 - protein, 9 aa, Homo Sapiens
QRRFTVTII

SEQ ID NO: 590334 - protein, 9 aa, Homo Sapiens
SGDILFPVL

SEQ ID NO: 590335 - protein, 9 aa, Homo Sapiens
SKVTQSEHS

SEQ ID NO: 590336 - protein, 9 aa, Homo Sapiens
DNEEKMSRL

SEQ ID NO: 590337 - protein, 9 aa, Homo Sapiens
YHRLPVRKK

SEQ ID NO: 590338 - protein, 9 aa, Homo Sapiens
EINANYLDK

SEQ ID NO: 590339 - protein, 9 aa, Homo Sapiens
VIFTCLGEL

SEQ ID NO: 590340 - protein, 9 aa, Homo Sapiens
MAIPLQLFF

SEQ ID NO: 590341 - protein, 9 aa, Homo Sapiens
DRTVSKAMT

SEQ ID NO: 590342 - protein, 9 aa, Homo Sapiens
FCYSMETAL

SEQ ID NO: 590343 - protein, 9 aa, Homo Sapiens
RPFPGLDQM

SEQ ID NO: 590344 - protein, 9 aa, Homo Sapiens
QAITKKVQS

SEQ ID NO: 590345 - protein, 9 aa, Homo Sapiens
STCTEVRSN

SEQ ID NO: 590346 - protein, 9 aa, Homo Sapiens
SWGEEERNT

SEQ ID NO: 590347 - protein, 9 aa, Homo Sapiens
WHDTSERFD

SEQ ID NO: 590348 - protein, 9 aa, Homo Sapiens
LFQAFLVIY

SEQ ID NO: 590349 - protein, 9 aa, Homo Sapiens
HVGHGRSEG

SEQ ID NO: 590350 - protein, 9 aa, Homo Sapiens
RFDTHGCRF

SEQ ID NO: 590351 - protein, 9 aa, Homo Sapiens
EECGKSFKQ

SEQ ID NO: 590352 - protein, 9 aa, Homo Sapiens
AVMFLLCAV

SEQ ID NO: 590353 - protein, 9 aa, Homo Sapiens
VPYATPPTG

SEQ ID NO: 590354 - protein, 9 aa, Homo Sapiens
YWVIKGNID

SEQ ID NO: 590355 - protein, 9 aa, Homo Sapiens
DLQYVNQRN

SEQ ID NO: 590356 - protein, 9 aa, Homo Sapiens
IPQGRDSSI

SEQ ID NO: 590357 - protein, 9 aa, Homo Sapiens
PKNSKVTQS

SEQ ID NO: 590358 - protein, 9 aa, Homo Sapiens
GKEKAQAVE

SEQ ID NO: 590359 - protein, 9 aa, Homo Sapiens
RCIASNAAG

SEQ ID NO: 590360 - protein, 9 aa, Homo Sapiens
MHLLYNFCH

SEQ ID NO: 590361 - protein, 9 aa, Homo Sapiens
MVVLVVTRT

SEQ ID NO: 590362 - protein, 9 aa, Homo Sapiens
TVAWQAKSS

SEQ ID NO: 590363 - protein, 9 aa, Homo Sapiens
GHGRSEGER

SEQ ID NO: 590364 - protein, 9 aa, Homo Sapiens
QQGPEAHKG

SEQ ID NO: 590365 - protein, 9 aa, Homo Sapiens
ECLPPTRGL

SEQ ID NO: 590366 - protein, 9 aa, Homo Sapiens
WVIKGNIDK

SEQ ID NO: 590367 - protein, 9 aa, Homo Sapiens
FRHDGYRSH

SEQ ID NO: 590368 - protein, 9 aa, Homo Sapiens
RTTHHRSSS

SEQ ID NO: 590369 - protein, 9 aa, Homo Sapiens
LYNFCHSCD

SEQ ID NO: 590370 - protein, 9 aa, Homo Sapiens
LRTDFDLNV

SEQ ID NO: 590371 - protein, 9 aa, Homo Sapiens
CLSLWGPGA

SEQ ID NO: 590372 - protein, 9 aa, Homo Sapiens
EKPYKCGLC

SEQ ID NO: 590373 - protein, 9 aa, Homo Sapiens
RIWQGCSAK

SEQ ID NO: 590374 - protein, 9 aa, Homo Sapiens
NLAGLKYWV

SEQ ID NO: 590375 - protein, 9 aa, Homo Sapiens
IWQGCSAKS

SEQ ID NO: 590376 - protein, 9 aa, Homo Sapiens
LDIKLEELG

SEQ ID NO: 590377 - protein, 9 aa, Homo Sapiens
TSDHINLYK

SEQ ID NO: 590378 - protein, 9 aa, Homo Sapiens
IKVIGNMRA

SEQ ID NO: 590379 - protein, 9 aa, Homo Sapiens
TVSKAMTAY

SEQ ID NO: 590380 - protein, 9 aa, Homo Sapiens
TMRVLGESG

SEQ ID NO: 590381 - protein, 9 aa, Homo Sapiens
KTLAFAGLV

SEQ ID NO: 590382 - protein, 9 aa, Homo Sapiens
DLLAVGLLR

SEQ ID NO: 590383 - protein, 9 aa, Homo Sapiens
QEKEVKDFR

SEQ ID NO: 590384 - protein, 9 aa, Homo Sapiens
GPPAPSQGP

SEQ ID NO: 590385 - protein, 9 aa, Homo Sapiens
RNTTSFPFS

SEQ ID NO: 590386 - protein, 9 aa, Homo Sapiens
SSKSEGSPC

SEQ ID NO: 590387 - protein, 9 aa, Homo Sapiens
RRMTDVARA

SEQ ID NO: 590388 - protein, 9 aa, Homo Sapiens
QSNRRHYRD

SEQ ID NO: 590389 - protein, 9 aa, Homo Sapiens
PPFLDDIPE

SEQ ID NO: 590390 - protein, 9 aa, Homo Sapiens
LTLPGNFSD

SEQ ID NO: 590391 - protein, 9 aa, Homo Sapiens
QVSNTELYV

SEQ ID NO: 590392 - protein, 9 aa, Homo Sapiens
HQRIHTGGK

SEQ ID NO: 590393 - protein, 9 aa, Homo Sapiens
VIFSLYLVL

SEQ ID NO: 590394 - protein, 9 aa, Homo Sapiens
AHKGPPAPS

SEQ ID NO: 590395 - protein, 9 aa, Homo Sapiens
QWSEVMIHP

SEQ ID NO: 590396 - protein, 9 aa, Homo Sapiens
EEEANKLTR

SEQ ID NO: 590397 - protein, 9 aa, Homo Sapiens
RLEQLTLEK

SEQ ID NO: 590398 - protein, 9 aa, Homo Sapiens
ALLPRNTAP

SEQ ID NO: 590399 - protein, 9 aa, Homo Sapiens
DHVGHGRSE

SEQ ID NO: 590400 - protein, 9 aa, Homo Sapiens
EDSIKVIGN

SEQ ID NO: 590401 - protein, 9 aa, Homo Sapiens
RMTDVARAL

SEQ ID NO: 590402 - protein, 9 aa, Homo Sapiens
LFFEMKPLL

SEQ ID NO: 590403 - protein, 9 aa, Homo Sapiens
ERDGEPSKL

SEQ ID NO: 590404 - protein, 9 aa, Homo Sapiens
TPHFLVIFQ

SEQ ID NO: 590405 - protein, 9 aa, Homo Sapiens
DVQAIWYFG

SEQ ID NO: 590406 - protein, 9 aa, Homo Sapiens
PDVECEFSN

SEQ ID NO: 590407 - protein, 9 aa, Homo Sapiens
FYVIVRGTF

SEQ ID NO: 590408 - protein, 9 aa, Homo Sapiens
QCLSLWGPG

SEQ ID NO: 590409 - protein, 9 aa, Homo Sapiens
ISAFQAESK

SEQ ID NO: 590410 - protein, 9 aa, Homo Sapiens
ILRTLLLYL

SEQ ID NO: 590411 - protein, 9 aa, Homo Sapiens
VNQTPKKMN

SEQ ID NO: 590412 - protein, 9 aa, Homo Sapiens
THHRSSSVS

SEQ ID NO: 590413 - protein, 9 aa, Homo Sapiens
VQSQVLTQS

SEQ ID NO: 590414 - protein, 9 aa, Homo Sapiens
AFAERVGKE

SEQ ID NO: 590415 - protein, 9 aa, Homo Sapiens
LGQVPGAEC

SEQ ID NO: 590416 - protein, 9 aa, Homo Sapiens
HTSQVTQLV

SEQ ID NO: 590417 - protein, 9 aa, Homo Sapiens
LRAALILRV

SEQ ID NO: 590418 - protein, 9 aa, Homo Sapiens
RGKYKAAQK

SEQ ID NO: 590419 - protein, 9 aa, Homo Sapiens
HLKQIKEQE

SEQ ID NO: 590420 - protein, 9 aa, Homo Sapiens
SNSREYCSM

SEQ ID NO: 590421 - protein, 9 aa, Homo Sapiens
IKLEELGDL

SEQ ID NO: 590422 - protein, 9 aa, Homo Sapiens
IVRGTFDIY

SEQ ID NO: 590423 - protein, 9 aa, Homo Sapiens
SKEVQRDYV

SEQ ID NO: 590424 - protein, 9 aa, Homo Sapiens
CDHFTKPSP

SEQ ID NO: 590425 - protein, 9 aa, Homo Sapiens
VEDFKDHIP

SEQ ID NO: 590426 - protein, 9 aa, Homo Sapiens
RLQSCIAFG

SEQ ID NO: 590427 - protein, 9 aa, Homo Sapiens
KGEALFPGS

SEQ ID NO: 590428 - protein, 9 aa, Homo Sapiens
LDKQNQMRP

SEQ ID NO: 590429 - protein, 9 aa, Homo Sapiens
ALQGLVASC

SEQ ID NO: 590430 - protein, 9 aa, Homo Sapiens
GKSSFTVIA

SEQ ID NO: 590431 - protein, 9 aa, Homo Sapiens
EQTDQTPAQ

SEQ ID NO: 590432 - protein, 9 aa, Homo Sapiens
EEYARTSQE

SEQ ID NO: 590433 - protein, 9 aa, Homo Sapiens
LVASCASAP

SEQ ID NO: 590434 - protein, 9 aa, Homo Sapiens
SDHINLYKV

SEQ ID NO: 590435 - protein, 9 aa, Homo Sapiens
IFVTDTAKA

SEQ ID NO: 590436 - protein, 9 aa, Homo Sapiens
EYARTSQEI

SEQ ID NO: 590437 - protein, 9 aa, Homo Sapiens
VVLMKTMGN

SEQ ID NO: 590438 - protein, 9 aa, Homo Sapiens
GTYRCIASN

SEQ ID NO: 590439 - protein, 9 aa, Homo Sapiens
SSAYCKNDL

SEQ ID NO: 590440 - protein, 9 aa, Homo Sapiens
EGRRNPIYP

SEQ ID NO: 590441 - protein, 9 aa, Homo Sapiens
PQWKIPLFQ

SEQ ID NO: 590442 - protein, 9 aa, Homo Sapiens
SKSIKSVVP

SEQ ID NO: 590443 - protein, 9 aa, Homo Sapiens
SVVVPCEPP

SEQ ID NO: 590444 - protein, 9 aa, Homo Sapiens
DLEADEETL

SEQ ID NO: 590445 - protein, 9 aa, Homo Sapiens
KLRYRKEVE

SEQ ID NO: 590446 - protein, 9 aa, Homo Sapiens
RQSKGEEEE

SEQ ID NO: 590447 - protein, 9 aa, Homo Sapiens
NNPYPKSYT

SEQ ID NO: 590448 - protein, 9 aa, Homo Sapiens
QCDFITLQN

SEQ ID NO: 590449 - protein, 9 aa, Homo Sapiens
DLPKDKFWL

SEQ ID NO: 590450 - protein, 9 aa, Homo Sapiens
ASELVLAQQ

SEQ ID NO: 590451 - protein, 9 aa, Homo Sapiens
LIMHLLYNF

SEQ ID NO: 590452 - protein, 9 aa, Homo Sapiens
GGASKHKLR

SEQ ID NO: 590453 - protein, 9 aa, Homo Sapiens
HSVFSMLIM

SEQ ID NO: 590454 - protein, 9 aa, Homo Sapiens
RTLEDNEEK

SEQ ID NO: 590455 - protein, 9 aa, Homo Sapiens
EDLIFVTDT

SEQ ID NO: 590456 - protein, 9 aa, Homo Sapiens
ATPPTGERR

SEQ ID NO: 590457 - protein, 9 aa, Homo Sapiens
ELVLAQQQQ

SEQ ID NO: 590458 - protein, 9 aa, Homo Sapiens
TSVSPFYLG

SEQ ID NO: 590459 - protein, 9 aa, Homo Sapiens
QIEFEQQER

SEQ ID NO: 590460 - protein, 9 aa, Homo Sapiens
AFAGLVIII

SEQ ID NO: 590461 - protein, 9 aa, Homo Sapiens
LREDASHQL

SEQ ID NO: 590462 - protein, 9 aa, Homo Sapiens
YLVLDRGHL

SEQ ID NO: 590463 - protein, 9 aa, Homo Sapiens
IVSGLSCVL

SEQ ID NO: 590464 - protein, 9 aa, Homo Sapiens
HAEGQLQWL

SEQ ID NO: 590465 - protein, 9 aa, Homo Sapiens
IIRALVRDT

SEQ ID NO: 590466 - protein, 9 aa, Homo Sapiens
KYLQCQLEF

SEQ ID NO: 590467 - protein, 9 aa, Homo Sapiens
WSWMKLFFE

SEQ ID NO: 590468 - protein, 9 aa, Homo Sapiens
REQTDQTPA

SEQ ID NO: 590469 - protein, 9 aa, Homo Sapiens
EVQRDYVFY

SEQ ID NO: 590470 - protein, 9 aa, Homo Sapiens
TKVMLICDI

SEQ ID NO: 590471 - protein, 9 aa, Homo Sapiens
VVPVYLKRL

SEQ ID NO: 590472 - protein, 9 aa, Homo Sapiens
ICDVDCHGS

SEQ ID NO: 590473 - protein, 9 aa, Homo Sapiens
QLIRSMIGY

SEQ ID NO: 590474 - protein, 9 aa, Homo Sapiens
IFSLYLVLD

SEQ ID NO: 590475 - protein, 9 aa, Homo Sapiens
RAFAERVGK

SEQ ID NO: 590476 - protein, 9 aa, Homo Sapiens
TGKRSYGCC

SEQ ID NO: 590477 - protein, 9 aa, Homo Sapiens
VLDRGHLDY

SEQ ID NO: 590478 - protein, 9 aa, Homo Sapiens
HIPFLVSSV

SEQ ID NO: 590479 - protein, 9 aa, Homo Sapiens
FSSGYIQSN

SEQ ID NO: 590480 - protein, 9 aa, Homo Sapiens
MAENTCHKS

SEQ ID NO: 590481 - protein, 9 aa, Homo Sapiens
DKFWLYFSQ

SEQ ID NO: 590482 - protein, 9 aa, Homo Sapiens
NNRVNQTPK

SEQ ID NO: 590483 - protein, 9 aa, Homo Sapiens
HVVANPHAE

SEQ ID NO: 590484 - protein, 9 aa, Homo Sapiens
EQGAELSYE

SEQ ID NO: 590485 - protein, 9 aa, Homo Sapiens
IVYSVTCEL

SEQ ID NO: 590486 - protein, 9 aa, Homo Sapiens
PLQLFFSGV

SEQ ID NO: 590487 - protein, 9 aa, Homo Sapiens
VGKEKAQAV

SEQ ID NO: 590488 - protein, 9 aa, Homo Sapiens
CPQCDFITL

SEQ ID NO: 590489 - protein, 9 aa, Homo Sapiens
AECLPPTRG

SEQ ID NO: 590490 - protein, 9 aa, Homo Sapiens
LKDEGRRMT

SEQ ID NO: 590491 - protein, 9 aa, Homo Sapiens
NFYVIVRGT

SEQ ID NO: 590492 - protein, 9 aa, Homo Sapiens
TYRCIASNA

SEQ ID NO: 590493 - protein, 9 aa, Homo Sapiens
PDILDKQNQ

SEQ ID NO: 590494 - protein, 9 aa, Homo Sapiens
RTVSKAMTA

SEQ ID NO: 590495 - protein, 9 aa, Homo Sapiens
DFDLNVISL

SEQ ID NO: 590496 - protein, 9 aa, Homo Sapiens
MLTEDFFAF

SEQ ID NO: 590497 - protein, 9 aa, Homo Sapiens
NLPENECCP

SEQ ID NO: 590498 - protein, 9 aa, Homo Sapiens
VVANPHAEG

SEQ ID NO: 590499 - protein, 9 aa, Homo Sapiens
LLPSYCSSE

SEQ ID NO: 590500 - protein, 9 aa, Homo Sapiens
HFLVIFQWH

SEQ ID NO: 590501 - protein, 9 aa, Homo Sapiens
LYGYLAQHY

SEQ ID NO: 590502 - protein, 9 aa, Homo Sapiens
SAEPTENRE

SEQ ID NO: 590503 - protein, 9 aa, Homo Sapiens
HKGPPAPSQ

SEQ ID NO: 590504 - protein, 9 aa, Homo Sapiens
HHFGKDFLK

SEQ ID NO: 590505 - protein, 9 aa, Homo Sapiens
RALVRDTLK

SEQ ID NO: 590506 - protein, 9 aa, Homo Sapiens
QMKGSQIEF

SEQ ID NO: 590507 - protein, 9 aa, Homo Sapiens
YRCIASNAA

SEQ ID NO: 590508 - protein, 9 aa, Homo Sapiens
NFKYLQCQL

SEQ ID NO: 590509 - protein, 9 aa, Homo Sapiens
TRFTGVIPQ

SEQ ID NO: 590510 - protein, 9 aa, Homo Sapiens
LDDIPEENL

SEQ ID NO: 590511 - protein, 9 aa, Homo Sapiens
GCCECGKFF

SEQ ID NO: 590512 - protein, 9 aa, Homo Sapiens
TCDHFTKPS

SEQ ID NO: 590513 - protein, 9 aa, Homo Sapiens
VTSDHINLY

SEQ ID NO: 590514 - protein, 9 aa, Homo Sapiens
SARHILVAV

SEQ ID NO: 590515 - protein, 9 aa, Homo Sapiens
EEDLIFVTD

SEQ ID NO: 590516 - protein, 9 aa, Homo Sapiens
LLAVGLLRA

SEQ ID NO: 590517 - protein, 9 aa, Homo Sapiens
CPPSWYKFS

SEQ ID NO: 590518 - protein, 9 aa, Homo Sapiens
FTVTIIHEK

SEQ ID NO: 590519 - protein, 9 aa, Homo Sapiens
ENLAGLKYW

SEQ ID NO: 590520 - protein, 9 aa, Homo Sapiens
VDCHGSCSD

SEQ ID NO: 590521 - protein, 9 aa, Homo Sapiens
SSFTVIAEE

SEQ ID NO: 590522 - protein, 9 aa, Homo Sapiens
NLCRSNQQL

SEQ ID NO: 590523 - protein, 9 aa, Homo Sapiens
GKRSYGCCE

SEQ ID NO: 590524 - protein, 9 aa, Homo Sapiens
DHINLYKVK

SEQ ID NO: 590525 - protein, 9 aa, Homo Sapiens
VTPGMLMLT

SEQ ID NO: 590526 - protein, 9 aa, Homo Sapiens
SIKSVVPVY

SEQ ID NO: 590527 - protein, 9 aa, Homo Sapiens
QGTYRCIAS

SEQ ID NO: 590528 - protein, 9 aa, Homo Sapiens
SSVSGDILF

SEQ ID NO: 590529 - protein, 9 aa, Homo Sapiens
LKYWVIKGN

SEQ ID NO: 590530 - protein, 9 aa, Homo Sapiens
LAGLKYWVI

SEQ ID NO: 590531 - protein, 9 aa, Homo Sapiens
DRLYEEYAR

SEQ ID NO: 590532 - protein, 9 aa, Homo Sapiens
DLTLPGNFS

SEQ ID NO: 590533 - protein, 9 aa, Homo Sapiens
EFSNLPENE

SEQ ID NO: 590534 - protein, 9 aa, Homo Sapiens
DKQNQMRPI

SEQ ID NO: 590535 - protein, 9 aa, Homo Sapiens
DCDLRGKSG

SEQ ID NO: 590536 - protein, 9 aa, Homo Sapiens
STSQYQGVV

SEQ ID NO: 590537 - protein, 9 aa, Homo Sapiens
LTISAFQAE

SEQ ID NO: 590538 - protein, 9 aa, Homo Sapiens
KVTQSEHSS

SEQ ID NO: 590539 - protein, 9 aa, Homo Sapiens
FLDDIPEEN

SEQ ID NO: 590540 - protein, 9 aa, Homo Sapiens
TSTCTEVRS

SEQ ID NO: 590541 - protein, 9 aa, Homo Sapiens
QCHWHCPQA

SEQ ID NO: 590542 - protein, 9 aa, Homo Sapiens
KKKGRPSRP

SEQ ID NO: 590543 - protein, 9 aa, Homo Sapiens
AGLVIIIIK

SEQ ID NO: 590544 - protein, 9 aa, Homo Sapiens
ECFSSLSLG

SEQ ID NO: 590545 - protein, 9 aa, Homo Sapiens
GVLEGVVSS

SEQ ID NO: 590546 - protein, 9 aa, Homo Sapiens
VGPLRFQGD

SEQ ID NO: 590547 - protein, 9 aa, Homo Sapiens
SPACEPSEP

SEQ ID NO: 590548 - protein, 9 aa, Homo Sapiens
HGRSEGERM

SEQ ID NO: 590549 - protein, 9 aa, Homo Sapiens
SCIAFGMKQ

SEQ ID NO: 590550 - protein, 9 aa, Homo Sapiens
YVINHHSSC

SEQ ID NO: 590551 - protein, 9 aa, Homo Sapiens
DQTPAQELH

SEQ ID NO: 590552 - protein, 9 aa, Homo Sapiens
YEERNLLSV

SEQ ID NO: 590553 - protein, 9 aa, Homo Sapiens
FLYYEAGDV

SEQ ID NO: 590554 - protein, 9 aa, Homo Sapiens
LRYRKEVEI

SEQ ID NO: 590555 - protein, 9 aa, Homo Sapiens
HHRSSSVSP

SEQ ID NO: 590556 - protein, 9 aa, Homo Sapiens
HFYDICDVD

SEQ ID NO: 590557 - protein, 9 aa, Homo Sapiens
VFEKRRKKP

SEQ ID NO: 590558 - protein, 9 aa, Homo Sapiens
KSPGRGKVT

SEQ ID NO: 590559 - protein, 9 aa, Homo Sapiens
CEFSNLPEN

SEQ ID NO: 590560 - protein, 9 aa, Homo Sapiens
ELSYEERNL

SEQ ID NO: 590561 - protein, 9 aa, Homo Sapiens
ELVKMDFDE

SEQ ID NO: 590562 - protein, 9 aa, Homo Sapiens
IKDVFEKRR

SEQ ID NO: 590563 - protein, 9 aa, Homo Sapiens
AVEGGHVNV

SEQ ID NO: 590564 - protein, 9 aa, Homo Sapiens
RCPQCDFIT

SEQ ID NO: 590565 - protein, 9 aa, Homo Sapiens
YVIVRGTFD

SEQ ID NO: 590566 - protein, 9 aa, Homo Sapiens
GRVTPGMLM

SEQ ID NO: 590567 - protein, 9 aa, Homo Sapiens
SIELVKLGH

SEQ ID NO: 590568 - protein, 9 aa, Homo Sapiens
IINSVFLAM

SEQ ID NO: 590569 - protein, 9 aa, Homo Sapiens
GRRMTDVAR

SEQ ID NO: 590570 - protein, 9 aa, Homo Sapiens
TEEKQLSES

SEQ ID NO: 590571 - protein, 9 aa, Homo Sapiens
VECEFSNLP

SEQ ID NO: 590572 - protein, 9 aa, Homo Sapiens
IDYFYEEQI

SEQ ID NO: 590573 - protein, 9 aa, Homo Sapiens
KGKGKPKSP

SEQ ID NO: 590574 - protein, 9 aa, Homo Sapiens
LLPRNTAPA

SEQ ID NO: 590575 - protein, 9 aa, Homo Sapiens
SEHSSEHVT

SEQ ID NO: 590576 - protein, 9 aa, Homo Sapiens
KRRKKPTHS

SEQ ID NO: 590577 - protein, 9 aa, Homo Sapiens
AHHLQCHWH

SEQ ID NO: 590578 - protein, 9 aa, Homo Sapiens
LQQHLAKLE

SEQ ID NO: 590579 - protein, 9 aa, Homo Sapiens
RVGVFLYYE

SEQ ID NO: 590580 - protein, 9 aa, Homo Sapiens
DVFEKRRKK

SEQ ID NO: 590581 - protein, 9 aa, Homo Sapiens
SIKVIGNMR

SEQ ID NO: 590582 - protein, 9 aa, Homo Sapiens
NSVFLAMEH

SEQ ID NO: 590583 - protein, 9 aa, Homo Sapiens
GKSGDACNL

SEQ ID NO: 590584 - protein, 9 aa, Homo Sapiens
FLKSEKLSP

SEQ ID NO: 590585 - protein, 9 aa, Homo Sapiens
EQTNARQSK

SEQ ID NO: 590586 - protein, 9 aa, Homo Sapiens
LTRIWQGCS

SEQ ID NO: 590587 - protein, 9 aa, Homo Sapiens
RVCRQAPVE

SEQ ID NO: 590588 - protein, 9 aa, Homo Sapiens
GALDVQELS

SEQ ID NO: 590589 - protein, 9 aa, Homo Sapiens
FEKRRKKPT

SEQ ID NO: 590590 - protein, 9 aa, Homo Sapiens
RHSVVVPCE

SEQ ID NO: 590591 - protein, 9 aa, Homo Sapiens
HWKAHHLQC

SEQ ID NO: 590592 - protein, 9 aa, Homo Sapiens
LEGVVSSGS

SEQ ID NO: 590593 - protein, 9 aa, Homo Sapiens
KQIKEQEEE

SEQ ID NO: 590594 - protein, 9 aa, Homo Sapiens
LHHQTLYEQ

SEQ ID NO: 590595 - protein, 9 aa, Homo Sapiens
VVLVVTRTK

SEQ ID NO: 590596 - protein, 9 aa, Homo Sapiens
ICIIINSVF

SEQ ID NO: 590597 - protein, 9 aa, Homo Sapiens
AAVMFLLCA

SEQ ID NO: 590598 - protein, 9 aa, Homo Sapiens
VANPHAEGQ

SEQ ID NO: 590599 - protein, 9 aa, Homo Sapiens
PGLRPFPGL

SEQ ID NO: 590600 - protein, 9 aa, Homo Sapiens
GFASCVVRY

SEQ ID NO: 590601 - protein, 9 aa, Homo Sapiens
SQIEFEQQE

SEQ ID NO: 590602 - protein, 9 aa, Homo Sapiens
LAVGLLRAA

SEQ ID NO: 590603 - protein, 9 aa, Homo Sapiens
MRGKYKAAQ

SEQ ID NO: 590604 - protein, 9 aa, Homo Sapiens
RITESTSQY

SEQ ID NO: 590605 - protein, 9 aa, Homo Sapiens
WGEEERNTT

SEQ ID NO: 590606 - protein, 9 aa, Homo Sapiens
VIVRGTFDI

SEQ ID NO: 590607 - protein, 9 aa, Homo Sapiens
SHQLIISSA

SEQ ID NO: 590608 - protein, 9 aa, Homo Sapiens
HINLYKVKP

SEQ ID NO: 590609 - protein, 9 aa, Homo Sapiens
DNFYVIVRG

SEQ ID NO: 590610 - protein, 9 aa, Homo Sapiens
ESRQKCPPS

SEQ ID NO: 590611 - protein, 9 aa, Homo Sapiens
ALDVQELSL

SEQ ID NO: 590612 - protein, 9 aa, Homo Sapiens
VSGLSCVLC

SEQ ID NO: 590613 - protein, 9 aa, Homo Sapiens
RYVINHHSS

SEQ ID NO: 590614 - protein, 9 aa, Homo Sapiens
LHWKAHHLQ

SEQ ID NO: 590615 - protein, 9 aa, Homo Sapiens
GLGRITEST

SEQ ID NO: 590616 - protein, 9 aa, Homo Sapiens
LAFAGLVII

SEQ ID NO: 590617 - protein, 9 aa, Homo Sapiens
FLKDEGRRM

SEQ ID NO: 590618 - protein, 9 aa, Homo Sapiens
HVFFLSNDL

SEQ ID NO: 590619 - protein, 9 aa, Homo Sapiens
GLNRLEQLT

SEQ ID NO: 590620 - protein, 9 aa, Homo Sapiens
LITSNPYDY

SEQ ID NO: 590621 - protein, 9 aa, Homo Sapiens
EEKMSRLSK

SEQ ID NO: 590622 - protein, 9 aa, Homo Sapiens
HVFKAGTVA

SEQ ID NO: 590623 - protein, 9 aa, Homo Sapiens
DLPDILDKQ

SEQ ID NO: 590624 - protein, 9 aa, Homo Sapiens
HFGKDFLKS

SEQ ID NO: 590625 - protein, 9 aa, Homo Sapiens
GMLMLTEDF

SEQ ID NO: 590626 - protein, 9 aa, Homo Sapiens
TSLTISAFQ

SEQ ID NO: 590627 - protein, 9 aa, Homo Sapiens
GKYKAAQKA

SEQ ID NO: 590628 - protein, 9 aa, Homo Sapiens
SVSGDILFP

SEQ ID NO: 590629 - protein, 9 aa, Homo Sapiens
LGHVFFLSN

SEQ ID NO: 590630 - protein, 9 aa, Homo Sapiens
APEASLQDN

SEQ ID NO: 590631 - protein, 9 aa, Homo Sapiens
VGHGRSEGE

SEQ ID NO: 590632 - protein, 9 aa, Homo Sapiens
SKAMTAYWT

SEQ ID NO: 590633 - protein, 9 aa, Homo Sapiens
SGLNRLEQL

SEQ ID NO: 590634 - protein, 9 aa, Homo Sapiens
QTDQTPAQE

SEQ ID NO: 590635 - protein, 9 aa, Homo Sapiens
CLNERAALL

SEQ ID NO: 590636 - protein, 9 aa, Homo Sapiens
LQSCIAFGM

SEQ ID NO: 590637 - protein, 9 aa, Homo Sapiens
PLFQAFLVI

SEQ ID NO: 590638 - protein, 9 aa, Homo Sapiens
LMQQLDLEA

SEQ ID NO: 590639 - protein, 9 aa, Homo Sapiens
ARTSQEIQM

SEQ ID NO: 590640 - protein, 9 aa, Homo Sapiens
EGRRMTDVA

SEQ ID NO: 590641 - protein, 9 aa, Homo Sapiens
ASHQLIISS

SEQ ID NO: 590642 - protein, 9 aa, Homo Sapiens
LDQASVIAD

SEQ ID NO: 590643 - protein, 9 aa, Homo Sapiens
RAFSGLNRL

SEQ ID NO: 590644 - protein, 9 aa, Homo Sapiens
DQAITKKVQ

SEQ ID NO: 590645 - protein, 9 aa, Homo Sapiens
RKERSSAYC

SEQ ID NO: 590646 - protein, 9 aa, Homo Sapiens
MSWKVRRSA

SEQ ID NO: 590647 - protein, 9 aa, Homo Sapiens
NSKVTQSEH

SEQ ID NO: 590648 - protein, 9 aa, Homo Sapiens
IWYFGSAQG

SEQ ID NO: 590649 - protein, 9 aa, Homo Sapiens
LGRIKTFSQ

SEQ ID NO: 590650 - protein, 9 aa, Homo Sapiens
EKAKSPGRG

SEQ ID NO: 590651 - protein, 9 aa, Homo Sapiens
LRFQGDRNY

SEQ ID NO: 590652 - protein, 9 aa, Homo Sapiens
PCDCDLRGK

SEQ ID NO: 590653 - protein, 9 aa, Homo Sapiens
SNNRVNQTP

SEQ ID NO: 590654 - protein, 9 aa, Homo Sapiens
STEEKQLSE

SEQ ID NO: 590655 - protein, 9 aa, Homo Sapiens
DILFPVLSE

SEQ ID NO: 590656 - protein, 9 aa, Homo Sapiens
KLEELGDLV

SEQ ID NO: 590657 - protein, 9 aa, Homo Sapiens
QVLWDWLRN

SEQ ID NO: 590658 - protein, 9 aa, Homo Sapiens
RRKKPTHSE

SEQ ID NO: 590659 - protein, 9 aa, Homo Sapiens
VKDFRKKFK

SEQ ID NO: 590660 - protein, 9 aa, Homo Sapiens
FGKDFLKSE

SEQ ID NO: 590661 - protein, 9 aa, Homo Sapiens
IHPGLVCCV

SEQ ID NO: 590662 - protein, 9 aa, Homo Sapiens
KKGRPSRPA

SEQ ID NO: 590663 - protein, 9 aa, Homo Sapiens
CFSSLSLGR

SEQ ID NO: 590664 - protein, 9 aa, Homo Sapiens
QGPEAHKGP

SEQ ID NO: 590665 - protein, 9 aa, Homo Sapiens
RTAVTQGGW

SEQ ID NO: 590666 - protein, 9 aa, Homo Sapiens
TSERFDTHG

SEQ ID NO: 590667 - protein, 9 aa, Homo Sapiens
SEINANYLD

SEQ ID NO: 590668 - protein, 9 aa, Homo Sapiens
LVAVKCMLL

SEQ ID NO: 590669 - protein, 9 aa, Homo Sapiens
RSNQQLQVM

SEQ ID NO: 590670 - protein, 9 aa, Homo Sapiens
VQAIWYFGS

SEQ ID NO: 590671 - protein, 9 aa, Homo Sapiens
LIDYFYEEQ

SEQ ID NO: 590672 - protein, 9 aa, Homo Sapiens
MDFKELLQV

SEQ ID NO: 590673 - protein, 9 aa, Homo Sapiens
QQLDLEADE

SEQ ID NO: 590674 - protein, 9 aa, Homo Sapiens
PEDLEALLQ

SEQ ID NO: 590675 - protein, 9 aa, Homo Sapiens
HLLYNFCHS

SEQ ID NO: 590676 - protein, 9 aa, Homo Sapiens
GKGKPKSPA

SEQ ID NO: 590677 - protein, 9 aa, Homo Sapiens
FKLMWNILL

SEQ ID NO: 590678 - protein, 9 aa, Homo Sapiens
LGEEVLRQL

SEQ ID NO: 590679 - protein, 9 aa, Homo Sapiens
DFKELLQVD

SEQ ID NO: 590680 - protein, 9 aa, Homo Sapiens
FTMRVLGES

SEQ ID NO: 590681 - protein, 9 aa, Homo Sapiens
RGKSGDACN

SEQ ID NO: 590682 - protein, 9 aa, Homo Sapiens
SVTCELCWP

SEQ ID NO: 590683 - protein, 9 aa, Homo Sapiens
GDILFPVLS

SEQ ID NO: 590684 - protein, 9 aa, Homo Sapiens
FSSLSLGRI

SEQ ID NO: 590685 - protein, 9 aa, Homo Sapiens
VVTRTKHMR

SEQ ID NO: 590686 - protein, 9 aa, Homo Sapiens
GPLRFQGDR

SEQ ID NO: 590687 - protein, 9 aa, Homo Sapiens
SAKSKNLLA

SEQ ID NO: 590688 - protein, 9 aa, Homo Sapiens
LDILFAFTM

SEQ ID NO: 590689 - protein, 9 aa, Homo Sapiens
FDYLAVYDG

SEQ ID NO: 590690 - protein, 9 aa, Homo Sapiens
KSKNLLAWN

SEQ ID NO: 590691 - protein, 9 aa, Homo Sapiens
ASCVVRYFV

SEQ ID NO: 590692 - protein, 9 aa, Homo Sapiens
GYRSHGPLL

SEQ ID NO: 590693 - protein, 9 aa, Homo Sapiens
NRVNQTPKK

SEQ ID NO: 590694 - protein, 9 aa, Homo Sapiens
KLGHVFFLS

SEQ ID NO: 590695 - protein, 9 aa, Homo Sapiens
LLQVDPRLL

SEQ ID NO: 590696 - protein, 9 aa, Homo Sapiens
QQCLSLWGP

SEQ ID NO: 590697 - protein, 9 aa, Homo Sapiens
LLLPAHTLQ

SEQ ID NO: 590698 - protein, 9 aa, Homo Sapiens
YIQSNRRHY

SEQ ID NO: 590699 - protein, 9 aa, Homo Sapiens
ILVHSVFSM

SEQ ID NO: 590700 - protein, 9 aa, Homo Sapiens
IKILVHSVF

SEQ ID NO: 590701 - protein, 9 aa, Homo Sapiens
PFTKQQLNN

SEQ ID NO: 590702 - protein, 9 aa, Homo Sapiens
RHILVAVKC

SEQ ID NO: 590703 - protein, 9 aa, Homo Sapiens
IKSVVPVYL

SEQ ID NO: 590704 - protein, 9 aa, Homo Sapiens
KVDGFFRRS

SEQ ID NO: 590705 - protein, 9 aa, Homo Sapiens
FMAFDRYVA

SEQ ID NO: 590706 - protein, 9 aa, Homo Sapiens
LEELGDLVD

SEQ ID NO: 590707 - protein, 9 aa, Homo Sapiens
YWASELVLA

SEQ ID NO: 590708 - protein, 9 aa, Homo Sapiens
TMGNVATFC

SEQ ID NO: 590709 - protein, 9 aa, Homo Sapiens
HLAKLEEAL

SEQ ID NO: 590710 - protein, 9 aa, Homo Sapiens
TTSFPFSPG

SEQ ID NO: 590711 - protein, 9 aa, Homo Sapiens
EPFTKQQLN

SEQ ID NO: 590712 - protein, 9 aa, Homo Sapiens
QGAELSYEE

SEQ ID NO: 590713 - protein, 9 aa, Homo Sapiens
GTCDHFTKP

SEQ ID NO: 590714 - protein, 9 aa, Homo Sapiens
ITESTSQYQ

SEQ ID NO: 590715 - protein, 9 aa, Homo Sapiens
GIQRRFTVT

SEQ ID NO: 590716 - protein, 9 aa, Homo Sapiens
VSSGSRVCG

SEQ ID NO: 590717 - protein, 9 aa, Homo Sapiens
EHMAGAAAV

SEQ ID NO: 590718 - protein, 9 aa, Homo Sapiens
LLHWKAHHL

SEQ ID NO: 590719 - protein, 9 aa, Homo Sapiens
EELMQQLDL

SEQ ID NO: 590720 - protein, 9 aa, Homo Sapiens
LIRSMIGYI

SEQ ID NO: 590721 - protein, 9 aa, Homo Sapiens
WSDLPKDKF

SEQ ID NO: 590722 - protein, 9 aa, Homo Sapiens
QASVIADRF

SEQ ID NO: 590723 - protein, 9 aa, Homo Sapiens
KGNNPYPKS

SEQ ID NO: 590724 - protein, 9 aa, Homo Sapiens
PYSQELPGA

SEQ ID NO: 590725 - protein, 9 aa, Homo Sapiens
PLRFQGDRN

SEQ ID NO: 590726 - protein, 9 aa, Homo Sapiens
YCRLQSCIA

SEQ ID NO: 590727 - protein, 9 aa, Homo Sapiens
NNTPSSAEP

SEQ ID NO: 590728 - protein, 9 aa, Homo Sapiens
ILDKQNQMR

SEQ ID NO: 590729 - protein, 9 aa, Homo Sapiens
LNLDEDSIT

SEQ ID NO: 590730 - protein, 9 aa, Homo Sapiens
NFKLMWNIL

SEQ ID NO: 590731 - protein, 9 aa, Homo Sapiens
PDKVDGFFR

SEQ ID NO: 590732 - protein, 9 aa, Homo Sapiens
DLELAILHH

SEQ ID NO: 590733 - protein, 9 aa, Homo Sapiens
IILREDASH

SEQ ID NO: 590734 - protein, 9 aa, Homo Sapiens
DFDPASTMS

SEQ ID NO: 590735 - protein, 9 aa, Homo Sapiens
ICDIDGDGC

SEQ ID NO: 590736 - protein, 9 aa, Homo Sapiens
TQGGWRSLW

SEQ ID NO: 590737 - protein, 9 aa, Homo Sapiens
PFPGLDQMS

SEQ ID NO: 590738 - protein, 9 aa, Homo Sapiens
FASCVVRYF

SEQ ID NO: 590739 - protein, 9 aa, Homo Sapiens
SFKQSSNLT

SEQ ID NO: 590740 - protein, 9 aa, Homo Sapiens
LKSEKLSPD

SEQ ID NO: 590741 - protein, 9 aa, Homo Sapiens
GLTRIWQGC

SEQ ID NO: 590742 - protein, 9 aa, Homo Sapiens
DFITLQNVS

SEQ ID NO: 590743 - protein, 9 aa, Homo Sapiens
IPAERDGEP

SEQ ID NO: 590744 - protein, 9 aa, Homo Sapiens
LGGLFTYVS

SEQ ID NO: 590745 - protein, 9 aa, Homo Sapiens
KLKKQEKEV

SEQ ID NO: 590746 - protein, 9 aa, Homo Sapiens
EDSITKPVH

SEQ ID NO: 590747 - protein, 9 aa, Homo Sapiens
VEPFTKQQL

SEQ ID NO: 590748 - protein, 9 aa, Homo Sapiens
VVRYFVALY

SEQ ID NO: 590749 - protein, 9 aa, Homo Sapiens
YNFKYLQCQ

SEQ ID NO: 590750 - protein, 9 aa, Homo Sapiens
GSKEVQRDY

SEQ ID NO: 590751 - protein, 9 aa, Homo Sapiens
LQMKGSQIE

SEQ ID NO: 590752 - protein, 9 aa, Homo Sapiens
THPCSLRKH

SEQ ID NO: 590753 - protein, 9 aa, Homo Sapiens
GLLRAALIL

SEQ ID NO: 590754 - protein, 9 aa, Homo Sapiens
LLITSNPYD

SEQ ID NO: 590755 - protein, 9 aa, Homo Sapiens
KIPLFQAFL

SEQ ID NO: 590756 - protein, 9 aa, Homo Sapiens
TQEPSAQLG

SEQ ID NO: 590757 - protein, 9 aa, Homo Sapiens
RHTSQVTQL

SEQ ID NO: 590758 - protein, 9 aa, Homo Sapiens
AERVGKEKA

SEQ ID NO: 590759 - protein, 9 aa, Homo Sapiens
FLVIFQWHQ

SEQ ID NO: 590760 - protein, 9 aa, Homo Sapiens
LVKMDFDEK

SEQ ID NO: 590761 - protein, 9 aa, Homo Sapiens
AQTSLTISA

SEQ ID NO: 590762 - protein, 9 aa, Homo Sapiens
FSLPPGGIN

SEQ ID NO: 590763 - protein, 9 aa, Homo Sapiens
VGVFLYYEA

SEQ ID NO: 590764 - protein, 9 aa, Homo Sapiens
LVRDTLKIV

SEQ ID NO: 590765 - protein, 9 aa, Homo Sapiens
YGISARHIL

SEQ ID NO: 590766 - protein, 9 aa, Homo Sapiens
KSVVPVYLK

SEQ ID NO: 590767 - protein, 9 aa, Homo Sapiens
EASLQDNEG

SEQ ID NO: 590768 - protein, 9 aa, Homo Sapiens
YSVTCELCW

SEQ ID NO: 590769 - protein, 9 aa, Homo Sapiens
HCLLLPAHT

SEQ ID NO: 590770 - protein, 9 aa, Homo Sapiens
EKEVKDFRK

SEQ ID NO: 590771 - protein, 9 aa, Homo Sapiens
FAGLVIIII

SEQ ID NO: 590772 - protein, 9 aa, Homo Sapiens
LAKLEEALR

SEQ ID NO: 590773 - protein, 9 aa, Homo Sapiens
CSAKSKNLL

SEQ ID NO: 590774 - protein, 9 aa, Homo Sapiens
IGNMRAASP

SEQ ID NO: 590775 - protein, 9 aa, Homo Sapiens
YQLIRSMIG

SEQ ID NO: 590776 - protein, 9 aa, Homo Sapiens
SREYCSMII

SEQ ID NO: 590777 - protein, 9 aa, Homo Sapiens
TESTSQYQG

SEQ ID NO: 590778 - protein, 9 aa, Homo Sapiens
SVGPLRFQG

SEQ ID NO: 590779 - protein, 9 aa, Homo Sapiens
SGYIQSNRR

SEQ ID NO: 590780 - protein, 9 aa, Homo Sapiens
MATNVGDQR

SEQ ID NO: 590781 - protein, 9 aa, Homo Sapiens
STMSKYDSL

SEQ ID NO: 590782 - protein, 9 aa, Homo Sapiens
PRGLDIKLE

SEQ ID NO: 590783 - protein, 9 aa, Homo Sapiens
IHTGGKPYV

SEQ ID NO: 590784 - protein, 9 aa, Homo Sapiens
LEALLQSDE

SEQ ID NO: 590785 - protein, 9 aa, Homo Sapiens
VTVIPLLPS

SEQ ID NO: 590786 - protein, 9 aa, Homo Sapiens
PIIRALVRD

SEQ ID NO: 590787 - protein, 9 aa, Homo Sapiens
EDASHQLII

SEQ ID NO: 590788 - protein, 9 aa, Homo Sapiens
DGDNFYVIV

SEQ ID NO: 590789 - protein, 9 aa, Homo Sapiens
VRRSAAKCI

SEQ ID NO: 590790 - protein, 9 aa, Homo Sapiens
LLQMKGSQI

SEQ ID NO: 590791 - protein, 9 aa, Homo Sapiens
TPAQELHRS

SEQ ID NO: 590792 - protein, 9 aa, Homo Sapiens
INANYLDKY

SEQ ID NO: 590793 - protein, 9 aa, Homo Sapiens
LYLVLDRGH

SEQ ID NO: 590794 - protein, 9 aa, Homo Sapiens
YRSHGPLLP

SEQ ID NO: 590795 - protein, 9 aa, Homo Sapiens
KLYGYLAQH

SEQ ID NO: 590796 - protein, 9 aa, Homo Sapiens
PPDKVDGFF

SEQ ID NO: 590797 - protein, 9 aa, Homo Sapiens
HHPNCTFDY

SEQ ID NO: 590798 - protein, 9 aa, Homo Sapiens
KGPPAPSQG

SEQ ID NO: 590799 - protein, 9 aa, Homo Sapiens
ESTSQYQGV

SEQ ID NO: 590800 - protein, 9 aa, Homo Sapiens
YTHPCSLRK

SEQ ID NO: 590801 - protein, 9 aa, Homo Sapiens
SLYLVLDRG

SEQ ID NO: 590802 - protein, 9 aa, Homo Sapiens
VTQSEHSSE

SEQ ID NO: 590803 - protein, 9 aa, Homo Sapiens
SSCNGTWSE

SEQ ID NO: 590804 - protein, 9 aa, Homo Sapiens
CPYSQELPG

SEQ ID NO: 590805 - protein, 9 aa, Homo Sapiens
GKPKSPACE

SEQ ID NO: 590806 - protein, 9 aa, Homo Sapiens
QYLGVPYAT

SEQ ID NO: 590807 - protein, 9 aa, Homo Sapiens
SAQLGEEVL

SEQ ID NO: 590808 - protein, 9 aa, Homo Sapiens
ARCVSNSRE

SEQ ID NO: 590809 - protein, 9 aa, Homo Sapiens
PDSTEEKQL

SEQ ID NO: 590810 - protein, 9 aa, Homo Sapiens
NRVLALIVS

SEQ ID NO: 590811 - protein, 9 aa, Homo Sapiens
RSAAKCIAA

SEQ ID NO: 590812 - protein, 9 aa, Homo Sapiens
EISYRIPLG

SEQ ID NO: 590813 - protein, 9 aa, Homo Sapiens
PIAAGTCDH

SEQ ID NO: 590814 - protein, 9 aa, Homo Sapiens
DASHQLIIS

SEQ ID NO: 590815 - protein, 9 aa, Homo Sapiens
LQVDPRLLN

SEQ ID NO: 590816 - protein, 9 aa, Homo Sapiens
SAAKCIAAL

SEQ ID NO: 590817 - protein, 9 aa, Homo Sapiens
VGSSPHLQR

SEQ ID NO: 590818 - protein, 9 aa, Homo Sapiens
RFQGDRNYW

SEQ ID NO: 590819 - protein, 9 aa, Homo Sapiens
HGLTRIWQG

SEQ ID NO: 590820 - protein, 9 aa, Homo Sapiens
GLDIKLEEL

SEQ ID NO: 590821 - protein, 9 aa, Homo Sapiens
PCSLRKHMK

SEQ ID NO: 590822 - protein, 9 aa, Homo Sapiens
QEEEANKLT

SEQ ID NO: 590823 - protein, 9 aa, Homo Sapiens
ALLQSDERE

SEQ ID NO: 590824 - protein, 9 aa, Homo Sapiens
ASVIADRFV

SEQ ID NO: 590825 - protein, 9 aa, Homo Sapiens
TGVIPQGRD

SEQ ID NO: 590826 - protein, 9 aa, Homo Sapiens
HRLPVRKKV

SEQ ID NO: 590827 - protein, 9 aa, Homo Sapiens
RVNQTPKKM

SEQ ID NO: 590828 - protein, 9 aa, Homo Sapiens
HRSSSVSPH

SEQ ID NO: 590829 - protein, 9 aa, Homo Sapiens
YRIPLGGLF

SEQ ID NO: 590830 - protein, 9 aa, Homo Sapiens
LKGNNPYPK

SEQ ID NO: 590831 - protein, 9 aa, Homo Sapiens
TKPVHSSIL

SEQ ID NO: 590832 - protein, 9 aa, Homo Sapiens
HRAFSGLNR

SEQ ID NO: 590833 - protein, 9 aa, Homo Sapiens
LFAFTMRVL

SEQ ID NO: 590834 - protein, 9 aa, Homo Sapiens
LPPGGINAA

SEQ ID NO: 590835 - protein, 9 aa, Homo Sapiens
VLMKTMGNV

SEQ ID NO: 590836 - protein, 9 aa, Homo Sapiens
LLQQHLAKL

SEQ ID NO: 590837 - protein, 9 aa, Homo Sapiens
IAAGTCDHF

SEQ ID NO: 590838 - protein, 9 aa, Homo Sapiens
HHVFKAGTV

SEQ ID NO: 590839 - protein, 9 aa, Homo Sapiens
TRIWQGCSA

SEQ ID NO: 590840 - protein, 9 aa, Homo Sapiens
WASELVLAQ

SEQ ID NO: 590841 - protein, 9 aa, Homo Sapiens
QAFLVIYLI

SEQ ID NO: 590842 - protein, 9 aa, Homo Sapiens
IMVVLVVTR

SEQ ID NO: 590843 - protein, 9 aa, Homo Sapiens
VPCEPPEVG

SEQ ID NO: 590844 - protein, 9 aa, Homo Sapiens
PCEPPEVGS

SEQ ID NO: 590845 - protein, 9 aa, Homo Sapiens
LICDIDGDG

SEQ ID NO: 590846 - protein, 9 aa, Homo Sapiens
SAYCKNDLW

SEQ ID NO: 590847 - protein, 9 aa, Homo Sapiens
CRNQGYQLI

SEQ ID NO: 590848 - protein, 9 aa, Homo Sapiens
LDLEADEET

SEQ ID NO: 590849 - protein, 9 aa, Homo Sapiens
ERKLYGYLA

SEQ ID NO: 590850 - protein, 9 aa, Homo Sapiens
VDQAITKKV

SEQ ID NO: 590851 - protein, 9 aa, Homo Sapiens
LHQGIQRRF

SEQ ID NO: 590852 - protein, 9 aa, Homo Sapiens
VQELSLGVL

SEQ ID NO: 590853 - protein, 9 aa, Homo Sapiens
EPSAQLGEE

SEQ ID NO: 590854 - protein, 9 aa, Homo Sapiens
SVSPFYLGA

SEQ ID NO: 590855 - protein, 9 aa, Homo Sapiens
QLEFTKKTP

SEQ ID NO: 590856 - protein, 9 aa, Homo Sapiens
PYKCGLCGK

SEQ ID NO: 590857 - protein, 9 aa, Homo Sapiens
NTRDLLHWK

SEQ ID NO: 590858 - protein, 9 aa, Homo Sapiens
DPHCLLLPA

SEQ ID NO: 590859 - protein, 9 aa, Homo Sapiens
SLSQGPDST

SEQ ID NO: 590860 - protein, 9 aa, Homo Sapiens
LMVLPSVAA

SEQ ID NO: 590861 - protein, 9 aa, Homo Sapiens
PSQTSLKKK

SEQ ID NO: 590862 - protein, 9 aa, Homo Sapiens
RLILIPCWC

SEQ ID NO: 590863 - protein, 9 aa, Homo Sapiens
IGKTSGVNL

SEQ ID NO: 590864 - protein, 9 aa, Homo Sapiens
GQITDLKVE

SEQ ID NO: 590865 - protein, 9 aa, Homo Sapiens
DTLIPTLGE

SEQ ID NO: 590866 - protein, 9 aa, Homo Sapiens
YSQFLQVTV

SEQ ID NO: 590867 - protein, 9 aa, Homo Sapiens
IVTPEWVLD

SEQ ID NO: 590868 - protein, 9 aa, Homo Sapiens
DPTPYPETS

SEQ ID NO: 590869 - protein, 9 aa, Homo Sapiens
CVLSDLQKT

SEQ ID NO: 590870 - protein, 9 aa, Homo Sapiens
QLTNDKSPE

SEQ ID NO: 590871 - protein, 9 aa, Homo Sapiens
DVDAHHPIQ

SEQ ID NO: 590872 - protein, 9 aa, Homo Sapiens
AAKLVEAHG

SEQ ID NO: 590873 - protein, 9 aa, Homo Sapiens
GTQSGIFNV

SEQ ID NO: 590874 - protein, 9 aa, Homo Sapiens
YWLPLTDGQ

SEQ ID NO: 590875 - protein, 9 aa, Homo Sapiens
IWKKIAIQG

SEQ ID NO: 590876 - protein, 9 aa, Homo Sapiens
SHKLKGVCP

SEQ ID NO: 590877 - protein, 9 aa, Homo Sapiens
YAVHAGVVR

SEQ ID NO: 590878 - protein, 9 aa, Homo Sapiens
RPSCCLTTC

SEQ ID NO: 590879 - protein, 9 aa, Homo Sapiens
VEEAGGQAL

SEQ ID NO: 590880 - protein, 9 aa, Homo Sapiens
MAEGGDPEP

SEQ ID NO: 590881 - protein, 9 aa, Homo Sapiens
GFSGYSQFL

SEQ ID NO: 590882 - protein, 9 aa, Homo Sapiens
GRTVSFVDI

SEQ ID NO: 590883 - protein, 9 aa, Homo Sapiens
KAFKQRQRL

SEQ ID NO: 590884 - protein, 9 aa, Homo Sapiens
TARDIYLPP

SEQ ID NO: 590885 - protein, 9 aa, Homo Sapiens
LLLNCFSFL

SEQ ID NO: 590886 - protein, 9 aa, Homo Sapiens
KGIGKTSGV

SEQ ID NO: 590887 - protein, 9 aa, Homo Sapiens
DDNYCRNPY

SEQ ID NO: 590888 - protein, 9 aa, Homo Sapiens
DGSSEEQSD

SEQ ID NO: 590889 - protein, 9 aa, Homo Sapiens
ASIKIVTPE

SEQ ID NO: 590890 - protein, 9 aa, Homo Sapiens
PIQCPGTPA

SEQ ID NO: 590891 - protein, 9 aa, Homo Sapiens
ISKITYFKR

SEQ ID NO: 590892 - protein, 9 aa, Homo Sapiens
DIVGGYNWR

SEQ ID NO: 590893 - protein, 9 aa, Homo Sapiens
ACSRNAVPD

SEQ ID NO: 590894 - protein, 9 aa, Homo Sapiens
PRSLVVFGN

SEQ ID NO: 590895 - protein, 9 aa, Homo Sapiens
PPGPPPPDN

SEQ ID NO: 590896 - protein, 9 aa, Homo Sapiens
VIAFSYFIT

SEQ ID NO: 590897 - protein, 9 aa, Homo Sapiens
EKNHVYCLF

SEQ ID NO: 590898 - protein, 9 aa, Homo Sapiens
FLGEAERVA

SEQ ID NO: 590899 - protein, 9 aa, Homo Sapiens
FQIQARTAA

SEQ ID NO: 590900 - protein, 9 aa, Homo Sapiens
AGMTGYEMP

SEQ ID NO: 590901 - protein, 9 aa, Homo Sapiens
VLETSPQTL

SEQ ID NO: 590902 - protein, 9 aa, Homo Sapiens
FPSLFFCDF

SEQ ID NO: 590903 - protein, 9 aa, Homo Sapiens
YVFQIQART

SEQ ID NO: 590904 - protein, 9 aa, Homo Sapiens
CSTDVCDSV

SEQ ID NO: 590905 - protein, 9 aa, Homo Sapiens
KYFNPESLQ

SEQ ID NO: 590906 - protein, 9 aa, Homo Sapiens
WDDALHTVR

SEQ ID NO: 590907 - protein, 9 aa, Homo Sapiens
VDTRQQEYI

SEQ ID NO: 590908 - protein, 9 aa, Homo Sapiens
LDAGTLAIA

SEQ ID NO: 590909 - protein, 9 aa, Homo Sapiens
RKIDIVGGY

SEQ ID NO: 590910 - protein, 9 aa, Homo Sapiens
ITKGQNVQQ

SEQ ID NO: 590911 - protein, 9 aa, Homo Sapiens
HEVDTTLKS

SEQ ID NO: 590912 - protein, 9 aa, Homo Sapiens
LGCPSQTSL

SEQ ID NO: 590913 - protein, 9 aa, Homo Sapiens
PMHTRLGPE

SEQ ID NO: 590914 - protein, 9 aa, Homo Sapiens
EQLTNDKSP

SEQ ID NO: 590915 - protein, 9 aa, Homo Sapiens
ERKIDIVGG

SEQ ID NO: 590916 - protein, 9 aa, Homo Sapiens
SRFLGEAER

SEQ ID NO: 590917 - protein, 9 aa, Homo Sapiens
ILRNLAGEP

SEQ ID NO: 590918 - protein, 9 aa, Homo Sapiens
SDTRSHSQS

SEQ ID NO: 590919 - protein, 9 aa, Homo Sapiens
QRQRLAQHH

SEQ ID NO: 590920 - protein, 9 aa, Homo Sapiens
DTRSHSQSS

SEQ ID NO: 590921 - protein, 9 aa, Homo Sapiens
RMDSRAQVN

SEQ ID NO: 590922 - protein, 9 aa, Homo Sapiens
ETSPQTLCQ

SEQ ID NO: 590923 - protein, 9 aa, Homo Sapiens
MGNCVKEAN

SEQ ID NO: 590924 - protein, 9 aa, Homo Sapiens
FARELELGH

SEQ ID NO: 590925 - protein, 9 aa, Homo Sapiens
RSHSQSSDT

SEQ ID NO: 590926 - protein, 9 aa, Homo Sapiens
QARTAAGYG

SEQ ID NO: 590927 - protein, 9 aa, Homo Sapiens
DGSMHNYCP

SEQ ID NO: 590928 - protein, 9 aa, Homo Sapiens
PLPKEFTYL

SEQ ID NO: 590929 - protein, 9 aa, Homo Sapiens
QIKPNSTVD

SEQ ID NO: 590930 - protein, 9 aa, Homo Sapiens
MIHSASTKL

SEQ ID NO: 590931 - protein, 9 aa, Homo Sapiens
QLPPKIFQF

SEQ ID NO: 590932 - protein, 9 aa, Homo Sapiens
QIGFAASCS

SEQ ID NO: 590933 - protein, 9 aa, Homo Sapiens
TDSASSPSL

SEQ ID NO: 590934 - protein, 9 aa, Homo Sapiens
GGDPEPGEQ

SEQ ID NO: 590935 - protein, 9 aa, Homo Sapiens
QQSYLGSGI

SEQ ID NO: 590936 - protein, 9 aa, Homo Sapiens
MTVTDFGWD

SEQ ID NO: 590937 - protein, 9 aa, Homo Sapiens
QRSGAAVGQ

SEQ ID NO: 590938 - protein, 9 aa, Homo Sapiens
GAPVEETLH

SEQ ID NO: 590939 - protein, 9 aa, Homo Sapiens
PLVKIMPVK

SEQ ID NO: 590940 - protein, 9 aa, Homo Sapiens
SLPSPLPKE

SEQ ID NO: 590941 - protein, 9 aa, Homo Sapiens
PQRRLGCPS

SEQ ID NO: 590942 - protein, 9 aa, Homo Sapiens
SLKKKLRGT

SEQ ID NO: 590943 - protein, 9 aa, Homo Sapiens
IFNVKLPGS

SEQ ID NO: 590944 - protein, 9 aa, Homo Sapiens
LPSPLPKEF

SEQ ID NO: 590945 - protein, 9 aa, Homo Sapiens
DSKHGSSEA

SEQ ID NO: 590946 - protein, 9 aa, Homo Sapiens
KILRNLAGE

SEQ ID NO: 590947 - protein, 9 aa, Homo Sapiens
RGPAGEQGP

SEQ ID NO: 590948 - protein, 9 aa, Homo Sapiens
RLRVCVLSD

SEQ ID NO: 590949 - protein, 9 aa, Homo Sapiens
NSNSLPANV

SEQ ID NO: 590950 - protein, 9 aa, Homo Sapiens
KNVDPTPYP

SEQ ID NO: 590951 - protein, 9 aa, Homo Sapiens
WLPLTDGQI

SEQ ID NO: 590952 - protein, 9 aa, Homo Sapiens
PASQGLGPS

SEQ ID NO: 590953 - protein, 9 aa, Homo Sapiens
LHRLKCFLR

SEQ ID NO: 590954 - protein, 9 aa, Homo Sapiens
YLIIFLLIL

SEQ ID NO: 590955 - protein, 9 aa, Homo Sapiens
QSLKTPQRR

SEQ ID NO: 590956 - protein, 9 aa, Homo Sapiens
LLNCFSFLI

SEQ ID NO: 590957 - protein, 9 aa, Homo Sapiens
APDHGAPVE

SEQ ID NO: 590958 - protein, 9 aa, Homo Sapiens
EKAVSRVRN

SEQ ID NO: 590959 - protein, 9 aa, Homo Sapiens
KMKVNEISL

SEQ ID NO: 590960 - protein, 9 aa, Homo Sapiens
GMTGYEMPR

SEQ ID NO: 590961 - protein, 9 aa, Homo Sapiens
TPKGTARDI

SEQ ID NO: 590962 - protein, 9 aa, Homo Sapiens
TDVTTNSVG

SEQ ID NO: 590963 - protein, 9 aa, Homo Sapiens
AQAARCQPS

SEQ ID NO: 590964 - protein, 9 aa, Homo Sapiens
IFLMGNCVK

SEQ ID NO: 590965 - protein, 9 aa, Homo Sapiens
ICTSEMEYF

SEQ ID NO: 590966 - protein, 9 aa, Homo Sapiens
WKSENKTPS

SEQ ID NO: 590967 - protein, 9 aa, Homo Sapiens
CTSEMEYFI

SEQ ID NO: 590968 - protein, 9 aa, Homo Sapiens
CLGAKAIQL

SEQ ID NO: 590969 - protein, 9 aa, Homo Sapiens
LEQLGTKHG

SEQ ID NO: 590970 - protein, 9 aa, Homo Sapiens
HGAPVEETL

SEQ ID NO: 590971 - protein, 9 aa, Homo Sapiens
QAHPNIIAL

SEQ ID NO: 590972 - protein, 9 aa, Homo Sapiens
NVKLPGSSK

SEQ ID NO: 590973 - protein, 9 aa, Homo Sapiens
VDTIEESPS

SEQ ID NO: 590974 - protein, 9 aa, Homo Sapiens
PQTLCQIYL

SEQ ID NO: 590975 - protein, 9 aa, Homo Sapiens
FLQQKDYLI

SEQ ID NO: 590976 - protein, 9 aa, Homo Sapiens
NSMVADIQE

SEQ ID NO: 590977 - protein, 9 aa, Homo Sapiens
KTCRMEPAG

SEQ ID NO: 590978 - protein, 9 aa, Homo Sapiens
LSDLQKTER

SEQ ID NO: 590979 - protein, 9 aa, Homo Sapiens
AFSYFITSL

SEQ ID NO: 590980 - protein, 9 aa, Homo Sapiens
LCQIYLQSL

SEQ ID NO: 590981 - protein, 9 aa, Homo Sapiens
KGTARDIYL

SEQ ID NO: 590982 - protein, 9 aa, Homo Sapiens
IYRLILIPC

SEQ ID NO: 590983 - protein, 9 aa, Homo Sapiens
VCVLSDLQK

SEQ ID NO: 590984 - protein, 9 aa, Homo Sapiens
VADIQELPA

SEQ ID NO: 590985 - protein, 9 aa, Homo Sapiens
SRAQVNKPG

SEQ ID NO: 590986 - protein, 9 aa, Homo Sapiens
EKMKVNEIS

SEQ ID NO: 590987 - protein, 9 aa, Homo Sapiens
MQAHPNIIA

SEQ ID NO: 590988 - protein, 9 aa, Homo Sapiens
QYIPKHKLC

SEQ ID NO: 590989 - protein, 9 aa, Homo Sapiens
AYTKPSHVK

SEQ ID NO: 590990 - protein, 9 aa, Homo Sapiens
VCDSVYSAS

SEQ ID NO: 590991 - protein, 9 aa, Homo Sapiens
GCPSQTSLK

SEQ ID NO: 590992 - protein, 9 aa, Homo Sapiens
VTTNSVGLS

SEQ ID NO: 590993 - protein, 9 aa, Homo Sapiens
NVDPTPYPE

SEQ ID NO: 590994 - protein, 9 aa, Homo Sapiens
NPITISKIT

SEQ ID NO: 590995 - protein, 9 aa, Homo Sapiens
IKWKLSAEL

SEQ ID NO: 590996 - protein, 9 aa, Homo Sapiens
SSECLKGPL

SEQ ID NO: 590997 - protein, 9 aa, Homo Sapiens
AVSRVRNLV

SEQ ID NO: 590998 - protein, 9 aa, Homo Sapiens
KIDIVGGYN

SEQ ID NO: 590999 - protein, 9 aa, Homo Sapiens
KKLRGTWKS

SEQ ID NO: 591000 - protein, 9 aa, Homo Sapiens
LNCFSFLIT

SEQ ID NO: 591001 - protein, 9 aa, Homo Sapiens
RSLVVFGNG

SEQ ID NO: 591002 - protein, 9 aa, Homo Sapiens
VDAHHPIQC

SEQ ID NO: 591003 - protein, 9 aa, Homo Sapiens
PRGPAGEQG

SEQ ID NO: 591004 - protein, 9 aa, Homo Sapiens
PSVAAPAVV

SEQ ID NO: 591005 - protein, 9 aa, Homo Sapiens
SRVRNLVEA

SEQ ID NO: 591006 - protein, 9 aa, Homo Sapiens
MRKLQKTCR

SEQ ID NO: 591007 - protein, 9 aa, Homo Sapiens
ALSEMKFQY

SEQ ID NO: 591008 - protein, 9 aa, Homo Sapiens
ITRFCNHPV

SEQ ID NO: 591009 - protein, 9 aa, Homo Sapiens
QSYLGSGIH

SEQ ID NO: 591010 - protein, 9 aa, Homo Sapiens
SFLQIGFAA

SEQ ID NO: 591011 - protein, 9 aa, Homo Sapiens
DAGDVDAHH

SEQ ID NO: 591012 - protein, 9 aa, Homo Sapiens
VNEISLHSI

SEQ ID NO: 591013 - protein, 9 aa, Homo Sapiens
QRRLGCPSQ

SEQ ID NO: 591014 - protein, 9 aa, Homo Sapiens
VSSCGDAGD

SEQ ID NO: 591015 - protein, 9 aa, Homo Sapiens
TNLVLPSDG

SEQ ID NO: 591016 - protein, 9 aa, Homo Sapiens
RLKILRNLA

SEQ ID NO: 591017 - protein, 9 aa, Homo Sapiens
TTYAVHAGV

SEQ ID NO: 591018 - protein, 9 aa, Homo Sapiens
CLLERKIDI

SEQ ID NO: 591019 - protein, 9 aa, Homo Sapiens
GKMGFQQRS

SEQ ID NO: 591020 - protein, 9 aa, Homo Sapiens
KHGSSEAAP

SEQ ID NO: 591021 - protein, 9 aa, Homo Sapiens
RLFAMQAHP

SEQ ID NO: 591022 - protein, 9 aa, Homo Sapiens
AQENVEVVR

SEQ ID NO: 591023 - protein, 9 aa, Homo Sapiens
RGTWKSENK

SEQ ID NO: 591024 - protein, 9 aa, Homo Sapiens
RTVSFVDID

SEQ ID NO: 591025 - protein, 9 aa, Homo Sapiens
SIQDVNHRV

SEQ ID NO: 591026 - protein, 9 aa, Homo Sapiens
AMQAHPNII

SEQ ID NO: 591027 - protein, 9 aa, Homo Sapiens
QHELSKIKH

SEQ ID NO: 591028 - protein, 9 aa, Homo Sapiens
PAEVLWGGA

SEQ ID NO: 591029 - protein, 9 aa, Homo Sapiens
CRNTCCQPT

SEQ ID NO: 591030 - protein, 9 aa, Homo Sapiens
CCRPSCCLT

SEQ ID NO: 591031 - protein, 9 aa, Homo Sapiens
VEIHGGSLI

SEQ ID NO: 591032 - protein, 9 aa, Homo Sapiens
ASAQENVEV

SEQ ID NO: 591033 - protein, 9 aa, Homo Sapiens
QGSIQDVNH

SEQ ID NO: 591034 - protein, 9 aa, Homo Sapiens
QCPGTPATT

SEQ ID NO: 591035 - protein, 9 aa, Homo Sapiens
NEISLHSIN

SEQ ID NO: 591036 - protein, 9 aa, Homo Sapiens
PSEVSSCGD

SEQ ID NO: 591037 - protein, 9 aa, Homo Sapiens
VFGNGDPKT

SEQ ID NO: 591038 - protein, 9 aa, Homo Sapiens
PNEVIRKYT

SEQ ID NO: 591039 - protein, 9 aa, Homo Sapiens
AEVLWGGAE

SEQ ID NO: 591040 - protein, 9 aa, Homo Sapiens
KLRGTWKSE

SEQ ID NO: 591041 - protein, 9 aa, Homo Sapiens
GGQALGRLL

SEQ ID NO: 591042 - protein, 9 aa, Homo Sapiens
LKKKLRGTW

SEQ ID NO: 591043 - protein, 9 aa, Homo Sapiens
SQGARQPPA

SEQ ID NO: 591044 - protein, 9 aa, Homo Sapiens
PPSLLLNCF

SEQ ID NO: 591045 - protein, 9 aa, Homo Sapiens
WQYPLIYRL

SEQ ID NO: 591046 - protein, 9 aa, Homo Sapiens
LKYFNPESL

SEQ ID NO: 591047 - protein, 9 aa, Homo Sapiens
SGIFNVKLP

SEQ ID NO: 591048 - protein, 9 aa, Homo Sapiens
TKPNEVIRK

SEQ ID NO: 591049 - protein, 9 aa, Homo Sapiens
KTITRFCNH

SEQ ID NO: 591050 - protein, 9 aa, Homo Sapiens
AGPMHTRLG

SEQ ID NO: 591051 - protein, 9 aa, Homo Sapiens
EHIIVDVSL

SEQ ID NO: 591052 - protein, 9 aa, Homo Sapiens
TSPQTLCQI

SEQ ID NO: 591053 - protein, 9 aa, Homo Sapiens
DSPLFLATG

SEQ ID NO: 591054 - protein, 9 aa, Homo Sapiens
SLVVFGNGD

SEQ ID NO: 591055 - protein, 9 aa, Homo Sapiens
CNHPVHFVF

SEQ ID NO: 591056 - protein, 9 aa, Homo Sapiens
LGSGIHSGA

SEQ ID NO: 591057 - protein, 9 aa, Homo Sapiens
KAVSRVRNL

SEQ ID NO: 591058 - protein, 9 aa, Homo Sapiens
NFLRRKPIV

SEQ ID NO: 591059 - protein, 9 aa, Homo Sapiens
ITGTGFSGY

SEQ ID NO: 591060 - protein, 9 aa, Homo Sapiens
DGQIVQKEA

SEQ ID NO: 591061 - protein, 9 aa, Homo Sapiens
SFVDIDQSS

SEQ ID NO: 591062 - protein, 9 aa, Homo Sapiens
VLSDLQKTE

SEQ ID NO: 591063 - protein, 9 aa, Homo Sapiens
ELTRYDCEL

SEQ ID NO: 591064 - protein, 9 aa, Homo Sapiens
EVLWGGAED

SEQ ID NO: 591065 - protein, 9 aa, Homo Sapiens
TTGFTDQPE

SEQ ID NO: 591066 - protein, 9 aa, Homo Sapiens
LGEYLPPSG

SEQ ID NO: 591067 - protein, 9 aa, Homo Sapiens
PTNSNSLPA

SEQ ID NO: 591068 - protein, 9 aa, Homo Sapiens
IINYNLEQP

SEQ ID NO: 591069 - protein, 9 aa, Homo Sapiens
STDVCDSVY

SEQ ID NO: 591070 - protein, 9 aa, Homo Sapiens
IPTLGEYLP

SEQ ID NO: 591071 - protein, 9 aa, Homo Sapiens
SEVSSCGDA

SEQ ID NO: 591072 - protein, 9 aa, Homo Sapiens
GTARDIYLP

SEQ ID NO: 591073 - protein, 9 aa, Homo Sapiens
NEVIRKYTI

SEQ ID NO: 591074 - protein, 9 aa, Homo Sapiens
ARGSMTLDV

SEQ ID NO: 591075 - protein, 9 aa, Homo Sapiens
SGTRMDSRA

SEQ ID NO: 591076 - protein, 9 aa, Homo Sapiens
LLERKIDIV

SEQ ID NO: 591077 - protein, 9 aa, Homo Sapiens
QQHELSKIK

SEQ ID NO: 591078 - protein, 9 aa, Homo Sapiens
SCGDAGDVD

SEQ ID NO: 591079 - protein, 9 aa, Homo Sapiens
ELSPEETPT

SEQ ID NO: 591080 - protein, 9 aa, Homo Sapiens
RLAQHHRTH

SEQ ID NO: 591081 - protein, 9 aa, Homo Sapiens
DAHHPIQCP

SEQ ID NO: 591082 - protein, 9 aa, Homo Sapiens
YIRSEKQIM

SEQ ID NO: 591083 - protein, 9 aa, Homo Sapiens
MGFQQRSGA

SEQ ID NO: 591084 - protein, 9 aa, Homo Sapiens
IPAAKLVEA

SEQ ID NO: 591085 - protein, 9 aa, Homo Sapiens
EGFQQHELS

SEQ ID NO: 591086 - protein, 9 aa, Homo Sapiens
LNVPVLGSS

SEQ ID NO: 591087 - protein, 9 aa, Homo Sapiens
YTSLPVLET

SEQ ID NO: 591088 - protein, 9 aa, Homo Sapiens
MKFQYSKVL

SEQ ID NO: 591089 - protein, 9 aa, Homo Sapiens
FFKTVFHST

SEQ ID NO: 591090 - protein, 9 aa, Homo Sapiens
MLSQGARQP

SEQ ID NO: 591091 - protein, 9 aa, Homo Sapiens
PVLETSPQT

SEQ ID NO: 591092 - protein, 9 aa, Homo Sapiens
SNSMVADIQ

SEQ ID NO: 591093 - protein, 9 aa, Homo Sapiens
FLQIGFAAS

SEQ ID NO: 591094 - protein, 9 aa, Homo Sapiens
KDYLIIFLL

SEQ ID NO: 591095 - protein, 9 aa, Homo Sapiens
DNDEDDPVP

SEQ ID NO: 591096 - protein, 9 aa, Homo Sapiens
CCLTTCCRT

SEQ ID NO: 591097 - protein, 9 aa, Homo Sapiens
LKTITRFCN

SEQ ID NO: 591098 - protein, 9 aa, Homo Sapiens
REQLTNDKS

SEQ ID NO: 591099 - protein, 9 aa, Homo Sapiens
LDNFLRRKP

SEQ ID NO: 591100 - protein, 9 aa, Homo Sapiens
GVVEAYTTR

SEQ ID NO: 591101 - protein, 9 aa, Homo Sapiens
RKLQKTCRM

SEQ ID NO: 591102 - protein, 9 aa, Homo Sapiens
NLVLPSDGS

SEQ ID NO: 591103 - protein, 9 aa, Homo Sapiens
EAGGQALGR

SEQ ID NO: 591104 - protein, 9 aa, Homo Sapiens
DNFLRRKPI

SEQ ID NO: 591105 - protein, 9 aa, Homo Sapiens
PEWVLDCVS

SEQ ID NO: 591106 - protein, 9 aa, Homo Sapiens
AARCQPSEV

SEQ ID NO: 591107 - protein, 9 aa, Homo Sapiens
LQLPPKIFQ

SEQ ID NO: 591108 - protein, 9 aa, Homo Sapiens
HHPIQCPGT

SEQ ID NO: 591109 - protein, 9 aa, Homo Sapiens
VDIDQSSLI

SEQ ID NO: 591110 - protein, 9 aa, Homo Sapiens
RQRLAQHHR

SEQ ID NO: 591111 - protein, 9 aa, Homo Sapiens
TGHFLKLVF

SEQ ID NO: 591112 - protein, 9 aa, Homo Sapiens
VNKLGLMRD

SEQ ID NO: 591113 - protein, 9 aa, Homo Sapiens
VTTYAVHAG

SEQ ID NO: 591114 - protein, 9 aa, Homo Sapiens
IQDVNHRVW

SEQ ID NO: 591115 - protein, 9 aa, Homo Sapiens
STDNTFVVS

SEQ ID NO: 591116 - protein, 9 aa, Homo Sapiens
KQRQRLAQH

SEQ ID NO: 591117 - protein, 9 aa, Homo Sapiens
TISKITYFK

SEQ ID NO: 591118 - protein, 9 aa, Homo Sapiens
ARTGGHSPI

SEQ ID NO: 591119 - protein, 9 aa, Homo Sapiens
ASVYVFQIQ

SEQ ID NO: 591120 - protein, 9 aa, Homo Sapiens
GIPAAKLVE

SEQ ID NO: 591121 - protein, 9 aa, Homo Sapiens
PKEFTYLNS

SEQ ID NO: 591122 - protein, 9 aa, Homo Sapiens
WQQQSYLGS

SEQ ID NO: 591123 - protein, 9 aa, Homo Sapiens
FGNGDPKTR

SEQ ID NO: 591124 - protein, 9 aa, Homo Sapiens
AKLVEAHGT

SEQ ID NO: 591125 - protein, 9 aa, Homo Sapiens
GWDDALHTV

SEQ ID NO: 591126 - protein, 9 aa, Homo Sapiens
RKPIVPEHK

SEQ ID NO: 591127 - protein, 9 aa, Homo Sapiens
AKHAMHQTR

SEQ ID NO: 591128 - protein, 9 aa, Homo Sapiens
IQCPGTPAT

SEQ ID NO: 591129 - protein, 9 aa, Homo Sapiens
YGVVEAYTT

SEQ ID NO: 591130 - protein, 9 aa, Homo Sapiens
AIHENRIKS

SEQ ID NO: 591131 - protein, 9 aa, Homo Sapiens
WLPPTKPNE

SEQ ID NO: 591132 - protein, 9 aa, Homo Sapiens
DIDQSSLIY

SEQ ID NO: 591133 - protein, 9 aa, Homo Sapiens
TDGQIVQKE

SEQ ID NO: 591134 - protein, 9 aa, Homo Sapiens
DLQKTERDY

SEQ ID NO: 591135 - protein, 9 aa, Homo Sapiens
NARGSMTLD

SEQ ID NO: 591136 - protein, 9 aa, Homo Sapiens
KKKLRGTWK

SEQ ID NO: 591137 - protein, 9 aa, Homo Sapiens
HATPPDPAS

SEQ ID NO: 591138 - protein, 9 aa, Homo Sapiens
YHFPSLFFC

SEQ ID NO: 591139 - protein, 9 aa, Homo Sapiens
KTSGVNLTQ

SEQ ID NO: 591140 - protein, 9 aa, Homo Sapiens
GDPEPGEQE

SEQ ID NO: 591141 - protein, 9 aa, Homo Sapiens
CKVFSRREN

SEQ ID NO: 591142 - protein, 9 aa, Homo Sapiens
DFGWDDALH

SEQ ID NO: 591143 - protein, 9 aa, Homo Sapiens
SSSSDTRSH

SEQ ID NO: 591144 - protein, 9 aa, Homo Sapiens
HSASTKLLR

SEQ ID NO: 591145 - protein, 9 aa, Homo Sapiens
MIFQASRFL

SEQ ID NO: 591146 - protein, 9 aa, Homo Sapiens
VSACSRNAV

SEQ ID NO: 591147 - protein, 9 aa, Homo Sapiens
RNLAGEPRV

SEQ ID NO: 591148 - protein, 9 aa, Homo Sapiens
PAGDQDHAP

SEQ ID NO: 591149 - protein, 9 aa, Homo Sapiens
STSTDSASS

SEQ ID NO: 591150 - protein, 9 aa, Homo Sapiens
LGCFQLKLR

SEQ ID NO: 591151 - protein, 9 aa, Homo Sapiens
GHFLKLVFD

SEQ ID NO: 591152 - protein, 9 aa, Homo Sapiens
HAMHQTRHL

SEQ ID NO: 591153 - protein, 9 aa, Homo Sapiens
CNECCKVFS

SEQ ID NO: 591154 - protein, 9 aa, Homo Sapiens
CELNVPVLG

SEQ ID NO: 591155 - protein, 9 aa, Homo Sapiens
LRNLAGEPR

SEQ ID NO: 591156 - protein, 9 aa, Homo Sapiens
CFSFLITQC

SEQ ID NO: 591157 - protein, 9 aa, Homo Sapiens
SKHGSSEAA

SEQ ID NO: 591158 - protein, 9 aa, Homo Sapiens
AWGKMGFQQ

SEQ ID NO: 591159 - protein, 9 aa, Homo Sapiens
PEETPTGAW

SEQ ID NO: 591160 - protein, 9 aa, Homo Sapiens
LIPTLGEYL

SEQ ID NO: 591161 - protein, 9 aa, Homo Sapiens
TDVCDSVYS

SEQ ID NO: 591162 - protein, 9 aa, Homo Sapiens
HENRIKSGK

SEQ ID NO: 591163 - protein, 9 aa, Homo Sapiens
MVADIQELP

SEQ ID NO: 591164 - protein, 9 aa, Homo Sapiens
ELNVPVLGS

SEQ ID NO: 591165 - protein, 9 aa, Homo Sapiens
PDHGAPVEE

SEQ ID NO: 591166 - protein, 9 aa, Homo Sapiens
CCQNTCCRN

SEQ ID NO: 591167 - protein, 9 aa, Homo Sapiens
CFQLKLRGD

SEQ ID NO: 591168 - protein, 9 aa, Homo Sapiens
NSTVDFRVK

SEQ ID NO: 591169 - protein, 9 aa, Homo Sapiens
PQTPLVIAF

SEQ ID NO: 591170 - protein, 9 aa, Homo Sapiens
VSGIPAAKL

SEQ ID NO: 591171 - protein, 9 aa, Homo Sapiens
SAKNVDPTP

SEQ ID NO: 591172 - protein, 9 aa, Homo Sapiens
INYNLEQPS

SEQ ID NO: 591173 - protein, 9 aa, Homo Sapiens
CVYYVATSS

SEQ ID NO: 591174 - protein, 9 aa, Homo Sapiens
TKPSHVKAE

SEQ ID NO: 591175 - protein, 9 aa, Homo Sapiens
AGAQAARCQ

SEQ ID NO: 591176 - protein, 9 aa, Homo Sapiens
GCFQLKLRG

SEQ ID NO: 591177 - protein, 9 aa, Homo Sapiens
GTWKSENKT

SEQ ID NO: 591178 - protein, 9 aa, Homo Sapiens
CVQHFAREL

SEQ ID NO: 591179 - protein, 9 aa, Homo Sapiens
HPIQCPGTP

SEQ ID NO: 591180 - protein, 9 aa, Homo Sapiens
TPYPETSAG

SEQ ID NO: 591181 - protein, 9 aa, Homo Sapiens
TLAYTKPSH

SEQ ID NO: 591182 - protein, 9 aa, Homo Sapiens
KHAMHQTRH

SEQ ID NO: 591183 - protein, 9 aa, Homo Sapiens
ENKTPSPQD

SEQ ID NO: 591184 - protein, 9 aa, Homo Sapiens
LIIFLLILL

SEQ ID NO: 591185 - protein, 9 aa, Homo Sapiens
WKLSAELAG

SEQ ID NO: 591186 - protein, 9 aa, Homo Sapiens
VKLPGSSKI

SEQ ID NO: 591187 - protein, 9 aa, Homo Sapiens
LVKIMPVKQ

SEQ ID NO: 591188 - protein, 9 aa, Homo Sapiens
LIYRLILIP

SEQ ID NO: 591189 - protein, 9 aa, Homo Sapiens
AKGPPTNSN

SEQ ID NO: 591190 - protein, 9 aa, Homo Sapiens
KWKLSAELA

SEQ ID NO: 591191 - protein, 9 aa, Homo Sapiens
SECLKGPLD

SEQ ID NO: 591192 - protein, 9 aa, Homo Sapiens
VFQIQARTA

SEQ ID NO: 591193 - protein, 9 aa, Homo Sapiens
YCLFDVSDI

SEQ ID NO: 591194 - protein, 9 aa, Homo Sapiens
QPSEVSSCG

SEQ ID NO: 591195 - protein, 9 aa, Homo Sapiens
SIKIVTPEW

SEQ ID NO: 591196 - protein, 9 aa, Homo Sapiens
FSAKNVDPT

SEQ ID NO: 591197 - protein, 9 aa, Homo Sapiens
EGSKGIGKT

SEQ ID NO: 591198 - protein, 9 aa, Homo Sapiens
GQALGRLLV

SEQ ID NO: 591199 - protein, 9 aa, Homo Sapiens
CPSQTSLKK

SEQ ID NO: 591200 - protein, 9 aa, Homo Sapiens
ELMVLPSVA

SEQ ID NO: 591201 - protein, 9 aa, Homo Sapiens
FQGILFASS

SEQ ID NO: 591202 - protein, 9 aa, Homo Sapiens
SLQEDLENM

SEQ ID NO: 591203 - protein, 9 aa, Homo Sapiens
QIQARTAAG

SEQ ID NO: 591204 - protein, 9 aa, Homo Sapiens
LLSHKLKGV

SEQ ID NO: 591205 - protein, 9 aa, Homo Sapiens
LLHATPPDP

SEQ ID NO: 591206 - protein, 9 aa, Homo Sapiens
KLRGDVEMK

SEQ ID NO: 591207 - protein, 9 aa, Homo Sapiens
QEARLFAMQ

SEQ ID NO: 591208 - protein, 9 aa, Homo Sapiens
DELEGFQQH

SEQ ID NO: 591209 - protein, 9 aa, Homo Sapiens
LHATPPDPA

SEQ ID NO: 591210 - protein, 9 aa, Homo Sapiens
VDPTPYPET

SEQ ID NO: 591211 - protein, 9 aa, Homo Sapiens
VTWMRNELE

SEQ ID NO: 591212 - protein, 9 aa, Homo Sapiens
KARTGGHSP

SEQ ID NO: 591213 - protein, 9 aa, Homo Sapiens
PLNVDTIEE

SEQ ID NO: 591214 - protein, 9 aa, Homo Sapiens
DVCDSVYSA

SEQ ID NO: 591215 - protein, 9 aa, Homo Sapiens
LKILRNLAG

SEQ ID NO: 591216 - protein, 9 aa, Homo Sapiens
FNPESLQED

SEQ ID NO: 591217 - protein, 9 aa, Homo Sapiens
PTGAWARAT

SEQ ID NO: 591218 - protein, 9 aa, Homo Sapiens
LPPTKPNEV

SEQ ID NO: 591219 - protein, 9 aa, Homo Sapiens
VTPEWVLDC

SEQ ID NO: 591220 - protein, 9 aa, Homo Sapiens
RVSGIPAAK

SEQ ID NO: 591221 - protein, 9 aa, Homo Sapiens
TPQRRLGCP

SEQ ID NO: 591222 - protein, 9 aa, Homo Sapiens
PYTCNECCK

SEQ ID NO: 591223 - protein, 9 aa, Homo Sapiens
NCVKEANVW

SEQ ID NO: 591224 - protein, 9 aa, Homo Sapiens
KKEKMKVNE

SEQ ID NO: 591225 - protein, 9 aa, Homo Sapiens
DVNHRVWVL

SEQ ID NO: 591226 - protein, 9 aa, Homo Sapiens
GTPATTGFT

SEQ ID NO: 591227 - protein, 9 aa, Homo Sapiens
RPAEVLWGG

SEQ ID NO: 591228 - protein, 9 aa, Homo Sapiens
KRYSRALCL

SEQ ID NO: 591229 - protein, 9 aa, Homo Sapiens
YNAAGVNKL

SEQ ID NO: 591230 - protein, 9 aa, Homo Sapiens
TTLQLPPKI

SEQ ID NO: 591231 - protein, 9 aa, Homo Sapiens
KLKGVCPEP

SEQ ID NO: 591232 - protein, 9 aa, Homo Sapiens
LELDAGTLA

SEQ ID NO: 591233 - protein, 9 aa, Homo Sapiens
VTTLQLPPK

SEQ ID NO: 591234 - protein, 9 aa, Homo Sapiens
YLQSLKTPQ

SEQ ID NO: 591235 - protein, 9 aa, Homo Sapiens
MKVNEISLH

SEQ ID NO: 591236 - protein, 9 aa, Homo Sapiens
VQGPLVKIM

SEQ ID NO: 591237 - protein, 9 aa, Homo Sapiens
QKTCRMEPA

SEQ ID NO: 591238 - protein, 9 aa, Homo Sapiens
FVDIDQSSL

SEQ ID NO: 591239 - protein, 9 aa, Homo Sapiens
SDSKHGSSE

SEQ ID NO: 591240 - protein, 9 aa, Homo Sapiens
KTLAYTKPS

SEQ ID NO: 591241 - protein, 9 aa, Homo Sapiens
TITRFCNHP

SEQ ID NO: 591242 - protein, 9 aa, Homo Sapiens
PSDGSMHNY

SEQ ID NO: 591243 - protein, 9 aa, Homo Sapiens
QQQSYLGSG

SEQ ID NO: 591244 - protein, 9 aa, Homo Sapiens
RWQYPLIYR

SEQ ID NO: 591245 - protein, 9 aa, Homo Sapiens
VELLSHKLK

SEQ ID NO: 591246 - protein, 9 aa, Homo Sapiens
ASDSKHGSS

SEQ ID NO: 591247 - protein, 9 aa, Homo Sapiens
PKHKLCKLE

SEQ ID NO: 591248 - protein, 9 aa, Homo Sapiens
FQASRFLGE

SEQ ID NO: 591249 - protein, 9 aa, Homo Sapiens
SNIWKKIAI

SEQ ID NO: 591250 - protein, 9 aa, Homo Sapiens
LVLPSDGSM

SEQ ID NO: 591251 - protein, 9 aa, Homo Sapiens
GKLELDAGT

SEQ ID NO: 591252 - protein, 9 aa, Homo Sapiens
CDSVYSASR

SEQ ID NO: 591253 - protein, 9 aa, Homo Sapiens
SNPITISKI

SEQ ID NO: 591254 - protein, 9 aa, Homo Sapiens
SVAAPAVVA

SEQ ID NO: 591255 - protein, 9 aa, Homo Sapiens
NAVPDKAPG

SEQ ID NO: 591256 - protein, 9 aa, Homo Sapiens
PPPDNDEDD

SEQ ID NO: 591257 - protein, 9 aa, Homo Sapiens
STDSASSPS

SEQ ID NO: 591258 - protein, 9 aa, Homo Sapiens
GAQAARCQP

SEQ ID NO: 591259 - protein, 9 aa, Homo Sapiens
DHGAPVEET

SEQ ID NO: 591260 - protein, 9 aa, Homo Sapiens
KTVFHSTWQ

SEQ ID NO: 591261 - protein, 9 aa, Homo Sapiens
TWMRNELEQ

SEQ ID NO: 591262 - protein, 9 aa, Homo Sapiens
PGPRGPAGE

SEQ ID NO: 591263 - protein, 9 aa, Homo Sapiens
VYSASRWKA

SEQ ID NO: 591264 - protein, 9 aa, Homo Sapiens
GNCVKEANV

SEQ ID NO: 591265 - protein, 9 aa, Homo Sapiens
HAKGPPTNS

SEQ ID NO: 591266 - protein, 9 aa, Homo Sapiens
GAPASDSKH

SEQ ID NO: 591267 - protein, 9 aa, Homo Sapiens
AKNVDPTPY

SEQ ID NO: 591268 - protein, 9 aa, Homo Sapiens
PEKAVSRVR

SEQ ID NO: 591269 - protein, 9 aa, Homo Sapiens
MDSRAQVNK

SEQ ID NO: 591270 - protein, 9 aa, Homo Sapiens
CEDTNVCVY

SEQ ID NO: 591271 - protein, 9 aa, Homo Sapiens
ITISKITYF

SEQ ID NO: 591272 - protein, 9 aa, Homo Sapiens
YTCNECCKV

SEQ ID NO: 591273 - protein, 9 aa, Homo Sapiens
PAAKLVEAH

SEQ ID NO: 591274 - protein, 9 aa, Homo Sapiens
TDFGWDDAL

SEQ ID NO: 591275 - protein, 9 aa, Homo Sapiens
VSFFKTVFH

SEQ ID NO: 591276 - protein, 9 aa, Homo Sapiens
HVYCLFDVS

SEQ ID NO: 591277 - protein, 9 aa, Homo Sapiens
TGYEMPRQI

SEQ ID NO: 591278 - protein, 9 aa, Homo Sapiens
GSNSMVADI

SEQ ID NO: 591279 - protein, 9 aa, Homo Sapiens
EMASKAAEA

SEQ ID NO: 591280 - protein, 9 aa, Homo Sapiens
VGEVYGVVE

SEQ ID NO: 591281 - protein, 9 aa, Homo Sapiens
SKRYSRALC

SEQ ID NO: 591282 - protein, 9 aa, Homo Sapiens
FASSECLKG

SEQ ID NO: 591283 - protein, 9 aa, Homo Sapiens
SAQENVEVV

SEQ ID NO: 591284 - protein, 9 aa, Homo Sapiens
HGSSEAAPS

SEQ ID NO: 591285 - protein, 9 aa, Homo Sapiens
EARLFAMQA

SEQ ID NO: 591286 - protein, 9 aa, Homo Sapiens
QEYIRSEKQ

SEQ ID NO: 591287 - protein, 9 aa, Homo Sapiens
LHAPDHGAP

SEQ ID NO: 591288 - protein, 9 aa, Homo Sapiens
NHVYCLFDV

SEQ ID NO: 591289 - protein, 9 aa, Homo Sapiens
KEKMKVNEI

SEQ ID NO: 591290 - protein, 9 aa, Homo Sapiens
DTRQQEYIR

SEQ ID NO: 591291 - protein, 9 aa, Homo Sapiens
SDGSMHNYC

SEQ ID NO: 591292 - protein, 9 aa, Homo Sapiens
IKLLADKIP

SEQ ID NO: 591293 - protein, 9 aa, Homo Sapiens
PGQITDLKV

SEQ ID NO: 591294 - protein, 9 aa, Homo Sapiens
FQDLQDGSS

SEQ ID NO: 591295 - protein, 9 aa, Homo Sapiens
SCCRPSCCL

SEQ ID NO: 591296 - protein, 9 aa, Homo Sapiens
VVFGNGDPK

SEQ ID NO: 591297 - protein, 9 aa, Homo Sapiens
VLQNARGSM

SEQ ID NO: 591298 - protein, 9 aa, Homo Sapiens
LGKLELDAG

SEQ ID NO: 591299 - protein, 9 aa, Homo Sapiens
RYDCELNVP

SEQ ID NO: 591300 - protein, 9 aa, Homo Sapiens
LFDVSDITL

SEQ ID NO: 591301 - protein, 9 aa, Homo Sapiens
IDQSSLIYT

SEQ ID NO: 591302 - protein, 9 aa, Homo Sapiens
LSEMKFQYS

SEQ ID NO: 591303 - protein, 9 aa, Homo Sapiens
PLTDGQIVQ

SEQ ID NO: 591304 - protein, 9 aa, Homo Sapiens
SIKWKLSAE

SEQ ID NO: 591305 - protein, 9 aa, Homo Sapiens
PCLHRLKCF

SEQ ID NO: 591306 - protein, 9 aa, Homo Sapiens
PRLKILRNL

SEQ ID NO: 591307 - protein, 9 aa, Homo Sapiens
AFKQRQRLA

SEQ ID NO: 591308 - protein, 9 aa, Homo Sapiens
LLRGDGLKD

SEQ ID NO: 591309 - protein, 9 aa, Homo Sapiens
IHENRIKSG

SEQ ID NO: 591310 - protein, 9 aa, Homo Sapiens
ENVEVVRTL

SEQ ID NO: 591311 - protein, 9 aa, Homo Sapiens
GSIQDVNHR

SEQ ID NO: 591312 - protein, 9 aa, Homo Sapiens
KIIINYNLE

SEQ ID NO: 591313 - protein, 9 aa, Homo Sapiens
PLIYRLILI

SEQ ID NO: 591314 - protein, 9 aa, Homo Sapiens
NTPKGTARD

SEQ ID NO: 591315 - protein, 9 aa, Homo Sapiens
YITKGQNVQ

SEQ ID NO: 591316 - protein, 9 aa, Homo Sapiens
EMKFQYSKV

SEQ ID NO: 591317 - protein, 9 aa, Homo Sapiens
FEHIIVDVS

SEQ ID NO: 591318 - protein, 9 aa, Homo Sapiens
SKAAEAVLK

SEQ ID NO: 591319 - protein, 9 aa, Homo Sapiens
PASDSKHGS

SEQ ID NO: 591320 - protein, 9 aa, Homo Sapiens
TCRMEPAGS

SEQ ID NO: 591321 - protein, 9 aa, Homo Sapiens
QTSLKKKLR

SEQ ID NO: 591322 - protein, 9 aa, Homo Sapiens
QRATSIKWK

SEQ ID NO: 591323 - protein, 9 aa, Homo Sapiens
GNGDPKTRR

SEQ ID NO: 591324 - protein, 9 aa, Homo Sapiens
PLVIAFSYF

SEQ ID NO: 591325 - protein, 9 aa, Homo Sapiens
VNHRVWVLQ

SEQ ID NO: 591326 - protein, 9 aa, Homo Sapiens
RTGGHSPIF

SEQ ID NO: 591327 - protein, 9 aa, Homo Sapiens
GPRGPAGEQ

SEQ ID NO: 591328 - protein, 9 aa, Homo Sapiens
IASAQENVE

SEQ ID NO: 591329 - protein, 9 aa, Homo Sapiens
YAWGKMGFQ

SEQ ID NO: 591330 - protein, 9 aa, Homo Sapiens
NELEQLGTK

SEQ ID NO: 591331 - protein, 9 aa, Homo Sapiens
LETSPQTLC

SEQ ID NO: 591332 - protein, 9 aa, Homo Sapiens
RVKVGNEYI

SEQ ID NO: 591333 - protein, 9 aa, Homo Sapiens
PESLQEDLE

SEQ ID NO: 591334 - protein, 9 aa, Homo Sapiens
YCRNPYGQP

SEQ ID NO: 591335 - protein, 9 aa, Homo Sapiens
KFTAAGAQA

SEQ ID NO: 591336 - protein, 9 aa, Homo Sapiens
RNTCCQPTC

SEQ ID NO: 591337 - protein, 9 aa, Homo Sapiens
SQAGMTGYE

SEQ ID NO: 591338 - protein, 9 aa, Homo Sapiens
TGGHSPIFR

SEQ ID NO: 591339 - protein, 9 aa, Homo Sapiens
NPYGQPRPW

SEQ ID NO: 591340 - protein, 9 aa, Homo Sapiens
ELEQLGTKH

SEQ ID NO: 591341 - protein, 9 aa, Homo Sapiens
VKVGNEYIT

SEQ ID NO: 591342 - protein, 9 aa, Homo Sapiens
TSTDSASSP

SEQ ID NO: 591343 - protein, 9 aa, Homo Sapiens
KGPPGPRGP

SEQ ID NO: 591344 - protein, 9 aa, Homo Sapiens
GPMHTRLGP

SEQ ID NO: 591345 - protein, 9 aa, Homo Sapiens
KIVTPEWVL

SEQ ID NO: 591346 - protein, 9 aa, Homo Sapiens
RFLGEAERV

SEQ ID NO: 591347 - protein, 9 aa, Homo Sapiens
ASSECLKGP

SEQ ID NO: 591348 - protein, 9 aa, Homo Sapiens
QYAWGKMGF

SEQ ID NO: 591349 - protein, 9 aa, Homo Sapiens
ELDAGTLAI

SEQ ID NO: 591350 - protein, 9 aa, Homo Sapiens
LFLATGHFL

SEQ ID NO: 591351 - protein, 9 aa, Homo Sapiens
IYLQSLKTP

SEQ ID NO: 591352 - protein, 9 aa, Homo Sapiens
AGTLAIAVI

SEQ ID NO: 591353 - protein, 9 aa, Homo Sapiens
GELVTSTST

SEQ ID NO: 591354 - protein, 9 aa, Homo Sapiens
RFCNHPVHF

SEQ ID NO: 591355 - protein, 9 aa, Homo Sapiens
FDTLIPTLG

SEQ ID NO: 591356 - protein, 9 aa, Homo Sapiens
SSSDTRSHS

SEQ ID NO: 591357 - protein, 9 aa, Homo Sapiens
SMVADIQEL

SEQ ID NO: 591358 - protein, 9 aa, Homo Sapiens
SYLGSGIHS

SEQ ID NO: 591359 - protein, 9 aa, Homo Sapiens
YRLILIPCW

SEQ ID NO: 591360 - protein, 9 aa, Homo Sapiens
DDALHTVRA

SEQ ID NO: 591361 - protein, 9 aa, Homo Sapiens
TPATTGFTD

SEQ ID NO: 591362 - protein, 9 aa, Homo Sapiens
RISIKLLAD

SEQ ID NO: 591363 - protein, 9 aa, Homo Sapiens
GEVYGVVEA

SEQ ID NO: 591364 - protein, 9 aa, Homo Sapiens
QHFARELEL

SEQ ID NO: 591365 - protein, 9 aa, Homo Sapiens
TLCQIYLQS

SEQ ID NO: 591366 - protein, 9 aa, Homo Sapiens
HAPDHGAPV

SEQ ID NO: 591367 - protein, 9 aa, Homo Sapiens
LKCFLRPPV

SEQ ID NO: 591368 - protein, 9 aa, Homo Sapiens
QQKDYLIIF

SEQ ID NO: 591369 - protein, 9 aa, Homo Sapiens
CQPSEVSSC

SEQ ID NO: 591370 - protein, 9 aa, Homo Sapiens
ELDVSFFKT

SEQ ID NO: 591371 - protein, 9 aa, Homo Sapiens
QTPLVIAFS

SEQ ID NO: 591372 - protein, 9 aa, Homo Sapiens
DNTFVVSHL

SEQ ID NO: 591373 - protein, 9 aa, Homo Sapiens
HAGVVRSEL

SEQ ID NO: 591374 - protein, 9 aa, Homo Sapiens
GCEDTNVCV

SEQ ID NO: 591375 - protein, 9 aa, Homo Sapiens
IENAIHENR

SEQ ID NO: 591376 - protein, 9 aa, Homo Sapiens
TNSNSLPAN

SEQ ID NO: 591377 - protein, 9 aa, Homo Sapiens
AGVNKLGLM

SEQ ID NO: 591378 - protein, 9 aa, Homo Sapiens
ADIQELPAT

SEQ ID NO: 591379 - protein, 9 aa, Homo Sapiens
LLADKIPKT

SEQ ID NO: 591380 - protein, 9 aa, Homo Sapiens
RRLGCPSQT

SEQ ID NO: 591381 - protein, 9 aa, Homo Sapiens
PLKTITRFC

SEQ ID NO: 591382 - protein, 9 aa, Homo Sapiens
LQKTCRMEP

SEQ ID NO: 591383 - protein, 9 aa, Homo Sapiens
VRDRDHEVD

SEQ ID NO: 591384 - protein, 9 aa, Homo Sapiens
RNAVPDKAP

SEQ ID NO: 591385 - protein, 9 aa, Homo Sapiens
TPTGAWARA

SEQ ID NO: 591386 - protein, 9 aa, Homo Sapiens
RNMLSQGAR

SEQ ID NO: 591387 - protein, 9 aa, Homo Sapiens
TRFCNHPVH

SEQ ID NO: 591388 - protein, 9 aa, Homo Sapiens
VTSTSTDSA

SEQ ID NO: 591389 - protein, 9 aa, Homo Sapiens
PPKIFQFNN

SEQ ID NO: 591390 - protein, 9 aa, Homo Sapiens
GVTTYAVHA

SEQ ID NO: 591391 - protein, 9 aa, Homo Sapiens
EHPEKAVSR

SEQ ID NO: 591392 - protein, 9 aa, Homo Sapiens
SELDVSFFK

SEQ ID NO: 591393 - protein, 9 aa, Homo Sapiens
CCLLERKID

SEQ ID NO: 591394 - protein, 9 aa, Homo Sapiens
WGKMGFQQR

SEQ ID NO: 591395 - protein, 9 aa, Homo Sapiens
VGNEYITKG

SEQ ID NO: 591396 - protein, 9 aa, Homo Sapiens
GYSQFLQVT

SEQ ID NO: 591397 - protein, 9 aa, Homo Sapiens
RALCLGAKA

SEQ ID NO: 591398 - protein, 9 aa, Homo Sapiens
LGRISIKLL

SEQ ID NO: 591399 - protein, 9 aa, Homo Sapiens
GTGFSGYSQ

SEQ ID NO: 591400 - protein, 9 aa, Homo Sapiens
KCFLRPPVH

SEQ ID NO: 591401 - protein, 9 aa, Homo Sapiens
KLLADKIPK

SEQ ID NO: 591402 - protein, 9 aa, Homo Sapiens
DRAPFICTS

SEQ ID NO: 591403 - protein, 9 aa, Homo Sapiens
PSLFFCDFS

SEQ ID NO: 591404 - protein, 9 aa, Homo Sapiens
AGGQALGRL

SEQ ID NO: 591405 - protein, 9 aa, Homo Sapiens
TFVVSHLGS

SEQ ID NO: 591406 - protein, 9 aa, Homo Sapiens
ALCVQHFAR

SEQ ID NO: 591407 - protein, 9 aa, Homo Sapiens
NIWKKIAIQ

SEQ ID NO: 591408 - protein, 9 aa, Homo Sapiens
YDCELNVPV

SEQ ID NO: 591409 - protein, 9 aa, Homo Sapiens
FQQRSGAAV

SEQ ID NO: 591410 - protein, 9 aa, Homo Sapiens
PTPYPETSA

SEQ ID NO: 591411 - protein, 9 aa, Homo Sapiens
KLELDAGTL

SEQ ID NO: 591412 - protein, 9 aa, Homo Sapiens
SLKTPQRRL

SEQ ID NO: 591413 - protein, 9 aa, Homo Sapiens
ERVSGIPAA

SEQ ID NO: 591414 - protein, 9 aa, Homo Sapiens
ATGHFLKLV

SEQ ID NO: 591415 - protein, 9 aa, Homo Sapiens
VTQIKPNST

SEQ ID NO: 591416 - protein, 9 aa, Homo Sapiens
LDVSFFKTV

SEQ ID NO: 591417 - protein, 9 aa, Homo Sapiens
YNLEQPSQL

SEQ ID NO: 591418 - protein, 9 aa, Homo Sapiens
KVEIHGGSL

SEQ ID NO: 591419 - protein, 9 aa, Homo Sapiens
LQNARGSMT

SEQ ID NO: 591420 - protein, 9 aa, Homo Sapiens
DRDHEVDTT

SEQ ID NO: 591421 - protein, 9 aa, Homo Sapiens
CRNPYGQPR

SEQ ID NO: 591422 - protein, 9 aa, Homo Sapiens
TNSVGLSWT

SEQ ID NO: 591423 - protein, 9 aa, Homo Sapiens
PKTLAYTKP

SEQ ID NO: 591424 - protein, 9 aa, Homo Sapiens
DLKVEIHGG

SEQ ID NO: 591425 - protein, 9 aa, Homo Sapiens
SNTPKGTAR

SEQ ID NO: 591426 - protein, 9 aa, Homo Sapiens
RVCVLSDLQ

SEQ ID NO: 591427 - protein, 9 aa, Homo Sapiens
KRDRAPFIC

SEQ ID NO: 591428 - protein, 9 aa, Homo Sapiens
FQLKLRGDV

SEQ ID NO: 591429 - protein, 9 aa, Homo Sapiens
ASTKLLRGD

SEQ ID NO: 591430 - protein, 9 aa, Homo Sapiens
SFFKTVFHS

SEQ ID NO: 591431 - protein, 9 aa, Homo Sapiens
TGTGFSGYS

SEQ ID NO: 591432 - protein, 9 aa, Homo Sapiens
NEDSFLQIG

SEQ ID NO: 591433 - protein, 9 aa, Homo Sapiens
VFSTEMASK

SEQ ID NO: 591434 - protein, 9 aa, Homo Sapiens
TGCEDTNVC

SEQ ID NO: 591435 - protein, 9 aa, Homo Sapiens
KIFQFNNHR

SEQ ID NO: 591436 - protein, 9 aa, Homo Sapiens
EPPAGPMHT

SEQ ID NO: 591437 - protein, 9 aa, Homo Sapiens
LVVFGNGDP

SEQ ID NO: 591438 - protein, 9 aa, Homo Sapiens
PTNLVLPSD

SEQ ID NO: 591439 - protein, 9 aa, Homo Sapiens
ARQPPAEPP

SEQ ID NO: 591440 - protein, 9 aa, Homo Sapiens
GFQDLQDGS

SEQ ID NO: 591441 - protein, 9 aa, Homo Sapiens
DYLIIFLLI

SEQ ID NO: 591442 - protein, 9 aa, Homo Sapiens
DTIEESPSK

SEQ ID NO: 591443 - protein, 9 aa, Homo Sapiens
GPPPPDNDE

SEQ ID NO: 591444 - protein, 9 aa, Homo Sapiens
EDTNVCVYY

SEQ ID NO: 591445 - protein, 9 aa, Homo Sapiens
HWQQQSYLG

SEQ ID NO: 591446 - protein, 9 aa, Homo Sapiens
QDGSSEEQS

SEQ ID NO: 591447 - protein, 9 aa, Homo Sapiens
CCKVFSRRE

SEQ ID NO: 591448 - protein, 9 aa, Homo Sapiens
TPPDPASQG

SEQ ID NO: 591449 - protein, 9 aa, Homo Sapiens
QVQGPLVKI

SEQ ID NO: 591450 - protein, 9 aa, Homo Sapiens
CPGTPATTG

SEQ ID NO: 591451 - protein, 9 aa, Homo Sapiens
KSENKTPSP

SEQ ID NO: 591452 - protein, 9 aa, Homo Sapiens
RDRDHEVDT

SEQ ID NO: 591453 - protein, 9 aa, Homo Sapiens
YFLQQKDYL

SEQ ID NO: 591454 - protein, 9 aa, Homo Sapiens
PPPPDNDED

SEQ ID NO: 591455 - protein, 9 aa, Homo Sapiens
GSKGIGKTS

SEQ ID NO: 591456 - protein, 9 aa, Homo Sapiens
ENAIHENRI

SEQ ID NO: 591457 - protein, 9 aa, Homo Sapiens
FLATGHFLK

SEQ ID NO: 591458 - protein, 9 aa, Homo Sapiens
KWYYNAAGV

SEQ ID NO: 591459 - protein, 9 aa, Homo Sapiens
PPDNDEDDP

SEQ ID NO: 591460 - protein, 9 aa, Homo Sapiens
GQIVQKEAE

SEQ ID NO: 591461 - protein, 9 aa, Homo Sapiens
IQELPATIH

SEQ ID NO: 591462 - protein, 9 aa, Homo Sapiens
GFQQHELSK

SEQ ID NO: 591463 - protein, 9 aa, Homo Sapiens
DPASQGLGP

SEQ ID NO: 591464 - protein, 9 aa, Homo Sapiens
SENKTPSPQ

SEQ ID NO: 591465 - protein, 9 aa, Homo Sapiens
TQIKPNSTV

SEQ ID NO: 591466 - protein, 9 aa, Homo Sapiens
FSYFITSLS

SEQ ID NO: 591467 - protein, 9 aa, Homo Sapiens
HPEKAVSRV

SEQ ID NO: 591468 - protein, 9 aa, Homo Sapiens
PSNIWKKIA

SEQ ID NO: 591469 - protein, 9 aa, Homo Sapiens
VSFVDIDQS

SEQ ID NO: 591470 - protein, 9 aa, Homo Sapiens
LQDGSSEEQ

SEQ ID NO: 591471 - protein, 9 aa, Homo Sapiens
LPSVAAPAV

SEQ ID NO: 591472 - protein, 9 aa, Homo Sapiens
FSGYSQFLQ

SEQ ID NO: 591473 - protein, 9 aa, Homo Sapiens
YTKPSHVKA

SEQ ID NO: 591474 - protein, 9 aa, Homo Sapiens
FSTEMASKA

SEQ ID NO: 591475 - protein, 9 aa, Homo Sapiens
AGVVRSELV

SEQ ID NO: 591476 - protein, 9 aa, Homo Sapiens
NYCRNPYGQ

SEQ ID NO: 591477 - protein, 9 aa, Homo Sapiens
SRNAVPDKA

SEQ ID NO: 591478 - protein, 9 aa, Homo Sapiens
ALCLGAKAI

SEQ ID NO: 591479 - protein, 9 aa, Homo Sapiens
CSRNAVPDK

SEQ ID NO: 591480 - protein, 9 aa, Homo Sapiens
QALGRLLVV

SEQ ID NO: 591481 - protein, 9 aa, Homo Sapiens
SDLQKTERD

SEQ ID NO: 591482 - protein, 9 aa, Homo Sapiens
QTLCQIYLQ

SEQ ID NO: 591483 - protein, 9 aa, Homo Sapiens
DTNVCVYYV

SEQ ID NO: 591484 - protein, 9 aa, Homo Sapiens
LSIASAQEN

SEQ ID NO: 591485 - protein, 9 aa, Homo Sapiens
EYITKGQNV

SEQ ID NO: 591486 - protein, 9 aa, Homo Sapiens
LCKLETAHC

SEQ ID NO: 591487 - protein, 9 aa, Homo Sapiens
TPEWVLDCV

SEQ ID NO: 591488 - protein, 9 aa, Homo Sapiens
KLQKTCRME

SEQ ID NO: 591489 - protein, 9 aa, Homo Sapiens
LIFLMGNCV

SEQ ID NO: 591490 - protein, 9 aa, Homo Sapiens
LGEAERVAF

SEQ ID NO: 591491 - protein, 9 aa, Homo Sapiens
GYEMPRQIL

SEQ ID NO: 591492 - protein, 9 aa, Homo Sapiens
TQSGIFNVK

SEQ ID NO: 591493 - protein, 9 aa, Homo Sapiens
SLLLNCFSF

SEQ ID NO: 591494 - protein, 9 aa, Homo Sapiens
TRYDCELNV

SEQ ID NO: 591495 - protein, 9 aa, Homo Sapiens
LMGNCVKEA

SEQ ID NO: 591496 - protein, 9 aa, Homo Sapiens
PLAWSKART

SEQ ID NO: 591497 - protein, 9 aa, Homo Sapiens
FLMGNCVKE

SEQ ID NO: 591498 - protein, 9 aa, Homo Sapiens
SPQTLCQIY

SEQ ID NO: 591499 - protein, 9 aa, Homo Sapiens
NVCVYYVAT

SEQ ID NO: 591500 - protein, 9 aa, Homo Sapiens
DIQELPATI

SEQ ID NO: 591501 - protein, 9 aa, Homo Sapiens
CKLETAHCV

SEQ ID NO: 591502 - protein, 9 aa, Homo Sapiens
TRMDSRAQV

SEQ ID NO: 591503 - protein, 9 aa, Homo Sapiens
TKLLRGDGL

SEQ ID NO: 591504 - protein, 9 aa, Homo Sapiens
CQIYLQSLK

SEQ ID NO: 591505 - protein, 9 aa, Homo Sapiens
ILFASSECL

SEQ ID NO: 591506 - protein, 9 aa, Homo Sapiens
SGYSQFLQV

SEQ ID NO: 591507 - protein, 9 aa, Homo Sapiens
QNARGSMTL

SEQ ID NO: 591508 - protein, 9 aa, Homo Sapiens
FVVSHLGSK

SEQ ID NO: 591509 - protein, 9 aa, Homo Sapiens
LATGHFLKL

SEQ ID NO: 591510 - protein, 9 aa, Homo Sapiens
TSLPVLETS

SEQ ID NO: 591511 - protein, 9 aa, Homo Sapiens
DELGCFQLK

SEQ ID NO: 591512 - protein, 9 aa, Homo Sapiens
MTLDVQPSI

SEQ ID NO: 591513 - protein, 9 aa, Homo Sapiens
EWVLDCVSE

SEQ ID NO: 591514 - protein, 9 aa, Homo Sapiens
GISNPITIS

SEQ ID NO: 591515 - protein, 9 aa, Homo Sapiens
NECCKVFSR

SEQ ID NO: 591516 - protein, 9 aa, Homo Sapiens
RATSIKWKL

SEQ ID NO: 591517 - protein, 9 aa, Homo Sapiens
LTDGQIVQK

SEQ ID NO: 591518 - protein, 9 aa, Homo Sapiens
VVEAYTTRV

SEQ ID NO: 591519 - protein, 9 aa, Homo Sapiens
PDNDEDDPV

SEQ ID NO: 591520 - protein, 9 aa, Homo Sapiens
GEYLPPSGH

SEQ ID NO: 591521 - protein, 9 aa, Homo Sapiens
TGFTDQPEM

SEQ ID NO: 591522 - protein, 9 aa, Homo Sapiens
VEHPEKAVS

SEQ ID NO: 591523 - protein, 9 aa, Homo Sapiens
VPAGDQDHA

SEQ ID NO: 591524 - protein, 9 aa, Homo Sapiens
QKDYLIIFL

SEQ ID NO: 591525 - protein, 9 aa, Homo Sapiens
IAFSYFITS

SEQ ID NO: 591526 - protein, 9 aa, Homo Sapiens
QDHAPHRGK

SEQ ID NO: 591527 - protein, 9 aa, Homo Sapiens
LADKIPKTA

SEQ ID NO: 591528 - protein, 9 aa, Homo Sapiens
FTAAGAQAA

SEQ ID NO: 591529 - protein, 9 aa, Homo Sapiens
APFICTSEM

SEQ ID NO: 591530 - protein, 9 aa, Homo Sapiens
VSRVRNLVE

SEQ ID NO: 591531 - protein, 9 aa, Homo Sapiens
TKIIINYNL

SEQ ID NO: 591532 - protein, 9 aa, Homo Sapiens
FLRRKPIVP

SEQ ID NO: 591533 - protein, 9 aa, Homo Sapiens
YPLIYRLIL

SEQ ID NO: 591534 - protein, 9 aa, Homo Sapiens
DSVYSASRW

SEQ ID NO: 591535 - protein, 9 aa, Homo Sapiens
CFLRPPVHH

SEQ ID NO: 591536 - protein, 9 aa, Homo Sapiens
TRSHSQSSD

SEQ ID NO: 591537 - protein, 9 aa, Homo Sapiens
RRPAEVLWG

SEQ ID NO: 591538 - protein, 9 aa, Homo Sapiens
QQRSGAAVG

SEQ ID NO: 591539 - protein, 9 aa, Homo Sapiens
LQEIENAIH

SEQ ID NO: 591540 - protein, 9 aa, Homo Sapiens
QITDLKVEI

SEQ ID NO: 591541 - protein, 9 aa, Homo Sapiens
VSTDNTFVV

SEQ ID NO: 591542 - protein, 9 aa, Homo Sapiens
IQARTAAGY

SEQ ID NO: 591543 - protein, 9 aa, Homo Sapiens
EISLHSINR

SEQ ID NO: 591544 - protein, 9 aa, Homo Sapiens
QENVEVVRT

SEQ ID NO: 591545 - protein, 9 aa, Homo Sapiens
WGGAEDRQV

SEQ ID NO: 591546 - protein, 9 aa, Homo Sapiens
QYPLIYRLI

SEQ ID NO: 591547 - protein, 9 aa, Homo Sapiens
LPLTDGQIV

SEQ ID NO: 591548 - protein, 9 aa, Homo Sapiens
VLSIASAQE

SEQ ID NO: 591549 - protein, 9 aa, Homo Sapiens
LVTSTSTDS

SEQ ID NO: 591550 - protein, 9 aa, Homo Sapiens
PNSTVDFRV

SEQ ID NO: 591551 - protein, 9 aa, Homo Sapiens
AGDQDHAPH

SEQ ID NO: 591552 - protein, 9 aa, Homo Sapiens
AGDVDAHHP

SEQ ID NO: 591553 - protein, 9 aa, Homo Sapiens
ATPPDPASQ

SEQ ID NO: 591554 - protein, 9 aa, Homo Sapiens
ESLQEDLEN

SEQ ID NO: 591555 - protein, 9 aa, Homo Sapiens
TDLKVEIHG

SEQ ID NO: 591556 - protein, 9 aa, Homo Sapiens
QAARCQPSE

SEQ ID NO: 591557 - protein, 9 aa, Homo Sapiens
SIKLLADKI

SEQ ID NO: 591558 - protein, 9 aa, Homo Sapiens
VLWGGAEDR

SEQ ID NO: 591559 - protein, 9 aa, Homo Sapiens
STKLLRGDG

SEQ ID NO: 591560 - protein, 9 aa, Homo Sapiens
PSLDNFLRR

SEQ ID NO: 591561 - protein, 9 aa, Homo Sapiens
SEMKFQYSK

SEQ ID NO: 591562 - protein, 9 aa, Homo Sapiens
PKIFQFNNH

SEQ ID NO: 591563 - protein, 9 aa, Homo Sapiens
PPDPASQGL

SEQ ID NO: 591564 - protein, 9 aa, Homo Sapiens
ANVVRDRDH

SEQ ID NO: 591565 - protein, 9 aa, Homo Sapiens
LCVQHFARE

SEQ ID NO: 591566 - protein, 9 aa, Homo Sapiens
IFQASRFLG

SEQ ID NO: 591567 - protein, 9 aa, Homo Sapiens
LCLGAKAIQ

SEQ ID NO: 591568 - protein, 9 aa, Homo Sapiens
VLPSDGSMH

SEQ ID NO: 591569 - protein, 9 aa, Homo Sapiens
LAWSKARTG

SEQ ID NO: 591570 - protein, 9 aa, Homo Sapiens
ELGCFQLKL

SEQ ID NO: 591571 - protein, 9 aa, Homo Sapiens
ECCKVFSRR

SEQ ID NO: 591572 - protein, 9 aa, Homo Sapiens
EYIRSEKQI

SEQ ID NO: 591573 - protein, 9 aa, Homo Sapiens
GSGIHSGAT

SEQ ID NO: 591574 - protein, 9 aa, Homo Sapiens
RLKCFLRPP

SEQ ID NO: 591575 - protein, 9 aa, Homo Sapiens
RAQVNKPGE

SEQ ID NO: 591576 - protein, 9 aa, Homo Sapiens
KNHVYCLFD

SEQ ID NO: 591577 - protein, 9 aa, Homo Sapiens
FTPLNVDTI

SEQ ID NO: 591578 - protein, 9 aa, Homo Sapiens
TVTDFGWDD

SEQ ID NO: 591579 - protein, 9 aa, Homo Sapiens
IGFAASCSV

SEQ ID NO: 591580 - protein, 9 aa, Homo Sapiens
RLGCPSQTS

SEQ ID NO: 591581 - protein, 9 aa, Homo Sapiens
YYNAAGVNK

SEQ ID NO: 591582 - protein, 9 aa, Homo Sapiens
VLPSVAAPA

SEQ ID NO: 591583 - protein, 9 aa, Homo Sapiens
SMTLDVQPS

SEQ ID NO: 591584 - protein, 9 aa, Homo Sapiens
SVTQIKPNS

SEQ ID NO: 591585 - protein, 9 aa, Homo Sapiens
KEFTYLNSP

SEQ ID NO: 591586 - protein, 9 aa, Homo Sapiens
LKTPQRRLG

SEQ ID NO: 591587 - protein, 9 aa, Homo Sapiens
DQDHAPHRG

SEQ ID NO: 591588 - protein, 9 aa, Homo Sapiens
TNVCVYYVA

SEQ ID NO: 591589 - protein, 9 aa, Homo Sapiens
ARLFAMQAH

SEQ ID NO: 591590 - protein, 9 aa, Homo Sapiens
VVRDRDHEV

SEQ ID NO: 591591 - protein, 9 aa, Homo Sapiens
SLFFCDFSL

SEQ ID NO: 591592 - protein, 9 aa, Homo Sapiens
TDNTFVVSH

SEQ ID NO: 591593 - protein, 9 aa, Homo Sapiens
DVSFFKTVF

SEQ ID NO: 591594 - protein, 9 aa, Homo Sapiens
IKIVTPEWV

SEQ ID NO: 591595 - protein, 9 aa, Homo Sapiens
WVTWMRNEL

SEQ ID NO: 591596 - protein, 9 aa, Homo Sapiens
GPRLKILRN

SEQ ID NO: 591597 - protein, 9 aa, Homo Sapiens
AQVNKPGEV

SEQ ID NO: 591598 - protein, 9 aa, Homo Sapiens
NVVRDRDHE

SEQ ID NO: 591599 - protein, 9 aa, Homo Sapiens
PPTNSNSLP

SEQ ID NO: 591600 - protein, 9 aa, Homo Sapiens
SKARTGGHS

SEQ ID NO: 591601 - protein, 9 aa, Homo Sapiens
VYCLFDVSD

SEQ ID NO: 591602 - protein, 9 aa, Homo Sapiens
GSMTLDVQP

SEQ ID NO: 591603 - protein, 9 aa, Homo Sapiens
PATTGFTDQ

SEQ ID NO: 591604 - protein, 9 aa, Homo Sapiens
IVDTRQQEY

SEQ ID NO: 591605 - protein, 9 aa, Homo Sapiens
GARQPPAEP

SEQ ID NO: 591606 - protein, 9 aa, Homo Sapiens
LSPEETPTG

SEQ ID NO: 591607 - protein, 9 aa, Homo Sapiens
VYGVVEAYT

SEQ ID NO: 591608 - protein, 9 aa, Homo Sapiens
TSTSTDSAS

SEQ ID NO: 591609 - protein, 9 aa, Homo Sapiens
LWGGAEDRQ

SEQ ID NO: 591610 - protein, 9 aa, Homo Sapiens
QQEYIRSEK

SEQ ID NO: 591611 - protein, 9 aa, Homo Sapiens
NTCCRNTCC

SEQ ID NO: 591612 - protein, 9 aa, Homo Sapiens
GTLAIAVIN

SEQ ID NO: 591613 - protein, 9 aa, Homo Sapiens
GIFNVKLPG

SEQ ID NO: 591614 - protein, 9 aa, Homo Sapiens
CRPSCCLTT

SEQ ID NO: 591615 - protein, 9 aa, Homo Sapiens
LVIAFSYFI

SEQ ID NO: 591616 - protein, 9 aa, Homo Sapiens
SACSRNAVP

SEQ ID NO: 591617 - protein, 9 aa, Homo Sapiens
FKQRQRLAQ

SEQ ID NO: 591618 - protein, 9 aa, Homo Sapiens
SSDTRSHSQ

SEQ ID NO: 591619 - protein, 9 aa, Homo Sapiens
RSLPSPLPK

SEQ ID NO: 591620 - protein, 9 aa, Homo Sapiens
HPSSSSDTR

SEQ ID NO: 591621 - protein, 9 aa, Homo Sapiens
QDVNHRVWV

SEQ ID NO: 591622 - protein, 9 aa, Homo Sapiens
FGWDDALHT

SEQ ID NO: 591623 - protein, 9 aa, Homo Sapiens
VMRKLQKTC

SEQ ID NO: 591624 - protein, 9 aa, Homo Sapiens
LTRYDCELN

SEQ ID NO: 591625 - protein, 9 aa, Homo Sapiens
LPPKIFQFN

SEQ ID NO: 591626 - protein, 9 aa, Homo Sapiens
YLGSGIHSG

SEQ ID NO: 591627 - protein, 9 aa, Homo Sapiens
QASRFLGEA

SEQ ID NO: 591628 - protein, 9 aa, Homo Sapiens
NVEEAGGQA

SEQ ID NO: 591629 - protein, 9 aa, Homo Sapiens
QDLQDGSSE

SEQ ID NO: 591630 - protein, 9 aa, Homo Sapiens
ATSIKWKLS

SEQ ID NO: 591631 - protein, 9 aa, Homo Sapiens
AVPDKAPGS

SEQ ID NO: 591632 - protein, 9 aa, Homo Sapiens
ELTVTDVTT

SEQ ID NO: 591633 - protein, 9 aa, Homo Sapiens
TSGVNLTQK

SEQ ID NO: 591634 - protein, 9 aa, Homo Sapiens
SLDNFLRRK

SEQ ID NO: 591635 - protein, 9 aa, Homo Sapiens
FAMQAHPNI

SEQ ID NO: 591636 - protein, 9 aa, Homo Sapiens
DCELNVPVL

SEQ ID NO: 591637 - protein, 9 aa, Homo Sapiens
TCNECCKVF

SEQ ID NO: 591638 - protein, 9 aa, Homo Sapiens
LKLRGDVEM

SEQ ID NO: 591639 - protein, 9 aa, Homo Sapiens
FFCDFSLLF

SEQ ID NO: 591640 - protein, 9 aa, Homo Sapiens
PQVQGPLVK

SEQ ID NO: 591641 - protein, 9 aa, Homo Sapiens
QGILFASSE

SEQ ID NO: 591642 - protein, 9 aa, Homo Sapiens
HAPHRGKPA

SEQ ID NO: 591643 - protein, 9 aa, Homo Sapiens
KMGFQQRSG

SEQ ID NO: 591644 - protein, 9 aa, Homo Sapiens
GPLVKIMPV

SEQ ID NO: 591645 - protein, 9 aa, Homo Sapiens
YIPKHKLCK

SEQ ID NO: 591646 - protein, 9 aa, Homo Sapiens
CDFSLLFHI

SEQ ID NO: 591647 - protein, 9 aa, Homo Sapiens
ASRFLGEAE

SEQ ID NO: 591648 - protein, 9 aa, Homo Sapiens
RDHEVDTTL

SEQ ID NO: 591649 - protein, 9 aa, Homo Sapiens
LSHKLKGVC

SEQ ID NO: 591650 - protein, 9 aa, Homo Sapiens
APVEETLHA

SEQ ID NO: 591651 - protein, 9 aa, Homo Sapiens
QLKLRGDVE

SEQ ID NO: 591652 - protein, 9 aa, Homo Sapiens
DAGTLAIAV

SEQ ID NO: 591653 - protein, 9 aa, Homo Sapiens
GKAFKQRQR

SEQ ID NO: 591654 - protein, 9 aa, Homo Sapiens
RDRAPFICT

SEQ ID NO: 591655 - protein, 9 aa, Homo Sapiens
FQQHELSKI

SEQ ID NO: 591656 - protein, 9 aa, Homo Sapiens
FNVKLPGSS

SEQ ID NO: 591657 - protein, 9 aa, Homo Sapiens
TCCRNTCCQ

SEQ ID NO: 591658 - protein, 9 aa, Homo Sapiens
LPKEFTYLN

SEQ ID NO: 591659 - protein, 9 aa, Homo Sapiens
CLHRLKCFL

SEQ ID NO: 591660 - protein, 9 aa, Homo Sapiens
LLALCVQHF

SEQ ID NO: 591661 - protein, 9 aa, Homo Sapiens
TRQQEYIRS

SEQ ID NO: 591662 - protein, 9 aa, Homo Sapiens
VPKTLAYTK

SEQ ID NO: 591663 - protein, 9 aa, Homo Sapiens
RQPPAEPPT

SEQ ID NO: 591664 - protein, 9 aa, Homo Sapiens
TLGEYLPPS

SEQ ID NO: 591665 - protein, 9 aa, Homo Sapiens
SASTKLLRG

SEQ ID NO: 591666 - protein, 9 aa, Homo Sapiens
WSKARTGGH

SEQ ID NO: 591667 - protein, 9 aa, Homo Sapiens
QGARQPPAE

SEQ ID NO: 591668 - protein, 9 aa, Homo Sapiens
KFQYSKVLN

SEQ ID NO: 591669 - protein, 9 aa, Homo Sapiens
PKGTARDIY

SEQ ID NO: 591670 - protein, 9 aa, Homo Sapiens
MNVEEAGGQ

SEQ ID NO: 591671 - protein, 9 aa, Homo Sapiens
VYVFQIQAR

SEQ ID NO: 591672 - protein, 9 aa, Homo Sapiens
ELEGFQQHE

SEQ ID NO: 591673 - protein, 9 aa, Homo Sapiens
GSSEEQSDI

SEQ ID NO: 591674 - protein, 9 aa, Homo Sapiens
VTDFGWDDA

SEQ ID NO: 591675 - protein, 9 aa, Homo Sapiens
NAAGVNKLG

SEQ ID NO: 591676 - protein, 9 aa, Homo Sapiens
IYWLPLTDG

SEQ ID NO: 591677 - protein, 9 aa, Homo Sapiens
NTFVVSHLG

SEQ ID NO: 591678 - protein, 9 aa, Homo Sapiens
SGIPAAKLV

SEQ ID NO: 591679 - protein, 9 aa, Homo Sapiens
ELLSHKLKG

SEQ ID NO: 591680 - protein, 9 aa, Homo Sapiens
HKLCKLETA

SEQ ID NO: 591681 - protein, 9 aa, Homo Sapiens
LPSDGSMHN

SEQ ID NO: 591682 - protein, 9 aa, Homo Sapiens
NDEDDPVPL

SEQ ID NO: 591683 - protein, 9 aa, Homo Sapiens
CRMEPAGSQ

SEQ ID NO: 591684 - protein, 9 aa, Homo Sapiens
IFEHIIVDV

SEQ ID NO: 591685 - protein, 9 aa, Homo Sapiens
GKTSGVNLT

SEQ ID NO: 591686 - protein, 9 aa, Homo Sapiens
KPNEVIRKY

SEQ ID NO: 591687 - protein, 9 aa, Homo Sapiens
ASKAAEAVL

SEQ ID NO: 591688 - protein, 9 aa, Homo Sapiens
DHEVDTTLK

SEQ ID NO: 591689 - protein, 9 aa, Homo Sapiens
KGPPTNSNS

SEQ ID NO: 591690 - protein, 9 aa, Homo Sapiens
YFNPESLQE

SEQ ID NO: 591691 - protein, 9 aa, Homo Sapiens
YSRALCLGA

SEQ ID NO: 591692 - protein, 9 aa, Homo Sapiens
EVSSCGDAG

SEQ ID NO: 591693 - protein, 9 aa, Homo Sapiens
DSFLQIGFA

SEQ ID NO: 591694 - protein, 9 aa, Homo Sapiens
YISNTPKGT

SEQ ID NO: 591695 - protein, 9 aa, Homo Sapiens
LQEDLENMY

SEQ ID NO: 591696 - protein, 9 aa, Homo Sapiens
PTLGEYLPP

SEQ ID NO: 591697 - protein, 9 aa, Homo Sapiens
LTTCCRTTC

SEQ ID NO: 591698 - protein, 9 aa, Homo Sapiens
GVNKLGLMR

SEQ ID NO: 591699 - protein, 9 aa, Homo Sapiens
GGAEDRQVA

SEQ ID NO: 591700 - protein, 9 aa, Homo Sapiens
VPDKAPGSG

SEQ ID NO: 591701 - protein, 9 aa, Homo Sapiens
VEAYTTRVG

SEQ ID NO: 591702 - protein, 9 aa, Homo Sapiens
HTRLGPEPA

SEQ ID NO: 591703 - protein, 9 aa, Homo Sapiens
KTPQRRLGC

SEQ ID NO: 591704 - protein, 9 aa, Homo Sapiens
PPQVQGPLV

SEQ ID NO: 591705 - protein, 9 aa, Homo Sapiens
PFICTSEME

SEQ ID NO: 591706 - protein, 9 aa, Homo Sapiens
SPLFLATGH

SEQ ID NO: 591707 - protein, 9 aa, Homo Sapiens
LKVEIHGGS

SEQ ID NO: 591708 - protein, 9 aa, Homo Sapiens
PGPPPPDND

SEQ ID NO: 591709 - protein, 9 aa, Homo Sapiens
DVTTNSVGL

SEQ ID NO: 591710 - protein, 9 aa, Homo Sapiens
RSGAAVGQQ

SEQ ID NO: 591711 - protein, 9 aa, Homo Sapiens
ELVTSTSTD

SEQ ID NO: 591712 - protein, 9 aa, Homo Sapiens
TRLGPEPAG

SEQ ID NO: 591713 - protein, 9 aa, Homo Sapiens
IKPNSTVDF

SEQ ID NO: 591714 - protein, 9 aa, Homo Sapiens
DHAPHRGKP

SEQ ID NO: 591715 - protein, 9 aa, Homo Sapiens
TYAVHAGVV

SEQ ID NO: 591716 - protein, 9 aa, Homo Sapiens
RQQEYIRSE

SEQ ID NO: 591717 - protein, 9 aa, Homo Sapiens
TVSFVDIDQ

SEQ ID NO: 591718 - protein, 9 aa, Homo Sapiens
NAIHENRIK

SEQ ID NO: 591719 - protein, 9 aa, Homo Sapiens
TPLVIAFSY

SEQ ID NO: 591720 - protein, 9 aa, Homo Sapiens
LALCVQHFA

SEQ ID NO: 591721 - protein, 9 aa, Homo Sapiens
CLFDVSDIT

SEQ ID NO: 591722 - protein, 9 aa, Homo Sapiens
ITDLKVEIH

SEQ ID NO: 591723 - protein, 9 aa, Homo Sapiens
KPSHVKAEP

SEQ ID NO: 591724 - protein, 9 aa, Homo Sapiens
GFQQRSGAA

SEQ ID NO: 591725 - protein, 9 aa, Homo Sapiens
FDVSDITLE

SEQ ID NO: 591726 - protein, 9 aa, Homo Sapiens
PTKPNEVIR

SEQ ID NO: 591727 - protein, 9 aa, Homo Sapiens
GTRMDSRAQ

SEQ ID NO: 591728 - protein, 9 aa, Homo Sapiens
IHSASTKLL

SEQ ID NO: 591729 - protein, 9 aa, Homo Sapiens
SIASAQENV

SEQ ID NO: 591730 - protein, 9 aa, Homo Sapiens
WYYNAAGVN

SEQ ID NO: 591731 - protein, 9 aa, Homo Sapiens
PYGQPRPWC

SEQ ID NO: 591732 - protein, 9 aa, Homo Sapiens
CCRNTCCQP

SEQ ID NO: 591733 - protein, 9 aa, Homo Sapiens
RNELEQLGT

SEQ ID NO: 591734 - protein, 9 aa, Homo Sapiens
LRGTWKSEN

SEQ ID NO: 591735 - protein, 9 aa, Homo Sapiens
APASDSKHG

SEQ ID NO: 591736 - protein, 9 aa, Homo Sapiens
FQYSKVLNE

SEQ ID NO: 591737 - protein, 9 aa, Homo Sapiens
CGDAGDVDA

SEQ ID NO: 591738 - protein, 9 aa, Homo Sapiens
SSCGDAGDV

SEQ ID NO: 591739 - protein, 9 aa, Homo Sapiens
WKKIAIQGL

SEQ ID NO: 591740 - protein, 9 aa, Homo Sapiens
MASKAAEAV

SEQ ID NO: 591741 - protein, 9 aa, Homo Sapiens
QQGSIQDVN

SEQ ID NO: 591742 - protein, 9 aa, Homo Sapiens
VCVYYVATS

SEQ ID NO: 591743 - protein, 9 aa, Homo Sapiens
TTNSVGLSW

SEQ ID NO: 591744 - protein, 9 aa, Homo Sapiens
RGISNPITI

SEQ ID NO: 591745 - protein, 9 aa, Homo Sapiens
KVGNEYITK

SEQ ID NO: 591746 - protein, 9 aa, Homo Sapiens
TLQLPPKIF

SEQ ID NO: 591747 - protein, 9 aa, Homo Sapiens
PSSSSDTRS

SEQ ID NO: 591748 - protein, 9 aa, Homo Sapiens
EVYGVVEAY

SEQ ID NO: 591749 - protein, 9 aa, Homo Sapiens
CGPRLKILR

SEQ ID NO: 591750 - protein, 9 aa, Homo Sapiens
SPEETPTGA

SEQ ID NO: 591751 - protein, 9 aa, Homo Sapiens
TPLNVDTIE

SEQ ID NO: 591752 - protein, 9 aa, Homo Sapiens
AAGVNKLGL

SEQ ID NO: 591753 - protein, 9 aa, Homo Sapiens
HRLKCFLRP

SEQ ID NO: 591754 - protein, 9 aa, Homo Sapiens
MRNELEQLG

SEQ ID NO: 591755 - protein, 9 aa, Homo Sapiens
PDVELLSHK

SEQ ID NO: 591756 - protein, 9 aa, Homo Sapiens
HFPSLFFCD

SEQ ID NO: 591757 - protein, 9 aa, Homo Sapiens
SNSLPANVS

SEQ ID NO: 591758 - protein, 9 aa, Homo Sapiens
STEMASKAA

SEQ ID NO: 591759 - protein, 9 aa, Homo Sapiens
IPKHKLCKL

SEQ ID NO: 591760 - protein, 9 aa, Homo Sapiens
DLQDGSSEE

SEQ ID NO: 591761 - protein, 9 aa, Homo Sapiens
LQIGFAASC

SEQ ID NO: 591762 - protein, 9 aa, Homo Sapiens
GNEYITKGQ

SEQ ID NO: 591763 - protein, 9 aa, Homo Sapiens
LQQKDYLII

SEQ ID NO: 591764 - protein, 9 aa, Homo Sapiens
LPVLETSPQ

SEQ ID NO: 591765 - protein, 9 aa, Homo Sapiens
GIGKTSGVN

SEQ ID NO: 591766 - protein, 9 aa, Homo Sapiens
TWKSENKTP

SEQ ID NO: 591767 - protein, 9 aa, Homo Sapiens
FCDFSLLFH

SEQ ID NO: 591768 - protein, 9 aa, Homo Sapiens
VHAGVVRSE

SEQ ID NO: 591769 - protein, 9 aa, Homo Sapiens
QRLAQHHRT

SEQ ID NO: 591770 - protein, 9 aa, Homo Sapiens
NGFQDLQDG

SEQ ID NO: 591771 - protein, 9 aa, Homo Sapiens
LQSLKTPQR

SEQ ID NO: 591772 - protein, 9 aa, Homo Sapiens
LERKIDIVG

SEQ ID NO: 591773 - protein, 9 aa, Homo Sapiens
TGFSGYSQF

SEQ ID NO: 591774 - protein, 9 aa, Homo Sapiens
PGTPATTGF

SEQ ID NO: 591775 - protein, 9 aa, Homo Sapiens
CVKEANVWN

SEQ ID NO: 591776 - protein, 9 aa, Homo Sapiens
RGSMTLDVQ

SEQ ID NO: 591777 - protein, 9 aa, Homo Sapiens
TLIPTLGEY

SEQ ID NO: 591778 - protein, 9 aa, Homo Sapiens
EIENAIHEN

SEQ ID NO: 591779 - protein, 9 aa, Homo Sapiens
LRRKPIVPE

SEQ ID NO: 591780 - protein, 9 aa, Homo Sapiens
NYNLEQPSQ

SEQ ID NO: 591781 - protein, 9 aa, Homo Sapiens
TSLKKKLRG

SEQ ID NO: 591782 - protein, 9 aa, Homo Sapiens
FQRATSIKW

SEQ ID NO: 591783 - protein, 9 aa, Homo Sapiens
KVNEISLHS

SEQ ID NO: 591784 - protein, 9 aa, Homo Sapiens
SRALCLGAK

SEQ ID NO: 591785 - protein, 9 aa, Homo Sapiens
YVFSTEMAS

SEQ ID NO: 591786 - protein, 9 aa, Homo Sapiens
GLIFLMGNC

SEQ ID NO: 591787 - protein, 9 aa, Homo Sapiens
HELSKIKHM

SEQ ID NO: 591788 - protein, 9 aa, Homo Sapiens
AWSKARTGG

SEQ ID NO: 591789 - protein, 9 aa, Homo Sapiens
PQQGSIQDV

SEQ ID NO: 591790 - protein, 9 aa, Homo Sapiens
RCQPSEVSS

SEQ ID NO: 591791 - protein, 9 aa, Homo Sapiens
PLFLATGHF

SEQ ID NO: 591792 - protein, 9 aa, Homo Sapiens
QNTCCRNTC

SEQ ID NO: 591793 - protein, 9 aa, Homo Sapiens
GILFASSEC

SEQ ID NO: 591794 - protein, 9 aa, Homo Sapiens
VQELMVLPS

SEQ ID NO: 591795 - protein, 9 aa, Homo Sapiens
FKTVFHSTW

SEQ ID NO: 591796 - protein, 9 aa, Homo Sapiens
LTNDKSPEA

SEQ ID NO: 591797 - protein, 9 aa, Homo Sapiens
GFAASCSVT

SEQ ID NO: 591798 - protein, 9 aa, Homo Sapiens
LFASSECLK

SEQ ID NO: 591799 - protein, 9 aa, Homo Sapiens
MHTRLGPEP

SEQ ID NO: 591800 - protein, 9 aa, Homo Sapiens
IIINYNLEQ

SEQ ID NO: 591801 - protein, 9 aa, Homo Sapiens
CLTTCCRTT

SEQ ID NO: 591802 - protein, 9 aa, Homo Sapiens
GPKGPPGPR

SEQ ID NO: 591803 - protein, 9 aa, Homo Sapiens
LTVTDVTTN

SEQ ID NO: 591804 - protein, 9 aa, Homo Sapiens
AHHPIQCPG

SEQ ID NO: 591805 - protein, 9 aa, Homo Sapiens
TAAGAQAAR

SEQ ID NO: 591806 - protein, 9 aa, Homo Sapiens
NKTPSPQDP

SEQ ID NO: 591807 - protein, 9 aa, Homo Sapiens
MVLPSVAAP

SEQ ID NO: 591808 - protein, 9 aa, Homo Sapiens
TIEESPSKE

SEQ ID NO: 591809 - protein, 9 aa, Homo Sapiens
AAGAQAARC

SEQ ID NO: 591810 - protein, 9 aa, Homo Sapiens
SVYSASRWK

SEQ ID NO: 591811 - protein, 9 aa, Homo Sapiens
ATTGFTDQP

SEQ ID NO: 591812 - protein, 9 aa, Homo Sapiens
RRKPIVPEH

SEQ ID NO: 591813 - protein, 9 aa, Homo Sapiens
FCNHPVHFV

SEQ ID NO: 591814 - protein, 9 aa, Homo Sapiens
RNPYGQPRP

SEQ ID NO: 591815 - protein, 9 aa, Homo Sapiens
PAGPMHTRL

SEQ ID NO: 591816 - protein, 9 aa, Homo Sapiens
TGAWARATH

SEQ ID NO: 591817 - protein, 9 aa, Homo Sapiens
QGPLVKIMP

SEQ ID NO: 591818 - protein, 9 aa, Homo Sapiens
MTGYEMPRQ

SEQ ID NO: 591819 - protein, 9 aa, Homo Sapiens
RYSRALCLG

SEQ ID NO: 591820 - protein, 9 aa, Homo Sapiens
SLPVLETSP

SEQ ID NO: 591821 - protein, 9 aa, Homo Sapiens
NMLSQGARQ

SEQ ID NO: 591822 - protein, 9 aa, Homo Sapiens
SPLPKEFTY

SEQ ID NO: 591823 - protein, 9 aa, Homo Sapiens
EDALSEMKF

SEQ ID NO: 591824 - protein, 9 aa, Homo Sapiens
LEGFQQHEL

SEQ ID NO: 591825 - protein, 9 aa, Homo Sapiens
PPAGPMHTR

SEQ ID NO: 591826 - protein, 9 aa, Homo Sapiens
DSRAQVNKP

SEQ ID NO: 591827 - protein, 9 aa, Homo Sapiens
KLCKLETAH

SEQ ID NO: 591828 - protein, 9 aa, Homo Sapiens
KPYTCNECC

SEQ ID NO: 591829 - protein, 9 aa, Homo Sapiens
LRVCVLSDL

SEQ ID NO: 591830 - protein, 9 aa, Homo Sapiens
FICTSEMEY

SEQ ID NO: 591831 - protein, 9 aa, Homo Sapiens
QELMVLPSV

SEQ ID NO: 591832 - protein, 9 aa, Homo Sapiens
DVELLSHKL

SEQ ID NO: 591833 - protein, 9 aa, Homo Sapiens
RAPFICTSE

SEQ ID NO: 591834 - protein, 9 aa, Homo Sapiens
DSVTQIKPN

SEQ ID NO: 591835 - protein, 9 aa, Homo Sapiens
PPRSLVVFG

SEQ ID NO: 591836 - protein, 9 aa, Homo Sapiens
EEAGGQALG

SEQ ID NO: 591837 - protein, 9 aa, Homo Sapiens
DNYCRNPYG

SEQ ID NO: 591838 - protein, 9 aa, Homo Sapiens
CQNTCCRNT

SEQ ID NO: 591839 - protein, 9 aa, Homo Sapiens
VTDVTTNSV

SEQ ID NO: 591840 - protein, 9 aa, Homo Sapiens
YGQPRPWCY

SEQ ID NO: 591841 - protein, 9 aa, Homo Sapiens
TVTDVTTNS

SEQ ID NO: 591842 - protein, 9 aa, Homo Sapiens
LFAMQAHPN

SEQ ID NO: 591843 - protein, 9 aa, Homo Sapiens
PDPASQGLG

SEQ ID NO: 591844 - protein, 9 aa, Homo Sapiens
GPPTNSNSL

SEQ ID NO: 591845 - protein, 9 aa, Homo Sapiens
IDIVGGYNW

SEQ ID NO: 591846 - protein, 9 aa, Homo Sapiens
EETPTGAWA

SEQ ID NO: 591847 - protein, 9 aa, Homo Sapiens
QEIENAIHE

SEQ ID NO: 591848 - protein, 9 aa, Homo Sapiens
ISNTPKGTA

SEQ ID NO: 591849 - protein, 9 aa, Homo Sapiens
HKLKGVCPE

SEQ ID NO: 591850 - protein, 9 aa, Homo Sapiens
VKIMPVKQP

SEQ ID NO: 591851 - protein, 9 aa, Homo Sapiens
NVDTIEESP

SEQ ID NO: 591852 - protein, 9 aa, Homo Sapiens
KHKLCKLET

SEQ ID NO: 591853 - protein, 9 aa, Homo Sapiens
PVSTDNTFV

SEQ ID NO: 591854 - protein, 9 aa, Homo Sapiens
AVHAGVVRS

SEQ ID NO: 591855 - protein, 9 aa, Homo Sapiens
TTKIIINYN

SEQ ID NO: 591856 - protein, 9 aa, Homo Sapiens
LAYTKPSHV

SEQ ID NO: 591857 - protein, 9 aa, Homo Sapiens
EAYTTRVGI

SEQ ID NO: 591858 - protein, 9 aa, Homo Sapiens
DALSEMKFQ

SEQ ID NO: 591859 - protein, 9 aa, Homo Sapiens
NLEQPSQLQ

SEQ ID NO: 591860 - protein, 9 aa, Homo Sapiens
LFTPLNVDT

SEQ ID NO: 591861 - protein, 9 aa, Homo Sapiens
GRISIKLLA

SEQ ID NO: 591862 - protein, 9 aa, Homo Sapiens
QSGIFNVKL

SEQ ID NO: 591863 - protein, 9 aa, Homo Sapiens
LNVDTIEES

SEQ ID NO: 591864 - protein, 9 aa, Homo Sapiens
SCCLTTCCR

SEQ ID NO: 591865 - protein, 9 aa, Homo Sapiens
YLHAPDHGA

SEQ ID NO: 591866 - protein, 9 aa, Homo Sapiens
VQHFARELE

SEQ ID NO: 591867 - protein, 9 aa, Homo Sapiens
KPNSTVDFR

SEQ ID NO: 591868 - protein, 9 aa, Homo Sapiens
HFARELELG

SEQ ID NO: 591869 - protein, 9 aa, Homo Sapiens
NPESLQEDL

SEQ ID NO: 591870 - protein, 9 aa, Homo Sapiens
GDAGDVDAH

SEQ ID NO: 591871 - protein, 9 aa, Homo Sapiens
EGGDPEPGE

SEQ ID NO: 591872 - protein, 9 aa, Homo Sapiens
LSQGARQPP

SEQ ID NO: 591873 - protein, 9 aa, Homo Sapiens
DPEPGEQER

SEQ ID NO: 591874 - protein, 9 aa, Homo Sapiens
GDQDHAPHR

SEQ ID NO: 591875 - protein, 9 aa, Homo Sapiens
ISIKLLADK

SEQ ID NO: 591876 - protein, 9 aa, Homo Sapiens
ETPTGAWAR

SEQ ID NO: 591877 - protein, 9 aa, Homo Sapiens
ISNPITISK

SEQ ID NO: 591878 - protein, 9 aa, Homo Sapiens
PKGPPGPRG

SEQ ID NO: 591879 - protein, 9 aa, Homo Sapiens
NCFSFLITQ

SEQ ID NO: 591880 - protein, 9 aa, Homo Sapiens
SKGIGKTSG

SEQ ID NO: 591881 - protein, 9 aa, Homo Sapiens
FSFLITQCP

SEQ ID NO: 591882 - protein, 9 aa, Homo Sapiens
EVIRKYTIF

SEQ ID NO: 591883 - protein, 9 aa, Homo Sapiens
TEMASKAAE

SEQ ID NO: 591884 - protein, 9 aa, Homo Sapiens
PSCCLTTCC

SEQ ID NO: 591885 - protein, 9 aa, Homo Sapiens
GDVDAHHPI

SEQ ID NO: 591886 - protein, 9 aa, Homo Sapiens
EDSFLQIGF

SEQ ID NO: 591887 - protein, 9 aa, Homo Sapiens
QIYLQSLKT

SEQ ID NO: 591888 - protein, 9 aa, Homo Sapiens
PSLLLNCFS

SEQ ID NO: 591889 - protein, 9 aa, Homo Sapiens
WMRNELEQL

SEQ ID NO: 591890 - protein, 9 aa, Homo Sapiens
SQTSLKKKL

SEQ ID NO: 591891 - protein, 9 aa, Homo Sapiens
SVYVFQIQA

SEQ ID NO: 591892 - protein, 9 aa, Homo Sapiens
ARCQPSEVS

SEQ ID NO: 591893 - protein, 9 aa, Homo Sapiens
VVSHLGSKY

SEQ ID NO: 591894 - protein, 9 aa, Homo Sapiens
LFFCDFSLL

SEQ ID NO: 591895 - protein, 9 aa, Homo Sapiens
KLLRGDGLK

SEQ ID NO: 591896 - protein, 9 aa, Homo Sapiens
RPCLHRLKC

SEQ ID NO: 591897 - protein, 9 aa, Homo Sapiens
PITISKITY

SEQ ID NO: 591898 - protein, 9 aa, Homo Sapiens
NEYITKGQN

SEQ ID NO: 591899 - protein, 9 aa, Homo Sapiens
QAGMTGYEM

SEQ ID NO: 591900 - protein, 9 aa, Homo Sapiens
MVPAGDQDH

SEQ ID NO: 591901 - protein, 9 aa, Homo Sapiens
PPTKPNEVI

SEQ ID NO: 591902 - protein, 9 aa, Homo Sapiens
PSPLPKEFT

SEQ ID NO: 591903 - protein, 9 aa, Homo Sapiens
TSIKWKLSA

SEQ ID NO: 591904 - protein, 9 aa, Homo Sapiens
AEGGDPEPG

SEQ ID NO: 591905 - protein, 9 aa, Homo Sapiens
LIPAWLITM

SEQ ID NO: 591906 - protein, 9 aa, Homo Sapiens
HLKSITGIA

SEQ ID NO: 591907 - protein, 9 aa, Homo Sapiens
EGLYRKLGA

SEQ ID NO: 591908 - protein, 9 aa, Homo Sapiens
KEEPLAGGK

SEQ ID NO: 591909 - protein, 9 aa, Homo Sapiens
KQFFHAILR

SEQ ID NO: 591910 - protein, 9 aa, Homo Sapiens
SQDHGMFLM

SEQ ID NO: 591911 - protein, 9 aa, Homo Sapiens
GREAGWPAG

SEQ ID NO: 591912 - protein, 9 aa, Homo Sapiens
GCEYACNAI

SEQ ID NO: 591913 - protein, 9 aa, Homo Sapiens
YMFSSNSGI

SEQ ID NO: 591914 - protein, 9 aa, Homo Sapiens
STLAEEVAA

SEQ ID NO: 591915 - protein, 9 aa, Homo Sapiens
EITEMQKTL

SEQ ID NO: 591916 - protein, 9 aa, Homo Sapiens
LCGMREMRA

SEQ ID NO: 591917 - protein, 9 aa, Homo Sapiens
FPSIKAMLS

SEQ ID NO: 591918 - protein, 9 aa, Homo Sapiens
ELQEWRVTS

SEQ ID NO: 591919 - protein, 9 aa, Homo Sapiens
YTEGLYRKL

SEQ ID NO: 591920 - protein, 9 aa, Homo Sapiens
MRALEEANA

SEQ ID NO: 591921 - protein, 9 aa, Homo Sapiens
AGWPAGVQA

SEQ ID NO: 591922 - protein, 9 aa, Homo Sapiens
LLGASLGGI

SEQ ID NO: 591923 - protein, 9 aa, Homo Sapiens
SSESTGHAT

SEQ ID NO: 591924 - protein, 9 aa, Homo Sapiens
FFGDTLDLT

SEQ ID NO: 591925 - protein, 9 aa, Homo Sapiens
FSWQSVLLS

SEQ ID NO: 591926 - protein, 9 aa, Homo Sapiens
EAIVREDCT

SEQ ID NO: 591927 - protein, 9 aa, Homo Sapiens
STTAAPVEV

SEQ ID NO: 591928 - protein, 9 aa, Homo Sapiens
TPVNLAVLT

SEQ ID NO: 591929 - protein, 9 aa, Homo Sapiens
ADHQGIVTA

SEQ ID NO: 591930 - protein, 9 aa, Homo Sapiens
HITPAQAPL

SEQ ID NO: 591931 - protein, 9 aa, Homo Sapiens
MFSSNSGIM

SEQ ID NO: 591932 - protein, 9 aa, Homo Sapiens
LIISYLRMH

SEQ ID NO: 591933 - protein, 9 aa, Homo Sapiens
REKRECRRT

SEQ ID NO: 591934 - protein, 9 aa, Homo Sapiens
TTVMENIRF

SEQ ID NO: 591935 - protein, 9 aa, Homo Sapiens
PQWLSQKQN

SEQ ID NO: 591936 - protein, 9 aa, Homo Sapiens
PLSRFPINI

SEQ ID NO: 591937 - protein, 9 aa, Homo Sapiens
IPELAETLE

SEQ ID NO: 591938 - protein, 9 aa, Homo Sapiens
KMRALEEAN

SEQ ID NO: 591939 - protein, 9 aa, Homo Sapiens
TIMKMRSTS

SEQ ID NO: 591940 - protein, 9 aa, Homo Sapiens
VLTDLHHTQ

SEQ ID NO: 591941 - protein, 9 aa, Homo Sapiens
VTPLVPSSR

SEQ ID NO: 591942 - protein, 9 aa, Homo Sapiens
QSVVDRPQW

SEQ ID NO: 591943 - protein, 9 aa, Homo Sapiens
SIKAMLSID

SEQ ID NO: 591944 - protein, 9 aa, Homo Sapiens
SQKYFNNDV

SEQ ID NO: 591945 - protein, 9 aa, Homo Sapiens
ERKRRLKGS

SEQ ID NO: 591946 - protein, 9 aa, Homo Sapiens
TAAAAADAA

SEQ ID NO: 591947 - protein, 9 aa, Homo Sapiens
NFGRRLIPA

SEQ ID NO: 591948 - protein, 9 aa, Homo Sapiens
KDNGSALLH

SEQ ID NO: 591949 - protein, 9 aa, Homo Sapiens
NNDVLVPPT

SEQ ID NO: 591950 - protein, 9 aa, Homo Sapiens
GASLGGIIY

SEQ ID NO: 591951 - protein, 9 aa, Homo Sapiens
VTAVYVRRL

SEQ ID NO: 591952 - protein, 9 aa, Homo Sapiens
AADHQGIVT

SEQ ID NO: 591953 - protein, 9 aa, Homo Sapiens
WPVRRGTVD

SEQ ID NO: 591954 - protein, 9 aa, Homo Sapiens
TSGRQKTFS

SEQ ID NO: 591955 - protein, 9 aa, Homo Sapiens
GVQVAAVQA

SEQ ID NO: 591956 - protein, 9 aa, Homo Sapiens
SGMDIFTKE

SEQ ID NO: 591957 - protein, 9 aa, Homo Sapiens
RGTGDHGGP

SEQ ID NO: 591958 - protein, 9 aa, Homo Sapiens
LGPSTDDDL

SEQ ID NO: 591959 - protein, 9 aa, Homo Sapiens
TEMQKTLEG

SEQ ID NO: 591960 - protein, 9 aa, Homo Sapiens
VRDGAVREV

SEQ ID NO: 591961 - protein, 9 aa, Homo Sapiens
RGDDSNRNY

SEQ ID NO: 591962 - protein, 9 aa, Homo Sapiens
SLKLKENGN

SEQ ID NO: 591963 - protein, 9 aa, Homo Sapiens
DGCADCTDH

SEQ ID NO: 591964 - protein, 9 aa, Homo Sapiens
LQEWRVTSM

SEQ ID NO: 591965 - protein, 9 aa, Homo Sapiens
VIELEIPDQ

SEQ ID NO: 591966 - protein, 9 aa, Homo Sapiens
VTPVTHQPL

SEQ ID NO: 591967 - protein, 9 aa, Homo Sapiens
VVLRVPQMR

SEQ ID NO: 591968 - protein, 9 aa, Homo Sapiens
SSTLAEEVA

SEQ ID NO: 591969 - protein, 9 aa, Homo Sapiens
QCGREAGWP

SEQ ID NO: 591970 - protein, 9 aa, Homo Sapiens
RKRGDDSNR

SEQ ID NO: 591971 - protein, 9 aa, Homo Sapiens
MAAFNKLVN

SEQ ID NO: 591972 - protein, 9 aa, Homo Sapiens
DAEQPDCDL

SEQ ID NO: 591973 - protein, 9 aa, Homo Sapiens
AALLHTLHS

SEQ ID NO: 591974 - protein, 9 aa, Homo Sapiens
SKFVRAEND

SEQ ID NO: 591975 - protein, 9 aa, Homo Sapiens
TDTDWRALA

SEQ ID NO: 591976 - protein, 9 aa, Homo Sapiens
RRLKGSKEG

SEQ ID NO: 591977 - protein, 9 aa, Homo Sapiens
MNTHLGIEQ

SEQ ID NO: 591978 - protein, 9 aa, Homo Sapiens
RLASYLDKM

SEQ ID NO: 591979 - protein, 9 aa, Homo Sapiens
LPPSIVLDV

SEQ ID NO: 591980 - protein, 9 aa, Homo Sapiens
DFSCNKFPS

SEQ ID NO: 591981 - protein, 9 aa, Homo Sapiens
MRSTSGRQK

SEQ ID NO: 591982 - protein, 9 aa, Homo Sapiens
SYFFGDTLD

SEQ ID NO: 591983 - protein, 9 aa, Homo Sapiens
STDDDLCVS

SEQ ID NO: 591984 - protein, 9 aa, Homo Sapiens
RCDGCADCT

SEQ ID NO: 591985 - protein, 9 aa, Homo Sapiens
GLQDHLNVI

SEQ ID NO: 591986 - protein, 9 aa, Homo Sapiens
TFPLASTKI

SEQ ID NO: 591987 - protein, 9 aa, Homo Sapiens
LLGEEREKR

SEQ ID NO: 591988 - protein, 9 aa, Homo Sapiens
EKGKRTGLG

SEQ ID NO: 591989 - protein, 9 aa, Homo Sapiens
PLLGASLGG

SEQ ID NO: 591990 - protein, 9 aa, Homo Sapiens
GPSTDDDLC

SEQ ID NO: 591991 - protein, 9 aa, Homo Sapiens
IALQQPEAI

SEQ ID NO: 591992 - protein, 9 aa, Homo Sapiens
MDIFTKENL

SEQ ID NO: 591993 - protein, 9 aa, Homo Sapiens
ENATALHAK

SEQ ID NO: 591994 - protein, 9 aa, Homo Sapiens
VQVAAVQAH

SEQ ID NO: 591995 - protein, 9 aa, Homo Sapiens
FKGNTQKMF

SEQ ID NO: 591996 - protein, 9 aa, Homo Sapiens
SKLYEAIVR

SEQ ID NO: 591997 - protein, 9 aa, Homo Sapiens
SSLHITPAQ

SEQ ID NO: 591998 - protein, 9 aa, Homo Sapiens
SNYLGLAAE

SEQ ID NO: 591999 - protein, 9 aa, Homo Sapiens
AGVKGSAAE

SEQ ID NO: 592000 - protein, 9 aa, Homo Sapiens
GASRGTGDH

SEQ ID NO: 592001 - protein, 9 aa, Homo Sapiens
KASIMRLII

SEQ ID NO: 592002 - protein, 9 aa, Homo Sapiens
HGGPVLLPL

SEQ ID NO: 592003 - protein, 9 aa, Homo Sapiens
SIMRLIISY

SEQ ID NO: 592004 - protein, 9 aa, Homo Sapiens
RDGAVREVA

SEQ ID NO: 592005 - protein, 9 aa, Homo Sapiens
PSSRAVTST

SEQ ID NO: 592006 - protein, 9 aa, Homo Sapiens
LQTIPELAE

SEQ ID NO: 592007 - protein, 9 aa, Homo Sapiens
QVTATDSDI

SEQ ID NO: 592008 - protein, 9 aa, Homo Sapiens
LEHEKGKRT

SEQ ID NO: 592009 - protein, 9 aa, Homo Sapiens
ASLKLKENG

SEQ ID NO: 592010 - protein, 9 aa, Homo Sapiens
TVPVQTAFS

SEQ ID NO: 592011 - protein, 9 aa, Homo Sapiens
ENGGCEYAC

SEQ ID NO: 592012 - protein, 9 aa, Homo Sapiens
SLHITPAQA

SEQ ID NO: 592013 - protein, 9 aa, Homo Sapiens
RFHYSWPVR

SEQ ID NO: 592014 - protein, 9 aa, Homo Sapiens
SSLLLQKEE

SEQ ID NO: 592015 - protein, 9 aa, Homo Sapiens
AKFPENKKQ

SEQ ID NO: 592016 - protein, 9 aa, Homo Sapiens
QSVLLSHQR

SEQ ID NO: 592017 - protein, 9 aa, Homo Sapiens
YASMNTHLG

SEQ ID NO: 592018 - protein, 9 aa, Homo Sapiens
SQVVGHLKS

SEQ ID NO: 592019 - protein, 9 aa, Homo Sapiens
ELEHEKGKR

SEQ ID NO: 592020 - protein, 9 aa, Homo Sapiens
IVLDVKEIT

SEQ ID NO: 592021 - protein, 9 aa, Homo Sapiens
VVAPLLGAS

SEQ ID NO: 592022 - protein, 9 aa, Homo Sapiens
TDDDLCVSE

SEQ ID NO: 592023 - protein, 9 aa, Homo Sapiens
LHPRHAYSI

SEQ ID NO: 592024 - protein, 9 aa, Homo Sapiens
AVAGASRGT

SEQ ID NO: 592025 - protein, 9 aa, Homo Sapiens
DRPQWLSQK

SEQ ID NO: 592026 - protein, 9 aa, Homo Sapiens
VSEITEMQK

SEQ ID NO: 592027 - protein, 9 aa, Homo Sapiens
MREMRAGGC

SEQ ID NO: 592028 - protein, 9 aa, Homo Sapiens
QIKAMKIAL

SEQ ID NO: 592029 - protein, 9 aa, Homo Sapiens
AMGQGLVLT

SEQ ID NO: 592030 - protein, 9 aa, Homo Sapiens
SNSGIMCLD

SEQ ID NO: 592031 - protein, 9 aa, Homo Sapiens
SWQSVLLSH

SEQ ID NO: 592032 - protein, 9 aa, Homo Sapiens
LREKRECRR

SEQ ID NO: 592033 - protein, 9 aa, Homo Sapiens
GQGLVLTDL

SEQ ID NO: 592034 - protein, 9 aa, Homo Sapiens
HSKLYEAIV

SEQ ID NO: 592035 - protein, 9 aa, Homo Sapiens
ASMNTHLGI

SEQ ID NO: 592036 - protein, 9 aa, Homo Sapiens
PRTVPVQTA

SEQ ID NO: 592037 - protein, 9 aa, Homo Sapiens
SRKRGDDSN

SEQ ID NO: 592038 - protein, 9 aa, Homo Sapiens
TQKMFSPKK

SEQ ID NO: 592039 - protein, 9 aa, Homo Sapiens
QIPSVTFPL

SEQ ID NO: 592040 - protein, 9 aa, Homo Sapiens
YICRVHNLI

SEQ ID NO: 592041 - protein, 9 aa, Homo Sapiens
KLGAANRTR

SEQ ID NO: 592042 - protein, 9 aa, Homo Sapiens
LHAKFPENK

SEQ ID NO: 592043 - protein, 9 aa, Homo Sapiens
LFGTTVMEN

SEQ ID NO: 592044 - protein, 9 aa, Homo Sapiens
FGDTLDLTY

SEQ ID NO: 592045 - protein, 9 aa, Homo Sapiens
YASLKLKEN

SEQ ID NO: 592046 - protein, 9 aa, Homo Sapiens
TDASSESTG

SEQ ID NO: 592047 - protein, 9 aa, Homo Sapiens
TQRTFKGNT

SEQ ID NO: 592048 - protein, 9 aa, Homo Sapiens
ERRPTAIWT

SEQ ID NO: 592049 - protein, 9 aa, Homo Sapiens
GEEREKRRR

SEQ ID NO: 592050 - protein, 9 aa, Homo Sapiens
TALHAKFPE

SEQ ID NO: 592051 - protein, 9 aa, Homo Sapiens
ASLGGIIYL

SEQ ID NO: 592052 - protein, 9 aa, Homo Sapiens
ALLCGMREM

SEQ ID NO: 592053 - protein, 9 aa, Homo Sapiens
YACNAIPGA

SEQ ID NO: 592054 - protein, 9 aa, Homo Sapiens
LLDPAVTPV

SEQ ID NO: 592055 - protein, 9 aa, Homo Sapiens
VAAVQAHGG

SEQ ID NO: 592056 - protein, 9 aa, Homo Sapiens
SARWGCGSA

SEQ ID NO: 592057 - protein, 9 aa, Homo Sapiens
RGLQDHLNV

SEQ ID NO: 592058 - protein, 9 aa, Homo Sapiens
ADAAATNAA

SEQ ID NO: 592059 - protein, 9 aa, Homo Sapiens
GDDSNRNYR

SEQ ID NO: 592060 - protein, 9 aa, Homo Sapiens
SMNTHLGIE

SEQ ID NO: 592061 - protein, 9 aa, Homo Sapiens
APLLGASLG

SEQ ID NO: 592062 - protein, 9 aa, Homo Sapiens
CADCTDHSD

SEQ ID NO: 592063 - protein, 9 aa, Homo Sapiens
SWKESSMNV

SEQ ID NO: 592064 - protein, 9 aa, Homo Sapiens
NVIELEIPD

SEQ ID NO: 592065 - protein, 9 aa, Homo Sapiens
AQVTATDSD

SEQ ID NO: 592066 - protein, 9 aa, Homo Sapiens
AEEVAALLH

SEQ ID NO: 592067 - protein, 9 aa, Homo Sapiens
PAGVQAVLG

SEQ ID NO: 592068 - protein, 9 aa, Homo Sapiens
LDVKEITTQ

SEQ ID NO: 592069 - protein, 9 aa, Homo Sapiens
RKELRCDGC

SEQ ID NO: 592070 - protein, 9 aa, Homo Sapiens
TGTARYASM

SEQ ID NO: 592071 - protein, 9 aa, Homo Sapiens
ECRRTIHTF

SEQ ID NO: 592072 - protein, 9 aa, Homo Sapiens
WLSQKQNFG

SEQ ID NO: 592073 - protein, 9 aa, Homo Sapiens
AAADAAATN

SEQ ID NO: 592074 - protein, 9 aa, Homo Sapiens
TSHMGGKFS

SEQ ID NO: 592075 - protein, 9 aa, Homo Sapiens
GLLQAKAGE

SEQ ID NO: 592076 - protein, 9 aa, Homo Sapiens
QFFHAILRQ

SEQ ID NO: 592077 - protein, 9 aa, Homo Sapiens
LPRGQCGRE

SEQ ID NO: 592078 - protein, 9 aa, Homo Sapiens
SMAYESRSQ

SEQ ID NO: 592079 - protein, 9 aa, Homo Sapiens
KESSMNVIE

SEQ ID NO: 592080 - protein, 9 aa, Homo Sapiens
PVNLAVLTL

SEQ ID NO: 592081 - protein, 9 aa, Homo Sapiens
RTVPVQTAF

SEQ ID NO: 592082 - protein, 9 aa, Homo Sapiens
PLGPSTDDD

SEQ ID NO: 592083 - protein, 9 aa, Homo Sapiens
ESLGLHPRH

SEQ ID NO: 592084 - protein, 9 aa, Homo Sapiens
QKQNFGRRL

SEQ ID NO: 592085 - protein, 9 aa, Homo Sapiens
HEKGKRTGL

SEQ ID NO: 592086 - protein, 9 aa, Homo Sapiens
GSAAEMYGS

SEQ ID NO: 592087 - protein, 9 aa, Homo Sapiens
QWLSQKQNF

SEQ ID NO: 592088 - protein, 9 aa, Homo Sapiens
EEVAALLHT

SEQ ID NO: 592089 - protein, 9 aa, Homo Sapiens
VVTPLVPSS

SEQ ID NO: 592090 - protein, 9 aa, Homo Sapiens
TFKGNTQKM

SEQ ID NO: 592091 - protein, 9 aa, Homo Sapiens
AGASRGTGD

SEQ ID NO: 592092 - protein, 9 aa, Homo Sapiens
GSAPGGLCG

SEQ ID NO: 592093 - protein, 9 aa, Homo Sapiens
SLLLQKEEP

SEQ ID NO: 592094 - protein, 9 aa, Homo Sapiens
AYESLGLHP

SEQ ID NO: 592095 - protein, 9 aa, Homo Sapiens
KMRSTSGRQ

SEQ ID NO: 592096 - protein, 9 aa, Homo Sapiens
GVQAVLGQC

SEQ ID NO: 592097 - protein, 9 aa, Homo Sapiens
FPINIFFTP

SEQ ID NO: 592098 - protein, 9 aa, Homo Sapiens
MKIALQQPE

SEQ ID NO: 592099 - protein, 9 aa, Homo Sapiens
FQQIKAMKI

SEQ ID NO: 592100 - protein, 9 aa, Homo Sapiens
ETRVFTSHM

SEQ ID NO: 592101 - protein, 9 aa, Homo Sapiens
FHYSWPVRR

SEQ ID NO: 592102 - protein, 9 aa, Homo Sapiens
RECRRTIHT

SEQ ID NO: 592103 - protein, 9 aa, Homo Sapiens
MRAGGCCHA

SEQ ID NO: 592104 - protein, 9 aa, Homo Sapiens
ESSMNVIEL

SEQ ID NO: 592105 - protein, 9 aa, Homo Sapiens
GASSSQDHG

SEQ ID NO: 592106 - protein, 9 aa, Homo Sapiens
GVKGSAAEM

SEQ ID NO: 592107 - protein, 9 aa, Homo Sapiens
HPRHAYSIL

SEQ ID NO: 592108 - protein, 9 aa, Homo Sapiens
VAVAGASRG

SEQ ID NO: 592109 - protein, 9 aa, Homo Sapiens
LLQAKAGEG

SEQ ID NO: 592110 - protein, 9 aa, Homo Sapiens
DHLNVIIFS

SEQ ID NO: 592111 - protein, 9 aa, Homo Sapiens
WRVTSMAQS

SEQ ID NO: 592112 - protein, 9 aa, Homo Sapiens
CGREAGWPA

SEQ ID NO: 592113 - protein, 9 aa, Homo Sapiens
VAPLLGASL

SEQ ID NO: 592114 - protein, 9 aa, Homo Sapiens
GEGGVQVAA

SEQ ID NO: 592115 - protein, 9 aa, Homo Sapiens
VNLAVLTLS

SEQ ID NO: 592116 - protein, 9 aa, Homo Sapiens
PAWLITMDR

SEQ ID NO: 592117 - protein, 9 aa, Homo Sapiens
NYAPSGMDI

SEQ ID NO: 592118 - protein, 9 aa, Homo Sapiens
DHGGPVLLP

SEQ ID NO: 592119 - protein, 9 aa, Homo Sapiens
GMDIFTKEN

SEQ ID NO: 592120 - protein, 9 aa, Homo Sapiens
AGEGGVQVA

SEQ ID NO: 592121 - protein, 9 aa, Homo Sapiens
DAAATNAAI

SEQ ID NO: 592122 - protein, 9 aa, Homo Sapiens
YFFGDTLDL

SEQ ID NO: 592123 - protein, 9 aa, Homo Sapiens
RKQFFHAIL

SEQ ID NO: 592124 - protein, 9 aa, Homo Sapiens
INIFFTPKQ

SEQ ID NO: 592125 - protein, 9 aa, Homo Sapiens
VLGQCEGLL

SEQ ID NO: 592126 - protein, 9 aa, Homo Sapiens
YESLGLHPR

SEQ ID NO: 592127 - protein, 9 aa, Homo Sapiens
HQGIVTAVY

SEQ ID NO: 592128 - protein, 9 aa, Homo Sapiens
HYSWPVRRG

SEQ ID NO: 592129 - protein, 9 aa, Homo Sapiens
DKASIMRLI

SEQ ID NO: 592130 - protein, 9 aa, Homo Sapiens
SEITEMQKT

SEQ ID NO: 592131 - protein, 9 aa, Homo Sapiens
TIPELAETL

SEQ ID NO: 592132 - protein, 9 aa, Homo Sapiens
QLLGEEREK

SEQ ID NO: 592133 - protein, 9 aa, Homo Sapiens
MRLIISYLR

SEQ ID NO: 592134 - protein, 9 aa, Homo Sapiens
PLPRGQCGR

SEQ ID NO: 592135 - protein, 9 aa, Homo Sapiens
VLIVMFLLS

SEQ ID NO: 592136 - protein, 9 aa, Homo Sapiens
KNNQDSPQI

SEQ ID NO: 592137 - protein, 9 aa, Homo Sapiens
FGTTVMENI

SEQ ID NO: 592138 - protein, 9 aa, Homo Sapiens
SLDAEQPDC

SEQ ID NO: 592139 - protein, 9 aa, Homo Sapiens
KAGEGGVQV

SEQ ID NO: 592140 - protein, 9 aa, Homo Sapiens
SDIGSNGEF

SEQ ID NO: 592141 - protein, 9 aa, Homo Sapiens
KLYEAIVRE

SEQ ID NO: 592142 - protein, 9 aa, Homo Sapiens
AVLTLSEAG

SEQ ID NO: 592143 - protein, 9 aa, Homo Sapiens
APSGMDIFT

SEQ ID NO: 592144 - protein, 9 aa, Homo Sapiens
WGCGSAPGG

SEQ ID NO: 592145 - protein, 9 aa, Homo Sapiens
SSSQDHGMF

SEQ ID NO: 592146 - protein, 9 aa, Homo Sapiens
VTSMAQSAP

SEQ ID NO: 592147 - protein, 9 aa, Homo Sapiens
FAVKATGER

SEQ ID NO: 592148 - protein, 9 aa, Homo Sapiens
QEWRVTSMA

SEQ ID NO: 592149 - protein, 9 aa, Homo Sapiens
IVREDCTTI

SEQ ID NO: 592150 - protein, 9 aa, Homo Sapiens
PINIFFTPK

SEQ ID NO: 592151 - protein, 9 aa, Homo Sapiens
AVQAHGGGH

SEQ ID NO: 592152 - protein, 9 aa, Homo Sapiens
PELQEWRVT

SEQ ID NO: 592153 - protein, 9 aa, Homo Sapiens
PDCDLDSED

SEQ ID NO: 592154 - protein, 9 aa, Homo Sapiens
LTAAAAADA

SEQ ID NO: 592155 - protein, 9 aa, Homo Sapiens
KGSAAEMYG

SEQ ID NO: 592156 - protein, 9 aa, Homo Sapiens
TPVTHQPLL

SEQ ID NO: 592157 - protein, 9 aa, Homo Sapiens
KELRCDGCA

SEQ ID NO: 592158 - protein, 9 aa, Homo Sapiens
GLVLTDLHH

SEQ ID NO: 592159 - protein, 9 aa, Homo Sapiens
TPLVPSSRA

SEQ ID NO: 592160 - protein, 9 aa, Homo Sapiens
VVDRPQWLS

SEQ ID NO: 592161 - protein, 9 aa, Homo Sapiens
HENVNETAI

SEQ ID NO: 592162 - protein, 9 aa, Homo Sapiens
NLAVLTLSE

SEQ ID NO: 592163 - protein, 9 aa, Homo Sapiens
LGLHPRHAY

SEQ ID NO: 592164 - protein, 9 aa, Homo Sapiens
RAENDSILM

SEQ ID NO: 592165 - protein, 9 aa, Homo Sapiens
HLYHLESGV

SEQ ID NO: 592166 - protein, 9 aa, Homo Sapiens
GSLHWQSCS

SEQ ID NO: 592167 - protein, 9 aa, Homo Sapiens
LHWQSCSDG

SEQ ID NO: 592168 - protein, 9 aa, Homo Sapiens
VGHLKSITG

SEQ ID NO: 592169 - protein, 9 aa, Homo Sapiens
EWRVTSMAQ

SEQ ID NO: 592170 - protein, 9 aa, Homo Sapiens
EAGWPAGVQ

SEQ ID NO: 592171 - protein, 9 aa, Homo Sapiens
QKYFNNDVL

SEQ ID NO: 592172 - protein, 9 aa, Homo Sapiens
YLHLYHLES

SEQ ID NO: 592173 - protein, 9 aa, Homo Sapiens
AAVRDGAVR

SEQ ID NO: 592174 - protein, 9 aa, Homo Sapiens
GAVREVAVA

SEQ ID NO: 592175 - protein, 9 aa, Homo Sapiens
GPVLLPLPR

SEQ ID NO: 592176 - protein, 9 aa, Homo Sapiens
RRPTAIWTK

SEQ ID NO: 592177 - protein, 9 aa, Homo Sapiens
SAPGGLCGS

SEQ ID NO: 592178 - protein, 9 aa, Homo Sapiens
MRVSVMPML

SEQ ID NO: 592179 - protein, 9 aa, Homo Sapiens
SGIMCLDIH

SEQ ID NO: 592180 - protein, 9 aa, Homo Sapiens
MDRVVLKQV

SEQ ID NO: 592181 - protein, 9 aa, Homo Sapiens
DSNRNYRSH

SEQ ID NO: 592182 - protein, 9 aa, Homo Sapiens
NPRTVPVQT

SEQ ID NO: 592183 - protein, 9 aa, Homo Sapiens
NNQDSPQIP

SEQ ID NO: 592184 - protein, 9 aa, Homo Sapiens
SLGGIIYLV

SEQ ID NO: 592185 - protein, 9 aa, Homo Sapiens
VLREKRECR

SEQ ID NO: 592186 - protein, 9 aa, Homo Sapiens
RKRRLKGSK

SEQ ID NO: 592187 - protein, 9 aa, Homo Sapiens
KATGERRPT

SEQ ID NO: 592188 - protein, 9 aa, Homo Sapiens
GGHSARWGC

SEQ ID NO: 592189 - protein, 9 aa, Homo Sapiens
TPLKNNQDS

SEQ ID NO: 592190 - protein, 9 aa, Homo Sapiens
SRGTGDHGG

SEQ ID NO: 592191 - protein, 9 aa, Homo Sapiens
SGVVTPLVP

SEQ ID NO: 592192 - protein, 9 aa, Homo Sapiens
SNRNYRSHL

SEQ ID NO: 592193 - protein, 9 aa, Homo Sapiens
SPPSTTAAP

SEQ ID NO: 592194 - protein, 9 aa, Homo Sapiens
MGDCCKRLL

SEQ ID NO: 592195 - protein, 9 aa, Homo Sapiens
GQCGREAGW

SEQ ID NO: 592196 - protein, 9 aa, Homo Sapiens
KQNFGRRLI

SEQ ID NO: 592197 - protein, 9 aa, Homo Sapiens
GKRTGLGQS

SEQ ID NO: 592198 - protein, 9 aa, Homo Sapiens
NGGCEYACN

SEQ ID NO: 592199 - protein, 9 aa, Homo Sapiens
TPSPKDNGS

SEQ ID NO: 592200 - protein, 9 aa, Homo Sapiens
SPKDNGSAL

SEQ ID NO: 592201 - protein, 9 aa, Homo Sapiens
STTQKEIFQ

SEQ ID NO: 592202 - protein, 9 aa, Homo Sapiens
WQSVLLSHQ

SEQ ID NO: 592203 - protein, 9 aa, Homo Sapiens
GERRPTAIW

SEQ ID NO: 592204 - protein, 9 aa, Homo Sapiens
EEFYICRVH

SEQ ID NO: 592205 - protein, 9 aa, Homo Sapiens
QAKAGEGGV

SEQ ID NO: 592206 - protein, 9 aa, Homo Sapiens
SPTSPEPPN

SEQ ID NO: 592207 - protein, 9 aa, Homo Sapiens
TMDRVVLKQ

SEQ ID NO: 592208 - protein, 9 aa, Homo Sapiens
EGPLGPSTD

SEQ ID NO: 592209 - protein, 9 aa, Homo Sapiens
NAGVKGSAA

SEQ ID NO: 592210 - protein, 9 aa, Homo Sapiens
LQAKAGEGG

SEQ ID NO: 592211 - protein, 9 aa, Homo Sapiens
GNAGVKGSA

SEQ ID NO: 592212 - protein, 9 aa, Homo Sapiens
RDSMAYESR

SEQ ID NO: 592213 - protein, 9 aa, Homo Sapiens
NTQKMFSPK

SEQ ID NO: 592214 - protein, 9 aa, Homo Sapiens
IWNYAPSGM

SEQ ID NO: 592215 - protein, 9 aa, Homo Sapiens
ARYASMNTH

SEQ ID NO: 592216 - protein, 9 aa, Homo Sapiens
PVLFGTTVM

SEQ ID NO: 592217 - protein, 9 aa, Homo Sapiens
KQVLIVMFL

SEQ ID NO: 592218 - protein, 9 aa, Homo Sapiens
PSPKDNGSA

SEQ ID NO: 592219 - protein, 9 aa, Homo Sapiens
RWGCGSAPG

SEQ ID NO: 592220 - protein, 9 aa, Homo Sapiens
PSPPSTTAA

SEQ ID NO: 592221 - protein, 9 aa, Homo Sapiens
VTATDSDIG

SEQ ID NO: 592222 - protein, 9 aa, Homo Sapiens
RVPQMRVSV

SEQ ID NO: 592223 - protein, 9 aa, Homo Sapiens
VENGGCEYA

SEQ ID NO: 592224 - protein, 9 aa, Homo Sapiens
RVFTSHMGG

SEQ ID NO: 592225 - protein, 9 aa, Homo Sapiens
SNENLDYAS

SEQ ID NO: 592226 - protein, 9 aa, Homo Sapiens
AAVQAHGGG

SEQ ID NO: 592227 - protein, 9 aa, Homo Sapiens
KRECRRTIH

SEQ ID NO: 592228 - protein, 9 aa, Homo Sapiens
GVVTPLVPS

SEQ ID NO: 592229 - protein, 9 aa, Homo Sapiens
QAHGGGHSA

SEQ ID NO: 592230 - protein, 9 aa, Homo Sapiens
PPSTTAAPV

SEQ ID NO: 592231 - protein, 9 aa, Homo Sapiens
ALAMEALEG

SEQ ID NO: 592232 - protein, 9 aa, Homo Sapiens
LGQCEGLLQ

SEQ ID NO: 592233 - protein, 9 aa, Homo Sapiens
RYASMNTHL

SEQ ID NO: 592234 - protein, 9 aa, Homo Sapiens
KYGYLHLYH

SEQ ID NO: 592235 - protein, 9 aa, Homo Sapiens
DYASLKLKE

SEQ ID NO: 592236 - protein, 9 aa, Homo Sapiens
EPPNTTSPE

SEQ ID NO: 592237 - protein, 9 aa, Homo Sapiens
RALAMEALE

SEQ ID NO: 592238 - protein, 9 aa, Homo Sapiens
PSGMDIFTK

SEQ ID NO: 592239 - protein, 9 aa, Homo Sapiens
ATALHAKFP

SEQ ID NO: 592240 - protein, 9 aa, Homo Sapiens
ALHAKFPEN

SEQ ID NO: 592241 - protein, 9 aa, Homo Sapiens
NQCLSTTQK

SEQ ID NO: 592242 - protein, 9 aa, Homo Sapiens
LTDLHHTQQ

SEQ ID NO: 592243 - protein, 9 aa, Homo Sapiens
IQERGLQDH

SEQ ID NO: 592244 - protein, 9 aa, Homo Sapiens
SEGPLGPST

SEQ ID NO: 592245 - protein, 9 aa, Homo Sapiens
LRCDGCADC

SEQ ID NO: 592246 - protein, 9 aa, Homo Sapiens
RTFKGNTQK

SEQ ID NO: 592247 - protein, 9 aa, Homo Sapiens
LDKMRALEE

SEQ ID NO: 592248 - protein, 9 aa, Homo Sapiens
VLKQVLIVM

SEQ ID NO: 592249 - protein, 9 aa, Homo Sapiens
EDDRDSMAY

SEQ ID NO: 592250 - protein, 9 aa, Homo Sapiens
WPAGVQAVL

SEQ ID NO: 592251 - protein, 9 aa, Homo Sapiens
VQETPLKNN

SEQ ID NO: 592252 - protein, 9 aa, Homo Sapiens
ISSIQMGDC

SEQ ID NO: 592253 - protein, 9 aa, Homo Sapiens
KLVNFIYAL

SEQ ID NO: 592254 - protein, 9 aa, Homo Sapiens
AVLGQCEGL

SEQ ID NO: 592255 - protein, 9 aa, Homo Sapiens
GCGSAPGGL

SEQ ID NO: 592256 - protein, 9 aa, Homo Sapiens
WNYAPSGMD

SEQ ID NO: 592257 - protein, 9 aa, Homo Sapiens
GLHPRHAYS

SEQ ID NO: 592258 - protein, 9 aa, Homo Sapiens
KSITGIALA

SEQ ID NO: 592259 - protein, 9 aa, Homo Sapiens
KRRLKGSKE

SEQ ID NO: 592260 - protein, 9 aa, Homo Sapiens
CGMREMRAG

SEQ ID NO: 592261 - protein, 9 aa, Homo Sapiens
QRFHYSWPV

SEQ ID NO: 592262 - protein, 9 aa, Homo Sapiens
PSIVLDVKE

SEQ ID NO: 592263 - protein, 9 aa, Homo Sapiens
AHGGGHSAR

SEQ ID NO: 592264 - protein, 9 aa, Homo Sapiens
LVPSSRAVT

SEQ ID NO: 592265 - protein, 9 aa, Homo Sapiens
PTSPEPPNT

SEQ ID NO: 592266 - protein, 9 aa, Homo Sapiens
PSIKAMLSI

SEQ ID NO: 592267 - protein, 9 aa, Homo Sapiens
DASSESTGH

SEQ ID NO: 592268 - protein, 9 aa, Homo Sapiens
AEQPDCDLD

SEQ ID NO: 592269 - protein, 9 aa, Homo Sapiens
SIQMGDCCK

SEQ ID NO: 592270 - protein, 9 aa, Homo Sapiens
SISSIQMGD

SEQ ID NO: 592271 - protein, 9 aa, Homo Sapiens
REDDRDSMA

SEQ ID NO: 592272 - protein, 9 aa, Homo Sapiens
CGSLHWQSC

SEQ ID NO: 592273 - protein, 9 aa, Homo Sapiens
RKLGAANRT

SEQ ID NO: 592274 - protein, 9 aa, Homo Sapiens
CGSAPGGLC

SEQ ID NO: 592275 - protein, 9 aa, Homo Sapiens
VQRFHYSWP

SEQ ID NO: 592276 - protein, 9 aa, Homo Sapiens
ASIMRLIIS

SEQ ID NO: 592277 - protein, 9 aa, Homo Sapiens
QVAAVQAHG

SEQ ID NO: 592278 - protein, 9 aa, Homo Sapiens
LLCGMREMR

SEQ ID NO: 592279 - protein, 9 aa, Homo Sapiens
PVLLPLPRG

SEQ ID NO: 592280 - protein, 9 aa, Homo Sapiens
VREVAVAGA

SEQ ID NO: 592281 - protein, 9 aa, Homo Sapiens
EKRECRRTI

SEQ ID NO: 592282 - protein, 9 aa, Homo Sapiens
YGYLHLYHL

SEQ ID NO: 592283 - protein, 9 aa, Homo Sapiens
GGLCGSLHW

SEQ ID NO: 592284 - protein, 9 aa, Homo Sapiens
PNTTSPESP

SEQ ID NO: 592285 - protein, 9 aa, Homo Sapiens
VPSSRAVTS

SEQ ID NO: 592286 - protein, 9 aa, Homo Sapiens
KYFNNDVLV

SEQ ID NO: 592287 - protein, 9 aa, Homo Sapiens
CNKFPSIKA

SEQ ID NO: 592288 - protein, 9 aa, Homo Sapiens
ASYLDKMRA

SEQ ID NO: 592289 - protein, 9 aa, Homo Sapiens
DGAVREVAV

SEQ ID NO: 592290 - protein, 9 aa, Homo Sapiens
ESTGHATPL

SEQ ID NO: 592291 - protein, 9 aa, Homo Sapiens
HLESGVCIC

SEQ ID NO: 592292 - protein, 9 aa, Homo Sapiens
CVVLRVPQM

SEQ ID NO: 592293 - protein, 9 aa, Homo Sapiens
GPLGPSTDD

SEQ ID NO: 592294 - protein, 9 aa, Homo Sapiens
LKAVSEITE

SEQ ID NO: 592295 - protein, 9 aa, Homo Sapiens
KRGDDSNRN

SEQ ID NO: 592296 - protein, 9 aa, Homo Sapiens
DTDWRALAM

SEQ ID NO: 592297 - protein, 9 aa, Homo Sapiens
DPAVTPVTH

SEQ ID NO: 592298 - protein, 9 aa, Homo Sapiens
DRDSMAYES

SEQ ID NO: 592299 - protein, 9 aa, Homo Sapiens
QMGDCCKRL

SEQ ID NO: 592300 - protein, 9 aa, Homo Sapiens
CRVHNLITD

SEQ ID NO: 592301 - protein, 9 aa, Homo Sapiens
EDGVSSLHI

SEQ ID NO: 592302 - protein, 9 aa, Homo Sapiens
GYLHLYHLE

SEQ ID NO: 592303 - protein, 9 aa, Homo Sapiens
LASTKITTL

SEQ ID NO: 592304 - protein, 9 aa, Homo Sapiens
LYEAIVRED

SEQ ID NO: 592305 - protein, 9 aa, Homo Sapiens
VLDVKEITT

SEQ ID NO: 592306 - protein, 9 aa, Homo Sapiens
PKDNGSALL

SEQ ID NO: 592307 - protein, 9 aa, Homo Sapiens
AAMGQGLVL

SEQ ID NO: 592308 - protein, 9 aa, Homo Sapiens
MGQGLVLTD

SEQ ID NO: 592309 - protein, 9 aa, Homo Sapiens
LDAEQPDCD

SEQ ID NO: 592310 - protein, 9 aa, Homo Sapiens
GNTQKMFSP

SEQ ID NO: 592311 - protein, 9 aa, Homo Sapiens
QGIVTAVYV

SEQ ID NO: 592312 - protein, 9 aa, Homo Sapiens
LRVPQMRVS

SEQ ID NO: 592313 - protein, 9 aa, Homo Sapiens
ELAETLELI

SEQ ID NO: 592314 - protein, 9 aa, Homo Sapiens
TSQKYFNND

SEQ ID NO: 592315 - protein, 9 aa, Homo Sapiens
RSTSGRQKT

SEQ ID NO: 592316 - protein, 9 aa, Homo Sapiens
LTLSEAGVL

SEQ ID NO: 592317 - protein, 9 aa, Homo Sapiens
PLLDPAVTP

SEQ ID NO: 592318 - protein, 9 aa, Homo Sapiens
VKGSAAEMY

SEQ ID NO: 592319 - protein, 9 aa, Homo Sapiens
LLLQKEEPL

SEQ ID NO: 592320 - protein, 9 aa, Homo Sapiens
ASRGTGDHG

SEQ ID NO: 592321 - protein, 9 aa, Homo Sapiens
YLDKMRALE

SEQ ID NO: 592322 - protein, 9 aa, Homo Sapiens
TGDHGGPVL

SEQ ID NO: 592323 - protein, 9 aa, Homo Sapiens
VAALLHTLH

SEQ ID NO: 592324 - protein, 9 aa, Homo Sapiens
LYRKLGAAN

SEQ ID NO: 592325 - protein, 9 aa, Homo Sapiens
LYHLESGVC

SEQ ID NO: 592326 - protein, 9 aa, Homo Sapiens
NSGIMCLDI

SEQ ID NO: 592327 - protein, 9 aa, Homo Sapiens
NATALHAKF

SEQ ID NO: 592328 - protein, 9 aa, Homo Sapiens
SWPVRRGTV

SEQ ID NO: 592329 - protein, 9 aa, Homo Sapiens
GTSQKYFNN

SEQ ID NO: 592330 - protein, 9 aa, Homo Sapiens
DSMAYESRS

SEQ ID NO: 592331 - protein, 9 aa, Homo Sapiens
GDCCKRLLE

SEQ ID NO: 592332 - protein, 9 aa, Homo Sapiens
VFTSHMGGK

SEQ ID NO: 592333 - protein, 9 aa, Homo Sapiens
VAQVTATDS

SEQ ID NO: 592334 - protein, 9 aa, Homo Sapiens
KSRKRGDDS

SEQ ID NO: 592335 - protein, 9 aa, Homo Sapiens
TLAEEVAAL

SEQ ID NO: 592336 - protein, 9 aa, Homo Sapiens
AAEPAIMSY

SEQ ID NO: 592337 - protein, 9 aa, Homo Sapiens
VRAENDSIL

SEQ ID NO: 592338 - protein, 9 aa, Homo Sapiens
ENLDYASLK

SEQ ID NO: 592339 - protein, 9 aa, Homo Sapiens
YRKLGAANR

SEQ ID NO: 592340 - protein, 9 aa, Homo Sapiens
NETAIQTED

SEQ ID NO: 592341 - protein, 9 aa, Homo Sapiens
FGRRLIPAW

SEQ ID NO: 592342 - protein, 9 aa, Homo Sapiens
TDWRALAME

SEQ ID NO: 592343 - protein, 9 aa, Homo Sapiens
VLTLSEAGV

SEQ ID NO: 592344 - protein, 9 aa, Homo Sapiens
AVKATGERR

SEQ ID NO: 592345 - protein, 9 aa, Homo Sapiens
SLQTIPELA

SEQ ID NO: 592346 - protein, 9 aa, Homo Sapiens
MLKAVSEIT

SEQ ID NO: 592347 - protein, 9 aa, Homo Sapiens
AAFNKLVNF

SEQ ID NO: 592348 - protein, 9 aa, Homo Sapiens
FPLASTKIT

SEQ ID NO: 592349 - protein, 9 aa, Homo Sapiens
VLLSHQRTH

SEQ ID NO: 592350 - protein, 9 aa, Homo Sapiens
TTIMKMRST

SEQ ID NO: 592351 - protein, 9 aa, Homo Sapiens
QMRVSVMPM

SEQ ID NO: 592352 - protein, 9 aa, Homo Sapiens
DRVVLKQVL

SEQ ID NO: 592353 - protein, 9 aa, Homo Sapiens
AREERKRRL

SEQ ID NO: 592354 - protein, 9 aa, Homo Sapiens
LLQKEEPLA

SEQ ID NO: 592355 - protein, 9 aa, Homo Sapiens
QQIKAMKIA

SEQ ID NO: 592356 - protein, 9 aa, Homo Sapiens
ICRVHNLIT

SEQ ID NO: 592357 - protein, 9 aa, Homo Sapiens
FYQEEFYIC

SEQ ID NO: 592358 - protein, 9 aa, Homo Sapiens
ELRCDGCAD

SEQ ID NO: 592359 - protein, 9 aa, Homo Sapiens
RGQCGREAG

SEQ ID NO: 592360 - protein, 9 aa, Homo Sapiens
AFNKLVNFI

SEQ ID NO: 592361 - protein, 9 aa, Homo Sapiens
YEAIVREDC

SEQ ID NO: 592362 - protein, 9 aa, Homo Sapiens
SSLQTIPEL

SEQ ID NO: 592363 - protein, 9 aa, Homo Sapiens
PQMRVSVMP

SEQ ID NO: 592364 - protein, 9 aa, Homo Sapiens
VVGHLKSIT

SEQ ID NO: 592365 - protein, 9 aa, Homo Sapiens
LAETLELIE

SEQ ID NO: 592366 - protein, 9 aa, Homo Sapiens
AAAADAAAT

SEQ ID NO: 592367 - protein, 9 aa, Homo Sapiens
TSPEPPNTT

SEQ ID NO: 592368 - protein, 9 aa, Homo Sapiens
EVAVAGASR

SEQ ID NO: 592369 - protein, 9 aa, Homo Sapiens
REMRAGGCC

SEQ ID NO: 592370 - protein, 9 aa, Homo Sapiens
NVNETAIQT

SEQ ID NO: 592371 - protein, 9 aa, Homo Sapiens
SESTGHATP

SEQ ID NO: 592372 - protein, 9 aa, Homo Sapiens
DNHSYFFGD

SEQ ID NO: 592373 - protein, 9 aa, Homo Sapiens
LSTTQKEIF

SEQ ID NO: 592374 - protein, 9 aa, Homo Sapiens
ETPLKNNQD

SEQ ID NO: 592375 - protein, 9 aa, Homo Sapiens
EMRAGGCCH

SEQ ID NO: 592376 - protein, 9 aa, Homo Sapiens
TVMENIRFG

SEQ ID NO: 592377 - protein, 9 aa, Homo Sapiens
AADAAATNA

SEQ ID NO: 592378 - protein, 9 aa, Homo Sapiens
YQEEFYICR

SEQ ID NO: 592379 - protein, 9 aa, Homo Sapiens
LQSVVDRPQ

SEQ ID NO: 592380 - protein, 9 aa, Homo Sapiens
GLYRKLGAA

SEQ ID NO: 592381 - protein, 9 aa, Homo Sapiens
LKGSKEGPV

SEQ ID NO: 592382 - protein, 9 aa, Homo Sapiens
PGGLCGSLH

SEQ ID NO: 592383 - protein, 9 aa, Homo Sapiens
RGNAGVKGS

SEQ ID NO: 592384 - protein, 9 aa, Homo Sapiens
RFPINIFFT

SEQ ID NO: 592385 - protein, 9 aa, Homo Sapiens
HVTDASSES

SEQ ID NO: 592386 - protein, 9 aa, Homo Sapiens
ASSSQDHGM

SEQ ID NO: 592387 - protein, 9 aa, Homo Sapiens
GDTLDLTYE

SEQ ID NO: 592388 - protein, 9 aa, Homo Sapiens
RLIISYLRM

SEQ ID NO: 592389 - protein, 9 aa, Homo Sapiens
IKAMKIALQ

SEQ ID NO: 592390 - protein, 9 aa, Homo Sapiens
AMKIALQQP

SEQ ID NO: 592391 - protein, 9 aa, Homo Sapiens
SMAAFNKLV

SEQ ID NO: 592392 - protein, 9 aa, Homo Sapiens
LITMDRVVL

SEQ ID NO: 592393 - protein, 9 aa, Homo Sapiens
LGEEREKRR

SEQ ID NO: 592394 - protein, 9 aa, Homo Sapiens
GDHGGPVLL

SEQ ID NO: 592395 - protein, 9 aa, Homo Sapiens
NKFPSIKAM

SEQ ID NO: 592396 - protein, 9 aa, Homo Sapiens
DNGSALLHS

SEQ ID NO: 592397 - protein, 9 aa, Homo Sapiens
VMENIRFGK

SEQ ID NO: 592398 - protein, 9 aa, Homo Sapiens
TAFSTVPFS

SEQ ID NO: 592399 - protein, 9 aa, Homo Sapiens
AVTPVTHQP

SEQ ID NO: 592400 - protein, 9 aa, Homo Sapiens
EGLLQAKAG

SEQ ID NO: 592401 - protein, 9 aa, Homo Sapiens
DGVSSLHIT

SEQ ID NO: 592402 - protein, 9 aa, Homo Sapiens
ERGLQDHLN

SEQ ID NO: 592403 - protein, 9 aa, Homo Sapiens
HPLLDPAVT

SEQ ID NO: 592404 - protein, 9 aa, Homo Sapiens
SLGLHPRHA

SEQ ID NO: 592405 - protein, 9 aa, Homo Sapiens
CEYACNAIP

SEQ ID NO: 592406 - protein, 9 aa, Homo Sapiens
DWRALAMEA

SEQ ID NO: 592407 - protein, 9 aa, Homo Sapiens
LNQCLSTTQ

SEQ ID NO: 592408 - protein, 9 aa, Homo Sapiens
DDRDSMAYE

SEQ ID NO: 592409 - protein, 9 aa, Homo Sapiens
VREDCTTIE

SEQ ID NO: 592410 - protein, 9 aa, Homo Sapiens
LKQVLIVMF

SEQ ID NO: 592411 - protein, 9 aa, Homo Sapiens
RTGLGQSNA

SEQ ID NO: 592412 - protein, 9 aa, Homo Sapiens
GWPAGVQAV

SEQ ID NO: 592413 - protein, 9 aa, Homo Sapiens
REERKRRLK

SEQ ID NO: 592414 - protein, 9 aa, Homo Sapiens
GIVTAVYVR

SEQ ID NO: 592415 - protein, 9 aa, Homo Sapiens
LGLAAEPAI

SEQ ID NO: 592416 - protein, 9 aa, Homo Sapiens
EVAALLHTL

SEQ ID NO: 592417 - protein, 9 aa, Homo Sapiens
NIFFTPKQE

SEQ ID NO: 592418 - protein, 9 aa, Homo Sapiens
VQAHGGGHS

SEQ ID NO: 592419 - protein, 9 aa, Homo Sapiens
VSSLHITPA

SEQ ID NO: 592420 - protein, 9 aa, Homo Sapiens
QCEGLLQAK

SEQ ID NO: 592421 - protein, 9 aa, Homo Sapiens
AWLITMDRV

SEQ ID NO: 592422 - protein, 9 aa, Homo Sapiens
CRRTIHTFP

SEQ ID NO: 592423 - protein, 9 aa, Homo Sapiens
NKLVNFIYA

SEQ ID NO: 592424 - protein, 9 aa, Homo Sapiens
VLFGTTVME

SEQ ID NO: 592425 - protein, 9 aa, Homo Sapiens
AIVREDCTT

SEQ ID NO: 592426 - protein, 9 aa, Homo Sapiens
VLLPLPRGQ

SEQ ID NO: 592427 - protein, 9 aa, Homo Sapiens
KKHTHENVN

SEQ ID NO: 592428 - protein, 9 aa, Homo Sapiens
MNVIELEIP

SEQ ID NO: 592429 - protein, 9 aa, Homo Sapiens
VQTAFSTVP

SEQ ID NO: 592430 - protein, 9 aa, Homo Sapiens
EPAIMSYAE

SEQ ID NO: 592431 - protein, 9 aa, Homo Sapiens
GHSARWGCG

SEQ ID NO: 592432 - protein, 9 aa, Homo Sapiens
VKEITTQIT

SEQ ID NO: 592433 - protein, 9 aa, Homo Sapiens
KRTGLGQSN

SEQ ID NO: 592434 - protein, 9 aa, Homo Sapiens
LCGSLHWQS

SEQ ID NO: 592435 - protein, 9 aa, Homo Sapiens
TLSEAGVLD

SEQ ID NO: 592436 - protein, 9 aa, Homo Sapiens
TEGLYRKLG

SEQ ID NO: 592437 - protein, 9 aa, Homo Sapiens
PVQTAFSTV

SEQ ID NO: 592438 - protein, 9 aa, Homo Sapiens
SAYESLGLH

SEQ ID NO: 592439 - protein, 9 aa, Homo Sapiens
VSSLLLQKE

SEQ ID NO: 592440 - protein, 9 aa, Homo Sapiens
IPSVTFPLA

SEQ ID NO: 592441 - protein, 9 aa, Homo Sapiens
SSIQMGDCC

SEQ ID NO: 592442 - protein, 9 aa, Homo Sapiens
REVAVAGAS

SEQ ID NO: 592443 - protein, 9 aa, Homo Sapiens
NRGNAGVKG

SEQ ID NO: 592444 - protein, 9 aa, Homo Sapiens
HGMFLMLFY

SEQ ID NO: 592445 - protein, 9 aa, Homo Sapiens
LDYASLKLK

SEQ ID NO: 592446 - protein, 9 aa, Homo Sapiens
PSTTAAPVE

SEQ ID NO: 592447 - protein, 9 aa, Homo Sapiens
KGNTQKMFS

SEQ ID NO: 592448 - protein, 9 aa, Homo Sapiens
IQMGDCCKR

SEQ ID NO: 592449 - protein, 9 aa, Homo Sapiens
HTHENVNET

SEQ ID NO: 592450 - protein, 9 aa, Homo Sapiens
RVVLKQVLI

SEQ ID NO: 592451 - protein, 9 aa, Homo Sapiens
PLASTKITT

SEQ ID NO: 592452 - protein, 9 aa, Homo Sapiens
KAVSEITEM

SEQ ID NO: 592453 - protein, 9 aa, Homo Sapiens
PSTDDDLCV

SEQ ID NO: 592454 - protein, 9 aa, Homo Sapiens
QVLIVMFLL

SEQ ID NO: 592455 - protein, 9 aa, Homo Sapiens
YLGLAAEPA

SEQ ID NO: 592456 - protein, 9 aa, Homo Sapiens
TSMAQSAPS

SEQ ID NO: 592457 - protein, 9 aa, Homo Sapiens
QERGLQDHL

SEQ ID NO: 592458 - protein, 9 aa, Homo Sapiens
CEGLLQAKA

SEQ ID NO: 592459 - protein, 9 aa, Homo Sapiens
NSKFVRAEN

SEQ ID NO: 592460 - protein, 9 aa, Homo Sapiens
AKAGEGGVQ

SEQ ID NO: 592461 - protein, 9 aa, Homo Sapiens
GIMCLDIHV

SEQ ID NO: 592462 - protein, 9 aa, Homo Sapiens
NHSYFFGDT

SEQ ID NO: 592463 - protein, 9 aa, Homo Sapiens
LPLPRGQCG

SEQ ID NO: 592464 - protein, 9 aa, Homo Sapiens
VTFPLASTK

SEQ ID NO: 592465 - protein, 9 aa, Homo Sapiens
VQAVLGQCE

SEQ ID NO: 592466 - protein, 9 aa, Homo Sapiens
NYLGLAAEP

SEQ ID NO: 592467 - protein, 9 aa, Homo Sapiens
GQCEGLLQA

SEQ ID NO: 592468 - protein, 9 aa, Homo Sapiens
RVLREKREC

SEQ ID NO: 592469 - protein, 9 aa, Homo Sapiens
QGLVLTDLH

SEQ ID NO: 592470 - protein, 9 aa, Homo Sapiens
GRRLIPAWL

SEQ ID NO: 592471 - protein, 9 aa, Homo Sapiens
QPDCDLDSE

SEQ ID NO: 592472 - protein, 9 aa, Homo Sapiens
GCADCTDHS

SEQ ID NO: 592473 - protein, 9 aa, Homo Sapiens
QETPLKNNQ

SEQ ID NO: 592474 - protein, 9 aa, Homo Sapiens
LDPAVTPVT

SEQ ID NO: 592475 - protein, 9 aa, Homo Sapiens
EHEKGKRTG

SEQ ID NO: 592476 - protein, 9 aa, Homo Sapiens
HLNVIIFSD

SEQ ID NO: 592477 - protein, 9 aa, Homo Sapiens
GSALLHSAL

SEQ ID NO: 592478 - protein, 9 aa, Homo Sapiens
RVTSMAQSA

SEQ ID NO: 592479 - protein, 9 aa, Homo Sapiens
SVLLSHQRT

SEQ ID NO: 592480 - protein, 9 aa, Homo Sapiens
NLDYASLKL

SEQ ID NO: 592481 - protein, 9 aa, Homo Sapiens
ARWGCGSAP

SEQ ID NO: 592482 - protein, 9 aa, Homo Sapiens
AVSEITEMQ

SEQ ID NO: 592483 - protein, 9 aa, Homo Sapiens
IISYLRMHR

SEQ ID NO: 592484 - protein, 9 aa, Homo Sapiens
LASYLDKMR

SEQ ID NO: 592485 - protein, 9 aa, Homo Sapiens
CLSTTQKEI

SEQ ID NO: 592486 - protein, 9 aa, Homo Sapiens
EYACNAIPG

SEQ ID NO: 592487 - protein, 9 aa, Homo Sapiens
WKESSMNVI

SEQ ID NO: 592488 - protein, 9 aa, Homo Sapiens
SIVLDVKEI

SEQ ID NO: 592489 - protein, 9 aa, Homo Sapiens
LNSKFVRAE

SEQ ID NO: 592490 - protein, 9 aa, Homo Sapiens
KFVRAENDS

SEQ ID NO: 592491 - protein, 9 aa, Homo Sapiens
VTDASSEST

SEQ ID NO: 592492 - protein, 9 aa, Homo Sapiens
QTIPELAET

SEQ ID NO: 592493 - protein, 9 aa, Homo Sapiens
DVKEITTQI

SEQ ID NO: 592494 - protein, 9 aa, Homo Sapiens
DKMRALEEA

SEQ ID NO: 592495 - protein, 9 aa, Homo Sapiens
SALLHSALP

SEQ ID NO: 592496 - protein, 9 aa, Homo Sapiens
LHLYHLESG

SEQ ID NO: 592497 - protein, 9 aa, Homo Sapiens
WSQVVGHLK

SEQ ID NO: 592498 - protein, 9 aa, Homo Sapiens
SMNVIELEI

SEQ ID NO: 592499 - protein, 9 aa, Homo Sapiens
EERKRRLKG

SEQ ID NO: 592500 - protein, 9 aa, Homo Sapiens
KAMKIALQQ

SEQ ID NO: 592501 - protein, 9 aa, Homo Sapiens
KGKRTGLGQ

SEQ ID NO: 592502 - protein, 9 aa, Homo Sapiens
DCDLDSEDE

SEQ ID NO: 592503 - protein, 9 aa, Homo Sapiens
CDLDSEDEV

SEQ ID NO: 592504 - protein, 9 aa, Homo Sapiens
ASMAAFNKL

SEQ ID NO: 592505 - protein, 9 aa, Homo Sapiens
PVLNSKFVR

SEQ ID NO: 592506 - protein, 9 aa, Homo Sapiens
PPSIVLDVK

SEQ ID NO: 592507 - protein, 9 aa, Homo Sapiens
MAYESRSQD

SEQ ID NO: 592508 - protein, 9 aa, Homo Sapiens
DSDIGSNGE

SEQ ID NO: 592509 - protein, 9 aa, Homo Sapiens
HAKFPENKK

SEQ ID NO: 592510 - protein, 9 aa, Homo Sapiens
EQPDCDLDS

SEQ ID NO: 592511 - protein, 9 aa, Homo Sapiens
GGVQVAAVQ

SEQ ID NO: 592512 - protein, 9 aa, Homo Sapiens
AVREVAVAG

SEQ ID NO: 592513 - protein, 9 aa, Homo Sapiens
PLKNNQDSP

SEQ ID NO: 592514 - protein, 9 aa, Homo Sapiens
WLITMDRVV

SEQ ID NO: 592515 - protein, 9 aa, Homo Sapiens
SVTFPLAST

SEQ ID NO: 592516 - protein, 9 aa, Homo Sapiens
VVSSLLLQK

SEQ ID NO: 592517 - protein, 9 aa, Homo Sapiens
GVSSLHITP

SEQ ID NO: 592518 - protein, 9 aa, Homo Sapiens
EFYICRVHN

SEQ ID NO: 592519 - protein, 9 aa, Homo Sapiens
KFPSIKAML

SEQ ID NO: 592520 - protein, 9 aa, Homo Sapiens
ASSESTGHA

SEQ ID NO: 592521 - protein, 9 aa, Homo Sapiens
PLVPSSRAV

SEQ ID NO: 592522 - protein, 9 aa, Homo Sapiens
NENLDYASL

SEQ ID NO: 592523 - protein, 9 aa, Homo Sapiens
RPQWLSQKQ

SEQ ID NO: 592524 - protein, 9 aa, Homo Sapiens
SQKQNFGRR

SEQ ID NO: 592525 - protein, 9 aa, Homo Sapiens
GGPVLLPLP

SEQ ID NO: 592526 - protein, 9 aa, Homo Sapiens
FSCNKFPSI

SEQ ID NO: 592527 - protein, 9 aa, Homo Sapiens
LKSITGIAL

SEQ ID NO: 592528 - protein, 9 aa, Homo Sapiens
LAEEVAALL

SEQ ID NO: 592529 - protein, 9 aa, Homo Sapiens
TGERRPTAI

SEQ ID NO: 592530 - protein, 9 aa, Homo Sapiens
DASMAAFNK

SEQ ID NO: 592531 - protein, 9 aa, Homo Sapiens
GGCEYACNA

SEQ ID NO: 592532 - protein, 9 aa, Homo Sapiens
LQKEEPLAG

SEQ ID NO: 592533 - protein, 9 aa, Homo Sapiens
QKEEPLAGG

SEQ ID NO: 592534 - protein, 9 aa, Homo Sapiens
LSRFPINIF

SEQ ID NO: 592535 - protein, 9 aa, Homo Sapiens
WRALAMEAL

SEQ ID NO: 592536 - protein, 9 aa, Homo Sapiens
IMKMRSTSG

SEQ ID NO: 592537 - protein, 9 aa, Homo Sapiens
FSSNSGIMC

SEQ ID NO: 592538 - protein, 9 aa, Homo Sapiens
VDRPQWLSQ

SEQ ID NO: 592539 - protein, 9 aa, Homo Sapiens
DHQGIVTAV

SEQ ID NO: 592540 - protein, 9 aa, Homo Sapiens
SSQDHGMFL

SEQ ID NO: 592541 - protein, 9 aa, Homo Sapiens
LLPLPRGQC

SEQ ID NO: 592542 - protein, 9 aa, Homo Sapiens
VAGASRGTG

SEQ ID NO: 592543 - protein, 9 aa, Homo Sapiens
LGASLGGII

SEQ ID NO: 592544 - protein, 9 aa, Homo Sapiens
VVLKQVLIV

SEQ ID NO: 592545 - protein, 9 aa, Homo Sapiens
STSGRQKTF

SEQ ID NO: 592546 - protein, 9 aa, Homo Sapiens
LGAANRTRE

SEQ ID NO: 592547 - protein, 9 aa, Homo Sapiens
GTARYASMN

SEQ ID NO: 592548 - protein, 9 aa, Homo Sapiens
YSWPVRRGT

SEQ ID NO: 592549 - protein, 9 aa, Homo Sapiens
VNETAIQTE

SEQ ID NO: 592550 - protein, 9 aa, Homo Sapiens
SSNSGIMCL

SEQ ID NO: 592551 - protein, 9 aa, Homo Sapiens
AVRDGAVRE

SEQ ID NO: 592552 - protein, 9 aa, Homo Sapiens
LKNNQDSPQ

SEQ ID NO: 592553 - protein, 9 aa, Homo Sapiens
QDHLNVIIF

SEQ ID NO: 592554 - protein, 9 aa, Homo Sapiens
LHITPAQAP

SEQ ID NO: 592555 - protein, 9 aa, Homo Sapiens
YFNNDVLVP

SEQ ID NO: 592556 - protein, 9 aa, Homo Sapiens
QEEFYICRV

SEQ ID NO: 592557 - protein, 9 aa, Homo Sapiens
NQDSPQIPD

SEQ ID NO: 592558 - protein, 9 aa, Homo Sapiens
AGVQAVLGQ

SEQ ID NO: 592559 - protein, 9 aa, Homo Sapiens
ATGERRPTA

SEQ ID NO: 592560 - protein, 9 aa, Homo Sapiens
TRVFTSHMG

SEQ ID NO: 592561 - protein, 9 aa, Homo Sapiens
ENVNETAIQ

SEQ ID NO: 592562 - protein, 9 aa, Homo Sapiens
FVRAENDSI

SEQ ID NO: 592563 - protein, 9 aa, Homo Sapiens
QDHGMFLML

SEQ ID NO: 592564 - protein, 9 aa, Homo Sapiens
QRTFKGNTQ

SEQ ID NO: 592565 - protein, 9 aa, Homo Sapiens
FNKLVNFIY

SEQ ID NO: 592566 - protein, 9 aa, Homo Sapiens
TARYASMNT

SEQ ID NO: 592567 - protein, 9 aa, Homo Sapiens
VLRVPQMRV

SEQ ID NO: 592568 - protein, 9 aa, Homo Sapiens
FTSHMGGKF

SEQ ID NO: 592569 - protein, 9 aa, Homo Sapiens
NGSALLHSA

SEQ ID NO: 592570 - protein, 9 aa, Homo Sapiens
QVVGHLKSI

SEQ ID NO: 592571 - protein, 9 aa, Homo Sapiens
ITEMQKTLE

SEQ ID NO: 592572 - protein, 9 aa, Homo Sapiens
PDNHSYFFG

SEQ ID NO: 592573 - protein, 9 aa, Homo Sapiens
LAAEPAIMS

SEQ ID NO: 592574 - protein, 9 aa, Homo Sapiens
GTGDHGGPV

SEQ ID NO: 592575 - protein, 9 aa, Homo Sapiens
PPNTTSPES

SEQ ID NO: 592576 - protein, 9 aa, Homo Sapiens
GHLKSITGI

SEQ ID NO: 592577 - protein, 9 aa, Homo Sapiens
GGGHSARWG

SEQ ID NO: 592578 - protein, 9 aa, Homo Sapiens
GTTVMENIR

SEQ ID NO: 592579 - protein, 9 aa, Homo Sapiens
PELAETLEL

SEQ ID NO: 592580 - protein, 9 aa, Homo Sapiens
DDSNRNYRS

SEQ ID NO: 592581 - protein, 9 aa, Homo Sapiens
SPEPPNTTS

SEQ ID NO: 592582 - protein, 9 aa, Homo Sapiens
GLNQCLSTT

SEQ ID NO: 592583 - protein, 9 aa, Homo Sapiens
HGGGHSARW

SEQ ID NO: 592584 - protein, 9 aa, Homo Sapiens
SSMNVIELE

SEQ ID NO: 592585 - protein, 9 aa, Homo Sapiens
THENVNETA

SEQ ID NO: 592586 - protein, 9 aa, Homo Sapiens
GMREMRAGG

SEQ ID NO: 592587 - protein, 9 aa, Homo Sapiens
RRLIPAWLI

SEQ ID NO: 592588 - protein, 9 aa, Homo Sapiens
YVQRFHYSW

SEQ ID NO: 592589 - protein, 9 aa, Homo Sapiens
GLTAAAAAD

SEQ ID NO: 592590 - protein, 9 aa, Homo Sapiens
PEPPNTTSP

SEQ ID NO: 592591 - protein, 9 aa, Homo Sapiens
IMRLIISYL

SEQ ID NO: 592592 - protein, 9 aa, Homo Sapiens
PSVTFPLAS

SEQ ID NO: 592593 - protein, 9 aa, Homo Sapiens
APGGLCGSL

SEQ ID NO: 592594 - protein, 9 aa, Homo Sapiens
ITMDRVVLK

SEQ ID NO: 592595 - protein, 9 aa, Homo Sapiens
FYICRVHNL

SEQ ID NO: 592596 - protein, 9 aa, Homo Sapiens
KHTHENVNE

SEQ ID NO: 592597 - protein, 9 aa, Homo Sapiens
IPAWLITMD

SEQ ID NO: 592598 - protein, 9 aa, Homo Sapiens
SRFPINIFF

SEQ ID NO: 592599 - protein, 9 aa, Homo Sapiens
REAGWPAGV

SEQ ID NO: 592600 - protein, 9 aa, Homo Sapiens
LSQKQNFGR

SEQ ID NO: 592601 - protein, 9 aa, Homo Sapiens
SVVDRPQWL

SEQ ID NO: 592602 - protein, 9 aa, Homo Sapiens
DREDDRDSM

SEQ ID NO: 592603 - protein, 9 aa, Homo Sapiens
TENATALHA

SEQ ID NO: 592604 - protein, 9 aa, Homo Sapiens
SYLDKMRAL

SEQ ID NO: 592605 - protein, 9 aa, Homo Sapiens
PRGQCGREA

SEQ ID NO: 592606 - protein, 9 aa, Homo Sapiens
DHGMFLMLF

SEQ ID NO: 592607 - protein, 9 aa, Homo Sapiens
KIALQQPEA

SEQ ID NO: 592608 - protein, 9 aa, Homo Sapiens
FNNDVLVPP

SEQ ID NO: 592609 - protein, 9 aa, Homo Sapiens
RLIPAWLIT

SEQ ID NO: 592610 - protein, 9 aa, Homo Sapiens
QNFGRRLIP

SEQ ID NO: 592611 - protein, 9 aa, Homo Sapiens
VTDTDWRAL

SEQ ID NO: 592612 - protein, 9 aa, Homo Sapiens
NTTSPESPD

SEQ ID NO: 592613 - protein, 9 aa, Homo Sapiens
PGASSSQDH

SEQ ID NO: 592614 - protein, 9 aa, Homo Sapiens
PSISSIQMG

SEQ ID NO: 592615 - protein, 9 aa, Homo Sapiens
TAVYVRRLA

SEQ ID NO: 592616 - protein, 9 aa, Homo Sapiens
RLKGSKEGP

SEQ ID NO: 592617 - protein, 9 aa, Homo Sapiens
VPQMRVSVM

SEQ ID NO: 592618 - protein, 9 aa, Homo Sapiens
IMCLDIHVD

SEQ ID NO: 592619 - protein, 9 aa, Homo Sapiens
VPVQTAFST

SEQ ID NO: 592620 - protein, 9 aa, Homo Sapiens
VKATGERRP

SEQ ID NO: 592621 - protein, 9 aa, Homo Sapiens
LHVTDASSE

SEQ ID NO: 592622 - protein, 9 aa, Homo Sapiens
IVTAVYVRR

SEQ ID NO: 592623 - protein, 9 aa, Homo Sapiens
EGGVQVAAV

SEQ ID NO: 592624 - protein, 9 aa, Homo Sapiens
LAVLTLSEA

SEQ ID NO: 592625 - protein, 9 aa, Homo Sapiens
NDVLVPPTI

SEQ ID NO: 592626 - protein, 9 aa, Homo Sapiens
AEPAIMSYA

SEQ ID NO: 592627 - protein, 9 aa, Homo Sapiens
HSYFFGDTL

SEQ ID NO: 592628 - protein, 9 aa, Homo Sapiens
MKMRSTSGR

SEQ ID NO: 592629 - protein, 9 aa, Homo Sapiens
PPLSRFPIN

SEQ ID NO: 592630 - protein, 9 aa, Homo Sapiens
QAVLGQCEG

SEQ ID NO: 592631 - protein, 9 aa, Homo Sapiens
EPVLFGTTV

SEQ ID NO: 592632 - protein, 9 aa, Homo Sapiens
HWQSCSDGG

SEQ ID NO: 592633 - protein, 9 aa, Homo Sapiens
LVLTDLHHT

SEQ ID NO: 592634 - protein, 9 aa, Homo Sapiens
SLHWQSCSD

SEQ ID NO: 592635 - protein, 9 aa, Homo Sapiens
GVTDTDWRA

SEQ ID NO: 592636 - protein, 9 aa, Homo Sapiens
PAVTPVTHQ

SEQ ID NO: 592637 - protein, 9 aa, Homo Sapiens
SCNKFPSIK

SEQ ID NO: 592638 - protein, 9 aa, Homo Sapiens
HSARWGCGS

SEQ ID NO: 592639 - protein, 9 aa, Homo Sapiens
CDGCADCTD

SEQ ID NO: 592640 - protein, 9 aa, Homo Sapiens
YHLESGVCI

SEQ ID NO: 592641 - protein, 9 aa, Homo Sapiens
METRVFTSH

SEQ ID NO: 592642 - protein, 9 aa, Homo Sapiens
LIVMFLLSQ

SEQ ID NO: 592643 - protein, 9 aa, Homo Sapiens
QTAFSTVPF

SEQ ID NO: 592644 - protein, 9 aa, Homo Sapiens
SVENGGCEY

SEQ ID NO: 592645 - protein, 9 aa, Homo Sapiens
GLCGSLHWQ

SEQ ID NO: 592646 - protein, 9 aa, Homo Sapiens
VEDGVSSLH

SEQ ID NO: 592647 - protein, 9 aa, Homo Sapiens
GLAAEPAIM

SEQ ID NO: 592648 - protein, 9 aa, Homo Sapiens
YAPSGMDIF

SEQ ID NO: 592649 - protein, 9 aa, Homo Sapiens
QCLSTTQKE

SEQ ID NO: 592650 - protein, 9 aa, Homo Sapiens
LQDHLNVII

SEQ ID NO: 592651 - protein, 9 aa, Homo Sapiens
VLNSKFVRA

SEQ ID NO: 592652 - protein, 9 aa, Homo Sapiens
IQSPPSIGL

SEQ ID NO: 592653 - protein, 9 aa, Homo Sapiens
FFLFLAIFT

SEQ ID NO: 592654 - protein, 9 aa, Homo Sapiens
LVAGAYVAC

SEQ ID NO: 592655 - protein, 9 aa, Homo Sapiens
MTPTVFSSH

SEQ ID NO: 592656 - protein, 9 aa, Homo Sapiens
LVKSEEAVI

SEQ ID NO: 592657 - protein, 9 aa, Homo Sapiens
SGPPRGARR

SEQ ID NO: 592658 - protein, 9 aa, Homo Sapiens
QQPQQKVGL

SEQ ID NO: 592659 - protein, 9 aa, Homo Sapiens
AITGSSTEK

SEQ ID NO: 592660 - protein, 9 aa, Homo Sapiens
EEVGDGRVK

SEQ ID NO: 592661 - protein, 9 aa, Homo Sapiens
CLACERLLY

SEQ ID NO: 592662 - protein, 9 aa, Homo Sapiens
MDFDHNCIY

SEQ ID NO: 592663 - protein, 9 aa, Homo Sapiens
PCSPEIRVH

SEQ ID NO: 592664 - protein, 9 aa, Homo Sapiens
QGYLAIAEV

SEQ ID NO: 592665 - protein, 9 aa, Homo Sapiens
IRVHTKALS

SEQ ID NO: 592666 - protein, 9 aa, Homo Sapiens
MEPEEETGG

SEQ ID NO: 592667 - protein, 9 aa, Homo Sapiens
PEETPAPSS

SEQ ID NO: 592668 - protein, 9 aa, Homo Sapiens
GPSPEFATV

SEQ ID NO: 592669 - protein, 9 aa, Homo Sapiens
IMECYLPAE

SEQ ID NO: 592670 - protein, 9 aa, Homo Sapiens
CCVDLASEI

SEQ ID NO: 592671 - protein, 9 aa, Homo Sapiens
YPVKIVSTP

SEQ ID NO: 592672 - protein, 9 aa, Homo Sapiens
AEQDGGSHR

SEQ ID NO: 592673 - protein, 9 aa, Homo Sapiens
TPSSCPEQP

SEQ ID NO: 592674 - protein, 9 aa, Homo Sapiens
PSPAKCVSA

SEQ ID NO: 592675 - protein, 9 aa, Homo Sapiens
CQVRLGAAA

SEQ ID NO: 592676 - protein, 9 aa, Homo Sapiens
PQQKVGLLQ

SEQ ID NO: 592677 - protein, 9 aa, Homo Sapiens
KGLLPTPRG

SEQ ID NO: 592678 - protein, 9 aa, Homo Sapiens
EIRVHTKAL

SEQ ID NO: 592679 - protein, 9 aa, Homo Sapiens
KLIENICWS

SEQ ID NO: 592680 - protein, 9 aa, Homo Sapiens
NMSNEEYKF

SEQ ID NO: 592681 - protein, 9 aa, Homo Sapiens
EFATVQQYN

SEQ ID NO: 592682 - protein, 9 aa, Homo Sapiens
CAPNFHKMD

SEQ ID NO: 592683 - protein, 9 aa, Homo Sapiens
AIFTLMGNL

SEQ ID NO: 592684 - protein, 9 aa, Homo Sapiens
SMPTQRCSH

SEQ ID NO: 592685 - protein, 9 aa, Homo Sapiens
CVAALTNVC

SEQ ID NO: 592686 - protein, 9 aa, Homo Sapiens
SLKNYKLSP

SEQ ID NO: 592687 - protein, 9 aa, Homo Sapiens
KSPRSPKVT

SEQ ID NO: 592688 - protein, 9 aa, Homo Sapiens
KYEGCCVDL

SEQ ID NO: 592689 - protein, 9 aa, Homo Sapiens
TGAGLAPGL

SEQ ID NO: 592690 - protein, 9 aa, Homo Sapiens
GLEKCCRPS

SEQ ID NO: 592691 - protein, 9 aa, Homo Sapiens
RALEEENAK

SEQ ID NO: 592692 - protein, 9 aa, Homo Sapiens
DRLLQQPGS

SEQ ID NO: 592693 - protein, 9 aa, Homo Sapiens
LLGTGTDRS

SEQ ID NO: 592694 - protein, 9 aa, Homo Sapiens
CRRVSEALS

SEQ ID NO: 592695 - protein, 9 aa, Homo Sapiens
TSCRRSHDF

SEQ ID NO: 592696 - protein, 9 aa, Homo Sapiens
VLLLYMVSR

SEQ ID NO: 592697 - protein, 9 aa, Homo Sapiens
SSCPEQPDS

SEQ ID NO: 592698 - protein, 9 aa, Homo Sapiens
EYTVFMKEN

SEQ ID NO: 592699 - protein, 9 aa, Homo Sapiens
ASCRRNNPK

SEQ ID NO: 592700 - protein, 9 aa, Homo Sapiens
QEEREQQLR

SEQ ID NO: 592701 - protein, 9 aa, Homo Sapiens
LRTLGNERG

SEQ ID NO: 592702 - protein, 9 aa, Homo Sapiens
FATHLSFAS

SEQ ID NO: 592703 - protein, 9 aa, Homo Sapiens
SNRSHVYAV

SEQ ID NO: 592704 - protein, 9 aa, Homo Sapiens
AGEFRKSLA

SEQ ID NO: 592705 - protein, 9 aa, Homo Sapiens
GSFLGQYTE

SEQ ID NO: 592706 - protein, 9 aa, Homo Sapiens
LLTKDPEWM

SEQ ID NO: 592707 - protein, 9 aa, Homo Sapiens
LPERAKLAA

SEQ ID NO: 592708 - protein, 9 aa, Homo Sapiens
EGSLRYGEE

SEQ ID NO: 592709 - protein, 9 aa, Homo Sapiens
REKFENSME

SEQ ID NO: 592710 - protein, 9 aa, Homo Sapiens
NTGSYYDHV

SEQ ID NO: 592711 - protein, 9 aa, Homo Sapiens
LREKFENSM

SEQ ID NO: 592712 - protein, 9 aa, Homo Sapiens
QNTHVPILE

SEQ ID NO: 592713 - protein, 9 aa, Homo Sapiens
SAFNPSPQY

SEQ ID NO: 592714 - protein, 9 aa, Homo Sapiens
AKCVSAFPA

SEQ ID NO: 592715 - protein, 9 aa, Homo Sapiens
EWMNAKMKF

SEQ ID NO: 592716 - protein, 9 aa, Homo Sapiens
APGLPGWGP

SEQ ID NO: 592717 - protein, 9 aa, Homo Sapiens
CAKRAFVHW

SEQ ID NO: 592718 - protein, 9 aa, Homo Sapiens
ENSMESLRL

SEQ ID NO: 592719 - protein, 9 aa, Homo Sapiens
HLASCRRNN

SEQ ID NO: 592720 - protein, 9 aa, Homo Sapiens
YTVFMKENN

SEQ ID NO: 592721 - protein, 9 aa, Homo Sapiens
GSLRYGEEK

SEQ ID NO: 592722 - protein, 9 aa, Homo Sapiens
AQGPLAASE

SEQ ID NO: 592723 - protein, 9 aa, Homo Sapiens
LGNERGAQQ

SEQ ID NO: 592724 - protein, 9 aa, Homo Sapiens
NTHVPILEG

SEQ ID NO: 592725 - protein, 9 aa, Homo Sapiens
VFSSHHTAG

SEQ ID NO: 592726 - protein, 9 aa, Homo Sapiens
ELRTLGNER

SEQ ID NO: 592727 - protein, 9 aa, Homo Sapiens
CSTVEGAAL

SEQ ID NO: 592728 - protein, 9 aa, Homo Sapiens
LATSGSFLG

SEQ ID NO: 592729 - protein, 9 aa, Homo Sapiens
LRYGEEKEP

SEQ ID NO: 592730 - protein, 9 aa, Homo Sapiens
CGHWPVLRA

SEQ ID NO: 592731 - protein, 9 aa, Homo Sapiens
RFWLEMPES

SEQ ID NO: 592732 - protein, 9 aa, Homo Sapiens
KNYKLSPND

SEQ ID NO: 592733 - protein, 9 aa, Homo Sapiens
QMLRAEEQT

SEQ ID NO: 592734 - protein, 9 aa, Homo Sapiens
YDHVKISAP

SEQ ID NO: 592735 - protein, 9 aa, Homo Sapiens
RGARRRNCY

SEQ ID NO: 592736 - protein, 9 aa, Homo Sapiens
LASCRRNNP

SEQ ID NO: 592737 - protein, 9 aa, Homo Sapiens
HVPILEGVD

SEQ ID NO: 592738 - protein, 9 aa, Homo Sapiens
MDYSGPPRG

SEQ ID NO: 592739 - protein, 9 aa, Homo Sapiens
GSGGSTFAP

SEQ ID NO: 592740 - protein, 9 aa, Homo Sapiens
MDRGIENRM

SEQ ID NO: 592741 - protein, 9 aa, Homo Sapiens
SQAPKKLNH

SEQ ID NO: 592742 - protein, 9 aa, Homo Sapiens
SCPEQPDSC

SEQ ID NO: 592743 - protein, 9 aa, Homo Sapiens
EMAVSVGVD

SEQ ID NO: 592744 - protein, 9 aa, Homo Sapiens
FDHNCIYLS

SEQ ID NO: 592745 - protein, 9 aa, Homo Sapiens
IENICWSLM

SEQ ID NO: 592746 - protein, 9 aa, Homo Sapiens
LSEGSLRYG

SEQ ID NO: 592747 - protein, 9 aa, Homo Sapiens
ALAITGSST

SEQ ID NO: 592748 - protein, 9 aa, Homo Sapiens
ESPVNQLVN

SEQ ID NO: 592749 - protein, 9 aa, Homo Sapiens
GEKTSTVSS

SEQ ID NO: 592750 - protein, 9 aa, Homo Sapiens
SPKSPRSPK

SEQ ID NO: 592751 - protein, 9 aa, Homo Sapiens
CPEQPDSCQ

SEQ ID NO: 592752 - protein, 9 aa, Homo Sapiens
SHVYAVIMT

SEQ ID NO: 592753 - protein, 9 aa, Homo Sapiens
QIIVNPARQ

SEQ ID NO: 592754 - protein, 9 aa, Homo Sapiens
AVKFHTVIT

SEQ ID NO: 592755 - protein, 9 aa, Homo Sapiens
WHTKPSMPT

SEQ ID NO: 592756 - protein, 9 aa, Homo Sapiens
SEEAVILQC

SEQ ID NO: 592757 - protein, 9 aa, Homo Sapiens
HESPVNQLV

SEQ ID NO: 592758 - protein, 9 aa, Homo Sapiens
EQDGGSHRD

SEQ ID NO: 592759 - protein, 9 aa, Homo Sapiens
AVILQCWSD

SEQ ID NO: 592760 - protein, 9 aa, Homo Sapiens
PSHQAAPGP

SEQ ID NO: 592761 - protein, 9 aa, Homo Sapiens
LYSGESHAQ

SEQ ID NO: 592762 - protein, 9 aa, Homo Sapiens
AERFMEEMK

SEQ ID NO: 592763 - protein, 9 aa, Homo Sapiens
TVFMKENNP

SEQ ID NO: 592764 - protein, 9 aa, Homo Sapiens
QEAEQPSHQ

SEQ ID NO: 592765 - protein, 9 aa, Homo Sapiens
AGAGTFKDF

SEQ ID NO: 592766 - protein, 9 aa, Homo Sapiens
DLMDHPVTR

SEQ ID NO: 592767 - protein, 9 aa, Homo Sapiens
NICWSLMDR

SEQ ID NO: 592768 - protein, 9 aa, Homo Sapiens
FRSMDRGIE

SEQ ID NO: 592769 - protein, 9 aa, Homo Sapiens
LQQPQQKVG

SEQ ID NO: 592770 - protein, 9 aa, Homo Sapiens
GIENRMGTP

SEQ ID NO: 592771 - protein, 9 aa, Homo Sapiens
IAGEFRKSL

SEQ ID NO: 592772 - protein, 9 aa, Homo Sapiens
SVWLCKMCI

SEQ ID NO: 592773 - protein, 9 aa, Homo Sapiens
LDHKFDLMC

SEQ ID NO: 592774 - protein, 9 aa, Homo Sapiens
QDGGSHRDR

SEQ ID NO: 592775 - protein, 9 aa, Homo Sapiens
KDVTQLLRK

SEQ ID NO: 592776 - protein, 9 aa, Homo Sapiens
SAVRDSRHR

SEQ ID NO: 592777 - protein, 9 aa, Homo Sapiens
EKFENSMES

SEQ ID NO: 592778 - protein, 9 aa, Homo Sapiens
LLPTPRGTG

SEQ ID NO: 592779 - protein, 9 aa, Homo Sapiens
ATGSRPRGL

SEQ ID NO: 592780 - protein, 9 aa, Homo Sapiens
CCRPPVRDI

SEQ ID NO: 592781 - protein, 9 aa, Homo Sapiens
TNVCLSRPV

SEQ ID NO: 592782 - protein, 9 aa, Homo Sapiens
MMDYSGPPR

SEQ ID NO: 592783 - protein, 9 aa, Homo Sapiens
HINCIRPSV

SEQ ID NO: 592784 - protein, 9 aa, Homo Sapiens
TGSSTEKAK

SEQ ID NO: 592785 - protein, 9 aa, Homo Sapiens
KADFAIIPA

SEQ ID NO: 592786 - protein, 9 aa, Homo Sapiens
QCKGELERA

SEQ ID NO: 592787 - protein, 9 aa, Homo Sapiens
PPSRRGEQL

SEQ ID NO: 592788 - protein, 9 aa, Homo Sapiens
MDHPVTRSE

SEQ ID NO: 592789 - protein, 9 aa, Homo Sapiens
DLMYKIFVK

SEQ ID NO: 592790 - protein, 9 aa, Homo Sapiens
AALTNVCLS

SEQ ID NO: 592791 - protein, 9 aa, Homo Sapiens
LDFLRCVCG

SEQ ID NO: 592792 - protein, 9 aa, Homo Sapiens
RAAKNRPPV

SEQ ID NO: 592793 - protein, 9 aa, Homo Sapiens
QRKRKVQLP

SEQ ID NO: 592794 - protein, 9 aa, Homo Sapiens
IEKPRISTV

SEQ ID NO: 592795 - protein, 9 aa, Homo Sapiens
QVRLGAAAQ

SEQ ID NO: 592796 - protein, 9 aa, Homo Sapiens
VVGSDVATI

SEQ ID NO: 592797 - protein, 9 aa, Homo Sapiens
VEGAALSTT

SEQ ID NO: 592798 - protein, 9 aa, Homo Sapiens
LRWQFPANY

SEQ ID NO: 592799 - protein, 9 aa, Homo Sapiens
AYLPPLSLE

SEQ ID NO: 592800 - protein, 9 aa, Homo Sapiens
LSFASPFLP

SEQ ID NO: 592801 - protein, 9 aa, Homo Sapiens
DHSGQVTII

SEQ ID NO: 592802 - protein, 9 aa, Homo Sapiens
EPLAAGRHV

SEQ ID NO: 592803 - protein, 9 aa, Homo Sapiens
TFAPPLRAQ

SEQ ID NO: 592804 - protein, 9 aa, Homo Sapiens
VNMQNMRLG

SEQ ID NO: 592805 - protein, 9 aa, Homo Sapiens
GKKDGEKTS

SEQ ID NO: 592806 - protein, 9 aa, Homo Sapiens
RSHVYAVIM

SEQ ID NO: 592807 - protein, 9 aa, Homo Sapiens
EKTEEVGDG

SEQ ID NO: 592808 - protein, 9 aa, Homo Sapiens
ALPERAKLA

SEQ ID NO: 592809 - protein, 9 aa, Homo Sapiens
NLSCHSAFN

SEQ ID NO: 592810 - protein, 9 aa, Homo Sapiens
CGLEKCCRP

SEQ ID NO: 592811 - protein, 9 aa, Homo Sapiens
ARPPLGGAE

SEQ ID NO: 592812 - protein, 9 aa, Homo Sapiens
RVHTGEKPC

SEQ ID NO: 592813 - protein, 9 aa, Homo Sapiens
AEQPSHQAA

SEQ ID NO: 592814 - protein, 9 aa, Homo Sapiens
PQIIVNPAR

SEQ ID NO: 592815 - protein, 9 aa, Homo Sapiens
KRIGAYLPP

SEQ ID NO: 592816 - protein, 9 aa, Homo Sapiens
RFMEEMKDI

SEQ ID NO: 592817 - protein, 9 aa, Homo Sapiens
SWHTKPSMP

SEQ ID NO: 592818 - protein, 9 aa, Homo Sapiens
LAPGLPGWG

SEQ ID NO: 592819 - protein, 9 aa, Homo Sapiens
LTKDPEWMN

SEQ ID NO: 592820 - protein, 9 aa, Homo Sapiens
LPATGSRPR

SEQ ID NO: 592821 - protein, 9 aa, Homo Sapiens
YRNGVPESS

SEQ ID NO: 592822 - protein, 9 aa, Homo Sapiens
GPTSTQKFS

SEQ ID NO: 592823 - protein, 9 aa, Homo Sapiens
RLHRIWQML

SEQ ID NO: 592824 - protein, 9 aa, Homo Sapiens
SNDECERIV

SEQ ID NO: 592825 - protein, 9 aa, Homo Sapiens
IVNPARQKM

SEQ ID NO: 592826 - protein, 9 aa, Homo Sapiens
GCGPKLTSV

SEQ ID NO: 592827 - protein, 9 aa, Homo Sapiens
SGESHAQAT

SEQ ID NO: 592828 - protein, 9 aa, Homo Sapiens
SSHHTAGGM

SEQ ID NO: 592829 - protein, 9 aa, Homo Sapiens
RKVQLPPSR

SEQ ID NO: 592830 - protein, 9 aa, Homo Sapiens
ELKGLLPTP

SEQ ID NO: 592831 - protein, 9 aa, Homo Sapiens
YHLASCRRN

SEQ ID NO: 592832 - protein, 9 aa, Homo Sapiens
AKLPDEPEE

SEQ ID NO: 592833 - protein, 9 aa, Homo Sapiens
VHTKALSSL

SEQ ID NO: 592834 - protein, 9 aa, Homo Sapiens
ENRGLEEMA

SEQ ID NO: 592835 - protein, 9 aa, Homo Sapiens
FVLLFGDGV

SEQ ID NO: 592836 - protein, 9 aa, Homo Sapiens
HRDRLLQQP

SEQ ID NO: 592837 - protein, 9 aa, Homo Sapiens
FMEEMKDIL

SEQ ID NO: 592838 - protein, 9 aa, Homo Sapiens
NEEYKFYLH

SEQ ID NO: 592839 - protein, 9 aa, Homo Sapiens
LNTGSYYDH

SEQ ID NO: 592840 - protein, 9 aa, Homo Sapiens
GEFRKSLAE

SEQ ID NO: 592841 - protein, 9 aa, Homo Sapiens
DFLRCVCGH

SEQ ID NO: 592842 - protein, 9 aa, Homo Sapiens
GLVVVMLGG

SEQ ID NO: 592843 - protein, 9 aa, Homo Sapiens
AGLAPGLPG

SEQ ID NO: 592844 - protein, 9 aa, Homo Sapiens
GGAEQDGGS

SEQ ID NO: 592845 - protein, 9 aa, Homo Sapiens
PPLGGAEQD

SEQ ID NO: 592846 - protein, 9 aa, Homo Sapiens
SRGRHGSAS

SEQ ID NO: 592847 - protein, 9 aa, Homo Sapiens
DVTQLLRKA

SEQ ID NO: 592848 - protein, 9 aa, Homo Sapiens
PSALAQGPL

SEQ ID NO: 592849 - protein, 9 aa, Homo Sapiens
GSWGRPGPS

SEQ ID NO: 592850 - protein, 9 aa, Homo Sapiens
GSTFAPPLR

SEQ ID NO: 592851 - protein, 9 aa, Homo Sapiens
PEIRVHTKA

SEQ ID NO: 592852 - protein, 9 aa, Homo Sapiens
SHINCIRPS

SEQ ID NO: 592853 - protein, 9 aa, Homo Sapiens
IFVKNKKKS

SEQ ID NO: 592854 - protein, 9 aa, Homo Sapiens
MLRAEEQTW

SEQ ID NO: 592855 - protein, 9 aa, Homo Sapiens
SGKYRNGVP

SEQ ID NO: 592856 - protein, 9 aa, Homo Sapiens
SPSLRTPDV

SEQ ID NO: 592857 - protein, 9 aa, Homo Sapiens
PSRGRHGSA

SEQ ID NO: 592858 - protein, 9 aa, Homo Sapiens
DGSARSSPS

SEQ ID NO: 592859 - protein, 9 aa, Homo Sapiens
LALPERAKL

SEQ ID NO: 592860 - protein, 9 aa, Homo Sapiens
EKTSTVSSQ

SEQ ID NO: 592861 - protein, 9 aa, Homo Sapiens
DKYEGCCVD

SEQ ID NO: 592862 - protein, 9 aa, Homo Sapiens
LAITGSSTE

SEQ ID NO: 592863 - protein, 9 aa, Homo Sapiens
VTGVLVCLA

SEQ ID NO: 592864 - protein, 9 aa, Homo Sapiens
LSCHSAFNP

SEQ ID NO: 592865 - protein, 9 aa, Homo Sapiens
VRTVQNSGC

SEQ ID NO: 592866 - protein, 9 aa, Homo Sapiens
PCKCGECGK

SEQ ID NO: 592867 - protein, 9 aa, Homo Sapiens
NPSNGTWKE

SEQ ID NO: 592868 - protein, 9 aa, Homo Sapiens
TQVGANVQS

SEQ ID NO: 592869 - protein, 9 aa, Homo Sapiens
GRHVEVLAD

SEQ ID NO: 592870 - protein, 9 aa, Homo Sapiens
NEIMECYLP

SEQ ID NO: 592871 - protein, 9 aa, Homo Sapiens
EEREQQLRR

SEQ ID NO: 592872 - protein, 9 aa, Homo Sapiens
LFGDGVWLC

SEQ ID NO: 592873 - protein, 9 aa, Homo Sapiens
TSTVSSQKP

SEQ ID NO: 592874 - protein, 9 aa, Homo Sapiens
YSGESHAQA

SEQ ID NO: 592875 - protein, 9 aa, Homo Sapiens
SGCGPKLTS

SEQ ID NO: 592876 - protein, 9 aa, Homo Sapiens
TDRSEPCGL

SEQ ID NO: 592877 - protein, 9 aa, Homo Sapiens
TFKDFSHIF

SEQ ID NO: 592878 - protein, 9 aa, Homo Sapiens
EETGGAAVR

SEQ ID NO: 592879 - protein, 9 aa, Homo Sapiens
GNSTPRSNP

SEQ ID NO: 592880 - protein, 9 aa, Homo Sapiens
MYKIFVKNK

SEQ ID NO: 592881 - protein, 9 aa, Homo Sapiens
HSAFNPSPQ

SEQ ID NO: 592882 - protein, 9 aa, Homo Sapiens
VIMTDLFTK

SEQ ID NO: 592883 - protein, 9 aa, Homo Sapiens
SARRGFEGE

SEQ ID NO: 592884 - protein, 9 aa, Homo Sapiens
REGHCYAEF

SEQ ID NO: 592885 - protein, 9 aa, Homo Sapiens
LLGSGGSTF

SEQ ID NO: 592886 - protein, 9 aa, Homo Sapiens
ITGSSTEKA

SEQ ID NO: 592887 - protein, 9 aa, Homo Sapiens
VSAFPAAPA

SEQ ID NO: 592888 - protein, 9 aa, Homo Sapiens
RSQSHINCI

SEQ ID NO: 592889 - protein, 9 aa, Homo Sapiens
PSPEFATVQ

SEQ ID NO: 592890 - protein, 9 aa, Homo Sapiens
AVKFCQVRL

SEQ ID NO: 592891 - protein, 9 aa, Homo Sapiens
KCCRPSCCQ

SEQ ID NO: 592892 - protein, 9 aa, Homo Sapiens
RFAKLPDEP

SEQ ID NO: 592893 - protein, 9 aa, Homo Sapiens
SRLISPKPL

SEQ ID NO: 592894 - protein, 9 aa, Homo Sapiens
VVTGVLVCL

SEQ ID NO: 592895 - protein, 9 aa, Homo Sapiens
PHLKFACYY

SEQ ID NO: 592896 - protein, 9 aa, Homo Sapiens
GTFKDFSHI

SEQ ID NO: 592897 - protein, 9 aa, Homo Sapiens
VGINSLKNY

SEQ ID NO: 592898 - protein, 9 aa, Homo Sapiens
VCLACERLL

SEQ ID NO: 592899 - protein, 9 aa, Homo Sapiens
NWGPSPEFA

SEQ ID NO: 592900 - protein, 9 aa, Homo Sapiens
SGASQAPKK

SEQ ID NO: 592901 - protein, 9 aa, Homo Sapiens
FEDLMDHPV

SEQ ID NO: 592902 - protein, 9 aa, Homo Sapiens
EETPAPSST

SEQ ID NO: 592903 - protein, 9 aa, Homo Sapiens
SLLLACCRP

SEQ ID NO: 592904 - protein, 9 aa, Homo Sapiens
CSPEIRVHT

SEQ ID NO: 592905 - protein, 9 aa, Homo Sapiens
ALSLPVVFI

SEQ ID NO: 592906 - protein, 9 aa, Homo Sapiens
HHTAGGMTP

SEQ ID NO: 592907 - protein, 9 aa, Homo Sapiens
GSHRDRLLQ

SEQ ID NO: 592908 - protein, 9 aa, Homo Sapiens
ADFAIIPAE

SEQ ID NO: 592909 - protein, 9 aa, Homo Sapiens
SLPHLKFAC

SEQ ID NO: 592910 - protein, 9 aa, Homo Sapiens
SWGRPGPSP

SEQ ID NO: 592911 - protein, 9 aa, Homo Sapiens
ASQAPKKLN

SEQ ID NO: 592912 - protein, 9 aa, Homo Sapiens
TPAPSSTSV

SEQ ID NO: 592913 - protein, 9 aa, Homo Sapiens
LAIAEVKVL

SEQ ID NO: 592914 - protein, 9 aa, Homo Sapiens
ERAKLAASL

SEQ ID NO: 592915 - protein, 9 aa, Homo Sapiens
AALSTTFPT

SEQ ID NO: 592916 - protein, 9 aa, Homo Sapiens
GTGTDRSEP

SEQ ID NO: 592917 - protein, 9 aa, Homo Sapiens
AVRDSRHRG

SEQ ID NO: 592918 - protein, 9 aa, Homo Sapiens
SNGTWKEWR

SEQ ID NO: 592919 - protein, 9 aa, Homo Sapiens
LPTPRGTGA

SEQ ID NO: 592920 - protein, 9 aa, Homo Sapiens
DHKFDLMCA

SEQ ID NO: 592921 - protein, 9 aa, Homo Sapiens
TSQRAAKNR

SEQ ID NO: 592922 - protein, 9 aa, Homo Sapiens
VGLLQPPVR

SEQ ID NO: 592923 - protein, 9 aa, Homo Sapiens
SLNRGNSTP

SEQ ID NO: 592924 - protein, 9 aa, Homo Sapiens
LACCRPPVR

SEQ ID NO: 592925 - protein, 9 aa, Homo Sapiens
TLGNERGAQ

SEQ ID NO: 592926 - protein, 9 aa, Homo Sapiens
WGPEARPPL

SEQ ID NO: 592927 - protein, 9 aa, Homo Sapiens
SKDVTQLLR

SEQ ID NO: 592928 - protein, 9 aa, Homo Sapiens
MDLMYKIFV

SEQ ID NO: 592929 - protein, 9 aa, Homo Sapiens
SKRWESAFQ

SEQ ID NO: 592930 - protein, 9 aa, Homo Sapiens
KVAPVDGFS

SEQ ID NO: 592931 - protein, 9 aa, Homo Sapiens
GHQGYLAIA

SEQ ID NO: 592932 - protein, 9 aa, Homo Sapiens
IWQMLRAEE

SEQ ID NO: 592933 - protein, 9 aa, Homo Sapiens
GKYRNGVPE

SEQ ID NO: 592934 - protein, 9 aa, Homo Sapiens
DHVKISAPN

SEQ ID NO: 592935 - protein, 9 aa, Homo Sapiens
PLGGAEQDG

SEQ ID NO: 592936 - protein, 9 aa, Homo Sapiens
MPTQRCSHG

SEQ ID NO: 592937 - protein, 9 aa, Homo Sapiens
LCFRSMDRG

SEQ ID NO: 592938 - protein, 9 aa, Homo Sapiens
LLYMVSRLI

SEQ ID NO: 592939 - protein, 9 aa, Homo Sapiens
SDQGCGLEK

SEQ ID NO: 592940 - protein, 9 aa, Homo Sapiens
GTSCRRSHD

SEQ ID NO: 592941 - protein, 9 aa, Homo Sapiens
GVLVCLACE

SEQ ID NO: 592942 - protein, 9 aa, Homo Sapiens
ERLYSGESH

SEQ ID NO: 592943 - protein, 9 aa, Homo Sapiens
PTPRGTGAG

SEQ ID NO: 592944 - protein, 9 aa, Homo Sapiens
PSNGTWKEW

SEQ ID NO: 592945 - protein, 9 aa, Homo Sapiens
GSDVATILS

SEQ ID NO: 592946 - protein, 9 aa, Homo Sapiens
EAVILQCWS

SEQ ID NO: 592947 - protein, 9 aa, Homo Sapiens
HFATHLSFA

SEQ ID NO: 592948 - protein, 9 aa, Homo Sapiens
PSSCPEQPD

SEQ ID NO: 592949 - protein, 9 aa, Homo Sapiens
QLLGTGTDR

SEQ ID NO: 592950 - protein, 9 aa, Homo Sapiens
LAQGPLAAS

SEQ ID NO: 592951 - protein, 9 aa, Homo Sapiens
KSLAELDED

SEQ ID NO: 592952 - protein, 9 aa, Homo Sapiens
ALPATGSRP

SEQ ID NO: 592953 - protein, 9 aa, Homo Sapiens
NSTPRSNPS

SEQ ID NO: 592954 - protein, 9 aa, Homo Sapiens
SEPPQIIVN

SEQ ID NO: 592955 - protein, 9 aa, Homo Sapiens
DLMCAKRAF

SEQ ID NO: 592956 - protein, 9 aa, Homo Sapiens
VFVLLFGDG

SEQ ID NO: 592957 - protein, 9 aa, Homo Sapiens
KDGEKTSTV

SEQ ID NO: 592958 - protein, 9 aa, Homo Sapiens
SCHSAFNPS

SEQ ID NO: 592959 - protein, 9 aa, Homo Sapiens
LCKMCIEQR

SEQ ID NO: 592960 - protein, 9 aa, Homo Sapiens
PMDLMYKIF

SEQ ID NO: 592961 - protein, 9 aa, Homo Sapiens
GQVTIIKLE

SEQ ID NO: 592962 - protein, 9 aa, Homo Sapiens
VRLGAAAQR

SEQ ID NO: 592963 - protein, 9 aa, Homo Sapiens
SYQGTQVGA

SEQ ID NO: 592964 - protein, 9 aa, Homo Sapiens
PPEETPAPS

SEQ ID NO: 592965 - protein, 9 aa, Homo Sapiens
VDGFSDLAM

SEQ ID NO: 592966 - protein, 9 aa, Homo Sapiens
DQGCGLEKC

SEQ ID NO: 592967 - protein, 9 aa, Homo Sapiens
ALSTTFPTR

SEQ ID NO: 592968 - protein, 9 aa, Homo Sapiens
PGLPGWGPE

SEQ ID NO: 592969 - protein, 9 aa, Homo Sapiens
GMEYQGGDV

SEQ ID NO: 592970 - protein, 9 aa, Homo Sapiens
DSRHRGYSG

SEQ ID NO: 592971 - protein, 9 aa, Homo Sapiens
FKDFSHIFL

SEQ ID NO: 592972 - protein, 9 aa, Homo Sapiens
VLSFMDACY

SEQ ID NO: 592973 - protein, 9 aa, Homo Sapiens
GPSPAGPPR

SEQ ID NO: 592974 - protein, 9 aa, Homo Sapiens
VLVCLACER

SEQ ID NO: 592975 - protein, 9 aa, Homo Sapiens
QPGSLPAPG

SEQ ID NO: 592976 - protein, 9 aa, Homo Sapiens
CYYLANKSS

SEQ ID NO: 592977 - protein, 9 aa, Homo Sapiens
SLAELDEDL

SEQ ID NO: 592978 - protein, 9 aa, Homo Sapiens
SIREGHCYA

SEQ ID NO: 592979 - protein, 9 aa, Homo Sapiens
FAKLPDEPE

SEQ ID NO: 592980 - protein, 9 aa, Homo Sapiens
QPQQKVGLL

SEQ ID NO: 592981 - protein, 9 aa, Homo Sapiens
RVSEALSLP

SEQ ID NO: 592982 - protein, 9 aa, Homo Sapiens
HRIWQMLRA

SEQ ID NO: 592983 - protein, 9 aa, Homo Sapiens
VAGAYVACL

SEQ ID NO: 592984 - protein, 9 aa, Homo Sapiens
EYPVKIVST

SEQ ID NO: 592985 - protein, 9 aa, Homo Sapiens
VAPVDGFSD

SEQ ID NO: 592986 - protein, 9 aa, Homo Sapiens
HSGQVTIIK

SEQ ID NO: 592987 - protein, 9 aa, Homo Sapiens
LVCLACERL

SEQ ID NO: 592988 - protein, 9 aa, Homo Sapiens
HKFDLMCAK

SEQ ID NO: 592989 - protein, 9 aa, Homo Sapiens
SIGLRRSGQ

SEQ ID NO: 592990 - protein, 9 aa, Homo Sapiens
GPPRGARRR

SEQ ID NO: 592991 - protein, 9 aa, Homo Sapiens
SHAQATLLQ

SEQ ID NO: 592992 - protein, 9 aa, Homo Sapiens
ETGGAAVRE

SEQ ID NO: 592993 - protein, 9 aa, Homo Sapiens
SASGQSSSY

SEQ ID NO: 592994 - protein, 9 aa, Homo Sapiens
PERAKLAAS

SEQ ID NO: 592995 - protein, 9 aa, Homo Sapiens
AQDARFWLE

SEQ ID NO: 592996 - protein, 9 aa, Homo Sapiens
KFACYYLAN

SEQ ID NO: 592997 - protein, 9 aa, Homo Sapiens
LLSNDECER

SEQ ID NO: 592998 - protein, 9 aa, Homo Sapiens
KNRPPVSDQ

SEQ ID NO: 592999 - protein, 9 aa, Homo Sapiens
APSPAKCVS

SEQ ID NO: 593000 - protein, 9 aa, Homo Sapiens
SLDIQSPPS

SEQ ID NO: 593001 - protein, 9 aa, Homo Sapiens
GLEEMAVSV

SEQ ID NO: 593002 - protein, 9 aa, Homo Sapiens
PANYRRLRH

SEQ ID NO: 593003 - protein, 9 aa, Homo Sapiens
ALAQDARFW

SEQ ID NO: 593004 - protein, 9 aa, Homo Sapiens
ENICWSLMD

SEQ ID NO: 593005 - protein, 9 aa, Homo Sapiens
MVSRLISPK

SEQ ID NO: 593006 - protein, 9 aa, Homo Sapiens
RLYSGESHA

SEQ ID NO: 593007 - protein, 9 aa, Homo Sapiens
WMNAKMKFF

SEQ ID NO: 593008 - protein, 9 aa, Homo Sapiens
NSGCGPKLT

SEQ ID NO: 593009 - protein, 9 aa, Homo Sapiens
FMKENNPPG

SEQ ID NO: 593010 - protein, 9 aa, Homo Sapiens
ESGASQAPK

SEQ ID NO: 593011 - protein, 9 aa, Homo Sapiens
TPRGTGAGL

SEQ ID NO: 593012 - protein, 9 aa, Homo Sapiens
THVPILEGV

SEQ ID NO: 593013 - protein, 9 aa, Homo Sapiens
RIGAYLPPL

SEQ ID NO: 593014 - protein, 9 aa, Homo Sapiens
RRGFEGESD

SEQ ID NO: 593015 - protein, 9 aa, Homo Sapiens
KFGTSCRRS

SEQ ID NO: 593016 - protein, 9 aa, Homo Sapiens
STFAPPLRA

SEQ ID NO: 593017 - protein, 9 aa, Homo Sapiens
QSHINCIRP

SEQ ID NO: 593018 - protein, 9 aa, Homo Sapiens
GDVEFFDLD

SEQ ID NO: 593019 - protein, 9 aa, Homo Sapiens
ISLLLACCR

SEQ ID NO: 593020 - protein, 9 aa, Homo Sapiens
SEGSLRYGE

SEQ ID NO: 593021 - protein, 9 aa, Homo Sapiens
ETPAPSSTS

SEQ ID NO: 593022 - protein, 9 aa, Homo Sapiens
PTVFSSHHT

SEQ ID NO: 593023 - protein, 9 aa, Homo Sapiens
GSSTEKAKD

SEQ ID NO: 593024 - protein, 9 aa, Homo Sapiens
ALAQGPLAA

SEQ ID NO: 593025 - protein, 9 aa, Homo Sapiens
NKDKTYIPY

SEQ ID NO: 593026 - protein, 9 aa, Homo Sapiens
GNDKYEGCC

SEQ ID NO: 593027 - protein, 9 aa, Homo Sapiens
LSTTFPTRG

SEQ ID NO: 593028 - protein, 9 aa, Homo Sapiens
MKENNPPGC

SEQ ID NO: 593029 - protein, 9 aa, Homo Sapiens
WLSKDVTQL

SEQ ID NO: 593030 - protein, 9 aa, Homo Sapiens
VAALTNVCL

SEQ ID NO: 593031 - protein, 9 aa, Homo Sapiens
NDECERIVL

SEQ ID NO: 593032 - protein, 9 aa, Homo Sapiens
FVKNKKKSH

SEQ ID NO: 593033 - protein, 9 aa, Homo Sapiens
WQFPANYRR

SEQ ID NO: 593034 - protein, 9 aa, Homo Sapiens
HTKALSSLE

SEQ ID NO: 593035 - protein, 9 aa, Homo Sapiens
PVNQLVNMQ

SEQ ID NO: 593036 - protein, 9 aa, Homo Sapiens
GPEARPPLG

SEQ ID NO: 593037 - protein, 9 aa, Homo Sapiens
SQCAPNFHK

SEQ ID NO: 593038 - protein, 9 aa, Homo Sapiens
VTIIKLEQE

SEQ ID NO: 593039 - protein, 9 aa, Homo Sapiens
TGTDRSEPC

SEQ ID NO: 593040 - protein, 9 aa, Homo Sapiens
DRSEPCGLS

SEQ ID NO: 593041 - protein, 9 aa, Homo Sapiens
RHRGYSGSQ

SEQ ID NO: 593042 - protein, 9 aa, Homo Sapiens
LNGDSYQGT

SEQ ID NO: 593043 - protein, 9 aa, Homo Sapiens
YVACLISAL

SEQ ID NO: 593044 - protein, 9 aa, Homo Sapiens
PRSPKVTTH

SEQ ID NO: 593045 - protein, 9 aa, Homo Sapiens
EYQGGDVEF

SEQ ID NO: 593046 - protein, 9 aa, Homo Sapiens
SQRAAKNRP

SEQ ID NO: 593047 - protein, 9 aa, Homo Sapiens
GTDRSEPCG

SEQ ID NO: 593048 - protein, 9 aa, Homo Sapiens
VTQLLRKAK

SEQ ID NO: 593049 - protein, 9 aa, Homo Sapiens
FHTVITEKW

SEQ ID NO: 593050 - protein, 9 aa, Homo Sapiens
QSPPSIGLR

SEQ ID NO: 593051 - protein, 9 aa, Homo Sapiens
NYRRLRHAL

SEQ ID NO: 593052 - protein, 9 aa, Homo Sapiens
HQGYLAIAE

SEQ ID NO: 593053 - protein, 9 aa, Homo Sapiens
GFFVFVLLF

SEQ ID NO: 593054 - protein, 9 aa, Homo Sapiens
GDGRVKRGP

SEQ ID NO: 593055 - protein, 9 aa, Homo Sapiens
SGMLTQNTH

SEQ ID NO: 593056 - protein, 9 aa, Homo Sapiens
LPGWGPEAR

SEQ ID NO: 593057 - protein, 9 aa, Homo Sapiens
RGRHGSASG

SEQ ID NO: 593058 - protein, 9 aa, Homo Sapiens
HVYAVIMTD

SEQ ID NO: 593059 - protein, 9 aa, Homo Sapiens
KTELLRKIR

SEQ ID NO: 593060 - protein, 9 aa, Homo Sapiens
RGTGAGLAP

SEQ ID NO: 593061 - protein, 9 aa, Homo Sapiens
NSLKNYKLS

SEQ ID NO: 593062 - protein, 9 aa, Homo Sapiens
LERALSAVI

SEQ ID NO: 593063 - protein, 9 aa, Homo Sapiens
AKVAPVDGF

SEQ ID NO: 593064 - protein, 9 aa, Homo Sapiens
ATSGSFLGQ

SEQ ID NO: 593065 - protein, 9 aa, Homo Sapiens
TIIKLEQEN

SEQ ID NO: 593066 - protein, 9 aa, Homo Sapiens
DARFWLEMP

SEQ ID NO: 593067 - protein, 9 aa, Homo Sapiens
GGSHRDRLL

SEQ ID NO: 593068 - protein, 9 aa, Homo Sapiens
DRGIENRMG

SEQ ID NO: 593069 - protein, 9 aa, Homo Sapiens
LPPLSLEEL

SEQ ID NO: 593070 - protein, 9 aa, Homo Sapiens
NQLVNMQNM

SEQ ID NO: 593071 - protein, 9 aa, Homo Sapiens
ICWSLMDRL

SEQ ID NO: 593072 - protein, 9 aa, Homo Sapiens
SEEKADFAI

SEQ ID NO: 593073 - protein, 9 aa, Homo Sapiens
YLPAEDSVK

SEQ ID NO: 593074 - protein, 9 aa, Homo Sapiens
FPANYRRLR

SEQ ID NO: 593075 - protein, 9 aa, Homo Sapiens
GGMEPEEET

SEQ ID NO: 593076 - protein, 9 aa, Homo Sapiens
FTTRRSQSH

SEQ ID NO: 593077 - protein, 9 aa, Homo Sapiens
MESLRLFKN

SEQ ID NO: 593078 - protein, 9 aa, Homo Sapiens
KLPDEPEEP

SEQ ID NO: 593079 - protein, 9 aa, Homo Sapiens
IIHFATHLS

SEQ ID NO: 593080 - protein, 9 aa, Homo Sapiens
YLALPERAK

SEQ ID NO: 593081 - protein, 9 aa, Homo Sapiens
KRDVVGSDV

SEQ ID NO: 593082 - protein, 9 aa, Homo Sapiens
AFNPSPQYS

SEQ ID NO: 593083 - protein, 9 aa, Homo Sapiens
RPPLGGAEQ

SEQ ID NO: 593084 - protein, 9 aa, Homo Sapiens
WGPSPEFAT

SEQ ID NO: 593085 - protein, 9 aa, Homo Sapiens
MNAKMKFFL

SEQ ID NO: 593086 - protein, 9 aa, Homo Sapiens
LHRIWQMLR

SEQ ID NO: 593087 - protein, 9 aa, Homo Sapiens
EAEQPSHQA

SEQ ID NO: 593088 - protein, 9 aa, Homo Sapiens
TGSYYDHVK

SEQ ID NO: 593089 - protein, 9 aa, Homo Sapiens
SSQCAPNFH

SEQ ID NO: 593090 - protein, 9 aa, Homo Sapiens
QPEYTVFMK

SEQ ID NO: 593091 - protein, 9 aa, Homo Sapiens
STPSSCPEQ

SEQ ID NO: 593092 - protein, 9 aa, Homo Sapiens
MEYQGGDVE

SEQ ID NO: 593093 - protein, 9 aa, Homo Sapiens
SLRYGEEKE

SEQ ID NO: 593094 - protein, 9 aa, Homo Sapiens
INSLNRGNS

SEQ ID NO: 593095 - protein, 9 aa, Homo Sapiens
QEKRDVVGS

SEQ ID NO: 593096 - protein, 9 aa, Homo Sapiens
LQCKGELER

SEQ ID NO: 593097 - protein, 9 aa, Homo Sapiens
SPSPPEETP

SEQ ID NO: 593098 - protein, 9 aa, Homo Sapiens
EKPRISTVI

SEQ ID NO: 593099 - protein, 9 aa, Homo Sapiens
ALATSGSFL

SEQ ID NO: 593100 - protein, 9 aa, Homo Sapiens
QRAAKNRPP

SEQ ID NO: 593101 - protein, 9 aa, Homo Sapiens
GGSTFAPPL

SEQ ID NO: 593102 - protein, 9 aa, Homo Sapiens
FFVFVLLFG

SEQ ID NO: 593103 - protein, 9 aa, Homo Sapiens
SPPSIGLRR

SEQ ID NO: 593104 - protein, 9 aa, Homo Sapiens
RRVSEALSL

SEQ ID NO: 593105 - protein, 9 aa, Homo Sapiens
ECKFGTSCR

SEQ ID NO: 593106 - protein, 9 aa, Homo Sapiens
YSGPPRGAR

SEQ ID NO: 593107 - protein, 9 aa, Homo Sapiens
RPPVRDILS

SEQ ID NO: 593108 - protein, 9 aa, Homo Sapiens
RHGSASGQS

SEQ ID NO: 593109 - protein, 9 aa, Homo Sapiens
SPPEETPAP

SEQ ID NO: 593110 - protein, 9 aa, Homo Sapiens
ALTNVCLSR

SEQ ID NO: 593111 - protein, 9 aa, Homo Sapiens
SGQVTIIKL

SEQ ID NO: 593112 - protein, 9 aa, Homo Sapiens
AEPLAAGRH

SEQ ID NO: 593113 - protein, 9 aa, Homo Sapiens
CKGELERAL

SEQ ID NO: 593114 - protein, 9 aa, Homo Sapiens
FVFVLLFGD

SEQ ID NO: 593115 - protein, 9 aa, Homo Sapiens
NSMESLRLF

SEQ ID NO: 593116 - protein, 9 aa, Homo Sapiens
SFLGQYTEA

SEQ ID NO: 593117 - protein, 9 aa, Homo Sapiens
LVVVMLGGA

SEQ ID NO: 593118 - protein, 9 aa, Homo Sapiens
KCVSAFPAA

SEQ ID NO: 593119 - protein, 9 aa, Homo Sapiens
AAGAGTFKD

SEQ ID NO: 593120 - protein, 9 aa, Homo Sapiens
YFLSVLSFM

SEQ ID NO: 593121 - protein, 9 aa, Homo Sapiens
KKDGEKTST

SEQ ID NO: 593122 - protein, 9 aa, Homo Sapiens
LSLPVVFID

SEQ ID NO: 593123 - protein, 9 aa, Homo Sapiens
DVVGSDVAT

SEQ ID NO: 593124 - protein, 9 aa, Homo Sapiens
YYDHVKISA

SEQ ID NO: 593125 - protein, 9 aa, Homo Sapiens
EGCCVDLAS

SEQ ID NO: 593126 - protein, 9 aa, Homo Sapiens
GMFSIITSY

SEQ ID NO: 593127 - protein, 9 aa, Homo Sapiens
FLSVLSFMD

SEQ ID NO: 593128 - protein, 9 aa, Homo Sapiens
GSRPRGLQA

SEQ ID NO: 593129 - protein, 9 aa, Homo Sapiens
VWLCKMCIE

SEQ ID NO: 593130 - protein, 9 aa, Homo Sapiens
NRSHVYAVI

SEQ ID NO: 593131 - protein, 9 aa, Homo Sapiens
MCAKRAFVH

SEQ ID NO: 593132 - protein, 9 aa, Homo Sapiens
HTVITEKWG

SEQ ID NO: 593133 - protein, 9 aa, Homo Sapiens
LAIFTLMGN

SEQ ID NO: 593134 - protein, 9 aa, Homo Sapiens
EKCCRPSCC

SEQ ID NO: 593135 - protein, 9 aa, Homo Sapiens
KTYIPYLHK

SEQ ID NO: 593136 - protein, 9 aa, Homo Sapiens
GGDVEFFDL

SEQ ID NO: 593137 - protein, 9 aa, Homo Sapiens
GGSSIREGH

SEQ ID NO: 593138 - protein, 9 aa, Homo Sapiens
EEKTEEVGD

SEQ ID NO: 593139 - protein, 9 aa, Homo Sapiens
LEKCCRPSC

SEQ ID NO: 593140 - protein, 9 aa, Homo Sapiens
SFNKDKTYI

SEQ ID NO: 593141 - protein, 9 aa, Homo Sapiens
CERIVLLVA

SEQ ID NO: 593142 - protein, 9 aa, Homo Sapiens
DVEFFDLDD

SEQ ID NO: 593143 - protein, 9 aa, Homo Sapiens
QAVKFCQVR

SEQ ID NO: 593144 - protein, 9 aa, Homo Sapiens
SIITSYILF

SEQ ID NO: 593145 - protein, 9 aa, Homo Sapiens
GWGPEARPP

SEQ ID NO: 593146 - protein, 9 aa, Homo Sapiens
AGRHVEVLA

SEQ ID NO: 593147 - protein, 9 aa, Homo Sapiens
FSSHHTAGG

SEQ ID NO: 593148 - protein, 9 aa, Homo Sapiens
LRCVCGHWP

SEQ ID NO: 593149 - protein, 9 aa, Homo Sapiens
WGRPGPSPA

SEQ ID NO: 593150 - protein, 9 aa, Homo Sapiens
GLPGWGPEA

SEQ ID NO: 593151 - protein, 9 aa, Homo Sapiens
ERIVLLVAR

SEQ ID NO: 593152 - protein, 9 aa, Homo Sapiens
FAIIPAEGI

SEQ ID NO: 593153 - protein, 9 aa, Homo Sapiens
GSYYDHVKI

SEQ ID NO: 593154 - protein, 9 aa, Homo Sapiens
YIPYLHKAL

SEQ ID NO: 593155 - protein, 9 aa, Homo Sapiens
HSDELRTLG

SEQ ID NO: 593156 - protein, 9 aa, Homo Sapiens
KFDLMCAKR

SEQ ID NO: 593157 - protein, 9 aa, Homo Sapiens
FLAIFTLMG

SEQ ID NO: 593158 - protein, 9 aa, Homo Sapiens
KFHTVITEK

SEQ ID NO: 593159 - protein, 9 aa, Homo Sapiens
LIENICWSL

SEQ ID NO: 593160 - protein, 9 aa, Homo Sapiens
SSPSPPEET

SEQ ID NO: 593161 - protein, 9 aa, Homo Sapiens
AKSFEDLMD

SEQ ID NO: 593162 - protein, 9 aa, Homo Sapiens
YMVSRLISP

SEQ ID NO: 593163 - protein, 9 aa, Homo Sapiens
KPRISTVIG

SEQ ID NO: 593164 - protein, 9 aa, Homo Sapiens
IISGKYRNG

SEQ ID NO: 593165 - protein, 9 aa, Homo Sapiens
RGFEGESDE

SEQ ID NO: 593166 - protein, 9 aa, Homo Sapiens
AQPEYTVFM

SEQ ID NO: 593167 - protein, 9 aa, Homo Sapiens
SQIEKPRIS

SEQ ID NO: 593168 - protein, 9 aa, Homo Sapiens
RNGVPESSR

SEQ ID NO: 593169 - protein, 9 aa, Homo Sapiens
RALSAVIAT

SEQ ID NO: 593170 - protein, 9 aa, Homo Sapiens
SWLSKDVTQ

SEQ ID NO: 593171 - protein, 9 aa, Homo Sapiens
LMYKIFVKN

SEQ ID NO: 593172 - protein, 9 aa, Homo Sapiens
LKNYKLSPN

SEQ ID NO: 593173 - protein, 9 aa, Homo Sapiens
PKSPRSPKV

SEQ ID NO: 593174 - protein, 9 aa, Homo Sapiens
INSLKNYKL

SEQ ID NO: 593175 - protein, 9 aa, Homo Sapiens
PGPSPAGPP

SEQ ID NO: 593176 - protein, 9 aa, Homo Sapiens
LLQQPQQKV

SEQ ID NO: 593177 - protein, 9 aa, Homo Sapiens
LRKIRALEE

SEQ ID NO: 593178 - protein, 9 aa, Homo Sapiens
HNPSNGTWK

SEQ ID NO: 593179 - protein, 9 aa, Homo Sapiens
KSEEAVILQ

SEQ ID NO: 593180 - protein, 9 aa, Homo Sapiens
VQNSGCGPK

SEQ ID NO: 593181 - protein, 9 aa, Homo Sapiens
KIRALEEEN

SEQ ID NO: 593182 - protein, 9 aa, Homo Sapiens
SSIREGHCY

SEQ ID NO: 593183 - protein, 9 aa, Homo Sapiens
KRALAITGS

SEQ ID NO: 593184 - protein, 9 aa, Homo Sapiens
EGNDKYEGC

SEQ ID NO: 593185 - protein, 9 aa, Homo Sapiens
VKIVSTPQG

SEQ ID NO: 593186 - protein, 9 aa, Homo Sapiens
RLISPKPLA

SEQ ID NO: 593187 - protein, 9 aa, Homo Sapiens
FDLMCAKRA

SEQ ID NO: 593188 - protein, 9 aa, Homo Sapiens
LKGLLPTPR

SEQ ID NO: 593189 - protein, 9 aa, Homo Sapiens
WAALPATGS

SEQ ID NO: 593190 - protein, 9 aa, Homo Sapiens
CRRSHDFSN

SEQ ID NO: 593191 - protein, 9 aa, Homo Sapiens
IRALEEENA

SEQ ID NO: 593192 - protein, 9 aa, Homo Sapiens
ECERIVLLV

SEQ ID NO: 593193 - protein, 9 aa, Homo Sapiens
MWGMFSIIT

SEQ ID NO: 593194 - protein, 9 aa, Homo Sapiens
ERFMEEMKD

SEQ ID NO: 593195 - protein, 9 aa, Homo Sapiens
EQPSHQAAP

SEQ ID NO: 593196 - protein, 9 aa, Homo Sapiens
LMCAKRAFV

SEQ ID NO: 593197 - protein, 9 aa, Homo Sapiens
SPAGPPRAH

SEQ ID NO: 593198 - protein, 9 aa, Homo Sapiens
IITSYILFR

SEQ ID NO: 593199 - protein, 9 aa, Homo Sapiens
MSMGLVVVM

SEQ ID NO: 593200 - protein, 9 aa, Homo Sapiens
DKTYIPYLH

SEQ ID NO: 593201 - protein, 9 aa, Homo Sapiens
FEMRFAKLP

SEQ ID NO: 593202 - protein, 9 aa, Homo Sapiens
EARPPLGGA

SEQ ID NO: 593203 - protein, 9 aa, Homo Sapiens
GFNEIMECY

SEQ ID NO: 593204 - protein, 9 aa, Homo Sapiens
LSMSMGLVV

SEQ ID NO: 593205 - protein, 9 aa, Homo Sapiens
EPPQIIVNP

SEQ ID NO: 593206 - protein, 9 aa, Homo Sapiens
QQKVGLLQP

SEQ ID NO: 593207 - protein, 9 aa, Homo Sapiens
DEESGASQA

SEQ ID NO: 593208 - protein, 9 aa, Homo Sapiens
FNPSPQYSW

SEQ ID NO: 593209 - protein, 9 aa, Homo Sapiens
PEARPPLGG

SEQ ID NO: 593210 - protein, 9 aa, Homo Sapiens
ARFWLEMPE

SEQ ID NO: 593211 - protein, 9 aa, Homo Sapiens
LGQYTEADL

SEQ ID NO: 593212 - protein, 9 aa, Homo Sapiens
CLISALVRT

SEQ ID NO: 593213 - protein, 9 aa, Homo Sapiens
RRSQSHINC

SEQ ID NO: 593214 - protein, 9 aa, Homo Sapiens
MGLVVVMLG

SEQ ID NO: 593215 - protein, 9 aa, Homo Sapiens
AAKSFEDLM

SEQ ID NO: 593216 - protein, 9 aa, Homo Sapiens
THLSFASPF

SEQ ID NO: 593217 - protein, 9 aa, Homo Sapiens
QVTIIKLEQ

SEQ ID NO: 593218 - protein, 9 aa, Homo Sapiens
IREGHCYAE

SEQ ID NO: 593219 - protein, 9 aa, Homo Sapiens
LEEMAVSVG

SEQ ID NO: 593220 - protein, 9 aa, Homo Sapiens
KFENSMESL

SEQ ID NO: 593221 - protein, 9 aa, Homo Sapiens
CVSAFPAAP

SEQ ID NO: 593222 - protein, 9 aa, Homo Sapiens
CAAGAGTFK

SEQ ID NO: 593223 - protein, 9 aa, Homo Sapiens
TEYPVKIVS

SEQ ID NO: 593224 - protein, 9 aa, Homo Sapiens
IKLEQENCT

SEQ ID NO: 593225 - protein, 9 aa, Homo Sapiens
VITEKWGLN

SEQ ID NO: 593226 - protein, 9 aa, Homo Sapiens
KIVSTPQGC

SEQ ID NO: 593227 - protein, 9 aa, Homo Sapiens
CVCGHWPVL

SEQ ID NO: 593228 - protein, 9 aa, Homo Sapiens
LAVKFHTVI

SEQ ID NO: 593229 - protein, 9 aa, Homo Sapiens
SKLNMSNEE

SEQ ID NO: 593230 - protein, 9 aa, Homo Sapiens
TVITEKWGL

SEQ ID NO: 593231 - protein, 9 aa, Homo Sapiens
VSTPQGCLW

SEQ ID NO: 593232 - protein, 9 aa, Homo Sapiens
RDSRHRGYS

SEQ ID NO: 593233 - protein, 9 aa, Homo Sapiens
FACYYLANK

SEQ ID NO: 593234 - protein, 9 aa, Homo Sapiens
SFEDLMDHP

SEQ ID NO: 593235 - protein, 9 aa, Homo Sapiens
TVQNSGCGP

SEQ ID NO: 593236 - protein, 9 aa, Homo Sapiens
KPSMPTQRC

SEQ ID NO: 593237 - protein, 9 aa, Homo Sapiens
GAGTFKDFS

SEQ ID NO: 593238 - protein, 9 aa, Homo Sapiens
LSMWGMFSI

SEQ ID NO: 593239 - protein, 9 aa, Homo Sapiens
GCCVDLASE

SEQ ID NO: 593240 - protein, 9 aa, Homo Sapiens
LLRWQFPAN

SEQ ID NO: 593241 - protein, 9 aa, Homo Sapiens
QPSHQAAPG

SEQ ID NO: 593242 - protein, 9 aa, Homo Sapiens
NSLNRGNST

SEQ ID NO: 593243 - protein, 9 aa, Homo Sapiens
EEKADFAII

SEQ ID NO: 593244 - protein, 9 aa, Homo Sapiens
CRPPVRDIL

SEQ ID NO: 593245 - protein, 9 aa, Homo Sapiens
SPEFATVQQ

SEQ ID NO: 593246 - protein, 9 aa, Homo Sapiens
PDVGINSLK

SEQ ID NO: 593247 - protein, 9 aa, Homo Sapiens
FNEIMECYL

SEQ ID NO: 593248 - protein, 9 aa, Homo Sapiens
WLCKMCIEQ

SEQ ID NO: 593249 - protein, 9 aa, Homo Sapiens
KVQLPPSRR

SEQ ID NO: 593250 - protein, 9 aa, Homo Sapiens
RTVQNSGCG

SEQ ID NO: 593251 - protein, 9 aa, Homo Sapiens
VVMLGGAVQ

SEQ ID NO: 593252 - protein, 9 aa, Homo Sapiens
APKKLNHTP

SEQ ID NO: 593253 - protein, 9 aa, Homo Sapiens
GAALSTTFP

SEQ ID NO: 593254 - protein, 9 aa, Homo Sapiens
HTKPSMPTQ

SEQ ID NO: 593255 - protein, 9 aa, Homo Sapiens
KLAASLGLT

SEQ ID NO: 593256 - protein, 9 aa, Homo Sapiens
QFPANYRRL

SEQ ID NO: 593257 - protein, 9 aa, Homo Sapiens
VFEMRFAKL

SEQ ID NO: 593258 - protein, 9 aa, Homo Sapiens
MDACYSTVV

SEQ ID NO: 593259 - protein, 9 aa, Homo Sapiens
SWAALPATG

SEQ ID NO: 593260 - protein, 9 aa, Homo Sapiens
GPLAASEGC

SEQ ID NO: 593261 - protein, 9 aa, Homo Sapiens
VRDSRHRGY

SEQ ID NO: 593262 - protein, 9 aa, Homo Sapiens
GIISGKYRN

SEQ ID NO: 593263 - protein, 9 aa, Homo Sapiens
NGDSYQGTQ

SEQ ID NO: 593264 - protein, 9 aa, Homo Sapiens
RDVVGSDVA

SEQ ID NO: 593265 - protein, 9 aa, Homo Sapiens
SPEIRVHTK

SEQ ID NO: 593266 - protein, 9 aa, Homo Sapiens
EIMECYLPA

SEQ ID NO: 593267 - protein, 9 aa, Homo Sapiens
KRKVQLPPS

SEQ ID NO: 593268 - protein, 9 aa, Homo Sapiens
DERLYSGES

SEQ ID NO: 593269 - protein, 9 aa, Homo Sapiens
RSKSPKSPR

SEQ ID NO: 593270 - protein, 9 aa, Homo Sapiens
QGPLAASEG

SEQ ID NO: 593271 - protein, 9 aa, Homo Sapiens
RYGEEKEPP

SEQ ID NO: 593272 - protein, 9 aa, Homo Sapiens
SGGSTFAPP

SEQ ID NO: 593273 - protein, 9 aa, Homo Sapiens
VCGHWPVLR

SEQ ID NO: 593274 - protein, 9 aa, Homo Sapiens
PEQPDSCQP

SEQ ID NO: 593275 - protein, 9 aa, Homo Sapiens
RHVEVLADL

SEQ ID NO: 593276 - protein, 9 aa, Homo Sapiens
LELKGLLPT

SEQ ID NO: 593277 - protein, 9 aa, Homo Sapiens
MRFAKLPDE

SEQ ID NO: 593278 - protein, 9 aa, Homo Sapiens
CWSLMDRLG

SEQ ID NO: 593279 - protein, 9 aa, Homo Sapiens
PAKCVSAFP

SEQ ID NO: 593280 - protein, 9 aa, Homo Sapiens
QLVNMQNMR

SEQ ID NO: 593281 - protein, 9 aa, Homo Sapiens
LSKDVTQLL

SEQ ID NO: 593282 - protein, 9 aa, Homo Sapiens
PSPPEETPA

SEQ ID NO: 593283 - protein, 9 aa, Homo Sapiens
PPRGARRRN

SEQ ID NO: 593284 - protein, 9 aa, Homo Sapiens
PPSIGLRRS

SEQ ID NO: 593285 - protein, 9 aa, Homo Sapiens
FSIITSYIL

SEQ ID NO: 593286 - protein, 9 aa, Homo Sapiens
IIVNPARQK

SEQ ID NO: 593287 - protein, 9 aa, Homo Sapiens
WSLMDRLGY

SEQ ID NO: 593288 - protein, 9 aa, Homo Sapiens
EEAVILQCW

SEQ ID NO: 593289 - protein, 9 aa, Homo Sapiens
VQLPPSRRG

SEQ ID NO: 593290 - protein, 9 aa, Homo Sapiens
RISTVIGPN

SEQ ID NO: 593291 - protein, 9 aa, Homo Sapiens
LQQPGSLPA

SEQ ID NO: 593292 - protein, 9 aa, Homo Sapiens
SMGLVVVML

SEQ ID NO: 593293 - protein, 9 aa, Homo Sapiens
EESGASQAP

SEQ ID NO: 593294 - protein, 9 aa, Homo Sapiens
LTQNTHVPI

SEQ ID NO: 593295 - protein, 9 aa, Homo Sapiens
NNPKKAKKM

SEQ ID NO: 593296 - protein, 9 aa, Homo Sapiens
KDFSHIFLL

SEQ ID NO: 593297 - protein, 9 aa, Homo Sapiens
QGCGLEKCC

SEQ ID NO: 593298 - protein, 9 aa, Homo Sapiens
IMSWLSKDV

SEQ ID NO: 593299 - protein, 9 aa, Homo Sapiens
NVCLSRPVP

SEQ ID NO: 593300 - protein, 9 aa, Homo Sapiens
AKNRPPVSD

SEQ ID NO: 593301 - protein, 9 aa, Homo Sapiens
PVKIVSTPQ

SEQ ID NO: 593302 - protein, 9 aa, Homo Sapiens
TKPSMPTQR

SEQ ID NO: 593303 - protein, 9 aa, Homo Sapiens
DIQSPPSIG

SEQ ID NO: 593304 - protein, 9 aa, Homo Sapiens
RKRIGAYLP

SEQ ID NO: 593305 - protein, 9 aa, Homo Sapiens
RSSPSLRTP

SEQ ID NO: 593306 - protein, 9 aa, Homo Sapiens
SGSFLGQYT

SEQ ID NO: 593307 - protein, 9 aa, Homo Sapiens
KYRNGVPES

SEQ ID NO: 593308 - protein, 9 aa, Homo Sapiens
YSTPSSCPE

SEQ ID NO: 593309 - protein, 9 aa, Homo Sapiens
VNPARQKMV

SEQ ID NO: 593310 - protein, 9 aa, Homo Sapiens
KRWESAFQS

SEQ ID NO: 593311 - protein, 9 aa, Homo Sapiens
LSVLSFMDA

SEQ ID NO: 593312 - protein, 9 aa, Homo Sapiens
RLLQQPGSL

SEQ ID NO: 593313 - protein, 9 aa, Homo Sapiens
CFRSMDRGI

SEQ ID NO: 593314 - protein, 9 aa, Homo Sapiens
LSARRGFEG

SEQ ID NO: 593315 - protein, 9 aa, Homo Sapiens
RNNPKKAKK

SEQ ID NO: 593316 - protein, 9 aa, Homo Sapiens
GPLVKSEEA

SEQ ID NO: 593317 - protein, 9 aa, Homo Sapiens
SARSSPSLR

SEQ ID NO: 593318 - protein, 9 aa, Homo Sapiens
LPPSRRGEQ

SEQ ID NO: 593319 - protein, 9 aa, Homo Sapiens
IIKLEQENC

SEQ ID NO: 593320 - protein, 9 aa, Homo Sapiens
RKIRALEEE

SEQ ID NO: 593321 - protein, 9 aa, Homo Sapiens
STPRSNPSP

SEQ ID NO: 593322 - protein, 9 aa, Homo Sapiens
VSEALSLPV

SEQ ID NO: 593323 - protein, 9 aa, Homo Sapiens
WLEMPESVT

SEQ ID NO: 593324 - protein, 9 aa, Homo Sapiens
QAPKKLNHT

SEQ ID NO: 593325 - protein, 9 aa, Homo Sapiens
EEYKFYLHS

SEQ ID NO: 593326 - protein, 9 aa, Homo Sapiens
SLMDRLGYP

SEQ ID NO: 593327 - protein, 9 aa, Homo Sapiens
VKFHTVITE

SEQ ID NO: 593328 - protein, 9 aa, Homo Sapiens
RCRRVSEAL

SEQ ID NO: 593329 - protein, 9 aa, Homo Sapiens
AVIMTDLFT

SEQ ID NO: 593330 - protein, 9 aa, Homo Sapiens
CHSAFNPSP

SEQ ID NO: 593331 - protein, 9 aa, Homo Sapiens
WVVTGVLVC

SEQ ID NO: 593332 - protein, 9 aa, Homo Sapiens
HSVWLCKMC

SEQ ID NO: 593333 - protein, 9 aa, Homo Sapiens
TWKEWRESN

SEQ ID NO: 593334 - protein, 9 aa, Homo Sapiens
DECERIVLL

SEQ ID NO: 593335 - protein, 9 aa, Homo Sapiens
ARSSPSLRT

SEQ ID NO: 593336 - protein, 9 aa, Homo Sapiens
FENSMESLR

SEQ ID NO: 593337 - protein, 9 aa, Homo Sapiens
LDIQSPPSI

SEQ ID NO: 593338 - protein, 9 aa, Homo Sapiens
PVDGFSDLA

SEQ ID NO: 593339 - protein, 9 aa, Homo Sapiens
QSEEKADFA

SEQ ID NO: 593340 - protein, 9 aa, Homo Sapiens
ECYLPAEDS

SEQ ID NO: 593341 - protein, 9 aa, Homo Sapiens
AGTFKDFSH

SEQ ID NO: 593342 - protein, 9 aa, Homo Sapiens
GAGLAPGLP

SEQ ID NO: 593343 - protein, 9 aa, Homo Sapiens
PRGTGAGLA

SEQ ID NO: 593344 - protein, 9 aa, Homo Sapiens
LYMVSRLIS

SEQ ID NO: 593345 - protein, 9 aa, Homo Sapiens
GNERGAQQH

SEQ ID NO: 593346 - protein, 9 aa, Homo Sapiens
SKSPKSPRS

SEQ ID NO: 593347 - protein, 9 aa, Homo Sapiens
IAEVKVLGH

SEQ ID NO: 593348 - protein, 9 aa, Homo Sapiens
LMDHPVTRS

SEQ ID NO: 593349 - protein, 9 aa, Homo Sapiens
NGTWKEWRE

SEQ ID NO: 593350 - protein, 9 aa, Homo Sapiens
QLPPSRRGE

SEQ ID NO: 593351 - protein, 9 aa, Homo Sapiens
IPYLHKALL

SEQ ID NO: 593352 - protein, 9 aa, Homo Sapiens
LLLYMVSRL

SEQ ID NO: 593353 - protein, 9 aa, Homo Sapiens
VVVMLGGAV

SEQ ID NO: 593354 - protein, 9 aa, Homo Sapiens
KTEEVGDGR

SEQ ID NO: 593355 - protein, 9 aa, Homo Sapiens
SHHTAGGMT

SEQ ID NO: 593356 - protein, 9 aa, Homo Sapiens
SMSMGLVVV

SEQ ID NO: 593357 - protein, 9 aa, Homo Sapiens
LPHLKFACY

SEQ ID NO: 593358 - protein, 9 aa, Homo Sapiens
AAKNRPPVS

SEQ ID NO: 593359 - protein, 9 aa, Homo Sapiens
SYYDHVKIS

SEQ ID NO: 593360 - protein, 9 aa, Homo Sapiens
SRHRGYSGS

SEQ ID NO: 593361 - protein, 9 aa, Homo Sapiens
APVDGFSDL

SEQ ID NO: 593362 - protein, 9 aa, Homo Sapiens
PHNPSNGTW

SEQ ID NO: 593363 - protein, 9 aa, Homo Sapiens
YLAIAEVKV

SEQ ID NO: 593364 - protein, 9 aa, Homo Sapiens
KDKTYIPYL

SEQ ID NO: 593365 - protein, 9 aa, Homo Sapiens
IFTLMGNLG

SEQ ID NO: 593366 - protein, 9 aa, Homo Sapiens
FRKSLAELD

SEQ ID NO: 593367 - protein, 9 aa, Homo Sapiens
RREQEEREQ

SEQ ID NO: 593368 - protein, 9 aa, Homo Sapiens
ILAVKFHTV

SEQ ID NO: 593369 - protein, 9 aa, Homo Sapiens
GSARSSPSL

SEQ ID NO: 593370 - protein, 9 aa, Homo Sapiens
YAERFMEEM

SEQ ID NO: 593371 - protein, 9 aa, Homo Sapiens
RSMDRGIEN

SEQ ID NO: 593372 - protein, 9 aa, Homo Sapiens
PTQRCSHGM

SEQ ID NO: 593373 - protein, 9 aa, Homo Sapiens
ISGKYRNGV

SEQ ID NO: 593374 - protein, 9 aa, Homo Sapiens
QCAPNFHKM

SEQ ID NO: 593375 - protein, 9 aa, Homo Sapiens
TVEGAALST

SEQ ID NO: 593376 - protein, 9 aa, Homo Sapiens
GAYLPPLSL

SEQ ID NO: 593377 - protein, 9 aa, Homo Sapiens
LNMSNEEYK

SEQ ID NO: 593378 - protein, 9 aa, Homo Sapiens
TELLRKIRA

SEQ ID NO: 593379 - protein, 9 aa, Homo Sapiens
RPGPSPAGP

SEQ ID NO: 593380 - protein, 9 aa, Homo Sapiens
VYAVIMTDL

SEQ ID NO: 593381 - protein, 9 aa, Homo Sapiens
PLAASEGCL

SEQ ID NO: 593382 - protein, 9 aa, Homo Sapiens
LKFACYYLA

SEQ ID NO: 593383 - protein, 9 aa, Homo Sapiens
QKVGLLQPP

SEQ ID NO: 593384 - protein, 9 aa, Homo Sapiens
CRRNNPKKA

SEQ ID NO: 593385 - protein, 9 aa, Homo Sapiens
FWLEMPESV

SEQ ID NO: 593386 - protein, 9 aa, Homo Sapiens
VKFCQVRLG

SEQ ID NO: 593387 - protein, 9 aa, Homo Sapiens
LIAGEFRKS

SEQ ID NO: 593388 - protein, 9 aa, Homo Sapiens
NRPPVSDQK

SEQ ID NO: 593389 - protein, 9 aa, Homo Sapiens
PPQIIVNPA

SEQ ID NO: 593390 - protein, 9 aa, Homo Sapiens
SLRTPDVLE

SEQ ID NO: 593391 - protein, 9 aa, Homo Sapiens
PTSTQKFSC

SEQ ID NO: 593392 - protein, 9 aa, Homo Sapiens
LLLACCRPP

SEQ ID NO: 593393 - protein, 9 aa, Homo Sapiens
HVEVLADLF

SEQ ID NO: 593394 - protein, 9 aa, Homo Sapiens
YLSGGSSIR

SEQ ID NO: 593395 - protein, 9 aa, Homo Sapiens
TGVLVCLAC

SEQ ID NO: 593396 - protein, 9 aa, Homo Sapiens
VACLISALV

SEQ ID NO: 593397 - protein, 9 aa, Homo Sapiens
RSPKVTTHI

SEQ ID NO: 593398 - protein, 9 aa, Homo Sapiens
ELLRKIRAL

SEQ ID NO: 593399 - protein, 9 aa, Homo Sapiens
LNRGNSTPR

SEQ ID NO: 593400 - protein, 9 aa, Homo Sapiens
PLAAGRHVE

SEQ ID NO: 593401 - protein, 9 aa, Homo Sapiens
GCGLEKCCR

SEQ ID NO: 593402 - protein, 9 aa, Homo Sapiens
YQGTQVGAN

SEQ ID NO: 593403 - protein, 9 aa, Homo Sapiens
DYSGPPRGA

SEQ ID NO: 593404 - protein, 9 aa, Homo Sapiens
RGLEEMAVS

SEQ ID NO: 593405 - protein, 9 aa, Homo Sapiens
VLLFGDGVW

SEQ ID NO: 593406 - protein, 9 aa, Homo Sapiens
FGTSCRRSH

SEQ ID NO: 593407 - protein, 9 aa, Homo Sapiens
REQEEREQQ

SEQ ID NO: 593408 - protein, 9 aa, Homo Sapiens
FATVQQYNV

SEQ ID NO: 593409 - protein, 9 aa, Homo Sapiens
IGAYLPPLS

SEQ ID NO: 593410 - protein, 9 aa, Homo Sapiens
KFCQVRLGA

SEQ ID NO: 593411 - protein, 9 aa, Homo Sapiens
DGRVKRGPS

SEQ ID NO: 593412 - protein, 9 aa, Homo Sapiens
RGIENRMGT

SEQ ID NO: 593413 - protein, 9 aa, Homo Sapiens
LSFMDACYS

SEQ ID NO: 593414 - protein, 9 aa, Homo Sapiens
RAKLAASLG

SEQ ID NO: 593415 - protein, 9 aa, Homo Sapiens
VFCVAALTN

SEQ ID NO: 593416 - protein, 9 aa, Homo Sapiens
WQMLRAEEQ

SEQ ID NO: 593417 - protein, 9 aa, Homo Sapiens
TVFSSHHTA

SEQ ID NO: 593418 - protein, 9 aa, Homo Sapiens
VGDGRVKRG

SEQ ID NO: 593419 - protein, 9 aa, Homo Sapiens
CYLPAEDSV

SEQ ID NO: 593420 - protein, 9 aa, Homo Sapiens
SFASPFLPT

SEQ ID NO: 593421 - protein, 9 aa, Homo Sapiens
ANYRRLRHA

SEQ ID NO: 593422 - protein, 9 aa, Homo Sapiens
EQEEREQQL

SEQ ID NO: 593423 - protein, 9 aa, Homo Sapiens
FLFLAIFTL

SEQ ID NO: 593424 - protein, 9 aa, Homo Sapiens
AKLAASLGL

SEQ ID NO: 593425 - protein, 9 aa, Homo Sapiens
STVSSQKPP

SEQ ID NO: 593426 - protein, 9 aa, Homo Sapiens
PEFATVQQY

SEQ ID NO: 593427 - protein, 9 aa, Homo Sapiens
SYAAKVAPV

SEQ ID NO: 593428 - protein, 9 aa, Homo Sapiens
SHRDRLLQQ

SEQ ID NO: 593429 - protein, 9 aa, Homo Sapiens
FCQVRLGAA

SEQ ID NO: 593430 - protein, 9 aa, Homo Sapiens
CKMCIEQRE

SEQ ID NO: 593431 - protein, 9 aa, Homo Sapiens
YKIFVKNKK

SEQ ID NO: 593432 - protein, 9 aa, Homo Sapiens
PEYTVFMKE

SEQ ID NO: 593433 - protein, 9 aa, Homo Sapiens
ERALSAVIA

SEQ ID NO: 593434 - protein, 9 aa, Homo Sapiens
CKFGTSCRR

SEQ ID NO: 593435 - protein, 9 aa, Homo Sapiens
SSKLNMSNE

SEQ ID NO: 593436 - protein, 9 aa, Homo Sapiens
GLAPGLPGW

SEQ ID NO: 593437 - protein, 9 aa, Homo Sapiens
YAAKVAPVD

SEQ ID NO: 593438 - protein, 9 aa, Homo Sapiens
CGIISGKYR

SEQ ID NO: 593439 - protein, 9 aa, Homo Sapiens
PSIGLRRSG

SEQ ID NO: 593440 - protein, 9 aa, Homo Sapiens
AIAEVKVLG

SEQ ID NO: 593441 - protein, 9 aa, Homo Sapiens
AEVKVLGHP

SEQ ID NO: 593442 - protein, 9 aa, Homo Sapiens
RRNNPKKAK

SEQ ID NO: 593443 - protein, 9 aa, Homo Sapiens
PEWMNAKMK

SEQ ID NO: 593444 - protein, 9 aa, Homo Sapiens
LLFGDGVWL

SEQ ID NO: 593445 - protein, 9 aa, Homo Sapiens
TGSRPRGLQ

SEQ ID NO: 593446 - protein, 9 aa, Homo Sapiens
NSSQCAPNF

SEQ ID NO: 593447 - protein, 9 aa, Homo Sapiens
GMLTQNTHV

SEQ ID NO: 593448 - protein, 9 aa, Homo Sapiens
AAKVAPVDG

SEQ ID NO: 593449 - protein, 9 aa, Homo Sapiens
RPPVSDQKE

SEQ ID NO: 593450 - protein, 9 aa, Homo Sapiens
TGGAAVREV

SEQ ID NO: 593451 - protein, 9 aa, Homo Sapiens
QDARFWLEM

SEQ ID NO: 593452 - protein, 9 aa, Homo Sapiens
YAVIMTDLF

SEQ ID NO: 593453 - protein, 9 aa, Homo Sapiens
SCRRSHDFS

SEQ ID NO: 593454 - protein, 9 aa, Homo Sapiens
SGGSSIREG

SEQ ID NO: 593455 - protein, 9 aa, Homo Sapiens
TYIPYLHKA

SEQ ID NO: 593456 - protein, 9 aa, Homo Sapiens
GYLAIAEVK

SEQ ID NO: 593457 - protein, 9 aa, Homo Sapiens
WKEWRESNI

SEQ ID NO: 593458 - protein, 9 aa, Homo Sapiens
FLRCVCGHW

SEQ ID NO: 593459 - protein, 9 aa, Homo Sapiens
SMWGMFSII

SEQ ID NO: 593460 - protein, 9 aa, Homo Sapiens
RKRKVQLPP

SEQ ID NO: 593461 - protein, 9 aa, Homo Sapiens
QGTQVGANV

SEQ ID NO: 593462 - protein, 9 aa, Homo Sapiens
GTGAGLAPG

SEQ ID NO: 593463 - protein, 9 aa, Homo Sapiens
KMCIEQREV

SEQ ID NO: 593464 - protein, 9 aa, Homo Sapiens
MAVSVGVDG

SEQ ID NO: 593465 - protein, 9 aa, Homo Sapiens
GAEQDGGSH

SEQ ID NO: 593466 - protein, 9 aa, Homo Sapiens
DELRTLGNE

SEQ ID NO: 593467 - protein, 9 aa, Homo Sapiens
SYSQIEKPR

SEQ ID NO: 593468 - protein, 9 aa, Homo Sapiens
PEEETGGAA

SEQ ID NO: 593469 - protein, 9 aa, Homo Sapiens
SMDRGIENR

SEQ ID NO: 593470 - protein, 9 aa, Homo Sapiens
KSFEDLMDH

SEQ ID NO: 593471 - protein, 9 aa, Homo Sapiens
MFSIITSYI

SEQ ID NO: 593472 - protein, 9 aa, Homo Sapiens
MLTQNTHVP

SEQ ID NO: 593473 - protein, 9 aa, Homo Sapiens
RIWQMLRAE

SEQ ID NO: 593474 - protein, 9 aa, Homo Sapiens
ACYYLANKS

SEQ ID NO: 593475 - protein, 9 aa, Homo Sapiens
TQNTHVPIL

SEQ ID NO: 593476 - protein, 9 aa, Homo Sapiens
WGMFSIITS

SEQ ID NO: 593477 - protein, 9 aa, Homo Sapiens
ARRGFEGES

SEQ ID NO: 593478 - protein, 9 aa, Homo Sapiens
EALSLPVVF

SEQ ID NO: 593479 - protein, 9 aa, Homo Sapiens
DFDHNCIYL

SEQ ID NO: 593480 - protein, 9 aa, Homo Sapiens
LGSGGSTFA

SEQ ID NO: 593481 - protein, 9 aa, Homo Sapiens
TGEKPCKCG

SEQ ID NO: 593482 - protein, 9 aa, Homo Sapiens
RENRGLEEM

SEQ ID NO: 593483 - protein, 9 aa, Homo Sapiens
AIIPAEGIE

SEQ ID NO: 593484 - protein, 9 aa, Homo Sapiens
FCVAALTNV

SEQ ID NO: 593485 - protein, 9 aa, Homo Sapiens
SDVATILSR

SEQ ID NO: 593486 - protein, 9 aa, Homo Sapiens
ESHAQATLL

SEQ ID NO: 593487 - protein, 9 aa, Homo Sapiens
GRHGSASGQ

SEQ ID NO: 593488 - protein, 9 aa, Homo Sapiens
SSTEKAKDK

SEQ ID NO: 593489 - protein, 9 aa, Homo Sapiens
QLDFLRCVC

SEQ ID NO: 593490 - protein, 9 aa, Homo Sapiens
LNLSCHSAF

SEQ ID NO: 593491 - protein, 9 aa, Homo Sapiens
RKSLAELDE

SEQ ID NO: 593492 - protein, 9 aa, Homo Sapiens
TRRSQSHIN

SEQ ID NO: 593493 - protein, 9 aa, Homo Sapiens
TKDPEWMNA

SEQ ID NO: 593494 - protein, 9 aa, Homo Sapiens
SNEEYKFYL

SEQ ID NO: 593495 - protein, 9 aa, Homo Sapiens
AGAYVACLI

SEQ ID NO: 593496 - protein, 9 aa, Homo Sapiens
DPEWMNAKM

SEQ ID NO: 593497 - protein, 9 aa, Homo Sapiens
QNSGCGPKL

SEQ ID NO: 593498 - protein, 9 aa, Homo Sapiens
EELSARRGF

SEQ ID NO: 593499 - protein, 9 aa, Homo Sapiens
TPTVFSSHH

SEQ ID NO: 593500 - protein, 9 aa, Homo Sapiens
VGSDVATIL

SEQ ID NO: 593501 - protein, 9 aa, Homo Sapiens
RSEPCGLSD

SEQ ID NO: 593502 - protein, 9 aa, Homo Sapiens
VSRLISPKP

SEQ ID NO: 593503 - protein, 9 aa, Homo Sapiens
YGEEKEPPM

SEQ ID NO: 593504 - protein, 9 aa, Homo Sapiens
EGAALSTTF

SEQ ID NO: 593505 - protein, 9 aa, Homo Sapiens
HLKFACYYL

SEQ ID NO: 593506 - protein, 9 aa, Homo Sapiens
AALPATGSR

SEQ ID NO: 593507 - protein, 9 aa, Homo Sapiens
PQEAEQPSH

SEQ ID NO: 593508 - protein, 9 aa, Homo Sapiens
LHSVWLCKM

SEQ ID NO: 593509 - protein, 9 aa, Homo Sapiens
LLACCRPPV

SEQ ID NO: 593510 - protein, 9 aa, Homo Sapiens
NFHKMDGYS

SEQ ID NO: 593511 - protein, 9 aa, Homo Sapiens
QNWGPSPEF

SEQ ID NO: 593512 - protein, 9 aa, Homo Sapiens
VKSEEAVIL

SEQ ID NO: 593513 - protein, 9 aa, Homo Sapiens
SPRSPKVTT

SEQ ID NO: 593514 - protein, 9 aa, Homo Sapiens
GTQVGANVQ

SEQ ID NO: 593515 - protein, 9 aa, Homo Sapiens
CYSTPSSCP

SEQ ID NO: 593516 - protein, 9 aa, Homo Sapiens
RVHTKALSS

SEQ ID NO: 593517 - protein, 9 aa, Homo Sapiens
PLVKSEEAV

SEQ ID NO: 593518 - protein, 9 aa, Homo Sapiens
EREQQLRRE

SEQ ID NO: 593519 - protein, 9 aa, Homo Sapiens
RWQFPANYR

SEQ ID NO: 593520 - protein, 9 aa, Homo Sapiens
MSWLSKDVT

SEQ ID NO: 593521 - protein, 9 aa, Homo Sapiens
SQSHINCIR

SEQ ID NO: 593522 - protein, 9 aa, Homo Sapiens
VFMKENNPP

SEQ ID NO: 593523 - protein, 9 aa, Homo Sapiens
KIFVKNKKK

SEQ ID NO: 593524 - protein, 9 aa, Homo Sapiens
PNFHKMDGY

SEQ ID NO: 593525 - protein, 9 aa, Homo Sapiens
QIEKPRIST

SEQ ID NO: 593526 - protein, 9 aa, Homo Sapiens
RALAITGSS

SEQ ID NO: 593527 - protein, 9 aa, Homo Sapiens
GASQAPKKL

SEQ ID NO: 593528 - protein, 9 aa, Homo Sapiens
YLPPLSLEE

SEQ ID NO: 593529 - protein, 9 aa, Homo Sapiens
LLRKIRALE

SEQ ID NO: 593530 - protein, 9 aa, Homo Sapiens
HLSFASPFL

SEQ ID NO: 593531 - protein, 9 aa, Homo Sapiens
EMRFAKLPD

SEQ ID NO: 593532 - protein, 9 aa, Homo Sapiens
PSLRTPDVL

SEQ ID NO: 593533 - protein, 9 aa, Homo Sapiens
LAASEGCLP

SEQ ID NO: 593534 - protein, 9 aa, Homo Sapiens
CGPKLTSVH

SEQ ID NO: 593535 - protein, 9 aa, Homo Sapiens
RTLGNERGA

SEQ ID NO: 593536 - protein, 9 aa, Homo Sapiens
STVEGAALS

SEQ ID NO: 593537 - protein, 9 aa, Homo Sapiens
LGGAEQDGG

SEQ ID NO: 593538 - protein, 9 aa, Homo Sapiens
FLGQYTEAD

SEQ ID NO: 593539 - protein, 9 aa, Homo Sapiens
YSQIEKPRI

SEQ ID NO: 593540 - protein, 9 aa, Homo Sapiens
LPDEPEEPV

SEQ ID NO: 593541 - protein, 9 aa, Homo Sapiens
QGGDVEFFD

SEQ ID NO: 593542 - protein, 9 aa, Homo Sapiens
YQGGDVEFF

SEQ ID NO: 593543 - protein, 9 aa, Homo Sapiens
KPCKCGECG

SEQ ID NO: 593544 - protein, 9 aa, Homo Sapiens
DFAIIPAEG

SEQ ID NO: 593545 - protein, 9 aa, Homo Sapiens
LLQQPGSLP

SEQ ID NO: 593546 - protein, 9 aa, Homo Sapiens
DGGSHRDRL

SEQ ID NO: 593547 - protein, 9 aa, Homo Sapiens
GMEPEEETG

SEQ ID NO: 593548 - protein, 9 aa, Homo Sapiens
SSEPPQIIV

SEQ ID NO: 593549 - protein, 9 aa, Homo Sapiens
GDSYQGTQV

SEQ ID NO: 593550 - protein, 9 aa, Homo Sapiens
PRGARRRNC

SEQ ID NO: 593551 - protein, 9 aa, Homo Sapiens
LSGGSSIRE

SEQ ID NO: 593552 - protein, 9 aa, Homo Sapiens
EVGDGRVKR

SEQ ID NO: 593553 - protein, 9 aa, Homo Sapiens
RLGAAAQRQ

SEQ ID NO: 593554 - protein, 9 aa, Homo Sapiens
IVSTPQGCL

SEQ ID NO: 593555 - protein, 9 aa, Homo Sapiens
SVLSFMDAC

SEQ ID NO: 593556 - protein, 9 aa, Homo Sapiens
PRISTVIGP

SEQ ID NO: 593557 - protein, 9 aa, Homo Sapiens
VRKRIGAYL

SEQ ID NO: 593558 - protein, 9 aa, Homo Sapiens
SMESLRLFK

SEQ ID NO: 593559 - protein, 9 aa, Homo Sapiens
TTRRSQSHI

SEQ ID NO: 593560 - protein, 9 aa, Homo Sapiens
KLNMSNEEY

SEQ ID NO: 593561 - protein, 9 aa, Homo Sapiens
KDPEWMNAK

SEQ ID NO: 593562 - protein, 9 aa, Homo Sapiens
VEFFDLDDY

SEQ ID NO: 593563 - protein, 9 aa, Homo Sapiens
AAGRHVEVL

SEQ ID NO: 593564 - protein, 9 aa, Homo Sapiens
PSMPTQRCS

SEQ ID NO: 593565 - protein, 9 aa, Homo Sapiens
VGFFVFVLL

SEQ ID NO: 593566 - protein, 9 aa, Homo Sapiens
EEETGGAAV

SEQ ID NO: 593567 - protein, 9 aa, Homo Sapiens
VNQLVNMQN

SEQ ID NO: 593568 - protein, 9 aa, Homo Sapiens
QQPGSLPAP

SEQ ID NO: 593569 - protein, 9 aa, Homo Sapiens
PATGSRPRG

SEQ ID NO: 593570 - protein, 9 aa, Homo Sapiens
LLNTGSYYD

SEQ ID NO: 593571 - protein, 9 aa, Homo Sapiens
CGPTSTQKF

SEQ ID NO: 593572 - protein, 9 aa, Homo Sapiens
SCRRNNPKK

SEQ ID NO: 593573 - protein, 9 aa, Homo Sapiens
DSYQGTQVG

SEQ ID NO: 593574 - protein, 9 aa, Homo Sapiens
LGTGTDRSE

SEQ ID NO: 593575 - protein, 9 aa, Homo Sapiens
FEGESDEDS

SEQ ID NO: 593576 - protein, 9 aa, Homo Sapiens
SDELRTLGN

SEQ ID NO: 593577 - protein, 9 aa, Homo Sapiens
GFEGESDED

SEQ ID NO: 593578 - protein, 9 aa, Homo Sapiens
ASGQSSSYG

SEQ ID NO: 593579 - protein, 9 aa, Homo Sapiens
EPEEETGGA

SEQ ID NO: 593580 - protein, 9 aa, Homo Sapiens
SSPSLRTPD

SEQ ID NO: 593581 - protein, 9 aa, Homo Sapiens
IHFATHLSF

SEQ ID NO: 593582 - protein, 9 aa, Homo Sapiens
ELSARRGFE

SEQ ID NO: 593583 - protein, 9 aa, Homo Sapiens
RCVCGHWPV

SEQ ID NO: 593584 - protein, 9 aa, Homo Sapiens
DGEKTSTVS

SEQ ID NO: 593585 - protein, 9 aa, Homo Sapiens
SALAQGPLA

SEQ ID NO: 593586 - protein, 9 aa, Homo Sapiens
TSGSFLGQY

SEQ ID NO: 593587 - protein, 9 aa, Homo Sapiens
GLLPTPRGT

SEQ ID NO: 593588 - protein, 9 aa, Homo Sapiens
SPAKCVSAF

SEQ ID NO: 593589 - protein, 9 aa, Homo Sapiens
GRPGPSPAG

SEQ ID NO: 593590 - protein, 9 aa, Homo Sapiens
SFMDACYST

SEQ ID NO: 593591 - protein, 9 aa, Homo Sapiens
LAQDARFWL

SEQ ID NO: 593592 - protein, 9 aa, Homo Sapiens
KVGLLQPPV

SEQ ID NO: 593593 - protein, 9 aa, Homo Sapiens
PGWGPEARP

SEQ ID NO: 593594 - protein, 9 aa, Homo Sapiens
EDLMDHPVT

SEQ ID NO: 593595 - protein, 9 aa, Homo Sapiens
ACCRPPVRD

SEQ ID NO: 593596 - protein, 9 aa, Homo Sapiens
LVNMQNMRL

SEQ ID NO: 593597 - protein, 9 aa, Homo Sapiens
NRGNSTPRS

SEQ ID NO: 593598 - protein, 9 aa, Homo Sapiens
ALLSNDECE

SEQ ID NO: 593599 - protein, 9 aa, Homo Sapiens
RAPSPAKCV

SEQ ID NO: 593600 - protein, 9 aa, Homo Sapiens
RDRLLQQPG

SEQ ID NO: 593601 - protein, 9 aa, Homo Sapiens
KTSTVSSQK

SEQ ID NO: 593602 - protein, 9 aa, Homo Sapiens
PSPAGPPRA

SEQ ID NO: 593603 - protein, 9 aa, Homo Sapiens
AYVACLISA

SEQ ID NO: 593604 - protein, 9 aa, Homo Sapiens
APNFHKMDG

SEQ ID NO: 593605 - protein, 9 aa, Homo Sapiens
LAAGRHVEV

SEQ ID NO: 593606 - protein, 9 aa, Homo Sapiens
EKRDVVGSD

SEQ ID NO: 593607 - protein, 9 aa, Homo Sapiens
NDKYEGCCV

SEQ ID NO: 593608 - protein, 9 aa, Homo Sapiens
YEGCCVDLA

SEQ ID NO: 593609 - protein, 9 aa, Homo Sapiens
GAYVACLIS

SEQ ID NO: 593610 - protein, 9 aa, Homo Sapiens
DVGINSLKN

SEQ ID NO: 593611 - protein, 9 aa, Homo Sapiens
MECYLPAED

SEQ ID NO: 593612 - protein, 9 aa, Homo Sapiens
GINSLKNYK

SEQ ID NO: 593613 - protein, 9 aa, Homo Sapiens
ATHLSFASP

SEQ ID NO: 593614 - protein, 9 aa, Homo Sapiens
GTWKEWRES

SEQ ID NO: 593615 - protein, 9 aa, Homo Sapiens
EEMAVSVGV

SEQ ID NO: 593616 - protein, 9 aa, Homo Sapiens
CKCGECGKY

SEQ ID NO: 593617 - protein, 9 aa, Homo Sapiens
SLLGSGGST

SEQ ID NO: 593618 - protein, 9 aa, Homo Sapiens
MCIEQREVW

SEQ ID NO: 593619 - protein, 9 aa, Homo Sapiens
VLSEGSLRY

SEQ ID NO: 593620 - protein, 9 aa, Homo Sapiens
LTNVCLSRP

SEQ ID NO: 593621 - protein, 9 aa, Homo Sapiens
ERLHRIWQM

SEQ ID NO: 593622 - protein, 9 aa, Homo Sapiens
LFLAIFTLM

SEQ ID NO: 593623 - protein, 9 aa, Homo Sapiens
RGNSTPRSN

SEQ ID NO: 593624 - protein, 9 aa, Homo Sapiens
SEALSLPVV

SEQ ID NO: 593625 - protein, 9 aa, Homo Sapiens
SPVNQLVNM

SEQ ID NO: 593626 - protein, 9 aa, Homo Sapiens
MSNEEYKFY

SEQ ID NO: 593627 - protein, 9 aa, Homo Sapiens
TEEVGDGRV

SEQ ID NO: 593628 - protein, 9 aa, Homo Sapiens
STPQGCLWY

SEQ ID NO: 593629 - protein, 9 aa, Homo Sapiens
LSNDECERI

SEQ ID NO: 593630 - protein, 9 aa, Homo Sapiens
FMDACYSTV

SEQ ID NO: 593631 - protein, 9 aa, Homo Sapiens
PPQEAEQPS

SEQ ID NO: 593632 - protein, 9 aa, Homo Sapiens
GSSIREGHC

SEQ ID NO: 593633 - protein, 9 aa, Homo Sapiens
EFRKSLAEL

SEQ ID NO: 593634 - protein, 9 aa, Homo Sapiens
FNKDKTYIP

SEQ ID NO: 593635 - protein, 9 aa, Homo Sapiens
NRGLEEMAV

SEQ ID NO: 593636 - protein, 9 aa, Homo Sapiens
GESHAQATL

SEQ ID NO: 593637 - protein, 9 aa, Homo Sapiens
ACLISALVR

SEQ ID NO: 593638 - protein, 9 aa, Homo Sapiens
LRREQEERE

SEQ ID NO: 593639 - protein, 9 aa, Homo Sapiens
EKADFAIIP

SEQ ID NO: 593640 - protein, 9 aa, Homo Sapiens
FHKMDGYSC

SEQ ID NO: 593641 - protein, 9 aa, Homo Sapiens
FFFLFLAIF

SEQ ID NO: 593642 - protein, 9 aa, Homo Sapiens
YPPQEAEQP

SEQ ID NO: 593643 - protein, 9 aa, Homo Sapiens
RRSHDFSNS

SEQ ID NO: 593644 - protein, 9 aa, Homo Sapiens
EVYAPDLSC

SEQ ID NO: 593645 - protein, 9 aa, Homo Sapiens
GIIWNNFSI

SEQ ID NO: 593646 - protein, 9 aa, Homo Sapiens
QASFHELYN

SEQ ID NO: 593647 - protein, 9 aa, Homo Sapiens
KFLYVLERT

SEQ ID NO: 593648 - protein, 9 aa, Homo Sapiens
IGIIWNNFS

SEQ ID NO: 593649 - protein, 9 aa, Homo Sapiens
TGEALKISL

SEQ ID NO: 593650 - protein, 9 aa, Homo Sapiens
EKKYHQPPD

SEQ ID NO: 593651 - protein, 9 aa, Homo Sapiens
GYGTALTTA

SEQ ID NO: 593652 - protein, 9 aa, Homo Sapiens
YSDLYQMTA

SEQ ID NO: 593653 - protein, 9 aa, Homo Sapiens
ELPGIPREH

SEQ ID NO: 593654 - protein, 9 aa, Homo Sapiens
YLLNLGTFL

SEQ ID NO: 593655 - protein, 9 aa, Homo Sapiens
NIIVNFIGI

SEQ ID NO: 593656 - protein, 9 aa, Homo Sapiens
NVVDNGLRK

SEQ ID NO: 593657 - protein, 9 aa, Homo Sapiens
YPSQASFHE

SEQ ID NO: 593658 - protein, 9 aa, Homo Sapiens
LEITEKWES

SEQ ID NO: 593659 - protein, 9 aa, Homo Sapiens
CHVLAKPAH

SEQ ID NO: 593660 - protein, 9 aa, Homo Sapiens
KAVIQILTH

SEQ ID NO: 593661 - protein, 9 aa, Homo Sapiens
ATELERLAL

SEQ ID NO: 593662 - protein, 9 aa, Homo Sapiens
SKLHFCDSN

SEQ ID NO: 593663 - protein, 9 aa, Homo Sapiens
NTNSKKQWQ

SEQ ID NO: 593664 - protein, 9 aa, Homo Sapiens
TMGSDTTTA

SEQ ID NO: 593665 - protein, 9 aa, Homo Sapiens
TTSDMSIKD

SEQ ID NO: 593666 - protein, 9 aa, Homo Sapiens
QGQEEKMRG

SEQ ID NO: 593667 - protein, 9 aa, Homo Sapiens
TTVTTMGSD

SEQ ID NO: 593668 - protein, 9 aa, Homo Sapiens
QNRWDAEAW

SEQ ID NO: 593669 - protein, 9 aa, Homo Sapiens
KPLSRQVDT

SEQ ID NO: 593670 - protein, 9 aa, Homo Sapiens
ISINNRYTG

SEQ ID NO: 593671 - protein, 9 aa, Homo Sapiens
NGTDSACHV

SEQ ID NO: 593672 - protein, 9 aa, Homo Sapiens
QTEQNISIR

SEQ ID NO: 593673 - protein, 9 aa, Homo Sapiens
WDAEAWFNE

SEQ ID NO: 593674 - protein, 9 aa, Homo Sapiens
SFELRPQCA

SEQ ID NO: 593675 - protein, 9 aa, Homo Sapiens
NNFSIGKLR

SEQ ID NO: 593676 - protein, 9 aa, Homo Sapiens
FLIQRKNGS

SEQ ID NO: 593677 - protein, 9 aa, Homo Sapiens
PGIPREHVK

SEQ ID NO: 593678 - protein, 9 aa, Homo Sapiens
HKAEELFSE

SEQ ID NO: 593679 - protein, 9 aa, Homo Sapiens
QPSYSDLYQ

SEQ ID NO: 593680 - protein, 9 aa, Homo Sapiens
LKISLSESG

SEQ ID NO: 593681 - protein, 9 aa, Homo Sapiens
PKPCPPPKC

SEQ ID NO: 593682 - protein, 9 aa, Homo Sapiens
PRKAVIQIL

SEQ ID NO: 593683 - protein, 9 aa, Homo Sapiens
EPSVYQSST

SEQ ID NO: 593684 - protein, 9 aa, Homo Sapiens
MGYLGSIEL

SEQ ID NO: 593685 - protein, 9 aa, Homo Sapiens
KMYCKDCPQ

SEQ ID NO: 593686 - protein, 9 aa, Homo Sapiens
MPTYGQLDG

SEQ ID NO: 593687 - protein, 9 aa, Homo Sapiens
LAEQNRWDA

SEQ ID NO: 593688 - protein, 9 aa, Homo Sapiens
KWTHQQPSY

SEQ ID NO: 593689 - protein, 9 aa, Homo Sapiens
PSYSDLYQM

SEQ ID NO: 593690 - protein, 9 aa, Homo Sapiens
SITSQSGSG

SEQ ID NO: 593691 - protein, 9 aa, Homo Sapiens
CGKVGKKNI

SEQ ID NO: 593692 - protein, 9 aa, Homo Sapiens
VNFIGIIWN

SEQ ID NO: 593693 - protein, 9 aa, Homo Sapiens
KNGSNIIVN

SEQ ID NO: 593694 - protein, 9 aa, Homo Sapiens
EMQVQTDSY

SEQ ID NO: 593695 - protein, 9 aa, Homo Sapiens
NSRTINVVD

SEQ ID NO: 593696 - protein, 9 aa, Homo Sapiens
NLGTFLIQR

SEQ ID NO: 593697 - protein, 9 aa, Homo Sapiens
DTGEALKIS

SEQ ID NO: 593698 - protein, 9 aa, Homo Sapiens
PPYKEPSVY

SEQ ID NO: 593699 - protein, 9 aa, Homo Sapiens
NIARNERDA

SEQ ID NO: 593700 - protein, 9 aa, Homo Sapiens
NRYTGKANA

SEQ ID NO: 593701 - protein, 9 aa, Homo Sapiens
LDPELPGIP

SEQ ID NO: 593702 - protein, 9 aa, Homo Sapiens
IVLDPTCTI

SEQ ID NO: 593703 - protein, 9 aa, Homo Sapiens
ANGTDSACH

SEQ ID NO: 593704 - protein, 9 aa, Homo Sapiens
KAEELFSET

SEQ ID NO: 593705 - protein, 9 aa, Homo Sapiens
QSGSGLVSL

SEQ ID NO: 593706 - protein, 9 aa, Homo Sapiens
IIVNFIGII

SEQ ID NO: 593707 - protein, 9 aa, Homo Sapiens
HQPPDRNKF

SEQ ID NO: 593708 - protein, 9 aa, Homo Sapiens
YSSPTTSDM

SEQ ID NO: 593709 - protein, 9 aa, Homo Sapiens
SSKCRKMYC

SEQ ID NO: 593710 - protein, 9 aa, Homo Sapiens
GKVGKKNIR

SEQ ID NO: 593711 - protein, 9 aa, Homo Sapiens
IVNVVCKVT

SEQ ID NO: 593712 - protein, 9 aa, Homo Sapiens
DVEMQVQTD

SEQ ID NO: 593713 - protein, 9 aa, Homo Sapiens
INVVDNGLR

SEQ ID NO: 593714 - protein, 9 aa, Homo Sapiens
KHYLLNLGT

SEQ ID NO: 593715 - protein, 9 aa, Homo Sapiens
EAAEASSVE

SEQ ID NO: 593716 - protein, 9 aa, Homo Sapiens
ETTLILHRK

SEQ ID NO: 593717 - protein, 9 aa, Homo Sapiens
ELVSSLCQR

SEQ ID NO: 593718 - protein, 9 aa, Homo Sapiens
CWLCGKNTN

SEQ ID NO: 593719 - protein, 9 aa, Homo Sapiens
TTEAAEASS

SEQ ID NO: 593720 - protein, 9 aa, Homo Sapiens
GKNTNSKKQ

SEQ ID NO: 593721 - protein, 9 aa, Homo Sapiens
LKLAGWQCP

SEQ ID NO: 593722 - protein, 9 aa, Homo Sapiens
QNISIRIQK

SEQ ID NO: 593723 - protein, 9 aa, Homo Sapiens
GQWRGYGTA

SEQ ID NO: 593724 - protein, 9 aa, Homo Sapiens
KKYHQPPDR

SEQ ID NO: 593725 - protein, 9 aa, Homo Sapiens
SGLVSLALP

SEQ ID NO: 593726 - protein, 9 aa, Homo Sapiens
GSGLVSLAL

SEQ ID NO: 593727 - protein, 9 aa, Homo Sapiens
RTINVVDNG

SEQ ID NO: 593728 - protein, 9 aa, Homo Sapiens
PYKEPSVYQ

SEQ ID NO: 593729 - protein, 9 aa, Homo Sapiens
HSMPTYGQL

SEQ ID NO: 593730 - protein, 9 aa, Homo Sapiens
KYHQPPDRN

SEQ ID NO: 593731 - protein, 9 aa, Homo Sapiens
TDSACHVLA

SEQ ID NO: 593732 - protein, 9 aa, Homo Sapiens
SMPTYGQLD

SEQ ID NO: 593733 - protein, 9 aa, Homo Sapiens
DLQSLAEVY

SEQ ID NO: 593734 - protein, 9 aa, Homo Sapiens
ALDIVLDPT

SEQ ID NO: 593735 - protein, 9 aa, Homo Sapiens
RNERDAYAI

SEQ ID NO: 593736 - protein, 9 aa, Homo Sapiens
CPKPCPPPK

SEQ ID NO: 593737 - protein, 9 aa, Homo Sapiens
IISEKKYHQ

SEQ ID NO: 593738 - protein, 9 aa, Homo Sapiens
RLRDGREMP

SEQ ID NO: 593739 - protein, 9 aa, Homo Sapiens
TVTTMGSDT

SEQ ID NO: 593740 - protein, 9 aa, Homo Sapiens
VYAPDLSCL

SEQ ID NO: 593741 - protein, 9 aa, Homo Sapiens
SLRKPRSSQ

SEQ ID NO: 593742 - protein, 9 aa, Homo Sapiens
SACHVLAKP

SEQ ID NO: 593743 - protein, 9 aa, Homo Sapiens
PDATLSPTT

SEQ ID NO: 593744 - protein, 9 aa, Homo Sapiens
NFSFQVEAR

SEQ ID NO: 593745 - protein, 9 aa, Homo Sapiens
SAETTLILH

SEQ ID NO: 593746 - protein, 9 aa, Homo Sapiens
DNSRTINVV

SEQ ID NO: 593747 - protein, 9 aa, Homo Sapiens
ALDPELPGI

SEQ ID NO: 593748 - protein, 9 aa, Homo Sapiens
NTILHHLGR

SEQ ID NO: 593749 - protein, 9 aa, Homo Sapiens
PSAETTLIL

SEQ ID NO: 593750 - protein, 9 aa, Homo Sapiens
SPTTTTSSG

SEQ ID NO: 593751 - protein, 9 aa, Homo Sapiens
DMLQSEVFF

SEQ ID NO: 593752 - protein, 9 aa, Homo Sapiens
VGLLMPRKA

SEQ ID NO: 593753 - protein, 9 aa, Homo Sapiens
LCGKNTNSK

SEQ ID NO: 593754 - protein, 9 aa, Homo Sapiens
EIQAKFLYV

SEQ ID NO: 593755 - protein, 9 aa, Homo Sapiens
KNFSFQVEA

SEQ ID NO: 593756 - protein, 9 aa, Homo Sapiens
LMQGGYPSQ

SEQ ID NO: 593757 - protein, 9 aa, Homo Sapiens
PDMLQSEVF

SEQ ID NO: 593758 - protein, 9 aa, Homo Sapiens
HGHTQGGSY

SEQ ID NO: 593759 - protein, 9 aa, Homo Sapiens
RWDAEAWFN

SEQ ID NO: 593760 - protein, 9 aa, Homo Sapiens
NVAMIMGYL

SEQ ID NO: 593761 - protein, 9 aa, Homo Sapiens
GEALKISLS

SEQ ID NO: 593762 - protein, 9 aa, Homo Sapiens
YDVEMQVQT

SEQ ID NO: 593763 - protein, 9 aa, Homo Sapiens
GWGQWRGYG

SEQ ID NO: 593764 - protein, 9 aa, Homo Sapiens
QTDSYVINS

SEQ ID NO: 593765 - protein, 9 aa, Homo Sapiens
PKPLSRQVD

SEQ ID NO: 593766 - protein, 9 aa, Homo Sapiens
INNRYTGKA

SEQ ID NO: 593767 - protein, 9 aa, Homo Sapiens
QNDLDQDPR

SEQ ID NO: 593768 - protein, 9 aa, Homo Sapiens
IGMNMEEDY

SEQ ID NO: 593769 - protein, 9 aa, Homo Sapiens
EQNISIRIQ

SEQ ID NO: 593770 - protein, 9 aa, Homo Sapiens
VNVVWMSKL

SEQ ID NO: 593771 - protein, 9 aa, Homo Sapiens
IGFMGNLLI

SEQ ID NO: 593772 - protein, 9 aa, Homo Sapiens
TLPSAETTL

SEQ ID NO: 593773 - protein, 9 aa, Homo Sapiens
RSPLQNDLD

SEQ ID NO: 593774 - protein, 9 aa, Homo Sapiens
TQGGSYSSV

SEQ ID NO: 593775 - protein, 9 aa, Homo Sapiens
LKQKLMTRT

SEQ ID NO: 593776 - protein, 9 aa, Homo Sapiens
VQTDSYVIN

SEQ ID NO: 593777 - protein, 9 aa, Homo Sapiens
QKLMTRTMK

SEQ ID NO: 593778 - protein, 9 aa, Homo Sapiens
PRSSQHGGS

SEQ ID NO: 593779 - protein, 9 aa, Homo Sapiens
MDTGEALKI

SEQ ID NO: 593780 - protein, 9 aa, Homo Sapiens
KNTNSKKQW

SEQ ID NO: 593781 - protein, 9 aa, Homo Sapiens
SKCRKMYCK

SEQ ID NO: 593782 - protein, 9 aa, Homo Sapiens
RKLISINNR

SEQ ID NO: 593783 - protein, 9 aa, Homo Sapiens
AEELFSETT

SEQ ID NO: 593784 - protein, 9 aa, Homo Sapiens
HSLHSMPTY

SEQ ID NO: 593785 - protein, 9 aa, Homo Sapiens
RKPRSSQHG

SEQ ID NO: 593786 - protein, 9 aa, Homo Sapiens
PSQASFHEL

SEQ ID NO: 593787 - protein, 9 aa, Homo Sapiens
GHTQGGSYS

SEQ ID NO: 593788 - protein, 9 aa, Homo Sapiens
MGSDTTTAS

SEQ ID NO: 593789 - protein, 9 aa, Homo Sapiens
LRKPRSSQH

SEQ ID NO: 593790 - protein, 9 aa, Homo Sapiens
LHSMPTYGQ

SEQ ID NO: 593791 - protein, 9 aa, Homo Sapiens
MNMEEDYCG

SEQ ID NO: 593792 - protein, 9 aa, Homo Sapiens
MEEDYCGKV

SEQ ID NO: 593793 - protein, 9 aa, Homo Sapiens
FRVQELAHD

SEQ ID NO: 593794 - protein, 9 aa, Homo Sapiens
PLQNDLDQD

SEQ ID NO: 593795 - protein, 9 aa, Homo Sapiens
VSLIGFMGN

SEQ ID NO: 593796 - protein, 9 aa, Homo Sapiens
QILTHLKQK

SEQ ID NO: 593797 - protein, 9 aa, Homo Sapiens
ISIRIQKLL

SEQ ID NO: 593798 - protein, 9 aa, Homo Sapiens
YAPDLSCLL

SEQ ID NO: 593799 - protein, 9 aa, Homo Sapiens
VKHYLLNLG

SEQ ID NO: 593800 - protein, 9 aa, Homo Sapiens
SILNVAMIM

SEQ ID NO: 593801 - protein, 9 aa, Homo Sapiens
KQTEQNISI

SEQ ID NO: 593802 - protein, 9 aa, Homo Sapiens
SIGKLRVGL

SEQ ID NO: 593803 - protein, 9 aa, Homo Sapiens
ILHHLGRTL

SEQ ID NO: 593804 - protein, 9 aa, Homo Sapiens
ETTNNEVDD

SEQ ID NO: 593805 - protein, 9 aa, Homo Sapiens
QEQEEKMWR

SEQ ID NO: 593806 - protein, 9 aa, Homo Sapiens
YTFVSLIGF

SEQ ID NO: 593807 - protein, 9 aa, Homo Sapiens
DGREMPHSC

SEQ ID NO: 593808 - protein, 9 aa, Homo Sapiens
IMGYLGSIE

SEQ ID NO: 593809 - protein, 9 aa, Homo Sapiens
RDAYAINSY

SEQ ID NO: 593810 - protein, 9 aa, Homo Sapiens
LHHLGRTLG

SEQ ID NO: 593811 - protein, 9 aa, Homo Sapiens
CRKMYCKDC

SEQ ID NO: 593812 - protein, 9 aa, Homo Sapiens
NGSNIIVNF

SEQ ID NO: 593813 - protein, 9 aa, Homo Sapiens
SVYQSSTRS

SEQ ID NO: 593814 - protein, 9 aa, Homo Sapiens
YCGKVGKKN

SEQ ID NO: 593815 - protein, 9 aa, Homo Sapiens
TSPGSLRKP

SEQ ID NO: 593816 - protein, 9 aa, Homo Sapiens
VVCKVTRPL

SEQ ID NO: 593817 - protein, 9 aa, Homo Sapiens
TLSPTTTTS

SEQ ID NO: 593818 - protein, 9 aa, Homo Sapiens
FSETTNNEV

SEQ ID NO: 593819 - protein, 9 aa, Homo Sapiens
SVEAGSEVS

SEQ ID NO: 593820 - protein, 9 aa, Homo Sapiens
DPELPGIPR

SEQ ID NO: 593821 - protein, 9 aa, Homo Sapiens
TGKATELER

SEQ ID NO: 593822 - protein, 9 aa, Homo Sapiens
RKNGSNIIV

SEQ ID NO: 593823 - protein, 9 aa, Homo Sapiens
KWESIGMNM

SEQ ID NO: 593824 - protein, 9 aa, Homo Sapiens
PGSLRKPRS

SEQ ID NO: 593825 - protein, 9 aa, Homo Sapiens
KLMTRTMKN

SEQ ID NO: 593826 - protein, 9 aa, Homo Sapiens
MPHSCRRYR

SEQ ID NO: 593827 - protein, 9 aa, Homo Sapiens
TPLKLAGWQ

SEQ ID NO: 593828 - protein, 9 aa, Homo Sapiens
ALKISLSES

SEQ ID NO: 593829 - protein, 9 aa, Homo Sapiens
FFRVQELAH

SEQ ID NO: 593830 - protein, 9 aa, Homo Sapiens
EALAEQNRW

SEQ ID NO: 593831 - protein, 9 aa, Homo Sapiens
TTLILHRKG

SEQ ID NO: 593832 - protein, 9 aa, Homo Sapiens
LLMPRKAVI

SEQ ID NO: 593833 - protein, 9 aa, Homo Sapiens
YHQPPDRNK

SEQ ID NO: 593834 - protein, 9 aa, Homo Sapiens
WMSKLHFCD

SEQ ID NO: 593835 - protein, 9 aa, Homo Sapiens
EQNRWDAEA

SEQ ID NO: 593836 - protein, 9 aa, Homo Sapiens
EQLKNFSFQ

SEQ ID NO: 593837 - protein, 9 aa, Homo Sapiens
GREMPHSCR

SEQ ID NO: 593838 - protein, 9 aa, Homo Sapiens
TFVSLIGFM

SEQ ID NO: 593839 - protein, 9 aa, Homo Sapiens
LRLRDGREM

SEQ ID NO: 593840 - protein, 9 aa, Homo Sapiens
GLYTFVSLI

SEQ ID NO: 593841 - protein, 9 aa, Homo Sapiens
FVSLIGFMG

SEQ ID NO: 593842 - protein, 9 aa, Homo Sapiens
HQQPSYSDL

SEQ ID NO: 593843 - protein, 9 aa, Homo Sapiens
GQEEKMRGQ

SEQ ID NO: 593844 - protein, 9 aa, Homo Sapiens
AVIQILTHL

SEQ ID NO: 593845 - protein, 9 aa, Homo Sapiens
QLKNFSFQV

SEQ ID NO: 593846 - protein, 9 aa, Homo Sapiens
HHLGRTLGL

SEQ ID NO: 593847 - protein, 9 aa, Homo Sapiens
VAMIMGYLG

SEQ ID NO: 593848 - protein, 9 aa, Homo Sapiens
DTTTASTAG

SEQ ID NO: 593849 - protein, 9 aa, Homo Sapiens
CARETYPFR

SEQ ID NO: 593850 - protein, 9 aa, Homo Sapiens
SLAEVYAPD

SEQ ID NO: 593851 - protein, 9 aa, Homo Sapiens
ITSQSGSGL

SEQ ID NO: 593852 - protein, 9 aa, Homo Sapiens
IARNERDAY

SEQ ID NO: 593853 - protein, 9 aa, Homo Sapiens
ELRPQCARE

SEQ ID NO: 593854 - protein, 9 aa, Homo Sapiens
GKLRVGLLM

SEQ ID NO: 593855 - protein, 9 aa, Homo Sapiens
GEKRSPLQN

SEQ ID NO: 593856 - protein, 9 aa, Homo Sapiens
SHGHTQGGS

SEQ ID NO: 593857 - protein, 9 aa, Homo Sapiens
KEPSVYQSS

SEQ ID NO: 593858 - protein, 9 aa, Homo Sapiens
DSSIPWFFR

SEQ ID NO: 593859 - protein, 9 aa, Homo Sapiens
RDGREMPHS

SEQ ID NO: 593860 - protein, 9 aa, Homo Sapiens
AMIMGYLGS

SEQ ID NO: 593861 - protein, 9 aa, Homo Sapiens
QVQTDSYVI

SEQ ID NO: 593862 - protein, 9 aa, Homo Sapiens
VVWMSKLHF

SEQ ID NO: 593863 - protein, 9 aa, Homo Sapiens
LVSSLCQRI

SEQ ID NO: 593864 - protein, 9 aa, Homo Sapiens
RISKALDIV

SEQ ID NO: 593865 - protein, 9 aa, Homo Sapiens
EELFSETTN

SEQ ID NO: 593866 - protein, 9 aa, Homo Sapiens
SSIPWFFRV

SEQ ID NO: 593867 - protein, 9 aa, Homo Sapiens
SDMSIKDSP

SEQ ID NO: 593868 - protein, 9 aa, Homo Sapiens
MSKLHFCDS

SEQ ID NO: 593869 - protein, 9 aa, Homo Sapiens
MQGGYPSQA

SEQ ID NO: 593870 - protein, 9 aa, Homo Sapiens
TLALDPELP

SEQ ID NO: 593871 - protein, 9 aa, Homo Sapiens
LGFVSVGYV

SEQ ID NO: 593872 - protein, 9 aa, Homo Sapiens
SGSGLVSLA

SEQ ID NO: 593873 - protein, 9 aa, Homo Sapiens
PTTSDMSIK

SEQ ID NO: 593874 - protein, 9 aa, Homo Sapiens
QRKNGSNII

SEQ ID NO: 593875 - protein, 9 aa, Homo Sapiens
SPTTSDMSI

SEQ ID NO: 593876 - protein, 9 aa, Homo Sapiens
LPSAETTLI

SEQ ID NO: 593877 - protein, 9 aa, Homo Sapiens
PPKCPKPCP

SEQ ID NO: 593878 - protein, 9 aa, Homo Sapiens
PTYGQLDGT

SEQ ID NO: 593879 - protein, 9 aa, Homo Sapiens
ERDAYAINS

SEQ ID NO: 593880 - protein, 9 aa, Homo Sapiens
SQSGSGLVS

SEQ ID NO: 593881 - protein, 9 aa, Homo Sapiens
TSDMSIKDS

SEQ ID NO: 593882 - protein, 9 aa, Homo Sapiens
PLKLAGWQC

SEQ ID NO: 593883 - protein, 9 aa, Homo Sapiens
TEAAEASSV

SEQ ID NO: 593884 - protein, 9 aa, Homo Sapiens
WESIGMNME

SEQ ID NO: 593885 - protein, 9 aa, Homo Sapiens
LFSETTNNE

SEQ ID NO: 593886 - protein, 9 aa, Homo Sapiens
SIGMNMEED

SEQ ID NO: 593887 - protein, 9 aa, Homo Sapiens
EIISEKKYH

SEQ ID NO: 593888 - protein, 9 aa, Homo Sapiens
SINNRYTGK

SEQ ID NO: 593889 - protein, 9 aa, Homo Sapiens
SEVFFSVGG

SEQ ID NO: 593890 - protein, 9 aa, Homo Sapiens
SYSSVGSGG

SEQ ID NO: 593891 - protein, 9 aa, Homo Sapiens
RGYGTALTT

SEQ ID NO: 593892 - protein, 9 aa, Homo Sapiens
VGKKNIRVK

SEQ ID NO: 593893 - protein, 9 aa, Homo Sapiens
LYTFVSLIG

SEQ ID NO: 593894 - protein, 9 aa, Homo Sapiens
KLHFCDSNV

SEQ ID NO: 593895 - protein, 9 aa, Homo Sapiens
HRKLISINN

SEQ ID NO: 593896 - protein, 9 aa, Homo Sapiens
KRSPLQNDL

SEQ ID NO: 593897 - protein, 9 aa, Homo Sapiens
FIGIIWNNF

SEQ ID NO: 593898 - protein, 9 aa, Homo Sapiens
TTTTSSGVS

SEQ ID NO: 593899 - protein, 9 aa, Homo Sapiens
VTPLKLAGW

SEQ ID NO: 593900 - protein, 9 aa, Homo Sapiens
YGQLDGTYP

SEQ ID NO: 593901 - protein, 9 aa, Homo Sapiens
LLNLGTFLI

SEQ ID NO: 593902 - protein, 9 aa, Homo Sapiens
NVVWMSKLH

SEQ ID NO: 593903 - protein, 9 aa, Homo Sapiens
FELVSSLCQ

SEQ ID NO: 593904 - protein, 9 aa, Homo Sapiens
LSPTTTTSS

SEQ ID NO: 593905 - protein, 9 aa, Homo Sapiens
LNIARNERD

SEQ ID NO: 593906 - protein, 9 aa, Homo Sapiens
IGKLRVGLL

SEQ ID NO: 593907 - protein, 9 aa, Homo Sapiens
SAYFELVSS

SEQ ID NO: 593908 - protein, 9 aa, Homo Sapiens
SIPWFFRVQ

SEQ ID NO: 593909 - protein, 9 aa, Homo Sapiens
FSITSQSGS

SEQ ID NO: 593910 - protein, 9 aa, Homo Sapiens
AKFLYVLER

SEQ ID NO: 593911 - protein, 9 aa, Homo Sapiens
NISIRIQKL

SEQ ID NO: 593912 - protein, 9 aa, Homo Sapiens
PQCARETYP

SEQ ID NO: 593913 - protein, 9 aa, Homo Sapiens
ATGKATELE

SEQ ID NO: 593914 - protein, 9 aa, Homo Sapiens
TFLIQRKNG

SEQ ID NO: 593915 - protein, 9 aa, Homo Sapiens
KKNIRVKHY

SEQ ID NO: 593916 - protein, 9 aa, Homo Sapiens
PLSRQVDTV

SEQ ID NO: 593917 - protein, 9 aa, Homo Sapiens
NIVNVVCKV

SEQ ID NO: 593918 - protein, 9 aa, Homo Sapiens
YQSNTILHH

SEQ ID NO: 593919 - protein, 9 aa, Homo Sapiens
ISKALDIVL

SEQ ID NO: 593920 - protein, 9 aa, Homo Sapiens
HDNSRTINV

SEQ ID NO: 593921 - protein, 9 aa, Homo Sapiens
QWRGYGTAL

SEQ ID NO: 593922 - protein, 9 aa, Homo Sapiens
DSACHVLAK

SEQ ID NO: 593923 - protein, 9 aa, Homo Sapiens
HLKQKLMTR

SEQ ID NO: 593924 - protein, 9 aa, Homo Sapiens
IAVTPLKLA

SEQ ID NO: 593925 - protein, 9 aa, Homo Sapiens
SPDATLSPT

SEQ ID NO: 593926 - protein, 9 aa, Homo Sapiens
LAGWQCPEC

SEQ ID NO: 593927 - protein, 9 aa, Homo Sapiens
GYPSQASFH

SEQ ID NO: 593928 - protein, 9 aa, Homo Sapiens
AVTPLKLAG

SEQ ID NO: 593929 - protein, 9 aa, Homo Sapiens
SNTILHHLG

SEQ ID NO: 593930 - protein, 9 aa, Homo Sapiens
IPWFFRVQE

SEQ ID NO: 593931 - protein, 9 aa, Homo Sapiens
ACHVLAKPA

SEQ ID NO: 593932 - protein, 9 aa, Homo Sapiens
LISINNRYT

SEQ ID NO: 593933 - protein, 9 aa, Homo Sapiens
VSVGYVRGW

SEQ ID NO: 593934 - protein, 9 aa, Homo Sapiens
GTFLIQRKN

SEQ ID NO: 593935 - protein, 9 aa, Homo Sapiens
EKWESIGMN

SEQ ID NO: 593936 - protein, 9 aa, Homo Sapiens
FFSVGGRHS

SEQ ID NO: 593937 - protein, 9 aa, Homo Sapiens
VEMQVQTDS

SEQ ID NO: 593938 - protein, 9 aa, Homo Sapiens
FSIGKLRVG

SEQ ID NO: 593939 - protein, 9 aa, Homo Sapiens
TEQNISIRI

SEQ ID NO: 593940 - protein, 9 aa, Homo Sapiens
MLQSEVFFS

SEQ ID NO: 593941 - protein, 9 aa, Homo Sapiens
AEQNRWDAE

SEQ ID NO: 593942 - protein, 9 aa, Homo Sapiens
NRWDAEAWF

SEQ ID NO: 593943 - protein, 9 aa, Homo Sapiens
NDLDQDPRS

SEQ ID NO: 593944 - protein, 9 aa, Homo Sapiens
SYSDLYQMT

SEQ ID NO: 593945 - protein, 9 aa, Homo Sapiens
THLKQKLMT

SEQ ID NO: 593946 - protein, 9 aa, Homo Sapiens
FVFLGFVSV

SEQ ID NO: 593947 - protein, 9 aa, Homo Sapiens
ILTHLKQKL

SEQ ID NO: 593948 - protein, 9 aa, Homo Sapiens
VFLGFVSVG

SEQ ID NO: 593949 - protein, 9 aa, Homo Sapiens
LMTRTMKNA

SEQ ID NO: 593950 - protein, 9 aa, Homo Sapiens
AEFVFLGFV

SEQ ID NO: 593951 - protein, 9 aa, Homo Sapiens
VIQILTHLK

SEQ ID NO: 593952 - protein, 9 aa, Homo Sapiens
SSVEAGSEV

SEQ ID NO: 593953 - protein, 9 aa, Homo Sapiens
LYVLERTCP

SEQ ID NO: 593954 - protein, 9 aa, Homo Sapiens
IQAKFLYVL

SEQ ID NO: 593955 - protein, 9 aa, Homo Sapiens
KALDIVLDP

SEQ ID NO: 593956 - protein, 9 aa, Homo Sapiens
TNSKKQWQQ

SEQ ID NO: 593957 - protein, 9 aa, Homo Sapiens
DATLSPTTT

SEQ ID NO: 593958 - protein, 9 aa, Homo Sapiens
GMNMEEDYC

SEQ ID NO: 593959 - protein, 9 aa, Homo Sapiens
NMEEDYCGK

SEQ ID NO: 593960 - protein, 9 aa, Homo Sapiens
GYSSPTTSD

SEQ ID NO: 593961 - protein, 9 aa, Homo Sapiens
SEKKYHQPP

SEQ ID NO: 593962 - protein, 9 aa, Homo Sapiens
PWFFRVQEL

SEQ ID NO: 593963 - protein, 9 aa, Homo Sapiens
NVVCKVTRP

SEQ ID NO: 593964 - protein, 9 aa, Homo Sapiens
WFFRVQELA

SEQ ID NO: 593965 - protein, 9 aa, Homo Sapiens
HCWLCGKNT

SEQ ID NO: 593966 - protein, 9 aa, Homo Sapiens
GGYPSQASF

SEQ ID NO: 593967 - protein, 9 aa, Homo Sapiens
LTHLKQKLM

SEQ ID NO: 593968 - protein, 9 aa, Homo Sapiens
PTTTTSSGV

SEQ ID NO: 593969 - protein, 9 aa, Homo Sapiens
TDSSIPWFF

SEQ ID NO: 593970 - protein, 9 aa, Homo Sapiens
CKVTRPLAS

SEQ ID NO: 593971 - protein, 9 aa, Homo Sapiens
YFELVSSLC

SEQ ID NO: 593972 - protein, 9 aa, Homo Sapiens
QAKFLYVLE

SEQ ID NO: 593973 - protein, 9 aa, Homo Sapiens
TINVVDNGL

SEQ ID NO: 593974 - protein, 9 aa, Homo Sapiens
EDYCGKVGK

SEQ ID NO: 593975 - protein, 9 aa, Homo Sapiens
EVFFSVGGR

SEQ ID NO: 593976 - protein, 9 aa, Homo Sapiens
QGGSYSSVG

SEQ ID NO: 593977 - protein, 9 aa, Homo Sapiens
ISLSESGRR

SEQ ID NO: 593978 - protein, 9 aa, Homo Sapiens
WRGYGTALT

SEQ ID NO: 593979 - protein, 9 aa, Homo Sapiens
EASSVEAGS

SEQ ID NO: 593980 - protein, 9 aa, Homo Sapiens
MRGQEEKMR

SEQ ID NO: 593981 - protein, 9 aa, Homo Sapiens
LNVAMIMGY

SEQ ID NO: 593982 - protein, 9 aa, Homo Sapiens
SPGSLRKPR

SEQ ID NO: 593983 - protein, 9 aa, Homo Sapiens
VCKVTRPLA

SEQ ID NO: 593984 - protein, 9 aa, Homo Sapiens
ELFSETTNN

SEQ ID NO: 593985 - protein, 9 aa, Homo Sapiens
ASSVEAGSE

SEQ ID NO: 593986 - protein, 9 aa, Homo Sapiens
LNLGTFLIQ

SEQ ID NO: 593987 - protein, 9 aa, Homo Sapiens
SSLCQRIPQ

SEQ ID NO: 593988 - protein, 9 aa, Homo Sapiens
QSNTILHHL

SEQ ID NO: 593989 - protein, 9 aa, Homo Sapiens
FRISKALDI

SEQ ID NO: 593990 - protein, 9 aa, Homo Sapiens
VFFSVGGRH

SEQ ID NO: 593991 - protein, 9 aa, Homo Sapiens
TELERLALW

SEQ ID NO: 593992 - protein, 9 aa, Homo Sapiens
REMPHSCRR

SEQ ID NO: 593993 - protein, 9 aa, Homo Sapiens
SETTNNEVD

SEQ ID NO: 593994 - protein, 9 aa, Homo Sapiens
IWNNFSIGK

SEQ ID NO: 593995 - protein, 9 aa, Homo Sapiens
LQATGKATE

SEQ ID NO: 593996 - protein, 9 aa, Homo Sapiens
QQPSYSDLY

SEQ ID NO: 593997 - protein, 9 aa, Homo Sapiens
CPPPKCPKP

SEQ ID NO: 593998 - protein, 9 aa, Homo Sapiens
IVNFIGIIW

SEQ ID NO: 593999 - protein, 9 aa, Homo Sapiens
FVSVGYVRG

SEQ ID NO: 594000 - protein, 9 aa, Homo Sapiens
QATGKATEL

SEQ ID NO: 594001 - protein, 9 aa, Homo Sapiens
LYQSNTILH

SEQ ID NO: 594002 - protein, 9 aa, Homo Sapiens
LRVGLLMPR

SEQ ID NO: 594003 - protein, 9 aa, Homo Sapiens
NERDAYAIN

SEQ ID NO: 594004 - protein, 9 aa, Homo Sapiens
SKALDIVLD

SEQ ID NO: 594005 - protein, 9 aa, Homo Sapiens
DTLPSAETT

SEQ ID NO: 594006 - protein, 9 aa, Homo Sapiens
LRPQCARET

SEQ ID NO: 594007 - protein, 9 aa, Homo Sapiens
GKATELERL

SEQ ID NO: 594008 - protein, 9 aa, Homo Sapiens
RVKHYLLNL

SEQ ID NO: 594009 - protein, 9 aa, Homo Sapiens
VNVVCKVTR

SEQ ID NO: 594010 - protein, 9 aa, Homo Sapiens
KVGKKNIRV

SEQ ID NO: 594011 - protein, 9 aa, Homo Sapiens
KPCPPPKCP

SEQ ID NO: 594012 - protein, 9 aa, Homo Sapiens
DIVLDPTCT

SEQ ID NO: 594013 - protein, 9 aa, Homo Sapiens
ATLSPTTTT

SEQ ID NO: 594014 - protein, 9 aa, Homo Sapiens
TSQSGSGLV

SEQ ID NO: 594015 - protein, 9 aa, Homo Sapiens
KQKLMTRTM

SEQ ID NO: 594016 - protein, 9 aa, Homo Sapiens
TDSYVINSV

SEQ ID NO: 594017 - protein, 9 aa, Homo Sapiens
ISEKKYHQP

SEQ ID NO: 594018 - protein, 9 aa, Homo Sapiens
VWMSKLHFC

SEQ ID NO: 594019 - protein, 9 aa, Homo Sapiens
DYCGKVGKK

SEQ ID NO: 594020 - protein, 9 aa, Homo Sapiens
FDYEQLKNF

SEQ ID NO: 594021 - protein, 9 aa, Homo Sapiens
LIGFMGNLL

SEQ ID NO: 594022 - protein, 9 aa, Homo Sapiens
TTMGSDTTT

SEQ ID NO: 594023 - protein, 9 aa, Homo Sapiens
ALAEQNRWD

SEQ ID NO: 594024 - protein, 9 aa, Homo Sapiens
DYEQLKNFS

SEQ ID NO: 594025 - protein, 9 aa, Homo Sapiens
EKRSPLQND

SEQ ID NO: 594026 - protein, 9 aa, Homo Sapiens
LLQATGKAT

SEQ ID NO: 594027 - protein, 9 aa, Homo Sapiens
KISLSESGR

SEQ ID NO: 594028 - protein, 9 aa, Homo Sapiens
KPRSSQHGG

SEQ ID NO: 594029 - protein, 9 aa, Homo Sapiens
AEVYAPDLS

SEQ ID NO: 594030 - protein, 9 aa, Homo Sapiens
THQQPSYSD

SEQ ID NO: 594031 - protein, 9 aa, Homo Sapiens
MPRKAVIQI

SEQ ID NO: 594032 - protein, 9 aa, Homo Sapiens
FLYVLERTC

SEQ ID NO: 594033 - protein, 9 aa, Homo Sapiens
IIWNNFSIG

SEQ ID NO: 594034 - protein, 9 aa, Homo Sapiens
LMPRKAVIQ

SEQ ID NO: 594035 - protein, 9 aa, Homo Sapiens
QVDTVSGSI

SEQ ID NO: 594036 - protein, 9 aa, Homo Sapiens
EEDYCGKVG

SEQ ID NO: 594037 - protein, 9 aa, Homo Sapiens
PCPPPKCPK

SEQ ID NO: 594038 - protein, 9 aa, Homo Sapiens
SSPTTSDMS

SEQ ID NO: 594039 - protein, 9 aa, Homo Sapiens
SLHSMPTYG

SEQ ID NO: 594040 - protein, 9 aa, Homo Sapiens
SNIIVNFIG

SEQ ID NO: 594041 - protein, 9 aa, Homo Sapiens
WGQWRGYGT

SEQ ID NO: 594042 - protein, 9 aa, Homo Sapiens
AEASSVEAG

SEQ ID NO: 594043 - protein, 9 aa, Homo Sapiens
LNIVNVVCK

SEQ ID NO: 594044 - protein, 9 aa, Homo Sapiens
QGGYPSQAS

SEQ ID NO: 594045 - protein, 9 aa, Homo Sapiens
KATELERLA

SEQ ID NO: 594046 - protein, 9 aa, Homo Sapiens
SQASFHELY

SEQ ID NO: 594047 - protein, 9 aa, Homo Sapiens
ARNERDAYA

SEQ ID NO: 594048 - protein, 9 aa, Homo Sapiens
GKKNIRVKH

SEQ ID NO: 594049 - protein, 9 aa, Homo Sapiens
QSSKCRKMY

SEQ ID NO: 594050 - protein, 9 aa, Homo Sapiens
CGKNTNSKK

SEQ ID NO: 594051 - protein, 9 aa, Homo Sapiens
AYFELVSSL

SEQ ID NO: 594052 - protein, 9 aa, Homo Sapiens
KNIRVKHYL

SEQ ID NO: 594053 - protein, 9 aa, Homo Sapiens
YEQLKNFSF

SEQ ID NO: 594054 - protein, 9 aa, Homo Sapiens
RQVDTVSGS

SEQ ID NO: 594055 - protein, 9 aa, Homo Sapiens
ILNVAMIMG

SEQ ID NO: 594056 - protein, 9 aa, Homo Sapiens
LQNDLDQDP

SEQ ID NO: 594057 - protein, 9 aa, Homo Sapiens
QANGTDSAC

SEQ ID NO: 594058 - protein, 9 aa, Homo Sapiens
IRIQKLLQD

SEQ ID NO: 594059 - protein, 9 aa, Homo Sapiens
DMSIKDSPS

SEQ ID NO: 594060 - protein, 9 aa, Homo Sapiens
AETTLILHR

SEQ ID NO: 594061 - protein, 9 aa, Homo Sapiens
WTHQQPSYS

SEQ ID NO: 594062 - protein, 9 aa, Homo Sapiens
NFIGIIWNN

SEQ ID NO: 594063 - protein, 9 aa, Homo Sapiens
GSLRKPRSS

SEQ ID NO: 594064 - protein, 9 aa, Homo Sapiens
KLAGWQCPE

SEQ ID NO: 594065 - protein, 9 aa, Homo Sapiens
QSEVFFSVG

SEQ ID NO: 594066 - protein, 9 aa, Homo Sapiens
GTDSACHVL

SEQ ID NO: 594067 - protein, 9 aa, Homo Sapiens
PKCPKPCPP

SEQ ID NO: 594068 - protein, 9 aa, Homo Sapiens
KCPKPCPPP

SEQ ID NO: 594069 - protein, 9 aa, Homo Sapiens
DPKPLSRQV

SEQ ID NO: 594070 - protein, 9 aa, Homo Sapiens
FELRPQCAR

SEQ ID NO: 594071 - protein, 9 aa, Homo Sapiens
RPQCARETY

SEQ ID NO: 594072 - protein, 9 aa, Homo Sapiens
GLLMPRKAV

SEQ ID NO: 594073 - protein, 9 aa, Homo Sapiens
TILHHLGRT

SEQ ID NO: 594074 - protein, 9 aa, Homo Sapiens
LGTFLIQRK

SEQ ID NO: 594075 - protein, 9 aa, Homo Sapiens
IQILTHLKQ

SEQ ID NO: 594076 - protein, 9 aa, Homo Sapiens
LGWGQWRGY

SEQ ID NO: 594077 - protein, 9 aa, Homo Sapiens
KLISINNRY

SEQ ID NO: 594078 - protein, 9 aa, Homo Sapiens
LQSEVFFSV

SEQ ID NO: 594079 - protein, 9 aa, Homo Sapiens
SPLQNDLDQ

SEQ ID NO: 594080 - protein, 9 aa, Homo Sapiens
WNNFSIGKL

SEQ ID NO: 594081 - protein, 9 aa, Homo Sapiens
SFDYEQLKN

SEQ ID NO: 594082 - protein, 9 aa, Homo Sapiens
EITEKWESI

SEQ ID NO: 594083 - protein, 9 aa, Homo Sapiens
WLCGKNTNS

SEQ ID NO: 594084 - protein, 9 aa, Homo Sapiens
LSRQVDTVS

SEQ ID NO: 594085 - protein, 9 aa, Homo Sapiens
PEIQAKFLY

SEQ ID NO: 594086 - protein, 9 aa, Homo Sapiens
YCKDCPQFV

SEQ ID NO: 594087 - protein, 9 aa, Homo Sapiens
DIAVTPLKL

SEQ ID NO: 594088 - protein, 9 aa, Homo Sapiens
MYCKDCPQF

SEQ ID NO: 594089 - protein, 9 aa, Homo Sapiens
PSVYQSSTR

SEQ ID NO: 594090 - protein, 9 aa, Homo Sapiens
EMPHSCRRY

SEQ ID NO: 594091 - protein, 9 aa, Homo Sapiens
TLILHRKGF

SEQ ID NO: 594092 - protein, 9 aa, Homo Sapiens
LQSLAEVYA

SEQ ID NO: 594093 - protein, 9 aa, Homo Sapiens
SPPYKEPSV

SEQ ID NO: 594094 - protein, 9 aa, Homo Sapiens
FLGFVSVGY

SEQ ID NO: 594095 - protein, 9 aa, Homo Sapiens
ITEKWESIG

SEQ ID NO: 594096 - protein, 9 aa, Homo Sapiens
RGQEEKMRG

SEQ ID NO: 594097 - protein, 9 aa, Homo Sapiens
PELPGIPRE

SEQ ID NO: 594098 - protein, 9 aa, Homo Sapiens
VTTMGSDTT

SEQ ID NO: 594099 - protein, 9 aa, Homo Sapiens
LALDPELPG

SEQ ID NO: 594100 - protein, 9 aa, Homo Sapiens
MQVQTDSYV

SEQ ID NO: 594101 - protein, 9 aa, Homo Sapiens
AAEASSVEA

SEQ ID NO: 594102 - protein, 9 aa, Homo Sapiens
GFVSVGYVR

SEQ ID NO: 594103 - protein, 9 aa, Homo Sapiens
RKAVIQILT

SEQ ID NO: 594104 - protein, 9 aa, Homo Sapiens
QEKRQEQEE

SEQ ID NO: 594105 - protein, 9 aa, Homo Sapiens
NFSIGKLRV

SEQ ID NO: 594106 - protein, 9 aa, Homo Sapiens
QSLAEVYAP

SEQ ID NO: 594107 - protein, 9 aa, Homo Sapiens
VSSLCQRIP

SEQ ID NO: 594108 - protein, 9 aa, Homo Sapiens
TEKWESIGM

SEQ ID NO: 594109 - protein, 9 aa, Homo Sapiens
LPGIPREHV

SEQ ID NO: 594110 - protein, 9 aa, Homo Sapiens
NIRVKHYLL

SEQ ID NO: 594111 - protein, 9 aa, Homo Sapiens
SLCQRIPQL

SEQ ID NO: 594112 - protein, 9 aa, Homo Sapiens
ESIGMNMEE

SEQ ID NO: 594113 - protein, 9 aa, Homo Sapiens
IQRKNGSNI

SEQ ID NO: 594114 - protein, 9 aa, Homo Sapiens
LRDGREMPH

SEQ ID NO: 594115 - protein, 9 aa, Homo Sapiens
NNRYTGKAN

SEQ ID NO: 594116 - protein, 9 aa, Homo Sapiens
PPPKCPKPC

SEQ ID NO: 594117 - protein, 9 aa, Homo Sapiens
QCARETYPF

SEQ ID NO: 594118 - protein, 9 aa, Homo Sapiens
GSYSSVGSG

SEQ ID NO: 594119 - protein, 9 aa, Homo Sapiens
RVGLLMPRK

SEQ ID NO: 594120 - protein, 9 aa, Homo Sapiens
VDTVSGSIY

SEQ ID NO: 594121 - protein, 9 aa, Homo Sapiens
YVLERTCPS

SEQ ID NO: 594122 - protein, 9 aa, Homo Sapiens
YKEPSVYQS

SEQ ID NO: 594123 - protein, 9 aa, Homo Sapiens
FVNVVWMSK

SEQ ID NO: 594124 - protein, 9 aa, Homo Sapiens
IRVKHYLLN

SEQ ID NO: 594125 - protein, 9 aa, Homo Sapiens
LIQRKNGSN

SEQ ID NO: 594126 - protein, 9 aa, Homo Sapiens
EALKISLSE

SEQ ID NO: 594127 - protein, 9 aa, Homo Sapiens
RKMYCKDCP

SEQ ID NO: 594128 - protein, 9 aa, Homo Sapiens
HTQGGSYSS

SEQ ID NO: 594129 - protein, 9 aa, Homo Sapiens
VSFELRPQC

SEQ ID NO: 594130 - protein, 9 aa, Homo Sapiens
TYGQLDGTY

SEQ ID NO: 594131 - protein, 9 aa, Homo Sapiens
YGTALTTAP

SEQ ID NO: 594132 - protein, 9 aa, Homo Sapiens
EFVFLGFVS

SEQ ID NO: 594133 - protein, 9 aa, Homo Sapiens
SIRIQKLLQ

SEQ ID NO: 594134 - protein, 9 aa, Homo Sapiens
SLIGFMGNL

SEQ ID NO: 594135 - protein, 9 aa, Homo Sapiens
SDTTTASTA

SEQ ID NO: 594136 - protein, 9 aa, Homo Sapiens
SRTINVVDN

SEQ ID NO: 594137 - protein, 9 aa, Homo Sapiens
KLNIARNER

SEQ ID NO: 594138 - protein, 9 aa, Homo Sapiens
VYQSSTRSP

SEQ ID NO: 594139 - protein, 9 aa, Homo Sapiens
MIMGYLGSI

SEQ ID NO: 594140 - protein, 9 aa, Homo Sapiens
SRQVDTVSG

SEQ ID NO: 594141 - protein, 9 aa, Homo Sapiens
LKNFSFQVE

SEQ ID NO: 594142 - protein, 9 aa, Homo Sapiens
GSNIIVNFI

SEQ ID NO: 594143 - protein, 9 aa, Homo Sapiens
KCRKMYCKD

SEQ ID NO: 594144 - protein, 9 aa, Homo Sapiens
LDIVLDPTC

SEQ ID NO: 594145 - protein, 9 aa, Homo Sapiens
IHDNSRTIN

SEQ ID NO: 594146 - protein, 9 aa, Homo Sapiens
LAEVYAPDL

SEQ ID NO: 594147 - protein, 9 aa, Homo Sapiens
KLRVGLLMP

SEQ ID NO: 594148 - protein, 9 aa, Homo Sapiens
HYLLNLGTF

SEQ ID NO: 594149 - protein, 9 aa, Homo Sapiens
GGSYSSVGS

SEQ ID NO: 594150 - protein, 9 aa, Homo Sapiens
EAQKLSVST

SEQ ID NO: 594151 - protein, 9 aa, Homo Sapiens
IWLLILSYV

SEQ ID NO: 594152 - protein, 9 aa, Homo Sapiens
ELFVMAWEH

SEQ ID NO: 594153 - protein, 9 aa, Homo Sapiens
DISSLNRMP

SEQ ID NO: 594154 - protein, 9 aa, Homo Sapiens
RYTNPMSPK

SEQ ID NO: 594155 - protein, 9 aa, Homo Sapiens
TNPMSPKIC

SEQ ID NO: 594156 - protein, 9 aa, Homo Sapiens
AVCTAGQPG

SEQ ID NO: 594157 - protein, 9 aa, Homo Sapiens
SHLCANGST

SEQ ID NO: 594158 - protein, 9 aa, Homo Sapiens
ISAIGERFP

SEQ ID NO: 594159 - protein, 9 aa, Homo Sapiens
NSRFWAKIR

SEQ ID NO: 594160 - protein, 9 aa, Homo Sapiens
PEIDQNKDH

SEQ ID NO: 594161 - protein, 9 aa, Homo Sapiens
LCANGSTCT

SEQ ID NO: 594162 - protein, 9 aa, Homo Sapiens
QSLAGGSWR

SEQ ID NO: 594163 - protein, 9 aa, Homo Sapiens
SPDEQSEIR

SEQ ID NO: 594164 - protein, 9 aa, Homo Sapiens
SCRYGEDYS

SEQ ID NO: 594165 - protein, 9 aa, Homo Sapiens
AGGSWRTKE

SEQ ID NO: 594166 - protein, 9 aa, Homo Sapiens
DNWREAQKL

SEQ ID NO: 594167 - protein, 9 aa, Homo Sapiens
LAHNSENIC

SEQ ID NO: 594168 - protein, 9 aa, Homo Sapiens
TGRNYPEDD

SEQ ID NO: 594169 - protein, 9 aa, Homo Sapiens
EPGQPPPHA

SEQ ID NO: 594170 - protein, 9 aa, Homo Sapiens
KGIVILGHV

SEQ ID NO: 594171 - protein, 9 aa, Homo Sapiens
ESPDEQSEI

SEQ ID NO: 594172 - protein, 9 aa, Homo Sapiens
PRGQPCRHT

SEQ ID NO: 594173 - protein, 9 aa, Homo Sapiens
TNVRLEELT

SEQ ID NO: 594174 - protein, 9 aa, Homo Sapiens
KPKTPFWYQ

SEQ ID NO: 594175 - protein, 9 aa, Homo Sapiens
LMAPGRGLP

SEQ ID NO: 594176 - protein, 9 aa, Homo Sapiens
CCPTCNRVG

SEQ ID NO: 594177 - protein, 9 aa, Homo Sapiens
PNSRFWAKI

SEQ ID NO: 594178 - protein, 9 aa, Homo Sapiens
SRGLSSPSQ

SEQ ID NO: 594179 - protein, 9 aa, Homo Sapiens
AHGESSLAS

SEQ ID NO: 594180 - protein, 9 aa, Homo Sapiens
TQQLAQAQA

SEQ ID NO: 594181 - protein, 9 aa, Homo Sapiens
RLEELTPAP

SEQ ID NO: 594182 - protein, 9 aa, Homo Sapiens
LFKFSVVYI

SEQ ID NO: 594183 - protein, 9 aa, Homo Sapiens
NFIYDASNQ

SEQ ID NO: 594184 - protein, 9 aa, Homo Sapiens
LEELTPAPS

SEQ ID NO: 594185 - protein, 9 aa, Homo Sapiens
GKGIVILGH

SEQ ID NO: 594186 - protein, 9 aa, Homo Sapiens
LLGEEREKR

SEQ ID NO: 594187 - protein, 9 aa, Homo Sapiens
EKCFFRDEP

SEQ ID NO: 594188 - protein, 9 aa, Homo Sapiens
QSSGHSRQG

SEQ ID NO: 594189 - protein, 9 aa, Homo Sapiens
LDISSLNRM

SEQ ID NO: 594190 - protein, 9 aa, Homo Sapiens
HRRCRRGLE

SEQ ID NO: 594191 - protein, 9 aa, Homo Sapiens
KCFFRDEPK

SEQ ID NO: 594192 - protein, 9 aa, Homo Sapiens
CLSHLCANG

SEQ ID NO: 594193 - protein, 9 aa, Homo Sapiens
DHMLEILEG

SEQ ID NO: 594194 - protein, 9 aa, Homo Sapiens
HCSAEGQYR

SEQ ID NO: 594195 - protein, 9 aa, Homo Sapiens
CHPLRYTNP

SEQ ID NO: 594196 - protein, 9 aa, Homo Sapiens
AWEHAPSII

SEQ ID NO: 594197 - protein, 9 aa, Homo Sapiens
EIDQNKDHM

SEQ ID NO: 594198 - protein, 9 aa, Homo Sapiens
NFIKTCSQG

SEQ ID NO: 594199 - protein, 9 aa, Homo Sapiens
VTFVLQFFL

SEQ ID NO: 594200 - protein, 9 aa, Homo Sapiens
GLFLYFRNQ

SEQ ID NO: 594201 - protein, 9 aa, Homo Sapiens
ILNFIKTCS

SEQ ID NO: 594202 - protein, 9 aa, Homo Sapiens
GFSCRYGED

SEQ ID NO: 594203 - protein, 9 aa, Homo Sapiens
IDGTYFKIR

SEQ ID NO: 594204 - protein, 9 aa, Homo Sapiens
EFLCEKCFF

SEQ ID NO: 594205 - protein, 9 aa, Homo Sapiens
FLVDGSYRI

SEQ ID NO: 594206 - protein, 9 aa, Homo Sapiens
GESSLASSQ

SEQ ID NO: 594207 - protein, 9 aa, Homo Sapiens
QQLTQQLAQ

SEQ ID NO: 594208 - protein, 9 aa, Homo Sapiens
RCRRGLECD

SEQ ID NO: 594209 - protein, 9 aa, Homo Sapiens
PVCREMAVC

SEQ ID NO: 594210 - protein, 9 aa, Homo Sapiens
HLCANGSTC

SEQ ID NO: 594211 - protein, 9 aa, Homo Sapiens
LKLAGWQCP

SEQ ID NO: 594212 - protein, 9 aa, Homo Sapiens
KLAGWQCPE

SEQ ID NO: 594213 - protein, 9 aa, Homo Sapiens
GQYRQPPGL

SEQ ID NO: 594214 - protein, 9 aa, Homo Sapiens
PPPHAEPTL

SEQ ID NO: 594215 - protein, 9 aa, Homo Sapiens
RDEPKFFSI

SEQ ID NO: 594216 - protein, 9 aa, Homo Sapiens
SSGHSRQGS

SEQ ID NO: 594217 - protein, 9 aa, Homo Sapiens
SWRTKEEEL

SEQ ID NO: 594218 - protein, 9 aa, Homo Sapiens
PRDVKPKTP

SEQ ID NO: 594219 - protein, 9 aa, Homo Sapiens
PKFFSIRIL

SEQ ID NO: 594220 - protein, 9 aa, Homo Sapiens
LRYTNPMSP

SEQ ID NO: 594221 - protein, 9 aa, Homo Sapiens
TNGLCIWLL

SEQ ID NO: 594222 - protein, 9 aa, Homo Sapiens
DVLLPRDWL

SEQ ID NO: 594223 - protein, 9 aa, Homo Sapiens
CNRVGTRRH

SEQ ID NO: 594224 - protein, 9 aa, Homo Sapiens
CFFRDEPKF

SEQ ID NO: 594225 - protein, 9 aa, Homo Sapiens
AIGERFPKL

SEQ ID NO: 594226 - protein, 9 aa, Homo Sapiens
NICWSTFPS

SEQ ID NO: 594227 - protein, 9 aa, Homo Sapiens
PEKVTSANK

SEQ ID NO: 594228 - protein, 9 aa, Homo Sapiens
ILKHWTGGC

SEQ ID NO: 594229 - protein, 9 aa, Homo Sapiens
FFSIRILAH

SEQ ID NO: 594230 - protein, 9 aa, Homo Sapiens
GEEREKRRR

SEQ ID NO: 594231 - protein, 9 aa, Homo Sapiens
LCIWLLILS

SEQ ID NO: 594232 - protein, 9 aa, Homo Sapiens
VVYIVQEYM

SEQ ID NO: 594233 - protein, 9 aa, Homo Sapiens
LKHWTGGCP

SEQ ID NO: 594234 - protein, 9 aa, Homo Sapiens
FIYDASNQV

SEQ ID NO: 594235 - protein, 9 aa, Homo Sapiens
AGLFLYFRN

SEQ ID NO: 594236 - protein, 9 aa, Homo Sapiens
DGSYRIGIA

SEQ ID NO: 594237 - protein, 9 aa, Homo Sapiens
VKPKTPFWY

SEQ ID NO: 594238 - protein, 9 aa, Homo Sapiens
GAHGESSLA

SEQ ID NO: 594239 - protein, 9 aa, Homo Sapiens
IGERFPKLL

SEQ ID NO: 594240 - protein, 9 aa, Homo Sapiens
EMAVCTAGQ

SEQ ID NO: 594241 - protein, 9 aa, Homo Sapiens
QLGFSCRYG

SEQ ID NO: 594242 - protein, 9 aa, Homo Sapiens
MTNGLCIWL

SEQ ID NO: 594243 - protein, 9 aa, Homo Sapiens
WTGGCPFRE

SEQ ID NO: 594244 - protein, 9 aa, Homo Sapiens
KFSVVYIVQ

SEQ ID NO: 594245 - protein, 9 aa, Homo Sapiens
FFRDEPKFF

SEQ ID NO: 594246 - protein, 9 aa, Homo Sapiens
CREMAVCTA

SEQ ID NO: 594247 - protein, 9 aa, Homo Sapiens
NSENICWST

SEQ ID NO: 594248 - protein, 9 aa, Homo Sapiens
FLCEKCFFR

SEQ ID NO: 594249 - protein, 9 aa, Homo Sapiens
PGSGGQPGS

SEQ ID NO: 594250 - protein, 9 aa, Homo Sapiens
PSVSRGLSS

SEQ ID NO: 594251 - protein, 9 aa, Homo Sapiens
VFLVDGSYR

SEQ ID NO: 594252 - protein, 9 aa, Homo Sapiens
WPQGAHGES

SEQ ID NO: 594253 - protein, 9 aa, Homo Sapiens
SPSVSRGLS

SEQ ID NO: 594254 - protein, 9 aa, Homo Sapiens
IPRDVKPKT

SEQ ID NO: 594255 - protein, 9 aa, Homo Sapiens
YTNPMSPKI

SEQ ID NO: 594256 - protein, 9 aa, Homo Sapiens
QPGSGGQPG

SEQ ID NO: 594257 - protein, 9 aa, Homo Sapiens
SANKTNKQT

SEQ ID NO: 594258 - protein, 9 aa, Homo Sapiens
NPMSPKICG

SEQ ID NO: 594259 - protein, 9 aa, Homo Sapiens
WLMAPGRGL

SEQ ID NO: 594260 - protein, 9 aa, Homo Sapiens
HNSENICWS

SEQ ID NO: 594261 - protein, 9 aa, Homo Sapiens
QLAQAQATH

SEQ ID NO: 594262 - protein, 9 aa, Homo Sapiens
NVRLEELTP

SEQ ID NO: 594263 - protein, 9 aa, Homo Sapiens
IRILAHNSE

SEQ ID NO: 594264 - protein, 9 aa, Homo Sapiens
PTCNRVGTR

SEQ ID NO: 594265 - protein, 9 aa, Homo Sapiens
FKFSVVYIV

SEQ ID NO: 594266 - protein, 9 aa, Homo Sapiens
PMSPKICGL

SEQ ID NO: 594267 - protein, 9 aa, Homo Sapiens
SNFIYDASN

SEQ ID NO: 594268 - protein, 9 aa, Homo Sapiens
IYDASNQVL

SEQ ID NO: 594269 - protein, 9 aa, Homo Sapiens
SLVTFVLQF

SEQ ID NO: 594270 - protein, 9 aa, Homo Sapiens
QPPGLPRGQ

SEQ ID NO: 594271 - protein, 9 aa, Homo Sapiens
QLLGEEREK

SEQ ID NO: 594272 - protein, 9 aa, Homo Sapiens
FLWQRLQAL

SEQ ID NO: 594273 - protein, 9 aa, Homo Sapiens
FFLFLPSMR

SEQ ID NO: 594274 - protein, 9 aa, Homo Sapiens
TGGCPFREG

SEQ ID NO: 594275 - protein, 9 aa, Homo Sapiens
QPPPHAEPT

SEQ ID NO: 594276 - protein, 9 aa, Homo Sapiens
LIAAGKGIV

SEQ ID NO: 594277 - protein, 9 aa, Homo Sapiens
CTAGQPGSG

SEQ ID NO: 594278 - protein, 9 aa, Homo Sapiens
PRDWLMAPG

SEQ ID NO: 594279 - protein, 9 aa, Homo Sapiens
LVDGSYRIG

SEQ ID NO: 594280 - protein, 9 aa, Homo Sapiens
SSCHCSAEG

SEQ ID NO: 594281 - protein, 9 aa, Homo Sapiens
KMDLEESPD

SEQ ID NO: 594282 - protein, 9 aa, Homo Sapiens
GTYFKIRAI

SEQ ID NO: 594283 - protein, 9 aa, Homo Sapiens
PEKEFLCEK

SEQ ID NO: 594284 - protein, 9 aa, Homo Sapiens
GSRQSSGHS

SEQ ID NO: 594285 - protein, 9 aa, Homo Sapiens
ESSLASSQA

SEQ ID NO: 594286 - protein, 9 aa, Homo Sapiens
HGESSLASS

SEQ ID NO: 594287 - protein, 9 aa, Homo Sapiens
ATQQLTQQL

SEQ ID NO: 594288 - protein, 9 aa, Homo Sapiens
SSLASSQAK

SEQ ID NO: 594289 - protein, 9 aa, Homo Sapiens
GAGLFLYFR

SEQ ID NO: 594290 - protein, 9 aa, Homo Sapiens
KEFLCEKCF

SEQ ID NO: 594291 - protein, 9 aa, Homo Sapiens
PPKCPPFSS

SEQ ID NO: 594292 - protein, 9 aa, Homo Sapiens
CSAEGQYRQ

SEQ ID NO: 594293 - protein, 9 aa, Homo Sapiens
FWAKIRYHM

SEQ ID NO: 594294 - protein, 9 aa, Homo Sapiens
YISAIGERF

SEQ ID NO: 594295 - protein, 9 aa, Homo Sapiens
WEHAPSIIF

SEQ ID NO: 594296 - protein, 9 aa, Homo Sapiens
IRYHMPVKN

SEQ ID NO: 594297 - protein, 9 aa, Homo Sapiens
ELTPAPSTS

SEQ ID NO: 594298 - protein, 9 aa, Homo Sapiens
DLEESPDEQ

SEQ ID NO: 594299 - protein, 9 aa, Homo Sapiens
AGKGIVILG

SEQ ID NO: 594300 - protein, 9 aa, Homo Sapiens
NRVGTRRHS

SEQ ID NO: 594301 - protein, 9 aa, Homo Sapiens
RNYPEDDMQ

SEQ ID NO: 594302 - protein, 9 aa, Homo Sapiens
SGGQPGSSC

SEQ ID NO: 594303 - protein, 9 aa, Homo Sapiens
PKEPSPTTP

SEQ ID NO: 594304 - protein, 9 aa, Homo Sapiens
ETGRNYPED

SEQ ID NO: 594305 - protein, 9 aa, Homo Sapiens
GERFPKLLR

SEQ ID NO: 594306 - protein, 9 aa, Homo Sapiens
EDHPHRRCR

SEQ ID NO: 594307 - protein, 9 aa, Homo Sapiens
QSCCPTCNR

SEQ ID NO: 594308 - protein, 9 aa, Homo Sapiens
SIRILAHNS

SEQ ID NO: 594309 - protein, 9 aa, Homo Sapiens
TCNRVGTRR

SEQ ID NO: 594310 - protein, 9 aa, Homo Sapiens
TPLKLAGWQ

SEQ ID NO: 594311 - protein, 9 aa, Homo Sapiens
GSSCHCSAE

SEQ ID NO: 594312 - protein, 9 aa, Homo Sapiens
ANKTNKQTT

SEQ ID NO: 594313 - protein, 9 aa, Homo Sapiens
HSRQGSGSG

SEQ ID NO: 594314 - protein, 9 aa, Homo Sapiens
IAAGKGIVI

SEQ ID NO: 594315 - protein, 9 aa, Homo Sapiens
ACLSHLCAN

SEQ ID NO: 594316 - protein, 9 aa, Homo Sapiens
PPSSPSVSR

SEQ ID NO: 594317 - protein, 9 aa, Homo Sapiens
LTNVRLEEL

SEQ ID NO: 594318 - protein, 9 aa, Homo Sapiens
FKIRAIYDK

SEQ ID NO: 594319 - protein, 9 aa, Homo Sapiens
SAIGERFPK

SEQ ID NO: 594320 - protein, 9 aa, Homo Sapiens
YRQPPGLPR

SEQ ID NO: 594321 - protein, 9 aa, Homo Sapiens
SRQGSGSGH

SEQ ID NO: 594322 - protein, 9 aa, Homo Sapiens
SYRIGIANF

SEQ ID NO: 594323 - protein, 9 aa, Homo Sapiens
CPPFSSCCS

SEQ ID NO: 594324 - protein, 9 aa, Homo Sapiens
KHWTGGCPF

SEQ ID NO: 594325 - protein, 9 aa, Homo Sapiens
LYFRNQKGH

SEQ ID NO: 594326 - protein, 9 aa, Homo Sapiens
TCSQGFPGG

SEQ ID NO: 594327 - protein, 9 aa, Homo Sapiens
PQGAHGESS

SEQ ID NO: 594328 - protein, 9 aa, Homo Sapiens
SRQSSGHSR

SEQ ID NO: 594329 - protein, 9 aa, Homo Sapiens
DSWQPYGSS

SEQ ID NO: 594330 - protein, 9 aa, Homo Sapiens
VTSANKTNK

SEQ ID NO: 594331 - protein, 9 aa, Homo Sapiens
KCPPFSSCC

SEQ ID NO: 594332 - protein, 9 aa, Homo Sapiens
LTPAPSTSY

SEQ ID NO: 594333 - protein, 9 aa, Homo Sapiens
ENICWSTFP

SEQ ID NO: 594334 - protein, 9 aa, Homo Sapiens
KILKHWTGG

SEQ ID NO: 594335 - protein, 9 aa, Homo Sapiens
IKTCSQGFP

SEQ ID NO: 594336 - protein, 9 aa, Homo Sapiens
VCREMAVCT

SEQ ID NO: 594337 - protein, 9 aa, Homo Sapiens
WQPYGSSFY

SEQ ID NO: 594338 - protein, 9 aa, Homo Sapiens
FLGAGLFLY

SEQ ID NO: 594339 - protein, 9 aa, Homo Sapiens
AHSNFIYDA

SEQ ID NO: 594340 - protein, 9 aa, Homo Sapiens
LSHLCANGS

SEQ ID NO: 594341 - protein, 9 aa, Homo Sapiens
AEGQYRQPP

SEQ ID NO: 594342 - protein, 9 aa, Homo Sapiens
FPSTRIFSF

SEQ ID NO: 594343 - protein, 9 aa, Homo Sapiens
MDLEESPDE

SEQ ID NO: 594344 - protein, 9 aa, Homo Sapiens
GQLGFSCRY

SEQ ID NO: 594345 - protein, 9 aa, Homo Sapiens
PSTRIFSFE

SEQ ID NO: 594346 - protein, 9 aa, Homo Sapiens
EQPDSWQPY

SEQ ID NO: 594347 - protein, 9 aa, Homo Sapiens
MFLWQRLQA

SEQ ID NO: 594348 - protein, 9 aa, Homo Sapiens
QKLSVSTQH

SEQ ID NO: 594349 - protein, 9 aa, Homo Sapiens
ELFKFSVVY

SEQ ID NO: 594350 - protein, 9 aa, Homo Sapiens
GQPGSGGQP

SEQ ID NO: 594351 - protein, 9 aa, Homo Sapiens
GDNWREAQK

SEQ ID NO: 594352 - protein, 9 aa, Homo Sapiens
DACLSHLCA

SEQ ID NO: 594353 - protein, 9 aa, Homo Sapiens
WSTFPSTRI

SEQ ID NO: 594354 - protein, 9 aa, Homo Sapiens
CRYGEDYSR

SEQ ID NO: 594355 - protein, 9 aa, Homo Sapiens
CPPKCPPFS

SEQ ID NO: 594356 - protein, 9 aa, Homo Sapiens
DAQYMFLWQ

SEQ ID NO: 594357 - protein, 9 aa, Homo Sapiens
WLLILSYVG

SEQ ID NO: 594358 - protein, 9 aa, Homo Sapiens
MAVCTAGQP

SEQ ID NO: 594359 - protein, 9 aa, Homo Sapiens
PLKLAGWQC

SEQ ID NO: 594360 - protein, 9 aa, Homo Sapiens
VSRGLSSPS

SEQ ID NO: 594361 - protein, 9 aa, Homo Sapiens
VMAWEHAPS

SEQ ID NO: 594362 - protein, 9 aa, Homo Sapiens
LCEKCFFRD

SEQ ID NO: 594363 - protein, 9 aa, Homo Sapiens
PGQPPPHAE

SEQ ID NO: 594364 - protein, 9 aa, Homo Sapiens
QQLAQAQAT

SEQ ID NO: 594365 - protein, 9 aa, Homo Sapiens
VCTAGQPGS

SEQ ID NO: 594366 - protein, 9 aa, Homo Sapiens
CIWLLILSY

SEQ ID NO: 594367 - protein, 9 aa, Homo Sapiens
DQNKDHMLE

SEQ ID NO: 594368 - protein, 9 aa, Homo Sapiens
GSGQLGFSC

SEQ ID NO: 594369 - protein, 9 aa, Homo Sapiens
VTPLKLAGW

SEQ ID NO: 594370 - protein, 9 aa, Homo Sapiens
LPRGQPCRH

SEQ ID NO: 594371 - protein, 9 aa, Homo Sapiens
MAWEHAPSI

SEQ ID NO: 594372 - protein, 9 aa, Homo Sapiens
LEQPDSWQP

SEQ ID NO: 594373 - protein, 9 aa, Homo Sapiens
NALIAAGKG

SEQ ID NO: 594374 - protein, 9 aa, Homo Sapiens
AQYMFLWQR

SEQ ID NO: 594375 - protein, 9 aa, Homo Sapiens
HTFSNLETF

SEQ ID NO: 594376 - protein, 9 aa, Homo Sapiens
PLRYTNPMS

SEQ ID NO: 594377 - protein, 9 aa, Homo Sapiens
DWLMAPGRG

SEQ ID NO: 594378 - protein, 9 aa, Homo Sapiens
ALIAAGKGI

SEQ ID NO: 594379 - protein, 9 aa, Homo Sapiens
LAGGSWRTK

SEQ ID NO: 594380 - protein, 9 aa, Homo Sapiens
RQSSGHSRQ

SEQ ID NO: 594381 - protein, 9 aa, Homo Sapiens
QSTYISAIG

SEQ ID NO: 594382 - protein, 9 aa, Homo Sapiens
QNKDHMLEI

SEQ ID NO: 594383 - protein, 9 aa, Homo Sapiens
PMNAHSNFI

SEQ ID NO: 594384 - protein, 9 aa, Homo Sapiens
HWTGGCPFR

SEQ ID NO: 594385 - protein, 9 aa, Homo Sapiens
EKEFLCEKC

SEQ ID NO: 594386 - protein, 9 aa, Homo Sapiens
RDVKPKTPF

SEQ ID NO: 594387 - protein, 9 aa, Homo Sapiens
EPKFFSIRI

SEQ ID NO: 594388 - protein, 9 aa, Homo Sapiens
DGTYFKIRA

SEQ ID NO: 594389 - protein, 9 aa, Homo Sapiens
IAVTPLKLA

SEQ ID NO: 594390 - protein, 9 aa, Homo Sapiens
GQPPPHAEP

SEQ ID NO: 594391 - protein, 9 aa, Homo Sapiens
LAGWQCPEC

SEQ ID NO: 594392 - protein, 9 aa, Homo Sapiens
SEDHPHRRC

SEQ ID NO: 594393 - protein, 9 aa, Homo Sapiens
AHNSENICW

SEQ ID NO: 594394 - protein, 9 aa, Homo Sapiens
VLQFFLFLP

SEQ ID NO: 594395 - protein, 9 aa, Homo Sapiens
SVVYIVQEY

SEQ ID NO: 594396 - protein, 9 aa, Homo Sapiens
AVTPLKLAG

SEQ ID NO: 594397 - protein, 9 aa, Homo Sapiens
EGQYRQPPG

SEQ ID NO: 594398 - protein, 9 aa, Homo Sapiens
TDACLSHLC

SEQ ID NO: 594399 - protein, 9 aa, Homo Sapiens
NWREAQKLS

SEQ ID NO: 594400 - protein, 9 aa, Homo Sapiens
VDGSYRIGI

SEQ ID NO: 594401 - protein, 9 aa, Homo Sapiens
RDWLMAPGR

SEQ ID NO: 594402 - protein, 9 aa, Homo Sapiens
KTPFWYQYD

SEQ ID NO: 594403 - protein, 9 aa, Homo Sapiens
TYISAIGER

SEQ ID NO: 594404 - protein, 9 aa, Homo Sapiens
PARETGRNY

SEQ ID NO: 594405 - protein, 9 aa, Homo Sapiens
QLTQQLAQA

SEQ ID NO: 594406 - protein, 9 aa, Homo Sapiens
VGDNWREAQ

SEQ ID NO: 594407 - protein, 9 aa, Homo Sapiens
WTDACLSHL

SEQ ID NO: 594408 - protein, 9 aa, Homo Sapiens
AKIRYHMPV

SEQ ID NO: 594409 - protein, 9 aa, Homo Sapiens
DEPKFFSIR

SEQ ID NO: 594410 - protein, 9 aa, Homo Sapiens
RNALIAAGK

SEQ ID NO: 594411 - protein, 9 aa, Homo Sapiens
TPFWYQYDV

SEQ ID NO: 594412 - protein, 9 aa, Homo Sapiens
SWQPYGSSF

SEQ ID NO: 594413 - protein, 9 aa, Homo Sapiens
FIKTCSQGF

SEQ ID NO: 594414 - protein, 9 aa, Homo Sapiens
HPHRRCRRG

SEQ ID NO: 594415 - protein, 9 aa, Homo Sapiens
PGLPRGQPC

SEQ ID NO: 594416 - protein, 9 aa, Homo Sapiens
TAGQPGSGG

SEQ ID NO: 594417 - protein, 9 aa, Homo Sapiens
WAKIRYHMP

SEQ ID NO: 594418 - protein, 9 aa, Homo Sapiens
ICWSTFPST

SEQ ID NO: 594419 - protein, 9 aa, Homo Sapiens
GGCPFREGV

SEQ ID NO: 594420 - protein, 9 aa, Homo Sapiens
AQKLSVSTQ

SEQ ID NO: 594421 - protein, 9 aa, Homo Sapiens
LFLGAGLFL

SEQ ID NO: 594422 - protein, 9 aa, Homo Sapiens
LGEEREKRR

SEQ ID NO: 594423 - protein, 9 aa, Homo Sapiens
EESPDEQSE

SEQ ID NO: 594424 - protein, 9 aa, Homo Sapiens
AEPGQPPPH

SEQ ID NO: 594425 - protein, 9 aa, Homo Sapiens
LPRDWLMAP

SEQ ID NO: 594426 - protein, 9 aa, Homo Sapiens
AQSLAGGSW

SEQ ID NO: 594427 - protein, 9 aa, Homo Sapiens
GGSWRTKEE

SEQ ID NO: 594428 - protein, 9 aa, Homo Sapiens
GRNYPEDDM

SEQ ID NO: 594429 - protein, 9 aa, Homo Sapiens
GLPRGQPCR

SEQ ID NO: 594430 - protein, 9 aa, Homo Sapiens
QFFLFLPSM

SEQ ID NO: 594431 - protein, 9 aa, Homo Sapiens
SVSRGLSSP

SEQ ID NO: 594432 - protein, 9 aa, Homo Sapiens
EKMDLEESP

SEQ ID NO: 594433 - protein, 9 aa, Homo Sapiens
DHPHRRCRR

SEQ ID NO: 594434 - protein, 9 aa, Homo Sapiens
VKILKHWTG

SEQ ID NO: 594435 - protein, 9 aa, Homo Sapiens
NGLCIWLLI

SEQ ID NO: 594436 - protein, 9 aa, Homo Sapiens
ILAHNSENI

SEQ ID NO: 594437 - protein, 9 aa, Homo Sapiens
YRIGIANFV

SEQ ID NO: 594438 - protein, 9 aa, Homo Sapiens
SCHCSAEGQ

SEQ ID NO: 594439 - protein, 9 aa, Homo Sapiens
TFPSTRIFS

SEQ ID NO: 594440 - protein, 9 aa, Homo Sapiens
YATQQLTQQ

SEQ ID NO: 594441 - protein, 9 aa, Homo Sapiens
GELFKFSVV

SEQ ID NO: 594442 - protein, 9 aa, Homo Sapiens
CLEQPDSWQ

SEQ ID NO: 594443 - protein, 9 aa, Homo Sapiens
SCCPTCNRV

SEQ ID NO: 594444 - protein, 9 aa, Homo Sapiens
PDSWQPYGS

SEQ ID NO: 594445 - protein, 9 aa, Homo Sapiens
DVKPKTPFW

SEQ ID NO: 594446 - protein, 9 aa, Homo Sapiens
LLPRDWLMA

SEQ ID NO: 594447 - protein, 9 aa, Homo Sapiens
SLAGGSWRT

SEQ ID NO: 594448 - protein, 9 aa, Homo Sapiens
PPFSSCCSV

SEQ ID NO: 594449 - protein, 9 aa, Homo Sapiens
QYRQPPGLP

SEQ ID NO: 594450 - protein, 9 aa, Homo Sapiens
PAEPGQPPP

SEQ ID NO: 594451 - protein, 9 aa, Homo Sapiens
HMLEILEGK

SEQ ID NO: 594452 - protein, 9 aa, Homo Sapiens
SGQLGFSCR

SEQ ID NO: 594453 - protein, 9 aa, Homo Sapiens
RILAHNSEN

SEQ ID NO: 594454 - protein, 9 aa, Homo Sapiens
NRMPSVTEA

SEQ ID NO: 594455 - protein, 9 aa, Homo Sapiens
PPGLPRGQP

SEQ ID NO: 594456 - protein, 9 aa, Homo Sapiens
GSGGQPGSS

SEQ ID NO: 594457 - protein, 9 aa, Homo Sapiens
SGHSRQGSG

SEQ ID NO: 594458 - protein, 9 aa, Homo Sapiens
RFWAKIRYH

SEQ ID NO: 594459 - protein, 9 aa, Homo Sapiens
SRFWAKIRY

SEQ ID NO: 594460 - protein, 9 aa, Homo Sapiens
EEKMDLEES

SEQ ID NO: 594461 - protein, 9 aa, Homo Sapiens
IDQNKDHML

SEQ ID NO: 594462 - protein, 9 aa, Homo Sapiens
REMAVCTAG

SEQ ID NO: 594463 - protein, 9 aa, Homo Sapiens
YMFLWQRLQ

SEQ ID NO: 594464 - protein, 9 aa, Homo Sapiens
LGFSCRYGE

SEQ ID NO: 594465 - protein, 9 aa, Homo Sapiens
GLCIWLLIL

SEQ ID NO: 594466 - protein, 9 aa, Homo Sapiens
SAEGQYRQP

SEQ ID NO: 594467 - protein, 9 aa, Homo Sapiens
CRRGLECDG

SEQ ID NO: 594468 - protein, 9 aa, Homo Sapiens
FSCRYGEDY

SEQ ID NO: 594469 - protein, 9 aa, Homo Sapiens
LNRMPSVTE

SEQ ID NO: 594470 - protein, 9 aa, Homo Sapiens
VRELFVMAW

SEQ ID NO: 594471 - protein, 9 aa, Homo Sapiens
QPGSSCHCS

SEQ ID NO: 594472 - protein, 9 aa, Homo Sapiens
PKCPPFSSC

SEQ ID NO: 594473 - protein, 9 aa, Homo Sapiens
PGSSCHCSA

SEQ ID NO: 594474 - protein, 9 aa, Homo Sapiens
CRHTVPAEP

SEQ ID NO: 594475 - protein, 9 aa, Homo Sapiens
HSNFIYDAS

SEQ ID NO: 594476 - protein, 9 aa, Homo Sapiens
PFSSCCSVS

SEQ ID NO: 594477 - protein, 9 aa, Homo Sapiens
LQFFLFLPS

SEQ ID NO: 594478 - protein, 9 aa, Homo Sapiens
SQSCCPTCN

SEQ ID NO: 594479 - protein, 9 aa, Homo Sapiens
TYFKIRAIY

SEQ ID NO: 594480 - protein, 9 aa, Homo Sapiens
GGQPGSSCH

SEQ ID NO: 594481 - protein, 9 aa, Homo Sapiens
SENICWSTF

SEQ ID NO: 594482 - protein, 9 aa, Homo Sapiens
FLYFRNQKG

SEQ ID NO: 594483 - protein, 9 aa, Homo Sapiens
RILNFIKTC

SEQ ID NO: 594484 - protein, 9 aa, Homo Sapiens
KDHMLEILE

SEQ ID NO: 594485 - protein, 9 aa, Homo Sapiens
LNFIKTCSQ

SEQ ID NO: 594486 - protein, 9 aa, Homo Sapiens
LGAGLFLYF

SEQ ID NO: 594487 - protein, 9 aa, Homo Sapiens
EKVTSANKT

SEQ ID NO: 594488 - protein, 9 aa, Homo Sapiens
TFVLQFFLF

SEQ ID NO: 594489 - protein, 9 aa, Homo Sapiens
VPAEPGQPP

SEQ ID NO: 594490 - protein, 9 aa, Homo Sapiens
NKTNKQTTT

SEQ ID NO: 594491 - protein, 9 aa, Homo Sapiens
RETGRNYPE

SEQ ID NO: 594492 - protein, 9 aa, Homo Sapiens
KIRAIYDKP

SEQ ID NO: 594493 - protein, 9 aa, Homo Sapiens
RGLSSPSQG

SEQ ID NO: 594494 - protein, 9 aa, Homo Sapiens
RHTVPAEPG

SEQ ID NO: 594495 - protein, 9 aa, Homo Sapiens
RGQPCRHTV

SEQ ID NO: 594496 - protein, 9 aa, Homo Sapiens
GHSRQGSGS

SEQ ID NO: 594497 - protein, 9 aa, Homo Sapiens
VLLPRDWLM

SEQ ID NO: 594498 - protein, 9 aa, Homo Sapiens
TQQLTQQLA

SEQ ID NO: 594499 - protein, 9 aa, Homo Sapiens
RELFVMAWE

SEQ ID NO: 594500 - protein, 9 aa, Homo Sapiens
VRLEELTPA

SEQ ID NO: 594501 - protein, 9 aa, Homo Sapiens
QGAHGESSL

SEQ ID NO: 594502 - protein, 9 aa, Homo Sapiens
FSVVYIVQE

SEQ ID NO: 594503 - protein, 9 aa, Homo Sapiens
QPCRHTVPA

SEQ ID NO: 594504 - protein, 9 aa, Homo Sapiens
CSQGFPGGV

SEQ ID NO: 594505 - protein, 9 aa, Homo Sapiens
SCLEQPDSW

SEQ ID NO: 594506 - protein, 9 aa, Homo Sapiens
RQPPGLPRG

SEQ ID NO: 594507 - protein, 9 aa, Homo Sapiens
PHRRCRRGL

SEQ ID NO: 594508 - protein, 9 aa, Homo Sapiens
CPTCNRVGT

SEQ ID NO: 594509 - protein, 9 aa, Homo Sapiens
GSWRTKEEE

SEQ ID NO: 594510 - protein, 9 aa, Homo Sapiens
STFPSTRIF

SEQ ID NO: 594511 - protein, 9 aa, Homo Sapiens
PSSPSVSRG

SEQ ID NO: 594512 - protein, 9 aa, Homo Sapiens
KHTFSNLET

SEQ ID NO: 594513 - protein, 9 aa, Homo Sapiens
CWSTFPSTR

SEQ ID NO: 594514 - protein, 9 aa, Homo Sapiens
TSANKTNKQ

SEQ ID NO: 594515 - protein, 9 aa, Homo Sapiens
WRTKEEELQ

SEQ ID NO: 594516 - protein, 9 aa, Homo Sapiens
SSPSVSRGL

SEQ ID NO: 594517 - protein, 9 aa, Homo Sapiens
DIAVTPLKL

SEQ ID NO: 594518 - protein, 9 aa, Homo Sapiens
HTVPAEPGQ

SEQ ID NO: 594519 - protein, 9 aa, Homo Sapiens
SLNRMPSVT

SEQ ID NO: 594520 - protein, 9 aa, Homo Sapiens
PKTPFWYQY

SEQ ID NO: 594521 - protein, 9 aa, Homo Sapiens
KTCSQGFPG

SEQ ID NO: 594522 - protein, 9 aa, Homo Sapiens
GQPGSSCHC

SEQ ID NO: 594523 - protein, 9 aa, Homo Sapiens
LVTFVLQFF

SEQ ID NO: 594524 - protein, 9 aa, Homo Sapiens
MAKHTFSNL

SEQ ID NO: 594525 - protein, 9 aa, Homo Sapiens
KFFSIRILA

SEQ ID NO: 594526 - protein, 9 aa, Homo Sapiens
GSYRIGIAN

SEQ ID NO: 594527 - protein, 9 aa, Homo Sapiens
RRCRRGLEC

SEQ ID NO: 594528 - protein, 9 aa, Homo Sapiens
WQRLQALDT

SEQ ID NO: 594529 - protein, 9 aa, Homo Sapiens
KVTSANKTN

SEQ ID NO: 594530 - protein, 9 aa, Homo Sapiens
NYPEDDMQL

SEQ ID NO: 594531 - protein, 9 aa, Homo Sapiens
FSIRILAHN

SEQ ID NO: 594532 - protein, 9 aa, Homo Sapiens
REAQKLSVS

SEQ ID NO: 594533 - protein, 9 aa, Homo Sapiens
ARETGRNYP

SEQ ID NO: 594534 - protein, 9 aa, Homo Sapiens
SPEKVTSAN

SEQ ID NO: 594535 - protein, 9 aa, Homo Sapiens
LFLYFRNQK

SEQ ID NO: 594536 - protein, 9 aa, Homo Sapiens
FVMAWEHAP

SEQ ID NO: 594537 - protein, 9 aa, Homo Sapiens
STYISAIGE

SEQ ID NO: 594538 - protein, 9 aa, Homo Sapiens
HPLRYTNPM

SEQ ID NO: 594539 - protein, 9 aa, Homo Sapiens
RIGIANFVK

SEQ ID NO: 594540 - protein, 9 aa, Homo Sapiens
LTQQLAQAQ

SEQ ID NO: 594541 - protein, 9 aa, Homo Sapiens
MPSVTEASP

SEQ ID NO: 594542 - protein, 9 aa, Homo Sapiens
ISSLNRMPS

SEQ ID NO: 594543 - protein, 9 aa, Homo Sapiens
LEESPDEQS

SEQ ID NO: 594544 - protein, 9 aa, Homo Sapiens
KCPPKCPPF

SEQ ID NO: 594545 - protein, 9 aa, Homo Sapiens
WREAQKLSV

SEQ ID NO: 594546 - protein, 9 aa, Homo Sapiens
FSSCCSVSS

SEQ ID NO: 594547 - protein, 9 aa, Homo Sapiens
AKHTFSNLE

SEQ ID NO: 594548 - protein, 9 aa, Homo Sapiens
TDAQYMFLW

SEQ ID NO: 594549 - protein, 9 aa, Homo Sapiens
NAHSNFIYD

SEQ ID NO: 594550 - protein, 9 aa, Homo Sapiens
FRDEPKFFS

SEQ ID NO: 594551 - protein, 9 aa, Homo Sapiens
RMPSVTEAS

SEQ ID NO: 594552 - protein, 9 aa, Homo Sapiens
CHCSAEGQY

SEQ ID NO: 594553 - protein, 9 aa, Homo Sapiens
NKDHMLEIL

SEQ ID NO: 594554 - protein, 9 aa, Homo Sapiens
GQPCRHTVP

SEQ ID NO: 594555 - protein, 9 aa, Homo Sapiens
EELTPAPST

SEQ ID NO: 594556 - protein, 9 aa, Homo Sapiens
LWQRLQALD

SEQ ID NO: 594557 - protein, 9 aa, Homo Sapiens
TVPAEPGQP

SEQ ID NO: 594558 - protein, 9 aa, Homo Sapiens
KIRYHMPVK

SEQ ID NO: 594559 - protein, 9 aa, Homo Sapiens
PCRHTVPAE

SEQ ID NO: 594560 - protein, 9 aa, Homo Sapiens
MNAHSNFIY

SEQ ID NO: 594561 - protein, 9 aa, Homo Sapiens
SSLNRMPSV

SEQ ID NO: 594562 - protein, 9 aa, Homo Sapiens
QPDSWQPYG

SEQ ID NO: 594563 - protein, 9 aa, Homo Sapiens
AAGKGIVIL

SEQ ID NO: 594564 - protein, 9 aa, Homo Sapiens
CEKCFFRDE

SEQ ID NO: 594565 - protein, 9 aa, Homo Sapiens
AGQPGSGGQ

SEQ ID NO: 594566 - protein, 9 aa, Homo Sapiens
QYMFLWQRL

SEQ ID NO: 594567 - protein, 9 aa, Homo Sapiens
YFKIRAIYD

SEQ ID NO: 594568 - protein, 9 aa, Homo Sapiens
IMTNGLCIW

SEQ ID NO: 594569 - protein, 9 aa, Homo Sapiens
LFVMAWEHA

SEQ ID NO: 594570 - protein, 9 aa, Homo Sapiens
FVLQFFLFL

SEQ ID NO: 594571 - protein, 9 aa, Homo Sapiens
LLRALRCHS

SEQ ID NO: 594572 - protein, 9 aa, Homo Sapiens
SKNVSVISF

SEQ ID NO: 594573 - protein, 9 aa, Homo Sapiens
KDSCCDMSV

SEQ ID NO: 594574 - protein, 9 aa, Homo Sapiens
HGPAPVGRF

SEQ ID NO: 594575 - protein, 9 aa, Homo Sapiens
SSCYFFLPL

SEQ ID NO: 594576 - protein, 9 aa, Homo Sapiens
QTLQTYQGH

SEQ ID NO: 594577 - protein, 9 aa, Homo Sapiens
AAELSAQKR

SEQ ID NO: 594578 - protein, 9 aa, Homo Sapiens
SSLTVAYGP

SEQ ID NO: 594579 - protein, 9 aa, Homo Sapiens
VNRTLQADF

SEQ ID NO: 594580 - protein, 9 aa, Homo Sapiens
QCALCRHST

SEQ ID NO: 594581 - protein, 9 aa, Homo Sapiens
RPFPPAPRI

SEQ ID NO: 594582 - protein, 9 aa, Homo Sapiens
SHVCSRTPV

SEQ ID NO: 594583 - protein, 9 aa, Homo Sapiens
PFPPAPRID

SEQ ID NO: 594584 - protein, 9 aa, Homo Sapiens
QRSERSSLT

SEQ ID NO: 594585 - protein, 9 aa, Homo Sapiens
VAVPSISQV

SEQ ID NO: 594586 - protein, 9 aa, Homo Sapiens
VSLPELEDW

SEQ ID NO: 594587 - protein, 9 aa, Homo Sapiens
PLQCWGRRR

SEQ ID NO: 594588 - protein, 9 aa, Homo Sapiens
SWSGDPACS

SEQ ID NO: 594589 - protein, 9 aa, Homo Sapiens
VGTARMLQL

SEQ ID NO: 594590 - protein, 9 aa, Homo Sapiens
NASSFHVNL

SEQ ID NO: 594591 - protein, 9 aa, Homo Sapiens
TVKTPSTKA

SEQ ID NO: 594592 - protein, 9 aa, Homo Sapiens
SVISFTENM

SEQ ID NO: 594593 - protein, 9 aa, Homo Sapiens
LIWELSRFQ

SEQ ID NO: 594594 - protein, 9 aa, Homo Sapiens
GAINQERRV

SEQ ID NO: 594595 - protein, 9 aa, Homo Sapiens
CECFPCYES

SEQ ID NO: 594596 - protein, 9 aa, Homo Sapiens
LGVDLKEED

SEQ ID NO: 594597 - protein, 9 aa, Homo Sapiens
PPAPGSSCY

SEQ ID NO: 594598 - protein, 9 aa, Homo Sapiens
LRALRCHSL

SEQ ID NO: 594599 - protein, 9 aa, Homo Sapiens
PDPAVPDGH

SEQ ID NO: 594600 - protein, 9 aa, Homo Sapiens
QMQKSPIFC

SEQ ID NO: 594601 - protein, 9 aa, Homo Sapiens
RALRCHSLT

SEQ ID NO: 594602 - protein, 9 aa, Homo Sapiens
VTGAPQLEE

SEQ ID NO: 594603 - protein, 9 aa, Homo Sapiens
SHQQSHRKK

SEQ ID NO: 594604 - protein, 9 aa, Homo Sapiens
VLVVLILIL

SEQ ID NO: 594605 - protein, 9 aa, Homo Sapiens
VILQTLEGH

SEQ ID NO: 594606 - protein, 9 aa, Homo Sapiens
MLGAINQER

SEQ ID NO: 594607 - protein, 9 aa, Homo Sapiens
GSGLRRSSL

SEQ ID NO: 594608 - protein, 9 aa, Homo Sapiens
QALLRALRC

SEQ ID NO: 594609 - protein, 9 aa, Homo Sapiens
TLQQLSLHF

SEQ ID NO: 594610 - protein, 9 aa, Homo Sapiens
DLNDNDPVF

SEQ ID NO: 594611 - protein, 9 aa, Homo Sapiens
HHMEALLQS

SEQ ID NO: 594612 - protein, 9 aa, Homo Sapiens
HSDAQKLAM

SEQ ID NO: 594613 - protein, 9 aa, Homo Sapiens
QVLRIWLCP

SEQ ID NO: 594614 - protein, 9 aa, Homo Sapiens
TPLKQPCGL

SEQ ID NO: 594615 - protein, 9 aa, Homo Sapiens
VKSFQYSHN

SEQ ID NO: 594616 - protein, 9 aa, Homo Sapiens
GTARMLQLA

SEQ ID NO: 594617 - protein, 9 aa, Homo Sapiens
SSHPLVLPN

SEQ ID NO: 594618 - protein, 9 aa, Homo Sapiens
VLEEMLHNF

SEQ ID NO: 594619 - protein, 9 aa, Homo Sapiens
PLSSLKSLT

SEQ ID NO: 594620 - protein, 9 aa, Homo Sapiens
VPKVNRTLQ

SEQ ID NO: 594621 - protein, 9 aa, Homo Sapiens
QEEEEELRV

SEQ ID NO: 594622 - protein, 9 aa, Homo Sapiens
HNFSGYHIG

SEQ ID NO: 594623 - protein, 9 aa, Homo Sapiens
PGTRVRAMS

SEQ ID NO: 594624 - protein, 9 aa, Homo Sapiens
EARPFPPAP

SEQ ID NO: 594625 - protein, 9 aa, Homo Sapiens
CSGSGLRRS

SEQ ID NO: 594626 - protein, 9 aa, Homo Sapiens
RSSLTVAYG

SEQ ID NO: 594627 - protein, 9 aa, Homo Sapiens
TSSVTGAPQ

SEQ ID NO: 594628 - protein, 9 aa, Homo Sapiens
LQTLQTYQG

SEQ ID NO: 594629 - protein, 9 aa, Homo Sapiens
GSGTRRDSR

SEQ ID NO: 594630 - protein, 9 aa, Homo Sapiens
NDPVFPDPS

SEQ ID NO: 594631 - protein, 9 aa, Homo Sapiens
IQAVKEYVE

SEQ ID NO: 594632 - protein, 9 aa, Homo Sapiens
AMPDPAVPD

SEQ ID NO: 594633 - protein, 9 aa, Homo Sapiens
AVPSISQVL

SEQ ID NO: 594634 - protein, 9 aa, Homo Sapiens
LDSTLQQLS

SEQ ID NO: 594635 - protein, 9 aa, Homo Sapiens
AINQERRVS

SEQ ID NO: 594636 - protein, 9 aa, Homo Sapiens
SSVTGAPQL

SEQ ID NO: 594637 - protein, 9 aa, Homo Sapiens
NAVLIWELS

SEQ ID NO: 594638 - protein, 9 aa, Homo Sapiens
LAEPKKSHQ

SEQ ID NO: 594639 - protein, 9 aa, Homo Sapiens
HALKFGDTE

SEQ ID NO: 594640 - protein, 9 aa, Homo Sapiens
RQDCARPSP

SEQ ID NO: 594641 - protein, 9 aa, Homo Sapiens
YFFLPLAPA

SEQ ID NO: 594642 - protein, 9 aa, Homo Sapiens
AQKHEPRVP

SEQ ID NO: 594643 - protein, 9 aa, Homo Sapiens
CSWDSALRL

SEQ ID NO: 594644 - protein, 9 aa, Homo Sapiens
MPSPEARVL

SEQ ID NO: 594645 - protein, 9 aa, Homo Sapiens
GFLLIPKFS

SEQ ID NO: 594646 - protein, 9 aa, Homo Sapiens
PSATVKTPS

SEQ ID NO: 594647 - protein, 9 aa, Homo Sapiens
RAMPSPEAR

SEQ ID NO: 594648 - protein, 9 aa, Homo Sapiens
NQKNIPLAH

SEQ ID NO: 594649 - protein, 9 aa, Homo Sapiens
APGSSCYFF

SEQ ID NO: 594650 - protein, 9 aa, Homo Sapiens
KLRLCLFTL

SEQ ID NO: 594651 - protein, 9 aa, Homo Sapiens
AEPKKSHQQ

SEQ ID NO: 594652 - protein, 9 aa, Homo Sapiens
RYKCEAGGS

SEQ ID NO: 594653 - protein, 9 aa, Homo Sapiens
PWRDVGSPY

SEQ ID NO: 594654 - protein, 9 aa, Homo Sapiens
AGTHHMEAL

SEQ ID NO: 594655 - protein, 9 aa, Homo Sapiens
CWGRRRRQW

SEQ ID NO: 594656 - protein, 9 aa, Homo Sapiens
CGLRAMPSP

SEQ ID NO: 594657 - protein, 9 aa, Homo Sapiens
SPPRLDLQT

SEQ ID NO: 594658 - protein, 9 aa, Homo Sapiens
PKQEHEDRR

SEQ ID NO: 594659 - protein, 9 aa, Homo Sapiens
VAVHGPAPV

SEQ ID NO: 594660 - protein, 9 aa, Homo Sapiens
QVSLPELED

SEQ ID NO: 594661 - protein, 9 aa, Homo Sapiens
ASFWVLCCQ

SEQ ID NO: 594662 - protein, 9 aa, Homo Sapiens
MAWQVSLPE

SEQ ID NO: 594663 - protein, 9 aa, Homo Sapiens
GVDLKEEDP

SEQ ID NO: 594664 - protein, 9 aa, Homo Sapiens
LDLQTLQTY

SEQ ID NO: 594665 - protein, 9 aa, Homo Sapiens
HSTTDCGGP

SEQ ID NO: 594666 - protein, 9 aa, Homo Sapiens
HEDRRHDKV

SEQ ID NO: 594667 - protein, 9 aa, Homo Sapiens
TVTVTIGFL

SEQ ID NO: 594668 - protein, 9 aa, Homo Sapiens
AVHGPAPVG

SEQ ID NO: 594669 - protein, 9 aa, Homo Sapiens
INQERRVSK

SEQ ID NO: 594670 - protein, 9 aa, Homo Sapiens
EHRPPAPGS

SEQ ID NO: 594671 - protein, 9 aa, Homo Sapiens
LSIFCKDTQ

SEQ ID NO: 594672 - protein, 9 aa, Homo Sapiens
PVQELRKLR

SEQ ID NO: 594673 - protein, 9 aa, Homo Sapiens
HFVDHPYPS

SEQ ID NO: 594674 - protein, 9 aa, Homo Sapiens
ALKFGDTEA

SEQ ID NO: 594675 - protein, 9 aa, Homo Sapiens
SLTSSVTGA

SEQ ID NO: 594676 - protein, 9 aa, Homo Sapiens
PSGHSDAQK

SEQ ID NO: 594677 - protein, 9 aa, Homo Sapiens
EVKCEENPE

SEQ ID NO: 594678 - protein, 9 aa, Homo Sapiens
LQADFPLGP

SEQ ID NO: 594679 - protein, 9 aa, Homo Sapiens
VWNYKLRLC

SEQ ID NO: 594680 - protein, 9 aa, Homo Sapiens
HVTILFLYC

SEQ ID NO: 594681 - protein, 9 aa, Homo Sapiens
DQLLPSDGI

SEQ ID NO: 594682 - protein, 9 aa, Homo Sapiens
QVIIPEASF

SEQ ID NO: 594683 - protein, 9 aa, Homo Sapiens
KWTAYDSHT

SEQ ID NO: 594684 - protein, 9 aa, Homo Sapiens
HIKENQKNI

SEQ ID NO: 594685 - protein, 9 aa, Homo Sapiens
DCARPSPSW

SEQ ID NO: 594686 - protein, 9 aa, Homo Sapiens
EAWDSEGMK

SEQ ID NO: 594687 - protein, 9 aa, Homo Sapiens
CALCRHSTT

SEQ ID NO: 594688 - protein, 9 aa, Homo Sapiens
LQQLSLHFL

SEQ ID NO: 594689 - protein, 9 aa, Homo Sapiens
CYESGFMLM

SEQ ID NO: 594690 - protein, 9 aa, Homo Sapiens
AASGNAVLI

SEQ ID NO: 594691 - protein, 9 aa, Homo Sapiens
AAAELSAQK

SEQ ID NO: 594692 - protein, 9 aa, Homo Sapiens
KHIKENQKN

SEQ ID NO: 594693 - protein, 9 aa, Homo Sapiens
PEASFWVLC

SEQ ID NO: 594694 - protein, 9 aa, Homo Sapiens
SSFHVNLLC

SEQ ID NO: 594695 - protein, 9 aa, Homo Sapiens
QEESELPVS

SEQ ID NO: 594696 - protein, 9 aa, Homo Sapiens
RSWSGDPAC

SEQ ID NO: 594697 - protein, 9 aa, Homo Sapiens
LFENSDRFS

SEQ ID NO: 594698 - protein, 9 aa, Homo Sapiens
LSLHFLGGS

SEQ ID NO: 594699 - protein, 9 aa, Homo Sapiens
WNMALDVRN

SEQ ID NO: 594700 - protein, 9 aa, Homo Sapiens
SFPLQCVGR

SEQ ID NO: 594701 - protein, 9 aa, Homo Sapiens
QIPWRDVGS

SEQ ID NO: 594702 - protein, 9 aa, Homo Sapiens
LHFVQKSAG

SEQ ID NO: 594703 - protein, 9 aa, Homo Sapiens
LAGPWSSEA

SEQ ID NO: 594704 - protein, 9 aa, Homo Sapiens
CSGSLSPSS

SEQ ID NO: 594705 - protein, 9 aa, Homo Sapiens
VSVISFTEN

SEQ ID NO: 594706 - protein, 9 aa, Homo Sapiens
LGAINQERR

SEQ ID NO: 594707 - protein, 9 aa, Homo Sapiens
GHSHFPAAV

SEQ ID NO: 594708 - protein, 9 aa, Homo Sapiens
LRRSSLSPT

SEQ ID NO: 594709 - protein, 9 aa, Homo Sapiens
VNLPDPQWK

SEQ ID NO: 594710 - protein, 9 aa, Homo Sapiens
NCSGSLSPS

SEQ ID NO: 594711 - protein, 9 aa, Homo Sapiens
ALLRALRCH

SEQ ID NO: 594712 - protein, 9 aa, Homo Sapiens
ELAVNLPDP

SEQ ID NO: 594713 - protein, 9 aa, Homo Sapiens
SSLKSLTYL

SEQ ID NO: 594714 - protein, 9 aa, Homo Sapiens
IKENQKNIP

SEQ ID NO: 594715 - protein, 9 aa, Homo Sapiens
QELRKLREN

SEQ ID NO: 594716 - protein, 9 aa, Homo Sapiens
LDSGIPSGA

SEQ ID NO: 594717 - protein, 9 aa, Homo Sapiens
SWFRSCSWD

SEQ ID NO: 594718 - protein, 9 aa, Homo Sapiens
IDHFVDHPY

SEQ ID NO: 594719 - protein, 9 aa, Homo Sapiens
NRTPLKQPC

SEQ ID NO: 594720 - protein, 9 aa, Homo Sapiens
YKCEAGGSC

SEQ ID NO: 594721 - protein, 9 aa, Homo Sapiens
LGPRVFPVP

SEQ ID NO: 594722 - protein, 9 aa, Homo Sapiens
LEPVPSGAL

SEQ ID NO: 594723 - protein, 9 aa, Homo Sapiens
PAIMVLRNI

SEQ ID NO: 594724 - protein, 9 aa, Homo Sapiens
EFFSDILLS

SEQ ID NO: 594725 - protein, 9 aa, Homo Sapiens
FKFTSSQNF

SEQ ID NO: 594726 - protein, 9 aa, Homo Sapiens
TLPPSREEL

SEQ ID NO: 594727 - protein, 9 aa, Homo Sapiens
RALDVIQAV

SEQ ID NO: 594728 - protein, 9 aa, Homo Sapiens
LAGTHHMEA

SEQ ID NO: 594729 - protein, 9 aa, Homo Sapiens
PCEVAVHGP

SEQ ID NO: 594730 - protein, 9 aa, Homo Sapiens
KENQKNIPL

SEQ ID NO: 594731 - protein, 9 aa, Homo Sapiens
NFGSKNVSV

SEQ ID NO: 594732 - protein, 9 aa, Homo Sapiens
SEAWDSEGM

SEQ ID NO: 594733 - protein, 9 aa, Homo Sapiens
VKEYVEHTV

SEQ ID NO: 594734 - protein, 9 aa, Homo Sapiens
LRNDFTDLF

SEQ ID NO: 594735 - protein, 9 aa, Homo Sapiens
WQVSLPELE

SEQ ID NO: 594736 - protein, 9 aa, Homo Sapiens
EALRAFQEE

SEQ ID NO: 594737 - protein, 9 aa, Homo Sapiens
ERSSLTVAY

SEQ ID NO: 594738 - protein, 9 aa, Homo Sapiens
EEEELRVLT

SEQ ID NO: 594739 - protein, 9 aa, Homo Sapiens
ESELPVSGQ

SEQ ID NO: 594740 - protein, 9 aa, Homo Sapiens
SLAAAAELS

SEQ ID NO: 594741 - protein, 9 aa, Homo Sapiens
LTSSVTGAP

SEQ ID NO: 594742 - protein, 9 aa, Homo Sapiens
MVLRNILKV

SEQ ID NO: 594743 - protein, 9 aa, Homo Sapiens
LMSPASSNC

SEQ ID NO: 594744 - protein, 9 aa, Homo Sapiens
SGNAVLIWE

SEQ ID NO: 594745 - protein, 9 aa, Homo Sapiens
KVNRTLQAD

SEQ ID NO: 594746 - protein, 9 aa, Homo Sapiens
IFHVTILFL

SEQ ID NO: 594747 - protein, 9 aa, Homo Sapiens
EVAVHGPAP

SEQ ID NO: 594748 - protein, 9 aa, Homo Sapiens
CARPSPSWF

SEQ ID NO: 594749 - protein, 9 aa, Homo Sapiens
FENSDRFSE

SEQ ID NO: 594750 - protein, 9 aa, Homo Sapiens
WGSFPLQCV

SEQ ID NO: 594751 - protein, 9 aa, Homo Sapiens
SGHSDAQKL

SEQ ID NO: 594752 - protein, 9 aa, Homo Sapiens
LKEEDPIRH

SEQ ID NO: 594753 - protein, 9 aa, Homo Sapiens
GSKNVSVIS

SEQ ID NO: 594754 - protein, 9 aa, Homo Sapiens
GLRRSSLSP

SEQ ID NO: 594755 - protein, 9 aa, Homo Sapiens
QDCARPSPS

SEQ ID NO: 594756 - protein, 9 aa, Homo Sapiens
QCVGRRRQW

SEQ ID NO: 594757 - protein, 9 aa, Homo Sapiens
SPASSNCSG

SEQ ID NO: 594758 - protein, 9 aa, Homo Sapiens
NQPDASIAQ

SEQ ID NO: 594759 - protein, 9 aa, Homo Sapiens
AYDSHTSEN

SEQ ID NO: 594760 - protein, 9 aa, Homo Sapiens
SSEAWDSEG

SEQ ID NO: 594761 - protein, 9 aa, Homo Sapiens
ANSEKLFDL

SEQ ID NO: 594762 - protein, 9 aa, Homo Sapiens
PVPSGALIK

SEQ ID NO: 594763 - protein, 9 aa, Homo Sapiens
SFPLQCWGR

SEQ ID NO: 594764 - protein, 9 aa, Homo Sapiens
SLHFLGGSM

SEQ ID NO: 594765 - protein, 9 aa, Homo Sapiens
CFPCYESGF

SEQ ID NO: 594766 - protein, 9 aa, Homo Sapiens
ALRLWEGPV

SEQ ID NO: 594767 - protein, 9 aa, Homo Sapiens
GLRAMPSPE

SEQ ID NO: 594768 - protein, 9 aa, Homo Sapiens
SSNCSGSLS

SEQ ID NO: 594769 - protein, 9 aa, Homo Sapiens
EGLRGAQTE

SEQ ID NO: 594770 - protein, 9 aa, Homo Sapiens
DPLSSLKSL

SEQ ID NO: 594771 - protein, 9 aa, Homo Sapiens
VPQEEEEEL

SEQ ID NO: 594772 - protein, 9 aa, Homo Sapiens
LVVLILILY

SEQ ID NO: 594773 - protein, 9 aa, Homo Sapiens
ALRCHSLTP

SEQ ID NO: 594774 - protein, 9 aa, Homo Sapiens
QAYCTSANF

SEQ ID NO: 594775 - protein, 9 aa, Homo Sapiens
QKSAGDYVP

SEQ ID NO: 594776 - protein, 9 aa, Homo Sapiens
RHDKVTDKG

SEQ ID NO: 594777 - protein, 9 aa, Homo Sapiens
RVAQKHEPR

SEQ ID NO: 594778 - protein, 9 aa, Homo Sapiens
DSHTSENAP

SEQ ID NO: 594779 - protein, 9 aa, Homo Sapiens
SSQNFSNCL

SEQ ID NO: 594780 - protein, 9 aa, Homo Sapiens
RSCSWDSAL

SEQ ID NO: 594781 - protein, 9 aa, Homo Sapiens
WEGPVQELR

SEQ ID NO: 594782 - protein, 9 aa, Homo Sapiens
LQSIRSWSG

SEQ ID NO: 594783 - protein, 9 aa, Homo Sapiens
IAEFFSDIL

SEQ ID NO: 594784 - protein, 9 aa, Homo Sapiens
RSCGSGTRR

SEQ ID NO: 594785 - protein, 9 aa, Homo Sapiens
LDPLSSLKS

SEQ ID NO: 594786 - protein, 9 aa, Homo Sapiens
PSWFRSCSW

SEQ ID NO: 594787 - protein, 9 aa, Homo Sapiens
AQLLGCSHV

SEQ ID NO: 594788 - protein, 9 aa, Homo Sapiens
EDPIRHYYA

SEQ ID NO: 594789 - protein, 9 aa, Homo Sapiens
FFLPLAPAS

SEQ ID NO: 594790 - protein, 9 aa, Homo Sapiens
LQCWGRRRR

SEQ ID NO: 594791 - protein, 9 aa, Homo Sapiens
QDTNKDSCC

SEQ ID NO: 594792 - protein, 9 aa, Homo Sapiens
ATALWNMAL

SEQ ID NO: 594793 - protein, 9 aa, Homo Sapiens
ELSAQKREQ

SEQ ID NO: 594794 - protein, 9 aa, Homo Sapiens
AGDYVPKEH

SEQ ID NO: 594795 - protein, 9 aa, Homo Sapiens
GNAVLIWEL

SEQ ID NO: 594796 - protein, 9 aa, Homo Sapiens
KDTQTVFQK

SEQ ID NO: 594797 - protein, 9 aa, Homo Sapiens
DILLSWFPF

SEQ ID NO: 594798 - protein, 9 aa, Homo Sapiens
YKLRLCLFT

SEQ ID NO: 594799 - protein, 9 aa, Homo Sapiens
SEGMKRSST

SEQ ID NO: 594800 - protein, 9 aa, Homo Sapiens
LGDLDPLSS

SEQ ID NO: 594801 - protein, 9 aa, Homo Sapiens
RDLNDNDPV

SEQ ID NO: 594802 - protein, 9 aa, Homo Sapiens
LKVIQAYCT

SEQ ID NO: 594803 - protein, 9 aa, Homo Sapiens
LCLFTLLGH

SEQ ID NO: 594804 - protein, 9 aa, Homo Sapiens
DAQILKVIQ

SEQ ID NO: 594805 - protein, 9 aa, Homo Sapiens
ELRKLRENL

SEQ ID NO: 594806 - protein, 9 aa, Homo Sapiens
TEGDSPLRG

SEQ ID NO: 594807 - protein, 9 aa, Homo Sapiens
DLKEEDPIR

SEQ ID NO: 594808 - protein, 9 aa, Homo Sapiens
KQTLHKPEA

SEQ ID NO: 594809 - protein, 9 aa, Homo Sapiens
SEKLFDLPI

SEQ ID NO: 594810 - protein, 9 aa, Homo Sapiens
DVGSPYVVE

SEQ ID NO: 594811 - protein, 9 aa, Homo Sapiens
ARMLQLAFG

SEQ ID NO: 594812 - protein, 9 aa, Homo Sapiens
DQTFKFTSS

SEQ ID NO: 594813 - protein, 9 aa, Homo Sapiens
LHNFDFCDI

SEQ ID NO: 594814 - protein, 9 aa, Homo Sapiens
FDFCDILVI

SEQ ID NO: 594815 - protein, 9 aa, Homo Sapiens
ALRAFQEES

SEQ ID NO: 594816 - protein, 9 aa, Homo Sapiens
LRGAQTEGD

SEQ ID NO: 594817 - protein, 9 aa, Homo Sapiens
IFCKDTQTV

SEQ ID NO: 594818 - protein, 9 aa, Homo Sapiens
ELRVLTLPL

SEQ ID NO: 594819 - protein, 9 aa, Homo Sapiens
DRRHDKVTD

SEQ ID NO: 594820 - protein, 9 aa, Homo Sapiens
PASSHPLVL

SEQ ID NO: 594821 - protein, 9 aa, Homo Sapiens
SPSSASTGQ

SEQ ID NO: 594822 - protein, 9 aa, Homo Sapiens
LPCEVAVHG

SEQ ID NO: 594823 - protein, 9 aa, Homo Sapiens
LVPPNASSF

SEQ ID NO: 594824 - protein, 9 aa, Homo Sapiens
TSPVGTARM

SEQ ID NO: 594825 - protein, 9 aa, Homo Sapiens
VIIPEASFW

SEQ ID NO: 594826 - protein, 9 aa, Homo Sapiens
LCEYILRND

SEQ ID NO: 594827 - protein, 9 aa, Homo Sapiens
EGPVQELRK

SEQ ID NO: 594828 - protein, 9 aa, Homo Sapiens
LQKVLVVLI

SEQ ID NO: 594829 - protein, 9 aa, Homo Sapiens
TLEHRPPAP

SEQ ID NO: 594830 - protein, 9 aa, Homo Sapiens
GGSCSSSIV

SEQ ID NO: 594831 - protein, 9 aa, Homo Sapiens
FRSCSWDSA

SEQ ID NO: 594832 - protein, 9 aa, Homo Sapiens
PKQIPWRDV

SEQ ID NO: 594833 - protein, 9 aa, Homo Sapiens
VCSRTPVET

SEQ ID NO: 594834 - protein, 9 aa, Homo Sapiens
EASFWVLCC

SEQ ID NO: 594835 - protein, 9 aa, Homo Sapiens
LQDQLLPSD

SEQ ID NO: 594836 - protein, 9 aa, Homo Sapiens
WGSFPLQCW

SEQ ID NO: 594837 - protein, 9 aa, Homo Sapiens
ALDVIQAVK

SEQ ID NO: 594838 - protein, 9 aa, Homo Sapiens
QKVLVVLIL

SEQ ID NO: 594839 - protein, 9 aa, Homo Sapiens
LTPESPLFH

SEQ ID NO: 594840 - protein, 9 aa, Homo Sapiens
LRLCLFTLL

SEQ ID NO: 594841 - protein, 9 aa, Homo Sapiens
EEDPIRHYY

SEQ ID NO: 594842 - protein, 9 aa, Homo Sapiens
WGSFPQHCA

SEQ ID NO: 594843 - protein, 9 aa, Homo Sapiens
ARDPAIMVL

SEQ ID NO: 594844 - protein, 9 aa, Homo Sapiens
RTPLKQPCG

SEQ ID NO: 594845 - protein, 9 aa, Homo Sapiens
GCSHVCSRT

SEQ ID NO: 594846 - protein, 9 aa, Homo Sapiens
SDQDTNKDS

SEQ ID NO: 594847 - protein, 9 aa, Homo Sapiens
SPVGTARML

SEQ ID NO: 594848 - protein, 9 aa, Homo Sapiens
SSLTSSVTG

SEQ ID NO: 594849 - protein, 9 aa, Homo Sapiens
SCQCALCRH

SEQ ID NO: 594850 - protein, 9 aa, Homo Sapiens
EHEDRRHDK

SEQ ID NO: 594851 - protein, 9 aa, Homo Sapiens
SQVLRIWLC

SEQ ID NO: 594852 - protein, 9 aa, Homo Sapiens
VHGPAPVGR

SEQ ID NO: 594853 - protein, 9 aa, Homo Sapiens
PICGLRAMP

SEQ ID NO: 594854 - protein, 9 aa, Homo Sapiens
THRKCVAKV

SEQ ID NO: 594855 - protein, 9 aa, Homo Sapiens
PVPRVPSAL

SEQ ID NO: 594856 - protein, 9 aa, Homo Sapiens
GRRRQWGSF

SEQ ID NO: 594857 - protein, 9 aa, Homo Sapiens
TPSTKAPPP

SEQ ID NO: 594858 - protein, 9 aa, Homo Sapiens
RSERSSLTV

SEQ ID NO: 594859 - protein, 9 aa, Homo Sapiens
PEAMMRILQ

SEQ ID NO: 594860 - protein, 9 aa, Homo Sapiens
AWDSEGMKR

SEQ ID NO: 594861 - protein, 9 aa, Homo Sapiens
LSAQKREQR

SEQ ID NO: 594862 - protein, 9 aa, Homo Sapiens
RDSRVQVNK

SEQ ID NO: 594863 - protein, 9 aa, Homo Sapiens
TCTQCVKSF

SEQ ID NO: 594864 - protein, 9 aa, Homo Sapiens
KCVAKVTSA

SEQ ID NO: 594865 - protein, 9 aa, Homo Sapiens
SVTGAPQLE

SEQ ID NO: 594866 - protein, 9 aa, Homo Sapiens
PSAVGRERH

SEQ ID NO: 594867 - protein, 9 aa, Homo Sapiens
KNVSVISFT

SEQ ID NO: 594868 - protein, 9 aa, Homo Sapiens
TVTIGFLLI

SEQ ID NO: 594869 - protein, 9 aa, Homo Sapiens
EEMLHNFDF

SEQ ID NO: 594870 - protein, 9 aa, Homo Sapiens
LCRHSTTDC

SEQ ID NO: 594871 - protein, 9 aa, Homo Sapiens
SWDSALRLW

SEQ ID NO: 594872 - protein, 9 aa, Homo Sapiens
QILKVIQAY

SEQ ID NO: 594873 - protein, 9 aa, Homo Sapiens
GLVPPNASS

SEQ ID NO: 594874 - protein, 9 aa, Homo Sapiens
KLAMMLQEQ

SEQ ID NO: 594875 - protein, 9 aa, Homo Sapiens
AVKEYVEHT

SEQ ID NO: 594876 - protein, 9 aa, Homo Sapiens
EMLHNFDFC

SEQ ID NO: 594877 - protein, 9 aa, Homo Sapiens
TLQTYQGHT

SEQ ID NO: 594878 - protein, 9 aa, Homo Sapiens
AWQVSLPEL

SEQ ID NO: 594879 - protein, 9 aa, Homo Sapiens
FPCYESGFM

SEQ ID NO: 594880 - protein, 9 aa, Homo Sapiens
RPSLQSIRS

SEQ ID NO: 594881 - protein, 9 aa, Homo Sapiens
ITIFHVTIL

SEQ ID NO: 594882 - protein, 9 aa, Homo Sapiens
RDGEVKCEE

SEQ ID NO: 594883 - protein, 9 aa, Homo Sapiens
VIQAVKEYV

SEQ ID NO: 594884 - protein, 9 aa, Homo Sapiens
GTRRDSRVQ

SEQ ID NO: 594885 - protein, 9 aa, Homo Sapiens
FPPAPRIDP

SEQ ID NO: 594886 - protein, 9 aa, Homo Sapiens
DLQTLQTYQ

SEQ ID NO: 594887 - protein, 9 aa, Homo Sapiens
KPYTCTQCV

SEQ ID NO: 594888 - protein, 9 aa, Homo Sapiens
PLKQPCGLP

SEQ ID NO: 594889 - protein, 9 aa, Homo Sapiens
ASYSLAGTH

SEQ ID NO: 594890 - protein, 9 aa, Homo Sapiens
VGRRRQWGS

SEQ ID NO: 594891 - protein, 9 aa, Homo Sapiens
PSLQSIRSW

SEQ ID NO: 594892 - protein, 9 aa, Homo Sapiens
NPVPQMQMQ

SEQ ID NO: 594893 - protein, 9 aa, Homo Sapiens
PASSNCSGS

SEQ ID NO: 594894 - protein, 9 aa, Homo Sapiens
CQCALCRHS

SEQ ID NO: 594895 - protein, 9 aa, Homo Sapiens
FVQKSAGDY

SEQ ID NO: 594896 - protein, 9 aa, Homo Sapiens
GRRRRQWGS

SEQ ID NO: 594897 - protein, 9 aa, Homo Sapiens
SNCSGSLSP

SEQ ID NO: 594898 - protein, 9 aa, Homo Sapiens
IHELAVNLP

SEQ ID NO: 594899 - protein, 9 aa, Homo Sapiens
TLQADFPLG

SEQ ID NO: 594900 - protein, 9 aa, Homo Sapiens
ARPFPPAPR

SEQ ID NO: 594901 - protein, 9 aa, Homo Sapiens
GIPSGATTT

SEQ ID NO: 594902 - protein, 9 aa, Homo Sapiens
RRQWGSFPL

SEQ ID NO: 594903 - protein, 9 aa, Homo Sapiens
RLKDEARPF

SEQ ID NO: 594904 - protein, 9 aa, Homo Sapiens
CRHSTTDCG

SEQ ID NO: 594905 - protein, 9 aa, Homo Sapiens
DSEGMKRSS

SEQ ID NO: 594906 - protein, 9 aa, Homo Sapiens
LKPEGHSHF

SEQ ID NO: 594907 - protein, 9 aa, Homo Sapiens
LAAAAELSA

SEQ ID NO: 594908 - protein, 9 aa, Homo Sapiens
QDIKNVILQ

SEQ ID NO: 594909 - protein, 9 aa, Homo Sapiens
IKNVILQTL

SEQ ID NO: 594910 - protein, 9 aa, Homo Sapiens
KPEAMMRIL

SEQ ID NO: 594911 - protein, 9 aa, Homo Sapiens
DSALRLWEG

SEQ ID NO: 594912 - protein, 9 aa, Homo Sapiens
PENNQPDAS

SEQ ID NO: 594913 - protein, 9 aa, Homo Sapiens
SISQVLRIW

SEQ ID NO: 594914 - protein, 9 aa, Homo Sapiens
LRAMPSPEA

SEQ ID NO: 594915 - protein, 9 aa, Homo Sapiens
RLDLQTLQT

SEQ ID NO: 594916 - protein, 9 aa, Homo Sapiens
GDLDPLSSL

SEQ ID NO: 594917 - protein, 9 aa, Homo Sapiens
RRQWGSFPQ

SEQ ID NO: 594918 - protein, 9 aa, Homo Sapiens
WDSEGMKRS

SEQ ID NO: 594919 - protein, 9 aa, Homo Sapiens
AAAAELSAQ

SEQ ID NO: 594920 - protein, 9 aa, Homo Sapiens
SALRLWEGP

SEQ ID NO: 594921 - protein, 9 aa, Homo Sapiens
PSGATTTAP

SEQ ID NO: 594922 - protein, 9 aa, Homo Sapiens
EPKQIPWRD

SEQ ID NO: 594923 - protein, 9 aa, Homo Sapiens
TARMLQLAF

SEQ ID NO: 594924 - protein, 9 aa, Homo Sapiens
VRAMSIYKQ

SEQ ID NO: 594925 - protein, 9 aa, Homo Sapiens
DAQKLAMML

SEQ ID NO: 594926 - protein, 9 aa, Homo Sapiens
KSAGDYVPK

SEQ ID NO: 594927 - protein, 9 aa, Homo Sapiens
DGEVKCEEN

SEQ ID NO: 594928 - protein, 9 aa, Homo Sapiens
KKSHQQSHR

SEQ ID NO: 594929 - protein, 9 aa, Homo Sapiens
QKHEPRVPT

SEQ ID NO: 594930 - protein, 9 aa, Homo Sapiens
AGRRRQDCA

SEQ ID NO: 594931 - protein, 9 aa, Homo Sapiens
GSCSSSIVR

SEQ ID NO: 594932 - protein, 9 aa, Homo Sapiens
PSPSWFRSC

SEQ ID NO: 594933 - protein, 9 aa, Homo Sapiens
HELAVNLPD

SEQ ID NO: 594934 - protein, 9 aa, Homo Sapiens
GHSDAQKLA

SEQ ID NO: 594935 - protein, 9 aa, Homo Sapiens
PKVNRTLQA

SEQ ID NO: 594936 - protein, 9 aa, Homo Sapiens
SLPELEDWL

SEQ ID NO: 594937 - protein, 9 aa, Homo Sapiens
PQLQKVLVV

SEQ ID NO: 594938 - protein, 9 aa, Homo Sapiens
FPQHCAGRR

SEQ ID NO: 594939 - protein, 9 aa, Homo Sapiens
VQKSAGDYV

SEQ ID NO: 594940 - protein, 9 aa, Homo Sapiens
ALGVDLKEE

SEQ ID NO: 594941 - protein, 9 aa, Homo Sapiens
HRPPAPGSS

SEQ ID NO: 594942 - protein, 9 aa, Homo Sapiens
ELGDLDPLS

SEQ ID NO: 594943 - protein, 9 aa, Homo Sapiens
VLIWELSRF

SEQ ID NO: 594944 - protein, 9 aa, Homo Sapiens
AGPWSSEAW

SEQ ID NO: 594945 - protein, 9 aa, Homo Sapiens
ILQTLEGHL

SEQ ID NO: 594946 - protein, 9 aa, Homo Sapiens
CEAGGSCSS

SEQ ID NO: 594947 - protein, 9 aa, Homo Sapiens
PELEDWLQC

SEQ ID NO: 594948 - protein, 9 aa, Homo Sapiens
ALWNMALDV

SEQ ID NO: 594949 - protein, 9 aa, Homo Sapiens
NFDFCDILV

SEQ ID NO: 594950 - protein, 9 aa, Homo Sapiens
VPENNQPDA

SEQ ID NO: 594951 - protein, 9 aa, Homo Sapiens
ASGNAVLIW

SEQ ID NO: 594952 - protein, 9 aa, Homo Sapiens
SITIFHVTI

SEQ ID NO: 594953 - protein, 9 aa, Homo Sapiens
ISQVLRIWL

SEQ ID NO: 594954 - protein, 9 aa, Homo Sapiens
NVILQTLEG

SEQ ID NO: 594955 - protein, 9 aa, Homo Sapiens
EELRVLTLP

SEQ ID NO: 594956 - protein, 9 aa, Homo Sapiens
QAVKEYVEH

SEQ ID NO: 594957 - protein, 9 aa, Homo Sapiens
LRAFQEESE

SEQ ID NO: 594958 - protein, 9 aa, Homo Sapiens
LWEGPVQEL

SEQ ID NO: 594959 - protein, 9 aa, Homo Sapiens
GALLKPEGH

SEQ ID NO: 594960 - protein, 9 aa, Homo Sapiens
DPVFPDPSI

SEQ ID NO: 594961 - protein, 9 aa, Homo Sapiens
RMLQLAFGC

SEQ ID NO: 594962 - protein, 9 aa, Homo Sapiens
IPSGATTTA

SEQ ID NO: 594963 - protein, 9 aa, Homo Sapiens
NDNDPVFPD

SEQ ID NO: 594964 - protein, 9 aa, Homo Sapiens
RLLCEYILR

SEQ ID NO: 594965 - protein, 9 aa, Homo Sapiens
AQTEGDSPL

SEQ ID NO: 594966 - protein, 9 aa, Homo Sapiens
RVFPVPRVP

SEQ ID NO: 594967 - protein, 9 aa, Homo Sapiens
VATALWNMA

SEQ ID NO: 594968 - protein, 9 aa, Homo Sapiens
SCSSSIVRV

SEQ ID NO: 594969 - protein, 9 aa, Homo Sapiens
AVPKVNRTL

SEQ ID NO: 594970 - protein, 9 aa, Homo Sapiens
PNMTPSAVG

SEQ ID NO: 594971 - protein, 9 aa, Homo Sapiens
SYLDSGIPS

SEQ ID NO: 594972 - protein, 9 aa, Homo Sapiens
SPSATVKTP

SEQ ID NO: 594973 - protein, 9 aa, Homo Sapiens
VDHPYPSSS

SEQ ID NO: 594974 - protein, 9 aa, Homo Sapiens
WDSALRLWE

SEQ ID NO: 594975 - protein, 9 aa, Homo Sapiens
LKFGDTEAD

SEQ ID NO: 594976 - protein, 9 aa, Homo Sapiens
WNYKLRLCL

SEQ ID NO: 594977 - protein, 9 aa, Homo Sapiens
GPVQELRKL

SEQ ID NO: 594978 - protein, 9 aa, Homo Sapiens
SIRSWSGDP

SEQ ID NO: 594979 - protein, 9 aa, Homo Sapiens
FPVPRVPSA

SEQ ID NO: 594980 - protein, 9 aa, Homo Sapiens
CVGRRRQWG

SEQ ID NO: 594981 - protein, 9 aa, Homo Sapiens
EGMKRSSTL

SEQ ID NO: 594982 - protein, 9 aa, Homo Sapiens
PLQDQLLPS

SEQ ID NO: 594983 - protein, 9 aa, Homo Sapiens
SIFCKDTQT

SEQ ID NO: 594984 - protein, 9 aa, Homo Sapiens
SDILLSWFP

SEQ ID NO: 594985 - protein, 9 aa, Homo Sapiens
GTHHMEALL

SEQ ID NO: 594986 - protein, 9 aa, Homo Sapiens
LAVNLPDPQ

SEQ ID NO: 594987 - protein, 9 aa, Homo Sapiens
LIKGAATFA

SEQ ID NO: 594988 - protein, 9 aa, Homo Sapiens
FQRSERSSL

SEQ ID NO: 594989 - protein, 9 aa, Homo Sapiens
AMPSPEARV

SEQ ID NO: 594990 - protein, 9 aa, Homo Sapiens
VQELRKLRE

SEQ ID NO: 594991 - protein, 9 aa, Homo Sapiens
QQLSLHFLG

SEQ ID NO: 594992 - protein, 9 aa, Homo Sapiens
PSISQVLRI

SEQ ID NO: 594993 - protein, 9 aa, Homo Sapiens
TSSQNFSNC

SEQ ID NO: 594994 - protein, 9 aa, Homo Sapiens
FQEESELPV

SEQ ID NO: 594995 - protein, 9 aa, Homo Sapiens
PEGHSHFPA

SEQ ID NO: 594996 - protein, 9 aa, Homo Sapiens
EPKKSHQQS

SEQ ID NO: 594997 - protein, 9 aa, Homo Sapiens
YAASGNAVL

SEQ ID NO: 594998 - protein, 9 aa, Homo Sapiens
ALLKPEGHS

SEQ ID NO: 594999 - protein, 9 aa, Homo Sapiens
RTLQADFPL

SEQ ID NO: 595000 - protein, 9 aa, Homo Sapiens
RLWEGPVQE

SEQ ID NO: 595001 - protein, 9 aa, Homo Sapiens
PGSSCYFFL

SEQ ID NO: 595002 - protein, 9 aa, Homo Sapiens
LNDNDPVFP

SEQ ID NO: 595003 - protein, 9 aa, Homo Sapiens
GTRVRAMSI

SEQ ID NO: 595004 - protein, 9 aa, Homo Sapiens
RRHDKVTDK

SEQ ID NO: 595005 - protein, 9 aa, Homo Sapiens
MQMQKSPIF

SEQ ID NO: 595006 - protein, 9 aa, Homo Sapiens
SIYKQSQHM

SEQ ID NO: 595007 - protein, 9 aa, Homo Sapiens
AELSAQKRE

SEQ ID NO: 595008 - protein, 9 aa, Homo Sapiens
MTPSAVGRE

SEQ ID NO: 595009 - protein, 9 aa, Homo Sapiens
MLHNFDFCD

SEQ ID NO: 595010 - protein, 9 aa, Homo Sapiens
PYTCTQCVK

SEQ ID NO: 595011 - protein, 9 aa, Homo Sapiens
KHEPRVPTC

SEQ ID NO: 595012 - protein, 9 aa, Homo Sapiens
PCYESGFML

SEQ ID NO: 595013 - protein, 9 aa, Homo Sapiens
VQALLRALR

SEQ ID NO: 595014 - protein, 9 aa, Homo Sapiens
KQIPWRDVG

SEQ ID NO: 595015 - protein, 9 aa, Homo Sapiens
SDRFSEDSS

SEQ ID NO: 595016 - protein, 9 aa, Homo Sapiens
ASSNCSGSL

SEQ ID NO: 595017 - protein, 9 aa, Homo Sapiens
AVLIWELSR

SEQ ID NO: 595018 - protein, 9 aa, Homo Sapiens
EYILRNDFT

SEQ ID NO: 595019 - protein, 9 aa, Homo Sapiens
DQVIIPEAS

SEQ ID NO: 595020 - protein, 9 aa, Homo Sapiens
QTLHKPEAM

SEQ ID NO: 595021 - protein, 9 aa, Homo Sapiens
TIGFLLIPK

SEQ ID NO: 595022 - protein, 9 aa, Homo Sapiens
TALWNMALD

SEQ ID NO: 595023 - protein, 9 aa, Homo Sapiens
GPWSSEAWD

SEQ ID NO: 595024 - protein, 9 aa, Homo Sapiens
PQHCAGRRR

SEQ ID NO: 595025 - protein, 9 aa, Homo Sapiens
VPRVPSALM

SEQ ID NO: 595026 - protein, 9 aa, Homo Sapiens
PSGALIKGA

SEQ ID NO: 595027 - protein, 9 aa, Homo Sapiens
VIQAYCTSA

SEQ ID NO: 595028 - protein, 9 aa, Homo Sapiens
MLQLAFGCT

SEQ ID NO: 595029 - protein, 9 aa, Homo Sapiens
CTQCVKSFQ

SEQ ID NO: 595030 - protein, 9 aa, Homo Sapiens
LYAMPDPAV

SEQ ID NO: 595031 - protein, 9 aa, Homo Sapiens
RTQRGERKP

SEQ ID NO: 595032 - protein, 9 aa, Homo Sapiens
RENLAGPWS

SEQ ID NO: 595033 - protein, 9 aa, Homo Sapiens
SFHVNLLCG

SEQ ID NO: 595034 - protein, 9 aa, Homo Sapiens
QWGSFPQHC

SEQ ID NO: 595035 - protein, 9 aa, Homo Sapiens
IQAYCTSAN

SEQ ID NO: 595036 - protein, 9 aa, Homo Sapiens
LKDEARPFP

SEQ ID NO: 595037 - protein, 9 aa, Homo Sapiens
AVPDGHLPA

SEQ ID NO: 595038 - protein, 9 aa, Homo Sapiens
IMVLRNILK

SEQ ID NO: 595039 - protein, 9 aa, Homo Sapiens
LRLWEGPVQ

SEQ ID NO: 595040 - protein, 9 aa, Homo Sapiens
SERSSLTVA

SEQ ID NO: 595041 - protein, 9 aa, Homo Sapiens
VATHRKCVA

SEQ ID NO: 595042 - protein, 9 aa, Homo Sapiens
TNKDSCCDM

SEQ ID NO: 595043 - protein, 9 aa, Homo Sapiens
AIMVLRNIL

SEQ ID NO: 595044 - protein, 9 aa, Homo Sapiens
CKDTQTVFQ

SEQ ID NO: 595045 - protein, 9 aa, Homo Sapiens
TSITIFHVT

SEQ ID NO: 595046 - protein, 9 aa, Homo Sapiens
RPSPSWFRS

SEQ ID NO: 595047 - protein, 9 aa, Homo Sapiens
WPLQDQLLP

SEQ ID NO: 595048 - protein, 9 aa, Homo Sapiens
SCYFFLPLA

SEQ ID NO: 595049 - protein, 9 aa, Homo Sapiens
HPLVLPNKL

SEQ ID NO: 595050 - protein, 9 aa, Homo Sapiens
AEFFSDILL

SEQ ID NO: 595051 - protein, 9 aa, Homo Sapiens
AQKLAMMLQ

SEQ ID NO: 595052 - protein, 9 aa, Homo Sapiens
LLPCEVAVH

SEQ ID NO: 595053 - protein, 9 aa, Homo Sapiens
DHFVDHPYP

SEQ ID NO: 595054 - protein, 9 aa, Homo Sapiens
REELTKNQV

SEQ ID NO: 595055 - protein, 9 aa, Homo Sapiens
LFHNFSGYH

SEQ ID NO: 595056 - protein, 9 aa, Homo Sapiens
DSDQDTNKD

SEQ ID NO: 595057 - protein, 9 aa, Homo Sapiens
MSIYKQSQH

SEQ ID NO: 595058 - protein, 9 aa, Homo Sapiens
RQWGSFPQH

SEQ ID NO: 595059 - protein, 9 aa, Homo Sapiens
DPAVPDGHL

SEQ ID NO: 595060 - protein, 9 aa, Homo Sapiens
NMTPSAVGR

SEQ ID NO: 595061 - protein, 9 aa, Homo Sapiens
VISFTENMG

SEQ ID NO: 595062 - protein, 9 aa, Homo Sapiens
YAMPDPAVP

SEQ ID NO: 595063 - protein, 9 aa, Homo Sapiens
AVATALWNM

SEQ ID NO: 595064 - protein, 9 aa, Homo Sapiens
HPYPSSSPM

SEQ ID NO: 595065 - protein, 9 aa, Homo Sapiens
KLRENLAGP

SEQ ID NO: 595066 - protein, 9 aa, Homo Sapiens
QELANSEKL

SEQ ID NO: 595067 - protein, 9 aa, Homo Sapiens
IIPEASFWV

SEQ ID NO: 595068 - protein, 9 aa, Homo Sapiens
LQCVGRRRQ

SEQ ID NO: 595069 - protein, 9 aa, Homo Sapiens
ENQKNIPLA

SEQ ID NO: 595070 - protein, 9 aa, Homo Sapiens
RRDSRVQVN

SEQ ID NO: 595071 - protein, 9 aa, Homo Sapiens
KSRQELANS

SEQ ID NO: 595072 - protein, 9 aa, Homo Sapiens
PERLSIFCK

SEQ ID NO: 595073 - protein, 9 aa, Homo Sapiens
LTSITIFHV

SEQ ID NO: 595074 - protein, 9 aa, Homo Sapiens
HRKCVAKVT

SEQ ID NO: 595075 - protein, 9 aa, Homo Sapiens
NQERRVSKA

SEQ ID NO: 595076 - protein, 9 aa, Homo Sapiens
DVERDGEVK

SEQ ID NO: 595077 - protein, 9 aa, Homo Sapiens
VLRIWLCPH

SEQ ID NO: 595078 - protein, 9 aa, Homo Sapiens
KTPSTKAPP

SEQ ID NO: 595079 - protein, 9 aa, Homo Sapiens
LEEMLHNFD

SEQ ID NO: 595080 - protein, 9 aa, Homo Sapiens
VERDGEVKC

SEQ ID NO: 595081 - protein, 9 aa, Homo Sapiens
CVKSFQYSH

SEQ ID NO: 595082 - protein, 9 aa, Homo Sapiens
SSTLEHRPP

SEQ ID NO: 595083 - protein, 9 aa, Homo Sapiens
SIHELAVNL

SEQ ID NO: 595084 - protein, 9 aa, Homo Sapiens
LHKPEAMMR

SEQ ID NO: 595085 - protein, 9 aa, Homo Sapiens
QDQLLPSDG

SEQ ID NO: 595086 - protein, 9 aa, Homo Sapiens
DEARPFPPA

SEQ ID NO: 595087 - protein, 9 aa, Homo Sapiens
PAPGSSCYF

SEQ ID NO: 595088 - protein, 9 aa, Homo Sapiens
KEEDPIRHY

SEQ ID NO: 595089 - protein, 9 aa, Homo Sapiens
LWNMALDVR

SEQ ID NO: 595090 - protein, 9 aa, Homo Sapiens
DSGIPSGAT

SEQ ID NO: 595091 - protein, 9 aa, Homo Sapiens
GEGLRGAQT

SEQ ID NO: 595092 - protein, 9 aa, Homo Sapiens
IFQRSERSS

SEQ ID NO: 595093 - protein, 9 aa, Homo Sapiens
SAVGRERHS

SEQ ID NO: 595094 - protein, 9 aa, Homo Sapiens
ECECFPCYE

SEQ ID NO: 595095 - protein, 9 aa, Homo Sapiens
EELTKNQVS

SEQ ID NO: 595096 - protein, 9 aa, Homo Sapiens
RGAQTEGDS

SEQ ID NO: 595097 - protein, 9 aa, Homo Sapiens
PQMQMQKSP

SEQ ID NO: 595098 - protein, 9 aa, Homo Sapiens
VVLILILYL

SEQ ID NO: 595099 - protein, 9 aa, Homo Sapiens
VKTPSTKAP

SEQ ID NO: 595100 - protein, 9 aa, Homo Sapiens
PVPNMTPSA

SEQ ID NO: 595101 - protein, 9 aa, Homo Sapiens
PSSASTGQA

SEQ ID NO: 595102 - protein, 9 aa, Homo Sapiens
VTVTIGFLL

SEQ ID NO: 595103 - protein, 9 aa, Homo Sapiens
PVGTARMLQ

SEQ ID NO: 595104 - protein, 9 aa, Homo Sapiens
PPSREELTK

SEQ ID NO: 595105 - protein, 9 aa, Homo Sapiens
GIRVAQKHE

SEQ ID NO: 595106 - protein, 9 aa, Homo Sapiens
CAVATALWN

SEQ ID NO: 595107 - protein, 9 aa, Homo Sapiens
PNASSFHVN

SEQ ID NO: 595108 - protein, 9 aa, Homo Sapiens
ILRNDFTDL

SEQ ID NO: 595109 - protein, 9 aa, Homo Sapiens
ENNQPDASI

SEQ ID NO: 595110 - protein, 9 aa, Homo Sapiens
DRFSEDSST

SEQ ID NO: 595111 - protein, 9 aa, Homo Sapiens
FLLIPKFSH

SEQ ID NO: 595112 - protein, 9 aa, Homo Sapiens
EEEEELRVL

SEQ ID NO: 595113 - protein, 9 aa, Homo Sapiens
PDASIAQVS

SEQ ID NO: 595114 - protein, 9 aa, Homo Sapiens
IPWRDVGSP

SEQ ID NO: 595115 - protein, 9 aa, Homo Sapiens
IPEASFWVL

SEQ ID NO: 595116 - protein, 9 aa, Homo Sapiens
GSFPLQCWG

SEQ ID NO: 595117 - protein, 9 aa, Homo Sapiens
DVIQAVKEY

SEQ ID NO: 595118 - protein, 9 aa, Homo Sapiens
NLPDPQWKS

SEQ ID NO: 595119 - protein, 9 aa, Homo Sapiens
QERRVSKAV

SEQ ID NO: 595120 - protein, 9 aa, Homo Sapiens
RDVGSPYVV

SEQ ID NO: 595121 - protein, 9 aa, Homo Sapiens
VPSISQVLR

SEQ ID NO: 595122 - protein, 9 aa, Homo Sapiens
RAMSIYKQS

SEQ ID NO: 595123 - protein, 9 aa, Homo Sapiens
GMKRSSTLE

SEQ ID NO: 595124 - protein, 9 aa, Homo Sapiens
RRVSKAVEV

SEQ ID NO: 595125 - protein, 9 aa, Homo Sapiens
KCEAGGSCS

SEQ ID NO: 595126 - protein, 9 aa, Homo Sapiens
LRVLTLPLQ

SEQ ID NO: 595127 - protein, 9 aa, Homo Sapiens
SGLRRSSLS

SEQ ID NO: 595128 - protein, 9 aa, Homo Sapiens
THHMEALLQ

SEQ ID NO: 595129 - protein, 9 aa, Homo Sapiens
EPICGLRAM

SEQ ID NO: 595130 - protein, 9 aa, Homo Sapiens
LGCSHVCSR

SEQ ID NO: 595131 - protein, 9 aa, Homo Sapiens
GSFPQHCAG

SEQ ID NO: 595132 - protein, 9 aa, Homo Sapiens
YSLAGTHHM

SEQ ID NO: 595133 - protein, 9 aa, Homo Sapiens
TFKFTSSQN

SEQ ID NO: 595134 - protein, 9 aa, Homo Sapiens
PVPQMQMQK

SEQ ID NO: 595135 - protein, 9 aa, Homo Sapiens
LPELEDWLQ

SEQ ID NO: 595136 - protein, 9 aa, Homo Sapiens
LTKHIKENQ

SEQ ID NO: 595137 - protein, 9 aa, Homo Sapiens
LRENLAGPW

SEQ ID NO: 595138 - protein, 9 aa, Homo Sapiens
KFTSSQNFS

SEQ ID NO: 595139 - protein, 9 aa, Homo Sapiens
QCWGRRRRQ

SEQ ID NO: 595140 - protein, 9 aa, Homo Sapiens
RHSTTDCGG

SEQ ID NO: 595141 - protein, 9 aa, Homo Sapiens
QHCAGRRRQ

SEQ ID NO: 595142 - protein, 9 aa, Homo Sapiens
SRWPLQDQL

SEQ ID NO: 595143 - protein, 9 aa, Homo Sapiens
VTIGFLLIP

SEQ ID NO: 595144 - protein, 9 aa, Homo Sapiens
TARDPAIMV

SEQ ID NO: 595145 - protein, 9 aa, Homo Sapiens
AVNLPDPQW

SEQ ID NO: 595146 - protein, 9 aa, Homo Sapiens
DIKNVILQT

SEQ ID NO: 595147 - protein, 9 aa, Homo Sapiens
SCSWDSALR

SEQ ID NO: 595148 - protein, 9 aa, Homo Sapiens
FTSSQNFSN

SEQ ID NO: 595149 - protein, 9 aa, Homo Sapiens
ECFPCYESG

SEQ ID NO: 595150 - protein, 9 aa, Homo Sapiens
PSTKAPPPH

SEQ ID NO: 595151 - protein, 9 aa, Homo Sapiens
QPDASIAQV

SEQ ID NO: 595152 - protein, 9 aa, Homo Sapiens
SGALIKGAA

SEQ ID NO: 595153 - protein, 9 aa, Homo Sapiens
VTILFLYCV

SEQ ID NO: 595154 - protein, 9 aa, Homo Sapiens
CLKQTLHKP

SEQ ID NO: 595155 - protein, 9 aa, Homo Sapiens
KHALKFGDT

SEQ ID NO: 595156 - protein, 9 aa, Homo Sapiens
EEELRVLTL

SEQ ID NO: 595157 - protein, 9 aa, Homo Sapiens
SLAGTHHME

SEQ ID NO: 595158 - protein, 9 aa, Homo Sapiens
YPQLQKVLV

SEQ ID NO: 595159 - protein, 9 aa, Homo Sapiens
FHVTILFLY

SEQ ID NO: 595160 - protein, 9 aa, Homo Sapiens
QSYLDSGIP

SEQ ID NO: 595161 - protein, 9 aa, Homo Sapiens
NSEKLFDLP

SEQ ID NO: 595162 - protein, 9 aa, Homo Sapiens
CGSGTRRDS

SEQ ID NO: 595163 - protein, 9 aa, Homo Sapiens
GSFPLQCVG

SEQ ID NO: 595164 - protein, 9 aa, Homo Sapiens
TQCVKSFQY

SEQ ID NO: 595165 - protein, 9 aa, Homo Sapiens
WFRSCSWDS

SEQ ID NO: 595166 - protein, 9 aa, Homo Sapiens
ARPSPSWFR

SEQ ID NO: 595167 - protein, 9 aa, Homo Sapiens
LLCEYILRN

SEQ ID NO: 595168 - protein, 9 aa, Homo Sapiens
CYFFLPLAP

SEQ ID NO: 595169 - protein, 9 aa, Homo Sapiens
PPRLDLQTL

SEQ ID NO: 595170 - protein, 9 aa, Homo Sapiens
VPPNASSFH

SEQ ID NO: 595171 - protein, 9 aa, Homo Sapiens
GRRRQDCAR

SEQ ID NO: 595172 - protein, 9 aa, Homo Sapiens
TPESPLFHN

SEQ ID NO: 595173 - protein, 9 aa, Homo Sapiens
RRRQDCARP

SEQ ID NO: 595174 - protein, 9 aa, Homo Sapiens
VPSGALIKG

SEQ ID NO: 595175 - protein, 9 aa, Homo Sapiens
RLSIFCKDT

SEQ ID NO: 595176 - protein, 9 aa, Homo Sapiens
ASSHPLVLP

SEQ ID NO: 595177 - protein, 9 aa, Homo Sapiens
FPLQCWGRR

SEQ ID NO: 595178 - protein, 9 aa, Homo Sapiens
PQEEEEELR

SEQ ID NO: 595179 - protein, 9 aa, Homo Sapiens
GAQTEGDSP

SEQ ID NO: 595180 - protein, 9 aa, Homo Sapiens
ATHRKCVAK

SEQ ID NO: 595181 - protein, 9 aa, Homo Sapiens
KNVILQTLE

SEQ ID NO: 595182 - protein, 9 aa, Homo Sapiens
FLPLAPASS

SEQ ID NO: 595183 - protein, 9 aa, Homo Sapiens
VLRNILKVC

SEQ ID NO: 595184 - protein, 9 aa, Homo Sapiens
RNDFTDLFD

SEQ ID NO: 595185 - protein, 9 aa, Homo Sapiens
SPSWFRSCS

SEQ ID NO: 595186 - protein, 9 aa, Homo Sapiens
FFSDILLSW

SEQ ID NO: 595187 - protein, 9 aa, Homo Sapiens
TKHIKENQK

SEQ ID NO: 595188 - protein, 9 aa, Homo Sapiens
WKHALKFGD

SEQ ID NO: 595189 - protein, 9 aa, Homo Sapiens
NVQDIKNVI

SEQ ID NO: 595190 - protein, 9 aa, Homo Sapiens
HQQSHRKKV

SEQ ID NO: 595191 - protein, 9 aa, Homo Sapiens
RFSEDSSTL

SEQ ID NO: 595192 - protein, 9 aa, Homo Sapiens
QQSHRKKVL

SEQ ID NO: 595193 - protein, 9 aa, Homo Sapiens
PSREELTKN

SEQ ID NO: 595194 - protein, 9 aa, Homo Sapiens
RKCVAKVTS

SEQ ID NO: 595195 - protein, 9 aa, Homo Sapiens
SATVKTPST

SEQ ID NO: 595196 - protein, 9 aa, Homo Sapiens
PLQCVGRRR

SEQ ID NO: 595197 - protein, 9 aa, Homo Sapiens
NKDSCCDMS

SEQ ID NO: 595198 - protein, 9 aa, Homo Sapiens
PLFHNFSGY

SEQ ID NO: 595199 - protein, 9 aa, Homo Sapiens
HVPENNQPD

SEQ ID NO: 595200 - protein, 9 aa, Homo Sapiens
WRDVGSPYV

SEQ ID NO: 595201 - protein, 9 aa, Homo Sapiens
YAQWKHALK

SEQ ID NO: 595202 - protein, 9 aa, Homo Sapiens
SLQSIRSWS

SEQ ID NO: 595203 - protein, 9 aa, Homo Sapiens
RRRQWGSFP

SEQ ID NO: 595204 - protein, 9 aa, Homo Sapiens
DSCCDMSVR

SEQ ID NO: 595205 - protein, 9 aa, Homo Sapiens
YTCTQCVKS

SEQ ID NO: 595206 - protein, 9 aa, Homo Sapiens
STLEHRPPA

SEQ ID NO: 595207 - protein, 9 aa, Homo Sapiens
LTVTVTIGF

SEQ ID NO: 595208 - protein, 9 aa, Homo Sapiens
EAGGSCSSS

SEQ ID NO: 595209 - protein, 9 aa, Homo Sapiens
TRRDSRVQV

SEQ ID NO: 595210 - protein, 9 aa, Homo Sapiens
RLCLFTLLG

SEQ ID NO: 595211 - protein, 9 aa, Homo Sapiens
ILLSWFPFY

SEQ ID NO: 595212 - protein, 9 aa, Homo Sapiens
VRDLNDNDP

SEQ ID NO: 595213 - protein, 9 aa, Homo Sapiens
IRSWSGDPA

SEQ ID NO: 595214 - protein, 9 aa, Homo Sapiens
SFPQHCAGR

SEQ ID NO: 595215 - protein, 9 aa, Homo Sapiens
HVCSRTPVE

SEQ ID NO: 595216 - protein, 9 aa, Homo Sapiens
LANSEKLFD

SEQ ID NO: 595217 - protein, 9 aa, Homo Sapiens
EESELPVSG

SEQ ID NO: 595218 - protein, 9 aa, Homo Sapiens
SGIPSGATT

SEQ ID NO: 595219 - protein, 9 aa, Homo Sapiens
TAYDSHTSE

SEQ ID NO: 595220 - protein, 9 aa, Homo Sapiens
RWPLQDQLL

SEQ ID NO: 595221 - protein, 9 aa, Homo Sapiens
SGIRVAQKH

SEQ ID NO: 595222 - protein, 9 aa, Homo Sapiens
WSSEAWDSE

SEQ ID NO: 595223 - protein, 9 aa, Homo Sapiens
YILRNDFTD

SEQ ID NO: 595224 - protein, 9 aa, Homo Sapiens
VPQMQMQKS

SEQ ID NO: 595225 - protein, 9 aa, Homo Sapiens
LAPASSHPL

SEQ ID NO: 595226 - protein, 9 aa, Homo Sapiens
SGTRRDSRV

SEQ ID NO: 595227 - protein, 9 aa, Homo Sapiens
ESPLFHNFS

SEQ ID NO: 595228 - protein, 9 aa, Homo Sapiens
KPEGHSHFP

SEQ ID NO: 595229 - protein, 9 aa, Homo Sapiens
PWSSEAWDS

SEQ ID NO: 595230 - protein, 9 aa, Homo Sapiens
FCKDTQTVF

SEQ ID NO: 595231 - protein, 9 aa, Homo Sapiens
APASSHPLV

SEQ ID NO: 595232 - protein, 9 aa, Homo Sapiens
QSIRSWSGD

SEQ ID NO: 595233 - protein, 9 aa, Homo Sapiens
PKKSHQQSH

SEQ ID NO: 595234 - protein, 9 aa, Homo Sapiens
NRTLQADFP

SEQ ID NO: 595235 - protein, 9 aa, Homo Sapiens
VQDIKNVIL

SEQ ID NO: 595236 - protein, 9 aa, Homo Sapiens
QKLAMMLQE

SEQ ID NO: 595237 - protein, 9 aa, Homo Sapiens
NYKLRLCLF

SEQ ID NO: 595238 - protein, 9 aa, Homo Sapiens
GALIKGAAT

SEQ ID NO: 595239 - protein, 9 aa, Homo Sapiens
RAFQEESEL

SEQ ID NO: 595240 - protein, 9 aa, Homo Sapiens
SRQELANSE

SEQ ID NO: 595241 - protein, 9 aa, Homo Sapiens
KDEARPFPP

SEQ ID NO: 595242 - protein, 9 aa, Homo Sapiens
DPAIMVLRN

SEQ ID NO: 595243 - protein, 9 aa, Homo Sapiens
LPPSREELT

SEQ ID NO: 595244 - protein, 9 aa, Homo Sapiens
RDPAIMVLR

SEQ ID NO: 595245 - protein, 9 aa, Homo Sapiens
VYAQWKHAL

SEQ ID NO: 595246 - protein, 9 aa, Homo Sapiens
YKWTAYDSH

SEQ ID NO: 595247 - protein, 9 aa, Homo Sapiens
CAGRRRQDC

SEQ ID NO: 595248 - protein, 9 aa, Homo Sapiens
DTNKDSCCD

SEQ ID NO: 595249 - protein, 9 aa, Homo Sapiens
LDVIQAVKE

SEQ ID NO: 595250 - protein, 9 aa, Homo Sapiens
RRRRQWGSF

SEQ ID NO: 595251 - protein, 9 aa, Homo Sapiens
YVQALLRAL

SEQ ID NO: 595252 - protein, 9 aa, Homo Sapiens
RVRAMSIYK

SEQ ID NO: 595253 - protein, 9 aa, Homo Sapiens
AFQEESELP

SEQ ID NO: 595254 - protein, 9 aa, Homo Sapiens
ILKVIQAYC

SEQ ID NO: 595255 - protein, 9 aa, Homo Sapiens
ATVKTPSTK

SEQ ID NO: 595256 - protein, 9 aa, Homo Sapiens
ENSDRFSED

SEQ ID NO: 595257 - protein, 9 aa, Homo Sapiens
VCAVATALW

SEQ ID NO: 595258 - protein, 9 aa, Homo Sapiens
ENLAGPWSS

SEQ ID NO: 595259 - protein, 9 aa, Homo Sapiens
ADVERDGEV

SEQ ID NO: 595260 - protein, 9 aa, Homo Sapiens
STLQQLSLH

SEQ ID NO: 595261 - protein, 9 aa, Homo Sapiens
GSSCYFFLP

SEQ ID NO: 595262 - protein, 9 aa, Homo Sapiens
DHPYPSSSP

SEQ ID NO: 595263 - protein, 9 aa, Homo Sapiens
FPLQCVGRR

SEQ ID NO: 595264 - protein, 9 aa, Homo Sapiens
ERDGEVKCE

SEQ ID NO: 595265 - protein, 9 aa, Homo Sapiens
DLDPLSSLK

SEQ ID NO: 595266 - protein, 9 aa, Homo Sapiens
PESPLFHNF

SEQ ID NO: 595267 - protein, 9 aa, Homo Sapiens
WGRRRRQWG

SEQ ID NO: 595268 - protein, 9 aa, Homo Sapiens
PPNASSFHV

SEQ ID NO: 595269 - protein, 9 aa, Homo Sapiens
ERRVSKAVE

SEQ ID NO: 595270 - protein, 9 aa, Homo Sapiens
FSDILLSWF

SEQ ID NO: 595271 - protein, 9 aa, Homo Sapiens
IGFLLIPKF

SEQ ID NO: 595272 - protein, 9 aa, Homo Sapiens
KRSSTLEHR

SEQ ID NO: 595273 - protein, 9 aa, Homo Sapiens
ERLSIFCKD

SEQ ID NO: 595274 - protein, 9 aa, Homo Sapiens
LLKPEGHSH

SEQ ID NO: 595275 - protein, 9 aa, Homo Sapiens
LLHFVQKSA

SEQ ID NO: 595276 - protein, 9 aa, Homo Sapiens
KSHQQSHRK

SEQ ID NO: 595277 - protein, 9 aa, Homo Sapiens
SFECECFPC

SEQ ID NO: 595278 - protein, 9 aa, Homo Sapiens
QLLGCSHVC

SEQ ID NO: 595279 - protein, 9 aa, Homo Sapiens
SAQKREQRL

SEQ ID NO: 595280 - protein, 9 aa, Homo Sapiens
RPPAPGSSC

SEQ ID NO: 595281 - protein, 9 aa, Homo Sapiens
QLSLHFLGG

SEQ ID NO: 595282 - protein, 9 aa, Homo Sapiens
QWKHALKFG

SEQ ID NO: 595283 - protein, 9 aa, Homo Sapiens
PRLDLQTLQ

SEQ ID NO: 595284 - protein, 9 aa, Homo Sapiens
PLGPRVFPV

SEQ ID NO: 595285 - protein, 9 aa, Homo Sapiens
SHPLVLPNK

SEQ ID NO: 595286 - protein, 9 aa, Homo Sapiens
MCSGSGLRR

SEQ ID NO: 595287 - protein, 9 aa, Homo Sapiens
AVGRERHSC

SEQ ID NO: 595288 - protein, 9 aa, Homo Sapiens
QMQMQKSPI

SEQ ID NO: 595289 - protein, 9 aa, Homo Sapiens
CEVAVHGPA

SEQ ID NO: 595290 - protein, 9 aa, Homo Sapiens
SAGDYVPKE

SEQ ID NO: 595291 - protein, 9 aa, Homo Sapiens
HKPEAMMRI

SEQ ID NO: 595292 - protein, 9 aa, Homo Sapiens
LLFENSDRF

SEQ ID NO: 595293 - protein, 9 aa, Homo Sapiens
RRQDCARPS

SEQ ID NO: 595294 - protein, 9 aa, Homo Sapiens
LSSLKSLTY

SEQ ID NO: 595295 - protein, 9 aa, Homo Sapiens
SYSLAGTHH

SEQ ID NO: 595296 - protein, 9 aa, Homo Sapiens
EIFQRSERS

SEQ ID NO: 595297 - protein, 9 aa, Homo Sapiens
ELANSEKLF

SEQ ID NO: 595298 - protein, 9 aa, Homo Sapiens
RKLRENLAG

SEQ ID NO: 595299 - protein, 9 aa, Homo Sapiens
SGSGLRRSS

SEQ ID NO: 595300 - protein, 9 aa, Homo Sapiens
AQILKVIQA

SEQ ID NO: 595301 - protein, 9 aa, Homo Sapiens
YLDSGIPSG

SEQ ID NO: 595302 - protein, 9 aa, Homo Sapiens
ICGLRAMPS

SEQ ID NO: 595303 - protein, 9 aa, Homo Sapiens
LRCHSLTPN

SEQ ID NO: 595304 - protein, 9 aa, Homo Sapiens
MPDPAVPDG

SEQ ID NO: 595305 - protein, 9 aa, Homo Sapiens
PAVPDGHLP

SEQ ID NO: 595306 - protein, 9 aa, Homo Sapiens
VPDGHLPAV

SEQ ID NO: 595307 - protein, 9 aa, Homo Sapiens
SDAQKLAMM

SEQ ID NO: 595308 - protein, 9 aa, Homo Sapiens
VAKVTSACQ

SEQ ID NO: 595309 - protein, 9 aa, Homo Sapiens
GPRVFPVPR

SEQ ID NO: 595310 - protein, 9 aa, Homo Sapiens
LLGCSHVCS

SEQ ID NO: 595311 - protein, 9 aa, Homo Sapiens
GEVKCEENP

SEQ ID NO: 595312 - protein, 9 aa, Homo Sapiens
QWGSFPLQC

SEQ ID NO: 595313 - protein, 9 aa, Homo Sapiens
CSHVCSRTP

SEQ ID NO: 595314 - protein, 9 aa, Homo Sapiens
FHNFSGYHI

SEQ ID NO: 595315 - protein, 9 aa, Homo Sapiens
KVATHRKCV

SEQ ID NO: 595316 - protein, 9 aa, Homo Sapiens
MNPVPQMQM

SEQ ID NO: 595317 - protein, 9 aa, Homo Sapiens
LVRDLNDND

SEQ ID NO: 595318 - protein, 9 aa, Homo Sapiens
HNFDFCDIL

SEQ ID NO: 595319 - protein, 9 aa, Homo Sapiens
AQWKHALKF

SEQ ID NO: 595320 - protein, 9 aa, Homo Sapiens
ALCRHSTTD

SEQ ID NO: 595321 - protein, 9 aa, Homo Sapiens
LEHRPPAPG

SEQ ID NO: 595322 - protein, 9 aa, Homo Sapiens
KQEHEDRRH

SEQ ID NO: 595323 - protein, 9 aa, Homo Sapiens
NNQPDASIA

SEQ ID NO: 595324 - protein, 9 aa, Homo Sapiens
TRVRAMSIY

SEQ ID NO: 595325 - protein, 9 aa, Homo Sapiens
NSDRFSEDS

SEQ ID NO: 595326 - protein, 9 aa, Homo Sapiens
EDRRHDKVT

SEQ ID NO: 595327 - protein, 9 aa, Homo Sapiens
ASRWPLQDQ

SEQ ID NO: 595328 - protein, 9 aa, Homo Sapiens
FYKWTAYDS

SEQ ID NO: 595329 - protein, 9 aa, Homo Sapiens
SSSLTSSVT

SEQ ID NO: 595330 - protein, 9 aa, Homo Sapiens
FECECFPCY

SEQ ID NO: 595331 - protein, 9 aa, Homo Sapiens
AMSIYKQSQ

SEQ ID NO: 595332 - protein, 9 aa, Homo Sapiens
PLAPASSHP

SEQ ID NO: 595333 - protein, 9 aa, Homo Sapiens
VDLKEEDPI

SEQ ID NO: 595334 - protein, 9 aa, Homo Sapiens
SHTSENAPS

SEQ ID NO: 595335 - protein, 9 aa, Homo Sapiens
SREELTKNQ

SEQ ID NO: 595336 - protein, 9 aa, Homo Sapiens
ASSFHVNLL

SEQ ID NO: 595337 - protein, 9 aa, Homo Sapiens
AGGSCSSSI

SEQ ID NO: 595338 - protein, 9 aa, Homo Sapiens
DSTLQQLSL

SEQ ID NO: 595339 - protein, 9 aa, Homo Sapiens
WTAYDSHTS

SEQ ID NO: 595340 - protein, 9 aa, Homo Sapiens
NVSVISFTE

SEQ ID NO: 595341 - protein, 9 aa, Homo Sapiens
QTEGDSPLR

SEQ ID NO: 595342 - protein, 9 aa, Homo Sapiens
PRVFPVPRV

SEQ ID NO: 595343 - protein, 9 aa, Homo Sapiens
LRKLRENLA

SEQ ID NO: 595344 - protein, 9 aa, Homo Sapiens
QLLPSDGIS

SEQ ID NO: 595345 - protein, 9 aa, Homo Sapiens
HEPRVPTCV

SEQ ID NO: 595346 - protein, 9 aa, Homo Sapiens
TLHKPEAMM

SEQ ID NO: 595347 - protein, 9 aa, Homo Sapiens
TIFHVTILF

SEQ ID NO: 595348 - protein, 9 aa, Homo Sapiens
HFVQKSAGD

SEQ ID NO: 595349 - protein, 9 aa, Homo Sapiens
YDSHTSENA

SEQ ID NO: 595350 - protein, 9 aa, Homo Sapiens
VGALLKPEG

SEQ ID NO: 595351 - protein, 9 aa, Homo Sapiens
ALIKGAATF

SEQ ID NO: 595352 - protein, 9 aa, Homo Sapiens
VPNMTPSAV

SEQ ID NO: 595353 - protein, 9 aa, Homo Sapiens
NLAGPWSSE

SEQ ID NO: 595354 - protein, 9 aa, Homo Sapiens
SLLFENSDR

SEQ ID NO: 595355 - protein, 9 aa, Homo Sapiens
KVLVVLILI

SEQ ID NO: 595356 - protein, 9 aa, Homo Sapiens
IIDHFVDHP

SEQ ID NO: 595357 - protein, 9 aa, Homo Sapiens
MKRSSTLEH

SEQ ID NO: 595358 - protein, 9 aa, Homo Sapiens
SCGSGTRRD

SEQ ID NO: 595359 - protein, 9 aa, Homo Sapiens
VFPVPRVPS

SEQ ID NO: 595360 - protein, 9 aa, Homo Sapiens
EGHSHFPAA

SEQ ID NO: 595361 - protein, 9 aa, Homo Sapiens
DASIAQVSA

SEQ ID NO: 595362 - protein, 9 aa, Homo Sapiens
IIIDHFVDH

SEQ ID NO: 595363 - protein, 9 aa, Homo Sapiens
KVWNYKLRL

SEQ ID NO: 595364 - protein, 9 aa, Homo Sapiens
RSSTLEHRP

SEQ ID NO: 595365 - protein, 9 aa, Homo Sapiens
TPSAVGRER

SEQ ID NO: 595366 - protein, 9 aa, Homo Sapiens
QEHEDRRHD

SEQ ID NO: 595367 - protein, 9 aa, Homo Sapiens
MSPASSNCS

SEQ ID NO: 595368 - protein, 9 aa, Homo Sapiens
RQELANSEK

SEQ ID NO: 595369 - protein, 9 aa, Homo Sapiens
TGAPQLEEA

SEQ ID NO: 595370 - protein, 9 aa, Homo Sapiens
EPVPSGALI

SEQ ID NO: 595371 - protein, 9 aa, Homo Sapiens
HCAGRRRQD

SEQ ID NO: 595372 - protein, 9 aa, Homo Sapiens
DNDPVFPDP

SEQ ID NO: 595373 - protein, 9 aa, Homo Sapiens
FGSKNVSVI

SEQ ID NO: 595374 - protein, 9 aa, Homo Sapiens
VAQKHEPRV

SEQ ID NO: 595375 - protein, 9 aa, Homo Sapiens
NSIHELAVN

SEQ ID NO: 595376 - protein, 9 aa, Homo Sapiens
KVIQAYCTS

SEQ ID NO: 595377 - protein, 9 aa, Homo Sapiens
QLQKVLVVL

SEQ ID NO: 595378 - protein, 9 aa, Homo Sapiens
QKNIPLAHS

SEQ ID NO: 595379 - protein, 9 aa, Homo Sapiens
SQNFSNCLP

SEQ ID NO: 595380 - protein, 9 aa, Homo Sapiens
QCVKSFQYS

SEQ ID NO: 595381 - protein, 9 aa, Homo Sapiens
GLRGAQTEG

SEQ ID NO: 595382 - protein, 9 aa, Homo Sapiens
LPLAPASSH

SEQ ID NO: 595383 - protein, 9 aa, Homo Sapiens
CVAKVTSAC

SEQ ID NO: 595384 - protein, 9 aa, Homo Sapiens
DQDTNKDSC

SEQ ID NO: 595385 - protein, 9 aa, Homo Sapiens
QTFKFTSSQ

SEQ ID NO: 595386 - protein, 9 aa, Homo Sapiens
IRVAQKHEP

SEQ ID NO: 595387 - protein, 9 aa, Homo Sapiens
RQWGSFPLQ

SEQ ID NO: 595388 - protein, 9 aa, Homo Sapiens
VKCEENPEF

SEQ ID NO: 595389 - protein, 9 aa, Homo Sapiens
LKQTLHKPE

SEQ ID NO: 595390 - protein, 9 aa, Homo Sapiens
FVDHPYPSS

SEQ ID NO: 595391 - protein, 9 aa, Homo Sapiens
SPLFHNFSG

SEQ ID NO: 595392 - protein, 9 aa, Homo Sapiens
CEYILRNDF

SEQ ID NO: 595393 - protein, 9 aa, Homo Sapiens
QLRAGRFIM

SEQ ID NO: 595394 - protein, 9 aa, Homo Sapiens
NKETGEMCV

SEQ ID NO: 595395 - protein, 9 aa, Homo Sapiens
QTQPIYDFI

SEQ ID NO: 595396 - protein, 9 aa, Homo Sapiens
ARKRNLALG

SEQ ID NO: 595397 - protein, 9 aa, Homo Sapiens
DNMSFLILT

SEQ ID NO: 595398 - protein, 9 aa, Homo Sapiens
TLTVKIITL

SEQ ID NO: 595399 - protein, 9 aa, Homo Sapiens
HNTQGSDVC

SEQ ID NO: 595400 - protein, 9 aa, Homo Sapiens
SYRSRFCHL

SEQ ID NO: 595401 - protein, 9 aa, Homo Sapiens
RQSHTLGVY

SEQ ID NO: 595402 - protein, 9 aa, Homo Sapiens
NSAQQLRMQ

SEQ ID NO: 595403 - protein, 9 aa, Homo Sapiens
VVSYVPITG

SEQ ID NO: 595404 - protein, 9 aa, Homo Sapiens
GGTDSVMCR

SEQ ID NO: 595405 - protein, 9 aa, Homo Sapiens
ETGEMCVML

SEQ ID NO: 595406 - protein, 9 aa, Homo Sapiens
MNKCTNEEQ

SEQ ID NO: 595407 - protein, 9 aa, Homo Sapiens
LWDQEHEEA

SEQ ID NO: 595408 - protein, 9 aa, Homo Sapiens
QIAKLWRKS

SEQ ID NO: 595409 - protein, 9 aa, Homo Sapiens
KRPSSGVSE

SEQ ID NO: 595410 - protein, 9 aa, Homo Sapiens
HGTDPWATP

SEQ ID NO: 595411 - protein, 9 aa, Homo Sapiens
GRGSVTGSL

SEQ ID NO: 595412 - protein, 9 aa, Homo Sapiens
TEAFSQRYC

SEQ ID NO: 595413 - protein, 9 aa, Homo Sapiens
WLWDQEHEE

SEQ ID NO: 595414 - protein, 9 aa, Homo Sapiens
GCDGQDQLN

SEQ ID NO: 595415 - protein, 9 aa, Homo Sapiens
EVTFDVDAN

SEQ ID NO: 595416 - protein, 9 aa, Homo Sapiens
EHLAILCHW

SEQ ID NO: 595417 - protein, 9 aa, Homo Sapiens
TFKTPGVSG

SEQ ID NO: 595418 - protein, 9 aa, Homo Sapiens
FKKDGLVKQ

SEQ ID NO: 595419 - protein, 9 aa, Homo Sapiens
LILQHRIHT

SEQ ID NO: 595420 - protein, 9 aa, Homo Sapiens
KLHLHQWRS

SEQ ID NO: 595421 - protein, 9 aa, Homo Sapiens
SIKDNIRLA

SEQ ID NO: 595422 - protein, 9 aa, Homo Sapiens
AGPLLSYRR

SEQ ID NO: 595423 - protein, 9 aa, Homo Sapiens
ENLKNEIKN

SEQ ID NO: 595424 - protein, 9 aa, Homo Sapiens
HSFADPAST

SEQ ID NO: 595425 - protein, 9 aa, Homo Sapiens
EESRKKIKS

SEQ ID NO: 595426 - protein, 9 aa, Homo Sapiens
SKKPQKPIT

SEQ ID NO: 595427 - protein, 9 aa, Homo Sapiens
DGLVKQCMG

SEQ ID NO: 595428 - protein, 9 aa, Homo Sapiens
DAPSPQPRL

SEQ ID NO: 595429 - protein, 9 aa, Homo Sapiens
VPQVGSRLE

SEQ ID NO: 595430 - protein, 9 aa, Homo Sapiens
DPFGSVPFV

SEQ ID NO: 595431 - protein, 9 aa, Homo Sapiens
RAVKLHWDV

SEQ ID NO: 595432 - protein, 9 aa, Homo Sapiens
EGQYTIRGH

SEQ ID NO: 595433 - protein, 9 aa, Homo Sapiens
IRLAELLSN

SEQ ID NO: 595434 - protein, 9 aa, Homo Sapiens
TLGVYPCAI

SEQ ID NO: 595435 - protein, 9 aa, Homo Sapiens
GRGVHGTDP

SEQ ID NO: 595436 - protein, 9 aa, Homo Sapiens
NKSEFTISA

SEQ ID NO: 595437 - protein, 9 aa, Homo Sapiens
LIKRPSSGV

SEQ ID NO: 595438 - protein, 9 aa, Homo Sapiens
TASSNISLN

SEQ ID NO: 595439 - protein, 9 aa, Homo Sapiens
ECWIHSKYE

SEQ ID NO: 595440 - protein, 9 aa, Homo Sapiens
LLGVIAVFV

SEQ ID NO: 595441 - protein, 9 aa, Homo Sapiens
MVVVGASRV

SEQ ID NO: 595442 - protein, 9 aa, Homo Sapiens
TILNSAQQL

SEQ ID NO: 595443 - protein, 9 aa, Homo Sapiens
PDVVSLVHH

SEQ ID NO: 595444 - protein, 9 aa, Homo Sapiens
ALTGGSHGG

SEQ ID NO: 595445 - protein, 9 aa, Homo Sapiens
QPGPPIAAA

SEQ ID NO: 595446 - protein, 9 aa, Homo Sapiens
PFGSVPFVS

SEQ ID NO: 595447 - protein, 9 aa, Homo Sapiens
GTLSSPQWI

SEQ ID NO: 595448 - protein, 9 aa, Homo Sapiens
KSSSQERAP

SEQ ID NO: 595449 - protein, 9 aa, Homo Sapiens
IPRVRDSLI

SEQ ID NO: 595450 - protein, 9 aa, Homo Sapiens
KRWRAVKLH

SEQ ID NO: 595451 - protein, 9 aa, Homo Sapiens
MFRNMQIAE

SEQ ID NO: 595452 - protein, 9 aa, Homo Sapiens
IKSWVESQT

SEQ ID NO: 595453 - protein, 9 aa, Homo Sapiens
CDGQDQLNS

SEQ ID NO: 595454 - protein, 9 aa, Homo Sapiens
GEMCVMLVS

SEQ ID NO: 595455 - protein, 9 aa, Homo Sapiens
YLGGPRGGA

SEQ ID NO: 595456 - protein, 9 aa, Homo Sapiens
VKQCMGTVT

SEQ ID NO: 595457 - protein, 9 aa, Homo Sapiens
SLSWQSHPD

SEQ ID NO: 595458 - protein, 9 aa, Homo Sapiens
LAHGSPFQG

SEQ ID NO: 595459 - protein, 9 aa, Homo Sapiens
RLTEAFSQR

SEQ ID NO: 595460 - protein, 9 aa, Homo Sapiens
SFSVSFRWS

SEQ ID NO: 595461 - protein, 9 aa, Homo Sapiens
IKRPSSGVS

SEQ ID NO: 595462 - protein, 9 aa, Homo Sapiens
YRSRFCHLI

SEQ ID NO: 595463 - protein, 9 aa, Homo Sapiens
CPPPPGLPH

SEQ ID NO: 595464 - protein, 9 aa, Homo Sapiens
IKLNSDSVK

SEQ ID NO: 595465 - protein, 9 aa, Homo Sapiens
KGIYALVTQ

SEQ ID NO: 595466 - protein, 9 aa, Homo Sapiens
FDASHVALT

SEQ ID NO: 595467 - protein, 9 aa, Homo Sapiens
KECWIHSKY

SEQ ID NO: 595468 - protein, 9 aa, Homo Sapiens
WRSPHPAGG

SEQ ID NO: 595469 - protein, 9 aa, Homo Sapiens
LVLKKGTRL

SEQ ID NO: 595470 - protein, 9 aa, Homo Sapiens
PASTLMGSF

SEQ ID NO: 595471 - protein, 9 aa, Homo Sapiens
RLAHGSPFQ

SEQ ID NO: 595472 - protein, 9 aa, Homo Sapiens
DMKEKTPVP

SEQ ID NO: 595473 - protein, 9 aa, Homo Sapiens
PSRSLGNMC

SEQ ID NO: 595474 - protein, 9 aa, Homo Sapiens
YDSFHKDLR

SEQ ID NO: 595475 - protein, 9 aa, Homo Sapiens
KFQDVRFKP

SEQ ID NO: 595476 - protein, 9 aa, Homo Sapiens
QRDNPRASP

SEQ ID NO: 595477 - protein, 9 aa, Homo Sapiens
MEAFHVVSY

SEQ ID NO: 595478 - protein, 9 aa, Homo Sapiens
TNLTGKLLP

SEQ ID NO: 595479 - protein, 9 aa, Homo Sapiens
PSSGVSEAL

SEQ ID NO: 595480 - protein, 9 aa, Homo Sapiens
PKCPQSCPP

SEQ ID NO: 595481 - protein, 9 aa, Homo Sapiens
EAFHVVSYV

SEQ ID NO: 595482 - protein, 9 aa, Homo Sapiens
TLASTSSIQ

SEQ ID NO: 595483 - protein, 9 aa, Homo Sapiens
GPPQKNPAT

SEQ ID NO: 595484 - protein, 9 aa, Homo Sapiens
TVLQTQPIY

SEQ ID NO: 595485 - protein, 9 aa, Homo Sapiens
TALDMKEKT

SEQ ID NO: 595486 - protein, 9 aa, Homo Sapiens
FCHLIYFPP

SEQ ID NO: 595487 - protein, 9 aa, Homo Sapiens
RAGRFIMRH

SEQ ID NO: 595488 - protein, 9 aa, Homo Sapiens
TFVFNQKHN

SEQ ID NO: 595489 - protein, 9 aa, Homo Sapiens
KGHRLCCEV

SEQ ID NO: 595490 - protein, 9 aa, Homo Sapiens
YNYDSFHKD

SEQ ID NO: 595491 - protein, 9 aa, Homo Sapiens
RDNPRASPS

SEQ ID NO: 595492 - protein, 9 aa, Homo Sapiens
VVVAQLFGD

SEQ ID NO: 595493 - protein, 9 aa, Homo Sapiens
YGADIESEN

SEQ ID NO: 595494 - protein, 9 aa, Homo Sapiens
LIYFPPRRW

SEQ ID NO: 595495 - protein, 9 aa, Homo Sapiens
GILLGVIAV

SEQ ID NO: 595496 - protein, 9 aa, Homo Sapiens
GTYSKPGGY

SEQ ID NO: 595497 - protein, 9 aa, Homo Sapiens
RILIRTSFP

SEQ ID NO: 595498 - protein, 9 aa, Homo Sapiens
DFSAVTMER

SEQ ID NO: 595499 - protein, 9 aa, Homo Sapiens
YMPIPRVRD

SEQ ID NO: 595500 - protein, 9 aa, Homo Sapiens
PDWLWDQEH

SEQ ID NO: 595501 - protein, 9 aa, Homo Sapiens
FYSAFHAIL

SEQ ID NO: 595502 - protein, 9 aa, Homo Sapiens
VLNLVPGVL

SEQ ID NO: 595503 - protein, 9 aa, Homo Sapiens
RYIAICHAL

SEQ ID NO: 595504 - protein, 9 aa, Homo Sapiens
DIFQPPLFG

SEQ ID NO: 595505 - protein, 9 aa, Homo Sapiens
LLLLLSGGH

SEQ ID NO: 595506 - protein, 9 aa, Homo Sapiens
GEAGQRSTM

SEQ ID NO: 595507 - protein, 9 aa, Homo Sapiens
QENGTVSRY

SEQ ID NO: 595508 - protein, 9 aa, Homo Sapiens
PLFGLVGAE

SEQ ID NO: 595509 - protein, 9 aa, Homo Sapiens
LRSPPQMES

SEQ ID NO: 595510 - protein, 9 aa, Homo Sapiens
GGHGGVQAQ

SEQ ID NO: 595511 - protein, 9 aa, Homo Sapiens
HGSPFQGMS

SEQ ID NO: 595512 - protein, 9 aa, Homo Sapiens
LAQLQRSHT

SEQ ID NO: 595513 - protein, 9 aa, Homo Sapiens
TSSIQLPIG

SEQ ID NO: 595514 - protein, 9 aa, Homo Sapiens
ELAQLQRSH

SEQ ID NO: 595515 - protein, 9 aa, Homo Sapiens
HLHQWRSPH

SEQ ID NO: 595516 - protein, 9 aa, Homo Sapiens
VSHSGSPEK

SEQ ID NO: 595517 - protein, 9 aa, Homo Sapiens
QTPVTKGCY

SEQ ID NO: 595518 - protein, 9 aa, Homo Sapiens
RTGGGMTVA

SEQ ID NO: 595519 - protein, 9 aa, Homo Sapiens
RTMEAFHVV

SEQ ID NO: 595520 - protein, 9 aa, Homo Sapiens
YRMVVVGAS

SEQ ID NO: 595521 - protein, 9 aa, Homo Sapiens
FHVVSYVPI

SEQ ID NO: 595522 - protein, 9 aa, Homo Sapiens
LRSFYSAFH

SEQ ID NO: 595523 - protein, 9 aa, Homo Sapiens
LSYPAHEQV

SEQ ID NO: 595524 - protein, 9 aa, Homo Sapiens
SSGACLDSH

SEQ ID NO: 595525 - protein, 9 aa, Homo Sapiens
RHPRTGGGM

SEQ ID NO: 595526 - protein, 9 aa, Homo Sapiens
YDICIQWRT

SEQ ID NO: 595527 - protein, 9 aa, Homo Sapiens
TGEMCVMLV

SEQ ID NO: 595528 - protein, 9 aa, Homo Sapiens
KCLVEKILV

SEQ ID NO: 595529 - protein, 9 aa, Homo Sapiens
NIRLAELLS

SEQ ID NO: 595530 - protein, 9 aa, Homo Sapiens
CHALRYTNL

SEQ ID NO: 595531 - protein, 9 aa, Homo Sapiens
SLSINAKLH

SEQ ID NO: 595532 - protein, 9 aa, Homo Sapiens
FVKTLTVKI

SEQ ID NO: 595533 - protein, 9 aa, Homo Sapiens
TPVTKGCYL

SEQ ID NO: 595534 - protein, 9 aa, Homo Sapiens
DAVELASRS

SEQ ID NO: 595535 - protein, 9 aa, Homo Sapiens
IRDVPGNEH

SEQ ID NO: 595536 - protein, 9 aa, Homo Sapiens
LLSILAEFC

SEQ ID NO: 595537 - protein, 9 aa, Homo Sapiens
LASRSDNSS

SEQ ID NO: 595538 - protein, 9 aa, Homo Sapiens
NKYDICIQW

SEQ ID NO: 595539 - protein, 9 aa, Homo Sapiens
RGGAPSQFE

SEQ ID NO: 595540 - protein, 9 aa, Homo Sapiens
VTFDVDANG

SEQ ID NO: 595541 - protein, 9 aa, Homo Sapiens
SSYLNVQQE

SEQ ID NO: 595542 - protein, 9 aa, Homo Sapiens
PNLLNGKRK

SEQ ID NO: 595543 - protein, 9 aa, Homo Sapiens
KHNTQGSDV

SEQ ID NO: 595544 - protein, 9 aa, Homo Sapiens
VERLTEAFS

SEQ ID NO: 595545 - protein, 9 aa, Homo Sapiens
LFEVKSVTH

SEQ ID NO: 595546 - protein, 9 aa, Homo Sapiens
LAILCHWSQ

SEQ ID NO: 595547 - protein, 9 aa, Homo Sapiens
LPHGNKPLT

SEQ ID NO: 595548 - protein, 9 aa, Homo Sapiens
LAELLSNPN

SEQ ID NO: 595549 - protein, 9 aa, Homo Sapiens
SGTLPLATK

SEQ ID NO: 595550 - protein, 9 aa, Homo Sapiens
RKWVYLESI

SEQ ID NO: 595551 - protein, 9 aa, Homo Sapiens
AITLHPNRR

SEQ ID NO: 595552 - protein, 9 aa, Homo Sapiens
NLVPGVLSG

SEQ ID NO: 595553 - protein, 9 aa, Homo Sapiens
RNLALGEAG

SEQ ID NO: 595554 - protein, 9 aa, Homo Sapiens
EQLRAGRFI

SEQ ID NO: 595555 - protein, 9 aa, Homo Sapiens
LGNMCRLPA

SEQ ID NO: 595556 - protein, 9 aa, Homo Sapiens
LGGPRGGAP

SEQ ID NO: 595557 - protein, 9 aa, Homo Sapiens
KAISKFSIL

SEQ ID NO: 595558 - protein, 9 aa, Homo Sapiens
QEEEIRENH

SEQ ID NO: 595559 - protein, 9 aa, Homo Sapiens
RLFEHGGFP

SEQ ID NO: 595560 - protein, 9 aa, Homo Sapiens
RWRAVKLHW

SEQ ID NO: 595561 - protein, 9 aa, Homo Sapiens
VQQENGTVS

SEQ ID NO: 595562 - protein, 9 aa, Homo Sapiens
VYGGTDSVM

SEQ ID NO: 595563 - protein, 9 aa, Homo Sapiens
GTLVLKKGT

SEQ ID NO: 595564 - protein, 9 aa, Homo Sapiens
AFHVVSYVP

SEQ ID NO: 595565 - protein, 9 aa, Homo Sapiens
AGPGTLVLK

SEQ ID NO: 595566 - protein, 9 aa, Homo Sapiens
EFTISATVQ

SEQ ID NO: 595567 - protein, 9 aa, Homo Sapiens
PHGNKPLTL

SEQ ID NO: 595568 - protein, 9 aa, Homo Sapiens
IQVDLGFLR

SEQ ID NO: 595569 - protein, 9 aa, Homo Sapiens
SFSLSWQSH

SEQ ID NO: 595570 - protein, 9 aa, Homo Sapiens
LKKGTRLND

SEQ ID NO: 595571 - protein, 9 aa, Homo Sapiens
PYMPIPRVR

SEQ ID NO: 595572 - protein, 9 aa, Homo Sapiens
KPKLEEVQV

SEQ ID NO: 595573 - protein, 9 aa, Homo Sapiens
AHSGMCVCP

SEQ ID NO: 595574 - protein, 9 aa, Homo Sapiens
FVLNLVPGV

SEQ ID NO: 595575 - protein, 9 aa, Homo Sapiens
QDKDAPSPQ

SEQ ID NO: 595576 - protein, 9 aa, Homo Sapiens
LAEFCFSPF

SEQ ID NO: 595577 - protein, 9 aa, Homo Sapiens
EIRENHPYF

SEQ ID NO: 595578 - protein, 9 aa, Homo Sapiens
VDANGIVHV

SEQ ID NO: 595579 - protein, 9 aa, Homo Sapiens
VPGVLSGEF

SEQ ID NO: 595580 - protein, 9 aa, Homo Sapiens
AVKLHWDVL

SEQ ID NO: 595581 - protein, 9 aa, Homo Sapiens
NYDSFHKDL

SEQ ID NO: 595582 - protein, 9 aa, Homo Sapiens
LLLSGGHGG

SEQ ID NO: 595583 - protein, 9 aa, Homo Sapiens
KRNLALGEA

SEQ ID NO: 595584 - protein, 9 aa, Homo Sapiens
VVEKELLRQ

SEQ ID NO: 595585 - protein, 9 aa, Homo Sapiens
QCMGTVTLN

SEQ ID NO: 595586 - protein, 9 aa, Homo Sapiens
AAGGCDGQD

SEQ ID NO: 595587 - protein, 9 aa, Homo Sapiens
INSWLLLCF

SEQ ID NO: 595588 - protein, 9 aa, Homo Sapiens
KLHWDVLNY

SEQ ID NO: 595589 - protein, 9 aa, Homo Sapiens
RKLFEVKSV

SEQ ID NO: 595590 - protein, 9 aa, Homo Sapiens
RDLEKSTAK

SEQ ID NO: 595591 - protein, 9 aa, Homo Sapiens
TLPLATKRR

SEQ ID NO: 595592 - protein, 9 aa, Homo Sapiens
HQWRSPHPA

SEQ ID NO: 595593 - protein, 9 aa, Homo Sapiens
CEECGKAIS

SEQ ID NO: 595594 - protein, 9 aa, Homo Sapiens
SPDHGKALF

SEQ ID NO: 595595 - protein, 9 aa, Homo Sapiens
KLLSILAEF

SEQ ID NO: 595596 - protein, 9 aa, Homo Sapiens
EKKAFQEAH

SEQ ID NO: 595597 - protein, 9 aa, Homo Sapiens
LLKQKPDWL

SEQ ID NO: 595598 - protein, 9 aa, Homo Sapiens
PTRKLFEVK

SEQ ID NO: 595599 - protein, 9 aa, Homo Sapiens
GNMCRLPAT

SEQ ID NO: 595600 - protein, 9 aa, Homo Sapiens
TYSKPGGYR

SEQ ID NO: 595601 - protein, 9 aa, Homo Sapiens
DLEKSTAKF

SEQ ID NO: 595602 - protein, 9 aa, Homo Sapiens
TLKMRILIR

SEQ ID NO: 595603 - protein, 9 aa, Homo Sapiens
ACLDSHLHR

SEQ ID NO: 595604 - protein, 9 aa, Homo Sapiens
DWLWDQEHE

SEQ ID NO: 595605 - protein, 9 aa, Homo Sapiens
AGRFIMRHT

SEQ ID NO: 595606 - protein, 9 aa, Homo Sapiens
PAHEQVALL

SEQ ID NO: 595607 - protein, 9 aa, Homo Sapiens
TQDVFLLLR

SEQ ID NO: 595608 - protein, 9 aa, Homo Sapiens
FQSLPHGNK

SEQ ID NO: 595609 - protein, 9 aa, Homo Sapiens
GQYTIRGHP

SEQ ID NO: 595610 - protein, 9 aa, Homo Sapiens
RGSVTGSLS

SEQ ID NO: 595611 - protein, 9 aa, Homo Sapiens
IEMFRNMQI

SEQ ID NO: 595612 - protein, 9 aa, Homo Sapiens
EEEIRENHP

SEQ ID NO: 595613 - protein, 9 aa, Homo Sapiens
QVGSRLESE

SEQ ID NO: 595614 - protein, 9 aa, Homo Sapiens
APFMLSSLL

SEQ ID NO: 595615 - protein, 9 aa, Homo Sapiens
TPKGGAPFM

SEQ ID NO: 595616 - protein, 9 aa, Homo Sapiens
AILCHWSQR

SEQ ID NO: 595617 - protein, 9 aa, Homo Sapiens
KCEECGKAI

SEQ ID NO: 595618 - protein, 9 aa, Homo Sapiens
SRFCHLIYF

SEQ ID NO: 595619 - protein, 9 aa, Homo Sapiens
SLGNMCRLP

SEQ ID NO: 595620 - protein, 9 aa, Homo Sapiens
SVNRVFKEV

SEQ ID NO: 595621 - protein, 9 aa, Homo Sapiens
LGVYPCAIC

SEQ ID NO: 595622 - protein, 9 aa, Homo Sapiens
RKSELAQLQ

SEQ ID NO: 595623 - protein, 9 aa, Homo Sapiens
IAVFVATVG

SEQ ID NO: 595624 - protein, 9 aa, Homo Sapiens
GIYALVTQD

SEQ ID NO: 595625 - protein, 9 aa, Homo Sapiens
EKECWIHSK

SEQ ID NO: 595626 - protein, 9 aa, Homo Sapiens
LRLFEHGGF

SEQ ID NO: 595627 - protein, 9 aa, Homo Sapiens
MILSSYNTV

SEQ ID NO: 595628 - protein, 9 aa, Homo Sapiens
VHHYVASCT

SEQ ID NO: 595629 - protein, 9 aa, Homo Sapiens
QPRLSPRET

SEQ ID NO: 595630 - protein, 9 aa, Homo Sapiens
LTVKIITLE

SEQ ID NO: 595631 - protein, 9 aa, Homo Sapiens
VTELPEWSE

SEQ ID NO: 595632 - protein, 9 aa, Homo Sapiens
KKPKLEEVQ

SEQ ID NO: 595633 - protein, 9 aa, Homo Sapiens
AAITLHPNR

SEQ ID NO: 595634 - protein, 9 aa, Homo Sapiens
LRLPRDVTE

SEQ ID NO: 595635 - protein, 9 aa, Homo Sapiens
QIRPSGTLP

SEQ ID NO: 595636 - protein, 9 aa, Homo Sapiens
QYTIRGHPG

SEQ ID NO: 595637 - protein, 9 aa, Homo Sapiens
ATFKTPGVS

SEQ ID NO: 595638 - protein, 9 aa, Homo Sapiens
LLLLSGGHG

SEQ ID NO: 595639 - protein, 9 aa, Homo Sapiens
RVFKEVEGQ

SEQ ID NO: 595640 - protein, 9 aa, Homo Sapiens
ISLNLLKIK

SEQ ID NO: 595641 - protein, 9 aa, Homo Sapiens
QSHTLGVYP

SEQ ID NO: 595642 - protein, 9 aa, Homo Sapiens
SAPNLLNGK

SEQ ID NO: 595643 - protein, 9 aa, Homo Sapiens
VTGSLSSLE

SEQ ID NO: 595644 - protein, 9 aa, Homo Sapiens
ALVTQDVFL

SEQ ID NO: 595645 - protein, 9 aa, Homo Sapiens
ATLASTSSI

SEQ ID NO: 595646 - protein, 9 aa, Homo Sapiens
VEKELLRQE

SEQ ID NO: 595647 - protein, 9 aa, Homo Sapiens
YRRTGSSLP

SEQ ID NO: 595648 - protein, 9 aa, Homo Sapiens
AKLWRKSSS

SEQ ID NO: 595649 - protein, 9 aa, Homo Sapiens
DASHVALTG

SEQ ID NO: 595650 - protein, 9 aa, Homo Sapiens
SRSDNSSDS

SEQ ID NO: 595651 - protein, 9 aa, Homo Sapiens
VVSLVHHYV

SEQ ID NO: 595652 - protein, 9 aa, Homo Sapiens
RSFSLSWQS

SEQ ID NO: 595653 - protein, 9 aa, Homo Sapiens
AGGCDGQDQ

SEQ ID NO: 595654 - protein, 9 aa, Homo Sapiens
CLTTGYVIA

SEQ ID NO: 595655 - protein, 9 aa, Homo Sapiens
YPAHEQVAL

SEQ ID NO: 595656 - protein, 9 aa, Homo Sapiens
FHCAICGKS

SEQ ID NO: 595657 - protein, 9 aa, Homo Sapiens
RMQLLRSFY

SEQ ID NO: 595658 - protein, 9 aa, Homo Sapiens
STAKFQDVR

SEQ ID NO: 595659 - protein, 9 aa, Homo Sapiens
LNSDSVKPN

SEQ ID NO: 595660 - protein, 9 aa, Homo Sapiens
EPLNKETGE

SEQ ID NO: 595661 - protein, 9 aa, Homo Sapiens
PEDCIRDVP

SEQ ID NO: 595662 - protein, 9 aa, Homo Sapiens
DIESENKCG

SEQ ID NO: 595663 - protein, 9 aa, Homo Sapiens
KEKKAFQEA

SEQ ID NO: 595664 - protein, 9 aa, Homo Sapiens
SIFGRGALP

SEQ ID NO: 595665 - protein, 9 aa, Homo Sapiens
DCIRDVPGN

SEQ ID NO: 595666 - protein, 9 aa, Homo Sapiens
FVFNQKHNT

SEQ ID NO: 595667 - protein, 9 aa, Homo Sapiens
GAPFMLSSL

SEQ ID NO: 595668 - protein, 9 aa, Homo Sapiens
NKCTNEEQM

SEQ ID NO: 595669 - protein, 9 aa, Homo Sapiens
QKPDWLWDQ

SEQ ID NO: 595670 - protein, 9 aa, Homo Sapiens
MSFLILTSI

SEQ ID NO: 595671 - protein, 9 aa, Homo Sapiens
SFHKDLRKL

SEQ ID NO: 595672 - protein, 9 aa, Homo Sapiens
LNKETGEMC

SEQ ID NO: 595673 - protein, 9 aa, Homo Sapiens
KEITVTARG

SEQ ID NO: 595674 - protein, 9 aa, Homo Sapiens
LVPGVLSGE

SEQ ID NO: 595675 - protein, 9 aa, Homo Sapiens
NSWLLLCFP

SEQ ID NO: 595676 - protein, 9 aa, Homo Sapiens
KVQEEEIRE

SEQ ID NO: 595677 - protein, 9 aa, Homo Sapiens
ESIFGRGAL

SEQ ID NO: 595678 - protein, 9 aa, Homo Sapiens
STLMGSFDD

SEQ ID NO: 595679 - protein, 9 aa, Homo Sapiens
LSILAEFCF

SEQ ID NO: 595680 - protein, 9 aa, Homo Sapiens
QKNPATLGL

SEQ ID NO: 595681 - protein, 9 aa, Homo Sapiens
TFDVDANGI

SEQ ID NO: 595682 - protein, 9 aa, Homo Sapiens
TNEEQMFGF

SEQ ID NO: 595683 - protein, 9 aa, Homo Sapiens
SGDHHIFKK

SEQ ID NO: 595684 - protein, 9 aa, Homo Sapiens
VFKRWRAVK

SEQ ID NO: 595685 - protein, 9 aa, Homo Sapiens
LSGGHGGVQ

SEQ ID NO: 595686 - protein, 9 aa, Homo Sapiens
NQKHNTQGS

SEQ ID NO: 595687 - protein, 9 aa, Homo Sapiens
AHGSPFQGM

SEQ ID NO: 595688 - protein, 9 aa, Homo Sapiens
LKQKPDWLW

SEQ ID NO: 595689 - protein, 9 aa, Homo Sapiens
AQQLRMQLL

SEQ ID NO: 595690 - protein, 9 aa, Homo Sapiens
DVVSLVHHY

SEQ ID NO: 595691 - protein, 9 aa, Homo Sapiens
AKCSSGACL

SEQ ID NO: 595692 - protein, 9 aa, Homo Sapiens
QLLRSFYSA

SEQ ID NO: 595693 - protein, 9 aa, Homo Sapiens
PRASPSRAT

SEQ ID NO: 595694 - protein, 9 aa, Homo Sapiens
RVFQSLPHG

SEQ ID NO: 595695 - protein, 9 aa, Homo Sapiens
ETKPEDCIR

SEQ ID NO: 595696 - protein, 9 aa, Homo Sapiens
NKVATFKTP

SEQ ID NO: 595697 - protein, 9 aa, Homo Sapiens
KKIKSWVES

SEQ ID NO: 595698 - protein, 9 aa, Homo Sapiens
AELLSNPNM

SEQ ID NO: 595699 - protein, 9 aa, Homo Sapiens
GACLDSHLH

SEQ ID NO: 595700 - protein, 9 aa, Homo Sapiens
QMNKCTNEE

SEQ ID NO: 595701 - protein, 9 aa, Homo Sapiens
ITVTARGPC

SEQ ID NO: 595702 - protein, 9 aa, Homo Sapiens
TVWDIFQPP

SEQ ID NO: 595703 - protein, 9 aa, Homo Sapiens
SSQIFSLGY

SEQ ID NO: 595704 - protein, 9 aa, Homo Sapiens
QKEITVTAR

SEQ ID NO: 595705 - protein, 9 aa, Homo Sapiens
RVRDSLIQP

SEQ ID NO: 595706 - protein, 9 aa, Homo Sapiens
QPPLFGLVG

SEQ ID NO: 595707 - protein, 9 aa, Homo Sapiens
IFQPPLFGL

SEQ ID NO: 595708 - protein, 9 aa, Homo Sapiens
GLRLPRDVT

SEQ ID NO: 595709 - protein, 9 aa, Homo Sapiens
SLVHHYVAS

SEQ ID NO: 595710 - protein, 9 aa, Homo Sapiens
FTISATVQQ

SEQ ID NO: 595711 - protein, 9 aa, Homo Sapiens
NAKLHLHQW

SEQ ID NO: 595712 - protein, 9 aa, Homo Sapiens
SLEPEDFSA

SEQ ID NO: 595713 - protein, 9 aa, Homo Sapiens
KPDWLWDQE

SEQ ID NO: 595714 - protein, 9 aa, Homo Sapiens
KSELAQLQR

SEQ ID NO: 595715 - protein, 9 aa, Homo Sapiens
PKLEEVQVR

SEQ ID NO: 595716 - protein, 9 aa, Homo Sapiens
LNSAQQLRM

SEQ ID NO: 595717 - protein, 9 aa, Homo Sapiens
LRQEKEKLY

SEQ ID NO: 595718 - protein, 9 aa, Homo Sapiens
DKDAPSPQP

SEQ ID NO: 595719 - protein, 9 aa, Homo Sapiens
CFHCAICGK

SEQ ID NO: 595720 - protein, 9 aa, Homo Sapiens
QHRIHTGEK

SEQ ID NO: 595721 - protein, 9 aa, Homo Sapiens
RSFYSAFHA

SEQ ID NO: 595722 - protein, 9 aa, Homo Sapiens
EITASSNIS

SEQ ID NO: 595723 - protein, 9 aa, Homo Sapiens
IKNKELTLE

SEQ ID NO: 595724 - protein, 9 aa, Homo Sapiens
LVTQDVFLL

SEQ ID NO: 595725 - protein, 9 aa, Homo Sapiens
KVATFKTPG

SEQ ID NO: 595726 - protein, 9 aa, Homo Sapiens
PFQGMSLLH

SEQ ID NO: 595727 - protein, 9 aa, Homo Sapiens
IFVKTLTVK

SEQ ID NO: 595728 - protein, 9 aa, Homo Sapiens
PRGGAPSQF

SEQ ID NO: 595729 - protein, 9 aa, Homo Sapiens
KCTNEEQMF

SEQ ID NO: 595730 - protein, 9 aa, Homo Sapiens
EEDVKQGTY

SEQ ID NO: 595731 - protein, 9 aa, Homo Sapiens
PQMESPDHG

SEQ ID NO: 595732 - protein, 9 aa, Homo Sapiens
GRINSWLLL

SEQ ID NO: 595733 - protein, 9 aa, Homo Sapiens
LHQWRSPHP

SEQ ID NO: 595734 - protein, 9 aa, Homo Sapiens
RSRFCHLIY

SEQ ID NO: 595735 - protein, 9 aa, Homo Sapiens
GPTSTDNMS

SEQ ID NO: 595736 - protein, 9 aa, Homo Sapiens
CWIHSKYEE

SEQ ID NO: 595737 - protein, 9 aa, Homo Sapiens
QPYMPIPRV

SEQ ID NO: 595738 - protein, 9 aa, Homo Sapiens
ITRPGNKFQ

SEQ ID NO: 595739 - protein, 9 aa, Homo Sapiens
HVALTGGSH

SEQ ID NO: 595740 - protein, 9 aa, Homo Sapiens
QNIVSTVNI

SEQ ID NO: 595741 - protein, 9 aa, Homo Sapiens
SSSQERAPY

SEQ ID NO: 595742 - protein, 9 aa, Homo Sapiens
GHGGVQAQR

SEQ ID NO: 595743 - protein, 9 aa, Homo Sapiens
TTVEHLAIL

SEQ ID NO: 595744 - protein, 9 aa, Homo Sapiens
QIAEIIRKM

SEQ ID NO: 595745 - protein, 9 aa, Homo Sapiens
SWQSHPDVT

SEQ ID NO: 595746 - protein, 9 aa, Homo Sapiens
KCSSGACLD

SEQ ID NO: 595747 - protein, 9 aa, Homo Sapiens
IGCKLDLKT

SEQ ID NO: 595748 - protein, 9 aa, Homo Sapiens
PEDFSAVTM

SEQ ID NO: 595749 - protein, 9 aa, Homo Sapiens
QSHPDVTEP

SEQ ID NO: 595750 - protein, 9 aa, Homo Sapiens
MRILIRTSF

SEQ ID NO: 595751 - protein, 9 aa, Homo Sapiens
LYQNNGLCS

SEQ ID NO: 595752 - protein, 9 aa, Homo Sapiens
LQHRIHTGE

SEQ ID NO: 595753 - protein, 9 aa, Homo Sapiens
VTQDVFLLL

SEQ ID NO: 595754 - protein, 9 aa, Homo Sapiens
MCRLPATQE

SEQ ID NO: 595755 - protein, 9 aa, Homo Sapiens
GNKPLTLSN

SEQ ID NO: 595756 - protein, 9 aa, Homo Sapiens
EEIRENHPY

SEQ ID NO: 595757 - protein, 9 aa, Homo Sapiens
KPWHKTCFH

SEQ ID NO: 595758 - protein, 9 aa, Homo Sapiens
TISATVQQK

SEQ ID NO: 595759 - protein, 9 aa, Homo Sapiens
GTDSVMCRF

SEQ ID NO: 595760 - protein, 9 aa, Homo Sapiens
QNNGLCSSH

SEQ ID NO: 595761 - protein, 9 aa, Homo Sapiens
RKVQEEEIR

SEQ ID NO: 595762 - protein, 9 aa, Homo Sapiens
VALLVPEKL

SEQ ID NO: 595763 - protein, 9 aa, Homo Sapiens
LGVIAVFVA

SEQ ID NO: 595764 - protein, 9 aa, Homo Sapiens
SLPHGNKPL

SEQ ID NO: 595765 - protein, 9 aa, Homo Sapiens
LGEAGQRST

SEQ ID NO: 595766 - protein, 9 aa, Homo Sapiens
AFQEAHQQT

SEQ ID NO: 595767 - protein, 9 aa, Homo Sapiens
EDVKQGTYS

SEQ ID NO: 595768 - protein, 9 aa, Homo Sapiens
PTSTDNMSF

SEQ ID NO: 595769 - protein, 9 aa, Homo Sapiens
FEHGGFPPE

SEQ ID NO: 595770 - protein, 9 aa, Homo Sapiens
IEVTFDVDA

SEQ ID NO: 595771 - protein, 9 aa, Homo Sapiens
SFYSAFHAI

SEQ ID NO: 595772 - protein, 9 aa, Homo Sapiens
LKNEIKNKE

SEQ ID NO: 595773 - protein, 9 aa, Homo Sapiens
GDSYIYHWD

SEQ ID NO: 595774 - protein, 9 aa, Homo Sapiens
TDLLRLFEH

SEQ ID NO: 595775 - protein, 9 aa, Homo Sapiens
NMSFLILTS

SEQ ID NO: 595776 - protein, 9 aa, Homo Sapiens
DSYIYHWDP

SEQ ID NO: 595777 - protein, 9 aa, Homo Sapiens
GRSFSLSWQ

SEQ ID NO: 595778 - protein, 9 aa, Homo Sapiens
EVVEKELLR

SEQ ID NO: 595779 - protein, 9 aa, Homo Sapiens
GSVTGSLSS

SEQ ID NO: 595780 - protein, 9 aa, Homo Sapiens
ESENKCGLT

SEQ ID NO: 595781 - protein, 9 aa, Homo Sapiens
IQMNKCTNE

SEQ ID NO: 595782 - protein, 9 aa, Homo Sapiens
GSVPFVSHS

SEQ ID NO: 595783 - protein, 9 aa, Homo Sapiens
YNMRHPRTG

SEQ ID NO: 595784 - protein, 9 aa, Homo Sapiens
QKHNTQGSD

SEQ ID NO: 595785 - protein, 9 aa, Homo Sapiens
IAICHALRY

SEQ ID NO: 595786 - protein, 9 aa, Homo Sapiens
PSPQPRLSP

SEQ ID NO: 595787 - protein, 9 aa, Homo Sapiens
NFACLTTGY

SEQ ID NO: 595788 - protein, 9 aa, Homo Sapiens
YPSKCLVEK

SEQ ID NO: 595789 - protein, 9 aa, Homo Sapiens
TSTDNMSFL

SEQ ID NO: 595790 - protein, 9 aa, Homo Sapiens
KDGLVKQCM

SEQ ID NO: 595791 - protein, 9 aa, Homo Sapiens
RGVHGTDPW

SEQ ID NO: 595792 - protein, 9 aa, Homo Sapiens
LCFSVNRVF

SEQ ID NO: 595793 - protein, 9 aa, Homo Sapiens
FEVKSVTHH

SEQ ID NO: 595794 - protein, 9 aa, Homo Sapiens
YPLAVPKGH

SEQ ID NO: 595795 - protein, 9 aa, Homo Sapiens
RDVPGNEHA

SEQ ID NO: 595796 - protein, 9 aa, Homo Sapiens
AKFQDVRFK

SEQ ID NO: 595797 - protein, 9 aa, Homo Sapiens
MWVKLLSIL

SEQ ID NO: 595798 - protein, 9 aa, Homo Sapiens
SIQLPIGFS

SEQ ID NO: 595799 - protein, 9 aa, Homo Sapiens
ESRKKIKSW

SEQ ID NO: 595800 - protein, 9 aa, Homo Sapiens
AVAQTPVTK

SEQ ID NO: 595801 - protein, 9 aa, Homo Sapiens
RINSWLLLC

SEQ ID NO: 595802 - protein, 9 aa, Homo Sapiens
GVSEALISE

SEQ ID NO: 595803 - protein, 9 aa, Homo Sapiens
KTLTVKIIT

SEQ ID NO: 595804 - protein, 9 aa, Homo Sapiens
AVELASRSD

SEQ ID NO: 595805 - protein, 9 aa, Homo Sapiens
NIGCKLDLK

SEQ ID NO: 595806 - protein, 9 aa, Homo Sapiens
SYLGGPRGG

SEQ ID NO: 595807 - protein, 9 aa, Homo Sapiens
MPIPRVRDS

SEQ ID NO: 595808 - protein, 9 aa, Homo Sapiens
SYPAHEQVA

SEQ ID NO: 595809 - protein, 9 aa, Homo Sapiens
KKPQKPITR

SEQ ID NO: 595810 - protein, 9 aa, Homo Sapiens
TLCTNLTGK

SEQ ID NO: 595811 - protein, 9 aa, Homo Sapiens
DVTELPEWS

SEQ ID NO: 595812 - protein, 9 aa, Homo Sapiens
TPGVSGHGV

SEQ ID NO: 595813 - protein, 9 aa, Homo Sapiens
KPEDCIRDV

SEQ ID NO: 595814 - protein, 9 aa, Homo Sapiens
FQGMSLLHL

SEQ ID NO: 595815 - protein, 9 aa, Homo Sapiens
HGGVQAQRP

SEQ ID NO: 595816 - protein, 9 aa, Homo Sapiens
ASRSDNSSD

SEQ ID NO: 595817 - protein, 9 aa, Homo Sapiens
YLNVQQENG

SEQ ID NO: 595818 - protein, 9 aa, Homo Sapiens
PFMLSSLLH

SEQ ID NO: 595819 - protein, 9 aa, Homo Sapiens
WHKTCFHCA

SEQ ID NO: 595820 - protein, 9 aa, Homo Sapiens
LVEKILVLG

SEQ ID NO: 595821 - protein, 9 aa, Homo Sapiens
QWRSPHPAG

SEQ ID NO: 595822 - protein, 9 aa, Homo Sapiens
AVPKGHRLC

SEQ ID NO: 595823 - protein, 9 aa, Homo Sapiens
EEKECWIHS

SEQ ID NO: 595824 - protein, 9 aa, Homo Sapiens
QVDLGFLRF

SEQ ID NO: 595825 - protein, 9 aa, Homo Sapiens
LRMQLLRSF

SEQ ID NO: 595826 - protein, 9 aa, Homo Sapiens
FPVPQVGSR

SEQ ID NO: 595827 - protein, 9 aa, Homo Sapiens
AQKVERLTE

SEQ ID NO: 595828 - protein, 9 aa, Homo Sapiens
SIAGPLLSY

SEQ ID NO: 595829 - protein, 9 aa, Homo Sapiens
PPQMESPDH

SEQ ID NO: 595830 - protein, 9 aa, Homo Sapiens
SENKCGLTP

SEQ ID NO: 595831 - protein, 9 aa, Homo Sapiens
AISKFSILT

SEQ ID NO: 595832 - protein, 9 aa, Homo Sapiens
RLAELLSNP

SEQ ID NO: 595833 - protein, 9 aa, Homo Sapiens
LHPNRRPAY

SEQ ID NO: 595834 - protein, 9 aa, Homo Sapiens
GDFPVPQVG

SEQ ID NO: 595835 - protein, 9 aa, Homo Sapiens
KPITRPGNK

SEQ ID NO: 595836 - protein, 9 aa, Homo Sapiens
WQSHPDVTE

SEQ ID NO: 595837 - protein, 9 aa, Homo Sapiens
TGSLSSLES

SEQ ID NO: 595838 - protein, 9 aa, Homo Sapiens
STSSIQLPI

SEQ ID NO: 595839 - protein, 9 aa, Homo Sapiens
ITLHPNRRP

SEQ ID NO: 595840 - protein, 9 aa, Homo Sapiens
FGLRLPRDV

SEQ ID NO: 595841 - protein, 9 aa, Homo Sapiens
IRENHPYFD

SEQ ID NO: 595842 - protein, 9 aa, Homo Sapiens
CGKAISKFS

SEQ ID NO: 595843 - protein, 9 aa, Homo Sapiens
FHKDLRKLY

SEQ ID NO: 595844 - protein, 9 aa, Homo Sapiens
SAATILNSA

SEQ ID NO: 595845 - protein, 9 aa, Homo Sapiens
VLYQNNGLC

SEQ ID NO: 595846 - protein, 9 aa, Homo Sapiens
VELASRSDN

SEQ ID NO: 595847 - protein, 9 aa, Homo Sapiens
ESPDHGKAL

SEQ ID NO: 595848 - protein, 9 aa, Homo Sapiens
FQEAHQQTL

SEQ ID NO: 595849 - protein, 9 aa, Homo Sapiens
RFCHLIYFP

SEQ ID NO: 595850 - protein, 9 aa, Homo Sapiens
YAAGGCDGQ

SEQ ID NO: 595851 - protein, 9 aa, Homo Sapiens
PLAVPKGHR

SEQ ID NO: 595852 - protein, 9 aa, Homo Sapiens
GYEGRGSVT

SEQ ID NO: 595853 - protein, 9 aa, Homo Sapiens
SYNTVQSVF

SEQ ID NO: 595854 - protein, 9 aa, Homo Sapiens
LLRQEKEKL

SEQ ID NO: 595855 - protein, 9 aa, Homo Sapiens
RLPRDVTEL

SEQ ID NO: 595856 - protein, 9 aa, Homo Sapiens
ERLGRGVHG

SEQ ID NO: 595857 - protein, 9 aa, Homo Sapiens
VRTMEAFHV

SEQ ID NO: 595858 - protein, 9 aa, Homo Sapiens
LQPYMPIPR

SEQ ID NO: 595859 - protein, 9 aa, Homo Sapiens
CIYAAGGCD

SEQ ID NO: 595860 - protein, 9 aa, Homo Sapiens
LSSAATILN

SEQ ID NO: 595861 - protein, 9 aa, Homo Sapiens
VYLESIFGR

SEQ ID NO: 595862 - protein, 9 aa, Homo Sapiens
LCNKYDICI

SEQ ID NO: 595863 - protein, 9 aa, Homo Sapiens
FQTLKMRIL

SEQ ID NO: 595864 - protein, 9 aa, Homo Sapiens
PQPRLSPRE

SEQ ID NO: 595865 - protein, 9 aa, Homo Sapiens
ELLRQEKEK

SEQ ID NO: 595866 - protein, 9 aa, Homo Sapiens
EHGRINSWL

SEQ ID NO: 595867 - protein, 9 aa, Homo Sapiens
VKLHWDVLN

SEQ ID NO: 595868 - protein, 9 aa, Homo Sapiens
TSAKVVYGG

SEQ ID NO: 595869 - protein, 9 aa, Homo Sapiens
NCIYAAGGC

SEQ ID NO: 595870 - protein, 9 aa, Homo Sapiens
KDSLSINAK

SEQ ID NO: 595871 - protein, 9 aa, Homo Sapiens
INFTVLQTQ

SEQ ID NO: 595872 - protein, 9 aa, Homo Sapiens
TLMGSFDDK

SEQ ID NO: 595873 - protein, 9 aa, Homo Sapiens
TCFHCAICG

SEQ ID NO: 595874 - protein, 9 aa, Homo Sapiens
VLKKGTRLN

SEQ ID NO: 595875 - protein, 9 aa, Homo Sapiens
LNLVPGVLS

SEQ ID NO: 595876 - protein, 9 aa, Homo Sapiens
TLVLKKGTR

SEQ ID NO: 595877 - protein, 9 aa, Homo Sapiens
LTEAFSQRY

SEQ ID NO: 595878 - protein, 9 aa, Homo Sapiens
TVTARGPCY

SEQ ID NO: 595879 - protein, 9 aa, Homo Sapiens
LTKEKKAFQ

SEQ ID NO: 595880 - protein, 9 aa, Homo Sapiens
CNKYDICIQ

SEQ ID NO: 595881 - protein, 9 aa, Homo Sapiens
KTCFHCAIC

SEQ ID NO: 595882 - protein, 9 aa, Homo Sapiens
NRVFKEVEG

SEQ ID NO: 595883 - protein, 9 aa, Homo Sapiens
KSEFTISAT

SEQ ID NO: 595884 - protein, 9 aa, Homo Sapiens
AQPGPPIAA

SEQ ID NO: 595885 - protein, 9 aa, Homo Sapiens
KKDGLVKQC

SEQ ID NO: 595886 - protein, 9 aa, Homo Sapiens
GYHLILQHR

SEQ ID NO: 595887 - protein, 9 aa, Homo Sapiens
KSTAKFQDV

SEQ ID NO: 595888 - protein, 9 aa, Homo Sapiens
KTPGVSGHG

SEQ ID NO: 595889 - protein, 9 aa, Homo Sapiens
EAQKVERLT

SEQ ID NO: 595890 - protein, 9 aa, Homo Sapiens
KQKPDWLWD

SEQ ID NO: 595891 - protein, 9 aa, Homo Sapiens
NNGLCSSHG

SEQ ID NO: 595892 - protein, 9 aa, Homo Sapiens
EECGKAISK

SEQ ID NO: 595893 - protein, 9 aa, Homo Sapiens
GAPSQFEER

SEQ ID NO: 595894 - protein, 9 aa, Homo Sapiens
CIRDVPGNE

SEQ ID NO: 595895 - protein, 9 aa, Homo Sapiens
MLCFSVNRV

SEQ ID NO: 595896 - protein, 9 aa, Homo Sapiens
AICHALRYT

SEQ ID NO: 595897 - protein, 9 aa, Homo Sapiens
SRKKIKSWV

SEQ ID NO: 595898 - protein, 9 aa, Homo Sapiens
KGGAPFMLS

SEQ ID NO: 595899 - protein, 9 aa, Homo Sapiens
TRKLFEVKS

SEQ ID NO: 595900 - protein, 9 aa, Homo Sapiens
HSGMCVCPP

SEQ ID NO: 595901 - protein, 9 aa, Homo Sapiens
TGGSHGGFI

SEQ ID NO: 595902 - protein, 9 aa, Homo Sapiens
CLDSHLHRM

SEQ ID NO: 595903 - protein, 9 aa, Homo Sapiens
GHYPSKCLV

SEQ ID NO: 595904 - protein, 9 aa, Homo Sapiens
ASPSRATRD

SEQ ID NO: 595905 - protein, 9 aa, Homo Sapiens
HGNKPLTLS

SEQ ID NO: 595906 - protein, 9 aa, Homo Sapiens
ILAEFCFSP

SEQ ID NO: 595907 - protein, 9 aa, Homo Sapiens
SGACLDSHL

SEQ ID NO: 595908 - protein, 9 aa, Homo Sapiens
LQTQPIYDF

SEQ ID NO: 595909 - protein, 9 aa, Homo Sapiens
HRQSHTLGV

SEQ ID NO: 595910 - protein, 9 aa, Homo Sapiens
GPPIAAANF

SEQ ID NO: 595911 - protein, 9 aa, Homo Sapiens
LESIFGRGA

SEQ ID NO: 595912 - protein, 9 aa, Homo Sapiens
RNMQIAEII

SEQ ID NO: 595913 - protein, 9 aa, Homo Sapiens
SKGIYALVT

SEQ ID NO: 595914 - protein, 9 aa, Homo Sapiens
SRGYHLILQ

SEQ ID NO: 595915 - protein, 9 aa, Homo Sapiens
YVIAINYNE

SEQ ID NO: 595916 - protein, 9 aa, Homo Sapiens
VRKKPKLEE

SEQ ID NO: 595917 - protein, 9 aa, Homo Sapiens
KKLMSTALD

SEQ ID NO: 595918 - protein, 9 aa, Homo Sapiens
HPNRRPAYQ

SEQ ID NO: 595919 - protein, 9 aa, Homo Sapiens
NAVAQTPVT

SEQ ID NO: 595920 - protein, 9 aa, Homo Sapiens
ALDMKEKTP

SEQ ID NO: 595921 - protein, 9 aa, Homo Sapiens
RIFVKTLTV

SEQ ID NO: 595922 - protein, 9 aa, Homo Sapiens
FPDVVSLVH

SEQ ID NO: 595923 - protein, 9 aa, Homo Sapiens
PLNKETGEM

SEQ ID NO: 595924 - protein, 9 aa, Homo Sapiens
HCAICGKSL

SEQ ID NO: 595925 - protein, 9 aa, Homo Sapiens
CHLIYFPPR

SEQ ID NO: 595926 - protein, 9 aa, Homo Sapiens
STDNMSFLI

SEQ ID NO: 595927 - protein, 9 aa, Homo Sapiens
IYAAGGCDG

SEQ ID NO: 595928 - protein, 9 aa, Homo Sapiens
GGPRGGAPS

SEQ ID NO: 595929 - protein, 9 aa, Homo Sapiens
WDIFQPPLF

SEQ ID NO: 595930 - protein, 9 aa, Homo Sapiens
RRPAYQYRL

SEQ ID NO: 595931 - protein, 9 aa, Homo Sapiens
KDLRKLYKM

SEQ ID NO: 595932 - protein, 9 aa, Homo Sapiens
SFADPASTL

SEQ ID NO: 595933 - protein, 9 aa, Homo Sapiens
SPFQGMSLL

SEQ ID NO: 595934 - protein, 9 aa, Homo Sapiens
PPGLPHPCM

SEQ ID NO: 595935 - protein, 9 aa, Homo Sapiens
ASTLMGSFD

SEQ ID NO: 595936 - protein, 9 aa, Homo Sapiens
DAYNMRHPR

SEQ ID NO: 595937 - protein, 9 aa, Homo Sapiens
QQENGTVSR

SEQ ID NO: 595938 - protein, 9 aa, Homo Sapiens
NFTVLQTQP

SEQ ID NO: 595939 - protein, 9 aa, Homo Sapiens
IRPSGTLPL

SEQ ID NO: 595940 - protein, 9 aa, Homo Sapiens
ECGKAISKF

SEQ ID NO: 595941 - protein, 9 aa, Homo Sapiens
MRHPRTGGG

SEQ ID NO: 595942 - protein, 9 aa, Homo Sapiens
PIAAANFPL

SEQ ID NO: 595943 - protein, 9 aa, Homo Sapiens
GPLLSYRRT

SEQ ID NO: 595944 - protein, 9 aa, Homo Sapiens
YHLILQHRI

SEQ ID NO: 595945 - protein, 9 aa, Homo Sapiens
GLCSSHGFG

SEQ ID NO: 595946 - protein, 9 aa, Homo Sapiens
ISATVQQKP

SEQ ID NO: 595947 - protein, 9 aa, Homo Sapiens
IAAANFPLG

SEQ ID NO: 595948 - protein, 9 aa, Homo Sapiens
SAFHAILII

SEQ ID NO: 595949 - protein, 9 aa, Homo Sapiens
RNKSEFTIS

SEQ ID NO: 595950 - protein, 9 aa, Homo Sapiens
CLVEKILVL

SEQ ID NO: 595951 - protein, 9 aa, Homo Sapiens
SYRMVVVGA

SEQ ID NO: 595952 - protein, 9 aa, Homo Sapiens
PQKPITRPG

SEQ ID NO: 595953 - protein, 9 aa, Homo Sapiens
YVRKKPKLE

SEQ ID NO: 595954 - protein, 9 aa, Homo Sapiens
NPATLGLEE

SEQ ID NO: 595955 - protein, 9 aa, Homo Sapiens
FKKTSHGYE

SEQ ID NO: 595956 - protein, 9 aa, Homo Sapiens
APNLLNGKR

SEQ ID NO: 595957 - protein, 9 aa, Homo Sapiens
YSAFHAILI

SEQ ID NO: 595958 - protein, 9 aa, Homo Sapiens
ILCHWSQRP

SEQ ID NO: 595959 - protein, 9 aa, Homo Sapiens
QEGQYTIRG

SEQ ID NO: 595960 - protein, 9 aa, Homo Sapiens
VNRVFKEVE

SEQ ID NO: 595961 - protein, 9 aa, Homo Sapiens
DRYIAICHA

SEQ ID NO: 595962 - protein, 9 aa, Homo Sapiens
FKRWRAVKL

SEQ ID NO: 595963 - protein, 9 aa, Homo Sapiens
LSSYNTVQS

SEQ ID NO: 595964 - protein, 9 aa, Homo Sapiens
QLRMQLLRS

SEQ ID NO: 595965 - protein, 9 aa, Homo Sapiens
NEIKNKELT

SEQ ID NO: 595966 - protein, 9 aa, Homo Sapiens
QSLPHGNKP

SEQ ID NO: 595967 - protein, 9 aa, Homo Sapiens
TLSSPQWIT

SEQ ID NO: 595968 - protein, 9 aa, Homo Sapiens
RPSGTLPLA

SEQ ID NO: 595969 - protein, 9 aa, Homo Sapiens
KETGEMCVM

SEQ ID NO: 595970 - protein, 9 aa, Homo Sapiens
VEHLAILCH

SEQ ID NO: 595971 - protein, 9 aa, Homo Sapiens
ASQEGQYTI

SEQ ID NO: 595972 - protein, 9 aa, Homo Sapiens
AQLQRSHTG

SEQ ID NO: 595973 - protein, 9 aa, Homo Sapiens
YLESIFGRG

SEQ ID NO: 595974 - protein, 9 aa, Homo Sapiens
VNIGCKLDL

SEQ ID NO: 595975 - protein, 9 aa, Homo Sapiens
CPPPKCPQS

SEQ ID NO: 595976 - protein, 9 aa, Homo Sapiens
YEGRGSVTG

SEQ ID NO: 595977 - protein, 9 aa, Homo Sapiens
HQKEITVTA

SEQ ID NO: 595978 - protein, 9 aa, Homo Sapiens
FQPPLFGLV

SEQ ID NO: 595979 - protein, 9 aa, Homo Sapiens
CVCPPPPGL

SEQ ID NO: 595980 - protein, 9 aa, Homo Sapiens
GVYPCAICF

SEQ ID NO: 595981 - protein, 9 aa, Homo Sapiens
SKCLVEKIL

SEQ ID NO: 595982 - protein, 9 aa, Homo Sapiens
IFKKTSHGY

SEQ ID NO: 595983 - protein, 9 aa, Homo Sapiens
IENLKNEIK

SEQ ID NO: 595984 - protein, 9 aa, Homo Sapiens
KLWRKSSSQ

SEQ ID NO: 595985 - protein, 9 aa, Homo Sapiens
TREEKECWI

SEQ ID NO: 595986 - protein, 9 aa, Homo Sapiens
HKTCFHCAI

SEQ ID NO: 595987 - protein, 9 aa, Homo Sapiens
QVALLVPEK

SEQ ID NO: 595988 - protein, 9 aa, Homo Sapiens
VSTVNIGCK

SEQ ID NO: 595989 - protein, 9 aa, Homo Sapiens
LLSGGHGGV

SEQ ID NO: 595990 - protein, 9 aa, Homo Sapiens
LEEVQVRLE

SEQ ID NO: 595991 - protein, 9 aa, Homo Sapiens
TVQSVFCCC

SEQ ID NO: 595992 - protein, 9 aa, Homo Sapiens
ISKFSILTK

SEQ ID NO: 595993 - protein, 9 aa, Homo Sapiens
FDVDANGIV

SEQ ID NO: 595994 - protein, 9 aa, Homo Sapiens
PKGHRLCCE

SEQ ID NO: 595995 - protein, 9 aa, Homo Sapiens
KLMSTALDM

SEQ ID NO: 595996 - protein, 9 aa, Homo Sapiens
CRLPATQEV

SEQ ID NO: 595997 - protein, 9 aa, Homo Sapiens
RDVTELPEW

SEQ ID NO: 595998 - protein, 9 aa, Homo Sapiens
LGRGVHGTD

SEQ ID NO: 595999 - protein, 9 aa, Homo Sapiens
SSIQLPIGF

SEQ ID NO: 596000 - protein, 9 aa, Homo Sapiens
GGAPSQFEE

SEQ ID NO: 596001 - protein, 9 aa, Homo Sapiens
KLLPSRNTD

SEQ ID NO: 596002 - protein, 9 aa, Homo Sapiens
RLGRGVHGT

SEQ ID NO: 596003 - protein, 9 aa, Homo Sapiens
ASSNISLNL

SEQ ID NO: 596004 - protein, 9 aa, Homo Sapiens
TGYVIAINY

SEQ ID NO: 596005 - protein, 9 aa, Homo Sapiens
KNPATLGLE

SEQ ID NO: 596006 - protein, 9 aa, Homo Sapiens
GTDPWATPP

SEQ ID NO: 596007 - protein, 9 aa, Homo Sapiens
KDNIRLAEL

SEQ ID NO: 596008 - protein, 9 aa, Homo Sapiens
EGDFPVPQV

SEQ ID NO: 596009 - protein, 9 aa, Homo Sapiens
PRDVTELPE

SEQ ID NO: 596010 - protein, 9 aa, Homo Sapiens
VVGASRVGK

SEQ ID NO: 596011 - protein, 9 aa, Homo Sapiens
NEEQMFGFI

SEQ ID NO: 596012 - protein, 9 aa, Homo Sapiens
HGRINSWLL

SEQ ID NO: 596013 - protein, 9 aa, Homo Sapiens
SILAEFCFS

SEQ ID NO: 596014 - protein, 9 aa, Homo Sapiens
LQAQPGPPI

SEQ ID NO: 596015 - protein, 9 aa, Homo Sapiens
GDHHIFKKT

SEQ ID NO: 596016 - protein, 9 aa, Homo Sapiens
ASHVALTGG

SEQ ID NO: 596017 - protein, 9 aa, Homo Sapiens
TDNMSFLIL

SEQ ID NO: 596018 - protein, 9 aa, Homo Sapiens
PPQKNPATL

SEQ ID NO: 596019 - protein, 9 aa, Homo Sapiens
GPRGGAPSQ

SEQ ID NO: 596020 - protein, 9 aa, Homo Sapiens
LTTGYVIAI

SEQ ID NO: 596021 - protein, 9 aa, Homo Sapiens
AFHAILIIK

SEQ ID NO: 596022 - protein, 9 aa, Homo Sapiens
SHVALTGGS

SEQ ID NO: 596023 - protein, 9 aa, Homo Sapiens
PEESRKKIK

SEQ ID NO: 596024 - protein, 9 aa, Homo Sapiens
SSNISLNLL

SEQ ID NO: 596025 - protein, 9 aa, Homo Sapiens
VFNQKHNTQ

SEQ ID NO: 596026 - protein, 9 aa, Homo Sapiens
PVPQVGSRL

SEQ ID NO: 596027 - protein, 9 aa, Homo Sapiens
IQLPIGFST

SEQ ID NO: 596028 - protein, 9 aa, Homo Sapiens
FLRFVTAVG

SEQ ID NO: 596029 - protein, 9 aa, Homo Sapiens
KHQKEITVT

SEQ ID NO: 596030 - protein, 9 aa, Homo Sapiens
LEKSTAKFQ

SEQ ID NO: 596031 - protein, 9 aa, Homo Sapiens
SSYNTVQSV

SEQ ID NO: 596032 - protein, 9 aa, Homo Sapiens
RFIMRHTSE

SEQ ID NO: 596033 - protein, 9 aa, Homo Sapiens
VTARGPCYS

SEQ ID NO: 596034 - protein, 9 aa, Homo Sapiens
YALVTQDVF

SEQ ID NO: 596035 - protein, 9 aa, Homo Sapiens
WRKSSSQER

SEQ ID NO: 596036 - protein, 9 aa, Homo Sapiens
ERLTEAFSQ

SEQ ID NO: 596037 - protein, 9 aa, Homo Sapiens
HKDLRKLYK

SEQ ID NO: 596038 - protein, 9 aa, Homo Sapiens
VKLLSILAE

SEQ ID NO: 596039 - protein, 9 aa, Homo Sapiens
EPEDFSAVT

SEQ ID NO: 596040 - protein, 9 aa, Homo Sapiens
TSGDHHIFK

SEQ ID NO: 596041 - protein, 9 aa, Homo Sapiens
GFLRFVTAV

SEQ ID NO: 596042 - protein, 9 aa, Homo Sapiens
RMVVVGASR

SEQ ID NO: 596043 - protein, 9 aa, Homo Sapiens
TEHGRINSW

SEQ ID NO: 596044 - protein, 9 aa, Homo Sapiens
PWHKTCFHC

SEQ ID NO: 596045 - protein, 9 aa, Homo Sapiens
HALRYTNLM

SEQ ID NO: 596046 - protein, 9 aa, Homo Sapiens
PFVSHSGSP

SEQ ID NO: 596047 - protein, 9 aa, Homo Sapiens
KSVTHHDYR

SEQ ID NO: 596048 - protein, 9 aa, Homo Sapiens
INKVATFKT

SEQ ID NO: 596049 - protein, 9 aa, Homo Sapiens
IKDNIRLAE

SEQ ID NO: 596050 - protein, 9 aa, Homo Sapiens
KNEIKNKEL

SEQ ID NO: 596051 - protein, 9 aa, Homo Sapiens
KLTKEKKAF

SEQ ID NO: 596052 - protein, 9 aa, Homo Sapiens
EMFRNMQIA

SEQ ID NO: 596053 - protein, 9 aa, Homo Sapiens
ILIRTSFPQ

SEQ ID NO: 596054 - protein, 9 aa, Homo Sapiens
GRFIMRHTS

SEQ ID NO: 596055 - protein, 9 aa, Homo Sapiens
TSDAVELAS

SEQ ID NO: 596056 - protein, 9 aa, Homo Sapiens
SSAATILNS

SEQ ID NO: 596057 - protein, 9 aa, Homo Sapiens
KYDICIQWR

SEQ ID NO: 596058 - protein, 9 aa, Homo Sapiens
EGRGSVTGS

SEQ ID NO: 596059 - protein, 9 aa, Homo Sapiens
KKAFQEAHQ

SEQ ID NO: 596060 - protein, 9 aa, Homo Sapiens
PSKCLVEKI

SEQ ID NO: 596061 - protein, 9 aa, Homo Sapiens
TVKIITLEV

SEQ ID NO: 596062 - protein, 9 aa, Homo Sapiens
HVVSYVPIT

SEQ ID NO: 596063 - protein, 9 aa, Homo Sapiens
ILNSAQQLR

SEQ ID NO: 596064 - protein, 9 aa, Homo Sapiens
PPKCPQSCP

SEQ ID NO: 596065 - protein, 9 aa, Homo Sapiens
FSAVTMERF

SEQ ID NO: 596066 - protein, 9 aa, Homo Sapiens
ALCNKYDIC

SEQ ID NO: 596067 - protein, 9 aa, Homo Sapiens
IVSTVNIGC

SEQ ID NO: 596068 - protein, 9 aa, Homo Sapiens
VQEEEIREN

SEQ ID NO: 596069 - protein, 9 aa, Homo Sapiens
FTVLQTQPI

SEQ ID NO: 596070 - protein, 9 aa, Homo Sapiens
KSWVESQTN

SEQ ID NO: 596071 - protein, 9 aa, Homo Sapiens
LRAGRFIMR

SEQ ID NO: 596072 - protein, 9 aa, Homo Sapiens
PNRRPAYQY

SEQ ID NO: 596073 - protein, 9 aa, Homo Sapiens
CGTLSSPQW

SEQ ID NO: 596074 - protein, 9 aa, Homo Sapiens
VDLGFLRFV

SEQ ID NO: 596075 - protein, 9 aa, Homo Sapiens
RKSSSQERA

SEQ ID NO: 596076 - protein, 9 aa, Homo Sapiens
GNAVAQTPV

SEQ ID NO: 596077 - protein, 9 aa, Homo Sapiens
NGNAVAQTP

SEQ ID NO: 596078 - protein, 9 aa, Homo Sapiens
QKVERLTEA

SEQ ID NO: 596079 - protein, 9 aa, Homo Sapiens
GPGTLVLKK

SEQ ID NO: 596080 - protein, 9 aa, Homo Sapiens
QGMSLLHLA

SEQ ID NO: 596081 - protein, 9 aa, Homo Sapiens
AYVALCNKY

SEQ ID NO: 596082 - protein, 9 aa, Homo Sapiens
DLLRLFEHG

SEQ ID NO: 596083 - protein, 9 aa, Homo Sapiens
AQLFGDSYI

SEQ ID NO: 596084 - protein, 9 aa, Homo Sapiens
ADPASTLMG

SEQ ID NO: 596085 - protein, 9 aa, Homo Sapiens
VFVATVGMK

SEQ ID NO: 596086 - protein, 9 aa, Homo Sapiens
SLQIRPSGT

SEQ ID NO: 596087 - protein, 9 aa, Homo Sapiens
ELASRSDNS

SEQ ID NO: 596088 - protein, 9 aa, Homo Sapiens
PIPRVRDSL

SEQ ID NO: 596089 - protein, 9 aa, Homo Sapiens
PQIEVTFDV

SEQ ID NO: 596090 - protein, 9 aa, Homo Sapiens
SEGDFPVPQ

SEQ ID NO: 596091 - protein, 9 aa, Homo Sapiens
GKAISKFSI

SEQ ID NO: 596092 - protein, 9 aa, Homo Sapiens
DLSFSVSFR

SEQ ID NO: 596093 - protein, 9 aa, Homo Sapiens
IAKLWRKSS

SEQ ID NO: 596094 - protein, 9 aa, Homo Sapiens
QVCGTLSSP

SEQ ID NO: 596095 - protein, 9 aa, Homo Sapiens
FIMRHTSEV

SEQ ID NO: 596096 - protein, 9 aa, Homo Sapiens
RKKPKLEEV

SEQ ID NO: 596097 - protein, 9 aa, Homo Sapiens
SEFTISATV

SEQ ID NO: 596098 - protein, 9 aa, Homo Sapiens
RQEKEKLYM

SEQ ID NO: 596099 - protein, 9 aa, Homo Sapiens
NTVQSVFCC

SEQ ID NO: 596100 - protein, 9 aa, Homo Sapiens
YGGTDSVMC

SEQ ID NO: 596101 - protein, 9 aa, Homo Sapiens
DSLSINAKL

SEQ ID NO: 596102 - protein, 9 aa, Homo Sapiens
MESPDHGKA

SEQ ID NO: 596103 - protein, 9 aa, Homo Sapiens
SHTLGVYPC

SEQ ID NO: 596104 - protein, 9 aa, Homo Sapiens
EDFSAVTME

SEQ ID NO: 596105 - protein, 9 aa, Homo Sapiens
VVVGASRVG

SEQ ID NO: 596106 - protein, 9 aa, Homo Sapiens
VALCNKYDI

SEQ ID NO: 596107 - protein, 9 aa, Homo Sapiens
MQLLRSFYS

SEQ ID NO: 596108 - protein, 9 aa, Homo Sapiens
SNISLNLLK

SEQ ID NO: 596109 - protein, 9 aa, Homo Sapiens
VSAPNLLNG

SEQ ID NO: 596110 - protein, 9 aa, Homo Sapiens
HEQVALLVP

SEQ ID NO: 596111 - protein, 9 aa, Homo Sapiens
KWVYLESIF

SEQ ID NO: 596112 - protein, 9 aa, Homo Sapiens
FHAILIIKS

SEQ ID NO: 596113 - protein, 9 aa, Homo Sapiens
NLKNEIKNK

SEQ ID NO: 596114 - protein, 9 aa, Homo Sapiens
FACLTTGYV

SEQ ID NO: 596115 - protein, 9 aa, Homo Sapiens
TRPGNKFQG

SEQ ID NO: 596116 - protein, 9 aa, Homo Sapiens
TKPEDCIRD

SEQ ID NO: 596117 - protein, 9 aa, Homo Sapiens
ILLGVIAVF

SEQ ID NO: 596118 - protein, 9 aa, Homo Sapiens
AYNMRHPRT

SEQ ID NO: 596119 - protein, 9 aa, Homo Sapiens
NMCRLPATQ

SEQ ID NO: 596120 - protein, 9 aa, Homo Sapiens
RKKIKSWVE

SEQ ID NO: 596121 - protein, 9 aa, Homo Sapiens
KLNSDSVKP

SEQ ID NO: 596122 - protein, 9 aa, Homo Sapiens
YIAICHALR

SEQ ID NO: 596123 - protein, 9 aa, Homo Sapiens
QGTYSKPGG

SEQ ID NO: 596124 - protein, 9 aa, Homo Sapiens
GSPFQGMSL

SEQ ID NO: 596125 - protein, 9 aa, Homo Sapiens
VPFVSHSGS

SEQ ID NO: 596126 - protein, 9 aa, Homo Sapiens
PPLFGLVGA

SEQ ID NO: 596127 - protein, 9 aa, Homo Sapiens
INAKLHLHQ

SEQ ID NO: 596128 - protein, 9 aa, Homo Sapiens
WRAVKLHWD

SEQ ID NO: 596129 - protein, 9 aa, Homo Sapiens
KAFQEAHQQ

SEQ ID NO: 596130 - protein, 9 aa, Homo Sapiens
VSEALISEN

SEQ ID NO: 596131 - protein, 9 aa, Homo Sapiens
GGCDGQDQL

SEQ ID NO: 596132 - protein, 9 aa, Homo Sapiens
TTGYVIAIN

SEQ ID NO: 596133 - protein, 9 aa, Homo Sapiens
FFVLNLVPG

SEQ ID NO: 596134 - protein, 9 aa, Homo Sapiens
EWIQVDLGF

SEQ ID NO: 596135 - protein, 9 aa, Homo Sapiens
RGYHLILQH

SEQ ID NO: 596136 - protein, 9 aa, Homo Sapiens
AATILNSAQ

SEQ ID NO: 596137 - protein, 9 aa, Homo Sapiens
STVNIGCKL

SEQ ID NO: 596138 - protein, 9 aa, Homo Sapiens
EKSTAKFQD

SEQ ID NO: 596139 - protein, 9 aa, Homo Sapiens
HRLCCEVCE

SEQ ID NO: 596140 - protein, 9 aa, Homo Sapiens
LTGGSHGGF

SEQ ID NO: 596141 - protein, 9 aa, Homo Sapiens
SGGHGGVQA

SEQ ID NO: 596142 - protein, 9 aa, Homo Sapiens
QMESPDHGK

SEQ ID NO: 596143 - protein, 9 aa, Homo Sapiens
SQEGQYTIR

SEQ ID NO: 596144 - protein, 9 aa, Homo Sapiens
LPRDVTELP

SEQ ID NO: 596145 - protein, 9 aa, Homo Sapiens
LWRKSSSQE

SEQ ID NO: 596146 - protein, 9 aa, Homo Sapiens
AGPPQKNPA

SEQ ID NO: 596147 - protein, 9 aa, Homo Sapiens
VWSLEPEDF

SEQ ID NO: 596148 - protein, 9 aa, Homo Sapiens
ASTSSIQLP

SEQ ID NO: 596149 - protein, 9 aa, Homo Sapiens
RASPSRATR

SEQ ID NO: 596150 - protein, 9 aa, Homo Sapiens
HLAILCHWS

SEQ ID NO: 596151 - protein, 9 aa, Homo Sapiens
GMCVCPPPP

SEQ ID NO: 596152 - protein, 9 aa, Homo Sapiens
EDCIRDVPG

SEQ ID NO: 596153 - protein, 9 aa, Homo Sapiens
VPKGHRLCC

SEQ ID NO: 596154 - protein, 9 aa, Homo Sapiens
NLTGKLLPS

SEQ ID NO: 596155 - protein, 9 aa, Homo Sapiens
SFFVLNLVP

SEQ ID NO: 596156 - protein, 9 aa, Homo Sapiens
NLALGEAGQ

SEQ ID NO: 596157 - protein, 9 aa, Homo Sapiens
MQIAEIIRK

SEQ ID NO: 596158 - protein, 9 aa, Homo Sapiens
LEPEDFSAV

SEQ ID NO: 596159 - protein, 9 aa, Homo Sapiens
KIKSWVESQ

SEQ ID NO: 596160 - protein, 9 aa, Homo Sapiens
KVERLTEAF

SEQ ID NO: 596161 - protein, 9 aa, Homo Sapiens
AQTPVTKGC

SEQ ID NO: 596162 - protein, 9 aa, Homo Sapiens
LLRLFEHGG

SEQ ID NO: 596163 - protein, 9 aa, Homo Sapiens
HSASQEGQY

SEQ ID NO: 596164 - protein, 9 aa, Homo Sapiens
SASQEGQYT

SEQ ID NO: 596165 - protein, 9 aa, Homo Sapiens
FKTPGVSGH

SEQ ID NO: 596166 - protein, 9 aa, Homo Sapiens
EHGGFPPEA

SEQ ID NO: 596167 - protein, 9 aa, Homo Sapiens
KPQKPITRP

SEQ ID NO: 596168 - protein, 9 aa, Homo Sapiens
WMLCFSVNR

SEQ ID NO: 596169 - protein, 9 aa, Homo Sapiens
FADPASTLM

SEQ ID NO: 596170 - protein, 9 aa, Homo Sapiens
TAKFQDVRF

SEQ ID NO: 596171 - protein, 9 aa, Homo Sapiens
HGGFPPEAN

SEQ ID NO: 596172 - protein, 9 aa, Homo Sapiens
TKEKKAFQE

SEQ ID NO: 596173 - protein, 9 aa, Homo Sapiens
GYNYDSFHK

SEQ ID NO: 596174 - protein, 9 aa, Homo Sapiens
NEPLNKETG

SEQ ID NO: 596175 - protein, 9 aa, Homo Sapiens
SELAQLQRS

SEQ ID NO: 596176 - protein, 9 aa, Homo Sapiens
KQGTYSKPG

SEQ ID NO: 596177 - protein, 9 aa, Homo Sapiens
SAKVVYGGT

SEQ ID NO: 596178 - protein, 9 aa, Homo Sapiens
AVFVATVGM

SEQ ID NO: 596179 - protein, 9 aa, Homo Sapiens
RPSSGVSEA

SEQ ID NO: 596180 - protein, 9 aa, Homo Sapiens
RSPPQMESP

SEQ ID NO: 596181 - protein, 9 aa, Homo Sapiens
RLEAASQQN

SEQ ID NO: 596182 - protein, 9 aa, Homo Sapiens
NGLCSSHGF

SEQ ID NO: 596183 - protein, 9 aa, Homo Sapiens
NMRHPRTGG

SEQ ID NO: 596184 - protein, 9 aa, Homo Sapiens
PPPKCPQSC

SEQ ID NO: 596185 - protein, 9 aa, Homo Sapiens
TNGNAVAQT

SEQ ID NO: 596186 - protein, 9 aa, Homo Sapiens
FGSVPFVSH

SEQ ID NO: 596187 - protein, 9 aa, Homo Sapiens
LSTEHGRIN

SEQ ID NO: 596188 - protein, 9 aa, Homo Sapiens
HTLGVYPCA

SEQ ID NO: 596189 - protein, 9 aa, Homo Sapiens
WSLEPEDFS

SEQ ID NO: 596190 - protein, 9 aa, Homo Sapiens
FMLSSLLHQ

SEQ ID NO: 596191 - protein, 9 aa, Homo Sapiens
RSPHPAGGI

SEQ ID NO: 596192 - protein, 9 aa, Homo Sapiens
EITVTARGP

SEQ ID NO: 596193 - protein, 9 aa, Homo Sapiens
FNQKHNTQG

SEQ ID NO: 596194 - protein, 9 aa, Homo Sapiens
HHYVASCTA

SEQ ID NO: 596195 - protein, 9 aa, Homo Sapiens
LVKQCMGTV

SEQ ID NO: 596196 - protein, 9 aa, Homo Sapiens
ILQHRIHTG

SEQ ID NO: 596197 - protein, 9 aa, Homo Sapiens
LSINAKLHL

SEQ ID NO: 596198 - protein, 9 aa, Homo Sapiens
IYALVTQDV

SEQ ID NO: 596199 - protein, 9 aa, Homo Sapiens
SPQPRLSPR

SEQ ID NO: 596200 - protein, 9 aa, Homo Sapiens
YTIRGHPGS

SEQ ID NO: 596201 - protein, 9 aa, Homo Sapiens
GKLLPSRNT

SEQ ID NO: 596202 - protein, 9 aa, Homo Sapiens
GGAPFMLSS

SEQ ID NO: 596203 - protein, 9 aa, Homo Sapiens
DVKQGTYSK

SEQ ID NO: 596204 - protein, 9 aa, Homo Sapiens
AKVVYGGTD

SEQ ID NO: 596205 - protein, 9 aa, Homo Sapiens
KKGTRLNDV

SEQ ID NO: 596206 - protein, 9 aa, Homo Sapiens
LKMRILIRT

SEQ ID NO: 596207 - protein, 9 aa, Homo Sapiens
QTLKMRILI

SEQ ID NO: 596208 - protein, 9 aa, Homo Sapiens
PPIAAANFP

SEQ ID NO: 596209 - protein, 9 aa, Homo Sapiens
LFEHGGFPP

SEQ ID NO: 596210 - protein, 9 aa, Homo Sapiens
HLIYFPPRR

SEQ ID NO: 596211 - protein, 9 aa, Homo Sapiens
ILSSYNTVQ

SEQ ID NO: 596212 - protein, 9 aa, Homo Sapiens
QIEVTFDVD

SEQ ID NO: 596213 - protein, 9 aa, Homo Sapiens
MCVCPPPPG

SEQ ID NO: 596214 - protein, 9 aa, Homo Sapiens
AKLHLHQWR

SEQ ID NO: 596215 - protein, 9 aa, Homo Sapiens
LSYRRTGSS

SEQ ID NO: 596216 - protein, 9 aa, Homo Sapiens
VALTGGSHG

SEQ ID NO: 596217 - protein, 9 aa, Homo Sapiens
KLEEVQVRL

SEQ ID NO: 596218 - protein, 9 aa, Homo Sapiens
TQPIYDFIT

SEQ ID NO: 596219 - protein, 9 aa, Homo Sapiens
RKRNLALGE

SEQ ID NO: 596220 - protein, 9 aa, Homo Sapiens
PRVRDSLIQ

SEQ ID NO: 596221 - protein, 9 aa, Homo Sapiens
GLVKQCMGT

SEQ ID NO: 596222 - protein, 9 aa, Homo Sapiens
VSLVHHYVA

SEQ ID NO: 596223 - protein, 9 aa, Homo Sapiens
VKIITLEVE

SEQ ID NO: 596224 - protein, 9 aa, Homo Sapiens
KNSYRMVVV

SEQ ID NO: 596225 - protein, 9 aa, Homo Sapiens
EIENLKNEI

SEQ ID NO: 596226 - protein, 9 aa, Homo Sapiens
LHLHQWRSP

SEQ ID NO: 596227 - protein, 9 aa, Homo Sapiens
LNVQQENGT

SEQ ID NO: 596228 - protein, 9 aa, Homo Sapiens
GADIESENK

SEQ ID NO: 596229 - protein, 9 aa, Homo Sapiens
EEVQVRLEE

SEQ ID NO: 596230 - protein, 9 aa, Homo Sapiens
DSFHKDLRK

SEQ ID NO: 596231 - protein, 9 aa, Homo Sapiens
PKGGAPFML

SEQ ID NO: 596232 - protein, 9 aa, Homo Sapiens
VQSVFCCCC

SEQ ID NO: 596233 - protein, 9 aa, Homo Sapiens
PGVLSGEFS

SEQ ID NO: 596234 - protein, 9 aa, Homo Sapiens
NRRPAYQYR

SEQ ID NO: 596235 - protein, 9 aa, Homo Sapiens
PLLSYRRTG

SEQ ID NO: 596236 - protein, 9 aa, Homo Sapiens
YNTVQSVFC

SEQ ID NO: 596237 - protein, 9 aa, Homo Sapiens
CSSHGFGTR

SEQ ID NO: 596238 - protein, 9 aa, Homo Sapiens
PPPGLPHPC

SEQ ID NO: 596239 - protein, 9 aa, Homo Sapiens
AHEQVALLV

SEQ ID NO: 596240 - protein, 9 aa, Homo Sapiens
VVAQLFGDS

SEQ ID NO: 596241 - protein, 9 aa, Homo Sapiens
LLSYRRTGS

SEQ ID NO: 596242 - protein, 9 aa, Homo Sapiens
YQNNGLCSS

SEQ ID NO: 596243 - protein, 9 aa, Homo Sapiens
STFVFNQKH

SEQ ID NO: 596244 - protein, 9 aa, Homo Sapiens
SDAVELASR

SEQ ID NO: 596245 - protein, 9 aa, Homo Sapiens
SLSSAATIL

SEQ ID NO: 596246 - protein, 9 aa, Homo Sapiens
LASTSSIQL

SEQ ID NO: 596247 - protein, 9 aa, Homo Sapiens
KKTSHGYEA

SEQ ID NO: 596248 - protein, 9 aa, Homo Sapiens
PRTGGGMTV

SEQ ID NO: 596249 - protein, 9 aa, Homo Sapiens
QPIYDFITV

SEQ ID NO: 596250 - protein, 9 aa, Homo Sapiens
PITRPGNKF

SEQ ID NO: 596251 - protein, 9 aa, Homo Sapiens
STEHGRINS

SEQ ID NO: 596252 - protein, 9 aa, Homo Sapiens
MSTALDMKE

SEQ ID NO: 596253 - protein, 9 aa, Homo Sapiens
ENKCGLTPL

SEQ ID NO: 596254 - protein, 9 aa, Homo Sapiens
VHGTDPWAT

SEQ ID NO: 596255 - protein, 9 aa, Homo Sapiens
LGFLRFVTA

SEQ ID NO: 596256 - protein, 9 aa, Homo Sapiens
VCGTLSSPQ

SEQ ID NO: 596257 - protein, 9 aa, Homo Sapiens
FSLSWQSHP

SEQ ID NO: 596258 - protein, 9 aa, Homo Sapiens
NIVSTVNIG

SEQ ID NO: 596259 - protein, 9 aa, Homo Sapiens
KMRILIRTS

SEQ ID NO: 596260 - protein, 9 aa, Homo Sapiens
REQLRAGRF

SEQ ID NO: 596261 - protein, 9 aa, Homo Sapiens
KELLRQEKE

SEQ ID NO: 596262 - protein, 9 aa, Homo Sapiens
RGHYPSKCL

SEQ ID NO: 596263 - protein, 9 aa, Homo Sapiens
PGPPIAAAN

SEQ ID NO: 596264 - protein, 9 aa, Homo Sapiens
EIKNKELTL

SEQ ID NO: 596265 - protein, 9 aa, Homo Sapiens
VCPPPPGLP

SEQ ID NO: 596266 - protein, 9 aa, Homo Sapiens
VLQTQPIYD

SEQ ID NO: 596267 - protein, 9 aa, Homo Sapiens
ACLTTGYVI

SEQ ID NO: 596268 - protein, 9 aa, Homo Sapiens
LSFSVSFRW

SEQ ID NO: 596269 - protein, 9 aa, Homo Sapiens
QKPITRPGN

SEQ ID NO: 596270 - protein, 9 aa, Homo Sapiens
EQVALLVPE

SEQ ID NO: 596271 - protein, 9 aa, Homo Sapiens
REEKECWIH

SEQ ID NO: 596272 - protein, 9 aa, Homo Sapiens
GHRLCCEVC

SEQ ID NO: 596273 - protein, 9 aa, Homo Sapiens
SVTGSLSSL

SEQ ID NO: 596274 - protein, 9 aa, Homo Sapiens
VAQTPVTKG

SEQ ID NO: 596275 - protein, 9 aa, Homo Sapiens
LCSSHGFGT

SEQ ID NO: 596276 - protein, 9 aa, Homo Sapiens
CSSGACLDS

SEQ ID NO: 596277 - protein, 9 aa, Homo Sapiens
VGASRVGKS

SEQ ID NO: 596278 - protein, 9 aa, Homo Sapiens
PSGTLPLAT

SEQ ID NO: 596279 - protein, 9 aa, Homo Sapiens
PGTLVLKKG

SEQ ID NO: 596280 - protein, 9 aa, Homo Sapiens
SYLNVQQEN

SEQ ID NO: 596281 - protein, 9 aa, Homo Sapiens
LQIRPSGTL

SEQ ID NO: 596282 - protein, 9 aa, Homo Sapiens
LTGKLLPSR

SEQ ID NO: 596283 - protein, 9 aa, Homo Sapiens
LSWQSHPDV

SEQ ID NO: 596284 - protein, 9 aa, Homo Sapiens
DVDANGIVH

SEQ ID NO: 596285 - protein, 9 aa, Homo Sapiens
LCHWSQRPA

SEQ ID NO: 596286 - protein, 9 aa, Homo Sapiens
LDMKEKTPV

SEQ ID NO: 596287 - protein, 9 aa, Homo Sapiens
DPASTLMGS

SEQ ID NO: 596288 - protein, 9 aa, Homo Sapiens
NISLNLLKI

SEQ ID NO: 596289 - protein, 9 aa, Homo Sapiens
NSSYLNVQQ

SEQ ID NO: 596290 - protein, 9 aa, Homo Sapiens
FSVNRVFKE

SEQ ID NO: 596291 - protein, 9 aa, Homo Sapiens
ATILNSAQQ

SEQ ID NO: 596292 - protein, 9 aa, Homo Sapiens
LCTNLTGKL

SEQ ID NO: 596293 - protein, 9 aa, Homo Sapiens
PQKNPATLG

SEQ ID NO: 596294 - protein, 9 aa, Homo Sapiens
NVQQENGTV

SEQ ID NO: 596295 - protein, 9 aa, Homo Sapiens
DFPVPQVGS

SEQ ID NO: 596296 - protein, 9 aa, Homo Sapiens
WVYLESIFG

SEQ ID NO: 596297 - protein, 9 aa, Homo Sapiens
LMSTALDMK

SEQ ID NO: 596298 - protein, 9 aa, Homo Sapiens
FGDSYIYHW

SEQ ID NO: 596299 - protein, 9 aa, Homo Sapiens
DHHIFKKTS

SEQ ID NO: 596300 - protein, 9 aa, Homo Sapiens
IIQMNKCTN

SEQ ID NO: 596301 - protein, 9 aa, Homo Sapiens
PQVGSRLES

SEQ ID NO: 596302 - protein, 9 aa, Homo Sapiens
NSYRMVVVG

SEQ ID NO: 596303 - protein, 9 aa, Homo Sapiens
VFQSLPHGN

SEQ ID NO: 596304 - protein, 9 aa, Homo Sapiens
WIQVDLGFL

SEQ ID NO: 596305 - protein, 9 aa, Homo Sapiens
SGMCVCPPP

SEQ ID NO: 596306 - protein, 9 aa, Homo Sapiens
LLRSFYSAF

SEQ ID NO: 596307 - protein, 9 aa, Homo Sapiens
SPPQMESPD

SEQ ID NO: 596308 - protein, 9 aa, Homo Sapiens
EKELLRQEK

SEQ ID NO: 596309 - protein, 9 aa, Homo Sapiens
HIFKKTSHG

SEQ ID NO: 596310 - protein, 9 aa, Homo Sapiens
DNIRLAELL

SEQ ID NO: 596311 - protein, 9 aa, Homo Sapiens
QGPTSTDNM

SEQ ID NO: 596312 - protein, 9 aa, Homo Sapiens
LAVPKGHRL

SEQ ID NO: 596313 - protein, 9 aa, Homo Sapiens
SATVQQKPS

SEQ ID NO: 596314 - protein, 9 aa, Homo Sapiens
SSGVSEALI

SEQ ID NO: 596315 - protein, 9 aa, Homo Sapiens
APSPQPRLS

SEQ ID NO: 596316 - protein, 9 aa, Homo Sapiens
CTNEEQMFG

SEQ ID NO: 596317 - protein, 9 aa, Homo Sapiens
TMEAFHVVS

SEQ ID NO: 596318 - protein, 9 aa, Homo Sapiens
MAGPPQKNP

SEQ ID NO: 596319 - protein, 9 aa, Homo Sapiens
ICHALRYTN

SEQ ID NO: 596320 - protein, 9 aa, Homo Sapiens
GYVIAINYN

SEQ ID NO: 596321 - protein, 9 aa, Homo Sapiens
DNPRASPSR

SEQ ID NO: 596322 - protein, 9 aa, Homo Sapiens
TVEHLAILC

SEQ ID NO: 596323 - protein, 9 aa, Homo Sapiens
GEITASSNI

SEQ ID NO: 596324 - protein, 9 aa, Homo Sapiens
QQLRMQLLR

SEQ ID NO: 596325 - protein, 9 aa, Homo Sapiens
SGVSEALIS

SEQ ID NO: 596326 - protein, 9 aa, Homo Sapiens
ASLSSAATI

SEQ ID NO: 596327 - protein, 9 aa, Homo Sapiens
QAQPGPPIA

SEQ ID NO: 596328 - protein, 9 aa, Homo Sapiens
LQRSHTGEK

SEQ ID NO: 596329 - protein, 9 aa, Homo Sapiens
SYRRTGSSL

SEQ ID NO: 596330 - protein, 9 aa, Homo Sapiens
GVIAVFVAT

SEQ ID NO: 596331 - protein, 9 aa, Homo Sapiens
GVHGTDPWA

SEQ ID NO: 596332 - protein, 9 aa, Homo Sapiens
DLGFLRFVT

SEQ ID NO: 596333 - protein, 9 aa, Homo Sapiens
HYPSKCLVE

SEQ ID NO: 596334 - protein, 9 aa, Homo Sapiens
KSTREEKEC

SEQ ID NO: 596335 - protein, 9 aa, Homo Sapiens
IESENKCGL

SEQ ID NO: 596336 - protein, 9 aa, Homo Sapiens
TGKLLPSRN

SEQ ID NO: 596337 - protein, 9 aa, Homo Sapiens
EVKSVTHHD

SEQ ID NO: 596338 - protein, 9 aa, Homo Sapiens
STALDMKEK

SEQ ID NO: 596339 - protein, 9 aa, Homo Sapiens
KQCMGTVTL

SEQ ID NO: 596340 - protein, 9 aa, Homo Sapiens
LALGEAGQR

SEQ ID NO: 596341 - protein, 9 aa, Homo Sapiens
VIAVFVATV

SEQ ID NO: 596342 - protein, 9 aa, Homo Sapiens
CFSVNRVFK

SEQ ID NO: 596343 - protein, 9 aa, Homo Sapiens
VATFKTPGV

SEQ ID NO: 596344 - protein, 9 aa, Homo Sapiens
IAEIIRKMT

SEQ ID NO: 596345 - protein, 9 aa, Homo Sapiens
SAQQLRMQL

SEQ ID NO: 596346 - protein, 9 aa, Homo Sapiens
WVKLLSILA

SEQ ID NO: 596347 - protein, 9 aa, Homo Sapiens
VKQGTYSKP

SEQ ID NO: 596348 - protein, 9 aa, Homo Sapiens
QRKWVYLES

SEQ ID NO: 596349 - protein, 9 aa, Homo Sapiens
TVNIGCKLD

SEQ ID NO: 596350 - protein, 9 aa, Homo Sapiens
CTNLTGKLL

SEQ ID NO: 596351 - protein, 9 aa, Homo Sapiens
RSLGNMCRL

SEQ ID NO: 596352 - protein, 9 aa, Homo Sapiens
NMQIAEIIR

SEQ ID NO: 596353 - protein, 9 aa, Homo Sapiens
IAGPLLSYR

SEQ ID NO: 596354 - protein, 9 aa, Homo Sapiens
SVPFVSHSG

SEQ ID NO: 596355 - protein, 9 aa, Homo Sapiens
VWDIFQPPL

SEQ ID NO: 596356 - protein, 9 aa, Homo Sapiens
VKSVTHHDY

SEQ ID NO: 596357 - protein, 9 aa, Homo Sapiens
NPRASPSRA

SEQ ID NO: 596358 - protein, 9 aa, Homo Sapiens
LFGDSYIYH

SEQ ID NO: 596359 - protein, 9 aa, Homo Sapiens
SINAKLHLH

SEQ ID NO: 596360 - protein, 9 aa, Homo Sapiens
SRSLGNMCR

SEQ ID NO: 596361 - protein, 9 aa, Homo Sapiens
MLSSLLHQD

SEQ ID NO: 596362 - protein, 9 aa, Homo Sapiens
HHIFKKTSH

SEQ ID NO: 596363 - protein, 9 aa, Homo Sapiens
GMAGPPQKN

SEQ ID NO: 596364 - protein, 9 aa, Homo Sapiens
TARGPCYSD

SEQ ID NO: 596365 - protein, 9 aa, Homo Sapiens
GTLPLATKR

SEQ ID NO: 596366 - protein, 9 aa, Homo Sapiens
PPPPGLPHP

SEQ ID NO: 596367 - protein, 9 aa, Homo Sapiens
VVYGGTDSV

SEQ ID NO: 596368 - protein, 9 aa, Homo Sapiens
FVSHSGSPE

SEQ ID NO: 596369 - protein, 9 aa, Homo Sapiens
ITASSNISL

SEQ ID NO: 596370 - protein, 9 aa, Homo Sapiens
HPRTGGGMT

SEQ ID NO: 596371 - protein, 9 aa, Homo Sapiens
KDAPSPQPR

SEQ ID NO: 596372 - protein, 9 aa, Homo Sapiens
TLHPNRRPA

SEQ ID NO: 596373 - protein, 9 aa, Homo Sapiens
ALGEAGQRS

SEQ ID NO: 596374 - protein, 9 aa, Homo Sapiens
YVALCNKYD

SEQ ID NO: 596375 - protein, 9 aa, Homo Sapiens
LVHHYVASC

SEQ ID NO: 596376 - protein, 9 aa, Homo Sapiens
QLFGDSYIY

SEQ ID NO: 596377 - protein, 9 aa, Homo Sapiens
KLFEVKSVT

SEQ ID NO: 596378 - protein, 9 aa, Homo Sapiens
STREEKECW

SEQ ID NO: 596379 - protein, 9 aa, Homo Sapiens
LYGADIESE

SEQ ID NO: 596380 - protein, 9 aa, Homo Sapiens
VAQLFGDSY

SEQ ID NO: 596381 - protein, 9 aa, Homo Sapiens
HLILQHRIH

SEQ ID NO: 596382 - protein, 9 aa, Homo Sapiens
FRNMQIAEI

SEQ ID NO: 596383 - protein, 9 aa, Homo Sapiens
VKTLTVKII

SEQ ID NO: 596384 - protein, 9 aa, Homo Sapiens
KRKVQEEEI

SEQ ID NO: 596385 - protein, 9 aa, Homo Sapiens
VYPCAICFK

SEQ ID NO: 596386 - protein, 9 aa, Homo Sapiens
ADIESENKC

SEQ ID NO: 596387 - protein, 9 aa, Homo Sapiens
QLQRSHTGE

SEQ ID NO: 596388 - protein, 9 aa, Homo Sapiens
LAKCSSGAC

SEQ ID NO: 596389 - protein, 9 aa, Homo Sapiens
YRKSELAQL

SEQ ID NO: 596390 - protein, 9 aa, Homo Sapiens
KVVYGGTDS

SEQ ID NO: 596391 - protein, 9 aa, Homo Sapiens
ALRYTNLMR

SEQ ID NO: 596392 - protein, 9 aa, Homo Sapiens
MGDEDKRNR

SEQ ID NO: 596393 - protein, 9 aa, Homo Sapiens
DMVERVKDL

SEQ ID NO: 596394 - protein, 9 aa, Homo Sapiens
QQKAHTRSQ

SEQ ID NO: 596395 - protein, 9 aa, Homo Sapiens
ENKRGRMSD

SEQ ID NO: 596396 - protein, 9 aa, Homo Sapiens
PGQQQVLGA

SEQ ID NO: 596397 - protein, 9 aa, Homo Sapiens
ESAWALTSI

SEQ ID NO: 596398 - protein, 9 aa, Homo Sapiens
SPVPAVFGF

SEQ ID NO: 596399 - protein, 9 aa, Homo Sapiens
KEVGIWVNI

SEQ ID NO: 596400 - protein, 9 aa, Homo Sapiens
AAPSPPGCA

SEQ ID NO: 596401 - protein, 9 aa, Homo Sapiens
PHLLTKQVT

SEQ ID NO: 596402 - protein, 9 aa, Homo Sapiens
KILGYDLCD

SEQ ID NO: 596403 - protein, 9 aa, Homo Sapiens
LPLQLEVVR

SEQ ID NO: 596404 - protein, 9 aa, Homo Sapiens
KREKMVWGE

SEQ ID NO: 596405 - protein, 9 aa, Homo Sapiens
ERVKDLGHS

SEQ ID NO: 596406 - protein, 9 aa, Homo Sapiens
TSSQMVLRG

SEQ ID NO: 596407 - protein, 9 aa, Homo Sapiens
ASTSLVGTV

SEQ ID NO: 596408 - protein, 9 aa, Homo Sapiens
HFFCDKYPL

SEQ ID NO: 596409 - protein, 9 aa, Homo Sapiens
LISSSERAL

SEQ ID NO: 596410 - protein, 9 aa, Homo Sapiens
RVKDLGHST

SEQ ID NO: 596411 - protein, 9 aa, Homo Sapiens
LQGGRPRQG

SEQ ID NO: 596412 - protein, 9 aa, Homo Sapiens
ANAPSAYTR

SEQ ID NO: 596413 - protein, 9 aa, Homo Sapiens
AWKILGYDL

SEQ ID NO: 596414 - protein, 9 aa, Homo Sapiens
HESIKNEID

SEQ ID NO: 596415 - protein, 9 aa, Homo Sapiens
NFGYCEVGE

SEQ ID NO: 596416 - protein, 9 aa, Homo Sapiens
EHSPVPAVF

SEQ ID NO: 596417 - protein, 9 aa, Homo Sapiens
EQSSSDQTR

SEQ ID NO: 596418 - protein, 9 aa, Homo Sapiens
KTYNGTYRC

SEQ ID NO: 596419 - protein, 9 aa, Homo Sapiens
YINIGSWDN

SEQ ID NO: 596420 - protein, 9 aa, Homo Sapiens
LSQSSDSES

SEQ ID NO: 596421 - protein, 9 aa, Homo Sapiens
QGTFTKLFK

SEQ ID NO: 596422 - protein, 9 aa, Homo Sapiens
MQPNSNLNV

SEQ ID NO: 596423 - protein, 9 aa, Homo Sapiens
GAERGPLAS

SEQ ID NO: 596424 - protein, 9 aa, Homo Sapiens
IDDPNCEMR

SEQ ID NO: 596425 - protein, 9 aa, Homo Sapiens
IGAWDCDTC

SEQ ID NO: 596426 - protein, 9 aa, Homo Sapiens
YITSQLPDL

SEQ ID NO: 596427 - protein, 9 aa, Homo Sapiens
LDACHLNPC

SEQ ID NO: 596428 - protein, 9 aa, Homo Sapiens
EVGIWVNID

SEQ ID NO: 596429 - protein, 9 aa, Homo Sapiens
AAEKEIPVP

SEQ ID NO: 596430 - protein, 9 aa, Homo Sapiens
GRKPKERAP

SEQ ID NO: 596431 - protein, 9 aa, Homo Sapiens
IIHSEIEIY

SEQ ID NO: 596432 - protein, 9 aa, Homo Sapiens
PQCKQIEQS

SEQ ID NO: 596433 - protein, 9 aa, Homo Sapiens
TYNGTYRCE

SEQ ID NO: 596434 - protein, 9 aa, Homo Sapiens
PAVFGFSAA

SEQ ID NO: 596435 - protein, 9 aa, Homo Sapiens
LVRNSFEVR

SEQ ID NO: 596436 - protein, 9 aa, Homo Sapiens
KQVTQVERD

SEQ ID NO: 596437 - protein, 9 aa, Homo Sapiens
ILGYDLCDA

SEQ ID NO: 596438 - protein, 9 aa, Homo Sapiens
VCTSYANED

SEQ ID NO: 596439 - protein, 9 aa, Homo Sapiens
GRPQCKQIE

SEQ ID NO: 596440 - protein, 9 aa, Homo Sapiens
ERKKREKMV

SEQ ID NO: 596441 - protein, 9 aa, Homo Sapiens
NLLVRNSFE

SEQ ID NO: 596442 - protein, 9 aa, Homo Sapiens
PVIGAWDCD

SEQ ID NO: 596443 - protein, 9 aa, Homo Sapiens
AERGPLASA

SEQ ID NO: 596444 - protein, 9 aa, Homo Sapiens
QQVLGAGAG

SEQ ID NO: 596445 - protein, 9 aa, Homo Sapiens
EFASDEVCT

SEQ ID NO: 596446 - protein, 9 aa, Homo Sapiens
SEIEIYLQG

SEQ ID NO: 596447 - protein, 9 aa, Homo Sapiens
FVLMEKITL

SEQ ID NO: 596448 - protein, 9 aa, Homo Sapiens
GTRMDSTVQ

SEQ ID NO: 596449 - protein, 9 aa, Homo Sapiens
TSIASGTSE

SEQ ID NO: 596450 - protein, 9 aa, Homo Sapiens
IRDRITWLG

SEQ ID NO: 596451 - protein, 9 aa, Homo Sapiens
TFTKLFKGV

SEQ ID NO: 596452 - protein, 9 aa, Homo Sapiens
KQIEQSSSD

SEQ ID NO: 596453 - protein, 9 aa, Homo Sapiens
NTVVTGIYP

SEQ ID NO: 596454 - protein, 9 aa, Homo Sapiens
LDCGIHSGA

SEQ ID NO: 596455 - protein, 9 aa, Homo Sapiens
HSEIEIYLQ

SEQ ID NO: 596456 - protein, 9 aa, Homo Sapiens
MIEERKQLI

SEQ ID NO: 596457 - protein, 9 aa, Homo Sapiens
QPNSNLNVS

SEQ ID NO: 596458 - protein, 9 aa, Homo Sapiens
TSQLPDLPI

SEQ ID NO: 596459 - protein, 9 aa, Homo Sapiens
RNVRAVSMS

SEQ ID NO: 596460 - protein, 9 aa, Homo Sapiens
SQMMIEERK

SEQ ID NO: 596461 - protein, 9 aa, Homo Sapiens
GLNLRNVLL

SEQ ID NO: 596462 - protein, 9 aa, Homo Sapiens
TKKDTWTKV

SEQ ID NO: 596463 - protein, 9 aa, Homo Sapiens
ALRGMCTPH

SEQ ID NO: 596464 - protein, 9 aa, Homo Sapiens
LGINCLDAC

SEQ ID NO: 596465 - protein, 9 aa, Homo Sapiens
LNDLISHED

SEQ ID NO: 596466 - protein, 9 aa, Homo Sapiens
RKKREKMVW

SEQ ID NO: 596467 - protein, 9 aa, Homo Sapiens
SESEAPDPT

SEQ ID NO: 596468 - protein, 9 aa, Homo Sapiens
TASKSSVRK

SEQ ID NO: 596469 - protein, 9 aa, Homo Sapiens
NIDDPNCEM

SEQ ID NO: 596470 - protein, 9 aa, Homo Sapiens
ICQRLQGGR

SEQ ID NO: 596471 - protein, 9 aa, Homo Sapiens
LRAEDNIRL

SEQ ID NO: 596472 - protein, 9 aa, Homo Sapiens
SKFHDHLEF

SEQ ID NO: 596473 - protein, 9 aa, Homo Sapiens
DGDAVNYIT

SEQ ID NO: 596474 - protein, 9 aa, Homo Sapiens
EKEIPVPPP

SEQ ID NO: 596475 - protein, 9 aa, Homo Sapiens
DPSEKEKLS

SEQ ID NO: 596476 - protein, 9 aa, Homo Sapiens
HCKPWKDCC

SEQ ID NO: 596477 - protein, 9 aa, Homo Sapiens
YTRPSSTKS

SEQ ID NO: 596478 - protein, 9 aa, Homo Sapiens
SSAAPSPPG

SEQ ID NO: 596479 - protein, 9 aa, Homo Sapiens
QCKQIEQSS

SEQ ID NO: 596480 - protein, 9 aa, Homo Sapiens
APGLPSLPL

SEQ ID NO: 596481 - protein, 9 aa, Homo Sapiens
KDYFDYINI

SEQ ID NO: 596482 - protein, 9 aa, Homo Sapiens
YSDGMNITV

SEQ ID NO: 596483 - protein, 9 aa, Homo Sapiens
VFGFSAAAG

SEQ ID NO: 596484 - protein, 9 aa, Homo Sapiens
CNFSKNLVQ

SEQ ID NO: 596485 - protein, 9 aa, Homo Sapiens
EKLSQMLIV

SEQ ID NO: 596486 - protein, 9 aa, Homo Sapiens
GQGTFTKLF

SEQ ID NO: 596487 - protein, 9 aa, Homo Sapiens
DHHEYLLIT

SEQ ID NO: 596488 - protein, 9 aa, Homo Sapiens
FPIDMQPNS

SEQ ID NO: 596489 - protein, 9 aa, Homo Sapiens
LAVSDLNRS

SEQ ID NO: 596490 - protein, 9 aa, Homo Sapiens
SEKEKLSQM

SEQ ID NO: 596491 - protein, 9 aa, Homo Sapiens
EEEFLAFWK

SEQ ID NO: 596492 - protein, 9 aa, Homo Sapiens
QLISSSERA

SEQ ID NO: 596493 - protein, 9 aa, Homo Sapiens
VAHVETGGL

SEQ ID NO: 596494 - protein, 9 aa, Homo Sapiens
DAVNYITSQ

SEQ ID NO: 596495 - protein, 9 aa, Homo Sapiens
FCDKYPLLK

SEQ ID NO: 596496 - protein, 9 aa, Homo Sapiens
PGLPSLPLA

SEQ ID NO: 596497 - protein, 9 aa, Homo Sapiens
QQQSYLDCG

SEQ ID NO: 596498 - protein, 9 aa, Homo Sapiens
DLGHSTQQF

SEQ ID NO: 596499 - protein, 9 aa, Homo Sapiens
FYTLILKTV

SEQ ID NO: 596500 - protein, 9 aa, Homo Sapiens
ALGIPLTPK

SEQ ID NO: 596501 - protein, 9 aa, Homo Sapiens
RITWLGDVQ

SEQ ID NO: 596502 - protein, 9 aa, Homo Sapiens
VVTGIYPCC

SEQ ID NO: 596503 - protein, 9 aa, Homo Sapiens
HLLTKQVTQ

SEQ ID NO: 596504 - protein, 9 aa, Homo Sapiens
SLAVGRGSM

SEQ ID NO: 596505 - protein, 9 aa, Homo Sapiens
RGRMSDLSV

SEQ ID NO: 596506 - protein, 9 aa, Homo Sapiens
LRGMCTPHR

SEQ ID NO: 596507 - protein, 9 aa, Homo Sapiens
EYLLITENG

SEQ ID NO: 596508 - protein, 9 aa, Homo Sapiens
PANAPSAYT

SEQ ID NO: 596509 - protein, 9 aa, Homo Sapiens
KNLVQGQGN

SEQ ID NO: 596510 - protein, 9 aa, Homo Sapiens
RKEASKGYE

SEQ ID NO: 596511 - protein, 9 aa, Homo Sapiens
KLLTQHESI

SEQ ID NO: 596512 - protein, 9 aa, Homo Sapiens
RSGAERGPL

SEQ ID NO: 596513 - protein, 9 aa, Homo Sapiens
KPWKDCCWR

SEQ ID NO: 596514 - protein, 9 aa, Homo Sapiens
IILACTILF

SEQ ID NO: 596515 - protein, 9 aa, Homo Sapiens
EAPKEVGIW

SEQ ID NO: 596516 - protein, 9 aa, Homo Sapiens
HEDILSTIQ

SEQ ID NO: 596517 - protein, 9 aa, Homo Sapiens
DRITWLGDV

SEQ ID NO: 596518 - protein, 9 aa, Homo Sapiens
VLSQSSDSE

SEQ ID NO: 596519 - protein, 9 aa, Homo Sapiens
FTPAFKCTG

SEQ ID NO: 596520 - protein, 9 aa, Homo Sapiens
GEKCRQSFE

SEQ ID NO: 596521 - protein, 9 aa, Homo Sapiens
LNRSGQRQV

SEQ ID NO: 596522 - protein, 9 aa, Homo Sapiens
LAVGRGSMV

SEQ ID NO: 596523 - protein, 9 aa, Homo Sapiens
VFYTLILKT

SEQ ID NO: 596524 - protein, 9 aa, Homo Sapiens
GAWDCDTCL

SEQ ID NO: 596525 - protein, 9 aa, Homo Sapiens
RERKTASKS

SEQ ID NO: 596526 - protein, 9 aa, Homo Sapiens
IHSEIEIYL

SEQ ID NO: 596527 - protein, 9 aa, Homo Sapiens
CCPPGSLPL

SEQ ID NO: 596528 - protein, 9 aa, Homo Sapiens
RPRQGPAAA

SEQ ID NO: 596529 - protein, 9 aa, Homo Sapiens
QPGQQQVLG

SEQ ID NO: 596530 - protein, 9 aa, Homo Sapiens
VFVLMEKIT

SEQ ID NO: 596531 - protein, 9 aa, Homo Sapiens
KMVWGEEYM

SEQ ID NO: 596532 - protein, 9 aa, Homo Sapiens
IRQQKAHTR

SEQ ID NO: 596533 - protein, 9 aa, Homo Sapiens
IIEVRENKR

SEQ ID NO: 596534 - protein, 9 aa, Homo Sapiens
KTASKSSVR

SEQ ID NO: 596535 - protein, 9 aa, Homo Sapiens
EGPAPGLPS

SEQ ID NO: 596536 - protein, 9 aa, Homo Sapiens
VVQFTPAFK

SEQ ID NO: 596537 - protein, 9 aa, Homo Sapiens
VIGAWDCDT

SEQ ID NO: 596538 - protein, 9 aa, Homo Sapiens
LLVQTKRRS

SEQ ID NO: 596539 - protein, 9 aa, Homo Sapiens
LCCPPGSLP

SEQ ID NO: 596540 - protein, 9 aa, Homo Sapiens
MGGGLPAGF

SEQ ID NO: 596541 - protein, 9 aa, Homo Sapiens
PRNVRAVSM

SEQ ID NO: 596542 - protein, 9 aa, Homo Sapiens
LFTFFLSPA

SEQ ID NO: 596543 - protein, 9 aa, Homo Sapiens
RMDSTVQVN

SEQ ID NO: 596544 - protein, 9 aa, Homo Sapiens
APSAYTRPS

SEQ ID NO: 596545 - protein, 9 aa, Homo Sapiens
FINNLNKTY

SEQ ID NO: 596546 - protein, 9 aa, Homo Sapiens
YFDYINIGS

SEQ ID NO: 596547 - protein, 9 aa, Homo Sapiens
EKEKLSQML

SEQ ID NO: 596548 - protein, 9 aa, Homo Sapiens
SSGNLLVRN

SEQ ID NO: 596549 - protein, 9 aa, Homo Sapiens
GYDLCDAGW

SEQ ID NO: 596550 - protein, 9 aa, Homo Sapiens
MVAHVETGG

SEQ ID NO: 596551 - protein, 9 aa, Homo Sapiens
KGSEGPAPG

SEQ ID NO: 596552 - protein, 9 aa, Homo Sapiens
GYLGINCLD

SEQ ID NO: 596553 - protein, 9 aa, Homo Sapiens
ILACTILFT

SEQ ID NO: 596554 - protein, 9 aa, Homo Sapiens
INFGYCEVG

SEQ ID NO: 596555 - protein, 9 aa, Homo Sapiens
KEKLSQMLI

SEQ ID NO: 596556 - protein, 9 aa, Homo Sapiens
IEVRENKRG

SEQ ID NO: 596557 - protein, 9 aa, Homo Sapiens
IEQSSSDQT

SEQ ID NO: 596558 - protein, 9 aa, Homo Sapiens
NTKKDTWTK

SEQ ID NO: 596559 - protein, 9 aa, Homo Sapiens
QGGRPRQGP

SEQ ID NO: 596560 - protein, 9 aa, Homo Sapiens
GGRPRQGPA

SEQ ID NO: 596561 - protein, 9 aa, Homo Sapiens
VLLHGFASP

SEQ ID NO: 596562 - protein, 9 aa, Homo Sapiens
PLNPQQAQA

SEQ ID NO: 596563 - protein, 9 aa, Homo Sapiens
ALMGGGLPA

SEQ ID NO: 596564 - protein, 9 aa, Homo Sapiens
CLDACHLNP

SEQ ID NO: 596565 - protein, 9 aa, Homo Sapiens
SKNLVQGQG

SEQ ID NO: 596566 - protein, 9 aa, Homo Sapiens
ALTSIASGT

SEQ ID NO: 596567 - protein, 9 aa, Homo Sapiens
AVFYTLILK

SEQ ID NO: 596568 - protein, 9 aa, Homo Sapiens
LLHGFASPE

SEQ ID NO: 596569 - protein, 9 aa, Homo Sapiens
HEYLLITEN

SEQ ID NO: 596570 - protein, 9 aa, Homo Sapiens
QRLQGGRPR

SEQ ID NO: 596571 - protein, 9 aa, Homo Sapiens
PNSNLNVSK

SEQ ID NO: 596572 - protein, 9 aa, Homo Sapiens
DCNFSKNLV

SEQ ID NO: 596573 - protein, 9 aa, Homo Sapiens
TRMDSTVQV

SEQ ID NO: 596574 - protein, 9 aa, Homo Sapiens
TDQVSKFHD

SEQ ID NO: 596575 - protein, 9 aa, Homo Sapiens
LFKGVRREV

SEQ ID NO: 596576 - protein, 9 aa, Homo Sapiens
NVRAVSMSS

SEQ ID NO: 596577 - protein, 9 aa, Homo Sapiens
LISHEDILS

SEQ ID NO: 596578 - protein, 9 aa, Homo Sapiens
NCEMRKKNS

SEQ ID NO: 596579 - protein, 9 aa, Homo Sapiens
VGIWVNIDH

SEQ ID NO: 596580 - protein, 9 aa, Homo Sapiens
LNTVVTGIY

SEQ ID NO: 596581 - protein, 9 aa, Homo Sapiens
KLFKGVRRE

SEQ ID NO: 596582 - protein, 9 aa, Homo Sapiens
VETGGLLPI

SEQ ID NO: 596583 - protein, 9 aa, Homo Sapiens
VIDHFFCDK

SEQ ID NO: 596584 - protein, 9 aa, Homo Sapiens
NPQQAQALG

SEQ ID NO: 596585 - protein, 9 aa, Homo Sapiens
RPQCKQIEQ

SEQ ID NO: 596586 - protein, 9 aa, Homo Sapiens
LNPQQAQAL

SEQ ID NO: 596587 - protein, 9 aa, Homo Sapiens
ILLRAEDNI

SEQ ID NO: 596588 - protein, 9 aa, Homo Sapiens
QQSYLDCGI

SEQ ID NO: 596589 - protein, 9 aa, Homo Sapiens
KRRSLEKID

SEQ ID NO: 596590 - protein, 9 aa, Homo Sapiens
CQRLQGGRP

SEQ ID NO: 596591 - protein, 9 aa, Homo Sapiens
EKITLKKMR

SEQ ID NO: 596592 - protein, 9 aa, Homo Sapiens
NCLDACHLN

SEQ ID NO: 596593 - protein, 9 aa, Homo Sapiens
EDSSGNLLV

SEQ ID NO: 596594 - protein, 9 aa, Homo Sapiens
GTFTKLFKG

SEQ ID NO: 596595 - protein, 9 aa, Homo Sapiens
SYLDCGIHS

SEQ ID NO: 596596 - protein, 9 aa, Homo Sapiens
VYNTKKDTW

SEQ ID NO: 596597 - protein, 9 aa, Homo Sapiens
CTILFTFFL

SEQ ID NO: 596598 - protein, 9 aa, Homo Sapiens
KPVIGAWDC

SEQ ID NO: 596599 - protein, 9 aa, Homo Sapiens
NGLLVALMG

SEQ ID NO: 596600 - protein, 9 aa, Homo Sapiens
LAFWKQTPS

SEQ ID NO: 596601 - protein, 9 aa, Homo Sapiens
MQPHLLTKQ

SEQ ID NO: 596602 - protein, 9 aa, Homo Sapiens
EWWTDQVSK

SEQ ID NO: 596603 - protein, 9 aa, Homo Sapiens
VRSLAVGRG

SEQ ID NO: 596604 - protein, 9 aa, Homo Sapiens
SGAERGPLA

SEQ ID NO: 596605 - protein, 9 aa, Homo Sapiens
AFWKQTPSA

SEQ ID NO: 596606 - protein, 9 aa, Homo Sapiens
AEDNIRLAV

SEQ ID NO: 596607 - protein, 9 aa, Homo Sapiens
STSLVGTVT

SEQ ID NO: 596608 - protein, 9 aa, Homo Sapiens
MRKKNSFVG

SEQ ID NO: 596609 - protein, 9 aa, Homo Sapiens
SKPYSDGMN

SEQ ID NO: 596610 - protein, 9 aa, Homo Sapiens
AASSLNTVV

SEQ ID NO: 596611 - protein, 9 aa, Homo Sapiens
LMEKITLKK

SEQ ID NO: 596612 - protein, 9 aa, Homo Sapiens
SIASGTSEQ

SEQ ID NO: 596613 - protein, 9 aa, Homo Sapiens
CPPGSLPLA

SEQ ID NO: 596614 - protein, 9 aa, Homo Sapiens
ISSSERALG

SEQ ID NO: 596615 - protein, 9 aa, Homo Sapiens
DEVCTSYAN

SEQ ID NO: 596616 - protein, 9 aa, Homo Sapiens
LSGIGALRG

SEQ ID NO: 596617 - protein, 9 aa, Homo Sapiens
QPHLLTKQV

SEQ ID NO: 596618 - protein, 9 aa, Homo Sapiens
WKQTPSAGK

SEQ ID NO: 596619 - protein, 9 aa, Homo Sapiens
RAVSMSSTE

SEQ ID NO: 596620 - protein, 9 aa, Homo Sapiens
SMSSTEVRV

SEQ ID NO: 596621 - protein, 9 aa, Homo Sapiens
AWALTSIAS

SEQ ID NO: 596622 - protein, 9 aa, Homo Sapiens
HHEYLLITE

SEQ ID NO: 596623 - protein, 9 aa, Homo Sapiens
YCEVGEKCR

SEQ ID NO: 596624 - protein, 9 aa, Homo Sapiens
QSYLDCGIH

SEQ ID NO: 596625 - protein, 9 aa, Homo Sapiens
YNGTYRCEA

SEQ ID NO: 596626 - protein, 9 aa, Homo Sapiens
RKPKERAPE

SEQ ID NO: 596627 - protein, 9 aa, Homo Sapiens
GSSNSKCSR

SEQ ID NO: 596628 - protein, 9 aa, Homo Sapiens
NFSKNLVQG

SEQ ID NO: 596629 - protein, 9 aa, Homo Sapiens
LVALMGGGL

SEQ ID NO: 596630 - protein, 9 aa, Homo Sapiens
DRYVVQFTP

SEQ ID NO: 596631 - protein, 9 aa, Homo Sapiens
QHESIKNEI

SEQ ID NO: 596632 - protein, 9 aa, Homo Sapiens
CDKYPLLKL

SEQ ID NO: 596633 - protein, 9 aa, Homo Sapiens
LACTILFTF

SEQ ID NO: 596634 - protein, 9 aa, Homo Sapiens
TILFTFFLS

SEQ ID NO: 596635 - protein, 9 aa, Homo Sapiens
DSTVQVNKP

SEQ ID NO: 596636 - protein, 9 aa, Homo Sapiens
YVVQFTPAF

SEQ ID NO: 596637 - protein, 9 aa, Homo Sapiens
TKRRSLEKI

SEQ ID NO: 596638 - protein, 9 aa, Homo Sapiens
GHCKPWKDC

SEQ ID NO: 596639 - protein, 9 aa, Homo Sapiens
DDCNFSKNL

SEQ ID NO: 596640 - protein, 9 aa, Homo Sapiens
VRENKRGRM

SEQ ID NO: 596641 - protein, 9 aa, Homo Sapiens
KERAPEEPV

SEQ ID NO: 596642 - protein, 9 aa, Homo Sapiens
NLRNVLLHG

SEQ ID NO: 596643 - protein, 9 aa, Homo Sapiens
HTRSQQCIS

SEQ ID NO: 596644 - protein, 9 aa, Homo Sapiens
RNVLLHGFA

SEQ ID NO: 596645 - protein, 9 aa, Homo Sapiens
LVGTVTGMV

SEQ ID NO: 596646 - protein, 9 aa, Homo Sapiens
KKREKMVWG

SEQ ID NO: 596647 - protein, 9 aa, Homo Sapiens
IVRSLAVGR

SEQ ID NO: 596648 - protein, 9 aa, Homo Sapiens
VSSAAPSPP

SEQ ID NO: 596649 - protein, 9 aa, Homo Sapiens
AVSMSSTEV

SEQ ID NO: 596650 - protein, 9 aa, Homo Sapiens
TRPSSTKST

SEQ ID NO: 596651 - protein, 9 aa, Homo Sapiens
CGIHSGATT

SEQ ID NO: 596652 - protein, 9 aa, Homo Sapiens
AVFGFSAAA

SEQ ID NO: 596653 - protein, 9 aa, Homo Sapiens
INNLNKTYN

SEQ ID NO: 596654 - protein, 9 aa, Homo Sapiens
DIRDRITWL

SEQ ID NO: 596655 - protein, 9 aa, Homo Sapiens
IDAESRHLV

SEQ ID NO: 596656 - protein, 9 aa, Homo Sapiens
EIYLQGEDY

SEQ ID NO: 596657 - protein, 9 aa, Homo Sapiens
EEETSKPYS

SEQ ID NO: 596658 - protein, 9 aa, Homo Sapiens
EGHCKPWKD

SEQ ID NO: 596659 - protein, 9 aa, Homo Sapiens
PSPPGCADG

SEQ ID NO: 596660 - protein, 9 aa, Homo Sapiens
NELYVYNTK

SEQ ID NO: 596661 - protein, 9 aa, Homo Sapiens
SAFTSLSPS

SEQ ID NO: 596662 - protein, 9 aa, Homo Sapiens
ILIAVFYTL

SEQ ID NO: 596663 - protein, 9 aa, Homo Sapiens
ASSLNTVVT

SEQ ID NO: 596664 - protein, 9 aa, Homo Sapiens
GQQQVLGAG

SEQ ID NO: 596665 - protein, 9 aa, Homo Sapiens
PIDMQPNSN

SEQ ID NO: 596666 - protein, 9 aa, Homo Sapiens
VRNSFEVRV

SEQ ID NO: 596667 - protein, 9 aa, Homo Sapiens
GDEDKRNRA

SEQ ID NO: 596668 - protein, 9 aa, Homo Sapiens
ISHEDILST

SEQ ID NO: 596669 - protein, 9 aa, Homo Sapiens
QVLGAGAGQ

SEQ ID NO: 596670 - protein, 9 aa, Homo Sapiens
PPGSLPLAH

SEQ ID NO: 596671 - protein, 9 aa, Homo Sapiens
YNTKKDTWT

SEQ ID NO: 596672 - protein, 9 aa, Homo Sapiens
LEASTSLVG

SEQ ID NO: 596673 - protein, 9 aa, Homo Sapiens
PGSLPLAHV

SEQ ID NO: 596674 - protein, 9 aa, Homo Sapiens
YDIRDRITW

SEQ ID NO: 596675 - protein, 9 aa, Homo Sapiens
GSGTRMDST

SEQ ID NO: 596676 - protein, 9 aa, Homo Sapiens
LEDHHEYLL

SEQ ID NO: 596677 - protein, 9 aa, Homo Sapiens
RHLVTGCAD

SEQ ID NO: 596678 - protein, 9 aa, Homo Sapiens
CTSYANEDE

SEQ ID NO: 596679 - protein, 9 aa, Homo Sapiens
GIGALRGMC

SEQ ID NO: 596680 - protein, 9 aa, Homo Sapiens
GRPRQGPAA

SEQ ID NO: 596681 - protein, 9 aa, Homo Sapiens
HVETGGLLP

SEQ ID NO: 596682 - protein, 9 aa, Homo Sapiens
TNGLLVALM

SEQ ID NO: 596683 - protein, 9 aa, Homo Sapiens
GTTSSQMVL

SEQ ID NO: 596684 - protein, 9 aa, Homo Sapiens
VQFTPAFKC

SEQ ID NO: 596685 - protein, 9 aa, Homo Sapiens
DTGSSNSKC

SEQ ID NO: 596686 - protein, 9 aa, Homo Sapiens
LLTKQVTQV

SEQ ID NO: 596687 - protein, 9 aa, Homo Sapiens
EVRENKRGR

SEQ ID NO: 596688 - protein, 9 aa, Homo Sapiens
HSPVPAVFG

SEQ ID NO: 596689 - protein, 9 aa, Homo Sapiens
KPYSDGMNI

SEQ ID NO: 596690 - protein, 9 aa, Homo Sapiens
MSSTEVRVS

SEQ ID NO: 596691 - protein, 9 aa, Homo Sapiens
QQQLISSSE

SEQ ID NO: 596692 - protein, 9 aa, Homo Sapiens
EASKGYEAR

SEQ ID NO: 596693 - protein, 9 aa, Homo Sapiens
SPSGRTPSQ

SEQ ID NO: 596694 - protein, 9 aa, Homo Sapiens
SDGMNITVL

SEQ ID NO: 596695 - protein, 9 aa, Homo Sapiens
GPAPGLPSL

SEQ ID NO: 596696 - protein, 9 aa, Homo Sapiens
NKTYNGTYR

SEQ ID NO: 596697 - protein, 9 aa, Homo Sapiens
RAPEEPVAK

SEQ ID NO: 596698 - protein, 9 aa, Homo Sapiens
MDSTVQVNK

SEQ ID NO: 596699 - protein, 9 aa, Homo Sapiens
QFTPAFKCT

SEQ ID NO: 596700 - protein, 9 aa, Homo Sapiens
AFTSLSPSG

SEQ ID NO: 596701 - protein, 9 aa, Homo Sapiens
PQGTTSSQM

SEQ ID NO: 596702 - protein, 9 aa, Homo Sapiens
EDKRNRAIT

SEQ ID NO: 596703 - protein, 9 aa, Homo Sapiens
EKKRERKTA

SEQ ID NO: 596704 - protein, 9 aa, Homo Sapiens
FFCDKYPLL

SEQ ID NO: 596705 - protein, 9 aa, Homo Sapiens
DLCDAGWLA

SEQ ID NO: 596706 - protein, 9 aa, Homo Sapiens
MYPQGTTSS

SEQ ID NO: 596707 - protein, 9 aa, Homo Sapiens
FIDAESRHL

SEQ ID NO: 596708 - protein, 9 aa, Homo Sapiens
TKQVTQVER

SEQ ID NO: 596709 - protein, 9 aa, Homo Sapiens
DCGIHSGAT

SEQ ID NO: 596710 - protein, 9 aa, Homo Sapiens
LCDAGWLAD

SEQ ID NO: 596711 - protein, 9 aa, Homo Sapiens
DKFKPVIGA

SEQ ID NO: 596712 - protein, 9 aa, Homo Sapiens
RGLSGIGAL

SEQ ID NO: 596713 - protein, 9 aa, Homo Sapiens
RSLEKIDLK

SEQ ID NO: 596714 - protein, 9 aa, Homo Sapiens
ELYVYNTKK

SEQ ID NO: 596715 - protein, 9 aa, Homo Sapiens
NSNLNVSKE

SEQ ID NO: 596716 - protein, 9 aa, Homo Sapiens
TKLFKGVRR

SEQ ID NO: 596717 - protein, 9 aa, Homo Sapiens
IDHFFCDKY

SEQ ID NO: 596718 - protein, 9 aa, Homo Sapiens
NAPSAYTRP

SEQ ID NO: 596719 - protein, 9 aa, Homo Sapiens
PGCADGRDA

SEQ ID NO: 596720 - protein, 9 aa, Homo Sapiens
TFHLEDHHE

SEQ ID NO: 596721 - protein, 9 aa, Homo Sapiens
AWDCDTCLV

SEQ ID NO: 596722 - protein, 9 aa, Homo Sapiens
VALMGGGLP

SEQ ID NO: 596723 - protein, 9 aa, Homo Sapiens
FTKLFKGVR

SEQ ID NO: 596724 - protein, 9 aa, Homo Sapiens
YVYNTKKDT

SEQ ID NO: 596725 - protein, 9 aa, Homo Sapiens
GLSGIGALR

SEQ ID NO: 596726 - protein, 9 aa, Homo Sapiens
VDFILIAVF

SEQ ID NO: 596727 - protein, 9 aa, Homo Sapiens
PSGQRKEAS

SEQ ID NO: 596728 - protein, 9 aa, Homo Sapiens
PVFVLMEKI

SEQ ID NO: 596729 - protein, 9 aa, Homo Sapiens
VGEKCRQSF

SEQ ID NO: 596730 - protein, 9 aa, Homo Sapiens
SPPGCADGR

SEQ ID NO: 596731 - protein, 9 aa, Homo Sapiens
IGSWDNGEL

SEQ ID NO: 596732 - protein, 9 aa, Homo Sapiens
MVWGEEYMG

SEQ ID NO: 596733 - protein, 9 aa, Homo Sapiens
NKRGRMSDL

SEQ ID NO: 596734 - protein, 9 aa, Homo Sapiens
KDCCWRCRR

SEQ ID NO: 596735 - protein, 9 aa, Homo Sapiens
EKMVWGEEY

SEQ ID NO: 596736 - protein, 9 aa, Homo Sapiens
KYPLLKLVC

SEQ ID NO: 596737 - protein, 9 aa, Homo Sapiens
SGIGALRGM

SEQ ID NO: 596738 - protein, 9 aa, Homo Sapiens
IAVFYTLIL

SEQ ID NO: 596739 - protein, 9 aa, Homo Sapiens
AVGRGSMVC

SEQ ID NO: 596740 - protein, 9 aa, Homo Sapiens
LRNVLLHGF

SEQ ID NO: 596741 - protein, 9 aa, Homo Sapiens
FLAFWKQTP

SEQ ID NO: 596742 - protein, 9 aa, Homo Sapiens
FDYINIGSW

SEQ ID NO: 596743 - protein, 9 aa, Homo Sapiens
LSPSGRTPS

SEQ ID NO: 596744 - protein, 9 aa, Homo Sapiens
VWGEEYMGY

SEQ ID NO: 596745 - protein, 9 aa, Homo Sapiens
FILLRAEDN

SEQ ID NO: 596746 - protein, 9 aa, Homo Sapiens
VQTKRRSLE

SEQ ID NO: 596747 - protein, 9 aa, Homo Sapiens
FDTGSSNSK

SEQ ID NO: 596748 - protein, 9 aa, Homo Sapiens
FTFFLSPAG

SEQ ID NO: 596749 - protein, 9 aa, Homo Sapiens
CKQIEQSSS

SEQ ID NO: 596750 - protein, 9 aa, Homo Sapiens
ASKGYEARE

SEQ ID NO: 596751 - protein, 9 aa, Homo Sapiens
APEEPVAKL

SEQ ID NO: 596752 - protein, 9 aa, Homo Sapiens
TVVTGIYPC

SEQ ID NO: 596753 - protein, 9 aa, Homo Sapiens
GQRKEASKG

SEQ ID NO: 596754 - protein, 9 aa, Homo Sapiens
LHGFASPEE

SEQ ID NO: 596755 - protein, 9 aa, Homo Sapiens
AEKEIPVPP

SEQ ID NO: 596756 - protein, 9 aa, Homo Sapiens
LTKQVTQVE

SEQ ID NO: 596757 - protein, 9 aa, Homo Sapiens
ESRESQMMI

SEQ ID NO: 596758 - protein, 9 aa, Homo Sapiens
GSLPLAHVN

SEQ ID NO: 596759 - protein, 9 aa, Homo Sapiens
LTSIASGTS

SEQ ID NO: 596760 - protein, 9 aa, Homo Sapiens
ACTILFTFF

SEQ ID NO: 596761 - protein, 9 aa, Homo Sapiens
ESEAPDPTQ

SEQ ID NO: 596762 - protein, 9 aa, Homo Sapiens
YDLCDAGWL

SEQ ID NO: 596763 - protein, 9 aa, Homo Sapiens
VPPPKKPEA

SEQ ID NO: 596764 - protein, 9 aa, Homo Sapiens
SSDSESEAP

SEQ ID NO: 596765 - protein, 9 aa, Homo Sapiens
KITLKKMRE

SEQ ID NO: 596766 - protein, 9 aa, Homo Sapiens
AEHSPVPAV

SEQ ID NO: 596767 - protein, 9 aa, Homo Sapiens
QVSKFHDHL

SEQ ID NO: 596768 - protein, 9 aa, Homo Sapiens
LLVRNSFEV

SEQ ID NO: 596769 - protein, 9 aa, Homo Sapiens
TCLEASTSL

SEQ ID NO: 596770 - protein, 9 aa, Homo Sapiens
QMMIEERKQ

SEQ ID NO: 596771 - protein, 9 aa, Homo Sapiens
FTSLSPSGR

SEQ ID NO: 596772 - protein, 9 aa, Homo Sapiens
TRSQQCISS

SEQ ID NO: 596773 - protein, 9 aa, Homo Sapiens
KEIPVPPPK

SEQ ID NO: 596774 - protein, 9 aa, Homo Sapiens
RSLAVGRGS

SEQ ID NO: 596775 - protein, 9 aa, Homo Sapiens
GDAVNYITS

SEQ ID NO: 596776 - protein, 9 aa, Homo Sapiens
SEGPAPGLP

SEQ ID NO: 596777 - protein, 9 aa, Homo Sapiens
WQQQSYLDC

SEQ ID NO: 596778 - protein, 9 aa, Homo Sapiens
REKMVWGEE

SEQ ID NO: 596779 - protein, 9 aa, Homo Sapiens
PSGRTPSQR

SEQ ID NO: 596780 - protein, 9 aa, Homo Sapiens
GRGSMVCRL

SEQ ID NO: 596781 - protein, 9 aa, Homo Sapiens
KLSQMLIVN

SEQ ID NO: 596782 - protein, 9 aa, Homo Sapiens
WTDQVSKFH

SEQ ID NO: 596783 - protein, 9 aa, Homo Sapiens
GPLASAPRG

SEQ ID NO: 596784 - protein, 9 aa, Homo Sapiens
VSDLNRSGQ

SEQ ID NO: 596785 - protein, 9 aa, Homo Sapiens
KGYLGINCL

SEQ ID NO: 596786 - protein, 9 aa, Homo Sapiens
PPPKKPEAP

SEQ ID NO: 596787 - protein, 9 aa, Homo Sapiens
PLQLEVVRG

SEQ ID NO: 596788 - protein, 9 aa, Homo Sapiens
NRSGQRQVF

SEQ ID NO: 596789 - protein, 9 aa, Homo Sapiens
SCPACACST

SEQ ID NO: 596790 - protein, 9 aa, Homo Sapiens
DYFDYINIG

SEQ ID NO: 596791 - protein, 9 aa, Homo Sapiens
SSLNTVVTG

SEQ ID NO: 596792 - protein, 9 aa, Homo Sapiens
NDLISHEDI

SEQ ID NO: 596793 - protein, 9 aa, Homo Sapiens
IGALRGMCT

SEQ ID NO: 596794 - protein, 9 aa, Homo Sapiens
VLGAGAGQR

SEQ ID NO: 596795 - protein, 9 aa, Homo Sapiens
MMIEERKQL

SEQ ID NO: 596796 - protein, 9 aa, Homo Sapiens
QKAHTRSQQ

SEQ ID NO: 596797 - protein, 9 aa, Homo Sapiens
DQVSKFHDH

SEQ ID NO: 596798 - protein, 9 aa, Homo Sapiens
TQQQLISSS

SEQ ID NO: 596799 - protein, 9 aa, Homo Sapiens
GEFASDEVC

SEQ ID NO: 596800 - protein, 9 aa, Homo Sapiens
SIKNEIDNY

SEQ ID NO: 596801 - protein, 9 aa, Homo Sapiens
RKTASKSSV

SEQ ID NO: 596802 - protein, 9 aa, Homo Sapiens
LQLEVVRGL

SEQ ID NO: 596803 - protein, 9 aa, Homo Sapiens
VRAVSMSST

SEQ ID NO: 596804 - protein, 9 aa, Homo Sapiens
LAPGLASCP

SEQ ID NO: 596805 - protein, 9 aa, Homo Sapiens
IPVPPPKKP

SEQ ID NO: 596806 - protein, 9 aa, Homo Sapiens
STVQVNKPG

SEQ ID NO: 596807 - protein, 9 aa, Homo Sapiens
LFIDAESRH

SEQ ID NO: 596808 - protein, 9 aa, Homo Sapiens
QDMVERVKD

SEQ ID NO: 596809 - protein, 9 aa, Homo Sapiens
DPNCEMRKK

SEQ ID NO: 596810 - protein, 9 aa, Homo Sapiens
KQLCCPPGS

SEQ ID NO: 596811 - protein, 9 aa, Homo Sapiens
AMFILLRAE

SEQ ID NO: 596812 - protein, 9 aa, Homo Sapiens
SGTRMDSTV

SEQ ID NO: 596813 - protein, 9 aa, Homo Sapiens
VTGIYPCCN

SEQ ID NO: 596814 - protein, 9 aa, Homo Sapiens
PAPGLPSLP

SEQ ID NO: 596815 - protein, 9 aa, Homo Sapiens
QAMFILLRA

SEQ ID NO: 596816 - protein, 9 aa, Homo Sapiens
RDRYVVQFT

SEQ ID NO: 596817 - protein, 9 aa, Homo Sapiens
ASKSSVRKR

SEQ ID NO: 596818 - protein, 9 aa, Homo Sapiens
DLNRSGQRQ

SEQ ID NO: 596819 - protein, 9 aa, Homo Sapiens
DMQPNSNLN

SEQ ID NO: 596820 - protein, 9 aa, Homo Sapiens
CKPWKDCCW

SEQ ID NO: 596821 - protein, 9 aa, Homo Sapiens
NIGSWDNGE

SEQ ID NO: 596822 - protein, 9 aa, Homo Sapiens
SAWALTSIA

SEQ ID NO: 596823 - protein, 9 aa, Homo Sapiens
TSLSPSGRT

SEQ ID NO: 596824 - protein, 9 aa, Homo Sapiens
ERAPEEPVA

SEQ ID NO: 596825 - protein, 9 aa, Homo Sapiens
GNLLVRNSF

SEQ ID NO: 596826 - protein, 9 aa, Homo Sapiens
KRERKTASK

SEQ ID NO: 596827 - protein, 9 aa, Homo Sapiens
DKYPLLKLV

SEQ ID NO: 596828 - protein, 9 aa, Homo Sapiens
ASDEVCTSY

SEQ ID NO: 596829 - protein, 9 aa, Homo Sapiens
SRHLVTGCA

SEQ ID NO: 596830 - protein, 9 aa, Homo Sapiens
RLQGGRPRQ

SEQ ID NO: 596831 - protein, 9 aa, Homo Sapiens
QGTTSSQMV

SEQ ID NO: 596832 - protein, 9 aa, Homo Sapiens
ERGPLASAP

SEQ ID NO: 596833 - protein, 9 aa, Homo Sapiens
WWTDQVSKF

SEQ ID NO: 596834 - protein, 9 aa, Homo Sapiens
LLTQHESIK

SEQ ID NO: 596835 - protein, 9 aa, Homo Sapiens
SGQRKEASK

SEQ ID NO: 596836 - protein, 9 aa, Homo Sapiens
RGPLASAPR

SEQ ID NO: 596837 - protein, 9 aa, Homo Sapiens
RGSMVCRLA

SEQ ID NO: 596838 - protein, 9 aa, Homo Sapiens
VSKFHDHLE

SEQ ID NO: 596839 - protein, 9 aa, Homo Sapiens
PEPEPLPLQ

SEQ ID NO: 596840 - protein, 9 aa, Homo Sapiens
HLVTGCADG

SEQ ID NO: 596841 - protein, 9 aa, Homo Sapiens
CEVGEKCRQ

SEQ ID NO: 596842 - protein, 9 aa, Homo Sapiens
IEIYLQGED

SEQ ID NO: 596843 - protein, 9 aa, Homo Sapiens
QQLISSSER

SEQ ID NO: 596844 - protein, 9 aa, Homo Sapiens
AVNYITSQL

SEQ ID NO: 596845 - protein, 9 aa, Homo Sapiens
EETSKPYSD

SEQ ID NO: 596846 - protein, 9 aa, Homo Sapiens
VGRGSMVCR

SEQ ID NO: 596847 - protein, 9 aa, Homo Sapiens
ILFTFFLSP

SEQ ID NO: 596848 - protein, 9 aa, Homo Sapiens
FMYPQGTTS

SEQ ID NO: 596849 - protein, 9 aa, Homo Sapiens
AESRHLVTG

SEQ ID NO: 596850 - protein, 9 aa, Homo Sapiens
TESRESQMM

SEQ ID NO: 596851 - protein, 9 aa, Homo Sapiens
QTKRRSLEK

SEQ ID NO: 596852 - protein, 9 aa, Homo Sapiens
DKRNRAITA

SEQ ID NO: 596853 - protein, 9 aa, Homo Sapiens
FKPVIGAWD

SEQ ID NO: 596854 - protein, 9 aa, Homo Sapiens
SDEVCTSYA

SEQ ID NO: 596855 - protein, 9 aa, Homo Sapiens
PPGCADGRD

SEQ ID NO: 596856 - protein, 9 aa, Homo Sapiens
EASTSLVGT

SEQ ID NO: 596857 - protein, 9 aa, Homo Sapiens
APGLASCPA

SEQ ID NO: 596858 - protein, 9 aa, Homo Sapiens
ESRHLVTGC

SEQ ID NO: 596859 - protein, 9 aa, Homo Sapiens
SKGYEAREL

SEQ ID NO: 596860 - protein, 9 aa, Homo Sapiens
MVERVKDLG

SEQ ID NO: 596861 - protein, 9 aa, Homo Sapiens
NSKCSRLYT

SEQ ID NO: 596862 - protein, 9 aa, Homo Sapiens
KEASKGYEA

SEQ ID NO: 596863 - protein, 9 aa, Homo Sapiens
TLNDLISHE

SEQ ID NO: 596864 - protein, 9 aa, Homo Sapiens
PWKDCCWRC

SEQ ID NO: 596865 - protein, 9 aa, Homo Sapiens
GLASCPACA

SEQ ID NO: 596866 - protein, 9 aa, Homo Sapiens
VNYITSQLP

SEQ ID NO: 596867 - protein, 9 aa, Homo Sapiens
IDMQPNSNL

SEQ ID NO: 596868 - protein, 9 aa, Homo Sapiens
GTQQQLISS

SEQ ID NO: 596869 - protein, 9 aa, Homo Sapiens
EIPVPPPKK

SEQ ID NO: 596870 - protein, 9 aa, Homo Sapiens
CEMRKKNSF

SEQ ID NO: 596871 - protein, 9 aa, Homo Sapiens
VPAVFGFSA

SEQ ID NO: 596872 - protein, 9 aa, Homo Sapiens
SGQRQVFFE

SEQ ID NO: 596873 - protein, 9 aa, Homo Sapiens
SQSSDSESE

SEQ ID NO: 596874 - protein, 9 aa, Homo Sapiens
DDPNCEMRK

SEQ ID NO: 596875 - protein, 9 aa, Homo Sapiens
FASDEVCTS

SEQ ID NO: 596876 - protein, 9 aa, Homo Sapiens
RSGQRQVFF

SEQ ID NO: 596877 - protein, 9 aa, Homo Sapiens
ITWLGDVQY

SEQ ID NO: 596878 - protein, 9 aa, Homo Sapiens
QIEQSSSDQ

SEQ ID NO: 596879 - protein, 9 aa, Homo Sapiens
SLVGTVTGM

SEQ ID NO: 596880 - protein, 9 aa, Homo Sapiens
DHFFCDKYP

SEQ ID NO: 596881 - protein, 9 aa, Homo Sapiens
RSQQCISSS

SEQ ID NO: 596882 - protein, 9 aa, Homo Sapiens
TSKPYSDGM

SEQ ID NO: 596883 - protein, 9 aa, Homo Sapiens
SGRTPSQRA

SEQ ID NO: 596884 - protein, 9 aa, Homo Sapiens
GIIHSEIEI

SEQ ID NO: 596885 - protein, 9 aa, Homo Sapiens
TGSSNSKCS

SEQ ID NO: 596886 - protein, 9 aa, Homo Sapiens
TVQVNKPGE

SEQ ID NO: 596887 - protein, 9 aa, Homo Sapiens
TEAPKEVGI

SEQ ID NO: 596888 - protein, 9 aa, Homo Sapiens
NVLLHGFAS

SEQ ID NO: 596889 - protein, 9 aa, Homo Sapiens
WKDCCWRCR

SEQ ID NO: 596890 - protein, 9 aa, Homo Sapiens
PKEVGIWVN

SEQ ID NO: 596891 - protein, 9 aa, Homo Sapiens
SAAPSPPGC

SEQ ID NO: 596892 - protein, 9 aa, Homo Sapiens
GLLVALMGG

SEQ ID NO: 596893 - protein, 9 aa, Homo Sapiens
ESIKNEIDN

SEQ ID NO: 596894 - protein, 9 aa, Homo Sapiens
QLCCPPGSL

SEQ ID NO: 596895 - protein, 9 aa, Homo Sapiens
KRGRMSDLS

SEQ ID NO: 596896 - protein, 9 aa, Homo Sapiens
EVCTSYANE

SEQ ID NO: 596897 - protein, 9 aa, Homo Sapiens
PYSDGMNIT

SEQ ID NO: 596898 - protein, 9 aa, Homo Sapiens
PLPLQLEVV

SEQ ID NO: 596899 - protein, 9 aa, Homo Sapiens
AVSDLNRSG

SEQ ID NO: 596900 - protein, 9 aa, Homo Sapiens
FHLEDHHEY

SEQ ID NO: 596901 - protein, 9 aa, Homo Sapiens
GALRGMCTP

SEQ ID NO: 596902 - protein, 9 aa, Homo Sapiens
APSPPGCAD

SEQ ID NO: 596903 - protein, 9 aa, Homo Sapiens
YPQGTTSSQ

SEQ ID NO: 596904 - protein, 9 aa, Homo Sapiens
FGYCEVGEK

SEQ ID NO: 596905 - protein, 9 aa, Homo Sapiens
DAESRHLVT

SEQ ID NO: 596906 - protein, 9 aa, Homo Sapiens
ESQMMIEER

SEQ ID NO: 596907 - protein, 9 aa, Homo Sapiens
EDILSTIQK

SEQ ID NO: 596908 - protein, 9 aa, Homo Sapiens
KDLGHSTQQ

SEQ ID NO: 596909 - protein, 9 aa, Homo Sapiens
PKERAPEEP

SEQ ID NO: 596910 - protein, 9 aa, Homo Sapiens
SFMYPQGTT

SEQ ID NO: 596911 - protein, 9 aa, Homo Sapiens
AHVETGGLL

SEQ ID NO: 596912 - protein, 9 aa, Homo Sapiens
TEWWTDQVS

SEQ ID NO: 596913 - protein, 9 aa, Homo Sapiens
QVTQVERDP

SEQ ID NO: 596914 - protein, 9 aa, Homo Sapiens
LTQHESIKN

SEQ ID NO: 596915 - protein, 9 aa, Homo Sapiens
YLGINCLDA

SEQ ID NO: 596916 - protein, 9 aa, Homo Sapiens
VLMEKITLK

SEQ ID NO: 596917 - protein, 9 aa, Homo Sapiens
KKDTWTKVD

SEQ ID NO: 596918 - protein, 9 aa, Homo Sapiens
WALTSIASG

SEQ ID NO: 596919 - protein, 9 aa, Homo Sapiens
EMRKKNSFV

SEQ ID NO: 596920 - protein, 9 aa, Homo Sapiens
DSESEAPDP

SEQ ID NO: 596921 - protein, 9 aa, Homo Sapiens
QSSDSESEA

SEQ ID NO: 596922 - protein, 9 aa, Homo Sapiens
PGLASCPAC

SEQ ID NO: 596923 - protein, 9 aa, Homo Sapiens
SLSPSGRTP

SEQ ID NO: 596924 - protein, 9 aa, Homo Sapiens
EPLPLQLEV

SEQ ID NO: 596925 - protein, 9 aa, Homo Sapiens
LMGGGLPAG

SEQ ID NO: 596926 - protein, 9 aa, Homo Sapiens
QRKEASKGY

SEQ ID NO: 596927 - protein, 9 aa, Homo Sapiens
YDDCNFSKN

SEQ ID NO: 596928 - protein, 9 aa, Homo Sapiens
EIEIYLQGE

SEQ ID NO: 596929 - protein, 9 aa, Homo Sapiens
LASAPRGDL

SEQ ID NO: 596930 - protein, 9 aa, Homo Sapiens
HLEDHHEYL

SEQ ID NO: 596931 - protein, 9 aa, Homo Sapiens
NNLNKTYNG

SEQ ID NO: 596932 - protein, 9 aa, Homo Sapiens
INCLDACHL

SEQ ID NO: 596933 - protein, 9 aa, Homo Sapiens
TEEEFLAFW

SEQ ID NO: 596934 - protein, 9 aa, Homo Sapiens
RESQMMIEE

SEQ ID NO: 596935 - protein, 9 aa, Homo Sapiens
SAYTRPSST

SEQ ID NO: 596936 - protein, 9 aa, Homo Sapiens
SRESQMMIE

SEQ ID NO: 596937 - protein, 9 aa, Homo Sapiens
EPEPLPLQL

SEQ ID NO: 596938 - protein, 9 aa, Homo Sapiens
RRSLEKIDL

SEQ ID NO: 596939 - protein, 9 aa, Homo Sapiens
WLGDVQYKM

SEQ ID NO: 596940 - protein, 9 aa, Homo Sapiens
KKRERKTAS

SEQ ID NO: 596941 - protein, 9 aa, Homo Sapiens
FSKNLVQGQ

SEQ ID NO: 596942 - protein, 9 aa, Homo Sapiens
GSEGPAPGL

SEQ ID NO: 596943 - protein, 9 aa, Homo Sapiens
MFILLRAED

SEQ ID NO: 596944 - protein, 9 aa, Homo Sapiens
RQQKAHTRS

SEQ ID NO: 596945 - protein, 9 aa, Homo Sapiens
VFDTGSSNS

SEQ ID NO: 596946 - protein, 9 aa, Homo Sapiens
LNLRNVLLH

SEQ ID NO: 596947 - protein, 9 aa, Homo Sapiens
SLEKIDLKF

SEQ ID NO: 596948 - protein, 9 aa, Homo Sapiens
TGTQQQLIS

SEQ ID NO: 596949 - protein, 9 aa, Homo Sapiens
SNLNVSKES

SEQ ID NO: 596950 - protein, 9 aa, Homo Sapiens
KAHTRSQQC

SEQ ID NO: 596951 - protein, 9 aa, Homo Sapiens
LGQGTFTKL

SEQ ID NO: 596952 - protein, 9 aa, Homo Sapiens
APVFVLMEK

SEQ ID NO: 596953 - protein, 9 aa, Homo Sapiens
PNCEMRKKN

SEQ ID NO: 596954 - protein, 9 aa, Homo Sapiens
LSQMLIVNE

SEQ ID NO: 596955 - protein, 9 aa, Homo Sapiens
EFLAFWKQT

SEQ ID NO: 596956 - protein, 9 aa, Homo Sapiens
SNSKCSRLY

SEQ ID NO: 596957 - protein, 9 aa, Homo Sapiens
SLPLAHVNG

SEQ ID NO: 596958 - protein, 9 aa, Homo Sapiens
SHEDILSTI

SEQ ID NO: 596959 - protein, 9 aa, Homo Sapiens
DKGSEGPAP

SEQ ID NO: 596960 - protein, 9 aa, Homo Sapiens
VERVKDLGH

SEQ ID NO: 596961 - protein, 9 aa, Homo Sapiens
YLDCGIHSG

SEQ ID NO: 596962 - protein, 9 aa, Homo Sapiens
GIWVNIDHF

SEQ ID NO: 596963 - protein, 9 aa, Homo Sapiens
ITSQLPDLP

SEQ ID NO: 596964 - protein, 9 aa, Homo Sapiens
INIGSWDNG

SEQ ID NO: 596965 - protein, 9 aa, Homo Sapiens
ETSKPYSDG

SEQ ID NO: 596966 - protein, 9 aa, Homo Sapiens
PEPLPLQLE

SEQ ID NO: 596967 - protein, 9 aa, Homo Sapiens
WKILGYDLC

SEQ ID NO: 596968 - protein, 9 aa, Homo Sapiens
RYVVQFTPA

SEQ ID NO: 596969 - protein, 9 aa, Homo Sapiens
GYCEVGEKC

SEQ ID NO: 596970 - protein, 9 aa, Homo Sapiens
DYINIGSWD

SEQ ID NO: 596971 - protein, 9 aa, Homo Sapiens
TQHESIKNE

SEQ ID NO: 596972 - protein, 9 aa, Homo Sapiens
RENKRGRMS

SEQ ID NO: 596973 - protein, 9 aa, Homo Sapiens
DEDKRNRAI

SEQ ID NO: 596974 - protein, 9 aa, Homo Sapiens
SGNLLVRNS

SEQ ID NO: 596975 - protein, 9 aa, Homo Sapiens
LNKTYNGTY

SEQ ID NO: 596976 - protein, 9 aa, Homo Sapiens
FILIAVFYT

SEQ ID NO: 596977 - protein, 9 aa, Homo Sapiens
HEGHCKPWK

SEQ ID NO: 596978 - protein, 9 aa, Homo Sapiens
AYTRPSSTK

SEQ ID NO: 596979 - protein, 9 aa, Homo Sapiens
LASCPACAC

SEQ ID NO: 596980 - protein, 9 aa, Homo Sapiens
GINCLDACH

SEQ ID NO: 596981 - protein, 9 aa, Homo Sapiens
DSSGNLLVR

SEQ ID NO: 596982 - protein, 9 aa, Homo Sapiens
EDHHEYLLI

SEQ ID NO: 596983 - protein, 9 aa, Homo Sapiens
DLISHEDIL

SEQ ID NO: 596984 - protein, 9 aa, Homo Sapiens
LGAGAGQRP

SEQ ID NO: 596985 - protein, 9 aa, Homo Sapiens
ASCPACACS

SEQ ID NO: 596986 - protein, 9 aa, Homo Sapiens
GAGAGQRPL

SEQ ID NO: 596987 - protein, 9 aa, Homo Sapiens
QLEVVRGLL

SEQ ID NO: 596988 - protein, 9 aa, Homo Sapiens
DFILIAVFY

SEQ ID NO: 596989 - protein, 9 aa, Homo Sapiens
LIAVFYTLI

SEQ ID NO: 596990 - protein, 9 aa, Homo Sapiens
PSAYTRPSS

SEQ ID NO: 596991 - protein, 9 aa, Homo Sapiens
PLASAPRGD

SEQ ID NO: 596992 - protein, 9 aa, Homo Sapiens
MEKITLKKM

SEQ ID NO: 596993 - protein, 9 aa, Homo Sapiens
NYITSQLPD

SEQ ID NO: 596994 - protein, 9 aa, Homo Sapiens
SSNSKCSRL

SEQ ID NO: 596995 - protein, 9 aa, Homo Sapiens
SDSESEAPD

SEQ ID NO: 596996 - protein, 9 aa, Homo Sapiens
EEFLAFWKQ

SEQ ID NO: 596997 - protein, 9 aa, Homo Sapiens
LLRAEDNIR

SEQ ID NO: 596998 - protein, 9 aa, Homo Sapiens
NLNKTYNGT

SEQ ID NO: 596999 - protein, 9 aa, Homo Sapiens
AHTRSQQCI

SEQ ID NO: 597000 - protein, 9 aa, Homo Sapiens
VSMSSTEVR

SEQ ID NO: 597001 - protein, 9 aa, Homo Sapiens
KFKPVIGAW

SEQ ID NO: 597002 - protein, 9 aa, Homo Sapiens
LLVALMGGG

SEQ ID NO: 597003 - protein, 9 aa, Homo Sapiens
IWVNIDHFT

SEQ ID NO: 597004 - protein, 9 aa, Homo Sapiens
EVGEKCRQS

SEQ ID NO: 597005 - protein, 9 aa, Homo Sapiens
ERKTASKSS

SEQ ID NO: 597006 - protein, 9 aa, Homo Sapiens
CLEASTSLV

SEQ ID NO: 597007 - protein, 9 aa, Homo Sapiens
QQQVLGAGA

SEQ ID NO: 597008 - protein, 9 aa, Homo Sapiens
LVQTKRRSL

SEQ ID NO: 597009 - protein, 9 aa, Homo Sapiens
TTGTQQQLI

SEQ ID NO: 597010 - protein, 9 aa, Homo Sapiens
SDLNRSGQR

SEQ ID NO: 597011 - protein, 9 aa, Homo Sapiens
PVPAVFGFS

SEQ ID NO: 597012 - protein, 9 aa, Homo Sapiens
VKDLGHSTQ

SEQ ID NO: 597013 - protein, 9 aa, Homo Sapiens
TTSSQMVLR

SEQ ID NO: 597014 - protein, 9 aa, Homo Sapiens
TSLVGTVTG

SEQ ID NO: 597015 - protein, 9 aa, Homo Sapiens
FYDDCNFSK

SEQ ID NO: 597016 - protein, 9 aa, Homo Sapiens
RDRITWLGD

SEQ ID NO: 597017 - protein, 9 aa, Homo Sapiens
PSEKEKLSQ

SEQ ID NO: 597018 - protein, 9 aa, Homo Sapiens
KPKERAPEE

SEQ ID NO: 597019 - protein, 9 aa, Homo Sapiens
LYVYNTKKD

SEQ ID NO: 597020 - protein, 9 aa, Homo Sapiens
APKEVGIWV

SEQ ID NO: 597021 - protein, 9 aa, Homo Sapiens
LGYDLCDAG

SEQ ID NO: 597022 - protein, 9 aa, Homo Sapiens
TWLGDVQYK

SEQ ID NO: 597023 - protein, 9 aa, Homo Sapiens
FESAWALTS

SEQ ID NO: 597024 - protein, 9 aa, Homo Sapiens
SLNTVVTGI

SEQ ID NO: 597025 - protein, 9 aa, Homo Sapiens
EKLLTQHES

SEQ ID NO: 597026 - protein, 9 aa, Homo Sapiens
IRDRYVVQF

SEQ ID NO: 597027 - protein, 9 aa, Homo Sapiens
RGRKPKERA

SEQ ID NO: 597028 - protein, 9 aa, Homo Sapiens
RAEDNIRLA

SEQ ID NO: 597029 - protein, 9 aa, Homo Sapiens
LDPSEKEKL

SEQ ID NO: 597030 - protein, 9 aa, Homo Sapiens
FWKQTPSAG

SEQ ID NO: 597031 - protein, 9 aa, Homo Sapiens
KKQAAEVTK

SEQ ID NO: 597032 - protein, 9 aa, Homo Sapiens
PTKLSAPAY

SEQ ID NO: 597033 - protein, 9 aa, Homo Sapiens
MVDPKLNHI

SEQ ID NO: 597034 - protein, 9 aa, Homo Sapiens
GYKLLNKHT

SEQ ID NO: 597035 - protein, 9 aa, Homo Sapiens
FPIKVINSE

SEQ ID NO: 597036 - protein, 9 aa, Homo Sapiens
TLSYSMNPK

SEQ ID NO: 597037 - protein, 9 aa, Homo Sapiens
KETQPEIGC

SEQ ID NO: 597038 - protein, 9 aa, Homo Sapiens
LSTLTLNEA

SEQ ID NO: 597039 - protein, 9 aa, Homo Sapiens
RQYTELLSD

SEQ ID NO: 597040 - protein, 9 aa, Homo Sapiens
KKQGHKKQA

SEQ ID NO: 597041 - protein, 9 aa, Homo Sapiens
NLSRYMESR

SEQ ID NO: 597042 - protein, 9 aa, Homo Sapiens
KVSKILEGK

SEQ ID NO: 597043 - protein, 9 aa, Homo Sapiens
YILHPKTVG

SEQ ID NO: 597044 - protein, 9 aa, Homo Sapiens
DTEPQPCKG

SEQ ID NO: 597045 - protein, 9 aa, Homo Sapiens
MYENDNAPT

SEQ ID NO: 597046 - protein, 9 aa, Homo Sapiens
LELQNLLLC

SEQ ID NO: 597047 - protein, 9 aa, Homo Sapiens
NFLPPPGYA

SEQ ID NO: 597048 - protein, 9 aa, Homo Sapiens
SLCHLQKVN

SEQ ID NO: 597049 - protein, 9 aa, Homo Sapiens
ITRKRSEGA

SEQ ID NO: 597050 - protein, 9 aa, Homo Sapiens
EAQLLQPSH

SEQ ID NO: 597051 - protein, 9 aa, Homo Sapiens
ILVQRQNKE

SEQ ID NO: 597052 - protein, 9 aa, Homo Sapiens
AGVPLPRGD

SEQ ID NO: 597053 - protein, 9 aa, Homo Sapiens
DWDSGEVKL

SEQ ID NO: 597054 - protein, 9 aa, Homo Sapiens
DWVNNKICL

SEQ ID NO: 597055 - protein, 9 aa, Homo Sapiens
ILWAFTGHV

SEQ ID NO: 597056 - protein, 9 aa, Homo Sapiens
LLPLVEGEG

SEQ ID NO: 597057 - protein, 9 aa, Homo Sapiens
GSWGGNVAL

SEQ ID NO: 597058 - protein, 9 aa, Homo Sapiens
ISICCRPSC

SEQ ID NO: 597059 - protein, 9 aa, Homo Sapiens
PGILVQRQN

SEQ ID NO: 597060 - protein, 9 aa, Homo Sapiens
GFPQGPKDL

SEQ ID NO: 597061 - protein, 9 aa, Homo Sapiens
SYLRPQMHV

SEQ ID NO: 597062 - protein, 9 aa, Homo Sapiens
TKLSAPAYS

SEQ ID NO: 597063 - protein, 9 aa, Homo Sapiens
DRIISQMVD

SEQ ID NO: 597064 - protein, 9 aa, Homo Sapiens
MWMSYLRPQ

SEQ ID NO: 597065 - protein, 9 aa, Homo Sapiens
AVKVDHILR

SEQ ID NO: 597066 - protein, 9 aa, Homo Sapiens
MESRDSSGT

SEQ ID NO: 597067 - protein, 9 aa, Homo Sapiens
SCMGQLLQF

SEQ ID NO: 597068 - protein, 9 aa, Homo Sapiens
HPKHHHHRH

SEQ ID NO: 597069 - protein, 9 aa, Homo Sapiens
LLCALQTIY

SEQ ID NO: 597070 - protein, 9 aa, Homo Sapiens
DSHEGGSAV

SEQ ID NO: 597071 - protein, 9 aa, Homo Sapiens
YVEITTFFS

SEQ ID NO: 597072 - protein, 9 aa, Homo Sapiens
NSTDELPTL

SEQ ID NO: 597073 - protein, 9 aa, Homo Sapiens
YTELLSDIG

SEQ ID NO: 597074 - protein, 9 aa, Homo Sapiens
TYLAQNVII

SEQ ID NO: 597075 - protein, 9 aa, Homo Sapiens
EFNFLPPPG

SEQ ID NO: 597076 - protein, 9 aa, Homo Sapiens
VDWVNNKIC

SEQ ID NO: 597077 - protein, 9 aa, Homo Sapiens
WVDRCLAFT

SEQ ID NO: 597078 - protein, 9 aa, Homo Sapiens
QNKEVLATP

SEQ ID NO: 597079 - protein, 9 aa, Homo Sapiens
PIKVINSET

SEQ ID NO: 597080 - protein, 9 aa, Homo Sapiens
GSWYAITRK

SEQ ID NO: 597081 - protein, 9 aa, Homo Sapiens
NIVMVTTQL

SEQ ID NO: 597082 - protein, 9 aa, Homo Sapiens
MTAYWTNFA

SEQ ID NO: 597083 - protein, 9 aa, Homo Sapiens
ARPMYVLLG

SEQ ID NO: 597084 - protein, 9 aa, Homo Sapiens
CDWDSGEVK

SEQ ID NO: 597085 - protein, 9 aa, Homo Sapiens
SQMVDPKLN

SEQ ID NO: 597086 - protein, 9 aa, Homo Sapiens
HPSCSISIC

SEQ ID NO: 597087 - protein, 9 aa, Homo Sapiens
RALRTIWSS

SEQ ID NO: 597088 - protein, 9 aa, Homo Sapiens
HIFFPIKVI

SEQ ID NO: 597089 - protein, 9 aa, Homo Sapiens
IEPNRSENS

SEQ ID NO: 597090 - protein, 9 aa, Homo Sapiens
QKVNHYLIL

SEQ ID NO: 597091 - protein, 9 aa, Homo Sapiens
NEDIKKASF

SEQ ID NO: 597092 - protein, 9 aa, Homo Sapiens
NHYLILPSE

SEQ ID NO: 597093 - protein, 9 aa, Homo Sapiens
LQDSQDRCY

SEQ ID NO: 597094 - protein, 9 aa, Homo Sapiens
HHAWLVFVF

SEQ ID NO: 597095 - protein, 9 aa, Homo Sapiens
HGEFNFLPP

SEQ ID NO: 597096 - protein, 9 aa, Homo Sapiens
SVPNLSRYM

SEQ ID NO: 597097 - protein, 9 aa, Homo Sapiens
YFFSKRTTS

SEQ ID NO: 597098 - protein, 9 aa, Homo Sapiens
STLTLNEAD

SEQ ID NO: 597099 - protein, 9 aa, Homo Sapiens
ANTSPRLGQ

SEQ ID NO: 597100 - protein, 9 aa, Homo Sapiens
LCHLQKVNH

SEQ ID NO: 597101 - protein, 9 aa, Homo Sapiens
NENRQNSNG

SEQ ID NO: 597102 - protein, 9 aa, Homo Sapiens
GEGAGGAGP

SEQ ID NO: 597103 - protein, 9 aa, Homo Sapiens
LRTIWSSGD

SEQ ID NO: 597104 - protein, 9 aa, Homo Sapiens
TMDLHSDDQ

SEQ ID NO: 597105 - protein, 9 aa, Homo Sapiens
TKRENKTTS

SEQ ID NO: 597106 - protein, 9 aa, Homo Sapiens
LQILNIVMV

SEQ ID NO: 597107 - protein, 9 aa, Homo Sapiens
PLSTLTLNE

SEQ ID NO: 597108 - protein, 9 aa, Homo Sapiens
AWLVFVFLV

SEQ ID NO: 597109 - protein, 9 aa, Homo Sapiens
ALPQVTLDD

SEQ ID NO: 597110 - protein, 9 aa, Homo Sapiens
LHDPSGVFH

SEQ ID NO: 597111 - protein, 9 aa, Homo Sapiens
AFTMDLHSD

SEQ ID NO: 597112 - protein, 9 aa, Homo Sapiens
EPEVLQDSQ

SEQ ID NO: 597113 - protein, 9 aa, Homo Sapiens
ASPSNDCSL

SEQ ID NO: 597114 - protein, 9 aa, Homo Sapiens
IWSSGDDKE

SEQ ID NO: 597115 - protein, 9 aa, Homo Sapiens
LFVMYENDN

SEQ ID NO: 597116 - protein, 9 aa, Homo Sapiens
DSGEVKLLQ

SEQ ID NO: 597117 - protein, 9 aa, Homo Sapiens
FFFFFPFFF

SEQ ID NO: 597118 - protein, 9 aa, Homo Sapiens
KKQNSLSSK

SEQ ID NO: 597119 - protein, 9 aa, Homo Sapiens
HVYYFFSKR

SEQ ID NO: 597120 - protein, 9 aa, Homo Sapiens
NGKACFGTF

SEQ ID NO: 597121 - protein, 9 aa, Homo Sapiens
NETYLAQNV

SEQ ID NO: 597122 - protein, 9 aa, Homo Sapiens
SVGMPGLEY

SEQ ID NO: 597123 - protein, 9 aa, Homo Sapiens
QERALRTIW

SEQ ID NO: 597124 - protein, 9 aa, Homo Sapiens
TYDAYILHP

SEQ ID NO: 597125 - protein, 9 aa, Homo Sapiens
TGNITFETM

SEQ ID NO: 597126 - protein, 9 aa, Homo Sapiens
LNKHTGNIT

SEQ ID NO: 597127 - protein, 9 aa, Homo Sapiens
IKTDTEPQP

SEQ ID NO: 597128 - protein, 9 aa, Homo Sapiens
KKWFSGIKV

SEQ ID NO: 597129 - protein, 9 aa, Homo Sapiens
PNFSCMGQL

SEQ ID NO: 597130 - protein, 9 aa, Homo Sapiens
KQSHILWAF

SEQ ID NO: 597131 - protein, 9 aa, Homo Sapiens
FSVGMPGLE

SEQ ID NO: 597132 - protein, 9 aa, Homo Sapiens
QLALPQVTL

SEQ ID NO: 597133 - protein, 9 aa, Homo Sapiens
VFVFLVEMR

SEQ ID NO: 597134 - protein, 9 aa, Homo Sapiens
QPEIGCSQE

SEQ ID NO: 597135 - protein, 9 aa, Homo Sapiens
RLGQTFLQL

SEQ ID NO: 597136 - protein, 9 aa, Homo Sapiens
GGAEAGVPL

SEQ ID NO: 597137 - protein, 9 aa, Homo Sapiens
LNEADPSSK

SEQ ID NO: 597138 - protein, 9 aa, Homo Sapiens
SQLKLGSWG

SEQ ID NO: 597139 - protein, 9 aa, Homo Sapiens
KGGAEAGVP

SEQ ID NO: 597140 - protein, 9 aa, Homo Sapiens
LQVIAVPQL

SEQ ID NO: 597141 - protein, 9 aa, Homo Sapiens
QQPQLQVIA

SEQ ID NO: 597142 - protein, 9 aa, Homo Sapiens
NQERALRTI

SEQ ID NO: 597143 - protein, 9 aa, Homo Sapiens
TGYVYSTDL

SEQ ID NO: 597144 - protein, 9 aa, Homo Sapiens
ISQMVDPKL

SEQ ID NO: 597145 - protein, 9 aa, Homo Sapiens
ELQNLLLCA

SEQ ID NO: 597146 - protein, 9 aa, Homo Sapiens
KTYDAYILH

SEQ ID NO: 597147 - protein, 9 aa, Homo Sapiens
FLHVYYFFS

SEQ ID NO: 597148 - protein, 9 aa, Homo Sapiens
ICCRPSCCE

SEQ ID NO: 597149 - protein, 9 aa, Homo Sapiens
CSISICCRP

SEQ ID NO: 597150 - protein, 9 aa, Homo Sapiens
KMWVDRCLA

SEQ ID NO: 597151 - protein, 9 aa, Homo Sapiens
GGWEAEARG

SEQ ID NO: 597152 - protein, 9 aa, Homo Sapiens
VYSTDLHKL

SEQ ID NO: 597153 - protein, 9 aa, Homo Sapiens
IGCSQESAD

SEQ ID NO: 597154 - protein, 9 aa, Homo Sapiens
YLRPQMHVN

SEQ ID NO: 597155 - protein, 9 aa, Homo Sapiens
ERALRTIWS

SEQ ID NO: 597156 - protein, 9 aa, Homo Sapiens
MKHTPTKLS

SEQ ID NO: 597157 - protein, 9 aa, Homo Sapiens
WCWELEAGF

SEQ ID NO: 597158 - protein, 9 aa, Homo Sapiens
LKLGSWGGN

SEQ ID NO: 597159 - protein, 9 aa, Homo Sapiens
EQKTKRENK

SEQ ID NO: 597160 - protein, 9 aa, Homo Sapiens
PASPSNDCS

SEQ ID NO: 597161 - protein, 9 aa, Homo Sapiens
SICCRPSCC

SEQ ID NO: 597162 - protein, 9 aa, Homo Sapiens
KYKKQNSLS

SEQ ID NO: 597163 - protein, 9 aa, Homo Sapiens
RGSGDLETE

SEQ ID NO: 597164 - protein, 9 aa, Homo Sapiens
DPDGSWYAI

SEQ ID NO: 597165 - protein, 9 aa, Homo Sapiens
VAGFNGKLV

SEQ ID NO: 597166 - protein, 9 aa, Homo Sapiens
KICLVETKV

SEQ ID NO: 597167 - protein, 9 aa, Homo Sapiens
QIKVLHDPS

SEQ ID NO: 597168 - protein, 9 aa, Homo Sapiens
CMGQLLQFE

SEQ ID NO: 597169 - protein, 9 aa, Homo Sapiens
SAPAYSFRG

SEQ ID NO: 597170 - protein, 9 aa, Homo Sapiens
ELPTLSYSM

SEQ ID NO: 597171 - protein, 9 aa, Homo Sapiens
LCARPMYVL

SEQ ID NO: 597172 - protein, 9 aa, Homo Sapiens
VNHYLILPS

SEQ ID NO: 597173 - protein, 9 aa, Homo Sapiens
WFSGIKVPE

SEQ ID NO: 597174 - protein, 9 aa, Homo Sapiens
AQEAQLLQP

SEQ ID NO: 597175 - protein, 9 aa, Homo Sapiens
TDELPTLSY

SEQ ID NO: 597176 - protein, 9 aa, Homo Sapiens
WKLGLQILN

SEQ ID NO: 597177 - protein, 9 aa, Homo Sapiens
GRHGEFNFL

SEQ ID NO: 597178 - protein, 9 aa, Homo Sapiens
VPNLSRYME

SEQ ID NO: 597179 - protein, 9 aa, Homo Sapiens
YDAYILHPK

SEQ ID NO: 597180 - protein, 9 aa, Homo Sapiens
DLLPLVEGE

SEQ ID NO: 597181 - protein, 9 aa, Homo Sapiens
CARPMYVLL

SEQ ID NO: 597182 - protein, 9 aa, Homo Sapiens
QILNIVMVT

SEQ ID NO: 597183 - protein, 9 aa, Homo Sapiens
TTCKVSKIL

SEQ ID NO: 597184 - protein, 9 aa, Homo Sapiens
MYVLLGVLS

SEQ ID NO: 597185 - protein, 9 aa, Homo Sapiens
CWCWELEAG

SEQ ID NO: 597186 - protein, 9 aa, Homo Sapiens
HSDDQDLTR

SEQ ID NO: 597187 - protein, 9 aa, Homo Sapiens
TEPQPCKGN

SEQ ID NO: 597188 - protein, 9 aa, Homo Sapiens
SFLLIRKLY

SEQ ID NO: 597189 - protein, 9 aa, Homo Sapiens
QNLLLCALQ

SEQ ID NO: 597190 - protein, 9 aa, Homo Sapiens
PRLGQTFLQ

SEQ ID NO: 597191 - protein, 9 aa, Homo Sapiens
WMSYLRPQM

SEQ ID NO: 597192 - protein, 9 aa, Homo Sapiens
YAITRKRSE

SEQ ID NO: 597193 - protein, 9 aa, Homo Sapiens
QFFFFFFPF

SEQ ID NO: 597194 - protein, 9 aa, Homo Sapiens
KLLQGERYK

SEQ ID NO: 597195 - protein, 9 aa, Homo Sapiens
KDLLPLVEG

SEQ ID NO: 597196 - protein, 9 aa, Homo Sapiens
DLHSDDQDL

SEQ ID NO: 597197 - protein, 9 aa, Homo Sapiens
TQPEIGCSQ

SEQ ID NO: 597198 - protein, 9 aa, Homo Sapiens
RGQERETSS

SEQ ID NO: 597199 - protein, 9 aa, Homo Sapiens
TSPRLGQTF

SEQ ID NO: 597200 - protein, 9 aa, Homo Sapiens
RTIWSSGDD

SEQ ID NO: 597201 - protein, 9 aa, Homo Sapiens
ILHPKTVGE

SEQ ID NO: 597202 - protein, 9 aa, Homo Sapiens
FGGTTGYVY

SEQ ID NO: 597203 - protein, 9 aa, Homo Sapiens
WELEAGFPS

SEQ ID NO: 597204 - protein, 9 aa, Homo Sapiens
KTDTEPQPC

SEQ ID NO: 597205 - protein, 9 aa, Homo Sapiens
FTGHVQRQR

SEQ ID NO: 597206 - protein, 9 aa, Homo Sapiens
ICLVETKVN

SEQ ID NO: 597207 - protein, 9 aa, Homo Sapiens
GGRHGEFNF

SEQ ID NO: 597208 - protein, 9 aa, Homo Sapiens
DIKKASFLL

SEQ ID NO: 597209 - protein, 9 aa, Homo Sapiens
LHVYYFFSK

SEQ ID NO: 597210 - protein, 9 aa, Homo Sapiens
DHILRHSLL

SEQ ID NO: 597211 - protein, 9 aa, Homo Sapiens
EAEARGSGD

SEQ ID NO: 597212 - protein, 9 aa, Homo Sapiens
LIAFTMDLH

SEQ ID NO: 597213 - protein, 9 aa, Homo Sapiens
LHPKTVGEG

SEQ ID NO: 597214 - protein, 9 aa, Homo Sapiens
NKEVLATPL

SEQ ID NO: 597215 - protein, 9 aa, Homo Sapiens
SHEGGSAVD

SEQ ID NO: 597216 - protein, 9 aa, Homo Sapiens
QLLQPSHFL

SEQ ID NO: 597217 - protein, 9 aa, Homo Sapiens
PNRSENSMD

SEQ ID NO: 597218 - protein, 9 aa, Homo Sapiens
GGSAVDQAG

SEQ ID NO: 597219 - protein, 9 aa, Homo Sapiens
RTVSKAMTA

SEQ ID NO: 597220 - protein, 9 aa, Homo Sapiens
HEGGSAVDQ

SEQ ID NO: 597221 - protein, 9 aa, Homo Sapiens
GARHHAWLV

SEQ ID NO: 597222 - protein, 9 aa, Homo Sapiens
TKKWFSGIK

SEQ ID NO: 597223 - protein, 9 aa, Homo Sapiens
HPKTVGEGS

SEQ ID NO: 597224 - protein, 9 aa, Homo Sapiens
QNVIIFASI

SEQ ID NO: 597225 - protein, 9 aa, Homo Sapiens
SKAMTAYWT

SEQ ID NO: 597226 - protein, 9 aa, Homo Sapiens
YNPASPSND

SEQ ID NO: 597227 - protein, 9 aa, Homo Sapiens
NDCSLGQSY

SEQ ID NO: 597228 - protein, 9 aa, Homo Sapiens
RHHHHHRHS

SEQ ID NO: 597229 - protein, 9 aa, Homo Sapiens
QSHILWAFT

SEQ ID NO: 597230 - protein, 9 aa, Homo Sapiens
TPTKLSAPA

SEQ ID NO: 597231 - protein, 9 aa, Homo Sapiens
KAMTAYWTN

SEQ ID NO: 597232 - protein, 9 aa, Homo Sapiens
SWGGNVALD

SEQ ID NO: 597233 - protein, 9 aa, Homo Sapiens
NTSPRLGQT

SEQ ID NO: 597234 - protein, 9 aa, Homo Sapiens
FIQIKVLHD

SEQ ID NO: 597235 - protein, 9 aa, Homo Sapiens
EGAGGAGPP

SEQ ID NO: 597236 - protein, 9 aa, Homo Sapiens
NKHTGNITF

SEQ ID NO: 597237 - protein, 9 aa, Homo Sapiens
TIWSSGDDK

SEQ ID NO: 597238 - protein, 9 aa, Homo Sapiens
VTLDDDGEM

SEQ ID NO: 597239 - protein, 9 aa, Homo Sapiens
LNIVMVTTQ

SEQ ID NO: 597240 - protein, 9 aa, Homo Sapiens
PMWMSYLRP

SEQ ID NO: 597241 - protein, 9 aa, Homo Sapiens
SENSMDIFK

SEQ ID NO: 597242 - protein, 9 aa, Homo Sapiens
GTTGYVYST

SEQ ID NO: 597243 - protein, 9 aa, Homo Sapiens
VYHIFFPIK

SEQ ID NO: 597244 - protein, 9 aa, Homo Sapiens
ATKKWFSGI

SEQ ID NO: 597245 - protein, 9 aa, Homo Sapiens
HILWAFTGH

SEQ ID NO: 597246 - protein, 9 aa, Homo Sapiens
SPRLGQTFL

SEQ ID NO: 597247 - protein, 9 aa, Homo Sapiens
FFSVGMPGL

SEQ ID NO: 597248 - protein, 9 aa, Homo Sapiens
RIISQMVDP

SEQ ID NO: 597249 - protein, 9 aa, Homo Sapiens
QKTKRENKT

SEQ ID NO: 597250 - protein, 9 aa, Homo Sapiens
FSKRTTSLI

SEQ ID NO: 597251 - protein, 9 aa, Homo Sapiens
HHPKHHHHR

SEQ ID NO: 597252 - protein, 9 aa, Homo Sapiens
DRCLAFTEE

SEQ ID NO: 597253 - protein, 9 aa, Homo Sapiens
KQNSLSSKL

SEQ ID NO: 597254 - protein, 9 aa, Homo Sapiens
GVDRIISQM

SEQ ID NO: 597255 - protein, 9 aa, Homo Sapiens
NNKICLVET

SEQ ID NO: 597256 - protein, 9 aa, Homo Sapiens
TSSHGQGRY

SEQ ID NO: 597257 - protein, 9 aa, Homo Sapiens
NRSENSMDI

SEQ ID NO: 597258 - protein, 9 aa, Homo Sapiens
SLFVMYEND

SEQ ID NO: 597259 - protein, 9 aa, Homo Sapiens
GQERETSSH

SEQ ID NO: 597260 - protein, 9 aa, Homo Sapiens
FSCMGQLLQ

SEQ ID NO: 597261 - protein, 9 aa, Homo Sapiens
ATVSLFVMY

SEQ ID NO: 597262 - protein, 9 aa, Homo Sapiens
LAQNVIIFA

SEQ ID NO: 597263 - protein, 9 aa, Homo Sapiens
SCSISICCR

SEQ ID NO: 597264 - protein, 9 aa, Homo Sapiens
DGSWYAITR

SEQ ID NO: 597265 - protein, 9 aa, Homo Sapiens
ERKMWVDRC

SEQ ID NO: 597266 - protein, 9 aa, Homo Sapiens
VQRQNKEVL

SEQ ID NO: 597267 - protein, 9 aa, Homo Sapiens
VNNKICLVE

SEQ ID NO: 597268 - protein, 9 aa, Homo Sapiens
KTTCKVSKI

SEQ ID NO: 597269 - protein, 9 aa, Homo Sapiens
WEAEARGSG

SEQ ID NO: 597270 - protein, 9 aa, Homo Sapiens
KTGEGEQKT

SEQ ID NO: 597271 - protein, 9 aa, Homo Sapiens
YKKQNSLSS

SEQ ID NO: 597272 - protein, 9 aa, Homo Sapiens
WDSGEVKLL

SEQ ID NO: 597273 - protein, 9 aa, Homo Sapiens
PPLSTLTLN

SEQ ID NO: 597274 - protein, 9 aa, Homo Sapiens
NSNGKACFG

SEQ ID NO: 597275 - protein, 9 aa, Homo Sapiens
PSCSISICC

SEQ ID NO: 597276 - protein, 9 aa, Homo Sapiens
TAYWTNFAK

SEQ ID NO: 597277 - protein, 9 aa, Homo Sapiens
AQLLQPSHF

SEQ ID NO: 597278 - protein, 9 aa, Homo Sapiens
MWVDRCLAF

SEQ ID NO: 597279 - protein, 9 aa, Homo Sapiens
LPQVTLDDD

SEQ ID NO: 597280 - protein, 9 aa, Homo Sapiens
FVMYENDNA

SEQ ID NO: 597281 - protein, 9 aa, Homo Sapiens
HHHHRHHHH

SEQ ID NO: 597282 - protein, 9 aa, Homo Sapiens
ENRQNSNGK

SEQ ID NO: 597283 - protein, 9 aa, Homo Sapiens
GILVQRQNK

SEQ ID NO: 597284 - protein, 9 aa, Homo Sapiens
VISPNFSCM

SEQ ID NO: 597285 - protein, 9 aa, Homo Sapiens
PDGSWYAIT

SEQ ID NO: 597286 - protein, 9 aa, Homo Sapiens
IAVKVDHIL

SEQ ID NO: 597287 - protein, 9 aa, Homo Sapiens
CLVETKVNR

SEQ ID NO: 597288 - protein, 9 aa, Homo Sapiens
LSAPAYSFR

SEQ ID NO: 597289 - protein, 9 aa, Homo Sapiens
SNGKACFGT

SEQ ID NO: 597290 - protein, 9 aa, Homo Sapiens
ARHHAWLVF

SEQ ID NO: 597291 - protein, 9 aa, Homo Sapiens
KLSAPAYSF

SEQ ID NO: 597292 - protein, 9 aa, Homo Sapiens
LRPQMHVNL

SEQ ID NO: 597293 - protein, 9 aa, Homo Sapiens
TDTEPQPCK

SEQ ID NO: 597294 - protein, 9 aa, Homo Sapiens
FLLIRKLYI

SEQ ID NO: 597295 - protein, 9 aa, Homo Sapiens
AATDPVAGF

SEQ ID NO: 597296 - protein, 9 aa, Homo Sapiens
WINETYLAQ

SEQ ID NO: 597297 - protein, 9 aa, Homo Sapiens
VDRIISQMV

SEQ ID NO: 597298 - protein, 9 aa, Homo Sapiens
VMYENDNAP

SEQ ID NO: 597299 - protein, 9 aa, Homo Sapiens
WAFTGHVQR

SEQ ID NO: 597300 - protein, 9 aa, Homo Sapiens
HAWLVFVFL

SEQ ID NO: 597301 - protein, 9 aa, Homo Sapiens
ANENRQNSN

SEQ ID NO: 597302 - protein, 9 aa, Homo Sapiens
LLNKHTGNI

SEQ ID NO: 597303 - protein, 9 aa, Homo Sapiens
KTKRENKTT

SEQ ID NO: 597304 - protein, 9 aa, Homo Sapiens
VFGGTTGYV

SEQ ID NO: 597305 - protein, 9 aa, Homo Sapiens
NLLLCALQT

SEQ ID NO: 597306 - protein, 9 aa, Homo Sapiens
HHRHHHHHR

SEQ ID NO: 597307 - protein, 9 aa, Homo Sapiens
EANTSPRLG

SEQ ID NO: 597308 - protein, 9 aa, Homo Sapiens
FSGIKVPEK

SEQ ID NO: 597309 - protein, 9 aa, Homo Sapiens
SLKRQYTEL

SEQ ID NO: 597310 - protein, 9 aa, Homo Sapiens
DRTVSKAMT

SEQ ID NO: 597311 - protein, 9 aa, Homo Sapiens
YMESRDSSG

SEQ ID NO: 597312 - protein, 9 aa, Homo Sapiens
TLTLNEADP

SEQ ID NO: 597313 - protein, 9 aa, Homo Sapiens
GSAVDQAGG

SEQ ID NO: 597314 - protein, 9 aa, Homo Sapiens
KVNHYLILP

SEQ ID NO: 597315 - protein, 9 aa, Homo Sapiens
SISICCRPS

SEQ ID NO: 597316 - protein, 9 aa, Homo Sapiens
ISPNFSCMG

SEQ ID NO: 597317 - protein, 9 aa, Homo Sapiens
SPNFSCMGQ

SEQ ID NO: 597318 - protein, 9 aa, Homo Sapiens
TVSLFVMYE

SEQ ID NO: 597319 - protein, 9 aa, Homo Sapiens
LTLNEADPS

SEQ ID NO: 597320 - protein, 9 aa, Homo Sapiens
GYVYSTDLH

SEQ ID NO: 597321 - protein, 9 aa, Homo Sapiens
YVLLGVLSF

SEQ ID NO: 597322 - protein, 9 aa, Homo Sapiens
GCYLKYKKQ

SEQ ID NO: 597323 - protein, 9 aa, Homo Sapiens
GGTTGYVYS

SEQ ID NO: 597324 - protein, 9 aa, Homo Sapiens
QLKLGSWGG

SEQ ID NO: 597325 - protein, 9 aa, Homo Sapiens
RLAATDPVA

SEQ ID NO: 597326 - protein, 9 aa, Homo Sapiens
AGAQEAQLL

SEQ ID NO: 597327 - protein, 9 aa, Homo Sapiens
QVTLDDDGE

SEQ ID NO: 597328 - protein, 9 aa, Homo Sapiens
QRQNKEVLA

SEQ ID NO: 597329 - protein, 9 aa, Homo Sapiens
GAGGAGPPT

SEQ ID NO: 597330 - protein, 9 aa, Homo Sapiens
IAFTMDLHS

SEQ ID NO: 597331 - protein, 9 aa, Homo Sapiens
KRQYTELLS

SEQ ID NO: 597332 - protein, 9 aa, Homo Sapiens
NKICLVETK

SEQ ID NO: 597333 - protein, 9 aa, Homo Sapiens
GQTFLQLSD

SEQ ID NO: 597334 - protein, 9 aa, Homo Sapiens
AEAGVPLPR

SEQ ID NO: 597335 - protein, 9 aa, Homo Sapiens
LGGRHGEFN

SEQ ID NO: 597336 - protein, 9 aa, Homo Sapiens
RQNSNGKAC

SEQ ID NO: 597337 - protein, 9 aa, Homo Sapiens
LGQTFLQLS

SEQ ID NO: 597338 - protein, 9 aa, Homo Sapiens
LKYKKQNSL

SEQ ID NO: 597339 - protein, 9 aa, Homo Sapiens
NPASPSNDC

SEQ ID NO: 597340 - protein, 9 aa, Homo Sapiens
LGGWEAEAR

SEQ ID NO: 597341 - protein, 9 aa, Homo Sapiens
LVQRQNKEV

SEQ ID NO: 597342 - protein, 9 aa, Homo Sapiens
GPKDLLPLV

SEQ ID NO: 597343 - protein, 9 aa, Homo Sapiens
STDELPTLS

SEQ ID NO: 597344 - protein, 9 aa, Homo Sapiens
IQQPQLQVI

SEQ ID NO: 597345 - protein, 9 aa, Homo Sapiens
IKKASFLLI

SEQ ID NO: 597346 - protein, 9 aa, Homo Sapiens
EARGSGDLE

SEQ ID NO: 597347 - protein, 9 aa, Homo Sapiens
LQNLLLCAL

SEQ ID NO: 597348 - protein, 9 aa, Homo Sapiens
TVSKAMTAY

SEQ ID NO: 597349 - protein, 9 aa, Homo Sapiens
NRQNSNGKA

SEQ ID NO: 597350 - protein, 9 aa, Homo Sapiens
KVDHILRHS

SEQ ID NO: 597351 - protein, 9 aa, Homo Sapiens
LLLCALQTI

SEQ ID NO: 597352 - protein, 9 aa, Homo Sapiens
IKVPEKSIN

SEQ ID NO: 597353 - protein, 9 aa, Homo Sapiens
MASLKRQYT

SEQ ID NO: 597354 - protein, 9 aa, Homo Sapiens
QGPKDLLPL

SEQ ID NO: 597355 - protein, 9 aa, Homo Sapiens
LALPQVTLD

SEQ ID NO: 597356 - protein, 9 aa, Homo Sapiens
RYMESRDSS

SEQ ID NO: 597357 - protein, 9 aa, Homo Sapiens
SGEVKLLQG

SEQ ID NO: 597358 - protein, 9 aa, Homo Sapiens
WYNPASPSN

SEQ ID NO: 597359 - protein, 9 aa, Homo Sapiens
HIKTDTEPQ

SEQ ID NO: 597360 - protein, 9 aa, Homo Sapiens
QERETSSHG

SEQ ID NO: 597361 - protein, 9 aa, Homo Sapiens
PVAGFNGKL

SEQ ID NO: 597362 - protein, 9 aa, Homo Sapiens
QQFFFFFFP

SEQ ID NO: 597363 - protein, 9 aa, Homo Sapiens
WVNNKICLV

SEQ ID NO: 597364 - protein, 9 aa, Homo Sapiens
GLQILNIVM

SEQ ID NO: 597365 - protein, 9 aa, Homo Sapiens
HILRHSLLL

SEQ ID NO: 597366 - protein, 9 aa, Homo Sapiens
TTFFSVGMP

SEQ ID NO: 597367 - protein, 9 aa, Homo Sapiens
EPQPCKGNE

SEQ ID NO: 597368 - protein, 9 aa, Homo Sapiens
NYCWCWELE

SEQ ID NO: 597369 - protein, 9 aa, Homo Sapiens
GCSQESADA

SEQ ID NO: 597370 - protein, 9 aa, Homo Sapiens
LSYSMNPKP

SEQ ID NO: 597371 - protein, 9 aa, Homo Sapiens
YDSHEGGSA

SEQ ID NO: 597372 - protein, 9 aa, Homo Sapiens
ICYDSHEGG

SEQ ID NO: 597373 - protein, 9 aa, Homo Sapiens
FFFPFFFLR

SEQ ID NO: 597374 - protein, 9 aa, Homo Sapiens
CHLQKVNHY

SEQ ID NO: 597375 - protein, 9 aa, Homo Sapiens
KHHHHRHHH

SEQ ID NO: 597376 - protein, 9 aa, Homo Sapiens
VYYFFSKRT

SEQ ID NO: 597377 - protein, 9 aa, Homo Sapiens
QAAEVTKAA

SEQ ID NO: 597378 - protein, 9 aa, Homo Sapiens
NEADPSSKA

SEQ ID NO: 597379 - protein, 9 aa, Homo Sapiens
EVKLLQGER

SEQ ID NO: 597380 - protein, 9 aa, Homo Sapiens
QLQVIAVPQ

SEQ ID NO: 597381 - protein, 9 aa, Homo Sapiens
ATDPVAGFN

SEQ ID NO: 597382 - protein, 9 aa, Homo Sapiens
IISQMVDPK

SEQ ID NO: 597383 - protein, 9 aa, Homo Sapiens
AAKGGAEAG

SEQ ID NO: 597384 - protein, 9 aa, Homo Sapiens
WYAITRKRS

SEQ ID NO: 597385 - protein, 9 aa, Homo Sapiens
QPCKGNEYG

SEQ ID NO: 597386 - protein, 9 aa, Homo Sapiens
FFFFFFPFF

SEQ ID NO: 597387 - protein, 9 aa, Homo Sapiens
KASFLLIRK

SEQ ID NO: 597388 - protein, 9 aa, Homo Sapiens
KLGLQILNI

SEQ ID NO: 597389 - protein, 9 aa, Homo Sapiens
IKVLHDPSG

SEQ ID NO: 597390 - protein, 9 aa, Homo Sapiens
MSYLRPQMH

SEQ ID NO: 597391 - protein, 9 aa, Homo Sapiens
RHGEFNFLP

SEQ ID NO: 597392 - protein, 9 aa, Homo Sapiens
GEFNFLPPP

SEQ ID NO: 597393 - protein, 9 aa, Homo Sapiens
VDRCLAFTE

SEQ ID NO: 597394 - protein, 9 aa, Homo Sapiens
EGGSAVDQA

SEQ ID NO: 597395 - protein, 9 aa, Homo Sapiens
IQIKVLHDP

SEQ ID NO: 597396 - protein, 9 aa, Homo Sapiens
QAGAQEAQL

SEQ ID NO: 597397 - protein, 9 aa, Homo Sapiens
GEGEQKTKR

SEQ ID NO: 597398 - protein, 9 aa, Homo Sapiens
QQLALPQVT

SEQ ID NO: 597399 - protein, 9 aa, Homo Sapiens
PEIGCSQES

SEQ ID NO: 597400 - protein, 9 aa, Homo Sapiens
RQNKEVLAT

SEQ ID NO: 597401 - protein, 9 aa, Homo Sapiens
AQQLALPQV

SEQ ID NO: 597402 - protein, 9 aa, Homo Sapiens
PFFFLRRSL

SEQ ID NO: 597403 - protein, 9 aa, Homo Sapiens
IFFPIKVIN

SEQ ID NO: 597404 - protein, 9 aa, Homo Sapiens
EDIKKASFL

SEQ ID NO: 597405 - protein, 9 aa, Homo Sapiens
QMVDPKLNH

SEQ ID NO: 597406 - protein, 9 aa, Homo Sapiens
NKSQLKLGS

SEQ ID NO: 597407 - protein, 9 aa, Homo Sapiens
GEQKTKREN

SEQ ID NO: 597408 - protein, 9 aa, Homo Sapiens
EIGCSQESA

SEQ ID NO: 597409 - protein, 9 aa, Homo Sapiens
RPMYVLLGV

SEQ ID NO: 597410 - protein, 9 aa, Homo Sapiens
TLELQNLLL

SEQ ID NO: 597411 - protein, 9 aa, Homo Sapiens
EGEQKTKRE

SEQ ID NO: 597412 - protein, 9 aa, Homo Sapiens
DIAVKVDHI

SEQ ID NO: 597413 - protein, 9 aa, Homo Sapiens
FFPIKVINS

SEQ ID NO: 597414 - protein, 9 aa, Homo Sapiens
VLLGVLSFL

SEQ ID NO: 597415 - protein, 9 aa, Homo Sapiens
ILNIVMVTT

SEQ ID NO: 597416 - protein, 9 aa, Homo Sapiens
MNYCWCWEL

SEQ ID NO: 597417 - protein, 9 aa, Homo Sapiens
FTMDLHSDD

SEQ ID NO: 597418 - protein, 9 aa, Homo Sapiens
AKGGAEAGV

SEQ ID NO: 597419 - protein, 9 aa, Homo Sapiens
MDLHSDDQD

SEQ ID NO: 597420 - protein, 9 aa, Homo Sapiens
KLCARPMYV

SEQ ID NO: 597421 - protein, 9 aa, Homo Sapiens
HTGNITFET

SEQ ID NO: 597422 - protein, 9 aa, Homo Sapiens
SSHGQGRYP

SEQ ID NO: 597423 - protein, 9 aa, Homo Sapiens
LGSWGGNVA

SEQ ID NO: 597424 - protein, 9 aa, Homo Sapiens
CYLKYKKQN

SEQ ID NO: 597425 - protein, 9 aa, Homo Sapiens
KQAAEVTKA

SEQ ID NO: 597426 - protein, 9 aa, Homo Sapiens
RCLAFTEEK

SEQ ID NO: 597427 - protein, 9 aa, Homo Sapiens
SHILWAFTG

SEQ ID NO: 597428 - protein, 9 aa, Homo Sapiens
VSKAMTAYW

SEQ ID NO: 597429 - protein, 9 aa, Homo Sapiens
LGLQILNIV

SEQ ID NO: 597430 - protein, 9 aa, Homo Sapiens
RHHAWLVFV

SEQ ID NO: 597431 - protein, 9 aa, Homo Sapiens
VLQDSQDRC

SEQ ID NO: 597432 - protein, 9 aa, Homo Sapiens
LKRQYTELL

SEQ ID NO: 597433 - protein, 9 aa, Homo Sapiens
PSNDCSLGQ

SEQ ID NO: 597434 - protein, 9 aa, Homo Sapiens
ALRTIWSSG

SEQ ID NO: 597435 - protein, 9 aa, Homo Sapiens
SKILEGKDY

SEQ ID NO: 597436 - protein, 9 aa, Homo Sapiens
HDPSGVFHF

SEQ ID NO: 597437 - protein, 9 aa, Homo Sapiens
EITTFFSVG

SEQ ID NO: 597438 - protein, 9 aa, Homo Sapiens
LQIQQPQLQ

SEQ ID NO: 597439 - protein, 9 aa, Homo Sapiens
ETQPEIGCS

SEQ ID NO: 597440 - protein, 9 aa, Homo Sapiens
PQPCKGNEY

SEQ ID NO: 597441 - protein, 9 aa, Homo Sapiens
CLAFTEEKA

SEQ ID NO: 597442 - protein, 9 aa, Homo Sapiens
VDHILRHSL

SEQ ID NO: 597443 - protein, 9 aa, Homo Sapiens
QEAQLLQPS

SEQ ID NO: 597444 - protein, 9 aa, Homo Sapiens
KWFSGIKVP

SEQ ID NO: 597445 - protein, 9 aa, Homo Sapiens
WLVFVFLVE

SEQ ID NO: 597446 - protein, 9 aa, Homo Sapiens
KVLHDPSGV

SEQ ID NO: 597447 - protein, 9 aa, Homo Sapiens
LVFVFLVEM

SEQ ID NO: 597448 - protein, 9 aa, Homo Sapiens
GPMWMSYLR

SEQ ID NO: 597449 - protein, 9 aa, Homo Sapiens
TDPVAGFNG

SEQ ID NO: 597450 - protein, 9 aa, Homo Sapiens
YKLLNKHTG

SEQ ID NO: 597451 - protein, 9 aa, Homo Sapiens
GHKKQAAEV

SEQ ID NO: 597452 - protein, 9 aa, Homo Sapiens
KTVYHIFFP

SEQ ID NO: 597453 - protein, 9 aa, Homo Sapiens
CWELEAGFP

SEQ ID NO: 597454 - protein, 9 aa, Homo Sapiens
LAATDPVAG

SEQ ID NO: 597455 - protein, 9 aa, Homo Sapiens
TGEGEQKTK

SEQ ID NO: 597456 - protein, 9 aa, Homo Sapiens
CYDSHEGGS

SEQ ID NO: 597457 - protein, 9 aa, Homo Sapiens
QYTELLSDI

SEQ ID NO: 597458 - protein, 9 aa, Homo Sapiens
HHHRHHHHH

SEQ ID NO: 597459 - protein, 9 aa, Homo Sapiens
SNDCSLGQS

SEQ ID NO: 597460 - protein, 9 aa, Homo Sapiens
PQGPKDLLP

SEQ ID NO: 597461 - protein, 9 aa, Homo Sapiens
NSMDIFKCQ

SEQ ID NO: 597462 - protein, 9 aa, Homo Sapiens
GEVKLLQGE

SEQ ID NO: 597463 - protein, 9 aa, Homo Sapiens
INETYLAQN

SEQ ID NO: 597464 - protein, 9 aa, Homo Sapiens
KLGSWGGNV

SEQ ID NO: 597465 - protein, 9 aa, Homo Sapiens
AMTAYWTNF

SEQ ID NO: 597466 - protein, 9 aa, Homo Sapiens
GVISPNFSC

SEQ ID NO: 597467 - protein, 9 aa, Homo Sapiens
AFTGHVQRQ

SEQ ID NO: 597468 - protein, 9 aa, Homo Sapiens
YLAQNVIIF

SEQ ID NO: 597469 - protein, 9 aa, Homo Sapiens
ILEGKDYIF

SEQ ID NO: 597470 - protein, 9 aa, Homo Sapiens
DPVAGFNGK

SEQ ID NO: 597471 - protein, 9 aa, Homo Sapiens
QLQIQQPQL

SEQ ID NO: 597472 - protein, 9 aa, Homo Sapiens
KILEGKDYI

SEQ ID NO: 597473 - protein, 9 aa, Homo Sapiens
LQKVNHYLI

SEQ ID NO: 597474 - protein, 9 aa, Homo Sapiens
SMDIFKCQQ

SEQ ID NO: 597475 - protein, 9 aa, Homo Sapiens
GAEAGVPLP

SEQ ID NO: 597476 - protein, 9 aa, Homo Sapiens
CSQESADAA

SEQ ID NO: 597477 - protein, 9 aa, Homo Sapiens
DPSGVFHFM

SEQ ID NO: 597478 - protein, 9 aa, Homo Sapiens
SKRTTSLIL

SEQ ID NO: 597479 - protein, 9 aa, Homo Sapiens
SWYAITRKR

SEQ ID NO: 597480 - protein, 9 aa, Homo Sapiens
TVYHIFFPI

SEQ ID NO: 597481 - protein, 9 aa, Homo Sapiens
YHIFFPIKV

SEQ ID NO: 597482 - protein, 9 aa, Homo Sapiens
CKVSKILEG

SEQ ID NO: 597483 - protein, 9 aa, Homo Sapiens
TFFSVGMPG

SEQ ID NO: 597484 - protein, 9 aa, Homo Sapiens
CHPSCSISI

SEQ ID NO: 597485 - protein, 9 aa, Homo Sapiens
ETYLAQNVI

SEQ ID NO: 597486 - protein, 9 aa, Homo Sapiens
ERETSSHGQ

SEQ ID NO: 597487 - protein, 9 aa, Homo Sapiens
SRYMESRDS

SEQ ID NO: 597488 - protein, 9 aa, Homo Sapiens
KHTPTKLSA

SEQ ID NO: 597489 - protein, 9 aa, Homo Sapiens
ENSMDIFKC

SEQ ID NO: 597490 - protein, 9 aa, Homo Sapiens
FFFFPFFFL

SEQ ID NO: 597491 - protein, 9 aa, Homo Sapiens
NFSCMGQLL

SEQ ID NO: 597492 - protein, 9 aa, Homo Sapiens
ETLELQNLL

SEQ ID NO: 597493 - protein, 9 aa, Homo Sapiens
PNLSRYMES

SEQ ID NO: 597494 - protein, 9 aa, Homo Sapiens
QNSLSSKLP

SEQ ID NO: 597495 - protein, 9 aa, Homo Sapiens
EAGVPLPRG

SEQ ID NO: 597496 - protein, 9 aa, Homo Sapiens
EPNRSENSM

SEQ ID NO: 597497 - protein, 9 aa, Homo Sapiens
PKHHHHRHH

SEQ ID NO: 597498 - protein, 9 aa, Homo Sapiens
AITRKRSEG

SEQ ID NO: 597499 - protein, 9 aa, Homo Sapiens
LWAFTGHVQ

SEQ ID NO: 597500 - protein, 9 aa, Homo Sapiens
PQLQVIAVP

SEQ ID NO: 597501 - protein, 9 aa, Homo Sapiens
KLLNKHTGN

SEQ ID NO: 597502 - protein, 9 aa, Homo Sapiens
HKKQAAEVT

SEQ ID NO: 597503 - protein, 9 aa, Homo Sapiens
VEITTFFSV

SEQ ID NO: 597504 - protein, 9 aa, Homo Sapiens
QGHKKQAAE

SEQ ID NO: 597505 - protein, 9 aa, Homo Sapiens
PMYVLLGVL

SEQ ID NO: 597506 - protein, 9 aa, Homo Sapiens
KKASFLLIR

SEQ ID NO: 597507 - protein, 9 aa, Homo Sapiens
EVLQDSQDR

SEQ ID NO: 597508 - protein, 9 aa, Homo Sapiens
VLHDPSGVF

SEQ ID NO: 597509 - protein, 9 aa, Homo Sapiens
QNSNGKACF

SEQ ID NO: 597510 - protein, 9 aa, Homo Sapiens
TCKVSKILE

SEQ ID NO: 597511 - protein, 9 aa, Homo Sapiens
RSENSMDIF

SEQ ID NO: 597512 - protein, 9 aa, Homo Sapiens
TLNEADPSS

SEQ ID NO: 597513 - protein, 9 aa, Homo Sapiens
EMASLKRQY

SEQ ID NO: 597514 - protein, 9 aa, Homo Sapiens
LPTLSYSMN

SEQ ID NO: 597515 - protein, 9 aa, Homo Sapiens
YCWCWELEA

SEQ ID NO: 597516 - protein, 9 aa, Homo Sapiens
FNFLPPPGY

SEQ ID NO: 597517 - protein, 9 aa, Homo Sapiens
VSKILEGKD

SEQ ID NO: 597518 - protein, 9 aa, Homo Sapiens
VKLLQGERY

SEQ ID NO: 597519 - protein, 9 aa, Homo Sapiens
GIKVPEKSI

SEQ ID NO: 597520 - protein, 9 aa, Homo Sapiens
AEARGSGDL

SEQ ID NO: 597521 - protein, 9 aa, Homo Sapiens
ARLAATDPV

SEQ ID NO: 597522 - protein, 9 aa, Homo Sapiens
AYILHPKTV

SEQ ID NO: 597523 - protein, 9 aa, Homo Sapiens
FPFFFLRRS

SEQ ID NO: 597524 - protein, 9 aa, Homo Sapiens
GAQEAQLLQ

SEQ ID NO: 597525 - protein, 9 aa, Homo Sapiens
PEVLQDSQD

SEQ ID NO: 597526 - protein, 9 aa, Homo Sapiens
TTGYVYSTD

SEQ ID NO: 597527 - protein, 9 aa, Homo Sapiens
AQNVIIFAS

SEQ ID NO: 597528 - protein, 9 aa, Homo Sapiens
GWEAEARGS

SEQ ID NO: 597529 - protein, 9 aa, Homo Sapiens
SDIAVKVDH

SEQ ID NO: 597530 - protein, 9 aa, Homo Sapiens
FFPFFFLRR

SEQ ID NO: 597531 - protein, 9 aa, Homo Sapiens
FFSKRTTSL

SEQ ID NO: 597532 - protein, 9 aa, Homo Sapiens
LSRYMESRD

SEQ ID NO: 597533 - protein, 9 aa, Homo Sapiens
GRGQERETS

SEQ ID NO: 597534 - protein, 9 aa, Homo Sapiens
DELPTLSYS

SEQ ID NO: 597535 - protein, 9 aa, Homo Sapiens
RKKQGHKKQ

SEQ ID NO: 597536 - protein, 9 aa, Homo Sapiens
ELEAGFPSY

SEQ ID NO: 597537 - protein, 9 aa, Homo Sapiens
ITTFFSVGM

SEQ ID NO: 597538 - protein, 9 aa, Homo Sapiens
YENDNAPTV

SEQ ID NO: 597539 - protein, 9 aa, Homo Sapiens
DAYILHPKT

SEQ ID NO: 597540 - protein, 9 aa, Homo Sapiens
QPQLQVIAV

SEQ ID NO: 597541 - protein, 9 aa, Homo Sapiens
PQVTLDDDG

SEQ ID NO: 597542 - protein, 9 aa, Homo Sapiens
HRHHHHHRH

SEQ ID NO: 597543 - protein, 9 aa, Homo Sapiens
ARGSGDLET

SEQ ID NO: 597544 - protein, 9 aa, Homo Sapiens
FPQGPKDLL

SEQ ID NO: 597545 - protein, 9 aa, Homo Sapiens
FMNYCWCWE

SEQ ID NO: 597546 - protein, 9 aa, Homo Sapiens
KQGHKKQAA

SEQ ID NO: 597547 - protein, 9 aa, Homo Sapiens
KHTGNITFE

SEQ ID NO: 597548 - protein, 9 aa, Homo Sapiens
YVYSTDLHK

SEQ ID NO: 597549 - protein, 9 aa, Homo Sapiens
ASFLLIRKL

SEQ ID NO: 597550 - protein, 9 aa, Homo Sapiens
VSLFVMYEN

SEQ ID NO: 597551 - protein, 9 aa, Homo Sapiens
SGIKVPEKS

SEQ ID NO: 597552 - protein, 9 aa, Homo Sapiens
RPQMHVNLA

SEQ ID NO: 597553 - protein, 9 aa, Homo Sapiens
VKVDHILRH

SEQ ID NO: 597554 - protein, 9 aa, Homo Sapiens
HLQKVNHYL

SEQ ID NO: 597555 - protein, 9 aa, Homo Sapiens
QIQQPQLQV

SEQ ID NO: 597556 - protein, 9 aa, Homo Sapiens
PKDLLPLVE

SEQ ID NO: 597557 - protein, 9 aa, Homo Sapiens
ASLKRQYTE

SEQ ID NO: 597558 - protein, 9 aa, Homo Sapiens
GVPLPRGDL

SEQ ID NO: 597559 - protein, 9 aa, Homo Sapiens
YLKYKKQNS

SEQ ID NO: 597560 - protein, 9 aa, Homo Sapiens
LHSDDQDLT

SEQ ID NO: 597561 - protein, 9 aa, Homo Sapiens
RKMWVDRCL

SEQ ID NO: 597562 - protein, 9 aa, Homo Sapiens
LLQPSHFLD

SEQ ID NO: 597563 - protein, 9 aa, Homo Sapiens
SPSNDCSLG

SEQ ID NO: 597564 - protein, 9 aa, Homo Sapiens
PTLSYSMNP

SEQ ID NO: 597565 - protein, 9 aa, Homo Sapiens
KSQLKLGSW

SEQ ID NO: 597566 - protein, 9 aa, Homo Sapiens
YYFFSKRTT

SEQ ID NO: 597567 - protein, 9 aa, Homo Sapiens
RETSSHGQG

SEQ ID NO: 597568 - protein, 9 aa, Homo Sapiens
HTPTKLSAP

SEQ ID NO: 597569 - protein, 9 aa, Homo Sapiens
ETSSHGQGR

SEQ ID NO: 597570 - protein, 9 aa, Homo Sapiens
RKLGLRPPA

SEQ ID NO: 597571 - protein, 9 aa, Homo Sapiens
TPVVLPPDH

SEQ ID NO: 597572 - protein, 9 aa, Homo Sapiens
SASPTCASP

SEQ ID NO: 597573 - protein, 9 aa, Homo Sapiens
FITVFYTII

SEQ ID NO: 597574 - protein, 9 aa, Homo Sapiens
PAGTVEKCV

SEQ ID NO: 597575 - protein, 9 aa, Homo Sapiens
PERSGELHL

SEQ ID NO: 597576 - protein, 9 aa, Homo Sapiens
AALNMPSSG

SEQ ID NO: 597577 - protein, 9 aa, Homo Sapiens
ERSGELHLE

SEQ ID NO: 597578 - protein, 9 aa, Homo Sapiens
LGNAITFSI

SEQ ID NO: 597579 - protein, 9 aa, Homo Sapiens
SKEPELLIS

SEQ ID NO: 597580 - protein, 9 aa, Homo Sapiens
LKFRKLIYY

SEQ ID NO: 597581 - protein, 9 aa, Homo Sapiens
GGGLRAGSR

SEQ ID NO: 597582 - protein, 9 aa, Homo Sapiens
VPYHHYEPF

SEQ ID NO: 597583 - protein, 9 aa, Homo Sapiens
ERASGLPSG

SEQ ID NO: 597584 - protein, 9 aa, Homo Sapiens
LVESDQRLP

SEQ ID NO: 597585 - protein, 9 aa, Homo Sapiens
PEDLRKQVV

SEQ ID NO: 597586 - protein, 9 aa, Homo Sapiens
LRGILQFEY

SEQ ID NO: 597587 - protein, 9 aa, Homo Sapiens
NMPSSGDIR

SEQ ID NO: 597588 - protein, 9 aa, Homo Sapiens
NQKTMPLSS

SEQ ID NO: 597589 - protein, 9 aa, Homo Sapiens
HFDSLVRST

SEQ ID NO: 597590 - protein, 9 aa, Homo Sapiens
FPTDKFITV

SEQ ID NO: 597591 - protein, 9 aa, Homo Sapiens
DAYEPPVQE

SEQ ID NO: 597592 - protein, 9 aa, Homo Sapiens
PPEELQTPG

SEQ ID NO: 597593 - protein, 9 aa, Homo Sapiens
MINVSNLYV

SEQ ID NO: 597594 - protein, 9 aa, Homo Sapiens
LGFLVNYIL

SEQ ID NO: 597595 - protein, 9 aa, Homo Sapiens
AVRDMRQSV

SEQ ID NO: 597596 - protein, 9 aa, Homo Sapiens
LERLYVTVM

SEQ ID NO: 597597 - protein, 9 aa, Homo Sapiens
LHRYKSLLL

SEQ ID NO: 597598 - protein, 9 aa, Homo Sapiens
VESRMINVS

SEQ ID NO: 597599 - protein, 9 aa, Homo Sapiens
AQDYVLTCN

SEQ ID NO: 597600 - protein, 9 aa, Homo Sapiens
HCPEALEQL

SEQ ID NO: 597601 - protein, 9 aa, Homo Sapiens
DLRKQVVPL

SEQ ID NO: 597602 - protein, 9 aa, Homo Sapiens
AYKFRTHCP

SEQ ID NO: 597603 - protein, 9 aa, Homo Sapiens
HIDESGKMR

SEQ ID NO: 597604 - protein, 9 aa, Homo Sapiens
FNKAKFIGF

SEQ ID NO: 597605 - protein, 9 aa, Homo Sapiens
DWCPSKKRK

SEQ ID NO: 597606 - protein, 9 aa, Homo Sapiens
DHIDESGKM

SEQ ID NO: 597607 - protein, 9 aa, Homo Sapiens
GELKHGHPW

SEQ ID NO: 597608 - protein, 9 aa, Homo Sapiens
QGLIYFMST

SEQ ID NO: 597609 - protein, 9 aa, Homo Sapiens
KKQVLKTLR

SEQ ID NO: 597610 - protein, 9 aa, Homo Sapiens
GTTTYPGIA

SEQ ID NO: 597611 - protein, 9 aa, Homo Sapiens
PVVLPPDHA

SEQ ID NO: 597612 - protein, 9 aa, Homo Sapiens
PFGEAKKNS

SEQ ID NO: 597613 - protein, 9 aa, Homo Sapiens
VRSTNLLFI

SEQ ID NO: 597614 - protein, 9 aa, Homo Sapiens
YRQGDLELK

SEQ ID NO: 597615 - protein, 9 aa, Homo Sapiens
MLINDADWE

SEQ ID NO: 597616 - protein, 9 aa, Homo Sapiens
MWRSQPVRL

SEQ ID NO: 597617 - protein, 9 aa, Homo Sapiens
HVPNLFCLQ

SEQ ID NO: 597618 - protein, 9 aa, Homo Sapiens
INVMKQLIA

SEQ ID NO: 597619 - protein, 9 aa, Homo Sapiens
ASPTCASPP

SEQ ID NO: 597620 - protein, 9 aa, Homo Sapiens
GILQFEYVS

SEQ ID NO: 597621 - protein, 9 aa, Homo Sapiens
RLTFPFGEA

SEQ ID NO: 597622 - protein, 9 aa, Homo Sapiens
KFITVFYTI

SEQ ID NO: 597623 - protein, 9 aa, Homo Sapiens
GKLVESDQR

SEQ ID NO: 597624 - protein, 9 aa, Homo Sapiens
AGASPGGGI

SEQ ID NO: 597625 - protein, 9 aa, Homo Sapiens
LKHGHPWNT

SEQ ID NO: 597626 - protein, 9 aa, Homo Sapiens
KSLLLQVSE

SEQ ID NO: 597627 - protein, 9 aa, Homo Sapiens
CLQLCGAGF

SEQ ID NO: 597628 - protein, 9 aa, Homo Sapiens
FVLERLYVT

SEQ ID NO: 597629 - protein, 9 aa, Homo Sapiens
GGERSWRRR

SEQ ID NO: 597630 - protein, 9 aa, Homo Sapiens
MTKDDPKPG

SEQ ID NO: 597631 - protein, 9 aa, Homo Sapiens
RTLFASSVH

SEQ ID NO: 597632 - protein, 9 aa, Homo Sapiens
HHRGKLVES

SEQ ID NO: 597633 - protein, 9 aa, Homo Sapiens
GLIYFMSTG

SEQ ID NO: 597634 - protein, 9 aa, Homo Sapiens
FPFGEAKKN

SEQ ID NO: 597635 - protein, 9 aa, Homo Sapiens
RKTYFSSPK

SEQ ID NO: 597636 - protein, 9 aa, Homo Sapiens
QAGLVAMVI

SEQ ID NO: 597637 - protein, 9 aa, Homo Sapiens
CWQPRIGQR

SEQ ID NO: 597638 - protein, 9 aa, Homo Sapiens
HAQDYVLTC

SEQ ID NO: 597639 - protein, 9 aa, Homo Sapiens
LPTLPPNTS

SEQ ID NO: 597640 - protein, 9 aa, Homo Sapiens
QRPGQGLPT

SEQ ID NO: 597641 - protein, 9 aa, Homo Sapiens
LSAQPQVTM

SEQ ID NO: 597642 - protein, 9 aa, Homo Sapiens
RFVLERLYV

SEQ ID NO: 597643 - protein, 9 aa, Homo Sapiens
RGYKGQYCE

SEQ ID NO: 597644 - protein, 9 aa, Homo Sapiens
GSRLPDTGE

SEQ ID NO: 597645 - protein, 9 aa, Homo Sapiens
ELKKQVQFQ

SEQ ID NO: 597646 - protein, 9 aa, Homo Sapiens
STSTMSKEP

SEQ ID NO: 597647 - protein, 9 aa, Homo Sapiens
SGQLSGERA

SEQ ID NO: 597648 - protein, 9 aa, Homo Sapiens
CPEALEQLY

SEQ ID NO: 597649 - protein, 9 aa, Homo Sapiens
AGEIYLKIQ

SEQ ID NO: 597650 - protein, 9 aa, Homo Sapiens
VLKTLRKFL

SEQ ID NO: 597651 - protein, 9 aa, Homo Sapiens
KDHIDESGK

SEQ ID NO: 597652 - protein, 9 aa, Homo Sapiens
LQTPGAVRV

SEQ ID NO: 597653 - protein, 9 aa, Homo Sapiens
EKCVQKFIE

SEQ ID NO: 597654 - protein, 9 aa, Homo Sapiens
QSDWCPSKK

SEQ ID NO: 597655 - protein, 9 aa, Homo Sapiens
TDSGYSILQ

SEQ ID NO: 597656 - protein, 9 aa, Homo Sapiens
QSVAVGVIK

SEQ ID NO: 597657 - protein, 9 aa, Homo Sapiens
FGKNRANVL

SEQ ID NO: 597658 - protein, 9 aa, Homo Sapiens
KLGLRPPAS

SEQ ID NO: 597659 - protein, 9 aa, Homo Sapiens
ERADAYEPP

SEQ ID NO: 597660 - protein, 9 aa, Homo Sapiens
TLFASSVHN

SEQ ID NO: 597661 - protein, 9 aa, Homo Sapiens
IPVHAFNGR

SEQ ID NO: 597662 - protein, 9 aa, Homo Sapiens
YKFRTHCPE

SEQ ID NO: 597663 - protein, 9 aa, Homo Sapiens
GGICWQPRI

SEQ ID NO: 597664 - protein, 9 aa, Homo Sapiens
LELKFRKLI

SEQ ID NO: 597665 - protein, 9 aa, Homo Sapiens
AYILQGGIC

SEQ ID NO: 597666 - protein, 9 aa, Homo Sapiens
GDILHRYKS

SEQ ID NO: 597667 - protein, 9 aa, Homo Sapiens
LLLLQILGN

SEQ ID NO: 597668 - protein, 9 aa, Homo Sapiens
SRKTYFSSP

SEQ ID NO: 597669 - protein, 9 aa, Homo Sapiens
EAGASPGGG

SEQ ID NO: 597670 - protein, 9 aa, Homo Sapiens
QYGGRVTDG

SEQ ID NO: 597671 - protein, 9 aa, Homo Sapiens
AEGVGLTVT

SEQ ID NO: 597672 - protein, 9 aa, Homo Sapiens
WYRQGDLEL

SEQ ID NO: 597673 - protein, 9 aa, Homo Sapiens
LLRKLGLRP

SEQ ID NO: 597674 - protein, 9 aa, Homo Sapiens
GGLRAGSRL

SEQ ID NO: 597675 - protein, 9 aa, Homo Sapiens
RKKQVLKTL

SEQ ID NO: 597676 - protein, 9 aa, Homo Sapiens
IPILDVECE

SEQ ID NO: 597677 - protein, 9 aa, Homo Sapiens
RFLAEPERS

SEQ ID NO: 597678 - protein, 9 aa, Homo Sapiens
IQWERILNL

SEQ ID NO: 597679 - protein, 9 aa, Homo Sapiens
LTLPAPTST

SEQ ID NO: 597680 - protein, 9 aa, Homo Sapiens
DESGKMRKK

SEQ ID NO: 597681 - protein, 9 aa, Homo Sapiens
LRFVLERLY

SEQ ID NO: 597682 - protein, 9 aa, Homo Sapiens
HYEPFGPDE

SEQ ID NO: 597683 - protein, 9 aa, Homo Sapiens
VERADAYEP

SEQ ID NO: 597684 - protein, 9 aa, Homo Sapiens
TVHNTTYKK

SEQ ID NO: 597685 - protein, 9 aa, Homo Sapiens
DSLVRSTNL

SEQ ID NO: 597686 - protein, 9 aa, Homo Sapiens
SVRPGILML

SEQ ID NO: 597687 - protein, 9 aa, Homo Sapiens
ILSQDSFYC

SEQ ID NO: 597688 - protein, 9 aa, Homo Sapiens
VHHRGKLVE

SEQ ID NO: 597689 - protein, 9 aa, Homo Sapiens
AGLVAMVIV

SEQ ID NO: 597690 - protein, 9 aa, Homo Sapiens
VHNTTYKKK

SEQ ID NO: 597691 - protein, 9 aa, Homo Sapiens
VFLYDTDSG

SEQ ID NO: 597692 - protein, 9 aa, Homo Sapiens
QFEYVSYGI

SEQ ID NO: 597693 - protein, 9 aa, Homo Sapiens
AEPERSGEL

SEQ ID NO: 597694 - protein, 9 aa, Homo Sapiens
TSTMSKEPE

SEQ ID NO: 597695 - protein, 9 aa, Homo Sapiens
QGDLELKFR

SEQ ID NO: 597696 - protein, 9 aa, Homo Sapiens
SCFCGELKH

SEQ ID NO: 597697 - protein, 9 aa, Homo Sapiens
LNMPSSGDI

SEQ ID NO: 597698 - protein, 9 aa, Homo Sapiens
LRKLGLRPP

SEQ ID NO: 597699 - protein, 9 aa, Homo Sapiens
FAVRDMRQS

SEQ ID NO: 597700 - protein, 9 aa, Homo Sapiens
GGGIYNNCS

SEQ ID NO: 597701 - protein, 9 aa, Homo Sapiens
ILGFLVNYI

SEQ ID NO: 597702 - protein, 9 aa, Homo Sapiens
NFPTDKFIT

SEQ ID NO: 597703 - protein, 9 aa, Homo Sapiens
PGGGIYNNC

SEQ ID NO: 597704 - protein, 9 aa, Homo Sapiens
SPTCASPPV

SEQ ID NO: 597705 - protein, 9 aa, Homo Sapiens
LQMSGAGEI

SEQ ID NO: 597706 - protein, 9 aa, Homo Sapiens
VELKKQVQF

SEQ ID NO: 597707 - protein, 9 aa, Homo Sapiens
GERASGLPS

SEQ ID NO: 597708 - protein, 9 aa, Homo Sapiens
FSGQLSGER

SEQ ID NO: 597709 - protein, 9 aa, Homo Sapiens
KLLTNETST

SEQ ID NO: 597710 - protein, 9 aa, Homo Sapiens
RPGQGLPTL

SEQ ID NO: 597711 - protein, 9 aa, Homo Sapiens
RSTNLLFIV

SEQ ID NO: 597712 - protein, 9 aa, Homo Sapiens
KGKNITPVV

SEQ ID NO: 597713 - protein, 9 aa, Homo Sapiens
TTYPGIADR

SEQ ID NO: 597714 - protein, 9 aa, Homo Sapiens
KFLQMSGAG

SEQ ID NO: 597715 - protein, 9 aa, Homo Sapiens
GVKGIPGSQ

SEQ ID NO: 597716 - protein, 9 aa, Homo Sapiens
LTNETSTDN

SEQ ID NO: 597717 - protein, 9 aa, Homo Sapiens
WDMKINCSG

SEQ ID NO: 597718 - protein, 9 aa, Homo Sapiens
FSSPKYGEG

SEQ ID NO: 597719 - protein, 9 aa, Homo Sapiens
PVHAFNGRR

SEQ ID NO: 597720 - protein, 9 aa, Homo Sapiens
GQLSGERAS

SEQ ID NO: 597721 - protein, 9 aa, Homo Sapiens
EQSQSLTLP

SEQ ID NO: 597722 - protein, 9 aa, Homo Sapiens
QDSFYCVLT

SEQ ID NO: 597723 - protein, 9 aa, Homo Sapiens
VMKQLIASS

SEQ ID NO: 597724 - protein, 9 aa, Homo Sapiens
LGLRPPASG

SEQ ID NO: 597725 - protein, 9 aa, Homo Sapiens
GILMLINDA

SEQ ID NO: 597726 - protein, 9 aa, Homo Sapiens
FASSVHNLT

SEQ ID NO: 597727 - protein, 9 aa, Homo Sapiens
GIYNNCSPV

SEQ ID NO: 597728 - protein, 9 aa, Homo Sapiens
SQDSFYCVL

SEQ ID NO: 597729 - protein, 9 aa, Homo Sapiens
KTLRKFLQM

SEQ ID NO: 597730 - protein, 9 aa, Homo Sapiens
SSLFVDQPG

SEQ ID NO: 597731 - protein, 9 aa, Homo Sapiens
EDLRKQVVP

SEQ ID NO: 597732 - protein, 9 aa, Homo Sapiens
TKDDPKPGL

SEQ ID NO: 597733 - protein, 9 aa, Homo Sapiens
KLEEDSDDL

SEQ ID NO: 597734 - protein, 9 aa, Homo Sapiens
LLGAMAATP

SEQ ID NO: 597735 - protein, 9 aa, Homo Sapiens
PSVPYHHYE

SEQ ID NO: 597736 - protein, 9 aa, Homo Sapiens
YDGCAYRKG

SEQ ID NO: 597737 - protein, 9 aa, Homo Sapiens
PRGYKGQYC

SEQ ID NO: 597738 - protein, 9 aa, Homo Sapiens
KTYFSSPKY

SEQ ID NO: 597739 - protein, 9 aa, Homo Sapiens
QEHPGLGGE

SEQ ID NO: 597740 - protein, 9 aa, Homo Sapiens
AYRKGYEKT

SEQ ID NO: 597741 - protein, 9 aa, Homo Sapiens
PLSSLFVDQ

SEQ ID NO: 597742 - protein, 9 aa, Homo Sapiens
KAKFIGFTM

SEQ ID NO: 597743 - protein, 9 aa, Homo Sapiens
RYKSLLLQV

SEQ ID NO: 597744 - protein, 9 aa, Homo Sapiens
EDSDDLLED

SEQ ID NO: 597745 - protein, 9 aa, Homo Sapiens
RADAYEPPV

SEQ ID NO: 597746 - protein, 9 aa, Homo Sapiens
ETAEGVGLT

SEQ ID NO: 597747 - protein, 9 aa, Homo Sapiens
GKNITPVVL

SEQ ID NO: 597748 - protein, 9 aa, Homo Sapiens
CSDIPKLEE

SEQ ID NO: 597749 - protein, 9 aa, Homo Sapiens
KEEVFLFVQ

SEQ ID NO: 597750 - protein, 9 aa, Homo Sapiens
TLPPNTSPF

SEQ ID NO: 597751 - protein, 9 aa, Homo Sapiens
PYHHYEPFG

SEQ ID NO: 597752 - protein, 9 aa, Homo Sapiens
PTLPPNTSP

SEQ ID NO: 597753 - protein, 9 aa, Homo Sapiens
MVNAVDRSY

SEQ ID NO: 597754 - protein, 9 aa, Homo Sapiens
LDVECEYIC

SEQ ID NO: 597755 - protein, 9 aa, Homo Sapiens
VTVHNTTYK

SEQ ID NO: 597756 - protein, 9 aa, Homo Sapiens
RGILQFEYV

SEQ ID NO: 597757 - protein, 9 aa, Homo Sapiens
PKLEEDSDD

SEQ ID NO: 597758 - protein, 9 aa, Homo Sapiens
QVVPLLKSF

SEQ ID NO: 597759 - protein, 9 aa, Homo Sapiens
GLGGEAVGT

SEQ ID NO: 597760 - protein, 9 aa, Homo Sapiens
NKAKFIGFT

SEQ ID NO: 597761 - protein, 9 aa, Homo Sapiens
QKRLTFPFG

SEQ ID NO: 597762 - protein, 9 aa, Homo Sapiens
ASASPTCAS

SEQ ID NO: 597763 - protein, 9 aa, Homo Sapiens
LTCNYEGRG

SEQ ID NO: 597764 - protein, 9 aa, Homo Sapiens
LFVQSCARA

SEQ ID NO: 597765 - protein, 9 aa, Homo Sapiens
VHAFNGRRS

SEQ ID NO: 597766 - protein, 9 aa, Homo Sapiens
QLLRKLGLR

SEQ ID NO: 597767 - protein, 9 aa, Homo Sapiens
DSGYSILQA

SEQ ID NO: 597768 - protein, 9 aa, Homo Sapiens
FFKLEWDMK

SEQ ID NO: 597769 - protein, 9 aa, Homo Sapiens
KQLIASSNL

SEQ ID NO: 597770 - protein, 9 aa, Homo Sapiens
GASASPTCA

SEQ ID NO: 597771 - protein, 9 aa, Homo Sapiens
VECEYICSL

SEQ ID NO: 597772 - protein, 9 aa, Homo Sapiens
TLYDGCAYR

SEQ ID NO: 597773 - protein, 9 aa, Homo Sapiens
ACPRGYKGQ

SEQ ID NO: 597774 - protein, 9 aa, Homo Sapiens
RRSLRVLTL

SEQ ID NO: 597775 - protein, 9 aa, Homo Sapiens
GGEAVGTGE

SEQ ID NO: 597776 - protein, 9 aa, Homo Sapiens
KVQMWRSQP

SEQ ID NO: 597777 - protein, 9 aa, Homo Sapiens
WQILLISIL

SEQ ID NO: 597778 - protein, 9 aa, Homo Sapiens
NFNKAKFIG

SEQ ID NO: 597779 - protein, 9 aa, Homo Sapiens
IDESGKMRK

SEQ ID NO: 597780 - protein, 9 aa, Homo Sapiens
GYKGQYCER

SEQ ID NO: 597781 - protein, 9 aa, Homo Sapiens
YKGQYCERC

SEQ ID NO: 597782 - protein, 9 aa, Homo Sapiens
SQSLTLPAP

SEQ ID NO: 597783 - protein, 9 aa, Homo Sapiens
SGDVDKVST

SEQ ID NO: 597784 - protein, 9 aa, Homo Sapiens
SAYILQGGI

SEQ ID NO: 597785 - protein, 9 aa, Homo Sapiens
QSQSLTLPA

SEQ ID NO: 597786 - protein, 9 aa, Homo Sapiens
SGELHLEEV

SEQ ID NO: 597787 - protein, 9 aa, Homo Sapiens
GSQGAAGLK

SEQ ID NO: 597788 - protein, 9 aa, Homo Sapiens
CFCGELKHG

SEQ ID NO: 597789 - protein, 9 aa, Homo Sapiens
VLTCNYEGR

SEQ ID NO: 597790 - protein, 9 aa, Homo Sapiens
QLIASSNLF

SEQ ID NO: 597791 - protein, 9 aa, Homo Sapiens
KTMPLSSLF

SEQ ID NO: 597792 - protein, 9 aa, Homo Sapiens
THVPNLFCL

SEQ ID NO: 597793 - protein, 9 aa, Homo Sapiens
MAYKFRTHC

SEQ ID NO: 597794 - protein, 9 aa, Homo Sapiens
DFFKLEWDM

SEQ ID NO: 597795 - protein, 9 aa, Homo Sapiens
DGYDKRLLN

SEQ ID NO: 597796 - protein, 9 aa, Homo Sapiens
GGRVTDGYD

SEQ ID NO: 597797 - protein, 9 aa, Homo Sapiens
ILDVECEYI

SEQ ID NO: 597798 - protein, 9 aa, Homo Sapiens
RQSVAVGVI

SEQ ID NO: 597799 - protein, 9 aa, Homo Sapiens
LKTLRKFLQ

SEQ ID NO: 597800 - protein, 9 aa, Homo Sapiens
SGAGEIYLK

SEQ ID NO: 597801 - protein, 9 aa, Homo Sapiens
VFLFVQSCA

SEQ ID NO: 597802 - protein, 9 aa, Homo Sapiens
HPGLGGEAV

SEQ ID NO: 597803 - protein, 9 aa, Homo Sapiens
VRPGILMLI

SEQ ID NO: 597804 - protein, 9 aa, Homo Sapiens
LKKQVQFQF

SEQ ID NO: 597805 - protein, 9 aa, Homo Sapiens
VKGIPGSQG

SEQ ID NO: 597806 - protein, 9 aa, Homo Sapiens
GLVAMVIVL

SEQ ID NO: 597807 - protein, 9 aa, Homo Sapiens
GDVDKVSTV

SEQ ID NO: 597808 - protein, 9 aa, Homo Sapiens
DMRQSVAVG

SEQ ID NO: 597809 - protein, 9 aa, Homo Sapiens
TAEGVGLTV

SEQ ID NO: 597810 - protein, 9 aa, Homo Sapiens
THCPEALEQ

SEQ ID NO: 597811 - protein, 9 aa, Homo Sapiens
EMTHMVNAV

SEQ ID NO: 597812 - protein, 9 aa, Homo Sapiens
RKMTKDDPK

SEQ ID NO: 597813 - protein, 9 aa, Homo Sapiens
MPSSGDIRA

SEQ ID NO: 597814 - protein, 9 aa, Homo Sapiens
QVQFQFVLL

SEQ ID NO: 597815 - protein, 9 aa, Homo Sapiens
TPGAVRVLF

SEQ ID NO: 597816 - protein, 9 aa, Homo Sapiens
SKKRKRHQR

SEQ ID NO: 597817 - protein, 9 aa, Homo Sapiens
SNFPTDKFI

SEQ ID NO: 597818 - protein, 9 aa, Homo Sapiens
PGILMLIND

SEQ ID NO: 597819 - protein, 9 aa, Homo Sapiens
GYDKRLLNT

SEQ ID NO: 597820 - protein, 9 aa, Homo Sapiens
GGIYNNCSP

SEQ ID NO: 597821 - protein, 9 aa, Homo Sapiens
LGAMAATPV

SEQ ID NO: 597822 - protein, 9 aa, Homo Sapiens
ISVELKKQV

SEQ ID NO: 597823 - protein, 9 aa, Homo Sapiens
VLSGGTTTY

SEQ ID NO: 597824 - protein, 9 aa, Homo Sapiens
QFGKNRANV

SEQ ID NO: 597825 - protein, 9 aa, Homo Sapiens
IPGSQGAAG

SEQ ID NO: 597826 - protein, 9 aa, Homo Sapiens
PSSGDIRAD

SEQ ID NO: 597827 - protein, 9 aa, Homo Sapiens
NSGDVDKVS

SEQ ID NO: 597828 - protein, 9 aa, Homo Sapiens
AYEPPVQES

SEQ ID NO: 597829 - protein, 9 aa, Homo Sapiens
LFASSVHNL

SEQ ID NO: 597830 - protein, 9 aa, Homo Sapiens
KKQKRLTFP

SEQ ID NO: 597831 - protein, 9 aa, Homo Sapiens
GQGLPTLPP

SEQ ID NO: 597832 - protein, 9 aa, Homo Sapiens
HNLTELAAL

SEQ ID NO: 597833 - protein, 9 aa, Homo Sapiens
KHGHPWNTP

SEQ ID NO: 597834 - protein, 9 aa, Homo Sapiens
TCNYEGRGS

SEQ ID NO: 597835 - protein, 9 aa, Homo Sapiens
NMGPGKVQM

SEQ ID NO: 597836 - protein, 9 aa, Homo Sapiens
ILQGGICWQ

SEQ ID NO: 597837 - protein, 9 aa, Homo Sapiens
KVSTVFYTV

SEQ ID NO: 597838 - protein, 9 aa, Homo Sapiens
RTHCPEALE

SEQ ID NO: 597839 - protein, 9 aa, Homo Sapiens
GRVTDGYDK

SEQ ID NO: 597840 - protein, 9 aa, Homo Sapiens
FRTHCPEAL

SEQ ID NO: 597841 - protein, 9 aa, Homo Sapiens
MVTVHNTTY

SEQ ID NO: 597842 - protein, 9 aa, Homo Sapiens
QKTMPLSSL

SEQ ID NO: 597843 - protein, 9 aa, Homo Sapiens
ELQTPGAVR

SEQ ID NO: 597844 - protein, 9 aa, Homo Sapiens
EEDSDDLLE

SEQ ID NO: 597845 - protein, 9 aa, Homo Sapiens
EHPGLGGEA

SEQ ID NO: 597846 - protein, 9 aa, Homo Sapiens
VRDMRQSVA

SEQ ID NO: 597847 - protein, 9 aa, Homo Sapiens
LLISILGFL

SEQ ID NO: 597848 - protein, 9 aa, Homo Sapiens
YGGRVTDGY

SEQ ID NO: 597849 - protein, 9 aa, Homo Sapiens
FMSTGLAHF

SEQ ID NO: 597850 - protein, 9 aa, Homo Sapiens
QMWRSQPVR

SEQ ID NO: 597851 - protein, 9 aa, Homo Sapiens
FDKPGGERS

SEQ ID NO: 597852 - protein, 9 aa, Homo Sapiens
PNLFCLQLC

SEQ ID NO: 597853 - protein, 9 aa, Homo Sapiens
NPQQHLSAQ

SEQ ID NO: 597854 - protein, 9 aa, Homo Sapiens
DVDKVSTVF

SEQ ID NO: 597855 - protein, 9 aa, Homo Sapiens
SVAVGVIKA

SEQ ID NO: 597856 - protein, 9 aa, Homo Sapiens
CPSKKRKRH

SEQ ID NO: 597857 - protein, 9 aa, Homo Sapiens
ESDQRLPPE

SEQ ID NO: 597858 - protein, 9 aa, Homo Sapiens
LSSLFVDQP

SEQ ID NO: 597859 - protein, 9 aa, Homo Sapiens
GIPGSQGAA

SEQ ID NO: 597860 - protein, 9 aa, Homo Sapiens
STMSKEPEL

SEQ ID NO: 597861 - protein, 9 aa, Homo Sapiens
CPENFNKAK

SEQ ID NO: 597862 - protein, 9 aa, Homo Sapiens
LIASSNLFV

SEQ ID NO: 597863 - protein, 9 aa, Homo Sapiens
LTQSDWCPS

SEQ ID NO: 597864 - protein, 9 aa, Homo Sapiens
SPSKEEVFL

SEQ ID NO: 597865 - protein, 9 aa, Homo Sapiens
KGIPGSQGA

SEQ ID NO: 597866 - protein, 9 aa, Homo Sapiens
HPSVPYHHY

SEQ ID NO: 597867 - protein, 9 aa, Homo Sapiens
EEVFLFVQS

SEQ ID NO: 597868 - protein, 9 aa, Homo Sapiens
DKPGGERSW

SEQ ID NO: 597869 - protein, 9 aa, Homo Sapiens
MPLSSLFVD

SEQ ID NO: 597870 - protein, 9 aa, Homo Sapiens
YRKGYEKTV

SEQ ID NO: 597871 - protein, 9 aa, Homo Sapiens
MSKEPELLI

SEQ ID NO: 597872 - protein, 9 aa, Homo Sapiens
PGSQGAAGL

SEQ ID NO: 597873 - protein, 9 aa, Homo Sapiens
GDLELKFRK

SEQ ID NO: 597874 - protein, 9 aa, Homo Sapiens
LAEPERSGE

SEQ ID NO: 597875 - protein, 9 aa, Homo Sapiens
SVPYHHYEP

SEQ ID NO: 597876 - protein, 9 aa, Homo Sapiens
EIYLKIQWE

SEQ ID NO: 597877 - protein, 9 aa, Homo Sapiens
PSKKRKRHQ

SEQ ID NO: 597878 - protein, 9 aa, Homo Sapiens
KLEWDMKIN

SEQ ID NO: 597879 - protein, 9 aa, Homo Sapiens
TMPLSSLFV

SEQ ID NO: 597880 - protein, 9 aa, Homo Sapiens
LIYFMSTGL

SEQ ID NO: 597881 - protein, 9 aa, Homo Sapiens
DSVRPGILM

SEQ ID NO: 597882 - protein, 9 aa, Homo Sapiens
RFEGTKLLT

SEQ ID NO: 597883 - protein, 9 aa, Homo Sapiens
VPSTSTMSK

SEQ ID NO: 597884 - protein, 9 aa, Homo Sapiens
GLTVTGVAQ

SEQ ID NO: 597885 - protein, 9 aa, Homo Sapiens
SGKMRKKQV

SEQ ID NO: 597886 - protein, 9 aa, Homo Sapiens
SGGTTTYPG

SEQ ID NO: 597887 - protein, 9 aa, Homo Sapiens
SAQPQVTMQ

SEQ ID NO: 597888 - protein, 9 aa, Homo Sapiens
AHFDSLVRS

SEQ ID NO: 597889 - protein, 9 aa, Homo Sapiens
GRQGLIYFM

SEQ ID NO: 597890 - protein, 9 aa, Homo Sapiens
KGQYCERCA

SEQ ID NO: 597891 - protein, 9 aa, Homo Sapiens
LAALNMPSS

SEQ ID NO: 597892 - protein, 9 aa, Homo Sapiens
EYVSYGIEP

SEQ ID NO: 597893 - protein, 9 aa, Homo Sapiens
FVFLYDTDS

SEQ ID NO: 597894 - protein, 9 aa, Homo Sapiens
RDMRQSVAV

SEQ ID NO: 597895 - protein, 9 aa, Homo Sapiens
PSTSTMSKE

SEQ ID NO: 597896 - protein, 9 aa, Homo Sapiens
QTPGAVRVL

SEQ ID NO: 597897 - protein, 9 aa, Homo Sapiens
TYFSSPKYG

SEQ ID NO: 597898 - protein, 9 aa, Homo Sapiens
LVESRMINV

SEQ ID NO: 597899 - protein, 9 aa, Homo Sapiens
PVSRKTYFS

SEQ ID NO: 597900 - protein, 9 aa, Homo Sapiens
FLQMSGAGE

SEQ ID NO: 597901 - protein, 9 aa, Homo Sapiens
VESDQRLPP

SEQ ID NO: 597902 - protein, 9 aa, Homo Sapiens
LSGGTTTYP

SEQ ID NO: 597903 - protein, 9 aa, Homo Sapiens
TCASPPVSA

SEQ ID NO: 597904 - protein, 9 aa, Homo Sapiens
AVDRSYADQ

SEQ ID NO: 597905 - protein, 9 aa, Homo Sapiens
DKVSTVFYT

SEQ ID NO: 597906 - protein, 9 aa, Homo Sapiens
DVETAEGVG

SEQ ID NO: 597907 - protein, 9 aa, Homo Sapiens
ILHRYKSLL

SEQ ID NO: 597908 - protein, 9 aa, Homo Sapiens
MRQSVAVGV

SEQ ID NO: 597909 - protein, 9 aa, Homo Sapiens
PVVICTAVI

SEQ ID NO: 597910 - protein, 9 aa, Homo Sapiens
QMSGAGEIY

SEQ ID NO: 597911 - protein, 9 aa, Homo Sapiens
KFRTHCPEA

SEQ ID NO: 597912 - protein, 9 aa, Homo Sapiens
YVLTCNYEG

SEQ ID NO: 597913 - protein, 9 aa, Homo Sapiens
KNITPVVLP

SEQ ID NO: 597914 - protein, 9 aa, Homo Sapiens
QQHLSAQPQ

SEQ ID NO: 597915 - protein, 9 aa, Homo Sapiens
ELKHGHPWN

SEQ ID NO: 597916 - protein, 9 aa, Homo Sapiens
VQMWRSQPV

SEQ ID NO: 597917 - protein, 9 aa, Homo Sapiens
QILLISILG

SEQ ID NO: 597918 - protein, 9 aa, Homo Sapiens
FGDILHRYK

SEQ ID NO: 597919 - protein, 9 aa, Homo Sapiens
MTHMVNAVD

SEQ ID NO: 597920 - protein, 9 aa, Homo Sapiens
SLVRSTNLL

SEQ ID NO: 597921 - protein, 9 aa, Homo Sapiens
PGQGLPTLP

SEQ ID NO: 597922 - protein, 9 aa, Homo Sapiens
RKFLQMSGA

SEQ ID NO: 597923 - protein, 9 aa, Homo Sapiens
LEQSQSLTL

SEQ ID NO: 597924 - protein, 9 aa, Homo Sapiens
ELKFRKLIY

SEQ ID NO: 597925 - protein, 9 aa, Homo Sapiens
QHLSAQPQV

SEQ ID NO: 597926 - protein, 9 aa, Homo Sapiens
GAKVERADA

SEQ ID NO: 597927 - protein, 9 aa, Homo Sapiens
ALEQSQSLT

SEQ ID NO: 597928 - protein, 9 aa, Homo Sapiens
SSVHNLTEL

SEQ ID NO: 597929 - protein, 9 aa, Homo Sapiens
GAGEIYLKI

SEQ ID NO: 597930 - protein, 9 aa, Homo Sapiens
LFCLQLCGA

SEQ ID NO: 597931 - protein, 9 aa, Homo Sapiens
LSGERASGL

SEQ ID NO: 597932 - protein, 9 aa, Homo Sapiens
TFPFGEAKK

SEQ ID NO: 597933 - protein, 9 aa, Homo Sapiens
AMAATPVVI

SEQ ID NO: 597934 - protein, 9 aa, Homo Sapiens
RPGILMLIN

SEQ ID NO: 597935 - protein, 9 aa, Homo Sapiens
HLAALNMPS

SEQ ID NO: 597936 - protein, 9 aa, Homo Sapiens
TEDFFKLEW

SEQ ID NO: 597937 - protein, 9 aa, Homo Sapiens
WCPSKKRKR

SEQ ID NO: 597938 - protein, 9 aa, Homo Sapiens
CNYEGRGSV

SEQ ID NO: 597939 - protein, 9 aa, Homo Sapiens
KCVQKFIEI

SEQ ID NO: 597940 - protein, 9 aa, Homo Sapiens
EPERSGELH

SEQ ID NO: 597941 - protein, 9 aa, Homo Sapiens
EWDMKINCS

SEQ ID NO: 597942 - protein, 9 aa, Homo Sapiens
TPVVICTAV

SEQ ID NO: 597943 - protein, 9 aa, Homo Sapiens
AKVERADAY

SEQ ID NO: 597944 - protein, 9 aa, Homo Sapiens
ATPVVICTA

SEQ ID NO: 597945 - protein, 9 aa, Homo Sapiens
AGSRLPDTG

SEQ ID NO: 597946 - protein, 9 aa, Homo Sapiens
TVEKCVQKF

SEQ ID NO: 597947 - protein, 9 aa, Homo Sapiens
YFSSPKYGE

SEQ ID NO: 597948 - protein, 9 aa, Homo Sapiens
LVAMVIVLT

SEQ ID NO: 597949 - protein, 9 aa, Homo Sapiens
GPGKVQMWR

SEQ ID NO: 597950 - protein, 9 aa, Homo Sapiens
ENFNKAKFI

SEQ ID NO: 597951 - protein, 9 aa, Homo Sapiens
VSTVFYTVV

SEQ ID NO: 597952 - protein, 9 aa, Homo Sapiens
PGKVQMWRS

SEQ ID NO: 597953 - protein, 9 aa, Homo Sapiens
ANVLPFIQK

SEQ ID NO: 597954 - protein, 9 aa, Homo Sapiens
AFNGRRSLR

SEQ ID NO: 597955 - protein, 9 aa, Homo Sapiens
SDIPKLEED

SEQ ID NO: 597956 - protein, 9 aa, Homo Sapiens
RKCPENFNK

SEQ ID NO: 597957 - protein, 9 aa, Homo Sapiens
YFMSTGLAH

SEQ ID NO: 597958 - protein, 9 aa, Homo Sapiens
PTCASPPVS

SEQ ID NO: 597959 - protein, 9 aa, Homo Sapiens
VRNPQQHLS

SEQ ID NO: 597960 - protein, 9 aa, Homo Sapiens
RGKLVESDQ

SEQ ID NO: 597961 - protein, 9 aa, Homo Sapiens
YILQGGICW

SEQ ID NO: 597962 - protein, 9 aa, Homo Sapiens
PGLGGEAVG

SEQ ID NO: 597963 - protein, 9 aa, Homo Sapiens
TKLLTNETS

SEQ ID NO: 597964 - protein, 9 aa, Homo Sapiens
GLPTLPPNT

SEQ ID NO: 597965 - protein, 9 aa, Homo Sapiens
GAMAATPVV

SEQ ID NO: 597966 - protein, 9 aa, Homo Sapiens
YCVLTSEQK

SEQ ID NO: 597967 - protein, 9 aa, Homo Sapiens
DGCAYRKGY

SEQ ID NO: 597968 - protein, 9 aa, Homo Sapiens
KQVQFQFVL

SEQ ID NO: 597969 - protein, 9 aa, Homo Sapiens
RKQVVPLLK

SEQ ID NO: 597970 - protein, 9 aa, Homo Sapiens
TYPGIADRM

SEQ ID NO: 597971 - protein, 9 aa, Homo Sapiens
FNGRRSLRV

SEQ ID NO: 597972 - protein, 9 aa, Homo Sapiens
GTKLLTNET

SEQ ID NO: 597973 - protein, 9 aa, Homo Sapiens
LYDGCAYRK

SEQ ID NO: 597974 - protein, 9 aa, Homo Sapiens
DQFDKPGGE

SEQ ID NO: 597975 - protein, 9 aa, Homo Sapiens
LGGEAVGTG

SEQ ID NO: 597976 - protein, 9 aa, Homo Sapiens
VETAEGVGL

SEQ ID NO: 597977 - protein, 9 aa, Homo Sapiens
LKIQWERIL

SEQ ID NO: 597978 - protein, 9 aa, Homo Sapiens
EVFLFVQSC

SEQ ID NO: 597979 - protein, 9 aa, Homo Sapiens
TNETSTDNA

SEQ ID NO: 597980 - protein, 9 aa, Homo Sapiens
CAYRKGYEK

SEQ ID NO: 597981 - protein, 9 aa, Homo Sapiens
RAGSRLPDT

SEQ ID NO: 597982 - protein, 9 aa, Homo Sapiens
TTTYPGIAD

SEQ ID NO: 597983 - protein, 9 aa, Homo Sapiens
IYFMSTGLA

SEQ ID NO: 597984 - protein, 9 aa, Homo Sapiens
MKQLIASSN

SEQ ID NO: 597985 - protein, 9 aa, Homo Sapiens
TPQEHPGLG

SEQ ID NO: 597986 - protein, 9 aa, Homo Sapiens
TDKFITVFY

SEQ ID NO: 597987 - protein, 9 aa, Homo Sapiens
GKMRKKQVL

SEQ ID NO: 597988 - protein, 9 aa, Homo Sapiens
KNRANVLPF

SEQ ID NO: 597989 - protein, 9 aa, Homo Sapiens
RQGDLELKF

SEQ ID NO: 597990 - protein, 9 aa, Homo Sapiens
GVGLTVTGV

SEQ ID NO: 597991 - protein, 9 aa, Homo Sapiens
IYLKIQWER

SEQ ID NO: 597992 - protein, 9 aa, Homo Sapiens
QSLTLPAPT

SEQ ID NO: 597993 - protein, 9 aa, Homo Sapiens
YKKKMFDLE

SEQ ID NO: 597994 - protein, 9 aa, Homo Sapiens
SVHNLTELA

SEQ ID NO: 597995 - protein, 9 aa, Homo Sapiens
RQGLIYFMS

SEQ ID NO: 597996 - protein, 9 aa, Homo Sapiens
LAHFDSLVR

SEQ ID NO: 597997 - protein, 9 aa, Homo Sapiens
NAITFSIRY

SEQ ID NO: 597998 - protein, 9 aa, Homo Sapiens
DILHRYKSL

SEQ ID NO: 597999 - protein, 9 aa, Homo Sapiens
FYCVLTSEQ

SEQ ID NO: 598000 - protein, 9 aa, Homo Sapiens
RVTDGYDKR

SEQ ID NO: 598001 - protein, 9 aa, Homo Sapiens
SSGDIRADF

SEQ ID NO: 598002 - protein, 9 aa, Homo Sapiens
VPLLKSFQG

SEQ ID NO: 598003 - protein, 9 aa, Homo Sapiens
HLSAQPQVT

SEQ ID NO: 598004 - protein, 9 aa, Homo Sapiens
TYKKKMFDL

SEQ ID NO: 598005 - protein, 9 aa, Homo Sapiens
LRKQVVPLL

SEQ ID NO: 598006 - protein, 9 aa, Homo Sapiens
GCAYRKGYE

SEQ ID NO: 598007 - protein, 9 aa, Homo Sapiens
FDQFDKPGG

SEQ ID NO: 598008 - protein, 9 aa, Homo Sapiens
QLSGERASG

SEQ ID NO: 598009 - protein, 9 aa, Homo Sapiens
STVFYTVVI

SEQ ID NO: 598010 - protein, 9 aa, Homo Sapiens
NVMKQLIAS

SEQ ID NO: 598011 - protein, 9 aa, Homo Sapiens
LQGGICWQP

SEQ ID NO: 598012 - protein, 9 aa, Homo Sapiens
SLTLPAPTS

SEQ ID NO: 598013 - protein, 9 aa, Homo Sapiens
GLRAGSRLP

SEQ ID NO: 598014 - protein, 9 aa, Homo Sapiens
KIQWERILN

SEQ ID NO: 598015 - protein, 9 aa, Homo Sapiens
WQPRIGQRI

SEQ ID NO: 598016 - protein, 9 aa, Homo Sapiens
PQAGLVAMV

SEQ ID NO: 598017 - protein, 9 aa, Homo Sapiens
GLRPPASGQ

SEQ ID NO: 598018 - protein, 9 aa, Homo Sapiens
DLELKFRKL

SEQ ID NO: 598019 - protein, 9 aa, Homo Sapiens
SVGGGLRAG

SEQ ID NO: 598020 - protein, 9 aa, Homo Sapiens
ASSVHNLTE

SEQ ID NO: 598021 - protein, 9 aa, Homo Sapiens
MGPGKVQMW

SEQ ID NO: 598022 - protein, 9 aa, Homo Sapiens
KMRKKQVLK

SEQ ID NO: 598023 - protein, 9 aa, Homo Sapiens
VAMVIVLTS

SEQ ID NO: 598024 - protein, 9 aa, Homo Sapiens
VDKVSTVFY

SEQ ID NO: 598025 - protein, 9 aa, Homo Sapiens
PQQHLSAQP

SEQ ID NO: 598026 - protein, 9 aa, Homo Sapiens
SVELKKQVQ

SEQ ID NO: 598027 - protein, 9 aa, Homo Sapiens
CVLTSEQKA

SEQ ID NO: 598028 - protein, 9 aa, Homo Sapiens
GTVEKCVQK

SEQ ID NO: 598029 - protein, 9 aa, Homo Sapiens
FCGELKHGH

SEQ ID NO: 598030 - protein, 9 aa, Homo Sapiens
GNAITFSIR

SEQ ID NO: 598031 - protein, 9 aa, Homo Sapiens
SKEEVFLFV

SEQ ID NO: 598032 - protein, 9 aa, Homo Sapiens
PSKEEVFLF

SEQ ID NO: 598033 - protein, 9 aa, Homo Sapiens
FLFVQSCAR

SEQ ID NO: 598034 - protein, 9 aa, Homo Sapiens
QQLLRKLGL

SEQ ID NO: 598035 - protein, 9 aa, Homo Sapiens
ASSNLFVMQ

SEQ ID NO: 598036 - protein, 9 aa, Homo Sapiens
EGVGLTVTG

SEQ ID NO: 598037 - protein, 9 aa, Homo Sapiens
VEKCVQKFI

SEQ ID NO: 598038 - protein, 9 aa, Homo Sapiens
LQFEYVSYG

SEQ ID NO: 598039 - protein, 9 aa, Homo Sapiens
FKLEWDMKI

SEQ ID NO: 598040 - protein, 9 aa, Homo Sapiens
ILLISILGF

SEQ ID NO: 598041 - protein, 9 aa, Homo Sapiens
TLVESRMIN

SEQ ID NO: 598042 - protein, 9 aa, Homo Sapiens
PEELQTPGA

SEQ ID NO: 598043 - protein, 9 aa, Homo Sapiens
ILGNAITFS

SEQ ID NO: 598044 - protein, 9 aa, Homo Sapiens
DTDSGYSIL

SEQ ID NO: 598045 - protein, 9 aa, Homo Sapiens
DVECEYICS

SEQ ID NO: 598046 - protein, 9 aa, Homo Sapiens
NHPSVPYHH

SEQ ID NO: 598047 - protein, 9 aa, Homo Sapiens
KCPENFNKA

SEQ ID NO: 598048 - protein, 9 aa, Homo Sapiens
GEIYLKIQW

SEQ ID NO: 598049 - protein, 9 aa, Homo Sapiens
VLERLYVTV

SEQ ID NO: 598050 - protein, 9 aa, Homo Sapiens
GASPGGGIY

SEQ ID NO: 598051 - protein, 9 aa, Homo Sapiens
YLKIQWERI

SEQ ID NO: 598052 - protein, 9 aa, Homo Sapiens
AISVELKKQ

SEQ ID NO: 598053 - protein, 9 aa, Homo Sapiens
ILMLINDAD

SEQ ID NO: 598054 - protein, 9 aa, Homo Sapiens
EGTKLLTNE

SEQ ID NO: 598055 - protein, 9 aa, Homo Sapiens
PILDVECEY

SEQ ID NO: 598056 - protein, 9 aa, Homo Sapiens
GERSWRRRA

SEQ ID NO: 598057 - protein, 9 aa, Homo Sapiens
YDTDSGYSI

SEQ ID NO: 598058 - protein, 9 aa, Homo Sapiens
PQEHPGLGG

SEQ ID NO: 598059 - protein, 9 aa, Homo Sapiens
KKQVQFQFV

SEQ ID NO: 598060 - protein, 9 aa, Homo Sapiens
SRMINVSNL

SEQ ID NO: 598061 - protein, 9 aa, Homo Sapiens
IASSNLFVM

SEQ ID NO: 598062 - protein, 9 aa, Homo Sapiens
LISILGFLV

SEQ ID NO: 598063 - protein, 9 aa, Homo Sapiens
ESGKMRKKQ

SEQ ID NO: 598064 - protein, 9 aa, Homo Sapiens
KMTKDDPKP

SEQ ID NO: 598065 - protein, 9 aa, Homo Sapiens
LRAGSRLPD

SEQ ID NO: 598066 - protein, 9 aa, Homo Sapiens
ITVFYTIIT

SEQ ID NO: 598067 - protein, 9 aa, Homo Sapiens
FCLQLCGAG

SEQ ID NO: 598068 - protein, 9 aa, Homo Sapiens
NLFCLQLCG

SEQ ID NO: 598069 - protein, 9 aa, Homo Sapiens
DFSGQLSGE

SEQ ID NO: 598070 - protein, 9 aa, Homo Sapiens
ITPVVLPPD

SEQ ID NO: 598071 - protein, 9 aa, Homo Sapiens
RQFGKNRAN

SEQ ID NO: 598072 - protein, 9 aa, Homo Sapiens
DIPKLEEDS

SEQ ID NO: 598073 - protein, 9 aa, Homo Sapiens
NITPVVLPP

SEQ ID NO: 598074 - protein, 9 aa, Homo Sapiens
VNAVDRSYA

SEQ ID NO: 598075 - protein, 9 aa, Homo Sapiens
ICWQPRIGQ

SEQ ID NO: 598076 - protein, 9 aa, Homo Sapiens
MSGAGEIYL

SEQ ID NO: 598077 - protein, 9 aa, Homo Sapiens
ECEYICSLA

SEQ ID NO: 598078 - protein, 9 aa, Homo Sapiens
TMSKEPELL

SEQ ID NO: 598079 - protein, 9 aa, Homo Sapiens
DKFITVFYT

SEQ ID NO: 598080 - protein, 9 aa, Homo Sapiens
CTACPRGYK

SEQ ID NO: 598081 - protein, 9 aa, Homo Sapiens
THMVNAVDR

SEQ ID NO: 598082 - protein, 9 aa, Homo Sapiens
MRKKQVLKT

SEQ ID NO: 598083 - protein, 9 aa, Homo Sapiens
PGAVRVLFL

SEQ ID NO: 598084 - protein, 9 aa, Homo Sapiens
YKSLLLQVS

SEQ ID NO: 598085 - protein, 9 aa, Homo Sapiens
RMINVSNLY

SEQ ID NO: 598086 - protein, 9 aa, Homo Sapiens
KQKRLTFPF

SEQ ID NO: 598087 - protein, 9 aa, Homo Sapiens
VDRSYADQS

SEQ ID NO: 598088 - protein, 9 aa, Homo Sapiens
VGLTVTGVA

SEQ ID NO: 598089 - protein, 9 aa, Homo Sapiens
VGGGLRAGS

SEQ ID NO: 598090 - protein, 9 aa, Homo Sapiens
PGASASPTC

SEQ ID NO: 598091 - protein, 9 aa, Homo Sapiens
VTDGYDKRL

SEQ ID NO: 598092 - protein, 9 aa, Homo Sapiens
QGGICWQPR

SEQ ID NO: 598093 - protein, 9 aa, Homo Sapiens
IPKLEEDSD

SEQ ID NO: 598094 - protein, 9 aa, Homo Sapiens
HPGASASPT

SEQ ID NO: 598095 - protein, 9 aa, Homo Sapiens
TLRKFLQMS

SEQ ID NO: 598096 - protein, 9 aa, Homo Sapiens
LEWDMKINC

SEQ ID NO: 598097 - protein, 9 aa, Homo Sapiens
HGHPWNTPQ

SEQ ID NO: 598098 - protein, 9 aa, Homo Sapiens
LSQDSFYCV

SEQ ID NO: 598099 - protein, 9 aa, Homo Sapiens
LRPPASGQE

SEQ ID NO: 598100 - protein, 9 aa, Homo Sapiens
DYVLTCNYE

SEQ ID NO: 598101 - protein, 9 aa, Homo Sapiens
KQVLKTLRK

SEQ ID NO: 598102 - protein, 9 aa, Homo Sapiens
KRKMTKDDP

SEQ ID NO: 598103 - protein, 9 aa, Homo Sapiens
FLYDTDSGY

SEQ ID NO: 598104 - protein, 9 aa, Homo Sapiens
KEPELLISG

SEQ ID NO: 598105 - protein, 9 aa, Homo Sapiens
QILGNAITF

SEQ ID NO: 598106 - protein, 9 aa, Homo Sapiens
LTFPFGEAK

SEQ ID NO: 598107 - protein, 9 aa, Homo Sapiens
PTDKFITVF

SEQ ID NO: 598108 - protein, 9 aa, Homo Sapiens
HMVNAVDRS

SEQ ID NO: 598109 - protein, 9 aa, Homo Sapiens
GKNRANVLP

SEQ ID NO: 598110 - protein, 9 aa, Homo Sapiens
KQVVPLLKS

SEQ ID NO: 598111 - protein, 9 aa, Homo Sapiens
GTLVESRMI

SEQ ID NO: 598112 - protein, 9 aa, Homo Sapiens
KVERADAYE

SEQ ID NO: 598113 - protein, 9 aa, Homo Sapiens
YVSYGIEPL

SEQ ID NO: 598114 - protein, 9 aa, Homo Sapiens
GKVQMWRSQ

SEQ ID NO: 598115 - protein, 9 aa, Homo Sapiens
GRRSLRVLT

SEQ ID NO: 598116 - protein, 9 aa, Homo Sapiens
RSGELHLEE

SEQ ID NO: 598117 - protein, 9 aa, Homo Sapiens
LLQILGNAI

SEQ ID NO: 598118 - protein, 9 aa, Homo Sapiens
PENFNKAKF

SEQ ID NO: 598119 - protein, 9 aa, Homo Sapiens
MAATPVVIC

SEQ ID NO: 598120 - protein, 9 aa, Homo Sapiens
RANVLPFIQ

SEQ ID NO: 598121 - protein, 9 aa, Homo Sapiens
FLAEPERSG

SEQ ID NO: 598122 - protein, 9 aa, Homo Sapiens
HRGKLVESD

SEQ ID NO: 598123 - protein, 9 aa, Homo Sapiens
HGVKGIPGS

SEQ ID NO: 598124 - protein, 9 aa, Homo Sapiens
CEYICSLAL

SEQ ID NO: 598125 - protein, 9 aa, Homo Sapiens
QFDKPGGER

SEQ ID NO: 598126 - protein, 9 aa, Homo Sapiens
DSFYCVLTS

SEQ ID NO: 598127 - protein, 9 aa, Homo Sapiens
HNTTYKKKM

SEQ ID NO: 598128 - protein, 9 aa, Homo Sapiens
ILQFEYVSY

SEQ ID NO: 598129 - protein, 9 aa, Homo Sapiens
SPGGGIYNN

SEQ ID NO: 598130 - protein, 9 aa, Homo Sapiens
EELQTPGAV

SEQ ID NO: 598131 - protein, 9 aa, Homo Sapiens
EDFFKLEWD

SEQ ID NO: 598132 - protein, 9 aa, Homo Sapiens
SILGFLVNY

SEQ ID NO: 598133 - protein, 9 aa, Homo Sapiens
LGTLVESRM

SEQ ID NO: 598134 - protein, 9 aa, Homo Sapiens
TLPAPTSTS

SEQ ID NO: 598135 - protein, 9 aa, Homo Sapiens
LEEDSDDLL

SEQ ID NO: 598136 - protein, 9 aa, Homo Sapiens
CGELKHGHP

SEQ ID NO: 598137 - protein, 9 aa, Homo Sapiens
FKGKNITPV

SEQ ID NO: 598138 - protein, 9 aa, Homo Sapiens
TTYKKKMFD

SEQ ID NO: 598139 - protein, 9 aa, Homo Sapiens
FEGTKLLTN

SEQ ID NO: 598140 - protein, 9 aa, Homo Sapiens
TDGYDKRLL

SEQ ID NO: 598141 - protein, 9 aa, Homo Sapiens
GICWQPRIG

SEQ ID NO: 598142 - protein, 9 aa, Homo Sapiens
NGRRSLRVL

SEQ ID NO: 598143 - protein, 9 aa, Homo Sapiens
KNQKTMPLS

SEQ ID NO: 598144 - protein, 9 aa, Homo Sapiens
QDYVLTCNY

SEQ ID NO: 598145 - protein, 9 aa, Homo Sapiens
SDWCPSKKR

SEQ ID NO: 598146 - protein, 9 aa, Homo Sapiens
TACPRGYKG

SEQ ID NO: 598147 - protein, 9 aa, Homo Sapiens
SFYCVLTSE

SEQ ID NO: 598148 - protein, 9 aa, Homo Sapiens
KLVESDQRL

SEQ ID NO: 598149 - protein, 9 aa, Homo Sapiens
QVLKTLRKF

SEQ ID NO: 598150 - protein, 9 aa, Homo Sapiens
FEYVSYGIE

SEQ ID NO: 598151 - protein, 9 aa, Homo Sapiens
AMVIVLTSV

SEQ ID NO: 598152 - protein, 9 aa, Homo Sapiens
PGGERSWRR

SEQ ID NO: 598153 - protein, 9 aa, Homo Sapiens
SQGAAGLKG

SEQ ID NO: 598154 - protein, 9 aa, Homo Sapiens
HAFNGRRSL

SEQ ID NO: 598155 - protein, 9 aa, Homo Sapiens
VSRKTYFSS

SEQ ID NO: 598156 - protein, 9 aa, Homo Sapiens
VPNLFCLQL

SEQ ID NO: 598157 - protein, 9 aa, Homo Sapiens
AGTVEKCVQ

SEQ ID NO: 598158 - protein, 9 aa, Homo Sapiens
YRQFGKNRA

SEQ ID NO: 598159 - protein, 9 aa, Homo Sapiens
LVRSTNLLF

SEQ ID NO: 598160 - protein, 9 aa, Homo Sapiens
YHHYEPFGP

SEQ ID NO: 598161 - protein, 9 aa, Homo Sapiens
NVLSGGTTT

SEQ ID NO: 598162 - protein, 9 aa, Homo Sapiens
NAVDRSYAD

SEQ ID NO: 598163 - protein, 9 aa, Homo Sapiens
ESRMINVSN

SEQ ID NO: 598164 - protein, 9 aa, Homo Sapiens
IGRQGLIYF

SEQ ID NO: 598165 - protein, 9 aa, Homo Sapiens
GIPQAGLVA

SEQ ID NO: 598166 - protein, 9 aa, Homo Sapiens
KTLYDGCAY

SEQ ID NO: 598167 - protein, 9 aa, Homo Sapiens
SGERASGLP

SEQ ID NO: 598168 - protein, 9 aa, Homo Sapiens
CPRGYKGQY

SEQ ID NO: 598169 - protein, 9 aa, Homo Sapiens
LLTNETSTD

SEQ ID NO: 598170 - protein, 9 aa, Homo Sapiens
ADAYEPPVQ

SEQ ID NO: 598171 - protein, 9 aa, Homo Sapiens
ALNMPSSGD

SEQ ID NO: 598172 - protein, 9 aa, Homo Sapiens
FDSLVRSTN

SEQ ID NO: 598173 - protein, 9 aa, Homo Sapiens
QGLPTLPPN

SEQ ID NO: 598174 - protein, 9 aa, Homo Sapiens
EKRKMTKDD

SEQ ID NO: 598175 - protein, 9 aa, Homo Sapiens
IPQAGLVAM

SEQ ID NO: 598176 - protein, 9 aa, Homo Sapiens
TQSDWCPSK

SEQ ID NO: 598177 - protein, 9 aa, Homo Sapiens
SGYSILQAI

SEQ ID NO: 598178 - protein, 9 aa, Homo Sapiens
LMLINDADW

SEQ ID NO: 598179 - protein, 9 aa, Homo Sapiens
PIPILDVEC

SEQ ID NO: 598180 - protein, 9 aa, Homo Sapiens
DVPAGTVEK

SEQ ID NO: 598181 - protein, 9 aa, Homo Sapiens
VHNLTELAA

SEQ ID NO: 598182 - protein, 9 aa, Homo Sapiens
RNPQQHLSA

SEQ ID NO: 598183 - protein, 9 aa, Homo Sapiens
VVPLLKSFQ

SEQ ID NO: 598184 - protein, 9 aa, Homo Sapiens
AATPVVICT

SEQ ID NO: 598185 - protein, 9 aa, Homo Sapiens
NTTYKKKMF

SEQ ID NO: 598186 - protein, 9 aa, Homo Sapiens
VPAGTVEKC

SEQ ID NO: 598187 - protein, 9 aa, Homo Sapiens
LQILGNAIT

SEQ ID NO: 598188 - protein, 9 aa, Homo Sapiens
QPRIGQRIV

SEQ ID NO: 598189 - protein, 9 aa, Homo Sapiens
KRLTFPFGE

SEQ ID NO: 598190 - protein, 9 aa, Homo Sapiens
ISILGFLVN

SEQ ID NO: 598191 - protein, 9 aa, Homo Sapiens
HHYEPFGPD

SEQ ID NO: 598192 - protein, 9 aa, Homo Sapiens
LLLQILGNA

SEQ ID NO: 598193 - protein, 9 aa, Homo Sapiens
HRYKSLLLQ

SEQ ID NO: 598194 - protein, 9 aa, Homo Sapiens
GGTTTYPGI

SEQ ID NO: 598195 - protein, 9 aa, Homo Sapiens
ASPGGGIYN

SEQ ID NO: 598196 - protein, 9 aa, Homo Sapiens
QTHVPNLFC

SEQ ID NO: 598197 - protein, 9 aa, Homo Sapiens
LYDTDSGYS

SEQ ID NO: 598198 - protein, 9 aa, Homo Sapiens
NRANVLPFI

SEQ ID NO: 598199 - protein, 9 aa, Homo Sapiens
KPGGERSWR

SEQ ID NO: 598200 - protein, 9 aa, Homo Sapiens
LRKFLQMSG

SEQ ID NO: 598201 - protein, 9 aa, Homo Sapiens
VVLPPDHAI

SEQ ID NO: 598202 - protein, 9 aa, Homo Sapiens
KMCKWCCHC

SEQ ID NO: 598203 - protein, 9 aa, Homo Sapiens
CSSKTGNVL

SEQ ID NO: 598204 - protein, 9 aa, Homo Sapiens
QDLPPQMAP

SEQ ID NO: 598205 - protein, 9 aa, Homo Sapiens
ESQLHLRCV

SEQ ID NO: 598206 - protein, 9 aa, Homo Sapiens
LETAEGVMT

SEQ ID NO: 598207 - protein, 9 aa, Homo Sapiens
PACSPSKAA

SEQ ID NO: 598208 - protein, 9 aa, Homo Sapiens
PHHKPTILR

SEQ ID NO: 598209 - protein, 9 aa, Homo Sapiens
FVTVGIVAP

SEQ ID NO: 598210 - protein, 9 aa, Homo Sapiens
YPVPMNRKK

SEQ ID NO: 598211 - protein, 9 aa, Homo Sapiens
GVPHPPPRD

SEQ ID NO: 598212 - protein, 9 aa, Homo Sapiens
KYEEAKASK

SEQ ID NO: 598213 - protein, 9 aa, Homo Sapiens
GGSSMTETE

SEQ ID NO: 598214 - protein, 9 aa, Homo Sapiens
TFETVIKMI

SEQ ID NO: 598215 - protein, 9 aa, Homo Sapiens
GGGGPGYCG

SEQ ID NO: 598216 - protein, 9 aa, Homo Sapiens
LGGSSMTET

SEQ ID NO: 598217 - protein, 9 aa, Homo Sapiens
ETAEGVMTA

SEQ ID NO: 598218 - protein, 9 aa, Homo Sapiens
YKPLYILSN

SEQ ID NO: 598219 - protein, 9 aa, Homo Sapiens
RMSSSSQHS

SEQ ID NO: 598220 - protein, 9 aa, Homo Sapiens
FPVIPILSS

SEQ ID NO: 598221 - protein, 9 aa, Homo Sapiens
ITMAGIAFG

SEQ ID NO: 598222 - protein, 9 aa, Homo Sapiens
IHSANVLYR

SEQ ID NO: 598223 - protein, 9 aa, Homo Sapiens
YLNYFKTNN

SEQ ID NO: 598224 - protein, 9 aa, Homo Sapiens
VESQLHLRC

SEQ ID NO: 598225 - protein, 9 aa, Homo Sapiens
IKIWVIGFF

SEQ ID NO: 598226 - protein, 9 aa, Homo Sapiens
ETVIKMIDL

SEQ ID NO: 598227 - protein, 9 aa, Homo Sapiens
IKEAIKSVK

SEQ ID NO: 598228 - protein, 9 aa, Homo Sapiens
TNLALVFVS

SEQ ID NO: 598229 - protein, 9 aa, Homo Sapiens
FYVSQTGTA

SEQ ID NO: 598230 - protein, 9 aa, Homo Sapiens
TKQRVETHF

SEQ ID NO: 598231 - protein, 9 aa, Homo Sapiens
KEAIKSVKY

SEQ ID NO: 598232 - protein, 9 aa, Homo Sapiens
EFPLGDHMV

SEQ ID NO: 598233 - protein, 9 aa, Homo Sapiens
KTGNVLRND

SEQ ID NO: 598234 - protein, 9 aa, Homo Sapiens
TQMAIKIWV

SEQ ID NO: 598235 - protein, 9 aa, Homo Sapiens
VRDLQDLPP

SEQ ID NO: 598236 - protein, 9 aa, Homo Sapiens
SRSIGLETT

SEQ ID NO: 598237 - protein, 9 aa, Homo Sapiens
VSGNQMVAS

SEQ ID NO: 598238 - protein, 9 aa, Homo Sapiens
ALTLGVPHP

SEQ ID NO: 598239 - protein, 9 aa, Homo Sapiens
ENVELAEGE

SEQ ID NO: 598240 - protein, 9 aa, Homo Sapiens
FPLGDHMVS

SEQ ID NO: 598241 - protein, 9 aa, Homo Sapiens
WKLYVDGES

SEQ ID NO: 598242 - protein, 9 aa, Homo Sapiens
LHLRCVKFQ

SEQ ID NO: 598243 - protein, 9 aa, Homo Sapiens
KAENYHDIK

SEQ ID NO: 598244 - protein, 9 aa, Homo Sapiens
IRVRLHPLH

SEQ ID NO: 598245 - protein, 9 aa, Homo Sapiens
TLRSKMCKW

SEQ ID NO: 598246 - protein, 9 aa, Homo Sapiens
QQLQKDSGA

SEQ ID NO: 598247 - protein, 9 aa, Homo Sapiens
DAKERKGKN

SEQ ID NO: 598248 - protein, 9 aa, Homo Sapiens
WTLGALALA

SEQ ID NO: 598249 - protein, 9 aa, Homo Sapiens
YEGWKLYVD

SEQ ID NO: 598250 - protein, 9 aa, Homo Sapiens
SADFLLTTA

SEQ ID NO: 598251 - protein, 9 aa, Homo Sapiens
LCTQMAIKI

SEQ ID NO: 598252 - protein, 9 aa, Homo Sapiens
AITMAGIAF

SEQ ID NO: 598253 - protein, 9 aa, Homo Sapiens
PLGDHMVSD

SEQ ID NO: 598254 - protein, 9 aa, Homo Sapiens
PEFENVELA

SEQ ID NO: 598255 - protein, 9 aa, Homo Sapiens
ETTSSQPAE

SEQ ID NO: 598256 - protein, 9 aa, Homo Sapiens
GPGYCGGSR

SEQ ID NO: 598257 - protein, 9 aa, Homo Sapiens
YGGGGPGYC

SEQ ID NO: 598258 - protein, 9 aa, Homo Sapiens
YEEAKASKA

SEQ ID NO: 598259 - protein, 9 aa, Homo Sapiens
VIPILSSSF

SEQ ID NO: 598260 - protein, 9 aa, Homo Sapiens
VPKKASGFS

SEQ ID NO: 598261 - protein, 9 aa, Homo Sapiens
LQQLQKDSG

SEQ ID NO: 598262 - protein, 9 aa, Homo Sapiens
SFPKGYETS

SEQ ID NO: 598263 - protein, 9 aa, Homo Sapiens
CKSLGRFPK

SEQ ID NO: 598264 - protein, 9 aa, Homo Sapiens
GVMSTSQMT

SEQ ID NO: 598265 - protein, 9 aa, Homo Sapiens
PKGPPAQIA

SEQ ID NO: 598266 - protein, 9 aa, Homo Sapiens
DPKGPPAQI

SEQ ID NO: 598267 - protein, 9 aa, Homo Sapiens
SQEFLRHLR

SEQ ID NO: 598268 - protein, 9 aa, Homo Sapiens
IFMEQVPRG

SEQ ID NO: 598269 - protein, 9 aa, Homo Sapiens
EPGQLIQTV

SEQ ID NO: 598270 - protein, 9 aa, Homo Sapiens
QVCSSKTGN

SEQ ID NO: 598271 - protein, 9 aa, Homo Sapiens
PSNGGSCTD

SEQ ID NO: 598272 - protein, 9 aa, Homo Sapiens
ASADFLLTT

SEQ ID NO: 598273 - protein, 9 aa, Homo Sapiens
ANVLYRDLK

SEQ ID NO: 598274 - protein, 9 aa, Homo Sapiens
HEKNSLFEH

SEQ ID NO: 598275 - protein, 9 aa, Homo Sapiens
VANSSPRIS

SEQ ID NO: 598276 - protein, 9 aa, Homo Sapiens
GALAITMAG

SEQ ID NO: 598277 - protein, 9 aa, Homo Sapiens
KGKVKEPPI

SEQ ID NO: 598278 - protein, 9 aa, Homo Sapiens
AKERKGKNA

SEQ ID NO: 598279 - protein, 9 aa, Homo Sapiens
LQDLPPQMA

SEQ ID NO: 598280 - protein, 9 aa, Homo Sapiens
GGGPGYCGG

SEQ ID NO: 598281 - protein, 9 aa, Homo Sapiens
KNSLFEHKI

SEQ ID NO: 598282 - protein, 9 aa, Homo Sapiens
NQQFDSEEE

SEQ ID NO: 598283 - protein, 9 aa, Homo Sapiens
TLGALALAQ

SEQ ID NO: 598284 - protein, 9 aa, Homo Sapiens
TVSCWTLGA

SEQ ID NO: 598285 - protein, 9 aa, Homo Sapiens
HPLHVIRIN

SEQ ID NO: 598286 - protein, 9 aa, Homo Sapiens
LYVNMLRNK

SEQ ID NO: 598287 - protein, 9 aa, Homo Sapiens
RLPSKTPYI

SEQ ID NO: 598288 - protein, 9 aa, Homo Sapiens
DKSTEPGTS

SEQ ID NO: 598289 - protein, 9 aa, Homo Sapiens
ITGQVCSSK

SEQ ID NO: 598290 - protein, 9 aa, Homo Sapiens
TLGVPHPPP

SEQ ID NO: 598291 - protein, 9 aa, Homo Sapiens
KSLGGSSMT

SEQ ID NO: 598292 - protein, 9 aa, Homo Sapiens
QCIKCMLAL

SEQ ID NO: 598293 - protein, 9 aa, Homo Sapiens
SQLHLRCVK

SEQ ID NO: 598294 - protein, 9 aa, Homo Sapiens
EQVPRGSLS

SEQ ID NO: 598295 - protein, 9 aa, Homo Sapiens
TSVLEPLKV

SEQ ID NO: 598296 - protein, 9 aa, Homo Sapiens
AHTALTLGV

SEQ ID NO: 598297 - protein, 9 aa, Homo Sapiens
RELKAENYH

SEQ ID NO: 598298 - protein, 9 aa, Homo Sapiens
LVFVSALLK

SEQ ID NO: 598299 - protein, 9 aa, Homo Sapiens
KERKGKNAR

SEQ ID NO: 598300 - protein, 9 aa, Homo Sapiens
PSKTPYITS

SEQ ID NO: 598301 - protein, 9 aa, Homo Sapiens
CGAFYSDGE

SEQ ID NO: 598302 - protein, 9 aa, Homo Sapiens
KIHEKNSLF

SEQ ID NO: 598303 - protein, 9 aa, Homo Sapiens
VCSSKTGNV

SEQ ID NO: 598304 - protein, 9 aa, Homo Sapiens
EDVKVDREL

SEQ ID NO: 598305 - protein, 9 aa, Homo Sapiens
LETTSSQPA

SEQ ID NO: 598306 - protein, 9 aa, Homo Sapiens
AEPGQLIQT

SEQ ID NO: 598307 - protein, 9 aa, Homo Sapiens
PYIVGFCGA

SEQ ID NO: 598308 - protein, 9 aa, Homo Sapiens
MCKWCCHCF

SEQ ID NO: 598309 - protein, 9 aa, Homo Sapiens
LQKDSGAIR

SEQ ID NO: 598310 - protein, 9 aa, Homo Sapiens
SRKKSLKNP

SEQ ID NO: 598311 - protein, 9 aa, Homo Sapiens
LSNRVNDGV

SEQ ID NO: 598312 - protein, 9 aa, Homo Sapiens
AATSVLEPL

SEQ ID NO: 598313 - protein, 9 aa, Homo Sapiens
SKATANSVW

SEQ ID NO: 598314 - protein, 9 aa, Homo Sapiens
KSLGRFPKG

SEQ ID NO: 598315 - protein, 9 aa, Homo Sapiens
VDRELRPGP

SEQ ID NO: 598316 - protein, 9 aa, Homo Sapiens
VVAVARELK

SEQ ID NO: 598317 - protein, 9 aa, Homo Sapiens
NPALFLEAE

SEQ ID NO: 598318 - protein, 9 aa, Homo Sapiens
EGVMTALIK

SEQ ID NO: 598319 - protein, 9 aa, Homo Sapiens
LYVDGESCT

SEQ ID NO: 598320 - protein, 9 aa, Homo Sapiens
AEGVMTALI

SEQ ID NO: 598321 - protein, 9 aa, Homo Sapiens
NYFKTNNFQ

SEQ ID NO: 598322 - protein, 9 aa, Homo Sapiens
AVSGNQMVA

SEQ ID NO: 598323 - protein, 9 aa, Homo Sapiens
QDYVEDTSK

SEQ ID NO: 598324 - protein, 9 aa, Homo Sapiens
SPEIKEAIK

SEQ ID NO: 598325 - protein, 9 aa, Homo Sapiens
PPKFPVIPI

SEQ ID NO: 598326 - protein, 9 aa, Homo Sapiens
KLYVDGESC

SEQ ID NO: 598327 - protein, 9 aa, Homo Sapiens
ARELKAENY

SEQ ID NO: 598328 - protein, 9 aa, Homo Sapiens
NPEFENVEL

SEQ ID NO: 598329 - protein, 9 aa, Homo Sapiens
VGFCGAFYS

SEQ ID NO: 598330 - protein, 9 aa, Homo Sapiens
NVELAEGEK

SEQ ID NO: 598331 - protein, 9 aa, Homo Sapiens
PSKAAVETQ

SEQ ID NO: 598332 - protein, 9 aa, Homo Sapiens
CWTLGALAL

SEQ ID NO: 598333 - protein, 9 aa, Homo Sapiens
TKYEEAKAS

SEQ ID NO: 598334 - protein, 9 aa, Homo Sapiens
DYVEDTSKY

SEQ ID NO: 598335 - protein, 9 aa, Homo Sapiens
SDPKGPPAQ

SEQ ID NO: 598336 - protein, 9 aa, Homo Sapiens
PPAQIARLE

SEQ ID NO: 598337 - protein, 9 aa, Homo Sapiens
FPKGYETSI

SEQ ID NO: 598338 - protein, 9 aa, Homo Sapiens
KNPALFLEA

SEQ ID NO: 598339 - protein, 9 aa, Homo Sapiens
VTMADLFLV

SEQ ID NO: 598340 - protein, 9 aa, Homo Sapiens
IRVLPGSVQ

SEQ ID NO: 598341 - protein, 9 aa, Homo Sapiens
ELKAENYHD

SEQ ID NO: 598342 - protein, 9 aa, Homo Sapiens
GAIRSQYAH

SEQ ID NO: 598343 - protein, 9 aa, Homo Sapiens
IKSVKYIAE

SEQ ID NO: 598344 - protein, 9 aa, Homo Sapiens
ENAEPGQLI

SEQ ID NO: 598345 - protein, 9 aa, Homo Sapiens
TVGIVAPGC

SEQ ID NO: 598346 - protein, 9 aa, Homo Sapiens
AIKSVKYIA

SEQ ID NO: 598347 - protein, 9 aa, Homo Sapiens
APGCFVLIV

SEQ ID NO: 598348 - protein, 9 aa, Homo Sapiens
ACSPSKAAV

SEQ ID NO: 598349 - protein, 9 aa, Homo Sapiens
KTLRSKMCK

SEQ ID NO: 598350 - protein, 9 aa, Homo Sapiens
MKTLRSKMC

SEQ ID NO: 598351 - protein, 9 aa, Homo Sapiens
PLRYPVPMN

SEQ ID NO: 598352 - protein, 9 aa, Homo Sapiens
SFSLSQEFL

SEQ ID NO: 598353 - protein, 9 aa, Homo Sapiens
HHKPTILRK

SEQ ID NO: 598354 - protein, 9 aa, Homo Sapiens
AFVRVLHCN

SEQ ID NO: 598355 - protein, 9 aa, Homo Sapiens
FKTNNFQAR

SEQ ID NO: 598356 - protein, 9 aa, Homo Sapiens
EIKEAIKSV

SEQ ID NO: 598357 - protein, 9 aa, Homo Sapiens
HIRVRLHPL

SEQ ID NO: 598358 - protein, 9 aa, Homo Sapiens
VTVGIVAPG

SEQ ID NO: 598359 - protein, 9 aa, Homo Sapiens
LTTAAAPKV

SEQ ID NO: 598360 - protein, 9 aa, Homo Sapiens
FVCENAEPG

SEQ ID NO: 598361 - protein, 9 aa, Homo Sapiens
LGVPHPPPR

SEQ ID NO: 598362 - protein, 9 aa, Homo Sapiens
FRLPSKTPY

SEQ ID NO: 598363 - protein, 9 aa, Homo Sapiens
FTFETVIKM

SEQ ID NO: 598364 - protein, 9 aa, Homo Sapiens
ATSVLEPLK

SEQ ID NO: 598365 - protein, 9 aa, Homo Sapiens
TDKSTEPGT

SEQ ID NO: 598366 - protein, 9 aa, Homo Sapiens
KTNNFQARV

SEQ ID NO: 598367 - protein, 9 aa, Homo Sapiens
LALFSSCPV

SEQ ID NO: 598368 - protein, 9 aa, Homo Sapiens
TGYKPLYIL

SEQ ID NO: 598369 - protein, 9 aa, Homo Sapiens
TTAAAPKVL

SEQ ID NO: 598370 - protein, 9 aa, Homo Sapiens
VHPNVANSS

SEQ ID NO: 598371 - protein, 9 aa, Homo Sapiens
SKYLAPQEG

SEQ ID NO: 598372 - protein, 9 aa, Homo Sapiens
ANSSPRISL

SEQ ID NO: 598373 - protein, 9 aa, Homo Sapiens
GDHMVSDEY

SEQ ID NO: 598374 - protein, 9 aa, Homo Sapiens
NVLVPKKAS

SEQ ID NO: 598375 - protein, 9 aa, Homo Sapiens
HSLMMGTHR

SEQ ID NO: 598376 - protein, 9 aa, Homo Sapiens
YETSIYSLS

SEQ ID NO: 598377 - protein, 9 aa, Homo Sapiens
SPSKAAVET

SEQ ID NO: 598378 - protein, 9 aa, Homo Sapiens
AQIARLEQN

SEQ ID NO: 598379 - protein, 9 aa, Homo Sapiens
TIRVLPGSV

SEQ ID NO: 598380 - protein, 9 aa, Homo Sapiens
GGSRRPHHK

SEQ ID NO: 598381 - protein, 9 aa, Homo Sapiens
LYRDLKPSN

SEQ ID NO: 598382 - protein, 9 aa, Homo Sapiens
QIARLEQNG

SEQ ID NO: 598383 - protein, 9 aa, Homo Sapiens
LFEHKILEM

SEQ ID NO: 598384 - protein, 9 aa, Homo Sapiens
GWKLYVDGE

SEQ ID NO: 598385 - protein, 9 aa, Homo Sapiens
LVESQLHLR

SEQ ID NO: 598386 - protein, 9 aa, Homo Sapiens
ANRHSLMMG

SEQ ID NO: 598387 - protein, 9 aa, Homo Sapiens
YNVLVPKKA

SEQ ID NO: 598388 - protein, 9 aa, Homo Sapiens
LNYFKTNNF

SEQ ID NO: 598389 - protein, 9 aa, Homo Sapiens
SLGGSSMTE

SEQ ID NO: 598390 - protein, 9 aa, Homo Sapiens
SGVKIFYVS

SEQ ID NO: 598391 - protein, 9 aa, Homo Sapiens
EAIKSVKYI

SEQ ID NO: 598392 - protein, 9 aa, Homo Sapiens
KYNVLVPKK

SEQ ID NO: 598393 - protein, 9 aa, Homo Sapiens
IVGFCGAFY

SEQ ID NO: 598394 - protein, 9 aa, Homo Sapiens
AVLLAFHAS

SEQ ID NO: 598395 - protein, 9 aa, Homo Sapiens
PGYCGGSRG

SEQ ID NO: 598396 - protein, 9 aa, Homo Sapiens
NPLRYPVPM

SEQ ID NO: 598397 - protein, 9 aa, Homo Sapiens
CNVAPPDVI

SEQ ID NO: 598398 - protein, 9 aa, Homo Sapiens
PRGSLSALL

SEQ ID NO: 598399 - protein, 9 aa, Homo Sapiens
NRMSSSSQH

SEQ ID NO: 598400 - protein, 9 aa, Homo Sapiens
FTGVFTFET

SEQ ID NO: 598401 - protein, 9 aa, Homo Sapiens
SPYIVGFCG

SEQ ID NO: 598402 - protein, 9 aa, Homo Sapiens
PGMVKTTDK

SEQ ID NO: 598403 - protein, 9 aa, Homo Sapiens
LMMGTHRED

SEQ ID NO: 598404 - protein, 9 aa, Homo Sapiens
SGNQMVASL

SEQ ID NO: 598405 - protein, 9 aa, Homo Sapiens
HSANVLYRD

SEQ ID NO: 598406 - protein, 9 aa, Homo Sapiens
QKDSGAIRS

SEQ ID NO: 598407 - protein, 9 aa, Homo Sapiens
SSCPPSNGG

SEQ ID NO: 598408 - protein, 9 aa, Homo Sapiens
PGSVQFNGY

SEQ ID NO: 598409 - protein, 9 aa, Homo Sapiens
KYLAPQEGN

SEQ ID NO: 598410 - protein, 9 aa, Homo Sapiens
CSSCPPSNG

SEQ ID NO: 598411 - protein, 9 aa, Homo Sapiens
MSSSSQHSR

SEQ ID NO: 598412 - protein, 9 aa, Homo Sapiens
RPHHKPTIL

SEQ ID NO: 598413 - protein, 9 aa, Homo Sapiens
DHMVSDEYE

SEQ ID NO: 598414 - protein, 9 aa, Homo Sapiens
FEHKILEME

SEQ ID NO: 598415 - protein, 9 aa, Homo Sapiens
ERKGKNARA

SEQ ID NO: 598416 - protein, 9 aa, Homo Sapiens
FHYLNYFKT

SEQ ID NO: 598417 - protein, 9 aa, Homo Sapiens
SVQFNGYNC

SEQ ID NO: 598418 - protein, 9 aa, Homo Sapiens
EAKASKATA

SEQ ID NO: 598419 - protein, 9 aa, Homo Sapiens
KSLKNPALF

SEQ ID NO: 598420 - protein, 9 aa, Homo Sapiens
GYKPLYILS

SEQ ID NO: 598421 - protein, 9 aa, Homo Sapiens
QVPRGSLSA

SEQ ID NO: 598422 - protein, 9 aa, Homo Sapiens
FVRVLHCNV

SEQ ID NO: 598423 - protein, 9 aa, Homo Sapiens
ESLDNQQFD

SEQ ID NO: 598424 - protein, 9 aa, Homo Sapiens
GVKIFYVSQ

SEQ ID NO: 598425 - protein, 9 aa, Homo Sapiens
QSNPEFENV

SEQ ID NO: 598426 - protein, 9 aa, Homo Sapiens
SANVLYRDL

SEQ ID NO: 598427 - protein, 9 aa, Homo Sapiens
YQCIKCMLA

SEQ ID NO: 598428 - protein, 9 aa, Homo Sapiens
CGGSRGYGS

SEQ ID NO: 598429 - protein, 9 aa, Homo Sapiens
LKYNVLVPK

SEQ ID NO: 598430 - protein, 9 aa, Homo Sapiens
CENAEPGQL

SEQ ID NO: 598431 - protein, 9 aa, Homo Sapiens
RARKSRNRM

SEQ ID NO: 598432 - protein, 9 aa, Homo Sapiens
VRLHPLHVI

SEQ ID NO: 598433 - protein, 9 aa, Homo Sapiens
KPLYILSNR

SEQ ID NO: 598434 - protein, 9 aa, Homo Sapiens
YITSEAVVP

SEQ ID NO: 598435 - protein, 9 aa, Homo Sapiens
GFCGAFYSD

SEQ ID NO: 598436 - protein, 9 aa, Homo Sapiens
FLVPQVANA

SEQ ID NO: 598437 - protein, 9 aa, Homo Sapiens
SIGLETTSS

SEQ ID NO: 598438 - protein, 9 aa, Homo Sapiens
NQMVASLLI

SEQ ID NO: 598439 - protein, 9 aa, Homo Sapiens
DLFLVPQVA

SEQ ID NO: 598440 - protein, 9 aa, Homo Sapiens
NAEPGQLIQ

SEQ ID NO: 598441 - protein, 9 aa, Homo Sapiens
SKTGNVLRN

SEQ ID NO: 598442 - protein, 9 aa, Homo Sapiens
VLHCNVAPP

SEQ ID NO: 598443 - protein, 9 aa, Homo Sapiens
KSVKYIAEN

SEQ ID NO: 598444 - protein, 9 aa, Homo Sapiens
SLMMGTHRE

SEQ ID NO: 598445 - protein, 9 aa, Homo Sapiens
HKPTILRKI

SEQ ID NO: 598446 - protein, 9 aa, Homo Sapiens
YGALAITMA

SEQ ID NO: 598447 - protein, 9 aa, Homo Sapiens
AVARELKAE

SEQ ID NO: 598448 - protein, 9 aa, Homo Sapiens
ALALAQVLF

SEQ ID NO: 598449 - protein, 9 aa, Homo Sapiens
RKKSLKNPA

SEQ ID NO: 598450 - protein, 9 aa, Homo Sapiens
HLRCVKFQE

SEQ ID NO: 598451 - protein, 9 aa, Homo Sapiens
GGPGYCGGS

SEQ ID NO: 598452 - protein, 9 aa, Homo Sapiens
LPPQMAPEI

SEQ ID NO: 598453 - protein, 9 aa, Homo Sapiens
SAVSGNQMV

SEQ ID NO: 598454 - protein, 9 aa, Homo Sapiens
RFPKGKVKE

SEQ ID NO: 598455 - protein, 9 aa, Homo Sapiens
HCNVAPPDV

SEQ ID NO: 598456 - protein, 9 aa, Homo Sapiens
MADLFLVPQ

SEQ ID NO: 598457 - protein, 9 aa, Homo Sapiens
PVPMNRKKC

SEQ ID NO: 598458 - protein, 9 aa, Homo Sapiens
GVFTFETVI

SEQ ID NO: 598459 - protein, 9 aa, Homo Sapiens
RLHPLHVIR

SEQ ID NO: 598460 - protein, 9 aa, Homo Sapiens
CMLALFSSC

SEQ ID NO: 598461 - protein, 9 aa, Homo Sapiens
MTETEAAPS

SEQ ID NO: 598462 - protein, 9 aa, Homo Sapiens
GSRRPHHKP

SEQ ID NO: 598463 - protein, 9 aa, Homo Sapiens
EFLRHLRQE

SEQ ID NO: 598464 - protein, 9 aa, Homo Sapiens
DYGALAITM

SEQ ID NO: 598465 - protein, 9 aa, Homo Sapiens
TVIKMIDLG

SEQ ID NO: 598466 - protein, 9 aa, Homo Sapiens
DEFPLGDHM

SEQ ID NO: 598467 - protein, 9 aa, Homo Sapiens
LPSKTPYIT

SEQ ID NO: 598468 - protein, 9 aa, Homo Sapiens
QMVASLLID

SEQ ID NO: 598469 - protein, 9 aa, Homo Sapiens
LRSKMCKWC

SEQ ID NO: 598470 - protein, 9 aa, Homo Sapiens
KREDVKVDR

SEQ ID NO: 598471 - protein, 9 aa, Homo Sapiens
KPSCMLESS

SEQ ID NO: 598472 - protein, 9 aa, Homo Sapiens
MVKTTDKST

SEQ ID NO: 598473 - protein, 9 aa, Homo Sapiens
NKPSCMLES

SEQ ID NO: 598474 - protein, 9 aa, Homo Sapiens
LSQEFLRHL

SEQ ID NO: 598475 - protein, 9 aa, Homo Sapiens
LHVIRINKM

SEQ ID NO: 598476 - protein, 9 aa, Homo Sapiens
YRDLKPSNL

SEQ ID NO: 598477 - protein, 9 aa, Homo Sapiens
LALVFVSAL

SEQ ID NO: 598478 - protein, 9 aa, Homo Sapiens
DAATSVLEP

SEQ ID NO: 598479 - protein, 9 aa, Homo Sapiens
ARKSRNRMS

SEQ ID NO: 598480 - protein, 9 aa, Homo Sapiens
TSKYLAPQE

SEQ ID NO: 598481 - protein, 9 aa, Homo Sapiens
GSVQFNGYN

SEQ ID NO: 598482 - protein, 9 aa, Homo Sapiens
RVETHFDLE

SEQ ID NO: 598483 - protein, 9 aa, Homo Sapiens
PGCFVLIVL

SEQ ID NO: 598484 - protein, 9 aa, Homo Sapiens
HTALTLGVP

SEQ ID NO: 598485 - protein, 9 aa, Homo Sapiens
KKSLKNPAL

SEQ ID NO: 598486 - protein, 9 aa, Homo Sapiens
FLRHLRQEE

SEQ ID NO: 598487 - protein, 9 aa, Homo Sapiens
YFKTNNFQA

SEQ ID NO: 598488 - protein, 9 aa, Homo Sapiens
NLALVFVSA

SEQ ID NO: 598489 - protein, 9 aa, Homo Sapiens
NVANSSPRI

SEQ ID NO: 598490 - protein, 9 aa, Homo Sapiens
VLLAFHASP

SEQ ID NO: 598491 - protein, 9 aa, Homo Sapiens
SKAAVETQL

SEQ ID NO: 598492 - protein, 9 aa, Homo Sapiens
VNMLRNKPS

SEQ ID NO: 598493 - protein, 9 aa, Homo Sapiens
PKFPVIPIL

SEQ ID NO: 598494 - protein, 9 aa, Homo Sapiens
ALVFVSALL

SEQ ID NO: 598495 - protein, 9 aa, Homo Sapiens
SLDNQQFDS

SEQ ID NO: 598496 - protein, 9 aa, Homo Sapiens
LAITMAGIA

SEQ ID NO: 598497 - protein, 9 aa, Homo Sapiens
SCWTLGALA

SEQ ID NO: 598498 - protein, 9 aa, Homo Sapiens
CKWCCHCFP

SEQ ID NO: 598499 - protein, 9 aa, Homo Sapiens
RDLQDLPPQ

SEQ ID NO: 598500 - protein, 9 aa, Homo Sapiens
VTKQRVETH

SEQ ID NO: 598501 - protein, 9 aa, Homo Sapiens
CTQMAIKIW

SEQ ID NO: 598502 - protein, 9 aa, Homo Sapiens
VSALLKKGK

SEQ ID NO: 598503 - protein, 9 aa, Homo Sapiens
PVIPILSSS

SEQ ID NO: 598504 - protein, 9 aa, Homo Sapiens
ALAITMAGI

SEQ ID NO: 598505 - protein, 9 aa, Homo Sapiens
GLETAEGVM

SEQ ID NO: 598506 - protein, 9 aa, Homo Sapiens
KIWVIGFFH

SEQ ID NO: 598507 - protein, 9 aa, Homo Sapiens
GKNARALMN

SEQ ID NO: 598508 - protein, 9 aa, Homo Sapiens
CFLVESQLH

SEQ ID NO: 598509 - protein, 9 aa, Homo Sapiens
AIKIWVIGF

SEQ ID NO: 598510 - protein, 9 aa, Homo Sapiens
ADFLLTTAA

SEQ ID NO: 598511 - protein, 9 aa, Homo Sapiens
TMADLFLVP

SEQ ID NO: 598512 - protein, 9 aa, Homo Sapiens
KVDEFPLGD

SEQ ID NO: 598513 - protein, 9 aa, Homo Sapiens
QLQKDSGAI

SEQ ID NO: 598514 - protein, 9 aa, Homo Sapiens
GRFPKGKVK

SEQ ID NO: 598515 - protein, 9 aa, Homo Sapiens
SLGRFPKGK

SEQ ID NO: 598516 - protein, 9 aa, Homo Sapiens
NFESLDNQQ

SEQ ID NO: 598517 - protein, 9 aa, Homo Sapiens
KFPVIPILS

SEQ ID NO: 598518 - protein, 9 aa, Homo Sapiens
EPPKFPVIP

SEQ ID NO: 598519 - protein, 9 aa, Homo Sapiens
YVEDTSKYL

SEQ ID NO: 598520 - protein, 9 aa, Homo Sapiens
VETHFDLEL

SEQ ID NO: 598521 - protein, 9 aa, Homo Sapiens
GDPACSPSK

SEQ ID NO: 598522 - protein, 9 aa, Homo Sapiens
SLKNPALFL

SEQ ID NO: 598523 - protein, 9 aa, Homo Sapiens
QEPPKFPVI

SEQ ID NO: 598524 - protein, 9 aa, Homo Sapiens
RGSLSALLR

SEQ ID NO: 598525 - protein, 9 aa, Homo Sapiens
TVTKQRVET

SEQ ID NO: 598526 - protein, 9 aa, Homo Sapiens
KFHYLNYFK

SEQ ID NO: 598527 - protein, 9 aa, Homo Sapiens
ASKATANSV

SEQ ID NO: 598528 - protein, 9 aa, Homo Sapiens
LVPKKASGF

SEQ ID NO: 598529 - protein, 9 aa, Homo Sapiens
CNPLRYPVP

SEQ ID NO: 598530 - protein, 9 aa, Homo Sapiens
LPGSVQFNG

SEQ ID NO: 598531 - protein, 9 aa, Homo Sapiens
PKGKVKEPP

SEQ ID NO: 598532 - protein, 9 aa, Homo Sapiens
ASGVMSTSQ

SEQ ID NO: 598533 - protein, 9 aa, Homo Sapiens
TSRSIGLET

SEQ ID NO: 598534 - protein, 9 aa, Homo Sapiens
KSRNRMSSS

SEQ ID NO: 598535 - protein, 9 aa, Homo Sapiens
SSKTGNVLR

SEQ ID NO: 598536 - protein, 9 aa, Homo Sapiens
AFHASPARP

SEQ ID NO: 598537 - protein, 9 aa, Homo Sapiens
DFLLTTAAA

SEQ ID NO: 598538 - protein, 9 aa, Homo Sapiens
VLVPKKASG

SEQ ID NO: 598539 - protein, 9 aa, Homo Sapiens
STDAATSVL

SEQ ID NO: 598540 - protein, 9 aa, Homo Sapiens
GSSMTETEA

SEQ ID NO: 598541 - protein, 9 aa, Homo Sapiens
DPACSPSKA

SEQ ID NO: 598542 - protein, 9 aa, Homo Sapiens
EEAKASKAT

SEQ ID NO: 598543 - protein, 9 aa, Homo Sapiens
MLRNKPSCM

SEQ ID NO: 598544 - protein, 9 aa, Homo Sapiens
PCSSCPPSN

SEQ ID NO: 598545 - protein, 9 aa, Homo Sapiens
RKGKNARAL

SEQ ID NO: 598546 - protein, 9 aa, Homo Sapiens
KIFYVSQTG

SEQ ID NO: 598547 - protein, 9 aa, Homo Sapiens
VLPGSVQFN

SEQ ID NO: 598548 - protein, 9 aa, Homo Sapiens
LPSSFPKGY

SEQ ID NO: 598549 - protein, 9 aa, Homo Sapiens
SLGLETAEG

SEQ ID NO: 598550 - protein, 9 aa, Homo Sapiens
DLPPQMAPE

SEQ ID NO: 598551 - protein, 9 aa, Homo Sapiens
VAVARELKA

SEQ ID NO: 598552 - protein, 9 aa, Homo Sapiens
IHEKNSLFE

SEQ ID NO: 598553 - protein, 9 aa, Homo Sapiens
LLTTAAAPK

SEQ ID NO: 598554 - protein, 9 aa, Homo Sapiens
GMVKTTDKS

SEQ ID NO: 598555 - protein, 9 aa, Homo Sapiens
GYCGGSRGY

SEQ ID NO: 598556 - protein, 9 aa, Homo Sapiens
KVDRELRPG

SEQ ID NO: 598557 - protein, 9 aa, Homo Sapiens
VPRGSLSAL

SEQ ID NO: 598558 - protein, 9 aa, Homo Sapiens
HPNVANSSP

SEQ ID NO: 598559 - protein, 9 aa, Homo Sapiens
DSGAIRSQY

SEQ ID NO: 598560 - protein, 9 aa, Homo Sapiens
SCYEGWKLY

SEQ ID NO: 598561 - protein, 9 aa, Homo Sapiens
VSQTGTAKG

SEQ ID NO: 598562 - protein, 9 aa, Homo Sapiens
HASPARPQP

SEQ ID NO: 598563 - protein, 9 aa, Homo Sapiens
VAPGCFVLI

SEQ ID NO: 598564 - protein, 9 aa, Homo Sapiens
LKAENYHDI

SEQ ID NO: 598565 - protein, 9 aa, Homo Sapiens
SKTPYITSE

SEQ ID NO: 598566 - protein, 9 aa, Homo Sapiens
DTASGVMST

SEQ ID NO: 598567 - protein, 9 aa, Homo Sapiens
RVRLHPLHV

SEQ ID NO: 598568 - protein, 9 aa, Homo Sapiens
NMLRNKPSC

SEQ ID NO: 598569 - protein, 9 aa, Homo Sapiens
LSLGLETAE

SEQ ID NO: 598570 - protein, 9 aa, Homo Sapiens
SSPRISLRS

SEQ ID NO: 598571 - protein, 9 aa, Homo Sapiens
FSLSQEFLR

SEQ ID NO: 598572 - protein, 9 aa, Homo Sapiens
KCMLALFSS

SEQ ID NO: 598573 - protein, 9 aa, Homo Sapiens
PNVANSSPR

SEQ ID NO: 598574 - protein, 9 aa, Homo Sapiens
YVSQTGTAK

SEQ ID NO: 598575 - protein, 9 aa, Homo Sapiens
RNKPSCMLE

SEQ ID NO: 598576 - protein, 9 aa, Homo Sapiens
TPYITSEAV

SEQ ID NO: 598577 - protein, 9 aa, Homo Sapiens
VKVDRELRP

SEQ ID NO: 598578 - protein, 9 aa, Homo Sapiens
TDAATSVLE

SEQ ID NO: 598579 - protein, 9 aa, Homo Sapiens
GPPAQIARL

SEQ ID NO: 598580 - protein, 9 aa, Homo Sapiens
RSIGLETTS

SEQ ID NO: 598581 - protein, 9 aa, Homo Sapiens
YVDGESCTS

SEQ ID NO: 598582 - protein, 9 aa, Homo Sapiens
PYITSEAVV

SEQ ID NO: 598583 - protein, 9 aa, Homo Sapiens
THFDLELRA

SEQ ID NO: 598584 - protein, 9 aa, Homo Sapiens
ISTDAATSV

SEQ ID NO: 598585 - protein, 9 aa, Homo Sapiens
PEIKEAIKS

SEQ ID NO: 598586 - protein, 9 aa, Homo Sapiens
ILSNRVNDG

SEQ ID NO: 598587 - protein, 9 aa, Homo Sapiens
ATLKYNVLV

SEQ ID NO: 598588 - protein, 9 aa, Homo Sapiens
CPPSNGGSC

SEQ ID NO: 598589 - protein, 9 aa, Homo Sapiens
NRHSLMMGT

SEQ ID NO: 598590 - protein, 9 aa, Homo Sapiens
QLCTQMAIK

SEQ ID NO: 598591 - protein, 9 aa, Homo Sapiens
VSAVSGNQM

SEQ ID NO: 598592 - protein, 9 aa, Homo Sapiens
NVAPPDVIA

SEQ ID NO: 598593 - protein, 9 aa, Homo Sapiens
KSRKKSLKN

SEQ ID NO: 598594 - protein, 9 aa, Homo Sapiens
AKASKATAN

SEQ ID NO: 598595 - protein, 9 aa, Homo Sapiens
KDSGAIRSQ

SEQ ID NO: 598596 - protein, 9 aa, Homo Sapiens
KAAVETQLA

SEQ ID NO: 598597 - protein, 9 aa, Homo Sapiens
SKMCKWCCH

SEQ ID NO: 598598 - protein, 9 aa, Homo Sapiens
TAEGVMTAL

SEQ ID NO: 598599 - protein, 9 aa, Homo Sapiens
VSGVKIFYV

SEQ ID NO: 598600 - protein, 9 aa, Homo Sapiens
RSKMCKWCC

SEQ ID NO: 598601 - protein, 9 aa, Homo Sapiens
TLKYNVLVP

SEQ ID NO: 598602 - protein, 9 aa, Homo Sapiens
IFYVSQTGT

SEQ ID NO: 598603 - protein, 9 aa, Homo Sapiens
YILSNRVND

SEQ ID NO: 598604 - protein, 9 aa, Homo Sapiens
LKNPALFLE

SEQ ID NO: 598605 - protein, 9 aa, Homo Sapiens
QMAIKIWVI

SEQ ID NO: 598606 - protein, 9 aa, Homo Sapiens
NARALMNLH

SEQ ID NO: 598607 - protein, 9 aa, Homo Sapiens
EGWKLYVDG

SEQ ID NO: 598608 - protein, 9 aa, Homo Sapiens
IVAPGCFVL

SEQ ID NO: 598609 - protein, 9 aa, Homo Sapiens
EDTSKYLAP

SEQ ID NO: 598610 - protein, 9 aa, Homo Sapiens
MGTHREDGV

SEQ ID NO: 598611 - protein, 9 aa, Homo Sapiens
KASKATANS

SEQ ID NO: 598612 - protein, 9 aa, Homo Sapiens
IPILSSSFM

SEQ ID NO: 598613 - protein, 9 aa, Homo Sapiens
SRRPHHKPT

SEQ ID NO: 598614 - protein, 9 aa, Homo Sapiens
LLAFHASPA

SEQ ID NO: 598615 - protein, 9 aa, Homo Sapiens
GKREDVKVD

SEQ ID NO: 598616 - protein, 9 aa, Homo Sapiens
WISTDAATS

SEQ ID NO: 598617 - protein, 9 aa, Homo Sapiens
VEDTSKYLA

SEQ ID NO: 598618 - protein, 9 aa, Homo Sapiens
RVLPGSVQF

SEQ ID NO: 598619 - protein, 9 aa, Homo Sapiens
SRNRMSSSS

SEQ ID NO: 598620 - protein, 9 aa, Homo Sapiens
VQFNGYNCD

SEQ ID NO: 598621 - protein, 9 aa, Homo Sapiens
LGLETAEGV

SEQ ID NO: 598622 - protein, 9 aa, Homo Sapiens
STNLALVFV

SEQ ID NO: 598623 - protein, 9 aa, Homo Sapiens
GIVAPGCFV

SEQ ID NO: 598624 - protein, 9 aa, Homo Sapiens
QQFDSEEET

SEQ ID NO: 598625 - protein, 9 aa, Homo Sapiens
NSSPRISLR

SEQ ID NO: 598626 - protein, 9 aa, Homo Sapiens
SCPPSNGGS

SEQ ID NO: 598627 - protein, 9 aa, Homo Sapiens
PKGYETSIY

SEQ ID NO: 598628 - protein, 9 aa, Homo Sapiens
KGYETSIYS

SEQ ID NO: 598629 - protein, 9 aa, Homo Sapiens
GKAHHNEWQ

SEQ ID NO: 598630 - protein, 9 aa, Homo Sapiens
DEVTMADLF

SEQ ID NO: 598631 - protein, 9 aa, Homo Sapiens
MMGTHREDG

SEQ ID NO: 598632 - protein, 9 aa, Homo Sapiens
CIKCMLALF

SEQ ID NO: 598633 - protein, 9 aa, Homo Sapiens
TFVCENAEP

SEQ ID NO: 598634 - protein, 9 aa, Homo Sapiens
NSLFEHKIL

SEQ ID NO: 598635 - protein, 9 aa, Homo Sapiens
KNARALMNL

SEQ ID NO: 598636 - protein, 9 aa, Homo Sapiens
KGKNARALM

SEQ ID NO: 598637 - protein, 9 aa, Homo Sapiens
SGAIRSQYA

SEQ ID NO: 598638 - protein, 9 aa, Homo Sapiens
LYILSNRVN

SEQ ID NO: 598639 - protein, 9 aa, Homo Sapiens
ETHFDLELR

SEQ ID NO: 598640 - protein, 9 aa, Homo Sapiens
FHASPARPQ

SEQ ID NO: 598641 - protein, 9 aa, Homo Sapiens
ADLFLVPQV

SEQ ID NO: 598642 - protein, 9 aa, Homo Sapiens
SGVMSTSQM

SEQ ID NO: 598643 - protein, 9 aa, Homo Sapiens
VELAEGEKI

SEQ ID NO: 598644 - protein, 9 aa, Homo Sapiens
PMNRKKCLL

SEQ ID NO: 598645 - protein, 9 aa, Homo Sapiens
FESLDNQQF

SEQ ID NO: 598646 - protein, 9 aa, Homo Sapiens
VPHPPPRDH

SEQ ID NO: 598647 - protein, 9 aa, Homo Sapiens
FLVESQLHL

SEQ ID NO: 598648 - protein, 9 aa, Homo Sapiens
FMEQVPRGS

SEQ ID NO: 598649 - protein, 9 aa, Homo Sapiens
TGVFTFETV

SEQ ID NO: 598650 - protein, 9 aa, Homo Sapiens
VKTTDKSTE

SEQ ID NO: 598651 - protein, 9 aa, Homo Sapiens
FETVIKMID

SEQ ID NO: 598652 - protein, 9 aa, Homo Sapiens
SLFEHKILE

SEQ ID NO: 598653 - protein, 9 aa, Homo Sapiens
LDNQQFDSE

SEQ ID NO: 598654 - protein, 9 aa, Homo Sapiens
MAIKIWVIG

SEQ ID NO: 598655 - protein, 9 aa, Homo Sapiens
SNPEFENVE

SEQ ID NO: 598656 - protein, 9 aa, Homo Sapiens
LGDHMVSDE

SEQ ID NO: 598657 - protein, 9 aa, Homo Sapiens
MEQVPRGSL

SEQ ID NO: 598658 - protein, 9 aa, Homo Sapiens
KTPYITSEA

SEQ ID NO: 598659 - protein, 9 aa, Homo Sapiens
KTTDKSTEP

SEQ ID NO: 598660 - protein, 9 aa, Homo Sapiens
FPKGKVKEP

SEQ ID NO: 598661 - protein, 9 aa, Homo Sapiens
RRPHHKPTI

SEQ ID NO: 598662 - protein, 9 aa, Homo Sapiens
VFTFETVIK

SEQ ID NO: 598663 - protein, 9 aa, Homo Sapiens
SVHPNVANS

SEQ ID NO: 598664 - protein, 9 aa, Homo Sapiens
ETFVCENAE

SEQ ID NO: 598665 - protein, 9 aa, Homo Sapiens
QRVETHFDL

SEQ ID NO: 598666 - protein, 9 aa, Homo Sapiens
EFENVELAE

SEQ ID NO: 598667 - protein, 9 aa, Homo Sapiens
GYETSIYSL

SEQ ID NO: 598668 - protein, 9 aa, Homo Sapiens
QFDSEEETV

SEQ ID NO: 598669 - protein, 9 aa, Homo Sapiens
YVNMLRNKP

SEQ ID NO: 598670 - protein, 9 aa, Homo Sapiens
REDVKVDRE

SEQ ID NO: 598671 - protein, 9 aa, Homo Sapiens
PSSFPKGYE

SEQ ID NO: 598672 - protein, 9 aa, Homo Sapiens
FCGAFYSDG

SEQ ID NO: 598673 - protein, 9 aa, Homo Sapiens
GNQMVASLL

SEQ ID NO: 598674 - protein, 9 aa, Homo Sapiens
YIHSANVLY

SEQ ID NO: 598675 - protein, 9 aa, Homo Sapiens
KSTEPGTSL

SEQ ID NO: 598676 - protein, 9 aa, Homo Sapiens
AYQCIKCML

SEQ ID NO: 598677 - protein, 9 aa, Homo Sapiens
NGGSCTDNL

SEQ ID NO: 598678 - protein, 9 aa, Homo Sapiens
TMAGIAFGF

SEQ ID NO: 598679 - protein, 9 aa, Homo Sapiens
VGIVAPGCF

SEQ ID NO: 598680 - protein, 9 aa, Homo Sapiens
DLQDLPPQM

SEQ ID NO: 598681 - protein, 9 aa, Homo Sapiens
LAFHASPAR

SEQ ID NO: 598682 - protein, 9 aa, Homo Sapiens
RNRMSSSSQ

SEQ ID NO: 598683 - protein, 9 aa, Homo Sapiens
RKSRNRMSS

SEQ ID NO: 598684 - protein, 9 aa, Homo Sapiens
SSFPKGYET

SEQ ID NO: 598685 - protein, 9 aa, Homo Sapiens
HYLNYFKTN

SEQ ID NO: 598686 - protein, 9 aa, Homo Sapiens
IKCMLALFS

SEQ ID NO: 598687 - protein, 9 aa, Homo Sapiens
RVRDLQDLP

SEQ ID NO: 598688 - protein, 9 aa, Homo Sapiens
GGGSRRPHH

SEQ ID NO: 598689 - protein, 9 aa, Homo Sapiens
DVKVDRELR

SEQ ID NO: 598690 - protein, 9 aa, Homo Sapiens
VSCWTLGAL

SEQ ID NO: 598691 - protein, 9 aa, Homo Sapiens
SANRHSLMM

SEQ ID NO: 598692 - protein, 9 aa, Homo Sapiens
EKSLGGSSM

SEQ ID NO: 598693 - protein, 9 aa, Homo Sapiens
IGLETTSSQ

SEQ ID NO: 598694 - protein, 9 aa, Homo Sapiens
LHPLHVIRI

SEQ ID NO: 598695 - protein, 9 aa, Homo Sapiens
EKNSLFEHK

SEQ ID NO: 598696 - protein, 9 aa, Homo Sapiens
KIFMEQVPR

SEQ ID NO: 598697 - protein, 9 aa, Homo Sapiens
SSMTETEAA

SEQ ID NO: 598698 - protein, 9 aa, Homo Sapiens
YCGGSRGYG

SEQ ID NO: 598699 - protein, 9 aa, Homo Sapiens
FENVELAEG

SEQ ID NO: 598700 - protein, 9 aa, Homo Sapiens
PLHVIRINK

SEQ ID NO: 598701 - protein, 9 aa, Homo Sapiens
PAQIARLEQ

SEQ ID NO: 598702 - protein, 9 aa, Homo Sapiens
LASADFLLT

SEQ ID NO: 598703 - protein, 9 aa, Homo Sapiens
VPMNRKKCL

SEQ ID NO: 598704 - protein, 9 aa, Homo Sapiens
VMSTSQMTA

SEQ ID NO: 598705 - protein, 9 aa, Homo Sapiens
PLYILSNRV

SEQ ID NO: 598706 - protein, 9 aa, Homo Sapiens
RRVRDLQDL

SEQ ID NO: 598707 - protein, 9 aa, Homo Sapiens
TTDKSTEPG

SEQ ID NO: 598708 - protein, 9 aa, Homo Sapiens
FLLTTAAAP

SEQ ID NO: 598709 - protein, 9 aa, Homo Sapiens
GALALAQVL

SEQ ID NO: 598710 - protein, 9 aa, Homo Sapiens
YIVGFCGAF

SEQ ID NO: 598711 - protein, 9 aa, Homo Sapiens
KQRVETHFD

SEQ ID NO: 598712 - protein, 9 aa, Homo Sapiens
GQVCSSKTG

SEQ ID NO: 598713 - protein, 9 aa, Homo Sapiens
LFLVPQVAN

SEQ ID NO: 598714 - protein, 9 aa, Homo Sapiens
TALTLGVPH

SEQ ID NO: 598715 - protein, 9 aa, Homo Sapiens
DTSKYLAPQ

SEQ ID NO: 598716 - protein, 9 aa, Homo Sapiens
TASGVMSTS

SEQ ID NO: 598717 - protein, 9 aa, Homo Sapiens
CYEGWKLYV

SEQ ID NO: 598718 - protein, 9 aa, Homo Sapiens
VRVLHCNVA

SEQ ID NO: 598719 - protein, 9 aa, Homo Sapiens
CSPSKAAVE

SEQ ID NO: 598720 - protein, 9 aa, Homo Sapiens
SPARPQPAY

SEQ ID NO: 598721 - protein, 9 aa, Homo Sapiens
VARELKAEN

SEQ ID NO: 598722 - protein, 9 aa, Homo Sapiens
EVTMADLFL

SEQ ID NO: 598723 - protein, 9 aa, Homo Sapiens
RHSLMMGTH

SEQ ID NO: 598724 - protein, 9 aa, Homo Sapiens
VDEFPLGDH

SEQ ID NO: 598725 - protein, 9 aa, Homo Sapiens
NVLYRDLKP

SEQ ID NO: 598726 - protein, 9 aa, Homo Sapiens
RVLHCNVAP

SEQ ID NO: 598727 - protein, 9 aa, Homo Sapiens
RDYGALAIT

SEQ ID NO: 598728 - protein, 9 aa, Homo Sapiens
TGQVCSSKT

SEQ ID NO: 598729 - protein, 9 aa, Homo Sapiens
LGRFPKGKV

SEQ ID NO: 598730 - protein, 9 aa, Homo Sapiens
QEFLRHLRQ

SEQ ID NO: 598731 - protein, 9 aa, Homo Sapiens
VFVSALLKK

SEQ ID NO: 598732 - protein, 9 aa, Homo Sapiens
MVASLLIDA

SEQ ID NO: 598733 - protein, 9 aa, Homo Sapiens
VCENAEPGQ

SEQ ID NO: 598734 - protein, 9 aa, Homo Sapiens
LGKREDVKV

SEQ ID NO: 598735 - protein, 9 aa, Homo Sapiens
VKIFYVSQT

SEQ ID NO: 598736 - protein, 9 aa, Homo Sapiens
LGALALAQV

SEQ ID NO: 598737 - protein, 9 aa, Homo Sapiens
ASPARPQPA

SEQ ID NO: 598738 - protein, 9 aa, Homo Sapiens
PPSNGGSCT

SEQ ID NO: 598739 - protein, 9 aa, Homo Sapiens
LRNKPSCML

SEQ ID NO: 598740 - protein, 9 aa, Homo Sapiens
DNQQFDSEE

SEQ ID NO: 598741 - protein, 9 aa, Homo Sapiens
SLSQEFLRH

SEQ ID NO: 598742 - protein, 9 aa, Homo Sapiens
SNGGSCTDN

SEQ ID NO: 598743 - protein, 9 aa, Homo Sapiens
NSPYIVGFC

SEQ ID NO: 598744 - protein, 9 aa, Homo Sapiens
LRYPVPMNR

SEQ ID NO: 598745 - protein, 9 aa, Homo Sapiens
GLETTSSQP

SEQ ID NO: 598746 - protein, 9 aa, Homo Sapiens
SMTETEAAP

SEQ ID NO: 598747 - protein, 9 aa, Homo Sapiens
FVSALLKKG

SEQ ID NO: 598748 - protein, 9 aa, Homo Sapiens
SSFSLSQEF

SEQ ID NO: 598749 - protein, 9 aa, Homo Sapiens
ATSRSIGLE

SEQ ID NO: 598750 - protein, 9 aa, Homo Sapiens
MWISTDAAT

SEQ ID NO: 598751 - protein, 9 aa, Homo Sapiens
MLALFSSCP

SEQ ID NO: 598752 - protein, 9 aa, Homo Sapiens
RYPVPMNRK

SEQ ID NO: 598753 - protein, 9 aa, Homo Sapiens
LHCNVAPPD

SEQ ID NO: 598754 - protein, 9 aa, Homo Sapiens
LTLGVPHPP

SEQ ID NO: 598755 - protein, 9 aa, Homo Sapiens
VLYRDLKPS

SEQ ID NO: 598756 - protein, 9 aa, Homo Sapiens
KGPPAQIAR

SEQ ID NO: 598757 - protein, 9 aa, Homo Sapiens
QLHLRCVKF

SEQ ID NO: 598758 - protein, 9 aa, Homo Sapiens
VRLTEAPLN

SEQ ID NO: 598759 - protein, 9 aa, Homo Sapiens
IVMGENHVF

SEQ ID NO: 598760 - protein, 9 aa, Homo Sapiens
YELCPETTL

SEQ ID NO: 598761 - protein, 9 aa, Homo Sapiens
HLTKDKRKQ

SEQ ID NO: 598762 - protein, 9 aa, Homo Sapiens
FCMAKTAEE

SEQ ID NO: 598763 - protein, 9 aa, Homo Sapiens
KKEACFKRL

SEQ ID NO: 598764 - protein, 9 aa, Homo Sapiens
CSPHNCSGL

SEQ ID NO: 598765 - protein, 9 aa, Homo Sapiens
HIRESMKKF

SEQ ID NO: 598766 - protein, 9 aa, Homo Sapiens
VEEYVLKLD

SEQ ID NO: 598767 - protein, 9 aa, Homo Sapiens
SRRFNIDLV

SEQ ID NO: 598768 - protein, 9 aa, Homo Sapiens
MSDGGSVLA

SEQ ID NO: 598769 - protein, 9 aa, Homo Sapiens
NSDSSTVSS

SEQ ID NO: 598770 - protein, 9 aa, Homo Sapiens
RAWLDSMVL

SEQ ID NO: 598771 - protein, 9 aa, Homo Sapiens
ATNSDSSTV

SEQ ID NO: 598772 - protein, 9 aa, Homo Sapiens
CCVDAVNFL

SEQ ID NO: 598773 - protein, 9 aa, Homo Sapiens
HLVPYAKGL

SEQ ID NO: 598774 - protein, 9 aa, Homo Sapiens
REEHQFGPT

SEQ ID NO: 598775 - protein, 9 aa, Homo Sapiens
FRGEMIVND

SEQ ID NO: 598776 - protein, 9 aa, Homo Sapiens
SGDIIRGLR

SEQ ID NO: 598777 - protein, 9 aa, Homo Sapiens
RSLQAAQPS

SEQ ID NO: 598778 - protein, 9 aa, Homo Sapiens
HDGALRSQQ

SEQ ID NO: 598779 - protein, 9 aa, Homo Sapiens
FQALSKANE

SEQ ID NO: 598780 - protein, 9 aa, Homo Sapiens
SRLPREEHQ

SEQ ID NO: 598781 - protein, 9 aa, Homo Sapiens
RRGISEKRR

SEQ ID NO: 598782 - protein, 9 aa, Homo Sapiens
SASPFSSPI

SEQ ID NO: 598783 - protein, 9 aa, Homo Sapiens
ETTLTYTEE

SEQ ID NO: 598784 - protein, 9 aa, Homo Sapiens
LLWKTAFAF

SEQ ID NO: 598785 - protein, 9 aa, Homo Sapiens
GAGEEKMPP

SEQ ID NO: 598786 - protein, 9 aa, Homo Sapiens
KEMLYLIIM

SEQ ID NO: 598787 - protein, 9 aa, Homo Sapiens
KESRRFNID

SEQ ID NO: 598788 - protein, 9 aa, Homo Sapiens
QIVKESRRF

SEQ ID NO: 598789 - protein, 9 aa, Homo Sapiens
SPPLFQSLS

SEQ ID NO: 598790 - protein, 9 aa, Homo Sapiens
SMAPSSPES

SEQ ID NO: 598791 - protein, 9 aa, Homo Sapiens
PLSPSFPLE

SEQ ID NO: 598792 - protein, 9 aa, Homo Sapiens
IIRGLRDET

SEQ ID NO: 598793 - protein, 9 aa, Homo Sapiens
NNTLIKEML

SEQ ID NO: 598794 - protein, 9 aa, Homo Sapiens
LSATGYEAL

SEQ ID NO: 598795 - protein, 9 aa, Homo Sapiens
QPGARSLQA

SEQ ID NO: 598796 - protein, 9 aa, Homo Sapiens
WQTATCSPH

SEQ ID NO: 598797 - protein, 9 aa, Homo Sapiens
SEFIQTLPG

SEQ ID NO: 598798 - protein, 9 aa, Homo Sapiens
SLSSMEESE

SEQ ID NO: 598799 - protein, 9 aa, Homo Sapiens
LSSSPLQLN

SEQ ID NO: 598800 - protein, 9 aa, Homo Sapiens
RSATEMSDG

SEQ ID NO: 598801 - protein, 9 aa, Homo Sapiens
LDSEIHSGA

SEQ ID NO: 598802 - protein, 9 aa, Homo Sapiens
GSGAGEEKM

SEQ ID NO: 598803 - protein, 9 aa, Homo Sapiens
GKEQSLMCI

SEQ ID NO: 598804 - protein, 9 aa, Homo Sapiens
ADQLVLKHR

SEQ ID NO: 598805 - protein, 9 aa, Homo Sapiens
ESMKKFLGP

SEQ ID NO: 598806 - protein, 9 aa, Homo Sapiens
YSGDIIRGL

SEQ ID NO: 598807 - protein, 9 aa, Homo Sapiens
RLLAETCWN

SEQ ID NO: 598808 - protein, 9 aa, Homo Sapiens
WKADVVESL

SEQ ID NO: 598809 - protein, 9 aa, Homo Sapiens
VRPGGSASP

SEQ ID NO: 598810 - protein, 9 aa, Homo Sapiens
VVVHKKKEA

SEQ ID NO: 598811 - protein, 9 aa, Homo Sapiens
FKFRGEMIV

SEQ ID NO: 598812 - protein, 9 aa, Homo Sapiens
KQRVEEYVL

SEQ ID NO: 598813 - protein, 9 aa, Homo Sapiens
VSEFIQTLP

SEQ ID NO: 598814 - protein, 9 aa, Homo Sapiens
VHKKKEACF

SEQ ID NO: 598815 - protein, 9 aa, Homo Sapiens
LRLLWKTAF

SEQ ID NO: 598816 - protein, 9 aa, Homo Sapiens
MKKFLGPKN

SEQ ID NO: 598817 - protein, 9 aa, Homo Sapiens
PVMPFHLYD

SEQ ID NO: 598818 - protein, 9 aa, Homo Sapiens
VINEIFSTE

SEQ ID NO: 598819 - protein, 9 aa, Homo Sapiens
LAETCWNGN

SEQ ID NO: 598820 - protein, 9 aa, Homo Sapiens
ALSKANEET

SEQ ID NO: 598821 - protein, 9 aa, Homo Sapiens
HSLSTPLSA

SEQ ID NO: 598822 - protein, 9 aa, Homo Sapiens
SYLDSEIHS

SEQ ID NO: 598823 - protein, 9 aa, Homo Sapiens
NHHDHSPEE

SEQ ID NO: 598824 - protein, 9 aa, Homo Sapiens
KFRGEMIVN

SEQ ID NO: 598825 - protein, 9 aa, Homo Sapiens
SDSSTVSSG

SEQ ID NO: 598826 - protein, 9 aa, Homo Sapiens
IRGLRDETN

SEQ ID NO: 598827 - protein, 9 aa, Homo Sapiens
TDYWLYTRG

SEQ ID NO: 598828 - protein, 9 aa, Homo Sapiens
ALSQTGFSY

SEQ ID NO: 598829 - protein, 9 aa, Homo Sapiens
RLPREEHQF

SEQ ID NO: 598830 - protein, 9 aa, Homo Sapiens
AAAEAALSQ

SEQ ID NO: 598831 - protein, 9 aa, Homo Sapiens
VDFSNYHSL

SEQ ID NO: 598832 - protein, 9 aa, Homo Sapiens
SLQAAQPSP

SEQ ID NO: 598833 - protein, 9 aa, Homo Sapiens
SLIGEKENS

SEQ ID NO: 598834 - protein, 9 aa, Homo Sapiens
EDRDRAWLD

SEQ ID NO: 598835 - protein, 9 aa, Homo Sapiens
ARVSIHEAL

SEQ ID NO: 598836 - protein, 9 aa, Homo Sapiens
NEETKINCV

SEQ ID NO: 598837 - protein, 9 aa, Homo Sapiens
FSNYHSLSS

SEQ ID NO: 598838 - protein, 9 aa, Homo Sapiens
HGCVHRISI

SEQ ID NO: 598839 - protein, 9 aa, Homo Sapiens
KEQSLMCIQ

SEQ ID NO: 598840 - protein, 9 aa, Homo Sapiens
REDRDRAWL

SEQ ID NO: 598841 - protein, 9 aa, Homo Sapiens
KNKWFFCMA

SEQ ID NO: 598842 - protein, 9 aa, Homo Sapiens
VLSLPEANL

SEQ ID NO: 598843 - protein, 9 aa, Homo Sapiens
LELSSPQFV

SEQ ID NO: 598844 - protein, 9 aa, Homo Sapiens
HRGNQLEIC

SEQ ID NO: 598845 - protein, 9 aa, Homo Sapiens
LTEPVMPFH

SEQ ID NO: 598846 - protein, 9 aa, Homo Sapiens
RTNVINEIF

SEQ ID NO: 598847 - protein, 9 aa, Homo Sapiens
SGKLPLSPS

SEQ ID NO: 598848 - protein, 9 aa, Homo Sapiens
DYELCPETT

SEQ ID NO: 598849 - protein, 9 aa, Homo Sapiens
QMESARVSI

SEQ ID NO: 598850 - protein, 9 aa, Homo Sapiens
FKRLLAETC

SEQ ID NO: 598851 - protein, 9 aa, Homo Sapiens
TATCSPHNC

SEQ ID NO: 598852 - protein, 9 aa, Homo Sapiens
LSKANEETK

SEQ ID NO: 598853 - protein, 9 aa, Homo Sapiens
FIQTLPGCE

SEQ ID NO: 598854 - protein, 9 aa, Homo Sapiens
NLVLSLPEA

SEQ ID NO: 598855 - protein, 9 aa, Homo Sapiens
EQSLMCIQQ

SEQ ID NO: 598856 - protein, 9 aa, Homo Sapiens
IFSTERDYI

SEQ ID NO: 598857 - protein, 9 aa, Homo Sapiens
FFEGKELQL

SEQ ID NO: 598858 - protein, 9 aa, Homo Sapiens
KELQLKQEY

SEQ ID NO: 598859 - protein, 9 aa, Homo Sapiens
KTAFAFQVD

SEQ ID NO: 598860 - protein, 9 aa, Homo Sapiens
RGEMIVNDL

SEQ ID NO: 598861 - protein, 9 aa, Homo Sapiens
LCHLVPYAK

SEQ ID NO: 598862 - protein, 9 aa, Homo Sapiens
DHSPEERII

SEQ ID NO: 598863 - protein, 9 aa, Homo Sapiens
TQMESARVS

SEQ ID NO: 598864 - protein, 9 aa, Homo Sapiens
DYWLYTRGV

SEQ ID NO: 598865 - protein, 9 aa, Homo Sapiens
RGLRDETNF

SEQ ID NO: 598866 - protein, 9 aa, Homo Sapiens
RVEEYVLKL

SEQ ID NO: 598867 - protein, 9 aa, Homo Sapiens
FQSLSSSPL

SEQ ID NO: 598868 - protein, 9 aa, Homo Sapiens
GSASPFSSP

SEQ ID NO: 598869 - protein, 9 aa, Homo Sapiens
SEEHPVRLT

SEQ ID NO: 598870 - protein, 9 aa, Homo Sapiens
DRDRAWLDS

SEQ ID NO: 598871 - protein, 9 aa, Homo Sapiens
HMTKQRVEE

SEQ ID NO: 598872 - protein, 9 aa, Homo Sapiens
EEHPVRLTE

SEQ ID NO: 598873 - protein, 9 aa, Homo Sapiens
SQIVKESRR

SEQ ID NO: 598874 - protein, 9 aa, Homo Sapiens
VMGENHVFR

SEQ ID NO: 598875 - protein, 9 aa, Homo Sapiens
SGAGEEKMP

SEQ ID NO: 598876 - protein, 9 aa, Homo Sapiens
TKQRVEEYV

SEQ ID NO: 598877 - protein, 9 aa, Homo Sapiens
LSSPQFVQM

SEQ ID NO: 598878 - protein, 9 aa, Homo Sapiens
ESARVSIHE

SEQ ID NO: 598879 - protein, 9 aa, Homo Sapiens
TRMDFRVQV

SEQ ID NO: 598880 - protein, 9 aa, Homo Sapiens
PGARSLQAA

SEQ ID NO: 598881 - protein, 9 aa, Homo Sapiens
FSTERDYIK

SEQ ID NO: 598882 - protein, 9 aa, Homo Sapiens
GTRMDFRVQ

SEQ ID NO: 598883 - protein, 9 aa, Homo Sapiens
QLKQEYFVV

SEQ ID NO: 598884 - protein, 9 aa, Homo Sapiens
DLHGCVHRI

SEQ ID NO: 598885 - protein, 9 aa, Homo Sapiens
EYVLKLDTE

SEQ ID NO: 598886 - protein, 9 aa, Homo Sapiens
RKRRRGISE

SEQ ID NO: 598887 - protein, 9 aa, Homo Sapiens
ESCMLNLVL

SEQ ID NO: 598888 - protein, 9 aa, Homo Sapiens
LVPYAKGLA

SEQ ID NO: 598889 - protein, 9 aa, Homo Sapiens
QRVEEYVLK

SEQ ID NO: 598890 - protein, 9 aa, Homo Sapiens
RPGGSASPF

SEQ ID NO: 598891 - protein, 9 aa, Homo Sapiens
SMKKFLGPK

SEQ ID NO: 598892 - protein, 9 aa, Homo Sapiens
IREDRDRAW

SEQ ID NO: 598893 - protein, 9 aa, Homo Sapiens
LRSQQNLVR

SEQ ID NO: 598894 - protein, 9 aa, Homo Sapiens
YTRGVCKTK

SEQ ID NO: 598895 - protein, 9 aa, Homo Sapiens
RESMKKFLG

SEQ ID NO: 598896 - protein, 9 aa, Homo Sapiens
LLAETCWNG

SEQ ID NO: 598897 - protein, 9 aa, Homo Sapiens
SATGYEALA

SEQ ID NO: 598898 - protein, 9 aa, Homo Sapiens
IVKESRRFN

SEQ ID NO: 598899 - protein, 9 aa, Homo Sapiens
YHSLSSMEE

SEQ ID NO: 598900 - protein, 9 aa, Homo Sapiens
CHLVPYAKG

SEQ ID NO: 598901 - protein, 9 aa, Homo Sapiens
RIVMGENHV

SEQ ID NO: 598902 - protein, 9 aa, Homo Sapiens
SLSTPLSAT

SEQ ID NO: 598903 - protein, 9 aa, Homo Sapiens
EPVMPFHLY

SEQ ID NO: 598904 - protein, 9 aa, Homo Sapiens
VNFLAESTR

SEQ ID NO: 598905 - protein, 9 aa, Homo Sapiens
EIHSGATTT

SEQ ID NO: 598906 - protein, 9 aa, Homo Sapiens
YSQIVKESR

SEQ ID NO: 598907 - protein, 9 aa, Homo Sapiens
RMDFRVQVN

SEQ ID NO: 598908 - protein, 9 aa, Homo Sapiens
KTLRLLWKT

SEQ ID NO: 598909 - protein, 9 aa, Homo Sapiens
CRGKEQSLM

SEQ ID NO: 598910 - protein, 9 aa, Homo Sapiens
SDYELCPET

SEQ ID NO: 598911 - protein, 9 aa, Homo Sapiens
KADVVESLI

SEQ ID NO: 598912 - protein, 9 aa, Homo Sapiens
EIFSTERDY

SEQ ID NO: 598913 - protein, 9 aa, Homo Sapiens
FLGPKNSEG

SEQ ID NO: 598914 - protein, 9 aa, Homo Sapiens
GDIIRGLRD

SEQ ID NO: 598915 - protein, 9 aa, Homo Sapiens
RSQQNLVRM

SEQ ID NO: 598916 - protein, 9 aa, Homo Sapiens
LQLKQEYFV

SEQ ID NO: 598917 - protein, 9 aa, Homo Sapiens
KDKRKQFQV

SEQ ID NO: 598918 - protein, 9 aa, Homo Sapiens
CFKRLLAET

SEQ ID NO: 598919 - protein, 9 aa, Homo Sapiens
ENHVFRFNH

SEQ ID NO: 598920 - protein, 9 aa, Homo Sapiens
LIKEMLYLI

SEQ ID NO: 598921 - protein, 9 aa, Homo Sapiens
DAVNFLAES

SEQ ID NO: 598922 - protein, 9 aa, Homo Sapiens
INEIFSTER

SEQ ID NO: 598923 - protein, 9 aa, Homo Sapiens
FRVQVNKPG

SEQ ID NO: 598924 - protein, 9 aa, Homo Sapiens
GEEKMPPSL

SEQ ID NO: 598925 - protein, 9 aa, Homo Sapiens
DQLVLKHRG

SEQ ID NO: 598926 - protein, 9 aa, Homo Sapiens
GGSASPFSS

SEQ ID NO: 598927 - protein, 9 aa, Homo Sapiens
ELTEPVMPF

SEQ ID NO: 598928 - protein, 9 aa, Homo Sapiens
ARKRRRGIS

SEQ ID NO: 598929 - protein, 9 aa, Homo Sapiens
LYTRGVCKT

SEQ ID NO: 598930 - protein, 9 aa, Homo Sapiens
TLPGCEEHG

SEQ ID NO: 598931 - protein, 9 aa, Homo Sapiens
DKRKQFQVL

SEQ ID NO: 598932 - protein, 9 aa, Homo Sapiens
TAKNKWFFC

SEQ ID NO: 598933 - protein, 9 aa, Homo Sapiens
MTKQRVEEY

SEQ ID NO: 598934 - protein, 9 aa, Homo Sapiens
YLDSEIHSG

SEQ ID NO: 598935 - protein, 9 aa, Homo Sapiens
IQTLPGCEE

SEQ ID NO: 598936 - protein, 9 aa, Homo Sapiens
LIGEKENSL

SEQ ID NO: 598937 - protein, 9 aa, Homo Sapiens
HHDHSPEER

SEQ ID NO: 598938 - protein, 9 aa, Homo Sapiens
SLSKLLELS

SEQ ID NO: 598939 - protein, 9 aa, Homo Sapiens
CVDAVNFLA

SEQ ID NO: 598940 - protein, 9 aa, Homo Sapiens
SGNRIVMGE

SEQ ID NO: 598941 - protein, 9 aa, Homo Sapiens
KMPPSLQER

SEQ ID NO: 598942 - protein, 9 aa, Homo Sapiens
HPVRLTEAP

SEQ ID NO: 598943 - protein, 9 aa, Homo Sapiens
TLIKEMLYL

SEQ ID NO: 598944 - protein, 9 aa, Homo Sapiens
PPSPFFKFR

SEQ ID NO: 598945 - protein, 9 aa, Homo Sapiens
MDFRVQVNK

SEQ ID NO: 598946 - protein, 9 aa, Homo Sapiens
AGEEKMPPS

SEQ ID NO: 598947 - protein, 9 aa, Homo Sapiens
HQFGPTFAL

SEQ ID NO: 598948 - protein, 9 aa, Homo Sapiens
KLPLSPSFP

SEQ ID NO: 598949 - protein, 9 aa, Homo Sapiens
KRRRGISEK

SEQ ID NO: 598950 - protein, 9 aa, Homo Sapiens
SNYHSLSSM

SEQ ID NO: 598951 - protein, 9 aa, Homo Sapiens
SLQVNIRKK

SEQ ID NO: 598952 - protein, 9 aa, Homo Sapiens
SEKRRRDRI

SEQ ID NO: 598953 - protein, 9 aa, Homo Sapiens
CPETTLTYT

SEQ ID NO: 598954 - protein, 9 aa, Homo Sapiens
RRRGISEKR

SEQ ID NO: 598955 - protein, 9 aa, Homo Sapiens
KWFFCMAKT

SEQ ID NO: 598956 - protein, 9 aa, Homo Sapiens
LHGCVHRIS

SEQ ID NO: 598957 - protein, 9 aa, Homo Sapiens
WFFCMAKTA

SEQ ID NO: 598958 - protein, 9 aa, Homo Sapiens
HDNHHDHSP

SEQ ID NO: 598959 - protein, 9 aa, Homo Sapiens
AKGLAVQVS

SEQ ID NO: 598960 - protein, 9 aa, Homo Sapiens
NKWFFCMAK

SEQ ID NO: 598961 - protein, 9 aa, Homo Sapiens
FSRLPREEH

SEQ ID NO: 598962 - protein, 9 aa, Homo Sapiens
DFRVQVNKP

SEQ ID NO: 598963 - protein, 9 aa, Homo Sapiens
HNCSGLRTC

SEQ ID NO: 598964 - protein, 9 aa, Homo Sapiens
SKLLELSSP

SEQ ID NO: 598965 - protein, 9 aa, Homo Sapiens
KRLLAETCW

SEQ ID NO: 598966 - protein, 9 aa, Homo Sapiens
AAEAALSQT

SEQ ID NO: 598967 - protein, 9 aa, Homo Sapiens
TKDKRKQFQ

SEQ ID NO: 598968 - protein, 9 aa, Homo Sapiens
STPLSATGY

SEQ ID NO: 598969 - protein, 9 aa, Homo Sapiens
VLKHRGNQL

SEQ ID NO: 598970 - protein, 9 aa, Homo Sapiens
ATCSPHNCS

SEQ ID NO: 598971 - protein, 9 aa, Homo Sapiens
QLVLKHRGN

SEQ ID NO: 598972 - protein, 9 aa, Homo Sapiens
RKKDNSRKE

SEQ ID NO: 598973 - protein, 9 aa, Homo Sapiens
LVLKHRGNQ

SEQ ID NO: 598974 - protein, 9 aa, Homo Sapiens
LSPSFPLEP

SEQ ID NO: 598975 - protein, 9 aa, Homo Sapiens
GNRIVMGEN

SEQ ID NO: 598976 - protein, 9 aa, Homo Sapiens
LSKLLELSS

SEQ ID NO: 598977 - protein, 9 aa, Homo Sapiens
AEAALSQTG

SEQ ID NO: 598978 - protein, 9 aa, Homo Sapiens
CGSGTRMDF

SEQ ID NO: 598979 - protein, 9 aa, Homo Sapiens
PPHDGALRS

SEQ ID NO: 598980 - protein, 8 aa, Homo Sapiens
LCLGWIFL

SEQ ID NO: 598981 - protein, 9 aa, Homo Sapiens
DFSNYHSLS

SEQ ID NO: 598982 - protein, 9 aa, Homo Sapiens
VVHKKKEAC

SEQ ID NO: 598983 - protein, 9 aa, Homo Sapiens
MAPSSPESD

SEQ ID NO: 598984 - protein, 9 aa, Homo Sapiens
PFFKFRGEM

SEQ ID NO: 598985 - protein, 9 aa, Homo Sapiens
LQAAQPSPA

SEQ ID NO: 598986 - protein, 9 aa, Homo Sapiens
ATEMSDGGS

SEQ ID NO: 598987 - protein, 9 aa, Homo Sapiens
NRIVMGENH

SEQ ID NO: 598988 - protein, 9 aa, Homo Sapiens
KGLAVQVST

SEQ ID NO: 598989 - protein, 9 aa, Homo Sapiens
PPLFQSLSS

SEQ ID NO: 598990 - protein, 9 aa, Homo Sapiens
VMPFHLYDA

SEQ ID NO: 598991 - protein, 9 aa, Homo Sapiens
EEHQFGPTF

SEQ ID NO: 598992 - protein, 9 aa, Homo Sapiens
DSSTVSSGA

SEQ ID NO: 598993 - protein, 9 aa, Homo Sapiens
SCMLNLVLS

SEQ ID NO: 598994 - protein, 9 aa, Homo Sapiens
TNSDSSTVS

SEQ ID NO: 598995 - protein, 9 aa, Homo Sapiens
EEYVLKLDT

SEQ ID NO: 598996 - protein, 9 aa, Homo Sapiens
ACFKRLLAE

SEQ ID NO: 598997 - protein, 9 aa, Homo Sapiens
EHQFGPTFA

SEQ ID NO: 598998 - protein, 9 aa, Homo Sapiens
MGENHVFRF

SEQ ID NO: 598999 - protein, 9 aa, Homo Sapiens
NFFEGKELQ

SEQ ID NO: 599000 - protein, 9 aa, Homo Sapiens
GKELQLKQE

SEQ ID NO: 599001 - protein, 9 aa, Homo Sapiens
IRESMKKFL

SEQ ID NO: 599002 - protein, 9 aa, Homo Sapiens
KANEETKIN

SEQ ID NO: 599003 - protein, 9 aa, Homo Sapiens
FFCMAKTAE

SEQ ID NO: 599004 - protein, 9 aa, Homo Sapiens
VDLHGCVHR

SEQ ID NO: 599005 - protein, 9 aa, Homo Sapiens
QSLSSSPLQ

SEQ ID NO: 599006 - protein, 9 aa, Homo Sapiens
GENHVFRFN

SEQ ID NO: 599007 - protein, 9 aa, Homo Sapiens
SATEMSDGG

SEQ ID NO: 599008 - protein, 9 aa, Homo Sapiens
DEVSEFIQT

SEQ ID NO: 599009 - protein, 9 aa, Homo Sapiens
LNLVLSLPE

SEQ ID NO: 599010 - protein, 9 aa, Homo Sapiens
EVSEFIQTL

SEQ ID NO: 599011 - protein, 9 aa, Homo Sapiens
LSTPLSATG

SEQ ID NO: 599012 - protein, 9 aa, Homo Sapiens
WLYTRGVCK

SEQ ID NO: 599013 - protein, 9 aa, Homo Sapiens
WKTAFAFQV

SEQ ID NO: 599014 - protein, 9 aa, Homo Sapiens
ADVVESLIG

SEQ ID NO: 599015 - protein, 9 aa, Homo Sapiens
SPHNCSGLR

SEQ ID NO: 599016 - protein, 9 aa, Homo Sapiens
EHPVRLTEA

SEQ ID NO: 599017 - protein, 9 aa, Homo Sapiens
AWLDSMVLL

SEQ ID NO: 599018 - protein, 9 aa, Homo Sapiens
LVLSLPEAN

SEQ ID NO: 599019 - protein, 9 aa, Homo Sapiens
KHRGNQLEI

SEQ ID NO: 599020 - protein, 9 aa, Homo Sapiens
LQVNIRKKD

SEQ ID NO: 599021 - protein, 9 aa, Homo Sapiens
NIRKKDNSR

SEQ ID NO: 599022 - protein, 9 aa, Homo Sapiens
SKANEETKI

SEQ ID NO: 599023 - protein, 9 aa, Homo Sapiens
ESLIGEKEN

SEQ ID NO: 599024 - protein, 9 aa, Homo Sapiens
PVRLTEAPL

SEQ ID NO: 599025 - protein, 9 aa, Homo Sapiens
KEACFKRLL

SEQ ID NO: 599026 - protein, 9 aa, Homo Sapiens
LWKTAFAFQ

SEQ ID NO: 599027 - protein, 9 aa, Homo Sapiens
ARSLQAAQP

SEQ ID NO: 599028 - protein, 9 aa, Homo Sapiens
NFLAESTRD

SEQ ID NO: 599029 - protein, 9 aa, Homo Sapiens
VYSGDIIRG

SEQ ID NO: 599030 - protein, 9 aa, Homo Sapiens
QELTEPVMP

SEQ ID NO: 599031 - protein, 9 aa, Homo Sapiens
ELQLKQEYF

SEQ ID NO: 599032 - protein, 9 aa, Homo Sapiens
LCPETTLTY

SEQ ID NO: 599033 - protein, 9 aa, Homo Sapiens
QQSYLDSEI

SEQ ID NO: 599034 - protein, 9 aa, Homo Sapiens
CMLNLVLSL

SEQ ID NO: 599035 - protein, 9 aa, Homo Sapiens
ESGKLPLSP

SEQ ID NO: 599036 - protein, 9 aa, Homo Sapiens
EKMPPSLQE

SEQ ID NO: 599037 - protein, 9 aa, Homo Sapiens
KKDNSRKEV

SEQ ID NO: 599038 - protein, 9 aa, Homo Sapiens
LFQSLSSSP

SEQ ID NO: 599039 - protein, 9 aa, Homo Sapiens
DGGSVLASL

SEQ ID NO: 599040 - protein, 9 aa, Homo Sapiens
YAKGLAVQV

SEQ ID NO: 599041 - protein, 9 aa, Homo Sapiens
SLMCIQQGI

SEQ ID NO: 599042 - protein, 9 aa, Homo Sapiens
NTAKNKWFF

SEQ ID NO: 599043 - protein, 9 aa, Homo Sapiens
TYSQIVKES

SEQ ID NO: 599044 - protein, 9 aa, Homo Sapiens
EMSDGGSVL

SEQ ID NO: 599045 - protein, 9 aa, Homo Sapiens
EAHLTKDKR

SEQ ID NO: 599046 - protein, 9 aa, Homo Sapiens
QTATCSPHN

SEQ ID NO: 599047 - protein, 9 aa, Homo Sapiens
DNHHDHSPE

SEQ ID NO: 599048 - protein, 9 aa, Homo Sapiens
KPPHDGALR

SEQ ID NO: 599049 - protein, 9 aa, Homo Sapiens
LMCIQQGIP

SEQ ID NO: 599050 - protein, 9 aa, Homo Sapiens
PETTLTYTE

SEQ ID NO: 599051 - protein, 9 aa, Homo Sapiens
YHSLSTPLS

SEQ ID NO: 599052 - protein, 9 aa, Homo Sapiens
EVDLHGCVH

SEQ ID NO: 599053 - protein, 9 aa, Homo Sapiens
VPYAKGLAV

SEQ ID NO: 599054 - protein, 9 aa, Homo Sapiens
LLELSSPQF

SEQ ID NO: 599055 - protein, 9 aa, Homo Sapiens
TNVINEIFS

SEQ ID NO: 599056 - protein, 9 aa, Homo Sapiens
HDHSPEERI

SEQ ID NO: 599057 - protein, 9 aa, Homo Sapiens
IKEMLYLII

SEQ ID NO: 599058 - protein, 9 aa, Homo Sapiens
LTVRPGGSA

SEQ ID NO: 599059 - protein, 9 aa, Homo Sapiens
NTLIKEMLY

SEQ ID NO: 599060 - protein, 9 aa, Homo Sapiens
QNNTLIKEM

SEQ ID NO: 599061 - protein, 9 aa, Homo Sapiens
GISEKRRRD

SEQ ID NO: 599062 - protein, 9 aa, Homo Sapiens
TFSEEHPVR

SEQ ID NO: 599063 - protein, 9 aa, Homo Sapiens
TVRPGGSAS

SEQ ID NO: 599064 - protein, 9 aa, Homo Sapiens
VESLIGEKE

SEQ ID NO: 599065 - protein, 9 aa, Homo Sapiens
PLSATGYEA

SEQ ID NO: 599066 - protein, 9 aa, Homo Sapiens
QSLMCIQQG

SEQ ID NO: 599067 - protein, 9 aa, Homo Sapiens
DVYSGDIIR

SEQ ID NO: 599068 - protein, 9 aa, Homo Sapiens
RAAAEAALS

SEQ ID NO: 599069 - protein, 9 aa, Homo Sapiens
DSEIHSGAT

SEQ ID NO: 599070 - protein, 9 aa, Homo Sapiens
ISEKRRRDR

SEQ ID NO: 599071 - protein, 9 aa, Homo Sapiens
MCIQQGIPD

SEQ ID NO: 599072 - protein, 9 aa, Homo Sapiens
QQQSYLDSE

SEQ ID NO: 599073 - protein, 9 aa, Homo Sapiens
IRKKDNSRK

SEQ ID NO: 599074 - protein, 9 aa, Homo Sapiens
KKKEACFKR

SEQ ID NO: 599075 - protein, 9 aa, Homo Sapiens
RGKEQSLMC

SEQ ID NO: 599076 - protein, 9 aa, Homo Sapiens
LADQLVLKH

SEQ ID NO: 599077 - protein, 9 aa, Homo Sapiens
NEIFSTERD

SEQ ID NO: 599078 - protein, 9 aa, Homo Sapiens
ANEETKINC

SEQ ID NO: 599079 - protein, 9 aa, Homo Sapiens
QVNIRKKDN

SEQ ID NO: 599080 - protein, 9 aa, Homo Sapiens
KKFLGPKNS

SEQ ID NO: 599081 - protein, 9 aa, Homo Sapiens
SGTRMDFRV

SEQ ID NO: 599082 - protein, 9 aa, Homo Sapiens
CVHRISIFD

SEQ ID NO: 599083 - protein, 9 aa, Homo Sapiens
APSSPESDP

SEQ ID NO: 599084 - protein, 9 aa, Homo Sapiens
SEIHSGATT

SEQ ID NO: 599085 - protein, 9 aa, Homo Sapiens
KLLELSSPQ

SEQ ID NO: 599086 - protein, 9 aa, Homo Sapiens
EETKINCVR

SEQ ID NO: 599087 - protein, 9 aa, Homo Sapiens
EACFKRLLA

SEQ ID NO: 599088 - protein, 9 aa, Homo Sapiens
TTLTYTEEF

SEQ ID NO: 599089 - protein, 9 aa, Homo Sapiens
LTQMESARV

SEQ ID NO: 599090 - protein, 9 aa, Homo Sapiens
AETCWNGNA

SEQ ID NO: 599091 - protein, 9 aa, Homo Sapiens
QSYLDSEIH

SEQ ID NO: 599092 - protein, 9 aa, Homo Sapiens
LTKDKRKQF

SEQ ID NO: 599093 - protein, 9 aa, Homo Sapiens
QLESGKLPL

SEQ ID NO: 599094 - protein, 9 aa, Homo Sapiens
LPREEHQFG

SEQ ID NO: 599095 - protein, 9 aa, Homo Sapiens
KEAHLTKDK

SEQ ID NO: 599096 - protein, 9 aa, Homo Sapiens
GTDYWLYTR

SEQ ID NO: 599097 - protein, 9 aa, Homo Sapiens
GSGTRMDFR

SEQ ID NO: 599098 - protein, 9 aa, Homo Sapiens
FLAESTRDQ

SEQ ID NO: 599099 - protein, 9 aa, Homo Sapiens
ELSSPQFVQ

SEQ ID NO: 599100 - protein, 9 aa, Homo Sapiens
ASPFSSPIT

SEQ ID NO: 599101 - protein, 9 aa, Homo Sapiens
DVVESLIGE

SEQ ID NO: 599102 - protein, 9 aa, Homo Sapiens
QQNNTLIKE

SEQ ID NO: 599103 - protein, 9 aa, Homo Sapiens
QALSKANEE

SEQ ID NO: 599104 - protein, 9 aa, Homo Sapiens
TPLSATGYE

SEQ ID NO: 599105 - protein, 9 aa, Homo Sapiens
LAESTRDQE

SEQ ID NO: 599106 - protein, 9 aa, Homo Sapiens
LRAAAEAAL

SEQ ID NO: 599107 - protein, 9 aa, Homo Sapiens
KESCMLNLV

SEQ ID NO: 599108 - protein, 9 aa, Homo Sapiens
MESARVSIH

SEQ ID NO: 599109 - protein, 9 aa, Homo Sapiens
SDGGSVLAS

SEQ ID NO: 599110 - protein, 9 aa, Homo Sapiens
VDAVNFLAE

SEQ ID NO: 599111 - protein, 9 aa, Homo Sapiens
NVINEIFST

SEQ ID NO: 599112 - protein, 9 aa, Homo Sapiens
VNIRKKDNS

SEQ ID NO: 599113 - protein, 9 aa, Homo Sapiens
GCVHRISIF

SEQ ID NO: 599114 - protein, 9 aa, Homo Sapiens
KDNSRKEVQ

SEQ ID NO: 599115 - protein, 9 aa, Homo Sapiens
LHHDNHHDH

SEQ ID NO: 599116 - protein, 9 aa, Homo Sapiens
TEPVMPFHL

SEQ ID NO: 599117 - protein, 9 aa, Homo Sapiens
DIIRGLRDE

SEQ ID NO: 599118 - protein, 9 aa, Homo Sapiens
PLQPGARSL

SEQ ID NO: 599119 - protein, 9 aa, Homo Sapiens
VEVDLHGCV

SEQ ID NO: 599120 - protein, 9 aa, Homo Sapiens
FSEEHPVRL

SEQ ID NO: 599121 - protein, 9 aa, Homo Sapiens
AKNKWFFCM

SEQ ID NO: 599122 - protein, 9 aa, Homo Sapiens
MPFHLYDAF

SEQ ID NO: 599123 - protein, 9 aa, Homo Sapiens
GGSVLASLS

SEQ ID NO: 599124 - protein, 9 aa, Homo Sapiens
HSLSSMEES

SEQ ID NO: 599125 - protein, 9 aa, Homo Sapiens
TCSPHNCSG

SEQ ID NO: 599126 - protein, 9 aa, Homo Sapiens
VKESRRFNI

SEQ ID NO: 599127 - protein, 9 aa, Homo Sapiens
GGSGAGEEK

SEQ ID NO: 599128 - protein, 9 aa, Homo Sapiens
EAALSQTGF

SEQ ID NO: 599129 - protein, 9 aa, Homo Sapiens
RVSIHEALK

SEQ ID NO: 599130 - protein, 9 aa, Homo Sapiens
PYAKGLAVQ

SEQ ID NO: 599131 - protein, 9 aa, Homo Sapiens
DGALRSQQN

SEQ ID NO: 599132 - protein, 9 aa, Homo Sapiens
GARSLQAAQ

SEQ ID NO: 599133 - protein, 9 aa, Homo Sapiens
LKHRGNQLE

SEQ ID NO: 599134 - protein, 9 aa, Homo Sapiens
RDRAWLDSM

SEQ ID NO: 599135 - protein, 9 aa, Homo Sapiens
ELCPETTLT

SEQ ID NO: 599136 - protein, 9 aa, Homo Sapiens
PGGSASPFS

SEQ ID NO: 599137 - protein, 9 aa, Homo Sapiens
KFLGPKNSE

SEQ ID NO: 599138 - protein, 9 aa, Homo Sapiens
ESRRFNIDL

SEQ ID NO: 599139 - protein, 9 aa, Homo Sapiens
PREEHQFGP

SEQ ID NO: 599140 - protein, 9 aa, Homo Sapiens
TEMSDGGSV

SEQ ID NO: 599141 - protein, 9 aa, Homo Sapiens
FEGKELQLK

SEQ ID NO: 599142 - protein, 9 aa, Homo Sapiens
ETCWNGNAL

SEQ ID NO: 599143 - protein, 9 aa, Homo Sapiens
TLRLLWKTA

SEQ ID NO: 599144 - protein, 9 aa, Homo Sapiens
LSQTGFSYD

SEQ ID NO: 599145 - protein, 9 aa, Homo Sapiens
PHDGALRSQ

SEQ ID NO: 599146 - protein, 9 aa, Homo Sapiens
TSLSKLLEL

SEQ ID NO: 599147 - protein, 9 aa, Homo Sapiens
LQPGARSLQ

SEQ ID NO: 599148 - protein, 9 aa, Homo Sapiens
LSSMEESEI

SEQ ID NO: 599149 - protein, 9 aa, Homo Sapiens
HKKKEACFK

SEQ ID NO: 599150 - protein, 9 aa, Homo Sapiens
NYHSLSSME

SEQ ID NO: 599151 - protein, 9 aa, Homo Sapiens
EGKELQLKQ

SEQ ID NO: 599152 - protein, 9 aa, Homo Sapiens
LQELTEPVM

SEQ ID NO: 599153 - protein, 9 aa, Homo Sapiens
QTLPGCEEH

SEQ ID NO: 599154 - protein, 9 aa, Homo Sapiens
EVVVHKKKE

SEQ ID NO: 599155 - protein, 9 aa, Homo Sapiens
TAFAFQVDI

SEQ ID NO: 599156 - protein, 9 aa, Homo Sapiens
RLTEAPLNP

SEQ ID NO: 599157 - protein, 9 aa, Homo Sapiens
EEKMPPSLQ

SEQ ID NO: 599158 - protein, 9 aa, Homo Sapiens
AVNFLAEST

SEQ ID NO: 599159 - protein, 9 aa, Homo Sapiens
VGTDYWLYT

SEQ ID NO: 599160 - protein, 9 aa, Homo Sapiens
SLSSSPLQL

SEQ ID NO: 599161 - protein, 9 aa, Homo Sapiens
DLHHDNHHD

SEQ ID NO: 599162 - protein, 9 aa, Homo Sapiens
NSMAPSSPE

SEQ ID NO: 599163 - protein, 9 aa, Homo Sapiens
AALSQTGFS

SEQ ID NO: 599164 - protein, 9 aa, Homo Sapiens
RGISEKRRR

SEQ ID NO: 599165 - protein, 9 aa, Homo Sapiens
ALRSQQNLV

SEQ ID NO: 599166 - protein, 9 aa, Homo Sapiens
TRGVCKTKS

SEQ ID NO: 599167 - protein, 9 aa, Homo Sapiens
ASPPLFQSL

SEQ ID NO: 599168 - protein, 9 aa, Homo Sapiens
SPFFKFRGE

SEQ ID NO: 599169 - protein, 9 aa, Homo Sapiens
PLFQSLSSS

SEQ ID NO: 599170 - protein, 9 aa, Homo Sapiens
PHNCSGLRT

SEQ ID NO: 599171 - protein, 9 aa, Homo Sapiens
YWLYTRGVC

SEQ ID NO: 599172 - protein, 9 aa, Homo Sapiens
ALTQMESAR

SEQ ID NO: 599173 - protein, 9 aa, Homo Sapiens
LESGKLPLS

SEQ ID NO: 599174 - protein, 9 aa, Homo Sapiens
WLDSMVLLI

SEQ ID NO: 599175 - protein, 9 aa, Homo Sapiens
AHLTKDKRK

SEQ ID NO: 599176 - protein, 9 aa, Homo Sapiens
DRAWLDSMV

SEQ ID NO: 599177 - protein, 9 aa, Homo Sapiens
VVESLIGEK

SEQ ID NO: 599178 - protein, 9 aa, Homo Sapiens
EFIQTLPGC

SEQ ID NO: 599179 - protein, 9 aa, Homo Sapiens
GKLPLSPSF

SEQ ID NO: 599180 - protein, 9 aa, Homo Sapiens
MVEVDLHGC

SEQ ID NO: 599181 - protein, 9 aa, Homo Sapiens
MLNLVLSLP

SEQ ID NO: 599182 - protein, 9 aa, Homo Sapiens
PSPFFKFRG

SEQ ID NO: 599183 - protein, 9 aa, Homo Sapiens
GALRSQQNL

SEQ ID NO: 599184 - protein, 9 aa, Homo Sapiens
LPLSPSFPL

SEQ ID NO: 599185 - protein, 9 aa, Homo Sapiens
HHDNHHDHS

SEQ ID NO: 599186 - protein, 9 aa, Homo Sapiens
RLLWKTAFA

SEQ ID NO: 599187 - protein, 9 aa, Homo Sapiens
FFKFRGEMI

SEQ ID NO: 599188 - protein, 9 aa, Homo Sapiens
SARVSIHEA

SEQ ID NO: 599189 - protein, 9 aa, Homo Sapiens
KRKQFQVLV

SEQ ID NO: 599190 - protein, 9 aa, Homo Sapiens
VQQNNTLIK

SEQ ID NO: 599191 - protein, 9 aa, Homo Sapiens
MQSLKMNFF

SEQ ID NO: 599192 - protein, 9 aa, Homo Sapiens
NTEEAYIGS

SEQ ID NO: 599193 - protein, 9 aa, Homo Sapiens
LEITKECKK

SEQ ID NO: 599194 - protein, 9 aa, Homo Sapiens
MSRRKQKNP

SEQ ID NO: 599195 - protein, 9 aa, Homo Sapiens
QRSCGNDSR

SEQ ID NO: 599196 - protein, 9 aa, Homo Sapiens
KFSNKSNIC

SEQ ID NO: 599197 - protein, 9 aa, Homo Sapiens
TYDRFVAIC

SEQ ID NO: 599198 - protein, 9 aa, Homo Sapiens
LHTPMNFLL

SEQ ID NO: 599199 - protein, 9 aa, Homo Sapiens
KLVGEMLKT

SEQ ID NO: 599200 - protein, 9 aa, Homo Sapiens
RIPSAPWMP

SEQ ID NO: 599201 - protein, 9 aa, Homo Sapiens
TKLSWSGAP

SEQ ID NO: 599202 - protein, 9 aa, Homo Sapiens
LIKLLKVKC

SEQ ID NO: 599203 - protein, 9 aa, Homo Sapiens
NSNITFQLV

SEQ ID NO: 599204 - protein, 9 aa, Homo Sapiens
MGYRQSEFQ

SEQ ID NO: 599205 - protein, 9 aa, Homo Sapiens
PLCVHFAHR

SEQ ID NO: 599206 - protein, 9 aa, Homo Sapiens
TQSAWQSSE

SEQ ID NO: 599207 - protein, 9 aa, Homo Sapiens
SRKLLESHI

SEQ ID NO: 599208 - protein, 9 aa, Homo Sapiens
QLHMLPCPC

SEQ ID NO: 599209 - protein, 9 aa, Homo Sapiens
KPSAQEITY

SEQ ID NO: 599210 - protein, 9 aa, Homo Sapiens
MNVHRPCET

SEQ ID NO: 599211 - protein, 9 aa, Homo Sapiens
STSRMRLPQ

SEQ ID NO: 599212 - protein, 9 aa, Homo Sapiens
KEANKDFVK

SEQ ID NO: 599213 - protein, 9 aa, Homo Sapiens
NFLLSHLSL

SEQ ID NO: 599214 - protein, 9 aa, Homo Sapiens
TIAEVAPLI

SEQ ID NO: 599215 - protein, 9 aa, Homo Sapiens
PVLPFVIGA

SEQ ID NO: 599216 - protein, 9 aa, Homo Sapiens
DSESAKLFA

SEQ ID NO: 599217 - protein, 9 aa, Homo Sapiens
KLNKLMTNL

SEQ ID NO: 599218 - protein, 9 aa, Homo Sapiens
TAGSPLQGL

SEQ ID NO: 599219 - protein, 9 aa, Homo Sapiens
AKIARPPGN

SEQ ID NO: 599220 - protein, 9 aa, Homo Sapiens
LSLLNDSES

SEQ ID NO: 599221 - protein, 9 aa, Homo Sapiens
LVRICAQAH

SEQ ID NO: 599222 - protein, 9 aa, Homo Sapiens
NKDFVKVVS

SEQ ID NO: 599223 - protein, 9 aa, Homo Sapiens
EIDKAVAII

SEQ ID NO: 599224 - protein, 9 aa, Homo Sapiens
FVIVILLAT

SEQ ID NO: 599225 - protein, 9 aa, Homo Sapiens
GFGQHESAS

SEQ ID NO: 599226 - protein, 9 aa, Homo Sapiens
SGSPSYRPT

SEQ ID NO: 599227 - protein, 9 aa, Homo Sapiens
EDIKGFSDA

SEQ ID NO: 599228 - protein, 9 aa, Homo Sapiens
VAIKLSKGQ

SEQ ID NO: 599229 - protein, 9 aa, Homo Sapiens
GPESSMSLL

SEQ ID NO: 599230 - protein, 9 aa, Homo Sapiens
NGTGGLRSL

SEQ ID NO: 599231 - protein, 9 aa, Homo Sapiens
DDEEINRMI

SEQ ID NO: 599232 - protein, 9 aa, Homo Sapiens
DSDGHLEVL

SEQ ID NO: 599233 - protein, 9 aa, Homo Sapiens
EKYRHMRRH

SEQ ID NO: 599234 - protein, 9 aa, Homo Sapiens
QAAPPSNMK

SEQ ID NO: 599235 - protein, 9 aa, Homo Sapiens
CDWCCKNGK

SEQ ID NO: 599236 - protein, 9 aa, Homo Sapiens
RGRSGSRIP

SEQ ID NO: 599237 - protein, 9 aa, Homo Sapiens
SGVCHNLSG

SEQ ID NO: 599238 - protein, 9 aa, Homo Sapiens
QQGDNWVES

SEQ ID NO: 599239 - protein, 9 aa, Homo Sapiens
IVLTTLPLP

SEQ ID NO: 599240 - protein, 9 aa, Homo Sapiens
KKKEDKIKQ

SEQ ID NO: 599241 - protein, 9 aa, Homo Sapiens
AAFTFLKSS

SEQ ID NO: 599242 - protein, 9 aa, Homo Sapiens
WLPGMCNSN

SEQ ID NO: 599243 - protein, 9 aa, Homo Sapiens
NMVPRIPEW

SEQ ID NO: 599244 - protein, 9 aa, Homo Sapiens
TSGFYYVDS

SEQ ID NO: 599245 - protein, 9 aa, Homo Sapiens
AAHDNRVSC

SEQ ID NO: 599246 - protein, 9 aa, Homo Sapiens
VVSTAVNVD

SEQ ID NO: 599247 - protein, 9 aa, Homo Sapiens
DICVIWVLA

SEQ ID NO: 599248 - protein, 9 aa, Homo Sapiens
ALQGNYEIR

SEQ ID NO: 599249 - protein, 9 aa, Homo Sapiens
DPTFVCSEC

SEQ ID NO: 599250 - protein, 9 aa, Homo Sapiens
SARHNSIQR

SEQ ID NO: 599251 - protein, 9 aa, Homo Sapiens
LDASARAPP

SEQ ID NO: 599252 - protein, 9 aa, Homo Sapiens
HDVHTQVAG

SEQ ID NO: 599253 - protein, 9 aa, Homo Sapiens
QTSIGMQLE

SEQ ID NO: 599254 - protein, 9 aa, Homo Sapiens
CGSAAQLAG

SEQ ID NO: 599255 - protein, 9 aa, Homo Sapiens
KEIASRLRQ

SEQ ID NO: 599256 - protein, 9 aa, Homo Sapiens
AKQTLNRLC

SEQ ID NO: 599257 - protein, 9 aa, Homo Sapiens
LAVASDPAN

SEQ ID NO: 599258 - protein, 9 aa, Homo Sapiens
YRQSEFQIL

SEQ ID NO: 599259 - protein, 9 aa, Homo Sapiens
IHDVHTQVA

SEQ ID NO: 599260 - protein, 9 aa, Homo Sapiens
CYGGLRKKA

SEQ ID NO: 599261 - protein, 9 aa, Homo Sapiens
ISSDDFRKL

SEQ ID NO: 599262 - protein, 9 aa, Homo Sapiens
STAVNVDGH

SEQ ID NO: 599263 - protein, 9 aa, Homo Sapiens
LEHLFKQLH

SEQ ID NO: 599264 - protein, 9 aa, Homo Sapiens
TSSVAQSGT

SEQ ID NO: 599265 - protein, 9 aa, Homo Sapiens
SNKSNICRF

SEQ ID NO: 599266 - protein, 9 aa, Homo Sapiens
GTVGDSMSY

SEQ ID NO: 599267 - protein, 9 aa, Homo Sapiens
VQGPDWHLR

SEQ ID NO: 599268 - protein, 9 aa, Homo Sapiens
WTGGAAAWT

SEQ ID NO: 599269 - protein, 9 aa, Homo Sapiens
SVVKAAFTF

SEQ ID NO: 599270 - protein, 9 aa, Homo Sapiens
GSLAEFFED

SEQ ID NO: 599271 - protein, 9 aa, Homo Sapiens
SHLEGTAYG

SEQ ID NO: 599272 - protein, 9 aa, Homo Sapiens
FRVTVDRST

SEQ ID NO: 599273 - protein, 9 aa, Homo Sapiens
TEATAIATA

SEQ ID NO: 599274 - protein, 9 aa, Homo Sapiens
PETCEELRR

SEQ ID NO: 599275 - protein, 9 aa, Homo Sapiens
KAWRDLTTS

SEQ ID NO: 599276 - protein, 9 aa, Homo Sapiens
FGAAFPLLA

SEQ ID NO: 599277 - protein, 9 aa, Homo Sapiens
MKCLDANET

SEQ ID NO: 599278 - protein, 9 aa, Homo Sapiens
RIGSLNLLV

SEQ ID NO: 599279 - protein, 9 aa, Homo Sapiens
HCGEEGHDP

SEQ ID NO: 599280 - protein, 9 aa, Homo Sapiens
EFWARLLEH

SEQ ID NO: 599281 - protein, 9 aa, Homo Sapiens
QTLGLSSPC

SEQ ID NO: 599282 - protein, 9 aa, Homo Sapiens
QGKGHHIRN

SEQ ID NO: 599283 - protein, 9 aa, Homo Sapiens
RIVPRAPWM

SEQ ID NO: 599284 - protein, 9 aa, Homo Sapiens
WSQVTTKTW

SEQ ID NO: 599285 - protein, 9 aa, Homo Sapiens
KSSPVQHAL

SEQ ID NO: 599286 - protein, 9 aa, Homo Sapiens
SLSRKLLES

SEQ ID NO: 599287 - protein, 9 aa, Homo Sapiens
MNSDYSTPS

SEQ ID NO: 599288 - protein, 9 aa, Homo Sapiens
IDQGKGHHI

SEQ ID NO: 599289 - protein, 9 aa, Homo Sapiens
VSALSWSQV

SEQ ID NO: 599290 - protein, 9 aa, Homo Sapiens
GNSLSPDDP

SEQ ID NO: 599291 - protein, 9 aa, Homo Sapiens
RTLMERTVS

SEQ ID NO: 599292 - protein, 9 aa, Homo Sapiens
EPSSGLRKE

SEQ ID NO: 599293 - protein, 9 aa, Homo Sapiens
AWKYNYIAS

SEQ ID NO: 599294 - protein, 9 aa, Homo Sapiens
NVVVSGSQP

SEQ ID NO: 599295 - protein, 9 aa, Homo Sapiens
TLPQLEWTL

SEQ ID NO: 599296 - protein, 9 aa, Homo Sapiens
YFLSHLPVI

SEQ ID NO: 599297 - protein, 9 aa, Homo Sapiens
LQVNLPHMT

SEQ ID NO: 599298 - protein, 9 aa, Homo Sapiens
DLRLHTPMN

SEQ ID NO: 599299 - protein, 9 aa, Homo Sapiens
LVTCTALTH

SEQ ID NO: 599300 - protein, 9 aa, Homo Sapiens
KAAFTFLKS

SEQ ID NO: 599301 - protein, 9 aa, Homo Sapiens
EFSEAREDT

SEQ ID NO: 599302 - protein, 9 aa, Homo Sapiens
LVEEALEKV

SEQ ID NO: 599303 - protein, 9 aa, Homo Sapiens
VLPFVIGAG

SEQ ID NO: 599304 - protein, 9 aa, Homo Sapiens
QGDPPLVVS

SEQ ID NO: 599305 - protein, 9 aa, Homo Sapiens
TTKLSWSGA

SEQ ID NO: 599306 - protein, 9 aa, Homo Sapiens
LAAVSPTTR

SEQ ID NO: 599307 - protein, 9 aa, Homo Sapiens
APEGVSHQR

SEQ ID NO: 599308 - protein, 9 aa, Homo Sapiens
ANLVKAYVE

SEQ ID NO: 599309 - protein, 9 aa, Homo Sapiens
QKEEEQEHS

SEQ ID NO: 599310 - protein, 9 aa, Homo Sapiens
KRTAKRDSK

SEQ ID NO: 599311 - protein, 9 aa, Homo Sapiens
SLTNIQRSC

SEQ ID NO: 599312 - protein, 9 aa, Homo Sapiens
EVGNLKNLL

SEQ ID NO: 599313 - protein, 9 aa, Homo Sapiens
SEIVYTWKK

SEQ ID NO: 599314 - protein, 9 aa, Homo Sapiens
IPNTQANVW

SEQ ID NO: 599315 - protein, 9 aa, Homo Sapiens
SGTFECICG

SEQ ID NO: 599316 - protein, 9 aa, Homo Sapiens
YVEKYRHMR

SEQ ID NO: 599317 - protein, 9 aa, Homo Sapiens
EDSGIFFDY

SEQ ID NO: 599318 - protein, 9 aa, Homo Sapiens
IDFTKPFMS

SEQ ID NO: 599319 - protein, 9 aa, Homo Sapiens
SEALVTCTA

SEQ ID NO: 599320 - protein, 9 aa, Homo Sapiens
FHWLLVDDP

SEQ ID NO: 599321 - protein, 9 aa, Homo Sapiens
LFGALVELL

SEQ ID NO: 599322 - protein, 9 aa, Homo Sapiens
TPSKFKDSG

SEQ ID NO: 599323 - protein, 9 aa, Homo Sapiens
RGGYLQRQA

SEQ ID NO: 599324 - protein, 9 aa, Homo Sapiens
WKYNYIASF

SEQ ID NO: 599325 - protein, 9 aa, Homo Sapiens
TLAKIARPP

SEQ ID NO: 599326 - protein, 9 aa, Homo Sapiens
KISSDDFRK

SEQ ID NO: 599327 - protein, 9 aa, Homo Sapiens
LAINSDGSA

SEQ ID NO: 599328 - protein, 9 aa, Homo Sapiens
TEKTTESKT

SEQ ID NO: 599329 - protein, 9 aa, Homo Sapiens
LRRGLGDED

SEQ ID NO: 599330 - protein, 9 aa, Homo Sapiens
SGIQYCGIK

SEQ ID NO: 599331 - protein, 9 aa, Homo Sapiens
KAHTCFVSD

SEQ ID NO: 599332 - protein, 9 aa, Homo Sapiens
AAAWTEATA

SEQ ID NO: 599333 - protein, 9 aa, Homo Sapiens
RFNSSDRIE

SEQ ID NO: 599334 - protein, 9 aa, Homo Sapiens
KCCKCDVCG

SEQ ID NO: 599335 - protein, 9 aa, Homo Sapiens
GLWTGGAAA

SEQ ID NO: 599336 - protein, 9 aa, Homo Sapiens
RADGSFSNI

SEQ ID NO: 599337 - protein, 9 aa, Homo Sapiens
KRTPPSSGE

SEQ ID NO: 599338 - protein, 9 aa, Homo Sapiens
EYPDLSFWN

SEQ ID NO: 599339 - protein, 9 aa, Homo Sapiens
PCLLTGSTA

SEQ ID NO: 599340 - protein, 9 aa, Homo Sapiens
FWARLLEHL

SEQ ID NO: 599341 - protein, 9 aa, Homo Sapiens
AICKGLIPN

SEQ ID NO: 599342 - protein, 9 aa, Homo Sapiens
SEVEEVEMA

SEQ ID NO: 599343 - protein, 9 aa, Homo Sapiens
VKAAFTFLK

SEQ ID NO: 599344 - protein, 9 aa, Homo Sapiens
LKANVISKS

SEQ ID NO: 599345 - protein, 9 aa, Homo Sapiens
SQMHTVSCS

SEQ ID NO: 599346 - protein, 9 aa, Homo Sapiens
SAGGLNVTC

SEQ ID NO: 599347 - protein, 9 aa, Homo Sapiens
LRAGDFWTL

SEQ ID NO: 599348 - protein, 9 aa, Homo Sapiens
RAGDFWTLP

SEQ ID NO: 599349 - protein, 9 aa, Homo Sapiens
AKCLKKEKI

SEQ ID NO: 599350 - protein, 9 aa, Homo Sapiens
DDDDEEINR

SEQ ID NO: 599351 - protein, 9 aa, Homo Sapiens
RSCGNDSRS

SEQ ID NO: 599352 - protein, 9 aa, Homo Sapiens
TLGSLAEFF

SEQ ID NO: 599353 - protein, 9 aa, Homo Sapiens
ATAMAQAHS

SEQ ID NO: 599354 - protein, 9 aa, Homo Sapiens
ALPSGPVLY

SEQ ID NO: 599355 - protein, 9 aa, Homo Sapiens
LPSFRVTVD

SEQ ID NO: 599356 - protein, 9 aa, Homo Sapiens
CTALTHPRV

SEQ ID NO: 599357 - protein, 9 aa, Homo Sapiens
LLTGSTAGS

SEQ ID NO: 599358 - protein, 9 aa, Homo Sapiens
SSVAQSGTE

SEQ ID NO: 599359 - protein, 9 aa, Homo Sapiens
EEEDDKDDM

SEQ ID NO: 599360 - protein, 9 aa, Homo Sapiens
ESFLLAVMT

SEQ ID NO: 599361 - protein, 9 aa, Homo Sapiens
VIDEIDKAV

SEQ ID NO: 599362 - protein, 9 aa, Homo Sapiens
PLINLLTAK

SEQ ID NO: 599363 - protein, 9 aa, Homo Sapiens
LCVHFAHRM

SEQ ID NO: 599364 - protein, 9 aa, Homo Sapiens
MHTVSCSGG

SEQ ID NO: 599365 - protein, 9 aa, Homo Sapiens
HHIRNQTYR

SEQ ID NO: 599366 - protein, 9 aa, Homo Sapiens
VYTWKKGPL

SEQ ID NO: 599367 - protein, 9 aa, Homo Sapiens
AQKEEEQEH

SEQ ID NO: 599368 - protein, 9 aa, Homo Sapiens
PFKLHLQRN

SEQ ID NO: 599369 - protein, 9 aa, Homo Sapiens
KTKFSSCES

SEQ ID NO: 599370 - protein, 9 aa, Homo Sapiens
PRRAPWALF

SEQ ID NO: 599371 - protein, 9 aa, Homo Sapiens
KGCLCSSAG

SEQ ID NO: 599372 - protein, 9 aa, Homo Sapiens
SFALPSGPV

SEQ ID NO: 599373 - protein, 9 aa, Homo Sapiens
LSSKEIASR

SEQ ID NO: 599374 - protein, 9 aa, Homo Sapiens
KKNKHSPKN

SEQ ID NO: 599375 - protein, 9 aa, Homo Sapiens
GHLEVLLNS

SEQ ID NO: 599376 - protein, 9 aa, Homo Sapiens
TKQAWYFLS

SEQ ID NO: 599377 - protein, 9 aa, Homo Sapiens
CGNNTINHF

SEQ ID NO: 599378 - protein, 9 aa, Homo Sapiens
SPSHCDWCC

SEQ ID NO: 599379 - protein, 9 aa, Homo Sapiens
TDTKFQKLK

SEQ ID NO: 599380 - protein, 9 aa, Homo Sapiens
TLCFLSPFA

SEQ ID NO: 599381 - protein, 9 aa, Homo Sapiens
EGIKSCGLE

SEQ ID NO: 599382 - protein, 9 aa, Homo Sapiens
VVAGHQQFD

SEQ ID NO: 599383 - protein, 9 aa, Homo Sapiens
NAQHVEELQ

SEQ ID NO: 599384 - protein, 9 aa, Homo Sapiens
NDFTIWSVI

SEQ ID NO: 599385 - protein, 9 aa, Homo Sapiens
LDGVDDGTK

SEQ ID NO: 599386 - protein, 9 aa, Homo Sapiens
NCYPNETVI

SEQ ID NO: 599387 - protein, 9 aa, Homo Sapiens
VNFSKKVKC

SEQ ID NO: 599388 - protein, 9 aa, Homo Sapiens
YKSSLTCYH

SEQ ID NO: 599389 - protein, 9 aa, Homo Sapiens
ERMKEKQNK

SEQ ID NO: 599390 - protein, 9 aa, Homo Sapiens
ESLRTLGAW

SEQ ID NO: 599391 - protein, 9 aa, Homo Sapiens
SRITLKSGY

SEQ ID NO: 599392 - protein, 9 aa, Homo Sapiens
GQDVSACQA

SEQ ID NO: 599393 - protein, 9 aa, Homo Sapiens
YPDLSFWNT

SEQ ID NO: 599394 - protein, 9 aa, Homo Sapiens
GENEEEIGS

SEQ ID NO: 599395 - protein, 9 aa, Homo Sapiens
ATDSDGHLE

SEQ ID NO: 599396 - protein, 9 aa, Homo Sapiens
AQHVEELQA

SEQ ID NO: 599397 - protein, 9 aa, Homo Sapiens
DKIKQWLGK

SEQ ID NO: 599398 - protein, 9 aa, Homo Sapiens
SDPGFKRTR

SEQ ID NO: 599399 - protein, 9 aa, Homo Sapiens
SKTKFSSCE

SEQ ID NO: 599400 - protein, 9 aa, Homo Sapiens
EQMLGAFHS

SEQ ID NO: 599401 - protein, 9 aa, Homo Sapiens
RSLPACRTL

SEQ ID NO: 599402 - protein, 9 aa, Homo Sapiens
KLYELRTMD

SEQ ID NO: 599403 - protein, 9 aa, Homo Sapiens
IEPTSGVAV

SEQ ID NO: 599404 - protein, 9 aa, Homo Sapiens
RDLKVLACL

SEQ ID NO: 599405 - protein, 9 aa, Homo Sapiens
NKCVFCKAI

SEQ ID NO: 599406 - protein, 9 aa, Homo Sapiens
AMYQEELRG

SEQ ID NO: 599407 - protein, 9 aa, Homo Sapiens
NVEALVVAD

SEQ ID NO: 599408 - protein, 9 aa, Homo Sapiens
FLKYYCSGH

SEQ ID NO: 599409 - protein, 9 aa, Homo Sapiens
KINVDIINF

SEQ ID NO: 599410 - protein, 9 aa, Homo Sapiens
ALVVADKKM

SEQ ID NO: 599411 - protein, 9 aa, Homo Sapiens
NSDYSTPSK

SEQ ID NO: 599412 - protein, 9 aa, Homo Sapiens
MLLKCLRNN

SEQ ID NO: 599413 - protein, 9 aa, Homo Sapiens
KQNKICLMA

SEQ ID NO: 599414 - protein, 9 aa, Homo Sapiens
MTLPQLEWT

SEQ ID NO: 599415 - protein, 9 aa, Homo Sapiens
YEAQPSATL

SEQ ID NO: 599416 - protein, 9 aa, Homo Sapiens
PTMKPSETR

SEQ ID NO: 599417 - protein, 9 aa, Homo Sapiens
LCNTGRLVR

SEQ ID NO: 599418 - protein, 9 aa, Homo Sapiens
GGYLQRQAL

SEQ ID NO: 599419 - protein, 9 aa, Homo Sapiens
QEFQHLSPP

SEQ ID NO: 599420 - protein, 9 aa, Homo Sapiens
VEALVVADK

SEQ ID NO: 599421 - protein, 9 aa, Homo Sapiens
LEGYHGTVG

SEQ ID NO: 599422 - protein, 9 aa, Homo Sapiens
RERLGLSPK

SEQ ID NO: 599423 - protein, 9 aa, Homo Sapiens
LSWHPDGNG

SEQ ID NO: 599424 - protein, 9 aa, Homo Sapiens
KKKKNKHSP

SEQ ID NO: 599425 - protein, 9 aa, Homo Sapiens
NAPENVPLG

SEQ ID NO: 599426 - protein, 9 aa, Homo Sapiens
LMTIYEDEL

SEQ ID NO: 599427 - protein, 9 aa, Homo Sapiens
PEKSKTKFS

SEQ ID NO: 599428 - protein, 9 aa, Homo Sapiens
LVGEMLKTS

SEQ ID NO: 599429 - protein, 9 aa, Homo Sapiens
PFIASIQYG

SEQ ID NO: 599430 - protein, 9 aa, Homo Sapiens
LSEVEEVEM

SEQ ID NO: 599431 - protein, 9 aa, Homo Sapiens
LLAINSDGS

SEQ ID NO: 599432 - protein, 9 aa, Homo Sapiens
SDEEDRASA

SEQ ID NO: 599433 - protein, 9 aa, Homo Sapiens
TESSEENLE

SEQ ID NO: 599434 - protein, 9 aa, Homo Sapiens
FWSRPFKLH

SEQ ID NO: 599435 - protein, 9 aa, Homo Sapiens
AEDSGIFFD

SEQ ID NO: 599436 - protein, 9 aa, Homo Sapiens
TNKSGDAPL

SEQ ID NO: 599437 - protein, 9 aa, Homo Sapiens
GAAFPLLAF

SEQ ID NO: 599438 - protein, 9 aa, Homo Sapiens
WGAPEGVSH

SEQ ID NO: 599439 - protein, 9 aa, Homo Sapiens
VMEGIKSCG

SEQ ID NO: 599440 - protein, 9 aa, Homo Sapiens
RLFVLVPPS

SEQ ID NO: 599441 - protein, 9 aa, Homo Sapiens
NVDLIHIVN

SEQ ID NO: 599442 - protein, 9 aa, Homo Sapiens
SVLSAPSHC

SEQ ID NO: 599443 - protein, 9 aa, Homo Sapiens
VREEVIDFT

SEQ ID NO: 599444 - protein, 9 aa, Homo Sapiens
SPHSRPFIA

SEQ ID NO: 599445 - protein, 9 aa, Homo Sapiens
DKRVAGKHI

SEQ ID NO: 599446 - protein, 9 aa, Homo Sapiens
TEFSVKSTF

SEQ ID NO: 599447 - protein, 9 aa, Homo Sapiens
VTTKTWCIF

SEQ ID NO: 599448 - protein, 9 aa, Homo Sapiens
AASPRIVPR

SEQ ID NO: 599449 - protein, 9 aa, Homo Sapiens
HPDGNGKLA

SEQ ID NO: 599450 - protein, 9 aa, Homo Sapiens
TESKVEPKK

SEQ ID NO: 599451 - protein, 9 aa, Homo Sapiens
TLSLLNDSE

SEQ ID NO: 599452 - protein, 9 aa, Homo Sapiens
KMNVHRPCE

SEQ ID NO: 599453 - protein, 9 aa, Homo Sapiens
VMKLFARAK

SEQ ID NO: 599454 - protein, 9 aa, Homo Sapiens
TTSTTKLSW

SEQ ID NO: 599455 - protein, 9 aa, Homo Sapiens
EIASRLRQW

SEQ ID NO: 599456 - protein, 9 aa, Homo Sapiens
CPLLLALAL

SEQ ID NO: 599457 - protein, 9 aa, Homo Sapiens
HHTEEGIDK

SEQ ID NO: 599458 - protein, 9 aa, Homo Sapiens
YGGLRKKAF

SEQ ID NO: 599459 - protein, 9 aa, Homo Sapiens
DSRITLKSG

SEQ ID NO: 599460 - protein, 9 aa, Homo Sapiens
CSECSFLAK

SEQ ID NO: 599461 - protein, 9 aa, Homo Sapiens
PSSGEASST

SEQ ID NO: 599462 - protein, 9 aa, Homo Sapiens
PYATDSDGH

SEQ ID NO: 599463 - protein, 9 aa, Homo Sapiens
SYRPTMGFT

SEQ ID NO: 599464 - protein, 9 aa, Homo Sapiens
HKEKLNKLM

SEQ ID NO: 599465 - protein, 9 aa, Homo Sapiens
VETFGPFGS

SEQ ID NO: 599466 - protein, 9 aa, Homo Sapiens
VLPRKKLFI

SEQ ID NO: 599467 - protein, 9 aa, Homo Sapiens
NNCYPNETV

SEQ ID NO: 599468 - protein, 9 aa, Homo Sapiens
NLNAKRSSP

SEQ ID NO: 599469 - protein, 9 aa, Homo Sapiens
KRSSPLISQ

SEQ ID NO: 599470 - protein, 9 aa, Homo Sapiens
GSLAFYGTV

SEQ ID NO: 599471 - protein, 9 aa, Homo Sapiens
MGLWFVRRL

SEQ ID NO: 599472 - protein, 9 aa, Homo Sapiens
VCHNLSGTF

SEQ ID NO: 599473 - protein, 9 aa, Homo Sapiens
QAQPLPYGG

SEQ ID NO: 599474 - protein, 9 aa, Homo Sapiens
SQERQYYGS

SEQ ID NO: 599475 - protein, 9 aa, Homo Sapiens
FTTSYRELT

SEQ ID NO: 599476 - protein, 9 aa, Homo Sapiens
YGLVMNRGS

SEQ ID NO: 599477 - protein, 9 aa, Homo Sapiens
PQTSRAIDR

SEQ ID NO: 599478 - protein, 9 aa, Homo Sapiens
DDFRKLWLS

SEQ ID NO: 599479 - protein, 9 aa, Homo Sapiens
LAEDSGIFF

SEQ ID NO: 599480 - protein, 9 aa, Homo Sapiens
RRPQGSTYR

SEQ ID NO: 599481 - protein, 9 aa, Homo Sapiens
SSPFYPRIV

SEQ ID NO: 599482 - protein, 9 aa, Homo Sapiens
LGLCWQEVG

SEQ ID NO: 599483 - protein, 9 aa, Homo Sapiens
KSSLTCYHR

SEQ ID NO: 599484 - protein, 9 aa, Homo Sapiens
SSLKRSSGP

SEQ ID NO: 599485 - protein, 9 aa, Homo Sapiens
AFTFLKSSV

SEQ ID NO: 599486 - protein, 9 aa, Homo Sapiens
SSIHNFDSD

SEQ ID NO: 599487 - protein, 9 aa, Homo Sapiens
EKSEGGFSA

SEQ ID NO: 599488 - protein, 9 aa, Homo Sapiens
KETEVAYLT

SEQ ID NO: 599489 - protein, 9 aa, Homo Sapiens
RQSVDQSTL

SEQ ID NO: 599490 - protein, 9 aa, Homo Sapiens
LDANETEPV

SEQ ID NO: 599491 - protein, 9 aa, Homo Sapiens
ASTLSLLND

SEQ ID NO: 599492 - protein, 9 aa, Homo Sapiens
VKCVSSPFY

SEQ ID NO: 599493 - protein, 9 aa, Homo Sapiens
LLKCLRNNL

SEQ ID NO: 599494 - protein, 9 aa, Homo Sapiens
AGKHILILA

SEQ ID NO: 599495 - protein, 9 aa, Homo Sapiens
KTATTTQVT

SEQ ID NO: 599496 - protein, 9 aa, Homo Sapiens
GVTANGGPV

SEQ ID NO: 599497 - protein, 9 aa, Homo Sapiens
KKKCQELCC

SEQ ID NO: 599498 - protein, 9 aa, Homo Sapiens
VDDILAAVS

SEQ ID NO: 599499 - protein, 9 aa, Homo Sapiens
GHHIRNQTY

SEQ ID NO: 599500 - protein, 9 aa, Homo Sapiens
HIVNRIGDI

SEQ ID NO: 599501 - protein, 9 aa, Homo Sapiens
HTCFVSDLK

SEQ ID NO: 599502 - protein, 9 aa, Homo Sapiens
SVSLASSCV

SEQ ID NO: 599503 - protein, 9 aa, Homo Sapiens
GERQAEATA

SEQ ID NO: 599504 - protein, 9 aa, Homo Sapiens
VFNNKLSDA

SEQ ID NO: 599505 - protein, 9 aa, Homo Sapiens
SLSEVEEVE

SEQ ID NO: 599506 - protein, 9 aa, Homo Sapiens
ACQCLPGYQ

SEQ ID NO: 599507 - protein, 9 aa, Homo Sapiens
VWYGLVMNR

SEQ ID NO: 599508 - protein, 9 aa, Homo Sapiens
QPTQGNLTF

SEQ ID NO: 599509 - protein, 9 aa, Homo Sapiens
TFISRYAFT

SEQ ID NO: 599510 - protein, 9 aa, Homo Sapiens
PAKKKPPSP

SEQ ID NO: 599511 - protein, 9 aa, Homo Sapiens
IKLSKGQRR

SEQ ID NO: 599512 - protein, 9 aa, Homo Sapiens
LQQGDNWVE

SEQ ID NO: 599513 - protein, 9 aa, Homo Sapiens
VEEDATVLP

SEQ ID NO: 599514 - protein, 9 aa, Homo Sapiens
SDCYSVYTS

SEQ ID NO: 599515 - protein, 9 aa, Homo Sapiens
LPMVMGPNN

SEQ ID NO: 599516 - protein, 9 aa, Homo Sapiens
LLATIQGLI

SEQ ID NO: 599517 - protein, 9 aa, Homo Sapiens
EDFQKKEPK

SEQ ID NO: 599518 - protein, 9 aa, Homo Sapiens
TTENSQCTK

SEQ ID NO: 599519 - protein, 9 aa, Homo Sapiens
NEEQTSTQP

SEQ ID NO: 599520 - protein, 9 aa, Homo Sapiens
ERLQQGDNW

SEQ ID NO: 599521 - protein, 9 aa, Homo Sapiens
PPCLLTGST

SEQ ID NO: 599522 - protein, 9 aa, Homo Sapiens
AGFLEGYLS

SEQ ID NO: 599523 - protein, 9 aa, Homo Sapiens
MLPCPCKAK

SEQ ID NO: 599524 - protein, 9 aa, Homo Sapiens
KLKYKDLCT

SEQ ID NO: 599525 - protein, 9 aa, Homo Sapiens
ETEVAYLTK

SEQ ID NO: 599526 - protein, 9 aa, Homo Sapiens
EEKRLNKMK

SEQ ID NO: 599527 - protein, 9 aa, Homo Sapiens
SLIQCSLNV

SEQ ID NO: 599528 - protein, 9 aa, Homo Sapiens
DMDSEKKGF

SEQ ID NO: 599529 - protein, 9 aa, Homo Sapiens
HMGYRQSEF

SEQ ID NO: 599530 - protein, 9 aa, Homo Sapiens
LLNVVVSGS

SEQ ID NO: 599531 - protein, 9 aa, Homo Sapiens
LLGSNKEHM

SEQ ID NO: 599532 - protein, 9 aa, Homo Sapiens
APWALFPDS

SEQ ID NO: 599533 - protein, 9 aa, Homo Sapiens
TQRYQENEE

SEQ ID NO: 599534 - protein, 9 aa, Homo Sapiens
MITTPPCLL

SEQ ID NO: 599535 - protein, 9 aa, Homo Sapiens
TDFSPAIHQ

SEQ ID NO: 599536 - protein, 9 aa, Homo Sapiens
RGNQTDVGN

SEQ ID NO: 599537 - protein, 9 aa, Homo Sapiens
RRSRAPSVA

SEQ ID NO: 599538 - protein, 9 aa, Homo Sapiens
LLWQGSGIQ

SEQ ID NO: 599539 - protein, 9 aa, Homo Sapiens
GWCCPCCSS

SEQ ID NO: 599540 - protein, 9 aa, Homo Sapiens
SSDRIESKG

SEQ ID NO: 599541 - protein, 9 aa, Homo Sapiens
FRKEESLSR

SEQ ID NO: 599542 - protein, 9 aa, Homo Sapiens
PLTRFQARS

SEQ ID NO: 599543 - protein, 9 aa, Homo Sapiens
SRCAFMLDR

SEQ ID NO: 599544 - protein, 9 aa, Homo Sapiens
MLSPPAGPR

SEQ ID NO: 599545 - protein, 9 aa, Homo Sapiens
LGDSSTSRM

SEQ ID NO: 599546 - protein, 9 aa, Homo Sapiens
TTESKTATT

SEQ ID NO: 599547 - protein, 9 aa, Homo Sapiens
QSLKMNFFR

SEQ ID NO: 599548 - protein, 9 aa, Homo Sapiens
GDPPLVVSW

SEQ ID NO: 599549 - protein, 9 aa, Homo Sapiens
YPKSEIVYT

SEQ ID NO: 599550 - protein, 9 aa, Homo Sapiens
FQNGEEGDG

SEQ ID NO: 599551 - protein, 9 aa, Homo Sapiens
TEEGIDKSA

SEQ ID NO: 599552 - protein, 9 aa, Homo Sapiens
RVHMGVKCC

SEQ ID NO: 599553 - protein, 9 aa, Homo Sapiens
NLNVGGFRQ

SEQ ID NO: 599554 - protein, 9 aa, Homo Sapiens
IVPRAPWME

SEQ ID NO: 599555 - protein, 9 aa, Homo Sapiens
VKDRTLKLH

SEQ ID NO: 599556 - protein, 9 aa, Homo Sapiens
MLGAFHSDL

SEQ ID NO: 599557 - protein, 9 aa, Homo Sapiens
SSMSLLQGA

SEQ ID NO: 599558 - protein, 9 aa, Homo Sapiens
TNCYKACLT

SEQ ID NO: 599559 - protein, 9 aa, Homo Sapiens
KSRVRLFVL

SEQ ID NO: 599560 - protein, 9 aa, Homo Sapiens
DTLPFLKYY

SEQ ID NO: 599561 - protein, 9 aa, Homo Sapiens
PHPLTRFQA

SEQ ID NO: 599562 - protein, 9 aa, Homo Sapiens
KGIKKDARK

SEQ ID NO: 599563 - protein, 9 aa, Homo Sapiens
MAKESLNAA

SEQ ID NO: 599564 - protein, 9 aa, Homo Sapiens
CRHHCPHFP

SEQ ID NO: 599565 - protein, 9 aa, Homo Sapiens
PKKEANKDF

SEQ ID NO: 599566 - protein, 9 aa, Homo Sapiens
PFSFSTFTT

SEQ ID NO: 599567 - protein, 9 aa, Homo Sapiens
ESVKNRVID

SEQ ID NO: 599568 - protein, 9 aa, Homo Sapiens
NLQNNKWYP

SEQ ID NO: 599569 - protein, 9 aa, Homo Sapiens
SQSSIHNFD

SEQ ID NO: 599570 - protein, 9 aa, Homo Sapiens
FAHRMFGLS

SEQ ID NO: 599571 - protein, 9 aa, Homo Sapiens
VCSECSFLA

SEQ ID NO: 599572 - protein, 9 aa, Homo Sapiens
LTRFQARSL

SEQ ID NO: 599573 - protein, 9 aa, Homo Sapiens
TENGQRTTF

SEQ ID NO: 599574 - protein, 9 aa, Homo Sapiens
TSIGMQLEG

SEQ ID NO: 599575 - protein, 9 aa, Homo Sapiens
HGFLVFHSF

SEQ ID NO: 599576 - protein, 9 aa, Homo Sapiens
DEEINRMID

SEQ ID NO: 599577 - protein, 9 aa, Homo Sapiens
RPFIASIQY

SEQ ID NO: 599578 - protein, 9 aa, Homo Sapiens
TLKSGYGKY

SEQ ID NO: 599579 - protein, 9 aa, Homo Sapiens
DEKRTPPSS

SEQ ID NO: 599580 - protein, 9 aa, Homo Sapiens
GGRGGKCTE

SEQ ID NO: 599581 - protein, 9 aa, Homo Sapiens
SLVWHQRIH

SEQ ID NO: 599582 - protein, 9 aa, Homo Sapiens
DSWVFGAIE

SEQ ID NO: 599583 - protein, 9 aa, Homo Sapiens
EESLSRKLL

SEQ ID NO: 599584 - protein, 9 aa, Homo Sapiens
VNQLAKGKT

SEQ ID NO: 599585 - protein, 9 aa, Homo Sapiens
QRYQENEEQ

SEQ ID NO: 599586 - protein, 9 aa, Homo Sapiens
EFQHLSPPS

SEQ ID NO: 599587 - protein, 9 aa, Homo Sapiens
DGVDDGTKS

SEQ ID NO: 599588 - protein, 9 aa, Homo Sapiens
IKRGKARNY

SEQ ID NO: 599589 - protein, 9 aa, Homo Sapiens
APTMKPSET

SEQ ID NO: 599590 - protein, 9 aa, Homo Sapiens
PTRELALEI

SEQ ID NO: 599591 - protein, 9 aa, Homo Sapiens
GGYFTWTPV

SEQ ID NO: 599592 - protein, 9 aa, Homo Sapiens
IVNRIGDII

SEQ ID NO: 599593 - protein, 9 aa, Homo Sapiens
SPLCPLLLA

SEQ ID NO: 599594 - protein, 9 aa, Homo Sapiens
GSPSYRPTM

SEQ ID NO: 599595 - protein, 9 aa, Homo Sapiens
TKTNCYKAC

SEQ ID NO: 599596 - protein, 9 aa, Homo Sapiens
TWTPVGIPT

SEQ ID NO: 599597 - protein, 9 aa, Homo Sapiens
VYVLENDVS

SEQ ID NO: 599598 - protein, 9 aa, Homo Sapiens
LIHIVNRIG

SEQ ID NO: 599599 - protein, 9 aa, Homo Sapiens
NLSALSDCY

SEQ ID NO: 599600 - protein, 9 aa, Homo Sapiens
DESPAMCSP

SEQ ID NO: 599601 - protein, 9 aa, Homo Sapiens
RVPVLPFVI

SEQ ID NO: 599602 - protein, 9 aa, Homo Sapiens
VYRERLGLS

SEQ ID NO: 599603 - protein, 9 aa, Homo Sapiens
LPSVPYVMF

SEQ ID NO: 599604 - protein, 9 aa, Homo Sapiens
RSWGAPEGV

SEQ ID NO: 599605 - protein, 9 aa, Homo Sapiens
PTFVCSECS

SEQ ID NO: 599606 - protein, 9 aa, Homo Sapiens
QHLSPPSGA

SEQ ID NO: 599607 - protein, 9 aa, Homo Sapiens
QYCGIKRRL

SEQ ID NO: 599608 - protein, 9 aa, Homo Sapiens
QQRDCGSAA

SEQ ID NO: 599609 - protein, 9 aa, Homo Sapiens
VKNSSLTVH

SEQ ID NO: 599610 - protein, 9 aa, Homo Sapiens
IEKNPTFSL

SEQ ID NO: 599611 - protein, 9 aa, Homo Sapiens
LALEITKEC

SEQ ID NO: 599612 - protein, 9 aa, Homo Sapiens
KNCREAFKT

SEQ ID NO: 599613 - protein, 9 aa, Homo Sapiens
ASPGKYLFK

SEQ ID NO: 599614 - protein, 9 aa, Homo Sapiens
DYDYAQIPY

SEQ ID NO: 599615 - protein, 9 aa, Homo Sapiens
EQCSPLPCN

SEQ ID NO: 599616 - protein, 9 aa, Homo Sapiens
HCDWCCKNG

SEQ ID NO: 599617 - protein, 9 aa, Homo Sapiens
LAFYGTVNE

SEQ ID NO: 599618 - protein, 9 aa, Homo Sapiens
SLLNDSESA

SEQ ID NO: 599619 - protein, 9 aa, Homo Sapiens
SDDFRKLWL

SEQ ID NO: 599620 - protein, 9 aa, Homo Sapiens
WHQRIHTAE

SEQ ID NO: 599621 - protein, 9 aa, Homo Sapiens
EDKIKQWLG

SEQ ID NO: 599622 - protein, 9 aa, Homo Sapiens
NCREAFKTL

SEQ ID NO: 599623 - protein, 9 aa, Homo Sapiens
GVAVMKLFA

SEQ ID NO: 599624 - protein, 9 aa, Homo Sapiens
AQEITYLAD

SEQ ID NO: 599625 - protein, 9 aa, Homo Sapiens
LISSAYSQV

SEQ ID NO: 599626 - protein, 9 aa, Homo Sapiens
VHTQVAGKI

SEQ ID NO: 599627 - protein, 9 aa, Homo Sapiens
LTGSTAGSP

SEQ ID NO: 599628 - protein, 9 aa, Homo Sapiens
YMSNHTNDF

SEQ ID NO: 599629 - protein, 9 aa, Homo Sapiens
FCKLVFSRC

SEQ ID NO: 599630 - protein, 9 aa, Homo Sapiens
KDFVKVVSK

SEQ ID NO: 599631 - protein, 9 aa, Homo Sapiens
EIVYTWKKG

SEQ ID NO: 599632 - protein, 9 aa, Homo Sapiens
NVGKASQPS

SEQ ID NO: 599633 - protein, 9 aa, Homo Sapiens
NAVVNYTNK

SEQ ID NO: 599634 - protein, 9 aa, Homo Sapiens
KRTRTLMER

SEQ ID NO: 599635 - protein, 9 aa, Homo Sapiens
FQKKEPKEQ

SEQ ID NO: 599636 - protein, 9 aa, Homo Sapiens
VAQSGTESK

SEQ ID NO: 599637 - protein, 9 aa, Homo Sapiens
RKEESLSRK

SEQ ID NO: 599638 - protein, 9 aa, Homo Sapiens
SNTGSVSLA

SEQ ID NO: 599639 - protein, 9 aa, Homo Sapiens
WPEGLDASA

SEQ ID NO: 599640 - protein, 9 aa, Homo Sapiens
SPLVTWVET

SEQ ID NO: 599641 - protein, 9 aa, Homo Sapiens
LQPLRSERE

SEQ ID NO: 599642 - protein, 9 aa, Homo Sapiens
SASGKSSGF

SEQ ID NO: 599643 - protein, 9 aa, Homo Sapiens
VFDINSTRG

SEQ ID NO: 599644 - protein, 9 aa, Homo Sapiens
LEDVTAVSE

SEQ ID NO: 599645 - protein, 9 aa, Homo Sapiens
CSINEDSGL

SEQ ID NO: 599646 - protein, 9 aa, Homo Sapiens
LPEKSKTKF

SEQ ID NO: 599647 - protein, 9 aa, Homo Sapiens
EESEVAIKL

SEQ ID NO: 599648 - protein, 9 aa, Homo Sapiens
QKLKYKDLC

SEQ ID NO: 599649 - protein, 9 aa, Homo Sapiens
VRRLELLLV

SEQ ID NO: 599650 - protein, 9 aa, Homo Sapiens
TRGRSGSRI

SEQ ID NO: 599651 - protein, 9 aa, Homo Sapiens
SLHKEKLNK

SEQ ID NO: 599652 - protein, 9 aa, Homo Sapiens
EFYTPSKFK

SEQ ID NO: 599653 - protein, 9 aa, Homo Sapiens
ISHQDGFPS

SEQ ID NO: 599654 - protein, 9 aa, Homo Sapiens
ESPAMCSPF

SEQ ID NO: 599655 - protein, 9 aa, Homo Sapiens
PSHCDWCCK

SEQ ID NO: 599656 - protein, 9 aa, Homo Sapiens
EDTLPFLKY

SEQ ID NO: 599657 - protein, 9 aa, Homo Sapiens
HNLSGTFEC

SEQ ID NO: 599658 - protein, 9 aa, Homo Sapiens
RLTQRYQEN

SEQ ID NO: 599659 - protein, 9 aa, Homo Sapiens
VTCTALTHP

SEQ ID NO: 599660 - protein, 9 aa, Homo Sapiens
PDGNGKLAV

SEQ ID NO: 599661 - protein, 9 aa, Homo Sapiens
VYAIDPQTS

SEQ ID NO: 599662 - protein, 9 aa, Homo Sapiens
KTKQAWYFL

SEQ ID NO: 599663 - protein, 9 aa, Homo Sapiens
NLSGTFECI

SEQ ID NO: 599664 - protein, 9 aa, Homo Sapiens
EAREDTAAL

SEQ ID NO: 599665 - protein, 9 aa, Homo Sapiens
GTKSDTSVT

SEQ ID NO: 599666 - protein, 9 aa, Homo Sapiens
CSPFTRDLW

SEQ ID NO: 599667 - protein, 9 aa, Homo Sapiens
QENEEQTST

SEQ ID NO: 599668 - protein, 9 aa, Homo Sapiens
NTSGFYYVD

SEQ ID NO: 599669 - protein, 9 aa, Homo Sapiens
KDPTFVCSE

SEQ ID NO: 599670 - protein, 9 aa, Homo Sapiens
DYIIDPWEN

SEQ ID NO: 599671 - protein, 9 aa, Homo Sapiens
SPCSRNHEE

SEQ ID NO: 599672 - protein, 9 aa, Homo Sapiens
QGLVYVLEN

SEQ ID NO: 599673 - protein, 9 aa, Homo Sapiens
TVPWNIFLL

SEQ ID NO: 599674 - protein, 9 aa, Homo Sapiens
NGEEGDGDF

SEQ ID NO: 599675 - protein, 9 aa, Homo Sapiens
VQRNEIYKQ

SEQ ID NO: 599676 - protein, 9 aa, Homo Sapiens
WNTEEAYIG

SEQ ID NO: 599677 - protein, 9 aa, Homo Sapiens
NLLQPQALK

SEQ ID NO: 599678 - protein, 9 aa, Homo Sapiens
DYGSTAKQT

SEQ ID NO: 599679 - protein, 9 aa, Homo Sapiens
KFSSCESLL

SEQ ID NO: 599680 - protein, 9 aa, Homo Sapiens
VRAGISWVT

SEQ ID NO: 599681 - protein, 9 aa, Homo Sapiens
DGSAESTAS

SEQ ID NO: 599682 - protein, 9 aa, Homo Sapiens
LRNNLCQKY

SEQ ID NO: 599683 - protein, 9 aa, Homo Sapiens
RSSPLISQK

SEQ ID NO: 599684 - protein, 9 aa, Homo Sapiens
STYRDHENE

SEQ ID NO: 599685 - protein, 9 aa, Homo Sapiens
KCVSSPFYP

SEQ ID NO: 599686 - protein, 9 aa, Homo Sapiens
INEDQSKSV

SEQ ID NO: 599687 - protein, 9 aa, Homo Sapiens
SRAIDRNEL

SEQ ID NO: 599688 - protein, 9 aa, Homo Sapiens
AGHQQFDEL

SEQ ID NO: 599689 - protein, 9 aa, Homo Sapiens
SLPEDEQGI

SEQ ID NO: 599690 - protein, 9 aa, Homo Sapiens
NGSLAFYGT

SEQ ID NO: 599691 - protein, 9 aa, Homo Sapiens
TPPCLLTGS

SEQ ID NO: 599692 - protein, 9 aa, Homo Sapiens
SPTISHKDN

SEQ ID NO: 599693 - protein, 9 aa, Homo Sapiens
AMRCSLIAE

SEQ ID NO: 599694 - protein, 9 aa, Homo Sapiens
NFLQSVVAG

SEQ ID NO: 599695 - protein, 9 aa, Homo Sapiens
KEDVFNNKL

SEQ ID NO: 599696 - protein, 9 aa, Homo Sapiens
LSWSQVTTK

SEQ ID NO: 599697 - protein, 9 aa, Homo Sapiens
MYAFRSEEG

SEQ ID NO: 599698 - protein, 9 aa, Homo Sapiens
IEKFSNKSN

SEQ ID NO: 599699 - protein, 9 aa, Homo Sapiens
LRTLGAWNL

SEQ ID NO: 599700 - protein, 9 aa, Homo Sapiens
QISADSGVN

SEQ ID NO: 599701 - protein, 9 aa, Homo Sapiens
RSEEGFKSP

SEQ ID NO: 599702 - protein, 9 aa, Homo Sapiens
ETINAVSQF

SEQ ID NO: 599703 - protein, 9 aa, Homo Sapiens
GQHESASGK

SEQ ID NO: 599704 - protein, 9 aa, Homo Sapiens
HMYGKRIGS

SEQ ID NO: 599705 - protein, 9 aa, Homo Sapiens
PSYRPTMGF

SEQ ID NO: 599706 - protein, 9 aa, Homo Sapiens
QWKVMEGIK

SEQ ID NO: 599707 - protein, 9 aa, Homo Sapiens
RAPWALFPD

SEQ ID NO: 599708 - protein, 9 aa, Homo Sapiens
ATATQSAWQ

SEQ ID NO: 599709 - protein, 9 aa, Homo Sapiens
YQEELRGQR

SEQ ID NO: 599710 - protein, 9 aa, Homo Sapiens
LMVDVEHSN

SEQ ID NO: 599711 - protein, 9 aa, Homo Sapiens
PKAPKSSPV

SEQ ID NO: 599712 - protein, 9 aa, Homo Sapiens
QMHGMKKKC

SEQ ID NO: 599713 - protein, 9 aa, Homo Sapiens
CTYWVRYIH

SEQ ID NO: 599714 - protein, 9 aa, Homo Sapiens
EGYLSAPHM

SEQ ID NO: 599715 - protein, 9 aa, Homo Sapiens
LRGQTSIGM

SEQ ID NO: 599716 - protein, 9 aa, Homo Sapiens
VSARAVSRS

SEQ ID NO: 599717 - protein, 9 aa, Homo Sapiens
ASPRIVPRA

SEQ ID NO: 599718 - protein, 9 aa, Homo Sapiens
KQEFQHLSP

SEQ ID NO: 599719 - protein, 9 aa, Homo Sapiens
INVDLIHIV

SEQ ID NO: 599720 - protein, 9 aa, Homo Sapiens
RICPNGTGG

SEQ ID NO: 599721 - protein, 9 aa, Homo Sapiens
QTLNRLCQI

SEQ ID NO: 599722 - protein, 9 aa, Homo Sapiens
ETFGPFGSG

SEQ ID NO: 599723 - protein, 9 aa, Homo Sapiens
AAVDLRAAQ

SEQ ID NO: 599724 - protein, 9 aa, Homo Sapiens
SGSPCSRNH

SEQ ID NO: 599725 - protein, 9 aa, Homo Sapiens
IASIQYGGH

SEQ ID NO: 599726 - protein, 9 aa, Homo Sapiens
SVKSTFISR

SEQ ID NO: 599727 - protein, 9 aa, Homo Sapiens
MKKKKKKNK

SEQ ID NO: 599728 - protein, 9 aa, Homo Sapiens
EEPSSGLRK

SEQ ID NO: 599729 - protein, 9 aa, Homo Sapiens
QGNYEIRYT

SEQ ID NO: 599730 - protein, 9 aa, Homo Sapiens
SCSINEDSG

SEQ ID NO: 599731 - protein, 9 aa, Homo Sapiens
RGQRDLVQA

SEQ ID NO: 599732 - protein, 9 aa, Homo Sapiens
GIVLTTLPL

SEQ ID NO: 599733 - protein, 9 aa, Homo Sapiens
ASGAAWLRT

SEQ ID NO: 599734 - protein, 9 aa, Homo Sapiens
YTFQNGEEG

SEQ ID NO: 599735 - protein, 9 aa, Homo Sapiens
LTKTNCYKA

SEQ ID NO: 599736 - protein, 9 aa, Homo Sapiens
MTIYEDELK

SEQ ID NO: 599737 - protein, 9 aa, Homo Sapiens
WHLRMPKVK

SEQ ID NO: 599738 - protein, 9 aa, Homo Sapiens
LVICIKIFL

SEQ ID NO: 599739 - protein, 9 aa, Homo Sapiens
SINEDSGLS

SEQ ID NO: 599740 - protein, 9 aa, Homo Sapiens
LVAVTCWNL

SEQ ID NO: 599741 - protein, 9 aa, Homo Sapiens
GIVSKPDLV

SEQ ID NO: 599742 - protein, 9 aa, Homo Sapiens
ALNAQHVEE

SEQ ID NO: 599743 - protein, 9 aa, Homo Sapiens
SLKMNFFRL

SEQ ID NO: 599744 - protein, 9 aa, Homo Sapiens
TQANVWVVD

SEQ ID NO: 599745 - protein, 9 aa, Homo Sapiens
EIEKNPTFS

SEQ ID NO: 599746 - protein, 9 aa, Homo Sapiens
LGCSCLGDS

SEQ ID NO: 599747 - protein, 9 aa, Homo Sapiens
KVLHQLKSE

SEQ ID NO: 599748 - protein, 9 aa, Homo Sapiens
KCLRNNLCQ

SEQ ID NO: 599749 - protein, 9 aa, Homo Sapiens
MIARICPNG

SEQ ID NO: 599750 - protein, 9 aa, Homo Sapiens
EDIKAHTCF

SEQ ID NO: 599751 - protein, 9 aa, Homo Sapiens
KEVAWKYNY

SEQ ID NO: 599752 - protein, 9 aa, Homo Sapiens
VFLLPAAVL

SEQ ID NO: 599753 - protein, 9 aa, Homo Sapiens
SRMRLPQPT

SEQ ID NO: 599754 - protein, 9 aa, Homo Sapiens
AHRMFGLSW

SEQ ID NO: 599755 - protein, 9 aa, Homo Sapiens
MPSVVKAAF

SEQ ID NO: 599756 - protein, 9 aa, Homo Sapiens
GLIPNTQAN

SEQ ID NO: 599757 - protein, 9 aa, Homo Sapiens
VICIKIFLV

SEQ ID NO: 599758 - protein, 9 aa, Homo Sapiens
AAAYEAQPS

SEQ ID NO: 599759 - protein, 9 aa, Homo Sapiens
SNPCNFDNA

SEQ ID NO: 599760 - protein, 9 aa, Homo Sapiens
LSATATKVD

SEQ ID NO: 599761 - protein, 9 aa, Homo Sapiens
STLSLLNDS

SEQ ID NO: 599762 - protein, 9 aa, Homo Sapiens
YALRNPYCK

SEQ ID NO: 599763 - protein, 9 aa, Homo Sapiens
VPYVMFCGW

SEQ ID NO: 599764 - protein, 9 aa, Homo Sapiens
NVFHWLLVD

SEQ ID NO: 599765 - protein, 9 aa, Homo Sapiens
GHCEGVLWA

SEQ ID NO: 599766 - protein, 9 aa, Homo Sapiens
LVTWVETFG

SEQ ID NO: 599767 - protein, 9 aa, Homo Sapiens
KEKINVDII

SEQ ID NO: 599768 - protein, 9 aa, Homo Sapiens
HINAPENVP

SEQ ID NO: 599769 - protein, 9 aa, Homo Sapiens
FLKTESSEE

SEQ ID NO: 599770 - protein, 9 aa, Homo Sapiens
EIDQGKGHH

SEQ ID NO: 599771 - protein, 9 aa, Homo Sapiens
SATATKVDI

SEQ ID NO: 599772 - protein, 9 aa, Homo Sapiens
CKQLIKLLK

SEQ ID NO: 599773 - protein, 9 aa, Homo Sapiens
SLALKYIRC

SEQ ID NO: 599774 - protein, 9 aa, Homo Sapiens
HETLELEKG

SEQ ID NO: 599775 - protein, 9 aa, Homo Sapiens
FSAAPARAV

SEQ ID NO: 599776 - protein, 9 aa, Homo Sapiens
QCGKAFVKN

SEQ ID NO: 599777 - protein, 9 aa, Homo Sapiens
LAAHDNRVS

SEQ ID NO: 599778 - protein, 9 aa, Homo Sapiens
EVAYLTKKQ

SEQ ID NO: 599779 - protein, 9 aa, Homo Sapiens
WASGAAWLR

SEQ ID NO: 599780 - protein, 9 aa, Homo Sapiens
VRICAQAHC

SEQ ID NO: 599781 - protein, 9 aa, Homo Sapiens
GLNVEALVV

SEQ ID NO: 599782 - protein, 9 aa, Homo Sapiens
TWVETFGPF

SEQ ID NO: 599783 - protein, 9 aa, Homo Sapiens
CDPVVLPSF

SEQ ID NO: 599784 - protein, 9 aa, Homo Sapiens
SWVTLQWSK

SEQ ID NO: 599785 - protein, 9 aa, Homo Sapiens
NSILTHEAA

SEQ ID NO: 599786 - protein, 9 aa, Homo Sapiens
KNPNKVHWD

SEQ ID NO: 599787 - protein, 9 aa, Homo Sapiens
SKIPITIKH

SEQ ID NO: 599788 - protein, 9 aa, Homo Sapiens
GEMLKTSTD

SEQ ID NO: 599789 - protein, 9 aa, Homo Sapiens
REDIKGFSD

SEQ ID NO: 599790 - protein, 9 aa, Homo Sapiens
VDLKANVIS

SEQ ID NO: 599791 - protein, 9 aa, Homo Sapiens
QLLDFEQTL

SEQ ID NO: 599792 - protein, 9 aa, Homo Sapiens
RKEHKRESM

SEQ ID NO: 599793 - protein, 9 aa, Homo Sapiens
TYLADSLQL

SEQ ID NO: 599794 - protein, 9 aa, Homo Sapiens
QLAKGKTIS

SEQ ID NO: 599795 - protein, 9 aa, Homo Sapiens
KGLIPNTQA

SEQ ID NO: 599796 - protein, 9 aa, Homo Sapiens
ANVWVVDLK

SEQ ID NO: 599797 - protein, 9 aa, Homo Sapiens
EKLNKLMTN

SEQ ID NO: 599798 - protein, 9 aa, Homo Sapiens
SYGAAAAYE

SEQ ID NO: 599799 - protein, 9 aa, Homo Sapiens
RASAPKSQD

SEQ ID NO: 599800 - protein, 9 aa, Homo Sapiens
SCLGDSSTS

SEQ ID NO: 599801 - protein, 9 aa, Homo Sapiens
GIFFDYSGR

SEQ ID NO: 599802 - protein, 9 aa, Homo Sapiens
LISQKLVGE

SEQ ID NO: 599803 - protein, 9 aa, Homo Sapiens
IATAMAQAH

SEQ ID NO: 599804 - protein, 9 aa, Homo Sapiens
GIAYLYGRG

SEQ ID NO: 599805 - protein, 9 aa, Homo Sapiens
GCTYWVRYI

SEQ ID NO: 599806 - protein, 9 aa, Homo Sapiens
RELTTGAPE

SEQ ID NO: 599807 - protein, 9 aa, Homo Sapiens
EHSNAAAAA

SEQ ID NO: 599808 - protein, 9 aa, Homo Sapiens
EVAPLISSA

SEQ ID NO: 599809 - protein, 9 aa, Homo Sapiens
ALEITKECK

SEQ ID NO: 599810 - protein, 9 aa, Homo Sapiens
VERLQQGDN

SEQ ID NO: 599811 - protein, 9 aa, Homo Sapiens
CKMNVHRPC

SEQ ID NO: 599812 - protein, 9 aa, Homo Sapiens
RDSKAKGKS

SEQ ID NO: 599813 - protein, 9 aa, Homo Sapiens
VSKFAGYCR

SEQ ID NO: 599814 - protein, 9 aa, Homo Sapiens
SQEWGSQER

SEQ ID NO: 599815 - protein, 9 aa, Homo Sapiens
CLPGYQKRG

SEQ ID NO: 599816 - protein, 9 aa, Homo Sapiens
KIARPPGNC

SEQ ID NO: 599817 - protein, 9 aa, Homo Sapiens
DLMVDVEHS

SEQ ID NO: 599818 - protein, 9 aa, Homo Sapiens
PRLVRAGIS

SEQ ID NO: 599819 - protein, 9 aa, Homo Sapiens
NASLFEMVQ

SEQ ID NO: 599820 - protein, 9 aa, Homo Sapiens
AFYGTVNED

SEQ ID NO: 599821 - protein, 9 aa, Homo Sapiens
LPAAVLPRK

SEQ ID NO: 599822 - protein, 9 aa, Homo Sapiens
LSFWNTEEA

SEQ ID NO: 599823 - protein, 9 aa, Homo Sapiens
RGSFACQCL

SEQ ID NO: 599824 - protein, 9 aa, Homo Sapiens
FQHLSPPSG

SEQ ID NO: 599825 - protein, 9 aa, Homo Sapiens
AVVNYTNKS

SEQ ID NO: 599826 - protein, 9 aa, Homo Sapiens
NSDSGENEE

SEQ ID NO: 599827 - protein, 9 aa, Homo Sapiens
YFTITSLTS

SEQ ID NO: 599828 - protein, 9 aa, Homo Sapiens
SVASLPEDE

SEQ ID NO: 599829 - protein, 9 aa, Homo Sapiens
LVITMSASS

SEQ ID NO: 599830 - protein, 9 aa, Homo Sapiens
IMLVICIKI

SEQ ID NO: 599831 - protein, 9 aa, Homo Sapiens
LSGTFECIC

SEQ ID NO: 599832 - protein, 9 aa, Homo Sapiens
FGAIEPTSG

SEQ ID NO: 599833 - protein, 9 aa, Homo Sapiens
ARTALLNVC

SEQ ID NO: 599834 - protein, 9 aa, Homo Sapiens
RTGVKEVAW

SEQ ID NO: 599835 - protein, 9 aa, Homo Sapiens
SRSYSSTMN

SEQ ID NO: 599836 - protein, 9 aa, Homo Sapiens
MSLADKGVT

SEQ ID NO: 599837 - protein, 9 aa, Homo Sapiens
PDLSFWNTE

SEQ ID NO: 599838 - protein, 9 aa, Homo Sapiens
FVKNSSLTV

SEQ ID NO: 599839 - protein, 9 aa, Homo Sapiens
SELPQEVGN

SEQ ID NO: 599840 - protein, 9 aa, Homo Sapiens
LVRLLVLDT

SEQ ID NO: 599841 - protein, 9 aa, Homo Sapiens
EDLMVDVEH

SEQ ID NO: 599842 - protein, 9 aa, Homo Sapiens
MVEAAKKKS

SEQ ID NO: 599843 - protein, 9 aa, Homo Sapiens
IALQGNYEI

SEQ ID NO: 599844 - protein, 9 aa, Homo Sapiens
YAIDPQTSR

SEQ ID NO: 599845 - protein, 9 aa, Homo Sapiens
SPTSVPSER

SEQ ID NO: 599846 - protein, 9 aa, Homo Sapiens
EKRLNKMKE

SEQ ID NO: 599847 - protein, 9 aa, Homo Sapiens
FCGNNTINH

SEQ ID NO: 599848 - protein, 9 aa, Homo Sapiens
WYGLVMNRG

SEQ ID NO: 599849 - protein, 9 aa, Homo Sapiens
KVLACLFLR

SEQ ID NO: 599850 - protein, 9 aa, Homo Sapiens
SRVRLFVLV

SEQ ID NO: 599851 - protein, 9 aa, Homo Sapiens
DPYRSCSIN

SEQ ID NO: 599852 - protein, 9 aa, Homo Sapiens
CSVPGIGSG

SEQ ID NO: 599853 - protein, 9 aa, Homo Sapiens
VNRIGDIIK

SEQ ID NO: 599854 - protein, 9 aa, Homo Sapiens
HMGVKCCKC

SEQ ID NO: 599855 - protein, 9 aa, Homo Sapiens
EIYKQDVER

SEQ ID NO: 599856 - protein, 9 aa, Homo Sapiens
CLTTCCRTT

SEQ ID NO: 599857 - protein, 9 aa, Homo Sapiens
KNLSALSDC

SEQ ID NO: 599858 - protein, 9 aa, Homo Sapiens
RKLLNVVVS

SEQ ID NO: 599859 - protein, 9 aa, Homo Sapiens
KAPKSSPVQ

SEQ ID NO: 599860 - protein, 9 aa, Homo Sapiens
YGNKCVFCK

SEQ ID NO: 599861 - protein, 9 aa, Homo Sapiens
SYKSSLTCY

SEQ ID NO: 599862 - protein, 9 aa, Homo Sapiens
STAGSPLQG

SEQ ID NO: 599863 - protein, 9 aa, Homo Sapiens
GMPVATTMS

SEQ ID NO: 599864 - protein, 9 aa, Homo Sapiens
GSTYRDHEN

SEQ ID NO: 599865 - protein, 9 aa, Homo Sapiens
LPQLEWTLQ

SEQ ID NO: 599866 - protein, 9 aa, Homo Sapiens
AKKKPPSPP

SEQ ID NO: 599867 - protein, 9 aa, Homo Sapiens
TRSNSILTH

SEQ ID NO: 599868 - protein, 9 aa, Homo Sapiens
GDMSLADKG

SEQ ID NO: 599869 - protein, 9 aa, Homo Sapiens
SLPSWKWEE

SEQ ID NO: 599870 - protein, 9 aa, Homo Sapiens
TCWNLQNNK

SEQ ID NO: 599871 - protein, 9 aa, Homo Sapiens
RLEKSEGGF

SEQ ID NO: 599872 - protein, 9 aa, Homo Sapiens
DQCGKAFVK

SEQ ID NO: 599873 - protein, 9 aa, Homo Sapiens
YRWNGMAFL

SEQ ID NO: 599874 - protein, 9 aa, Homo Sapiens
SLTCYHRCH

SEQ ID NO: 599875 - protein, 9 aa, Homo Sapiens
DLKVLACLF

SEQ ID NO: 599876 - protein, 9 aa, Homo Sapiens
TSHLEGTAY

SEQ ID NO: 599877 - protein, 9 aa, Homo Sapiens
KGQSGQILF

SEQ ID NO: 599878 - protein, 9 aa, Homo Sapiens
SGVNLTSSS

SEQ ID NO: 599879 - protein, 9 aa, Homo Sapiens
RNNLCQKYS

SEQ ID NO: 599880 - protein, 9 aa, Homo Sapiens
SEFQILKAE

SEQ ID NO: 599881 - protein, 9 aa, Homo Sapiens
ERGNQTDVG

SEQ ID NO: 599882 - protein, 9 aa, Homo Sapiens
KCLKKEKIN

SEQ ID NO: 599883 - protein, 9 aa, Homo Sapiens
STRCGSGGP

SEQ ID NO: 599884 - protein, 9 aa, Homo Sapiens
LSQWKVMEG

SEQ ID NO: 599885 - protein, 9 aa, Homo Sapiens
GKRIGSLNL

SEQ ID NO: 599886 - protein, 9 aa, Homo Sapiens
SSPVQHALP

SEQ ID NO: 599887 - protein, 9 aa, Homo Sapiens
FTITSLTSV

SEQ ID NO: 599888 - protein, 9 aa, Homo Sapiens
FRLVNALSE

SEQ ID NO: 599889 - protein, 9 aa, Homo Sapiens
INAVSQFEY

SEQ ID NO: 599890 - protein, 9 aa, Homo Sapiens
DLIHIVNRI

SEQ ID NO: 599891 - protein, 9 aa, Homo Sapiens
KQAWYFLSH

SEQ ID NO: 599892 - protein, 9 aa, Homo Sapiens
SIGMQLEGK

SEQ ID NO: 599893 - protein, 9 aa, Homo Sapiens
TAHGGRGGK

SEQ ID NO: 599894 - protein, 9 aa, Homo Sapiens
EATAIATAM

SEQ ID NO: 599895 - protein, 9 aa, Homo Sapiens
TSRAIDRNE

SEQ ID NO: 599896 - protein, 9 aa, Homo Sapiens
QKNPNKVHW

SEQ ID NO: 599897 - protein, 9 aa, Homo Sapiens
PSPNEVLLR

SEQ ID NO: 599898 - protein, 9 aa, Homo Sapiens
WTLCFLSPF

SEQ ID NO: 599899 - protein, 9 aa, Homo Sapiens
CLRNNLCQK

SEQ ID NO: 599900 - protein, 9 aa, Homo Sapiens
SCCLTTCCR

SEQ ID NO: 599901 - protein, 9 aa, Homo Sapiens
TSAYQELLQ

SEQ ID NO: 599902 - protein, 9 aa, Homo Sapiens
HWLPGMCNS

SEQ ID NO: 599903 - protein, 9 aa, Homo Sapiens
NQESLRTLG

SEQ ID NO: 599904 - protein, 9 aa, Homo Sapiens
IDPWENIVI

SEQ ID NO: 599905 - protein, 9 aa, Homo Sapiens
AKQEFQHLS

SEQ ID NO: 599906 - protein, 9 aa, Homo Sapiens
SSPPYSDKT

SEQ ID NO: 599907 - protein, 9 aa, Homo Sapiens
HNSIQRQLN

SEQ ID NO: 599908 - protein, 9 aa, Homo Sapiens
PSKFKDSGS

SEQ ID NO: 599909 - protein, 9 aa, Homo Sapiens
KPPSPPPQD

SEQ ID NO: 599910 - protein, 9 aa, Homo Sapiens
KRVAGKHIL

SEQ ID NO: 599911 - protein, 9 aa, Homo Sapiens
KVALFFRLV

SEQ ID NO: 599912 - protein, 9 aa, Homo Sapiens
DYSTPSKPT

SEQ ID NO: 599913 - protein, 9 aa, Homo Sapiens
GYLSAPHMN

SEQ ID NO: 599914 - protein, 9 aa, Homo Sapiens
HGMKKKCQE

SEQ ID NO: 599915 - protein, 9 aa, Homo Sapiens
IYKQDVERF

SEQ ID NO: 599916 - protein, 9 aa, Homo Sapiens
NRMIDDRHI

SEQ ID NO: 599917 - protein, 9 aa, Homo Sapiens
VPWNIFLLL

SEQ ID NO: 599918 - protein, 9 aa, Homo Sapiens
VASLPEDEQ

SEQ ID NO: 599919 - protein, 9 aa, Homo Sapiens
GPKGMITTP

SEQ ID NO: 599920 - protein, 9 aa, Homo Sapiens
GPVLYLHSA

SEQ ID NO: 599921 - protein, 9 aa, Homo Sapiens
NHTNDFTIW

SEQ ID NO: 599922 - protein, 9 aa, Homo Sapiens
KKPPSPPPQ

SEQ ID NO: 599923 - protein, 9 aa, Homo Sapiens
PPSSGEASS

SEQ ID NO: 599924 - protein, 9 aa, Homo Sapiens
DYAQIPYEV

SEQ ID NO: 599925 - protein, 9 aa, Homo Sapiens
GIFSTGLSM

SEQ ID NO: 599926 - protein, 9 aa, Homo Sapiens
TVGDSMSYH

SEQ ID NO: 599927 - protein, 9 aa, Homo Sapiens
FFNHVKIKH

SEQ ID NO: 599928 - protein, 9 aa, Homo Sapiens
QPTSTPSLP

SEQ ID NO: 599929 - protein, 9 aa, Homo Sapiens
SSAGGLNVT

SEQ ID NO: 599930 - protein, 9 aa, Homo Sapiens
KPRNKRVPV

SEQ ID NO: 599931 - protein, 9 aa, Homo Sapiens
WNGMAFLAC

SEQ ID NO: 599932 - protein, 9 aa, Homo Sapiens
LPAKKKPPS

SEQ ID NO: 599933 - protein, 9 aa, Homo Sapiens
NASVGSTRC

SEQ ID NO: 599934 - protein, 9 aa, Homo Sapiens
RCSLIAEHV

SEQ ID NO: 599935 - protein, 9 aa, Homo Sapiens
RSNSILTHE

SEQ ID NO: 599936 - protein, 9 aa, Homo Sapiens
VKESITRRS

SEQ ID NO: 599937 - protein, 9 aa, Homo Sapiens
EKIQAAEYE

SEQ ID NO: 599938 - protein, 9 aa, Homo Sapiens
FVQYISDHS

SEQ ID NO: 599939 - protein, 9 aa, Homo Sapiens
VLENDVSTL

SEQ ID NO: 599940 - protein, 9 aa, Homo Sapiens
RDSRQVLRA

SEQ ID NO: 599941 - protein, 9 aa, Homo Sapiens
LSAPHMNDH

SEQ ID NO: 599942 - protein, 9 aa, Homo Sapiens
VVVSTAVNV

SEQ ID NO: 599943 - protein, 9 aa, Homo Sapiens
LQLHMLPCP

SEQ ID NO: 599944 - protein, 9 aa, Homo Sapiens
EMKTFCKLV

SEQ ID NO: 599945 - protein, 9 aa, Homo Sapiens
IHIVNRIGD

SEQ ID NO: 599946 - protein, 9 aa, Homo Sapiens
GATATQSAW

SEQ ID NO: 599947 - protein, 9 aa, Homo Sapiens
RISQMHTVS

SEQ ID NO: 599948 - protein, 9 aa, Homo Sapiens
RSRAPSVAN

SEQ ID NO: 599949 - protein, 9 aa, Homo Sapiens
STTNNCYPN

SEQ ID NO: 599950 - protein, 9 aa, Homo Sapiens
EVIDFTKPF

SEQ ID NO: 599951 - protein, 9 aa, Homo Sapiens
VGNLKNLLC

SEQ ID NO: 599952 - protein, 9 aa, Homo Sapiens
CASPGKYLF

SEQ ID NO: 599953 - protein, 9 aa, Homo Sapiens
TRGQSQFNI

SEQ ID NO: 599954 - protein, 9 aa, Homo Sapiens
ITYLADSLQ

SEQ ID NO: 599955 - protein, 9 aa, Homo Sapiens
TRRSRAPSV

SEQ ID NO: 599956 - protein, 9 aa, Homo Sapiens
KKGIKKDAR

SEQ ID NO: 599957 - protein, 9 aa, Homo Sapiens
YGKRIGSLN

SEQ ID NO: 599958 - protein, 9 aa, Homo Sapiens
QVTTKTWCI

SEQ ID NO: 599959 - protein, 9 aa, Homo Sapiens
KGLCSLRFA

SEQ ID NO: 599960 - protein, 9 aa, Homo Sapiens
TVVPFYYAP

SEQ ID NO: 599961 - protein, 9 aa, Homo Sapiens
FQAAPPSNM

SEQ ID NO: 599962 - protein, 9 aa, Homo Sapiens
LNRISQMHT

SEQ ID NO: 599963 - protein, 9 aa, Homo Sapiens
TCTALTHPR

SEQ ID NO: 599964 - protein, 9 aa, Homo Sapiens
VLAAHDNRV

SEQ ID NO: 599965 - protein, 9 aa, Homo Sapiens
NGSLTKTNC

SEQ ID NO: 599966 - protein, 9 aa, Homo Sapiens
SNIWQEALS

SEQ ID NO: 599967 - protein, 9 aa, Homo Sapiens
AQSGTESKV

SEQ ID NO: 599968 - protein, 9 aa, Homo Sapiens
WLLVDDPSF

SEQ ID NO: 599969 - protein, 9 aa, Homo Sapiens
LVWHQRIHT

SEQ ID NO: 599970 - protein, 9 aa, Homo Sapiens
APKSSPVQH

SEQ ID NO: 599971 - protein, 9 aa, Homo Sapiens
AKRDSKAKG

SEQ ID NO: 599972 - protein, 9 aa, Homo Sapiens
PLVTWVETF

SEQ ID NO: 599973 - protein, 9 aa, Homo Sapiens
DGTKSDTSV

SEQ ID NO: 599974 - protein, 9 aa, Homo Sapiens
QSLSSKEIA

SEQ ID NO: 599975 - protein, 9 aa, Homo Sapiens
FNHVKIKHA

SEQ ID NO: 599976 - protein, 9 aa, Homo Sapiens
LFVLVPPSK

SEQ ID NO: 599977 - protein, 9 aa, Homo Sapiens
DMGLWFVRR

SEQ ID NO: 599978 - protein, 9 aa, Homo Sapiens
SSDDFRKLW

SEQ ID NO: 599979 - protein, 9 aa, Homo Sapiens
FKVALFFRL

SEQ ID NO: 599980 - protein, 9 aa, Homo Sapiens
NSLSPDDPT

SEQ ID NO: 599981 - protein, 9 aa, Homo Sapiens
IRTSAYQEL

SEQ ID NO: 599982 - protein, 9 aa, Homo Sapiens
VLRARMSSK

SEQ ID NO: 599983 - protein, 9 aa, Homo Sapiens
LGRWSPTSV

SEQ ID NO: 599984 - protein, 9 aa, Homo Sapiens
GDNWVESYL

SEQ ID NO: 599985 - protein, 9 aa, Homo Sapiens
TLTAHGGRG

SEQ ID NO: 599986 - protein, 9 aa, Homo Sapiens
LGMPVATTM

SEQ ID NO: 599987 - protein, 9 aa, Homo Sapiens
GKTISVLGC

SEQ ID NO: 599988 - protein, 9 aa, Homo Sapiens
VVLPSFRVT

SEQ ID NO: 599989 - protein, 9 aa, Homo Sapiens
VYALRNPYC

SEQ ID NO: 599990 - protein, 9 aa, Homo Sapiens
PVWYGLVMN

SEQ ID NO: 599991 - protein, 9 aa, Homo Sapiens
RNLNAKRSS

SEQ ID NO: 599992 - protein, 9 aa, Homo Sapiens
EFACSRCAF

SEQ ID NO: 599993 - protein, 9 aa, Homo Sapiens
IKLLKVKCL

SEQ ID NO: 599994 - protein, 9 aa, Homo Sapiens
AQPLPYGGF

SEQ ID NO: 599995 - protein, 9 aa, Homo Sapiens
LLKVKCLRN

SEQ ID NO: 599996 - protein, 9 aa, Homo Sapiens
NDSESAKLF

SEQ ID NO: 599997 - protein, 9 aa, Homo Sapiens
IAWARTALL

SEQ ID NO: 599998 - protein, 9 aa, Homo Sapiens
DSRQVLRAR

SEQ ID NO: 599999 - protein, 9 aa, Homo Sapiens
PDPKQKHLE

SEQ ID NO: 600000 - protein, 9 aa, Homo Sapiens
YQENEEQTS

SEQ ID NO: 600001 - protein, 9 aa, Homo Sapiens
ENFKKKEDK

SEQ ID NO: 600002 - protein, 9 aa, Homo Sapiens
LTHEAAFEL

SEQ ID NO: 600003 - protein, 9 aa, Homo Sapiens
HADSALERK

SEQ ID NO: 600004 - protein, 9 aa, Homo Sapiens
TSIALQGNY

SEQ ID NO: 600005 - protein, 9 aa, Homo Sapiens
VAGQSSLLE

SEQ ID NO: 600006 - protein, 9 aa, Homo Sapiens
KFKDSGSGK

SEQ ID NO: 600007 - protein, 9 aa, Homo Sapiens
NKMKELEKQ

SEQ ID NO: 600008 - protein, 9 aa, Homo Sapiens
YSHRTQHYN

SEQ ID NO: 600009 - protein, 9 aa, Homo Sapiens
NFKKKEDKI

SEQ ID NO: 600010 - protein, 9 aa, Homo Sapiens
LCCFVFFPP

SEQ ID NO: 600011 - protein, 9 aa, Homo Sapiens
AQQRDCGSA

SEQ ID NO: 600012 - protein, 9 aa, Homo Sapiens
EDQSKSVSA

SEQ ID NO: 600013 - protein, 9 aa, Homo Sapiens
AFRSEEGFK

SEQ ID NO: 600014 - protein, 9 aa, Homo Sapiens
CSEALVTCT

SEQ ID NO: 600015 - protein, 9 aa, Homo Sapiens
KVMEGIKSC

SEQ ID NO: 600016 - protein, 9 aa, Homo Sapiens
SVKAPTMKP

SEQ ID NO: 600017 - protein, 9 aa, Homo Sapiens
HRTQHYNVC

SEQ ID NO: 600018 - protein, 9 aa, Homo Sapiens
RRLELLLVI

SEQ ID NO: 600019 - protein, 9 aa, Homo Sapiens
IVSKPDLVT

SEQ ID NO: 600020 - protein, 9 aa, Homo Sapiens
LGSLAEFFE

SEQ ID NO: 600021 - protein, 9 aa, Homo Sapiens
LYFTITSLT

SEQ ID NO: 600022 - protein, 9 aa, Homo Sapiens
WVFRGGYLQ

SEQ ID NO: 600023 - protein, 9 aa, Homo Sapiens
LKDSKIPIT

SEQ ID NO: 600024 - protein, 9 aa, Homo Sapiens
KSNICRFLT

SEQ ID NO: 600025 - protein, 9 aa, Homo Sapiens
SSLLENNPM

SEQ ID NO: 600026 - protein, 9 aa, Homo Sapiens
YPIPEPSPN

SEQ ID NO: 600027 - protein, 9 aa, Homo Sapiens
EKFSNKSNI

SEQ ID NO: 600028 - protein, 9 aa, Homo Sapiens
KIQAAEYEL

SEQ ID NO: 600029 - protein, 9 aa, Homo Sapiens
CVHFAHRMF

SEQ ID NO: 600030 - protein, 9 aa, Homo Sapiens
ELQVNLPHM

SEQ ID NO: 600031 - protein, 9 aa, Homo Sapiens
DCGSAAQLA

SEQ ID NO: 600032 - protein, 9 aa, Homo Sapiens
GSIQESVKN

SEQ ID NO: 600033 - protein, 9 aa, Homo Sapiens
TNIQRSCGN

SEQ ID NO: 600034 - protein, 9 aa, Homo Sapiens
MGPNNVGKA

SEQ ID NO: 600035 - protein, 9 aa, Homo Sapiens
DNSRQRRPG

SEQ ID NO: 600036 - protein, 9 aa, Homo Sapiens
IANAVFKGQ

SEQ ID NO: 600037 - protein, 9 aa, Homo Sapiens
MEDFQKKEP

SEQ ID NO: 600038 - protein, 9 aa, Homo Sapiens
CSLNVQLPL

SEQ ID NO: 600039 - protein, 9 aa, Homo Sapiens
KEKQNKICL

SEQ ID NO: 600040 - protein, 9 aa, Homo Sapiens
TKSRVRLFV

SEQ ID NO: 600041 - protein, 9 aa, Homo Sapiens
QETVPWNIF

SEQ ID NO: 600042 - protein, 9 aa, Homo Sapiens
FGNDIFEEG

SEQ ID NO: 600043 - protein, 9 aa, Homo Sapiens
RNEIYKQDV

SEQ ID NO: 600044 - protein, 9 aa, Homo Sapiens
GTRTTENSQ

SEQ ID NO: 600045 - protein, 9 aa, Homo Sapiens
STRGRSGSR

SEQ ID NO: 600046 - protein, 9 aa, Homo Sapiens
DAASPRIVP

SEQ ID NO: 600047 - protein, 9 aa, Homo Sapiens
GSPCSRNHE

SEQ ID NO: 600048 - protein, 9 aa, Homo Sapiens
WKVMEGIKS

SEQ ID NO: 600049 - protein, 9 aa, Homo Sapiens
YNNYCVGLE

SEQ ID NO: 600050 - protein, 9 aa, Homo Sapiens
NLGLCWQEV

SEQ ID NO: 600051 - protein, 9 aa, Homo Sapiens
IQTCWLQLP

SEQ ID NO: 600052 - protein, 9 aa, Homo Sapiens
GKAEFACSR

SEQ ID NO: 600053 - protein, 9 aa, Homo Sapiens
VFALLGCSC

SEQ ID NO: 600054 - protein, 9 aa, Homo Sapiens
RAFLKTESS

SEQ ID NO: 600055 - protein, 9 aa, Homo Sapiens
PEGVSHQRY

SEQ ID NO: 600056 - protein, 9 aa, Homo Sapiens
VRWEETVQG

SEQ ID NO: 600057 - protein, 9 aa, Homo Sapiens
PYGGFSRPT

SEQ ID NO: 600058 - protein, 9 aa, Homo Sapiens
GFGAGNTCS

SEQ ID NO: 600059 - protein, 9 aa, Homo Sapiens
GSFACQCLP

SEQ ID NO: 600060 - protein, 9 aa, Homo Sapiens
LRRPQGSTY

SEQ ID NO: 600061 - protein, 9 aa, Homo Sapiens
EGSVVYNNY

SEQ ID NO: 600062 - protein, 9 aa, Homo Sapiens
VDSDGSGPL

SEQ ID NO: 600063 - protein, 9 aa, Homo Sapiens
DKAQYQEEM

SEQ ID NO: 600064 - protein, 9 aa, Homo Sapiens
LFRDFLASV

SEQ ID NO: 600065 - protein, 9 aa, Homo Sapiens
FLGIVSKPD

SEQ ID NO: 600066 - protein, 9 aa, Homo Sapiens
SLNVQLPLC

SEQ ID NO: 600067 - protein, 9 aa, Homo Sapiens
RRKQKNPNK

SEQ ID NO: 600068 - protein, 9 aa, Homo Sapiens
SGERPYGCK

SEQ ID NO: 600069 - protein, 9 aa, Homo Sapiens
GSSLKRSSG

SEQ ID NO: 600070 - protein, 9 aa, Homo Sapiens
ICKGLIPNT

SEQ ID NO: 600071 - protein, 9 aa, Homo Sapiens
EDRASAPKS

SEQ ID NO: 600072 - protein, 9 aa, Homo Sapiens
RSCVNAIPE

SEQ ID NO: 600073 - protein, 9 aa, Homo Sapiens
GFPSSPPAP

SEQ ID NO: 600074 - protein, 9 aa, Homo Sapiens
ETLGSLAEF

SEQ ID NO: 600075 - protein, 9 aa, Homo Sapiens
WSPSHCDWC

SEQ ID NO: 600076 - protein, 9 aa, Homo Sapiens
SPGKYLFKD

SEQ ID NO: 600077 - protein, 9 aa, Homo Sapiens
WALFPDSDP

SEQ ID NO: 600078 - protein, 9 aa, Homo Sapiens
FDNASLFEM

SEQ ID NO: 600079 - protein, 9 aa, Homo Sapiens
KAQYQEEMM

SEQ ID NO: 600080 - protein, 9 aa, Homo Sapiens
RNKRVPVLP

SEQ ID NO: 600081 - protein, 9 aa, Homo Sapiens
SRELTTGAP

SEQ ID NO: 600082 - protein, 9 aa, Homo Sapiens
SEGGFSAAP

SEQ ID NO: 600083 - protein, 9 aa, Homo Sapiens
EGGIVLTTL

SEQ ID NO: 600084 - protein, 9 aa, Homo Sapiens
MVDVEHSNA

SEQ ID NO: 600085 - protein, 9 aa, Homo Sapiens
KAEFACSRC

SEQ ID NO: 600086 - protein, 9 aa, Homo Sapiens
LCFLSPFAF

SEQ ID NO: 600087 - protein, 9 aa, Homo Sapiens
FALLGCSCL

SEQ ID NO: 600088 - protein, 9 aa, Homo Sapiens
QKMVQRNEI

SEQ ID NO: 600089 - protein, 9 aa, Homo Sapiens
EKQNKICLM

SEQ ID NO: 600090 - protein, 9 aa, Homo Sapiens
NQDNYHCHC

SEQ ID NO: 600091 - protein, 9 aa, Homo Sapiens
QKGLNVEAL

SEQ ID NO: 600092 - protein, 9 aa, Homo Sapiens
RLAEETLGS

SEQ ID NO: 600093 - protein, 9 aa, Homo Sapiens
GVAGQSSLL

SEQ ID NO: 600094 - protein, 9 aa, Homo Sapiens
CTTSHLEGT

SEQ ID NO: 600095 - protein, 9 aa, Homo Sapiens
LRLHTPMNF

SEQ ID NO: 600096 - protein, 9 aa, Homo Sapiens
RWSPTSVPS

SEQ ID NO: 600097 - protein, 9 aa, Homo Sapiens
GLVMNRGSQ

SEQ ID NO: 600098 - protein, 9 aa, Homo Sapiens
ELRRGLGDE

SEQ ID NO: 600099 - protein, 9 aa, Homo Sapiens
DFLASVPTF

SEQ ID NO: 600100 - protein, 9 aa, Homo Sapiens
LKYYCSGHC

SEQ ID NO: 600101 - protein, 9 aa, Homo Sapiens
TMKPSETRV

SEQ ID NO: 600102 - protein, 9 aa, Homo Sapiens
RLNKMKELE

SEQ ID NO: 600103 - protein, 9 aa, Homo Sapiens
SWASGAAWL

SEQ ID NO: 600104 - protein, 9 aa, Homo Sapiens
NPCNFDNAS

SEQ ID NO: 600105 - protein, 9 aa, Homo Sapiens
PWMPCTTSH

SEQ ID NO: 600106 - protein, 9 aa, Homo Sapiens
LFARAKVNV

SEQ ID NO: 600107 - protein, 9 aa, Homo Sapiens
WHPDGNGKL

SEQ ID NO: 600108 - protein, 9 aa, Homo Sapiens
NSTTNNCYP

SEQ ID NO: 600109 - protein, 9 aa, Homo Sapiens
MKEKQNKIC

SEQ ID NO: 600110 - protein, 9 aa, Homo Sapiens
EKKNSSPPY

SEQ ID NO: 600111 - protein, 9 aa, Homo Sapiens
FSNIWQEAL

SEQ ID NO: 600112 - protein, 9 aa, Homo Sapiens
CSAQGDPPL

SEQ ID NO: 600113 - protein, 9 aa, Homo Sapiens
EPIDMSPNI

SEQ ID NO: 600114 - protein, 9 aa, Homo Sapiens
SDNQMFVQY

SEQ ID NO: 600115 - protein, 9 aa, Homo Sapiens
PESSMSLLQ

SEQ ID NO: 600116 - protein, 9 aa, Homo Sapiens
LKEQKEDVF

SEQ ID NO: 600117 - protein, 9 aa, Homo Sapiens
ALSDCYSVY

SEQ ID NO: 600118 - protein, 9 aa, Homo Sapiens
STDFSPAIH

SEQ ID NO: 600119 - protein, 9 aa, Homo Sapiens
SFSNIWQEA

SEQ ID NO: 600120 - protein, 9 aa, Homo Sapiens
KYIRCRRGI

SEQ ID NO: 600121 - protein, 9 aa, Homo Sapiens
WAWVFRGGY

SEQ ID NO: 600122 - protein, 9 aa, Homo Sapiens
SHQDGFPSS

SEQ ID NO: 600123 - protein, 9 aa, Homo Sapiens
LSGQVGPKG

SEQ ID NO: 600124 - protein, 9 aa, Homo Sapiens
GNKCVFCKA

SEQ ID NO: 600125 - protein, 9 aa, Homo Sapiens
IQRQLNLSN

SEQ ID NO: 600126 - protein, 9 aa, Homo Sapiens
PQEPKAPKS

SEQ ID NO: 600127 - protein, 9 aa, Homo Sapiens
NSIQRQLNL

SEQ ID NO: 600128 - protein, 9 aa, Homo Sapiens
LPRKKLFIT

SEQ ID NO: 600129 - protein, 9 aa, Homo Sapiens
LKCLRNNLC

SEQ ID NO: 600130 - protein, 9 aa, Homo Sapiens
EGYHGTVGD

SEQ ID NO: 600131 - protein, 9 aa, Homo Sapiens
SEIDQGKGH

SEQ ID NO: 600132 - protein, 9 aa, Homo Sapiens
SLYFTITSL

SEQ ID NO: 600133 - protein, 9 aa, Homo Sapiens
GSNKEHMLP

SEQ ID NO: 600134 - protein, 9 aa, Homo Sapiens
KKSRQSIPP

SEQ ID NO: 600135 - protein, 9 aa, Homo Sapiens
HCEGVLWAL

SEQ ID NO: 600136 - protein, 9 aa, Homo Sapiens
SLTKTNCYK

SEQ ID NO: 600137 - protein, 9 aa, Homo Sapiens
LYMSNHTND

SEQ ID NO: 600138 - protein, 9 aa, Homo Sapiens
MSNHTNDFT

SEQ ID NO: 600139 - protein, 9 aa, Homo Sapiens
ACRTLSGQV

SEQ ID NO: 600140 - protein, 9 aa, Homo Sapiens
SGILIGRNL

SEQ ID NO: 600141 - protein, 9 aa, Homo Sapiens
NLPHMTASF

SEQ ID NO: 600142 - protein, 9 aa, Homo Sapiens
LNAQHVEEL

SEQ ID NO: 600143 - protein, 9 aa, Homo Sapiens
SEEGFKSPP

SEQ ID NO: 600144 - protein, 9 aa, Homo Sapiens
NAYRWNGMA

SEQ ID NO: 600145 - protein, 9 aa, Homo Sapiens
DRIESKGIK

SEQ ID NO: 600146 - protein, 9 aa, Homo Sapiens
LLVKCVSSP

SEQ ID NO: 600147 - protein, 9 aa, Homo Sapiens
VLCGWCCPC

SEQ ID NO: 600148 - protein, 9 aa, Homo Sapiens
KRIGSLNLL

SEQ ID NO: 600149 - protein, 9 aa, Homo Sapiens
SDGHLEVLL

SEQ ID NO: 600150 - protein, 9 aa, Homo Sapiens
TFDFGNDIF

SEQ ID NO: 600151 - protein, 9 aa, Homo Sapiens
DDPTGLPTS

SEQ ID NO: 600152 - protein, 9 aa, Homo Sapiens
SAWQSSESS

SEQ ID NO: 600153 - protein, 9 aa, Homo Sapiens
CSSAGGLNV

SEQ ID NO: 600154 - protein, 9 aa, Homo Sapiens
DATVLPKDR

SEQ ID NO: 600155 - protein, 9 aa, Homo Sapiens
TLSGQVGPK

SEQ ID NO: 600156 - protein, 9 aa, Homo Sapiens
CREAFKTLS

SEQ ID NO: 600157 - protein, 9 aa, Homo Sapiens
LTTGAPELD

SEQ ID NO: 600158 - protein, 9 aa, Homo Sapiens
NSSPPYSDK

SEQ ID NO: 600159 - protein, 9 aa, Homo Sapiens
RIESKGIKI

SEQ ID NO: 600160 - protein, 9 aa, Homo Sapiens
ALLGCSCLG

SEQ ID NO: 600161 - protein, 9 aa, Homo Sapiens
GRNLNAKRS

SEQ ID NO: 600162 - protein, 9 aa, Homo Sapiens
EGLDASARA

SEQ ID NO: 600163 - protein, 9 aa, Homo Sapiens
QPLPYGGFS

SEQ ID NO: 600164 - protein, 9 aa, Homo Sapiens
ESSEENLEF

SEQ ID NO: 600165 - protein, 9 aa, Homo Sapiens
GGFSAAPAR

SEQ ID NO: 600166 - protein, 9 aa, Homo Sapiens
AYEAQPSAT

SEQ ID NO: 600167 - protein, 9 aa, Homo Sapiens
SLEDVTAVS

SEQ ID NO: 600168 - protein, 9 aa, Homo Sapiens
LSYIKRGKA

SEQ ID NO: 600169 - protein, 9 aa, Homo Sapiens
EREPIDMSP

SEQ ID NO: 600170 - protein, 9 aa, Homo Sapiens
CKNCREAFK

SEQ ID NO: 600171 - protein, 9 aa, Homo Sapiens
PLLIMLVIC

SEQ ID NO: 600172 - protein, 9 aa, Homo Sapiens
GAVCTIINP

SEQ ID NO: 600173 - protein, 9 aa, Homo Sapiens
WNLQNNKWY

SEQ ID NO: 600174 - protein, 9 aa, Homo Sapiens
LKEMKTFCK

SEQ ID NO: 600175 - protein, 9 aa, Homo Sapiens
FARAKVNVN

SEQ ID NO: 600176 - protein, 9 aa, Homo Sapiens
SPFYPRIVD

SEQ ID NO: 600177 - protein, 9 aa, Homo Sapiens
NKICLMAGS

SEQ ID NO: 600178 - protein, 9 aa, Homo Sapiens
PTQGNLTFA

SEQ ID NO: 600179 - protein, 9 aa, Homo Sapiens
AVSEQSNQA

SEQ ID NO: 600180 - protein, 9 aa, Homo Sapiens
LNKMKELEK

SEQ ID NO: 600181 - protein, 9 aa, Homo Sapiens
AINSDGSAE

SEQ ID NO: 600182 - protein, 9 aa, Homo Sapiens
RHHCPHFPA

SEQ ID NO: 600183 - protein, 9 aa, Homo Sapiens
IVVFALLGC

SEQ ID NO: 600184 - protein, 9 aa, Homo Sapiens
WFVRRLELL

SEQ ID NO: 600185 - protein, 9 aa, Homo Sapiens
PKSSPVQHA

SEQ ID NO: 600186 - protein, 9 aa, Homo Sapiens
KHILILANK

SEQ ID NO: 600187 - protein, 9 aa, Homo Sapiens
MNFFRLQTE

SEQ ID NO: 600188 - protein, 9 aa, Homo Sapiens
FTFLKSSVD

SEQ ID NO: 600189 - protein, 9 aa, Homo Sapiens
LSCRHHCPH

SEQ ID NO: 600190 - protein, 9 aa, Homo Sapiens
IFDHHTEEG

SEQ ID NO: 600191 - protein, 9 aa, Homo Sapiens
PLVVSWTKV

SEQ ID NO: 600192 - protein, 9 aa, Homo Sapiens
KRSSGPVWL

SEQ ID NO: 600193 - protein, 9 aa, Homo Sapiens
AKKKSRQSI

SEQ ID NO: 600194 - protein, 9 aa, Homo Sapiens
KKRKAQKEE

SEQ ID NO: 600195 - protein, 9 aa, Homo Sapiens
FTKPFMSLG

SEQ ID NO: 600196 - protein, 9 aa, Homo Sapiens
IVILLATIQ

SEQ ID NO: 600197 - protein, 9 aa, Homo Sapiens
FKRTRTLME

SEQ ID NO: 600198 - protein, 9 aa, Homo Sapiens
NVWVVDLKA

SEQ ID NO: 600199 - protein, 9 aa, Homo Sapiens
RLELLLVIT

SEQ ID NO: 600200 - protein, 9 aa, Homo Sapiens
SGPVLYLHS

SEQ ID NO: 600201 - protein, 9 aa, Homo Sapiens
EALNAQHVE

SEQ ID NO: 600202 - protein, 9 aa, Homo Sapiens
DKDDMDSEK

SEQ ID NO: 600203 - protein, 9 aa, Homo Sapiens
STPVPFSFS

SEQ ID NO: 600204 - protein, 9 aa, Homo Sapiens
DWLLWQGSG

SEQ ID NO: 600205 - protein, 9 aa, Homo Sapiens
RMKEKQNKI

SEQ ID NO: 600206 - protein, 9 aa, Homo Sapiens
VMGPNNVGK

SEQ ID NO: 600207 - protein, 9 aa, Homo Sapiens
LLPSVPYVM

SEQ ID NO: 600208 - protein, 9 aa, Homo Sapiens
IINPEEEEQ

SEQ ID NO: 600209 - protein, 9 aa, Homo Sapiens
ETEPVFDER

SEQ ID NO: 600210 - protein, 9 aa, Homo Sapiens
TALLNVCMN

SEQ ID NO: 600211 - protein, 9 aa, Homo Sapiens
AEYELVVLE

SEQ ID NO: 600212 - protein, 9 aa, Homo Sapiens
ANVFDINST

SEQ ID NO: 600213 - protein, 9 aa, Homo Sapiens
ELVVLEEKL

SEQ ID NO: 600214 - protein, 9 aa, Homo Sapiens
LQNNKWYPL

SEQ ID NO: 600215 - protein, 9 aa, Homo Sapiens
EVEMAEEFE

SEQ ID NO: 600216 - protein, 9 aa, Homo Sapiens
DPYATDSDG

SEQ ID NO: 600217 - protein, 9 aa, Homo Sapiens
AHTVYALRN

SEQ ID NO: 600218 - protein, 9 aa, Homo Sapiens
SARAPPALV

SEQ ID NO: 600219 - protein, 9 aa, Homo Sapiens
VAGHQQFDE

SEQ ID NO: 600220 - protein, 9 aa, Homo Sapiens
KKKKKKNKH

SEQ ID NO: 600221 - protein, 9 aa, Homo Sapiens
IFLLLGGGF

SEQ ID NO: 600222 - protein, 9 aa, Homo Sapiens
AFPLLAFIL

SEQ ID NO: 600223 - protein, 9 aa, Homo Sapiens
GFNASVGST

SEQ ID NO: 600224 - protein, 9 aa, Homo Sapiens
LNAKRSSPL

SEQ ID NO: 600225 - protein, 9 aa, Homo Sapiens
SDPTTSTTK

SEQ ID NO: 600226 - protein, 9 aa, Homo Sapiens
KLFARAKVN

SEQ ID NO: 600227 - protein, 9 aa, Homo Sapiens
LRGQRDLVQ

SEQ ID NO: 600228 - protein, 9 aa, Homo Sapiens
VEMAEEFEQ

SEQ ID NO: 600229 - protein, 9 aa, Homo Sapiens
TLGAWNLEN

SEQ ID NO: 600230 - protein, 9 aa, Homo Sapiens
LNDSESAKL

SEQ ID NO: 600231 - protein, 9 aa, Homo Sapiens
LQGNYEIRY

SEQ ID NO: 600232 - protein, 9 aa, Homo Sapiens
ASVASLPED

SEQ ID NO: 600233 - protein, 9 aa, Homo Sapiens
PSVVKAAFT

SEQ ID NO: 600234 - protein, 9 aa, Homo Sapiens
QCTGLHGFL

SEQ ID NO: 600235 - protein, 9 aa, Homo Sapiens
MQLEGKHNG

SEQ ID NO: 600236 - protein, 9 aa, Homo Sapiens
FLLLGGGFA

SEQ ID NO: 600237 - protein, 9 aa, Homo Sapiens
NGGPVSKFA

SEQ ID NO: 600238 - protein, 9 aa, Homo Sapiens
TMELSKETL

SEQ ID NO: 600239 - protein, 9 aa, Homo Sapiens
VLPKDRAAN

SEQ ID NO: 600240 - protein, 9 aa, Homo Sapiens
LKQEIGSRS

SEQ ID NO: 600241 - protein, 9 aa, Homo Sapiens
EYEALNAQH

SEQ ID NO: 600242 - protein, 9 aa, Homo Sapiens
ARDSRQVLR

SEQ ID NO: 600243 - protein, 9 aa, Homo Sapiens
MRLPQPTST

SEQ ID NO: 600244 - protein, 9 aa, Homo Sapiens
SGENEEEIG

SEQ ID NO: 600245 - protein, 9 aa, Homo Sapiens
AGDFWTLPT

SEQ ID NO: 600246 - protein, 9 aa, Homo Sapiens
DNQMFVQYI

SEQ ID NO: 600247 - protein, 9 aa, Homo Sapiens
LDCASPGKY

SEQ ID NO: 600248 - protein, 9 aa, Homo Sapiens
RTTSGRGPA

SEQ ID NO: 600249 - protein, 9 aa, Homo Sapiens
KRESMKKLL

SEQ ID NO: 600250 - protein, 9 aa, Homo Sapiens
GSPLQGLWT

SEQ ID NO: 600251 - protein, 9 aa, Homo Sapiens
AYRWNGMAF

SEQ ID NO: 600252 - protein, 9 aa, Homo Sapiens
SYADLMKTT

SEQ ID NO: 600253 - protein, 9 aa, Homo Sapiens
AFKTLSSLY

SEQ ID NO: 600254 - protein, 9 aa, Homo Sapiens
EAQPSATLA

SEQ ID NO: 600255 - protein, 9 aa, Homo Sapiens
VGQSGLGIA

SEQ ID NO: 600256 - protein, 9 aa, Homo Sapiens
FKGQSGQIL

SEQ ID NO: 600257 - protein, 9 aa, Homo Sapiens
RLLEHLFKQ

SEQ ID NO: 600258 - protein, 9 aa, Homo Sapiens
TGRLVRICA

SEQ ID NO: 600259 - protein, 9 aa, Homo Sapiens
RLPQPTSTP

SEQ ID NO: 600260 - protein, 9 aa, Homo Sapiens
AHTCFVSDL

SEQ ID NO: 600261 - protein, 9 aa, Homo Sapiens
QKHLEFELK

SEQ ID NO: 600262 - protein, 9 aa, Homo Sapiens
PVPFSFSTF

SEQ ID NO: 600263 - protein, 9 aa, Homo Sapiens
LFFTFVEEW

SEQ ID NO: 600264 - protein, 9 aa, Homo Sapiens
PTTSTTKLS

SEQ ID NO: 600265 - protein, 9 aa, Homo Sapiens
NYTNKSGDA

SEQ ID NO: 600266 - protein, 9 aa, Homo Sapiens
APWMPCTTS

SEQ ID NO: 600267 - protein, 9 aa, Homo Sapiens
GDFWTLPTE

SEQ ID NO: 600268 - protein, 9 aa, Homo Sapiens
ANVISKSMH

SEQ ID NO: 600269 - protein, 9 aa, Homo Sapiens
ACTLTAHGG

SEQ ID NO: 600270 - protein, 9 aa, Homo Sapiens
MTYDRFVAI

SEQ ID NO: 600271 - protein, 9 aa, Homo Sapiens
KYYCSGHCP

SEQ ID NO: 600272 - protein, 9 aa, Homo Sapiens
GILIGRNLN

SEQ ID NO: 600273 - protein, 9 aa, Homo Sapiens
KLLKVKCLR

SEQ ID NO: 600274 - protein, 9 aa, Homo Sapiens
GEEGDGDFT

SEQ ID NO: 600275 - protein, 9 aa, Homo Sapiens
AVTCWNLQN

SEQ ID NO: 600276 - protein, 9 aa, Homo Sapiens
IQCSLNVQL

SEQ ID NO: 600277 - protein, 9 aa, Homo Sapiens
GDGQDVSAC

SEQ ID NO: 600278 - protein, 9 aa, Homo Sapiens
FGTRTTENS

SEQ ID NO: 600279 - protein, 9 aa, Homo Sapiens
KTSTDFSPA

SEQ ID NO: 600280 - protein, 9 aa, Homo Sapiens
AIEPTSGVA

SEQ ID NO: 600281 - protein, 9 aa, Homo Sapiens
AMGVAGQSS

SEQ ID NO: 600282 - protein, 9 aa, Homo Sapiens
PQGSTYRDH

SEQ ID NO: 600283 - protein, 9 aa, Homo Sapiens
DCYSVYTSA

SEQ ID NO: 600284 - protein, 9 aa, Homo Sapiens
LGETINAVS

SEQ ID NO: 600285 - protein, 9 aa, Homo Sapiens
EEGIDKSAN

SEQ ID NO: 600286 - protein, 9 aa, Homo Sapiens
PKGMITTPP

SEQ ID NO: 600287 - protein, 9 aa, Homo Sapiens
LRFNSSDRI

SEQ ID NO: 600288 - protein, 9 aa, Homo Sapiens
EFSVKSTFI

SEQ ID NO: 600289 - protein, 9 aa, Homo Sapiens
KGSSLKRSS

SEQ ID NO: 600290 - protein, 9 aa, Homo Sapiens
GVLAAHDNR

SEQ ID NO: 600291 - protein, 9 aa, Homo Sapiens
PNGTGGLRS

SEQ ID NO: 600292 - protein, 9 aa, Homo Sapiens
SGHIVRAFD

SEQ ID NO: 600293 - protein, 9 aa, Homo Sapiens
DSKAKGKSD

SEQ ID NO: 600294 - protein, 9 aa, Homo Sapiens
LPACRTLSG

SEQ ID NO: 600295 - protein, 9 aa, Homo Sapiens
RHCGEEGHD

SEQ ID NO: 600296 - protein, 9 aa, Homo Sapiens
LAKGKTISV

SEQ ID NO: 600297 - protein, 9 aa, Homo Sapiens
LEKVPGVTD

SEQ ID NO: 600298 - protein, 9 aa, Homo Sapiens
FYHMYGKRI

SEQ ID NO: 600299 - protein, 9 aa, Homo Sapiens
VKETEVAYL

SEQ ID NO: 600300 - protein, 9 aa, Homo Sapiens
TVSCSGGRS

SEQ ID NO: 600301 - protein, 9 aa, Homo Sapiens
LGSNKEHML

SEQ ID NO: 600302 - protein, 9 aa, Homo Sapiens
LGNGSLAFY

SEQ ID NO: 600303 - protein, 9 aa, Homo Sapiens
KSEGGFSAA

SEQ ID NO: 600304 - protein, 9 aa, Homo Sapiens
RLVRAGISW

SEQ ID NO: 600305 - protein, 9 aa, Homo Sapiens
FLEGYLSAP

SEQ ID NO: 600306 - protein, 9 aa, Homo Sapiens
RNPYCKSRA

SEQ ID NO: 600307 - protein, 9 aa, Homo Sapiens
SSTSRMRLP

SEQ ID NO: 600308 - protein, 9 aa, Homo Sapiens
AAWTEATAI

SEQ ID NO: 600309 - protein, 9 aa, Homo Sapiens
GPDWHLRMP

SEQ ID NO: 600310 - protein, 9 aa, Homo Sapiens
RTLSGQVGP

SEQ ID NO: 600311 - protein, 9 aa, Homo Sapiens
KHADSALER

SEQ ID NO: 600312 - protein, 9 aa, Homo Sapiens
RKREEKRLN

SEQ ID NO: 600313 - protein, 9 aa, Homo Sapiens
EALVVADKK

SEQ ID NO: 600314 - protein, 9 aa, Homo Sapiens
SDPANMVPR

SEQ ID NO: 600315 - protein, 9 aa, Homo Sapiens
CHNLSGTFE

SEQ ID NO: 600316 - protein, 9 aa, Homo Sapiens
EVAIKLSKG

SEQ ID NO: 600317 - protein, 9 aa, Homo Sapiens
YRSCSINED

SEQ ID NO: 600318 - protein, 9 aa, Homo Sapiens
PDWHLRMPK

SEQ ID NO: 600319 - protein, 9 aa, Homo Sapiens
LKYKDLCTH

SEQ ID NO: 600320 - protein, 9 aa, Homo Sapiens
QGSTYRDHE

SEQ ID NO: 600321 - protein, 9 aa, Homo Sapiens
SWKWEESGP

SEQ ID NO: 600322 - protein, 9 aa, Homo Sapiens
TKPFMSLGI

SEQ ID NO: 600323 - protein, 9 aa, Homo Sapiens
QYQEEMMNY

SEQ ID NO: 600324 - protein, 9 aa, Homo Sapiens
ISSLYFTIT

SEQ ID NO: 600325 - protein, 9 aa, Homo Sapiens
FVLVPPSKP

SEQ ID NO: 600326 - protein, 9 aa, Homo Sapiens
SPNPHPLTR

SEQ ID NO: 600327 - protein, 9 aa, Homo Sapiens
ALEKVPGVT

SEQ ID NO: 600328 - protein, 9 aa, Homo Sapiens
DMVEAAKKK

SEQ ID NO: 600329 - protein, 9 aa, Homo Sapiens
AEVAPLISS

SEQ ID NO: 600330 - protein, 9 aa, Homo Sapiens
KKEDKIKQW

SEQ ID NO: 600331 - protein, 9 aa, Homo Sapiens
FYGTVNEDA

SEQ ID NO: 600332 - protein, 9 aa, Homo Sapiens
APENVPLGT

SEQ ID NO: 600333 - protein, 9 aa, Homo Sapiens
GGNSLSPDD

SEQ ID NO: 600334 - protein, 9 aa, Homo Sapiens
DFVKVVSKK

SEQ ID NO: 600335 - protein, 9 aa, Homo Sapiens
VWVVDLKAN

SEQ ID NO: 600336 - protein, 9 aa, Homo Sapiens
SLLENNPMN

SEQ ID NO: 600337 - protein, 9 aa, Homo Sapiens
PYGCKTCGK

SEQ ID NO: 600338 - protein, 9 aa, Homo Sapiens
TVYALRNPY

SEQ ID NO: 600339 - protein, 9 aa, Homo Sapiens
TPSLPPSSL

SEQ ID NO: 600340 - protein, 9 aa, Homo Sapiens
ERALAEDSG

SEQ ID NO: 600341 - protein, 9 aa, Homo Sapiens
AHGGRGGKC

SEQ ID NO: 600342 - protein, 9 aa, Homo Sapiens
AVSPTTRLV

SEQ ID NO: 600343 - protein, 9 aa, Homo Sapiens
QCDWQQKGC

SEQ ID NO: 600344 - protein, 9 aa, Homo Sapiens
GRVYRERLG

SEQ ID NO: 600345 - protein, 9 aa, Homo Sapiens
TAALEKDYE

SEQ ID NO: 600346 - protein, 9 aa, Homo Sapiens
GTESKVEPK

SEQ ID NO: 600347 - protein, 9 aa, Homo Sapiens
ERQYYGSSS

SEQ ID NO: 600348 - protein, 9 aa, Homo Sapiens
DRLFFTFVE

SEQ ID NO: 600349 - protein, 9 aa, Homo Sapiens
SKKGIKKDA

SEQ ID NO: 600350 - protein, 9 aa, Homo Sapiens
QGLWTGGAA

SEQ ID NO: 600351 - protein, 9 aa, Homo Sapiens
MHSGERPYG

SEQ ID NO: 600352 - protein, 9 aa, Homo Sapiens
QAWYFLSHL

SEQ ID NO: 600353 - protein, 9 aa, Homo Sapiens
VSPHSRPFI

SEQ ID NO: 600354 - protein, 9 aa, Homo Sapiens
IGRNLNAKR

SEQ ID NO: 600355 - protein, 9 aa, Homo Sapiens
HLFKQLHPQ

SEQ ID NO: 600356 - protein, 9 aa, Homo Sapiens
SPFTRDLWP

SEQ ID NO: 600357 - protein, 9 aa, Homo Sapiens
KKHMGYRQS

SEQ ID NO: 600358 - protein, 9 aa, Homo Sapiens
KNSSPPYSD

SEQ ID NO: 600359 - protein, 9 aa, Homo Sapiens
GLRKEIEDP

SEQ ID NO: 600360 - protein, 9 aa, Homo Sapiens
RRKKRKNRS

SEQ ID NO: 600361 - protein, 9 aa, Homo Sapiens
INARNQDNY

SEQ ID NO: 600362 - protein, 9 aa, Homo Sapiens
ENEEQTSTQ

SEQ ID NO: 600363 - protein, 9 aa, Homo Sapiens
KKKSRQSIP

SEQ ID NO: 600364 - protein, 9 aa, Homo Sapiens
WVVDLKANV

SEQ ID NO: 600365 - protein, 9 aa, Homo Sapiens
WKWEESGPA

SEQ ID NO: 600366 - protein, 9 aa, Homo Sapiens
NQLAKGKTI

SEQ ID NO: 600367 - protein, 9 aa, Homo Sapiens
NSTRGRSGS

SEQ ID NO: 600368 - protein, 9 aa, Homo Sapiens
EALEKVPGV

SEQ ID NO: 600369 - protein, 9 aa, Homo Sapiens
PSAQEITYL

SEQ ID NO: 600370 - protein, 9 aa, Homo Sapiens
FRAFLKTES

SEQ ID NO: 600371 - protein, 9 aa, Homo Sapiens
SILTHEAAF

SEQ ID NO: 600372 - protein, 9 aa, Homo Sapiens
QKKEPKEQQ

SEQ ID NO: 600373 - protein, 9 aa, Homo Sapiens
VVKAAFTFL

SEQ ID NO: 600374 - protein, 9 aa, Homo Sapiens
KPSISAVTM

SEQ ID NO: 600375 - protein, 9 aa, Homo Sapiens
ANETEPVFD

SEQ ID NO: 600376 - protein, 9 aa, Homo Sapiens
LHMLPCPCK

SEQ ID NO: 600377 - protein, 9 aa, Homo Sapiens
DGNGKLAVA

SEQ ID NO: 600378 - protein, 9 aa, Homo Sapiens
CLDANETEP

SEQ ID NO: 600379 - protein, 9 aa, Homo Sapiens
SPAMCSPFT

SEQ ID NO: 600380 - protein, 9 aa, Homo Sapiens
LTQRYQENE

SEQ ID NO: 600381 - protein, 9 aa, Homo Sapiens
SDKRVAGKH

SEQ ID NO: 600382 - protein, 9 aa, Homo Sapiens
GSRIPSAPW

SEQ ID NO: 600383 - protein, 9 aa, Homo Sapiens
SLNAAFEMT

SEQ ID NO: 600384 - protein, 9 aa, Homo Sapiens
EGATATQSA

SEQ ID NO: 600385 - protein, 9 aa, Homo Sapiens
TKPGPESSM

SEQ ID NO: 600386 - protein, 9 aa, Homo Sapiens
SRQVLRARM

SEQ ID NO: 600387 - protein, 9 aa, Homo Sapiens
DGERQAEAT

SEQ ID NO: 600388 - protein, 9 aa, Homo Sapiens
PSISAVTME

SEQ ID NO: 600389 - protein, 9 aa, Homo Sapiens
ICPNGTGGL

SEQ ID NO: 600390 - protein, 9 aa, Homo Sapiens
KHMGYRQSE

SEQ ID NO: 600391 - protein, 9 aa, Homo Sapiens
GMITTPPCL

SEQ ID NO: 600392 - protein, 9 aa, Homo Sapiens
IDRLFFTFV

SEQ ID NO: 600393 - protein, 9 aa, Homo Sapiens
RGQTSIGMQ

SEQ ID NO: 600394 - protein, 9 aa, Homo Sapiens
DEEDRASAP

SEQ ID NO: 600395 - protein, 9 aa, Homo Sapiens
KYKDLCTHV

SEQ ID NO: 600396 - protein, 9 aa, Homo Sapiens
VVTFDFGND

SEQ ID NO: 600397 - protein, 9 aa, Homo Sapiens
VRLFVLVPP

SEQ ID NO: 600398 - protein, 9 aa, Homo Sapiens
LCPLLLALA

SEQ ID NO: 600399 - protein, 9 aa, Homo Sapiens
MYGKRIGSL

SEQ ID NO: 600400 - protein, 9 aa, Homo Sapiens
VFLGIVSKP

SEQ ID NO: 600401 - protein, 9 aa, Homo Sapiens
VVDLKANVI

SEQ ID NO: 600402 - protein, 9 aa, Homo Sapiens
SAQGDPPLV

SEQ ID NO: 600403 - protein, 9 aa, Homo Sapiens
PKDRAANKD

SEQ ID NO: 600404 - protein, 9 aa, Homo Sapiens
AFHSDLSSI

SEQ ID NO: 600405 - protein, 9 aa, Homo Sapiens
GSTAKQTLN

SEQ ID NO: 600406 - protein, 9 aa, Homo Sapiens
AFLKTESSE

SEQ ID NO: 600407 - protein, 9 aa, Homo Sapiens
NKHSPKNLL

SEQ ID NO: 600408 - protein, 9 aa, Homo Sapiens
CTIINPEEE

SEQ ID NO: 600409 - protein, 9 aa, Homo Sapiens
RELTRGQSQ

SEQ ID NO: 600410 - protein, 9 aa, Homo Sapiens
SAPHMNDHY

SEQ ID NO: 600411 - protein, 9 aa, Homo Sapiens
RRGLGDEDG

SEQ ID NO: 600412 - protein, 9 aa, Homo Sapiens
DSGENEEEI

SEQ ID NO: 600413 - protein, 9 aa, Homo Sapiens
LIGRNLNAK

SEQ ID NO: 600414 - protein, 9 aa, Homo Sapiens
QPQALKAWR

SEQ ID NO: 600415 - protein, 9 aa, Homo Sapiens
MGVAGQSSL

SEQ ID NO: 600416 - protein, 9 aa, Homo Sapiens
CSTHLTVVP

SEQ ID NO: 600417 - protein, 9 aa, Homo Sapiens
NARNQDNYH

SEQ ID NO: 600418 - protein, 9 aa, Homo Sapiens
GQLLDFEQT

SEQ ID NO: 600419 - protein, 9 aa, Homo Sapiens
QMFVQYISD

SEQ ID NO: 600420 - protein, 9 aa, Homo Sapiens
TGEKPFQCG

SEQ ID NO: 600421 - protein, 9 aa, Homo Sapiens
SGGNSLSPD

SEQ ID NO: 600422 - protein, 9 aa, Homo Sapiens
TLELEKGLC

SEQ ID NO: 600423 - protein, 9 aa, Homo Sapiens
TNDFTIWSV

SEQ ID NO: 600424 - protein, 9 aa, Homo Sapiens
CDQCGKAFV

SEQ ID NO: 600425 - protein, 9 aa, Homo Sapiens
PSVGSVLSA

SEQ ID NO: 600426 - protein, 9 aa, Homo Sapiens
GNGSLAFYG

SEQ ID NO: 600427 - protein, 9 aa, Homo Sapiens
SALSWSQVT

SEQ ID NO: 600428 - protein, 9 aa, Homo Sapiens
ASLPEDEQG

SEQ ID NO: 600429 - protein, 9 aa, Homo Sapiens
NGQRTTFAN

SEQ ID NO: 600430 - protein, 9 aa, Homo Sapiens
VGGFRQSVD

SEQ ID NO: 600431 - protein, 9 aa, Homo Sapiens
TMGFTTLAT

SEQ ID NO: 600432 - protein, 9 aa, Homo Sapiens
KGLNVEALV

SEQ ID NO: 600433 - protein, 9 aa, Homo Sapiens
KRVPVLPFV

SEQ ID NO: 600434 - protein, 9 aa, Homo Sapiens
AAFPLLAFI

SEQ ID NO: 600435 - protein, 9 aa, Homo Sapiens
QKEDVFNNK

SEQ ID NO: 600436 - protein, 9 aa, Homo Sapiens
TIINPEEEE

SEQ ID NO: 600437 - protein, 9 aa, Homo Sapiens
SRRKQKNPN

SEQ ID NO: 600438 - protein, 9 aa, Homo Sapiens
DFRKLWLSF

SEQ ID NO: 600439 - protein, 9 aa, Homo Sapiens
AQYQEEMMN

SEQ ID NO: 600440 - protein, 9 aa, Homo Sapiens
SSEENLEFW

SEQ ID NO: 600441 - protein, 9 aa, Homo Sapiens
RTTENSQCT

SEQ ID NO: 600442 - protein, 9 aa, Homo Sapiens
QVAGKITGM

SEQ ID NO: 600443 - protein, 9 aa, Homo Sapiens
GKRRKKRKN

SEQ ID NO: 600444 - protein, 9 aa, Homo Sapiens
PHMTASFSV

SEQ ID NO: 600445 - protein, 9 aa, Homo Sapiens
LEWTLCFLS

SEQ ID NO: 600446 - protein, 9 aa, Homo Sapiens
SLWAPGKPF

SEQ ID NO: 600447 - protein, 9 aa, Homo Sapiens
KMVQRNEIY

SEQ ID NO: 600448 - protein, 9 aa, Homo Sapiens
IAAVDLRAA

SEQ ID NO: 600449 - protein, 9 aa, Homo Sapiens
QAAEYELVV

SEQ ID NO: 600450 - protein, 9 aa, Homo Sapiens
TSTPSLPPS

SEQ ID NO: 600451 - protein, 9 aa, Homo Sapiens
LFGTRTTEN

SEQ ID NO: 600452 - protein, 9 aa, Homo Sapiens
RWNGMAFLA

SEQ ID NO: 600453 - protein, 9 aa, Homo Sapiens
TCYHRCHTG

SEQ ID NO: 600454 - protein, 9 aa, Homo Sapiens
LHLQRNSMR

SEQ ID NO: 600455 - protein, 9 aa, Homo Sapiens
DDILAAVSP

SEQ ID NO: 600456 - protein, 9 aa, Homo Sapiens
YQGLVYVLE

SEQ ID NO: 600457 - protein, 9 aa, Homo Sapiens
REEVIDFTK

SEQ ID NO: 600458 - protein, 9 aa, Homo Sapiens
ERLAEETLG

SEQ ID NO: 600459 - protein, 9 aa, Homo Sapiens
IEMVGEPQA

SEQ ID NO: 600460 - protein, 9 aa, Homo Sapiens
HLRMPKVKM

SEQ ID NO: 600461 - protein, 9 aa, Homo Sapiens
KEKLNKLMT

SEQ ID NO: 600462 - protein, 9 aa, Homo Sapiens
PLRAGDFWT

SEQ ID NO: 600463 - protein, 9 aa, Homo Sapiens
TRTTENSQC

SEQ ID NO: 600464 - protein, 9 aa, Homo Sapiens
AGNTCSVPG

SEQ ID NO: 600465 - protein, 9 aa, Homo Sapiens
FHSDLSSIS

SEQ ID NO: 600466 - protein, 9 aa, Homo Sapiens
RYQENEEQT

SEQ ID NO: 600467 - protein, 9 aa, Homo Sapiens
REEKRLNKM

SEQ ID NO: 600468 - protein, 9 aa, Homo Sapiens
LCSSAGGLN

SEQ ID NO: 600469 - protein, 9 aa, Homo Sapiens
NTCSVPGIG

SEQ ID NO: 600470 - protein, 9 aa, Homo Sapiens
VFKGQSGQI

SEQ ID NO: 600471 - protein, 9 aa, Homo Sapiens
MLVNQLAKG

SEQ ID NO: 600472 - protein, 9 aa, Homo Sapiens
TENSQCTKV

SEQ ID NO: 600473 - protein, 9 aa, Homo Sapiens
EELRRGLGD

SEQ ID NO: 600474 - protein, 9 aa, Homo Sapiens
SPNEVLLRM

SEQ ID NO: 600475 - protein, 9 aa, Homo Sapiens
LRAAQTPEH

SEQ ID NO: 600476 - protein, 9 aa, Homo Sapiens
GYRQSEFQI

SEQ ID NO: 600477 - protein, 9 aa, Homo Sapiens
DFTKPFMSL

SEQ ID NO: 600478 - protein, 9 aa, Homo Sapiens
PCTTSHLEG

SEQ ID NO: 600479 - protein, 9 aa, Homo Sapiens
SEREPIDMS

SEQ ID NO: 600480 - protein, 9 aa, Homo Sapiens
PQAAKVIVS

SEQ ID NO: 600481 - protein, 9 aa, Homo Sapiens
PSPPPQDGP

SEQ ID NO: 600482 - protein, 9 aa, Homo Sapiens
YRPTMGFTT

SEQ ID NO: 600483 - protein, 9 aa, Homo Sapiens
KTFCKLVFS

SEQ ID NO: 600484 - protein, 9 aa, Homo Sapiens
TANGGPVSK

SEQ ID NO: 600485 - protein, 9 aa, Homo Sapiens
RQSEFQILK

SEQ ID NO: 600486 - protein, 9 aa, Homo Sapiens
DEYHSGHIV

SEQ ID NO: 600487 - protein, 9 aa, Homo Sapiens
GGLRKKAFV

SEQ ID NO: 600488 - protein, 9 aa, Homo Sapiens
GEKVRWEET

SEQ ID NO: 600489 - protein, 9 aa, Homo Sapiens
RFQVVVSTA

SEQ ID NO: 600490 - protein, 9 aa, Homo Sapiens
KHLEFELKE

SEQ ID NO: 600491 - protein, 9 aa, Homo Sapiens
DANETEPVF

SEQ ID NO: 600492 - protein, 9 aa, Homo Sapiens
KGCTYWVRY

SEQ ID NO: 600493 - protein, 9 aa, Homo Sapiens
PMVMGPNNV

SEQ ID NO: 600494 - protein, 9 aa, Homo Sapiens
FRQSVDQST

SEQ ID NO: 600495 - protein, 9 aa, Homo Sapiens
EKRTPPSSG

SEQ ID NO: 600496 - protein, 9 aa, Homo Sapiens
QEVGNLKNL

SEQ ID NO: 600497 - protein, 9 aa, Homo Sapiens
DDDEEINRM

SEQ ID NO: 600498 - protein, 9 aa, Homo Sapiens
QLKSESTKN

SEQ ID NO: 600499 - protein, 9 aa, Homo Sapiens
DINSTRGRS

SEQ ID NO: 600500 - protein, 9 aa, Homo Sapiens
GRWSPTSVP

SEQ ID NO: 600501 - protein, 9 aa, Homo Sapiens
SQCSPNPHP

SEQ ID NO: 600502 - protein, 9 aa, Homo Sapiens
MFVQYISDH

SEQ ID NO: 600503 - protein, 9 aa, Homo Sapiens
TIPREDIKG

SEQ ID NO: 600504 - protein, 9 aa, Homo Sapiens
GNGSLTKTN

SEQ ID NO: 600505 - protein, 9 aa, Homo Sapiens
ESSMSLLQG

SEQ ID NO: 600506 - protein, 9 aa, Homo Sapiens
TGLHGFLVF

SEQ ID NO: 600507 - protein, 9 aa, Homo Sapiens
SAPKSQDQD

SEQ ID NO: 600508 - protein, 9 aa, Homo Sapiens
ARNQDNYHC

SEQ ID NO: 600509 - protein, 9 aa, Homo Sapiens
SSKEIASRL

SEQ ID NO: 600510 - protein, 9 aa, Homo Sapiens
MVQRNEIYK

SEQ ID NO: 600511 - protein, 9 aa, Homo Sapiens
QEWGSQERQ

SEQ ID NO: 600512 - protein, 9 aa, Homo Sapiens
GDREDGERQ

SEQ ID NO: 600513 - protein, 9 aa, Homo Sapiens
YYCSGHCPD

SEQ ID NO: 600514 - protein, 9 aa, Homo Sapiens
PKQKHLEFE

SEQ ID NO: 600515 - protein, 9 aa, Homo Sapiens
LIMLVICIK

SEQ ID NO: 600516 - protein, 9 aa, Homo Sapiens
AAYEAQPSA

SEQ ID NO: 600517 - protein, 9 aa, Homo Sapiens
LLNDSESAK

SEQ ID NO: 600518 - protein, 9 aa, Homo Sapiens
HTPMNFLLS

SEQ ID NO: 600519 - protein, 9 aa, Homo Sapiens
SNSILTHEA

SEQ ID NO: 600520 - protein, 9 aa, Homo Sapiens
PPSVGSVLS

SEQ ID NO: 600521 - protein, 9 aa, Homo Sapiens
HGGRGGKCT

SEQ ID NO: 600522 - protein, 9 aa, Homo Sapiens
KEHMLPKET

SEQ ID NO: 600523 - protein, 9 aa, Homo Sapiens
EWTLCFLSP

SEQ ID NO: 600524 - protein, 9 aa, Homo Sapiens
TTSGRGPAP

SEQ ID NO: 600525 - protein, 9 aa, Homo Sapiens
VKAYVEKYR

SEQ ID NO: 600526 - protein, 9 aa, Homo Sapiens
KDSKIPITI

SEQ ID NO: 600527 - protein, 9 aa, Homo Sapiens
LNVFHWLLV

SEQ ID NO: 600528 - protein, 9 aa, Homo Sapiens
PEPSPNEVL

SEQ ID NO: 600529 - protein, 9 aa, Homo Sapiens
VASDPANMV

SEQ ID NO: 600530 - protein, 9 aa, Homo Sapiens
FLFGALVEL

SEQ ID NO: 600531 - protein, 9 aa, Homo Sapiens
PYRSCSINE

SEQ ID NO: 600532 - protein, 9 aa, Homo Sapiens
FLSPFAFTV

SEQ ID NO: 600533 - protein, 9 aa, Homo Sapiens
SMHFSGILI

SEQ ID NO: 600534 - protein, 9 aa, Homo Sapiens
SLSPDDPTG

SEQ ID NO: 600535 - protein, 9 aa, Homo Sapiens
ATVLPKDRA

SEQ ID NO: 600536 - protein, 9 aa, Homo Sapiens
KKKNKHSPK

SEQ ID NO: 600537 - protein, 9 aa, Homo Sapiens
EKVPGVTDV

SEQ ID NO: 600538 - protein, 9 aa, Homo Sapiens
KSTFISRYA

SEQ ID NO: 600539 - protein, 9 aa, Homo Sapiens
PRNKRVPVL

SEQ ID NO: 600540 - protein, 9 aa, Homo Sapiens
LNVQLPLCG

SEQ ID NO: 600541 - protein, 9 aa, Homo Sapiens
LVVSWTKVG

SEQ ID NO: 600542 - protein, 9 aa, Homo Sapiens
YHRCHTGEK

SEQ ID NO: 600543 - protein, 9 aa, Homo Sapiens
LPYGGFSRP

SEQ ID NO: 600544 - protein, 9 aa, Homo Sapiens
SIALQGNYE

SEQ ID NO: 600545 - protein, 9 aa, Homo Sapiens
HCGIIEPLI

SEQ ID NO: 600546 - protein, 9 aa, Homo Sapiens
LHKEKLNKL

SEQ ID NO: 600547 - protein, 9 aa, Homo Sapiens
WNIFLLLGG

SEQ ID NO: 600548 - protein, 9 aa, Homo Sapiens
FKLHLQRNS

SEQ ID NO: 600549 - protein, 9 aa, Homo Sapiens
KKKPPSPPP

SEQ ID NO: 600550 - protein, 9 aa, Homo Sapiens
NAIPEQCSP

SEQ ID NO: 600551 - protein, 9 aa, Homo Sapiens
EKVRWEETV

SEQ ID NO: 600552 - protein, 9 aa, Homo Sapiens
TVLPKDRAA

SEQ ID NO: 600553 - protein, 9 aa, Homo Sapiens
NSSDRIESK

SEQ ID NO: 600554 - protein, 9 aa, Homo Sapiens
PRFIRTSAY

SEQ ID NO: 600555 - protein, 9 aa, Homo Sapiens
MHFSGILIG

SEQ ID NO: 600556 - protein, 9 aa, Homo Sapiens
KRRKKRKNR

SEQ ID NO: 600557 - protein, 9 aa, Homo Sapiens
NNVGKASQP

SEQ ID NO: 600558 - protein, 9 aa, Homo Sapiens
FPLLAFILF

SEQ ID NO: 600559 - protein, 9 aa, Homo Sapiens
PFLKYYCSG

SEQ ID NO: 600560 - protein, 9 aa, Homo Sapiens
GLCWQEVGA

SEQ ID NO: 600561 - protein, 9 aa, Homo Sapiens
VHRPCETNV

SEQ ID NO: 600562 - protein, 9 aa, Homo Sapiens
WLGETINAV

SEQ ID NO: 600563 - protein, 9 aa, Homo Sapiens
RAAQTPEHW

SEQ ID NO: 600564 - protein, 9 aa, Homo Sapiens
YAYPKSEIV

SEQ ID NO: 600565 - protein, 9 aa, Homo Sapiens
AAAAYEAQP

SEQ ID NO: 600566 - protein, 9 aa, Homo Sapiens
ENEEEIGSL

SEQ ID NO: 600567 - protein, 9 aa, Homo Sapiens
YVDSDGSGP

SEQ ID NO: 600568 - protein, 9 aa, Homo Sapiens
AGSPLQGLW

SEQ ID NO: 600569 - protein, 9 aa, Homo Sapiens
FFRLVNALS

SEQ ID NO: 600570 - protein, 9 aa, Homo Sapiens
NNIEMVGEP

SEQ ID NO: 600571 - protein, 9 aa, Homo Sapiens
VAPLISSAY

SEQ ID NO: 600572 - protein, 9 aa, Homo Sapiens
TIYEDELKQ

SEQ ID NO: 600573 - protein, 9 aa, Homo Sapiens
MSLLQGARP

SEQ ID NO: 600574 - protein, 9 aa, Homo Sapiens
TRLVSVIDE

SEQ ID NO: 600575 - protein, 9 aa, Homo Sapiens
LYELRTMDY

SEQ ID NO: 600576 - protein, 9 aa, Homo Sapiens
YGGFSRPTS

SEQ ID NO: 600577 - protein, 9 aa, Homo Sapiens
NVQLPLCGH

SEQ ID NO: 600578 - protein, 9 aa, Homo Sapiens
QVVVSTAVN

SEQ ID NO: 600579 - protein, 9 aa, Homo Sapiens
WVNHSESGE

SEQ ID NO: 600580 - protein, 9 aa, Homo Sapiens
QMLGAFHSD

SEQ ID NO: 600581 - protein, 9 aa, Homo Sapiens
KQLIKLLKV

SEQ ID NO: 600582 - protein, 9 aa, Homo Sapiens
HVGRVYRER

SEQ ID NO: 600583 - protein, 9 aa, Homo Sapiens
FRKLWLSFA

SEQ ID NO: 600584 - protein, 9 aa, Homo Sapiens
KRKAQKEEE

SEQ ID NO: 600585 - protein, 9 aa, Homo Sapiens
SSPLISQKL

SEQ ID NO: 600586 - protein, 9 aa, Homo Sapiens
ECSFLAKTP

SEQ ID NO: 600587 - protein, 9 aa, Homo Sapiens
AQAHSTIKG

SEQ ID NO: 600588 - protein, 9 aa, Homo Sapiens
STPSLPPSS

SEQ ID NO: 600589 - protein, 9 aa, Homo Sapiens
TWVNHSESG

SEQ ID NO: 600590 - protein, 9 aa, Homo Sapiens
YLSAPHMND

SEQ ID NO: 600591 - protein, 9 aa, Homo Sapiens
LEKSEGGFS

SEQ ID NO: 600592 - protein, 9 aa, Homo Sapiens
RTTFANEKT

SEQ ID NO: 600593 - protein, 9 aa, Homo Sapiens
HFSGILIGR

SEQ ID NO: 600594 - protein, 9 aa, Homo Sapiens
AVMTYDRFV

SEQ ID NO: 600595 - protein, 9 aa, Homo Sapiens
FVRRLELLL

SEQ ID NO: 600596 - protein, 9 aa, Homo Sapiens
YEALNAQHV

SEQ ID NO: 600597 - protein, 9 aa, Homo Sapiens
HVKIKHADS

SEQ ID NO: 600598 - protein, 9 aa, Homo Sapiens
YVLENDVST

SEQ ID NO: 600599 - protein, 9 aa, Homo Sapiens
GDARDSRQV

SEQ ID NO: 600600 - protein, 9 aa, Homo Sapiens
CPNGTGGLR

SEQ ID NO: 600601 - protein, 9 aa, Homo Sapiens
PSWAWVFRG

SEQ ID NO: 600602 - protein, 9 aa, Homo Sapiens
WAPGKPFLT

SEQ ID NO: 600603 - protein, 9 aa, Homo Sapiens
INSTRGRSG

SEQ ID NO: 600604 - protein, 9 aa, Homo Sapiens
LVRAGISWV

SEQ ID NO: 600605 - protein, 9 aa, Homo Sapiens
DDGTKSDTS

SEQ ID NO: 600606 - protein, 9 aa, Homo Sapiens
GNTCSVPGI

SEQ ID NO: 600607 - protein, 9 aa, Homo Sapiens
DLSFWNTEE

SEQ ID NO: 600608 - protein, 9 aa, Homo Sapiens
PELDCASPG

SEQ ID NO: 600609 - protein, 9 aa, Homo Sapiens
LPSWKWEES

SEQ ID NO: 600610 - protein, 9 aa, Homo Sapiens
CRVLCGWCC

SEQ ID NO: 600611 - protein, 9 aa, Homo Sapiens
ILIGRNLNA

SEQ ID NO: 600612 - protein, 9 aa, Homo Sapiens
TEPVFDERE

SEQ ID NO: 600613 - protein, 9 aa, Homo Sapiens
MEQMLGAFH

SEQ ID NO: 600614 - protein, 9 aa, Homo Sapiens
VGRVYRERL

SEQ ID NO: 600615 - protein, 9 aa, Homo Sapiens
VKCCKCDVC

SEQ ID NO: 600616 - protein, 9 aa, Homo Sapiens
DSGVNLTSS

SEQ ID NO: 600617 - protein, 9 aa, Homo Sapiens
AEFACSRCA

SEQ ID NO: 600618 - protein, 9 aa, Homo Sapiens
FFYHMYGKR

SEQ ID NO: 600619 - protein, 9 aa, Homo Sapiens
CKGLIPNTQ

SEQ ID NO: 600620 - protein, 9 aa, Homo Sapiens
ARSLPACRT

SEQ ID NO: 600621 - protein, 9 aa, Homo Sapiens
IAEHVEAFI

SEQ ID NO: 600622 - protein, 9 aa, Homo Sapiens
FFRLQTEKD

SEQ ID NO: 600623 - protein, 9 aa, Homo Sapiens
ELDYDYAQI

SEQ ID NO: 600624 - protein, 9 aa, Homo Sapiens
IQRSCGNDS

SEQ ID NO: 600625 - protein, 9 aa, Homo Sapiens
DFEQTLGLS

SEQ ID NO: 600626 - protein, 9 aa, Homo Sapiens
SPDDPTGLP

SEQ ID NO: 600627 - protein, 9 aa, Homo Sapiens
FIRTSAYQE

SEQ ID NO: 600628 - protein, 9 aa, Homo Sapiens
RAGISWVTL

SEQ ID NO: 600629 - protein, 9 aa, Homo Sapiens
KKEKINVDI

SEQ ID NO: 600630 - protein, 9 aa, Homo Sapiens
FLASVPTFR

SEQ ID NO: 600631 - protein, 9 aa, Homo Sapiens
RTIPREDIK

SEQ ID NO: 600632 - protein, 9 aa, Homo Sapiens
KDYIIDPWE

SEQ ID NO: 600633 - protein, 9 aa, Homo Sapiens
EEDRASAPK

SEQ ID NO: 600634 - protein, 9 aa, Homo Sapiens
SKFKDSGSG

SEQ ID NO: 600635 - protein, 9 aa, Homo Sapiens
NAVFKGQSG

SEQ ID NO: 600636 - protein, 9 aa, Homo Sapiens
GKKRKAQKE

SEQ ID NO: 600637 - protein, 9 aa, Homo Sapiens
KVDICVIWV

SEQ ID NO: 600638 - protein, 9 aa, Homo Sapiens
RPSCCLTTC

SEQ ID NO: 600639 - protein, 9 aa, Homo Sapiens
PNTQANVWV

SEQ ID NO: 600640 - protein, 9 aa, Homo Sapiens
VVPFYYAPF

SEQ ID NO: 600641 - protein, 9 aa, Homo Sapiens
WGSQERQYY

SEQ ID NO: 600642 - protein, 9 aa, Homo Sapiens
RTRTLMERT

SEQ ID NO: 600643 - protein, 9 aa, Homo Sapiens
GKLYELRTM

SEQ ID NO: 600644 - protein, 9 aa, Homo Sapiens
RQYYGSSSM

SEQ ID NO: 600645 - protein, 9 aa, Homo Sapiens
LSDCYSVYT

SEQ ID NO: 600646 - protein, 9 aa, Homo Sapiens
ATAIATAMA

SEQ ID NO: 600647 - protein, 9 aa, Homo Sapiens
LSELPQEVG

SEQ ID NO: 600648 - protein, 9 aa, Homo Sapiens
ILTHEAAFE

SEQ ID NO: 600649 - protein, 9 aa, Homo Sapiens
HTQVAGKIT

SEQ ID NO: 600650 - protein, 9 aa, Homo Sapiens
TSVPSERSS

SEQ ID NO: 600651 - protein, 9 aa, Homo Sapiens
TATKVDICV

SEQ ID NO: 600652 - protein, 9 aa, Homo Sapiens
AAVLPRKKL

SEQ ID NO: 600653 - protein, 9 aa, Homo Sapiens
SEAREDTAA

SEQ ID NO: 600654 - protein, 9 aa, Homo Sapiens
QGKRRKKRK

SEQ ID NO: 600655 - protein, 9 aa, Homo Sapiens
QSPLVTWVE

SEQ ID NO: 600656 - protein, 9 aa, Homo Sapiens
NEDSGLSTA

SEQ ID NO: 600657 - protein, 9 aa, Homo Sapiens
PYSDKTIIA

SEQ ID NO: 600658 - protein, 9 aa, Homo Sapiens
ALRNPYCKS

SEQ ID NO: 600659 - protein, 9 aa, Homo Sapiens
RETSIALQG

SEQ ID NO: 600660 - protein, 9 aa, Homo Sapiens
DDEKRTPPS

SEQ ID NO: 600661 - protein, 9 aa, Homo Sapiens
FFPPLLIII

SEQ ID NO: 600662 - protein, 9 aa, Homo Sapiens
DSYPRFIRT

SEQ ID NO: 600663 - protein, 9 aa, Homo Sapiens
RDCGSAAQL

SEQ ID NO: 600664 - protein, 9 aa, Homo Sapiens
VIVILLATI

SEQ ID NO: 600665 - protein, 9 aa, Homo Sapiens
VPVLPFVIG

SEQ ID NO: 600666 - protein, 9 aa, Homo Sapiens
GVNLTSSSQ

SEQ ID NO: 600667 - protein, 9 aa, Homo Sapiens
SQKGLNVEA

SEQ ID NO: 600668 - protein, 9 aa, Homo Sapiens
APLISSAYS

SEQ ID NO: 600669 - protein, 9 aa, Homo Sapiens
FRSEEGFKS

SEQ ID NO: 600670 - protein, 9 aa, Homo Sapiens
LASVPTFRK

SEQ ID NO: 600671 - protein, 9 aa, Homo Sapiens
DVFNNKLSD

SEQ ID NO: 600672 - protein, 9 aa, Homo Sapiens
SFWNTEEAY

SEQ ID NO: 600673 - protein, 9 aa, Homo Sapiens
PGKPFLTLV

SEQ ID NO: 600674 - protein, 9 aa, Homo Sapiens
WLLWQGSGI

SEQ ID NO: 600675 - protein, 9 aa, Homo Sapiens
ASVGSTRCG

SEQ ID NO: 600676 - protein, 9 aa, Homo Sapiens
SPFTNAYRW

SEQ ID NO: 600677 - protein, 9 aa, Homo Sapiens
KSVSARAVS

SEQ ID NO: 600678 - protein, 9 aa, Homo Sapiens
KYCYGGLRK

SEQ ID NO: 600679 - protein, 9 aa, Homo Sapiens
DVERLQQGD

SEQ ID NO: 600680 - protein, 9 aa, Homo Sapiens
AREDTAALE

SEQ ID NO: 600681 - protein, 9 aa, Homo Sapiens
YHGTVGDSM

SEQ ID NO: 600682 - protein, 9 aa, Homo Sapiens
WTEATAIAT

SEQ ID NO: 600683 - protein, 9 aa, Homo Sapiens
EGFKSPPIL

SEQ ID NO: 600684 - protein, 9 aa, Homo Sapiens
QTDVGNFLL

SEQ ID NO: 600685 - protein, 9 aa, Homo Sapiens
LKRSSGPVW

SEQ ID NO: 600686 - protein, 9 aa, Homo Sapiens
VLEDIKAHT

SEQ ID NO: 600687 - protein, 9 aa, Homo Sapiens
NETEPVFDE

SEQ ID NO: 600688 - protein, 9 aa, Homo Sapiens
RPFKLHLQR

SEQ ID NO: 600689 - protein, 9 aa, Homo Sapiens
FSNKSNICR

SEQ ID NO: 600690 - protein, 9 aa, Homo Sapiens
EASVASLPE

SEQ ID NO: 600691 - protein, 9 aa, Homo Sapiens
GMCNSNITF

SEQ ID NO: 600692 - protein, 9 aa, Homo Sapiens
SGLGIAYLY

SEQ ID NO: 600693 - protein, 9 aa, Homo Sapiens
INEDSGLST

SEQ ID NO: 600694 - protein, 9 aa, Homo Sapiens
KNKHSPKNL

SEQ ID NO: 600695 - protein, 9 aa, Homo Sapiens
MNFLLSHLS

SEQ ID NO: 600696 - protein, 9 aa, Homo Sapiens
EPQAAKVIV

SEQ ID NO: 600697 - protein, 9 aa, Homo Sapiens
RNQDNYHCH

SEQ ID NO: 600698 - protein, 9 aa, Homo Sapiens
GMQLEGKHN

SEQ ID NO: 600699 - protein, 9 aa, Homo Sapiens
RWSPSHCDW

SEQ ID NO: 600700 - protein, 9 aa, Homo Sapiens
ALLNVCMNA

SEQ ID NO: 600701 - protein, 9 aa, Homo Sapiens
IDPQTSRAI

SEQ ID NO: 600702 - protein, 9 aa, Homo Sapiens
SGLAGEKVR

SEQ ID NO: 600703 - protein, 9 aa, Homo Sapiens
LVSVIDEID

SEQ ID NO: 600704 - protein, 9 aa, Homo Sapiens
LLIMLVICI

SEQ ID NO: 600705 - protein, 9 aa, Homo Sapiens
ANKDFVKVV

SEQ ID NO: 600706 - protein, 9 aa, Homo Sapiens
DTKFQKLKY

SEQ ID NO: 600707 - protein, 9 aa, Homo Sapiens
QGPDWHLRM

SEQ ID NO: 600708 - protein, 9 aa, Homo Sapiens
AAKKKSRQS

SEQ ID NO: 600709 - protein, 9 aa, Homo Sapiens
LKVKCLRNN

SEQ ID NO: 600710 - protein, 9 aa, Homo Sapiens
LLVLDTNDN

SEQ ID NO: 600711 - protein, 9 aa, Homo Sapiens
ARICPNGTG

SEQ ID NO: 600712 - protein, 9 aa, Homo Sapiens
AGEKVRWEE

SEQ ID NO: 600713 - protein, 9 aa, Homo Sapiens
YNVCRESIP

SEQ ID NO: 600714 - protein, 9 aa, Homo Sapiens
LSLTNIQRS

SEQ ID NO: 600715 - protein, 9 aa, Homo Sapiens
GSSDASRSY

SEQ ID NO: 600716 - protein, 9 aa, Homo Sapiens
NSGNGKLYE

SEQ ID NO: 600717 - protein, 9 aa, Homo Sapiens
KIKQWLGKV

SEQ ID NO: 600718 - protein, 9 aa, Homo Sapiens
VAWKYNYIA

SEQ ID NO: 600719 - protein, 9 aa, Homo Sapiens
RLVSVIDEI

SEQ ID NO: 600720 - protein, 9 aa, Homo Sapiens
KLLNVVVSG

SEQ ID NO: 600721 - protein, 9 aa, Homo Sapiens
VKIKHADSA

SEQ ID NO: 600722 - protein, 9 aa, Homo Sapiens
GFKRTRTLM

SEQ ID NO: 600723 - protein, 9 aa, Homo Sapiens
GAPEGVSHQ

SEQ ID NO: 600724 - protein, 9 aa, Homo Sapiens
DNLGLCWQE

SEQ ID NO: 600725 - protein, 9 aa, Homo Sapiens
PGKYLFKDL

SEQ ID NO: 600726 - protein, 9 aa, Homo Sapiens
HTNDFTIWS

SEQ ID NO: 600727 - protein, 9 aa, Homo Sapiens
IVYTWKKGP

SEQ ID NO: 600728 - protein, 9 aa, Homo Sapiens
PSQSSIHNF

SEQ ID NO: 600729 - protein, 9 aa, Homo Sapiens
YVMFCGWQR

SEQ ID NO: 600730 - protein, 9 aa, Homo Sapiens
CCRPSCCLT

SEQ ID NO: 600731 - protein, 9 aa, Homo Sapiens
TAKRDSKAK

SEQ ID NO: 600732 - protein, 9 aa, Homo Sapiens
WSPTSVPSE

SEQ ID NO: 600733 - protein, 9 aa, Homo Sapiens
RAGVLAAHD

SEQ ID NO: 600734 - protein, 9 aa, Homo Sapiens
HLGRWSPTS

SEQ ID NO: 600735 - protein, 9 aa, Homo Sapiens
ASSRELTTG

SEQ ID NO: 600736 - protein, 9 aa, Homo Sapiens
FLLPSVPYV

SEQ ID NO: 600737 - protein, 9 aa, Homo Sapiens
FDFGNDIFE

SEQ ID NO: 600738 - protein, 9 aa, Homo Sapiens
PLCPLLLAL

SEQ ID NO: 600739 - protein, 9 aa, Homo Sapiens
TAKQTLNRL

SEQ ID NO: 600740 - protein, 9 aa, Homo Sapiens
GKARNYLYP

SEQ ID NO: 600741 - protein, 9 aa, Homo Sapiens
TFCKLVFSR

SEQ ID NO: 600742 - protein, 9 aa, Homo Sapiens
TISHKDNSR

SEQ ID NO: 600743 - protein, 9 aa, Homo Sapiens
SDGSAESTA

SEQ ID NO: 600744 - protein, 9 aa, Homo Sapiens
LMKTTLNQG

SEQ ID NO: 600745 - protein, 9 aa, Homo Sapiens
TKSVKAPTM

SEQ ID NO: 600746 - protein, 9 aa, Homo Sapiens
ALKAWRDLT

SEQ ID NO: 600747 - protein, 9 aa, Homo Sapiens
FDHHTEEGI

SEQ ID NO: 600748 - protein, 9 aa, Homo Sapiens
VTANGGPVS

SEQ ID NO: 600749 - protein, 9 aa, Homo Sapiens
QLSELPQEV

SEQ ID NO: 600750 - protein, 9 aa, Homo Sapiens
KKNSSPPYS

SEQ ID NO: 600751 - protein, 9 aa, Homo Sapiens
SIHNFDSDL

SEQ ID NO: 600752 - protein, 9 aa, Homo Sapiens
VEKYRHMRR

SEQ ID NO: 600753 - protein, 9 aa, Homo Sapiens
EEINRMIDD

SEQ ID NO: 600754 - protein, 9 aa, Homo Sapiens
SLSSKEIAS

SEQ ID NO: 600755 - protein, 9 aa, Homo Sapiens
GQSSLLENN

SEQ ID NO: 600756 - protein, 9 aa, Homo Sapiens
EINRMIDDR

SEQ ID NO: 600757 - protein, 9 aa, Homo Sapiens
MCNSNITFQ

SEQ ID NO: 600758 - protein, 9 aa, Homo Sapiens
LSPDDPTGL

SEQ ID NO: 600759 - protein, 9 aa, Homo Sapiens
FSTFTTTDS

SEQ ID NO: 600760 - protein, 9 aa, Homo Sapiens
TIKHLTNLP

SEQ ID NO: 600761 - protein, 9 aa, Homo Sapiens
FISRYAFTT

SEQ ID NO: 600762 - protein, 9 aa, Homo Sapiens
SGIFFDYSG

SEQ ID NO: 600763 - protein, 9 aa, Homo Sapiens
DVSACQAFQ

SEQ ID NO: 600764 - protein, 9 aa, Homo Sapiens
VSSPFYPRI

SEQ ID NO: 600765 - protein, 9 aa, Homo Sapiens
FRGGYLQRQ

SEQ ID NO: 600766 - protein, 9 aa, Homo Sapiens
RVRLFVLVP

SEQ ID NO: 600767 - protein, 9 aa, Homo Sapiens
YRELTRGQS

SEQ ID NO: 600768 - protein, 9 aa, Homo Sapiens
NAVSQFEYN

SEQ ID NO: 600769 - protein, 9 aa, Homo Sapiens
KESITRRSR

SEQ ID NO: 600770 - protein, 9 aa, Homo Sapiens
AHDNRVSCL

SEQ ID NO: 600771 - protein, 9 aa, Homo Sapiens
QDGFPSSPP

SEQ ID NO: 600772 - protein, 9 aa, Homo Sapiens
CRTLSGQVG

SEQ ID NO: 600773 - protein, 9 aa, Homo Sapiens
AWYFLSHLP

SEQ ID NO: 600774 - protein, 9 aa, Homo Sapiens
RRAPWALFP

SEQ ID NO: 600775 - protein, 9 aa, Homo Sapiens
TDSDGHLEV

SEQ ID NO: 600776 - protein, 9 aa, Homo Sapiens
YSDKTIIAP

SEQ ID NO: 600777 - protein, 9 aa, Homo Sapiens
PDDPTGLPT

SEQ ID NO: 600778 - protein, 9 aa, Homo Sapiens
AIRKLLNVV

SEQ ID NO: 600779 - protein, 9 aa, Homo Sapiens
EPESWASGA

SEQ ID NO: 600780 - protein, 9 aa, Homo Sapiens
LPFLKYYCS

SEQ ID NO: 600781 - protein, 9 aa, Homo Sapiens
TCSVPGIGS

SEQ ID NO: 600782 - protein, 9 aa, Homo Sapiens
HHCPHFPAP

SEQ ID NO: 600783 - protein, 9 aa, Homo Sapiens
GSVLSAPSH

SEQ ID NO: 600784 - protein, 9 aa, Homo Sapiens
QRNEIYKQD

SEQ ID NO: 600785 - protein, 9 aa, Homo Sapiens
LIPNTQANV

SEQ ID NO: 600786 - protein, 9 aa, Homo Sapiens
GGAAAWTEA

SEQ ID NO: 600787 - protein, 9 aa, Homo Sapiens
VLYLHSAPW

SEQ ID NO: 600788 - protein, 9 aa, Homo Sapiens
GCSCLGDSS

SEQ ID NO: 600789 - protein, 9 aa, Homo Sapiens
VTMELSKET

SEQ ID NO: 600790 - protein, 9 aa, Homo Sapiens
FTWTPVGIP

SEQ ID NO: 600791 - protein, 9 aa, Homo Sapiens
SADSGVNLT

SEQ ID NO: 600792 - protein, 9 aa, Homo Sapiens
SVPYVMFCG

SEQ ID NO: 600793 - protein, 9 aa, Homo Sapiens
FPSSPPAPQ

SEQ ID NO: 600794 - protein, 9 aa, Homo Sapiens
SGTESKVEP

SEQ ID NO: 600795 - protein, 9 aa, Homo Sapiens
NNTINHFAC

SEQ ID NO: 600796 - protein, 9 aa, Homo Sapiens
EDWLLWQGS

SEQ ID NO: 600797 - protein, 9 aa, Homo Sapiens
GITFTWVNH

SEQ ID NO: 600798 - protein, 9 aa, Homo Sapiens
YPRFIRTSA

SEQ ID NO: 600799 - protein, 9 aa, Homo Sapiens
LLCCFVFFP

SEQ ID NO: 600800 - protein, 9 aa, Homo Sapiens
FTNCSYADL

SEQ ID NO: 600801 - protein, 9 aa, Homo Sapiens
YTPSKFKDS

SEQ ID NO: 600802 - protein, 9 aa, Homo Sapiens
SGSRIPSAP

SEQ ID NO: 600803 - protein, 9 aa, Homo Sapiens
PREDIKGFS

SEQ ID NO: 600804 - protein, 9 aa, Homo Sapiens
IPSAPWMPC

SEQ ID NO: 600805 - protein, 9 aa, Homo Sapiens
EHLFKQLHP

SEQ ID NO: 600806 - protein, 9 aa, Homo Sapiens
CLLTGSTAG

SEQ ID NO: 600807 - protein, 9 aa, Homo Sapiens
CNFDNASLF

SEQ ID NO: 600808 - protein, 9 aa, Homo Sapiens
SSNPCNFDN

SEQ ID NO: 600809 - protein, 9 aa, Homo Sapiens
SNHTNDFTI

SEQ ID NO: 600810 - protein, 9 aa, Homo Sapiens
ISQKLVGEM

SEQ ID NO: 600811 - protein, 9 aa, Homo Sapiens
HTVYALRNP

SEQ ID NO: 600812 - protein, 9 aa, Homo Sapiens
NKRTAKRDS

SEQ ID NO: 600813 - protein, 9 aa, Homo Sapiens
PLRSEREPI

SEQ ID NO: 600814 - protein, 9 aa, Homo Sapiens
EACTLTAHG

SEQ ID NO: 600815 - protein, 9 aa, Homo Sapiens
LDEGGIVLT

SEQ ID NO: 600816 - protein, 9 aa, Homo Sapiens
ITRRSRAPS

SEQ ID NO: 600817 - protein, 9 aa, Homo Sapiens
ITRSNSILT

SEQ ID NO: 600818 - protein, 9 aa, Homo Sapiens
KRGKARNYL

SEQ ID NO: 600819 - protein, 9 aa, Homo Sapiens
PGMCNSNIT

SEQ ID NO: 600820 - protein, 9 aa, Homo Sapiens
GEPQAAKVI

SEQ ID NO: 600821 - protein, 9 aa, Homo Sapiens
VKEVAWKYN

SEQ ID NO: 600822 - protein, 9 aa, Homo Sapiens
PMNFLLSHL

SEQ ID NO: 600823 - protein, 9 aa, Homo Sapiens
FTFVEEWSE

SEQ ID NO: 600824 - protein, 9 aa, Homo Sapiens
PVGQSGLGI

SEQ ID NO: 600825 - protein, 9 aa, Homo Sapiens
LWQGSGIQY

SEQ ID NO: 600826 - protein, 9 aa, Homo Sapiens
SPLISQKLV

SEQ ID NO: 600827 - protein, 9 aa, Homo Sapiens
IPITIKHLT

SEQ ID NO: 600828 - protein, 9 aa, Homo Sapiens
DFWTLPTEF

SEQ ID NO: 600829 - protein, 9 aa, Homo Sapiens
SYSHRTQHY

SEQ ID NO: 600830 - protein, 9 aa, Homo Sapiens
VKFTLAKIA

SEQ ID NO: 600831 - protein, 9 aa, Homo Sapiens
VPFSFSTFT

SEQ ID NO: 600832 - protein, 9 aa, Homo Sapiens
TYGNKCVFC

SEQ ID NO: 600833 - protein, 9 aa, Homo Sapiens
ELRTMDYEA

SEQ ID NO: 600834 - protein, 9 aa, Homo Sapiens
NVFDINSTR

SEQ ID NO: 600835 - protein, 9 aa, Homo Sapiens
QQRKEHKRE

SEQ ID NO: 600836 - protein, 9 aa, Homo Sapiens
RNPCRVLCG

SEQ ID NO: 600837 - protein, 9 aa, Homo Sapiens
AKESLNAAF

SEQ ID NO: 600838 - protein, 9 aa, Homo Sapiens
HLEGTAYGP

SEQ ID NO: 600839 - protein, 9 aa, Homo Sapiens
MSLALKYIR

SEQ ID NO: 600840 - protein, 9 aa, Homo Sapiens
SPTTRLVTI

SEQ ID NO: 600841 - protein, 9 aa, Homo Sapiens
TINHFACEI

SEQ ID NO: 600842 - protein, 9 aa, Homo Sapiens
YIKRGKARN

SEQ ID NO: 600843 - protein, 9 aa, Homo Sapiens
YRLLAINSD

SEQ ID NO: 600844 - protein, 9 aa, Homo Sapiens
LVKAYVEKY

SEQ ID NO: 600845 - protein, 9 aa, Homo Sapiens
QESLRTLGA

SEQ ID NO: 600846 - protein, 9 aa, Homo Sapiens
INRMIDDRH

SEQ ID NO: 600847 - protein, 9 aa, Homo Sapiens
FGAGNTCSV

SEQ ID NO: 600848 - protein, 9 aa, Homo Sapiens
HPLTRFQAR

SEQ ID NO: 600849 - protein, 9 aa, Homo Sapiens
GNGKLYELR

SEQ ID NO: 600850 - protein, 9 aa, Homo Sapiens
CSLIAEHVE

SEQ ID NO: 600851 - protein, 9 aa, Homo Sapiens
IPEPSPNEV

SEQ ID NO: 600852 - protein, 9 aa, Homo Sapiens
SSLTCYHRC

SEQ ID NO: 600853 - protein, 9 aa, Homo Sapiens
VMTYDRFVA

SEQ ID NO: 600854 - protein, 9 aa, Homo Sapiens
SRRRHCGEE

SEQ ID NO: 600855 - protein, 9 aa, Homo Sapiens
RPTMGFTTL

SEQ ID NO: 600856 - protein, 9 aa, Homo Sapiens
AMAKESLNA

SEQ ID NO: 600857 - protein, 9 aa, Homo Sapiens
QESVKNRVI

SEQ ID NO: 600858 - protein, 9 aa, Homo Sapiens
TPVSLPSWK

SEQ ID NO: 600859 - protein, 9 aa, Homo Sapiens
FVFFPPLLI

SEQ ID NO: 600860 - protein, 9 aa, Homo Sapiens
GEKPFQCGE

SEQ ID NO: 600861 - protein, 9 aa, Homo Sapiens
CEGVLWALA

SEQ ID NO: 600862 - protein, 9 aa, Homo Sapiens
NVISKSMHF

SEQ ID NO: 600863 - protein, 9 aa, Homo Sapiens
SLIAEHVEA

SEQ ID NO: 600864 - protein, 9 aa, Homo Sapiens
QSSLLENNP

SEQ ID NO: 600865 - protein, 9 aa, Homo Sapiens
AAPPSNMKQ

SEQ ID NO: 600866 - protein, 9 aa, Homo Sapiens
MGQLLDFEQ

SEQ ID NO: 600867 - protein, 9 aa, Homo Sapiens
MYQEELRGQ

SEQ ID NO: 600868 - protein, 9 aa, Homo Sapiens
GEASVASLP

SEQ ID NO: 600869 - protein, 9 aa, Homo Sapiens
CLGDSSTSR

SEQ ID NO: 600870 - protein, 9 aa, Homo Sapiens
LPKDRAANK

SEQ ID NO: 600871 - protein, 9 aa, Homo Sapiens
DIKGFSDAE

SEQ ID NO: 600872 - protein, 9 aa, Homo Sapiens
QQKGCTYWV

SEQ ID NO: 600873 - protein, 9 aa, Homo Sapiens
KCLDANETE

SEQ ID NO: 600874 - protein, 9 aa, Homo Sapiens
DPGFKRTRT

SEQ ID NO: 600875 - protein, 9 aa, Homo Sapiens
SGFGQHESA

SEQ ID NO: 600876 - protein, 9 aa, Homo Sapiens
ISFGAAFPL

SEQ ID NO: 600877 - protein, 9 aa, Homo Sapiens
YLKEMKTFC

SEQ ID NO: 600878 - protein, 9 aa, Homo Sapiens
KTNCYKACL

SEQ ID NO: 600879 - protein, 9 aa, Homo Sapiens
VINARNQDN

SEQ ID NO: 600880 - protein, 9 aa, Homo Sapiens
QKLVGEMLK

SEQ ID NO: 600881 - protein, 9 aa, Homo Sapiens
QCLPGYQKR

SEQ ID NO: 600882 - protein, 9 aa, Homo Sapiens
RKKRKNRSY

SEQ ID NO: 600883 - protein, 9 aa, Homo Sapiens
PLARTTSGR

SEQ ID NO: 600884 - protein, 9 aa, Homo Sapiens
AGVLAAHDN

SEQ ID NO: 600885 - protein, 9 aa, Homo Sapiens
DMKVLHQLK

SEQ ID NO: 600886 - protein, 9 aa, Homo Sapiens
IIEPLINLL

SEQ ID NO: 600887 - protein, 9 aa, Homo Sapiens
GKLAVAYSC

SEQ ID NO: 600888 - protein, 9 aa, Homo Sapiens
DSKIPITIK

SEQ ID NO: 600889 - protein, 9 aa, Homo Sapiens
CEELRRGLG

SEQ ID NO: 600890 - protein, 9 aa, Homo Sapiens
KCVFCKAIV

SEQ ID NO: 600891 - protein, 9 aa, Homo Sapiens
VNAIPEQCS

SEQ ID NO: 600892 - protein, 9 aa, Homo Sapiens
VGEMLKTST

SEQ ID NO: 600893 - protein, 9 aa, Homo Sapiens
QRKEHKRES

SEQ ID NO: 600894 - protein, 9 aa, Homo Sapiens
QYTFQNGEE

SEQ ID NO: 600895 - protein, 9 aa, Homo Sapiens
NNYCVGLEV

SEQ ID NO: 600896 - protein, 9 aa, Homo Sapiens
SSNTGSVSL

SEQ ID NO: 600897 - protein, 9 aa, Homo Sapiens
KMNFFRLQT

SEQ ID NO: 600898 - protein, 9 aa, Homo Sapiens
VVFALLGCS

SEQ ID NO: 600899 - protein, 9 aa, Homo Sapiens
YGCKTCGKG

SEQ ID NO: 600900 - protein, 9 aa, Homo Sapiens
VVVSGSQPA

SEQ ID NO: 600901 - protein, 9 aa, Homo Sapiens
PCNFDNASL

SEQ ID NO: 600902 - protein, 9 aa, Homo Sapiens
PLLAFILFV

SEQ ID NO: 600903 - protein, 9 aa, Homo Sapiens
EYELVVLEE

SEQ ID NO: 600904 - protein, 9 aa, Homo Sapiens
AVSQFEYNV

SEQ ID NO: 600905 - protein, 9 aa, Homo Sapiens
VEEALEKVP

SEQ ID NO: 600906 - protein, 9 aa, Homo Sapiens
SDQCTGLHG

SEQ ID NO: 600907 - protein, 9 aa, Homo Sapiens
CCFQAAPPS

SEQ ID NO: 600908 - protein, 9 aa, Homo Sapiens
GFYYVDSDG

SEQ ID NO: 600909 - protein, 9 aa, Homo Sapiens
HKRESMKKL

SEQ ID NO: 600910 - protein, 9 aa, Homo Sapiens
PCRVLCGWC

SEQ ID NO: 600911 - protein, 9 aa, Homo Sapiens
NTGRLVRIC

SEQ ID NO: 600912 - protein, 9 aa, Homo Sapiens
RKNRSYKSS

SEQ ID NO: 600913 - protein, 9 aa, Homo Sapiens
QVLRARMSS

SEQ ID NO: 600914 - protein, 9 aa, Homo Sapiens
KIPLRAGDF

SEQ ID NO: 600915 - protein, 9 aa, Homo Sapiens
VSVIDEIDK

SEQ ID NO: 600916 - protein, 9 aa, Homo Sapiens
LQGLWTGGA

SEQ ID NO: 600917 - protein, 9 aa, Homo Sapiens
ITFTWVNHS

SEQ ID NO: 600918 - protein, 9 aa, Homo Sapiens
KLSDSRITL

SEQ ID NO: 600919 - protein, 9 aa, Homo Sapiens
VNLNVGGFR

SEQ ID NO: 600920 - protein, 9 aa, Homo Sapiens
TSTDFSPAI

SEQ ID NO: 600921 - protein, 9 aa, Homo Sapiens
LPQPTSTPS

SEQ ID NO: 600922 - protein, 9 aa, Homo Sapiens
FTWVNHSES

SEQ ID NO: 600923 - protein, 9 aa, Homo Sapiens
LRNPYCKSR

SEQ ID NO: 600924 - protein, 9 aa, Homo Sapiens
YHMYGKRIG

SEQ ID NO: 600925 - protein, 9 aa, Homo Sapiens
ALSWSQVTT

SEQ ID NO: 600926 - protein, 9 aa, Homo Sapiens
ERPYGCKTC

SEQ ID NO: 600927 - protein, 9 aa, Homo Sapiens
YAFRSEEGF

SEQ ID NO: 600928 - protein, 9 aa, Homo Sapiens
LQAQPLPYG

SEQ ID NO: 600929 - protein, 9 aa, Homo Sapiens
VRLLVLDTN

SEQ ID NO: 600930 - protein, 9 aa, Homo Sapiens
SWAWVFRGG

SEQ ID NO: 600931 - protein, 9 aa, Homo Sapiens
EEVEMAEEF

SEQ ID NO: 600932 - protein, 9 aa, Homo Sapiens
LEKGLCSLR

SEQ ID NO: 600933 - protein, 9 aa, Homo Sapiens
KVRWEETVQ

SEQ ID NO: 600934 - protein, 9 aa, Homo Sapiens
DHPNGDMGL

SEQ ID NO: 600935 - protein, 9 aa, Homo Sapiens
LEGYLSAPH

SEQ ID NO: 600936 - protein, 9 aa, Homo Sapiens
ELEKGLCSL

SEQ ID NO: 600937 - protein, 9 aa, Homo Sapiens
ATATKVDIC

SEQ ID NO: 600938 - protein, 9 aa, Homo Sapiens
IKAHTCFVS

SEQ ID NO: 600939 - protein, 9 aa, Homo Sapiens
PANMVPRIP

SEQ ID NO: 600940 - protein, 9 aa, Homo Sapiens
ETLELEKGL

SEQ ID NO: 600941 - protein, 9 aa, Homo Sapiens
MEEPSSGLR

SEQ ID NO: 600942 - protein, 9 aa, Homo Sapiens
DPPLVVSWT

SEQ ID NO: 600943 - protein, 9 aa, Homo Sapiens
DFQKKEPKE

SEQ ID NO: 600944 - protein, 9 aa, Homo Sapiens
CSYADLMKT

SEQ ID NO: 600945 - protein, 9 aa, Homo Sapiens
HSTIKGSSL

SEQ ID NO: 600946 - protein, 9 aa, Homo Sapiens
QSEFQILKA

SEQ ID NO: 600947 - protein, 9 aa, Homo Sapiens
DNDAASPRI

SEQ ID NO: 600948 - protein, 9 aa, Homo Sapiens
LLCNTGRLV

SEQ ID NO: 600949 - protein, 9 aa, Homo Sapiens
VCTIINPEE

SEQ ID NO: 600950 - protein, 9 aa, Homo Sapiens
GERPYGCKT

SEQ ID NO: 600951 - protein, 9 aa, Homo Sapiens
LDYDYAQIP

SEQ ID NO: 600952 - protein, 9 aa, Homo Sapiens
RLLVLDTND

SEQ ID NO: 600953 - protein, 9 aa, Homo Sapiens
INSDGSAES

SEQ ID NO: 600954 - protein, 9 aa, Homo Sapiens
IRKLLNVVV

SEQ ID NO: 600955 - protein, 9 aa, Homo Sapiens
NCYKACLTA

SEQ ID NO: 600956 - protein, 9 aa, Homo Sapiens
SECSFLAKT

SEQ ID NO: 600957 - protein, 9 aa, Homo Sapiens
KKEANKDFV

SEQ ID NO: 600958 - protein, 9 aa, Homo Sapiens
KAYVEKYRH

SEQ ID NO: 600959 - protein, 9 aa, Homo Sapiens
LPHMTASFS

SEQ ID NO: 600960 - protein, 9 aa, Homo Sapiens
PEDEQGIVP

SEQ ID NO: 600961 - protein, 9 aa, Homo Sapiens
CRPSCCLTT

SEQ ID NO: 600962 - protein, 9 aa, Homo Sapiens
LKVLACLFL

SEQ ID NO: 600963 - protein, 9 aa, Homo Sapiens
CVNAIPEQC

SEQ ID NO: 600964 - protein, 9 aa, Homo Sapiens
TGVKEVAWK

SEQ ID NO: 600965 - protein, 9 aa, Homo Sapiens
VKSTFISRY

SEQ ID NO: 600966 - protein, 9 aa, Homo Sapiens
FSTGLSMLS

SEQ ID NO: 600967 - protein, 9 aa, Homo Sapiens
HIVRAFDII

SEQ ID NO: 600968 - protein, 9 aa, Homo Sapiens
AGGLNVTCS

SEQ ID NO: 600969 - protein, 9 aa, Homo Sapiens
GLVYVLEND

SEQ ID NO: 600970 - protein, 9 aa, Homo Sapiens
RLLAINSDG

SEQ ID NO: 600971 - protein, 9 aa, Homo Sapiens
KSDTSVTAT

SEQ ID NO: 600972 - protein, 9 aa, Homo Sapiens
HVSIVASEI

SEQ ID NO: 600973 - protein, 9 aa, Homo Sapiens
SCCRPSCCL

SEQ ID NO: 600974 - protein, 9 aa, Homo Sapiens
NTINHFACE

SEQ ID NO: 600975 - protein, 9 aa, Homo Sapiens
CDWQQKGCT

SEQ ID NO: 600976 - protein, 9 aa, Homo Sapiens
KLLVKCVSS

SEQ ID NO: 600977 - protein, 9 aa, Homo Sapiens
QYHINAPEN

SEQ ID NO: 600978 - protein, 9 aa, Homo Sapiens
SSARHNSIQ

SEQ ID NO: 600979 - protein, 9 aa, Homo Sapiens
EITYLADSL

SEQ ID NO: 600980 - protein, 9 aa, Homo Sapiens
HTVSCSGGR

SEQ ID NO: 600981 - protein, 9 aa, Homo Sapiens
ENKRTAKRD

SEQ ID NO: 600982 - protein, 9 aa, Homo Sapiens
GIIEPLINL

SEQ ID NO: 600983 - protein, 9 aa, Homo Sapiens
VPSQSSIHN

SEQ ID NO: 600984 - protein, 9 aa, Homo Sapiens
IPLRAGDFW

SEQ ID NO: 600985 - protein, 9 aa, Homo Sapiens
QSGLGIAYL

SEQ ID NO: 600986 - protein, 9 aa, Homo Sapiens
CGKAFVKNS

SEQ ID NO: 600987 - protein, 9 aa, Homo Sapiens
VEEVEMAEE

SEQ ID NO: 600988 - protein, 9 aa, Homo Sapiens
KQGKRRKKR

SEQ ID NO: 600989 - protein, 9 aa, Homo Sapiens
SSGLRKEIE

SEQ ID NO: 600990 - protein, 9 aa, Homo Sapiens
FLEWTLCFL

SEQ ID NO: 600991 - protein, 9 aa, Homo Sapiens
DTAALEKDY

SEQ ID NO: 600992 - protein, 9 aa, Homo Sapiens
VALFFRLVN

SEQ ID NO: 600993 - protein, 9 aa, Homo Sapiens
GISFGAAFP

SEQ ID NO: 600994 - protein, 9 aa, Homo Sapiens
DMSLADKGV

SEQ ID NO: 600995 - protein, 9 aa, Homo Sapiens
TTPPCLLTG

SEQ ID NO: 600996 - protein, 9 aa, Homo Sapiens
CSGVCHNLS

SEQ ID NO: 600997 - protein, 9 aa, Homo Sapiens
AYVEKYRHM

SEQ ID NO: 600998 - protein, 9 aa, Homo Sapiens
FKKKEDKIK

SEQ ID NO: 600999 - protein, 9 aa, Homo Sapiens
AVFKGQSGQ

SEQ ID NO: 601000 - protein, 9 aa, Homo Sapiens
VAGKITGML

SEQ ID NO: 601001 - protein, 9 aa, Homo Sapiens
PKDYIIDPW

SEQ ID NO: 601002 - protein, 9 aa, Homo Sapiens
GSQERQYYG

SEQ ID NO: 601003 - protein, 9 aa, Homo Sapiens
APLARTTSG

SEQ ID NO: 601004 - protein, 9 aa, Homo Sapiens
KWEESGPAL

SEQ ID NO: 601005 - protein, 9 aa, Homo Sapiens
MDSEKKGFI

SEQ ID NO: 601006 - protein, 9 aa, Homo Sapiens
SLDDNLGLC

SEQ ID NO: 601007 - protein, 9 aa, Homo Sapiens
SLRTLGAWN

SEQ ID NO: 601008 - protein, 9 aa, Homo Sapiens
KRFLDEGGI

SEQ ID NO: 601009 - protein, 9 aa, Homo Sapiens
FWNTEEAYI

SEQ ID NO: 601010 - protein, 9 aa, Homo Sapiens
HTEEGIDKS

SEQ ID NO: 601011 - protein, 9 aa, Homo Sapiens
KDNSRQRRP

SEQ ID NO: 601012 - protein, 9 aa, Homo Sapiens
NPEEEEQTK

SEQ ID NO: 601013 - protein, 9 aa, Homo Sapiens
RVYRERLGL

SEQ ID NO: 601014 - protein, 9 aa, Homo Sapiens
DPWENIVIQ

SEQ ID NO: 601015 - protein, 9 aa, Homo Sapiens
LSRKLLESH

SEQ ID NO: 601016 - protein, 9 aa, Homo Sapiens
RNHEEADMW

SEQ ID NO: 601017 - protein, 9 aa, Homo Sapiens
FSVKSTFIS

SEQ ID NO: 601018 - protein, 9 aa, Homo Sapiens
KGHHIRNQT

SEQ ID NO: 601019 - protein, 9 aa, Homo Sapiens
CFVFFPPLL

SEQ ID NO: 601020 - protein, 9 aa, Homo Sapiens
QSVVAGHQQ

SEQ ID NO: 601021 - protein, 9 aa, Homo Sapiens
FQVVVSTAV

SEQ ID NO: 601022 - protein, 9 aa, Homo Sapiens
CSCLGDSST

SEQ ID NO: 601023 - protein, 9 aa, Homo Sapiens
EDGERQAEA

SEQ ID NO: 601024 - protein, 9 aa, Homo Sapiens
NSDGSAEST

SEQ ID NO: 601025 - protein, 9 aa, Homo Sapiens
DMEEPSSGL

SEQ ID NO: 601026 - protein, 9 aa, Homo Sapiens
QSGTESKVE

SEQ ID NO: 601027 - protein, 9 aa, Homo Sapiens
SLPACRTLS

SEQ ID NO: 601028 - protein, 9 aa, Homo Sapiens
EMVGEPQAA

SEQ ID NO: 601029 - protein, 9 aa, Homo Sapiens
DQSKSVSAR

SEQ ID NO: 601030 - protein, 9 aa, Homo Sapiens
STIKGSSLK

SEQ ID NO: 601031 - protein, 9 aa, Homo Sapiens
EWGSQERQY

SEQ ID NO: 601032 - protein, 9 aa, Homo Sapiens
RALAEDSGI

SEQ ID NO: 601033 - protein, 9 aa, Homo Sapiens
ETCEELRRG

SEQ ID NO: 601034 - protein, 9 aa, Homo Sapiens
IMQGHCEGV

SEQ ID NO: 601035 - protein, 9 aa, Homo Sapiens
NGKLYELRT

SEQ ID NO: 601036 - protein, 9 aa, Homo Sapiens
ANGGPVSKF

SEQ ID NO: 601037 - protein, 9 aa, Homo Sapiens
QYISDHSNE

SEQ ID NO: 601038 - protein, 9 aa, Homo Sapiens
KEPKEQQKL

SEQ ID NO: 601039 - protein, 9 aa, Homo Sapiens
VWHQRIHTA

SEQ ID NO: 601040 - protein, 9 aa, Homo Sapiens
VISKSMHFS

SEQ ID NO: 601041 - protein, 9 aa, Homo Sapiens
EEQMHGMKK

SEQ ID NO: 601042 - protein, 9 aa, Homo Sapiens
STFISRYAF

SEQ ID NO: 601043 - protein, 9 aa, Homo Sapiens
LNVVVSGSQ

SEQ ID NO: 601044 - protein, 9 aa, Homo Sapiens
YELRTMDYE

SEQ ID NO: 601045 - protein, 9 aa, Homo Sapiens
LELEKGLCS

SEQ ID NO: 601046 - protein, 9 aa, Homo Sapiens
KLHLQRNSM

SEQ ID NO: 601047 - protein, 9 aa, Homo Sapiens
TQHYNVCRE

SEQ ID NO: 601048 - protein, 9 aa, Homo Sapiens
LKTESSEEN

SEQ ID NO: 601049 - protein, 9 aa, Homo Sapiens
QRDCGSAAQ

SEQ ID NO: 601050 - protein, 9 aa, Homo Sapiens
GNLTFAPRG

SEQ ID NO: 601051 - protein, 9 aa, Homo Sapiens
CNSNITFQL

SEQ ID NO: 601052 - protein, 9 aa, Homo Sapiens
MSPLCPLLL

SEQ ID NO: 601053 - protein, 9 aa, Homo Sapiens
TSRMRLPQP

SEQ ID NO: 601054 - protein, 9 aa, Homo Sapiens
TTSHLEGTA

SEQ ID NO: 601055 - protein, 9 aa, Homo Sapiens
PWNIFLLLG

SEQ ID NO: 601056 - protein, 9 aa, Homo Sapiens
AVDLRAAQT

SEQ ID NO: 601057 - protein, 9 aa, Homo Sapiens
TQGNLTFAP

SEQ ID NO: 601058 - protein, 9 aa, Homo Sapiens
HQDGFPSSP

SEQ ID NO: 601059 - protein, 9 aa, Homo Sapiens
SSLVWHQRI

SEQ ID NO: 601060 - protein, 9 aa, Homo Sapiens
APPSNMKQS

SEQ ID NO: 601061 - protein, 9 aa, Homo Sapiens
EYHSGHIVR

SEQ ID NO: 601062 - protein, 9 aa, Homo Sapiens
INSDSGENE

SEQ ID NO: 601063 - protein, 9 aa, Homo Sapiens
FNNKLSDAL

SEQ ID NO: 601064 - protein, 9 aa, Homo Sapiens
YISSLYFTI

SEQ ID NO: 601065 - protein, 9 aa, Homo Sapiens
FIASIQYGG

SEQ ID NO: 601066 - protein, 9 aa, Homo Sapiens
QSAWQSSES

SEQ ID NO: 601067 - protein, 9 aa, Homo Sapiens
EKINVDIIN

SEQ ID NO: 601068 - protein, 9 aa, Homo Sapiens
ILAAVSPTT

SEQ ID NO: 601069 - protein, 9 aa, Homo Sapiens
SDSGENEEE

SEQ ID NO: 601070 - protein, 9 aa, Homo Sapiens
SLFGTRTTE

SEQ ID NO: 601071 - protein, 9 aa, Homo Sapiens
TKFQKLKYK

SEQ ID NO: 601072 - protein, 9 aa, Homo Sapiens
EPSPNEVLL

SEQ ID NO: 601073 - protein, 9 aa, Homo Sapiens
KRLNKMKEL

SEQ ID NO: 601074 - protein, 9 aa, Homo Sapiens
RITLKSGYG

SEQ ID NO: 601075 - protein, 9 aa, Homo Sapiens
KIPITIKHL

SEQ ID NO: 601076 - protein, 9 aa, Homo Sapiens
GNGKLAVAY

SEQ ID NO: 601077 - protein, 9 aa, Homo Sapiens
CYPNETVIL

SEQ ID NO: 601078 - protein, 9 aa, Homo Sapiens
EKGLCSLRF

SEQ ID NO: 601079 - protein, 9 aa, Homo Sapiens
RITRSNSIL

SEQ ID NO: 601080 - protein, 9 aa, Homo Sapiens
TKVDICVIW

SEQ ID NO: 601081 - protein, 9 aa, Homo Sapiens
INPEEEEQT

SEQ ID NO: 601082 - protein, 9 aa, Homo Sapiens
GCKTCGKGF

SEQ ID NO: 601083 - protein, 9 aa, Homo Sapiens
DQCTGLHGF

SEQ ID NO: 601084 - protein, 9 aa, Homo Sapiens
GSLTKTNCY

SEQ ID NO: 601085 - protein, 9 aa, Homo Sapiens
RPQGSTYRD

SEQ ID NO: 601086 - protein, 9 aa, Homo Sapiens
AQIPYEVTL

SEQ ID NO: 601087 - protein, 9 aa, Homo Sapiens
QKGCTYWVR

SEQ ID NO: 601088 - protein, 9 aa, Homo Sapiens
MERGNQTDV

SEQ ID NO: 601089 - protein, 9 aa, Homo Sapiens
VGDSMSYHS

SEQ ID NO: 601090 - protein, 9 aa, Homo Sapiens
LRMPKVKMP

SEQ ID NO: 601091 - protein, 9 aa, Homo Sapiens
VHFAHRMFG

SEQ ID NO: 601092 - protein, 9 aa, Homo Sapiens
LEDIKAHTC

SEQ ID NO: 601093 - protein, 9 aa, Homo Sapiens
RTQHYNVCR

SEQ ID NO: 601094 - protein, 9 aa, Homo Sapiens
QTSRAIDRN

SEQ ID NO: 601095 - protein, 9 aa, Homo Sapiens
GDGDREDGE

SEQ ID NO: 601096 - protein, 9 aa, Homo Sapiens
APKSQDQDS

SEQ ID NO: 601097 - protein, 9 aa, Homo Sapiens
VVVNFSKKV

SEQ ID NO: 601098 - protein, 9 aa, Homo Sapiens
SCVNAIPEQ

SEQ ID NO: 601099 - protein, 9 aa, Homo Sapiens
LLAVMTYDR

SEQ ID NO: 601100 - protein, 9 aa, Homo Sapiens
VMFCGWQRL

SEQ ID NO: 601101 - protein, 9 aa, Homo Sapiens
DVHTQVAGK

SEQ ID NO: 601102 - protein, 9 aa, Homo Sapiens
RDVERLQQG

SEQ ID NO: 601103 - protein, 9 aa, Homo Sapiens
KKRKNRSYK

SEQ ID NO: 601104 - protein, 9 aa, Homo Sapiens
RSCSINEDS

SEQ ID NO: 601105 - protein, 9 aa, Homo Sapiens
VVINARNQD

SEQ ID NO: 601106 - protein, 9 aa, Homo Sapiens
QCSLNVQLP

SEQ ID NO: 601107 - protein, 9 aa, Homo Sapiens
LTNIQRSCG

SEQ ID NO: 601108 - protein, 9 aa, Homo Sapiens
SWGAPEGVS

SEQ ID NO: 601109 - protein, 9 aa, Homo Sapiens
NVGGFRQSV

SEQ ID NO: 601110 - protein, 9 aa, Homo Sapiens
GFRKEESLS

SEQ ID NO: 601111 - protein, 9 aa, Homo Sapiens
GAIEPTSGV

SEQ ID NO: 601112 - protein, 9 aa, Homo Sapiens
REPIDMSPN

SEQ ID NO: 601113 - protein, 9 aa, Homo Sapiens
LINLLTAKD

SEQ ID NO: 601114 - protein, 9 aa, Homo Sapiens
EPKAPKSSP

SEQ ID NO: 601115 - protein, 9 aa, Homo Sapiens
RCAFMLDRI

SEQ ID NO: 601116 - protein, 9 aa, Homo Sapiens
LIAEHVEAF

SEQ ID NO: 601117 - protein, 9 aa, Homo Sapiens
CTGLHGFLV

SEQ ID NO: 601118 - protein, 9 aa, Homo Sapiens
GDSSTSRMR

SEQ ID NO: 601119 - protein, 9 aa, Homo Sapiens
KTTESKTAT

SEQ ID NO: 601120 - protein, 9 aa, Homo Sapiens
STHLTVVPF

SEQ ID NO: 601121 - protein, 9 aa, Homo Sapiens
KTESSEENL

SEQ ID NO: 601122 - protein, 9 aa, Homo Sapiens
AVAICKGLI

SEQ ID NO: 601123 - protein, 9 aa, Homo Sapiens
QLGNGSLAF

SEQ ID NO: 601124 - protein, 9 aa, Homo Sapiens
HSGHIVRAF

SEQ ID NO: 601125 - protein, 9 aa, Homo Sapiens
GKGHHIRNQ

SEQ ID NO: 601126 - protein, 9 aa, Homo Sapiens
VILLATIQG

SEQ ID NO: 601127 - protein, 9 aa, Homo Sapiens
LAKIARPPG

SEQ ID NO: 601128 - protein, 9 aa, Homo Sapiens
VDLIHIVNR

SEQ ID NO: 601129 - protein, 9 aa, Homo Sapiens
LSDSRITLK

SEQ ID NO: 601130 - protein, 9 aa, Homo Sapiens
EEGFKSPPI

SEQ ID NO: 601131 - protein, 9 aa, Homo Sapiens
GVLEDIKAH

SEQ ID NO: 601132 - protein, 9 aa, Homo Sapiens
PITIKHLTN

SEQ ID NO: 601133 - protein, 9 aa, Homo Sapiens
EKSKTKFSS

SEQ ID NO: 601134 - protein, 9 aa, Homo Sapiens
VSLPSWKWE

SEQ ID NO: 601135 - protein, 9 aa, Homo Sapiens
ESITRRSRA

SEQ ID NO: 601136 - protein, 9 aa, Homo Sapiens
QLPEFREMG

SEQ ID NO: 601137 - protein, 9 aa, Homo Sapiens
LDFEQTLGL

SEQ ID NO: 601138 - protein, 9 aa, Homo Sapiens
ALAKLDKAQ

SEQ ID NO: 601139 - protein, 9 aa, Homo Sapiens
NVHRPCETN

SEQ ID NO: 601140 - protein, 9 aa, Homo Sapiens
SAQEITYLA

SEQ ID NO: 601141 - protein, 9 aa, Homo Sapiens
LVYVLENDV

SEQ ID NO: 601142 - protein, 9 aa, Homo Sapiens
RTPPSSGEA

SEQ ID NO: 601143 - protein, 9 aa, Homo Sapiens
GSGIQYCGI

SEQ ID NO: 601144 - protein, 9 aa, Homo Sapiens
GNTSGFYYV

SEQ ID NO: 601145 - protein, 9 aa, Homo Sapiens
NTKSRVRLF

SEQ ID NO: 601146 - protein, 9 aa, Homo Sapiens
GALVELLDN

SEQ ID NO: 601147 - protein, 9 aa, Homo Sapiens
LPGMCNSNI

SEQ ID NO: 601148 - protein, 9 aa, Homo Sapiens
SVPGIGSGF

SEQ ID NO: 601149 - protein, 9 aa, Homo Sapiens
TATQSAWQS

SEQ ID NO: 601150 - protein, 9 aa, Homo Sapiens
LSAPLARTT

SEQ ID NO: 601151 - protein, 9 aa, Homo Sapiens
KEQKEDVFN

SEQ ID NO: 601152 - protein, 9 aa, Homo Sapiens
IARICPNGT

SEQ ID NO: 601153 - protein, 9 aa, Homo Sapiens
SGAAWLRTL

SEQ ID NO: 601154 - protein, 9 aa, Homo Sapiens
VKNRVIDSR

SEQ ID NO: 601155 - protein, 9 aa, Homo Sapiens
LKISSDDFR

SEQ ID NO: 601156 - protein, 9 aa, Homo Sapiens
EGVSHQRYL

SEQ ID NO: 601157 - protein, 9 aa, Homo Sapiens
RELALEITK

SEQ ID NO: 601158 - protein, 9 aa, Homo Sapiens
EAAKKKSRQ

SEQ ID NO: 601159 - protein, 9 aa, Homo Sapiens
FNASVGSTR

SEQ ID NO: 601160 - protein, 9 aa, Homo Sapiens
PACRTLSGQ

SEQ ID NO: 601161 - protein, 9 aa, Homo Sapiens
KLSKGQRRG

SEQ ID NO: 601162 - protein, 9 aa, Homo Sapiens
ALAEDSGIF

SEQ ID NO: 601163 - protein, 9 aa, Homo Sapiens
AIPEQCSPL

SEQ ID NO: 601164 - protein, 9 aa, Homo Sapiens
EQTLGLSSP

SEQ ID NO: 601165 - protein, 9 aa, Homo Sapiens
LPSGPVLYL

SEQ ID NO: 601166 - protein, 9 aa, Homo Sapiens
GFSAAPARA

SEQ ID NO: 601167 - protein, 9 aa, Homo Sapiens
EDTAALEKD

SEQ ID NO: 601168 - protein, 9 aa, Homo Sapiens
NQTDVGNFL

SEQ ID NO: 601169 - protein, 9 aa, Homo Sapiens
ELPQEVGNL

SEQ ID NO: 601170 - protein, 9 aa, Homo Sapiens
TAMAQAHST

SEQ ID NO: 601171 - protein, 9 aa, Homo Sapiens
LLDFEQTLG

SEQ ID NO: 601172 - protein, 9 aa, Homo Sapiens
ELDCASPGK

SEQ ID NO: 601173 - protein, 9 aa, Homo Sapiens
ESEVAIKLS

SEQ ID NO: 601174 - protein, 9 aa, Homo Sapiens
GLHGFLVFH

SEQ ID NO: 601175 - protein, 9 aa, Homo Sapiens
PLQGLWTGG

SEQ ID NO: 601176 - protein, 9 aa, Homo Sapiens
TRIAWARTA

SEQ ID NO: 601177 - protein, 9 aa, Homo Sapiens
LVKCVSSPF

SEQ ID NO: 601178 - protein, 9 aa, Homo Sapiens
HILILANKQ

SEQ ID NO: 601179 - protein, 9 aa, Homo Sapiens
SIQRQLNLS

SEQ ID NO: 601180 - protein, 9 aa, Homo Sapiens
ARNYLYPIW

SEQ ID NO: 601181 - protein, 9 aa, Homo Sapiens
GETINAVSQ

SEQ ID NO: 601182 - protein, 9 aa, Homo Sapiens
DCASPGKYL

SEQ ID NO: 601183 - protein, 9 aa, Homo Sapiens
ISKSMHFSG

SEQ ID NO: 601184 - protein, 9 aa, Homo Sapiens
ALLGSNKEH

SEQ ID NO: 601185 - protein, 9 aa, Homo Sapiens
VHMGVKCCK

SEQ ID NO: 601186 - protein, 9 aa, Homo Sapiens
KRDSKAKGK

SEQ ID NO: 601187 - protein, 9 aa, Homo Sapiens
SQVTTKTWC

SEQ ID NO: 601188 - protein, 9 aa, Homo Sapiens
ATIQGLIID

SEQ ID NO: 601189 - protein, 9 aa, Homo Sapiens
RLVRICAQA

SEQ ID NO: 601190 - protein, 9 aa, Homo Sapiens
KPGPESSMS

SEQ ID NO: 601191 - protein, 9 aa, Homo Sapiens
QARSLPACR

SEQ ID NO: 601192 - protein, 9 aa, Homo Sapiens
RMFGLSWGA

SEQ ID NO: 601193 - protein, 9 aa, Homo Sapiens
ITLKSGYGK

SEQ ID NO: 601194 - protein, 9 aa, Homo Sapiens
AAKTKQAWY

SEQ ID NO: 601195 - protein, 9 aa, Homo Sapiens
VDLRAAQTP

SEQ ID NO: 601196 - protein, 9 aa, Homo Sapiens
FYYVDSDGS

SEQ ID NO: 601197 - protein, 9 aa, Homo Sapiens
DARDSRQVL

SEQ ID NO: 601198 - protein, 9 aa, Homo Sapiens
NGDMGLWFV

SEQ ID NO: 601199 - protein, 9 aa, Homo Sapiens
NFFRLQTEK

SEQ ID NO: 601200 - protein, 9 aa, Homo Sapiens
QPKKEANKD

SEQ ID NO: 601201 - protein, 9 aa, Homo Sapiens
ICIKIFLVA

SEQ ID NO: 601202 - protein, 9 aa, Homo Sapiens
QSKSVSARA

SEQ ID NO: 601203 - protein, 9 aa, Homo Sapiens
GQSGLGIAY

SEQ ID NO: 601204 - protein, 9 aa, Homo Sapiens
ISHKDNSRQ

SEQ ID NO: 601205 - protein, 9 aa, Homo Sapiens
CLKKEKINV

SEQ ID NO: 601206 - protein, 9 aa, Homo Sapiens
GIKKDARKD

SEQ ID NO: 601207 - protein, 9 aa, Homo Sapiens
HKDNSRQRR

SEQ ID NO: 601208 - protein, 9 aa, Homo Sapiens
CCKCDVCGK

SEQ ID NO: 601209 - protein, 9 aa, Homo Sapiens
DRASAPKSQ

SEQ ID NO: 601210 - protein, 9 aa, Homo Sapiens
TFQNGEEGD

SEQ ID NO: 601211 - protein, 9 aa, Homo Sapiens
VNHSESGEV

SEQ ID NO: 601212 - protein, 9 aa, Homo Sapiens
ASRSYSSTM

SEQ ID NO: 601213 - protein, 9 aa, Homo Sapiens
NGKLAVAYS

SEQ ID NO: 601214 - protein, 9 aa, Homo Sapiens
FSEAREDTA

SEQ ID NO: 601215 - protein, 9 aa, Homo Sapiens
APRRAPWAL

SEQ ID NO: 601216 - protein, 9 aa, Homo Sapiens
DELKQEIGS

SEQ ID NO: 601217 - protein, 9 aa, Homo Sapiens
LATIQGLII

SEQ ID NO: 601218 - protein, 9 aa, Homo Sapiens
GFRQSVDQS

SEQ ID NO: 601219 - protein, 9 aa, Homo Sapiens
EKTTESKTA

SEQ ID NO: 601220 - protein, 9 aa, Homo Sapiens
HQLKSESTK

SEQ ID NO: 601221 - protein, 9 aa, Homo Sapiens
KKGSKKGIK

SEQ ID NO: 601222 - protein, 9 aa, Homo Sapiens
NYPIPEPSP

SEQ ID NO: 601223 - protein, 9 aa, Homo Sapiens
GRLVRICAQ

SEQ ID NO: 601224 - protein, 9 aa, Homo Sapiens
GSKKGIKKD

SEQ ID NO: 601225 - protein, 9 aa, Homo Sapiens
ANMVPRIPE

SEQ ID NO: 601226 - protein, 9 aa, Homo Sapiens
HSSSLVWHQ

SEQ ID NO: 601227 - protein, 9 aa, Homo Sapiens
MHGMKKKCQ

SEQ ID NO: 601228 - protein, 9 aa, Homo Sapiens
NTQANVWVV

SEQ ID NO: 601229 - protein, 9 aa, Homo Sapiens
QNGEEGDGD

SEQ ID NO: 601230 - protein, 9 aa, Homo Sapiens
PAPRRAPWA

SEQ ID NO: 601231 - protein, 9 aa, Homo Sapiens
SFACQCLPG

SEQ ID NO: 601232 - protein, 9 aa, Homo Sapiens
AWTEATAIA

SEQ ID NO: 601233 - protein, 9 aa, Homo Sapiens
LPEFREMGD

SEQ ID NO: 601234 - protein, 9 aa, Homo Sapiens
EEVIDFTKP

SEQ ID NO: 601235 - protein, 9 aa, Homo Sapiens
VSIVASEIE

SEQ ID NO: 601236 - protein, 9 aa, Homo Sapiens
YIAAVDLRA

SEQ ID NO: 601237 - protein, 9 aa, Homo Sapiens
ATQSAWQSS

SEQ ID NO: 601238 - protein, 9 aa, Homo Sapiens
LSALSDCYS

SEQ ID NO: 601239 - protein, 9 aa, Homo Sapiens
WARLLEHLF

SEQ ID NO: 601240 - protein, 9 aa, Homo Sapiens
SCRHHCPHF

SEQ ID NO: 601241 - protein, 9 aa, Homo Sapiens
DLKANVISK

SEQ ID NO: 601242 - protein, 9 aa, Homo Sapiens
LAGEKVRWE

SEQ ID NO: 601243 - protein, 9 aa, Homo Sapiens
SRIPSAPWM

SEQ ID NO: 601244 - protein, 9 aa, Homo Sapiens
IFSTGLSML

SEQ ID NO: 601245 - protein, 9 aa, Homo Sapiens
ELTRGQSQF

SEQ ID NO: 601246 - protein, 9 aa, Homo Sapiens
HYNVCRESI

SEQ ID NO: 601247 - protein, 9 aa, Homo Sapiens
GVKEVAWKY

SEQ ID NO: 601248 - protein, 9 aa, Homo Sapiens
PWENIVIQC

SEQ ID NO: 601249 - protein, 9 aa, Homo Sapiens
VLWALAVHP

SEQ ID NO: 601250 - protein, 9 aa, Homo Sapiens
AMCSPFTRD

SEQ ID NO: 601251 - protein, 9 aa, Homo Sapiens
SVPTFRKAA

SEQ ID NO: 601252 - protein, 9 aa, Homo Sapiens
MCSPFTRDL

SEQ ID NO: 601253 - protein, 9 aa, Homo Sapiens
PNNVGKASQ

SEQ ID NO: 601254 - protein, 9 aa, Homo Sapiens
CFQAAPPSN

SEQ ID NO: 601255 - protein, 9 aa, Homo Sapiens
PSSGLRKEI

SEQ ID NO: 601256 - protein, 9 aa, Homo Sapiens
AAQQRDCGS

SEQ ID NO: 601257 - protein, 9 aa, Homo Sapiens
SFSTFTTTD

SEQ ID NO: 601258 - protein, 9 aa, Homo Sapiens
INAPENVPL

SEQ ID NO: 601259 - protein, 9 aa, Homo Sapiens
STTKLSWSG

SEQ ID NO: 601260 - protein, 9 aa, Homo Sapiens
SKTATTTQV

SEQ ID NO: 601261 - protein, 9 aa, Homo Sapiens
DCKQLIKLL

SEQ ID NO: 601262 - protein, 9 aa, Homo Sapiens
ETVPWNIFL

SEQ ID NO: 601263 - protein, 9 aa, Homo Sapiens
QHVEELQAF

SEQ ID NO: 601264 - protein, 9 aa, Homo Sapiens
GRSGSRIPS

SEQ ID NO: 601265 - protein, 9 aa, Homo Sapiens
LNVEALVVA

SEQ ID NO: 601266 - protein, 9 aa, Homo Sapiens
SKSVSARAV

SEQ ID NO: 601267 - protein, 9 aa, Homo Sapiens
KKKKKNKHS

SEQ ID NO: 601268 - protein, 9 aa, Homo Sapiens
VDDGTKSDT

SEQ ID NO: 601269 - protein, 9 aa, Homo Sapiens
VAGKHILIL

SEQ ID NO: 601270 - protein, 9 aa, Homo Sapiens
SRSSNTGSV

SEQ ID NO: 601271 - protein, 9 aa, Homo Sapiens
GSVSLASSC

SEQ ID NO: 601272 - protein, 9 aa, Homo Sapiens
SSRELTTGA

SEQ ID NO: 601273 - protein, 9 aa, Homo Sapiens
NKPVWYGLV

SEQ ID NO: 601274 - protein, 9 aa, Homo Sapiens
ISQMHTVSC

SEQ ID NO: 601275 - protein, 9 aa, Homo Sapiens
ENQESLRTL

SEQ ID NO: 601276 - protein, 9 aa, Homo Sapiens
VVNFSKKVK

SEQ ID NO: 601277 - protein, 9 aa, Homo Sapiens
PFTNAYRWN

SEQ ID NO: 601278 - protein, 9 aa, Homo Sapiens
TRELALEIT

SEQ ID NO: 601279 - protein, 9 aa, Homo Sapiens
VASEIEKNP

SEQ ID NO: 601280 - protein, 9 aa, Homo Sapiens
FAPRGPGTL

SEQ ID NO: 601281 - protein, 9 aa, Homo Sapiens
TESKTATTT

SEQ ID NO: 601282 - protein, 9 aa, Homo Sapiens
EGIDKSANS

SEQ ID NO: 601283 - protein, 9 aa, Homo Sapiens
SPSYRPTMG

SEQ ID NO: 601284 - protein, 9 aa, Homo Sapiens
PTENGQRTT

SEQ ID NO: 601285 - protein, 9 aa, Homo Sapiens
GYHGTVGDS

SEQ ID NO: 601286 - protein, 9 aa, Homo Sapiens
FRHSSSLVW

SEQ ID NO: 601287 - protein, 9 aa, Homo Sapiens
SALSDCYSV

SEQ ID NO: 601288 - protein, 9 aa, Homo Sapiens
CIANAVFKG

SEQ ID NO: 601289 - protein, 9 aa, Homo Sapiens
ARAKVNVNL

SEQ ID NO: 601290 - protein, 9 aa, Homo Sapiens
ENGQRTTFA

SEQ ID NO: 601291 - protein, 9 aa, Homo Sapiens
DWHLRMPKV

SEQ ID NO: 601292 - protein, 9 aa, Homo Sapiens
KAFVKNSSL

SEQ ID NO: 601293 - protein, 9 aa, Homo Sapiens
VFELDYDYA

SEQ ID NO: 601294 - protein, 9 aa, Homo Sapiens
VTWVETFGP

SEQ ID NO: 601295 - protein, 9 aa, Homo Sapiens
PNPHPLTRF

SEQ ID NO: 601296 - protein, 9 aa, Homo Sapiens
RKQKNPNKV

SEQ ID NO: 601297 - protein, 9 aa, Homo Sapiens
IVRAFDIIE

SEQ ID NO: 601298 - protein, 9 aa, Homo Sapiens
TFANEKTTS

SEQ ID NO: 601299 - protein, 9 aa, Homo Sapiens
RMPKVKMPK

SEQ ID NO: 601300 - protein, 9 aa, Homo Sapiens
SSDASRSYS

SEQ ID NO: 601301 - protein, 9 aa, Homo Sapiens
RFLDEGGIV

SEQ ID NO: 601302 - protein, 9 aa, Homo Sapiens
PTISHKDNS

SEQ ID NO: 601303 - protein, 9 aa, Homo Sapiens
MKVLHQLKS

SEQ ID NO: 601304 - protein, 9 aa, Homo Sapiens
SITRRSRAP

SEQ ID NO: 601305 - protein, 9 aa, Homo Sapiens
EVEEVEMAE

SEQ ID NO: 601306 - protein, 9 aa, Homo Sapiens
AYPKSEIVY

SEQ ID NO: 601307 - protein, 9 aa, Homo Sapiens
LTTCCRTTC

SEQ ID NO: 601308 - protein, 9 aa, Homo Sapiens
VSGLAGEKV

SEQ ID NO: 601309 - protein, 9 aa, Homo Sapiens
CFLSPFAFT

SEQ ID NO: 601310 - protein, 9 aa, Homo Sapiens
STAKQTLNR

SEQ ID NO: 601311 - protein, 9 aa, Homo Sapiens
HSRPFIASI

SEQ ID NO: 601312 - protein, 9 aa, Homo Sapiens
EDELKQEIG

SEQ ID NO: 601313 - protein, 9 aa, Homo Sapiens
RSSGPVWLP

SEQ ID NO: 601314 - protein, 9 aa, Homo Sapiens
MKTFCKLVF

SEQ ID NO: 601315 - protein, 9 aa, Homo Sapiens
ALVELLDNA

SEQ ID NO: 601316 - protein, 9 aa, Homo Sapiens
LQSVVAGHQ

SEQ ID NO: 601317 - protein, 9 aa, Homo Sapiens
PSWKWEESG

SEQ ID NO: 601318 - protein, 9 aa, Homo Sapiens
CSLWAPGKP

SEQ ID NO: 601319 - protein, 9 aa, Homo Sapiens
EDDKDDMDS

SEQ ID NO: 601320 - protein, 9 aa, Homo Sapiens
LVNQLAKGK

SEQ ID NO: 601321 - protein, 9 aa, Homo Sapiens
FRQQRKEHK

SEQ ID NO: 601322 - protein, 9 aa, Homo Sapiens
ASVPTFRKA

SEQ ID NO: 601323 - protein, 9 aa, Homo Sapiens
LGAFHSDLS

SEQ ID NO: 601324 - protein, 9 aa, Homo Sapiens
AKLDKAQYQ

SEQ ID NO: 601325 - protein, 9 aa, Homo Sapiens
AQGDPPLVV

SEQ ID NO: 601326 - protein, 9 aa, Homo Sapiens
CGEEGHDPK

SEQ ID NO: 601327 - protein, 9 aa, Homo Sapiens
CQAFQAAKI

SEQ ID NO: 601328 - protein, 9 aa, Homo Sapiens
DPVVLPSFR

SEQ ID NO: 601329 - protein, 9 aa, Homo Sapiens
TGGAAAWTE

SEQ ID NO: 601330 - protein, 9 aa, Homo Sapiens
SIQESVKNR

SEQ ID NO: 601331 - protein, 9 aa, Homo Sapiens
SSPPAPQRT

SEQ ID NO: 601332 - protein, 9 aa, Homo Sapiens
PKSEIVYTW

SEQ ID NO: 601333 - protein, 9 aa, Homo Sapiens
LLLVITMSA

SEQ ID NO: 601334 - protein, 9 aa, Homo Sapiens
KARNYLYPI

SEQ ID NO: 601335 - protein, 9 aa, Homo Sapiens
VSPTTRLVT

SEQ ID NO: 601336 - protein, 9 aa, Homo Sapiens
TINAVSQFE

SEQ ID NO: 601337 - protein, 9 aa, Homo Sapiens
PYVMFCGWQ

SEQ ID NO: 601338 - protein, 9 aa, Homo Sapiens
HVEELQAFN

SEQ ID NO: 601339 - protein, 9 aa, Homo Sapiens
NKMSLALKY

SEQ ID NO: 601340 - protein, 9 aa, Homo Sapiens
TGAPELDVL

SEQ ID NO: 601341 - protein, 9 aa, Homo Sapiens
EEALEKVPG

SEQ ID NO: 601342 - protein, 9 aa, Homo Sapiens
GNYEIRYTA

SEQ ID NO: 601343 - protein, 9 aa, Homo Sapiens
VQYISDHSN

SEQ ID NO: 601344 - protein, 9 aa, Homo Sapiens
VPFYYAPFA

SEQ ID NO: 601345 - protein, 9 aa, Homo Sapiens
LDKAQYQEE

SEQ ID NO: 601346 - protein, 9 aa, Homo Sapiens
TAVSEQSNQ

SEQ ID NO: 601347 - protein, 9 aa, Homo Sapiens
HMTASFSVF

SEQ ID NO: 601348 - protein, 9 aa, Homo Sapiens
THLTVVPFY

SEQ ID NO: 601349 - protein, 9 aa, Homo Sapiens
FACQCLPGY

SEQ ID NO: 601350 - protein, 9 aa, Homo Sapiens
QVNLPHMTA

SEQ ID NO: 601351 - protein, 9 aa, Homo Sapiens
EGVLWALAV

SEQ ID NO: 601352 - protein, 9 aa, Homo Sapiens
ESLNAAFEM

SEQ ID NO: 601353 - protein, 9 aa, Homo Sapiens
TLSAPLART

SEQ ID NO: 601354 - protein, 9 aa, Homo Sapiens
SLASMNSDY

SEQ ID NO: 601355 - protein, 9 aa, Homo Sapiens
STGLSMLSP

SEQ ID NO: 601356 - protein, 9 aa, Homo Sapiens
QAQYHINAP

SEQ ID NO: 601357 - protein, 9 aa, Homo Sapiens
RSEREPIDM

SEQ ID NO: 601358 - protein, 9 aa, Homo Sapiens
KSKTKFSSC

SEQ ID NO: 601359 - protein, 9 aa, Homo Sapiens
TPPSSGEAS

SEQ ID NO: 601360 - protein, 9 aa, Homo Sapiens
TITSLTSVG

SEQ ID NO: 601361 - protein, 9 aa, Homo Sapiens
IEPLINLLT

SEQ ID NO: 601362 - protein, 9 aa, Homo Sapiens
NHVKIKHAD

SEQ ID NO: 601363 - protein, 9 aa, Homo Sapiens
WVETFGPFG

SEQ ID NO: 601364 - protein, 9 aa, Homo Sapiens
LCGWCCPCC

SEQ ID NO: 601365 - protein, 9 aa, Homo Sapiens
KQKNPNKVH

SEQ ID NO: 601366 - protein, 9 aa, Homo Sapiens
KGSKKGIKK

SEQ ID NO: 601367 - protein, 9 aa, Homo Sapiens
GIDKSANSV

SEQ ID NO: 601368 - protein, 9 aa, Homo Sapiens
LSPPSGAPG

SEQ ID NO: 601369 - protein, 9 aa, Homo Sapiens
GAAAWTEAT

SEQ ID NO: 601370 - protein, 9 aa, Homo Sapiens
PGFKRTRTL

SEQ ID NO: 601371 - protein, 9 aa, Homo Sapiens
VLPSFRVTV

SEQ ID NO: 601372 - protein, 9 aa, Homo Sapiens
HSDLSSISS

SEQ ID NO: 601373 - protein, 9 aa, Homo Sapiens
NSRQRRPGN

SEQ ID NO: 601374 - protein, 9 aa, Homo Sapiens
RKLWLSFAN

SEQ ID NO: 601375 - protein, 9 aa, Homo Sapiens
RPYGCKTCG

SEQ ID NO: 601376 - protein, 9 aa, Homo Sapiens
LSMLSPPAG

SEQ ID NO: 601377 - protein, 9 aa, Homo Sapiens
GQTSIGMQL

SEQ ID NO: 601378 - protein, 9 aa, Homo Sapiens
FKTLSSLYS

SEQ ID NO: 601379 - protein, 9 aa, Homo Sapiens
ASAPKSQDQ

SEQ ID NO: 601380 - protein, 9 aa, Homo Sapiens
VDICVIWVL

SEQ ID NO: 601381 - protein, 9 aa, Homo Sapiens
SDRIESKGI

SEQ ID NO: 601382 - protein, 9 aa, Homo Sapiens
PIPEPSPNE

SEQ ID NO: 601383 - protein, 9 aa, Homo Sapiens
KREEKRLNK

SEQ ID NO: 601384 - protein, 9 aa, Homo Sapiens
VLHVGRVYR

SEQ ID NO: 601385 - protein, 9 aa, Homo Sapiens
SFLFGALVE

SEQ ID NO: 601386 - protein, 9 aa, Homo Sapiens
SGSRRRHCG

SEQ ID NO: 601387 - protein, 9 aa, Homo Sapiens
EDDEKRTPP

SEQ ID NO: 601388 - protein, 9 aa, Homo Sapiens
SGLRKEIED

SEQ ID NO: 601389 - protein, 9 aa, Homo Sapiens
TGLSMLSPP

SEQ ID NO: 601390 - protein, 9 aa, Homo Sapiens
GIKSCGLEE

SEQ ID NO: 601391 - protein, 9 aa, Homo Sapiens
TIKGSSLKR

SEQ ID NO: 601392 - protein, 9 aa, Homo Sapiens
ELKQEIGSR

SEQ ID NO: 601393 - protein, 9 aa, Homo Sapiens
HPNGDMGLW

SEQ ID NO: 601394 - protein, 9 aa, Homo Sapiens
SCGNDSRSV

SEQ ID NO: 601395 - protein, 9 aa, Homo Sapiens
KQTLNRLCQ

SEQ ID NO: 601396 - protein, 9 aa, Homo Sapiens
ASEIEKNPT

SEQ ID NO: 601397 - protein, 9 aa, Homo Sapiens
RLQQGDNWV

SEQ ID NO: 601398 - protein, 9 aa, Homo Sapiens
KESLNAAFE

SEQ ID NO: 601399 - protein, 9 aa, Homo Sapiens
RMRLPQPTS

SEQ ID NO: 601400 - protein, 9 aa, Homo Sapiens
HLSPPSGAP

SEQ ID NO: 601401 - protein, 9 aa, Homo Sapiens
NLVKAYVEK

SEQ ID NO: 601402 - protein, 9 aa, Homo Sapiens
KSKYCYGGL

SEQ ID NO: 601403 - protein, 9 aa, Homo Sapiens
YAQIPYEVT

SEQ ID NO: 601404 - protein, 9 aa, Homo Sapiens
KGMITTPPC

SEQ ID NO: 601405 - protein, 9 aa, Homo Sapiens
FQKLKYKDL

SEQ ID NO: 601406 - protein, 9 aa, Homo Sapiens
GQVGPKGMI

SEQ ID NO: 601407 - protein, 9 aa, Homo Sapiens
IIDPWENIV

SEQ ID NO: 601408 - protein, 9 aa, Homo Sapiens
SRNHEEADM

SEQ ID NO: 601409 - protein, 9 aa, Homo Sapiens
SAAQLAGPA

SEQ ID NO: 601410 - protein, 9 aa, Homo Sapiens
DASRSYSST

SEQ ID NO: 601411 - protein, 9 aa, Homo Sapiens
GKAFVKNSS

SEQ ID NO: 601412 - protein, 9 aa, Homo Sapiens
AKVVTFDFG

SEQ ID NO: 601413 - protein, 9 aa, Homo Sapiens
KIKHADSAL

SEQ ID NO: 601414 - protein, 9 aa, Homo Sapiens
KVPGVTDVL

SEQ ID NO: 601415 - protein, 9 aa, Homo Sapiens
GMKKKCQEL

SEQ ID NO: 601416 - protein, 9 aa, Homo Sapiens
HEEADMWTT

SEQ ID NO: 601417 - protein, 9 aa, Homo Sapiens
PSLPPSSLS

SEQ ID NO: 601418 - protein, 9 aa, Homo Sapiens
GHIVRAFDI

SEQ ID NO: 601419 - protein, 9 aa, Homo Sapiens
TRFQARSLP

SEQ ID NO: 601420 - protein, 9 aa, Homo Sapiens
EEDATVLPK

SEQ ID NO: 601421 - protein, 9 aa, Homo Sapiens
REAFKTLSS

SEQ ID NO: 601422 - protein, 9 aa, Homo Sapiens
PEEEEQTKL

SEQ ID NO: 601423 - protein, 9 aa, Homo Sapiens
KAQKEEEQE

SEQ ID NO: 601424 - protein, 9 aa, Homo Sapiens
ASLHKEKLN

SEQ ID NO: 601425 - protein, 9 aa, Homo Sapiens
QGNLTFAPR

SEQ ID NO: 601426 - protein, 9 aa, Homo Sapiens
INLLTAKDT

SEQ ID NO: 601427 - protein, 9 aa, Homo Sapiens
VAMAKESLN

SEQ ID NO: 601428 - protein, 9 aa, Homo Sapiens
LTVVPFYYA

SEQ ID NO: 601429 - protein, 9 aa, Homo Sapiens
VGPKGMITT

SEQ ID NO: 601430 - protein, 9 aa, Homo Sapiens
LAKLDKAQY

SEQ ID NO: 601431 - protein, 9 aa, Homo Sapiens
PVSKFAGYC

SEQ ID NO: 601432 - protein, 9 aa, Homo Sapiens
GSTAGSPLQ

SEQ ID NO: 601433 - protein, 9 aa, Homo Sapiens
HLTVVPFYY

SEQ ID NO: 601434 - protein, 9 aa, Homo Sapiens
GTGGLRSLV

SEQ ID NO: 601435 - protein, 9 aa, Homo Sapiens
GGSSDASRS

SEQ ID NO: 601436 - protein, 9 aa, Homo Sapiens
VTFDFGNDI

SEQ ID NO: 601437 - protein, 9 aa, Homo Sapiens
VERMKEKQN

SEQ ID NO: 601438 - protein, 9 aa, Homo Sapiens
WYFLSHLPV

SEQ ID NO: 601439 - protein, 9 aa, Homo Sapiens
DQGKGHHIR

SEQ ID NO: 601440 - protein, 9 aa, Homo Sapiens
KDDMDSEKK

SEQ ID NO: 601441 - protein, 9 aa, Homo Sapiens
LELLLVITM

SEQ ID NO: 601442 - protein, 9 aa, Homo Sapiens
TTSYRELTR

SEQ ID NO: 601443 - protein, 9 aa, Homo Sapiens
VAYLTKKQL

SEQ ID NO: 601444 - protein, 9 aa, Homo Sapiens
ALFPDSDPF

SEQ ID NO: 601445 - protein, 9 aa, Homo Sapiens
SHCDWCCKN

SEQ ID NO: 601446 - protein, 9 aa, Homo Sapiens
VDYGSTAKQ

SEQ ID NO: 601447 - protein, 9 aa, Homo Sapiens
CIKIFLVAC

SEQ ID NO: 601448 - protein, 9 aa, Homo Sapiens
GSFSNIWQE

SEQ ID NO: 601449 - protein, 9 aa, Homo Sapiens
TGSVSLASS

SEQ ID NO: 601450 - protein, 9 aa, Homo Sapiens
VKLSDSRIT

SEQ ID NO: 601451 - protein, 9 aa, Homo Sapiens
LGIAYLYGR

SEQ ID NO: 601452 - protein, 9 aa, Homo Sapiens
YGSTAKQTL

SEQ ID NO: 601453 - protein, 9 aa, Homo Sapiens
LMEDFQKKE

SEQ ID NO: 601454 - protein, 9 aa, Homo Sapiens
AGRPPSVGS

SEQ ID NO: 601455 - protein, 9 aa, Homo Sapiens
EHMLPKETV

SEQ ID NO: 601456 - protein, 9 aa, Homo Sapiens
ASRLRQWSM

SEQ ID NO: 601457 - protein, 9 aa, Homo Sapiens
ASDPANMVP

SEQ ID NO: 601458 - protein, 9 aa, Homo Sapiens
PPLLIIIYC

SEQ ID NO: 601459 - protein, 9 aa, Homo Sapiens
SFGAAFPLL

SEQ ID NO: 601460 - protein, 9 aa, Homo Sapiens
PQALKAWRD

SEQ ID NO: 601461 - protein, 9 aa, Homo Sapiens
CCFVFFPPL

SEQ ID NO: 601462 - protein, 9 aa, Homo Sapiens
SLAFYGTVN

SEQ ID NO: 601463 - protein, 9 aa, Homo Sapiens
LSDQCTGLH

SEQ ID NO: 601464 - protein, 9 aa, Homo Sapiens
RPCETNVAP

SEQ ID NO: 601465 - protein, 9 aa, Homo Sapiens
FELDYDYAQ

SEQ ID NO: 601466 - protein, 9 aa, Homo Sapiens
QGDNWVESY

SEQ ID NO: 601467 - protein, 9 aa, Homo Sapiens
EAFKTLSSL

SEQ ID NO: 601468 - protein, 9 aa, Homo Sapiens
IKGSSLKRS

SEQ ID NO: 601469 - protein, 9 aa, Homo Sapiens
RGKSKYCYG

SEQ ID NO: 601470 - protein, 9 aa, Homo Sapiens
DHHTEEGID

SEQ ID NO: 601471 - protein, 9 aa, Homo Sapiens
NFDNASLFE

SEQ ID NO: 601472 - protein, 9 aa, Homo Sapiens
QEPKAPKSS

SEQ ID NO: 601473 - protein, 9 aa, Homo Sapiens
NKSGDAPLT

SEQ ID NO: 601474 - protein, 9 aa, Homo Sapiens
YEDELKQEI

SEQ ID NO: 601475 - protein, 9 aa, Homo Sapiens
YSTPSKPTS

SEQ ID NO: 601476 - protein, 9 aa, Homo Sapiens
RLQLHMLPC

SEQ ID NO: 601477 - protein, 9 aa, Homo Sapiens
LWFVRRLEL

SEQ ID NO: 601478 - protein, 9 aa, Homo Sapiens
FRDFLASVP

SEQ ID NO: 601479 - protein, 9 aa, Homo Sapiens
PPSPPPQDG

SEQ ID NO: 601480 - protein, 9 aa, Homo Sapiens
RSSNTGSVS

SEQ ID NO: 601481 - protein, 9 aa, Homo Sapiens
FSGILIGRN

SEQ ID NO: 601482 - protein, 9 aa, Homo Sapiens
CLFLREKRG

SEQ ID NO: 601483 - protein, 9 aa, Homo Sapiens
TAVNVDGHV

SEQ ID NO: 601484 - protein, 9 aa, Homo Sapiens
FKDSGSGKN

SEQ ID NO: 601485 - protein, 9 aa, Homo Sapiens
SMLSPPAGP

SEQ ID NO: 601486 - protein, 9 aa, Homo Sapiens
AGISWVTLQ

SEQ ID NO: 601487 - protein, 9 aa, Homo Sapiens
RPRTIPRED

SEQ ID NO: 601488 - protein, 9 aa, Homo Sapiens
RVAGKHILI

SEQ ID NO: 601489 - protein, 9 aa, Homo Sapiens
TEVAYLTKK

SEQ ID NO: 601490 - protein, 9 aa, Homo Sapiens
PPYSDKTII

SEQ ID NO: 601491 - protein, 9 aa, Homo Sapiens
GHQQFDELL

SEQ ID NO: 601492 - protein, 9 aa, Homo Sapiens
NKRVPVLPF

SEQ ID NO: 601493 - protein, 9 aa, Homo Sapiens
AIDPQTSRA

SEQ ID NO: 601494 - protein, 9 aa, Homo Sapiens
AKTKQAWYF

SEQ ID NO: 601495 - protein, 9 aa, Homo Sapiens
SRADGSFSN

SEQ ID NO: 601496 - protein, 9 aa, Homo Sapiens
LIHDVHTQV

SEQ ID NO: 601497 - protein, 9 aa, Homo Sapiens
HSFLFGALV

SEQ ID NO: 601498 - protein, 9 aa, Homo Sapiens
VVNYTNKSG

SEQ ID NO: 601499 - protein, 9 aa, Homo Sapiens
EEDDKDDMD

SEQ ID NO: 601500 - protein, 9 aa, Homo Sapiens
CNTGRLVRI

SEQ ID NO: 601501 - protein, 9 aa, Homo Sapiens
TFAPRGPGT

SEQ ID NO: 601502 - protein, 9 aa, Homo Sapiens
GRPPSVGSV

SEQ ID NO: 601503 - protein, 9 aa, Homo Sapiens
GPNNVGKAS

SEQ ID NO: 601504 - protein, 9 aa, Homo Sapiens
LKTSTDFSP

SEQ ID NO: 601505 - protein, 9 aa, Homo Sapiens
NPYCKSRAI

SEQ ID NO: 601506 - protein, 9 aa, Homo Sapiens
RQVLRARMS

SEQ ID NO: 601507 - protein, 9 aa, Homo Sapiens
VLRFNSSDR

SEQ ID NO: 601508 - protein, 9 aa, Homo Sapiens
YATDSDGHL

SEQ ID NO: 601509 - protein, 9 aa, Homo Sapiens
EQKEDVFNN

SEQ ID NO: 601510 - protein, 9 aa, Homo Sapiens
MEGIKSCGL

SEQ ID NO: 601511 - protein, 9 aa, Homo Sapiens
ITIKHLTNL

SEQ ID NO: 601512 - protein, 9 aa, Homo Sapiens
CLCSSAGGL

SEQ ID NO: 601513 - protein, 9 aa, Homo Sapiens
RQQRKEHKR

SEQ ID NO: 601514 - protein, 9 aa, Homo Sapiens
ISWVTLQWS

SEQ ID NO: 601515 - protein, 9 aa, Homo Sapiens
NFDSDLESL

SEQ ID NO: 601516 - protein, 9 aa, Homo Sapiens
AVNVDGHVL

SEQ ID NO: 601517 - protein, 9 aa, Homo Sapiens
IEGSVVYNN

SEQ ID NO: 601518 - protein, 9 aa, Homo Sapiens
SWVFGAIEP

SEQ ID NO: 601519 - protein, 9 aa, Homo Sapiens
DASARAPPA

SEQ ID NO: 601520 - protein, 9 aa, Homo Sapiens
WENIVIQCE

SEQ ID NO: 601521 - protein, 9 aa, Homo Sapiens
SEIEKNPTF

SEQ ID NO: 601522 - protein, 9 aa, Homo Sapiens
SQWKVMEGI

SEQ ID NO: 601523 - protein, 9 aa, Homo Sapiens
SWHPDGNGK

SEQ ID NO: 601524 - protein, 9 aa, Homo Sapiens
AVCTIINPE

SEQ ID NO: 601525 - protein, 9 aa, Homo Sapiens
KKFKVALFF

SEQ ID NO: 601526 - protein, 9 aa, Homo Sapiens
YELVVLEEK

SEQ ID NO: 601527 - protein, 9 aa, Homo Sapiens
AQYHINAPE

SEQ ID NO: 601528 - protein, 9 aa, Homo Sapiens
DDMDSEKKG

SEQ ID NO: 601529 - protein, 9 aa, Homo Sapiens
HGTVGDSMS

SEQ ID NO: 601530 - protein, 9 aa, Homo Sapiens
TIQGLIIDA

SEQ ID NO: 601531 - protein, 9 aa, Homo Sapiens
FSFSTFTTT

SEQ ID NO: 601532 - protein, 9 aa, Homo Sapiens
ASMNSDYST

SEQ ID NO: 601533 - protein, 9 aa, Homo Sapiens
ACLFLREKR

SEQ ID NO: 601534 - protein, 9 aa, Homo Sapiens
SKEIASRLR

SEQ ID NO: 601535 - protein, 9 aa, Homo Sapiens
TFVCSECSF

SEQ ID NO: 601536 - protein, 9 aa, Homo Sapiens
QDVSACQAF

SEQ ID NO: 601537 - protein, 9 aa, Homo Sapiens
ITTPPCLLT

SEQ ID NO: 601538 - protein, 9 aa, Homo Sapiens
FLDEGGIVL

SEQ ID NO: 601539 - protein, 9 aa, Homo Sapiens
FHIDRLFFT

SEQ ID NO: 601540 - protein, 9 aa, Homo Sapiens
VSTAVNVDG

SEQ ID NO: 601541 - protein, 9 aa, Homo Sapiens
LPFCGNNTI

SEQ ID NO: 601542 - protein, 9 aa, Homo Sapiens
PCPCKAKAT

SEQ ID NO: 601543 - protein, 9 aa, Homo Sapiens
QLIKLLKVK

SEQ ID NO: 601544 - protein, 9 aa, Homo Sapiens
CVSSPFYPR

SEQ ID NO: 601545 - protein, 9 aa, Homo Sapiens
FWTLPTEFL

SEQ ID NO: 601546 - protein, 9 aa, Homo Sapiens
VDVEHSNAA

SEQ ID NO: 601547 - protein, 9 aa, Homo Sapiens
SAKQEFQHL

SEQ ID NO: 601548 - protein, 9 aa, Homo Sapiens
TLPFLKYYC

SEQ ID NO: 601549 - protein, 9 aa, Homo Sapiens
LASMNSDYS

SEQ ID NO: 601550 - protein, 9 aa, Homo Sapiens
LAEETLGSL

SEQ ID NO: 601551 - protein, 9 aa, Homo Sapiens
KKCQELCCE

SEQ ID NO: 601552 - protein, 9 aa, Homo Sapiens
QAMRCSLIA

SEQ ID NO: 601553 - protein, 9 aa, Homo Sapiens
YIIDPWENI

SEQ ID NO: 601554 - protein, 9 aa, Homo Sapiens
IQESVKNRV

SEQ ID NO: 601555 - protein, 9 aa, Homo Sapiens
GVKCCKCDV

SEQ ID NO: 601556 - protein, 9 aa, Homo Sapiens
QRQLNLSNP

SEQ ID NO: 601557 - protein, 9 aa, Homo Sapiens
RLQAQPLPY

SEQ ID NO: 601558 - protein, 9 aa, Homo Sapiens
KSEIVYTWK

SEQ ID NO: 601559 - protein, 9 aa, Homo Sapiens
EQMHGMKKK

SEQ ID NO: 601560 - protein, 9 aa, Homo Sapiens
KVVTFDFGN

SEQ ID NO: 601561 - protein, 9 aa, Homo Sapiens
HNFDSDLES

SEQ ID NO: 601562 - protein, 9 aa, Homo Sapiens
FACSRCAFM

SEQ ID NO: 601563 - protein, 9 aa, Homo Sapiens
PFCGNNTIN

SEQ ID NO: 601564 - protein, 9 aa, Homo Sapiens
PVVLPSFRV

SEQ ID NO: 601565 - protein, 9 aa, Homo Sapiens
PNETVILTP

SEQ ID NO: 601566 - protein, 9 aa, Homo Sapiens
SYPRFIRTS

SEQ ID NO: 601567 - protein, 9 aa, Homo Sapiens
CCLTTCCRT

SEQ ID NO: 601568 - protein, 9 aa, Homo Sapiens
DFGNDIFEE

SEQ ID NO: 601569 - protein, 9 aa, Homo Sapiens
QDNYHCHCR

SEQ ID NO: 601570 - protein, 9 aa, Homo Sapiens
KFTLAKIAR

SEQ ID NO: 601571 - protein, 9 aa, Homo Sapiens
TDVGNFLLL

SEQ ID NO: 601572 - protein, 9 aa, Homo Sapiens
AAQTPEHWV

SEQ ID NO: 601573 - protein, 9 aa, Homo Sapiens
TRCGSGGPG

SEQ ID NO: 601574 - protein, 9 aa, Homo Sapiens
LKMNFFRLQ

SEQ ID NO: 601575 - protein, 9 aa, Homo Sapiens
TKFSSCESL

SEQ ID NO: 601576 - protein, 9 aa, Homo Sapiens
NAKRSSPLI

SEQ ID NO: 601577 - protein, 9 aa, Homo Sapiens
SGQVGPKGM

SEQ ID NO: 601578 - protein, 9 aa, Homo Sapiens
HLEGYHGTV

SEQ ID NO: 601579 - protein, 9 aa, Homo Sapiens
QSSIHNFDS

SEQ ID NO: 601580 - protein, 9 aa, Homo Sapiens
EGDGDFTIE

SEQ ID NO: 601581 - protein, 9 aa, Homo Sapiens
NRVIDSRLQ

SEQ ID NO: 601582 - protein, 9 aa, Homo Sapiens
NCSYADLMK

SEQ ID NO: 601583 - protein, 9 aa, Homo Sapiens
PTMGFTTLA

SEQ ID NO: 601584 - protein, 9 aa, Homo Sapiens
SIVASEIEK

SEQ ID NO: 601585 - protein, 9 aa, Homo Sapiens
IHNFDSDLE

SEQ ID NO: 601586 - protein, 9 aa, Homo Sapiens
VCKNCREAF

SEQ ID NO: 601587 - protein, 9 aa, Homo Sapiens
ATKVDICVI

SEQ ID NO: 601588 - protein, 9 aa, Homo Sapiens
DVTAVSEQS

SEQ ID NO: 601589 - protein, 9 aa, Homo Sapiens
DGSFSNIWQ

SEQ ID NO: 601590 - protein, 9 aa, Homo Sapiens
PLISQKLVG

SEQ ID NO: 601591 - protein, 9 aa, Homo Sapiens
IAEVAPLIS

SEQ ID NO: 601592 - protein, 9 aa, Homo Sapiens
TALTHPRVP

SEQ ID NO: 601593 - protein, 9 aa, Homo Sapiens
VTCWNLQNN

SEQ ID NO: 601594 - protein, 9 aa, Homo Sapiens
ECIANAVFK

SEQ ID NO: 601595 - protein, 9 aa, Homo Sapiens
PEGLDASAR

SEQ ID NO: 601596 - protein, 9 aa, Homo Sapiens
SEVAIKLSK

SEQ ID NO: 601597 - protein, 9 aa, Homo Sapiens
PFTRDLWPE

SEQ ID NO: 601598 - protein, 9 aa, Homo Sapiens
PSAPWMPCT

SEQ ID NO: 601599 - protein, 9 aa, Homo Sapiens
QEITYLADS

SEQ ID NO: 601600 - protein, 9 aa, Homo Sapiens
NTGSVSLAS

SEQ ID NO: 601601 - protein, 9 aa, Homo Sapiens
PGGSSDASR

SEQ ID NO: 601602 - protein, 9 aa, Homo Sapiens
LLGCSCLGD

SEQ ID NO: 601603 - protein, 9 aa, Homo Sapiens
QSLDDNLGL

SEQ ID NO: 601604 - protein, 9 aa, Homo Sapiens
HFYQGLVYV

SEQ ID NO: 601605 - protein, 9 aa, Homo Sapiens
EEEIGSLSK

SEQ ID NO: 601606 - protein, 9 aa, Homo Sapiens
ETSIALQGN

SEQ ID NO: 601607 - protein, 9 aa, Homo Sapiens
KYSLEDVTA

SEQ ID NO: 601608 - protein, 9 aa, Homo Sapiens
AEETLGSLA

SEQ ID NO: 601609 - protein, 9 aa, Homo Sapiens
RSYSSTMNG

SEQ ID NO: 601610 - protein, 9 aa, Homo Sapiens
NHEEADMWT

SEQ ID NO: 601611 - protein, 9 aa, Homo Sapiens
QERQYYGSS

SEQ ID NO: 601612 - protein, 9 aa, Homo Sapiens
EPTSGVAVL

SEQ ID NO: 601613 - protein, 9 aa, Homo Sapiens
KDSGSGKNK

SEQ ID NO: 601614 - protein, 9 aa, Homo Sapiens
TTFANEKTT

SEQ ID NO: 601615 - protein, 9 aa, Homo Sapiens
QNKICLMAG

SEQ ID NO: 601616 - protein, 9 aa, Homo Sapiens
GFLEGYLSA

SEQ ID NO: 601617 - protein, 9 aa, Homo Sapiens
RRHCGEEGH

SEQ ID NO: 601618 - protein, 9 aa, Homo Sapiens
RTAKRDSKA

SEQ ID NO: 601619 - protein, 9 aa, Homo Sapiens
MTASFSVFR

SEQ ID NO: 601620 - protein, 9 aa, Homo Sapiens
TCEELRRGL

SEQ ID NO: 601621 - protein, 9 aa, Homo Sapiens
TNNCYPNET

SEQ ID NO: 601622 - protein, 9 aa, Homo Sapiens
VLGMPVATT

SEQ ID NO: 601623 - protein, 9 aa, Homo Sapiens
KCSLWAPGK

SEQ ID NO: 601624 - protein, 9 aa, Homo Sapiens
FYQGLVYVL

SEQ ID NO: 601625 - protein, 9 aa, Homo Sapiens
AWVFRGGYL

SEQ ID NO: 601626 - protein, 9 aa, Homo Sapiens
ESKTATTTQ

SEQ ID NO: 601627 - protein, 9 aa, Homo Sapiens
LCWQEVGAD

SEQ ID NO: 601628 - protein, 9 aa, Homo Sapiens
VEAAKKKSR

SEQ ID NO: 601629 - protein, 9 aa, Homo Sapiens
QGHCEGVLW

SEQ ID NO: 601630 - protein, 9 aa, Homo Sapiens
GLWFVRRLE

SEQ ID NO: 601631 - protein, 9 aa, Homo Sapiens
NIFLLLGGG

SEQ ID NO: 601632 - protein, 9 aa, Homo Sapiens
NKLNVFHWL

SEQ ID NO: 601633 - protein, 9 aa, Homo Sapiens
FLLAVMTYD

SEQ ID NO: 601634 - protein, 9 aa, Homo Sapiens
AAEYELVVL

SEQ ID NO: 601635 - protein, 9 aa, Homo Sapiens
ESWASGAAW

SEQ ID NO: 601636 - protein, 9 aa, Homo Sapiens
CGWCCPCCS

SEQ ID NO: 601637 - protein, 9 aa, Homo Sapiens
LAVMTYDRF

SEQ ID NO: 601638 - protein, 9 aa, Homo Sapiens
ISAVTMELS

SEQ ID NO: 601639 - protein, 9 aa, Homo Sapiens
KEDKIKQWL

SEQ ID NO: 601640 - protein, 9 aa, Homo Sapiens
FSLFGTRTT

SEQ ID NO: 601641 - protein, 9 aa, Homo Sapiens
SDASRSYSS

SEQ ID NO: 601642 - protein, 9 aa, Homo Sapiens
GVLWALAVH

SEQ ID NO: 601643 - protein, 9 aa, Homo Sapiens
SMSLLQGAR

SEQ ID NO: 601644 - protein, 9 aa, Homo Sapiens
EMLKTSTDF

SEQ ID NO: 601645 - protein, 9 aa, Homo Sapiens
QVGPKGMIT

SEQ ID NO: 601646 - protein, 9 aa, Homo Sapiens
SVIDEIDKA

SEQ ID NO: 601647 - protein, 9 aa, Homo Sapiens
WVFGAIEPT

SEQ ID NO: 601648 - protein, 9 aa, Homo Sapiens
RHLGRWSPT

SEQ ID NO: 601649 - protein, 9 aa, Homo Sapiens
VAVTCWNLQ

SEQ ID NO: 601650 - protein, 9 aa, Homo Sapiens
LLQPQALKA

SEQ ID NO: 601651 - protein, 9 aa, Homo Sapiens
IKHADSALE

SEQ ID NO: 601652 - protein, 9 aa, Homo Sapiens
GEIEKFSNK

SEQ ID NO: 601653 - protein, 9 aa, Homo Sapiens
SMNSDYSTP

SEQ ID NO: 601654 - protein, 9 aa, Homo Sapiens
SFLLAVMTY

SEQ ID NO: 601655 - protein, 9 aa, Homo Sapiens
ARTTSGRGP

SEQ ID NO: 601656 - protein, 9 aa, Homo Sapiens
IQYCGIKRR

SEQ ID NO: 601657 - protein, 9 aa, Homo Sapiens
PWALFPDSD

SEQ ID NO: 601658 - protein, 9 aa, Homo Sapiens
NIWQEALSC

SEQ ID NO: 601659 - protein, 9 aa, Homo Sapiens
IQAAEYELV

SEQ ID NO: 601660 - protein, 9 aa, Homo Sapiens
DPKQKHLEF

SEQ ID NO: 601661 - protein, 9 aa, Homo Sapiens
DVEHSNAAA

SEQ ID NO: 601662 - protein, 9 aa, Homo Sapiens
MVGEPQAAK

SEQ ID NO: 601663 - protein, 9 aa, Homo Sapiens
QHESASGKS

SEQ ID NO: 601664 - protein, 9 aa, Homo Sapiens
PAAVLPRKK

SEQ ID NO: 601665 - protein, 9 aa, Homo Sapiens
MPCTTSHLE

SEQ ID NO: 601666 - protein, 9 aa, Homo Sapiens
KLDKAQYQE

SEQ ID NO: 601667 - protein, 9 aa, Homo Sapiens
TNAYRWNGM

SEQ ID NO: 601668 - protein, 9 aa, Homo Sapiens
DILAAVSPT

SEQ ID NO: 601669 - protein, 9 aa, Homo Sapiens
DSGIFFDYS

SEQ ID NO: 601670 - protein, 9 aa, Homo Sapiens
NIQRSCGND

SEQ ID NO: 601671 - protein, 9 aa, Homo Sapiens
ANAVFKGQS

SEQ ID NO: 601672 - protein, 9 aa, Homo Sapiens
GLGIAYLYG

SEQ ID NO: 601673 - protein, 9 aa, Homo Sapiens
DRAGVLAAH

SEQ ID NO: 601674 - protein, 9 aa, Homo Sapiens
VVYNNYCVG

SEQ ID NO: 601675 - protein, 9 aa, Homo Sapiens
KEEEQEHSN

SEQ ID NO: 601676 - protein, 9 aa, Homo Sapiens
LACLFLREK

SEQ ID NO: 601677 - protein, 9 aa, Homo Sapiens
YSLEDVTAV

SEQ ID NO: 601678 - protein, 9 aa, Homo Sapiens
QIEGSVVYN

SEQ ID NO: 601679 - protein, 9 aa, Homo Sapiens
LWAPGKPFL

SEQ ID NO: 601680 - protein, 9 aa, Homo Sapiens
YISDHSNEG

SEQ ID NO: 601681 - protein, 9 aa, Homo Sapiens
WARTALLNV

SEQ ID NO: 601682 - protein, 9 aa, Homo Sapiens
AGQSSLLEN

SEQ ID NO: 601683 - protein, 9 aa, Homo Sapiens
SVSARAVSR

SEQ ID NO: 601684 - protein, 9 aa, Homo Sapiens
RRRHCGEEG

SEQ ID NO: 601685 - protein, 9 aa, Homo Sapiens
REDTAALEK

SEQ ID NO: 601686 - protein, 9 aa, Homo Sapiens
FPPLLIIIY

SEQ ID NO: 601687 - protein, 9 aa, Homo Sapiens
ACQAFQAAK

SEQ ID NO: 601688 - protein, 9 aa, Homo Sapiens
PPLVVSWTK

SEQ ID NO: 601689 - protein, 9 aa, Homo Sapiens
VNLTSSSQR

SEQ ID NO: 601690 - protein, 9 aa, Homo Sapiens
EALVTCTAL

SEQ ID NO: 601691 - protein, 9 aa, Homo Sapiens
GKPFLTLVL

SEQ ID NO: 601692 - protein, 9 aa, Homo Sapiens
RLHTPMNFL

SEQ ID NO: 601693 - protein, 9 aa, Homo Sapiens
AKGKTISVL

SEQ ID NO: 601694 - protein, 9 aa, Homo Sapiens
PSFRVTVDR

SEQ ID NO: 601695 - protein, 9 aa, Homo Sapiens
VVAMAKESL

SEQ ID NO: 601696 - protein, 9 aa, Homo Sapiens
TGSTAGSPL

SEQ ID NO: 601697 - protein, 9 aa, Homo Sapiens
GGPVSKFAG

SEQ ID NO: 601698 - protein, 9 aa, Homo Sapiens
IGMQLEGKH

SEQ ID NO: 601699 - protein, 9 aa, Homo Sapiens
KEHKRESMK

SEQ ID NO: 601700 - protein, 9 aa, Homo Sapiens
TSLIQCSLN

SEQ ID NO: 601701 - protein, 9 aa, Homo Sapiens
AAVSPTTRL

SEQ ID NO: 601702 - protein, 9 aa, Homo Sapiens
HRMFGLSWG

SEQ ID NO: 601703 - protein, 9 aa, Homo Sapiens
KGKTISVLG

SEQ ID NO: 601704 - protein, 9 aa, Homo Sapiens
PCSRNHEEA

SEQ ID NO: 601705 - protein, 9 aa, Homo Sapiens
NEDWLLWQG

SEQ ID NO: 601706 - protein, 9 aa, Homo Sapiens
SISAVTMEL

SEQ ID NO: 601707 - protein, 9 aa, Homo Sapiens
LALKYIRCR

SEQ ID NO: 601708 - protein, 9 aa, Homo Sapiens
CQCLPGYQK

SEQ ID NO: 601709 - protein, 9 aa, Homo Sapiens
DWCCKNGKG

SEQ ID NO: 601710 - protein, 9 aa, Homo Sapiens
FLQSVVAGH

SEQ ID NO: 601711 - protein, 9 aa, Homo Sapiens
KNRVIDSRL

SEQ ID NO: 601712 - protein, 9 aa, Homo Sapiens
RFQARSLPA

SEQ ID NO: 601713 - protein, 9 aa, Homo Sapiens
STIAEVAPL

SEQ ID NO: 601714 - protein, 9 aa, Homo Sapiens
YLADSLQLE

SEQ ID NO: 601715 - protein, 9 aa, Homo Sapiens
PCETNVAPN

SEQ ID NO: 601716 - protein, 9 aa, Homo Sapiens
VLHQLKSES

SEQ ID NO: 601717 - protein, 9 aa, Homo Sapiens
PESWASGAA

SEQ ID NO: 601718 - protein, 9 aa, Homo Sapiens
ALFFRLVNA

SEQ ID NO: 601719 - protein, 9 aa, Homo Sapiens
YRERLGLSP

SEQ ID NO: 601720 - protein, 9 aa, Homo Sapiens
ESASGKSSG

SEQ ID NO: 601721 - protein, 9 aa, Homo Sapiens
CSRNHEEAD

SEQ ID NO: 601722 - protein, 9 aa, Homo Sapiens
WQGSGIQYC

SEQ ID NO: 601723 - protein, 9 aa, Homo Sapiens
AKRSSPLIS

SEQ ID NO: 601724 - protein, 9 aa, Homo Sapiens
EDATVLPKD

SEQ ID NO: 601725 - protein, 9 aa, Homo Sapiens
IPEQCSPLP

SEQ ID NO: 601726 - protein, 9 aa, Homo Sapiens
NDAASPRIV

SEQ ID NO: 601727 - protein, 9 aa, Homo Sapiens
EPLINLLTA

SEQ ID NO: 601728 - protein, 9 aa, Homo Sapiens
HMLPCPCKA

SEQ ID NO: 601729 - protein, 9 aa, Homo Sapiens
DPQTSRAID

SEQ ID NO: 601730 - protein, 9 aa, Homo Sapiens
AVLPRKKLF

SEQ ID NO: 601731 - protein, 9 aa, Homo Sapiens
AVMKLFARA

SEQ ID NO: 601732 - protein, 9 aa, Homo Sapiens
SWSQVTTKT

SEQ ID NO: 601733 - protein, 9 aa, Homo Sapiens
SDSRITLKS

SEQ ID NO: 601734 - protein, 9 aa, Homo Sapiens
SNKEHMLPK

SEQ ID NO: 601735 - protein, 9 aa, Homo Sapiens
KEMKTFCKL

SEQ ID NO: 601736 - protein, 9 aa, Homo Sapiens
EGGFSAAPA

SEQ ID NO: 601737 - protein, 9 aa, Homo Sapiens
LPCPCKAKA

SEQ ID NO: 601738 - protein, 9 aa, Homo Sapiens
FNSSDRIES

SEQ ID NO: 601739 - protein, 9 aa, Homo Sapiens
LPPSSLSSR

SEQ ID NO: 601740 - protein, 9 aa, Homo Sapiens
VSHQRYLRN
